United States Patent 10,706,955 (BIOINFORMATIC PROCESSES FOR DETERMINATION OF PEPTIDE BINDING) - sequence listing, part 78

SEQ ID NO: 2972609 - protein, 17 aa, Entamoeba invadens
VDEEICYTDDITIIDDT

SEQ ID NO: 2972610 - protein, 18 aa, Entamoeba invadens
VDEFEYLGTVFLVSYLYT

SEQ ID NO: 2972611 - protein, 19 aa, Entamoeba invadens
VDEFEYLGTVFLVSYLYTE

SEQ ID NO: 2972612 - protein, 20 aa, Entamoeba invadens
VDEFEYLGTVFLVSYLYTEG

SEQ ID NO: 2972613 - protein, 33 aa, Entamoeba invadens
VDEFLRWRTLCWKSFEWKDLTFFMAEDALIRKM

SEQ ID NO: 2972614 - protein, 19 aa, Entamoeba invadens
VDEIIPIKTQDAWKTSRLV

SEQ ID NO: 2972615 - protein, 18 aa, Entamoeba invadens
VDEIKSLLLMLEEARGWY

SEQ ID NO: 2972616 - protein, 21 aa, Entamoeba invadens
VDEIKSLLLMLEEARGWYSDD

SEQ ID NO: 2972617 - protein, 26 aa, Entamoeba invadens
VDEIRRKLCCGFVFKDTDRAMEMIKE

SEQ ID NO: 2972618 - protein, 23 aa, Entamoeba invadens
VDEKGRGAILIGKMFESVPREME

SEQ ID NO: 2972619 - protein, 19 aa, Entamoeba invadens
VDELKRIAIPKEKMDRDAI

SEQ ID NO: 2972620 - protein, 23 aa, Entamoeba invadens
VDENLDLVCEFYKNPSKHRNDED

SEQ ID NO: 2972621 - protein, 18 aa, Entamoeba invadens
VDERIAVGVGAFKKLIKV

SEQ ID NO: 2972622 - protein, 18 aa, Entamoeba invadens
VDESWDFRDMTQLEDLSF

SEQ ID NO: 2972623 - protein, 21 aa, Entamoeba invadens
VDFDFSEIVAVDFLMNLIDTG

SEQ ID NO: 2972624 - protein, 21 aa, Entamoeba invadens
VDFFATWCGPCKMMSPIFIEM

SEQ ID NO: 2972625 - protein, 19 aa, Entamoeba invadens
VDFFERRNVTLWKQQGKKV

SEQ ID NO: 2972626 - protein, 18 aa, Entamoeba invadens
VDFGDKLLHLFLKPTPIN

SEQ ID NO: 2972627 - protein, 31 aa, Entamoeba invadens
VDFKNYLLPLFPLKYLKTGSLLRGYIADVAN

SEQ ID NO: 2972628 - protein, 21 aa, Entamoeba invadens
VDFKPKILTIRGKTVKMQISG

SEQ ID NO: 2972629 - protein, 23 aa, Entamoeba invadens
VDFLCSKESLALFETEDAKLYEG

SEQ ID NO: 2972630 - protein, 18 aa, Entamoeba invadens
VDFLDNFVVTISSDFTVL

SEQ ID NO: 2972631 - protein, 22 aa, Entamoeba invadens
VDFMRKTFVFRKTFTKSKTMGG

SEQ ID NO: 2972632 - protein, 20 aa, Entamoeba invadens
VDFRDGSALLELAASLTKAA

SEQ ID NO: 2972633 - protein, 26 aa, Entamoeba invadens
VDFSIELVLFREEFLLSHDITLNSGG

SEQ ID NO: 2972634 - protein, 17 aa, Entamoeba invadens
VDFSNLVIKNELNVIEG

SEQ ID NO: 2972635 - protein, 32 aa, Entamoeba invadens
VDFVLKKSLCDGVVLAKLMNYLRPNTVDVSKF

SEQ ID NO: 2972636 - protein, 18 aa, Entamoeba invadens
VDFVSLRQTFPFESLYTQ

SEQ ID NO: 2972637 - protein, 26 aa, Entamoeba invadens
VDFYATWCGPCRSISPYVEELSRQYP

SEQ ID NO: 2972638 - protein, 24 aa, Entamoeba invadens
VDGEQKYILGMVWMMILKYKINNV

SEQ ID NO: 2972639 - protein, 36 aa, Entamoeba invadens
VDGGEGYKNVLGMLFSLYRMFCVKNYERNHKGTYEG

SEQ ID NO: 2972640 - protein, 21 aa, Entamoeba invadens
VDGHKLLKIRNPWGKCEWTGK

SEQ ID NO: 2972641 - protein, 20 aa, Entamoeba invadens
VDGHSGFQASYSFTQNFPKI

SEQ ID NO: 2972642 - protein, 17 aa, Entamoeba invadens
VDGKFELVDGLVVSPEV

SEQ ID NO: 2972643 - protein, 24 aa, Entamoeba invadens
VDGKPFRLAIWAGQEKYRSMVSMY

SEQ ID NO: 2972644 - protein, 18 aa, Entamoeba invadens
VDGLDFFWSGLCETTNPI

SEQ ID NO: 2972645 - protein, 18 aa, Entamoeba invadens
VDGMFLDIVMRRIEGSEK

SEQ ID NO: 2972646 - protein, 25 aa, Entamoeba invadens
VDGMFQYKVCYRVTYKMANAILKAH

SEQ ID NO: 2972647 - protein, 24 aa, Entamoeba invadens
VDGNQWYAIQAMRAVNQAVGRVIR

SEQ ID NO: 2972648 - protein, 24 aa, Entamoeba invadens
VDGQCLLCSNGFYSNGPQCVKCDT

SEQ ID NO: 2972649 - protein, 27 aa, Entamoeba invadens
VDGRLLQLRWDRGFRAKVVDRDYKLLL

SEQ ID NO: 2972650 - protein, 23 aa, Entamoeba invadens
VDGSVCSMLLKTYAISQFSNSHE

SEQ ID NO: 2972651 - protein, 24 aa, Entamoeba invadens
VDGVCPFAKIVQQRKRRYISARGN

SEQ ID NO: 2972652 - protein, 19 aa, Entamoeba invadens
VDGVLDVIAPLMFFGDFSP

SEQ ID NO: 2972653 - protein, 23 aa, Entamoeba invadens
VDHETREILPIGFAGELEVNSPI

SEQ ID NO: 2972654 - protein, 18 aa, Entamoeba invadens
VDHMRMCYTKIMCGEVWC

SEQ ID NO: 2972655 - protein, 20 aa, Entamoeba invadens
VDHSTWLYLFPYFDNDKFDL

SEQ ID NO: 2972656 - protein, 17 aa, Entamoeba invadens
VDHSYWYADFEASTQGY

SEQ ID NO: 2972657 - protein, 19 aa, Entamoeba invadens
VDHTIGAIVISCRGTSTIT

SEQ ID NO: 2972658 - protein, 18 aa, Entamoeba invadens
VDIAKLVIVKGLSKDPKE

SEQ ID NO: 2972659 - protein, 26 aa, Entamoeba invadens
VDIEKRYSIDQCVSHPFITGMEITKL

SEQ ID NO: 2972660 - protein, 18 aa, Entamoeba invadens
VDIFFKIMLEERYVFVTN

SEQ ID NO: 2972661 - protein, 17 aa, Entamoeba invadens
VDIFKMANGPARKVENF

SEQ ID NO: 2972662 - protein, 18 aa, Entamoeba invadens
VDIFKMCYSTLVELKTFD

SEQ ID NO: 2972663 - protein, 23 aa, Entamoeba invadens
VDIFRFPWTIAEFVTAGKRLENR

SEQ ID NO: 2972664 - protein, 17 aa, Entamoeba invadens
VDIKFRVKILLDASHGI

SEQ ID NO: 2972665 - protein, 19 aa, Entamoeba invadens
VDIKIQRKLFKTVFLYFQP

SEQ ID NO: 2972666 - protein, 25 aa, Entamoeba invadens
VDIKKMLAKVVKYGKEKAMLEVKTE

SEQ ID NO: 2972667 - protein, 28 aa, Entamoeba invadens
VDIKVQRKLFKTAFLFFQPFKSYTTYMG

SEQ ID NO: 2972668 - protein, 22 aa, Entamoeba invadens
VDILAKLDGWWVGKKGGNYGIF

SEQ ID NO: 2972669 - protein, 18 aa, Entamoeba invadens
VDILKQIIALIISKNPNV

SEQ ID NO: 2972670 - protein, 22 aa, Entamoeba invadens
VDIPRTKVYLEFKTKNENEVQI

SEQ ID NO: 2972671 - protein, 24 aa, Entamoeba invadens
VDIQCVTTAIAIVILRKYYADRKV

SEQ ID NO: 2972672 - protein, 24 aa, Entamoeba invadens
VDIQNVLFAWSIEALDKMYQNELK

SEQ ID NO: 2972673 - protein, 21 aa, Entamoeba invadens
VDIWLHVVPQIIARIQSDVSS

SEQ ID NO: 2972674 - protein, 19 aa, Entamoeba invadens
VDIWSLGAIYAEIGFGHPV

SEQ ID NO: 2972675 - protein, 17 aa, Entamoeba invadens
VDKALVVLFKDDYKVSS

SEQ ID NO: 2972676 - protein, 25 aa, Entamoeba invadens
VDKILKRFLNFEVYTPSVITKIDGV

SEQ ID NO: 2972677 - protein, 22 aa, Entamoeba invadens
VDKKEKHRRKVLGKEGRELEDK

SEQ ID NO: 2972678 - protein, 21 aa, Entamoeba invadens
VDKKLVWKARFLVKKYGTLEN

SEQ ID NO: 2972679 - protein, 21 aa, Entamoeba invadens
VDKKRLMTFVKLAKEGKLEKS

SEQ ID NO: 2972680 - protein, 30 aa, Entamoeba invadens
VDKLHRDCLRGCTALTRVAIQRDLFEKSKN

SEQ ID NO: 2972681 - protein, 22 aa, Entamoeba invadens
VDKLPIVFGKFIKVTDLGFYRA

SEQ ID NO: 2972682 - protein, 17 aa, Entamoeba invadens
VDKNWFKGCDCLTKNQL

SEQ ID NO: 2972683 - protein, 21 aa, Entamoeba invadens
VDKPIRCARFMARKEQIVVGS

SEQ ID NO: 2972684 - protein, 18 aa, Entamoeba invadens
VDKPLFFSKECRTNNRPA

SEQ ID NO: 2972685 - protein, 25 aa, Entamoeba invadens
VDKRCAARYALDISNGILEKTAIRR

SEQ ID NO: 2972686 - protein, 19 aa, Entamoeba invadens
VDKRMQVCRIIEGLKRKGI

SEQ ID NO: 2972687 - protein, 28 aa, Entamoeba invadens
VDKSCTFQLMRLAKGFVDGKCSQKFAEK

SEQ ID NO: 2972688 - protein, 24 aa, Entamoeba invadens
VDKSNVRLVLALKKPVILLYDSSA

SEQ ID NO: 2972689 - protein, 26 aa, Entamoeba invadens
VDKSSKCFLCQAKLFTNFVEYEGRGF

SEQ ID NO: 2972690 - protein, 29 aa, Entamoeba invadens
VDKTRFIQMCCAIVDYLKEAEKFKEEKKQ

SEQ ID NO: 2972691 - protein, 24 aa, Entamoeba invadens
VDKTVKFCRFEKGWFGDLKYLYNH

SEQ ID NO: 2972692 - protein, 21 aa, Entamoeba invadens
VDKVLCLKRKYIGEIGGNRCV

SEQ ID NO: 2972693 - protein, 26 aa, Entamoeba invadens
VDKWFYTLFCHWNFYVRQAFQHIVLY

SEQ ID NO: 2972694 - protein, 22 aa, Entamoeba invadens
VDLCGKKIFSGFVSIDEMRHLK

SEQ ID NO: 2972695 - protein, 23 aa, Entamoeba invadens
VDLCGKLTFSGLVSVTEMVRLSR

SEQ ID NO: 2972696 - protein, 23 aa, Entamoeba invadens
VDLCGKQQFDGFVSVEEKKLLHH

SEQ ID NO: 2972697 - protein, 20 aa, Entamoeba invadens
VDLCKLSSTIETFAVKHVVE

SEQ ID NO: 2972698 - protein, 29 aa, Entamoeba invadens
VDLCKTGLRLHKSFMKIEFSRLQNVMELG

SEQ ID NO: 2972699 - protein, 21 aa, Entamoeba invadens
VDLEAILPIPKVKTYVGDITT

SEQ ID NO: 2972700 - protein, 26 aa, Entamoeba invadens
VDLECRRGVIYLTFFDALYSKEIRGK

SEQ ID NO: 2972701 - protein, 19 aa, Entamoeba invadens
VDLFGPKAAVDFMEANETP

SEQ ID NO: 2972702 - protein, 26 aa, Entamoeba invadens
VDLFLEFLKFGLTLKEALSYTQVTSE

SEQ ID NO: 2972703 - protein, 17 aa, Entamoeba invadens
VDLIKCIGACFDGSYVL

SEQ ID NO: 2972704 - protein, 18 aa, Entamoeba invadens
VDLIPIGAWLGEGKRSGV

SEQ ID NO: 2972705 - protein, 26 aa, Entamoeba invadens
VDLKKGALVPPEFAFEFYKENTALIC

SEQ ID NO: 2972706 - protein, 23 aa, Entamoeba invadens
VDLKSIIIPISYLRQYTTCVIHL

SEQ ID NO: 2972707 - protein, 20 aa, Entamoeba invadens
VDLKTVYAFPLDNFKPNKKD

SEQ ID NO: 2972708 - protein, 20 aa, Entamoeba invadens
VDLLFVLFLNWNRGAEDWEL

SEQ ID NO: 2972709 - protein, 17 aa, Entamoeba invadens
VDLLSLLLLYGANVHAE

SEQ ID NO: 2972710 - protein, 17 aa, Entamoeba invadens
VDLNGVTKISNAMFESC

SEQ ID NO: 2972711 - protein, 21 aa, Entamoeba invadens
VDLPIKVSGFLVKKELGYFAQ

SEQ ID NO: 2972712 - protein, 26 aa, Entamoeba invadens
VDLPKSLLTIGDFCFENCYELSSITF

SEQ ID NO: 2972713 - protein, 21 aa, Entamoeba invadens
VDLQNELVCLGLTKFEAKVSD

SEQ ID NO: 2972714 - protein, 19 aa, Entamoeba invadens
VDLTTKMTECIMKKTNLGN

SEQ ID NO: 2972715 - protein, 30 aa, Entamoeba invadens
VDLYCGFVRSFAIIPEIDWIDSATKANPKC

SEQ ID NO: 2972716 - protein, 18 aa, Entamoeba invadens
VDLYLKLGEVLPDQKTLP

SEQ ID NO: 2972717 - protein, 23 aa, Entamoeba invadens
VDLYQRYCRVYGLSYEEKEYSTA

SEQ ID NO: 2972718 - protein, 24 aa, Entamoeba invadens
VDMFTHLLPVYSFDAMEKIADAYL

SEQ ID NO: 2972719 - protein, 18 aa, Entamoeba invadens
VDMIEWCKSGLVVYESQI

SEQ ID NO: 2972720 - protein, 18 aa, Entamoeba invadens
VDMILRIKMMLDASRGIL

SEQ ID NO: 2972721 - protein, 19 aa, Entamoeba invadens
VDMILRIKMMLDASSGILY

SEQ ID NO: 2972722 - protein, 27 aa, Entamoeba invadens
VDMKIRVKICLDGANGIEYLHTNGILH

SEQ ID NO: 2972723 - protein, 17 aa, Entamoeba invadens
VDMKIRVKMMIDGARGV

SEQ ID NO: 2972724 - protein, 17 aa, Entamoeba invadens
VDMKLRMKFLLDAAKGI

SEQ ID NO: 2972725 - protein, 17 aa, Entamoeba invadens
VDMKLRTKFVLDASKGI

SEQ ID NO: 2972726 - protein, 17 aa, Entamoeba invadens
VDMKLRVKMLLDAAKGI

SEQ ID NO: 2972727 - protein, 23 aa, Entamoeba invadens
VDMKRMDDAIWSEIYLHELDKCE

SEQ ID NO: 2972728 - protein, 18 aa, Entamoeba invadens
VDMLKEVLPFALKELTAD

SEQ ID NO: 2972729 - protein, 17 aa, Entamoeba invadens
VDMPPPGTSVVSFIAKL

SEQ ID NO: 2972730 - protein, 22 aa, Entamoeba invadens
VDMQANVCIFNIRKKSEETWMP

SEQ ID NO: 2972731 - protein, 29 aa, Entamoeba invadens
VDMTFGCFVCSDCGRIHRYFTNKPQVCAP

SEQ ID NO: 2972732 - protein, 22 aa, Entamoeba invadens
VDMYKLLKFLLVNKVVRETTST

SEQ ID NO: 2972733 - protein, 24 aa, Entamoeba invadens
VDNACFYGCLSLQSVEFANTVQDI

SEQ ID NO: 2972734 - protein, 19 aa, Entamoeba invadens
VDNCKTCDLNGFCVECKSS

SEQ ID NO: 2972735 - protein, 18 aa, Entamoeba invadens
VDNFLKEDFSFYGCNCIS

SEQ ID NO: 2972736 - protein, 17 aa, Entamoeba invadens
VDNKFFILKVVHQKLRR

SEQ ID NO: 2972737 - protein, 17 aa, Entamoeba invadens
VDNKLFILKVVHKRFRR

SEQ ID NO: 2972738 - protein, 27 aa, Entamoeba invadens
VDNKPFCKNCFVLKFAKLCATCGKPIT

SEQ ID NO: 2972739 - protein, 27 aa, Entamoeba invadens
VDNMGHLALYKRGLCAASNPNTTVLAF

SEQ ID NO: 2972740 - protein, 18 aa, Entamoeba invadens
VDNMKGKILQKLISETRF

SEQ ID NO: 2972741 - protein, 24 aa, Entamoeba invadens
VDNPYFPQIPFFKLKNQDKKTNNS

SEQ ID NO: 2972742 - protein, 25 aa, Entamoeba invadens
VDNRCVLCAPSGYYDLCTDETSDGC

SEQ ID NO: 2972743 - protein, 18 aa, Entamoeba invadens
VDPAKYLPAFPKVEKKRP

SEQ ID NO: 2972744 - protein, 26 aa, Entamoeba invadens
VDPEVLKAMLPYFCEVYGNPNSLHTF

SEQ ID NO: 2972745 - protein, 17 aa, Entamoeba invadens
VDPFFEAMFSLGEQDLY

SEQ ID NO: 2972746 - protein, 18 aa, Entamoeba invadens
VDPGLCMFGEKEMKMVDG

SEQ ID NO: 2972747 - protein, 17 aa, Entamoeba invadens
VDPIINCCEEIGLEFPL

SEQ ID NO: 2972748 - protein, 24 aa, Entamoeba invadens
VDPLGEGIFVRWLGTKDDILYIAC

SEQ ID NO: 2972749 - protein, 22 aa, Entamoeba invadens
VDPSVRRTLSFVPMFTTTGHIV

SEQ ID NO: 2972750 - protein, 24 aa, Entamoeba invadens
VDPTRGLASLAFYYSSEILLGDDF

SEQ ID NO: 2972751 - protein, 21 aa, Entamoeba invadens
VDPVEFGFSFRLKVFSHISIN

SEQ ID NO: 2972752 - protein, 32 aa, Entamoeba invadens
VDPYYRTFDGFGILIEKEWCLIGHKFSDRSRN

SEQ ID NO: 2972753 - protein, 20 aa, Entamoeba invadens
VDQCLSHDFFSFDLHGLYSP

SEQ ID NO: 2972754 - protein, 29 aa, Entamoeba invadens
VDQKNFPRCPWAVTLLYSLSAYKDRLVDT

SEQ ID NO: 2972755 - protein, 17 aa, Entamoeba invadens
VDQVYENARFVIPLHLK

SEQ ID NO: 2972756 - protein, 24 aa, Entamoeba invadens
VDQYTVRVVDVFAMPQNGTGVSVE

SEQ ID NO: 2972757 - protein, 19 aa, Entamoeba invadens
VDRCVLIGGDGCPIGEEYT

SEQ ID NO: 2972758 - protein, 21 aa, Entamoeba invadens
VDRDFFIAGDFLEKMVFSTHL

SEQ ID NO: 2972759 - protein, 19 aa, Entamoeba invadens
VDRDPKCGYVGIIDNVCPK

SEQ ID NO: 2972760 - protein, 24 aa, Entamoeba invadens
VDRDYKLLLPKDMAVLRVGPEADL

SEQ ID NO: 2972761 - protein, 25 aa, Entamoeba invadens
VDREARLLFCVKTELENFVEKKKNE

SEQ ID NO: 2972762 - protein, 30 aa, Entamoeba invadens
VDRFDLCLKIVLRMICLHALLCAKMEEFKG

SEQ ID NO: 2972763 - protein, 17 aa, Entamoeba invadens
VDRGCFGTEVIILLFCL

SEQ ID NO: 2972764 - protein, 17 aa, Entamoeba invadens
VDRGCFGTEVIILLICL

SEQ ID NO: 2972765 - protein, 37 aa, Entamoeba invadens
VDRGHYGLECLLLLAALKLRFPTKVSLLRGNHECSLQ

SEQ ID NO: 2972766 - protein, 30 aa, Entamoeba invadens
VDRGKSGVEILCLLFALKLKYPDNIYLIRG

SEQ ID NO: 2972767 - protein, 28 aa, Entamoeba invadens
VDRPEAFEIMEMPFFKSVNVLIASLKGL

SEQ ID NO: 2972768 - protein, 24 aa, Entamoeba invadens
VDRSALCFTSKGLLEIDPTKVVCV

SEQ ID NO: 2972769 - protein, 23 aa, Entamoeba invadens
VDRSGAYCARWIAKSIVNAGLCH

SEQ ID NO: 2972770 - protein, 25 aa, Entamoeba invadens
VDRSIRRVTLLAGIYGDGTTLKPLI

SEQ ID NO: 2972771 - protein, 22 aa, Entamoeba invadens
VDRYKGNGIVLGTSKLFSTALT

SEQ ID NO: 2972772 - protein, 28 aa, Entamoeba invadens
VDSAMSYKDLEALFTFGAELIPVKQSQF

SEQ ID NO: 2972773 - protein, 25 aa, Entamoeba invadens
VDSDAMKRCVAIALMALINVLKFSE

SEQ ID NO: 2972774 - protein, 29 aa, Entamoeba invadens
VDSFEKCYEGVEAIFGVDILRGNENELLS

SEQ ID NO: 2972775 - protein, 24 aa, Entamoeba invadens
VDSGEMKVALALYPVSMKQIMDIA

SEQ ID NO: 2972776 - protein, 19 aa, Entamoeba invadens
VDSGLWTPLLIAVAGAPSN

SEQ ID NO: 2972777 - protein, 23 aa, Entamoeba invadens
VDSLRYVFERIIPVNQQLQPRII

SEQ ID NO: 2972778 - protein, 28 aa, Entamoeba invadens
VDSLYYRVLVTIACCFIKQTSRPVLWID

SEQ ID NO: 2972779 - protein, 24 aa, Entamoeba invadens
VDSPKELLIVFATLAAVIESYIVK

SEQ ID NO: 2972780 - protein, 26 aa, Entamoeba invadens
VDSQCFKNSLSFAFYRFPRSVSNIGD

SEQ ID NO: 2972781 - protein, 23 aa, Entamoeba invadens
VDSQCLLYTLPMIEGGTMGTKGN

SEQ ID NO: 2972782 - protein, 17 aa, Entamoeba invadens
VDSRTSLYVSEEMKQRE

SEQ ID NO: 2972783 - protein, 20 aa, Entamoeba invadens
VDSSLPCFIVAQSTKVKVYL

SEQ ID NO: 2972784 - protein, 23 aa, Entamoeba invadens
VDSTCKTNHPWNAPKYLKTKKDN

SEQ ID NO: 2972785 - protein, 17 aa, Entamoeba invadens
VDSTFYLPGQNIVIDIL

SEQ ID NO: 2972786 - protein, 18 aa, Entamoeba invadens
VDTFADFMENFNVDMEQT

SEQ ID NO: 2972787 - protein, 17 aa, Entamoeba invadens
VDTLEAMACNISQEELI

SEQ ID NO: 2972788 - protein, 17 aa, Entamoeba invadens
VDTLGNIPLEWYDDYEH

SEQ ID NO: 2972789 - protein, 20 aa, Entamoeba invadens
VDTLRTIPAVICGNKNDLEN

SEQ ID NO: 2972790 - protein, 22 aa, Entamoeba invadens
VDTLRTIPAVICGNKNDLENKR

SEQ ID NO: 2972791 - protein, 24 aa, Entamoeba invadens
VDTLYFYLCPSFITRTIRIIASNS

SEQ ID NO: 2972792 - protein, 26 aa, Entamoeba invadens
VDTNLSTLCLFKLVTKFLPTANINPN

SEQ ID NO: 2972793 - protein, 17 aa, Entamoeba invadens
VDTSSWCNPFCVFLDKG

SEQ ID NO: 2972794 - protein, 20 aa, Entamoeba invadens
VDVAWVFNIRGDDILYSPLA

SEQ ID NO: 2972795 - protein, 19 aa, Entamoeba invadens
VDVFYGCIFKLPTHINKER

SEQ ID NO: 2972796 - protein, 17 aa, Entamoeba invadens
VDVGKGWDVLFEAYNEN

SEQ ID NO: 2972797 - protein, 20 aa, Entamoeba invadens
VDVIGVNEFVCVAKRDNSID

SEQ ID NO: 2972798 - protein, 18 aa, Entamoeba invadens
VDVIPKFIMSSGEMVNLL

SEQ ID NO: 2972799 - protein, 27 aa, Entamoeba invadens
VDVIPYGCFQRCKFLMKSRIFIKGNNV

SEQ ID NO: 2972800 - protein, 17 aa, Entamoeba invadens
VDVIRIFMTNFEHRLDD

SEQ ID NO: 2972801 - protein, 24 aa, Entamoeba invadens
VDVKYKAVFVWVDAALVLLDKRAD

SEQ ID NO: 2972802 - protein, 27 aa, Entamoeba invadens
VDVLIIGGVCLQIFPTIQRVEFVTEET

SEQ ID NO: 2972803 - protein, 19 aa, Entamoeba invadens
VDVNFLLGFQHIQIIELIK

SEQ ID NO: 2972804 - protein, 18 aa, Entamoeba invadens
VDVQWLLCKFGKENATSN

SEQ ID NO: 2972805 - protein, 23 aa, Entamoeba invadens
VDVRLKDGCVIGKSQEELKEFVD

SEQ ID NO: 2972806 - protein, 19 aa, Entamoeba invadens
VDVYPPYLLLLKLLTKNGK

SEQ ID NO: 2972807 - protein, 18 aa, Entamoeba invadens
VDWLRCGEFKNFYNPENL

SEQ ID NO: 2972808 - protein, 22 aa, Entamoeba invadens
VDWWGLGILIYEMLFTKSPFLA

SEQ ID NO: 2972809 - protein, 18 aa, Entamoeba invadens
VDYANCGVDAKGYLLHNE

SEQ ID NO: 2972810 - protein, 19 aa, Entamoeba invadens
VDYDCVVDLLKIIEPQSLN

SEQ ID NO: 2972811 - protein, 17 aa, Entamoeba invadens
VDYDWKFGGRDYDEAIG

SEQ ID NO: 2972812 - protein, 25 aa, Entamoeba invadens
VDYFEFLVFCWMKILVVDEKKTFHQ

SEQ ID NO: 2972813 - protein, 17 aa, Entamoeba invadens
VDYFISVVIIDTDERRY

SEQ ID NO: 2972814 - protein, 23 aa, Entamoeba invadens
VDYGEIFGLSTFVSVYIYQRLYT

SEQ ID NO: 2972815 - protein, 17 aa, Entamoeba invadens
VDYGLCFEKLPRKKEKI

SEQ ID NO: 2972816 - protein, 17 aa, Entamoeba invadens
VDYIAVFEISVDITEFI

SEQ ID NO: 2972817 - protein, 18 aa, Entamoeba invadens
VDYTENFVSIGYTSPKLM

SEQ ID NO: 2972818 - protein, 28 aa, Entamoeba invadens
VDYWSIGCMLFQFLTGEFPFRGKSDKLT

SEQ ID NO: 2972819 - protein, 25 aa, Entamoeba invadens
VDYYHFAFNIARKCNVINRLMYGID

SEQ ID NO: 2972820 - protein, 23 aa, Entamoeba invadens
VEAAALLRAECFGIKQNMTKDEM

SEQ ID NO: 2972821 - protein, 20 aa, Entamoeba invadens
VEAEGFFKLATGEGTSMLAK

SEQ ID NO: 2972822 - protein, 17 aa, Entamoeba invadens
VEAEWLQEFDVQLKVGE

SEQ ID NO: 2972823 - protein, 19 aa, Entamoeba invadens
VEAGIKHTLMQQVLLPKSL

SEQ ID NO: 2972824 - protein, 20 aa, Entamoeba invadens
VEAIGGNGLFYCLVDTDETA

SEQ ID NO: 2972825 - protein, 17 aa, Entamoeba invadens
VEAIWNSYVVPSMPVNT

SEQ ID NO: 2972826 - protein, 25 aa, Entamoeba invadens
VEAKITLGIFFQIVFQSFKINDIFY

SEQ ID NO: 2972827 - protein, 26 aa, Entamoeba invadens
VEALKGFARAIGFFRNQEEYYWANQC

SEQ ID NO: 2972828 - protein, 19 aa, Entamoeba invadens
VEALLSYIFPLFAEASKYK

SEQ ID NO: 2972829 - protein, 28 aa, Entamoeba invadens
VEALNKLPGGPFINGKIVCSEDCISEIL

SEQ ID NO: 2972830 - protein, 19 aa, Entamoeba invadens
VEALSAMSKYIGWVDTKAL

SEQ ID NO: 2972831 - protein, 17 aa, Entamoeba invadens
VEAMNKCIENLSFPKDL

SEQ ID NO: 2972832 - protein, 20 aa, Entamoeba invadens
VEANAWFVAMAYTIKLAPRI

SEQ ID NO: 2972833 - protein, 19 aa, Entamoeba invadens
VEAPRECQTVIEIAKSAHQ

SEQ ID NO: 2972834 - protein, 37 aa, Entamoeba invadens
VEASKLCPEIVWTPSMKRLFCLIVECFKNKEPALLIV

SEQ ID NO: 2972835 - protein, 23 aa, Entamoeba invadens
VEAVLRVTENFVKKVLKESPHLI

SEQ ID NO: 2972836 - protein, 24 aa, Entamoeba invadens
VECAKAISLLNGFDCNFYELNCAC

SEQ ID NO: 2972837 - protein, 22 aa, Entamoeba invadens
VECARSDYLLLMYTQATCATVL

SEQ ID NO: 2972838 - protein, 21 aa, Entamoeba invadens
VECFRYLGILLNMGAHRDVIN

SEQ ID NO: 2972839 - protein, 20 aa, Entamoeba invadens
VECKVCKANLIFSHHFARSF

SEQ ID NO: 2972840 - protein, 19 aa, Entamoeba invadens
VECLLKYSTQWMTDESTHL

SEQ ID NO: 2972841 - protein, 21 aa, Entamoeba invadens
VECLYVLLCTITQYPVGVYFA

SEQ ID NO: 2972842 - protein, 23 aa, Entamoeba invadens
VECSHPNDVCWNAVNNQIFVGTE

SEQ ID NO: 2972843 - protein, 25 aa, Entamoeba invadens
VEDAKVCILSCPFEPPKTKTTTNMN

SEQ ID NO: 2972844 - protein, 17 aa, Entamoeba invadens
VEDKFEMEDYYSIQNLY

SEQ ID NO: 2972845 - protein, 17 aa, Entamoeba invadens
VEDLCFSLQETLFAMLV

SEQ ID NO: 2972846 - protein, 20 aa, Entamoeba invadens
VEDLKDYFAIVGQNETNPFL

SEQ ID NO: 2972847 - protein, 29 aa, Entamoeba invadens
VEDLKLMGLAVDWRRSFITTDHNKFYDSF

SEQ ID NO: 2972848 - protein, 24 aa, Entamoeba invadens
VEDLRLSIPSSIIIQKDSNDQKVL

SEQ ID NO: 2972849 - protein, 21 aa, Entamoeba invadens
VEDNIRDKLAYYWREDGDKLK

SEQ ID NO: 2972850 - protein, 19 aa, Entamoeba invadens
VEDNLIVPGCYDISKINET

SEQ ID NO: 2972851 - protein, 17 aa, Entamoeba invadens
VEDRVVPSYSFSNHVLA

SEQ ID NO: 2972852 - protein, 22 aa, Entamoeba invadens
VEDRWFKCFTEYIDDRKTYLRT

SEQ ID NO: 2972853 - protein, 23 aa, Entamoeba invadens
VEDVEPLKLFFGLLDTDDDGELC

SEQ ID NO: 2972854 - protein, 23 aa, Entamoeba invadens
VEDYALWKCCSLVRHPKFVPAKG

SEQ ID NO: 2972855 - protein, 22 aa, Entamoeba invadens
VEDYSGVSFEVFIRWFQKVAED

SEQ ID NO: 2972856 - protein, 22 aa, Entamoeba invadens
VEEAEKFLKEQQESAGGNGQGT

SEQ ID NO: 2972857 - protein, 23 aa, Entamoeba invadens
VEEEVKYVYTIVKAIRSLNSTYQ

SEQ ID NO: 2972858 - protein, 17 aa, Entamoeba invadens
VEEFMKFPLNNPTNVWT

SEQ ID NO: 2972859 - protein, 19 aa, Entamoeba invadens
VEEGITLGVPKSMKKATNK

SEQ ID NO: 2972860 - protein, 32 aa, Entamoeba invadens
VEEGVLKKVYFWHQGLGFSFVHNGEELKNTLY

SEQ ID NO: 2972861 - protein, 23 aa, Entamoeba invadens
VEEKKCITHHGFFVEFKQNHTQH

SEQ ID NO: 2972862 - protein, 18 aa, Entamoeba invadens
VEEKKLLHHLGIKCSNLI

SEQ ID NO: 2972863 - protein, 32 aa, Entamoeba invadens
VEEKMTLLAQMVLDKRVEFISKKRKAEVLFDS

SEQ ID NO: 2972864 - protein, 23 aa, Entamoeba invadens
VEEKRAKNEAPAMLAQLASTVEK

SEQ ID NO: 2972865 - protein, 23 aa, Entamoeba invadens
VEEKRFQTIVGVQVRLMKRHKKI

SEQ ID NO: 2972866 - protein, 23 aa, Entamoeba invadens
VEEKRTLTQWSNRVNSHIKDSFL

SEQ ID NO: 2972867 - protein, 21 aa, Entamoeba invadens
VEELGELMVPYIEQMTPLVEC

SEQ ID NO: 2972868 - protein, 25 aa, Entamoeba invadens
VEELKEKLHPLGMFSNVEALPNVKS

SEQ ID NO: 2972869 - protein, 18 aa, Entamoeba invadens
VEELLCRPEKNSGRVKAA

SEQ ID NO: 2972870 - protein, 20 aa, Entamoeba invadens
VEELPVLNVEVSTQKEKNSW

SEQ ID NO: 2972871 - protein, 19 aa, Entamoeba invadens
VEELWSFDHGKSIYRNSMP

SEQ ID NO: 2972872 - protein, 24 aa, Entamoeba invadens
VEEMAQALFIYWKSKELLRTNEYQ

SEQ ID NO: 2972873 - protein, 24 aa, Entamoeba invadens
VEEMAQALYIYWKSRDIARSGECD

SEQ ID NO: 2972874 - protein, 23 aa, Entamoeba invadens
VEEMSELFTPFLFKVQEKRLAKY

SEQ ID NO: 2972875 - protein, 21 aa, Entamoeba invadens
VEERNELFILLAQSSNKTVYI

SEQ ID NO: 2972876 - protein, 20 aa, Entamoeba invadens
VEERPAFILVYTIATNTLST

SEQ ID NO: 2972877 - protein, 19 aa, Entamoeba invadens
VEERWGWKEIDESPFMCEF

SEQ ID NO: 2972878 - protein, 21 aa, Entamoeba invadens
VEETISLKAFVVLLVDKENNK

SEQ ID NO: 2972879 - protein, 25 aa, Entamoeba invadens
VEETWKIAEILSLKFDEGSNGLIIT

SEQ ID NO: 2972880 - protein, 26 aa, Entamoeba invadens
VEEVTGRFGFPFTCEYKYDGERGQIH

SEQ ID NO: 2972881 - protein, 30 aa, Entamoeba invadens
VEFAGCSNLNIIDTPGFRIGGEEGLRDDIS

SEQ ID NO: 2972882 - protein, 24 aa, Entamoeba invadens
VEFEKRNLLEFFTSNRVLFFKGDV

SEQ ID NO: 2972883 - protein, 20 aa, Entamoeba invadens
VEFFKVGGVSKYFGDVSTQN

SEQ ID NO: 2972884 - protein, 17 aa, Entamoeba invadens
VEFKNTLLTLLKEKEKI

SEQ ID NO: 2972885 - protein, 18 aa, Entamoeba invadens
VEFLERWKCSMDQEEMLS

SEQ ID NO: 2972886 - protein, 22 aa, Entamoeba invadens
VEFLKFLCDTFIFLNGSFTTQH

SEQ ID NO: 2972887 - protein, 17 aa, Entamoeba invadens
VEFMKLKHLIILQNKID

SEQ ID NO: 2972888 - protein, 21 aa, Entamoeba invadens
VEFRKCLERFGATSLEKFKKM

SEQ ID NO: 2972889 - protein, 24 aa, Entamoeba invadens
VEFSKQILPQFFKHSNICSFVRQL

SEQ ID NO: 2972890 - protein, 34 aa, Entamoeba invadens
VEFSVKRYDFLVQFLPKWGSGWEKLSSDHRNIEK

SEQ ID NO: 2972891 - protein, 17 aa, Entamoeba invadens
VEGAVIHDICTKVNAYI

SEQ ID NO: 2972892 - protein, 17 aa, Entamoeba invadens
VEGCTSVPYQSDSTSTF

SEQ ID NO: 2972893 - protein, 25 aa, Entamoeba invadens
VEGDTFKLGVKMLMATAYLPEDVIV

SEQ ID NO: 2972894 - protein, 18 aa, Entamoeba invadens
VEGGKGWHAELNKVMKEK

SEQ ID NO: 2972895 - protein, 23 aa, Entamoeba invadens
VEGHGRCFLISGLPNGTTVSNLK

SEQ ID NO: 2972896 - protein, 18 aa, Entamoeba invadens
VEGIFRLTGSKMKIDQII

SEQ ID NO: 2972897 - protein, 32 aa, Entamoeba invadens
VEGLREVVQLIAIKEEVDWDYFLKDPFVGALT

SEQ ID NO: 2972898 - protein, 20 aa, Entamoeba invadens
VEGTVLEKVVEWLNFHNEHP

SEQ ID NO: 2972899 - protein, 17 aa, Entamoeba invadens
VEGVWGMAGDLILIEEA

SEQ ID NO: 2972900 - protein, 24 aa, Entamoeba invadens
VEHFPMKKGGTFDVNIKCLRSVYH

SEQ ID NO: 2972901 - protein, 24 aa, Entamoeba invadens
VEHGACLGVGLAGIATEDFEIYEE

SEQ ID NO: 2972902 - protein, 24 aa, Entamoeba invadens
VEHKKRKITQCGRCQQYGHNKQTC

SEQ ID NO: 2972903 - protein, 19 aa, Entamoeba invadens
VEHLKTVNGTFAFSDTATQ

SEQ ID NO: 2972904 - protein, 23 aa, Entamoeba invadens
VEHLPQTIVELFTCHLSILSSLK

SEQ ID NO: 2972905 - protein, 20 aa, Entamoeba invadens
VEIAVPFPSFIRNIQLTVVS

SEQ ID NO: 2972906 - protein, 18 aa, Entamoeba invadens
VEIDCCVELSEFVCPCTL

SEQ ID NO: 2972907 - protein, 18 aa, Entamoeba invadens
VEIDFRSKIPFEQVFEEL

SEQ ID NO: 2972908 - protein, 26 aa, Entamoeba invadens
VEIDWKAEFDGLIVRGIKTFGLGMWS

SEQ ID NO: 2972909 - protein, 22 aa, Entamoeba invadens
VEIEKLMLLKCNREECLRVYLK

SEQ ID NO: 2972910 - protein, 18 aa, Entamoeba invadens
VEIELRHVAVLDALGKPK

SEQ ID NO: 2972911 - protein, 17 aa, Entamoeba invadens
VEIFATTGIEIYSETTH

SEQ ID NO: 2972912 - protein, 22 aa, Entamoeba invadens
VEIGCSCYLCANKERVISKKRI

SEQ ID NO: 2972913 - protein, 26 aa, Entamoeba invadens
VEIGPRMTLKLLSILSDFLRGRIVYR

SEQ ID NO: 2972914 - protein, 21 aa, Entamoeba invadens
VEIGVGCFENCISLTKLKLPH

SEQ ID NO: 2972915 - protein, 27 aa, Entamoeba invadens
VEIIKTTLFAIEWFVSANFGDSITSYV

SEQ ID NO: 2972916 - protein, 25 aa, Entamoeba invadens
VEIKEWTAIIPMMYKDEFMTLQHLL

SEQ ID NO: 2972917 - protein, 19 aa, Entamoeba invadens
VEIKPTYTMFPNVDSVMVS

SEQ ID NO: 2972918 - protein, 25 aa, Entamoeba invadens
VEILAFILGVSCLKDIRVQAKTFLL

SEQ ID NO: 2972919 - protein, 22 aa, Entamoeba invadens
VEILKDEYILFSIAELVNSRYD

SEQ ID NO: 2972920 - protein, 27 aa, Entamoeba invadens
VEILKFHKRTVKGFGSCATVVVYQGQE

SEQ ID NO: 2972921 - protein, 17 aa, Entamoeba invadens
VEILKTILKQCGENVTF

SEQ ID NO: 2972922 - protein, 21 aa, Entamoeba invadens
VEIPDFLPPDVINDIDIELID

SEQ ID NO: 2972923 - protein, 18 aa, Entamoeba invadens
VEIPDTIGDCIGLTYLSL

SEQ ID NO: 2972924 - protein, 26 aa, Entamoeba invadens
VEIPGSVKVLREWTFAGCVSLREVVL

SEQ ID NO: 2972925 - protein, 18 aa, Entamoeba invadens
VEIPLLSFLEQFKILNNR

SEQ ID NO: 2972926 - protein, 19 aa, Entamoeba invadens
VEIPLSLLEQHVIKTTKNK

SEQ ID NO: 2972927 - protein, 27 aa, Entamoeba invadens
VEIPTSGLLCDLVWSDPLLTPDIAPNL

SEQ ID NO: 2972928 - protein, 19 aa, Entamoeba invadens
VEIVTRILLFITDNCRAKL

SEQ ID NO: 2972929 - protein, 27 aa, Entamoeba invadens
VEIYDLFVVQLFEMFLAIFLVDEEHRK

SEQ ID NO: 2972930 - protein, 19 aa, Entamoeba invadens
VEKCFCFDNDNTLPVSKIE

SEQ ID NO: 2972931 - protein, 20 aa, Entamoeba invadens
VEKCNKKKGLVFGVFDTNKH

SEQ ID NO: 2972932 - protein, 22 aa, Entamoeba invadens
VEKCSLGVYSLLCIYGGVEMFP

SEQ ID NO: 2972933 - protein, 19 aa, Entamoeba invadens
VEKDFPILVKYATSSDEEK

SEQ ID NO: 2972934 - protein, 18 aa, Entamoeba invadens
VEKEGTVIVLFNYMTSID

SEQ ID NO: 2972935 - protein, 19 aa, Entamoeba invadens
VEKERKLLEEERIRLQKEE

SEQ ID NO: 2972936 - protein, 19 aa, Entamoeba invadens
VEKFINFKVDYEQYLNDKK

SEQ ID NO: 2972937 - protein, 25 aa, Entamoeba invadens
VEKGHLLFWRQEYFYLRDELIADIT

SEQ ID NO: 2972938 - protein, 19 aa, Entamoeba invadens
VEKGILRVEQYASFGSLLL

SEQ ID NO: 2972939 - protein, 18 aa, Entamoeba invadens
VEKGKRLILDKNIPTDYA

SEQ ID NO: 2972940 - protein, 25 aa, Entamoeba invadens
VEKGSLCFSCVTIPQVKKITAPVMF

SEQ ID NO: 2972941 - protein, 17 aa, Entamoeba invadens
VEKIEEWSGKKVDQVLF

SEQ ID NO: 2972942 - protein, 26 aa, Entamoeba invadens
VEKIIKMSGGVLDRSALFVVGTEEGE

SEQ ID NO: 2972943 - protein, 27 aa, Entamoeba invadens
VEKIKQFYIVVCQEIHDNGNTINQLKQ

SEQ ID NO: 2972944 - protein, 19 aa, Entamoeba invadens
VEKILKRQAVVEFFIENPT

SEQ ID NO: 2972945 - protein, 33 aa, Entamoeba invadens
VEKISFKTKSSWGAQDFLDFLLSVPESERYRTM

SEQ ID NO: 2972946 - protein, 23 aa, Entamoeba invadens
VEKKFPFLLSCLNDLNEAIKVVF

SEQ ID NO: 2972947 - protein, 21 aa, Entamoeba invadens
VEKKIKRLRVTKLKVDKKLDD

SEQ ID NO: 2972948 - protein, 20 aa, Entamoeba invadens
VEKKRPKVKCFDKKTSAKIE

SEQ ID NO: 2972949 - protein, 21 aa, Entamoeba invadens
VEKRGPWLFYINNVIFTKKCW

SEQ ID NO: 2972950 - protein, 22 aa, Entamoeba invadens
VEKRGPWLFYINNVIFTKKCWE

SEQ ID NO: 2972951 - protein, 17 aa, Entamoeba invadens
VEKRLHAIITVDKKDIA

SEQ ID NO: 2972952 - protein, 24 aa, Entamoeba invadens
VEKRVCGLQSRIKILTVENEKLRK

SEQ ID NO: 2972953 - protein, 25 aa, Entamoeba invadens
VEKSESLMECCGYRDGVVLYRDGDV

SEQ ID NO: 2972954 - protein, 22 aa, Entamoeba invadens
VEKSLKMTLNFRKSEKKPEKDE

SEQ ID NO: 2972955 - protein, 24 aa, Entamoeba invadens
VEKTREVVALLGILKSPRGIFEGN

SEQ ID NO: 2972956 - protein, 25 aa, Entamoeba invadens
VEKVKRGDSVLVHCSDGWDRTSQLT

SEQ ID NO: 2972957 - protein, 29 aa, Entamoeba invadens
VEKYNSVFFKVKIVMKYNEELVMTHLTTL

SEQ ID NO: 2972958 - protein, 17 aa, Entamoeba invadens
VELAGPMEKLFFIPERT

SEQ ID NO: 2972959 - protein, 27 aa, Entamoeba invadens
VELARKLFPKKLDQFNPAFVIVDEQGK

SEQ ID NO: 2972960 - protein, 18 aa, Entamoeba invadens
VELCAPQQIELKFLEKTP

SEQ ID NO: 2972961 - protein, 20 aa, Entamoeba invadens
VELCNEMFFRNEHLLFLEMI

SEQ ID NO: 2972962 - protein, 19 aa, Entamoeba invadens
VELCRKFGEEFYKFRRSLA

SEQ ID NO: 2972963 - protein, 18 aa, Entamoeba invadens
VELDLSFNKIDDFSPLCS

SEQ ID NO: 2972964 - protein, 34 aa, Entamoeba invadens
VELEAKLMLGDRFFRLNPKLPHYVDLDDCKDMEL

SEQ ID NO: 2972965 - protein, 30 aa, Entamoeba invadens
VELECVLLALLSLKYSFTISKPQKKAENTK

SEQ ID NO: 2972966 - protein, 23 aa, Entamoeba invadens
VELELKSKINAYFAENTPLFTPP

SEQ ID NO: 2972967 - protein, 23 aa, Entamoeba invadens
VELEPRQSFMIKGTHNKDEKNMS

SEQ ID NO: 2972968 - protein, 34 aa, Entamoeba invadens
VELEVKRILSKYPKFKASVMNSRLTSKQQLTLSG

SEQ ID NO: 2972969 - protein, 19 aa, Entamoeba invadens
VELEWSQKVYDNFFAGIGG

SEQ ID NO: 2972970 - protein, 17 aa, Entamoeba invadens
VELFISNIDFEYVDNGN

SEQ ID NO: 2972971 - protein, 19 aa, Entamoeba invadens
VELHKVFIHAHVLNRAFNT

SEQ ID NO: 2972972 - protein, 24 aa, Entamoeba invadens
VELKEIKNFVVWYEVSFSHTKRFA

SEQ ID NO: 2972973 - protein, 21 aa, Entamoeba invadens
VELKLLSGIVKLIIYYNDISS

SEQ ID NO: 2972974 - protein, 19 aa, Entamoeba invadens
VELKMIFHSFVNYIKDVLN

SEQ ID NO: 2972975 - protein, 24 aa, Entamoeba invadens
VELKTDYLRDFLVKYISRMDLFKF

SEQ ID NO: 2972976 - protein, 19 aa, Entamoeba invadens
VELLCWDISQEYLDQAETE

SEQ ID NO: 2972977 - protein, 21 aa, Entamoeba invadens
VELLGNLGCGFDCATLNEVKE

SEQ ID NO: 2972978 - protein, 21 aa, Entamoeba invadens
VELLMFACLYVFKIMDDETLR

SEQ ID NO: 2972979 - protein, 17 aa, Entamoeba invadens
VELLNFLDKSVVLSDEK

SEQ ID NO: 2972980 - protein, 23 aa, Entamoeba invadens
VELLSFKDRFVMFEKLTKDTDSK

SEQ ID NO: 2972981 - protein, 18 aa, Entamoeba invadens
VELNCSRGVDVRKDEMKE

SEQ ID NO: 2972982 - protein, 18 aa, Entamoeba invadens
VELNEAIFSAAFGTFMFD

SEQ ID NO: 2972983 - protein, 19 aa, Entamoeba invadens
VELNTNFDLVNSISKLISD

SEQ ID NO: 2972984 - protein, 23 aa, Entamoeba invadens
VELPFKPKVALTLFSMFYPIIPL

SEQ ID NO: 2972985 - protein, 23 aa, Entamoeba invadens
VELPISNGKLKFHLITQTDATVI

SEQ ID NO: 2972986 - protein, 27 aa, Entamoeba invadens
VELPKSLKLIGKEAFEYCVSLTTIVIP

SEQ ID NO: 2972987 - protein, 23 aa, Entamoeba invadens
VELPLRHPQLFQAIGIKPPKGVL

SEQ ID NO: 2972988 - protein, 18 aa, Entamoeba invadens
VELPSCIKELKIDSFCDV

SEQ ID NO: 2972989 - protein, 17 aa, Entamoeba invadens
VELRDGTGYCQCVIFGK

SEQ ID NO: 2972990 - protein, 20 aa, Entamoeba invadens
VELRGFPGYAGGLDTKENGD

SEQ ID NO: 2972991 - protein, 24 aa, Entamoeba invadens
VELSADLFANYVIQKALEFVPESR

SEQ ID NO: 2972992 - protein, 30 aa, Entamoeba invadens
VELSNALFGFDGWSSCITNLNVDYVDAEKG

SEQ ID NO: 2972993 - protein, 17 aa, Entamoeba invadens
VELSSIFNCEQKTIDMS

SEQ ID NO: 2972994 - protein, 26 aa, Entamoeba invadens
VELTSSFKEFFFKKITFGTANCGGDN

SEQ ID NO: 2972995 - protein, 19 aa, Entamoeba invadens
VELVKFVTSCFIRRESIEF

SEQ ID NO: 2972996 - protein, 18 aa, Entamoeba invadens
VELVPTFRDYLASKDDPT

SEQ ID NO: 2972997 - protein, 27 aa, Entamoeba invadens
VELYLQLGPPLKVFIPITVVTSQDPSI

SEQ ID NO: 2972998 - protein, 17 aa, Entamoeba invadens
VEMADGLIIHTKNEDFL

SEQ ID NO: 2972999 - protein, 21 aa, Entamoeba invadens
VEMAKTCWREIVKRRYDNRQI

SEQ ID NO: 2973000 - protein, 19 aa, Entamoeba invadens
VEMKNCNFVAPFEFMKNNF

SEQ ID NO: 2973001 - protein, 19 aa, Entamoeba invadens
VEMKNCNFVAPFEFMKNNL

SEQ ID NO: 2973002 - protein, 17 aa, Entamoeba invadens
VEMMCLFTKNNFIQCGN

SEQ ID NO: 2973003 - protein, 20 aa, Entamoeba invadens
VEMMQRWKAFLDVSKDFVKS

SEQ ID NO: 2973004 - protein, 25 aa, Entamoeba invadens
VEMPGSVKVLREWTFAGCVSLREVV

SEQ ID NO: 2973005 - protein, 21 aa, Entamoeba invadens
VEMRCGGTVASVIPMICEEKA

SEQ ID NO: 2973006 - protein, 24 aa, Entamoeba invadens
VENALYLLRWISLMMAEELPTDSL

SEQ ID NO: 2973007 - protein, 17 aa, Entamoeba invadens
VENCLKALQYSYVKMFF

SEQ ID NO: 2973008 - protein, 17 aa, Entamoeba invadens
VENCTPEVLAMIKRCEF

SEQ ID NO: 2973009 - protein, 30 aa, Entamoeba invadens
VENCVTCLQPSLRGYPFVYTYSIIHYTTLF

SEQ ID NO: 2973010 - protein, 17 aa, Entamoeba invadens
VENFAGVAYPQISKLKS

SEQ ID NO: 2973011 - protein, 17 aa, Entamoeba invadens
VENFCFVVEAKNRRGQI

SEQ ID NO: 2973012 - protein, 25 aa, Entamoeba invadens
VENHFGRLILSFKLMRNKYGLLKRD

SEQ ID NO: 2973013 - protein, 26 aa, Entamoeba invadens
VENHFSRLIILFKLMRNKYGLLKRDY

SEQ ID NO: 2973014 - protein, 25 aa, Entamoeba invadens
VENILRLFGVKIFCFEELTNVLKEW

SEQ ID NO: 2973015 - protein, 19 aa, Entamoeba invadens
VENKGDLLIYLYSSNPQKQ

SEQ ID NO: 2973016 - protein, 23 aa, Entamoeba invadens
VENLKGVRGFVIVIYSQDANNVF

SEQ ID NO: 2973017 - protein, 29 aa, Entamoeba invadens
VENMVQSWRCCLFYGLALVNSPTNYSYVF

SEQ ID NO: 2973018 - protein, 26 aa, Entamoeba invadens
VENTFFLSFNDICFDKIFNEAMKRRL

SEQ ID NO: 2973019 - protein, 28 aa, Entamoeba invadens
VENVFNYASKILIKFDHECLKCRDHKDK

SEQ ID NO: 2973020 - protein, 17 aa, Entamoeba invadens
VEPDVFIMVVGNKVDKP

SEQ ID NO: 2973021 - protein, 23 aa, Entamoeba invadens
VEPELRLGYLSVNQLKNHPWFEG

SEQ ID NO: 2973022 - protein, 25 aa, Entamoeba invadens
VEPGLYFKGNFGVRIENVCIVEYTT

SEQ ID NO: 2973023 - protein, 21 aa, Entamoeba invadens
VEPIYEGFTMKRCGLRTSVAG

SEQ ID NO: 2973024 - protein, 19 aa, Entamoeba invadens
VEPKNCIVEGQGITEPNDE

SEQ ID NO: 2973025 - protein, 26 aa, Entamoeba invadens
VEPLLHIFSAHALKVGSLYTEVYCQL

SEQ ID NO: 2973026 - protein, 18 aa, Entamoeba invadens
VEPMRKKKPVILLYDENG

SEQ ID NO: 2973027 - protein, 24 aa, Entamoeba invadens
VEPSADYYKAIVLIYASSALLTQQ

SEQ ID NO: 2973028 - protein, 23 aa, Entamoeba invadens
VEPSCAYSCVSFFINVSYNNEDG

SEQ ID NO: 2973029 - protein, 30 aa, Entamoeba invadens
VEPSKLPESWKILLREAGVKKRDLQNPDTR

SEQ ID NO: 2973030 - protein, 23 aa, Entamoeba invadens
VEPTKLKYGISLFDQYFPTLKPE

SEQ ID NO: 2973031 - protein, 25 aa, Entamoeba invadens
VEPTRKCFRLVNGVMVERTASEIIP

SEQ ID NO: 2973032 - protein, 18 aa, Entamoeba invadens
VEQCKVYVAKLMKMSDAV

SEQ ID NO: 2973033 - protein, 19 aa, Entamoeba invadens
VEQCSRVIIEYADDKCESS

SEQ ID NO: 2973034 - protein, 23 aa, Entamoeba invadens
VEQDAFNCCYFLTEIKFRCKDTK

SEQ ID NO: 2973035 - protein, 25 aa, Entamoeba invadens
VEQEDRMNWVKSLGKVKEEIKREHV

SEQ ID NO: 2973036 - protein, 23 aa, Entamoeba invadens
VEQIQKWSFLKIESVIFDSNLDD

SEQ ID NO: 2973037 - protein, 22 aa, Entamoeba invadens
VEQKKPKACVGMYRGETTKEIK

SEQ ID NO: 2973038 - protein, 27 aa, Entamoeba invadens
VEQLGDCHLWRFEALKEVGAVDAHGKS

SEQ ID NO: 2973039 - protein, 18 aa, Entamoeba invadens
VEQPIRAIIFGFNTEEIV

SEQ ID NO: 2973040 - protein, 30 aa, Entamoeba invadens
VEQRKCGVCNVPFDTGFNVTSQWDKIEGIS

SEQ ID NO: 2973041 - protein, 25 aa, Entamoeba invadens
VERCRELYESALLKCPAEFKLEISK

SEQ ID NO: 2973042 - protein, 17 aa, Entamoeba invadens
VEREMMKEEISVLESTV

SEQ ID NO: 2973043 - protein, 17 aa, Entamoeba invadens
VERFSISNIVHVKQVYN

SEQ ID NO: 2973044 - protein, 33 aa, Entamoeba invadens
VERKHGGGFGLSWSIVSPGTFCVCENGNVYVYT

SEQ ID NO: 2973045 - protein, 22 aa, Entamoeba invadens
VERLEKFGLYTFVFNALDMIYA

SEQ ID NO: 2973046 - protein, 25 aa, Entamoeba invadens
VERLELFKDLYLSKALEVIPDDVVM

SEQ ID NO: 2973047 - protein, 20 aa, Entamoeba invadens
VERLKVNFCEMGRLYSEFYM

SEQ ID NO: 2973048 - protein, 28 aa, Entamoeba invadens
VERLPRMCFYCCVSLKKAVITKGVIIIG

SEQ ID NO: 2973049 - protein, 24 aa, Entamoeba invadens
VERWESGWDFGYQFRYNNGGNPMI

SEQ ID NO: 2973050 - protein, 18 aa, Entamoeba invadens
VERWMFKSLKPEEHDTFK

SEQ ID NO: 2973051 - protein, 24 aa, Entamoeba invadens
VESARYGNMYSIFNLGVLAFKGLP

SEQ ID NO: 2973052 - protein, 24 aa, Entamoeba invadens
VESDMKDFSILVGIRDRKLLLCKI

SEQ ID NO: 2973053 - protein, 21 aa, Entamoeba invadens
VESHSAYTVWSMVLNNSSIIS

SEQ ID NO: 2973054 - protein, 20 aa, Entamoeba invadens
VESIPHCTFMKCYNLREIIL

SEQ ID NO: 2973055 - protein, 25 aa, Entamoeba invadens
VESLEAELLTLRQVVSSSDTKAIEL

SEQ ID NO: 2973056 - protein, 18 aa, Entamoeba invadens
VESLRIQLELFFHRVEEK

SEQ ID NO: 2973057 - protein, 18 aa, Entamoeba invadens
VESLRLVKEMLPIQTASM

SEQ ID NO: 2973058 - protein, 24 aa, Entamoeba invadens
VESLRPSLFEGWAKKQGGAVKTWK

SEQ ID NO: 2973059 - protein, 19 aa, Entamoeba invadens
VESLWPFVVSMRYEEKVIV

SEQ ID NO: 2973060 - protein, 22 aa, Entamoeba invadens
VESRNKWTLLQRRMDQLDQMLN

SEQ ID NO: 2973061 - protein, 27 aa, Entamoeba invadens
VESTCCVNCSALSLVIEDFANTIIFTE

SEQ ID NO: 2973062 - protein, 21 aa, Entamoeba invadens
VESYFKIKANFMPVALKTRVA

SEQ ID NO: 2973063 - protein, 17 aa, Entamoeba invadens
VETARLELEKTIDKAIT

SEQ ID NO: 2973064 - protein, 17 aa, Entamoeba invadens
VETCKHPQLEFEYELYK

SEQ ID NO: 2973065 - protein, 19 aa, Entamoeba invadens
VETCLLPKGISTVVLNKSQ

SEQ ID NO: 2973066 - protein, 25 aa, Entamoeba invadens
VETEKRYTDVVPISLGILSYGVLFE

SEQ ID NO: 2973067 - protein, 20 aa, Entamoeba invadens
VETFKSCPFPADDKVSEDPM

SEQ ID NO: 2973068 - protein, 25 aa, Entamoeba invadens
VETFLKRNFSEYFFAVTPRKEERKG

SEQ ID NO: 2973069 - protein, 17 aa, Entamoeba invadens
VETFLTKLFEWTDLSKA

SEQ ID NO: 2973070 - protein, 17 aa, Entamoeba invadens
VETFRVYFERMKEQERY

SEQ ID NO: 2973071 - protein, 27 aa, Entamoeba invadens
VETIGRNCFKGCVLLPSITLPLTVKSY

SEQ ID NO: 2973072 - protein, 24 aa, Entamoeba invadens
VETIGRSAFRVCERLERIEMSTSV

SEQ ID NO: 2973073 - protein, 23 aa, Entamoeba invadens
VETILKFLLQFGKVDVKKLDTNN

SEQ ID NO: 2973074 - protein, 25 aa, Entamoeba invadens
VETIPPCVDAAVTTRGVLLVSKKKV

SEQ ID NO: 2973075 - protein, 23 aa, Entamoeba invadens
VETIRLKGFIGRMKLSETVKRLE

SEQ ID NO: 2973076 - protein, 27 aa, Entamoeba invadens
VETKGPSLYCVFPLVGSEQLQLPFLLN

SEQ ID NO: 2973077 - protein, 20 aa, Entamoeba invadens
VETKKLYGLVHARYIVTPAG

SEQ ID NO: 2973078 - protein, 27 aa, Entamoeba invadens
VETKYGIKVPFMYGTMVECVRAALTAD

SEQ ID NO: 2973079 - protein, 17 aa, Entamoeba invadens
VETLEIRSLFQSDEEED

SEQ ID NO: 2973080 - protein, 20 aa, Entamoeba invadens
VETLNIWKIADFESRNSKFE

SEQ ID NO: 2973081 - protein, 17 aa, Entamoeba invadens
VETLRISTCPNLSSAIY

SEQ ID NO: 2973082 - protein, 34 aa, Entamoeba invadens
VETLRLNGCNKIGGKFVWKYLSEIEHLKRLDLSN

SEQ ID NO: 2973083 - protein, 23 aa, Entamoeba invadens
VETNPTLTWKDFYLDSKASKQKR

SEQ ID NO: 2973084 - protein, 29 aa, Entamoeba invadens
VETPKTSFKECVVFCMGTDETLKKKVNSK

SEQ ID NO: 2973085 - protein, 26 aa, Entamoeba invadens
VETRELIAGYLLHPAYLREWKGARPF

SEQ ID NO: 2973086 - protein, 18 aa, Entamoeba invadens
VETYRGRASVIQISTMKD

SEQ ID NO: 2973087 - protein, 17 aa, Entamoeba invadens
VEVAFQFILDNLDLSVV

SEQ ID NO: 2973088 - protein, 17 aa, Entamoeba invadens
VEVAMQWNDSYAEQVLC

SEQ ID NO: 2973089 - protein, 20 aa, Entamoeba invadens
VEVEGCAEDLFTLFEAITIA

SEQ ID NO: 2973090 - protein, 18 aa, Entamoeba invadens
VEVFDYVAQLGFMDIMKS

SEQ ID NO: 2973091 - protein, 18 aa, Entamoeba invadens
VEVGCRVLVRIDESDHFG

SEQ ID NO: 2973092 - protein, 17 aa, Entamoeba invadens
VEVGSLFYFLLRTQNGY

SEQ ID NO: 2973093 - protein, 17 aa, Entamoeba invadens
VEVIALECYNTISKLKI

SEQ ID NO: 2973094 - protein, 24 aa, Entamoeba invadens
VEVIEFNAKLLIIFHTLCSSDIKE

SEQ ID NO: 2973095 - protein, 21 aa, Entamoeba invadens
VEVKQRLHLIEKWKPSPTLEI

SEQ ID NO: 2973096 - protein, 17 aa, Entamoeba invadens
VEVLFQWMSSLSDTQEW

SEQ ID NO: 2973097 - protein, 17 aa, Entamoeba invadens
VEVLGCDNVITQLVHDY

SEQ ID NO: 2973098 - protein, 17 aa, Entamoeba invadens
VEVLGIPTQHEWGNGYS

SEQ ID NO: 2973099 - protein, 28 aa, Entamoeba invadens
VEVLSFEGMWWYGRKENSFGYFPGEYCQ

SEQ ID NO: 2973100 - protein, 17 aa, Entamoeba invadens
VEVNGCFVVSNVSIDAE

SEQ ID NO: 2973101 - protein, 20 aa, Entamoeba invadens
VEVNLSFLFDSTVGYVMKIK

SEQ ID NO: 2973102 - protein, 17 aa, Entamoeba invadens
VEVPRCDNVTEYIYGNG

SEQ ID NO: 2973103 - protein, 23 aa, Entamoeba invadens
VEVQLMFHNSCMPRETRIEKAKQ

SEQ ID NO: 2973104 - protein, 17 aa, Entamoeba invadens
VEVQSGAVLTPMGKAKQ

SEQ ID NO: 2973105 - protein, 19 aa, Entamoeba invadens
VEVRGMRYLIAFLAAMILE

SEQ ID NO: 2973106 - protein, 18 aa, Entamoeba invadens
VEVSALIPLKYGVERCIM

SEQ ID NO: 2973107 - protein, 26 aa, Entamoeba invadens
VEVVKMICWPWKYLIQSKMFSVGNIV

SEQ ID NO: 2973108 - protein, 22 aa, Entamoeba invadens
VEWLIEHLLHLMKEKKIGKTFI

SEQ ID NO: 2973109 - protein, 24 aa, Entamoeba invadens
VEWMKRLFDYTNYESLNFTISQQE

SEQ ID NO: 2973110 - protein, 32 aa, Entamoeba invadens
VEWRGVRFLLSICFDIKFPVFLRNTKLEYDVI

SEQ ID NO: 2973111 - protein, 23 aa, Entamoeba invadens
VEWSVKLQIALFIEDRVYDEEYA

SEQ ID NO: 2973112 - protein, 23 aa, Entamoeba invadens
VEYFSLFVRFVFSDGSFEEKRVK

SEQ ID NO: 2973113 - protein, 23 aa, Entamoeba invadens
VEYFSLFVRFVFSDGSFVDKRIK

SEQ ID NO: 2973114 - protein, 20 aa, Entamoeba invadens
VEYIESFAFSRCSSLSKILI

SEQ ID NO: 2973115 - protein, 23 aa, Entamoeba invadens
VEYKGKWYRANVVVVAPKANILK

SEQ ID NO: 2973116 - protein, 17 aa, Entamoeba invadens
VEYSQILVLWRLKNDLF

SEQ ID NO: 2973117 - protein, 26 aa, Entamoeba invadens
VEYTCSVKTLKICSDKGYSFTMNSMV

SEQ ID NO: 2973118 - protein, 25 aa, Entamoeba invadens
VEYVKVCIEKGSLYLPTAASILIKH

SEQ ID NO: 2973119 - protein, 18 aa, Entamoeba invadens
VFAKGCRLVAAQMVNGIG

SEQ ID NO: 2973120 - protein, 23 aa, Entamoeba invadens
VFAKNLWGDFAFDHKTHKFTKLT

SEQ ID NO: 2973121 - protein, 18 aa, Entamoeba invadens
VFAKRYVEQLSHSTAPLF

SEQ ID NO: 2973122 - protein, 17 aa, Entamoeba invadens
VFALTSFSLYHSVNGVK

SEQ ID NO: 2973123 - protein, 23 aa, Entamoeba invadens
VFARGRKGVKMSTRDILAIIAHV

SEQ ID NO: 2973124 - protein, 18 aa, Entamoeba invadens
VFCAMKVVEQFCYYLGEK

SEQ ID NO: 2973125 - protein, 18 aa, Entamoeba invadens
VFCCGETICENCLAKGTC

SEQ ID NO: 2973126 - protein, 18 aa, Entamoeba invadens
VFCEECKSVSSCPHSFLC

SEQ ID NO: 2973127 - protein, 18 aa, Entamoeba invadens
VFCGLPYIETTGFMAINR

SEQ ID NO: 2973128 - protein, 20 aa, Entamoeba invadens
VFCNCALCRQFTLVQQVPKI

SEQ ID NO: 2973129 - protein, 19 aa, Entamoeba invadens
VFCPCGGRPFSLNEDNIDD

SEQ ID NO: 2973130 - protein, 24 aa, Entamoeba invadens
VFDEEIKLLLIRKMGFIIKMSADM

SEQ ID NO: 2973131 - protein, 17 aa, Entamoeba invadens
VFDEHRNIFGGFTNKAG

SEQ ID NO: 2973132 - protein, 24 aa, Entamoeba invadens
VFDHKLSLCYSFSPTLQNDAFQRF

SEQ ID NO: 2973133 - protein, 17 aa, Entamoeba invadens
VFDKLEIDIRLQSRILD

SEQ ID NO: 2973134 - protein, 22 aa, Entamoeba invadens
VFDLYQKFLINFLKIESHPEIR

SEQ ID NO: 2973135 - protein, 25 aa, Entamoeba invadens
VFDQLYRPTIGVDFAVKMTTVDDKD

SEQ ID NO: 2973136 - protein, 24 aa, Entamoeba invadens
VFDRCDFTHPFSVITFPRITPYDI

SEQ ID NO: 2973137 - protein, 23 aa, Entamoeba invadens
VFDRLGALTSRVVKLTEIVQNLQ

SEQ ID NO: 2973138 - protein, 17 aa, Entamoeba invadens
VFDTIFFKERNFEKLTD

SEQ ID NO: 2973139 - protein, 17 aa, Entamoeba invadens
VFECTRDLFSQKTRLQR

SEQ ID NO: 2973140 - protein, 18 aa, Entamoeba invadens
VFEGCKYLTKITFSGQSI

SEQ ID NO: 2973141 - protein, 21 aa, Entamoeba invadens
VFEGNARYKLASTYPSLVYVP

SEQ ID NO: 2973142 - protein, 23 aa, Entamoeba invadens
VFEGNLNGLVYVGSDHKHPLETL

SEQ ID NO: 2973143 - protein, 34 aa, Entamoeba invadens
VFEGYKLVVKGVMRGEIYIEQSLLLDVGKKVNEF

SEQ ID NO: 2973144 - protein, 26 aa, Entamoeba invadens
VFEKVFYRIIVWFNVDFETVDKNKCR

SEQ ID NO: 2973145 - protein, 21 aa, Entamoeba invadens
VFERKRGGIVIKAKENGKSTS

SEQ ID NO: 2973146 - protein, 18 aa, Entamoeba invadens
VFETQSFEEFLLKMVAAA

SEQ ID NO: 2973147 - protein, 25 aa, Entamoeba invadens
VFEVLREFMDLIAFSEEEKINTEIH

SEQ ID NO: 2973148 - protein, 18 aa, Entamoeba invadens
VFFHIDFGHFLGNFKSKF

SEQ ID NO: 2973149 - protein, 25 aa, Entamoeba invadens
VFFKKSLKVAYQIILHENVNNMNAK

SEQ ID NO: 2973150 - protein, 24 aa, Entamoeba invadens
VFFPNKICMVTAFAEFGSVCDMLK

SEQ ID NO: 2973151 - protein, 18 aa, Entamoeba invadens
VFFTGFKPIVSFSNDGTS

SEQ ID NO: 2973152 - protein, 22 aa, Entamoeba invadens
VFFTVLVVDLIKNWKAEDVIAM

SEQ ID NO: 2973153 - protein, 19 aa, Entamoeba invadens
VFFYLKRNTIIGTFNSEVL

SEQ ID NO: 2973154 - protein, 24 aa, Entamoeba invadens
VFGDYCFCHCNSLSAITLGTNIIK

SEQ ID NO: 2973155 - protein, 20 aa, Entamoeba invadens
VFGDYCFCRCNSLSAITLGT

SEQ ID NO: 2973156 - protein, 23 aa, Entamoeba invadens
VFGEGNATWAAFVPFERGDGKKV

SEQ ID NO: 2973157 - protein, 26 aa, Entamoeba invadens
VFGGCNFGHIRGCSMIDIHETEFVQK

SEQ ID NO: 2973158 - protein, 18 aa, Entamoeba invadens
VFGKDVKGAMRITDIFKT

SEQ ID NO: 2973159 - protein, 20 aa, Entamoeba invadens
VFGKIKMYFKVMIIKVKNLD

SEQ ID NO: 2973160 - protein, 23 aa, Entamoeba invadens
VFGKIKMYFKVMIIKVKNLDTLS

SEQ ID NO: 2973161 - protein, 18 aa, Entamoeba invadens
VFGNFSFDPEALILEAKM

SEQ ID NO: 2973162 - protein, 24 aa, Entamoeba invadens
VFGRSEWVVIFSLIYEIFSVKFSE

SEQ ID NO: 2973163 - protein, 17 aa, Entamoeba invadens
VFHAVFRMRLIEMRHLV

SEQ ID NO: 2973164 - protein, 25 aa, Entamoeba invadens
VFHDGELPLKYCLEEWTEQLWDECE

SEQ ID NO: 2973165 - protein, 27 aa, Entamoeba invadens
VFHIWFYRKSDLFKCYEECHNGFTEQD

SEQ ID NO: 2973166 - protein, 19 aa, Entamoeba invadens
VFHKSCCQHVFTPCIPKEA

SEQ ID NO: 2973167 - protein, 23 aa, Entamoeba invadens
VFHKTFEEWKGVTLLLNIHDEIV

SEQ ID NO: 2973168 - protein, 25 aa, Entamoeba invadens
VFHVGEIPLKYCLEEWTEQLWEECE

SEQ ID NO: 2973169 - protein, 21 aa, Entamoeba invadens
VFICESCALVHVTCKHVKRTF

SEQ ID NO: 2973170 - protein, 23 aa, Entamoeba invadens
VFIGDAIISFLLKYKYADLALLF

SEQ ID NO: 2973171 - protein, 23 aa, Entamoeba invadens
VFIGKRVGDVLVEIRSGGVEIDN

SEQ ID NO: 2973172 - protein, 32 aa, Entamoeba invadens
VFIKSKPGRYGIKFWMCADCETGMTLNLQLYC

SEQ ID NO: 2973173 - protein, 21 aa, Entamoeba invadens
VFINLTFSQACLKQMLDNQLE

SEQ ID NO: 2973174 - protein, 23 aa, Entamoeba invadens
VFKALEGKNVWEVIEEGKSQMGS

SEQ ID NO: 2973175 - protein, 18 aa, Entamoeba invadens
VFKAPSFEFEQKKTTLNI

SEQ ID NO: 2973176 - protein, 17 aa, Entamoeba invadens
VFKDCIPVFKNAYKATI

SEQ ID NO: 2973177 - protein, 20 aa, Entamoeba invadens
VFKIANNRLKQFDYNTLTPL

SEQ ID NO: 2973178 - protein, 24 aa, Entamoeba invadens
VFKKLVASIAVCLGDKDAAIVPSF

SEQ ID NO: 2973179 - protein, 24 aa, Entamoeba invadens
VFKQKVNVVVPFSMHIAAKSETFN

SEQ ID NO: 2973180 - protein, 17 aa, Entamoeba invadens
VFKRCCSLTKIDVLHSR

SEQ ID NO: 2973181 - protein, 31 aa, Entamoeba invadens
VFKSLFCKKKLFRVVVWFNIDCQTVSMNNKN

SEQ ID NO: 2973182 - protein, 26 aa, Entamoeba invadens
VFKSLFCKKKLFRVVVWFNVDCQTVS

SEQ ID NO: 2973183 - protein, 26 aa, Entamoeba invadens
VFKTGFRSCDVEAAIGMGEFNKIVVN

SEQ ID NO: 2973184 - protein, 18 aa, Entamoeba invadens
VFLCFSPNVCRVMDVTGS

SEQ ID NO: 2973185 - protein, 17 aa, Entamoeba invadens
VFLCPNLETADIEADFE

SEQ ID NO: 2973186 - protein, 28 aa, Entamoeba invadens
VFLDNELKLFLKEIVAIVQKFMKQIKFK

SEQ ID NO: 2973187 - protein, 25 aa, Entamoeba invadens
VFLFKSGNESFGFYNSDMVPVASGE

SEQ ID NO: 2973188 - protein, 23 aa, Entamoeba invadens
VFLHEGFKVYLFSTIVPTPYTAF

SEQ ID NO: 2973189 - protein, 18 aa, Entamoeba invadens
VFLMTIKSFYWKEEENHT

SEQ ID NO: 2973190 - protein, 24 aa, Entamoeba invadens
VFLPKSDVFMSFFSFYIQIVYFTV

SEQ ID NO: 2973191 - protein, 23 aa, Entamoeba invadens
VFLQFPNYRTLVLKKEDMYRSVV

SEQ ID NO: 2973192 - protein, 19 aa, Entamoeba invadens
VFLQKKLESKHMSDKRYTV

SEQ ID NO: 2973193 - protein, 25 aa, Entamoeba invadens
VFLVKLELTAKVGYPVEKVLLPPNL

SEQ ID NO: 2973194 - protein, 22 aa, Entamoeba invadens
VFMKDRMLVHFGPLKIVEEKND

SEQ ID NO: 2973195 - protein, 23 aa, Entamoeba invadens
VFMSKGPLQFCCASKTGENVFII

SEQ ID NO: 2973196 - protein, 19 aa, Entamoeba invadens
VFNAVKGKCELVVSNVDID

SEQ ID NO: 2973197 - protein, 17 aa, Entamoeba invadens
VFNAVMIKYQLTAGDFP

SEQ ID NO: 2973198 - protein, 19 aa, Entamoeba invadens
VFNCFSIKTSNEITLNFGH

SEQ ID NO: 2973199 - protein, 22 aa, Entamoeba invadens
VFNDEITKFIAYVNRMTSFEKE

SEQ ID NO: 2973200 - protein, 25 aa, Entamoeba invadens
VFNLLRFSYPTPFYFLTGSKRVFSV

SEQ ID NO: 2973201 - protein, 21 aa, Entamoeba invadens
VFNLPLTKRIRGLSPSDIERL

SEQ ID NO: 2973202 - protein, 24 aa, Entamoeba invadens
VFNSTCIPFSFLTLETPHLGVKKP

SEQ ID NO: 2973203 - protein, 22 aa, Entamoeba invadens
VFNTYKYTKFVSEKCRDICDDI

SEQ ID NO: 2973204 - protein, 21 aa, Entamoeba invadens
VFNVLWLKESFLAHPTDFDKN

SEQ ID NO: 2973205 - protein, 20 aa, Entamoeba invadens
VFPENCELVASTFVLCSNLT

SEQ ID NO: 2973206 - protein, 17 aa, Entamoeba invadens
VFPFKTKFLKILTLTCL

SEQ ID NO: 2973207 - protein, 19 aa, Entamoeba invadens
VFPGCNEMTLLGTDIGKFV

SEQ ID NO: 2973208 - protein, 18 aa, Entamoeba invadens
VFPIPRSEYEVMEMVEGK

SEQ ID NO: 2973209 - protein, 25 aa, Entamoeba invadens
VFPLKTNYVGFGFNFVALDFAMNSS

SEQ ID NO: 2973210 - protein, 23 aa, Entamoeba invadens
VFPNKVCIEFIKAPNFGMEKSIF

SEQ ID NO: 2973211 - protein, 19 aa, Entamoeba invadens
VFPSCIFKTRHRHQLPSVH

SEQ ID NO: 2973212 - protein, 23 aa, Entamoeba invadens
VFPSMVGRPLMRSEEKIGGVEIK

SEQ ID NO: 2973213 - protein, 30 aa, Entamoeba invadens
VFPSRLTSIGSLCFYGCYSLTSVKFPRHLK

SEQ ID NO: 2973214 - protein, 30 aa, Entamoeba invadens
VFPSRLTSIGSLCFYGCYSLTSVNRLSEIS

SEQ ID NO: 2973215 - protein, 29 aa, Entamoeba invadens
VFPSRLTSIGSLCFYTFKTFYQKLIGAFQ

SEQ ID NO: 2973216 - protein, 17 aa, Entamoeba invadens
VFQCPTAVLYTVELNPM

SEQ ID NO: 2973217 - protein, 17 aa, Entamoeba invadens
VFQEGILVEAVRKGNWI

SEQ ID NO: 2973218 - protein, 18 aa, Entamoeba invadens
VFQIGNWQSLDNLKQLRL

SEQ ID NO: 2973219 - protein, 22 aa, Entamoeba invadens
VFQKLLETLICLSSKEHREGRD

SEQ ID NO: 2973220 - protein, 25 aa, Entamoeba invadens
VFQKLVSSMLFYFEKLMGLSQVIPS

SEQ ID NO: 2973221 - protein, 20 aa, Entamoeba invadens
VFQRTHLHPTKCLFDTKVDK

SEQ ID NO: 2973222 - protein, 19 aa, Entamoeba invadens
VFQSQLCFNEYLAQEQLQT

SEQ ID NO: 2973223 - protein, 20 aa, Entamoeba invadens
VFQTECDIFFTCNGKIVFQN

SEQ ID NO: 2973224 - protein, 20 aa, Entamoeba invadens
VFRDYFKNVFGIHLPVGVCE

SEQ ID NO: 2973225 - protein, 17 aa, Entamoeba invadens
VFREKYSPLLLENTDEV

SEQ ID NO: 2973226 - protein, 23 aa, Entamoeba invadens
VFREWAPNFKEMYLFGDYNNWDR

SEQ ID NO: 2973227 - protein, 18 aa, Entamoeba invadens
VFRLSIGEKVYFAKTLRP

SEQ ID NO: 2973228 - protein, 17 aa, Entamoeba invadens
VFRMRLIEMRHLVFKKW

SEQ ID NO: 2973229 - protein, 17 aa, Entamoeba invadens
VFRQACELFNFNCVLVV

SEQ ID NO: 2973230 - protein, 42 aa, Entamoeba invadens
VFRTTKIKLVCIDDCGTTLRKCFICGMYGHKSQDCLEKKGTY

SEQ ID NO: 2973231 - protein, 19 aa, Entamoeba invadens
VFSDMLWSDPLMYETYDEK

SEQ ID NO: 2973232 - protein, 24 aa, Entamoeba invadens
VFSFAITMFECFGWCEAYTKDLFK

SEQ ID NO: 2973233 - protein, 25 aa, Entamoeba invadens
VFSFGITMYEVFGWCDAYPKQSFKF

SEQ ID NO: 2973234 - protein, 26 aa, Entamoeba invadens
VFSFGVTLYECFSWKMAYQKDDVRFK

SEQ ID NO: 2973235 - protein, 24 aa, Entamoeba invadens
VFSGCTSLTCLVVPKINGIIKNTI

SEQ ID NO: 2973236 - protein, 22 aa, Entamoeba invadens
VFSGKSKYSLSAILDKEVAESL

SEQ ID NO: 2973237 - protein, 18 aa, Entamoeba invadens
VFTAIRFNGNESSEERLK

SEQ ID NO: 2973238 - protein, 27 aa, Entamoeba invadens
VFTARKCILCSLIGKNLFRELKYFQRA

SEQ ID NO: 2973239 - protein, 18 aa, Entamoeba invadens
VFTFCERHAFDVDDLLKK

SEQ ID NO: 2973240 - protein, 18 aa, Entamoeba invadens
VFTIFLSITIDQGFRNKR

SEQ ID NO: 2973241 - protein, 21 aa, Entamoeba invadens
VFTKRIQYYSANSFMRCNSKE

SEQ ID NO: 2973242 - protein, 31 aa, Entamoeba invadens
VFTRSGNWVSFDSRYSRRLSVESIYAPIELE

SEQ ID NO: 2973243 - protein, 24 aa, Entamoeba invadens
VFTSELFRKIKLIEFLKSTSNSTK

SEQ ID NO: 2973244 - protein, 26 aa, Entamoeba invadens
VFVDFGEAFVRAFLQTNCFHNWREKM

SEQ ID NO: 2973245 - protein, 19 aa, Entamoeba invadens
VFVGIGVIEKCDRLTKISI

SEQ ID NO: 2973246 - protein, 26 aa, Entamoeba invadens
VFVKAEDVLPFLLEFLRRNRLVENTL

SEQ ID NO: 2973247 - protein, 17 aa, Entamoeba invadens
VFVKCCENITIDNTLNT

SEQ ID NO: 2973248 - protein, 19 aa, Entamoeba invadens
VFVKCRLNTIVIPKSVTHL

SEQ ID NO: 2973249 - protein, 17 aa, Entamoeba invadens
VFVKFSFLKNRQGRKSV

SEQ ID NO: 2973250 - protein, 25 aa, Entamoeba invadens
VFVLKGCTPIPGATIFGFDTEEELL

SEQ ID NO: 2973251 - protein, 20 aa, Entamoeba invadens
VFVLNCSWTGAELEKQIPGS

SEQ ID NO: 2973252 - protein, 17 aa, Entamoeba invadens
VFVMIGNYSNFVCGNIE

SEQ ID NO: 2973253 - protein, 24 aa, Entamoeba invadens
VFVNKKCCSAVHFQHENAFYLRTT

SEQ ID NO: 2973254 - protein, 22 aa, Entamoeba invadens
VFVWTYKDYKAFDHTEELNYQF

SEQ ID NO: 2973255 - protein, 24 aa, Entamoeba invadens
VFYCKDFSTVCPKELQEFNERFED

SEQ ID NO: 2973256 - protein, 24 aa, Entamoeba invadens
VFYIERVVGSWAVVYVNEERYIFP

SEQ ID NO: 2973257 - protein, 24 aa, Entamoeba invadens
VFYMNGCQFEEPFLLKTDFLNVRQ

SEQ ID NO: 2973258 - protein, 28 aa, Entamoeba invadens
VFYRIGEVQKTYFLFKVLKEDMVLEVDV

SEQ ID NO: 2973259 - protein, 18 aa, Entamoeba invadens
VFYSKSNLALSCIQMCFL

SEQ ID NO: 2973260 - protein, 18 aa, Entamoeba invadens
VFYYCINFTQIVLPISLV

SEQ ID NO: 2973261 - protein, 18 aa, Entamoeba invadens
VGACRHGDACSRNHHRPE

SEQ ID NO: 2973262 - protein, 19 aa, Entamoeba invadens
VGAGVGYASFCCRGAKEVI

SEQ ID NO: 2973263 - protein, 17 aa, Entamoeba invadens
VGAKICYENCLGVANQI

SEQ ID NO: 2973264 - protein, 17 aa, Entamoeba invadens
VGARSFISATMRTTLLA

SEQ ID NO: 2973265 - protein, 29 aa, Entamoeba invadens
VGATFVEFAHYFKVYKMIVGNSEAVLAAM

SEQ ID NO: 2973266 - protein, 19 aa, Entamoeba invadens
VGAVTKCIIIREPSTQRSL

SEQ ID NO: 2973267 - protein, 22 aa, Entamoeba invadens
VGAYDFWPIDALSSALSVVTFN

SEQ ID NO: 2973268 - protein, 20 aa, Entamoeba invadens
VGAYRACHEKLRKYLIDLLN

SEQ ID NO: 2973269 - protein, 18 aa, Entamoeba invadens
VGCAKFDVLIYDIGGNSL

SEQ ID NO: 2973270 - protein, 26 aa, Entamoeba invadens
VGCIAAEFFLGIPLFAGTSEYNLLFK

SEQ ID NO: 2973271 - protein, 17 aa, Entamoeba invadens
VGCKGFVVENYFSSIKE

SEQ ID NO: 2973272 - protein, 19 aa, Entamoeba invadens
VGCTEIFPLQSKHREELLI

SEQ ID NO: 2973273 - protein, 26 aa, Entamoeba invadens
VGCVIPELFGTIPLFAANSAKKITTL

SEQ ID NO: 2973274 - protein, 23 aa, Entamoeba invadens
VGCWSARNRTHWKTLTKARAIEN

SEQ ID NO: 2973275 - protein, 22 aa, Entamoeba invadens
VGDFAELCLKYNTTKKEFKDKN

SEQ ID NO: 2973276 - protein, 18 aa, Entamoeba invadens
VGDFFCCHGGISPNLNKI

SEQ ID NO: 2973277 - protein, 36 aa, Entamoeba invadens
VGDFRYAPLVVRSLMFLCRVIWKKEYLESASKQSKK

SEQ ID NO: 2973278 - protein, 26 aa, Entamoeba invadens
VGDICRRMSNEAAWVIASSIRDIAYN

SEQ ID NO: 2973279 - protein, 24 aa, Entamoeba invadens
VGDKCFHHKCFVCSQCSKPMDPKK

SEQ ID NO: 2973280 - protein, 27 aa, Entamoeba invadens
VGDKKRLRVGYTLNFIFEENEWFPDIE

SEQ ID NO: 2973281 - protein, 26 aa, Entamoeba invadens
VGDSCCFNCLSLRILIPSTLKSIGVN

SEQ ID NO: 2973282 - protein, 19 aa, Entamoeba invadens
VGDVKRMPVIPLNSNAVHF

SEQ ID NO: 2973283 - protein, 18 aa, Entamoeba invadens
VGEASALVRKGMSRKEQI

SEQ ID NO: 2973284 - protein, 18 aa, Entamoeba invadens
VGECTKGRSLLDGEDSDD

SEQ ID NO: 2973285 - protein, 22 aa, Entamoeba invadens
VGEDKLLINWFKVRQIGNLIKE

SEQ ID NO: 2973286 - protein, 20 aa, Entamoeba invadens
VGEDVLRLRFSNIRRQITYI

SEQ ID NO: 2973287 - protein, 18 aa, Entamoeba invadens
VGEELVRVAVLWHESWHE

SEQ ID NO: 2973288 - protein, 29 aa, Entamoeba invadens
VGEKAKLKKGRWSGYRVYDPATEGPRFIQ

SEQ ID NO: 2973289 - protein, 19 aa, Entamoeba invadens
VGEKMFKYVDAHPVEYKEE

SEQ ID NO: 2973290 - protein, 19 aa, Entamoeba invadens
VGELRRKATDQAMVILVMF

SEQ ID NO: 2973291 - protein, 17 aa, Entamoeba invadens
VGENLPYDIIVKRNSKV

SEQ ID NO: 2973292 - protein, 25 aa, Entamoeba invadens
VGETPIIRRLFERIVAMKLSTKSMK

SEQ ID NO: 2973293 - protein, 21 aa, Entamoeba invadens
VGEVVKMNWDISSESIDDEDD

SEQ ID NO: 2973294 - protein, 20 aa, Entamoeba invadens
VGEWCRIYQSVTLGAMHFQE

SEQ ID NO: 2973295 - protein, 23 aa, Entamoeba invadens
VGFEAKKPGGMQLGLENCNLPNL

SEQ ID NO: 2973296 - protein, 19 aa, Entamoeba invadens
VGFNFVLKKLRGENFEVPV

SEQ ID NO: 2973297 - protein, 21 aa, Entamoeba invadens
VGFNRVLLYLFSRYFEKLLEK

SEQ ID NO: 2973298 - protein, 20 aa, Entamoeba invadens
VGFSPHFTKKITLFKLEHTN

SEQ ID NO: 2973299 - protein, 17 aa, Entamoeba invadens
VGFSVGLERIMIILEEK

SEQ ID NO: 2973300 - protein, 26 aa, Entamoeba invadens
VGFTFRNCKKVIPFSLESQALKTVLY

SEQ ID NO: 2973301 - protein, 19 aa, Entamoeba invadens
VGFVGDCSVFLLGKDGITR

SEQ ID NO: 2973302 - protein, 19 aa, Entamoeba invadens
VGGCCYCKESGNAYIGFNM

SEQ ID NO: 2973303 - protein, 19 aa, Entamoeba invadens
VGGDDVVKCLVPMLEAHGI

SEQ ID NO: 2973304 - protein, 24 aa, Entamoeba invadens
VGGSGRKAFYFFGIHHDQLLFLDP

SEQ ID NO: 2973305 - protein, 23 aa, Entamoeba invadens
VGHLNDLLKFFFFVEQEDVQEEI

SEQ ID NO: 2973306 - protein, 29 aa, Entamoeba invadens
VGHSYIRGGLPYRRPVGYMRYAINVLGKF

SEQ ID NO: 2973307 - protein, 31 aa, Entamoeba invadens
VGHTLAIELCKHFPPAIGEFRKLIPNMLNNL

SEQ ID NO: 2973308 - protein, 22 aa, Entamoeba invadens
VGIIHEGVWKPGMDAGNIIGNP

SEQ ID NO: 2973309 - protein, 25 aa, Entamoeba invadens
VGIKNIGKYAFIIGFEKCVMFDSDG

SEQ ID NO: 2973310 - protein, 18 aa, Entamoeba invadens
VGILKLFLECSCTPFFLH

SEQ ID NO: 2973311 - protein, 25 aa, Entamoeba invadens
VGIRDRKLLLCKIRTVRKNLRKISL

SEQ ID NO: 2973312 - protein, 26 aa, Entamoeba invadens
VGKEEWKTRAVLVLQALLKAKGDKLR

SEQ ID NO: 2973313 - protein, 23 aa, Entamoeba invadens
VGKERFLACEAYFQPSLLNLECL

SEQ ID NO: 2973314 - protein, 27 aa, Entamoeba invadens
VGKESLRLCVCYEQLLSFAMLFGISEQ

SEQ ID NO: 2973315 - protein, 18 aa, Entamoeba invadens
VGKFKRLSDLQVETYKVT

SEQ ID NO: 2973316 - protein, 34 aa, Entamoeba invadens
VGKFRIKFFQTFFLEKYFYTFFCHWNSTVRQFFH

SEQ ID NO: 2973317 - protein, 21 aa, Entamoeba invadens
VGKGNMSCLINFNEEDADYVI

SEQ ID NO: 2973318 - protein, 33 aa, Entamoeba invadens
VGKIAGFEKFAFVKLVFKLRIPPSQVDGWIVKY

SEQ ID NO: 2973319 - protein, 21 aa, Entamoeba invadens
VGKKVLKSTLDVTGAMKELVS

SEQ ID NO: 2973320 - protein, 18 aa, Entamoeba invadens
VGKSCLLLQYEDHRFQPI

SEQ ID NO: 2973321 - protein, 24 aa, Entamoeba invadens
VGKSNLLLRFTRNEFDPDKRSTIG

SEQ ID NO: 2973322 - protein, 27 aa, Entamoeba invadens
VGKSSITIRFCYNRFSGSYDPTLEDSY

SEQ ID NO: 2973323 - protein, 26 aa, Entamoeba invadens
VGKSTFALRFCHQVFVKINEPSDLNN

SEQ ID NO: 2973324 - protein, 20 aa, Entamoeba invadens
VGKTALLQRFCFGTYIDEYD

SEQ ID NO: 2973325 - protein, 23 aa, Entamoeba invadens
VGKTCILCSYTSGSFPTQYVPTV

SEQ ID NO: 2973326 - protein, 29 aa, Entamoeba invadens
VGKTQINLRCPLSFQMIQIPVRGCECKHT

SEQ ID NO: 2973327 - protein, 21 aa, Entamoeba invadens
VGKTSIAIRFICDRFIEVYDP

SEQ ID NO: 2973328 - protein, 23 aa, Entamoeba invadens
VGKTSLVRRLVCDSFTDEYETTK

SEQ ID NO: 2973329 - protein, 18 aa, Entamoeba invadens
VGKYCFHNCTRLRQVNIP

SEQ ID NO: 2973330 - protein, 26 aa, Entamoeba invadens
VGLKEVCEVANSWIMFSQALINNNER

SEQ ID NO: 2973331 - protein, 24 aa, Entamoeba invadens
VGLKEVFETIARVSVGLMDAEVTE

SEQ ID NO: 2973332 - protein, 24 aa, Entamoeba invadens
VGLKGFLAVIKFSYEEIGGTLVSE

SEQ ID NO: 2973333 - protein, 18 aa, Entamoeba invadens
VGLKYVFSLLKYAEVDND

SEQ ID NO: 2973334 - protein, 19 aa, Entamoeba invadens
VGLQGRFEHDLGRNDIEWI

SEQ ID NO: 2973335 - protein, 21 aa, Entamoeba invadens
VGLTNYGCRLVNIIVKGKDGK

SEQ ID NO: 2973336 - protein, 25 aa, Entamoeba invadens
VGLTTFLGCVILKIKGDADKFAVAY

SEQ ID NO: 2973337 - protein, 19 aa, Entamoeba invadens
VGLVEVLNVIEFSMKRADA

SEQ ID NO: 2973338 - protein, 25 aa, Entamoeba invadens
VGLVPRCLELLFQKKQRNLEVGISM

SEQ ID NO: 2973339 - protein, 17 aa, Entamoeba invadens
VGLYMMVHESPPSFRDD

SEQ ID NO: 2973340 - protein, 19 aa, Entamoeba invadens
VGMFCLYGDLTSWIKSVDM

SEQ ID NO: 2973341 - protein, 17 aa, Entamoeba invadens
VGMGGTFDRLHCGHYSL

SEQ ID NO: 2973342 - protein, 17 aa, Entamoeba invadens
VGMKMFSPKQIKGSSGE

SEQ ID NO: 2973343 - protein, 36 aa, Entamoeba invadens
VGMKRVYKYLIYWLLNGTVCIGNFFATEKRVDTLSF

SEQ ID NO: 2973344 - protein, 18 aa, Entamoeba invadens
VGMLKAKYFTPQKERTQF

SEQ ID NO: 2973345 - protein, 19 aa, Entamoeba invadens
VGMSILHYICYEFMMDASP

SEQ ID NO: 2973346 - protein, 17 aa, Entamoeba invadens
VGNCCISHYNHLKNIVV

SEQ ID NO: 2973347 - protein, 20 aa, Entamoeba invadens
VGNCLDRFARIMMIPNEPAP

SEQ ID NO: 2973348 - protein, 20 aa, Entamoeba invadens
VGNERVVNCLDIMPEATKAL

SEQ ID NO: 2973349 - protein, 27 aa, Entamoeba invadens
VGNIEIFCVYSAFTIDKHSKMEWYEEF

SEQ ID NO: 2973350 - protein, 25 aa, Entamoeba invadens
VGNITKLGAGAFVEEFVSSIDINGM

SEQ ID NO: 2973351 - protein, 24 aa, Entamoeba invadens
VGNNRLLPYIPRMDTMFYTLNTKY

SEQ ID NO: 2973352 - protein, 26 aa, Entamoeba invadens
VGNSGVFRPEMLRTMGVPEDISVIAW

SEQ ID NO: 2973353 - protein, 18 aa, Entamoeba invadens
VGNVPVILGEDGFKALFE

SEQ ID NO: 2973354 - protein, 23 aa, Entamoeba invadens
VGPDNAFFCFTFQNPFNTEPLKI

SEQ ID NO: 2973355 - protein, 17 aa, Entamoeba invadens
VGPKVTEKRAILQPPPK

SEQ ID NO: 2973356 - protein, 18 aa, Entamoeba invadens
VGPLCKERVSLLRTIFNR

SEQ ID NO: 2973357 - protein, 28 aa, Entamoeba invadens
VGQFFTEMRIELPFPLKKTHHLLFSIFD

SEQ ID NO: 2973358 - protein, 26 aa, Entamoeba invadens
VGQIEWKNVDITGVNFDCEIQIERGN

SEQ ID NO: 2973359 - protein, 24 aa, Entamoeba invadens
VGQKNKWESPSFLFRSPKCMACED

SEQ ID NO: 2973360 - protein, 25 aa, Entamoeba invadens
VGRDKLDVLGCSTFTVPDLLPNEAF

SEQ ID NO: 2973361 - protein, 25 aa, Entamoeba invadens
VGRDYYGVFPLRGKPLNAREISSAK

SEQ ID NO: 2973362 - protein, 17 aa, Entamoeba invadens
VGREYGESKVLGTIRAD

SEQ ID NO: 2973363 - protein, 20 aa, Entamoeba invadens
VGRGRYSDVFLGVIENGKYP

SEQ ID NO: 2973364 - protein, 27 aa, Entamoeba invadens
VGRKEKWKIKHIMNLDDWKSVGVTDEK

SEQ ID NO: 2973365 - protein, 23 aa, Entamoeba invadens
VGRQKLIWRLTRGLYIIKMDLCI

SEQ ID NO: 2973366 - protein, 25 aa, Entamoeba invadens
VGRTGVYCILSRIIDQVVHSILEKT

SEQ ID NO: 2973367 - protein, 31 aa, Entamoeba invadens
VGSATCLVDFRCAYCGMVVHSNCIPNAPLKC

SEQ ID NO: 2973368 - protein, 18 aa, Entamoeba invadens
VGSAVRRFTLNKTTEVHH

SEQ ID NO: 2973369 - protein, 19 aa, Entamoeba invadens
VGSEMCWKSNQRFVDIVRF

SEQ ID NO: 2973370 - protein, 25 aa, Entamoeba invadens
VGSLKKIKKANCKEKNDFFITRLIL

SEQ ID NO: 2973371 - protein, 23 aa, Entamoeba invadens
VGSPCLYVTMRLVSIPDMEYSVD

SEQ ID NO: 2973372 - protein, 20 aa, Entamoeba invadens
VGSPERRGSLLQNILSFITG

SEQ ID NO: 2973373 - protein, 18 aa, Entamoeba invadens
VGSSLIVFQDGRIVISDE

SEQ ID NO: 2973374 - protein, 26 aa, Entamoeba invadens
VGSVFLKFTPFLKMYSDYCRVYNAVT

SEQ ID NO: 2973375 - protein, 18 aa, Entamoeba invadens
VGSYLLVKGVSYRIESGI

SEQ ID NO: 2973376 - protein, 25 aa, Entamoeba invadens
VGTECFRYATDLTLTYPVNGKFTED

SEQ ID NO: 2973377 - protein, 20 aa, Entamoeba invadens
VGTIPIVYRGNRFCLPLCIM

SEQ ID NO: 2973378 - protein, 19 aa, Entamoeba invadens
VGTITSFFAEIGIDEENIG

SEQ ID NO: 2973379 - protein, 20 aa, Entamoeba invadens
VGTKYYGEYDYIFTSASHCD

SEQ ID NO: 2973380 - protein, 18 aa, Entamoeba invadens
VGTLYFVFYKSFTMLQSE

SEQ ID NO: 2973381 - protein, 23 aa, Entamoeba invadens
VGTPYWMAPELIRGHDYGVKIDI

SEQ ID NO: 2973382 - protein, 32 aa, Entamoeba invadens
VGTRESFELIGLEGRIPFDMFQVIQRDYKLRS

SEQ ID NO: 2973383 - protein, 21 aa, Entamoeba invadens
VGTTLPYAVVNPMMNCTALPT

SEQ ID NO: 2973384 - protein, 18 aa, Entamoeba invadens
VGVESFTLMCPRKRSDNS

SEQ ID NO: 2973385 - protein, 18 aa, Entamoeba invadens
VGVFSLKLYPKLQMLDLS

SEQ ID NO: 2973386 - protein, 18 aa, Entamoeba invadens
VGVGDGPFGVMYNLQKVV

SEQ ID NO: 2973387 - protein, 17 aa, Entamoeba invadens
VGVIGIIRALPKTHYAR

SEQ ID NO: 2973388 - protein, 25 aa, Entamoeba invadens
VGVLPKKTYLPISLKSLTLLNSLKM

SEQ ID NO: 2973389 - protein, 19 aa, Entamoeba invadens
VGVPSWRWFYPEHYAPFAE

SEQ ID NO: 2973390 - protein, 19 aa, Entamoeba invadens
VGVQWLHNRLNLIHRDIKP

SEQ ID NO: 2973391 - protein, 17 aa, Entamoeba invadens
VGVRHPLSSLVFVSKDK

SEQ ID NO: 2973392 - protein, 20 aa, Entamoeba invadens
VGVSTIWCNDTFYIKGESCN

SEQ ID NO: 2973393 - protein, 30 aa, Entamoeba invadens
VGVTSDFPLLGLMRKWLKALYEVKVESNLK

SEQ ID NO: 2973394 - protein, 39 aa, Entamoeba invadens
VGVTSFKKISMINFLIFYFGYDWKEVVNAPQGGNTEELA

SEQ ID NO: 2973395 - protein, 21 aa, Entamoeba invadens
VGYAVGFSSGKLCIVSRSGKV

SEQ ID NO: 2973396 - protein, 17 aa, Entamoeba invadens
VGYIRDIFKSTLNGNKL

SEQ ID NO: 2973397 - protein, 24 aa, Entamoeba invadens
VGYKDCVFHRVIKNAVIQSGDVLG

SEQ ID NO: 2973398 - protein, 20 aa, Entamoeba invadens
VGYLIFPLQFEFGGNDKMKI

SEQ ID NO: 2973399 - protein, 24 aa, Entamoeba invadens
VGYLKTNFLGTVPIRKHTTRIKSY

SEQ ID NO: 2973400 - protein, 24 aa, Entamoeba invadens
VGYMPNFWGVIVGTFIVENYIGEK

SEQ ID NO: 2973401 - protein, 21 aa, Entamoeba invadens
VGYMRYAINVLGKFDNGNDTW

SEQ ID NO: 2973402 - protein, 27 aa, Entamoeba invadens
VGYWVLRAICGDCDMTCRHIQHARFIE

SEQ ID NO: 2973403 - protein, 18 aa, Entamoeba invadens
VHAALAIIACCMSKVAND

SEQ ID NO: 2973404 - protein, 19 aa, Entamoeba invadens
VHAALAIIACCMSKVANDM

SEQ ID NO: 2973405 - protein, 24 aa, Entamoeba invadens
VHCGRSALVYQFCLNKYYANIDLL

SEQ ID NO: 2973406 - protein, 18 aa, Entamoeba invadens
VHCIGAIILIEYKKCVEK

SEQ ID NO: 2973407 - protein, 19 aa, Entamoeba invadens
VHDACPRVREHLLVLYQRL

SEQ ID NO: 2973408 - protein, 17 aa, Entamoeba invadens
VHDRFFIHRDIKPDNFV

SEQ ID NO: 2973409 - protein, 19 aa, Entamoeba invadens
VHDTVAFKFCVEDTPSFSM

SEQ ID NO: 2973410 - protein, 17 aa, Entamoeba invadens
VHFFPVIMQNLFCLFSE

SEQ ID NO: 2973411 - protein, 23 aa, Entamoeba invadens
VHFGDSMLRILPFHDDGKDDFRH

SEQ ID NO: 2973412 - protein, 18 aa, Entamoeba invadens
VHFKVWDLVSKKVVAQMY

SEQ ID NO: 2973413 - protein, 18 aa, Entamoeba invadens
VHFQKGNVVDVVFENEKH

SEQ ID NO: 2973414 - protein, 20 aa, Entamoeba invadens
VHFRETFFRLIVNIRDSLFS

SEQ ID NO: 2973415 - protein, 22 aa, Entamoeba invadens
VHGTLYKRSFIDAPKRGYTTSG

SEQ ID NO: 2973416 - protein, 18 aa, Entamoeba invadens
VHIGIVYDGIIVYLSELI

SEQ ID NO: 2973417 - protein, 17 aa, Entamoeba invadens
VHIIVWFSVDFETVDKN

SEQ ID NO: 2973418 - protein, 18 aa, Entamoeba invadens
VHIQACKKLNEITNKPSV

SEQ ID NO: 2973419 - protein, 33 aa, Entamoeba invadens
VHKYRFELKKEIGLLFKYVYLFYLKSPLAMMSY

SEQ ID NO: 2973420 - protein, 19 aa, Entamoeba invadens
VHLALSINSVDAFRVNIGK

SEQ ID NO: 2973421 - protein, 19 aa, Entamoeba invadens
VHLEKMIEAKTVKGFQEHH

SEQ ID NO: 2973422 - protein, 27 aa, Entamoeba invadens
VHLFDLRVGGLFMKTPLFTTIAEDDVN

SEQ ID NO: 2973423 - protein, 19 aa, Entamoeba invadens
VHLLEVMLLVGNFLNKGTA

SEQ ID NO: 2973424 - protein, 18 aa, Entamoeba invadens
VHLVDLCEELFPYVDQVM

SEQ ID NO: 2973425 - protein, 18 aa, Entamoeba invadens
VHLYRPFSAKHFLEQLPA

SEQ ID NO: 2973426 - protein, 27 aa, Entamoeba invadens
VHNAFMFGCLGVRKNCMCVSTRERDNW

SEQ ID NO: 2973427 - protein, 17 aa, Entamoeba invadens
VHNCIKKYFEVDSENLP

SEQ ID NO: 2973428 - protein, 27 aa, Entamoeba invadens
VHPRKLPTEFMYLFDLYQNNEISREDL

SEQ ID NO: 2973429 - protein, 33 aa, Entamoeba invadens
VHRFYKGKIQIMPKCTLAGFNWFNAYYTPGVSR

SEQ ID NO: 2973430 - protein, 19 aa, Entamoeba invadens
VHRLRLTKRFLNDEAITIL

SEQ ID NO: 2973431 - protein, 22 aa, Entamoeba invadens
VHSFNYMKGMYFVKETFDNFKS

SEQ ID NO: 2973432 - protein, 23 aa, Entamoeba invadens
VHSLCPPIFGHYIVKTAMILVLF

SEQ ID NO: 2973433 - protein, 22 aa, Entamoeba invadens
VHSLPEMAARCAESVSADYLLL

SEQ ID NO: 2973434 - protein, 25 aa, Entamoeba invadens
VHSVGDYGSIGWRSDWKEEEAEKCI

SEQ ID NO: 2973435 - protein, 27 aa, Entamoeba invadens
VHTIRSCDIKFQISLRPLYDSNTDMCQ

SEQ ID NO: 2973436 - protein, 20 aa, Entamoeba invadens
VHTKIAIAAFEFLLNNFEPI

SEQ ID NO: 2973437 - protein, 17 aa, Entamoeba invadens
VHTYPIEDSSFFFEECQ

SEQ ID NO: 2973438 - protein, 21 aa, Entamoeba invadens
VHVPCMVKFSGITYPILSMSF

SEQ ID NO: 2973439 - protein, 18 aa, Entamoeba invadens
VHYHFKNYLLDIFEPIIF

SEQ ID NO: 2973440 - protein, 23 aa, Entamoeba invadens
VIAAEPYNTIAFKIPNNELQTDQ

SEQ ID NO: 2973441 - protein, 23 aa, Entamoeba invadens
VIAENMLGAAMHELVRVGSNGLM

SEQ ID NO: 2973442 - protein, 23 aa, Entamoeba invadens
VIAEPMASVLYYLDVNKNSTIKN

SEQ ID NO: 2973443 - protein, 17 aa, Entamoeba invadens
VIAKGACLYARDMASQT

SEQ ID NO: 2973444 - protein, 18 aa, Entamoeba invadens
VIAKGACWYARDMASQTV

SEQ ID NO: 2973445 - protein, 18 aa, Entamoeba invadens
VIALEYIHGLGCIHRDLK

SEQ ID NO: 2973446 - protein, 24 aa, Entamoeba invadens
VIASIKERVIDRISRIHSNEQSKL

SEQ ID NO: 2973447 - protein, 30 aa, Entamoeba invadens
VICDLKVAAPILKFAVSVPFFATLSETSLS

SEQ ID NO: 2973448 - protein, 26 aa, Entamoeba invadens
VICFQEVFKELNWRREKLLKKAKKAG

SEQ ID NO: 2973449 - protein, 22 aa, Entamoeba invadens
VICGKCGVGYECVDGYCEEENN

SEQ ID NO: 2973450 - protein, 19 aa, Entamoeba invadens
VICILKTREDVFLDVIDLL

SEQ ID NO: 2973451 - protein, 17 aa, Entamoeba invadens
VICKVGYYYISKDCKQC

SEQ ID NO: 2973452 - protein, 23 aa, Entamoeba invadens
VICQGLPLPYCMDIQTLQKSCLS

SEQ ID NO: 2973453 - protein, 18 aa, Entamoeba invadens
VICRECRYVETLTTMTDN

SEQ ID NO: 2973454 - protein, 21 aa, Entamoeba invadens
VICRKYLRNPLEVFIDDGEKL

SEQ ID NO: 2973455 - protein, 17 aa, Entamoeba invadens
VICRPDRAFSKNDLHKV

SEQ ID NO: 2973456 - protein, 20 aa, Entamoeba invadens
VICVGKNMNIFGWYNSKKVP

SEQ ID NO: 2973457 - protein, 29 aa, Entamoeba invadens
VIDAFKLQKKFRVMIVLPAWSEGELQSIV

SEQ ID NO: 2973458 - protein, 18 aa, Entamoeba invadens
VIDALLVEKNRVSWESLV

SEQ ID NO: 2973459 - protein, 23 aa, Entamoeba invadens
VIDETYMLLGRSFSRGVPETQFY

SEQ ID NO: 2973460 - protein, 18 aa, Entamoeba invadens
VIDEVVDLFVGLNYGQIL

SEQ ID NO: 2973461 - protein, 18 aa, Entamoeba invadens
VIDFKTSKYRFKVNGSNL

SEQ ID NO: 2973462 - protein, 20 aa, Entamoeba invadens
VIDIFSRLLCVDFDTFNDKI

SEQ ID NO: 2973463 - protein, 23 aa, Entamoeba invadens
VIDKECFMNCFGLVHIVIPQSVE

SEQ ID NO: 2973464 - protein, 28 aa, Entamoeba invadens
VIDKIKRIQCIPLRLFVETERDDEIRKI

SEQ ID NO: 2973465 - protein, 24 aa, Entamoeba invadens
VIDKLAELCCFILVQKNGDGTLYQ

SEQ ID NO: 2973466 - protein, 24 aa, Entamoeba invadens
VIDLNNWVGCAAFVLQSRAIYQDM

SEQ ID NO: 2973467 - protein, 20 aa, Entamoeba invadens
VIDRALKMLSLSSVSLAIIH

SEQ ID NO: 2973468 - protein, 25 aa, Entamoeba invadens
VIDSKRLVGVYVELYKSECAIHMER

SEQ ID NO: 2973469 - protein, 25 aa, Entamoeba invadens
VIDTLKLVLRFKDFLDPQTLEEDYV

SEQ ID NO: 2973470 - protein, 18 aa, Entamoeba invadens
VIEAIAWNVLPPDVFMKL

SEQ ID NO: 2973471 - protein, 18 aa, Entamoeba invadens
VIECESFGQWKMVFDDWK

SEQ ID NO: 2973472 - protein, 22 aa, Entamoeba invadens
VIEDYIAFRVSRMNAEKSEKED

SEQ ID NO: 2973473 - protein, 24 aa, Entamoeba invadens
VIEGYNCTFFAYGQTGTGKTFTME

SEQ ID NO: 2973474 - protein, 23 aa, Entamoeba invadens
VIEICKSEHDGLIKYKPTRKFLS

SEQ ID NO: 2973475 - protein, 27 aa, Entamoeba invadens
VIEIPHLKEIVLFYTLFECIGYDSINN

SEQ ID NO: 2973476 - protein, 31 aa, Entamoeba invadens
VIEIPHPPPGLYPELFINTSLIADTEEMRME

SEQ ID NO: 2973477 - protein, 19 aa, Entamoeba invadens
VIEKCDRLTKISIPFDTNK

SEQ ID NO: 2973478 - protein, 21 aa, Entamoeba invadens
VIEKCWKQKVEERITINEAVN

SEQ ID NO: 2973479 - protein, 25 aa, Entamoeba invadens
VIELNLKAAVGWSVLMELEGGAFRT

SEQ ID NO: 2973480 - protein, 24 aa, Entamoeba invadens
VIENFKDCTFYSGKSMDVDDGCLI

SEQ ID NO: 2973481 - protein, 18 aa, Entamoeba invadens
VIERGWLGLVESLKNGNF

SEQ ID NO: 2973482 - protein, 24 aa, Entamoeba invadens
VIERRGVCRTCGLNEDNCPGHFGH

SEQ ID NO: 2973483 - protein, 19 aa, Entamoeba invadens
VIERTPCGVWKGEVNDQSG

SEQ ID NO: 2973484 - protein, 19 aa, Entamoeba invadens
VIESLPKVETHPVESLSTE

SEQ ID NO: 2973485 - protein, 24 aa, Entamoeba invadens
VIETIKLFLFIAEKFIKDEKYTQE

SEQ ID NO: 2973486 - protein, 24 aa, Entamoeba invadens
VIEVSRKRMTPLISDDHRPIPTFD

SEQ ID NO: 2973487 - protein, 24 aa, Entamoeba invadens
VIEYLVAEVLELAGGQAKDFGKTR

SEQ ID NO: 2973488 - protein, 18 aa, Entamoeba invadens
VIFDSRLNGMDQRELKAQ

SEQ ID NO: 2973489 - protein, 27 aa, Entamoeba invadens
VIFECRNLKNLDIFHLNNAICGKENIM

SEQ ID NO: 2973490 - protein, 17 aa, Entamoeba invadens
VIFIINFLQTVSRNESE

SEQ ID NO: 2973491 - protein, 25 aa, Entamoeba invadens
VIFINRLSVLISEVITFNTSIEKLK

SEQ ID NO: 2973492 - protein, 18 aa, Entamoeba invadens
VIFKKCTDLGFMLDSANR

SEQ ID NO: 2973493 - protein, 20 aa, Entamoeba invadens
VIFLFSRISFVSVLNTTDTN

SEQ ID NO: 2973494 - protein, 18 aa, Entamoeba invadens
VIFNSKFDGLNRETFNNR

SEQ ID NO: 2973495 - protein, 18 aa, Entamoeba invadens
VIFPFKYESPVISELCEE

SEQ ID NO: 2973496 - protein, 18 aa, Entamoeba invadens
VIFSYQYFFEMNIPISMK

SEQ ID NO: 2973497 - protein, 18 aa, Entamoeba invadens
VIGCFARVTATHFVTNTN

SEQ ID NO: 2973498 - protein, 19 aa, Entamoeba invadens
VIGCFARVTATHFVTNTNP

SEQ ID NO: 2973499 - protein, 20 aa, Entamoeba invadens
VIGDNAFFWCCALKTFEISE

SEQ ID NO: 2973500 - protein, 17 aa, Entamoeba invadens
VIGEGKTVNPKDLKGKT

SEQ ID NO: 2973501 - protein, 19 aa, Entamoeba invadens
VIGERCFKNAPITDVVIPP

SEQ ID NO: 2973502 - protein, 25 aa, Entamoeba invadens
VIGETAEVGKWCRMYQEVTLGAINF

SEQ ID NO: 2973503 - protein, 22 aa, Entamoeba invadens
VIGEVKRFIGLTYDDPAIKTIC

SEQ ID NO: 2973504 - protein, 17 aa, Entamoeba invadens
VIGGFAFYNCTGLTAIK

SEQ ID NO: 2973505 - protein, 17 aa, Entamoeba invadens
VIGGSLIHYKRSDKQIP

SEQ ID NO: 2973506 - protein, 39 aa, Entamoeba invadens
VIGQQAIQLAVEFKQVFMRCREFVSWGFFVDLETQIKSF

SEQ ID NO: 2973507 - protein, 21 aa, Entamoeba invadens
VIGRIRYFIRTTLTRTSFSKT

SEQ ID NO: 2973508 - protein, 18 aa, Entamoeba invadens
VIGSIGLRCLCGDATMYG

SEQ ID NO: 2973509 - protein, 18 aa, Entamoeba invadens
VIGSYAFLHCEKLEDINV

SEQ ID NO: 2973510 - protein, 18 aa, Entamoeba invadens
VIGVCLCKQSHNYQFGNI

SEQ ID NO: 2973511 - protein, 18 aa, Entamoeba invadens
VIHHCPKTPCLLVGTKLD

SEQ ID NO: 2973512 - protein, 24 aa, Entamoeba invadens
VIHPRGVVLDIVISLFARKGYAEM

SEQ ID NO: 2973513 - protein, 24 aa, Entamoeba invadens
VIIDKAGNVFGCYNKGSVRELCLS

SEQ ID NO: 2973514 - protein, 18 aa, Entamoeba invadens
VIIFDFFATWCGPCKSIA

SEQ ID NO: 2973515 - protein, 23 aa, Entamoeba invadens
VIIGENGYNFLIPKSGNCDEMVE

SEQ ID NO: 2973516 - protein, 24 aa, Entamoeba invadens
VIIISRPWGRPGAFRNKQSLNSLF

SEQ ID NO: 2973517 - protein, 17 aa, Entamoeba invadens
VIIKEFLAWEGDFGGRK

SEQ ID NO: 2973518 - protein, 23 aa, Entamoeba invadens
VIIMNLLLRYIFGLIGFVPTVSF

SEQ ID NO: 2973519 - protein, 26 aa, Entamoeba invadens
VIINAIYFKGEWDKPFHILPNKMEFE

SEQ ID NO: 2973520 - protein, 24 aa, Entamoeba invadens
VIIPPRGTNPISLVLSSVPVVDSD

SEQ ID NO: 2973521 - protein, 29 aa, Entamoeba invadens
VIISFLYKRLNSVYLRRQCLESYITVNGL

SEQ ID NO: 2973522 - protein, 25 aa, Entamoeba invadens
VIIVIKMKGGKIFGGYFSHIPEEGK

SEQ ID NO: 2973523 - protein, 19 aa, Entamoeba invadens
VIKENNCDFLLAVGGGSVI

SEQ ID NO: 2973524 - protein, 23 aa, Entamoeba invadens
VIKERKTSFVVGKIKTFVVLSVR

SEQ ID NO: 2973525 - protein, 18 aa, Entamoeba invadens
VIKGYRIKIEKELSEKCD

SEQ ID NO: 2973526 - protein, 21 aa, Entamoeba invadens
VIKIEALKILTSYFKAQKSQT

SEQ ID NO: 2973527 - protein, 20 aa, Entamoeba invadens
VIKKKVTALEGYYDRLQEAI

SEQ ID NO: 2973528 - protein, 21 aa, Entamoeba invadens
VIKKKVTALEGYYDRLQEAIL

SEQ ID NO: 2973529 - protein, 22 aa, Entamoeba invadens
VIKKLEKIFLIKDLYTEVMRKV

SEQ ID NO: 2973530 - protein, 23 aa, Entamoeba invadens
VIKMQELLLLFGKIGYLLLNTTY

SEQ ID NO: 2973531 - protein, 20 aa, Entamoeba invadens
VIKNEIKAGVDASVSQVWRL

SEQ ID NO: 2973532 - protein, 19 aa, Entamoeba invadens
VIKQIPGMKAFMKNINSLA

SEQ ID NO: 2973533 - protein, 17 aa, Entamoeba invadens
VIKSEGKQEVYPFSIKE

SEQ ID NO: 2973534 - protein, 22 aa, Entamoeba invadens
VIKSKFEPFAFNFEYTIQGVKY

SEQ ID NO: 2973535 - protein, 22 aa, Entamoeba invadens
VIKSLSLYGFDYFADVRSQALI

SEQ ID NO: 2973536 - protein, 27 aa, Entamoeba invadens
VIKTKGFAFGLFLGNWFKESNNIYVFK

SEQ ID NO: 2973537 - protein, 17 aa, Entamoeba invadens
VIKTWIDLYAIYYETDE

SEQ ID NO: 2973538 - protein, 17 aa, Entamoeba invadens
VIKVYTLLDVELVKREC

SEQ ID NO: 2973539 - protein, 29 aa, Entamoeba invadens
VIKYAFPMNRIVLLPCNSRKDAFKIRVGK

SEQ ID NO: 2973540 - protein, 21 aa, Entamoeba invadens
VILDSKLDFVTTLLNQMASKF

SEQ ID NO: 2973541 - protein, 25 aa, Entamoeba invadens
VILFVMVCGYPPFSDGDDGGNRQLF

SEQ ID NO: 2973542 - protein, 18 aa, Entamoeba invadens
VILGEYLYLMTFIAANQR

SEQ ID NO: 2973543 - protein, 24 aa, Entamoeba invadens
VILKNCSLERVLLFPKSEKILVEM

SEQ ID NO: 2973544 - protein, 23 aa, Entamoeba invadens
VILKNVLMTYSFYNMRLNYGQGM

SEQ ID NO: 2973545 - protein, 23 aa, Entamoeba invadens
VILLKETNGWTLVRHDNKVGYVP

SEQ ID NO: 2973546 - protein, 19 aa, Entamoeba invadens
VILNMKILFPLSTLFPNKT

SEQ ID NO: 2973547 - protein, 20 aa, Entamoeba invadens
VILSCVIRYLSFMDTNTVEY

SEQ ID NO: 2973548 - protein, 18 aa, Entamoeba invadens
VILTDELVGFVSRKNYLI

SEQ ID NO: 2973549 - protein, 28 aa, Entamoeba invadens
VILTDKWCVRIAINYVDRIYAQVLASVK

SEQ ID NO: 2973550 - protein, 18 aa, Entamoeba invadens
VILTEDRSLIGIFETTLR

SEQ ID NO: 2973551 - protein, 18 aa, Entamoeba invadens
VILVGGCALIPKVKQVVR

SEQ ID NO: 2973552 - protein, 17 aa, Entamoeba invadens
VILYSCENLNKFTLPKS

SEQ ID NO: 2973553 - protein, 20 aa, Entamoeba invadens
VIMALLGVWYNNFYKAESQA

SEQ ID NO: 2973554 - protein, 24 aa, Entamoeba invadens
VIMCKCKLEIILIKNHTGQLSNFE

SEQ ID NO: 2973555 - protein, 17 aa, Entamoeba invadens
VIMPRQIPNYQPERSRI

SEQ ID NO: 2973556 - protein, 18 aa, Entamoeba invadens
VIMQNLFCLFSEKKKIET

SEQ ID NO: 2973557 - protein, 24 aa, Entamoeba invadens
VINIKLIFELSVAVSLVCPVKNQY

SEQ ID NO: 2973558 - protein, 26 aa, Entamoeba invadens
VINQFRPPVGYTWQFPAGLIDDGEEP

SEQ ID NO: 2973559 - protein, 18 aa, Entamoeba invadens
VINQKGIVLYSIYDKESH

SEQ ID NO: 2973560 - protein, 21 aa, Entamoeba invadens
VINRYILQLCTKKHKFYNNEK

SEQ ID NO: 2973561 - protein, 22 aa, Entamoeba invadens
VINSCIKFKVYIKNSNNIDIIN

SEQ ID NO: 2973562 - protein, 22 aa, Entamoeba invadens
VINSPTIRWFFKHFSPDTFDSA

SEQ ID NO: 2973563 - protein, 36 aa, Entamoeba invadens
VINTLKATVVFQRKLKFAAEGVAWIGLNKYIAISEK

SEQ ID NO: 2973564 - protein, 24 aa, Entamoeba invadens
VINVKAACWMKKMLDAKNLEINKF

SEQ ID NO: 2973565 - protein, 23 aa, Entamoeba invadens
VIPDFCGRIAFNVFNDVDVLNIE

SEQ ID NO: 2973566 - protein, 17 aa, Entamoeba invadens
VIPDSVVEFGMFVCQDC

SEQ ID NO: 2973567 - protein, 18 aa, Entamoeba invadens
VIPFPKIEHDGIYDKILM

SEQ ID NO: 2973568 - protein, 32 aa, Entamoeba invadens
VIPHFIKVIIGNRCLFGYETLSSVAIPTSVIM

SEQ ID NO: 2973569 - protein, 24 aa, Entamoeba invadens
VIPHKVYQFRGFDIANMTFVRGEK

SEQ ID NO: 2973570 - protein, 25 aa, Entamoeba invadens
VIPIQELLEPIALPAEVVDKKIRRE

SEQ ID NO: 2973571 - protein, 25 aa, Entamoeba invadens
VIPKNFFASCIYLKEVVMDNSVVTV

SEQ ID NO: 2973572 - protein, 26 aa, Entamoeba invadens
VIPLGMKCNEIFGIPLSIGVKKSGWR

SEQ ID NO: 2973573 - protein, 17 aa, Entamoeba invadens
VIPLPVIHSYGADITKL

SEQ ID NO: 2973574 - protein, 25 aa, Entamoeba invadens
VIPLSSMSGLIGWVPHSDTLHQVVK

SEQ ID NO: 2973575 - protein, 21 aa, Entamoeba invadens
VIPPDWVVTSLLPLQSTIRSY

SEQ ID NO: 2973576 - protein, 26 aa, Entamoeba invadens
VIPQTVRYVGWYAFSECYKLKHVIYS

SEQ ID NO: 2973577 - protein, 22 aa, Entamoeba invadens
VIPSCILPHLYLGSVQASVKSS

SEQ ID NO: 2973578 - protein, 23 aa, Entamoeba invadens
VIPSLCIVEKGILNELKKYGEGT

SEQ ID NO: 2973579 - protein, 26 aa, Entamoeba invadens
VIPYCVPSLGYHCFAWCSSLSSITIP

SEQ ID NO: 2973580 - protein, 35 aa, Entamoeba invadens
VIQDTIHIWYHFRNWVWFRLFQKVRPILKKRRVDE

SEQ ID NO: 2973581 - protein, 19 aa, Entamoeba invadens
VIQKKRFNNELKVNTQRKK

SEQ ID NO: 2973582 - protein, 25 aa, Entamoeba invadens
VIQKTWCVLCVKLEQIWIKEEYVLR

SEQ ID NO: 2973583 - protein, 25 aa, Entamoeba invadens
VIQMCSSIQKWSYDIVDEIISGTKF

SEQ ID NO: 2973584 - protein, 18 aa, Entamoeba invadens
VIQPIPWLQSEDLNESLE

SEQ ID NO: 2973585 - protein, 23 aa, Entamoeba invadens
VIQRVGLYPVEFGTKTYYFEIRN

SEQ ID NO: 2973586 - protein, 23 aa, Entamoeba invadens
VIQRYDLWRSRDRLFNRREMRNL

SEQ ID NO: 2973587 - protein, 18 aa, Entamoeba invadens
VIQTCLDKSWGEYKLRLS

SEQ ID NO: 2973588 - protein, 24 aa, Entamoeba invadens
VIREISFPALDHVSVFPFSNFTSI

SEQ ID NO: 2973589 - protein, 24 aa, Entamoeba invadens
VIRGTELISQIGLLALKDIIPFFI

SEQ ID NO: 2973590 - protein, 25 aa, Entamoeba invadens
VIRKELRSTCEFVMGKNTLIRKAIK

SEQ ID NO: 2973591 - protein, 18 aa, Entamoeba invadens
VIRPDRYKNLSVSLYVHD

SEQ ID NO: 2973592 - protein, 22 aa, Entamoeba invadens
VISALPLWVEFMTDQKDWDLFF

SEQ ID NO: 2973593 - protein, 19 aa, Entamoeba invadens
VISEGVGFYVRKMEFKTLP

SEQ ID NO: 2973594 - protein, 22 aa, Entamoeba invadens
VISHSFSLICLLDVGDNQKIHF

SEQ ID NO: 2973595 - protein, 25 aa, Entamoeba invadens
VISITRFGGKLSIPDSIKSISVNFI

SEQ ID NO: 2973596 - protein, 32 aa, Entamoeba invadens
VISKLKLWLEMSIGRSRHCTVGFTGDTSMQET

SEQ ID NO: 2973597 - protein, 25 aa, Entamoeba invadens
VISLFARKGYAEMFEVIRRNKVNYN

SEQ ID NO: 2973598 - protein, 27 aa, Entamoeba invadens
VISNSSWRYNTIKSAITNNDWQNYESN

SEQ ID NO: 2973599 - protein, 25 aa, Entamoeba invadens
VISSVCKIAGMLLCVVGEDSGFDIL

SEQ ID NO: 2973600 - protein, 18 aa, Entamoeba invadens
VISTEIRARLNLTESALP

SEQ ID NO: 2973601 - protein, 26 aa, Entamoeba invadens
VITDFCSFFVVFFISRIELVDKNGWG

SEQ ID NO: 2973602 - protein, 22 aa, Entamoeba invadens
VITDRLEPVLAPFNGISPKIQN

SEQ ID NO: 2973603 - protein, 18 aa, Entamoeba invadens
VITEGVKTLPQRCFAECP

SEQ ID NO: 2973604 - protein, 19 aa, Entamoeba invadens
VITEGVKTLPQRCFAECPN

SEQ ID NO: 2973605 - protein, 26 aa, Entamoeba invadens
VITLSEFRGDVCMDECKPRCVNISQY

SEQ ID NO: 2973606 - protein, 21 aa, Entamoeba invadens
VITPPEIVGSVYPSKVDILSY

SEQ ID NO: 2973607 - protein, 25 aa, Entamoeba invadens
VIVGDGAVGKTCMLISYTTNAFPNE

SEQ ID NO: 2973608 - protein, 26 aa, Entamoeba invadens
VIVGKNRSSFCFAPLLLEIRKAIRQI

SEQ ID NO: 2973609 - protein, 18 aa, Entamoeba invadens
VIVLEGTRTLLIDQDVRS

SEQ ID NO: 2973610 - protein, 17 aa, Entamoeba invadens
VIVNNIFTYLAHSSEET

SEQ ID NO: 2973611 - protein, 25 aa, Entamoeba invadens
VIVRESDCIISLIGDSPVYVLFEGK

SEQ ID NO: 2973612 - protein, 23 aa, Entamoeba invadens
VIWPSPKLSSGVVEPYNAVLNTH

SEQ ID NO: 2973613 - protein, 35 aa, Entamoeba invadens
VIYEELKVVCEVFKEVLTYKEFCRSNVGKEYFQEI

SEQ ID NO: 2973614 - protein, 18 aa, Entamoeba invadens
VIYELSPFNEWRDINSPQ

SEQ ID NO: 2973615 - protein, 18 aa, Entamoeba invadens
VIYFPKEGNLVIFAHSFI

SEQ ID NO: 2973616 - protein, 31 aa, Entamoeba invadens
VIYNNWRQPIALLIRKGHTYKLISQNSLLLQ

SEQ ID NO: 2973617 - protein, 25 aa, Entamoeba invadens
VIYQTKWSSSGIFRLLPSLCQSLLL

SEQ ID NO: 2973618 - protein, 18 aa, Entamoeba invadens
VIYTLSFIVNKVCYNNIK

SEQ ID NO: 2973619 - protein, 21 aa, Entamoeba invadens
VKAEFIRMGVLKMKSVQLCDL

SEQ ID NO: 2973620 - protein, 19 aa, Entamoeba invadens
VKAFEELKRVFDFSKNYVI

SEQ ID NO: 2973621 - protein, 17 aa, Entamoeba invadens
VKAFSFVSHTSREALCQ

SEQ ID NO: 2973622 - protein, 22 aa, Entamoeba invadens
VKAGIKCMIDIVIQSSDMNVKM

SEQ ID NO: 2973623 - protein, 26 aa, Entamoeba invadens
VKAKIPVSLCEWFICEVGRSTKLAEY

SEQ ID NO: 2973624 - protein, 22 aa, Entamoeba invadens
VKAKRIELFVTHGKTLKFTKCE

SEQ ID NO: 2973625 - protein, 17 aa, Entamoeba invadens
VKAKSIWENIQRNKEGK

SEQ ID NO: 2973626 - protein, 19 aa, Entamoeba invadens
VKAKVPLQRVENVEEVRQK

SEQ ID NO: 2973627 - protein, 18 aa, Entamoeba invadens
VKALLLRGVGVHHAGLLP

SEQ ID NO: 2973628 - protein, 27 aa, Entamoeba invadens
VKALNGIVLECCRHPYGCRVVQRVIES

SEQ ID NO: 2973629 - protein, 27 aa, Entamoeba invadens
VKALNNWCFYKCSGIKNIIIPSSVTSI

SEQ ID NO: 2973630 - protein, 24 aa, Entamoeba invadens
VKALQPFCFTKCFTLIDFVLPENV

SEQ ID NO: 2973631 - protein, 17 aa, Entamoeba invadens
VKALSGVHTVKFREELQ

SEQ ID NO: 2973632 - protein, 24 aa, Entamoeba invadens
VKANYKPNDKWDLNAEINKANGGK

SEQ ID NO: 2973633 - protein, 17 aa, Entamoeba invadens
VKAPFGVECLSTKSIDN

SEQ ID NO: 2973634 - protein, 17 aa, Entamoeba invadens
VKAQGLPPRVTDEMLND

SEQ ID NO: 2973635 - protein, 19 aa, Entamoeba invadens
VKATCPYIVEYNANLRTVN

SEQ ID NO: 2973636 - protein, 17 aa, Entamoeba invadens
VKATFTQPIFLQKVYIG

SEQ ID NO: 2973637 - protein, 17 aa, Entamoeba invadens
VKAVVFLLTEISKNVEC

SEQ ID NO: 2973638 - protein, 17 aa, Entamoeba invadens
VKCCSLISSLLMIEYNY

SEQ ID NO: 2973639 - protein, 24 aa, Entamoeba invadens
VKCDYLRLATYLAQKREDKIHSDS

SEQ ID NO: 2973640 - protein, 22 aa, Entamoeba invadens
VKCEGDPSCLMRLFGSVSTPER

SEQ ID NO: 2973641 - protein, 25 aa, Entamoeba invadens
VKCQDVLRMITIFFQDVNVIQNENA

SEQ ID NO: 2973642 - protein, 18 aa, Entamoeba invadens
VKCRPGYETDIAMRVMKL

SEQ ID NO: 2973643 - protein, 17 aa, Entamoeba invadens
VKCRVPRCSIRICNISD

SEQ ID NO: 2973644 - protein, 19 aa, Entamoeba invadens
VKCSGLMLTGMASFNTMCI

SEQ ID NO: 2973645 - protein, 21 aa, Entamoeba invadens
VKCSTKFFDVGCGDINVVYNT

SEQ ID NO: 2973646 - protein, 19 aa, Entamoeba invadens
VKCTEVFATLLTKEGVNLG

SEQ ID NO: 2973647 - protein, 20 aa, Entamoeba invadens
VKCVKEFPSTHPYLVLIIDV

SEQ ID NO: 2973648 - protein, 25 aa, Entamoeba invadens
VKDFWTRVFYYSGFTKNVGYTEQDT

SEQ ID NO: 2973649 - protein, 23 aa, Entamoeba invadens
VKDGFKYACDFMVYKKNPKECHS

SEQ ID NO: 2973650 - protein, 18 aa, Entamoeba invadens
VKDGQIICKCGKNLFDYG

SEQ ID NO: 2973651 - protein, 18 aa, Entamoeba invadens
VKDHIAFFYFQKIEFVQP

SEQ ID NO: 2973652 - protein, 35 aa, Entamoeba invadens
VKDIIYKLMELFITFKFSPTFLYFMSRALVELHSR

SEQ ID NO: 2973653 - protein, 22 aa, Entamoeba invadens
VKDIKPGDLVGVNKDTYLILEK

SEQ ID NO: 2973654 - protein, 17 aa, Entamoeba invadens
VKDKCPEMYYKSEADKM

SEQ ID NO: 2973655 - protein, 24 aa, Entamoeba invadens
VKDKDGNMFYCYTYLVKNKSGEEH

SEQ ID NO: 2973656 - protein, 22 aa, Entamoeba invadens
VKDKPAVSFVWQYDKTKPKTER

SEQ ID NO: 2973657 - protein, 26 aa, Entamoeba invadens
VKDLEEVHPLFCYSVRDVARHITVVQ

SEQ ID NO: 2973658 - protein, 28 aa, Entamoeba invadens
VKDLLLHNPRVVFVFYDFEFTQFQDIGT

SEQ ID NO: 2973659 - protein, 21 aa, Entamoeba invadens
VKDLMKQICEKYKKDGKPRVY

SEQ ID NO: 2973660 - protein, 19 aa, Entamoeba invadens
VKDMECFQEAILVALINQF

SEQ ID NO: 2973661 - protein, 18 aa, Entamoeba invadens
VKDMWLKELASFEKKYPE

SEQ ID NO: 2973662 - protein, 24 aa, Entamoeba invadens
VKDREFIRLTGTLKKYSHTLQAQK

SEQ ID NO: 2973663 - protein, 23 aa, Entamoeba invadens
VKDSHKYWQMWALVNLEVVGLYE

SEQ ID NO: 2973664 - protein, 21 aa, Entamoeba invadens
VKDSKKKGCIVCVCNDMLIVY

SEQ ID NO: 2973665 - protein, 17 aa, Entamoeba invadens
VKDSMQVGSYDRAKSKI

SEQ ID NO: 2973666 - protein, 19 aa, Entamoeba invadens
VKDTLFKNFHIEIHATCQD

SEQ ID NO: 2973667 - protein, 24 aa, Entamoeba invadens
VKDVCIPEDIVGRYLPKLNGKVRD

SEQ ID NO: 2973668 - protein, 19 aa, Entamoeba invadens
VKDVCKAMIHCATEPKITI

SEQ ID NO: 2973669 - protein, 25 aa, Entamoeba invadens
VKDVKLRGSLRMKLYTEGIQSLQLI

SEQ ID NO: 2973670 - protein, 17 aa, Entamoeba invadens
VKDYDLSPQQMFYKVDT

SEQ ID NO: 2973671 - protein, 21 aa, Entamoeba invadens
VKEALLDIEVDGVKYILKAKT

SEQ ID NO: 2973672 - protein, 20 aa, Entamoeba invadens
VKECIKDQANALNWFNTQQK

SEQ ID NO: 2973673 - protein, 21 aa, Entamoeba invadens
VKEFKHLTYICLYERSESSPP

SEQ ID NO: 2973674 - protein, 19 aa, Entamoeba invadens
VKEFLKSRGLVTATENHFL

SEQ ID NO: 2973675 - protein, 21 aa, Entamoeba invadens
VKEFLLKCAVNMINMARTTEL

SEQ ID NO: 2973676 - protein, 33 aa, Entamoeba invadens
VKEGDLYLGDRWLRFDPPLGCVIDLDDIEKMPK

SEQ ID NO: 2973677 - protein, 36 aa, Entamoeba invadens
VKEIGDFCFKNCTCFLNDLYLPYGLTKIGYGAFENF

SEQ ID NO: 2973678 - protein, 17 aa, Entamoeba invadens
VKEIGFEGVHFSKKIRE

SEQ ID NO: 2973679 - protein, 22 aa, Entamoeba invadens
VKEINIRAVLCCPVSFNDAQKE

SEQ ID NO: 2973680 - protein, 21 aa, Entamoeba invadens
VKEINIRAVLCCPVSFNDVQK

SEQ ID NO: 2973681 - protein, 18 aa, Entamoeba invadens
VKEKERELETTIKQFDAI

SEQ ID NO: 2973682 - protein, 23 aa, Entamoeba invadens
VKEKGVLPRVVYLDDFMSELCVY

SEQ ID NO: 2973683 - protein, 32 aa, Entamoeba invadens
VKEKKTKQVGCYKCGSLDHIGRDCPDAWKYHD

SEQ ID NO: 2973684 - protein, 18 aa, Entamoeba invadens
VKEKLGIGEVLNKVKFIY

SEQ ID NO: 2973685 - protein, 17 aa, Entamoeba invadens
VKEKLRLFESKVVESNP

SEQ ID NO: 2973686 - protein, 21 aa, Entamoeba invadens
VKELKGWTFGGCVSLKEVVLN

SEQ ID NO: 2973687 - protein, 18 aa, Entamoeba invadens
VKELMAILETSFRKNEKV

SEQ ID NO: 2973688 - protein, 21 aa, Entamoeba invadens
VKELMKLCSKLEVPFSSEEEA

SEQ ID NO: 2973689 - protein, 21 aa, Entamoeba invadens
VKEMIIRGGHNVFPAEIIDTL

SEQ ID NO: 2973690 - protein, 17 aa, Entamoeba invadens
VKEMVPLIVQCRTALIA

SEQ ID NO: 2973691 - protein, 25 aa, Entamoeba invadens
VKENPVFEYIRYIILPFLGKAKLCG

SEQ ID NO: 2973692 - protein, 17 aa, Entamoeba invadens
VKERCLSILMQDKIHGI

SEQ ID NO: 2973693 - protein, 26 aa, Entamoeba invadens
VKERDEFRCQFSFLKFGDETYSDLLE

SEQ ID NO: 2973694 - protein, 32 aa, Entamoeba invadens
VKERGTKIVVCGSDSFLSLFIRQMTEAATKKA

SEQ ID NO: 2973695 - protein, 28 aa, Entamoeba invadens
VKERKIPMCQWPLFIYNEFENEVGKSKV

SEQ ID NO: 2973696 - protein, 21 aa, Entamoeba invadens
VKESFIRGDIDNVFYSSNAKA

SEQ ID NO: 2973697 - protein, 23 aa, Entamoeba invadens
VKESKIPIILFIDEIHTVLGAGA

SEQ ID NO: 2973698 - protein, 24 aa, Entamoeba invadens
VKESKIPIILFIDEIHTVLGAGAT

SEQ ID NO: 2973699 - protein, 19 aa, Entamoeba invadens
VKESMPICTSDIMKEAIVV

SEQ ID NO: 2973700 - protein, 22 aa, Entamoeba invadens
VKEVCFALSFVCVVEEILDLKK

SEQ ID NO: 2973701 - protein, 22 aa, Entamoeba invadens
VKEVCRQFTLCYTREQNVVPIT

SEQ ID NO: 2973702 - protein, 17 aa, Entamoeba invadens
VKEVFPVSVEVEGKTEL

SEQ ID NO: 2973703 - protein, 20 aa, Entamoeba invadens
VKEVLGLLVSGDLEDMAIKL

SEQ ID NO: 2973704 - protein, 18 aa, Entamoeba invadens
VKEVRWSGFDLRNVDSEI

SEQ ID NO: 2973705 - protein, 26 aa, Entamoeba invadens
VKEYAEAFEVIPFTLAENAGLNPMQL

SEQ ID NO: 2973706 - protein, 17 aa, Entamoeba invadens
VKFADFYSKTHLKTLQN

SEQ ID NO: 2973707 - protein, 21 aa, Entamoeba invadens
VKFEILDGFKKGTIEEISSGV

SEQ ID NO: 2973708 - protein, 19 aa, Entamoeba invadens
VKFIALFKELTSNKGTQVD

SEQ ID NO: 2973709 - protein, 23 aa, Entamoeba invadens
VKFICGMNGFIFITFGKEPEKTN

SEQ ID NO: 2973710 - protein, 20 aa, Entamoeba invadens
VKFIRRCVNKAKVLSLSGFD

SEQ ID NO: 2973711 - protein, 39 aa, Entamoeba invadens
VKFLEKHFYCGQLLCLYGCYHKNRIFSLLKKGEVSKDKL

SEQ ID NO: 2973712 - protein, 17 aa, Entamoeba invadens
VKFNCKIGVEEIAFCVD

SEQ ID NO: 2973713 - protein, 17 aa, Entamoeba invadens
VKFSKINFDIEVIGCFA

SEQ ID NO: 2973714 - protein, 24 aa, Entamoeba invadens
VKFSREGQSFYGIILDKVGEGFTV

SEQ ID NO: 2973715 - protein, 23 aa, Entamoeba invadens
VKFTIRDIDNWMGVCPNGDVEQL

SEQ ID NO: 2973716 - protein, 19 aa, Entamoeba invadens
VKFVPQFYQLVDDYYKTLD

SEQ ID NO: 2973717 - protein, 29 aa, Entamoeba invadens
VKGAFIIQKKLSTIVIISLMKYDQVTPER

SEQ ID NO: 2973718 - protein, 18 aa, Entamoeba invadens
VKGCFRFETRSIIPEKYK

SEQ ID NO: 2973719 - protein, 19 aa, Entamoeba invadens
VKGCYRPSESDWWINSLEE

SEQ ID NO: 2973720 - protein, 17 aa, Entamoeba invadens
VKGDVPSNLQCRVIALD

SEQ ID NO: 2973721 - protein, 22 aa, Entamoeba invadens
VKGDYNVNCKLNRRHIANSPFK

SEQ ID NO: 2973722 - protein, 17 aa, Entamoeba invadens
VKGELAFMTEGLKNERG

SEQ ID NO: 2973723 - protein, 24 aa, Entamoeba invadens
VKGHIIKMLIYRIRPEKDIVKEIG

SEQ ID NO: 2973724 - protein, 23 aa, Entamoeba invadens
VKGICGFKTAYLQEFFDYLEKQK

SEQ ID NO: 2973725 - protein, 18 aa, Entamoeba invadens
VKGIREIVEKAGHELVLL

SEQ ID NO: 2973726 - protein, 20 aa, Entamoeba invadens
VKGKAACWMKTLFDAKNLEV

SEQ ID NO: 2973727 - protein, 19 aa, Entamoeba invadens
VKGKCELVVSNVDIDKMII

SEQ ID NO: 2973728 - protein, 17 aa, Entamoeba invadens
VKGKHVIIYDDMTRTAG

SEQ ID NO: 2973729 - protein, 20 aa, Entamoeba invadens
VKGKLPLSVKYVAIDFISQV

SEQ ID NO: 2973730 - protein, 44 aa, Entamoeba invadens
VKGKPDVCVGCVNFELSLMPFPSIIEGWFYLRPLAFTDNVSTGR

SEQ ID NO: 2973731 - protein, 24 aa, Entamoeba invadens
VKGKSCEERAKLLKRVVNQMVNKL

SEQ ID NO: 2973732 - protein, 19 aa, Entamoeba invadens
VKGLNKWIQTGKCSFPKYH

SEQ ID NO: 2973733 - protein, 21 aa, Entamoeba invadens
VKGMKMTVCEKFVQMYRNLGK

SEQ ID NO: 2973734 - protein, 21 aa, Entamoeba invadens
VKGNGWVKVLWNPDGQPNRYR

SEQ ID NO: 2973735 - protein, 24 aa, Entamoeba invadens
VKGNISIRISDLISITDEILMIDT

SEQ ID NO: 2973736 - protein, 18 aa, Entamoeba invadens
VKGPEMLSKYVGETEGKI

SEQ ID NO: 2973737 - protein, 23 aa, Entamoeba invadens
VKGPFTLRSGTGYNLDCVNCTNV

SEQ ID NO: 2973738 - protein, 29 aa, Entamoeba invadens
VKGPSLYCVLPLVGSEKMQFPFLLNSPDF

SEQ ID NO: 2973739 - protein, 18 aa, Entamoeba invadens
VKGRCIVSSSVLSINMRG

SEQ ID NO: 2973740 - protein, 17 aa, Entamoeba invadens
VKGREWFCQNSCATNGD

SEQ ID NO: 2973741 - protein, 17 aa, Entamoeba invadens
VKGREWFCQTSCATNGD

SEQ ID NO: 2973742 - protein, 20 aa, Entamoeba invadens
VKGRKCYSMPIILNQYKGQT

SEQ ID NO: 2973743 - protein, 24 aa, Entamoeba invadens
VKGRKCYSMPLILKQYKGQTDAKT

SEQ ID NO: 2973744 - protein, 18 aa, Entamoeba invadens
VKGRKVVVATNIAETSIT

SEQ ID NO: 2973745 - protein, 22 aa, Entamoeba invadens
VKGRQGDMFGLLANLGMDVNCV

SEQ ID NO: 2973746 - protein, 17 aa, Entamoeba invadens
VKGSFKEIFAIDDTLSG

SEQ ID NO: 2973747 - protein, 23 aa, Entamoeba invadens
VKGTKCPICEDVLSEAIPLNRPF

SEQ ID NO: 2973748 - protein, 25 aa, Entamoeba invadens
VKGVRRYLDNLGFLEVETPILNTIP

SEQ ID NO: 2973749 - protein, 28 aa, Entamoeba invadens
VKGWNVDICKCIFHNAFSSDKLLFYTSL

SEQ ID NO: 2973750 - protein, 23 aa, Entamoeba invadens
VKHIKFTLTNHVFFNTKDYQSFG

SEQ ID NO: 2973751 - protein, 24 aa, Entamoeba invadens
VKHIKWIFWDVCGQQQFQRLWKTY

SEQ ID NO: 2973752 - protein, 24 aa, Entamoeba invadens
VKHKKRYSQKFKEDRQCEKTGKKI

SEQ ID NO: 2973753 - protein, 24 aa, Entamoeba invadens
VKHLGEGKYFISYTLPSVKGDYNV

SEQ ID NO: 2973754 - protein, 17 aa, Entamoeba invadens
VKHMLPFSLEIFLSQTA

SEQ ID NO: 2973755 - protein, 17 aa, Entamoeba invadens
VKHPFTFLDDDVWGPFQ

SEQ ID NO: 2973756 - protein, 17 aa, Entamoeba invadens
VKHRIVQDYSFSKRYTI

SEQ ID NO: 2973757 - protein, 18 aa, Entamoeba invadens
VKICEDCTICITQTVFEK

SEQ ID NO: 2973758 - protein, 17 aa, Entamoeba invadens
VKIDIWSLGIMVMEMAE

SEQ ID NO: 2973759 - protein, 20 aa, Entamoeba invadens
VKIECVDKILTLYNKNIPEK

SEQ ID NO: 2973760 - protein, 21 aa, Entamoeba invadens
VKIFYCKYNDPLYIKVEKLEI

SEQ ID NO: 2973761 - protein, 17 aa, Entamoeba invadens
VKIGFTTGFLFSKDTLG

SEQ ID NO: 2973762 - protein, 22 aa, Entamoeba invadens
VKIGSQITVEFSKWRNEHFSQK

SEQ ID NO: 2973763 - protein, 23 aa, Entamoeba invadens
VKIHCNRAIIGVLRGFDEYLNLV

SEQ ID NO: 2973764 - protein, 23 aa, Entamoeba invadens
VKIHRLKGFFTGVGDTFTYTLFA

SEQ ID NO: 2973765 - protein, 25 aa, Entamoeba invadens
VKIITELLITFGKVVPCTSLMIDEE

SEQ ID NO: 2973766 - protein, 27 aa, Entamoeba invadens
VKILEMENCSWFDFVFPFHSLLELTMN

SEQ ID NO: 2973767 - protein, 40 aa, Entamoeba invadens
VKILGKNTFKDWSCLSTFMQRDAYLMWGFYSNPEKVEEIY

SEQ ID NO: 2973768 - protein, 38 aa, Entamoeba invadens
VKILKSHNTGVCKFHLGMCYRKGCGVLESATKSAECYK

SEQ ID NO: 2973769 - protein, 25 aa, Entamoeba invadens
VKIMKNRGGAVLNTFIECLATQSIH

SEQ ID NO: 2973770 - protein, 20 aa, Entamoeba invadens
VKIMLSTLFMSLEKTHKKSR

SEQ ID NO: 2973771 - protein, 23 aa, Entamoeba invadens
VKIPEERSKVLLYTPAETRQWNE

SEQ ID NO: 2973772 - protein, 17 aa, Entamoeba invadens
VKIPFSVVVPKAYSEPW

SEQ ID NO: 2973773 - protein, 20 aa, Entamoeba invadens
VKIPQLRAVIPDQLLLEMCN

SEQ ID NO: 2973774 - protein, 18 aa, Entamoeba invadens
VKIVKVFFNVKGFENTSV

SEQ ID NO: 2973775 - protein, 25 aa, Entamoeba invadens
VKIVLPKGFKTPRQQAKFASRSPTE

SEQ ID NO: 2973776 - protein, 17 aa, Entamoeba invadens
VKKAAALQEQKDDITAK

SEQ ID NO: 2973777 - protein, 25 aa, Entamoeba invadens
VKKAVLKGQRFVAVGQIMHKRAVDD

SEQ ID NO: 2973778 - protein, 21 aa, Entamoeba invadens
VKKAVTIPVLVGSGVTPENIN

SEQ ID NO: 2973779 - protein, 22 aa, Entamoeba invadens
VKKCRIPATVILLGDILLERGV

SEQ ID NO: 2973780 - protein, 20 aa, Entamoeba invadens
VKKGKVLFKDVIAFYKTKYK

SEQ ID NO: 2973781 - protein, 25 aa, Entamoeba invadens
VKKGLPETIRVVTSCYVYIQCIGDQ

SEQ ID NO: 2973782 - protein, 19 aa, Entamoeba invadens
VKKGVAKPTAFRRYEKNKR

SEQ ID NO: 2973783 - protein, 30 aa, Entamoeba invadens
VKKIENWTDWWKIRQSSFYHLSQEARKYTT

SEQ ID NO: 2973784 - protein, 25 aa, Entamoeba invadens
VKKIKALSCCDCSALQNKGVAELFD

SEQ ID NO: 2973785 - protein, 24 aa, Entamoeba invadens
VKKIKRYQIGKVYRRDQPYMTKGR

SEQ ID NO: 2973786 - protein, 24 aa, Entamoeba invadens
VKKIVEILSELFVKNVMKTQRVVN

SEQ ID NO: 2973787 - protein, 20 aa, Entamoeba invadens
VKKLAEGCGGTIGSSGKEVC

SEQ ID NO: 2973788 - protein, 30 aa, Entamoeba invadens
VKKLQKGKEMPFRQVRFSIIPSKQELKKDW

SEQ ID NO: 2973789 - protein, 25 aa, Entamoeba invadens
VKKLRCVPGTSFGNGLFKIEFDKAV

SEQ ID NO: 2973790 - protein, 22 aa, Entamoeba invadens
VKKLSLKYNDLVVGVEYTVLLV

SEQ ID NO: 2973791 - protein, 23 aa, Entamoeba invadens
VKKMCLIGKVSVEFPQNTKFPIE

SEQ ID NO: 2973792 - protein, 29 aa, Entamoeba invadens
VKKNISKVLCEWYLMFVGQPIKQAEAAKI

SEQ ID NO: 2973793 - protein, 28 aa, Entamoeba invadens
VKKNISKVLCEWYLVFVGQPIKQAEAAK

SEQ ID NO: 2973794 - protein, 18 aa, Entamoeba invadens
VKKNLDVLCEKGLANKED

SEQ ID NO: 2973795 - protein, 20 aa, Entamoeba invadens
VKKNRAVYEIAKTCDLLMVI

SEQ ID NO: 2973796 - protein, 20 aa, Entamoeba invadens
VKKNRMSMGTQRKSEAQQDF

SEQ ID NO: 2973797 - protein, 25 aa, Entamoeba invadens
VKKQLPQICANCMRSYTDYINDTNE

SEQ ID NO: 2973798 - protein, 22 aa, Entamoeba invadens
VKKQYECVCVLLGITYKGKPFM

SEQ ID NO: 2973799 - protein, 23 aa, Entamoeba invadens
VKKRASLKGSNPFDDESKSASGN

SEQ ID NO: 2973800 - protein, 27 aa, Entamoeba invadens
VKKRPIPKRVPIVIPPKFTMDYNNYSK

SEQ ID NO: 2973801 - protein, 17 aa, Entamoeba invadens
VKKRVQIQWNLDIENQM

SEQ ID NO: 2973802 - protein, 19 aa, Entamoeba invadens
VKKRYGFDYPTTKNERRNW

SEQ ID NO: 2973803 - protein, 21 aa, Entamoeba invadens
VKKSAGSVLNLFKRVRNDTVT

SEQ ID NO: 2973804 - protein, 27 aa, Entamoeba invadens
VKKSGWRVPLVVYRAVEFLRTTKGYEQ

SEQ ID NO: 2973805 - protein, 20 aa, Entamoeba invadens
VKKSIKSLITKTGIGSCRTG

SEQ ID NO: 2973806 - protein, 19 aa, Entamoeba invadens
VKKSREFLEESFSLDEINE

SEQ ID NO: 2973807 - protein, 18 aa, Entamoeba invadens
VKKSYIWKEFKKLRLTTI

SEQ ID NO: 2973808 - protein, 19 aa, Entamoeba invadens
VKKTSGWTEDGFSASVTAE

SEQ ID NO: 2973809 - protein, 18 aa, Entamoeba invadens
VKKVKKAFEFVRNDSEPM

SEQ ID NO: 2973810 - protein, 27 aa, Entamoeba invadens
VKKVSENILYFAHLVLFVARNNTSSLI

SEQ ID NO: 2973811 - protein, 23 aa, Entamoeba invadens
VKKVVLFLIEKCKGYGVTQEMVI

SEQ ID NO: 2973812 - protein, 20 aa, Entamoeba invadens
VKKYFKVWHDELRVFDESGK

SEQ ID NO: 2973813 - protein, 25 aa, Entamoeba invadens
VKKYTRKSVGYSMWLFSAIENLVSV

SEQ ID NO: 2973814 - protein, 22 aa, Entamoeba invadens
VKLCGCGLLFKHYGNEIVKNVL

SEQ ID NO: 2973815 - protein, 18 aa, Entamoeba invadens
VKLCKVCQSERRIIEIDH

SEQ ID NO: 2973816 - protein, 17 aa, Entamoeba invadens
VKLDLGLNIHDFSLKNV

SEQ ID NO: 2973817 - protein, 25 aa, Entamoeba invadens
VKLEEFYPSILFHVVMKKKLGEVKE

SEQ ID NO: 2973818 - protein, 24 aa, Entamoeba invadens
VKLENIKKAFGIYLICDGHGGDLC

SEQ ID NO: 2973819 - protein, 17 aa, Entamoeba invadens
VKLESVQTALLFDKGVI

SEQ ID NO: 2973820 - protein, 17 aa, Entamoeba invadens
VKLFFLTNEKLQPVLEG

SEQ ID NO: 2973821 - protein, 23 aa, Entamoeba invadens
VKLGDALILRFAIPSRIMTKEDL

SEQ ID NO: 2973822 - protein, 17 aa, Entamoeba invadens
VKLGDAMILRFAIPSRK

SEQ ID NO: 2973823 - protein, 18 aa, Entamoeba invadens
VKLGDFGLARVFRSEAKH

SEQ ID NO: 2973824 - protein, 19 aa, Entamoeba invadens
VKLGDSFRNESFLLSVRTC

SEQ ID NO: 2973825 - protein, 18 aa, Entamoeba invadens
VKLICDQLSFGMVRAQTL

SEQ ID NO: 2973826 - protein, 17 aa, Entamoeba invadens
VKLIDFGLVTRVESKPH

SEQ ID NO: 2973827 - protein, 29 aa, Entamoeba invadens
VKLIKSYAFSCCLHLKCVKNMNQSTVVQR

SEQ ID NO: 2973828 - protein, 20 aa, Entamoeba invadens
VKLINCINCNIEMLEAKKIL

SEQ ID NO: 2973829 - protein, 27 aa, Entamoeba invadens
VKLIRAFEPLFNFCLLSQNTPKNIFDF

SEQ ID NO: 2973830 - protein, 20 aa, Entamoeba invadens
VKLKALVLNKSFISCLNSVD

SEQ ID NO: 2973831 - protein, 17 aa, Entamoeba invadens
VKLKGKIEFNKITEIGE

SEQ ID NO: 2973832 - protein, 18 aa, Entamoeba invadens
VKLLCFNLLLKMANNNSD

SEQ ID NO: 2973833 - protein, 25 aa, Entamoeba invadens
VKLLKGKEVFPVFLDSKGVVMSLPP

SEQ ID NO: 2973834 - protein, 22 aa, Entamoeba invadens
VKLPEIKRVVVLYKVDNWYANS

SEQ ID NO: 2973835 - protein, 28 aa, Entamoeba invadens
VKLPLDYRLSKLVFFGLYFGIFTECAKA

SEQ ID NO: 2973836 - protein, 19 aa, Entamoeba invadens
VKLQQAISVLQKIKHPNLS

SEQ ID NO: 2973837 - protein, 24 aa, Entamoeba invadens
VKLQYPLMKCVLEPLVKDLVIKFD

SEQ ID NO: 2973838 - protein, 18 aa, Entamoeba invadens
VKLTLAPIAPEWKATLKS

SEQ ID NO: 2973839 - protein, 22 aa, Entamoeba invadens
VKLWLCKMKEKVERGTDEVSVN

SEQ ID NO: 2973840 - protein, 18 aa, Entamoeba invadens
VKMDNEWVKAFYKQEDPS

SEQ ID NO: 2973841 - protein, 19 aa, Entamoeba invadens
VKMEFPSFRKWESFGNFVS

SEQ ID NO: 2973842 - protein, 23 aa, Entamoeba invadens
VKMEVPCCRNTNNLWSPRKLVIY

SEQ ID NO: 2973843 - protein, 17 aa, Entamoeba invadens
VKMFIVSNFNYVVALSI

SEQ ID NO: 2973844 - protein, 18 aa, Entamoeba invadens
VKMGDGFIIVYSIIEQQS

SEQ ID NO: 2973845 - protein, 23 aa, Entamoeba invadens
VKMGDMCFFECSKLKNVVLPQTT

SEQ ID NO: 2973846 - protein, 24 aa, Entamoeba invadens
VKMKECDKSVWPKLIEFEERNQCH

SEQ ID NO: 2973847 - protein, 18 aa, Entamoeba invadens
VKMKEERENLVTQIEDER

SEQ ID NO: 2973848 - protein, 17 aa, Entamoeba invadens
VKMKIGYDTKAHTQLDH

SEQ ID NO: 2973849 - protein, 18 aa, Entamoeba invadens
VKMKTWIKLEEFDVLQLP

SEQ ID NO: 2973850 - protein, 17 aa, Entamoeba invadens
VKMLFDIGMKSDDYLIG

SEQ ID NO: 2973851 - protein, 19 aa, Entamoeba invadens
VKMLPVKVSMGMDTIKNVL

SEQ ID NO: 2973852 - protein, 23 aa, Entamoeba invadens
VKMLRIGFNIVNSISKYSAYGLG

SEQ ID NO: 2973853 - protein, 26 aa, Entamoeba invadens
VKMMRELHPVFPILARYVYTIGELDK

SEQ ID NO: 2973854 - protein, 18 aa, Entamoeba invadens
VKMMYCVPENRKFYLEMF

SEQ ID NO: 2973855 - protein, 25 aa, Entamoeba invadens
VKMPELFTSVASFTIVRFVNGMVDA

SEQ ID NO: 2973856 - protein, 18 aa, Entamoeba invadens
VKMPLTIANRDWVNMRSW

SEQ ID NO: 2973857 - protein, 24 aa, Entamoeba invadens
VKNCTFRHSGLMGISFSGNYSTIT

SEQ ID NO: 2973858 - protein, 25 aa, Entamoeba invadens
VKNDFDCLLSFTVIDSIQSFPLTSH

SEQ ID NO: 2973859 - protein, 18 aa, Entamoeba invadens
VKNDVIPVPPFIMKEKYI

SEQ ID NO: 2973860 - protein, 19 aa, Entamoeba invadens
VKNECYVHDSIIPMKKGTK

SEQ ID NO: 2973861 - protein, 23 aa, Entamoeba invadens
VKNEISVPFNLRISDGAFQNKIE

SEQ ID NO: 2973862 - protein, 23 aa, Entamoeba invadens
VKNFFYEIVVWFSVDYETVDKNN

SEQ ID NO: 2973863 - protein, 29 aa, Entamoeba invadens
VKNGQRVYALLWRKYHGVEQICDEHKVPV

SEQ ID NO: 2973864 - protein, 25 aa, Entamoeba invadens
VKNIIWKKVEFRDSFYYTVNGLSYI

SEQ ID NO: 2973865 - protein, 29 aa, Entamoeba invadens
VKNKEIRLFADLFYALSIPLPKSEIDNFK

SEQ ID NO: 2973866 - protein, 22 aa, Entamoeba invadens
VKNKWLNVVKYVMELYIQDESV

SEQ ID NO: 2973867 - protein, 19 aa, Entamoeba invadens
VKNLGECFVYFNDDFILNR

SEQ ID NO: 2973868 - protein, 25 aa, Entamoeba invadens
VKNLLGVLMNVCFEEEWITKVFDKD

SEQ ID NO: 2973869 - protein, 18 aa, Entamoeba invadens
VKNLRELDDVAPYLKDLT

SEQ ID NO: 2973870 - protein, 26 aa, Entamoeba invadens
VKNLSGSTPLHWAVRSTPEIVDMLLK

SEQ ID NO: 2973871 - protein, 18 aa, Entamoeba invadens
VKNRDILKEIGLRKKEGQ

SEQ ID NO: 2973872 - protein, 23 aa, Entamoeba invadens
VKNRLREAVQWPLKYKDQLDLFK

SEQ ID NO: 2973873 - protein, 17 aa, Entamoeba invadens
VKNRYFGHIKRLGISEL

SEQ ID NO: 2973874 - protein, 19 aa, Entamoeba invadens
VKNVELCINKDCAKNVTCT

SEQ ID NO: 2973875 - protein, 18 aa, Entamoeba invadens
VKNVPLPALGRVSEELRK

SEQ ID NO: 2973876 - protein, 19 aa, Entamoeba invadens
VKNVYPVPFVLLFNPEEFR

SEQ ID NO: 2973877 - protein, 25 aa, Entamoeba invadens
VKNYVWKYKGGHSILVNQLCSELEN

SEQ ID NO: 2973878 - protein, 25 aa, Entamoeba invadens
VKPFLFNNVHALTIFVKSNFAGTKV

SEQ ID NO: 2973879 - protein, 24 aa, Entamoeba invadens
VKPFPPFLEDKWYTHGFEFKNMLL

SEQ ID NO: 2973880 - protein, 18 aa, Entamoeba invadens
VKPGHAKFAVKITHESGT

SEQ ID NO: 2973881 - protein, 25 aa, Entamoeba invadens
VKPGRFYVRCGALTEIGRKMNKPRF

SEQ ID NO: 2973882 - protein, 17 aa, Entamoeba invadens
VKPIRMGFESIMDKTMV

SEQ ID NO: 2973883 - protein, 17 aa, Entamoeba invadens
VKPIVMYWALRVTGVLL

SEQ ID NO: 2973884 - protein, 25 aa, Entamoeba invadens
VKPPLSSAVLAEFVGGGPLSMTFDY

SEQ ID NO: 2973885 - protein, 20 aa, Entamoeba invadens
VKPSETLMGYMLSPRNFVSE

SEQ ID NO: 2973886 - protein, 17 aa, Entamoeba invadens
VKPSIVVTMMRMLPNLP

SEQ ID NO: 2973887 - protein, 26 aa, Entamoeba invadens
VKPTSIFKICYGFRKNQYHVFEGKIT

SEQ ID NO: 2973888 - protein, 25 aa, Entamoeba invadens
VKPYRKEYTEGIAHIKTQTLARKNG

SEQ ID NO: 2973889 - protein, 24 aa, Entamoeba invadens
VKQCSVEAFDIFVAFLKMYRTMNH

SEQ ID NO: 2973890 - protein, 28 aa, Entamoeba invadens
VKQESFVFGSVWFFFEVMTRIVVSILDA

SEQ ID NO: 2973891 - protein, 21 aa, Entamoeba invadens
VKQGGVVQLVCDIDNKDLLIE

SEQ ID NO: 2973892 - protein, 18 aa, Entamoeba invadens
VKQKWLKEANWFVQNSLI

SEQ ID NO: 2973893 - protein, 25 aa, Entamoeba invadens
VKQLKLINFNGCFITPINLHLEKLE

SEQ ID NO: 2973894 - protein, 24 aa, Entamoeba invadens
VKQLLPRMQVEWRNIVQFVTRESG

SEQ ID NO: 2973895 - protein, 25 aa, Entamoeba invadens
VKQLNLRKLIGFPFTMKSLGAPEWF

SEQ ID NO: 2973896 - protein, 26 aa, Entamoeba invadens
VKQLSLPESLLFIGKGCFESCSSLCE

SEQ ID NO: 2973897 - protein, 36 aa, Entamoeba invadens
VKQQTYRWFVCLFSREFHYHMTFAIWDNFIVRNGFT

SEQ ID NO: 2973898 - protein, 24 aa, Entamoeba invadens
VKQTIERICYIFAMEHETLSYQQG

SEQ ID NO: 2973899 - protein, 18 aa, Entamoeba invadens
VKRADALGEFAATFTGTP

SEQ ID NO: 2973900 - protein, 19 aa, Entamoeba invadens
VKRCRNLTIYLCGETKVEQ

SEQ ID NO: 2973901 - protein, 25 aa, Entamoeba invadens
VKRDACSSLNLPVQITTGILSNLEV

SEQ ID NO: 2973902 - protein, 18 aa, Entamoeba invadens
VKREHLFDGKKFFVSREY

SEQ ID NO: 2973903 - protein, 20 aa, Entamoeba invadens
VKREKVLAGADVAFCVEGVK

SEQ ID NO: 2973904 - protein, 20 aa, Entamoeba invadens
VKRETPIIANKAFVFSLVNR

SEQ ID NO: 2973905 - protein, 26 aa, Entamoeba invadens
VKRFGRCELTKKFALNYANIPDEKHL

SEQ ID NO: 2973906 - protein, 22 aa, Entamoeba invadens
VKRIDWGEIAIIGGITIASIGI

SEQ ID NO: 2973907 - protein, 21 aa, Entamoeba invadens
VKRIREMYSMTEIRKDMNRME

SEQ ID NO: 2973908 - protein, 23 aa, Entamoeba invadens
VKRKKKGKSVCIWANNCRAYSFT

SEQ ID NO: 2973909 - protein, 19 aa, Entamoeba invadens
VKRLILHPIPFDTKRDLIT

SEQ ID NO: 2973910 - protein, 17 aa, Entamoeba invadens
VKRLLEWMRTIDDESAQ

SEQ ID NO: 2973911 - protein, 20 aa, Entamoeba invadens
VKRMLHPKIRAQVDKALSLS

SEQ ID NO: 2973912 - protein, 21 aa, Entamoeba invadens
VKRMYYLSIEYLIGRSLMNAI

SEQ ID NO: 2973913 - protein, 17 aa, Entamoeba invadens
VKRSEIASKKCETVNVK

SEQ ID NO: 2973914 - protein, 25 aa, Entamoeba invadens
VKRVFRELFYTYTLSVVINNPETLM

SEQ ID NO: 2973915 - protein, 44 aa, Entamoeba invadens
VKRVGKEWNPSSDLLMVLESLSISFGGSPPVRQSPKGARPATLP

SEQ ID NO: 2973916 - protein, 17 aa, Entamoeba invadens
VKRVILFHANKKVKKVI

SEQ ID NO: 2973917 - protein, 18 aa, Entamoeba invadens
VKRVKGVNKLKLLNASYI

SEQ ID NO: 2973918 - protein, 19 aa, Entamoeba invadens
VKRYFSMPKSRRQSRSSKK

SEQ ID NO: 2973919 - protein, 18 aa, Entamoeba invadens
VKSAEGMMKDVEEKWRNG

SEQ ID NO: 2973920 - protein, 18 aa, Entamoeba invadens
VKSAIPFFSAIQNAFLSK

SEQ ID NO: 2973921 - protein, 21 aa, Entamoeba invadens
VKSCNNLRSIALPKNLKKIFV

SEQ ID NO: 2973922 - protein, 24 aa, Entamoeba invadens
VKSDHASIKFPALGFEIPSTAQAS

SEQ ID NO: 2973923 - protein, 24 aa, Entamoeba invadens
VKSDLYSVGVMFFKMVTGRFPKQN

SEQ ID NO: 2973924 - protein, 25 aa, Entamoeba invadens
VKSDLYSVGVMIYKMVTGVFPKMNF

SEQ ID NO: 2973925 - protein, 19 aa, Entamoeba invadens
VKSEFLMLKTQCFKQKIEG

SEQ ID NO: 2973926 - protein, 17 aa, Entamoeba invadens
VKSEPGNRVYVVTFESD

SEQ ID NO: 2973927 - protein, 25 aa, Entamoeba invadens
VKSFAMCCLLNYFLMLRDRHADNYL

SEQ ID NO: 2973928 - protein, 23 aa, Entamoeba invadens
VKSFFPELRFINLENNRISNFNV

SEQ ID NO: 2973929 - protein, 22 aa, Entamoeba invadens
VKSGVALYRYEPRFPRHYIQPH

SEQ ID NO: 2973930 - protein, 22 aa, Entamoeba invadens
VKSIGQGCFDYCGSLSSVTIPS

SEQ ID NO: 2973931 - protein, 26 aa, Entamoeba invadens
VKSIGRCCFCKCISLSSVTIPSSVNS

SEQ ID NO: 2973932 - protein, 26 aa, Entamoeba invadens
VKSIHPMLVLVGKYSLPYIMLHHTGV

SEQ ID NO: 2973933 - protein, 25 aa, Entamoeba invadens
VKSIPDAKMALRIQIVNKMKSYCNG

SEQ ID NO: 2973934 - protein, 17 aa, Entamoeba invadens
VKSISDFCFNQCSNLSS

SEQ ID NO: 2973935 - protein, 18 aa, Entamoeba invadens
VKSKGIVFKDIFVNQKLK

SEQ ID NO: 2973936 - protein, 24 aa, Entamoeba invadens
VKSLRATCKQLWSLIHNLCSTEES

SEQ ID NO: 2973937 - protein, 17 aa, Entamoeba invadens
VKSMGWTSNYMVMVMTV

SEQ ID NO: 2973938 - protein, 19 aa, Entamoeba invadens
VKSMSEYYCDLFNSETIDV

SEQ ID NO: 2973939 - protein, 21 aa, Entamoeba invadens
VKSQIRRYICDILLLDERFGE

SEQ ID NO: 2973940 - protein, 23 aa, Entamoeba invadens
VKSQLPVVESFGFTTDILGQTSG

SEQ ID NO: 2973941 - protein, 17 aa, Entamoeba invadens
VKSQYQLYLGWYDNNPA

SEQ ID NO: 2973942 - protein, 27 aa, Entamoeba invadens
VKSSLFVTKLFKILGFQKEEREHIQLI

SEQ ID NO: 2973943 - protein, 18 aa, Entamoeba invadens
VKSTALKVCKSILDAKLV

SEQ ID NO: 2973944 - protein, 19 aa, Entamoeba invadens
VKSTIPLSVIQNSKNVLFC

SEQ ID NO: 2973945 - protein, 17 aa, Entamoeba invadens
VKSVKRGIAKKGTLIGY

SEQ ID NO: 2973946 - protein, 18 aa, Entamoeba invadens
VKSVLGFVKKSVAGVENV

SEQ ID NO: 2973947 - protein, 23 aa, Entamoeba invadens
VKSYIRVVSKFGLEENLVLYENY

SEQ ID NO: 2973948 - protein, 19 aa, Entamoeba invadens
VKTAERFYTQHNFFGLCAI

SEQ ID NO: 2973949 - protein, 20 aa, Entamoeba invadens
VKTEAGKLCFVEKGNETFKI

SEQ ID NO: 2973950 - protein, 24 aa, Entamoeba invadens
VKTEQAFTFALELLKNVSQLDERL

SEQ ID NO: 2973951 - protein, 23 aa, Entamoeba invadens
VKTESGLNLAQEWNIHFFESSAK

SEQ ID NO: 2973952 - protein, 24 aa, Entamoeba invadens
VKTHRRIINLLKAKYPDEILLQTD

SEQ ID NO: 2973953 - protein, 26 aa, Entamoeba invadens
VKTIPFESRMAMLAYRKEREMREMIE

SEQ ID NO: 2973954 - protein, 20 aa, Entamoeba invadens
VKTKLKVVLHKKIYAKRVID

SEQ ID NO: 2973955 - protein, 25 aa, Entamoeba invadens
VKTLKIKIGEFWGRSTAKNLTKWIT

SEQ ID NO: 2973956 - protein, 24 aa, Entamoeba invadens
VKTLKIKIGEFWRRSTAKNLTKWI

SEQ ID NO: 2973957 - protein, 22 aa, Entamoeba invadens
VKTLNPERWVPMYQRKRANKKN

SEQ ID NO: 2973958 - protein, 17 aa, Entamoeba invadens
VKTLPQRCFAECPNLKV

SEQ ID NO: 2973959 - protein, 18 aa, Entamoeba invadens
VKTLPQRCFAECPNLKVV

SEQ ID NO: 2973960 - protein, 17 aa, Entamoeba invadens
VKTLRILFSSMINTSDN

SEQ ID NO: 2973961 - protein, 28 aa, Entamoeba invadens
VKTLYCHASENLISLQFENGIQLESVIL

SEQ ID NO: 2973962 - protein, 17 aa, Entamoeba invadens
VKTLYCHSSETLISLQF

SEQ ID NO: 2973963 - protein, 23 aa, Entamoeba invadens
VKTNLFMQCCKGIQWLHNGMNIV

SEQ ID NO: 2973964 - protein, 18 aa, Entamoeba invadens
VKTNWKKYLNIMIEHLSL

SEQ ID NO: 2973965 - protein, 19 aa, Entamoeba invadens
VKTPCLINFEVPVWAKGVA

SEQ ID NO: 2973966 - protein, 18 aa, Entamoeba invadens
VKTPLMFINCDGSEYIGN

SEQ ID NO: 2973967 - protein, 26 aa, Entamoeba invadens
VKTRFLSLECVFRWVYNNYDNITIFL

SEQ ID NO: 2973968 - protein, 31 aa, Entamoeba invadens
VKTRNPIVISVGWRRYQTVATFSSEDLNGKQ

SEQ ID NO: 2973969 - protein, 20 aa, Entamoeba invadens
VKTSNFFRVMKRREEFRYML

SEQ ID NO: 2973970 - protein, 19 aa, Entamoeba invadens
VKTTRLVIMILQALKQLKP

SEQ ID NO: 2973971 - protein, 23 aa, Entamoeba invadens
VKTWKISHSPVIGASRPTSGNIV

SEQ ID NO: 2973972 - protein, 19 aa, Entamoeba invadens
VKTYCPLCIPEIDVNVSNE

SEQ ID NO: 2973973 - protein, 24 aa, Entamoeba invadens
VKTYMIASMLLNVIFMNPTSRYVF

SEQ ID NO: 2973974 - protein, 26 aa, Entamoeba invadens
VKVASCALLDSFYRLYFSWRPTAQKY

SEQ ID NO: 2973975 - protein, 17 aa, Entamoeba invadens
VKVCDFGFAVKVTKKKG

SEQ ID NO: 2973976 - protein, 23 aa, Entamoeba invadens
VKVESSEKFFLYGYNNNTENPIY

SEQ ID NO: 2973977 - protein, 17 aa, Entamoeba invadens
VKVGCRVVDRTITRKSE

SEQ ID NO: 2973978 - protein, 20 aa, Entamoeba invadens
VKVHSLLFARNVQEILEEFR

SEQ ID NO: 2973979 - protein, 17 aa, Entamoeba invadens
VKVINCDGVELEWSQKV

SEQ ID NO: 2973980 - protein, 22 aa, Entamoeba invadens
VKVKSRYSSAVSDKVNNIRKAR

SEQ ID NO: 2973981 - protein, 17 aa, Entamoeba invadens
VKVLMVVDLVGFDGKEV

SEQ ID NO: 2973982 - protein, 17 aa, Entamoeba invadens
VKVLPKYFAFIQENPQT

SEQ ID NO: 2973983 - protein, 25 aa, Entamoeba invadens
VKVLSDWLQKSCLSFAVAYQRVLEV

SEQ ID NO: 2973984 - protein, 24 aa, Entamoeba invadens
VKVMKRADFNLEMAQMQFQYGMQL

SEQ ID NO: 2973985 - protein, 20 aa, Entamoeba invadens
VKVMQRKVCDYVMNGEIVKA

SEQ ID NO: 2973986 - protein, 17 aa, Entamoeba invadens
VKVPCLLINGVMNDGFV

SEQ ID NO: 2973987 - protein, 17 aa, Entamoeba invadens
VKVPLHVGWSKMKEEVN

SEQ ID NO: 2973988 - protein, 18 aa, Entamoeba invadens
VKVPLYYLSNINLLNNPI

SEQ ID NO: 2973989 - protein, 32 aa, Entamoeba invadens
VKVQDDVIRVCFVFEKLFLVSKIKTFQGKVLE

SEQ ID NO: 2973990 - protein, 23 aa, Entamoeba invadens
VKVQEGVCKRCMLQPADPKNQTH

SEQ ID NO: 2973991 - protein, 20 aa, Entamoeba invadens
VKVQTAIQFKRHMKAHFTQI

SEQ ID NO: 2973992 - protein, 19 aa, Entamoeba invadens
VKVRRAELFRCFINEQEKL

SEQ ID NO: 2973993 - protein, 20 aa, Entamoeba invadens
VKVVSLMTCQHTHDFKPFKI

SEQ ID NO: 2973994 - protein, 18 aa, Entamoeba invadens
VKVYRLVSKNTYERYMFE

SEQ ID NO: 2973995 - protein, 19 aa, Entamoeba invadens
VKWMNRYSVLVFDLECINT

SEQ ID NO: 2973996 - protein, 30 aa, Entamoeba invadens
VKWNMKDLTQFYAICFSRDSSILSIRSLRQ

SEQ ID NO: 2973997 - protein, 25 aa, Entamoeba invadens
VKWNTDFHILYFWQGRNCPTLDKGA

SEQ ID NO: 2973998 - protein, 17 aa, Entamoeba invadens
VKWSYCDSTKIATFSDV

SEQ ID NO: 2973999 - protein, 24 aa, Entamoeba invadens
VKYAKSLLCSPTLATSGLSMADIN

SEQ ID NO: 2974000 - protein, 19 aa, Entamoeba invadens
VKYANNWIVICGSRQLEGK

SEQ ID NO: 2974001 - protein, 30 aa, Entamoeba invadens
VKYARMVPFSEKGFKEFGVGVIGIIRTLPK

SEQ ID NO: 2974002 - protein, 27 aa, Entamoeba invadens
VKYEMSVLCPQCLVHGLIHLIDMKQLK

SEQ ID NO: 2974003 - protein, 24 aa, Entamoeba invadens
VKYFDERPVFSFRNSVVGMKRVYK

SEQ ID NO: 2974004 - protein, 20 aa, Entamoeba invadens
VKYGTKCFAHCVSLKDVPVI

SEQ ID NO: 2974005 - protein, 18 aa, Entamoeba invadens
VKYHCSFTPIHSIYKNVI

SEQ ID NO: 2974006 - protein, 17 aa, Entamoeba invadens
VKYIECSALTQKNLRLV

SEQ ID NO: 2974007 - protein, 21 aa, Entamoeba invadens
VKYKNMFCTDFLTKIDNEKSK

SEQ ID NO: 2974008 - protein, 26 aa, Entamoeba invadens
VKYLCNRVGFADALVMGATLQFCADT

SEQ ID NO: 2974009 - protein, 27 aa, Entamoeba invadens
VKYLEKRLKAISARYGGKVDDLNNQKK

SEQ ID NO: 2974010 - protein, 19 aa, Entamoeba invadens
VKYLLKVFPGCNEMTLLGT

SEQ ID NO: 2974011 - protein, 20 aa, Entamoeba invadens
VKYMRKCFDGIRPNLTPNER

SEQ ID NO: 2974012 - protein, 18 aa, Entamoeba invadens
VKYPERIHLLRGNHESRM

SEQ ID NO: 2974013 - protein, 18 aa, Entamoeba invadens
VKYPKRINLLRGNHETRQ

SEQ ID NO: 2974014 - protein, 17 aa, Entamoeba invadens
VKYPLWMLVLLESVGKL

SEQ ID NO: 2974015 - protein, 17 aa, Entamoeba invadens
VKYSEVCFEETKQKIIE

SEQ ID NO: 2974016 - protein, 21 aa, Entamoeba invadens
VKYTPLVPGIHKVEVQVNDEQ

SEQ ID NO: 2974017 - protein, 17 aa, Entamoeba invadens
VKYVEQYGYILTRRPTK

SEQ ID NO: 2974018 - protein, 21 aa, Entamoeba invadens
VKYWVEYTWQMNINQSMPIVE

SEQ ID NO: 2974019 - protein, 24 aa, Entamoeba invadens
VKYYSGKPFATFRSPLRKLGDYFV

SEQ ID NO: 2974020 - protein, 20 aa, Entamoeba invadens
VLAAGYDLYSYIDFKISPHS

SEQ ID NO: 2974021 - protein, 17 aa, Entamoeba invadens
VLADFLVSSGLKLQSIV

SEQ ID NO: 2974022 - protein, 22 aa, Entamoeba invadens
VLADRGIVCVDEFDKMSVEDRA

SEQ ID NO: 2974023 - protein, 19 aa, Entamoeba invadens
VLAEKGIDAINMFSGGINF

SEQ ID NO: 2974024 - protein, 25 aa, Entamoeba invadens
VLAFKGLPGLIPVNIKTSIDLFTRS

SEQ ID NO: 2974025 - protein, 19 aa, Entamoeba invadens
VLALREWCDAVNPVLEFRG

SEQ ID NO: 2974026 - protein, 20 aa, Entamoeba invadens
VLANIDYEMCVKIMKEKSMA

SEQ ID NO: 2974027 - protein, 17 aa, Entamoeba invadens
VLAPIAMFARCGLPTPH

SEQ ID NO: 2974028 - protein, 17 aa, Entamoeba invadens
VLATCSISYFTDEYTRW

SEQ ID NO: 2974029 - protein, 19 aa, Entamoeba invadens
VLAWKELRKTPNGKSVIGE

SEQ ID NO: 2974030 - protein, 17 aa, Entamoeba invadens
VLCFSLVDQTSFDEIET

SEQ ID NO: 2974031 - protein, 17 aa, Entamoeba invadens
VLCKLSDYWNIREITGI

SEQ ID NO: 2974032 - protein, 21 aa, Entamoeba invadens
VLCNSKPIILYVLEQLSSLEG

SEQ ID NO: 2974033 - protein, 20 aa, Entamoeba invadens
VLCSAYCPDTSSLIAVGGEF

SEQ ID NO: 2974034 - protein, 24 aa, Entamoeba invadens
VLCSKESKWLFVFGNSKSKEYGDI

SEQ ID NO: 2974035 - protein, 27 aa, Entamoeba invadens
VLDAVLRYCYLWFNFMPLTRGTAACGM

SEQ ID NO: 2974036 - protein, 19 aa, Entamoeba invadens
VLDDSRFVGEVSVTTQSAL

SEQ ID NO: 2974037 - protein, 27 aa, Entamoeba invadens
VLDEAYCIECIPSDFWQKPGDLSDTVK

SEQ ID NO: 2974038 - protein, 21 aa, Entamoeba invadens
VLDFLKELLVSPISLKLKNRP

SEQ ID NO: 2974039 - protein, 25 aa, Entamoeba invadens
VLDGYTCDKCKTSSKASKRYFVKEL

SEQ ID NO: 2974040 - protein, 17 aa, Entamoeba invadens
VLDICGGGDYERSPLVI

SEQ ID NO: 2974041 - protein, 25 aa, Entamoeba invadens
VLDIIKQRFSVDWEKDTAVFLNSFL

SEQ ID NO: 2974042 - protein, 17 aa, Entamoeba invadens
VLDILGFHFNEYLANYL

SEQ ID NO: 2974043 - protein, 20 aa, Entamoeba invadens
VLDILLKIFFSYQHNCTLIR

SEQ ID NO: 2974044 - protein, 22 aa, Entamoeba invadens
VLDIRGCMMIRSYVLNEGMYRY

SEQ ID NO: 2974045 - protein, 18 aa, Entamoeba invadens
VLDKDFSEHIPIALCGNK

SEQ ID NO: 2974046 - protein, 24 aa, Entamoeba invadens
VLDKDFSEHIPIALCGNKCDLESE

SEQ ID NO: 2974047 - protein, 24 aa, Entamoeba invadens
VLDKDFSEHIPIALCGNKCDLESN

SEQ ID NO: 2974048 - protein, 24 aa, Entamoeba invadens
VLDKEYRGVVPVETIKLFLTQIGS

SEQ ID NO: 2974049 - protein, 28 aa, Entamoeba invadens
VLDKRFKVLTERRLDMDAAHDKFESIAK

SEQ ID NO: 2974050 - protein, 23 aa, Entamoeba invadens
VLDLLFEFDNLFVIKTTNGKNGA

SEQ ID NO: 2974051 - protein, 24 aa, Entamoeba invadens
VLDLLFEFDYLFVIKTTHGKNGAN

SEQ ID NO: 2974052 - protein, 24 aa, Entamoeba invadens
VLDLRWFGHCVAIANLEFLTKLVK

SEQ ID NO: 2974053 - protein, 28 aa, Entamoeba invadens
VLDNSLDCLKRFAHLTLIQNIKFSMACP

SEQ ID NO: 2974054 - protein, 35 aa, Entamoeba invadens
VLDSGDFAFRDEIRFNREAIIAIQLIAEDFIIRLF

SEQ ID NO: 2974055 - protein, 18 aa, Entamoeba invadens
VLDSLLFELKGIKIPPSS

SEQ ID NO: 2974056 - protein, 23 aa, Entamoeba invadens
VLDSLREAVNFTTSFLPKITQEE

SEQ ID NO: 2974057 - protein, 23 aa, Entamoeba invadens
VLDSLRKPLFLTFENEDPVGDPI

SEQ ID NO: 2974058 - protein, 25 aa, Entamoeba invadens
VLDTWFSSGLFPFSVMGWPEKTLDV

SEQ ID NO: 2974059 - protein, 27 aa, Entamoeba invadens
VLDVVKFIKKRCDALTAIMCDEGVKIE

SEQ ID NO: 2974060 - protein, 19 aa, Entamoeba invadens
VLDYLPISIQFYLLKDIKN

SEQ ID NO: 2974061 - protein, 20 aa, Entamoeba invadens
VLEAHWAKYGRNYYQRYDFD

SEQ ID NO: 2974062 - protein, 22 aa, Entamoeba invadens
VLEATKLVFSRIAFKIKDGLVI

SEQ ID NO: 2974063 - protein, 20 aa, Entamoeba invadens
VLEATSLVHSCISHSNRIVN

SEQ ID NO: 2974064 - protein, 28 aa, Entamoeba invadens
VLEELIIKYRKIEMEKMRQKVSFLEIIP

SEQ ID NO: 2974065 - protein, 19 aa, Entamoeba invadens
VLEFRGFVHKGILTAVSQY

SEQ ID NO: 2974066 - protein, 18 aa, Entamoeba invadens
VLEIGGKFKNSAMKMDLP

SEQ ID NO: 2974067 - protein, 24 aa, Entamoeba invadens
VLEIKTKRAEIIKVDFHNLSESVV

SEQ ID NO: 2974068 - protein, 19 aa, Entamoeba invadens
VLEISVKYKACYFTRTEAE

SEQ ID NO: 2974069 - protein, 18 aa, Entamoeba invadens
VLEKDFSEHIPIALCGNK

SEQ ID NO: 2974070 - protein, 25 aa, Entamoeba invadens
VLEKGGKVITSFSVGVFEMEYPLKL

SEQ ID NO: 2974071 - protein, 17 aa, Entamoeba invadens
VLEKKARTVKGFFDLIY

SEQ ID NO: 2974072 - protein, 32 aa, Entamoeba invadens
VLEKRVCLICGKILCPGCSVDHFQKCSMGYGI

SEQ ID NO: 2974073 - protein, 21 aa, Entamoeba invadens
VLELIKRWIETSPEDFEKLDE

SEQ ID NO: 2974074 - protein, 24 aa, Entamoeba invadens
VLELPRPLLTPGYEAVIHIHTCQE

SEQ ID NO: 2974075 - protein, 24 aa, Entamoeba invadens
VLEQCKKCSVAIKVNENVQIDNCE

SEQ ID NO: 2974076 - protein, 19 aa, Entamoeba invadens
VLEQLKLINLQSVVQCMVC

SEQ ID NO: 2974077 - protein, 20 aa, Entamoeba invadens
VLERPVPRAHPIEFKRDDTQ

SEQ ID NO: 2974078 - protein, 33 aa, Entamoeba invadens
VLESIVGRDFLPRGCGMVTKRPLILQLVNLPPT

SEQ ID NO: 2974079 - protein, 22 aa, Entamoeba invadens
VLESPPRPNLVDEHREALKKMF

SEQ ID NO: 2974080 - protein, 23 aa, Entamoeba invadens
VLETKRSFLLYSVINTNGVGKME

SEQ ID NO: 2974081 - protein, 23 aa, Entamoeba invadens
VLETLKPICFADFTVTDIDKNEE

SEQ ID NO: 2974082 - protein, 19 aa, Entamoeba invadens
VLEVGDWKLQNDMIEFKNV

SEQ ID NO: 2974083 - protein, 21 aa, Entamoeba invadens
VLFDKRRLQGVVTSYIRSGQI

SEQ ID NO: 2974084 - protein, 17 aa, Entamoeba invadens
VLFDYASDLPKRTPKAL

SEQ ID NO: 2974085 - protein, 17 aa, Entamoeba invadens
VLFECFDMYSNYLELER

SEQ ID NO: 2974086 - protein, 22 aa, Entamoeba invadens
VLFEKYHAICISIFTDEPSHII

SEQ ID NO: 2974087 - protein, 22 aa, Entamoeba invadens
VLFFTPRFKNIQIYGEEENAKL

SEQ ID NO: 2974088 - protein, 23 aa, Entamoeba invadens
VLFGEGVVLKGEITIKNATGKQV

SEQ ID NO: 2974089 - protein, 26 aa, Entamoeba invadens
VLFGRPNPWDGPVFITRKEEKMNEKK

SEQ ID NO: 2974090 - protein, 30 aa, Entamoeba invadens
VLFKNAEQEFAFFLNPPCQKQIFTGPDMAI

SEQ ID NO: 2974091 - protein, 17 aa, Entamoeba invadens
VLFPLRKFIGSTQDGAL

SEQ ID NO: 2974092 - protein, 26 aa, Entamoeba invadens
VLFSPFKLLSLFAAQLAELNAFLVET

SEQ ID NO: 2974093 - protein, 19 aa, Entamoeba invadens
VLFTFIGSEVQKCFNEICT

SEQ ID NO: 2974094 - protein, 22 aa, Entamoeba invadens
VLGCTLCPDGHFIKNKRCTPCD

SEQ ID NO: 2974095 - protein, 17 aa, Entamoeba invadens
VLGHGSFGQVLKCLDMN

SEQ ID NO: 2974096 - protein, 33 aa, Entamoeba invadens
VLGKKWIEISKCLPGKTPHAVHLRYKNHLKNLK

SEQ ID NO: 2974097 - protein, 33 aa, Entamoeba invadens
VLGKQCFSACHFLKEIKLVEGLCEIRECAFEKC

SEQ ID NO: 2974098 - protein, 22 aa, Entamoeba invadens
VLGMFNYAIKFFGQTVHAGTFP

SEQ ID NO: 2974099 - protein, 18 aa, Entamoeba invadens
VLGTCSFNLSKFYECKDY

SEQ ID NO: 2974100 - protein, 24 aa, Entamoeba invadens
VLHEVLCGILLKAIHLRVKKGVEM

SEQ ID NO: 2974101 - protein, 23 aa, Entamoeba invadens
VLHFIYLPILRLMKQSASPYYLI

SEQ ID NO: 2974102 - protein, 23 aa, Entamoeba invadens
VLHFLKVGGLFVYSTCSLNPIED

SEQ ID NO: 2974103 - protein, 19 aa, Entamoeba invadens
VLHIVKKDLSVEILSVMSQ

SEQ ID NO: 2974104 - protein, 18 aa, Entamoeba invadens
VLHLFRLLVHLENYKALL

SEQ ID NO: 2974105 - protein, 25 aa, Entamoeba invadens
VLHLGSNCFLSCGLSQITVLVKEIP

SEQ ID NO: 2974106 - protein, 21 aa, Entamoeba invadens
VLHPHFTPIVLCFLQNAAKIG

SEQ ID NO: 2974107 - protein, 17 aa, Entamoeba invadens
VLHPTSALFNMGVKPNY

SEQ ID NO: 2974108 - protein, 25 aa, Entamoeba invadens
VLHRSPRNSINFNFEKKNEKEKECG

SEQ ID NO: 2974109 - protein, 25 aa, Entamoeba invadens
VLHSLCIGCDYYAFAHIDGNITVIS

SEQ ID NO: 2974110 - protein, 26 aa, Entamoeba invadens
VLICKKFSCVLDRFRYNPIPVTTTKL

SEQ ID NO: 2974111 - protein, 19 aa, Entamoeba invadens
VLIDKEWIAFGHKFKDRCR

SEQ ID NO: 2974112 - protein, 24 aa, Entamoeba invadens
VLIDLCAAPGGWCQVAQKEMPVDQ

SEQ ID NO: 2974113 - protein, 19 aa, Entamoeba invadens
VLIEMACNCWGFDNTTFEN

SEQ ID NO: 2974114 - protein, 26 aa, Entamoeba invadens
VLIFCLKIKFPDRFFLLRGNHEVGNI

SEQ ID NO: 2974115 - protein, 26 aa, Entamoeba invadens
VLIFCLKIKFPDRFFLLRGNHEVQNL

SEQ ID NO: 2974116 - protein, 24 aa, Entamoeba invadens
VLIFMCQVVSLKMCDCVHLTSNND

SEQ ID NO: 2974117 - protein, 18 aa, Entamoeba invadens
VLIIVDCRFGCLQFNTKI

SEQ ID NO: 2974118 - protein, 24 aa, Entamoeba invadens
VLIQGCAFKKCRFLEKFEFEDGVC

SEQ ID NO: 2974119 - protein, 17 aa, Entamoeba invadens
VLISLGLEEALVFNQTF

SEQ ID NO: 2974120 - protein, 22 aa, Entamoeba invadens
VLISLLSRHCIVEISKPNKKSS

SEQ ID NO: 2974121 - protein, 21 aa, Entamoeba invadens
VLKAAVMKYGKNEWARISSLI

SEQ ID NO: 2974122 - protein, 18 aa, Entamoeba invadens
VLKEKKRIVEILKSNEIM

SEQ ID NO: 2974123 - protein, 21 aa, Entamoeba invadens
VLKKDVDTLLSYNIGTIKITE

SEQ ID NO: 2974124 - protein, 27 aa, Entamoeba invadens
VLKKEFFRIIVWFNVDFEIVDRNKSRN

SEQ ID NO: 2974125 - protein, 26 aa, Entamoeba invadens
VLKKEFFRIIVWFNVDFETVDRNNSR

SEQ ID NO: 2974126 - protein, 26 aa, Entamoeba invadens
VLKKEFYRIIVWFNVDFETVDRNKNR

SEQ ID NO: 2974127 - protein, 26 aa, Entamoeba invadens
VLKKELYRIIVWFNVDFETVDRNKSR

SEQ ID NO: 2974128 - protein, 19 aa, Entamoeba invadens
VLKKKPVVNKIEEKLNVDK

SEQ ID NO: 2974129 - protein, 19 aa, Entamoeba invadens
VLKKMCGDVKTGGAQQVEI

SEQ ID NO: 2974130 - protein, 28 aa, Entamoeba invadens
VLKKQKCGECGFAAKLVGDVSGIVLKVY

SEQ ID NO: 2974131 - protein, 25 aa, Entamoeba invadens
VLKLSDISRKGCDFSMTKISKSDLY

SEQ ID NO: 2974132 - protein, 23 aa, Entamoeba invadens
VLKNGKLKPELFVPLIQSLHQFY

SEQ ID NO: 2974133 - protein, 24 aa, Entamoeba invadens
VLKNKAIILWKALMKHFDEVAEIL

SEQ ID NO: 2974134 - protein, 17 aa, Entamoeba invadens
VLKPMMMKLDMPRNKRD

SEQ ID NO: 2974135 - protein, 24 aa, Entamoeba invadens
VLKREFYQIIVWFNVDFETVDRNI

SEQ ID NO: 2974136 - protein, 21 aa, Entamoeba invadens
VLKRFNKIRSFECYIETVERQ

SEQ ID NO: 2974137 - protein, 22 aa, Entamoeba invadens
VLKSFPVEKPQVVIHNEFEDFQ

SEQ ID NO: 2974138 - protein, 18 aa, Entamoeba invadens
VLKSNFFIVRSVSNNSKH

SEQ ID NO: 2974139 - protein, 18 aa, Entamoeba invadens
VLKTRVFELKQANEELLH

SEQ ID NO: 2974140 - protein, 31 aa, Entamoeba invadens
VLKVVKMKALKRVVSGGAYGDYAALIGKRQV

SEQ ID NO: 2974141 - protein, 20 aa, Entamoeba invadens
VLKYHYICSSLFSDEVSHII

SEQ ID NO: 2974142 - protein, 19 aa, Entamoeba invadens
VLLDKRLSAQVQRHCDDLF

SEQ ID NO: 2974143 - protein, 24 aa, Entamoeba invadens
VLLDKRLSAQVQRRCNDLFVTPPQ

SEQ ID NO: 2974144 - protein, 18 aa, Entamoeba invadens
VLLDPSVGGNEKFHDIMA

SEQ ID NO: 2974145 - protein, 25 aa, Entamoeba invadens
VLLEICFGGAVLWTGRSPMVCHVSN

SEQ ID NO: 2974146 - protein, 17 aa, Entamoeba invadens
VLLGAFKVRSLNFFEYK

SEQ ID NO: 2974147 - protein, 23 aa, Entamoeba invadens
VLLIRRGCLLLSDTFNVLNLNCN

SEQ ID NO: 2974148 - protein, 17 aa, Entamoeba invadens
VLLKGETYIGSKRNCVG

SEQ ID NO: 2974149 - protein, 17 aa, Entamoeba invadens
VLLKSVLITGFSPVISL

SEQ ID NO: 2974150 - protein, 29 aa, Entamoeba invadens
VLLLLEVIEPFEWVHLLITHLPSSMKSIT

SEQ ID NO: 2974151 - protein, 18 aa, Entamoeba invadens
VLLPLTPILVNPIRASLA

SEQ ID NO: 2974152 - protein, 21 aa, Entamoeba invadens
VLLRLLENFDGALFVTSNRPL

SEQ ID NO: 2974153 - protein, 19 aa, Entamoeba invadens
VLLSLAVDVTWGFYETIPI

SEQ ID NO: 2974154 - protein, 30 aa, Entamoeba invadens
VLLSVITLLRFKVVISMDFVINTINGNVPK

SEQ ID NO: 2974155 - protein, 17 aa, Entamoeba invadens
VLLTRSVSPMKHLQAAL

SEQ ID NO: 2974156 - protein, 18 aa, Entamoeba invadens
VLLVFDINNMESFKGMNS

SEQ ID NO: 2974157 - protein, 27 aa, Entamoeba invadens
VLMCDYRKICLWTKMTNFEQIGKSEND

SEQ ID NO: 2974158 - protein, 19 aa, Entamoeba invadens
VLMMSEFFTVGSMPSEYES

SEQ ID NO: 2974159 - protein, 18 aa, Entamoeba invadens
VLMNYPFIANFMIQTMFQ

SEQ ID NO: 2974160 - protein, 19 aa, Entamoeba invadens
VLMRMIDMHTVMPLDFKQQ

SEQ ID NO: 2974161 - protein, 24 aa, Entamoeba invadens
VLMSRTTCLYVCYESRPFSVQRIY

SEQ ID NO: 2974162 - protein, 32 aa, Entamoeba invadens
VLMTFKGKLSYQYVMTAMCFKANDINTFKEFL

SEQ ID NO: 2974163 - protein, 27 aa, Entamoeba invadens
VLNEALFNFLQLCVGDVSVLIRYVQEK

SEQ ID NO: 2974164 - protein, 27 aa, Entamoeba invadens
VLNEPFPDFFIVGGFEEMCYSVNFMGK

SEQ ID NO: 2974165 - protein, 22 aa, Entamoeba invadens
VLNETLKGLVYLHSIKIIHHDI

SEQ ID NO: 2974166 - protein, 20 aa, Entamoeba invadens
VLNEVWRISLLPSVADMDHL

SEQ ID NO: 2974167 - protein, 23 aa, Entamoeba invadens
VLNGYSALIGMVFENMKKKNNYF

SEQ ID NO: 2974168 - protein, 33 aa, Entamoeba invadens
VLNHMRRTPVLYPKDRFALVLFGVDAPSEKMPN

SEQ ID NO: 2974169 - protein, 25 aa, Entamoeba invadens
VLNKIRYGTVDEWCLNKLRERIDQE

SEQ ID NO: 2974170 - protein, 21 aa, Entamoeba invadens
VLNLFKRVRNDTVTLVMSGIQ

SEQ ID NO: 2974171 - protein, 18 aa, Entamoeba invadens
VLNNKSFINFDHFTITSS

SEQ ID NO: 2974172 - protein, 20 aa, Entamoeba invadens
VLNPPIFFLQLFKKRKDNVT

SEQ ID NO: 2974173 - protein, 19 aa, Entamoeba invadens
VLNSMGWKGITNSIPDADV

SEQ ID NO: 2974174 - protein, 29 aa, Entamoeba invadens
VLNTKCYICGGAHPVAFCPKKNEINPMDP

SEQ ID NO: 2974175 - protein, 28 aa, Entamoeba invadens
VLNYKGGPCYKCLYPTMPAASLNATAKT

SEQ ID NO: 2974176 - protein, 19 aa, Entamoeba invadens
VLPAFMFFAKLTFGKTKEC

SEQ ID NO: 2974177 - protein, 29 aa, Entamoeba invadens
VLPETFKIIGKFTFKNCFTLESLTFPQSL

SEQ ID NO: 2974178 - protein, 29 aa, Entamoeba invadens
VLPFNLKTIKAYAFYNCKSLVTLNIPKSV

SEQ ID NO: 2974179 - protein, 18 aa, Entamoeba invadens
VLPFYIKIFESELIEARF

SEQ ID NO: 2974180 - protein, 18 aa, Entamoeba invadens
VLPILQLLCYKFPKDMSE

SEQ ID NO: 2974181 - protein, 17 aa, Entamoeba invadens
VLPKFCVSLGLSKCLCD

SEQ ID NO: 2974182 - protein, 17 aa, Entamoeba invadens
VLPKRVAAVDEVVAQQI

SEQ ID NO: 2974183 - protein, 22 aa, Entamoeba invadens
VLPKSCFEGCDHLQKVHLPDGL

SEQ ID NO: 2974184 - protein, 22 aa, Entamoeba invadens
VLPKSIRSGIVVLNKQDFCVVI

SEQ ID NO: 2974185 - protein, 19 aa, Entamoeba invadens
VLPKSLEKINCRDNQITSL

SEQ ID NO: 2974186 - protein, 23 aa, Entamoeba invadens
VLPKSLQYTGNRAFEKCCSLTKV

SEQ ID NO: 2974187 - protein, 25 aa, Entamoeba invadens
VLPNPSSVFGIAWDPLGIIIVAQCT

SEQ ID NO: 2974188 - protein, 18 aa, Entamoeba invadens
VLPNTLVLHLKRFEFDYE

SEQ ID NO: 2974189 - protein, 19 aa, Entamoeba invadens
VLPPEMGQLEGIIQVLDLS

SEQ ID NO: 2974190 - protein, 20 aa, Entamoeba invadens
VLPSGFTNKRCCGGNSGIAI

SEQ ID NO: 2974191 - protein, 21 aa, Entamoeba invadens
VLPTFPAGGANTYLRYISDED

SEQ ID NO: 2974192 - protein, 19 aa, Entamoeba invadens
VLPVIISPRPMEWIYDRNN

SEQ ID NO: 2974193 - protein, 23 aa, Entamoeba invadens
VLPVKRVEMEIVVTIPENYCKVA

SEQ ID NO: 2974194 - protein, 21 aa, Entamoeba invadens
VLPYRIKVDIYLTEGTHQTEE

SEQ ID NO: 2974195 - protein, 23 aa, Entamoeba invadens
VLQKCKDAFRAKDFDNTVRHFIQ

SEQ ID NO: 2974196 - protein, 18 aa, Entamoeba invadens
VLQKITILEIHRLLAERL

SEQ ID NO: 2974197 - protein, 18 aa, Entamoeba invadens
VLQNFAFTQTHPFILNTF

SEQ ID NO: 2974198 - protein, 19 aa, Entamoeba invadens
VLQSGAIVPGEMCLGGSGS

SEQ ID NO: 2974199 - protein, 25 aa, Entamoeba invadens
VLQVAEPWIQKGIHPTIIISGFLDA

SEQ ID NO: 2974200 - protein, 17 aa, Entamoeba invadens
VLRAVGINPVLKGKKTE

SEQ ID NO: 2974201 - protein, 22 aa, Entamoeba invadens
VLRCFYVQFPLNSVNIETLVST

SEQ ID NO: 2974202 - protein, 21 aa, Entamoeba invadens
VLRCGEQILSPIFSETSTRNF

SEQ ID NO: 2974203 - protein, 17 aa, Entamoeba invadens
VLREATRLLNLLMFNAL

SEQ ID NO: 2974204 - protein, 19 aa, Entamoeba invadens
VLRECMKKDIVIYSVGAEP

SEQ ID NO: 2974205 - protein, 20 aa, Entamoeba invadens
VLRELCEFFYSMIKYNRVRE

SEQ ID NO: 2974206 - protein, 24 aa, Entamoeba invadens
VLRELRLFPKIQILQFRNELQMEE

SEQ ID NO: 2974207 - protein, 19 aa, Entamoeba invadens
VLRERSDIRLVITSATIDE

SEQ ID NO: 2974208 - protein, 20 aa, Entamoeba invadens
VLRFACIHNVMLDSISPFKT

SEQ ID NO: 2974209 - protein, 24 aa, Entamoeba invadens
VLRKGEACEFKLFVEVLCTTKVES

SEQ ID NO: 2974210 - protein, 21 aa, Entamoeba invadens
VLRKRVMKKIDDWKYLTSAHI

SEQ ID NO: 2974211 - protein, 24 aa, Entamoeba invadens
VLSFCQRNKIGIQAILMASQERAT

SEQ ID NO: 2974212 - protein, 24 aa, Entamoeba invadens
VLSFCQRYKIGVQAILMASQERAT

SEQ ID NO: 2974213 - protein, 24 aa, Entamoeba invadens
VLSFCRRYKIGVQAIIMASQERAT

SEQ ID NO: 2974214 - protein, 23 aa, Entamoeba invadens
VLSFCRRYKIGVQAILMAAQERA

SEQ ID NO: 2974215 - protein, 19 aa, Entamoeba invadens
VLSGILPKGEALYDMNLSG

SEQ ID NO: 2974216 - protein, 24 aa, Entamoeba invadens
VLSGPIEALVRWLVNPNIDNNIKF

SEQ ID NO: 2974217 - protein, 25 aa, Entamoeba invadens
VLSIGNECFRNCVLLSNLTLPDIKD

SEQ ID NO: 2974218 - protein, 19 aa, Entamoeba invadens
VLSKYPLTSSHSFVLIPHT

SEQ ID NO: 2974219 - protein, 17 aa, Entamoeba invadens
VLSLLNFDVHKIKFIPV

SEQ ID NO: 2974220 - protein, 27 aa, Entamoeba invadens
VLSMGKGCFFNCCFLETISIPSSVTSI

SEQ ID NO: 2974221 - protein, 29 aa, Entamoeba invadens
VLSNGLVKRTRLLGNAFKVPKAMQMLTFP

SEQ ID NO: 2974222 - protein, 31 aa, Entamoeba invadens
VLSPDRRFLCYSEGDSVVFIESGTLSQIEEV

SEQ ID NO: 2974223 - protein, 21 aa, Entamoeba invadens
VLSPLICFLTSLVNLNMEHNL

SEQ ID NO: 2974224 - protein, 18 aa, Entamoeba invadens
VLSQMSLYFMTNMNTAKA

SEQ ID NO: 2974225 - protein, 17 aa, Entamoeba invadens
VLSRYLLYHCECNSSSL

SEQ ID NO: 2974226 - protein, 26 aa, Entamoeba invadens
VLSVEEIDAMLALLIRDFSQVLVGCK

SEQ ID NO: 2974227 - protein, 24 aa, Entamoeba invadens
VLSVGFSHNLLRIALSALQTNSPS

SEQ ID NO: 2974228 - protein, 22 aa, Entamoeba invadens
VLSVLSEMWKKLGPEEKNKYIE

SEQ ID NO: 2974229 - protein, 19 aa, Entamoeba invadens
VLTEQRYDNVWPLTLYNSG

SEQ ID NO: 2974230 - protein, 19 aa, Entamoeba invadens
VLTHFKFLVELDCQNNPGI

SEQ ID NO: 2974231 - protein, 23 aa, Entamoeba invadens
VLTHPWLCGHSVYTNPYFQPLLI

SEQ ID NO: 2974232 - protein, 24 aa, Entamoeba invadens
VLTHPWLCGNSVYTNPLFTSLLEQ

SEQ ID NO: 2974233 - protein, 29 aa, Entamoeba invadens
VLTHYIVYILRCSPFRVGSYLLVKGVSYR

SEQ ID NO: 2974234 - protein, 24 aa, Entamoeba invadens
VLTIKKCQLSVEPFESFNSLEKLV

SEQ ID NO: 2974235 - protein, 18 aa, Entamoeba invadens
VLTKINFALSKLVTSIGT

SEQ ID NO: 2974236 - protein, 30 aa, Entamoeba invadens
VLTKSFDYCFPRFLVLLFPNELTSTFWQRC

SEQ ID NO: 2974237 - protein, 21 aa, Entamoeba invadens
VLTPIPKRFVENADDDQEVKR

SEQ ID NO: 2974238 - protein, 26 aa, Entamoeba invadens
VLVCKKFACILDRFRYNPIPVTSTRL

SEQ ID NO: 2974239 - protein, 19 aa, Entamoeba invadens
VLVDGHGKFHCPLKPFHFY

SEQ ID NO: 2974240 - protein, 21 aa, Entamoeba invadens
VLVDLLLRFVEKVISIGDESR

SEQ ID NO: 2974241 - protein, 17 aa, Entamoeba invadens
VLVDWSQAFVDTDGSFY

SEQ ID NO: 2974242 - protein, 17 aa, Entamoeba invadens
VLVEAVVIILRDEDFHH

SEQ ID NO: 2974243 - protein, 23 aa, Entamoeba invadens
VLVGEQPLELLFVCNGKDMYGCL

SEQ ID NO: 2974244 - protein, 26 aa, Entamoeba invadens
VLVKMGHCVLCDFGLAIRDQEPYDHT

SEQ ID NO: 2974245 - protein, 23 aa, Entamoeba invadens
VLVKPRICINPESYDTQDDTDSL

SEQ ID NO: 2974246 - protein, 24 aa, Entamoeba invadens
VLVKRRFAPKMKDVLETEDSISHT

SEQ ID NO: 2974247 - protein, 18 aa, Entamoeba invadens
VLVLCPISTFTLKITSMI

SEQ ID NO: 2974248 - protein, 18 aa, Entamoeba invadens
VLVLNKFGILTGISNILS

SEQ ID NO: 2974249 - protein, 19 aa, Entamoeba invadens
VLVSSVVMCLLKKSFQSEI

SEQ ID NO: 2974250 - protein, 26 aa, Entamoeba invadens
VLVTLKTGETFGCYQKCPMSFEQKFS

SEQ ID NO: 2974251 - protein, 19 aa, Entamoeba invadens
VLVVEAFNEFKKCKDLVDV

SEQ ID NO: 2974252 - protein, 19 aa, Entamoeba invadens
VLVVPLIPPEWFHDYINMP

SEQ ID NO: 2974253 - protein, 19 aa, Entamoeba invadens
VLWDVGRQAQNYDLIFRNT

SEQ ID NO: 2974254 - protein, 17 aa, Entamoeba invadens
VLWVFNFDASILASIPI

SEQ ID NO: 2974255 - protein, 19 aa, Entamoeba invadens
VLYCLCLIIQSLPRVCISE

SEQ ID NO: 2974256 - protein, 22 aa, Entamoeba invadens
VLYDRDHYKLALAQLSVAKKLV

SEQ ID NO: 2974257 - protein, 23 aa, Entamoeba invadens
VLYECPKIKRGLPLTKKKDGKTL

SEQ ID NO: 2974258 - protein, 17 aa, Entamoeba invadens
VLYELYATIPFDTTIYT

SEQ ID NO: 2974259 - protein, 18 aa, Entamoeba invadens
VLYLIAINYLKLLKPDLM

SEQ ID NO: 2974260 - protein, 17 aa, Entamoeba invadens
VLYMIVVDCAENHLKLS

SEQ ID NO: 2974261 - protein, 20 aa, Entamoeba invadens
VLYNAGILLFRVASSQASAQ

SEQ ID NO: 2974262 - protein, 26 aa, Entamoeba invadens
VLYTFDSIIIWKWSCEDLDLSDLNCM

SEQ ID NO: 2974263 - protein, 20 aa, Entamoeba invadens
VMALRYGKDILMSGTPETYN

SEQ ID NO: 2974264 - protein, 19 aa, Entamoeba invadens
VMASLKCNYKIVVDEKPDI

SEQ ID NO: 2974265 - protein, 21 aa, Entamoeba invadens
VMCGCATLIEFSKNHVKYNDP

SEQ ID NO: 2974266 - protein, 18 aa, Entamoeba invadens
VMCLKCFNIDMTEGTLNY

SEQ ID NO: 2974267 - protein, 17 aa, Entamoeba invadens
VMCLLKKSFQSEITIEK

SEQ ID NO: 2974268 - protein, 20 aa, Entamoeba invadens
VMDCVRVRRLFDAHTRVDNR

SEQ ID NO: 2974269 - protein, 23 aa, Entamoeba invadens
VMDEIWESGAFELFVNILESTFS

SEQ ID NO: 2974270 - protein, 17 aa, Entamoeba invadens
VMDLKLFECENFKMQSV

SEQ ID NO: 2974271 - protein, 26 aa, Entamoeba invadens
VMDLSLKRIKSFPVNFTPVKMESSGK

SEQ ID NO: 2974272 - protein, 19 aa, Entamoeba invadens
VMEEMSIEDSCIITFNEEC

SEQ ID NO: 2974273 - protein, 21 aa, Entamoeba invadens
VMEILKSVYIVPIDINNIMAV

SEQ ID NO: 2974274 - protein, 19 aa, Entamoeba invadens
VMEKCLKVTGFGASKLTKV

SEQ ID NO: 2974275 - protein, 21 aa, Entamoeba invadens
VMEKDFFGRKVLINAKVTDYR

SEQ ID NO: 2974276 - protein, 22 aa, Entamoeba invadens
VMELCPGGSLAEHIAIAPFSIP

SEQ ID NO: 2974277 - protein, 25 aa, Entamoeba invadens
VMENYCFRDCLALKEFSIPNGVTKV

SEQ ID NO: 2974278 - protein, 25 aa, Entamoeba invadens
VMEPPKKWMYFFLFNDRLVETIPEL

SEQ ID NO: 2974279 - protein, 23 aa, Entamoeba invadens
VMEPVMFYDILLSLEMLKNAFST

SEQ ID NO: 2974280 - protein, 24 aa, Entamoeba invadens
VMEPVMFYDILTSLEILKNAFNTF

SEQ ID NO: 2974281 - protein, 17 aa, Entamoeba invadens
VMERELRNYSAMTVGDV

SEQ ID NO: 2974282 - protein, 24 aa, Entamoeba invadens
VMEVECSCCHKKYHKACYDGSLCE

SEQ ID NO: 2974283 - protein, 22 aa, Entamoeba invadens
VMEYCSFESLDVYWKKNPSLRQ

SEQ ID NO: 2974284 - protein, 19 aa, Entamoeba invadens
VMFKHVFEKKSRGFMEALY

SEQ ID NO: 2974285 - protein, 21 aa, Entamoeba invadens
VMFKPYPIYLLDAEKAPRNNC

SEQ ID NO: 2974286 - protein, 20 aa, Entamoeba invadens
VMFMDVCNCFSAYRLMIEYN

SEQ ID NO: 2974287 - protein, 24 aa, Entamoeba invadens
VMGKKAFYEIIVWFDVDYETVDRN

SEQ ID NO: 2974288 - protein, 19 aa, Entamoeba invadens
VMGKRCFLGCTALSSISVP

SEQ ID NO: 2974289 - protein, 19 aa, Entamoeba invadens
VMGLFSSKSLIWVKSNDHT

SEQ ID NO: 2974290 - protein, 21 aa, Entamoeba invadens
VMGNIPKFELVLTLINRDDES

SEQ ID NO: 2974291 - protein, 20 aa, Entamoeba invadens
VMHSDWWFPFYSKDEAAAQL

SEQ ID NO: 2974292 - protein, 24 aa, Entamoeba invadens
VMHSYSGVCNVVYVKVDSDFLYCG

SEQ ID NO: 2974293 - protein, 18 aa, Entamoeba invadens
VMILKIQIRRSYYELFSL

SEQ ID NO: 2974294 - protein, 18 aa, Entamoeba invadens
VMIRCMRNDITTLTNTMH

SEQ ID NO: 2974295 - protein, 23 aa, Entamoeba invadens
VMIRRLKIDVLKELGKKERERVY

SEQ ID NO: 2974296 - protein, 18 aa, Entamoeba invadens
VMKEIKMFDDAVLMCDYR

SEQ ID NO: 2974297 - protein, 22 aa, Entamoeba invadens
VMKESIIMRFGCYKVLKPNLKD

SEQ ID NO: 2974298 - protein, 19 aa, Entamoeba invadens
VMKEYKLGPNGAIVTSLNL

SEQ ID NO: 2974299 - protein, 24 aa, Entamoeba invadens
VMKFSESVFKVFLDRSDDEEEVIR

SEQ ID NO: 2974300 - protein, 21 aa, Entamoeba invadens
VMKKCMCSRLDISPLSNSKEI

SEQ ID NO: 2974301 - protein, 19 aa, Entamoeba invadens
VMKNLSGTFEHFYKKRFES

SEQ ID NO: 2974302 - protein, 24 aa, Entamoeba invadens
VMKQRGMDGLLVWVNAMLEGSGIQ

SEQ ID NO: 2974303 - protein, 18 aa, Entamoeba invadens
VMKQRSFDEFDMETRRKY

SEQ ID NO: 2974304 - protein, 23 aa, Entamoeba invadens
VMKSESPTLFSYVKQALQEGQLD

SEQ ID NO: 2974305 - protein, 25 aa, Entamoeba invadens
VMKTYKIGVLYGRQGQQSEDEMYRN

SEQ ID NO: 2974306 - protein, 30 aa, Entamoeba invadens
VMKVHKTEGFFPYRIPPRTIYGGQNIDDAL

SEQ ID NO: 2974307 - protein, 19 aa, Entamoeba invadens
VMLDKFRNAYVVHFNGAVF

SEQ ID NO: 2974308 - protein, 18 aa, Entamoeba invadens
VMLEQGIQIFNKEYIEGI

SEQ ID NO: 2974309 - protein, 33 aa, Entamoeba invadens
VMLKKKFACEFSIYLKPKCTCRINNTICIVSKN

SEQ ID NO: 2974310 - protein, 17 aa, Entamoeba invadens
VMLLNGFSHPCFGNKEA

SEQ ID NO: 2974311 - protein, 17 aa, Entamoeba invadens
VMLPSGEACELEILLTL

SEQ ID NO: 2974312 - protein, 25 aa, Entamoeba invadens
VMLQRYRNYVGYSWVADKEEMVFSN

SEQ ID NO: 2974313 - protein, 17 aa, Entamoeba invadens
VMLRPLVILVRYLLHQG

SEQ ID NO: 2974314 - protein, 17 aa, Entamoeba invadens
VMLSDYFEMQKLLLDHF

SEQ ID NO: 2974315 - protein, 31 aa, Entamoeba invadens
VMLTRCQEGFGVKATPYWGYAYQNGQAVFGK

SEQ ID NO: 2974316 - protein, 18 aa, Entamoeba invadens
VMMFNDLNVPFLKIVNPA

SEQ ID NO: 2974317 - protein, 28 aa, Entamoeba invadens
VMMRVVRGRKCVGLPLLFRQYKKETTAD

SEQ ID NO: 2974318 - protein, 18 aa, Entamoeba invadens
VMMWTNMKAGLYGLTVTD

SEQ ID NO: 2974319 - protein, 23 aa, Entamoeba invadens
VMNAEFLLSTTFEKLREVTINVA

SEQ ID NO: 2974320 - protein, 24 aa, Entamoeba invadens
VMNEVMEEIRLLKKLKHKHIVRYI

SEQ ID NO: 2974321 - protein, 24 aa, Entamoeba invadens
VMNFPFMMGQGVWYGSKELKESDT

SEQ ID NO: 2974322 - protein, 25 aa, Entamoeba invadens
VMNKMCTVLIPILKIGRINPQYEEV

SEQ ID NO: 2974323 - protein, 18 aa, Entamoeba invadens
VMNNFAIENNDIVENNDI

SEQ ID NO: 2974324 - protein, 24 aa, Entamoeba invadens
VMNVKAACWMKEMLDAKNIEINEF

SEQ ID NO: 2974325 - protein, 26 aa, Entamoeba invadens
VMPCLKCSRTKIGIYTLNPLDKKSRI

SEQ ID NO: 2974326 - protein, 17 aa, Entamoeba invadens
VMQRMVVGYVMNNEAVS

SEQ ID NO: 2974327 - protein, 26 aa, Entamoeba invadens
VMQTPECLRVYVSSFWDQPLKDSMFV

SEQ ID NO: 2974328 - protein, 25 aa, Entamoeba invadens
VMQWAVKISDTFFYSIRSWTVKEGD

SEQ ID NO: 2974329 - protein, 23 aa, Entamoeba invadens
VMRHPPLLILNGFNKGGEEMKTV

SEQ ID NO: 2974330 - protein, 19 aa, Entamoeba invadens
VMRIVELLLSKGADRLVKN

SEQ ID NO: 2974331 - protein, 26 aa, Entamoeba invadens
VMRPFWRCNFPKTNVVIFVVDSCDKE

SEQ ID NO: 2974332 - protein, 17 aa, Entamoeba invadens
VMRQCLWGVTNIIIADD

SEQ ID NO: 2974333 - protein, 24 aa, Entamoeba invadens
VMRSGYVMCCLIKLSKASHQSDSN

SEQ ID NO: 2974334 - protein, 18 aa, Entamoeba invadens
VMRSLKVMFKKFKDEDTK

SEQ ID NO: 2974335 - protein, 18 aa, Entamoeba invadens
VMSDEMWMKKREQIKPHI

SEQ ID NO: 2974336 - protein, 18 aa, Entamoeba invadens
VMSEVAFENMNVSDLFIK

SEQ ID NO: 2974337 - protein, 24 aa, Entamoeba invadens
VMSEVTVDIMLKIASALTKSNKSS

SEQ ID NO: 2974338 - protein, 18 aa, Entamoeba invadens
VMSKRRGKIISEEQRPGT

SEQ ID NO: 2974339 - protein, 18 aa, Entamoeba invadens
VMSPLDFFGSGNMAMRED

SEQ ID NO: 2974340 - protein, 24 aa, Entamoeba invadens
VMSPNVYPSIDFVGLDVEKMTRTV

SEQ ID NO: 2974341 - protein, 23 aa, Entamoeba invadens
VMTKICGVRVALRRNEKCKRIVF

SEQ ID NO: 2974342 - protein, 18 aa, Entamoeba invadens
VMTKVLMNVASFLLADKE

SEQ ID NO: 2974343 - protein, 21 aa, Entamoeba invadens
VMTKWIKDVRITDPITERNNE

SEQ ID NO: 2974344 - protein, 17 aa, Entamoeba invadens
VMTNALFSLSNFALKNL

SEQ ID NO: 2974345 - protein, 17 aa, Entamoeba invadens
VMVGKCVDNPDLVIRSI

SEQ ID NO: 2974346 - protein, 26 aa, Entamoeba invadens
VMVHCGSRGLGHQVCQDFVDTFLSKN

SEQ ID NO: 2974347 - protein, 25 aa, Entamoeba invadens
VMWIESCTLISLKGYTKTELERVTI

SEQ ID NO: 2974348 - protein, 17 aa, Entamoeba invadens
VMYELFYEKIPFFDHTH

SEQ ID NO: 2974349 - protein, 22 aa, Entamoeba invadens
VMYLLYYFCFSLKDKFSDFIGN

SEQ ID NO: 2974350 - protein, 18 aa, Entamoeba invadens
VMYNKYVEKGIVFPPPIV

SEQ ID NO: 2974351 - protein, 19 aa, Entamoeba invadens
VMYWALRVTGVLLCSTADE

SEQ ID NO: 2974352 - protein, 29 aa, Entamoeba invadens
VNAHDSVVLQLCFTLKVIVEYWQNDYDIT

SEQ ID NO: 2974353 - protein, 18 aa, Entamoeba invadens
VNAISGIISFAGYQLDRP

SEQ ID NO: 2974354 - protein, 19 aa, Entamoeba invadens
VNALGYNYHPQCFVANVNC

SEQ ID NO: 2974355 - protein, 17 aa, Entamoeba invadens
VNALHTFFNSMKKVPVV

SEQ ID NO: 2974356 - protein, 27 aa, Entamoeba invadens
VNAQLLLANCYFKGEGVARDMAQAVNL

SEQ ID NO: 2974357 - protein, 19 aa, Entamoeba invadens
VNAVCWSPHCSTHLCSASS

SEQ ID NO: 2974358 - protein, 21 aa, Entamoeba invadens
VNAYGECDYLARYVESRIQRF

SEQ ID NO: 2974359 - protein, 17 aa, Entamoeba invadens
VNCCPTLNELAMSVLGD

SEQ ID NO: 2974360 - protein, 19 aa, Entamoeba invadens
VNCFDFFNNILLIYSSVSD

SEQ ID NO: 2974361 - protein, 19 aa, Entamoeba invadens
VNCKLKLSNEFNWFDMFNS

SEQ ID NO: 2974362 - protein, 26 aa, Entamoeba invadens
VNCSSELKATILSILVALDRGLEHPK

SEQ ID NO: 2974363 - protein, 17 aa, Entamoeba invadens
VNCTRNFPEKNIVFSVI

SEQ ID NO: 2974364 - protein, 17 aa, Entamoeba invadens
VNDEYCGVVQYFINSLS

SEQ ID NO: 2974365 - protein, 21 aa, Entamoeba invadens
VNDKSRVGAELEYQDVKMKFE

SEQ ID NO: 2974366 - protein, 20 aa, Entamoeba invadens
VNDKVLIRIGENVFISKSEV

SEQ ID NO: 2974367 - protein, 18 aa, Entamoeba invadens
VNDLKILNSFNVFMSFEM

SEQ ID NO: 2974368 - protein, 20 aa, Entamoeba invadens
VNDLLVVYCGLNVMKVISEK

SEQ ID NO: 2974369 - protein, 18 aa, Entamoeba invadens
VNDRSAQDDICWSTDSTH

SEQ ID NO: 2974370 - protein, 19 aa, Entamoeba invadens
VNDVCWSKANPEWIGAAMS

SEQ ID NO: 2974371 - protein, 20 aa, Entamoeba invadens
VNDVKESFDLSRIHNNEINT

SEQ ID NO: 2974372 - protein, 19 aa, Entamoeba invadens
VNDVSWSNVNLEWICTCIE

SEQ ID NO: 2974373 - protein, 24 aa, Entamoeba invadens
VNDWFTCWRKHCVETQKRELPVKE

SEQ ID NO: 2974374 - protein, 22 aa, Entamoeba invadens
VNEATKLPAMQKVVNDFEKQNN

SEQ ID NO: 2974375 - protein, 18 aa, Entamoeba invadens
VNECFDLTKLCFEGTGEV

SEQ ID NO: 2974376 - protein, 21 aa, Entamoeba invadens
VNEFLKKRCIEQKNDDVVHGV

SEQ ID NO: 2974377 - protein, 18 aa, Entamoeba invadens
VNEFLQQWVESVSEQSLE

SEQ ID NO: 2974378 - protein, 24 aa, Entamoeba invadens
VNEGDRWWSYPLFKFYLDDLDITQ

SEQ ID NO: 2974379 - protein, 29 aa, Entamoeba invadens
VNELKDRTIIYLCMDGTFSSCPSDYAQLY

SEQ ID NO: 2974380 - protein, 20 aa, Entamoeba invadens
VNELKIWRETVLDGLGGFAE

SEQ ID NO: 2974381 - protein, 26 aa, Entamoeba invadens
VNELKMAGLEMCVSHFLVYSSASTGL

SEQ ID NO: 2974382 - protein, 21 aa, Entamoeba invadens
VNELKSALVGGVVDVSIDART

SEQ ID NO: 2974383 - protein, 34 aa, Entamoeba invadens
VNEMIKTRCVLQFYIPSFRKLGFGGIKKRITIFM

SEQ ID NO: 2974384 - protein, 18 aa, Entamoeba invadens
VNEMKYAMVWGTSVEHSP

SEQ ID NO: 2974385 - protein, 21 aa, Entamoeba invadens
VNERLLHQMLWFGDYSYYSHR

SEQ ID NO: 2974386 - protein, 20 aa, Entamoeba invadens
VNETKIVFPTTITKLEECTT

SEQ ID NO: 2974387 - protein, 23 aa, Entamoeba invadens
VNETKYIYPYSFLHVFEDENDLK

SEQ ID NO: 2974388 - protein, 17 aa, Entamoeba invadens
VNFAHMFAGLTSVKRID

SEQ ID NO: 2974389 - protein, 25 aa, Entamoeba invadens
VNFAKCRKLSGIVIDVHRMKQVSYK

SEQ ID NO: 2974390 - protein, 19 aa, Entamoeba invadens
VNFDWTVLETIDFICTRFD

SEQ ID NO: 2974391 - protein, 18 aa, Entamoeba invadens
VNFFMKFFEDHKCEGSEN

SEQ ID NO: 2974392 - protein, 18 aa, Entamoeba invadens
VNFFRVVIWYEVDYKTSV

SEQ ID NO: 2974393 - protein, 19 aa, Entamoeba invadens
VNFKCFITGSLYYGVNLLA

SEQ ID NO: 2974394 - protein, 26 aa, Entamoeba invadens
VNFKVKVVDCFDCKRFESLIEKTYAP

SEQ ID NO: 2974395 - protein, 27 aa, Entamoeba invadens
VNFKYNRNPKMRVARLENTEQALKFII

SEQ ID NO: 2974396 - protein, 17 aa, Entamoeba invadens
VNFPCFEQLKQENIKFA

SEQ ID NO: 2974397 - protein, 17 aa, Entamoeba invadens
VNFSDVCYEQFKKLQQL

SEQ ID NO: 2974398 - protein, 21 aa, Entamoeba invadens
VNFVFKITVNFEFEAKCLGNI

SEQ ID NO: 2974399 - protein, 25 aa, Entamoeba invadens
VNFVNDCSLNFDFTATFSVNLPPFC

SEQ ID NO: 2974400 - protein, 18 aa, Entamoeba invadens
VNFVVNFSIPVSYPTKCF

SEQ ID NO: 2974401 - protein, 17 aa, Entamoeba invadens
VNGAMKEDVIKRGFSSL

SEQ ID NO: 2974402 - protein, 23 aa, Entamoeba invadens
VNGECVMPIGILLTNMKEAIVCL

SEQ ID NO: 2974403 - protein, 17 aa, Entamoeba invadens
VNGFFGFERSLYEGISM

SEQ ID NO: 2974404 - protein, 19 aa, Entamoeba invadens
VNGGDGWGGLGNEIDIVGK

SEQ ID NO: 2974405 - protein, 28 aa, Entamoeba invadens
VNGGGEIKFLLGLLFQVFMMFHKSDLLA

SEQ ID NO: 2974406 - protein, 20 aa, Entamoeba invadens
VNGGPGAICRTFLNKDSLEK

SEQ ID NO: 2974407 - protein, 20 aa, Entamoeba invadens
VNGIEVFQLLLALKIRYPKR

SEQ ID NO: 2974408 - protein, 17 aa, Entamoeba invadens
VNGKFDYTKCVFSTCQS

SEQ ID NO: 2974409 - protein, 25 aa, Entamoeba invadens
VNGKTLLYHVCAKGYANVVEMLLTK

SEQ ID NO: 2974410 - protein, 17 aa, Entamoeba invadens
VNGLVVDIGDVFTRVLP

SEQ ID NO: 2974411 - protein, 24 aa, Entamoeba invadens
VNGPMTWPGALSIEDEWGKTYLLP

SEQ ID NO: 2974412 - protein, 24 aa, Entamoeba invadens
VNGTCVICKAPLFDGQSVTVLPCG

SEQ ID NO: 2974413 - protein, 25 aa, Entamoeba invadens
VNGTLRFLLKEIINSEGLEQFVNEN

SEQ ID NO: 2974414 - protein, 20 aa, Entamoeba invadens
VNGTLRINRVIANYRSIGDK

SEQ ID NO: 2974415 - protein, 25 aa, Entamoeba invadens
VNHCSVLNCTFRHGGKRGVYIYGTV

SEQ ID NO: 2974416 - protein, 21 aa, Entamoeba invadens
VNHEVRFGGYVLKDELTGRKR

SEQ ID NO: 2974417 - protein, 32 aa, Entamoeba invadens
VNHKACESISCLKVNPWFTAKEDIEKFCSIHT

SEQ ID NO: 2974418 - protein, 21 aa, Entamoeba invadens
VNHLLAFPPVFTIFLSITIDQ

SEQ ID NO: 2974419 - protein, 17 aa, Entamoeba invadens
VNHLQQFDCEIGDIRSV

SEQ ID NO: 2974420 - protein, 26 aa, Entamoeba invadens
VNHNVNWWNSLWVHLGHYSATSLIIF

SEQ ID NO: 2974421 - protein, 17 aa, Entamoeba invadens
VNHSYWYAYFEASTQGY

SEQ ID NO: 2974422 - protein, 17 aa, Entamoeba invadens
VNIDVPSLITIVNGLRS

SEQ ID NO: 2974423 - protein, 23 aa, Entamoeba invadens
VNIFCPNPFFIRSIDKDGKDTTK

SEQ ID NO: 2974424 - protein, 23 aa, Entamoeba invadens
VNIFSLKWRDAVFTFSVSSIAIL

SEQ ID NO: 2974425 - protein, 17 aa, Entamoeba invadens
VNIGLGLGIESFNLDIY

SEQ ID NO: 2974426 - protein, 26 aa, Entamoeba invadens
VNIKCLRSVYHNVFPQAIPQKMDVGM

SEQ ID NO: 2974427 - protein, 27 aa, Entamoeba invadens
VNITIKNNFIWGCSNGVSYWGSNSVAY

SEQ ID NO: 2974428 - protein, 20 aa, Entamoeba invadens
VNITPHFLISLFSLSKMVRD

SEQ ID NO: 2974429 - protein, 19 aa, Entamoeba invadens
VNKCGHRFCKSCICDSIKE

SEQ ID NO: 2974430 - protein, 27 aa, Entamoeba invadens
VNKCGHRFCKSCIRDSIKEQKTNTRRK

SEQ ID NO: 2974431 - protein, 26 aa, Entamoeba invadens
VNKCGHRFCKSCIRDSIKEQKTNTWR

SEQ ID NO: 2974432 - protein, 24 aa, Entamoeba invadens
VNKEGKWEFFFLFQVIESKSDITK

SEQ ID NO: 2974433 - protein, 18 aa, Entamoeba invadens
VNKKAQDAIRCLKINPRS

SEQ ID NO: 2974434 - protein, 26 aa, Entamoeba invadens
VNKKCDSCLGGLYINPFIDVSVQSFS

SEQ ID NO: 2974435 - protein, 26 aa, Entamoeba invadens
VNKKCFECFQSLFINPLINLEIETFA

SEQ ID NO: 2974436 - protein, 24 aa, Entamoeba invadens
VNKKCKDALEILHINPGFANKLSL

SEQ ID NO: 2974437 - protein, 30 aa, Entamoeba invadens
VNKKCLEATEMLRFFPKMSLKTLQNKNEIV

SEQ ID NO: 2974438 - protein, 22 aa, Entamoeba invadens
VNKKCRIIKGFLKNLEGGDKTK

SEQ ID NO: 2974439 - protein, 25 aa, Entamoeba invadens
VNKKCSSCLNGLYINPFIDVAVQCF

SEQ ID NO: 2974440 - protein, 23 aa, Entamoeba invadens
VNKKIEDCRMVFIGAGSSNTTCL

SEQ ID NO: 2974441 - protein, 25 aa, Entamoeba invadens
VNKKRFYKIVIWYQVDFDTFHNVAK

SEQ ID NO: 2974442 - protein, 24 aa, Entamoeba invadens
VNKLYQAFCFKEVVTVDFVDSIGE

SEQ ID NO: 2974443 - protein, 19 aa, Entamoeba invadens
VNKRAHEAIRCLKVNPRSI

SEQ ID NO: 2974444 - protein, 22 aa, Entamoeba invadens
VNKSIQCLVGIEGEALYLVKAT

SEQ ID NO: 2974445 - protein, 18 aa, Entamoeba invadens
VNKTCCKIDSCDSEEVLV

SEQ ID NO: 2974446 - protein, 25 aa, Entamoeba invadens
VNKTVKFCRFEKGWFGNMKCLYNHN

SEQ ID NO: 2974447 - protein, 27 aa, Entamoeba invadens
VNLEIKRNSSYVFVKILSPISNFKISP

SEQ ID NO: 2974448 - protein, 17 aa, Entamoeba invadens
VNLFKMYMRGVTDALLN

SEQ ID NO: 2974449 - protein, 17 aa, Entamoeba invadens
VNLGNILTLTKLVLRMN

SEQ ID NO: 2974450 - protein, 23 aa, Entamoeba invadens
VNLGRVKRMFVSLKEASRLLHEA

SEQ ID NO: 2974451 - protein, 22 aa, Entamoeba invadens
VNLHKWAPYIKSGEGFGTEDEK

SEQ ID NO: 2974452 - protein, 42 aa, Entamoeba invadens
VNLKGMLDYCLNNCYWNCPICEKPCYFSMITIDQHLKTLIQL

SEQ ID NO: 2974453 - protein, 17 aa, Entamoeba invadens
VNLKRFQYLSGTFGKFY

SEQ ID NO: 2974454 - protein, 23 aa, Entamoeba invadens
VNLKTLQIFKVITKYIPSNGNHP

SEQ ID NO: 2974455 - protein, 20 aa, Entamoeba invadens
VNLLPRKILFFEANTSAVFL

SEQ ID NO: 2974456 - protein, 17 aa, Entamoeba invadens
VNLPFVTRVDKKCFANC

SEQ ID NO: 2974457 - protein, 17 aa, Entamoeba invadens
VNLPSGKSMICQHIDNM

SEQ ID NO: 2974458 - protein, 20 aa, Entamoeba invadens
VNLRPVFQIQGIWLSLQNLI

SEQ ID NO: 2974459 - protein, 17 aa, Entamoeba invadens
VNLSEFYCGVDIDDDVE

SEQ ID NO: 2974460 - protein, 22 aa, Entamoeba invadens
VNLYFRCEGLNLLTFTSEAQVT

SEQ ID NO: 2974461 - protein, 30 aa, Entamoeba invadens
VNMEHLKYLTLRLCRGVTFSSEMKCLKQIV

SEQ ID NO: 2974462 - protein, 20 aa, Entamoeba invadens
VNMNQQWKALVFLYVKEDQV

SEQ ID NO: 2974463 - protein, 23 aa, Entamoeba invadens
VNNEIPSPIPLASVDLHESKDED

SEQ ID NO: 2974464 - protein, 22 aa, Entamoeba invadens
VNNLCSVPSWVNYSQIDKGNLL

SEQ ID NO: 2974465 - protein, 35 aa, Entamoeba invadens
VNNLSMTLLWVFFLRQACLKNWPNSPLNIFERDGF

SEQ ID NO: 2974466 - protein, 21 aa, Entamoeba invadens
VNNLVKMYSFETIEVNQNSSA

SEQ ID NO: 2974467 - protein, 17 aa, Entamoeba invadens
VNPAVSVSNVFSSSPLH

SEQ ID NO: 2974468 - protein, 17 aa, Entamoeba invadens
VNPEFYEETSFMWFVSK

SEQ ID NO: 2974469 - protein, 25 aa, Entamoeba invadens
VNPFFTNEVSVVWFFKNFTPETFDS

SEQ ID NO: 2974470 - protein, 18 aa, Entamoeba invadens
VNPFPPFMTSAYFKHEPA

SEQ ID NO: 2974471 - protein, 20 aa, Entamoeba invadens
VNPIICFYGGEPLLRPDIIY

SEQ ID NO: 2974472 - protein, 24 aa, Entamoeba invadens
VNPILDARVPFRVETGRYLDDENV

SEQ ID NO: 2974473 - protein, 23 aa, Entamoeba invadens
VNPKELFSAFNVMLSGNVSLLES

SEQ ID NO: 2974474 - protein, 25 aa, Entamoeba invadens
VNPKGLRVVNKYFPTIFASSNTGLT

SEQ ID NO: 2974475 - protein, 19 aa, Entamoeba invadens
VNPLPVLKCTVRAEIGNAT

SEQ ID NO: 2974476 - protein, 29 aa, Entamoeba invadens
VNPMKRPTVRECLLFPFFSGKKRERGDFY

SEQ ID NO: 2974477 - protein, 30 aa, Entamoeba invadens
VNPQIRLPRTYKRFDGLMVQLLHKLSIHAS

SEQ ID NO: 2974478 - protein, 21 aa, Entamoeba invadens
VNPRSIYLGYNFLFNFFPHLN

SEQ ID NO: 2974479 - protein, 23 aa, Entamoeba invadens
VNPSGRLPLSFPENLANIPSHSF

SEQ ID NO: 2974480 - protein, 23 aa, Entamoeba invadens
VNPSGRLPMTFVKDLKSVSGYSF

SEQ ID NO: 2974481 - protein, 24 aa, Entamoeba invadens
VNPSLKFYACDIAQSAVEVVKKDE

SEQ ID NO: 2974482 - protein, 26 aa, Entamoeba invadens
VNPSSFKCVYSFREIRNYQSEQECVL

SEQ ID NO: 2974483 - protein, 17 aa, Entamoeba invadens
VNPWLTSTLDVEKFYDF

SEQ ID NO: 2974484 - protein, 25 aa, Entamoeba invadens
VNQEYLHVISVRFLQNCIGSCSEQN

SEQ ID NO: 2974485 - protein, 22 aa, Entamoeba invadens
VNQLSVILLQFVDATIEMSIQK

SEQ ID NO: 2974486 - protein, 20 aa, Entamoeba invadens
VNQRLKAAQLIRSLVTTDNY

SEQ ID NO: 2974487 - protein, 18 aa, Entamoeba invadens
VNQVCPVCDIYMNGGDYM

SEQ ID NO: 2974488 - protein, 21 aa, Entamoeba invadens
VNQVMRFQTMLSYLFPNEIFS

SEQ ID NO: 2974489 - protein, 17 aa, Entamoeba invadens
VNQVRNGLVDSFVHVYE

SEQ ID NO: 2974490 - protein, 22 aa, Entamoeba invadens
VNRAAFPESWRGLENEELENAV

SEQ ID NO: 2974491 - protein, 19 aa, Entamoeba invadens
VNRADGKAIRANKNEEEEM

SEQ ID NO: 2974492 - protein, 17 aa, Entamoeba invadens
VNRCIKKGGKNMQMTLK

SEQ ID NO: 2974493 - protein, 17 aa, Entamoeba invadens
VNRCVLIPMVEHVSHPV

SEQ ID NO: 2974494 - protein, 17 aa, Entamoeba invadens
VNRFLKYPKIFENLLGA

SEQ ID NO: 2974495 - protein, 24 aa, Entamoeba invadens
VNRLAAQHWEFFKIEVRSQHPEFL

SEQ ID NO: 2974496 - protein, 23 aa, Entamoeba invadens
VNRLGEKMVLGYDDLVMRVCDSV

SEQ ID NO: 2974497 - protein, 27 aa, Entamoeba invadens
VNRPGDVPKRICRMVNPGMTTLSFQVS

SEQ ID NO: 2974498 - protein, 25 aa, Entamoeba invadens
VNRRITRCLEFFRFGEKDEDDIFFF

SEQ ID NO: 2974499 - protein, 21 aa, Entamoeba invadens
VNRVVSLFTTFGLQEVPVEIL

SEQ ID NO: 2974500 - protein, 17 aa, Entamoeba invadens
VNSAFNLVQKAVTEHVK

SEQ ID NO: 2974501 - protein, 31 aa, Entamoeba invadens
VNSARISICIKKADGLEVILLRRFVSFLQQR

SEQ ID NO: 2974502 - protein, 22 aa, Entamoeba invadens
VNSDPLLLTRIVHEILDSSPKV

SEQ ID NO: 2974503 - protein, 28 aa, Entamoeba invadens
VNSEQESSCLFDRLLAIQQELLKNDKTA

SEQ ID NO: 2974504 - protein, 24 aa, Entamoeba invadens
VNSETVIITWGFIKGEFQASPSFA

SEQ ID NO: 2974505 - protein, 18 aa, Entamoeba invadens
VNSKMFFSFNSLPLYTCV

SEQ ID NO: 2974506 - protein, 27 aa, Entamoeba invadens
VNSLPLFPTRISPLFSTLGIDGVLCVF

SEQ ID NO: 2974507 - protein, 31 aa, Entamoeba invadens
VNSLSSFQKWTGYSHCKLIFDTAQEHDQDIH

SEQ ID NO: 2974508 - protein, 17 aa, Entamoeba invadens
VNSSILFGKADQQDREI

SEQ ID NO: 2974509 - protein, 25 aa, Entamoeba invadens
VNTCRDMLYHIELVKVVQKLYELFS

SEQ ID NO: 2974510 - protein, 21 aa, Entamoeba invadens
VNTCYDMLYEKEMVTSIKQCY

SEQ ID NO: 2974511 - protein, 23 aa, Entamoeba invadens
VNTGLKWLSYISWGMTKEPNIEY

SEQ ID NO: 2974512 - protein, 22 aa, Entamoeba invadens
VNTLCFKYEMSYSDVVKINGIQ

SEQ ID NO: 2974513 - protein, 26 aa, Entamoeba invadens
VNTLIAVAFYFRFIIFTQKDGTNEAQ

SEQ ID NO: 2974514 - protein, 25 aa, Entamoeba invadens
VNTLSDLFLIFSLFKKINTLSFPTV

SEQ ID NO: 2974515 - protein, 25 aa, Entamoeba invadens
VNTMYWVKWGNNFITAIDLTDNIFG

SEQ ID NO: 2974516 - protein, 18 aa, Entamoeba invadens
VNTNQRLSLNKIINQLYD

SEQ ID NO: 2974517 - protein, 27 aa, Entamoeba invadens
VNTSTVSKGRCFGVVGLGKIEKTGNPK

SEQ ID NO: 2974518 - protein, 30 aa, Entamoeba invadens
VNTYVQWGRLFSLWIAYQIVREKDEERRRQ

SEQ ID NO: 2974519 - protein, 19 aa, Entamoeba invadens
VNVCALEYTFQYQLTLKEI

SEQ ID NO: 2974520 - protein, 17 aa, Entamoeba invadens
VNVGKEFEDFRFVNEEK

SEQ ID NO: 2974521 - protein, 28 aa, Entamoeba invadens
VNVIKFAGKRAHICYISTIGAALNRDET

SEQ ID NO: 2974522 - protein, 24 aa, Entamoeba invadens
VNVKAACWMKDILDENLEVDEFYY

SEQ ID NO: 2974523 - protein, 24 aa, Entamoeba invadens
VNVKEHWQYFVAPLRDLLGTNYII

SEQ ID NO: 2974524 - protein, 17 aa, Entamoeba invadens
VNVLYDMVMQAQTIGLK

SEQ ID NO: 2974525 - protein, 34 aa, Entamoeba invadens
VNVSLLSRMLEPFCYALIYPKGQMGWQQEAKKTF

SEQ ID NO: 2974526 - protein, 25 aa, Entamoeba invadens
VNVSLTRARKVCVVVGNKKTLKRAE

SEQ ID NO: 2974527 - protein, 18 aa, Entamoeba invadens
VNVVGCGVYITWNYHNIV

SEQ ID NO: 2974528 - protein, 19 aa, Entamoeba invadens
VNYCFWICMDNVVFLWHHF

SEQ ID NO: 2974529 - protein, 25 aa, Entamoeba invadens
VNYLYLEKRLEMFGKSLKNAETILL

SEQ ID NO: 2974530 - protein, 18 aa, Entamoeba invadens
VNYNEFFDSVLFDGISSS

SEQ ID NO: 2974531 - protein, 19 aa, Entamoeba invadens
VNYTLKLMSVISHGKSEDV

SEQ ID NO: 2974532 - protein, 17 aa, Entamoeba invadens
VPAKFSKIFRDYFAEAI

SEQ ID NO: 2974533 - protein, 25 aa, Entamoeba invadens
VPALLDKLQYCLGLKGTEKNDIYEA

SEQ ID NO: 2974534 - protein, 19 aa, Entamoeba invadens
VPAPAELMPPPADLLPPPG

SEQ ID NO: 2974535 - protein, 17 aa, Entamoeba invadens
VPAVCLSLGLGYFDTDN

SEQ ID NO: 2974536 - protein, 18 aa, Entamoeba invadens
VPCKCSGGFVQVRLLVLP

SEQ ID NO: 2974537 - protein, 17 aa, Entamoeba invadens
VPCLLKISDFEENDTDG

SEQ ID NO: 2974538 - protein, 25 aa, Entamoeba invadens
VPCVLKRRKGVLILEIENYGVVNVS

SEQ ID NO: 2974539 - protein, 19 aa, Entamoeba invadens
VPDCVTCLEVDGCRNLQNL

SEQ ID NO: 2974540 - protein, 18 aa, Entamoeba invadens
VPDEWRWQVWKYLLRYVP

SEQ ID NO: 2974541 - protein, 19 aa, Entamoeba invadens
VPDKDVLMTPEYVGRKEFA

SEQ ID NO: 2974542 - protein, 23 aa, Entamoeba invadens
VPDKMFSNDFAYFQMNGVTIGNH

SEQ ID NO: 2974543 - protein, 17 aa, Entamoeba invadens
VPDNYKLRAKQHAKTEH

SEQ ID NO: 2974544 - protein, 29 aa, Entamoeba invadens
VPDSKTRYSLKCLFNIIKDALGVKNVVQY

SEQ ID NO: 2974545 - protein, 24 aa, Entamoeba invadens
VPDTGVFCDLLWSDPLQYEVYDEK

SEQ ID NO: 2974546 - protein, 24 aa, Entamoeba invadens
VPEELKTQIFPFIQSDLGIQMENI

SEQ ID NO: 2974547 - protein, 23 aa, Entamoeba invadens
VPEEQFKRLFSFVKDQKTLHHLF

SEQ ID NO: 2974548 - protein, 25 aa, Entamoeba invadens
VPEKEFKELFGFIQDPLTLHRIYIR

SEQ ID NO: 2974549 - protein, 20 aa, Entamoeba invadens
VPEKGKYPLGLSFEIVNEKT

SEQ ID NO: 2974550 - protein, 25 aa, Entamoeba invadens
VPEKIKIFINFGVVPSVKTISNLNI

SEQ ID NO: 2974551 - protein, 20 aa, Entamoeba invadens
VPEKMPFKLIKGDKLEENLR

SEQ ID NO: 2974552 - protein, 21 aa, Entamoeba invadens
VPEMLRTSLASVILHMKKIGI

SEQ ID NO: 2974553 - protein, 19 aa, Entamoeba invadens
VPEVDRFLVTIQMETLPWV

SEQ ID NO: 2974554 - protein, 20 aa, Entamoeba invadens
VPEVDRFLVTIQMETLPWVV

SEQ ID NO: 2974555 - protein, 21 aa, Entamoeba invadens
VPFDITKGSSFAVHTQDSMWT

SEQ ID NO: 2974556 - protein, 18 aa, Entamoeba invadens
VPFGEERANFVIENETSN

SEQ ID NO: 2974557 - protein, 24 aa, Entamoeba invadens
VPFGLPPKYSALCPQGVEEAVLQN

SEQ ID NO: 2974558 - protein, 25 aa, Entamoeba invadens
VPFKKCPKLRSVFFDGDVIEFGDIC

SEQ ID NO: 2974559 - protein, 20 aa, Entamoeba invadens
VPFLEYILSTALNFSPEKYK

SEQ ID NO: 2974560 - protein, 26 aa, Entamoeba invadens
VPFMKRVIPVLFRIASMCYGEPLFQQ

SEQ ID NO: 2974561 - protein, 18 aa, Entamoeba invadens
VPFYEAGKFFRTRELLLR

SEQ ID NO: 2974562 - protein, 20 aa, Entamoeba invadens
VPGAICIKSTNLFYLTVDAK

SEQ ID NO: 2974563 - protein, 24 aa, Entamoeba invadens
VPGCGLARLPYELVKNGNECYACE

SEQ ID NO: 2974564 - protein, 19 aa, Entamoeba invadens
VPGNLFLFNSMDFARLENL

SEQ ID NO: 2974565 - protein, 19 aa, Entamoeba invadens
VPGYELIRNVYFVDEEFST

SEQ ID NO: 2974566 - protein, 28 aa, Entamoeba invadens
VPGYFKYVYEYPVSYSFYLSNKSTKNEF

SEQ ID NO: 2974567 - protein, 17 aa, Entamoeba invadens
VPHEGRVEFLRQFNERI

SEQ ID NO: 2974568 - protein, 23 aa, Entamoeba invadens
VPHEGSFCDLMWSDPEENEKGMR

SEQ ID NO: 2974569 - protein, 22 aa, Entamoeba invadens
VPHKEIIVHDVAVKSHRVKKGD

SEQ ID NO: 2974570 - protein, 22 aa, Entamoeba invadens
VPHPFWLPKFQNGVSFSLPVLG

SEQ ID NO: 2974571 - protein, 28 aa, Entamoeba invadens
VPHTITFLFDEIKNFAFVRVYISHSQDE

SEQ ID NO: 2974572 - protein, 23 aa, Entamoeba invadens
VPIATVKHVFVWGNHSEKQCPDI

SEQ ID NO: 2974573 - protein, 28 aa, Entamoeba invadens
VPIDEVLDFVNKVGCSYFEISCRNQTDI

SEQ ID NO: 2974574 - protein, 30 aa, Entamoeba invadens
VPIFINKEAMARCYADLIYQFVTLTIHINS

SEQ ID NO: 2974575 - protein, 20 aa, Entamoeba invadens
VPIIEKVVMNYDFLTGDSTC

SEQ ID NO: 2974576 - protein, 35 aa, Entamoeba invadens
VPIIFSSHFPDFFPFPCFQLERLERVSIAFHKSYG

SEQ ID NO: 2974577 - protein, 24 aa, Entamoeba invadens
VPIIKCYIDRVSVDISLDNYEGIY

SEQ ID NO: 2974578 - protein, 31 aa, Entamoeba invadens
VPIIRVCINHIMNLFGSFKECCFKLGEFANE

SEQ ID NO: 2974579 - protein, 17 aa, Entamoeba invadens
VPIKAIDKGVEVVLKLV

SEQ ID NO: 2974580 - protein, 17 aa, Entamoeba invadens
VPIKMELETPIVNVEPP

SEQ ID NO: 2974581 - protein, 18 aa, Entamoeba invadens
VPILPRILLEYITSPFPY

SEQ ID NO: 2974582 - protein, 19 aa, Entamoeba invadens
VPIRICALTTAIANVDDMM

SEQ ID NO: 2974583 - protein, 29 aa, Entamoeba invadens
VPIRVGDPITCKYCQSILSYLDTVKDGEW

SEQ ID NO: 2974584 - protein, 18 aa, Entamoeba invadens
VPISSLFIPSTVALCNKD

SEQ ID NO: 2974585 - protein, 22 aa, Entamoeba invadens
VPITALTREQFVQLCNERPEVL

SEQ ID NO: 2974586 - protein, 19 aa, Entamoeba invadens
VPITCHAKVLGAMESKATK

SEQ ID NO: 2974587 - protein, 18 aa, Entamoeba invadens
VPIVCGGTSYYIDALIYR

SEQ ID NO: 2974588 - protein, 20 aa, Entamoeba invadens
VPKDDGFVLIRIVKGDPRGN

SEQ ID NO: 2974589 - protein, 20 aa, Entamoeba invadens
VPKETIEFCGCKIPKEYDGK

SEQ ID NO: 2974590 - protein, 19 aa, Entamoeba invadens
VPKFDVFEGKSTFENFYQF

SEQ ID NO: 2974591 - protein, 26 aa, Entamoeba invadens
VPKFQRRKAALLVLQFAYTFGDYLEV

SEQ ID NO: 2974592 - protein, 26 aa, Entamoeba invadens
VPKHLKLIGNFSFKNCCSLRHLTFPK

SEQ ID NO: 2974593 - protein, 26 aa, Entamoeba invadens
VPKKGMVKPSLYFVLENSFANINQSA

SEQ ID NO: 2974594 - protein, 23 aa, Entamoeba invadens
VPKKKSKVSLTFLTVSSVKDDLR

SEQ ID NO: 2974595 - protein, 19 aa, Entamoeba invadens
VPKKQCDYYTLMADSAMYN

SEQ ID NO: 2974596 - protein, 20 aa, Entamoeba invadens
VPKLHWVGVMDYDLRAFDII

SEQ ID NO: 2974597 - protein, 25 aa, Entamoeba invadens
VPKLTLFFRKMVLLKNGAELSDHPS

SEQ ID NO: 2974598 - protein, 19 aa, Entamoeba invadens
VPKNAALCKTRCTAGSAKY

SEQ ID NO: 2974599 - protein, 19 aa, Entamoeba invadens
VPKNTGVLCLVRNQHNSIF

SEQ ID NO: 2974600 - protein, 35 aa, Entamoeba invadens
VPKRLRCPKCSGLLRGASVLKCCGKSFCEDCLVKI

SEQ ID NO: 2974601 - protein, 24 aa, Entamoeba invadens
VPKSVFKLTIGYCANLKNINYQNK

SEQ ID NO: 2974602 - protein, 24 aa, Entamoeba invadens
VPKTEFKENVFIFTNIVKSNKITV

SEQ ID NO: 2974603 - protein, 22 aa, Entamoeba invadens
VPKTKEVFSFMDINPPGLKNPV

SEQ ID NO: 2974604 - protein, 22 aa, Entamoeba invadens
VPKYSLAYHQCRWNYMSQNEAE

SEQ ID NO: 2974605 - protein, 20 aa, Entamoeba invadens
VPLDDPRLVNSDPLLLTRIV

SEQ ID NO: 2974606 - protein, 18 aa, Entamoeba invadens
VPLDLSTGMTVDFGESFV

SEQ ID NO: 2974607 - protein, 25 aa, Entamoeba invadens
VPLFFKKNCVTKHSFSVYDNYHNLF

SEQ ID NO: 2974608 - protein, 17 aa, Entamoeba invadens
VPLKKNKKAKCEYYGVF

SEQ ID NO: 2974609 - protein, 19 aa, Entamoeba invadens
VPLLCPACRCRFMKNPITP

SEQ ID NO: 2974610 - protein, 23 aa, Entamoeba invadens
VPLLEENTAFVFLLKENGKESMK

SEQ ID NO: 2974611 - protein, 20 aa, Entamoeba invadens
VPLLRLEFHKTVLNLLKTPS

SEQ ID NO: 2974612 - protein, 19 aa, Entamoeba invadens
VPLLTPKPRPSLTSPTKTS

SEQ ID NO: 2974613 - protein, 17 aa, Entamoeba invadens
VPLMKPLLFSKGKMCRK

SEQ ID NO: 2974614 - protein, 17 aa, Entamoeba invadens
VPLPHAFLISHRPEFID

SEQ ID NO: 2974615 - protein, 17 aa, Entamoeba invadens
VPLPVIIVDDVKAIKDI

SEQ ID NO: 2974616 - protein, 21 aa, Entamoeba invadens
VPLQKSIAWAQVFKKENIVPQ

SEQ ID NO: 2974617 - protein, 25 aa, Entamoeba invadens
VPMDLRIPSPFPLFQDFYNTFDFTK

SEQ ID NO: 2974618 - protein, 22 aa, Entamoeba invadens
VPMLEIDCTLLGAVDGVEQECS

SEQ ID NO: 2974619 - protein, 19 aa, Entamoeba invadens
VPMVRRAKGQVLFNVCELI

SEQ ID NO: 2974620 - protein, 19 aa, Entamoeba invadens
VPNGFLLMEYCDGGNVDSY

SEQ ID NO: 2974621 - protein, 27 aa, Entamoeba invadens
VPNGKCVAVLLPRVIRYNCVVPRKLVM

SEQ ID NO: 2974622 - protein, 21 aa, Entamoeba invadens
VPNIACLWLKVLSIAQSECLC

SEQ ID NO: 2974623 - protein, 24 aa, Entamoeba invadens
VPNNIKCYYRMATAKTRLHQYDEA

SEQ ID NO: 2974624 - protein, 18 aa, Entamoeba invadens
VPNTSLIIKRCEKLTSVT

SEQ ID NO: 2974625 - protein, 17 aa, Entamoeba invadens
VPPLGDKKISVVFIGGG

SEQ ID NO: 2974626 - protein, 17 aa, Entamoeba invadens
VPPRLFPFVEYGKTMSL

SEQ ID NO: 2974627 - protein, 21 aa, Entamoeba invadens
VPPSYIYRLLAQLYNPEDTFF

SEQ ID NO: 2974628 - protein, 18 aa, Entamoeba invadens
VPQEWVKVINQYGGKLED

SEQ ID NO: 2974629 - protein, 25 aa, Entamoeba invadens
VPQFMKLELEDVLSIKVILLNVPPV

SEQ ID NO: 2974630 - protein, 19 aa, Entamoeba invadens
VPQIAEQFITFGVNKDIDV

SEQ ID NO: 2974631 - protein, 23 aa, Entamoeba invadens
VPQKKSVIALSYFRVIRLKSPER

SEQ ID NO: 2974632 - protein, 19 aa, Entamoeba invadens
VPQKSELPVQHQIEEIPKE

SEQ ID NO: 2974633 - protein, 24 aa, Entamoeba invadens
VPQKVRCVGSFAFENCVQLKELVF

SEQ ID NO: 2974634 - protein, 26 aa, Entamoeba invadens
VPQKVRFIGNFAFEMCIQLKELVFNN

SEQ ID NO: 2974635 - protein, 24 aa, Entamoeba invadens
VPQKVRFVGSFAFENCEQLEELNF

SEQ ID NO: 2974636 - protein, 26 aa, Entamoeba invadens
VPQKVRFVGSFAFKNCEQLVGLNFNE

SEQ ID NO: 2974637 - protein, 24 aa, Entamoeba invadens
VPQPETLARFAVLGLSGDMKDVKK

SEQ ID NO: 2974638 - protein, 17 aa, Entamoeba invadens
VPQRFLFARYKNITSAD

SEQ ID NO: 2974639 - protein, 20 aa, Entamoeba invadens
VPQRKFAKQVLPDFNDRGYW

SEQ ID NO: 2974640 - protein, 17 aa, Entamoeba invadens
VPQRYTPVCALKLIDAM

SEQ ID NO: 2974641 - protein, 24 aa, Entamoeba invadens
VPQSFMKMSSWIGLYDKYEMDTRR

SEQ ID NO: 2974642 - protein, 27 aa, Entamoeba invadens
VPQSPRFSLPSGLLVLRFDKPETQINL

SEQ ID NO: 2974643 - protein, 26 aa, Entamoeba invadens
VPREVVLPVHFEKMYECEKGEKEIVL

SEQ ID NO: 2974644 - protein, 21 aa, Entamoeba invadens
VPRKQGPPIPAPRTNGPPAPP

SEQ ID NO: 2974645 - protein, 26 aa, Entamoeba invadens
VPRNLCMSCVRLKRVKFDDSITVISD

SEQ ID NO: 2974646 - protein, 22 aa, Entamoeba invadens
VPRRRFLPVKSCSDLFVVQSTV

SEQ ID NO: 2974647 - protein, 18 aa, Entamoeba invadens
VPRSFLLNCINLKTIKFV

SEQ ID NO: 2974648 - protein, 27 aa, Entamoeba invadens
VPRSHRKEYYSVPSMEELQKMDVESLK

SEQ ID NO: 2974649 - protein, 18 aa, Entamoeba invadens
VPRSIDFSATLPKKETKK

SEQ ID NO: 2974650 - protein, 17 aa, Entamoeba invadens
VPRVVKELINYLTEKPV

SEQ ID NO: 2974651 - protein, 18 aa, Entamoeba invadens
VPSARMMLFESVLMTFKG

SEQ ID NO: 2974652 - protein, 19 aa, Entamoeba invadens
VPSFCQWVVDGDKTKIRLW

SEQ ID NO: 2974653 - protein, 19 aa, Entamoeba invadens
VPSGSFTASGFVFSTLAEP

SEQ ID NO: 2974654 - protein, 28 aa, Entamoeba invadens
VPSIVSLKPGYACEFEIFIKPLCTCSTK

SEQ ID NO: 2974655 - protein, 17 aa, Entamoeba invadens
VPSKERKRCNFVITVYV

SEQ ID NO: 2974656 - protein, 18 aa, Entamoeba invadens
VPSNLQCRVIALDMGALI

SEQ ID NO: 2974657 - protein, 23 aa, Entamoeba invadens
VPTGCAAIAYTLYTRHLKFTPKA

SEQ ID NO: 2974658 - protein, 19 aa, Entamoeba invadens
VPTGYKLVVETANFDMSTL

SEQ ID NO: 2974659 - protein, 18 aa, Entamoeba invadens
VPTISYSPLEEWKEATAR

SEQ ID NO: 2974660 - protein, 24 aa, Entamoeba invadens
VPTKRCPVLDSMDFFKNTTKAKFE

SEQ ID NO: 2974661 - protein, 18 aa, Entamoeba invadens
VPTLKPLPTFNVTQQQKD

SEQ ID NO: 2974662 - protein, 23 aa, Entamoeba invadens
VPTLLAIFFSHFEYRVLKIAHNQ

SEQ ID NO: 2974663 - protein, 19 aa, Entamoeba invadens
VPTLPSFKNIQLVSPRKYS

SEQ ID NO: 2974664 - protein, 21 aa, Entamoeba invadens
VPTNDIIHFVVKISGKTPSSQ

SEQ ID NO: 2974665 - protein, 17 aa, Entamoeba invadens
VPTPIQRKAIPAIMTGV

SEQ ID NO: 2974666 - protein, 19 aa, Entamoeba invadens
VPTPRNVSCQKMEIIDPEI

SEQ ID NO: 2974667 - protein, 25 aa, Entamoeba invadens
VPTRLETLSTVLFRHILLFRYFPLQ

SEQ ID NO: 2974668 - protein, 26 aa, Entamoeba invadens
VPTWCPTRWLSQGKIVFFRLSEMEKE

SEQ ID NO: 2974669 - protein, 17 aa, Entamoeba invadens
VPTYTPEEWIEGKVKDV

SEQ ID NO: 2974670 - protein, 17 aa, Entamoeba invadens
VPVCVSCVSAINKMWYP

SEQ ID NO: 2974671 - protein, 22 aa, Entamoeba invadens
VPVILGEDGFKALFEQYRPKNV

SEQ ID NO: 2974672 - protein, 25 aa, Entamoeba invadens
VPVKHLKLFPNMDVLLLYNPTDFPI

SEQ ID NO: 2974673 - protein, 22 aa, Entamoeba invadens
VPVNFSRHWTLVLFCLQSTRIA

SEQ ID NO: 2974674 - protein, 21 aa, Entamoeba invadens
VPVQVGILYSPKIEFIPFDMD

SEQ ID NO: 2974675 - protein, 17 aa, Entamoeba invadens
VPVRIFLNRIKELTPTL

SEQ ID NO: 2974676 - protein, 22 aa, Entamoeba invadens
VPVSEWPMWINSKIENTPFRAM

SEQ ID NO: 2974677 - protein, 24 aa, Entamoeba invadens
VPVSRLAAAAVYLARRMCGIQPYW

SEQ ID NO: 2974678 - protein, 23 aa, Entamoeba invadens
VPWNGECYKDFKTVESLGEGSYG

SEQ ID NO: 2974679 - protein, 26 aa, Entamoeba invadens
VPYGGLLCIFDQFLVSGIRSITRYIL

SEQ ID NO: 2974680 - protein, 20 aa, Entamoeba invadens
VPYMCSYTFEIPSSEESFSD

SEQ ID NO: 2974681 - protein, 17 aa, Entamoeba invadens
VQAFEWIDENAQEFVQL

SEQ ID NO: 2974682 - protein, 23 aa, Entamoeba invadens
VQALKGRHLPLITVFQDPTFGGT

SEQ ID NO: 2974683 - protein, 19 aa, Entamoeba invadens
VQAMAKGYFFRKSKLARKM

SEQ ID NO: 2974684 - protein, 21 aa, Entamoeba invadens
VQARPLPPVPAPRSFIPNTEP

SEQ ID NO: 2974685 - protein, 22 aa, Entamoeba invadens
VQARSCPSYALTRAVGKMCCLK

SEQ ID NO: 2974686 - protein, 17 aa, Entamoeba invadens
VQASLLLSFSQYLNTMN

SEQ ID NO: 2974687 - protein, 28 aa, Entamoeba invadens
VQAVRGKGGICFLFLRKGIYTCQAVATV

SEQ ID NO: 2974688 - protein, 20 aa, Entamoeba invadens
VQAYPILGGIQVTRESRVSP

SEQ ID NO: 2974689 - protein, 22 aa, Entamoeba invadens
VQCANFKKTAIQFGTRIAKVLN

SEQ ID NO: 2974690 - protein, 17 aa, Entamoeba invadens
VQCCSFKRRYAHPYSEI

SEQ ID NO: 2974691 - protein, 19 aa, Entamoeba invadens
VQCKASAPMLEKLSEKHKN

SEQ ID NO: 2974692 - protein, 32 aa, Entamoeba invadens
VQCTSFLRCEKCASGLILKNWACKPMSSVKEF

SEQ ID NO: 2974693 - protein, 18 aa, Entamoeba invadens
VQDIFCESSLMKFSSNVM

SEQ ID NO: 2974694 - protein, 25 aa, Entamoeba invadens
VQDSLGCIGCTANGLPDLKTHSIKV

SEQ ID NO: 2974695 - protein, 18 aa, Entamoeba invadens
VQEIKRVVEWMKKKLEKR

SEQ ID NO: 2974696 - protein, 25 aa, Entamoeba invadens
VQEKALSLLLNWGSVHGSSCPEYKS

SEQ ID NO: 2974697 - protein, 22 aa, Entamoeba invadens
VQELLDLGCKYIAEMIKGKSVE

SEQ ID NO: 2974698 - protein, 18 aa, Entamoeba invadens
VQERACFSLQSLLENLED

SEQ ID NO: 2974699 - protein, 18 aa, Entamoeba invadens
VQETFFLHIERFVCNSLA

SEQ ID NO: 2974700 - protein, 28 aa, Entamoeba invadens
VQEVFGGKLKDIWWMLLVTSQMTDLNFM

SEQ ID NO: 2974701 - protein, 23 aa, Entamoeba invadens
VQFEDIIIAFCMSLGGNQGAVEQ

SEQ ID NO: 2974702 - protein, 17 aa, Entamoeba invadens
VQFFGVSVDSVFCHKAW

SEQ ID NO: 2974703 - protein, 17 aa, Entamoeba invadens
VQFGYLWETILDVVAGS

SEQ ID NO: 2974704 - protein, 17 aa, Entamoeba invadens
VQFLEALFFYEKRKFTE

SEQ ID NO: 2974705 - protein, 18 aa, Entamoeba invadens
VQFLEKFDDFVSWKYVAA

SEQ ID NO: 2974706 - protein, 22 aa, Entamoeba invadens
VQFPEWSKLPLTSDELIKEQNL

SEQ ID NO: 2974707 - protein, 24 aa, Entamoeba invadens
VQFPHPLKSFVFHTKFPPNTNLDY

SEQ ID NO: 2974708 - protein, 18 aa, Entamoeba invadens
VQFRDICLGLLYRLLQTL

SEQ ID NO: 2974709 - protein, 27 aa, Entamoeba invadens
VQGCVVKMNFAFLAALMKWKREKDEEE

SEQ ID NO: 2974710 - protein, 18 aa, Entamoeba invadens
VQGFPTVVSRLYLMCIVG

SEQ ID NO: 2974711 - protein, 25 aa, Entamoeba invadens
VQGGTCAIPGAFGCGKTVISQALSK

SEQ ID NO: 2974712 - protein, 18 aa, Entamoeba invadens
VQGKKSFEYAWVMDTDDE

SEQ ID NO: 2974713 - protein, 28 aa, Entamoeba invadens
VQHCCDLSFPIQETFSLSSSSLLFIQTS

SEQ ID NO: 2974714 - protein, 19 aa, Entamoeba invadens
VQHFDEFDIQPVFPAMFPS

SEQ ID NO: 2974715 - protein, 25 aa, Entamoeba invadens
VQHKLFKTAFLFFQPFKSYTTYMGD

SEQ ID NO: 2974716 - protein, 31 aa, Entamoeba invadens
VQHLRSGSCGIVFDFHTFRGLKVDWGKETAL

SEQ ID NO: 2974717 - protein, 19 aa, Entamoeba invadens
VQHYKVVEVLAIIIQTYVD

SEQ ID NO: 2974718 - protein, 17 aa, Entamoeba invadens
VQIAFKIPMLQNLDVKH

SEQ ID NO: 2974719 - protein, 19 aa, Entamoeba invadens
VQIASKWASLNDIVERLKS

SEQ ID NO: 2974720 - protein, 26 aa, Entamoeba invadens
VQIEKWSSCKLDKVLFDTSVDSAEKS

SEQ ID NO: 2974721 - protein, 19 aa, Entamoeba invadens
VQIFICQLLDLQLVKYQLN

SEQ ID NO: 2974722 - protein, 17 aa, Entamoeba invadens
VQIFPFDYDLLVGFEDS

SEQ ID NO: 2974723 - protein, 19 aa, Entamoeba invadens
VQILYKFIVAEECLEIDFS

SEQ ID NO: 2974724 - protein, 17 aa, Entamoeba invadens
VQIPDGFGINPLLADLI

SEQ ID NO: 2974725 - protein, 25 aa, Entamoeba invadens
VQIPRSVTFIGVSAFGKCYNLLEVV

SEQ ID NO: 2974726 - protein, 28 aa, Entamoeba invadens
VQIPSSWPFEVFPFILQHRSHSIPTLNI

SEQ ID NO: 2974727 - protein, 24 aa, Entamoeba invadens
VQKFQDWYCAIIEKVEEIANRLEK

SEQ ID NO: 2974728 - protein, 28 aa, Entamoeba invadens
VQKHIPKEFKILVGETAKQGFANVREYL

SEQ ID NO: 2974729 - protein, 22 aa, Entamoeba invadens
VQKILPRLSFVRTRKTSLTPRD

SEQ ID NO: 2974730 - protein, 25 aa, Entamoeba invadens
VQKIREGKKGFGFDMRSGNFVDMMQ

SEQ ID NO: 2974731 - protein, 23 aa, Entamoeba invadens
VQKLKKLQVFDVRNCQLSKDIVL

SEQ ID NO: 2974732 - protein, 22 aa, Entamoeba invadens
VQKLRKMCVSKLNVHTPHFDDK

SEQ ID NO: 2974733 - protein, 18 aa, Entamoeba invadens
VQKNFLHFFKSESLENNS

SEQ ID NO: 2974734 - protein, 17 aa, Entamoeba invadens
VQKRPIVEFLLQNGKVG

SEQ ID NO: 2974735 - protein, 31 aa, Entamoeba invadens
VQKVPRGCVFFKNKSRAFGFFFDTNKKKHIS

SEQ ID NO: 2974736 - protein, 17 aa, Entamoeba invadens
VQLAANVLPRFFKHSNF

SEQ ID NO: 2974737 - protein, 17 aa, Entamoeba invadens
VQLFDFVNITLLSNKLV

SEQ ID NO: 2974738 - protein, 23 aa, Entamoeba invadens
VQLFFRFLEKYGFDATALTNAHA

SEQ ID NO: 2974739 - protein, 18 aa, Entamoeba invadens
VQLINSFFEFSRSMKTQF

SEQ ID NO: 2974740 - protein, 27 aa, Entamoeba invadens
VQLIPKVPNFQGNFNIIIEKLEKVIMK

SEQ ID NO: 2974741 - protein, 24 aa, Entamoeba invadens
VQLLCDLLREFGYYLEIEKKRGRK

SEQ ID NO: 2974742 - protein, 24 aa, Entamoeba invadens
VQLNTKGSITFSYSVTSVKGGKAP

SEQ ID NO: 2974743 - protein, 24 aa, Entamoeba invadens
VQLRSTGCGFGIYTIDDDVEDITA

SEQ ID NO: 2974744 - protein, 17 aa, Entamoeba invadens
VQLWDTAGQEKFRNITS

SEQ ID NO: 2974745 - protein, 18 aa, Entamoeba invadens
VQMFCPKLVDMFVGAYRA

SEQ ID NO: 2974746 - protein, 17 aa, Entamoeba invadens
VQMVFEEVFVRSSKLIL

SEQ ID NO: 2974747 - protein, 17 aa, Entamoeba invadens
VQNALEYFGCITKGCYF

SEQ ID NO: 2974748 - protein, 17 aa, Entamoeba invadens
VQNCCALIYQTKATSKE

SEQ ID NO: 2974749 - protein, 22 aa, Entamoeba invadens
VQNDILLSVGVESAVVFTQSFN

SEQ ID NO: 2974750 - protein, 25 aa, Entamoeba invadens
VQNGPRMSVNMSCMNQNVGQSVLGM

SEQ ID NO: 2974751 - protein, 19 aa, Entamoeba invadens
VQNIIWIKHVLGIEDTFEG

SEQ ID NO: 2974752 - protein, 19 aa, Entamoeba invadens
VQNKFPINKLIPLTYHCTQ

SEQ ID NO: 2974753 - protein, 27 aa, Entamoeba invadens
VQNLLIDMLLEFGFFFESKMAKKSTKT

SEQ ID NO: 2974754 - protein, 24 aa, Entamoeba invadens
VQNNCYKRALQICRCKEAMTDSRV

SEQ ID NO: 2974755 - protein, 24 aa, Entamoeba invadens
VQNPRANIHFFLYKPRLIGAKCVG

SEQ ID NO: 2974756 - protein, 22 aa, Entamoeba invadens
VQNRDVCLSYGFFEPFFHLCEI

SEQ ID NO: 2974757 - protein, 25 aa, Entamoeba invadens
VQNSLFCKCLMLCFSITEEKTIKIK

SEQ ID NO: 2974758 - protein, 20 aa, Entamoeba invadens
VQNVELFDPLFVHLIKKRFS

SEQ ID NO: 2974759 - protein, 21 aa, Entamoeba invadens
VQPKMSMSMSKLERREKSGIL

SEQ ID NO: 2974760 - protein, 23 aa, Entamoeba invadens
VQPQIKPQQQWRDQSPQMQQPPR

SEQ ID NO: 2974761 - protein, 28 aa, Entamoeba invadens
VQPSQIFPMKKRCFTFGVDDAPSFYLKK

SEQ ID NO: 2974762 - protein, 19 aa, Entamoeba invadens
VQPTIKILLQTGSPVVKSA

SEQ ID NO: 2974763 - protein, 22 aa, Entamoeba invadens
VQQEATFYWVLPRILDKTQFQF

SEQ ID NO: 2974764 - protein, 18 aa, Entamoeba invadens
VQQRGGAFAAAPINQKVQ

SEQ ID NO: 2974765 - protein, 36 aa, Entamoeba invadens
VQQTLLSFRELLAFKECHESVLMILFVCEEFINPKS

SEQ ID NO: 2974766 - protein, 23 aa, Entamoeba invadens
VQRACKKGCKLSRSETYIEQDKA

SEQ ID NO: 2974767 - protein, 17 aa, Entamoeba invadens
VQRACMEYKLKLPRLSK

SEQ ID NO: 2974768 - protein, 20 aa, Entamoeba invadens
VQRFQVLANLTLKVEASCKP

SEQ ID NO: 2974769 - protein, 24 aa, Entamoeba invadens
VQRIMPKMRIIKEKQKSDSSLFIR

SEQ ID NO: 2974770 - protein, 26 aa, Entamoeba invadens
VQRLPRYKLLLTDLFRHYWDTHDDYA

SEQ ID NO: 2974771 - protein, 27 aa, Entamoeba invadens
VQRNRKARIGVFAQHFVDQLNFKVNAI

SEQ ID NO: 2974772 - protein, 22 aa, Entamoeba invadens
VQRRIVPLLGQFTEAPINFLPT

SEQ ID NO: 2974773 - protein, 24 aa, Entamoeba invadens
VQRVMFPRVHYEERILCPKCLTLG

SEQ ID NO: 2974774 - protein, 23 aa, Entamoeba invadens
VQRVMRYPILISELIKTTPNKHP

SEQ ID NO: 2974775 - protein, 18 aa, Entamoeba invadens
VQSLLPVVTGAVSWRTPG

SEQ ID NO: 2974776 - protein, 19 aa, Entamoeba invadens
VQSLSKWCLDMCNAQTIHI

SEQ ID NO: 2974777 - protein, 19 aa, Entamoeba invadens
VQSRIRGYIVRRLHNKNTL

SEQ ID NO: 2974778 - protein, 24 aa, Entamoeba invadens
VQSSPRVNKFIGRVQTAQNNSSPE

SEQ ID NO: 2974779 - protein, 17 aa, Entamoeba invadens
VQSYLRFLYEKDTCKEE

SEQ ID NO: 2974780 - protein, 25 aa, Entamoeba invadens
VQTAEIRFGKLLVVTRNQVLLFDDK

SEQ ID NO: 2974781 - protein, 28 aa, Entamoeba invadens
VQTDAEVAFVWEVRKMRVVPKNKRNLID

SEQ ID NO: 2974782 - protein, 27 aa, Entamoeba invadens
VQTIARGTFDWCTLKSISLPGNVTALE

SEQ ID NO: 2974783 - protein, 24 aa, Entamoeba invadens
VQTKCGICRGFYDLSKEHILRSVD

SEQ ID NO: 2974784 - protein, 22 aa, Entamoeba invadens
VQTPLFFLDYFTIFTSLYQVGS

SEQ ID NO: 2974785 - protein, 21 aa, Entamoeba invadens
VQVCLGEYVQIKSFHLICNKC

SEQ ID NO: 2974786 - protein, 20 aa, Entamoeba invadens
VQVCLGEYVQIKSFHLTCNK

SEQ ID NO: 2974787 - protein, 23 aa, Entamoeba invadens
VQVELKFETSFCGSEEPQNIELK

SEQ ID NO: 2974788 - protein, 19 aa, Entamoeba invadens
VQVQIKYTKLNGFKGIRVI

SEQ ID NO: 2974789 - protein, 22 aa, Entamoeba invadens
VQVRGNIPLIWKTNEEDKFSPK

SEQ ID NO: 2974790 - protein, 25 aa, Entamoeba invadens
VQVTKELLSYICFVNKVSFEDVEKQ

SEQ ID NO: 2974791 - protein, 23 aa, Entamoeba invadens
VQVVYHIAPYLPFMETNDQQLDK

SEQ ID NO: 2974792 - protein, 19 aa, Entamoeba invadens
VQYILGLDPYFTIPHFDIN

SEQ ID NO: 2974793 - protein, 23 aa, Entamoeba invadens
VQYLKGEYYPNVLTISKTKEMRR

SEQ ID NO: 2974794 - protein, 17 aa, Entamoeba invadens
VQYRMHPAISSFPSKNF

SEQ ID NO: 2974795 - protein, 19 aa, Entamoeba invadens
VRAGVPTSHSAAVPADLSK

SEQ ID NO: 2974796 - protein, 19 aa, Entamoeba invadens
VRALGRCAIKLENVANQCI

SEQ ID NO: 2974797 - protein, 17 aa, Entamoeba invadens
VRALKGFETNRDEVDLL

SEQ ID NO: 2974798 - protein, 18 aa, Entamoeba invadens
VRALKVLKPFLINVKIVH

SEQ ID NO: 2974799 - protein, 21 aa, Entamoeba invadens
VRANIRISGYMVRIEDGKCKL

SEQ ID NO: 2974800 - protein, 23 aa, Entamoeba invadens
VRASTWLAKECYVKASKKGHVQA

SEQ ID NO: 2974801 - protein, 20 aa, Entamoeba invadens
VRAYKKLSVRVAKDKNDGTS

SEQ ID NO: 2974802 - protein, 17 aa, Entamoeba invadens
VRCALCHDHYTATMCRR

SEQ ID NO: 2974803 - protein, 18 aa, Entamoeba invadens
VRCLEMWGDHNMMSGSSD

SEQ ID NO: 2974804 - protein, 18 aa, Entamoeba invadens
VRCMSNFRVETVREHLID

SEQ ID NO: 2974805 - protein, 20 aa, Entamoeba invadens
VRCSCGKYICNGPVTNCSKC

SEQ ID NO: 2974806 - protein, 18 aa, Entamoeba invadens
VRCYTHPYLTATSIMGEN

SEQ ID NO: 2974807 - protein, 40 aa, Entamoeba invadens
VRDGFGGKLRFIFNGGAPITPALFEWLRVCTGAHIMQSYG

SEQ ID NO: 2974808 - protein, 21 aa, Entamoeba invadens
VRDICFICGANSILINGSCQT

SEQ ID NO: 2974809 - protein, 24 aa, Entamoeba invadens
VRDICLRSAAAPTYYKPYQNYIDG

SEQ ID NO: 2974810 - protein, 24 aa, Entamoeba invadens
VRDKCTTCCRVLLATQWNYDKNKA

SEQ ID NO: 2974811 - protein, 35 aa, Entamoeba invadens
VRDLVKCKIIMLSKHMYGCRVIQKIVEYSSSEQQE

SEQ ID NO: 2974812 - protein, 26 aa, Entamoeba invadens
VRDNLLSWLLDGFLGLAPDKYEQLFN

SEQ ID NO: 2974813 - protein, 17 aa, Entamoeba invadens
VRDVFRLARENAPSIVF

SEQ ID NO: 2974814 - protein, 22 aa, Entamoeba invadens
VRDVFRRPLLFKIVNEEKDSRQ

SEQ ID NO: 2974815 - protein, 20 aa, Entamoeba invadens
VRDWWYYPWLTEIVEDLTEL

SEQ ID NO: 2974816 - protein, 25 aa, Entamoeba invadens
VRECLYDFLCRCLAYDPKDRMTPDQ

SEQ ID NO: 2974817 - protein, 23 aa, Entamoeba invadens
VRECRKLKPTKGVILASRELYCV

SEQ ID NO: 2974818 - protein, 24 aa, Entamoeba invadens
VREEFLLFLSKRVKLQTLPEHIAE

SEQ ID NO: 2974819 - protein, 23 aa, Entamoeba invadens
VREKEFLQPLAHAVVDNVDSQST

SEQ ID NO: 2974820 - protein, 22 aa, Entamoeba invadens
VREKTVPCFARYSKQIVSDIFS

SEQ ID NO: 2974821 - protein, 21 aa, Entamoeba invadens
VRELIYKWGTYFPNELSEYVV

SEQ ID NO: 2974822 - protein, 18 aa, Entamoeba invadens
VRELMKKSVPQDTTRYIL

SEQ ID NO: 2974823 - protein, 23 aa, Entamoeba invadens
VRELYCGTIQLFADLFEKEKNSL

SEQ ID NO: 2974824 - protein, 22 aa, Entamoeba invadens
VRENCYLCVFDSEIFDDKFEFP

SEQ ID NO: 2974825 - protein, 17 aa, Entamoeba invadens
VRFDQVILSPIDFDSVE

SEQ ID NO: 2974826 - protein, 20 aa, Entamoeba invadens
VRFEPFVYLQLALPQQPKVI

SEQ ID NO: 2974827 - protein, 17 aa, Entamoeba invadens
VRFFLCCYSDGRCYFID

SEQ ID NO: 2974828 - protein, 24 aa, Entamoeba invadens
VRFLCSRREIGFFIREVGNFDMQS

SEQ ID NO: 2974829 - protein, 24 aa, Entamoeba invadens
VRFQALCTLSSFLDYNIPIVVNNV

SEQ ID NO: 2974830 - protein, 20 aa, Entamoeba invadens
VRFSSEWKGVSAGGCHAFPT

SEQ ID NO: 2974831 - protein, 25 aa, Entamoeba invadens
VRGAIPKMRGIGLSSRLCELLSHME

SEQ ID NO: 2974832 - protein, 22 aa, Entamoeba invadens
VRGGFPHGFNPADIKLKNTGGL

SEQ ID NO: 2974833 - protein, 18 aa, Entamoeba invadens
VRGHGDIVLRVVKQKMRG

SEQ ID NO: 2974834 - protein, 24 aa, Entamoeba invadens
VRGKRCTHQRTFDLKSFLQTAQKA

SEQ ID NO: 2974835 - protein, 33 aa, Entamoeba invadens
VRGKYTVKLFLKRENGFFMKEALVFVGKPIEAL

SEQ ID NO: 2974836 - protein, 19 aa, Entamoeba invadens
VRGNAMAVHLNWEQELSQP

SEQ ID NO: 2974837 - protein, 17 aa, Entamoeba invadens
VRGNILLSELAKESTLY

SEQ ID NO: 2974838 - protein, 22 aa, Entamoeba invadens
VRGVNCLHPIDLKSFVNNWYNK

SEQ ID NO: 2974839 - protein, 20 aa, Entamoeba invadens
VRGYVSSCCIAVIQMHPFST

SEQ ID NO: 2974840 - protein, 27 aa, Entamoeba invadens
VRHDKYPFLQEGWRWEQKGCLDATSED

SEQ ID NO: 2974841 - protein, 25 aa, Entamoeba invadens
VRIASWKLPCECLTTGFETRTGIMV

SEQ ID NO: 2974842 - protein, 18 aa, Entamoeba invadens
VRIDNFWEYTGLKKISAI

SEQ ID NO: 2974843 - protein, 23 aa, Entamoeba invadens
VRIFCTCEFFEAVELANALKHKI

SEQ ID NO: 2974844 - protein, 19 aa, Entamoeba invadens
VRIKKGIVGSGVVKVVPAI

SEQ ID NO: 2974845 - protein, 17 aa, Entamoeba invadens
VRIKTLIEIVIQKDVNE

SEQ ID NO: 2974846 - protein, 21 aa, Entamoeba invadens
VRINTAYTLFYAVRPTIDVEH

SEQ ID NO: 2974847 - protein, 17 aa, Entamoeba invadens
VRIPVCLGTLGDSAFYG

SEQ ID NO: 2974848 - protein, 18 aa, Entamoeba invadens
VRIREKFTSFKILEMARK

SEQ ID NO: 2974849 - protein, 24 aa, Entamoeba invadens
VRIVRRPSDNFLFEGEGTSIKIKM

SEQ ID NO: 2974850 - protein, 18 aa, Entamoeba invadens
VRIWRDWDNNGSNVLVSG

SEQ ID NO: 2974851 - protein, 24 aa, Entamoeba invadens
VRKARAMRGQAFVVYNSMDAAEHA

SEQ ID NO: 2974852 - protein, 20 aa, Entamoeba invadens
VRKDDCFAVTFSKPEKKEDD

SEQ ID NO: 2974853 - protein, 27 aa, Entamoeba invadens
VRKDKFPFLQEGWRWEEVAEEQNESGH

SEQ ID NO: 2974854 - protein, 17 aa, Entamoeba invadens
VRKELKKMLEIDFEITE

SEQ ID NO: 2974855 - protein, 26 aa, Entamoeba invadens
VRKIFKRLFRVYAHMFYNHMEHMEQL

SEQ ID NO: 2974856 - protein, 19 aa, Entamoeba invadens
VRKILKKCATFNRKGNGNG

SEQ ID NO: 2974857 - protein, 22 aa, Entamoeba invadens
VRKITFSLLGKMNESEKFIECI

SEQ ID NO: 2974858 - protein, 19 aa, Entamoeba invadens
VRKKVALARYRVVYTEKIS

SEQ ID NO: 2974859 - protein, 48 aa, Entamoeba invadens
VRKLGRTFIHFCKELKLDLPFVDPCLYLQRFGEDLAFEKTADVVRTAM

SEQ ID NO: 2974860 - protein, 21 aa, Entamoeba invadens
VRKLREGSFGIVFKGTYRGNV

SEQ ID NO: 2974861 - protein, 33 aa, Entamoeba invadens
VRKNLRKISLLKVRLIAQMRRGLDMVSYENQQR

SEQ ID NO: 2974862 - protein, 21 aa, Entamoeba invadens
VRKQYTLTRRREIWTDEEHSK

SEQ ID NO: 2974863 - protein, 17 aa, Entamoeba invadens
VRKSSLCSIKKKDGSFY

SEQ ID NO: 2974864 - protein, 23 aa, Entamoeba invadens
VRKTHFIYLPFKSHDLLKQIENF

SEQ ID NO: 2974865 - protein, 21 aa, Entamoeba invadens
VRKVGSFAFEKCEQLKELVFN

SEQ ID NO: 2974866 - protein, 18 aa, Entamoeba invadens
VRLFKDRYTRLAVSNVIY

SEQ ID NO: 2974867 - protein, 19 aa, Entamoeba invadens
VRLGISILDDSHCLVKEFN

SEQ ID NO: 2974868 - protein, 17 aa, Entamoeba invadens
VRLKNGLKSVGKDCFCE

SEQ ID NO: 2974869 - protein, 22 aa, Entamoeba invadens
VRLSRLCFASFLSTLKCEMLTL

SEQ ID NO: 2974870 - protein, 19 aa, Entamoeba invadens
VRLSVTLSKILSLFSFDPS

SEQ ID NO: 2974871 - protein, 19 aa, Entamoeba invadens
VRLVDHFLYHSHLCIVTEL

SEQ ID NO: 2974872 - protein, 26 aa, Entamoeba invadens
VRLYFKDIKGVLLVFQIDRQESFDHC

SEQ ID NO: 2974873 - protein, 17 aa, Entamoeba invadens
VRLYLSGLLKIILVGEK

SEQ ID NO: 2974874 - protein, 18 aa, Entamoeba invadens
VRMECIKIVNALTLSYFK

SEQ ID NO: 2974875 - protein, 18 aa, Entamoeba invadens
VRMFLVEMLLKEGADVDA

SEQ ID NO: 2974876 - protein, 19 aa, Entamoeba invadens
VRMNDMWRNNEKSLEMINI

SEQ ID NO: 2974877 - protein, 22 aa, Entamoeba invadens
VRMVDFTKWVKGRIGVKDPEFD

SEQ ID NO: 2974878 - protein, 27 aa, Entamoeba invadens
VRNFRRCDKLRKITFRTLPTIKENEKQ

SEQ ID NO: 2974879 - protein, 18 aa, Entamoeba invadens
VRNGISLTFLTNRIDHGA

SEQ ID NO: 2974880 - protein, 25 aa, Entamoeba invadens
VRNKPVGCVLIFLPGIFEITNLQRE

SEQ ID NO: 2974881 - protein, 24 aa, Entamoeba invadens
VRNKYKPSIGFAEGKMDSRANNIT

SEQ ID NO: 2974882 - protein, 23 aa, Entamoeba invadens
VRNVSKYSMKCFGDKNKQVQEKR

SEQ ID NO: 2974883 - protein, 19 aa, Entamoeba invadens
VRPEGKFVCSFRDDVLFGD

SEQ ID NO: 2974884 - protein, 17 aa, Entamoeba invadens
VRPELNMNCLVYALKQA

SEQ ID NO: 2974885 - protein, 22 aa, Entamoeba invadens
VRPELSSMLSGDIMFSLCRIAK

SEQ ID NO: 2974886 - protein, 17 aa, Entamoeba invadens
VRPELVPLVDFVLITDE

SEQ ID NO: 2974887 - protein, 18 aa, Entamoeba invadens
VRPFNFFDRISYITSTNF

SEQ ID NO: 2974888 - protein, 25 aa, Entamoeba invadens
VRPGQTCTFIGMPIAAPDTTRLAVG

SEQ ID NO: 2974889 - protein, 24 aa, Entamoeba invadens
VRPNTRFPALPVVYIEKLQNSFAR

SEQ ID NO: 2974890 - protein, 18 aa, Entamoeba invadens
VRPPLPRHIAKDINNYDE

SEQ ID NO: 2974891 - protein, 17 aa, Entamoeba invadens
VRPRKLVYMAVDGVAPR

SEQ ID NO: 2974892 - protein, 21 aa, Entamoeba invadens
VRPSAKYFVREVASFNKEEAE

SEQ ID NO: 2974893 - protein, 18 aa, Entamoeba invadens
VRPTLPITFVEKYGKDSS

SEQ ID NO: 2974894 - protein, 19 aa, Entamoeba invadens
VRPVLLVALGDKLLASNKH

SEQ ID NO: 2974895 - protein, 28 aa, Entamoeba invadens
VRPVNEYGISMIDLWNKKGVVVGVDNKV

SEQ ID NO: 2974896 - protein, 19 aa, Entamoeba invadens
VRQRAVLVGQELGLSKAIR

SEQ ID NO: 2974897 - protein, 18 aa, Entamoeba invadens
VRRDGEVYEIDFSRGQVQ

SEQ ID NO: 2974898 - protein, 29 aa, Entamoeba invadens
VRRDNCMLVKYVIERCLDLILLDKEKDNI

SEQ ID NO: 2974899 - protein, 33 aa, Entamoeba invadens
VRRDSCRATKHIMMGCIKYLMGKDVDALQLYLQ

SEQ ID NO: 2974900 - protein, 25 aa, Entamoeba invadens
VRRDVWRIVLFPAIDMGDLKKEFES

SEQ ID NO: 2974901 - protein, 25 aa, Entamoeba invadens
VRRHHCRACGRCICGECSKWKMPMP

SEQ ID NO: 2974902 - protein, 25 aa, Entamoeba invadens
VRRITPPLFRCYNKQKALPFLNFFF

SEQ ID NO: 2974903 - protein, 19 aa, Entamoeba invadens
VRRMMKVAMLISNRVMEGN

SEQ ID NO: 2974904 - protein, 22 aa, Entamoeba invadens
VRRNFKDITVITVAHRLQTIMD

SEQ ID NO: 2974905 - protein, 20 aa, Entamoeba invadens
VRSDIPRIVCFELINQNRIE

SEQ ID NO: 2974906 - protein, 17 aa, Entamoeba invadens
VRSFLRPKSESIATTLI

SEQ ID NO: 2974907 - protein, 23 aa, Entamoeba invadens
VRSFRPERIVLFTINNFNETSAK

SEQ ID NO: 2974908 - protein, 18 aa, Entamoeba invadens
VRSGKLWSKCIDDVIVKY

SEQ ID NO: 2974909 - protein, 19 aa, Entamoeba invadens
VRSIGLCCFGWCTSLNSVT

SEQ ID NO: 2974910 - protein, 17 aa, Entamoeba invadens
VRSIGYYCFSRCYSLSS

SEQ ID NO: 2974911 - protein, 17 aa, Entamoeba invadens
VRSINCRSFYGCRNLRN

SEQ ID NO: 2974912 - protein, 18 aa, Entamoeba invadens
VRSIPEFQVSLTDFVYLK

SEQ ID NO: 2974913 - protein, 23 aa, Entamoeba invadens
VRSKVPMAAPPVAAQQVPSQPQQ

SEQ ID NO: 2974914 - protein, 23 aa, Entamoeba invadens
VRSLARRQSRGWTVTENDLNKKR

SEQ ID NO: 2974915 - protein, 17 aa, Entamoeba invadens
VRSLLVVLIYHVFVMGH

SEQ ID NO: 2974916 - protein, 24 aa, Entamoeba invadens
VRSNSKGGIGFLADHRRLNVALTR

SEQ ID NO: 2974917 - protein, 21 aa, Entamoeba invadens
VRSVGRFCFYNSVGEENIIFE

SEQ ID NO: 2974918 - protein, 20 aa, Entamoeba invadens
VRSVLLIFGELNFKSGNKEL

SEQ ID NO: 2974919 - protein, 31 aa, Entamoeba invadens
VRTIGKQCFKGCGLLKIIPLPITVESYGAST

SEQ ID NO: 2974920 - protein, 19 aa, Entamoeba invadens
VRTKNGWRQLSGNEMSNII

SEQ ID NO: 2974921 - protein, 20 aa, Entamoeba invadens
VRTLLFTAVFSKPVHARKLL

SEQ ID NO: 2974922 - protein, 21 aa, Entamoeba invadens
VRTLQAATHFKYITGKSPITG

SEQ ID NO: 2974923 - protein, 19 aa, Entamoeba invadens
VRTQNMWKIPTPVQKTLQT

SEQ ID NO: 2974924 - protein, 17 aa, Entamoeba invadens
VRTRGGKRLVVVKHETV

SEQ ID NO: 2974925 - protein, 21 aa, Entamoeba invadens
VRTSFCLDTIEIAEDMKIDGK

SEQ ID NO: 2974926 - protein, 17 aa, Entamoeba invadens
VRVICWEYPGFCEENPQ

SEQ ID NO: 2974927 - protein, 24 aa, Entamoeba invadens
VRVLLKCLVNLGGMDIDGYEESDD

SEQ ID NO: 2974928 - protein, 17 aa, Entamoeba invadens
VRVLPLINYQNFQMNIS

SEQ ID NO: 2974929 - protein, 17 aa, Entamoeba invadens
VRVNISQIFVRFSNRDL

SEQ ID NO: 2974930 - protein, 17 aa, Entamoeba invadens
VRVSRKFKDVLLQFHIN

SEQ ID NO: 2974931 - protein, 28 aa, Entamoeba invadens
VRVTEIPRSEAFIFIGYDEDTINTYTNT

SEQ ID NO: 2974932 - protein, 19 aa, Entamoeba invadens
VRWIESMVGVGIDPDLCKS

SEQ ID NO: 2974933 - protein, 24 aa, Entamoeba invadens
VRYFADGYQFGWVNANNIKPFGEN

SEQ ID NO: 2974934 - protein, 17 aa, Entamoeba invadens
VRYKNGTKNIDFVDARN

SEQ ID NO: 2974935 - protein, 17 aa, Entamoeba invadens
VRYMALKLLDNINNKFV

SEQ ID NO: 2974936 - protein, 25 aa, Entamoeba invadens
VRYNLFCLLKSPILKMEKNYITAAH

SEQ ID NO: 2974937 - protein, 41 aa, Entamoeba invadens
VRYPLPEIFNLPKGWGMGCDRGELYFINWNKKYTTWIDPRT

SEQ ID NO: 2974938 - protein, 22 aa, Entamoeba invadens
VRYPPPEWNQSLDLLMKTNNWS

SEQ ID NO: 2974939 - protein, 25 aa, Entamoeba invadens
VRYWPEDTFSVFFDRNRLQSVINSF

SEQ ID NO: 2974940 - protein, 20 aa, Entamoeba invadens
VSAFGKCYNLLEVVIPKSIK

SEQ ID NO: 2974941 - protein, 18 aa, Entamoeba invadens
VSAGKTSEGIKCLETAIT

SEQ ID NO: 2974942 - protein, 25 aa, Entamoeba invadens
VSAHLHEWIDLIFGYKQQGEAALKA

SEQ ID NO: 2974943 - protein, 24 aa, Entamoeba invadens
VSAIYPGCFYDCNFIDKVTIPPSV

SEQ ID NO: 2974944 - protein, 24 aa, Entamoeba invadens
VSAIYPGCFYDCNFINKVTIPPSV

SEQ ID NO: 2974945 - protein, 24 aa, Entamoeba invadens
VSAKEMKNSPIVVFVKVLRKGGDD

SEQ ID NO: 2974946 - protein, 20 aa, Entamoeba invadens
VSAKVVTFGRTYVKSKGFGF

SEQ ID NO: 2974947 - protein, 18 aa, Entamoeba invadens
VSALRALVFVKLIGPALV

SEQ ID NO: 2974948 - protein, 25 aa, Entamoeba invadens
VSALRIRLGVKGERYLHGTVSDFEM

SEQ ID NO: 2974949 - protein, 20 aa, Entamoeba invadens
VSANCITDAIAYWMDNKVIT

SEQ ID NO: 2974950 - protein, 31 aa, Entamoeba invadens
VSAQRDPKKWWKFAFTATRDYLRQKEEDKTP

SEQ ID NO: 2974951 - protein, 24 aa, Entamoeba invadens
VSARSGKNVTDFFVTLAKLLLKAK

SEQ ID NO: 2974952 - protein, 20 aa, Entamoeba invadens
VSAYWIDYGHIIKCSSSSYY

SEQ ID NO: 2974953 - protein, 20 aa, Entamoeba invadens
VSCGEALQPTQYVFIPQESH

SEQ ID NO: 2974954 - protein, 24 aa, Entamoeba invadens
VSCGSCHTLALNVWGEIFSWGQDD

SEQ ID NO: 2974955 - protein, 25 aa, Entamoeba invadens
VSCIPDFLCDSCSSLKRVEVSKKLI

SEQ ID NO: 2974956 - protein, 22 aa, Entamoeba invadens
VSCTNAGFGKSLIKSASELDDL

SEQ ID NO: 2974957 - protein, 27 aa, Entamoeba invadens
VSCVCKILCVPGCPFQPQAILPQLIRF

SEQ ID NO: 2974958 - protein, 25 aa, Entamoeba invadens
VSDDELRARLDVIEKREAEVAQKEK

SEQ ID NO: 2974959 - protein, 24 aa, Entamoeba invadens
VSDEEYDVLLSLDFFNKSTSDNKM

SEQ ID NO: 2974960 - protein, 18 aa, Entamoeba invadens
VSDEVFRRTLTYLMSTNK

SEQ ID NO: 2974961 - protein, 26 aa, Entamoeba invadens
VSDFEMFNCLSLIKAIVTDSPLCRNE

SEQ ID NO: 2974962 - protein, 27 aa, Entamoeba invadens
VSDFPRNYFCKSVKFTLQRNEGGCDVS

SEQ ID NO: 2974963 - protein, 21 aa, Entamoeba invadens
VSDGRCVLVGLKADLKDVKQS

SEQ ID NO: 2974964 - protein, 17 aa, Entamoeba invadens
VSDGVRIISEFVGSERT

SEQ ID NO: 2974965 - protein, 26 aa, Entamoeba invadens
VSDHLNEWIDLIFGYKQRGEMAEKWC

SEQ ID NO: 2974966 - protein, 31 aa, Entamoeba invadens
VSDHRRMNVALTRARKGLVVVGNMRTLSTDQ

SEQ ID NO: 2974967 - protein, 24 aa, Entamoeba invadens
VSDKKRLGTFIFNIIDEDRSGNIS

SEQ ID NO: 2974968 - protein, 18 aa, Entamoeba invadens
VSDKVCYVGVGPKLYNVS

SEQ ID NO: 2974969 - protein, 18 aa, Entamoeba invadens
VSDLIPYIMQIALKKLCS

SEQ ID NO: 2974970 - protein, 23 aa, Entamoeba invadens
VSDNRFGVILKFNQLKEELSRLL

SEQ ID NO: 2974971 - protein, 23 aa, Entamoeba invadens
VSDRMIYKLGYVNRVMDILRRRR

SEQ ID NO: 2974972 - protein, 26 aa, Entamoeba invadens
VSDRMMYKLGYVDRVMDVLKRRQNNV

SEQ ID NO: 2974973 - protein, 18 aa, Entamoeba invadens
VSDSLVFFHPAIKSLFGG

SEQ ID NO: 2974974 - protein, 32 aa, Entamoeba invadens
VSDYVVSGVFLKDAFMDVCLYKMSQYKTVMKK

SEQ ID NO: 2974975 - protein, 25 aa, Entamoeba invadens
VSEALKKLQTEFERKTSEDETLKQE

SEQ ID NO: 2974976 - protein, 17 aa, Entamoeba invadens
VSECADLLQAIVMIPME

SEQ ID NO: 2974977 - protein, 17 aa, Entamoeba invadens
VSECSRVNNIIQFYGSN

SEQ ID NO: 2974978 - protein, 18 aa, Entamoeba invadens
VSEECPEAILLINKSVSF

SEQ ID NO: 2974979 - protein, 18 aa, Entamoeba invadens
VSEECPEAILLINQSVTI

SEQ ID NO: 2974980 - protein, 17 aa, Entamoeba invadens
VSEEFKNTLNVIKGDTV

SEQ ID NO: 2974981 - protein, 19 aa, Entamoeba invadens
VSEEQAMEWCKLHNHQYFE

SEQ ID NO: 2974982 - protein, 17 aa, Entamoeba invadens
VSEFGVVMLRRLLENPE

SEQ ID NO: 2974983 - protein, 22 aa, Entamoeba invadens
VSEFLTSELLRLLHKKRGVNYK

SEQ ID NO: 2974984 - protein, 17 aa, Entamoeba invadens
VSEFMTWVEDEERLSVE

SEQ ID NO: 2974985 - protein, 17 aa, Entamoeba invadens
VSEFVESYTSYKQTILE

SEQ ID NO: 2974986 - protein, 29 aa, Entamoeba invadens
VSELLKCRLLRKIDVRGCNVVKQYKTACV

SEQ ID NO: 2974987 - protein, 19 aa, Entamoeba invadens
VSEMLKPILCRFCGKTPHF

SEQ ID NO: 2974988 - protein, 22 aa, Entamoeba invadens
VSENLLAGVAMERRCVYMFGSN

SEQ ID NO: 2974989 - protein, 18 aa, Entamoeba invadens
VSENPVYYSLVLKHVIMK

SEQ ID NO: 2974990 - protein, 23 aa, Entamoeba invadens
VSERELYKPISFSIVSKLSSKLD

SEQ ID NO: 2974991 - protein, 30 aa, Entamoeba invadens
VSESLLALKFWKLDFGKEWCDKNMTDPHEV

SEQ ID NO: 2974992 - protein, 19 aa, Entamoeba invadens
VSESVKFFLQIVSALEYIH

SEQ ID NO: 2974993 - protein, 18 aa, Entamoeba invadens
VSEVAKRLGVPITSAEIL

SEQ ID NO: 2974994 - protein, 23 aa, Entamoeba invadens
VSEVFRWKYPLPGDGDFSYVCCN

SEQ ID NO: 2974995 - protein, 21 aa, Entamoeba invadens
VSEYAKALLLLILREKKCVLA

SEQ ID NO: 2974996 - protein, 18 aa, Entamoeba invadens
VSFEFDNALPFVVPSYEF

SEQ ID NO: 2974997 - protein, 27 aa, Entamoeba invadens
VSFGCSICRIGGLAFCECKSLVDVKLP

SEQ ID NO: 2974998 - protein, 18 aa, Entamoeba invadens
VSFGSQFDSLFSGLKKYD

SEQ ID NO: 2974999 - protein, 19 aa, Entamoeba invadens
VSFHPCVRIGRWEQQKVLS

SEQ ID NO: 2975000 - protein, 23 aa, Entamoeba invadens
VSFLEGLVFVFVYFMDVAHAEEC

SEQ ID NO: 2975001 - protein, 24 aa, Entamoeba invadens
VSFLGNSCFENCFSLKKVVFPSFF

SEQ ID NO: 2975002 - protein, 20 aa, Entamoeba invadens
VSFNKALLMGMYQFFVVPDK

SEQ ID NO: 2975003 - protein, 21 aa, Entamoeba invadens
VSFNLCERVSRLGIAEIANEV

SEQ ID NO: 2975004 - protein, 21 aa, Entamoeba invadens
VSFRRRFLETFTEFQKQNFPN

SEQ ID NO: 2975005 - protein, 18 aa, Entamoeba invadens
VSFSHGRIYPAMLEQYGV

SEQ ID NO: 2975006 - protein, 27 aa, Entamoeba invadens
VSFSRRVSVRLSFRIMEIMGMVAVCPD

SEQ ID NO: 2975007 - protein, 27 aa, Entamoeba invadens
VSFYTLKVPIYFMMKKVESIEPRQSAE

SEQ ID NO: 2975008 - protein, 24 aa, Entamoeba invadens
VSGCPLKVLRMAGGKDKGGKLGIN

SEQ ID NO: 2975009 - protein, 23 aa, Entamoeba invadens
VSGCSVLTSLVCENGTSFDLKKI

SEQ ID NO: 2975010 - protein, 17 aa, Entamoeba invadens
VSGDLSGVVKVWDIMGV

SEQ ID NO: 2975011 - protein, 17 aa, Entamoeba invadens
VSGEMKYTNILYCSYDE

SEQ ID NO: 2975012 - protein, 17 aa, Entamoeba invadens
VSGKLKISATVVVNEEE

SEQ ID NO: 2975013 - protein, 20 aa, Entamoeba invadens
VSGKMLYNFIEDGVKVIGEI

SEQ ID NO: 2975014 - protein, 17 aa, Entamoeba invadens
VSGLGLQYIKGREWFCQ

SEQ ID NO: 2975015 - protein, 17 aa, Entamoeba invadens
VSGLGLQYVKGREWFCQ

SEQ ID NO: 2975016 - protein, 18 aa, Entamoeba invadens
VSGLILAGIADFKTVLNK

SEQ ID NO: 2975017 - protein, 17 aa, Entamoeba invadens
VSGNVQIWGIWSTIKPL

SEQ ID NO: 2975018 - protein, 21 aa, Entamoeba invadens
VSGPCTFGPGLFVSGPCTFVP

SEQ ID NO: 2975019 - protein, 17 aa, Entamoeba invadens
VSGRTPFHYAVLGGHLG

SEQ ID NO: 2975020 - protein, 27 aa, Entamoeba invadens
VSGRVVGKFRFRMMLERSQVHTVFRIP

SEQ ID NO: 2975021 - protein, 18 aa, Entamoeba invadens
VSGSRLTPYIIEKGTMTR

SEQ ID NO: 2975022 - protein, 17 aa, Entamoeba invadens
VSGSVLRQGKCSKEGRT

SEQ ID NO: 2975023 - protein, 19 aa, Entamoeba invadens
VSGYCYGKLVSKYTKTFES

SEQ ID NO: 2975024 - protein, 18 aa, Entamoeba invadens
VSGYKLKTNSFFHSRKSQ

SEQ ID NO: 2975025 - protein, 27 aa, Entamoeba invadens
VSHDWKCLELLLKFLADSSVYLDTERF

SEQ ID NO: 2975026 - protein, 25 aa, Entamoeba invadens
VSHFHEFPKVYLALAKEKLLENMKG

SEQ ID NO: 2975027 - protein, 25 aa, Entamoeba invadens
VSHLAWKISECVRGFSKDIPVTKLQ

SEQ ID NO: 2975028 - protein, 18 aa, Entamoeba invadens
VSHPFITGMEITKLANER

SEQ ID NO: 2975029 - protein, 28 aa, Entamoeba invadens
VSHPQNRWMIQFPRIFHVCRGKKENFTF

SEQ ID NO: 2975030 - protein, 29 aa, Entamoeba invadens
VSHQLSLRPLLSWKDARVIELAEKHNGAV

SEQ ID NO: 2975031 - protein, 22 aa, Entamoeba invadens
VSHTLLPTSKQHLFFQNYQYQQ

SEQ ID NO: 2975032 - protein, 17 aa, Entamoeba invadens
VSIAFQIIQYVFYNPNT

SEQ ID NO: 2975033 - protein, 22 aa, Entamoeba invadens
VSICHRHHVVIISDEIHCDIIL

SEQ ID NO: 2975034 - protein, 25 aa, Entamoeba invadens
VSIDVTSCFPWFSSKTETKCFESSS

SEQ ID NO: 2975035 - protein, 17 aa, Entamoeba invadens
VSIGEEMNGWDAFVKTS

SEQ ID NO: 2975036 - protein, 18 aa, Entamoeba invadens
VSIIDVPSGVLFCAKYAF

SEQ ID NO: 2975037 - protein, 20 aa, Entamoeba invadens
VSIIYRADDYYKMFIDGGTN

SEQ ID NO: 2975038 - protein, 23 aa, Entamoeba invadens
VSIKEVIKELVNYVLNNVKKVLD

SEQ ID NO: 2975039 - protein, 27 aa, Entamoeba invadens
VSILPELCFHECIKMTGITLPKGVKYI

SEQ ID NO: 2975040 - protein, 24 aa, Entamoeba invadens
VSINPHGPWCLIPTDLETHFQTVF

SEQ ID NO: 2975041 - protein, 23 aa, Entamoeba invadens
VSIPINCTLFLKKNGYEEKGLEL

SEQ ID NO: 2975042 - protein, 17 aa, Entamoeba invadens
VSIPLKKVFLIPQTHDG

SEQ ID NO: 2975043 - protein, 23 aa, Entamoeba invadens
VSIRVLSKFSMRLKDWEAVFDDA

SEQ ID NO: 2975044 - protein, 17 aa, Entamoeba invadens
VSISVKRGEYVCIYGTS

SEQ ID NO: 2975045 - protein, 26 aa, Entamoeba invadens
VSITANCGYALFGLKHHCELYRCSSS

SEQ ID NO: 2975046 - protein, 20 aa, Entamoeba invadens
VSITLIVNEFIHLMQHAIDS

SEQ ID NO: 2975047 - protein, 22 aa, Entamoeba invadens
VSIVQHLKLYKRIFTSYLDSPI

SEQ ID NO: 2975048 - protein, 26 aa, Entamoeba invadens
VSIVRPRSLLFISIDGVCPVAKMVQQ

SEQ ID NO: 2975049 - protein, 19 aa, Entamoeba invadens
VSIYVLESFGLKVKDQKSL

SEQ ID NO: 2975050 - protein, 23 aa, Entamoeba invadens
VSKAGAIQRCGRAGRTEEGICYR

SEQ ID NO: 2975051 - protein, 24 aa, Entamoeba invadens
VSKALLPCIVLFPDVYKTVKNTAI

SEQ ID NO: 2975052 - protein, 23 aa, Entamoeba invadens
VSKDRLKAVVGNVQRLGITNTIV

SEQ ID NO: 2975053 - protein, 23 aa, Entamoeba invadens
VSKDVLWCLSNIVASNLTSVHNK

SEQ ID NO: 2975054 - protein, 23 aa, Entamoeba invadens
VSKEILLFLKAMLNIRNTNNKEI

SEQ ID NO: 2975055 - protein, 25 aa, Entamoeba invadens
VSKELKDFIARCFVFDFKQRPSCAE

SEQ ID NO: 2975056 - protein, 19 aa, Entamoeba invadens
VSKEWFSLITKEIFNVDFG

SEQ ID NO: 2975057 - protein, 25 aa, Entamoeba invadens
VSKGKVVGDFKCRGIYYESERTKKL

SEQ ID NO: 2975058 - protein, 17 aa, Entamoeba invadens
VSKGVGFYFGYTEEIDT

SEQ ID NO: 2975059 - protein, 30 aa, Entamoeba invadens
VSKIGKTCFRYCIFLHDIKLPIGLKEIPKK

SEQ ID NO: 2975060 - protein, 26 aa, Entamoeba invadens
VSKIGKTCFRYCIFLQDIKLLGLKEI

SEQ ID NO: 2975061 - protein, 25 aa, Entamoeba invadens
VSKIPKFCFNFCFSMKHIEIPNTVV

SEQ ID NO: 2975062 - protein, 24 aa, Entamoeba invadens
VSKIPRGCFENCFGLKEVVSSEFL

SEQ ID NO: 2975063 - protein, 25 aa, Entamoeba invadens
VSKKEKYKILSIDGGGMKGILEAIL

SEQ ID NO: 2975064 - protein, 25 aa, Entamoeba invadens
VSKKGRASLPAGIKIPHPDTDKIEH

SEQ ID NO: 2975065 - protein, 20 aa, Entamoeba invadens
VSKKLARPVGAKYSGERKID

SEQ ID NO: 2975066 - protein, 34 aa, Entamoeba invadens
VSKKRKGLESGSCLDVPLLLKWTDEYEPLPTDPW

SEQ ID NO: 2975067 - protein, 25 aa, Entamoeba invadens
VSKLFKEIIEKLVIYIDTVKEDQTE

SEQ ID NO: 2975068 - protein, 20 aa, Entamoeba invadens
VSKNALNRVAIWAIGEYGDL

SEQ ID NO: 2975069 - protein, 17 aa, Entamoeba invadens
VSKNTYERYMFERASMK

SEQ ID NO: 2975070 - protein, 17 aa, Entamoeba invadens
VSKRKAKMVKNIANNID

SEQ ID NO: 2975071 - protein, 23 aa, Entamoeba invadens
VSKRPRRQGSLWLPEEDAKLLEA

SEQ ID NO: 2975072 - protein, 22 aa, Entamoeba invadens
VSKRYPSKIEVLLKYKPVKDED

SEQ ID NO: 2975073 - protein, 23 aa, Entamoeba invadens
VSKSCLESVKMLHINPWFISIQN

SEQ ID NO: 2975074 - protein, 21 aa, Entamoeba invadens
VSKVKAGLKVAKGLKKAATGK

SEQ ID NO: 2975075 - protein, 21 aa, Entamoeba invadens
VSKVMPIPWCHPTDVKQGLRR

SEQ ID NO: 2975076 - protein, 20 aa, Entamoeba invadens
VSKYALFVFLKRVIMCDVDK

SEQ ID NO: 2975077 - protein, 25 aa, Entamoeba invadens
VSKYVTGICFRKHVAEIPPDDLSDV

SEQ ID NO: 2975078 - protein, 19 aa, Entamoeba invadens
VSLAALILHQIGKDITAET

SEQ ID NO: 2975079 - protein, 18 aa, Entamoeba invadens
VSLDCLKDLTSVDMSVVK

SEQ ID NO: 2975080 - protein, 19 aa, Entamoeba invadens
VSLDRLIYLMKIFGEFFYK

SEQ ID NO: 2975081 - protein, 28 aa, Entamoeba invadens
VSLECRKLSSVIYPSFVSFINDMCLVDV

SEQ ID NO: 2975082 - protein, 26 aa, Entamoeba invadens
VSLFTDERHTVWLPINMNIENLSLTE

SEQ ID NO: 2975083 - protein, 25 aa, Entamoeba invadens
VSLGKNCFYDCLKLSKIDMPTSVSY

SEQ ID NO: 2975084 - protein, 17 aa, Entamoeba invadens
VSLGLSKCLCDVKLGEA

SEQ ID NO: 2975085 - protein, 19 aa, Entamoeba invadens
VSLGLVIISGFFVFEESAL

SEQ ID NO: 2975086 - protein, 19 aa, Entamoeba invadens
VSLICAFAGAVLAIHVTSQ

SEQ ID NO: 2975087 - protein, 20 aa, Entamoeba invadens
VSLINIFKTGGFAKMQSAVD

SEQ ID NO: 2975088 - protein, 17 aa, Entamoeba invadens
VSLKNLAAKSCRMSIIS

SEQ ID NO: 2975089 - protein, 23 aa, Entamoeba invadens
VSLKNLADRVVWMRDGKVGKIEN

SEQ ID NO: 2975090 - protein, 25 aa, Entamoeba invadens
VSLKRSEVDWLLVMSDGITDVVTEK

SEQ ID NO: 2975091 - protein, 17 aa, Entamoeba invadens
VSLKYFPICSTLKSIGR

SEQ ID NO: 2975092 - protein, 28 aa, Entamoeba invadens
VSLLEYHKKSGLLFPSFLADATNYMKQT

SEQ ID NO: 2975093 - protein, 18 aa, Entamoeba invadens
VSLLPEVPTDLSVLPDNQ

SEQ ID NO: 2975094 - protein, 19 aa, Entamoeba invadens
VSLNFKRSALAANFALSDA

SEQ ID NO: 2975095 - protein, 19 aa, Entamoeba invadens
VSLNGEYKKTAALTKADKI

SEQ ID NO: 2975096 - protein, 17 aa, Entamoeba invadens
VSLPEWHSTGVVPSYYG

SEQ ID NO: 2975097 - protein, 25 aa, Entamoeba invadens
VSLPGIKLSNSFNWNYGFDSTFTSL

SEQ ID NO: 2975098 - protein, 25 aa, Entamoeba invadens
VSLRPHPFDPFVVSAIPFINDPFQT

SEQ ID NO: 2975099 - protein, 17 aa, Entamoeba invadens
VSLRRYQELQIFDLKQI

SEQ ID NO: 2975100 - protein, 18 aa, Entamoeba invadens
VSLSKKARTDCGINVLVH

SEQ ID NO: 2975101 - protein, 23 aa, Entamoeba invadens
VSLTRLRCFIGYFHVIHNNMKNQ

SEQ ID NO: 2975102 - protein, 18 aa, Entamoeba invadens
VSLVIAFAGIPPQTTTLD

SEQ ID NO: 2975103 - protein, 20 aa, Entamoeba invadens
VSLYKKRTVMDIELVLPGLL

SEQ ID NO: 2975104 - protein, 23 aa, Entamoeba invadens
VSMAWLDECLKLQKSVEKELFLY

SEQ ID NO: 2975105 - protein, 19 aa, Entamoeba invadens
VSMCGLKLSQLCDKVDTFS

SEQ ID NO: 2975106 - protein, 19 aa, Entamoeba invadens
VSMKCFNLFYGCYSCDYKQ

SEQ ID NO: 2975107 - protein, 25 aa, Entamoeba invadens
VSMKCSNLFYGCYSCDYKQLNLTID

SEQ ID NO: 2975108 - protein, 25 aa, Entamoeba invadens
VSMKGDLDVGVLICNKEIIPFDMRR

SEQ ID NO: 2975109 - protein, 25 aa, Entamoeba invadens
VSMKGWATACRWAKEIVRCNEDEIR

SEQ ID NO: 2975110 - protein, 24 aa, Entamoeba invadens
VSMKKANNLIGIWVDTKDSNFKDN

SEQ ID NO: 2975111 - protein, 24 aa, Entamoeba invadens
VSMKSPRKSMMFIFDSSQNASVDL

SEQ ID NO: 2975112 - protein, 18 aa, Entamoeba invadens
VSMPDGWEFPSKKHTEQC

SEQ ID NO: 2975113 - protein, 23 aa, Entamoeba invadens
VSMPRSGSTFAHHVMSSDPLATS

SEQ ID NO: 2975114 - protein, 23 aa, Entamoeba invadens
VSMPRSGSTFAHSVMSSDPYATS

SEQ ID NO: 2975115 - protein, 26 aa, Entamoeba invadens
VSNDFRAELELALYELHEIWMLSEEM

SEQ ID NO: 2975116 - protein, 22 aa, Entamoeba invadens
VSNDNCTYCFGCTNHCIDGYKC

SEQ ID NO: 2975117 - protein, 26 aa, Entamoeba invadens
VSNEAKFDREFIRLRRFVFGMCKKNF

SEQ ID NO: 2975118 - protein, 20 aa, Entamoeba invadens
VSNFAEWRDSTLVYRRYANL

SEQ ID NO: 2975119 - protein, 26 aa, Entamoeba invadens
VSNINFYCFPELFKPRKQVIDIKEPF

SEQ ID NO: 2975120 - protein, 34 aa, Entamoeba invadens
VSNLFLEFFKSMLGHFRYYFDVSKDGGTGFNVEA

SEQ ID NO: 2975121 - protein, 18 aa, Entamoeba invadens
VSNLIGVQILSMSKRIMN

SEQ ID NO: 2975122 - protein, 26 aa, Entamoeba invadens
VSNLTNWGIALKYFFLDIGFTAKHLL

SEQ ID NO: 2975123 - protein, 25 aa, Entamoeba invadens
VSNRASFEGISFWIADVKEKGNTKY

SEQ ID NO: 2975124 - protein, 22 aa, Entamoeba invadens
VSNTMKNCLSRSSFKEKGEEKT

SEQ ID NO: 2975125 - protein, 19 aa, Entamoeba invadens
VSPAFSFALSAGRQDVLSD

SEQ ID NO: 2975126 - protein, 22 aa, Entamoeba invadens
VSPCDILICCGDHLNFVTTDEI

SEQ ID NO: 2975127 - protein, 30 aa, Entamoeba invadens
VSPELCGMRLCKLAVMLVALGGVPHLDEVT

SEQ ID NO: 2975128 - protein, 18 aa, Entamoeba invadens
VSPFKMAKLTIENNINFV

SEQ ID NO: 2975129 - protein, 24 aa, Entamoeba invadens
VSPFKYEFPVIPVLTKSTFDLIDS

SEQ ID NO: 2975130 - protein, 32 aa, Entamoeba invadens
VSPFREFIRSGLLMKVCRKFNKERYFYLFNDM

SEQ ID NO: 2975131 - protein, 26 aa, Entamoeba invadens
VSPGEFACGVGRGSKKLLTSTGSGVL

SEQ ID NO: 2975132 - protein, 25 aa, Entamoeba invadens
VSPGVCYRLYTKEAFIKELPAATPP

SEQ ID NO: 2975133 - protein, 21 aa, Entamoeba invadens
VSPLCTVIVQLLLREAVTVVF

SEQ ID NO: 2975134 - protein, 26 aa, Entamoeba invadens
VSPLPKIRGADCFKDCKLLNLKLDGG

SEQ ID NO: 2975135 - protein, 25 aa, Entamoeba invadens
VSPNMGMLRQVNFQMAMNPAFMGQM

SEQ ID NO: 2975136 - protein, 19 aa, Entamoeba invadens
VSPPFYFAVTCGRQELFDE

SEQ ID NO: 2975137 - protein, 25 aa, Entamoeba invadens
VSPPKYCVRPSVVSFIDTMEVSEGS

SEQ ID NO: 2975138 - protein, 20 aa, Entamoeba invadens
VSPQFSQKVEKVFKVDKKKG

SEQ ID NO: 2975139 - protein, 17 aa, Entamoeba invadens
VSPQKKFVIPFTAQPSE

SEQ ID NO: 2975140 - protein, 18 aa, Entamoeba invadens
VSPRGMNGSSHMSTVSMA

SEQ ID NO: 2975141 - protein, 20 aa, Entamoeba invadens
VSPSRYGLATVHDRDVLIYC

SEQ ID NO: 2975142 - protein, 33 aa, Entamoeba invadens
VSPYLIRFYGACFIPNRICMVTELAKYGSLQDM

SEQ ID NO: 2975143 - protein, 26 aa, Entamoeba invadens
VSPYLRQFLLACFDRDINLRKTAKEL

SEQ ID NO: 2975144 - protein, 23 aa, Entamoeba invadens
VSQEMKCVVAHKLFEDGMNYLKL

SEQ ID NO: 2975145 - protein, 20 aa, Entamoeba invadens
VSQFIQRDWVRNGSDAEQQF

SEQ ID NO: 2975146 - protein, 22 aa, Entamoeba invadens
VSQGNVLFEWIVTMRLALRCLI

SEQ ID NO: 2975147 - protein, 26 aa, Entamoeba invadens
VSQHKPVICSASLYLQEFDKKKKAEV

SEQ ID NO: 2975148 - protein, 23 aa, Entamoeba invadens
VSQKSELRRCTKLNSPRKSKKSE

SEQ ID NO: 2975149 - protein, 26 aa, Entamoeba invadens
VSQLDERLVWFVTFVFEKRIRREWFE

SEQ ID NO: 2975150 - protein, 31 aa, Entamoeba invadens
VSQRWLPEVKHFCPNAPFLLAATKTDLRESE

SEQ ID NO: 2975151 - protein, 24 aa, Entamoeba invadens
VSQVVDIFGVFKFKVKQGDDLLNE

SEQ ID NO: 2975152 - protein, 24 aa, Entamoeba invadens
VSRCASMFETLNRWLYSPNSLTKT

SEQ ID NO: 2975153 - protein, 36 aa, Entamoeba invadens
VSRFLCNDCGLDFKKRFGSFKFNWMEPFNNTEFLMF

SEQ ID NO: 2975154 - protein, 19 aa, Entamoeba invadens
VSRKERRIQVSSLMLIGHI

SEQ ID NO: 2975155 - protein, 24 aa, Entamoeba invadens
VSRKRFIKSAIQFARKYNMDGIDI

SEQ ID NO: 2975156 - protein, 23 aa, Entamoeba invadens
VSRKVKMSKEFQVVSPHYVMDER

SEQ ID NO: 2975157 - protein, 24 aa, Entamoeba invadens
VSRNFSWPCSDFVSVREIQTAMNL

SEQ ID NO: 2975158 - protein, 24 aa, Entamoeba invadens
VSRRFSRDNIEIMFHVSTYMPLME

SEQ ID NO: 2975159 - protein, 20 aa, Entamoeba invadens
VSRYAVVDWCSPDAVRTREI

SEQ ID NO: 2975160 - protein, 17 aa, Entamoeba invadens
VSSCIRMLLDIPNATNL

SEQ ID NO: 2975161 - protein, 23 aa, Entamoeba invadens
VSSDGRSGVLLSSEIEETRSGKN

SEQ ID NO: 2975162 - protein, 17 aa, Entamoeba invadens
VSSEIDPFFPLNGDYSK

SEQ ID NO: 2975163 - protein, 24 aa, Entamoeba invadens
VSSEYLVHAGVKCYAIAETHKYGH

SEQ ID NO: 2975164 - protein, 23 aa, Entamoeba invadens
VSSFECYQNWFGRQSLLVPQISN

SEQ ID NO: 2975165 - protein, 19 aa, Entamoeba invadens
VSSFRLLRSLPLSCYIDKV

SEQ ID NO: 2975166 - protein, 17 aa, Entamoeba invadens
VSSGFEFGWNKLVENND

SEQ ID NO: 2975167 - protein, 23 aa, Entamoeba invadens
VSSHPNSSLLIMRSEIEETEPQF

SEQ ID NO: 2975168 - protein, 20 aa, Entamoeba invadens
VSSIELMWTIYRRWDEYVKY

SEQ ID NO: 2975169 - protein, 25 aa, Entamoeba invadens
VSSKGDSALNCLCNASLNIEALELL

SEQ ID NO: 2975170 - protein, 17 aa, Entamoeba invadens
VSSLFYPLLTLREQESD

SEQ ID NO: 2975171 - protein, 21 aa, Entamoeba invadens
VSSLGLKTSNSFECGLVSLIS

SEQ ID NO: 2975172 - protein, 17 aa, Entamoeba invadens
VSSLLGLLTETYHLIIY

SEQ ID NO: 2975173 - protein, 24 aa, Entamoeba invadens
VSSLPYKLTLSIRSSNEITFGEVK

SEQ ID NO: 2975174 - protein, 17 aa, Entamoeba invadens
VSSLRIEPTPLLLTAIV

SEQ ID NO: 2975175 - protein, 21 aa, Entamoeba invadens
VSSLSLFYSFFMKDITLPKLY

SEQ ID NO: 2975176 - protein, 19 aa, Entamoeba invadens
VSSLTGFNVYTAIKTMSSI

SEQ ID NO: 2975177 - protein, 23 aa, Entamoeba invadens
VSSREFPDPISPKSDNSENGIKG

SEQ ID NO: 2975178 - protein, 20 aa, Entamoeba invadens
VSSRMCLVCISSENEKNEIA

SEQ ID NO: 2975179 - protein, 26 aa, Entamoeba invadens
VSSSYSSSCGRKPSPPKYGNVSPNSF

SEQ ID NO: 2975180 - protein, 18 aa, Entamoeba invadens
VSSVELYKLPTIPENLAL

SEQ ID NO: 2975181 - protein, 22 aa, Entamoeba invadens
VSTCAKCNVKGGYYQYVEFTTI

SEQ ID NO: 2975182 - protein, 30 aa, Entamoeba invadens
VSTCCDGKCSVVFALFWKGGLFGVFNRELL

SEQ ID NO: 2975183 - protein, 17 aa, Entamoeba invadens
VSTDLLCGCITKCRTVY

SEQ ID NO: 2975184 - protein, 19 aa, Entamoeba invadens
VSTEAFFFVNAVAASLEKN

SEQ ID NO: 2975185 - protein, 24 aa, Entamoeba invadens
VSTKCKSVLGAVLLSAGLTTDVAI

SEQ ID NO: 2975186 - protein, 17 aa, Entamoeba invadens
VSTKFTAKNYIASGYHC

SEQ ID NO: 2975187 - protein, 23 aa, Entamoeba invadens
VSTKNFFLFTWKNKIFKTYERKE

SEQ ID NO: 2975188 - protein, 18 aa, Entamoeba invadens
VSTKRFDCENFRLFDEYE

SEQ ID NO: 2975189 - protein, 25 aa, Entamoeba invadens
VSTKYSLLFVNRVRSVLGIAPVSEN

SEQ ID NO: 2975190 - protein, 24 aa, Entamoeba invadens
VSTLDWDVTLCRIFINRLTQTQLL

SEQ ID NO: 2975191 - protein, 25 aa, Entamoeba invadens
VSTQKQAYFSMCYFSEECTSSLTNV

SEQ ID NO: 2975192 - protein, 24 aa, Entamoeba invadens
VSTRHLPDFERFFLSMITSLGFQC

SEQ ID NO: 2975193 - protein, 21 aa, Entamoeba invadens
VSTRIIGTVALVLSTVAMISE

SEQ ID NO: 2975194 - protein, 17 aa, Entamoeba invadens
VSTRPILLITNRNHDIS

SEQ ID NO: 2975195 - protein, 20 aa, Entamoeba invadens
VSTYLVTPILHFTEYGAVMR

SEQ ID NO: 2975196 - protein, 22 aa, Entamoeba invadens
VSTYRIGVIYIKEGQNTENEYF

SEQ ID NO: 2975197 - protein, 27 aa, Entamoeba invadens
VSVCIIAVQLLMRFEIIHSKNVIHRDV

SEQ ID NO: 2975198 - protein, 17 aa, Entamoeba invadens
VSVCIQYGVLIKNVTEV

SEQ ID NO: 2975199 - protein, 25 aa, Entamoeba invadens
VSVEFLKAIVLPGIGFIGVADDKVV

SEQ ID NO: 2975200 - protein, 20 aa, Entamoeba invadens
VSVGCFMFCSSLKSLEIEED

SEQ ID NO: 2975201 - protein, 18 aa, Entamoeba invadens
VSVGKGYEVMDKCDESGC

SEQ ID NO: 2975202 - protein, 24 aa, Entamoeba invadens
VSVKDNHWLFVFGKNEARDTRDIC

SEQ ID NO: 2975203 - protein, 24 aa, Entamoeba invadens
VSVKSKRVRPALMGNTYELVSFEF

SEQ ID NO: 2975204 - protein, 17 aa, Entamoeba invadens
VSVKVPLHVGWSKMKEE

SEQ ID NO: 2975205 - protein, 24 aa, Entamoeba invadens
VSVLDPRVGNFVSRTQVSNHLVNH

SEQ ID NO: 2975206 - protein, 27 aa, Entamoeba invadens
VSVLPFCCFMRCGSLKRFVIPRTVQYM

SEQ ID NO: 2975207 - protein, 19 aa, Entamoeba invadens
VSVLPQFWTALDKLFEKAL

SEQ ID NO: 2975208 - protein, 21 aa, Entamoeba invadens
VSVLVRGANRLVLDEAERSLH

SEQ ID NO: 2975209 - protein, 23 aa, Entamoeba invadens
VSVQSALVKLDMVDKENTNKISE

SEQ ID NO: 2975210 - protein, 19 aa, Entamoeba invadens
VSVRCVYFYMKCFTENFIL

SEQ ID NO: 2975211 - protein, 20 aa, Entamoeba invadens
VSVSPLLRFEILGLSGKYVL

SEQ ID NO: 2975212 - protein, 19 aa, Entamoeba invadens
VSVVFNGRKEWKYKKYAIV

SEQ ID NO: 2975213 - protein, 21 aa, Entamoeba invadens
VSVYLRFLYEQEIDKENLEKV

SEQ ID NO: 2975214 - protein, 20 aa, Entamoeba invadens
VSVYLRFLYEQEIDKENLSK

SEQ ID NO: 2975215 - protein, 27 aa, Entamoeba invadens
VSYCATEFYNLVGLMLLVFDNTKDSTV

SEQ ID NO: 2975216 - protein, 24 aa, Entamoeba invadens
VSYDCLRESFRPILTPMFDVLMQT

SEQ ID NO: 2975217 - protein, 23 aa, Entamoeba invadens
VSYECHLRLKALGTEKLDSSNKD

SEQ ID NO: 2975218 - protein, 18 aa, Entamoeba invadens
VSYGKRPGSRYRVLCLLG

SEQ ID NO: 2975219 - protein, 17 aa, Entamoeba invadens
VSYHFIRAIVCARDCTQ

SEQ ID NO: 2975220 - protein, 33 aa, Entamoeba invadens
VSYIYGIEAMKDFLKRNDLNLLIRGHQCFENGI

SEQ ID NO: 2975221 - protein, 23 aa, Entamoeba invadens
VSYLECLNIVLVLAGDNVLDVDR

SEQ ID NO: 2975222 - protein, 26 aa, Entamoeba invadens
VSYQSGCTIILTRGGFVVGYFDSPNT

SEQ ID NO: 2975223 - protein, 25 aa, Entamoeba invadens
VSYSCYYNGCTVPNCETCNSSSVCT

SEQ ID NO: 2975224 - protein, 25 aa, Entamoeba invadens
VSYSNASVFLLCFAVNSANSLDNIE

SEQ ID NO: 2975225 - protein, 19 aa, Entamoeba invadens
VSYSYPFVTFRCFDGCINL

SEQ ID NO: 2975226 - protein, 17 aa, Entamoeba invadens
VSYTCLGSFYKTRHRLF

SEQ ID NO: 2975227 - protein, 19 aa, Entamoeba invadens
VTACPAKCLAMTPFDKIGA

SEQ ID NO: 2975228 - protein, 19 aa, Entamoeba invadens
VTACSNLRAMNYCIEPADF

SEQ ID NO: 2975229 - protein, 19 aa, Entamoeba invadens
VTACSNLRAMNYCIQPADF

SEQ ID NO: 2975230 - protein, 18 aa, Entamoeba invadens
VTADLISIHFEKEKPTLT

SEQ ID NO: 2975231 - protein, 24 aa, Entamoeba invadens
VTAIYSMCFFNCVALKTITLPLKL

SEQ ID NO: 2975232 - protein, 28 aa, Entamoeba invadens
VTAKCFGVKVLFYYSRLLNMRSMLEEAE

SEQ ID NO: 2975233 - protein, 21 aa, Entamoeba invadens
VTAKMILRPQGFILTAEISDM

SEQ ID NO: 2975234 - protein, 26 aa, Entamoeba invadens
VTALTIPVNLYFNSLIFLNNLKRISA

SEQ ID NO: 2975235 - protein, 18 aa, Entamoeba invadens
VTANIYFDKNIVGKVIAT

SEQ ID NO: 2975236 - protein, 36 aa, Entamoeba invadens
VTASCVFEGNIFVCGHSLKKLPNCPHRHDGIEQTEC

SEQ ID NO: 2975237 - protein, 23 aa, Entamoeba invadens
VTCEPCIMCASALVECGITKIIY

SEQ ID NO: 2975238 - protein, 19 aa, Entamoeba invadens
VTCIVDLKKVTSAVVKGAI

SEQ ID NO: 2975239 - protein, 20 aa, Entamoeba invadens
VTCRVILPLLLLMITSKELL

SEQ ID NO: 2975240 - protein, 23 aa, Entamoeba invadens
VTDEWDVSAGWWIVSIKGSSAVP

SEQ ID NO: 2975241 - protein, 25 aa, Entamoeba invadens
VTDFEAKFTKVAALFALIENKMRNR

SEQ ID NO: 2975242 - protein, 20 aa, Entamoeba invadens
VTDFEWYLKLLSRLSTQKLE

SEQ ID NO: 2975243 - protein, 18 aa, Entamoeba invadens
VTDIFVIGGCDGMKKERN

SEQ ID NO: 2975244 - protein, 17 aa, Entamoeba invadens
VTDISVAIIKGDLKENK

SEQ ID NO: 2975245 - protein, 17 aa, Entamoeba invadens
VTDLAEKHQQVFNQLVD

SEQ ID NO: 2975246 - protein, 18 aa, Entamoeba invadens
VTDLPIFFHSHNTSGTML

SEQ ID NO: 2975247 - protein, 26 aa, Entamoeba invadens
VTDRVLTCDGCVFVASYDNPNSLDNL

SEQ ID NO: 2975248 - protein, 17 aa, Entamoeba invadens
VTDTISAVGKFDMDITH

SEQ ID NO: 2975249 - protein, 17 aa, Entamoeba invadens
VTEALDAIELWTNRQIL

SEQ ID NO: 2975250 - protein, 18 aa, Entamoeba invadens
VTEFKRLHAYFVNDEEKA

SEQ ID NO: 2975251 - protein, 18 aa, Entamoeba invadens
VTEIKRSNYANCNELTEI

SEQ ID NO: 2975252 - protein, 20 aa, Entamoeba invadens
VTEILKKGQRSLAFRLSHQK

SEQ ID NO: 2975253 - protein, 24 aa, Entamoeba invadens
VTEIPEFFEKIDLIAGLSASSLIC

SEQ ID NO: 2975254 - protein, 23 aa, Entamoeba invadens
VTEKSLQILQSWGNNYTNELFNY

SEQ ID NO: 2975255 - protein, 21 aa, Entamoeba invadens
VTEKYKVLSFNSIEIGTLKLT

SEQ ID NO: 2975256 - protein, 26 aa, Entamoeba invadens
VTELVGGLHVCAKVISQRKFIEQKLN

SEQ ID NO: 2975257 - protein, 23 aa, Entamoeba invadens
VTENRANYAVGFVKEVQKVPTLV

SEQ ID NO: 2975258 - protein, 23 aa, Entamoeba invadens
VTFEIGELVAGLANDTTQCKNTI

SEQ ID NO: 2975259 - protein, 18 aa, Entamoeba invadens
VTFFKTQGIIPLFVFDGA

SEQ ID NO: 2975260 - protein, 17 aa, Entamoeba invadens
VTFKGAEVLTDLEPQIV

SEQ ID NO: 2975261 - protein, 24 aa, Entamoeba invadens
VTFLMKYVGAPGFGEKAAKALRNL

SEQ ID NO: 2975262 - protein, 28 aa, Entamoeba invadens
VTFLPDFHEKFCAFNRHEVLSDKFEGDS

SEQ ID NO: 2975263 - protein, 18 aa, Entamoeba invadens
VTFLPELKNLFNGEELEK

SEQ ID NO: 2975264 - protein, 25 aa, Entamoeba invadens
VTFMGGVCDLSLLQIPKFVKSISLK

SEQ ID NO: 2975265 - protein, 21 aa, Entamoeba invadens
VTFMGGVCDLSLLQIPKYVKS

SEQ ID NO: 2975266 - protein, 23 aa, Entamoeba invadens
VTFQCPFYFVFDTIDTRDVVAFI

SEQ ID NO: 2975267 - protein, 17 aa, Entamoeba invadens
VTFSNKFMKKWMEYSYG

SEQ ID NO: 2975268 - protein, 26 aa, Entamoeba invadens
VTFTRLGYLALMRMLSHFGHYSQQIK

SEQ ID NO: 2975269 - protein, 18 aa, Entamoeba invadens
VTFTVDVNALLTVSAVVV

SEQ ID NO: 2975270 - protein, 18 aa, Entamoeba invadens
VTFVAKWATPVKVEEDIP

SEQ ID NO: 2975271 - protein, 25 aa, Entamoeba invadens
VTFYLESPLIWFKEKRLKMLEDLLD

SEQ ID NO: 2975272 - protein, 19 aa, Entamoeba invadens
VTFYVSFLSSLAFDNNIDF

SEQ ID NO: 2975273 - protein, 27 aa, Entamoeba invadens
VTGEYGWSANMERIMKAQALRDNSMST

SEQ ID NO: 2975274 - protein, 22 aa, Entamoeba invadens
VTGFKPYFYISVDHLYTESELN

SEQ ID NO: 2975275 - protein, 18 aa, Entamoeba invadens
VTGKLCIFVFGDYVTICV

SEQ ID NO: 2975276 - protein, 19 aa, Entamoeba invadens
VTGNSFVMHGLEIITGAIK

SEQ ID NO: 2975277 - protein, 21 aa, Entamoeba invadens
VTGPFKLSGVPLLQINQRYVI

SEQ ID NO: 2975278 - protein, 22 aa, Entamoeba invadens
VTGQGNIMFCFETVKGDVFGCF

SEQ ID NO: 2975279 - protein, 19 aa, Entamoeba invadens
VTGRSDVCIGCFDEDNYTN

SEQ ID NO: 2975280 - protein, 18 aa, Entamoeba invadens
VTGSVVRWEGHVTVLNYK

SEQ ID NO: 2975281 - protein, 31 aa, Entamoeba invadens
VTGVVLLRYVLAFRDFELVRTFDLAVLSTCD

SEQ ID NO: 2975282 - protein, 26 aa, Entamoeba invadens
VTHEPCLFCGMALLHSRFHRVFFIYK

SEQ ID NO: 2975283 - protein, 20 aa, Entamoeba invadens
VTHGHCTLMNGFQIQMMLGM

SEQ ID NO: 2975284 - protein, 25 aa, Entamoeba invadens
VTHIGKFAFKNCISLSSLNSKNVKI

SEQ ID NO: 2975285 - protein, 17 aa, Entamoeba invadens
VTHIGVFAFRKCYSLKE

SEQ ID NO: 2975286 - protein, 19 aa, Entamoeba invadens
VTHIKHFLFKSFDKDVYLC

SEQ ID NO: 2975287 - protein, 18 aa, Entamoeba invadens
VTHLSLPLGENFNPIPAG

SEQ ID NO: 2975288 - protein, 25 aa, Entamoeba invadens
VTHRDGFLALRWTDPMEMTLDKIPI

SEQ ID NO: 2975289 - protein, 30 aa, Entamoeba invadens
VTHWICPHTRYFCHVCHSFVPDQQNRFIEK

SEQ ID NO: 2975290 - protein, 17 aa, Entamoeba invadens
VTIISTFHISRRLVLMI

SEQ ID NO: 2975291 - protein, 18 aa, Entamoeba invadens
VTIKISLYSLLQKRRSLI

SEQ ID NO: 2975292 - protein, 25 aa, Entamoeba invadens
VTIKWQATEIIAIIVTFGGIDIIRK

SEQ ID NO: 2975293 - protein, 26 aa, Entamoeba invadens
VTILEIPYSLLFTFRVPESVQEIHVT

SEQ ID NO: 2975294 - protein, 24 aa, Entamoeba invadens
VTIPKSKFSLFFHSTGDYKSDSIF

SEQ ID NO: 2975295 - protein, 23 aa, Entamoeba invadens
VTIPRGEQVYAFVKFANTESASM

SEQ ID NO: 2975296 - protein, 17 aa, Entamoeba invadens
VTIPVNFLRDGQKTISK

SEQ ID NO: 2975297 - protein, 18 aa, Entamoeba invadens
VTKAMLYFAKKITLRNSI

SEQ ID NO: 2975298 - protein, 23 aa, Entamoeba invadens
VTKELKITIEKNFEEQPTQETTE

SEQ ID NO: 2975299 - protein, 19 aa, Entamoeba invadens
VTKELKLDKIVCACISNDR

SEQ ID NO: 2975300 - protein, 17 aa, Entamoeba invadens
VTKGESIVEMLHLKGSE

SEQ ID NO: 2975301 - protein, 24 aa, Entamoeba invadens
VTKIGNNFVRGCTNLKYVVFENGR

SEQ ID NO: 2975302 - protein, 26 aa, Entamoeba invadens
VTKIGRECFEYCPLDGEKVFRIPPNV

SEQ ID NO: 2975303 - protein, 17 aa, Entamoeba invadens
VTKILGVLGTSVNRNGY

SEQ ID NO: 2975304 - protein, 25 aa, Entamoeba invadens
VTKIPAKIPFIKKVAKPIYKTAKGC

SEQ ID NO: 2975305 - protein, 23 aa, Entamoeba invadens
VTKKDLEKIFGIIRKSFIISQMN

SEQ ID NO: 2975306 - protein, 21 aa, Entamoeba invadens
VTKLGESCFENCPLDGDNVFK

SEQ ID NO: 2975307 - protein, 24 aa, Entamoeba invadens
VTKLGKKCFKNCGVLSHIDTKYIK

SEQ ID NO: 2975308 - protein, 25 aa, Entamoeba invadens
VTKLGKKCFKNCGVLSHIDTKYIKQ

SEQ ID NO: 2975309 - protein, 24 aa, Entamoeba invadens
VTKLKFPGQFDIAFPVEVDNKEVI

SEQ ID NO: 2975310 - protein, 20 aa, Entamoeba invadens
VTKLSEFSFYGCVSLTSILC

SEQ ID NO: 2975311 - protein, 26 aa, Entamoeba invadens
VTKMKIYMVKGCVKFDECLLEVIKIN

SEQ ID NO: 2975312 - protein, 26 aa, Entamoeba invadens
VTKSEMFALGMVRPSHHNDIMFYRGY

SEQ ID NO: 2975313 - protein, 20 aa, Entamoeba invadens
VTKSVFVCALQWLDYLINKN

SEQ ID NO: 2975314 - protein, 26 aa, Entamoeba invadens
VTKVIKFGKGCFGETSVFSWGNQIPN

SEQ ID NO: 2975315 - protein, 23 aa, Entamoeba invadens
VTKVIPGKCNTLYSMLGNKFIDE

SEQ ID NO: 2975316 - protein, 24 aa, Entamoeba invadens
VTKWKPEVAYKFPNVPCLLVGTKL

SEQ ID NO: 2975317 - protein, 24 aa, Entamoeba invadens
VTKYKLKVANCCVLAIRLKGNVKI

SEQ ID NO: 2975318 - protein, 25 aa, Entamoeba invadens
VTKYPDYIVCLLKIVSTPEYKALQN

SEQ ID NO: 2975319 - protein, 21 aa, Entamoeba invadens
VTLFKGRNFPALKGKVCTSYC

SEQ ID NO: 2975320 - protein, 18 aa, Entamoeba invadens
VTLFVSMCGYYPFDGDSI

SEQ ID NO: 2975321 - protein, 27 aa, Entamoeba invadens
VTLHKGEACGFGLFIAPLCSCHINDKI

SEQ ID NO: 2975322 - protein, 19 aa, Entamoeba invadens
VTLIDNFAFKNCKKLKRVD

SEQ ID NO: 2975323 - protein, 25 aa, Entamoeba invadens
VTLIGDGCCRGCINLTSVTIPLSVT

SEQ ID NO: 2975324 - protein, 24 aa, Entamoeba invadens
VTLIPFERRWVLFDVSQHGFDVLL

SEQ ID NO: 2975325 - protein, 25 aa, Entamoeba invadens
VTLKCGFACEFEIFLTPYCTMQLID

SEQ ID NO: 2975326 - protein, 21 aa, Entamoeba invadens
VTLKVDFFQIVVWYQVTATLE

SEQ ID NO: 2975327 - protein, 23 aa, Entamoeba invadens
VTLLKVGLLVLFKGKATIDGGDY

SEQ ID NO: 2975328 - protein, 23 aa, Entamoeba invadens
VTLPCKILKLGENCFESCSQLYN

SEQ ID NO: 2975329 - protein, 22 aa, Entamoeba invadens
VTLPSFQPFKTFFPLVTTVNIS

SEQ ID NO: 2975330 - protein, 18 aa, Entamoeba invadens
VTLQKLSILHCFTSNFVL

SEQ ID NO: 2975331 - protein, 17 aa, Entamoeba invadens
VTLRKYFNSTNIAENFD

SEQ ID NO: 2975332 - protein, 20 aa, Entamoeba invadens
VTLVPQLDVLKSRRTIYRAE

SEQ ID NO: 2975333 - protein, 18 aa, Entamoeba invadens
VTLWEIFSDAATPYSSVG

SEQ ID NO: 2975334 - protein, 20 aa, Entamoeba invadens
VTMFECFKWGEIYPKKDFQF

SEQ ID NO: 2975335 - protein, 18 aa, Entamoeba invadens
VTMFEVFGWEEPYNKLEF

SEQ ID NO: 2975336 - protein, 18 aa, Entamoeba invadens
VTMFEVFGWEESYDKIKF

SEQ ID NO: 2975337 - protein, 20 aa, Entamoeba invadens
VTMFEVVGWSEAYQKDRFKY

SEQ ID NO: 2975338 - protein, 19 aa, Entamoeba invadens
VTMIPDLFFLISKALEEKK

SEQ ID NO: 2975339 - protein, 20 aa, Entamoeba invadens
VTMLGFDNTVFWTFNVPDEL

SEQ ID NO: 2975340 - protein, 20 aa, Entamoeba invadens
VTMLTHISLLFGKENKINSP

SEQ ID NO: 2975341 - protein, 24 aa, Entamoeba invadens
VTNCGGVLRVNEKIAITRSIGDKA

SEQ ID NO: 2975342 - protein, 17 aa, Entamoeba invadens
VTNDAFYQFSFNPEQQV

SEQ ID NO: 2975343 - protein, 25 aa, Entamoeba invadens
VTNFSNEVPLHFAVNKKRLDLVLLL

SEQ ID NO: 2975344 - protein, 24 aa, Entamoeba invadens
VTNGDMRTARLCEGTLFTDDYPKD

SEQ ID NO: 2975345 - protein, 25 aa, Entamoeba invadens
VTNKFAIMMSHVFYNAKYFKRGYNT

SEQ ID NO: 2975346 - protein, 28 aa, Entamoeba invadens
VTNKGIKIIKSRLFRNIETLTEIVGFEN

SEQ ID NO: 2975347 - protein, 19 aa, Entamoeba invadens
VTNMLPMPFVLKSESVEMP

SEQ ID NO: 2975348 - protein, 24 aa, Entamoeba invadens
VTNPKDFPFVVLINKMDEDPSKHT

SEQ ID NO: 2975349 - protein, 19 aa, Entamoeba invadens
VTNQISMFFAFAAPMVLCL

SEQ ID NO: 2975350 - protein, 26 aa, Entamoeba invadens
VTNRVSLQTVWKYFFLFSDVLVVTEI

SEQ ID NO: 2975351 - protein, 17 aa, Entamoeba invadens
VTPDFWLVFGDTTIAFV

SEQ ID NO: 2975352 - protein, 20 aa, Entamoeba invadens
VTPEINFRIFVFDSSSTEKK

SEQ ID NO: 2975353 - protein, 28 aa, Entamoeba invadens
VTPFEGSPMKIMRGVFDYPKNILDVQKG

SEQ ID NO: 2975354 - protein, 24 aa, Entamoeba invadens
VTPHEIALSWILRHPSHIQVVTGT

SEQ ID NO: 2975355 - protein, 20 aa, Entamoeba invadens
VTPLAFIVPLVFGNLTFDPY

SEQ ID NO: 2975356 - protein, 17 aa, Entamoeba invadens
VTPLCYATAMKELNISQ

SEQ ID NO: 2975357 - protein, 17 aa, Entamoeba invadens
VTPRTSLQMSRQSFQIA

SEQ ID NO: 2975358 - protein, 25 aa, Entamoeba invadens
VTPSQHVFLALSFRGKMNPGDKGSF

SEQ ID NO: 2975359 - protein, 19 aa, Entamoeba invadens
VTPTCRRNLILITKVIQNI

SEQ ID NO: 2975360 - protein, 23 aa, Entamoeba invadens
VTQEELDRTLSILNTSHIDLNSD

SEQ ID NO: 2975361 - protein, 21 aa, Entamoeba invadens
VTQFIPVYEGFVISNCVTKQY

SEQ ID NO: 2975362 - protein, 18 aa, Entamoeba invadens
VTQFPRYSIQEMTKNIHL

SEQ ID NO: 2975363 - protein, 25 aa, Entamoeba invadens
VTQGDCIQCHGGMRTVEFKVVEVTP

SEQ ID NO: 2975364 - protein, 20 aa, Entamoeba invadens
VTQLGADCFNGCVMLKEMNI

SEQ ID NO: 2975365 - protein, 25 aa, Entamoeba invadens
VTQLLDCLCPLKYSHFSRAPAEYSD

SEQ ID NO: 2975366 - protein, 18 aa, Entamoeba invadens
VTQPRRIAATAMAERVSE

SEQ ID NO: 2975367 - protein, 22 aa, Entamoeba invadens
VTQPRRVAAMSVARRVAEEVGC

SEQ ID NO: 2975368 - protein, 18 aa, Entamoeba invadens
VTQRTVILALKFLETIIR

SEQ ID NO: 2975369 - protein, 24 aa, Entamoeba invadens
VTRARKTITMPFLKIEKLSKGNTT

SEQ ID NO: 2975370 - protein, 17 aa, Entamoeba invadens
VTRDVCLERWIFKETHT

SEQ ID NO: 2975371 - protein, 27 aa, Entamoeba invadens
VTRIDWGNFWNCPNVEKIAIFSEKDIS

SEQ ID NO: 2975372 - protein, 29 aa, Entamoeba invadens
VTRIDWGNFWNCPNVEKIAIFSKKDISIS

SEQ ID NO: 2975373 - protein, 17 aa, Entamoeba invadens
VTRLVEIINRFVNERTY

SEQ ID NO: 2975374 - protein, 17 aa, Entamoeba invadens
VTSCFDEIMWFYRENDS

SEQ ID NO: 2975375 - protein, 17 aa, Entamoeba invadens
VTSCSIDMSLLFYTKNR

SEQ ID NO: 2975376 - protein, 24 aa, Entamoeba invadens
VTSGELFPEFLPAIFEMIHTGDRP

SEQ ID NO: 2975377 - protein, 25 aa, Entamoeba invadens
VTSICKKCFYECYSLNSVTIPSSVT

SEQ ID NO: 2975378 - protein, 26 aa, Entamoeba invadens
VTSIGACAFENCRFDKFDMPKGVKYI

SEQ ID NO: 2975379 - protein, 25 aa, Entamoeba invadens
VTSIGDFCFRGCISLSSITISSIIT

SEQ ID NO: 2975380 - protein, 25 aa, Entamoeba invadens
VTSIGDGCCRGCINLTSVTIPLSVT

SEQ ID NO: 2975381 - protein, 17 aa, Entamoeba invadens
VTSIGEKCFNWCSYLSN

SEQ ID NO: 2975382 - protein, 19 aa, Entamoeba invadens
VTSIGGYCFNRCNNLSNII

SEQ ID NO: 2975383 - protein, 21 aa, Entamoeba invadens
VTSIGGYCFSWCSSLTSVTIP

SEQ ID NO: 2975384 - protein, 23 aa, Entamoeba invadens
VTSISGYCFWGCSSLISVNIPSS

SEQ ID NO: 2975385 - protein, 25 aa, Entamoeba invadens
VTSLEKWTGCDSCRVIYDSTNGFTA

SEQ ID NO: 2975386 - protein, 23 aa, Entamoeba invadens
VTSLKVNPWFALTQDIEKFYDLF

SEQ ID NO: 2975387 - protein, 18 aa, Entamoeba invadens
VTSLLCQCFTGCHFQTII

SEQ ID NO: 2975388 - protein, 21 aa, Entamoeba invadens
VTSPKSLTSVPDWIQEKDAKG

SEQ ID NO: 2975389 - protein, 22 aa, Entamoeba invadens
VTSPLLINCDKNLLVVLNNFND

SEQ ID NO: 2975390 - protein, 18 aa, Entamoeba invadens
VTSPSEWLEKSVLDQLPF

SEQ ID NO: 2975391 - protein, 28 aa, Entamoeba invadens
VTTFKMMRNVWKLPLNKYGSYSIVAHAV

SEQ ID NO: 2975392 - protein, 17 aa, Entamoeba invadens
VTTGWVWYNNPAPRPKI

SEQ ID NO: 2975393 - protein, 28 aa, Entamoeba invadens
VTTISHFCCCSLLIPPEVRDSCFCKIAE

SEQ ID NO: 2975394 - protein, 22 aa, Entamoeba invadens
VTTKCFELTYLVNHYNPSVRRY

SEQ ID NO: 2975395 - protein, 25 aa, Entamoeba invadens
VTTREVMCAWDWKMRSLIGDERFGS

SEQ ID NO: 2975396 - protein, 19 aa, Entamoeba invadens
VTTVKCTKSDLVNLILNRI

SEQ ID NO: 2975397 - protein, 26 aa, Entamoeba invadens
VTVDDLISFFSFTGCIEEIHISQTSR

SEQ ID NO: 2975398 - protein, 26 aa, Entamoeba invadens
VTVDVLYFRDCESFVGAYRTIANKTS

SEQ ID NO: 2975399 - protein, 17 aa, Entamoeba invadens
VTVEICIRTTDSEIPDM

SEQ ID NO: 2975400 - protein, 22 aa, Entamoeba invadens
VTVFNFLKKLSFACNKIVQVNE

SEQ ID NO: 2975401 - protein, 18 aa, Entamoeba invadens
VTVFPSALILAPTRELGQ

SEQ ID NO: 2975402 - protein, 24 aa, Entamoeba invadens
VTVHDIFLNFCVFNKLTSTYTARL

SEQ ID NO: 2975403 - protein, 17 aa, Entamoeba invadens
VTVHKLYRPTDVAIGRD

SEQ ID NO: 2975404 - protein, 24 aa, Entamoeba invadens
VTVHSYPGFHFHNTIDLGIERDEQ

SEQ ID NO: 2975405 - protein, 17 aa, Entamoeba invadens
VTVPLFFDNKESPCFRV

SEQ ID NO: 2975406 - protein, 24 aa, Entamoeba invadens
VTVREAVCAWDWKMREQVGSDKFG

SEQ ID NO: 2975407 - protein, 22 aa, Entamoeba invadens
VTVSLCFSFSNMFIAMGSNDGY

SEQ ID NO: 2975408 - protein, 26 aa, Entamoeba invadens
VTYFKGLQLKFFFSILDGEMMENTTL

SEQ ID NO: 2975409 - protein, 29 aa, Entamoeba invadens
VTYKGVRIFLAICYDIQYPAFIRRTDAND

SEQ ID NO: 2975410 - protein, 23 aa, Entamoeba invadens
VTYKLRVEEQFACIQLFSNKTKV

SEQ ID NO: 2975411 - protein, 24 aa, Entamoeba invadens
VTYPYQRYAVWYGGSVMAELPVFV

SEQ ID NO: 2975412 - protein, 17 aa, Entamoeba invadens
VVACGGRVVNGRVNGDL

SEQ ID NO: 2975413 - protein, 19 aa, Entamoeba invadens
VVADIFGQVVAPLYAVKEP

SEQ ID NO: 2975414 - protein, 17 aa, Entamoeba invadens
VVADIVPIKSCFYLYST

SEQ ID NO: 2975415 - protein, 19 aa, Entamoeba invadens
VVAFKYNVEDKFEMEDYYS

SEQ ID NO: 2975416 - protein, 18 aa, Entamoeba invadens
VVAKQFLTVRYLKKQTDV

SEQ ID NO: 2975417 - protein, 24 aa, Entamoeba invadens
VVALKVRYPHRVFLLRGNHESRQI

SEQ ID NO: 2975418 - protein, 25 aa, Entamoeba invadens
VVAQKEFYMPFVFVDGAADKAQVDH

SEQ ID NO: 2975419 - protein, 18 aa, Entamoeba invadens
VVAQLLTLMDGMKSRANV

SEQ ID NO: 2975420 - protein, 18 aa, Entamoeba invadens
VVARQVVEPVPILHAPPK

SEQ ID NO: 2975421 - protein, 27 aa, Entamoeba invadens
VVAYSCWLLLEVLFDFISELTDLNSAL

SEQ ID NO: 2975422 - protein, 19 aa, Entamoeba invadens
VVCDDIKKDVYIIRVGTSG

SEQ ID NO: 2975423 - protein, 19 aa, Entamoeba invadens
VVCDVCGKVNLKFDSYIFW

SEQ ID NO: 2975424 - protein, 17 aa, Entamoeba invadens
VVCEKTWKEMNCDVLNP

SEQ ID NO: 2975425 - protein, 18 aa, Entamoeba invadens
VVCFHKLPLDKKMKSDIY

SEQ ID NO: 2975426 - protein, 26 aa, Entamoeba invadens
VVCGGCDGKVLFFWVDNGEEIGRLQF

SEQ ID NO: 2975427 - protein, 19 aa, Entamoeba invadens
VVCHCCGRVLCSNCIQTLQ

SEQ ID NO: 2975428 - protein, 17 aa, Entamoeba invadens
VVCKRVVFEQNDVEKHL

SEQ ID NO: 2975429 - protein, 23 aa, Entamoeba invadens
VVCSRFSPCLYKVTTEEGKKRVF

SEQ ID NO: 2975430 - protein, 25 aa, Entamoeba invadens
VVDCFYEILFTYGLLCEEGPSETNL

SEQ ID NO: 2975431 - protein, 17 aa, Entamoeba invadens
VVDEWKILFYETSAKNN

SEQ ID NO: 2975432 - protein, 19 aa, Entamoeba invadens
VVDEYPLFVNRKNVVGETP

SEQ ID NO: 2975433 - protein, 19 aa, Entamoeba invadens
VVDGITWWCTPYDFVKSFN

SEQ ID NO: 2975434 - protein, 31 aa, Entamoeba invadens
VVDHNILELFLFKICDLLVLKARTIVGMITQ

SEQ ID NO: 2975435 - protein, 24 aa, Entamoeba invadens
VVDIDICELFSFIANGQINSFVLY

SEQ ID NO: 2975436 - protein, 19 aa, Entamoeba invadens
VVDIISLEYFTFLKTSTTV

SEQ ID NO: 2975437 - protein, 22 aa, Entamoeba invadens
VVDIPVILPLPVDVKRNSYSII

SEQ ID NO: 2975438 - protein, 25 aa, Entamoeba invadens
VVDKKHCCFRVARNNMWELHIYTPK

SEQ ID NO: 2975439 - protein, 23 aa, Entamoeba invadens
VVDKVILRFLIKSEENERWIDCG

SEQ ID NO: 2975440 - protein, 18 aa, Entamoeba invadens
VVDLYFELVLACRPEVFN

SEQ ID NO: 2975441 - protein, 19 aa, Entamoeba invadens
VVDMKRSYEKTGVKISVLV

SEQ ID NO: 2975442 - protein, 25 aa, Entamoeba invadens
VVDPLKRFSVEECLGHEFFGLKHQR

SEQ ID NO: 2975443 - protein, 18 aa, Entamoeba invadens
VVDSVVFKTLPKISDIQQ

SEQ ID NO: 2975444 - protein, 23 aa, Entamoeba invadens
VVDYFELVKVLLLNNTQNQKNFT

SEQ ID NO: 2975445 - protein, 27 aa, Entamoeba invadens
VVEAYCQAIRRLSRNIVEPQLFISALI

SEQ ID NO: 2975446 - protein, 17 aa, Entamoeba invadens
VVEFSMWDEMVLTSYSD

SEQ ID NO: 2975447 - protein, 17 aa, Entamoeba invadens
VVEGNFEKAFLYALEEP

SEQ ID NO: 2975448 - protein, 22 aa, Entamoeba invadens
VVEGTIPIIVRIPFKAEDKYTL

SEQ ID NO: 2975449 - protein, 18 aa, Entamoeba invadens
VVEISFCAHSDHVHTTNF

SEQ ID NO: 2975450 - protein, 25 aa, Entamoeba invadens
VVEKCLKCGGEEEVSILIDALLNTE

SEQ ID NO: 2975451 - protein, 19 aa, Entamoeba invadens
VVEKICRTKMAFDRSKGVS

SEQ ID NO: 2975452 - protein, 25 aa, Entamoeba invadens
VVEKSGYQSFPWVRYMTFAGDYCFR

SEQ ID NO: 2975453 - protein, 17 aa, Entamoeba invadens
VVELPMLHPEAFENLGI

SEQ ID NO: 2975454 - protein, 27 aa, Entamoeba invadens
VVERIFLKMRILNFNEFLLKIGDIEKA

SEQ ID NO: 2975455 - protein, 30 aa, Entamoeba invadens
VVETLRHALKYDLTLRVGVDKPDFSIDVNE

SEQ ID NO: 2975456 - protein, 26 aa, Entamoeba invadens
VVETYWGIKFGDIFFNKKQIDSKGRK

SEQ ID NO: 2975457 - protein, 19 aa, Entamoeba invadens
VVEVCIKQSPELSVKGFQL

SEQ ID NO: 2975458 - protein, 18 aa, Entamoeba invadens
VVEYPDTSLLGFGKSGHV

SEQ ID NO: 2975459 - protein, 27 aa, Entamoeba invadens
VVFEKEFFRIIIWFNVDFETVDRNKSR

SEQ ID NO: 2975460 - protein, 17 aa, Entamoeba invadens
VVFGDLWNVVKMQLVED

SEQ ID NO: 2975461 - protein, 17 aa, Entamoeba invadens
VVFIGDSSVGKTCIIGR

SEQ ID NO: 2975462 - protein, 24 aa, Entamoeba invadens
VVFKNCKAEQGLLKYEGNVMNDGF

SEQ ID NO: 2975463 - protein, 23 aa, Entamoeba invadens
VVFKNPRNFEARKFLAEVYRQNA

SEQ ID NO: 2975464 - protein, 21 aa, Entamoeba invadens
VVFLCPVSYNFYMQNSETKNF

SEQ ID NO: 2975465 - protein, 17 aa, Entamoeba invadens
VVFMLAALINKLNLRLE

SEQ ID NO: 2975466 - protein, 21 aa, Entamoeba invadens
VVFPLTCLEFLNTTTNNKKEF

SEQ ID NO: 2975467 - protein, 17 aa, Entamoeba invadens
VVFQEIFVTPCKASQSV

SEQ ID NO: 2975468 - protein, 19 aa, Entamoeba invadens
VVFVHVIKSVIALLSDVTN

SEQ ID NO: 2975469 - protein, 18 aa, Entamoeba invadens
VVFYGNARVGKTSIVNRY

SEQ ID NO: 2975470 - protein, 24 aa, Entamoeba invadens
VVFYHFNPMYSLLCPTKCSDIHSA

SEQ ID NO: 2975471 - protein, 24 aa, Entamoeba invadens
VVGEGKEKLGYVFMWDAGSSVGEI

SEQ ID NO: 2975472 - protein, 17 aa, Entamoeba invadens
VVGENEPSYSQVFHNTV

SEQ ID NO: 2975473 - protein, 23 aa, Entamoeba invadens
VVGESESCLNHLYAVDETIQSAV

SEQ ID NO: 2975474 - protein, 18 aa, Entamoeba invadens
VVGGYNIIGFFELFVNLL

SEQ ID NO: 2975475 - protein, 19 aa, Entamoeba invadens
VVGMCAVCNTEVYNTEDSI

SEQ ID NO: 2975476 - protein, 18 aa, Entamoeba invadens
VVGNVCINTILVQNGLAT

SEQ ID NO: 2975477 - protein, 25 aa, Entamoeba invadens
VVGPGKGNGGAVCGRDGGVWGHSET

SEQ ID NO: 2975478 - protein, 18 aa, Entamoeba invadens
VVGQLCCVGIGKAKERDW

SEQ ID NO: 2975479 - protein, 23 aa, Entamoeba invadens
VVGRGGFSVVHRAIYKKTSDTVA

SEQ ID NO: 2975480 - protein, 21 aa, Entamoeba invadens
VVGRTPPGHFFIQRKNKSNSP

SEQ ID NO: 2975481 - protein, 21 aa, Entamoeba invadens
VVGVKTAFDVDGWISKLHGVI

SEQ ID NO: 2975482 - protein, 21 aa, Entamoeba invadens
VVGVSCFFACSALVEIHLPNT

SEQ ID NO: 2975483 - protein, 20 aa, Entamoeba invadens
VVHKKTRKAVSFQADLQNVL

SEQ ID NO: 2975484 - protein, 23 aa, Entamoeba invadens
VVHKMTDFEFFTRIKSESQTPSR

SEQ ID NO: 2975485 - protein, 18 aa, Entamoeba invadens
VVHLSRSAAITFNGIDSL

SEQ ID NO: 2975486 - protein, 18 aa, Entamoeba invadens
VVICKAAMDAVFSEYLDQ

SEQ ID NO: 2975487 - protein, 24 aa, Entamoeba invadens
VVIDLEKGKFVFAKKDEGSAPFTV

SEQ ID NO: 2975488 - protein, 17 aa, Entamoeba invadens
VVIEAVIQFFSGKPELL

SEQ ID NO: 2975489 - protein, 17 aa, Entamoeba invadens
VVIEKALAMDGFQDDKK

SEQ ID NO: 2975490 - protein, 18 aa, Entamoeba invadens
VVIEKALAMEGFQDDKKD

SEQ ID NO: 2975491 - protein, 21 aa, Entamoeba invadens
VVIFDEGWSVIGNQAVDRVYR

SEQ ID NO: 2975492 - protein, 24 aa, Entamoeba invadens
VVIGDWGFGFTFVHDGIELKNTLY

SEQ ID NO: 2975493 - protein, 24 aa, Entamoeba invadens
VVIGENGYNFLIPKSGNCDEMVEL

SEQ ID NO: 2975494 - protein, 19 aa, Entamoeba invadens
VVIGIYLHPAVCIDMEQNS

SEQ ID NO: 2975495 - protein, 18 aa, Entamoeba invadens
VVIGKFKSIPCKESKTFV

SEQ ID NO: 2975496 - protein, 17 aa, Entamoeba invadens
VVIHTCDEWLVGYDKLQ

SEQ ID NO: 2975497 - protein, 23 aa, Entamoeba invadens
VVIKRLIENYGEIFREIKMENEG

SEQ ID NO: 2975498 - protein, 27 aa, Entamoeba invadens
VVIKRSLPCGLSLPSCLEVLKVAQCNE

SEQ ID NO: 2975499 - protein, 28 aa, Entamoeba invadens
VVINPYQFFPIYTHFMINKYTGRRKEEV

SEQ ID NO: 2975500 - protein, 29 aa, Entamoeba invadens
VVINPYQFFPIYTPFMINKYTGRRKEEVA

SEQ ID NO: 2975501 - protein, 33 aa, Entamoeba invadens
VVIPKSVSFIGRFCFFNCGFVHFPEINVNVKTL

SEQ ID NO: 2975502 - protein, 18 aa, Entamoeba invadens
VVIPTRIGSQELELMNEV

SEQ ID NO: 2975503 - protein, 19 aa, Entamoeba invadens
VVIQMEYCSGSNLSRIIES

SEQ ID NO: 2975504 - protein, 19 aa, Entamoeba invadens
VVISKEFYAPMTTKSAGIP

SEQ ID NO: 2975505 - protein, 26 aa, Entamoeba invadens
VVIVHLFDAFSAFQCEKIQVLLRLEK

SEQ ID NO: 2975506 - protein, 21 aa, Entamoeba invadens
VVIYLNLWRLFYSKPHMHGHR

SEQ ID NO: 2975507 - protein, 19 aa, Entamoeba invadens
VVIYTSMRSNIFIPVSGLV

SEQ ID NO: 2975508 - protein, 17 aa, Entamoeba invadens
VVKDCPFLLSNTKHGKR

SEQ ID NO: 2975509 - protein, 21 aa, Entamoeba invadens
VVKDLMKLFCEKYKKQAKSEH

SEQ ID NO: 2975510 - protein, 18 aa, Entamoeba invadens
VVKDMVLPMLCRGNKFTV

SEQ ID NO: 2975511 - protein, 24 aa, Entamoeba invadens
VVKEIFFRSLGLSCCAKRNPVHAH

SEQ ID NO: 2975512 - protein, 24 aa, Entamoeba invadens
VVKEKLGWGHFSTVWLVEYTDQVT

SEQ ID NO: 2975513 - protein, 18 aa, Entamoeba invadens
VVKEKWECYDNLKDADKK

SEQ ID NO: 2975514 - protein, 18 aa, Entamoeba invadens
VVKFEFGTFSIKETKWEV

SEQ ID NO: 2975515 - protein, 22 aa, Entamoeba invadens
VVKFYGIIVDKQFAMVMEYCSQ

SEQ ID NO: 2975516 - protein, 18 aa, Entamoeba invadens
VVKGKFLCEYTKVSRDQT

SEQ ID NO: 2975517 - protein, 20 aa, Entamoeba invadens
VVKIRKFKIISAKYFSIQES

SEQ ID NO: 2975518 - protein, 20 aa, Entamoeba invadens
VVKISYCCFVNCFNLKTIEL

SEQ ID NO: 2975519 - protein, 18 aa, Entamoeba invadens
VVKKILKYFPKLQTLQID

SEQ ID NO: 2975520 - protein, 23 aa, Entamoeba invadens
VVKKTFKQIVAWFNVICTTVQIN

SEQ ID NO: 2975521 - protein, 25 aa, Entamoeba invadens
VVKLLENLFEFCIRSESSTTEAGLK

SEQ ID NO: 2975522 - protein, 26 aa, Entamoeba invadens
VVKMYFKEIMSVSPLFTHSKLWKLYF

SEQ ID NO: 2975523 - protein, 25 aa, Entamoeba invadens
VVKNCTKASGVSFLVGAVTLLDNSV

SEQ ID NO: 2975524 - protein, 17 aa, Entamoeba invadens
VVKNGDKLYILPPKYIP

SEQ ID NO: 2975525 - protein, 27 aa, Entamoeba invadens
VVKNHCFDCCGKLSQIQFCHSITAFEE

SEQ ID NO: 2975526 - protein, 19 aa, Entamoeba invadens
VVKPLTLLVLQKFVRYVLD

SEQ ID NO: 2975527 - protein, 24 aa, Entamoeba invadens
VVKQFKQNEFISGSADRTVHIWET

SEQ ID NO: 2975528 - protein, 26 aa, Entamoeba invadens
VVKRAESIANWFEIYSWWKNNIEAQE

SEQ ID NO: 2975529 - protein, 17 aa, Entamoeba invadens
VVKRCLQNKKAIIEVIE

SEQ ID NO: 2975530 - protein, 19 aa, Entamoeba invadens
VVKRGNMKDRIQVHEIDED

SEQ ID NO: 2975531 - protein, 23 aa, Entamoeba invadens
VVKRSQDGLNFGVVLIPEGLLEF

SEQ ID NO: 2975532 - protein, 19 aa, Entamoeba invadens
VVKSVLPFIHISKIIDPSG

SEQ ID NO: 2975533 - protein, 26 aa, Entamoeba invadens
VVKTHDIYDLFALYARDAVNEQLANI

SEQ ID NO: 2975534 - protein, 22 aa, Entamoeba invadens
VVKTIIRAPEKVIDESQRAPPK

SEQ ID NO: 2975535 - protein, 23 aa, Entamoeba invadens
VVKVPSKCFANCFSLENINIDQC

SEQ ID NO: 2975536 - protein, 23 aa, Entamoeba invadens
VVKVRLNNGYGFVDFRDEVSKTK

SEQ ID NO: 2975537 - protein, 20 aa, Entamoeba invadens
VVKYSFVFSYFVRDYEQISK

SEQ ID NO: 2975538 - protein, 23 aa, Entamoeba invadens
VVLADFCVLYLLDGNCFPETEQM

SEQ ID NO: 2975539 - protein, 17 aa, Entamoeba invadens
VVLCGDTIFAAGGDGCM

SEQ ID NO: 2975540 - protein, 22 aa, Entamoeba invadens
VVLEKNPLFAFILSKTLSQNIE

SEQ ID NO: 2975541 - protein, 20 aa, Entamoeba invadens
VVLERVYLLNVVLFFENTEV

SEQ ID NO: 2975542 - protein, 29 aa, Entamoeba invadens
VVLFERCCLGVQWLHNRFNLIHRNIKPSN

SEQ ID NO: 2975543 - protein, 17 aa, Entamoeba invadens
VVLFIGMAMSQNLPMFV

SEQ ID NO: 2975544 - protein, 20 aa, Entamoeba invadens
VVLFPCQRVLLVIYSKRIVK

SEQ ID NO: 2975545 - protein, 23 aa, Entamoeba invadens
VVLKDYLSVLNFDARFNNYKIGN

SEQ ID NO: 2975546 - protein, 27 aa, Entamoeba invadens
VVLKKEFFRIIVWFNVDFETFDRNKNR

SEQ ID NO: 2975547 - protein, 28 aa, Entamoeba invadens
VVLKKEFYRIIVWFTVDFETVYINKSQN

SEQ ID NO: 2975548 - protein, 27 aa, Entamoeba invadens
VVLKREFYRIIVWFDVNFETVDRNINR

SEQ ID NO: 2975549 - protein, 21 aa, Entamoeba invadens
VVLKSAYLIREEELVDTDKCN

SEQ ID NO: 2975550 - protein, 30 aa, Entamoeba invadens
VVLKSEHFFLRFSPNLIKPTFDSVLNFFKK

SEQ ID NO: 2975551 - protein, 23 aa, Entamoeba invadens
VVLPKWARGSYRRFVRTNMMALE

SEQ ID NO: 2975552 - protein, 19 aa, Entamoeba invadens
VVLQFPEGLIAQGVQLQQR

SEQ ID NO: 2975553 - protein, 25 aa, Entamoeba invadens
VVLQKGMVPRTFVPVVEEFAKEVDN

SEQ ID NO: 2975554 - protein, 26 aa, Entamoeba invadens
VVLREFYRIIVWFNVDFETINRNKSR

SEQ ID NO: 2975555 - protein, 20 aa, Entamoeba invadens
VVLRELYKLIDISKLDSLKN

SEQ ID NO: 2975556 - protein, 24 aa, Entamoeba invadens
VVLTCKISKVFFDEKVIVVDIVGN

SEQ ID NO: 2975557 - protein, 24 aa, Entamoeba invadens
VVMECFACCYFAGEMTTHSEVVKT

SEQ ID NO: 2975558 - protein, 17 aa, Entamoeba invadens
VVMLKFYTNDVAEKCIK

SEQ ID NO: 2975559 - protein, 18 aa, Entamoeba invadens
VVMPPELQSISQMQSTQP

SEQ ID NO: 2975560 - protein, 17 aa, Entamoeba invadens
VVMTHLIPHASIEETLD

SEQ ID NO: 2975561 - protein, 19 aa, Entamoeba invadens
VVNCCPSKVLSLSVIEFEG

SEQ ID NO: 2975562 - protein, 19 aa, Entamoeba invadens
VVNDIPLTITCEVAVFICQ

SEQ ID NO: 2975563 - protein, 18 aa, Entamoeba invadens
VVNISFDKYLFVKYNTSR

SEQ ID NO: 2975564 - protein, 24 aa, Entamoeba invadens
VVNKEKRKSRQFSPSKNIVSSKSN

SEQ ID NO: 2975565 - protein, 18 aa, Entamoeba invadens
VVNKMCKLYRNINTIVAP

SEQ ID NO: 2975566 - protein, 17 aa, Entamoeba invadens
VVNPLLVFLSAVKLASD

SEQ ID NO: 2975567 - protein, 17 aa, Entamoeba invadens
VVNSRKLQILYFDDNGT

SEQ ID NO: 2975568 - protein, 26 aa, Entamoeba invadens
VVPDRVYFLSEFCFLDCNNLREIVLP

SEQ ID NO: 2975569 - protein, 18 aa, Entamoeba invadens
VVPEVALKELSEFSHCLV

SEQ ID NO: 2975570 - protein, 23 aa, Entamoeba invadens
VVPFPPFLKDRWYPHNETTKNFI

SEQ ID NO: 2975571 - protein, 25 aa, Entamoeba invadens
VVPHIVIYDMLFKYTDYSTYRVPFA

SEQ ID NO: 2975572 - protein, 26 aa, Entamoeba invadens
VVPISRLDLVFLPKVVVAMLGGVGPL

SEQ ID NO: 2975573 - protein, 24 aa, Entamoeba invadens
VVPLRRVEGTFKIRSELTNTLPTD

SEQ ID NO: 2975574 - protein, 22 aa, Entamoeba invadens
VVPMGKVVFGLKGVKTGIKEML

SEQ ID NO: 2975575 - protein, 17 aa, Entamoeba invadens
VVPPHFITKIVAIYINA

SEQ ID NO: 2975576 - protein, 23 aa, Entamoeba invadens
VVPRCAEDVMLQCWDLDGKKRPS

SEQ ID NO: 2975577 - protein, 24 aa, Entamoeba invadens
VVQACPIDCRRDLYKNIILSGGST

SEQ ID NO: 2975578 - protein, 18 aa, Entamoeba invadens
VVQCVKFSSDGKYFVHTD

SEQ ID NO: 2975579 - protein, 26 aa, Entamoeba invadens
VVQEMWREEEIAFQITVINYPSFEYL

SEQ ID NO: 2975580 - protein, 33 aa, Entamoeba invadens
VVQFQWLKRPMQVTCRFYQIGILMLFNENPQIK

SEQ ID NO: 2975581 - protein, 24 aa, Entamoeba invadens
VVQGFPGQVIDTWLGLDKKGEIHI

SEQ ID NO: 2975582 - protein, 17 aa, Entamoeba invadens
VVQHVKGILGLQFPDTD

SEQ ID NO: 2975583 - protein, 17 aa, Entamoeba invadens
VVQKVRTGCLVVVGQKN

SEQ ID NO: 2975584 - protein, 18 aa, Entamoeba invadens
VVQLVKRQMNALPVWQNT

SEQ ID NO: 2975585 - protein, 27 aa, Entamoeba invadens
VVQMIFKRLFRIYAHIYLHHLNQITQL

SEQ ID NO: 2975586 - protein, 23 aa, Entamoeba invadens
VVQRFKPLCELYFAQNTFINLEL

SEQ ID NO: 2975587 - protein, 24 aa, Entamoeba invadens
VVQRLLLVPVGFYQKILRLLRCLL

SEQ ID NO: 2975588 - protein, 17 aa, Entamoeba invadens
VVRCLKPTKTTFVVFSL

SEQ ID NO: 2975589 - protein, 18 aa, Entamoeba invadens
VVRDKFLPLSQRGREIPH

SEQ ID NO: 2975590 - protein, 18 aa, Entamoeba invadens
VVRDMVLPMLCRGTKFTV

SEQ ID NO: 2975591 - protein, 22 aa, Entamoeba invadens
VVRDMYALMCKRTGKSCNIISV

SEQ ID NO: 2975592 - protein, 25 aa, Entamoeba invadens
VVREGWQKLCVMCMGLHPQDHTTTV

SEQ ID NO: 2975593 - protein, 24 aa, Entamoeba invadens
VVRLLCSPTHDWNFSFDVLSHNAA

SEQ ID NO: 2975594 - protein, 24 aa, Entamoeba invadens
VVRREWCLFSKEIGNYCINLILKD

SEQ ID NO: 2975595 - protein, 25 aa, Entamoeba invadens
VVSCKNKLIFIFRVNGDIFGFYQDE

SEQ ID NO: 2975596 - protein, 18 aa, Entamoeba invadens
VVSCRQVRNISVFTIDNN

SEQ ID NO: 2975597 - protein, 25 aa, Entamoeba invadens
VVSDAKEALEFFAKRRSKIMKGATS

SEQ ID NO: 2975598 - protein, 27 aa, Entamoeba invadens
VVSDRMMYKLGYVDRVMDVLKRRQNDV

SEQ ID NO: 2975599 - protein, 33 aa, Entamoeba invadens
VVSEAVCAISYLVARLKEGFIVYYPTVKNTLEI

SEQ ID NO: 2975600 - protein, 19 aa, Entamoeba invadens
VVSECRFLEEVILGPYLKL

SEQ ID NO: 2975601 - protein, 18 aa, Entamoeba invadens
VVSEEGFGKNDFVITTKP

SEQ ID NO: 2975602 - protein, 22 aa, Entamoeba invadens
VVSEVKLKFGRIDCLINNAGYA

SEQ ID NO: 2975603 - protein, 18 aa, Entamoeba invadens
VVSFCLEVSALSLLKFPL

SEQ ID NO: 2975604 - protein, 23 aa, Entamoeba invadens
VVSKLRGGINLIKQKNEPKVDKE

SEQ ID NO: 2975605 - protein, 25 aa, Entamoeba invadens
VVSKSCLDAIKMVRRTPPIKYNQLK

SEQ ID NO: 2975606 - protein, 26 aa, Entamoeba invadens
VVSLRMKGCPLLREIHNLEELCCLSR

SEQ ID NO: 2975607 - protein, 26 aa, Entamoeba invadens
VVSMKASGWVKVRWDINNNENRYRYG

SEQ ID NO: 2975608 - protein, 21 aa, Entamoeba invadens
VVSMMKNPFANYVLQRMLTVM

SEQ ID NO: 2975609 - protein, 27 aa, Entamoeba invadens
VVSMTWKSSEFQTVMSYTNDRRFDLVK

SEQ ID NO: 2975610 - protein, 27 aa, Entamoeba invadens
VVSMYLMKRGKVVPVSLIYYSLEQLLM

SEQ ID NO: 2975611 - protein, 25 aa, Entamoeba invadens
VVSNCSGCTIEFVVKDRKIFAENGQ

SEQ ID NO: 2975612 - protein, 20 aa, Entamoeba invadens
VVSPELFRNAGIQNVTIGNN

SEQ ID NO: 2975613 - protein, 18 aa, Entamoeba invadens
VVSRAEKVIIPFVSTHSG

SEQ ID NO: 2975614 - protein, 23 aa, Entamoeba invadens
VVSRALQATVVFERFVVQKVFGE

SEQ ID NO: 2975615 - protein, 22 aa, Entamoeba invadens
VVSRPTNIIHHFEIQQNTNARQ

SEQ ID NO: 2975616 - protein, 17 aa, Entamoeba invadens
VVSTCFDVWAAFFDLPI

SEQ ID NO: 2975617 - protein, 19 aa, Entamoeba invadens
VVSTEIKKLLAQVPKENRH

SEQ ID NO: 2975618 - protein, 20 aa, Entamoeba invadens
VVSYLKLPLQPLLSLLIDTE

SEQ ID NO: 2975619 - protein, 24 aa, Entamoeba invadens
VVTDSFLGNVLTLWKKDSTLQTLK

SEQ ID NO: 2975620 - protein, 19 aa, Entamoeba invadens
VVTETGVKVLPALLRYFEI

SEQ ID NO: 2975621 - protein, 19 aa, Entamoeba invadens
VVTGLKFSADLGIILSTGT

SEQ ID NO: 2975622 - protein, 27 aa, Entamoeba invadens
VVTIMKIYMVKGCVKFDECMLEIVKIV

SEQ ID NO: 2975623 - protein, 25 aa, Entamoeba invadens
VVTKKGICPCGFKHKVNGVLCDFAF

SEQ ID NO: 2975624 - protein, 24 aa, Entamoeba invadens
VVTLKRGFACEFEIFVKPNYTTKF

SEQ ID NO: 2975625 - protein, 31 aa, Entamoeba invadens
VVTMKATLRFSSTVALFSQMVLVFVEKKNAL

SEQ ID NO: 2975626 - protein, 23 aa, Entamoeba invadens
VVTMKGGVYCWIKSEVTLQDTIK

SEQ ID NO: 2975627 - protein, 29 aa, Entamoeba invadens
VVTPLRLKIMNFVRTWLKNAWKDFEGKDE

SEQ ID NO: 2975628 - protein, 17 aa, Entamoeba invadens
VVTRFKDVMIIVFPEED

SEQ ID NO: 2975629 - protein, 17 aa, Entamoeba invadens
VVVCSKSGLKFASKERL

SEQ ID NO: 2975630 - protein, 24 aa, Entamoeba invadens
VVVDCGYGLCQVVPIYENMVLEHA

SEQ ID NO: 2975631 - protein, 24 aa, Entamoeba invadens
VVVEALPIFCMQQLVNGGLVALEA

SEQ ID NO: 2975632 - protein, 19 aa, Entamoeba invadens
VVVGNVCINTILVQNGLAT

SEQ ID NO: 2975633 - protein, 20 aa, Entamoeba invadens
VVVHSVEFYNIMKSLIPYLS

SEQ ID NO: 2975634 - protein, 20 aa, Entamoeba invadens
VVVICEVCFSQCYNLKRVSL

SEQ ID NO: 2975635 - protein, 19 aa, Entamoeba invadens
VVVIKGGFSPTNLGLALVE

SEQ ID NO: 2975636 - protein, 23 aa, Entamoeba invadens
VVVKLLLYKQVKGVFDQIKNTHK

SEQ ID NO: 2975637 - protein, 22 aa, Entamoeba invadens
VVVKNCPLLGFNDRSYQKGKVL

SEQ ID NO: 2975638 - protein, 21 aa, Entamoeba invadens
VVVKNCPLLGLNDRSYQKGKV

SEQ ID NO: 2975639 - protein, 25 aa, Entamoeba invadens
VVVLKIIEDWEIFSKWKVSKISESE

SEQ ID NO: 2975640 - protein, 19 aa, Entamoeba invadens
VVVNYNCDPTFFLKFLKDI

SEQ ID NO: 2975641 - protein, 18 aa, Entamoeba invadens
VVVQKFCAVSKDASKIAL

SEQ ID NO: 2975642 - protein, 24 aa, Entamoeba invadens
VVVRAIEVLQMIGSGRWVFESPLL

SEQ ID NO: 2975643 - protein, 18 aa, Entamoeba invadens
VVVRKCLAKARLDKHDID

SEQ ID NO: 2975644 - protein, 19 aa, Entamoeba invadens
VVVSDMFRLFNIVFAEEVT

SEQ ID NO: 2975645 - protein, 19 aa, Entamoeba invadens
VVVSYTFYLQMKAFGYMFH

SEQ ID NO: 2975646 - protein, 18 aa, Entamoeba invadens
VVVVRKIREKIMIGMMTE

SEQ ID NO: 2975647 - protein, 22 aa, Entamoeba invadens
VVWCLDPARRKLFKKLCDQAVD

SEQ ID NO: 2975648 - protein, 17 aa, Entamoeba invadens
VVYASRWFGGDKLDFRA

SEQ ID NO: 2975649 - protein, 28 aa, Entamoeba invadens
VVYDGFKTDVWSAGVLMFVMSTKEYPFV

SEQ ID NO: 2975650 - protein, 26 aa, Entamoeba invadens
VVYNEFRLSVDAVIERYLQIAMKLSQ

SEQ ID NO: 2975651 - protein, 17 aa, Entamoeba invadens
VVYQCVLMSDGLFVLQP

SEQ ID NO: 2975652 - protein, 19 aa, Entamoeba invadens
VVYSSADLFVVCFSLIDPK

SEQ ID NO: 2975653 - protein, 25 aa, Entamoeba invadens
VVYYMVTGSLIFPKNNFRLFFSEKR

SEQ ID NO: 2975654 - protein, 21 aa, Entamoeba invadens
VWDERFDCIPNKYVSECRNLS

SEQ ID NO: 2975655 - protein, 18 aa, Entamoeba invadens
VWESRAGGEYTITLDESG

SEQ ID NO: 2975656 - protein, 35 aa, Entamoeba invadens
VWFEPDEVWEIKGADLSLSLAYRAAIKKVNLEGRG

SEQ ID NO: 2975657 - protein, 33 aa, Entamoeba invadens
VWGDRCFSKCYSLRWAVLPTIHGEEFFIGCNSL

SEQ ID NO: 2975658 - protein, 19 aa, Entamoeba invadens
VWHFVGITGSAGFVYDDFS

SEQ ID NO: 2975659 - protein, 29 aa, Entamoeba invadens
VWIDDVLPFKVFADRVGVNFVSYRDEAKF

SEQ ID NO: 2975660 - protein, 21 aa, Entamoeba invadens
VWKAVLITYFLWIKQNSDFSL

SEQ ID NO: 2975661 - protein, 24 aa, Entamoeba invadens
VWLNHLGKAMVLVRVGSFKVDLLI

SEQ ID NO: 2975662 - protein, 17 aa, Entamoeba invadens
VWLNQWLVFPRFFIRSC

SEQ ID NO: 2975663 - protein, 22 aa, Entamoeba invadens
VWMFEIPQLKSGKDCPNDKIHG

SEQ ID NO: 2975664 - protein, 18 aa, Entamoeba invadens
VWNTIIFMKSYQLLIIGT

SEQ ID NO: 2975665 - protein, 27 aa, Entamoeba invadens
VWQDMPSRCGWGIGQFLGWDQDGFKEK

SEQ ID NO: 2975666 - protein, 23 aa, Entamoeba invadens
VWRHKYPVRGVGFFDTKSVSVDE

SEQ ID NO: 2975667 - protein, 23 aa, Entamoeba invadens
VWRLPECCYFGIERLLEQNIFEV

SEQ ID NO: 2975668 - protein, 21 aa, Entamoeba invadens
VWRNIYLTGAFEIMGEKAKEF

SEQ ID NO: 2975669 - protein, 26 aa, Entamoeba invadens
VWRTEKRRRYILGELCYRALSKIFTT

SEQ ID NO: 2975670 - protein, 22 aa, Entamoeba invadens
VWSLPAEFFNFYDLVEDSLHSD

SEQ ID NO: 2975671 - protein, 20 aa, Entamoeba invadens
VWSLPAQFFNFYDIVKDSLP

SEQ ID NO: 2975672 - protein, 20 aa, Entamoeba invadens
VWSVETCQPIKKLIAHDKEV

SEQ ID NO: 2975673 - protein, 19 aa, Entamoeba invadens
VWTCMCGSGEIPKDNFVGE

SEQ ID NO: 2975674 - protein, 21 aa, Entamoeba invadens
VWTVECGILKLVVIYQKLDYF

SEQ ID NO: 2975675 - protein, 18 aa, Entamoeba invadens
VWVNMCLSAIEQTETFPP

SEQ ID NO: 2975676 - protein, 26 aa, Entamoeba invadens
VYAATSLSDHWGIIWGSFQTLLKSGI

SEQ ID NO: 2975677 - protein, 37 aa, Entamoeba invadens
VYAELTTSFPIWIGKSVRSCVLLFKAIEMGYLTLVET

SEQ ID NO: 2975678 - protein, 19 aa, Entamoeba invadens
VYAMKRFTYETEVQTSREN

SEQ ID NO: 2975679 - protein, 20 aa, Entamoeba invadens
VYANRMSFIIATSALTSINA

SEQ ID NO: 2975680 - protein, 25 aa, Entamoeba invadens
VYCLKGCTVKPVLDKGPNVMTISRN

SEQ ID NO: 2975681 - protein, 26 aa, Entamoeba invadens
VYCQECKTRFCAKCFRETHHHIYHSL

SEQ ID NO: 2975682 - protein, 21 aa, Entamoeba invadens
VYCVLEFLSISDIKKISFINK

SEQ ID NO: 2975683 - protein, 21 aa, Entamoeba invadens
VYDEVDLMIAYGYEKDITQIS

SEQ ID NO: 2975684 - protein, 19 aa, Entamoeba invadens
VYDFMCAYFDPLSSVSLDL

SEQ ID NO: 2975685 - protein, 18 aa, Entamoeba invadens
VYDFPLNTIFDVGYSNGL

SEQ ID NO: 2975686 - protein, 39 aa, Entamoeba invadens
VYDGVGVIPLDCPWFICYFSGRPHINFSCKSQDTLALLS

SEQ ID NO: 2975687 - protein, 35 aa, Entamoeba invadens
VYDTGMCYKRTDGLFEWTYRDYFAMKHNTQKRFEF

SEQ ID NO: 2975688 - protein, 20 aa, Entamoeba invadens
VYDVKMIIVKDITTPVNSFE

SEQ ID NO: 2975689 - protein, 23 aa, Entamoeba invadens
VYDYELFKKVGYKDFLEGCESPT

SEQ ID NO: 2975690 - protein, 17 aa, Entamoeba invadens
VYEEIDRNLKLIVNGLK

SEQ ID NO: 2975691 - protein, 21 aa, Entamoeba invadens
VYEFSGLPGVIPEQVENTETL

SEQ ID NO: 2975692 - protein, 17 aa, Entamoeba invadens
VYEGFVISNCVTKQYLA

SEQ ID NO: 2975693 - protein, 20 aa, Entamoeba invadens
VYEKYRFTQTLAEVSVVVPY

SEQ ID NO: 2975694 - protein, 18 aa, Entamoeba invadens
VYELLNFNPEIIYRKFYS

SEQ ID NO: 2975695 - protein, 19 aa, Entamoeba invadens
VYENARFVIPLHLKRKNVV

SEQ ID NO: 2975696 - protein, 18 aa, Entamoeba invadens
VYENARFVIPLNPNRKNV

SEQ ID NO: 2975697 - protein, 20 aa, Entamoeba invadens
VYFEKGQLVSLVYEDLDCTQ

SEQ ID NO: 2975698 - protein, 30 aa, Entamoeba invadens
VYFHNLKYDCCFLAKYGINTCIKKDSKTMK

SEQ ID NO: 2975699 - protein, 32 aa, Entamoeba invadens
VYFHNLKYDSCFLAKYGIEICIKKDGKTMKMK

SEQ ID NO: 2975700 - protein, 31 aa, Entamoeba invadens
VYFHNLKYDSCFSAKYGIETCIKKDGKTMKM

SEQ ID NO: 2975701 - protein, 23 aa, Entamoeba invadens
VYFLSHGGFSQWCMDITSINKIP

SEQ ID NO: 2975702 - protein, 18 aa, Entamoeba invadens
VYFNNCLLSPDDSISDIL

SEQ ID NO: 2975703 - protein, 18 aa, Entamoeba invadens
VYFVFDFDLTLLAQMSTN

SEQ ID NO: 2975704 - protein, 25 aa, Entamoeba invadens
VYFYMKCFTENFILQKVDKKYYPKF

SEQ ID NO: 2975705 - protein, 17 aa, Entamoeba invadens
VYGCCECSIPPDIYTAV

SEQ ID NO: 2975706 - protein, 18 aa, Entamoeba invadens
VYGDDAFEFIAEICQNYP

SEQ ID NO: 2975707 - protein, 25 aa, Entamoeba invadens
VYGDLAITWCFQVIAFKEIDDDRSA

SEQ ID NO: 2975708 - protein, 23 aa, Entamoeba invadens
VYGDPLKFFLVFTPTKFPWFNQE

SEQ ID NO: 2975709 - protein, 24 aa, Entamoeba invadens
VYGEAFQQFLRCVQITKEAKLNWD

SEQ ID NO: 2975710 - protein, 18 aa, Entamoeba invadens
VYGGEIFSAVTAAEIDVE

SEQ ID NO: 2975711 - protein, 23 aa, Entamoeba invadens
VYGKICPQAYLLKLADEERHREK

SEQ ID NO: 2975712 - protein, 18 aa, Entamoeba invadens
VYGTINLVEYVSNFDKLP

SEQ ID NO: 2975713 - protein, 30 aa, Entamoeba invadens
VYHISSSLVLRKRFLADFVKKNCPSSVSVC

SEQ ID NO: 2975714 - protein, 36 aa, Entamoeba invadens
VYHKHCLKFGKAFARFQQCLTKEPFKKMVDEIATSN

SEQ ID NO: 2975715 - protein, 26 aa, Entamoeba invadens
VYHSSRCYHALGFYKYEIATENGKHY

SEQ ID NO: 2975716 - protein, 18 aa, Entamoeba invadens
VYHVDARNGDLVKDDTGN

SEQ ID NO: 2975717 - protein, 23 aa, Entamoeba invadens
VYIADYVCRYCLLLKSVKMDTTV

SEQ ID NO: 2975718 - protein, 24 aa, Entamoeba invadens
VYIADYVCRYCLVLGVTRFINVNN

SEQ ID NO: 2975719 - protein, 18 aa, Entamoeba invadens
VYIHKIYVAYKERKGGVV

SEQ ID NO: 2975720 - protein, 25 aa, Entamoeba invadens
VYINTFCFKECKSLTAITLHDNIKA

SEQ ID NO: 2975721 - protein, 19 aa, Entamoeba invadens
VYIPKIVNYLSGWHYTHNV

SEQ ID NO: 2975722 - protein, 17 aa, Entamoeba invadens
VYIPYIIILKNTKLRQD

SEQ ID NO: 2975723 - protein, 21 aa, Entamoeba invadens
VYKARLKGSVVAVKVPKDEIS

SEQ ID NO: 2975724 - protein, 21 aa, Entamoeba invadens
VYKGHFCLPALHDPYNKGLPH

SEQ ID NO: 2975725 - protein, 18 aa, Entamoeba invadens
VYKGIFRENIVAIKKMKL

SEQ ID NO: 2975726 - protein, 17 aa, Entamoeba invadens
VYKKFLREIPGHIFNTS

SEQ ID NO: 2975727 - protein, 21 aa, Entamoeba invadens
VYKKISGAIEMGWFDIEDTTS

SEQ ID NO: 2975728 - protein, 25 aa, Entamoeba invadens
VYKLPEMQFYLSLYGHNLPVTSISI

SEQ ID NO: 2975729 - protein, 23 aa, Entamoeba invadens
VYKMFPDTTCYIAQYGKPCDPEA

SEQ ID NO: 2975730 - protein, 17 aa, Entamoeba invadens
VYKPSLKTRTPGRLITR

SEQ ID NO: 2975731 - protein, 22 aa, Entamoeba invadens
VYKSKRLLAIPISDAPLPDKVI

SEQ ID NO: 2975732 - protein, 24 aa, Entamoeba invadens
VYLDDCVLEMLVIKNYNGRTLAIN

SEQ ID NO: 2975733 - protein, 19 aa, Entamoeba invadens
VYLERVKKLALGCSTTVLI

SEQ ID NO: 2975734 - protein, 17 aa, Entamoeba invadens
VYLFPILVVKDGNETFP

SEQ ID NO: 2975735 - protein, 22 aa, Entamoeba invadens
VYLNEIEMVLNYGNRLYAGSKL

SEQ ID NO: 2975736 - protein, 17 aa, Entamoeba invadens
VYLRSSIMSGLLNDEVY

SEQ ID NO: 2975737 - protein, 18 aa, Entamoeba invadens
VYLSFGITEFGQNCFSKC

SEQ ID NO: 2975738 - protein, 19 aa, Entamoeba invadens
VYLSQWNFDECIKIHDQVK

SEQ ID NO: 2975739 - protein, 25 aa, Entamoeba invadens
VYLVCGECRVNLVISVFEFFVSAFR

SEQ ID NO: 2975740 - protein, 19 aa, Entamoeba invadens
VYMLRGNHETRLMCEYMTF

SEQ ID NO: 2975741 - protein, 17 aa, Entamoeba invadens
VYMPLYINYDKQSGFLK

SEQ ID NO: 2975742 - protein, 18 aa, Entamoeba invadens
VYNECLTLFDSLPLCAVI

SEQ ID NO: 2975743 - protein, 18 aa, Entamoeba invadens
VYNIFKFEENDVFEKFVN

SEQ ID NO: 2975744 - protein, 31 aa, Entamoeba invadens
VYNIPKCAFFVFCEECVFGFYSESQTLYLSP

SEQ ID NO: 2975745 - protein, 25 aa, Entamoeba invadens
VYNKLCITVGLGFDSFVVMRHGDQE

SEQ ID NO: 2975746 - protein, 19 aa, Entamoeba invadens
VYNLTAGKTLPQWLTEKQR

SEQ ID NO: 2975747 - protein, 25 aa, Entamoeba invadens
VYNPFSCYFFKDRVFGQCTFPSHSQ

SEQ ID NO: 2975748 - protein, 21 aa, Entamoeba invadens
VYPDLSVPLLLVLLRDTLYTL

SEQ ID NO: 2975749 - protein, 25 aa, Entamoeba invadens
VYPLWKSVLLPPGITFGKHKNKECV

SEQ ID NO: 2975750 - protein, 24 aa, Entamoeba invadens
VYPNCKRLAFSTSKCVECNDLFKL

SEQ ID NO: 2975751 - protein, 21 aa, Entamoeba invadens
VYPTRTARFGTVFSDDGMVAL

SEQ ID NO: 2975752 - protein, 18 aa, Entamoeba invadens
VYPVALCDLRQLHRSEEL

SEQ ID NO: 2975753 - protein, 36 aa, Entamoeba invadens
VYQCVNGLLNYYFEWFDEKEMFLAIVDNLAKDMKKD

SEQ ID NO: 2975754 - protein, 23 aa, Entamoeba invadens
VYQIKSAAKWAEKSTDVDFNEVY

SEQ ID NO: 2975755 - protein, 19 aa, Entamoeba invadens
VYQRLNIYKPWRATNEQLE

SEQ ID NO: 2975756 - protein, 32 aa, Entamoeba invadens
VYQTRYHYMPQISIFPDNKFAIKYIDKDDENR

SEQ ID NO: 2975757 - protein, 25 aa, Entamoeba invadens
VYQVKKEWNVFCAAITMGEYKHIRI

SEQ ID NO: 2975758 - protein, 23 aa, Entamoeba invadens
VYRDIHHPDILGMTGIILASSTI

SEQ ID NO: 2975759 - protein, 25 aa, Entamoeba invadens
VYRLPVECLIKPIMNCIKMYQFDKV

SEQ ID NO: 2975760 - protein, 20 aa, Entamoeba invadens
VYRMLLWKTFLNAMNDNATH

SEQ ID NO: 2975761 - protein, 25 aa, Entamoeba invadens
VYSASLRSCELWKQEEVCNIVSLVI

SEQ ID NO: 2975762 - protein, 24 aa, Entamoeba invadens
VYSFAITMFECFLWENAYPKNIYM

SEQ ID NO: 2975763 - protein, 26 aa, Entamoeba invadens
VYSFAITMLSCFAWDNSFPKTIYPCD

SEQ ID NO: 2975764 - protein, 43 aa, Entamoeba invadens
VYSFAVTMFECFKWGEIYPKKDFQFAWSIADFVSAGKRVQRDK

SEQ ID NO: 2975765 - protein, 44 aa, Entamoeba invadens
VYSFAVTMFECFKWGEIYPKKDFQFAWSIADFVSAGKRVQRDKN

SEQ ID NO: 2975766 - protein, 20 aa, Entamoeba invadens
VYSFGMTMIHIFTNEVPYKD

SEQ ID NO: 2975767 - protein, 18 aa, Entamoeba invadens
VYSGYFFLLEFVGAPFES

SEQ ID NO: 2975768 - protein, 25 aa, Entamoeba invadens
VYSHPTLPISICLRDNGCLILDSFT

SEQ ID NO: 2975769 - protein, 19 aa, Entamoeba invadens
VYSLGIIIWEMTYRTVYQK

SEQ ID NO: 2975770 - protein, 18 aa, Entamoeba invadens
VYSLGITMWEVFYESAPF

SEQ ID NO: 2975771 - protein, 17 aa, Entamoeba invadens
VYSRKKVCFGAKEFLEL

SEQ ID NO: 2975772 - protein, 23 aa, Entamoeba invadens
VYSSIGCIRCKKGYYTDKSNKCS

SEQ ID NO: 2975773 - protein, 32 aa, Entamoeba invadens
VYSSVSTCFLEFFIDFCELPSSIASKLYIETI

SEQ ID NO: 2975774 - protein, 30 aa, Entamoeba invadens
VYSTKLNVSDAFKIPEDFFYLTDKGGRYKT

SEQ ID NO: 2975775 - protein, 25 aa, Entamoeba invadens
VYSWFSLSVLTFWICHHPQNIPLVQ

SEQ ID NO: 2975776 - protein, 17 aa, Entamoeba invadens
VYTGARRGRGIVVAPKD

SEQ ID NO: 2975777 - protein, 22 aa, Entamoeba invadens
VYTKGVCKLLSYYYEKKKLVLI

SEQ ID NO: 2975778 - protein, 17 aa, Entamoeba invadens
VYTRAGSASVIYAAQKM

SEQ ID NO: 2975779 - protein, 25 aa, Entamoeba invadens
VYTREHLELFVLPPRPTYLVKSEEE

SEQ ID NO: 2975780 - protein, 25 aa, Entamoeba invadens
VYTTYYFKEAISFFSNKKLLKVNYM

SEQ ID NO: 2975781 - protein, 23 aa, Entamoeba invadens
VYVIDVEGGFFLNRPNYPDLFCS

SEQ ID NO: 2975782 - protein, 17 aa, Entamoeba invadens
VYVKLIGTETCKINREN

SEQ ID NO: 2975783 - protein, 26 aa, Entamoeba invadens
VYVPKRMFYQIVVWFDVDYVTINDEN

SEQ ID NO: 2975784 - protein, 19 aa, Entamoeba invadens
VYVTGLKVEEWLKKCYSNI

SEQ ID NO: 2975785 - protein, 19 aa, Entamoeba invadens
VYWEHLYSIVINTEMNIRR

SEQ ID NO: 2975786 - protein, 20 aa, Entamoeba invadens
VYWESKRGWAIGKLGNKIGL

SEQ ID NO: 2975787 - protein, 21 aa, Entamoeba invadens
VYWLCRCGDFYQSIENGNEFF

SEQ ID NO: 2975788 - protein, 26 aa, Entamoeba invadens
VYYDKATCFLICFSLINLDHFHSVQN

SEQ ID NO: 2975789 - protein, 23 aa, Entamoeba invadens
VYYLQFRCMNALYWEMRIQKKKL

SEQ ID NO: 2975790 - protein, 17 aa, Entamoeba invadens
VYYNGIIELLKRRGNLM

SEQ ID NO: 2975791 - protein, 26 aa, Entamoeba invadens
WAAGCVLAQMIIRPKPLFTGSCEEDI

SEQ ID NO: 2975792 - protein, 27 aa, Entamoeba invadens
WACHPPCLRASVFALPKVIDYLSIFSL

SEQ ID NO: 2975793 - protein, 23 aa, Entamoeba invadens
WADELKMNLTHQVLLTVANLFLK

SEQ ID NO: 2975794 - protein, 19 aa, Entamoeba invadens
WADIGLQFQQKCIAIQNAL

SEQ ID NO: 2975795 - protein, 20 aa, Entamoeba invadens
WADLTTMYIMLKYRKWQLKE

SEQ ID NO: 2975796 - protein, 27 aa, Entamoeba invadens
WADSVVYSFNYMKGMYFVKQGFSSSEV

SEQ ID NO: 2975797 - protein, 25 aa, Entamoeba invadens
WAEDPATRPEYKWIVDTLNDFSRTL

SEQ ID NO: 2975798 - protein, 25 aa, Entamoeba invadens
WAEEHGAVCFCHWFQPLTSKSAKKF

SEQ ID NO: 2975799 - protein, 19 aa, Entamoeba invadens
WAEKVGVEIIKKCTEEPAR

SEQ ID NO: 2975800 - protein, 26 aa, Entamoeba invadens
WAELYLPRYVGSVAMDITSFTLRGEY

SEQ ID NO: 2975801 - protein, 18 aa, Entamoeba invadens
WAFRNCKALKEITLPESL

SEQ ID NO: 2975802 - protein, 28 aa, Entamoeba invadens
WAGEGIKKPKLRAVMSVLKGDVKNNLVK

SEQ ID NO: 2975803 - protein, 21 aa, Entamoeba invadens
WAHNNPRLFVQTNIEALESEY

SEQ ID NO: 2975804 - protein, 17 aa, Entamoeba invadens
WAIGVMLYYLKFGMTPF

SEQ ID NO: 2975805 - protein, 20 aa, Entamoeba invadens
WAKEKARWDQAVSVEKDLES

SEQ ID NO: 2975806 - protein, 17 aa, Entamoeba invadens
WAKGEWKLTELKKCLMK

SEQ ID NO: 2975807 - protein, 21 aa, Entamoeba invadens
WAKGTECDSSIFVKQPVNFPD

SEQ ID NO: 2975808 - protein, 26 aa, Entamoeba invadens
WAKQKGYPWWPAKLVLVDSLPEDQKK

SEQ ID NO: 2975809 - protein, 23 aa, Entamoeba invadens
WAKRIVKDYGLNVTGKDSFRDGR

SEQ ID NO: 2975810 - protein, 20 aa, Entamoeba invadens
WAKVLPSVHPMYAVKCNPEP

SEQ ID NO: 2975811 - protein, 23 aa, Entamoeba invadens
WAKVPNLISAIAVVDLHTELPVT

SEQ ID NO: 2975812 - protein, 25 aa, Entamoeba invadens
WANNCRAYSFTVKRFIRVTPSVEGS

SEQ ID NO: 2975813 - protein, 23 aa, Entamoeba invadens
WANRCYLKSVLALTQIVYDNVQL

SEQ ID NO: 2975814 - protein, 17 aa, Entamoeba invadens
WAQALGVQCIFNNNIEY

SEQ ID NO: 2975815 - protein, 18 aa, Entamoeba invadens
WASKRPKTIQSLTPRFSL

SEQ ID NO: 2975816 - protein, 26 aa, Entamoeba invadens
WATCVTELFRTAGIALADEFAKVMFG

SEQ ID NO: 2975817 - protein, 20 aa, Entamoeba invadens
WATDFPVEFPEYVKFVQKYS

SEQ ID NO: 2975818 - protein, 19 aa, Entamoeba invadens
WATQLVDLFMLSRRDETVK

SEQ ID NO: 2975819 - protein, 24 aa, Entamoeba invadens
WAYLNFRSVTCWDKAVEDIKTLQR

SEQ ID NO: 2975820 - protein, 25 aa, Entamoeba invadens
WAYNCKIPANYLIQPVQRFPRYVLL

SEQ ID NO: 2975821 - protein, 19 aa, Entamoeba invadens
WCATKSFFVLCHSALLKSI

SEQ ID NO: 2975822 - protein, 21 aa, Entamoeba invadens
WCDAVNPVLEFRGFVHKGILT

SEQ ID NO: 2975823 - protein, 32 aa, Entamoeba invadens
WCDAYPKQSFKFPWKIAEFVMSKKRLVKKESI

SEQ ID NO: 2975824 - protein, 27 aa, Entamoeba invadens
WCETNGVDFVHRFGRDMGDQPPYNTEF

SEQ ID NO: 2975825 - protein, 20 aa, Entamoeba invadens
WCFDAATSISPTGRFEKFVR

SEQ ID NO: 2975826 - protein, 17 aa, Entamoeba invadens
WCFSGCISLSSVTISSN

SEQ ID NO: 2975827 - protein, 18 aa, Entamoeba invadens
WCFYNCTNLNSVVIPLSV

SEQ ID NO: 2975828 - protein, 19 aa, Entamoeba invadens
WCFYNCTNLSSVVIPLSVT

SEQ ID NO: 2975829 - protein, 19 aa, Entamoeba invadens
WCGPCCAFQPIFDEIVSTS

SEQ ID NO: 2975830 - protein, 22 aa, Entamoeba invadens
WCGPCKMMSPIFIEMAKKYPHV

SEQ ID NO: 2975831 - protein, 29 aa, Entamoeba invadens
WCKAYPTETFKFPWKIAEFVMSGKRLERR

SEQ ID NO: 2975832 - protein, 21 aa, Entamoeba invadens
WCKFCKKFIQNKAVTRQQHES

SEQ ID NO: 2975833 - protein, 17 aa, Entamoeba invadens
WCLELCNAKTINIPQSV

SEQ ID NO: 2975834 - protein, 18 aa, Entamoeba invadens
WCLSLKRNAPKMVKKFFG

SEQ ID NO: 2975835 - protein, 18 aa, Entamoeba invadens
WCNPFCVFLDKGMEIKTT

SEQ ID NO: 2975836 - protein, 17 aa, Entamoeba invadens
WCSMIEKYIYYPLFMLC

SEQ ID NO: 2975837 - protein, 17 aa, Entamoeba invadens
WCVTSGYEYFECSAKTG

SEQ ID NO: 2975838 - protein, 17 aa, Entamoeba invadens
WDAQSRLKLESKKDYDE

SEQ ID NO: 2975839 - protein, 17 aa, Entamoeba invadens
WDDIIPFSVTMIHIEDK

SEQ ID NO: 2975840 - protein, 17 aa, Entamoeba invadens
WDDRMIEGFLIEQIDAA

SEQ ID NO: 2975841 - protein, 18 aa, Entamoeba invadens
WDDRMLKIPVVSIDNRVD

SEQ ID NO: 2975842 - protein, 23 aa, Entamoeba invadens
WDEIGNSVKGWFSQSESYTALPE

SEQ ID NO: 2975843 - protein, 20 aa, Entamoeba invadens
WDETTVLPILSLVGEISSVM

SEQ ID NO: 2975844 - protein, 18 aa, Entamoeba invadens
WDEYCQNEAFYLQRAEQQ

SEQ ID NO: 2975845 - protein, 17 aa, Entamoeba invadens
WDFRTFDFPIATFDWHK

SEQ ID NO: 2975846 - protein, 23 aa, Entamoeba invadens
WDIDEARKIWCFGPDNNGPNIFV

SEQ ID NO: 2975847 - protein, 19 aa, Entamoeba invadens
WDIKEAIGKDVVKLITEQM

SEQ ID NO: 2975848 - protein, 20 aa, Entamoeba invadens
WDIKNEKFVAVKILKNKKAY

SEQ ID NO: 2975849 - protein, 17 aa, Entamoeba invadens
WDIKPYKTFVVAVCAKG

SEQ ID NO: 2975850 - protein, 20 aa, Entamoeba invadens
WDITCQLISLVLIMLDPYYR

SEQ ID NO: 2975851 - protein, 20 aa, Entamoeba invadens
WDKEKRKIYLKGAEGRIDLS

SEQ ID NO: 2975852 - protein, 20 aa, Entamoeba invadens
WDKKLLFFNIREFVAESGST

SEQ ID NO: 2975853 - protein, 18 aa, Entamoeba invadens
WDKTCKAFFVTSPTNIQG

SEQ ID NO: 2975854 - protein, 17 aa, Entamoeba invadens
WDLFKLWTGKACAEVLY

SEQ ID NO: 2975855 - protein, 19 aa, Entamoeba invadens
WDLKNGITQKTAMRRLARN

SEQ ID NO: 2975856 - protein, 20 aa, Entamoeba invadens
WDLKSGEPIQTYAVHEKGVV

SEQ ID NO: 2975857 - protein, 19 aa, Entamoeba invadens
WDLLFQKLNIFYNIDLYVK

SEQ ID NO: 2975858 - protein, 17 aa, Entamoeba invadens
WDLNAEINKANGGKVRY

SEQ ID NO: 2975859 - protein, 17 aa, Entamoeba invadens
WDLNSCTPITTLKEHGD

SEQ ID NO: 2975860 - protein, 19 aa, Entamoeba invadens
WDLRTDCVNPVIQYDSEAP

SEQ ID NO: 2975861 - protein, 18 aa, Entamoeba invadens
WDLTINKVNRMYHGHLSS

SEQ ID NO: 2975862 - protein, 29 aa, Entamoeba invadens
WDLTTKESVLKCWLKSKFYNPNYDKSPYF

SEQ ID NO: 2975863 - protein, 26 aa, Entamoeba invadens
WDNLKVDPVPSYPLTNFVYHGVVSPL

SEQ ID NO: 2975864 - protein, 32 aa, Entamoeba invadens
WDRIPCGGPYLPLCCERSGGFVPSIFKSEVVD

SEQ ID NO: 2975865 - protein, 24 aa, Entamoeba invadens
WDSSCDVTLLILIGEKGMNVPDLY

SEQ ID NO: 2975866 - protein, 18 aa, Entamoeba invadens
WDTCVEWSAQEGRMCTTG

SEQ ID NO: 2975867 - protein, 24 aa, Entamoeba invadens
WDTEALYYFQFCPCEKHKQWIVNK

SEQ ID NO: 2975868 - protein, 18 aa, Entamoeba invadens
WDTRCPDLPNSDVFFTGF

SEQ ID NO: 2975869 - protein, 22 aa, Entamoeba invadens
WDTTGKMLTIFSAPKYNGLTNF

SEQ ID NO: 2975870 - protein, 20 aa, Entamoeba invadens
WDVQYCPLEYYMISSSYDKT

SEQ ID NO: 2975871 - protein, 17 aa, Entamoeba invadens
WDVRTKLLIGEDNYKTI

SEQ ID NO: 2975872 - protein, 17 aa, Entamoeba invadens
WDYFLKDPFVGALTAAP

SEQ ID NO: 2975873 - protein, 21 aa, Entamoeba invadens
WDYNHATGHGVGYYSLCHQCP

SEQ ID NO: 2975874 - protein, 19 aa, Entamoeba invadens
WEAEAQCAYYNKTKMCDYV

SEQ ID NO: 2975875 - protein, 19 aa, Entamoeba invadens
WECADGYKLSDDKIECFAN

SEQ ID NO: 2975876 - protein, 18 aa, Entamoeba invadens
WEDFKTICEEIGFVNCKG

SEQ ID NO: 2975877 - protein, 17 aa, Entamoeba invadens
WEDFYILNKDTPPTKPT

SEQ ID NO: 2975878 - protein, 24 aa, Entamoeba invadens
WEDRVPRQIGWGLLPKGSVLYDSD

SEQ ID NO: 2975879 - protein, 20 aa, Entamoeba invadens
WEEKSGVLLKQFQAHNKKIN

SEQ ID NO: 2975880 - protein, 21 aa, Entamoeba invadens
WEETANFLKEFIVHKDFNEVA

SEQ ID NO: 2975881 - protein, 20 aa, Entamoeba invadens
WEETKVKMMFDKHDETKKTL

SEQ ID NO: 2975882 - protein, 20 aa, Entamoeba invadens
WEEYTYKKMVTFRKEKGKTY

SEQ ID NO: 2975883 - protein, 24 aa, Entamoeba invadens
WEFNLRDVLRYCKLYSEYSQRIDT

SEQ ID NO: 2975884 - protein, 18 aa, Entamoeba invadens
WEHHNDTKIHGCILGDDM

SEQ ID NO: 2975885 - protein, 24 aa, Entamoeba invadens
WEHLKMSVYMTLNLNLVGIIQSGG

SEQ ID NO: 2975886 - protein, 17 aa, Entamoeba invadens
WEIGVKDVVEFVSGSSN

SEQ ID NO: 2975887 - protein, 19 aa, Entamoeba invadens
WEIQKKIYYSNNFRKESVC

SEQ ID NO: 2975888 - protein, 25 aa, Entamoeba invadens
WEIVKQLRPGMSLDRVTLPTHILEP

SEQ ID NO: 2975889 - protein, 20 aa, Entamoeba invadens
WEKCKITLLNESYFLSKKKE

SEQ ID NO: 2975890 - protein, 27 aa, Entamoeba invadens
WEKFYMMLHGAALCLFLSEEEAAELKQ

SEQ ID NO: 2975891 - protein, 20 aa, Entamoeba invadens
WEKHWTCCQCNKLMYWEDVV

SEQ ID NO: 2975892 - protein, 17 aa, Entamoeba invadens
WEKKCFTTKVVKNETHS

SEQ ID NO: 2975893 - protein, 17 aa, Entamoeba invadens
WEKVKFLGSGGFGTVFK

SEQ ID NO: 2975894 - protein, 19 aa, Entamoeba invadens
WELCCLRGHTSIVSSVAFV

SEQ ID NO: 2975895 - protein, 17 aa, Entamoeba invadens
WELKSDYKLMSEDDLFS

SEQ ID NO: 2975896 - protein, 24 aa, Entamoeba invadens
WELMKEKYPISVRVVRDVAPKKIM

SEQ ID NO: 2975897 - protein, 19 aa, Entamoeba invadens
WELPFPTAMSKTISPCCSL

SEQ ID NO: 2975898 - protein, 17 aa, Entamoeba invadens
WELPHIAIATNEGALLW

SEQ ID NO: 2975899 - protein, 22 aa, Entamoeba invadens
WELRGICDPELVLKYEKQLTLL

SEQ ID NO: 2975900 - protein, 23 aa, Entamoeba invadens
WEMLFDITTDFKKRGKVTKEYVM

SEQ ID NO: 2975901 - protein, 18 aa, Entamoeba invadens
WENERLFVNKLFSYIITF

SEQ ID NO: 2975902 - protein, 25 aa, Entamoeba invadens
WENLDVKKIRSMVEDFGEKIIQPPW

SEQ ID NO: 2975903 - protein, 18 aa, Entamoeba invadens
WENQDGGIGGRGVVVSMK

SEQ ID NO: 2975904 - protein, 17 aa, Entamoeba invadens
WEPPCELLDCGTTYLLK

SEQ ID NO: 2975905 - protein, 25 aa, Entamoeba invadens
WEPRTCSTFRDISFMSPCNCIALHP

SEQ ID NO: 2975906 - protein, 17 aa, Entamoeba invadens
WERELTRRCRLFELRNR

SEQ ID NO: 2975907 - protein, 20 aa, Entamoeba invadens
WERRISIVSTLYFIRKRKFK

SEQ ID NO: 2975908 - protein, 18 aa, Entamoeba invadens
WERRPIQEKWSFACDILI

SEQ ID NO: 2975909 - protein, 24 aa, Entamoeba invadens
WESDSCVITAKFSCDGEYVVVLTK

SEQ ID NO: 2975910 - protein, 17 aa, Entamoeba invadens
WESKFSALPFFNSKEQL

SEQ ID NO: 2975911 - protein, 18 aa, Entamoeba invadens
WESSKCVQCNLCSLYCPH

SEQ ID NO: 2975912 - protein, 17 aa, Entamoeba invadens
WETHPDYALLKEMITLV

SEQ ID NO: 2975913 - protein, 19 aa, Entamoeba invadens
WEVLDGVLNKADFVKTKQL

SEQ ID NO: 2975914 - protein, 19 aa, Entamoeba invadens
WFAERVDMIVLVFDANKLD

SEQ ID NO: 2975915 - protein, 23 aa, Entamoeba invadens
WFASMKGEILVVTGCGFPDTATC

SEQ ID NO: 2975916 - protein, 17 aa, Entamoeba invadens
WFCNEINNLKFLFKYYL

SEQ ID NO: 2975917 - protein, 17 aa, Entamoeba invadens
WFCRKRKSSDYNQHCQI

SEQ ID NO: 2975918 - protein, 17 aa, Entamoeba invadens
WFCRKRRLSDYNQHCQI

SEQ ID NO: 2975919 - protein, 21 aa, Entamoeba invadens
WFDNECSFQNLELMYIKFSFN

SEQ ID NO: 2975920 - protein, 24 aa, Entamoeba invadens
WFFDDCSQLFKTVFIVFGNHDFYN

SEQ ID NO: 2975921 - protein, 18 aa, Entamoeba invadens
WFGDEVVNAFVSLLQSKV

SEQ ID NO: 2975922 - protein, 17 aa, Entamoeba invadens
WFIPQKYGNVYGQYFYL

SEQ ID NO: 2975923 - protein, 19 aa, Entamoeba invadens
WFKANGVIVGQMLTSDMAD

SEQ ID NO: 2975924 - protein, 17 aa, Entamoeba invadens
WFKEKRLKMLEDLLDAL

SEQ ID NO: 2975925 - protein, 21 aa, Entamoeba invadens
WFPKRVRKLRIFEEEVHTFAD

SEQ ID NO: 2975926 - protein, 21 aa, Entamoeba invadens
WFPKRVRKLRIFEEEVYTFAD

SEQ ID NO: 2975927 - protein, 20 aa, Entamoeba invadens
WFPKRVRKLRIFEQEVHTFA

SEQ ID NO: 2975928 - protein, 17 aa, Entamoeba invadens
WFPPKIRKLCVYPQQVI

SEQ ID NO: 2975929 - protein, 25 aa, Entamoeba invadens
WFPSKVRKIHVSWKEIEALGINASC

SEQ ID NO: 2975930 - protein, 25 aa, Entamoeba invadens
WFPSQWKVNFAKRLPNTNVTKYPTG

SEQ ID NO: 2975931 - protein, 18 aa, Entamoeba invadens
WFQGFLIPILTGTTFWLE

SEQ ID NO: 2975932 - protein, 19 aa, Entamoeba invadens
WFSRLETLHIWVREDEHFT

SEQ ID NO: 2975933 - protein, 17 aa, Entamoeba invadens
WFSYFPTIMETLNDQRM

SEQ ID NO: 2975934 - protein, 18 aa, Entamoeba invadens
WFYDEKHFIFSLDSKGLF

SEQ ID NO: 2975935 - protein, 17 aa, Entamoeba invadens
WFYLRLGDDVSTRNMAK

SEQ ID NO: 2975936 - protein, 45 aa, Entamoeba invadens
WGAFPKFPGDTFMSAYFPGYRFKPEFTKQRALELNQFLQALLQHP

SEQ ID NO: 2975937 - protein, 18 aa, Entamoeba invadens
WGAGIVFATLIFRQSKAL

SEQ ID NO: 2975938 - protein, 18 aa, Entamoeba invadens
WGALGAHKYIGVTFGTDN

SEQ ID NO: 2975939 - protein, 17 aa, Entamoeba invadens
WGALGSVFKKCDKKDKK

SEQ ID NO: 2975940 - protein, 17 aa, Entamoeba invadens
WGDMSYRHNTWVTLETS

SEQ ID NO: 2975941 - protein, 26 aa, Entamoeba invadens
WGEFAHKAGEVFKDFEDIKKEIENET

SEQ ID NO: 2975942 - protein, 27 aa, Entamoeba invadens
WGEMCRCVFDGLGKYDVLFDMSGVNYD

SEQ ID NO: 2975943 - protein, 23 aa, Entamoeba invadens
WGESFDMGVTWSPVVEKKKELIR

SEQ ID NO: 2975944 - protein, 18 aa, Entamoeba invadens
WGKIKVGAPYVKILSEAS

SEQ ID NO: 2975945 - protein, 17 aa, Entamoeba invadens
WGNDDVDNFIKTVAELI

SEQ ID NO: 2975946 - protein, 22 aa, Entamoeba invadens
WGQVFDRLTLIIFEYVDEENAI

SEQ ID NO: 2975947 - protein, 28 aa, Entamoeba invadens
WGTEMRYVYMALEWLSQTSFYVRATAQS

SEQ ID NO: 2975948 - protein, 26 aa, Entamoeba invadens
WGTYFPNELSEYVVLRQKYCKNGVID

SEQ ID NO: 2975949 - protein, 17 aa, Entamoeba invadens
WGVFGYPIECAVKKSSW

SEQ ID NO: 2975950 - protein, 19 aa, Entamoeba invadens
WGWKEIDESPFMCEFRGEN

SEQ ID NO: 2975951 - protein, 22 aa, Entamoeba invadens
WGWVNDKLLPGFLWIEKPTVTP

SEQ ID NO: 2975952 - protein, 24 aa, Entamoeba invadens
WGYGIRYQYGMFKQKIVDGYQIEM

SEQ ID NO: 2975953 - protein, 17 aa, Entamoeba invadens
WHDDVRFYDVFDENEKL

SEQ ID NO: 2975954 - protein, 21 aa, Entamoeba invadens
WHDLLTHWFVYEIVRQKTVED

SEQ ID NO: 2975955 - protein, 19 aa, Entamoeba invadens
WHEGLGFTFVHNGIELKNT

SEQ ID NO: 2975956 - protein, 27 aa, Entamoeba invadens
WHEKEHIRFLVCIQYLNATKCGGLPVQ

SEQ ID NO: 2975957 - protein, 19 aa, Entamoeba invadens
WHNILKHLVPFYIRCGLHP

SEQ ID NO: 2975958 - protein, 19 aa, Entamoeba invadens
WHQVRYMVGALFLVGSGTD

SEQ ID NO: 2975959 - protein, 20 aa, Entamoeba invadens
WHREYCLRYNAEFDAVDRLT

SEQ ID NO: 2975960 - protein, 18 aa, Entamoeba invadens
WHSPGHMGGVAYLRSPPG

SEQ ID NO: 2975961 - protein, 24 aa, Entamoeba invadens
WIALSEFRTAFLAYHTKLQNEYLK

SEQ ID NO: 2975962 - protein, 17 aa, Entamoeba invadens
WIASCPILPSSEKISDV

SEQ ID NO: 2975963 - protein, 21 aa, Entamoeba invadens
WICRGDMGVQLGFVGMAKFVR

SEQ ID NO: 2975964 - protein, 17 aa, Entamoeba invadens
WIDDVSMYCPQGVKIVL

SEQ ID NO: 2975965 - protein, 28 aa, Entamoeba invadens
WIDIPRCPVCGALIKLDVVLFGEPLQSD

SEQ ID NO: 2975966 - protein, 18 aa, Entamoeba invadens
WIDTKLVNIFKENSVFFH

SEQ ID NO: 2975967 - protein, 19 aa, Entamoeba invadens
WIDVAKPATRLRCAGFTKE

SEQ ID NO: 2975968 - protein, 19 aa, Entamoeba invadens
WIDVQLRWGDFDQHNIESY

SEQ ID NO: 2975969 - protein, 23 aa, Entamoeba invadens
WIEPIRYISRRVVKLEKALEVNR

SEQ ID NO: 2975970 - protein, 24 aa, Entamoeba invadens
WIERNCGQCCWFEVSINGVVRIPK

SEQ ID NO: 2975971 - protein, 17 aa, Entamoeba invadens
WIETSPEDFEKLDEHKE

SEQ ID NO: 2975972 - protein, 25 aa, Entamoeba invadens
WIGNSDFGLAIFKPSLCGSYSRKLS

SEQ ID NO: 2975973 - protein, 19 aa, Entamoeba invadens
WILPLRNYMAVWVYENRYE

SEQ ID NO: 2975974 - protein, 18 aa, Entamoeba invadens
WIMHDVVLITKSGETKLS

SEQ ID NO: 2975975 - protein, 18 aa, Entamoeba invadens
WIMHDVVLMQKNGETKMK

SEQ ID NO: 2975976 - protein, 17 aa, Entamoeba invadens
WINFIIKTLTTVNQQTL

SEQ ID NO: 2975977 - protein, 17 aa, Entamoeba invadens
WIPAWCVNKATKTMVGG

SEQ ID NO: 2975978 - protein, 24 aa, Entamoeba invadens
WIQCTKYPYPFGCNTIIQDWIYNC

SEQ ID NO: 2975979 - protein, 29 aa, Entamoeba invadens
WIQTGKCSFPKYHFSVWKIDQFSRDPFVE

SEQ ID NO: 2975980 - protein, 26 aa, Entamoeba invadens
WIQVACPRLSIDWGDNYRQVLMTPYE

SEQ ID NO: 2975981 - protein, 20 aa, Entamoeba invadens
WIRQLIQLIKDTPFDYKTQL

SEQ ID NO: 2975982 - protein, 17 aa, Entamoeba invadens
WISAGIFSSKKLEEAIS

SEQ ID NO: 2975983 - protein, 28 aa, Entamoeba invadens
WISELCFVVRGCLVLRGEFLDIGMRENC

SEQ ID NO: 2975984 - protein, 25 aa, Entamoeba invadens
WISSISFDPSNEWFCVGSHDETIKI

SEQ ID NO: 2975985 - protein, 17 aa, Entamoeba invadens
WITALFFEKDVEVGRAI

SEQ ID NO: 2975986 - protein, 26 aa, Entamoeba invadens
WITPIGMTFALHLLELITSNKADIEN

SEQ ID NO: 2975987 - protein, 17 aa, Entamoeba invadens
WIVCTPTTLEVRFGITN

SEQ ID NO: 2975988 - protein, 17 aa, Entamoeba invadens
WIVSEYCGFGNLENYWA

SEQ ID NO: 2975989 - protein, 24 aa, Entamoeba invadens
WIVYKKGLGDFVVYVKTRAKYIVL

SEQ ID NO: 2975990 - protein, 19 aa, Entamoeba invadens
WKADFEMKNTKLLQLNEEL

SEQ ID NO: 2975991 - protein, 19 aa, Entamoeba invadens
WKADPSSVVSGRLQKYLGY

SEQ ID NO: 2975992 - protein, 18 aa, Entamoeba invadens
WKAEMGLDEMCEDAWNWQ

SEQ ID NO: 2975993 - protein, 17 aa, Entamoeba invadens
WKAETKFEDGLKKTVEW

SEQ ID NO: 2975994 - protein, 24 aa, Entamoeba invadens
WKAKDAFRTYTKILRRIEDKISYL

SEQ ID NO: 2975995 - protein, 20 aa, Entamoeba invadens
WKALLRRGTAYYYLDKMGKA

SEQ ID NO: 2975996 - protein, 17 aa, Entamoeba invadens
WKASYEMCCTKSAQIAD

SEQ ID NO: 2975997 - protein, 32 aa, Entamoeba invadens
WKCKAKYPILAALANKCVDNFIAMKNQIIPNI

SEQ ID NO: 2975998 - protein, 21 aa, Entamoeba invadens
WKCTFSNCCLLKEFEMPNFVT

SEQ ID NO: 2975999 - protein, 18 aa, Entamoeba invadens
WKDFIVSTIKRLPQEINQ

SEQ ID NO: 2976000 - protein, 27 aa, Entamoeba invadens
WKDISIEEFNAFLAVTIIQGQFKDNKI

SEQ ID NO: 2976001 - protein, 18 aa, Entamoeba invadens
WKDKPYVLDLCWVSDETK

SEQ ID NO: 2976002 - protein, 27 aa, Entamoeba invadens
WKDLNVIELNSFIGFLLYMGVVHDSKK

SEQ ID NO: 2976003 - protein, 23 aa, Entamoeba invadens
WKDLVDGIVVCWVNGEQCGCGVA

SEQ ID NO: 2976004 - protein, 30 aa, Entamoeba invadens
WKDSTMRRMGLRYVLMKVKGYTDLSPTGKK

SEQ ID NO: 2976005 - protein, 18 aa, Entamoeba invadens
WKDVYGFDMSIMLKGVVC

SEQ ID NO: 2976006 - protein, 21 aa, Entamoeba invadens
WKEDEDLRLLSAVKSLGTKQW

SEQ ID NO: 2976007 - protein, 24 aa, Entamoeba invadens
WKEDEVCNFYKGLMACGVDFSLLE

SEQ ID NO: 2976008 - protein, 18 aa, Entamoeba invadens
WKEFKKLKLTTNMRSEGQ

SEQ ID NO: 2976009 - protein, 26 aa, Entamoeba invadens
WKEGKELQSLCAKEYINKCLDYVQQQ

SEQ ID NO: 2976010 - protein, 21 aa, Entamoeba invadens
WKEHSCDYPLISRLVPKYLCL

SEQ ID NO: 2976011 - protein, 24 aa, Entamoeba invadens
WKEIEALGINASCFTQLKSVFIDF

SEQ ID NO: 2976012 - protein, 20 aa, Entamoeba invadens
WKEKGSSIAPLLLKKAVKMH

SEQ ID NO: 2976013 - protein, 20 aa, Entamoeba invadens
WKEMNCDVLNPCFRQRILSS

SEQ ID NO: 2976014 - protein, 17 aa, Entamoeba invadens
WKEPIFKMDDRGNLTDD

SEQ ID NO: 2976015 - protein, 18 aa, Entamoeba invadens
WKESLMELSGGQKSLLAL

SEQ ID NO: 2976016 - protein, 32 aa, Entamoeba invadens
WKETWKEVLQLDVPFCVPCWEVMCKYTNEQFY

SEQ ID NO: 2976017 - protein, 19 aa, Entamoeba invadens
WKFEKRVPYTPLIPSVNHI

SEQ ID NO: 2976018 - protein, 17 aa, Entamoeba invadens
WKFSNFKDGVFSEVFHV

SEQ ID NO: 2976019 - protein, 19 aa, Entamoeba invadens
WKGAKEMYSLTKAMDDLYN

SEQ ID NO: 2976020 - protein, 19 aa, Entamoeba invadens
WKGGLFGVFNRELLHSEKT

SEQ ID NO: 2976021 - protein, 17 aa, Entamoeba invadens
WKGIAWQLRHKVWKVLL

SEQ ID NO: 2976022 - protein, 20 aa, Entamoeba invadens
WKGKDAGKCPGYGVTLTASS

SEQ ID NO: 2976023 - protein, 19 aa, Entamoeba invadens
WKGPKAKGMLKVRVRELKE

SEQ ID NO: 2976024 - protein, 18 aa, Entamoeba invadens
WKGPKARAMLKAKMTELR

SEQ ID NO: 2976025 - protein, 18 aa, Entamoeba invadens
WKGVTLLLNIHDEIVVEI

SEQ ID NO: 2976026 - protein, 20 aa, Entamoeba invadens
WKIDGKSLIMGKTIAGQNCG

SEQ ID NO: 2976027 - protein, 18 aa, Entamoeba invadens
WKIHSVEVSNVFYEKSRP

SEQ ID NO: 2976028 - protein, 20 aa, Entamoeba invadens
WKISESCFMGCERLFEIKIP

SEQ ID NO: 2976029 - protein, 21 aa, Entamoeba invadens
WKKAMPHIRPHFAMKSNPEPH

SEQ ID NO: 2976030 - protein, 20 aa, Entamoeba invadens
WKKDMLKTFPEKLMKKLQDM

SEQ ID NO: 2976031 - protein, 21 aa, Entamoeba invadens
WKKMLSDMIKMMGREMYTDSF

SEQ ID NO: 2976032 - protein, 20 aa, Entamoeba invadens
WKKPKELSITYSLDPQYPTI

SEQ ID NO: 2976033 - protein, 19 aa, Entamoeba invadens
WKLGEVDYETSFALDSIQK

SEQ ID NO: 2976034 - protein, 17 aa, Entamoeba invadens
WKLKKAGIEQAVLNYLF

SEQ ID NO: 2976035 - protein, 18 aa, Entamoeba invadens
WKLNQRVFGFEKNFPEKN

SEQ ID NO: 2976036 - protein, 27 aa, Entamoeba invadens
WKLSKKEIASIEYTYAFFGLKPESTDM

SEQ ID NO: 2976037 - protein, 17 aa, Entamoeba invadens
WKMFHEFEERCGNVQSM

SEQ ID NO: 2976038 - protein, 17 aa, Entamoeba invadens
WKNDFIEGANLTNPGSV

SEQ ID NO: 2976039 - protein, 19 aa, Entamoeba invadens
WKNIGAAFAVQRLGTLFVN

SEQ ID NO: 2976040 - protein, 24 aa, Entamoeba invadens
WKNMKEYIPESAYNYFVINTDKTP

SEQ ID NO: 2976041 - protein, 20 aa, Entamoeba invadens
WKNVIPDRQAVLLAGSPGVG

SEQ ID NO: 2976042 - protein, 24 aa, Entamoeba invadens
WKNVRKYLLFVFSCLDYCPHQRVN

SEQ ID NO: 2976043 - protein, 17 aa, Entamoeba invadens
WKPKIKIYFENVETLHL

SEQ ID NO: 2976044 - protein, 18 aa, Entamoeba invadens
WKPTISIKQILVGIQDLL

SEQ ID NO: 2976045 - protein, 19 aa, Entamoeba invadens
WKQNLDYLKLDDVYAGKSE

SEQ ID NO: 2976046 - protein, 25 aa, Entamoeba invadens
WKQSYETFVAFPIIKTNFATNENGV

SEQ ID NO: 2976047 - protein, 23 aa, Entamoeba invadens
WKRRWVVLCRGFLFYYNNPKDEI

SEQ ID NO: 2976048 - protein, 17 aa, Entamoeba invadens
WKRSEPMPQNFLDTIIE

SEQ ID NO: 2976049 - protein, 21 aa, Entamoeba invadens
WKSFGHRFMTRSGFGAESPFG

SEQ ID NO: 2976050 - protein, 21 aa, Entamoeba invadens
WKSKIKKSYEFIKPEDSCKDI

SEQ ID NO: 2976051 - protein, 24 aa, Entamoeba invadens
WKSLSPLFKKCCLHPDEDVSMGAV

SEQ ID NO: 2976052 - protein, 19 aa, Entamoeba invadens
WKSLVEAVGDHFVQTIPTR

SEQ ID NO: 2976053 - protein, 20 aa, Entamoeba invadens
WKSPMVRIVNDISLGEVLKK

SEQ ID NO: 2976054 - protein, 23 aa, Entamoeba invadens
WKTAKSCAARYYFSDVELSTQIN

SEQ ID NO: 2976055 - protein, 31 aa, Entamoeba invadens
WKTAMPHVKPCFAVKCCPEPHLVKLLAELGC

SEQ ID NO: 2976056 - protein, 21 aa, Entamoeba invadens
WKTRKLMKERDIEYQTAKTKA

SEQ ID NO: 2976057 - protein, 18 aa, Entamoeba invadens
WKTVLDMLKDRGYVTNDL

SEQ ID NO: 2976058 - protein, 17 aa, Entamoeba invadens
WKYIRVLVKNGITVDSQ

SEQ ID NO: 2976059 - protein, 25 aa, Entamoeba invadens
WKYSESLYIKFALLFQTLPLASLLH

SEQ ID NO: 2976060 - protein, 17 aa, Entamoeba invadens
WLAKKPSNFSLPKAGDQ

SEQ ID NO: 2976061 - protein, 17 aa, Entamoeba invadens
WLCAKCIESLPESTVSI

SEQ ID NO: 2976062 - protein, 17 aa, Entamoeba invadens
WLDCDREGENISFEVID

SEQ ID NO: 2976063 - protein, 17 aa, Entamoeba invadens
WLDKNEDGFLEGTELAK

SEQ ID NO: 2976064 - protein, 17 aa, Entamoeba invadens
WLDSVVFYNNSLYKPTD

SEQ ID NO: 2976065 - protein, 18 aa, Entamoeba invadens
WLEECRKYSNPNTTIMLV

SEQ ID NO: 2976066 - protein, 25 aa, Entamoeba invadens
WLEENCTIFPKFNFNDFRIKGIRYE

SEQ ID NO: 2976067 - protein, 19 aa, Entamoeba invadens
WLEERRKRFPRRKPTQNND

SEQ ID NO: 2976068 - protein, 19 aa, Entamoeba invadens
WLEKNCMVYPQVDFEKLRN

SEQ ID NO: 2976069 - protein, 18 aa, Entamoeba invadens
WLEKSVLDQLPFYGVPKE

SEQ ID NO: 2976070 - protein, 17 aa, Entamoeba invadens
WLFENKVALLLLCPHSS

SEQ ID NO: 2976071 - protein, 25 aa, Entamoeba invadens
WLFSNICRTRLTTDFTEMTKIADFF

SEQ ID NO: 2976072 - protein, 23 aa, Entamoeba invadens
WLGQADVDFSAFINSSNEPAMYR

SEQ ID NO: 2976073 - protein, 19 aa, Entamoeba invadens
WLHFACDYIIANGLCSEGI

SEQ ID NO: 2976074 - protein, 17 aa, Entamoeba invadens
WLILRERLVADDIPYVK

SEQ ID NO: 2976075 - protein, 19 aa, Entamoeba invadens
WLKEEEILLKVGDEGTKRT

SEQ ID NO: 2976076 - protein, 22 aa, Entamoeba invadens
WLKELIKYKKIGVLLINEEYEK

SEQ ID NO: 2976077 - protein, 21 aa, Entamoeba invadens
WLKKAGVDFTQLEFIFVPVNF

SEQ ID NO: 2976078 - protein, 25 aa, Entamoeba invadens
WLKKRGFKAHTWKRRYFVIKNNFIF

SEQ ID NO: 2976079 - protein, 17 aa, Entamoeba invadens
WLKRILKVEKTGHSGTL

SEQ ID NO: 2976080 - protein, 17 aa, Entamoeba invadens
WLLDGFLGLAPDKYEQL

SEQ ID NO: 2976081 - protein, 18 aa, Entamoeba invadens
WLLEEGAKFHNLVYSYMY

SEQ ID NO: 2976082 - protein, 20 aa, Entamoeba invadens
WLNEHTHAIVSLKNQYNINP

SEQ ID NO: 2976083 - protein, 18 aa, Entamoeba invadens
WLNNAIDIELFYTLFAPF

SEQ ID NO: 2976084 - protein, 19 aa, Entamoeba invadens
WLPPKIKKLRVSYPDFLSV

SEQ ID NO: 2976085 - protein, 28 aa, Entamoeba invadens
WLQEFDVQLKVGEVITFNIFDYDVIGKN

SEQ ID NO: 2976086 - protein, 24 aa, Entamoeba invadens
WLQSKKWFCYPLSGILDYKITESG

SEQ ID NO: 2976087 - protein, 17 aa, Entamoeba invadens
WLQTLSDALILRFVIPS

SEQ ID NO: 2976088 - protein, 18 aa, Entamoeba invadens
WLRECRKPLAEKRLQMLQ

SEQ ID NO: 2976089 - protein, 20 aa, Entamoeba invadens
WLRKHLIRPNILLTAVQEHV

SEQ ID NO: 2976090 - protein, 17 aa, Entamoeba invadens
WLRLMLTCIGETFEHRE

SEQ ID NO: 2976091 - protein, 23 aa, Entamoeba invadens
WLSEMRSGIVGMKFYNPETKKWG

SEQ ID NO: 2976092 - protein, 17 aa, Entamoeba invadens
WLSEVSSLLGLLTETYH

SEQ ID NO: 2976093 - protein, 18 aa, Entamoeba invadens
WLSKNRTVVVLNMSLMYG

SEQ ID NO: 2976094 - protein, 26 aa, Entamoeba invadens
WLSPELKEILKAAGVKPRHLAEKEVV

SEQ ID NO: 2976095 - protein, 17 aa, Entamoeba invadens
WLSQTSFYVRATAQSVS

SEQ ID NO: 2976096 - protein, 19 aa, Entamoeba invadens
WLVFGDTTIAFVGRRLCAN

SEQ ID NO: 2976097 - protein, 19 aa, Entamoeba invadens
WLVGKSVIRGRDWKWEDQD

SEQ ID NO: 2976098 - protein, 18 aa, Entamoeba invadens
WLYAMKMQSYRAALELFI

SEQ ID NO: 2976099 - protein, 19 aa, Entamoeba invadens
WLYGPTVYVNPYFQKLLAS

SEQ ID NO: 2976100 - protein, 17 aa, Entamoeba invadens
WLYLFPYFDNDKFDLTQ

SEQ ID NO: 2976101 - protein, 17 aa, Entamoeba invadens
WMAAFPHDFLDQCDKGI

SEQ ID NO: 2976102 - protein, 29 aa, Entamoeba invadens
WMCMKDGWICFKHSQLVCGQIDKAIIGSG

SEQ ID NO: 2976103 - protein, 21 aa, Entamoeba invadens
WMGEMKCFKSIGVRIVGEEYE

SEQ ID NO: 2976104 - protein, 24 aa, Entamoeba invadens
WMIPKRTIESYGLVTDDRIWFRAR

SEQ ID NO: 2976105 - protein, 23 aa, Entamoeba invadens
WMIRKDSEVDFGIWKSFSQQDLL

SEQ ID NO: 2976106 - protein, 18 aa, Entamoeba invadens
WMKLFANDKVRVLIVSDT

SEQ ID NO: 2976107 - protein, 23 aa, Entamoeba invadens
WMKSERGMGCVYGQDVCDDFLMK

SEQ ID NO: 2976108 - protein, 18 aa, Entamoeba invadens
WMKTLFDKKNIEVEEYMY

SEQ ID NO: 2976109 - protein, 24 aa, Entamoeba invadens
WMKYAFHATNFFELYLECRPQNVF

SEQ ID NO: 2976110 - protein, 19 aa, Entamoeba invadens
WMLICFKYCTKIIVENALK

SEQ ID NO: 2976111 - protein, 18 aa, Entamoeba invadens
WMSESPWGETVTGKKIRA

SEQ ID NO: 2976112 - protein, 19 aa, Entamoeba invadens
WMTQNFPTVVMYIWSKQYQ

SEQ ID NO: 2976113 - protein, 22 aa, Entamoeba invadens
WMYNHLLVGYSNEFPLTGEFSG

SEQ ID NO: 2976114 - protein, 20 aa, Entamoeba invadens
WMYYCCSNEISLYDFNPSTE

SEQ ID NO: 2976115 - protein, 27 aa, Entamoeba invadens
WNALEVVKRLPGIPIDKVYDLQNTPNL

SEQ ID NO: 2976116 - protein, 20 aa, Entamoeba invadens
WNDGLYKYSVKISEALNTDE

SEQ ID NO: 2976117 - protein, 21 aa, Entamoeba invadens
WNDLKTLFSIARNSATYRKSF

SEQ ID NO: 2976118 - protein, 22 aa, Entamoeba invadens
WNEKHWKPNIYNKAMPRNVFQL

SEQ ID NO: 2976119 - protein, 18 aa, Entamoeba invadens
WNEKLLKEYFLFQRNQTI

SEQ ID NO: 2976120 - protein, 21 aa, Entamoeba invadens
WNEPFHILPNKMEFEGAGEVT

SEQ ID NO: 2976121 - protein, 26 aa, Entamoeba invadens
WNFETLKLLDKANCTLGNPTPNLVKA

SEQ ID NO: 2976122 - protein, 19 aa, Entamoeba invadens
WNFETMKLLDEANCTLGNP

SEQ ID NO: 2976123 - protein, 25 aa, Entamoeba invadens
WNFRVKCLVINSASFLRRFEFPNHL

SEQ ID NO: 2976124 - protein, 17 aa, Entamoeba invadens
WNGLKFVDSDGLFIVPE

SEQ ID NO: 2976125 - protein, 21 aa, Entamoeba invadens
WNHARVLICVISLDNLDIINN

SEQ ID NO: 2976126 - protein, 22 aa, Entamoeba invadens
WNIKYIPDLVWTKIFEDTEAKD

SEQ ID NO: 2976127 - protein, 23 aa, Entamoeba invadens
WNIPDCVKKLCWNRSNNSDHANV

SEQ ID NO: 2976128 - protein, 19 aa, Entamoeba invadens
WNIPQSMCLNCCLYSLNLS

SEQ ID NO: 2976129 - protein, 28 aa, Entamoeba invadens
WNIPQSMCYNCNLHLLTLPFGVTKISSF

SEQ ID NO: 2976130 - protein, 20 aa, Entamoeba invadens
WNIQPCPLKEGSVEDMMDVA

SEQ ID NO: 2976131 - protein, 18 aa, Entamoeba invadens
WNKEEILFLVNIDSLPLY

SEQ ID NO: 2976132 - protein, 19 aa, Entamoeba invadens
WNKKLLFFNIREFVAESGS

SEQ ID NO: 2976133 - protein, 19 aa, Entamoeba invadens
WNKNFLKNGRYVFSVYTEQ

SEQ ID NO: 2976134 - protein, 20 aa, Entamoeba invadens
WNKRTEILLNTELKMSESGA

SEQ ID NO: 2976135 - protein, 20 aa, Entamoeba invadens
WNLEEILDRILLSGVDTLVE

SEQ ID NO: 2976136 - protein, 19 aa, Entamoeba invadens
WNLEPQKKYFLVRGNSAIV

SEQ ID NO: 2976137 - protein, 18 aa, Entamoeba invadens
WNLLCLDCSAKTKYNVEN

SEQ ID NO: 2976138 - protein, 21 aa, Entamoeba invadens
WNLPMNAWINERCGAVKQFLL

SEQ ID NO: 2976139 - protein, 19 aa, Entamoeba invadens
WNLVSSSVKINAVKEKKDG

SEQ ID NO: 2976140 - protein, 23 aa, Entamoeba invadens
WNNGCTACVVLLVGKRLYTANLG

SEQ ID NO: 2976141 - protein, 18 aa, Entamoeba invadens
WNNKEIQRSVAMTSCDKK

SEQ ID NO: 2976142 - protein, 24 aa, Entamoeba invadens
WNNLTKIMIHICDSDASPGMGIFA

SEQ ID NO: 2976143 - protein, 22 aa, Entamoeba invadens
WNNNIIWEFVKGLSPGVDLTRI

SEQ ID NO: 2976144 - protein, 17 aa, Entamoeba invadens
WNPNCLTLVVSPDKNAS

SEQ ID NO: 2976145 - protein, 17 aa, Entamoeba invadens
WNPSQGFLQEFTLPCVL

SEQ ID NO: 2976146 - protein, 17 aa, Entamoeba invadens
WNQTFQIKAEFGEEVVF

SEQ ID NO: 2976147 - protein, 29 aa, Entamoeba invadens
WNRIKSFNPRISWIRLQVLDLSFNELSVI

SEQ ID NO: 2976148 - protein, 23 aa, Entamoeba invadens
WNRTECRGWELFSIVTTSREGYM

SEQ ID NO: 2976149 - protein, 19 aa, Entamoeba invadens
WNSFKTVRRTVLIRATLAQ

SEQ ID NO: 2976150 - protein, 20 aa, Entamoeba invadens
WNSNSMYRTLLLNELAIPQG

SEQ ID NO: 2976151 - protein, 22 aa, Entamoeba invadens
WNTKENPLFISVFSQFTPDNQQ

SEQ ID NO: 2976152 - protein, 19 aa, Entamoeba invadens
WNTKHRQWLSTKMKEIEQL

SEQ ID NO: 2976153 - protein, 27 aa, Entamoeba invadens
WNTKRNVKCGICIKTNSSVLFTFGDLN

SEQ ID NO: 2976154 - protein, 17 aa, Entamoeba invadens
WNYEMLEEYLIYQLTNK

SEQ ID NO: 2976155 - protein, 21 aa, Entamoeba invadens
WPIEFGLVMSPYFKIGNNGAK

SEQ ID NO: 2976156 - protein, 18 aa, Entamoeba invadens
WPIPQFFKNDGKQFVGQP

SEQ ID NO: 2976157 - protein, 20 aa, Entamoeba invadens
WPSALKSRIIKERSLMNNAE

SEQ ID NO: 2976158 - protein, 24 aa, Entamoeba invadens
WQFGKTKLFIRLPESIFAIEEMLE

SEQ ID NO: 2976159 - protein, 20 aa, Entamoeba invadens
WQKMRCFCCDIYPIDFQVLL

SEQ ID NO: 2976160 - protein, 17 aa, Entamoeba invadens
WQKNFEFIGFNFKRIKN

SEQ ID NO: 2976161 - protein, 18 aa, Entamoeba invadens
WQLDVCWDSPAYVSWDFK

SEQ ID NO: 2976162 - protein, 28 aa, Entamoeba invadens
WQLMDYELRKTIGGIDCEGEVMKWVNTT

SEQ ID NO: 2976163 - protein, 25 aa, Entamoeba invadens
WQSHKELWAYSIFFFSSIAKKCMTY

SEQ ID NO: 2976164 - protein, 17 aa, Entamoeba invadens
WQSKRLYLFKQIEKCKT

SEQ ID NO: 2976165 - protein, 19 aa, Entamoeba invadens
WQTTNWSYMAGIFAVMKGY

SEQ ID NO: 2976166 - protein, 18 aa, Entamoeba invadens
WQTTNWSYMVGVYEVIKG

SEQ ID NO: 2976167 - protein, 17 aa, Entamoeba invadens
WQVECLEKSEVLAGKRN

SEQ ID NO: 2976168 - protein, 17 aa, Entamoeba invadens
WQYKRFGINYNRSDFLI

SEQ ID NO: 2976169 - protein, 19 aa, Entamoeba invadens
WRAIIPQVQLINSFFEFSR

SEQ ID NO: 2976170 - protein, 18 aa, Entamoeba invadens
WRDSTLVYRRYANLYFVT

SEQ ID NO: 2976171 - protein, 21 aa, Entamoeba invadens
WREDKLFECLSARLLNNPNNE

SEQ ID NO: 2976172 - protein, 27 aa, Entamoeba invadens
WREKDKFREVFGWMVEKIFIELHNGTR

SEQ ID NO: 2976173 - protein, 19 aa, Entamoeba invadens
WRENFRKLINQVRKSKGLP

SEQ ID NO: 2976174 - protein, 19 aa, Entamoeba invadens
WRFSDSATMTVSFEKHFFY

SEQ ID NO: 2976175 - protein, 21 aa, Entamoeba invadens
WRFVTKTLKQSPSRVILYGKG

SEQ ID NO: 2976176 - protein, 20 aa, Entamoeba invadens
WRGAMEKKPLVVYYSNSNSV

SEQ ID NO: 2976177 - protein, 18 aa, Entamoeba invadens
WRGLSVVHLGDRDVPNSL

SEQ ID NO: 2976178 - protein, 19 aa, Entamoeba invadens
WRKDEIRKLEMCEKERISF

SEQ ID NO: 2976179 - protein, 27 aa, Entamoeba invadens
WRKEVQKWLPSISVGLMGGTKESRDEC

SEQ ID NO: 2976180 - protein, 18 aa, Entamoeba invadens
WRKLGVQQSVGWEHFDIF

SEQ ID NO: 2976181 - protein, 19 aa, Entamoeba invadens
WRKTDVLDERFVKYYELQG

SEQ ID NO: 2976182 - protein, 20 aa, Entamoeba invadens
WRMSDYKNRIVVAGACGGVA

SEQ ID NO: 2976183 - protein, 17 aa, Entamoeba invadens
WRNIYLNGAFELEHTKE

SEQ ID NO: 2976184 - protein, 18 aa, Entamoeba invadens
WRPQEIEQFTTFTQSDSM

SEQ ID NO: 2976185 - protein, 17 aa, Entamoeba invadens
WRQLYYAVYNMPTRHFD

SEQ ID NO: 2976186 - protein, 17 aa, Entamoeba invadens
WRRKDLIHSAATILHKN

SEQ ID NO: 2976187 - protein, 18 aa, Entamoeba invadens
WRSFLIFQQECTRNWAVC

SEQ ID NO: 2976188 - protein, 17 aa, Entamoeba invadens
WRTTFDMYDANKDGLIS

SEQ ID NO: 2976189 - protein, 20 aa, Entamoeba invadens
WRVAFNVFIEDLYIRSKKNG

SEQ ID NO: 2976190 - protein, 20 aa, Entamoeba invadens
WRVFQLRKDFFPSAKLQMED

SEQ ID NO: 2976191 - protein, 19 aa, Entamoeba invadens
WRWCTEVFDYLNIAALIDG

SEQ ID NO: 2976192 - protein, 17 aa, Entamoeba invadens
WRYNSPGIVCKKVGDIV

SEQ ID NO: 2976193 - protein, 19 aa, Entamoeba invadens
WRYTYTTLHKKRHRVYDTP

SEQ ID NO: 2976194 - protein, 18 aa, Entamoeba invadens
WSALGNMSIDEVIKTTVD

SEQ ID NO: 2976195 - protein, 20 aa, Entamoeba invadens
WSALVSNWVAFALINQQNEM

SEQ ID NO: 2976196 - protein, 21 aa, Entamoeba invadens
WSASEIAAFVSYIASYARKNE

SEQ ID NO: 2976197 - protein, 18 aa, Entamoeba invadens
WSCHSCSKICTKEEIYFF

SEQ ID NO: 2976198 - protein, 21 aa, Entamoeba invadens
WSDELKYMETIICCTPIDNTV

SEQ ID NO: 2976199 - protein, 23 aa, Entamoeba invadens
WSEFEYLINLLFIHESCPAFSLK

SEQ ID NO: 2976200 - protein, 23 aa, Entamoeba invadens
WSEQIVMGKCFDREFMVKMDTLC

SEQ ID NO: 2976201 - protein, 23 aa, Entamoeba invadens
WSEVTRCVLSAVGNWGLKTYEPF

SEQ ID NO: 2976202 - protein, 28 aa, Entamoeba invadens
WSFGCMAAELFVGIPIFPGNSEYNMLYK

SEQ ID NO: 2976203 - protein, 24 aa, Entamoeba invadens
WSGNSPCVFARIMFSGVRDVHVKP

SEQ ID NO: 2976204 - protein, 23 aa, Entamoeba invadens
WSGRVDGGAGWRMSDYKNRIVVA

SEQ ID NO: 2976205 - protein, 20 aa, Entamoeba invadens
WSGVGLWSYKIEAVTCSICT

SEQ ID NO: 2976206 - protein, 22 aa, Entamoeba invadens
WSGYIKGLFCILKTLKNMEMGK

SEQ ID NO: 2976207 - protein, 20 aa, Entamoeba invadens
WSHKEFQDIFNYYLKSEKPL

SEQ ID NO: 2976208 - protein, 17 aa, Entamoeba invadens
WSHKPEAFYIVDCPLKQ

SEQ ID NO: 2976209 - protein, 22 aa, Entamoeba invadens
WSILPRHVHILQKIDLRMDIVD

SEQ ID NO: 2976210 - protein, 24 aa, Entamoeba invadens
WSIQPGSSFPLSICEFESYEKFIA

SEQ ID NO: 2976211 - protein, 21 aa, Entamoeba invadens
WSIREIDHLFVAGQQQPQKDT

SEQ ID NO: 2976212 - protein, 18 aa, Entamoeba invadens
WSIYKDYYHSVALFNQKK

SEQ ID NO: 2976213 - protein, 17 aa, Entamoeba invadens
WSKALYHQCITSNNLTY

SEQ ID NO: 2976214 - protein, 22 aa, Entamoeba invadens
WSKCLGCQMCTTKCTFDVLEKG

SEQ ID NO: 2976215 - protein, 20 aa, Entamoeba invadens
WSKLNGWSHPEIVPYHNLSI

SEQ ID NO: 2976216 - protein, 35 aa, Entamoeba invadens
WSKRMTSCAGICYGKPNGCVIRLSQGILSYRPTKD

SEQ ID NO: 2976217 - protein, 17 aa, Entamoeba invadens
WSLKKGKERYVLSVEGE

SEQ ID NO: 2976218 - protein, 17 aa, Entamoeba invadens
WSLKKGKVIGISQNLNE

SEQ ID NO: 2976219 - protein, 18 aa, Entamoeba invadens
WSLQRGGKYFYIKDLTTV

SEQ ID NO: 2976220 - protein, 18 aa, Entamoeba invadens
WSNTFKGYSICVKDPVQF

SEQ ID NO: 2976221 - protein, 18 aa, Entamoeba invadens
WSNVNLEWICTCIESTVH

SEQ ID NO: 2976222 - protein, 17 aa, Entamoeba invadens
WSPGITMFNVHDMAPAD

SEQ ID NO: 2976223 - protein, 18 aa, Entamoeba invadens
WSQYDCGFAAQNMIIAAD

SEQ ID NO: 2976224 - protein, 21 aa, Entamoeba invadens
WSQYFPFKISVFGNREVINDL

SEQ ID NO: 2976225 - protein, 18 aa, Entamoeba invadens
WSSFPTVPLRCLYTTFTD

SEQ ID NO: 2976226 - protein, 17 aa, Entamoeba invadens
WSSPVVPKETWYTQHET

SEQ ID NO: 2976227 - protein, 18 aa, Entamoeba invadens
WSSSQQCRIIYTTERFEF

SEQ ID NO: 2976228 - protein, 18 aa, Entamoeba invadens
WSTDQWLGEEVDRVLDDV

SEQ ID NO: 2976229 - protein, 19 aa, Entamoeba invadens
WSTVIPFQVKTILVNETKV

SEQ ID NO: 2976230 - protein, 19 aa, Entamoeba invadens
WSVEMPVDMVDVMVVGVSV

SEQ ID NO: 2976231 - protein, 24 aa, Entamoeba invadens
WSVGCVLAECILGTPLFPAESDEE

SEQ ID NO: 2976232 - protein, 35 aa, Entamoeba invadens
WSVKEGGIYLGDRWLRFDPPLGRIIKLDQIELIPE

SEQ ID NO: 2976233 - protein, 24 aa, Entamoeba invadens
WSVPDGRRPLRCNGAALSAAAALL

SEQ ID NO: 2976234 - protein, 19 aa, Entamoeba invadens
WSVSSAFSKAIFQSHRNFL

SEQ ID NO: 2976235 - protein, 17 aa, Entamoeba invadens
WSWDLCAPLKTACKEII

SEQ ID NO: 2976236 - protein, 17 aa, Entamoeba invadens
WSYCDSTKIATFSDVGD

SEQ ID NO: 2976237 - protein, 21 aa, Entamoeba invadens
WSYFRTAKRLIVCDLQGIIRP

SEQ ID NO: 2976238 - protein, 21 aa, Entamoeba invadens
WSYSYCLPVLVITFGNGTPVN

SEQ ID NO: 2976239 - protein, 17 aa, Entamoeba invadens
WSYTVCCNGKILRVESL

SEQ ID NO: 2976240 - protein, 17 aa, Entamoeba invadens
WTAKQALEHPFITGVNY

SEQ ID NO: 2976241 - protein, 18 aa, Entamoeba invadens
WTCQELRQRIFIVSDLND

SEQ ID NO: 2976242 - protein, 20 aa, Entamoeba invadens
WTDFLISSFMFFDKPQILPN

SEQ ID NO: 2976243 - protein, 17 aa, Entamoeba invadens
WTEKKRCEVIYDSDDDG

SEQ ID NO: 2976244 - protein, 18 aa, Entamoeba invadens
WTENGVLFCNLNIALDYQ

SEQ ID NO: 2976245 - protein, 17 aa, Entamoeba invadens
WTERGYKGSAFSHSAAD

SEQ ID NO: 2976246 - protein, 27 aa, Entamoeba invadens
WTGKNSFKGYCLHSIFENGMNPYQRVI

SEQ ID NO: 2976247 - protein, 25 aa, Entamoeba invadens
WTGLRHKVLVFDSAVNDWSVGSSVF

SEQ ID NO: 2976248 - protein, 21 aa, Entamoeba invadens
WTGSFPQEIVNGIRNQIAPQP

SEQ ID NO: 2976249 - protein, 19 aa, Entamoeba invadens
WTIDYGIKEYGYYGDNREM

SEQ ID NO: 2976250 - protein, 28 aa, Entamoeba invadens
WTITNAMCCFCFSAPFHAQFMTRGQITL

SEQ ID NO: 2976251 - protein, 19 aa, Entamoeba invadens
WTIYRRWDEYVKYLISLQR

SEQ ID NO: 2976252 - protein, 19 aa, Entamoeba invadens
WTKEEDALLLATVEMCKKN

SEQ ID NO: 2976253 - protein, 18 aa, Entamoeba invadens
WTKEVGYKRKYQFREKRN

SEQ ID NO: 2976254 - protein, 17 aa, Entamoeba invadens
WTKGGLILKNSYGTKGH

SEQ ID NO: 2976255 - protein, 27 aa, Entamoeba invadens
WTKGYIWRLTNKFNIGERITWFYEVKN

SEQ ID NO: 2976256 - protein, 17 aa, Entamoeba invadens
WTLILKYQISKNKMDAS

SEQ ID NO: 2976257 - protein, 20 aa, Entamoeba invadens
WTLNSLRLLKANVTDLLPRF

SEQ ID NO: 2976258 - protein, 28 aa, Entamoeba invadens
WTLNSTKYVMLKYRHWQLVHRRSVTFVD

SEQ ID NO: 2976259 - protein, 17 aa, Entamoeba invadens
WTMRSAKIHNFLKKAMG

SEQ ID NO: 2976260 - protein, 31 aa, Entamoeba invadens
WTNECTIKIIWLCLKNGIAARDKWVSEDPQR

SEQ ID NO: 2976261 - protein, 20 aa, Entamoeba invadens
WTNHVAICIEALTVDNKLEV

SEQ ID NO: 2976262 - protein, 22 aa, Entamoeba invadens
WTNLKFTRLSLVIVDNMRFLPI

SEQ ID NO: 2976263 - protein, 17 aa, Entamoeba invadens
WTNPSIRQACFKITENI

SEQ ID NO: 2976264 - protein, 24 aa, Entamoeba invadens
WTNTYKSIRFHLGEVKSLTKKTAQ

SEQ ID NO: 2976265 - protein, 17 aa, Entamoeba invadens
WTPFNITTTPFASRNYL

SEQ ID NO: 2976266 - protein, 23 aa, Entamoeba invadens
WTQECLDEHGVMVIIGTTGVVYP

SEQ ID NO: 2976267 - protein, 20 aa, Entamoeba invadens
WTQMRIGQVVFDGEHENWST

SEQ ID NO: 2976268 - protein, 20 aa, Entamoeba invadens
WTREHFKFNFTVLKYPFTAL

SEQ ID NO: 2976269 - protein, 19 aa, Entamoeba invadens
WTRTCRKLKELIEKEYITD

SEQ ID NO: 2976270 - protein, 23 aa, Entamoeba invadens
WTSFKKHSRQIFFFGKGGGQCRS

SEQ ID NO: 2976271 - protein, 19 aa, Entamoeba invadens
WTSKQCKSVRIFGGDGGHT

SEQ ID NO: 2976272 - protein, 17 aa, Entamoeba invadens
WTSKRLVTEILKKGQRS

SEQ ID NO: 2976273 - protein, 18 aa, Entamoeba invadens
WTSMNFNTGFPLVAKLGT

SEQ ID NO: 2976274 - protein, 19 aa, Entamoeba invadens
WTVLETIDFICTRFDLKNG

SEQ ID NO: 2976275 - protein, 20 aa, Entamoeba invadens
WTYASGFPMVSVRLERGKLY

SEQ ID NO: 2976276 - protein, 22 aa, Entamoeba invadens
WTYDIFKTLKLMELHCSVETLT

SEQ ID NO: 2976277 - protein, 24 aa, Entamoeba invadens
WVAPEVLRGSPFIHKSDVYSFGII

SEQ ID NO: 2976278 - protein, 17 aa, Entamoeba invadens
WVAQLSPYMKAFGVFQY

SEQ ID NO: 2976279 - protein, 17 aa, Entamoeba invadens
WVELRKYSIVYDSSKLN

SEQ ID NO: 2976280 - protein, 35 aa, Entamoeba invadens
WVEMDNFCIFKLFAKGKNCWNMWKQNPSDKKAIDF

SEQ ID NO: 2976281 - protein, 32 aa, Entamoeba invadens
WVEMPDHALLFIKRFIKAWSDCQKAEFFKIGR

SEQ ID NO: 2976282 - protein, 17 aa, Entamoeba invadens
WVFKSRDEFEFENKCKL

SEQ ID NO: 2976283 - protein, 17 aa, Entamoeba invadens
WVHNGIINNNKYVIDIN

SEQ ID NO: 2976284 - protein, 18 aa, Entamoeba invadens
WVIAPFEEFCVAKFVDDC

SEQ ID NO: 2976285 - protein, 17 aa, Entamoeba invadens
WVKDVICESDVLDKTAL

SEQ ID NO: 2976286 - protein, 25 aa, Entamoeba invadens
WVKKVEIWLYRGAWQEYEVYRADLI

SEQ ID NO: 2976287 - protein, 25 aa, Entamoeba invadens
WVKTDWKTKRFVILPKHINNGQESG

SEQ ID NO: 2976288 - protein, 17 aa, Entamoeba invadens
WVLEGGALVLADEGICC

SEQ ID NO: 2976289 - protein, 19 aa, Entamoeba invadens
WVNKVFKGTVFGYGKSKVL

SEQ ID NO: 2976290 - protein, 17 aa, Entamoeba invadens
WVNSIPLFSNFTGVFGY

SEQ ID NO: 2976291 - protein, 17 aa, Entamoeba invadens
WVPKNAFGNHILKRISR

SEQ ID NO: 2976292 - protein, 21 aa, Entamoeba invadens
WVPNRGEACGIKLNKSGTSLF

SEQ ID NO: 2976293 - protein, 31 aa, Entamoeba invadens
WVPPEKLVLFKAICIMCHIIASHSDVNLMNE

SEQ ID NO: 2976294 - protein, 17 aa, Entamoeba invadens
WVPRGHLSNYPKGIAED

SEQ ID NO: 2976295 - protein, 19 aa, Entamoeba invadens
WVPWDCLYSSGIPTEDSYN

SEQ ID NO: 2976296 - protein, 18 aa, Entamoeba invadens
WVQYPKERISIEKVIENL

SEQ ID NO: 2976297 - protein, 18 aa, Entamoeba invadens
WVSPYLGNYFTLYSIICL

SEQ ID NO: 2976298 - protein, 20 aa, Entamoeba invadens
WVTDIIETFVKYKLSYNYHT

SEQ ID NO: 2976299 - protein, 17 aa, Entamoeba invadens
WVTRDGKFSDTRELSFT

SEQ ID NO: 2976300 - protein, 18 aa, Entamoeba invadens
WVVMVCELNNKLTQILSN

SEQ ID NO: 2976301 - protein, 23 aa, Entamoeba invadens
WVVNCGIVPLLFDLFLSTEDSQI

SEQ ID NO: 2976302 - protein, 18 aa, Entamoeba invadens
WVYFDRIINTSALGKKES

SEQ ID NO: 2976303 - protein, 23 aa, Entamoeba invadens
WVYVLRLQSNISLKGKIESENMD

SEQ ID NO: 2976304 - protein, 26 aa, Entamoeba invadens
WVYVRHQFNGWGYIPSSYVIFEKYMY

SEQ ID NO: 2976305 - protein, 20 aa, Entamoeba invadens
WWEGELNGTVGIFPANYVIR

SEQ ID NO: 2976306 - protein, 27 aa, Entamoeba invadens
WWEIPEYVKELFLLKINPVVVEKAVNI

SEQ ID NO: 2976307 - protein, 17 aa, Entamoeba invadens
WWKKCFEKDGGGVNSVI

SEQ ID NO: 2976308 - protein, 26 aa, Entamoeba invadens
WWRLETKQKGGLCFLYKINATKKAAR

SEQ ID NO: 2976309 - protein, 17 aa, Entamoeba invadens
WWSLGCVSYEMMVGNTP

SEQ ID NO: 2976310 - protein, 18 aa, Entamoeba invadens
WWTFGILMYEILYGRTPF

SEQ ID NO: 2976311 - protein, 19 aa, Entamoeba invadens
WWVRDQKPSVEFNVGFIET

SEQ ID NO: 2976312 - protein, 19 aa, Entamoeba invadens
WYACGHTIMSIEKGSTEEF

SEQ ID NO: 2976313 - protein, 26 aa, Entamoeba invadens
WYALLLRPTDPWEIRALYSEAQGTQY

SEQ ID NO: 2976314 - protein, 18 aa, Entamoeba invadens
WYEVFGRHTLLTSGEEVK

SEQ ID NO: 2976315 - protein, 17 aa, Entamoeba invadens
WYFSPYPGKYGNVERLY

SEQ ID NO: 2976316 - protein, 17 aa, Entamoeba invadens
WYGKELVSYSVFIEKFY

SEQ ID NO: 2976317 - protein, 17 aa, Entamoeba invadens
WYHAVSISVKVLHPALV

SEQ ID NO: 2976318 - protein, 18 aa, Entamoeba invadens
WYIQLLLLSPKSRRLQVL

SEQ ID NO: 2976319 - protein, 17 aa, Entamoeba invadens
WYKADQIFERMAVKYEV

SEQ ID NO: 2976320 - protein, 24 aa, Entamoeba invadens
WYKESQRFCNLPAVKFILVGVEDN

SEQ ID NO: 2976321 - protein, 20 aa, Entamoeba invadens
WYKQPIWRAKVVELITKGLI

SEQ ID NO: 2976322 - protein, 17 aa, Entamoeba invadens
WYLELRSVVDTIGESAL

SEQ ID NO: 2976323 - protein, 23 aa, Entamoeba invadens
WYLTQEIKPLIKITEPVINDCMN

SEQ ID NO: 2976324 - protein, 23 aa, Entamoeba invadens
WYNDARDLFFLDVPKVLSEKVQL

SEQ ID NO: 2976325 - protein, 21 aa, Entamoeba invadens
WYPKRVRKMYVFRREIQSLST

SEQ ID NO: 2976326 - protein, 20 aa, Entamoeba invadens
WYPVNFRLANKHNKTYTNFE

SEQ ID NO: 2976327 - protein, 17 aa, Entamoeba invadens
WYRAPEILLGSQRYSFG

SEQ ID NO: 2976328 - protein, 19 aa, Entamoeba invadens
WYRPLEILLGKEVYTSAVD

SEQ ID NO: 2976329 - protein, 19 aa, Entamoeba invadens
WYRVSFFGMHGVGITSLIK

SEQ ID NO: 2976330 - protein, 17 aa, Entamoeba invadens
WYSDIVTGLLYKQGEKY

SEQ ID NO: 2976331 - protein, 28 aa, Entamoeba invadens
WYTHGFEFKNMLLRKILNGERTCLVTEQ

SEQ ID NO: 2976332 - protein, 19 aa, Entamoeba invadens
WYTSHSLKERERIIREVSN

SEQ ID NO: 2976333 - protein, 19 aa, Entamoeba invadens
WYYHCDQMGILVWQDMPSR

SEQ ID NO: 2976334 - protein, 18 aa, Entamoeba invadens
YAAACQKLAAAPQPPLVI

SEQ ID NO: 2976335 - protein, 17 aa, Entamoeba invadens
YAAEHFEELVIVSIGIP

SEQ ID NO: 2976336 - protein, 20 aa, Entamoeba invadens
YAAMALKLPSLDVAEQTAKW

SEQ ID NO: 2976337 - protein, 21 aa, Entamoeba invadens
YACALRMRIPSCLEVETVGGH

SEQ ID NO: 2976338 - protein, 26 aa, Entamoeba invadens
YACMCFPYNKVETIVPLIKTYNPNGR

SEQ ID NO: 2976339 - protein, 20 aa, Entamoeba invadens
YACNELNAFNAKSYRTLLNE

SEQ ID NO: 2976340 - protein, 27 aa, Entamoeba invadens
YACQFTFKHVYFDLGMNPSLEVVKRKQ

SEQ ID NO: 2976341 - protein, 20 aa, Entamoeba invadens
YACSVMRKDTTLLFELSGGC

SEQ ID NO: 2976342 - protein, 23 aa, Entamoeba invadens
YADKRIGYLALMLLLDETQEVLT

SEQ ID NO: 2976343 - protein, 18 aa, Entamoeba invadens
YADMVITPPEIVGSVYPS

SEQ ID NO: 2976344 - protein, 26 aa, Entamoeba invadens
YADYYIVYQLGFCYSTVDGRVQKVFD

SEQ ID NO: 2976345 - protein, 18 aa, Entamoeba invadens
YAEAIAFSQQYNAKKRKE

SEQ ID NO: 2976346 - protein, 19 aa, Entamoeba invadens
YAEKLMFLGAPKVTLSDPS

SEQ ID NO: 2976347 - protein, 31 aa, Entamoeba invadens
YAELLTESLQRVFPFSSVVVIGNKLDIADEL

SEQ ID NO: 2976348 - protein, 20 aa, Entamoeba invadens
YAENEWILRSFINSAATRTL

SEQ ID NO: 2976349 - protein, 21 aa, Entamoeba invadens
YAENKIIGSFHEKVPQFKKFT

SEQ ID NO: 2976350 - protein, 19 aa, Entamoeba invadens
YAERKVWPYWQHLMSGIGS

SEQ ID NO: 2976351 - protein, 19 aa, Entamoeba invadens
YAFEASRKRKSCVTLATKS

SEQ ID NO: 2976352 - protein, 19 aa, Entamoeba invadens
YAFEECHRLSAITIPSRFK

SEQ ID NO: 2976353 - protein, 21 aa, Entamoeba invadens
YAGDVEAFFNPKNRFLAEYST

SEQ ID NO: 2976354 - protein, 17 aa, Entamoeba invadens
YAGEKFSTHYLFSGELI

SEQ ID NO: 2976355 - protein, 27 aa, Entamoeba invadens
YAGRRLGYRITPAFADHFLRTLFSVPN

SEQ ID NO: 2976356 - protein, 19 aa, Entamoeba invadens
YAHIREIYIPNSVTFLGDN

SEQ ID NO: 2976357 - protein, 17 aa, Entamoeba invadens
YAIALSHFQNVRFQVPS

SEQ ID NO: 2976358 - protein, 20 aa, Entamoeba invadens
YAIDPSVCAKDVVPYLSLAL

SEQ ID NO: 2976359 - protein, 18 aa, Entamoeba invadens
YAIGTSIESIKLYSTDEK

SEQ ID NO: 2976360 - protein, 20 aa, Entamoeba invadens
YAIKEARISVSDYCNADLRG

SEQ ID NO: 2976361 - protein, 17 aa, Entamoeba invadens
YAIKGRIDYKILKLTQQ

SEQ ID NO: 2976362 - protein, 17 aa, Entamoeba invadens
YAKDMLKLFSNIKTLYL

SEQ ID NO: 2976363 - protein, 21 aa, Entamoeba invadens
YAKGIVLDFDKIKSFGNKYFE

SEQ ID NO: 2976364 - protein, 24 aa, Entamoeba invadens
YAKNFLGILVHRVMGYDPTLEDQS

SEQ ID NO: 2976365 - protein, 19 aa, Entamoeba invadens
YAKPILCSPTLATSGLSIK

SEQ ID NO: 2976366 - protein, 22 aa, Entamoeba invadens
YAKQQLKQWMLTLRQLYKHINR

SEQ ID NO: 2976367 - protein, 24 aa, Entamoeba invadens
YALCKEKTEKCFVEKVPMSVKVGE

SEQ ID NO: 2976368 - protein, 19 aa, Entamoeba invadens
YALHLKLPLMVKLILDIDN

SEQ ID NO: 2976369 - protein, 25 aa, Entamoeba invadens
YALLKRPLLHQKLWNVLVDYSEIVL

SEQ ID NO: 2976370 - protein, 17 aa, Entamoeba invadens
YALLKYELRNINAPERI

SEQ ID NO: 2976371 - protein, 19 aa, Entamoeba invadens
YALRCKFPTYHISAKNNVG

SEQ ID NO: 2976372 - protein, 25 aa, Entamoeba invadens
YALRLRHWIEFGFSEFGDLGAMGVG

SEQ ID NO: 2976373 - protein, 23 aa, Entamoeba invadens
YALRMKACRILHNVPSSQGGIGG

SEQ ID NO: 2976374 - protein, 27 aa, Entamoeba invadens
YALRTRKRISLSMARQFDLEQLFKFQV

SEQ ID NO: 2976375 - protein, 20 aa, Entamoeba invadens
YAMLKCIKFVNDLHNTFSNT

SEQ ID NO: 2976376 - protein, 24 aa, Entamoeba invadens
YAMNVPELFGVVIPLYPILHDVTI

SEQ ID NO: 2976377 - protein, 19 aa, Entamoeba invadens
YAMSSTYPALVYVPKTATD

SEQ ID NO: 2976378 - protein, 18 aa, Entamoeba invadens
YANIFSRNILLLLSRSTM

SEQ ID NO: 2976379 - protein, 18 aa, Entamoeba invadens
YAPDMGIMVRIMKNDTTA

SEQ ID NO: 2976380 - protein, 18 aa, Entamoeba invadens
YAPEMGVMVRILQNDGTT

SEQ ID NO: 2976381 - protein, 17 aa, Entamoeba invadens
YAPFTMPQFSPLRAIPQ

SEQ ID NO: 2976382 - protein, 18 aa, Entamoeba invadens
YAPKKSFVIGARTKSKHD

SEQ ID NO: 2976383 - protein, 25 aa, Entamoeba invadens
YAPSMKFVACGGLDNIVSIYSIAPK

SEQ ID NO: 2976384 - protein, 24 aa, Entamoeba invadens
YAQAMCLVAAFLRLVLSENKVYKI

SEQ ID NO: 2976385 - protein, 24 aa, Entamoeba invadens
YAQKCLPLGKSRDWHNALMDYGAL

SEQ ID NO: 2976386 - protein, 27 aa, Entamoeba invadens
YAQNLRIKYPFPLRRAPLLNKLAYMAV

SEQ ID NO: 2976387 - protein, 17 aa, Entamoeba invadens
YAQYQCYPQMMTSDQPQ

SEQ ID NO: 2976388 - protein, 17 aa, Entamoeba invadens
YARMCVSETPDFDKGYF

SEQ ID NO: 2976389 - protein, 27 aa, Entamoeba invadens
YASAIRCVLLRMGIIGIKVNIMLNTDP

SEQ ID NO: 2976390 - protein, 20 aa, Entamoeba invadens
YASDMISNICRIAESRQQFV

SEQ ID NO: 2976391 - protein, 24 aa, Entamoeba invadens
YASDYAFPCEVMVQGVNNNGFYSG

SEQ ID NO: 2976392 - protein, 25 aa, Entamoeba invadens
YASLPLMDMFGFEIDVRFFTRGQAF

SEQ ID NO: 2976393 - protein, 19 aa, Entamoeba invadens
YASPWKDQFPEWALLPKTS

SEQ ID NO: 2976394 - protein, 19 aa, Entamoeba invadens
YASRCPLNTKEKVNKAKIR

SEQ ID NO: 2976395 - protein, 21 aa, Entamoeba invadens
YASVCGLCGNKMVVDPKKGKI

SEQ ID NO: 2976396 - protein, 25 aa, Entamoeba invadens
YASYLRFLMERRLYKEKLESTDLLP

SEQ ID NO: 2976397 - protein, 19 aa, Entamoeba invadens
YATKLGRMFSDITMSSKLT

SEQ ID NO: 2976398 - protein, 17 aa, Entamoeba invadens
YAVEKARIIDFINPEQP

SEQ ID NO: 2976399 - protein, 20 aa, Entamoeba invadens
YAVFKGCVALVDIALPKTLK

SEQ ID NO: 2976400 - protein, 26 aa, Entamoeba invadens
YAVKEFKRLGGALIRDDNIVKIAKEI

SEQ ID NO: 2976401 - protein, 18 aa, Entamoeba invadens
YAVVNPMMNCTALPTQQF

SEQ ID NO: 2976402 - protein, 27 aa, Entamoeba invadens
YAYMDKSIKYRGFFDVIHFAITWDDQS

SEQ ID NO: 2976403 - protein, 17 aa, Entamoeba invadens
YCANCGDSRALLVQKNT

SEQ ID NO: 2976404 - protein, 20 aa, Entamoeba invadens
YCCFYKCSSLSSITIPSSVT

SEQ ID NO: 2976405 - protein, 19 aa, Entamoeba invadens
YCDKCSIGHGFRTTYSDTR

SEQ ID NO: 2976406 - protein, 22 aa, Entamoeba invadens
YCDLCGCPLFIQIDLLDSQLQI

SEQ ID NO: 2976407 - protein, 18 aa, Entamoeba invadens
YCDQTCGIKCEDCGKYFC

SEQ ID NO: 2976408 - protein, 24 aa, Entamoeba invadens
YCEKCCVNAHTLECIRHWKKWRII

SEQ ID NO: 2976409 - protein, 21 aa, Entamoeba invadens
YCETINNFNKQICENKEDRIA

SEQ ID NO: 2976410 - protein, 18 aa, Entamoeba invadens
YCEYDMAVCLAAHANCKV

SEQ ID NO: 2976411 - protein, 20 aa, Entamoeba invadens
YCFAYCKSLSALTLGTNIIK

SEQ ID NO: 2976412 - protein, 20 aa, Entamoeba invadens
YCFCGCDSLSAITLGTNITK

SEQ ID NO: 2976413 - protein, 19 aa, Entamoeba invadens
YCFCGCNLLANIIIPQKVT

SEQ ID NO: 2976414 - protein, 21 aa, Entamoeba invadens
YCFCHCKNLVGVILQPTVTKL

SEQ ID NO: 2976415 - protein, 17 aa, Entamoeba invadens
YCFELCKSLTKVNIPRD

SEQ ID NO: 2976416 - protein, 21 aa, Entamoeba invadens
YCFENCKKITILNTILQSNDD

SEQ ID NO: 2976417 - protein, 17 aa, Entamoeba invadens
YCFFGCQNLKVVTYEGG

SEQ ID NO: 2976418 - protein, 19 aa, Entamoeba invadens
YCFGCCSNLTRVKITALIT

SEQ ID NO: 2976419 - protein, 19 aa, Entamoeba invadens
YCFHECLDLKGIQIPHNIT

SEQ ID NO: 2976420 - protein, 27 aa, Entamoeba invadens
YCFHLKMQMKFVLGCRVGQTPNSNTYL

SEQ ID NO: 2976421 - protein, 20 aa, Entamoeba invadens
YCFHQCASLRSVIIPPSVTF

SEQ ID NO: 2976422 - protein, 17 aa, Entamoeba invadens
YCFNGCISLSSVTIPTS

SEQ ID NO: 2976423 - protein, 17 aa, Entamoeba invadens
YCFNGCSSLKTVTLSLD

SEQ ID NO: 2976424 - protein, 19 aa, Entamoeba invadens
YCFQGCSSLTSFDLKVVER

SEQ ID NO: 2976425 - protein, 19 aa, Entamoeba invadens
YCFSMCSNLSKISLSNNVT

SEQ ID NO: 2976426 - protein, 18 aa, Entamoeba invadens
YCFYECLNLSKVTIPSSV

SEQ ID NO: 2976427 - protein, 18 aa, Entamoeba invadens
YCFYGCASLSSVTITSNV

SEQ ID NO: 2976428 - protein, 18 aa, Entamoeba invadens
YCFYGCSSLSGVTIPSSV

SEQ ID NO: 2976429 - protein, 17 aa, Entamoeba invadens
YCGKCGGREENQGFRVT

SEQ ID NO: 2976430 - protein, 19 aa, Entamoeba invadens
YCGLTSINIPDSFITLPYG

SEQ ID NO: 2976431 - protein, 24 aa, Entamoeba invadens
YCHCSETLISLQFENGIQLETVVL

SEQ ID NO: 2976432 - protein, 19 aa, Entamoeba invadens
YCIKCGTAMIGEPSTTMVR

SEQ ID NO: 2976433 - protein, 19 aa, Entamoeba invadens
YCILQCNPAAFPLVASINS

SEQ ID NO: 2976434 - protein, 24 aa, Entamoeba invadens
YCKDEFKMMVGLKVDLRENAQEVK

SEQ ID NO: 2976435 - protein, 20 aa, Entamoeba invadens
YCKLEMKKKELRDHIWDACD

SEQ ID NO: 2976436 - protein, 33 aa, Entamoeba invadens
YCKYVVKTFLEFSCKFLNFPTMNVFNNVIHLVI

SEQ ID NO: 2976437 - protein, 18 aa, Entamoeba invadens
YCNTFSDGFINVFSGVFL

SEQ ID NO: 2976438 - protein, 20 aa, Entamoeba invadens
YCQNEAFYLQRAEQQTQQPC

SEQ ID NO: 2976439 - protein, 17 aa, Entamoeba invadens
YCQTSCATNGDGLYEGL

SEQ ID NO: 2976440 - protein, 21 aa, Entamoeba invadens
YCSKCALDFTRKCELCSNGKY

SEQ ID NO: 2976441 - protein, 20 aa, Entamoeba invadens
YCSKEAVVIYGGKSIVVMKD

SEQ ID NO: 2976442 - protein, 17 aa, Entamoeba invadens
YCTCCKYSPNTLNLATA

SEQ ID NO: 2976443 - protein, 17 aa, Entamoeba invadens
YCTNIRYNHKLAVYNYD

SEQ ID NO: 2976444 - protein, 20 aa, Entamoeba invadens
YCTSCASGFYLSSNMECISL

SEQ ID NO: 2976445 - protein, 17 aa, Entamoeba invadens
YCVRLSKIVLPNSIKKI

SEQ ID NO: 2976446 - protein, 20 aa, Entamoeba invadens
YCVVNCLSMQVAVSKSVSTF

SEQ ID NO: 2976447 - protein, 24 aa, Entamoeba invadens
YCYAYRILFDKVRIPPIITSIEEG

SEQ ID NO: 2976448 - protein, 17 aa, Entamoeba invadens
YCYSYSFSALNDGEQSL

SEQ ID NO: 2976449 - protein, 20 aa, Entamoeba invadens
YDAADFLAFVAKYAIHTTNG

SEQ ID NO: 2976450 - protein, 17 aa, Entamoeba invadens
YDACEFVGQSFIYGEST

SEQ ID NO: 2976451 - protein, 27 aa, Entamoeba invadens
YDAKMGCCIDLLAPLFTFVGYQLDLLM

SEQ ID NO: 2976452 - protein, 20 aa, Entamoeba invadens
YDARLTTIQIEMSKKTKDYE

SEQ ID NO: 2976453 - protein, 25 aa, Entamoeba invadens
YDASAKAGGFIAARFLTGVPPQEFY

SEQ ID NO: 2976454 - protein, 31 aa, Entamoeba invadens
YDCSSDIWSCGVMLFNMCCSKEFERCYDERA

SEQ ID NO: 2976455 - protein, 19 aa, Entamoeba invadens
YDCTSCLNSEKCITCLENR

SEQ ID NO: 2976456 - protein, 18 aa, Entamoeba invadens
YDDILKKNVQFVVQSQTF

SEQ ID NO: 2976457 - protein, 25 aa, Entamoeba invadens
YDDLGCLWWDVLKGDYITRLTGHEN

SEQ ID NO: 2976458 - protein, 23 aa, Entamoeba invadens
YDDPSCGMGIIFGTGTNGCYIEK

SEQ ID NO: 2976459 - protein, 24 aa, Entamoeba invadens
YDDRDGCVVLKCLNEKYDNNTRKV

SEQ ID NO: 2976460 - protein, 17 aa, Entamoeba invadens
YDEFKRATAKECLQHEW

SEQ ID NO: 2976461 - protein, 19 aa, Entamoeba invadens
YDEKVDIWSIGCVTQELAE

SEQ ID NO: 2976462 - protein, 23 aa, Entamoeba invadens
YDEKYLFLWREDIFSQFQVLSPF

SEQ ID NO: 2976463 - protein, 23 aa, Entamoeba invadens
YDELTQPLAFWVFDIKGVEDAIA

SEQ ID NO: 2976464 - protein, 29 aa, Entamoeba invadens
YDENKMTCSICKEKFDISEDGNFFKNAVS

SEQ ID NO: 2976465 - protein, 26 aa, Entamoeba invadens
YDERFKTLTTLAAWELKTTDFKIIFT

SEQ ID NO: 2976466 - protein, 21 aa, Entamoeba invadens
YDESLKGLVMVPFEGGSPIPV

SEQ ID NO: 2976467 - protein, 20 aa, Entamoeba invadens
YDFDFKSSRLQEKFFDDDNF

SEQ ID NO: 2976468 - protein, 18 aa, Entamoeba invadens
YDFERNWTLSFFGNLLAI

SEQ ID NO: 2976469 - protein, 18 aa, Entamoeba invadens
YDFFFPFVNDSFHAVFKN

SEQ ID NO: 2976470 - protein, 20 aa, Entamoeba invadens
YDFFGFIPHILLFVRGISPF

SEQ ID NO: 2976471 - protein, 18 aa, Entamoeba invadens
YDFLEFLGKGNFGVVKKV

SEQ ID NO: 2976472 - protein, 18 aa, Entamoeba invadens
YDFQRGRLPYFIAPPTPK

SEQ ID NO: 2976473 - protein, 25 aa, Entamoeba invadens
YDGENWGEGVILYCNDIIVIKNKQE

SEQ ID NO: 2976474 - protein, 22 aa, Entamoeba invadens
YDGFLAGWEFHRVDGVVKSKQT

SEQ ID NO: 2976475 - protein, 17 aa, Entamoeba invadens
YDGNELIVYSSFESNLS

SEQ ID NO: 2976476 - protein, 23 aa, Entamoeba invadens
YDGNLFGAVVFKSITSENVTFGD

SEQ ID NO: 2976477 - protein, 27 aa, Entamoeba invadens
YDGNTPFHFFCLNFSNPNYSAAMDLFF

SEQ ID NO: 2976478 - protein, 18 aa, Entamoeba invadens
YDHFSFDDTCCINNTKTL

SEQ ID NO: 2976479 - protein, 29 aa, Entamoeba invadens
YDHKEWIPDYVLLSFGMNDFWDVVANVVD

SEQ ID NO: 2976480 - protein, 26 aa, Entamoeba invadens
YDIFRIRYKKIWSFIQENFTVFPKQT

SEQ ID NO: 2976481 - protein, 17 aa, Entamoeba invadens
YDIFSMLLPHQRVAIKW

SEQ ID NO: 2976482 - protein, 20 aa, Entamoeba invadens
YDIGASFYVKGRTTVKITAI

SEQ ID NO: 2976483 - protein, 20 aa, Entamoeba invadens
YDIKVPLPIMCEGGVVDVDK

SEQ ID NO: 2976484 - protein, 17 aa, Entamoeba invadens
YDILLRDRQTVLSRMEN

SEQ ID NO: 2976485 - protein, 18 aa, Entamoeba invadens
YDIPRYVVDTPISSCKIE

SEQ ID NO: 2976486 - protein, 20 aa, Entamoeba invadens
YDIQSLCFVHPEFFIVNKSS

SEQ ID NO: 2976487 - protein, 24 aa, Entamoeba invadens
YDISGCYILRPAAYGLWENIQQFI

SEQ ID NO: 2976488 - protein, 17 aa, Entamoeba invadens
YDISISYLSKIMKRLGL

SEQ ID NO: 2976489 - protein, 27 aa, Entamoeba invadens
YDKCSKLCSVCGCDEYLEKMKKEKEEH

SEQ ID NO: 2976490 - protein, 50 aa, Entamoeba invadens
YDKDMRTKCAMCTAIRYCNYCTFTSETCRECIDGAYLDNGHCFKCDNDQG

SEQ ID NO: 2976491 - protein, 19 aa, Entamoeba invadens
YDKDVKGIIQYRDVVQVEG

SEQ ID NO: 2976492 - protein, 25 aa, Entamoeba invadens
YDKGEYRWAATVLNHLVFANYKNKE

SEQ ID NO: 2976493 - protein, 17 aa, Entamoeba invadens
YDKIGVCVFNHLRNLSL

SEQ ID NO: 2976494 - protein, 24 aa, Entamoeba invadens
YDKIKFKFPWKIAEFVISGKRLPK

SEQ ID NO: 2976495 - protein, 19 aa, Entamoeba invadens
YDKILAYIFLFMTFIPDSL

SEQ ID NO: 2976496 - protein, 26 aa, Entamoeba invadens
YDKKISFHLNKFRAMVSTKKIPDIAI

SEQ ID NO: 2976497 - protein, 18 aa, Entamoeba invadens
YDKLKTLDFRVAINYWSQ

SEQ ID NO: 2976498 - protein, 25 aa, Entamoeba invadens
YDKLRRLSFINATVFFVCYSADSKT

SEQ ID NO: 2976499 - protein, 17 aa, Entamoeba invadens
YDKNKAFTEDDYKKGDS

SEQ ID NO: 2976500 - protein, 25 aa, Entamoeba invadens
YDKTIKLWDLRSGLKKEAQVMKGVS

SEQ ID NO: 2976501 - protein, 21 aa, Entamoeba invadens
YDKTSSFILERFIVAYDYLFK

SEQ ID NO: 2976502 - protein, 21 aa, Entamoeba invadens
YDKTSSFILERFIVAYEYLFK

SEQ ID NO: 2976503 - protein, 19 aa, Entamoeba invadens
YDLCFNCCSCLVSVDIPNT

SEQ ID NO: 2976504 - protein, 23 aa, Entamoeba invadens
YDLFLTYLAKICMAYCDSQSFYL

SEQ ID NO: 2976505 - protein, 18 aa, Entamoeba invadens
YDLICPFSQCGEFFDEEM

SEQ ID NO: 2976506 - protein, 17 aa, Entamoeba invadens
YDLINLLIFNFQLKQLK

SEQ ID NO: 2976507 - protein, 19 aa, Entamoeba invadens
YDLLAHKSVYLSFNRVYTG

SEQ ID NO: 2976508 - protein, 17 aa, Entamoeba invadens
YDLLKLFSIGGDLPEKS

SEQ ID NO: 2976509 - protein, 20 aa, Entamoeba invadens
YDLPLTRKGWIEEFNVFMGG

SEQ ID NO: 2976510 - protein, 17 aa, Entamoeba invadens
YDLPSEFRGLAGELVSK

SEQ ID NO: 2976511 - protein, 25 aa, Entamoeba invadens
YDLQALRWHFSYGGVLTIPSVEKII

SEQ ID NO: 2976512 - protein, 19 aa, Entamoeba invadens
YDLQLIFKHCDYYTLMADS

SEQ ID NO: 2976513 - protein, 17 aa, Entamoeba invadens
YDMLISMNFYNESEKDK

SEQ ID NO: 2976514 - protein, 33 aa, Entamoeba invadens
YDMLKRLGDFKALIDCLLCKGKIVDALRLAKQK

SEQ ID NO: 2976515 - protein, 25 aa, Entamoeba invadens
YDMMLSEKCYIQWIEEHPLDIENIP

SEQ ID NO: 2976516 - protein, 20 aa, Entamoeba invadens
YDMTSSICFQGKDNRCISKE

SEQ ID NO: 2976517 - protein, 17 aa, Entamoeba invadens
YDNDIKRANGAVSNAEK

SEQ ID NO: 2976518 - protein, 24 aa, Entamoeba invadens
YDNHKKMLLSICEYLVDTGVTTDL

SEQ ID NO: 2976519 - protein, 22 aa, Entamoeba invadens
YDNKIKIGMNVDVFGVMLDAFF

SEQ ID NO: 2976520 - protein, 24 aa, Entamoeba invadens
YDNSKFMCCYSLGISNLYTVNPFF

SEQ ID NO: 2976521 - protein, 17 aa, Entamoeba invadens
YDPEMYIFVLKNHTAPE

SEQ ID NO: 2976522 - protein, 19 aa, Entamoeba invadens
YDPQQYAAYAAAYQQQQQS

SEQ ID NO: 2976523 - protein, 17 aa, Entamoeba invadens
YDQCEFLDFGATCDDSS

SEQ ID NO: 2976524 - protein, 17 aa, Entamoeba invadens
YDQKRHLILAGINQEEE

SEQ ID NO: 2976525 - protein, 21 aa, Entamoeba invadens
YDQMGCGFGRRPFYQPFYGYC

SEQ ID NO: 2976526 - protein, 22 aa, Entamoeba invadens
YDQMGCGFGRRPFYQPFYGYCP

SEQ ID NO: 2976527 - protein, 28 aa, Entamoeba invadens
YDRLDTEISKRVTAKHGMHRVIAPPERI

SEQ ID NO: 2976528 - protein, 17 aa, Entamoeba invadens
YDRSMRHQFDYIPNRGN

SEQ ID NO: 2976529 - protein, 23 aa, Entamoeba invadens
YDSEEFRKYFTLSSVLEGLFKVI

SEQ ID NO: 2976530 - protein, 20 aa, Entamoeba invadens
YDSFVQWQFWRLKNLGKILF

SEQ ID NO: 2976531 - protein, 23 aa, Entamoeba invadens
YDSLKLPFLGVDVVLDKKTQKLF

SEQ ID NO: 2976532 - protein, 31 aa, Entamoeba invadens
YDSLTRLYYRFAAGVFIVFSINDTTSFSKVE

SEQ ID NO: 2976533 - protein, 19 aa, Entamoeba invadens
YDSVRIMPCANREEIATKI

SEQ ID NO: 2976534 - protein, 17 aa, Entamoeba invadens
YDTEQIKMCGSIVNTYL

SEQ ID NO: 2976535 - protein, 27 aa, Entamoeba invadens
YDTFSFIGGLVFPVPADHLLLQQRQRE

SEQ ID NO: 2976536 - protein, 21 aa, Entamoeba invadens
YDTISKLSLWEVKESFKDPIG

SEQ ID NO: 2976537 - protein, 23 aa, Entamoeba invadens
YDTKDVICPLVLGKVHCGRSALV

SEQ ID NO: 2976538 - protein, 18 aa, Entamoeba invadens
YDTVPLRVSLVMRSKSES

SEQ ID NO: 2976539 - protein, 19 aa, Entamoeba invadens
YDVFSFFVALLKQSGEEVS

SEQ ID NO: 2976540 - protein, 18 aa, Entamoeba invadens
YDVGEIAAKIAQLYYHYY

SEQ ID NO: 2976541 - protein, 18 aa, Entamoeba invadens
YDVIPEIVDGMNIADYVD

SEQ ID NO: 2976542 - protein, 20 aa, Entamoeba invadens
YDVIQTCWVQYPKERISIEK

SEQ ID NO: 2976543 - protein, 24 aa, Entamoeba invadens
YDVKSGVSSFVIDWISQANAQQRA

SEQ ID NO: 2976544 - protein, 24 aa, Entamoeba invadens
YDVLRTVNELMYIKDRQPPKVSTK

SEQ ID NO: 2976545 - protein, 21 aa, Entamoeba invadens
YDVLTICGGFGKRSVGLGLFG

SEQ ID NO: 2976546 - protein, 24 aa, Entamoeba invadens
YDVQECLRLLNAINIGLSAFESKN

SEQ ID NO: 2976547 - protein, 17 aa, Entamoeba invadens
YDVRVLSYTLGFTYTSA

SEQ ID NO: 2976548 - protein, 22 aa, Entamoeba invadens
YDVRVVPFFPSLVSYSPEEQKK

SEQ ID NO: 2976549 - protein, 20 aa, Entamoeba invadens
YDVSCVPTFILFKDNVEVKR

SEQ ID NO: 2976550 - protein, 19 aa, Entamoeba invadens
YDVSVTLVFGDVVEANAWF

SEQ ID NO: 2976551 - protein, 18 aa, Entamoeba invadens
YDVVCATVAFGMGIDKAD

SEQ ID NO: 2976552 - protein, 25 aa, Entamoeba invadens
YDYDACSLYPIAMHILKLATGKPIL

SEQ ID NO: 2976553 - protein, 31 aa, Entamoeba invadens
YDYDACSLYPSAIHRLKLATGKPIVIPQESC

SEQ ID NO: 2976554 - protein, 30 aa, Entamoeba invadens
YDYDACSLYPSAIHRLKLATGKPIVIPQET

SEQ ID NO: 2976555 - protein, 30 aa, Entamoeba invadens
YDYDACSLYPSVIHRLKLATGKPIVIPQES

SEQ ID NO: 2976556 - protein, 31 aa, Entamoeba invadens
YDYRQMAVLQKRRVAVTPVQLIKVYNRKMCV

SEQ ID NO: 2976557 - protein, 25 aa, Entamoeba invadens
YEAFLTDYPYCFDYELPPETKLTAE

SEQ ID NO: 2976558 - protein, 21 aa, Entamoeba invadens
YEAFPQLGRFTLRDAGKTIAF

SEQ ID NO: 2976559 - protein, 20 aa, Entamoeba invadens
YEAKEAGAYIVATGRGDFPN

SEQ ID NO: 2976560 - protein, 20 aa, Entamoeba invadens
YEAPEIRKNLPYSSKSDLYS

SEQ ID NO: 2976561 - protein, 20 aa, Entamoeba invadens
YEAQAVISIGIIRSIDDKVV

SEQ ID NO: 2976562 - protein, 17 aa, Entamoeba invadens
YEARIKYTITKVEQKSD

SEQ ID NO: 2976563 - protein, 18 aa, Entamoeba invadens
YEAVFGWCQSLTSFDVLK

SEQ ID NO: 2976564 - protein, 19 aa, Entamoeba invadens
YEAYLKVLLSDSGNNSEDS

SEQ ID NO: 2976565 - protein, 22 aa, Entamoeba invadens
YECHLRLKALGFLFNNIKMTEK

SEQ ID NO: 2976566 - protein, 22 aa, Entamoeba invadens
YECHLRLKALGFNFNNIKLTEG

SEQ ID NO: 2976567 - protein, 23 aa, Entamoeba invadens
YECHLRLKALGFNFNNIKLTEGD

SEQ ID NO: 2976568 - protein, 21 aa, Entamoeba invadens
YECHLRLKALGYLFNNIKLTQ

SEQ ID NO: 2976569 - protein, 19 aa, Entamoeba invadens
YECIKFDSFTIPTSVDKIS

SEQ ID NO: 2976570 - protein, 21 aa, Entamoeba invadens
YEDEFIKSIAFILETTTSGGK

SEQ ID NO: 2976571 - protein, 19 aa, Entamoeba invadens
YEDFLRIVPKVQVGEEAPE

SEQ ID NO: 2976572 - protein, 17 aa, Entamoeba invadens
YEDLCSVFIDIVEGYPD

SEQ ID NO: 2976573 - protein, 24 aa, Entamoeba invadens
YEDMLCSKFIIRLKEIEEKKRKFF

SEQ ID NO: 2976574 - protein, 17 aa, Entamoeba invadens
YEDMLEAIPTFPQSSTE

SEQ ID NO: 2976575 - protein, 20 aa, Entamoeba invadens
YEEAARVFVLVSIKITSLYE

SEQ ID NO: 2976576 - protein, 18 aa, Entamoeba invadens
YEEFKEKPTEEVLDKAFT

SEQ ID NO: 2976577 - protein, 20 aa, Entamoeba invadens
YEEFTVLIQFMYDSVEHSEL

SEQ ID NO: 2976578 - protein, 26 aa, Entamoeba invadens
YEELRRYGPFKGKVPRIICGTKADLP

SEQ ID NO: 2976579 - protein, 17 aa, Entamoeba invadens
YEELVFPGCSFHCTVTT

SEQ ID NO: 2976580 - protein, 24 aa, Entamoeba invadens
YEERIYDILKYCFSVKEFEKVYLD

SEQ ID NO: 2976581 - protein, 19 aa, Entamoeba invadens
YEETFLKIFKIICVKESSV

SEQ ID NO: 2976582 - protein, 19 aa, Entamoeba invadens
YEEVFYLQCDSRWATHMYS

SEQ ID NO: 2976583 - protein, 24 aa, Entamoeba invadens
YEFKEIKILVKYAQNYPLTFCYNQ

SEQ ID NO: 2976584 - protein, 17 aa, Entamoeba invadens
YEFLEPNAPKYEVLFNC

SEQ ID NO: 2976585 - protein, 25 aa, Entamoeba invadens
YEFMGLYKFLELCFTLFVMNDTNRS

SEQ ID NO: 2976586 - protein, 17 aa, Entamoeba invadens
YEFQVDIVINSGCAGGA

SEQ ID NO: 2976587 - protein, 20 aa, Entamoeba invadens
YEFVVWKDFYLRDIEYSCEV

SEQ ID NO: 2976588 - protein, 20 aa, Entamoeba invadens
YEGAYCFSRNDILSSGKRVN

SEQ ID NO: 2976589 - protein, 20 aa, Entamoeba invadens
YEGGLRFVLSTGNLLEQDYE

SEQ ID NO: 2976590 - protein, 18 aa, Entamoeba invadens
YEGNVWIYSNGICIYDTE

SEQ ID NO: 2976591 - protein, 18 aa, Entamoeba invadens
YEGVVLREGIRPIKVSGN

SEQ ID NO: 2976592 - protein, 21 aa, Entamoeba invadens
YEHFACLLPLHLYQVLHGNLI

SEQ ID NO: 2976593 - protein, 27 aa, Entamoeba invadens
YEHFCSFKGKIWAKVFIKSKPGLYGIK

SEQ ID NO: 2976594 - protein, 26 aa, Entamoeba invadens
YEHGEGFKIFFLHKVVNACRTVIKCG

SEQ ID NO: 2976595 - protein, 22 aa, Entamoeba invadens
YEHLKLYISVAADLVESNRGDN

SEQ ID NO: 2976596 - protein, 31 aa, Entamoeba invadens
YEHNFIWIDSIWKWKEVCVSTPEEHQKYLDL

SEQ ID NO: 2976597 - protein, 28 aa, Entamoeba invadens
YEHQRVGVKWMYELYKQGGGGIVGDEMG

SEQ ID NO: 2976598 - protein, 21 aa, Entamoeba invadens
YEIEALWVFTGHELPKEFTDC

SEQ ID NO: 2976599 - protein, 17 aa, Entamoeba invadens
YEIEVLPNASSHVIEEM

SEQ ID NO: 2976600 - protein, 19 aa, Entamoeba invadens
YEIIESTTSFAKRNPKIEI

SEQ ID NO: 2976601 - protein, 18 aa, Entamoeba invadens
YEILYKWKIPNIEMSLKL

SEQ ID NO: 2976602 - protein, 18 aa, Entamoeba invadens
YEIPDKCFYMCANLKEID

SEQ ID NO: 2976603 - protein, 18 aa, Entamoeba invadens
YEIPDKCFYTCAKLKEIN

SEQ ID NO: 2976604 - protein, 17 aa, Entamoeba invadens
YEIPPIVDEAGEPITKV

SEQ ID NO: 2976605 - protein, 20 aa, Entamoeba invadens
YEIRSVPPLVTLKPGYACEF

SEQ ID NO: 2976606 - protein, 26 aa, Entamoeba invadens
YEISRGNKLLLFDLKEVYDCAHGIKG

SEQ ID NO: 2976607 - protein, 26 aa, Entamoeba invadens
YEITTTRSLFWSSFSKEYKCNKVLAV

SEQ ID NO: 2976608 - protein, 28 aa, Entamoeba invadens
YEKAKLKRKCFICGNYGHSKDECPQRNQ

SEQ ID NO: 2976609 - protein, 31 aa, Entamoeba invadens
YEKEAPLLCKMGNVRGFKLFKRLERLENRVS

SEQ ID NO: 2976610 - protein, 24 aa, Entamoeba invadens
YEKGFRYQEYEGFDKKQRVADDIN

SEQ ID NO: 2976611 - protein, 24 aa, Entamoeba invadens
YEKILKHAFYWFVPDDEEKMSLSR

SEQ ID NO: 2976612 - protein, 21 aa, Entamoeba invadens
YEKKCEYFICQNETFTEQNGM

SEQ ID NO: 2976613 - protein, 25 aa, Entamoeba invadens
YEKLFSSKTIEEFLVQFNQVVSKYL

SEQ ID NO: 2976614 - protein, 20 aa, Entamoeba invadens
YEKMIMTWLDIMGNAIREQC

SEQ ID NO: 2976615 - protein, 20 aa, Entamoeba invadens
YEKNEINTLIGWTVDNIDMK

SEQ ID NO: 2976616 - protein, 21 aa, Entamoeba invadens
YEKRAYLGVYRVQSRMTVGQK

SEQ ID NO: 2976617 - protein, 21 aa, Entamoeba invadens
YEKRMTKLVQDFRQKKICGPN

SEQ ID NO: 2976618 - protein, 19 aa, Entamoeba invadens
YEKSDIVGVHIHYESVVNE

SEQ ID NO: 2976619 - protein, 31 aa, Entamoeba invadens
YEKSLSTFGFLCFKERLALLNDEKFYLEILH

SEQ ID NO: 2976620 - protein, 19 aa, Entamoeba invadens
YEKSYAFIEFRTFDQAVKA

SEQ ID NO: 2976621 - protein, 17 aa, Entamoeba invadens
YEKTMYWDEVAQYEEQK

SEQ ID NO: 2976622 - protein, 24 aa, Entamoeba invadens
YEKVDRFNVLPAQHKRIQVDKLYV

SEQ ID NO: 2976623 - protein, 24 aa, Entamoeba invadens
YELENSLYIAMEFMDRNNLTAILE

SEQ ID NO: 2976624 - protein, 28 aa, Entamoeba invadens
YELFIKGFLKYLPRSHVEFEKLQPEIKT

SEQ ID NO: 2976625 - protein, 20 aa, Entamoeba invadens
YELFIKLILNSCDKIFENEE

SEQ ID NO: 2976626 - protein, 21 aa, Entamoeba invadens
YELINIFSRRLLEHIDKATKT

SEQ ID NO: 2976627 - protein, 17 aa, Entamoeba invadens
YELKNFIKEIVKITSED

SEQ ID NO: 2976628 - protein, 21 aa, Entamoeba invadens
YELKVGVCGEKATKIAERLKK

SEQ ID NO: 2976629 - protein, 21 aa, Entamoeba invadens
YELMLDLFGNYVIQKLFEFGT

SEQ ID NO: 2976630 - protein, 21 aa, Entamoeba invadens
YELPDGRIVKIGKECFTCGEM

SEQ ID NO: 2976631 - protein, 25 aa, Entamoeba invadens
YELPVCDMCSIPGSVVCFSSISIRL

SEQ ID NO: 2976632 - protein, 19 aa, Entamoeba invadens
YELSASFEFFKHAINKISL

SEQ ID NO: 2976633 - protein, 25 aa, Entamoeba invadens
YELSKRYNRICVVTHRSTEQSLFSK

SEQ ID NO: 2976634 - protein, 22 aa, Entamoeba invadens
YELVEAWTWDSVTGIQPSLANN

SEQ ID NO: 2976635 - protein, 22 aa, Entamoeba invadens
YENDIAEIIVRAETFEKNVHMA

SEQ ID NO: 2976636 - protein, 25 aa, Entamoeba invadens
YENDYDVMFSFGFGLDLCICKTNSG

SEQ ID NO: 2976637 - protein, 22 aa, Entamoeba invadens
YENELLPYFEIILKKRSLSAEF

SEQ ID NO: 2976638 - protein, 23 aa, Entamoeba invadens
YENETPNFLCFVDMTKLKIDELT

SEQ ID NO: 2976639 - protein, 17 aa, Entamoeba invadens
YENGILIIDKNEYRRYG

SEQ ID NO: 2976640 - protein, 23 aa, Entamoeba invadens
YENKRNIGTFVFDKLPKTEDIEF

SEQ ID NO: 2976641 - protein, 24 aa, Entamoeba invadens
YENLKDAFLDFSKTFYVGFESCLK

SEQ ID NO: 2976642 - protein, 18 aa, Entamoeba invadens
YENLRILCDCILKNSEGF

SEQ ID NO: 2976643 - protein, 35 aa, Entamoeba invadens
YEPEIFPGVVYRLAEPKMVLLIFASGKIVFTGGKE

SEQ ID NO: 2976644 - protein, 25 aa, Entamoeba invadens
YEPFIKIPLTMNALLNFSDLSHFLC

SEQ ID NO: 2976645 - protein, 29 aa, Entamoeba invadens
YEPHFIFSYGRPMAGNVFAVLTSDNDYTL

SEQ ID NO: 2976646 - protein, 17 aa, Entamoeba invadens
YEPRSEKELSLVPGDKV

SEQ ID NO: 2976647 - protein, 19 aa, Entamoeba invadens
YEQAILIFLVNQFGAVTLE

SEQ ID NO: 2976648 - protein, 19 aa, Entamoeba invadens
YEQEPKYLIEHGFLEAVPD

SEQ ID NO: 2976649 - protein, 19 aa, Entamoeba invadens
YEQGVLLAILNRHFSITLV

SEQ ID NO: 2976650 - protein, 25 aa, Entamoeba invadens
YEQIPFEMYSGLRIHTVKNQTLGEI

SEQ ID NO: 2976651 - protein, 26 aa, Entamoeba invadens
YEQIRKSGWFRVMFVKYNCVRHILDL

SEQ ID NO: 2976652 - protein, 19 aa, Entamoeba invadens
YEQSCIIVKIPNAKDVTKK

SEQ ID NO: 2976653 - protein, 25 aa, Entamoeba invadens
YEQVMFKERFCDFLEAPKKLKSWEF

SEQ ID NO: 2976654 - protein, 27 aa, Entamoeba invadens
YEREMRPKRSYRAMVFTSESEEEEDVK

SEQ ID NO: 2976655 - protein, 25 aa, Entamoeba invadens
YERKGIFKECYNLALTQQMKNKDIP

SEQ ID NO: 2976656 - protein, 21 aa, Entamoeba invadens
YERSILKFTYPIAGKLWMKYF

SEQ ID NO: 2976657 - protein, 18 aa, Entamoeba invadens
YERVDLICVEKCLETEEH

SEQ ID NO: 2976658 - protein, 18 aa, Entamoeba invadens
YESAIKIVSSCFTTFLVK

SEQ ID NO: 2976659 - protein, 26 aa, Entamoeba invadens
YESEYLIEIFFWRLVKYKIDQQKNPT

SEQ ID NO: 2976660 - protein, 28 aa, Entamoeba invadens
YESFKKDFGGLLWRPQPKNLIKDDLEVD

SEQ ID NO: 2976661 - protein, 27 aa, Entamoeba invadens
YESSELYPGELVELIISDVLVPLYLIP

SEQ ID NO: 2976662 - protein, 34 aa, Entamoeba invadens
YESYDRKIFGIAIPECVNSLGESCYTNTKKMTTF

SEQ ID NO: 2976663 - protein, 21 aa, Entamoeba invadens
YETISDLSLTYVILNKIVEDV

SEQ ID NO: 2976664 - protein, 23 aa, Entamoeba invadens
YETKKYFVRPKMIKGIDNLEIYN

SEQ ID NO: 2976665 - protein, 31 aa, Entamoeba invadens
YETPELFDALKYRIVPMLLTVVVVPSIFIQS

SEQ ID NO: 2976666 - protein, 25 aa, Entamoeba invadens
YETPFPAATTFDWGTVVSNTSDVTK

SEQ ID NO: 2976667 - protein, 25 aa, Entamoeba invadens
YETTDCIFICFSINDWNQFERTKTW

SEQ ID NO: 2976668 - protein, 21 aa, Entamoeba invadens
YEVDCSRGRQVLVQKQESPIL

SEQ ID NO: 2976669 - protein, 22 aa, Entamoeba invadens
YEVFIRFFLERLKSGFQSSMEK

SEQ ID NO: 2976670 - protein, 28 aa, Entamoeba invadens
YEVGNGEFWSGVRFGYFTIADINVKNSF

SEQ ID NO: 2976671 - protein, 20 aa, Entamoeba invadens
YEVIEKFVLGKGKRLRPLSI

SEQ ID NO: 2976672 - protein, 17 aa, Entamoeba invadens
YEVKYTPLVPGIHKVEV

SEQ ID NO: 2976673 - protein, 21 aa, Entamoeba invadens
YEVLEFAPGGNLFQLIKKKPL

SEQ ID NO: 2976674 - protein, 17 aa, Entamoeba invadens
YEVLKYAKGGNLYERIT

SEQ ID NO: 2976675 - protein, 19 aa, Entamoeba invadens
YEVLQCRPNLSARQLWDVR

SEQ ID NO: 2976676 - protein, 25 aa, Entamoeba invadens
YEVPELGELHWIRTPPKIFFEPHAI

SEQ ID NO: 2976677 - protein, 23 aa, Entamoeba invadens
YEVPHIVCATSPPPYDIKLEEPN

SEQ ID NO: 2976678 - protein, 18 aa, Entamoeba invadens
YEVSTLFLEEFVRITFLG

SEQ ID NO: 2976679 - protein, 22 aa, Entamoeba invadens
YEVVKKLGGAFIAHPELMRTIG

SEQ ID NO: 2976680 - protein, 24 aa, Entamoeba invadens
YEYIPFFVKNGFKGVARSMPTSAA

SEQ ID NO: 2976681 - protein, 17 aa, Entamoeba invadens
YEYMAWYLGDINVINGG

SEQ ID NO: 2976682 - protein, 18 aa, Entamoeba invadens
YEYWARPTKFLVEPVTIK

SEQ ID NO: 2976683 - protein, 21 aa, Entamoeba invadens
YFADRKIFCAGRVEEPDLKRV

SEQ ID NO: 2976684 - protein, 23 aa, Entamoeba invadens
YFALGCMMFEFVVGYPPFNAPTP

SEQ ID NO: 2976685 - protein, 18 aa, Entamoeba invadens
YFASSMIFYSGKYKAYCI

SEQ ID NO: 2976686 - protein, 25 aa, Entamoeba invadens
YFDAAFRRVSEIVVDYAIGAKRPEM

SEQ ID NO: 2976687 - protein, 17 aa, Entamoeba invadens
YFDEIVEVFKRKCVYKF

SEQ ID NO: 2976688 - protein, 20 aa, Entamoeba invadens
YFDFLRCLKSFGSLKSVEEV

SEQ ID NO: 2976689 - protein, 37 aa, Entamoeba invadens
YFDFRVIYDTGLDDFFLLHGFYCIRLEDALKEIVQFL

SEQ ID NO: 2976690 - protein, 18 aa, Entamoeba invadens
YFDFSKFFFVEDFDVLFD

SEQ ID NO: 2976691 - protein, 24 aa, Entamoeba invadens
YFDICRIKDAISLKAKLDEMKKMG

SEQ ID NO: 2976692 - protein, 18 aa, Entamoeba invadens
YFDKLAFHSLYYPFVSGV

SEQ ID NO: 2976693 - protein, 25 aa, Entamoeba invadens
YFDPRCFTSHFTHVFVVVTPDVNDE

SEQ ID NO: 2976694 - protein, 23 aa, Entamoeba invadens
YFDRIEFPTVRYAGLLEYDSDNH

SEQ ID NO: 2976695 - protein, 26 aa, Entamoeba invadens
YFDTRCIPNLPGINLNLSYTNDFNGE

SEQ ID NO: 2976696 - protein, 30 aa, Entamoeba invadens
YFDYGSLEDFCMRVPFRVGARDESRKDEIR

SEQ ID NO: 2976697 - protein, 20 aa, Entamoeba invadens
YFECFADKLGKCKHYTKSHI

SEQ ID NO: 2976698 - protein, 19 aa, Entamoeba invadens
YFEGVKMWRRDIVESDKAS

SEQ ID NO: 2976699 - protein, 22 aa, Entamoeba invadens
YFEKESRGWIDYSKPMVLTIEN

SEQ ID NO: 2976700 - protein, 28 aa, Entamoeba invadens
YFERTKVEYSFCYKWIVLLFKRDFEPAE

SEQ ID NO: 2976701 - protein, 26 aa, Entamoeba invadens
YFFDLTDWYIGYLIRSYRSGDTTIPS

SEQ ID NO: 2976702 - protein, 20 aa, Entamoeba invadens
YFFHFVKATCPYIVEYNANL

SEQ ID NO: 2976703 - protein, 18 aa, Entamoeba invadens
YFFHFVKSTCPYIVEYNS

SEQ ID NO: 2976704 - protein, 17 aa, Entamoeba invadens
YFFMKGKTLMAVNKKVG

SEQ ID NO: 2976705 - protein, 27 aa, Entamoeba invadens
YFGCSRSRIYPSIGFAEGVEMCNINGD

SEQ ID NO: 2976706 - protein, 24 aa, Entamoeba invadens
YFGELSCPLIYSSYIFAAQVAMTS

SEQ ID NO: 2976707 - protein, 18 aa, Entamoeba invadens
YFHPTKPWILSCSDDRTI

SEQ ID NO: 2976708 - protein, 18 aa, Entamoeba invadens
YFHYYLKYFSVRTKVRAR

SEQ ID NO: 2976709 - protein, 17 aa, Entamoeba invadens
YFIDCSFQTQFRVWCYP

SEQ ID NO: 2976710 - protein, 19 aa, Entamoeba invadens
YFKAPNCVVIGISNDTEDY

SEQ ID NO: 2976711 - protein, 20 aa, Entamoeba invadens
YFKDISFNLPYYVPKGKSKD

SEQ ID NO: 2976712 - protein, 26 aa, Entamoeba invadens
YFKKAFYRIVVWFGVDFETVDKNKGR

SEQ ID NO: 2976713 - protein, 19 aa, Entamoeba invadens
YFKKFTFNSVELEFIKAGQ

SEQ ID NO: 2976714 - protein, 17 aa, Entamoeba invadens
YFKRAKVVYKANSEISE

SEQ ID NO: 2976715 - protein, 27 aa, Entamoeba invadens
YFKVSIELYKRFNIWTIFKESDLRVKT

SEQ ID NO: 2976716 - protein, 17 aa, Entamoeba invadens
YFLCPEVTKGESIVEML

SEQ ID NO: 2976717 - protein, 19 aa, Entamoeba invadens
YFLHLFPKMNTIQITSSAL

SEQ ID NO: 2976718 - protein, 20 aa, Entamoeba invadens
YFLKESKLSVNGKHRVVYLL

SEQ ID NO: 2976719 - protein, 22 aa, Entamoeba invadens
YFLKSYCVYVNCIDCVNKREEQ

SEQ ID NO: 2976720 - protein, 20 aa, Entamoeba invadens
YFLNCHTIGANYSFSDTTLA

SEQ ID NO: 2976721 - protein, 25 aa, Entamoeba invadens
YFLPLREVMKNAPIVEGEYGKMPLF

SEQ ID NO: 2976722 - protein, 26 aa, Entamoeba invadens
YFLQVCSLITAVFCEKYVDMLMKCKR

SEQ ID NO: 2976723 - protein, 18 aa, Entamoeba invadens
YFLRCLISSSHLLKMDPK

SEQ ID NO: 2976724 - protein, 17 aa, Entamoeba invadens
YFLRCLISSSHLLKTDP

SEQ ID NO: 2976725 - protein, 17 aa, Entamoeba invadens
YFLVSTFFEIFISNMRS

SEQ ID NO: 2976726 - protein, 18 aa, Entamoeba invadens
YFMQVSMKKLKTFKDRTI

SEQ ID NO: 2976727 - protein, 26 aa, Entamoeba invadens
YFNAYRIDHILGFFRIWSIPAQHRTG

SEQ ID NO: 2976728 - protein, 26 aa, Entamoeba invadens
YFNCAGIFRSRFQRYLLHLYSSPYLF

SEQ ID NO: 2976729 - protein, 19 aa, Entamoeba invadens
YFNHKVFYDKAAIRSMGKQ

SEQ ID NO: 2976730 - protein, 20 aa, Entamoeba invadens
YFNHLIPISFPQNMTSLVIG

SEQ ID NO: 2976731 - protein, 18 aa, Entamoeba invadens
YFNSSFDLVARWYGLSHI

SEQ ID NO: 2976732 - protein, 25 aa, Entamoeba invadens
YFPENTKFSGVDVFTNCIKLSALTL

SEQ ID NO: 2976733 - protein, 18 aa, Entamoeba invadens
YFPESRDLVLKTFGELCN

SEQ ID NO: 2976734 - protein, 30 aa, Entamoeba invadens
YFPEVDFYECYKLDLVDVVMKFVDGEIKCV

SEQ ID NO: 2976735 - protein, 17 aa, Entamoeba invadens
YFPGEYCQVIGGIHKEV

SEQ ID NO: 2976736 - protein, 20 aa, Entamoeba invadens
YFPLVPREVALSFLEGQIDG

SEQ ID NO: 2976737 - protein, 18 aa, Entamoeba invadens
YFPNIEILHLWNKKDENF

SEQ ID NO: 2976738 - protein, 21 aa, Entamoeba invadens
YFPNIETLYLWDVKDENFGNG

SEQ ID NO: 2976739 - protein, 20 aa, Entamoeba invadens
YFPPRGEQFCFGKIERSSAV

SEQ ID NO: 2976740 - protein, 18 aa, Entamoeba invadens
YFQDGSKNLFGIFYGFWL

SEQ ID NO: 2976741 - protein, 35 aa, Entamoeba invadens
YFQEVPKYLFGAKESWKTKIFRLYVLTDNCSSEVV

SEQ ID NO: 2976742 - protein, 27 aa, Entamoeba invadens
YFQKDNCEVYRTICKDFYMKEKDYLRI

SEQ ID NO: 2976743 - protein, 21 aa, Entamoeba invadens
YFRHCGIIKKISPDEFDITKV

SEQ ID NO: 2976744 - protein, 21 aa, Entamoeba invadens
YFRNSSCVLLVFDINNMESFK

SEQ ID NO: 2976745 - protein, 18 aa, Entamoeba invadens
YFRSEFVFYAISRYVSMN

SEQ ID NO: 2976746 - protein, 27 aa, Entamoeba invadens
YFSAYRIDHILGFFRIWSIPAGHRTGL

SEQ ID NO: 2976747 - protein, 17 aa, Entamoeba invadens
YFSCNTAKGSGHTLDSL

SEQ ID NO: 2976748 - protein, 25 aa, Entamoeba invadens
YFSEYLRTNFKWIYNGKDKYGLGDN

SEQ ID NO: 2976749 - protein, 26 aa, Entamoeba invadens
YFSEYLRTNFRWIYNGKGKYGLGDNM

SEQ ID NO: 2976750 - protein, 21 aa, Entamoeba invadens
YFSKCHALRSVTFLDANIVNR

SEQ ID NO: 2976751 - protein, 22 aa, Entamoeba invadens
YFSLFVRFVFSDGLFEEKRVKI

SEQ ID NO: 2976752 - protein, 27 aa, Entamoeba invadens
YFSLKTLRRLLASKSRWNVRVTTKTVI

SEQ ID NO: 2976753 - protein, 19 aa, Entamoeba invadens
YFSMKYIHMNLEFSDVFWR

SEQ ID NO: 2976754 - protein, 19 aa, Entamoeba invadens
YFSREIIKAVKYLRFEKGV

SEQ ID NO: 2976755 - protein, 21 aa, Entamoeba invadens
YFTDAFCDLWKAKTITSPSTP

SEQ ID NO: 2976756 - protein, 18 aa, Entamoeba invadens
YFTEKLLCKSILTICAPN

SEQ ID NO: 2976757 - protein, 18 aa, Entamoeba invadens
YFTFKNFQAEDLLDKVCD

SEQ ID NO: 2976758 - protein, 19 aa, Entamoeba invadens
YFTGLKNIFDIVAAQCSEL

SEQ ID NO: 2976759 - protein, 17 aa, Entamoeba invadens
YFTLLLTFNRFGYRESS

SEQ ID NO: 2976760 - protein, 18 aa, Entamoeba invadens
YFTNCLDPSQIALLSHAD

SEQ ID NO: 2976761 - protein, 22 aa, Entamoeba invadens
YFTPEVLTLFFSRNYQISNVIF

SEQ ID NO: 2976762 - protein, 25 aa, Entamoeba invadens
YFTQECLQMYLSTKYDGVVDYAGQR

SEQ ID NO: 2976763 - protein, 18 aa, Entamoeba invadens
YFTVALYYFYKNVKQTLD

SEQ ID NO: 2976764 - protein, 18 aa, Entamoeba invadens
YFVERSASERNLCTAVPT

SEQ ID NO: 2976765 - protein, 17 aa, Entamoeba invadens
YFVFTMKNPHNILPTKF

SEQ ID NO: 2976766 - protein, 19 aa, Entamoeba invadens
YFVHRAKIPTICSLGIQWE

SEQ ID NO: 2976767 - protein, 34 aa, Entamoeba invadens
YFVIAFLKMRYSNMKIVWRLLVEKAEKYIASNLV

SEQ ID NO: 2976768 - protein, 23 aa, Entamoeba invadens
YFVLRQKHFISIAIKEYEKNHCD

SEQ ID NO: 2976769 - protein, 23 aa, Entamoeba invadens
YFVSHIHFLEALLLQPELNSQDQ

SEQ ID NO: 2976770 - protein, 23 aa, Entamoeba invadens
YFYEKRPNTLITERLNKRSRLNI

SEQ ID NO: 2976771 - protein, 24 aa, Entamoeba invadens
YFYMKCFTENFILQKVDKKYYPKF

SEQ ID NO: 2976772 - protein, 20 aa, Entamoeba invadens
YGAFHGCATLADLSTTTYIS

SEQ ID NO: 2976773 - protein, 18 aa, Entamoeba invadens
YGALEPLDLFSIKNTLLL

SEQ ID NO: 2976774 - protein, 31 aa, Entamoeba invadens
YGAQQAYPGYPQQAGACAQQPQGAAQTAKAQ

SEQ ID NO: 2976775 - protein, 20 aa, Entamoeba invadens
YGAVFARNKVCMVTEFATYG

SEQ ID NO: 2976776 - protein, 26 aa, Entamoeba invadens
YGCFKGCKCLETIQFPTTVLSIGCVC

SEQ ID NO: 2976777 - protein, 29 aa, Entamoeba invadens
YGCGVCLETGYLFAIKITFRREKILIEET

SEQ ID NO: 2976778 - protein, 20 aa, Entamoeba invadens
YGCRNLRNVIIPSNVTSIGK

SEQ ID NO: 2976779 - protein, 28 aa, Entamoeba invadens
YGCTVSLFTHWLPRFGVEVDLVDTSDME

SEQ ID NO: 2976780 - protein, 19 aa, Entamoeba invadens
YGDKLRALITVKDLYSYNR

SEQ ID NO: 2976781 - protein, 17 aa, Entamoeba invadens
YGDQQGREQHDGKDQRG

SEQ ID NO: 2976782 - protein, 17 aa, Entamoeba invadens
YGDVRVGLIGFTGVGKS

SEQ ID NO: 2976783 - protein, 23 aa, Entamoeba invadens
YGEQISRMMWAIDNIDAASRTKD

SEQ ID NO: 2976784 - protein, 24 aa, Entamoeba invadens
YGERLRHFLMQKLINGDRTTLKYP

SEQ ID NO: 2976785 - protein, 17 aa, Entamoeba invadens
YGFGGGVLMEEDEQLVF

SEQ ID NO: 2976786 - protein, 27 aa, Entamoeba invadens
YGFKKLETPTGFCFRHDSFIADHPELL

SEQ ID NO: 2976787 - protein, 27 aa, Entamoeba invadens
YGFRKLETQSGFCFRHESFIADHPELL

SEQ ID NO: 2976788 - protein, 18 aa, Entamoeba invadens
YGFVCLCGDGSQVNPVVL

SEQ ID NO: 2976789 - protein, 18 aa, Entamoeba invadens
YGGASKRPIEIFPKAAKA

SEQ ID NO: 2976790 - protein, 24 aa, Entamoeba invadens
YGGEHLLRLVAKLPQIAYEIRFDK

SEQ ID NO: 2976791 - protein, 18 aa, Entamoeba invadens
YGGGASFVNRPTYAAYDE

SEQ ID NO: 2976792 - protein, 22 aa, Entamoeba invadens
YGGKCCGCCSAATSTKDKIENI

SEQ ID NO: 2976793 - protein, 37 aa, Entamoeba invadens
YGGLKDFTVKKCELLFAMLYARFVIKMEDLKEGVADA

SEQ ID NO: 2976794 - protein, 24 aa, Entamoeba invadens
YGGWKATAIGANFQAAESIMKTEY

SEQ ID NO: 2976795 - protein, 17 aa, Entamoeba invadens
YGHIIPLNVNSLGDYCF

SEQ ID NO: 2976796 - protein, 42 aa, Entamoeba invadens
YGIAFLKEWLSAPSFQEWKERVCVDQALKFDVKHPGRTSKTS

SEQ ID NO: 2976797 - protein, 22 aa, Entamoeba invadens
YGICGICTKVINQMLEFVVRNG

SEQ ID NO: 2976798 - protein, 17 aa, Entamoeba invadens
YGIEIVKFIITNYDLIF

SEQ ID NO: 2976799 - protein, 18 aa, Entamoeba invadens
YGIFICIQCSGQHRGLGV

SEQ ID NO: 2976800 - protein, 26 aa, Entamoeba invadens
YGIFLCINCAGLHRGLGVHLTFVRSC

SEQ ID NO: 2976801 - protein, 33 aa, Entamoeba invadens
YGIGHWKNILGSYKFDGRSCVDLKDKWRNIENS

SEQ ID NO: 2976802 - protein, 23 aa, Entamoeba invadens
YGIKVLKMDFSIFSEFSNKKMNL

SEQ ID NO: 2976803 - protein, 17 aa, Entamoeba invadens
YGILSIYTSFVAVDKTT

SEQ ID NO: 2976804 - protein, 20 aa, Entamoeba invadens
YGITAWEIFYQEEPYKELKS

SEQ ID NO: 2976805 - protein, 17 aa, Entamoeba invadens
YGIYPALFDGVCYSDSQ

SEQ ID NO: 2976806 - protein, 20 aa, Entamoeba invadens
YGKAMPRNVFQLINANIETY

SEQ ID NO: 2976807 - protein, 21 aa, Entamoeba invadens
YGKDCAYDFLCDLPHNDVCYF

SEQ ID NO: 2976808 - protein, 20 aa, Entamoeba invadens
YGKEHFEEIAAKFKENPAGA

SEQ ID NO: 2976809 - protein, 25 aa, Entamoeba invadens
YGKGKTGSALFCYVNEKLGIVYIKY

SEQ ID NO: 2976810 - protein, 29 aa, Entamoeba invadens
YGKIFPKRWRVGEELVLEFVSSTKVAFEK

SEQ ID NO: 2976811 - protein, 18 aa, Entamoeba invadens
YGKKFKGEIEVMKTLGKH

SEQ ID NO: 2976812 - protein, 28 aa, Entamoeba invadens
YGKKSEMKIPLFSLFGKIPVEKVQKIIT

SEQ ID NO: 2976813 - protein, 18 aa, Entamoeba invadens
YGKNRKMFFSSFDADVIT

SEQ ID NO: 2976814 - protein, 18 aa, Entamoeba invadens
YGKSAVLYCGNFHETSVI

SEQ ID NO: 2976815 - protein, 24 aa, Entamoeba invadens
YGKVPLNLSVCRTFSLSTLQNSDV

SEQ ID NO: 2976816 - protein, 20 aa, Entamoeba invadens
YGKYCAYNFLCDLPHNAVCY

SEQ ID NO: 2976817 - protein, 28 aa, Entamoeba invadens
YGLAAGKCAICLTGTYYLYSACKSCGEM

SEQ ID NO: 2976818 - protein, 24 aa, Entamoeba invadens
YGLALRPNPNFGVDICLDAPSKNY

SEQ ID NO: 2976819 - protein, 17 aa, Entamoeba invadens
YGLATVHDRDVLIYCIS

SEQ ID NO: 2976820 - protein, 23 aa, Entamoeba invadens
YGLEFKGARIVIGLVSSSVDSSL

SEQ ID NO: 2976821 - protein, 19 aa, Entamoeba invadens
YGLFLERCNFDVYNNDIQN

SEQ ID NO: 2976822 - protein, 25 aa, Entamoeba invadens
YGLMYKGLWTIEGGRYLGSKCFEEL

SEQ ID NO: 2976823 - protein, 18 aa, Entamoeba invadens
YGLTCLMCDNKSRLVNGT

SEQ ID NO: 2976824 - protein, 25 aa, Entamoeba invadens
YGLTKFDYFISQGWSLFMEGCPQYQ

SEQ ID NO: 2976825 - protein, 20 aa, Entamoeba invadens
YGLVYSFKRALSVTKFKEEK

SEQ ID NO: 2976826 - protein, 20 aa, Entamoeba invadens
YGMGRILKMLLGLYTPSPIL

SEQ ID NO: 2976827 - protein, 26 aa, Entamoeba invadens
YGNEKCFLCAMHGNDFFWVHGVNRRI

SEQ ID NO: 2976828 - protein, 18 aa, Entamoeba invadens
YGNLHAVGIVSVDTNTVV

SEQ ID NO: 2976829 - protein, 17 aa, Entamoeba invadens
YGNPMSFVLHYDYNGRI

SEQ ID NO: 2976830 - protein, 17 aa, Entamoeba invadens
YGNRLYAGSKLKFYERK

SEQ ID NO: 2976831 - protein, 24 aa, Entamoeba invadens
YGNSFEMSQSLSLKMDNEEDENEE

SEQ ID NO: 2976832 - protein, 18 aa, Entamoeba invadens
YGNVNVWKKCISIFEFMA

SEQ ID NO: 2976833 - protein, 19 aa, Entamoeba invadens
YGQKEMKECNEFEYGSWNC

SEQ ID NO: 2976834 - protein, 23 aa, Entamoeba invadens
YGQMECLTLLSSHHYADKRIGYL

SEQ ID NO: 2976835 - protein, 17 aa, Entamoeba invadens
YGQSKWVGEQIIARTEG

SEQ ID NO: 2976836 - protein, 25 aa, Entamoeba invadens
YGQTEIKKAILLMLVGATEKIRLRS

SEQ ID NO: 2976837 - protein, 18 aa, Entamoeba invadens
YGREFTFSDGGVFDTRPR

SEQ ID NO: 2976838 - protein, 24 aa, Entamoeba invadens
YGRVYPLKLGYIGVLNRSQEDIEK

SEQ ID NO: 2976839 - protein, 26 aa, Entamoeba invadens
YGSGHELHFFCWIVLFVTIGVIKEEE

SEQ ID NO: 2976840 - protein, 19 aa, Entamoeba invadens
YGSHPRLPSLIYNTHNPIP

SEQ ID NO: 2976841 - protein, 28 aa, Entamoeba invadens
YGSIACSIARPFVSLALNGSTDCITYIE

SEQ ID NO: 2976842 - protein, 21 aa, Entamoeba invadens
YGSRVFNSFYFDTFKVPIHIT

SEQ ID NO: 2976843 - protein, 19 aa, Entamoeba invadens
YGTDVSRCASMFETLNRWL

SEQ ID NO: 2976844 - protein, 20 aa, Entamoeba invadens
YGTECFEGMKVFSTSEGVFN

SEQ ID NO: 2976845 - protein, 21 aa, Entamoeba invadens
YGTGEAFLFTLVPKVKKYKAT

SEQ ID NO: 2976846 - protein, 18 aa, Entamoeba invadens
YGTKCFAFCVSLKEVPVI

SEQ ID NO: 2976847 - protein, 23 aa, Entamoeba invadens
YGTKCLAFCVSLKKVPVITNMGV

SEQ ID NO: 2976848 - protein, 19 aa, Entamoeba invadens
YGTKFFAFCVSLKEVPVIK

SEQ ID NO: 2976849 - protein, 18 aa, Entamoeba invadens
YGTLMPLDIRQKLDDFIK

SEQ ID NO: 2976850 - protein, 17 aa, Entamoeba invadens
YGVEMYVGGTFLEAFIA

SEQ ID NO: 2976851 - protein, 22 aa, Entamoeba invadens
YGVFETCTKKGWSYSTDTNDYD

SEQ ID NO: 2976852 - protein, 22 aa, Entamoeba invadens
YGVGFFKNMTYFVAKENTFLDE

SEQ ID NO: 2976853 - protein, 19 aa, Entamoeba invadens
YGVGVYNLYIQNYVINTIL

SEQ ID NO: 2976854 - protein, 20 aa, Entamoeba invadens
YGVISIGGNCFRACSSLRNV

SEQ ID NO: 2976855 - protein, 19 aa, Entamoeba invadens
YGVKEIYGLKYGYEGLTPD

SEQ ID NO: 2976856 - protein, 18 aa, Entamoeba invadens
YGVKKMKDGLFFAFDFGG

SEQ ID NO: 2976857 - protein, 23 aa, Entamoeba invadens
YGVNRCIKKGGKHMQMILKFKGK

SEQ ID NO: 2976858 - protein, 20 aa, Entamoeba invadens
YGVNRCIKKSGKIMQITLKF

SEQ ID NO: 2976859 - protein, 18 aa, Entamoeba invadens
YGVPRKYDVPSTVVEIGK

SEQ ID NO: 2976860 - protein, 27 aa, Entamoeba invadens
YGVTIWELFSGGNLPYSNLVGAPAVLD

SEQ ID NO: 2976861 - protein, 31 aa, Entamoeba invadens
YGVTRIIKEIVLWKHMYNVGIVGEVFVDNCN

SEQ ID NO: 2976862 - protein, 17 aa, Entamoeba invadens
YGVYTKNSFTCLNYYSC

SEQ ID NO: 2976863 - protein, 32 aa, Entamoeba invadens
YGYFKMLQIGYSFMSKWVVVLFRRDFSHDKCA

SEQ ID NO: 2976864 - protein, 25 aa, Entamoeba invadens
YGYKDLKVHVLFSVYSHQMYIDFSF

SEQ ID NO: 2976865 - protein, 17 aa, Entamoeba invadens
YGYPRSAENYTVPTTVR

SEQ ID NO: 2976866 - protein, 25 aa, Entamoeba invadens
YGYTHPCILDLKIGDKTYCDDVRPQ

SEQ ID NO: 2976867 - protein, 22 aa, Entamoeba invadens
YHATRLFFFIKQQDPHALLRFI

SEQ ID NO: 2976868 - protein, 18 aa, Entamoeba invadens
YHDFRIFGLYEWDQYIRE

SEQ ID NO: 2976869 - protein, 20 aa, Entamoeba invadens
YHDICDAFTVILPKIDREKE

SEQ ID NO: 2976870 - protein, 25 aa, Entamoeba invadens
YHDMKCQDGCYLMRATCQLNDKSKT

SEQ ID NO: 2976871 - protein, 21 aa, Entamoeba invadens
YHEDCFVCTLCGEKFGGDRKI

SEQ ID NO: 2976872 - protein, 31 aa, Entamoeba invadens
YHFADFKQIWINSGFPLVLQFEGISHDIAKV

SEQ ID NO: 2976873 - protein, 19 aa, Entamoeba invadens
YHFRCPQFQFLPLPIRKRK

SEQ ID NO: 2976874 - protein, 17 aa, Entamoeba invadens
YHFVLNIVWLRIDKKVH

SEQ ID NO: 2976875 - protein, 18 aa, Entamoeba invadens
  misc_feature (17)..(18): Xaa can be any naturally occurring amino acid
YHGSRLTNFVGILSTGXX

SEQ ID NO: 2976876 - protein, 17 aa, Entamoeba invadens
YHHSKRAVVMPKVPEEF

SEQ ID NO: 2976877 - protein, 22 aa, Entamoeba invadens
YHIEHVDIYLSYSLEEIDFVKK

SEQ ID NO: 2976878 - protein, 21 aa, Entamoeba invadens
YHIKCSKAFLHIRMRNKVSHL

SEQ ID NO: 2976879 - protein, 27 aa, Entamoeba invadens
YHINCFRCICCGRILEGDVLPDPTQLV

SEQ ID NO: 2976880 - protein, 20 aa, Entamoeba invadens
YHITEYLALGATMAVSYASG

SEQ ID NO: 2976881 - protein, 25 aa, Entamoeba invadens
YHIVPRPVQVLSILRLADEILNRKG

SEQ ID NO: 2976882 - protein, 17 aa, Entamoeba invadens
YHKLPVLDFNYVTIVSN

SEQ ID NO: 2976883 - protein, 19 aa, Entamoeba invadens
YHKSFCSFCPHKDGQTKLT

SEQ ID NO: 2976884 - protein, 17 aa, Entamoeba invadens
YHLAVVYCQECKTRFCA

SEQ ID NO: 2976885 - protein, 19 aa, Entamoeba invadens
YHLCKRVDFLNSLSGALMK

SEQ ID NO: 2976886 - protein, 17 aa, Entamoeba invadens
YHLDPKINKRMWSIQED

SEQ ID NO: 2976887 - protein, 27 aa, Entamoeba invadens
YHMSDDMAKCFPILNSIIKLNKSEPFR

SEQ ID NO: 2976888 - protein, 24 aa, Entamoeba invadens
YHMSLEMLNGIVLYLEMYYDTFVV

SEQ ID NO: 2976889 - protein, 18 aa, Entamoeba invadens
YHPCKRVDFLNNLSGALM

SEQ ID NO: 2976890 - protein, 19 aa, Entamoeba invadens
YHPCKRVDFLNSLSGALMK

SEQ ID NO: 2976891 - protein, 18 aa, Entamoeba invadens
YHPDCFVCDGCLEPFNSS

SEQ ID NO: 2976892 - protein, 30 aa, Entamoeba invadens
YHPECFVCNVCKAPFPRGQFYNLDGKPVCA

SEQ ID NO: 2976893 - protein, 18 aa, Entamoeba invadens
YHRDWKRIEQHIKTKTVV

SEQ ID NO: 2976894 - protein, 21 aa, Entamoeba invadens
YHRKPSVMIYLKCAAEVSDKE

SEQ ID NO: 2976895 - protein, 18 aa, Entamoeba invadens
YHRLPLKKVVDAVEAKKE

SEQ ID NO: 2976896 - protein, 17 aa, Entamoeba invadens
YHRQPRSKIGMYTTRFT

SEQ ID NO: 2976897 - protein, 19 aa, Entamoeba invadens
YHRYCVINKKMSCMEAVVY

SEQ ID NO: 2976898 - protein, 22 aa, Entamoeba invadens
YHSHPYFLSLTFNNEIAKDGSE

SEQ ID NO: 2976899 - protein, 17 aa, Entamoeba invadens
YHTALCTLYKGAENEEG

SEQ ID NO: 2976900 - protein, 20 aa, Entamoeba invadens
YHTTPGMFYNLLDTMETSGV

SEQ ID NO: 2976901 - protein, 24 aa, Entamoeba invadens
YHVHTLKVAFCCTLEIPLENDDKF

SEQ ID NO: 2976902 - protein, 17 aa, Entamoeba invadens
YHVKKLRDGIQFECHFA

SEQ ID NO: 2976903 - protein, 20 aa, Entamoeba invadens
YHVNIHFGKFFEFFDHVARL

SEQ ID NO: 2976904 - protein, 19 aa, Entamoeba invadens
YHVPYQIKTRLNFNEKTAM

SEQ ID NO: 2976905 - protein, 24 aa, Entamoeba invadens
YHYEECRQVMEYLYKRLNEDGKNW

SEQ ID NO: 2976906 - protein, 20 aa, Entamoeba invadens
YIAGFKWMPKCELVMEQNAL

SEQ ID NO: 2976907 - protein, 17 aa, Entamoeba invadens
YIAGRYGDDVVFSKLCQ

SEQ ID NO: 2976908 - protein, 22 aa, Entamoeba invadens
YIAHKELHVFLPQVSHTQFSPL

SEQ ID NO: 2976909 - protein, 23 aa, Entamoeba invadens
YIAIHCVIDIPQIPFLQFGFDGK

SEQ ID NO: 2976910 - protein, 24 aa, Entamoeba invadens
YIAKRYCNEEGIAGYDPVNEPCLR

SEQ ID NO: 2976911 - protein, 22 aa, Entamoeba invadens
YIANCGWDLDQIQKWNEFLFNE

SEQ ID NO: 2976912 - protein, 27 aa, Entamoeba invadens
YICAVCQARLGPYYVNKEMNKVPQLQV

SEQ ID NO: 2976913 - protein, 23 aa, Entamoeba invadens
YICGQQGHAPDRCSHKGEIGAMD

SEQ ID NO: 2976914 - protein, 29 aa, Entamoeba invadens
YICKCDPRVTLYFCPACNSHLDPSTHTPL

SEQ ID NO: 2976915 - protein, 17 aa, Entamoeba invadens
YICKDMEGCVVSRYNTS

SEQ ID NO: 2976916 - protein, 25 aa, Entamoeba invadens
YICNCTEKPIFVCFDCNKRMLQNNH

SEQ ID NO: 2976917 - protein, 20 aa, Entamoeba invadens
YICTVGAFTKQGVKKSDEDD

SEQ ID NO: 2976918 - protein, 20 aa, Entamoeba invadens
YIDFALCSIEGFCGDSDPAY

SEQ ID NO: 2976919 - protein, 18 aa, Entamoeba invadens
YIDFESFIDFIADYTENK

SEQ ID NO: 2976920 - protein, 23 aa, Entamoeba invadens
YIDICKSYDAILLGSLGDPRTLP

SEQ ID NO: 2976921 - protein, 23 aa, Entamoeba invadens
YIDKILYCKPFLSPLNKARTEIN

SEQ ID NO: 2976922 - protein, 20 aa, Entamoeba invadens
YIDNIKEWVDVSSYTIKYDS

SEQ ID NO: 2976923 - protein, 22 aa, Entamoeba invadens
YIDRFSSFETFQCVSKNCVTAL

SEQ ID NO: 2976924 - protein, 23 aa, Entamoeba invadens
YIDRLSPKKSLIFDVPEGKLEGF

SEQ ID NO: 2976925 - protein, 19 aa, Entamoeba invadens
YIDSVSFRPFGNVYYVERS

SEQ ID NO: 2976926 - protein, 19 aa, Entamoeba invadens
YIDTLYACMNFAENVTQIN

SEQ ID NO: 2976927 - protein, 28 aa, Entamoeba invadens
YIEDLLKCVGKIHVCECINFVEKSLYKG

SEQ ID NO: 2976928 - protein, 24 aa, Entamoeba invadens
YIEDPKFFVSFFRKTENGIKYSKY

SEQ ID NO: 2976929 - protein, 31 aa, Entamoeba invadens
YIEEKCPELLWRWYITRGRTDEGVLCLLKLT

SEQ ID NO: 2976930 - protein, 18 aa, Entamoeba invadens
YIEKSCFLKQAINDVVMS

SEQ ID NO: 2976931 - protein, 18 aa, Entamoeba invadens
YIEKSCNLLQAINDVVLS

SEQ ID NO: 2976932 - protein, 20 aa, Entamoeba invadens
YIETEWWSKFFMRSVSKSHV

SEQ ID NO: 2976933 - protein, 17 aa, Entamoeba invadens
YIFAYEMTSHFDSKKER

SEQ ID NO: 2976934 - protein, 17 aa, Entamoeba invadens
YIFEKGSGVTIMNGNYI

SEQ ID NO: 2976935 - protein, 23 aa, Entamoeba invadens
YIFGFKGSIDILLKNDEGEVLVE

SEQ ID NO: 2976936 - protein, 17 aa, Entamoeba invadens
YIFGLIGFVPTVSFGNY

SEQ ID NO: 2976937 - protein, 19 aa, Entamoeba invadens
YIFPHGFQTRSKRISLINN

SEQ ID NO: 2976938 - protein, 17 aa, Entamoeba invadens
YIFSDPLLFIFTLFKIR

SEQ ID NO: 2976939 - protein, 17 aa, Entamoeba invadens
YIFTRRVDFSFNLLKNI

SEQ ID NO: 2976940 - protein, 20 aa, Entamoeba invadens
YIGCYLKIMDLLKVFEGSSA

SEQ ID NO: 2976941 - protein, 22 aa, Entamoeba invadens
YIGDNCFRECISLSNVIIPSTI

SEQ ID NO: 2976942 - protein, 19 aa, Entamoeba invadens
YIGDSAFRGCEGLKTVKFK

SEQ ID NO: 2976943 - protein, 20 aa, Entamoeba invadens
YIGEGCFKSCASLNNVMIPE

SEQ ID NO: 2976944 - protein, 22 aa, Entamoeba invadens
YIGKFAFKNCVSLCEVQTTKGA

SEQ ID NO: 2976945 - protein, 21 aa, Entamoeba invadens
YIGNTCFKSDYSLKKMNIPKS

SEQ ID NO: 2976946 - protein, 18 aa, Entamoeba invadens
YIGSNAFFHCHNIKNVTT

SEQ ID NO: 2976947 - protein, 18 aa, Entamoeba invadens
YIHFSVCLFNDIYTLVNE

SEQ ID NO: 2976948 - protein, 17 aa, Entamoeba invadens
YIHGDGFSKFIVSKLIN

SEQ ID NO: 2976949 - protein, 18 aa, Entamoeba invadens
YIHSIGYCHRDIKIENVL

SEQ ID NO: 2976950 - protein, 19 aa, Entamoeba invadens
YIHSTFSINDFEVVMNHPT

SEQ ID NO: 2976951 - protein, 36 aa, Entamoeba invadens
YIHVISFADIFPFTLLQFRLKQYFKEWKSIVKAQSE

SEQ ID NO: 2976952 - protein, 18 aa, Entamoeba invadens
YIHVLKMYVENIGDIEQL

SEQ ID NO: 2976953 - protein, 27 aa, Entamoeba invadens
YIIANGLCSEGIFRLSVAGQKLSEYKE

SEQ ID NO: 2976954 - protein, 17 aa, Entamoeba invadens
YIIDTFNEVFVYYGTSA

SEQ ID NO: 2976955 - protein, 24 aa, Entamoeba invadens
YIIGKGHHSVICRSGDYVLKIIPF

SEQ ID NO: 2976956 - protein, 18 aa, Entamoeba invadens
YIIMPSVSAPVVLDNVYK

SEQ ID NO: 2976957 - protein, 20 aa, Entamoeba invadens
YIIRRKRRFLFTFVKPKKVY

SEQ ID NO: 2976958 - protein, 18 aa, Entamoeba invadens
YIITYPIDVKYVLNPTLL

SEQ ID NO: 2976959 - protein, 28 aa, Entamoeba invadens
YIKEHAGQCGIVFCFSRKDCEKMDESLK

SEQ ID NO: 2976960 - protein, 25 aa, Entamoeba invadens
YIKEKGAHIEGIFRVSGSKEKIELI

SEQ ID NO: 2976961 - protein, 23 aa, Entamoeba invadens
YIKGVFRTANWSVFGLSERTNNR

SEQ ID NO: 2976962 - protein, 23 aa, Entamoeba invadens
YIKHFLFHASTQWSSPKHFISVS

SEQ ID NO: 2976963 - protein, 19 aa, Entamoeba invadens
YIKKLSLTKQKTWDLSAFT

SEQ ID NO: 2976964 - protein, 23 aa, Entamoeba invadens
YIKKVIVHPLVLLSISDHQTRAA

SEQ ID NO: 2976965 - protein, 25 aa, Entamoeba invadens
YIKQFLRYLIVREIEDNFRMPQTIF

SEQ ID NO: 2976966 - protein, 17 aa, Entamoeba invadens
YIKRFFQFIRKIVRTKI

SEQ ID NO: 2976967 - protein, 26 aa, Entamoeba invadens
YIKYIGVIDFRMTDYVLVGGIIKKIM

SEQ ID NO: 2976968 - protein, 20 aa, Entamoeba invadens
YILCILYHLKRYGDALNVVE

SEQ ID NO: 2976969 - protein, 19 aa, Entamoeba invadens
YILPCDKLKTKNCEIHKRF

SEQ ID NO: 2976970 - protein, 18 aa, Entamoeba invadens
YILPLFVVAWRVCSDESG

SEQ ID NO: 2976971 - protein, 19 aa, Entamoeba invadens
YILQALAFVCGQKEDMKMA

SEQ ID NO: 2976972 - protein, 17 aa, Entamoeba invadens
YILRASAVASKYSQSLS

SEQ ID NO: 2976973 - protein, 24 aa, Entamoeba invadens
YIMEFCPKYIKVFQEIDLNKNGKI

SEQ ID NO: 2976974 - protein, 19 aa, Entamoeba invadens
YIMHSAMKTWTFQPVTVAE

SEQ ID NO: 2976975 - protein, 18 aa, Entamoeba invadens
YIMTKCKDVFAIEGDPVY

SEQ ID NO: 2976976 - protein, 20 aa, Entamoeba invadens
YINALKIFKHLTLIQNIKFS

SEQ ID NO: 2976977 - protein, 22 aa, Entamoeba invadens
YINALTKLGCYIHGCYFHYTQC

SEQ ID NO: 2976978 - protein, 18 aa, Entamoeba invadens
YINCDLEGKMLGYMERNE

SEQ ID NO: 2976979 - protein, 21 aa, Entamoeba invadens
YINDYCFFQCIGLSDVTIPSS

SEQ ID NO: 2976980 - protein, 19 aa, Entamoeba invadens
YINGFGFENLEGWIKNQRA

SEQ ID NO: 2976981 - protein, 19 aa, Entamoeba invadens
YINKILCPFQVAGTDSEFI

SEQ ID NO: 2976982 - protein, 22 aa, Entamoeba invadens
YINMKPLTKWTAFMTESSRDDF

SEQ ID NO: 2976983 - protein, 21 aa, Entamoeba invadens
YINSFKALRAFVTVNKKCKKV

SEQ ID NO: 2976984 - protein, 17 aa, Entamoeba invadens
YINSILICHKFMCILDR

SEQ ID NO: 2976985 - protein, 18 aa, Entamoeba invadens
YINSLKVYTFEDFEKGVD

SEQ ID NO: 2976986 - protein, 18 aa, Entamoeba invadens
YINTFKSLLTFSTINKKC

SEQ ID NO: 2976987 - protein, 17 aa, Entamoeba invadens
YIPALKVLQQFLASVSR

SEQ ID NO: 2976988 - protein, 27 aa, Entamoeba invadens
YIPQKCFPEAWRGLRDETLSSVSHIAG

SEQ ID NO: 2976989 - protein, 17 aa, Entamoeba invadens
YIPRHCSVTHTLIAPDD

SEQ ID NO: 2976990 - protein, 19 aa, Entamoeba invadens
YIPTSPFLFLLKVEATVFG

SEQ ID NO: 2976991 - protein, 25 aa, Entamoeba invadens
YIQMAECVFICFALNYEEQQKIAQE

SEQ ID NO: 2976992 - protein, 17 aa, Entamoeba invadens
YIQRSKSSLSFDFERSK

SEQ ID NO: 2976993 - protein, 24 aa, Entamoeba invadens
YIRAMGGIIPIELANETEIFGIKK

SEQ ID NO: 2976994 - protein, 18 aa, Entamoeba invadens
YIRDIFKSTLNGNKLDAF

SEQ ID NO: 2976995 - protein, 25 aa, Entamoeba invadens
YIREMLRLSKPIKVMLVLEAGDFEK

SEQ ID NO: 2976996 - protein, 19 aa, Entamoeba invadens
YIRESRVAVVVYDISDRDS

SEQ ID NO: 2976997 - protein, 18 aa, Entamoeba invadens
YIRFPSFITDFLNGTLTK

SEQ ID NO: 2976998 - protein, 21 aa, Entamoeba invadens
YIRGVTLKFLCHVSERGILQP

SEQ ID NO: 2976999 - protein, 23 aa, Entamoeba invadens
YIRMKARILIMYLERKTSEGVLP

SEQ ID NO: 2977000 - protein, 17 aa, Entamoeba invadens
YIRRCVAHNEPIDIVLY

SEQ ID NO: 2977001 - protein, 18 aa, Entamoeba invadens
YISENWRTFGRVRVKMTF

SEQ ID NO: 2977002 - protein, 17 aa, Entamoeba invadens
YISKLKMRVKKMTNENI

SEQ ID NO: 2977003 - protein, 24 aa, Entamoeba invadens
YISRVLKSVFPDIGITLPSISVMD

SEQ ID NO: 2977004 - protein, 24 aa, Entamoeba invadens
YISYSFPVPKFMIFEREKLSNYID

SEQ ID NO: 2977005 - protein, 28 aa, Entamoeba invadens
YITAYFLMYLDIRFVKYIIKNQYDVLRL

SEQ ID NO: 2977006 - protein, 17 aa, Entamoeba invadens
YITDVNGFFGFERSLYE

SEQ ID NO: 2977007 - protein, 18 aa, Entamoeba invadens
YITLIRQFYRPFSVQQDN

SEQ ID NO: 2977008 - protein, 18 aa, Entamoeba invadens
YITLKAKEGNSILKTPAL

SEQ ID NO: 2977009 - protein, 18 aa, Entamoeba invadens
YITNFFIIYGRTILYSDL

SEQ ID NO: 2977010 - protein, 18 aa, Entamoeba invadens
YITSCLKSSKPETLKATQ

SEQ ID NO: 2977011 - protein, 19 aa, Entamoeba invadens
YITSDAFYSIIDFVIPKQA

SEQ ID NO: 2977012 - protein, 26 aa, Entamoeba invadens
YIVALDYLFRRTCNITNIKTLKFVKV

SEQ ID NO: 2977013 - protein, 26 aa, Entamoeba invadens
YIVALDYLFRRTCNITNIKTLKSVKV

SEQ ID NO: 2977014 - protein, 19 aa, Entamoeba invadens
YIVDFGLKMFVSATSLKSI

SEQ ID NO: 2977015 - protein, 19 aa, Entamoeba invadens
YIVRCYDGFLCEYENKLEY

SEQ ID NO: 2977016 - protein, 23 aa, Entamoeba invadens
YIVSFKAPIIFVVKRKETHNPNV

SEQ ID NO: 2977017 - protein, 18 aa, Entamoeba invadens
YIVYPPYFTETSFEPNCG

SEQ ID NO: 2977018 - protein, 26 aa, Entamoeba invadens
YIYFDMKKIVVWFGAKCNDFKKEKAR

SEQ ID NO: 2977019 - protein, 19 aa, Entamoeba invadens
YIYPGLKYQRPVSHMIGTV

SEQ ID NO: 2977020 - protein, 22 aa, Entamoeba invadens
YIYRGNMWTAYAPEKMGKTFYY

SEQ ID NO: 2977021 - protein, 21 aa, Entamoeba invadens
YIYRGNMWTAYVPDNVGKTFY

SEQ ID NO: 2977022 - protein, 17 aa, Entamoeba invadens
YIYSDAMLLTGIIMSNE

SEQ ID NO: 2977023 - protein, 37 aa, Entamoeba invadens
YIYSDRPKFQRRSHRYVKKQKSAKVVNHSASKSIKTH

SEQ ID NO: 2977024 - protein, 35 aa, Entamoeba invadens
YKAAEWTPEDFLWQGKCVVVGRGEQCIVKFVDPNT

SEQ ID NO: 2977025 - protein, 20 aa, Entamoeba invadens
YKADCQSTLTLFVEELKESM

SEQ ID NO: 2977026 - protein, 17 aa, Entamoeba invadens
YKAFAYGVAQGVIDNKE

SEQ ID NO: 2977027 - protein, 25 aa, Entamoeba invadens
YKAGQFIVYCIKRELFLRLDTSEKN

SEQ ID NO: 2977028 - protein, 26 aa, Entamoeba invadens
YKAHYKQHFEVLKTIFSLPMKLAEAG

SEQ ID NO: 2977029 - protein, 17 aa, Entamoeba invadens
YKAKRFISHGSFGLVFE

SEQ ID NO: 2977030 - protein, 21 aa, Entamoeba invadens
YKALQNLACILLRQVLMYSQL

SEQ ID NO: 2977031 - protein, 20 aa, Entamoeba invadens
YKAMNCQMILTGKDEKYIFV

SEQ ID NO: 2977032 - protein, 19 aa, Entamoeba invadens
YKANCASFGIRMNGALVFD

SEQ ID NO: 2977033 - protein, 17 aa, Entamoeba invadens
YKAPLVITMTSKKEFSK

SEQ ID NO: 2977034 - protein, 21 aa, Entamoeba invadens
YKARIQFCKDVMEKTENRIIK

SEQ ID NO: 2977035 - protein, 17 aa, Entamoeba invadens
YKATFSIILEVPPTDDC

SEQ ID NO: 2977036 - protein, 18 aa, Entamoeba invadens
YKAVDSFFNENCIELLIR

SEQ ID NO: 2977037 - protein, 20 aa, Entamoeba invadens
YKAWELREWERVKKEYLADL

SEQ ID NO: 2977038 - protein, 20 aa, Entamoeba invadens
YKAYMPKILSLILAELNKYV

SEQ ID NO: 2977039 - protein, 20 aa, Entamoeba invadens
  misc_feature (15)..(16): Xaa can be any naturally occurring amino acid
YKCDLSCSLCNTNLXXFCVG

SEQ ID NO: 2977040 - protein, 17 aa, Entamoeba invadens
YKCKAILNVPSLKPEYI

SEQ ID NO: 2977041 - protein, 17 aa, Entamoeba invadens
YKCKGLRSVTIPSSLTI

SEQ ID NO: 2977042 - protein, 22 aa, Entamoeba invadens
YKDCGILVFHVHKEGTIEYHDI

SEQ ID NO: 2977043 - protein, 17 aa, Entamoeba invadens
YKDFFLQKLSNVANEYD

SEQ ID NO: 2977044 - protein, 23 aa, Entamoeba invadens
YKDKMWKETRCEVRKKRKERAKE

SEQ ID NO: 2977045 - protein, 19 aa, Entamoeba invadens
YKDKVLAFNGIILGGDKIE

SEQ ID NO: 2977046 - protein, 18 aa, Entamoeba invadens
YKDLWKRQVSEVYWQEIV

SEQ ID NO: 2977047 - protein, 17 aa, Entamoeba invadens
YKDVLKIVNELKELMYE

SEQ ID NO: 2977048 - protein, 26 aa, Entamoeba invadens
YKDYCQQCVQRICQGKQKKGKKGTAG

SEQ ID NO: 2977049 - protein, 17 aa, Entamoeba invadens
YKEAINLINNGLDIIDC

SEQ ID NO: 2977050 - protein, 19 aa, Entamoeba invadens
YKEALGVMFYVLQAMVIEG

SEQ ID NO: 2977051 - protein, 17 aa, Entamoeba invadens
YKEAVESVMYLKMRNEE

SEQ ID NO: 2977052 - protein, 18 aa, Entamoeba invadens
YKEGDTFSATKFVPKPQK

SEQ ID NO: 2977053 - protein, 27 aa, Entamoeba invadens
YKEINKVGVLIIRRIEVITQSHVDFQD

SEQ ID NO: 2977054 - protein, 18 aa, Entamoeba invadens
YKEIVEDIKLLYQINNTY

SEQ ID NO: 2977055 - protein, 19 aa, Entamoeba invadens
YKEKYRVVSSFVADDLRVL

SEQ ID NO: 2977056 - protein, 24 aa, Entamoeba invadens
YKELKRTIPDFQIPKHGYLIEWAR

SEQ ID NO: 2977057 - protein, 17 aa, Entamoeba invadens
YKELLPSYVAFVQDKVI

SEQ ID NO: 2977058 - protein, 18 aa, Entamoeba invadens
YKELSLFLQQISGFDSDG

SEQ ID NO: 2977059 - protein, 18 aa, Entamoeba invadens
YKENFRVLQERPFLVWTD

SEQ ID NO: 2977060 - protein, 29 aa, Entamoeba invadens
YKEPSEPPFQYWIFFLRMNISVLNNLRKS

SEQ ID NO: 2977061 - protein, 17 aa, Entamoeba invadens
YKESHLRFFKKQPSGAF

SEQ ID NO: 2977062 - protein, 20 aa, Entamoeba invadens
YKETFLCNSYKINISRQRFD

SEQ ID NO: 2977063 - protein, 31 aa, Entamoeba invadens
YKEVTLLGCWFHFKQAIFKKVSKLGLSKIYT

SEQ ID NO: 2977064 - protein, 27 aa, Entamoeba invadens
YKEWAEEAHKIWGGLDMFAIDIIMEKD

SEQ ID NO: 2977065 - protein, 18 aa, Entamoeba invadens
YKEWEMDNNFPFPNVEEI

SEQ ID NO: 2977066 - protein, 21 aa, Entamoeba invadens
YKEYLYDKEIEPMQIEAKELR

SEQ ID NO: 2977067 - protein, 25 aa, Entamoeba invadens
YKFDAVKHLLIWNIGKQNPKVVPTI

SEQ ID NO: 2977068 - protein, 24 aa, Entamoeba invadens
YKFDIPVCGSGGVLTNLAQKYAEW

SEQ ID NO: 2977069 - protein, 19 aa, Entamoeba invadens
YKFDNFRVSPNLEKMNLYI

SEQ ID NO: 2977070 - protein, 21 aa, Entamoeba invadens
YKFGESFSKIVLPVIDEDMRD

SEQ ID NO: 2977071 - protein, 17 aa, Entamoeba invadens
YKFGVLYCQSNQSNEDE

SEQ ID NO: 2977072 - protein, 20 aa, Entamoeba invadens
YKFLFGRKLLRYGDSNNNRI

SEQ ID NO: 2977073 - protein, 17 aa, Entamoeba invadens
YKFLNTFNFKEFSVPTH

SEQ ID NO: 2977074 - protein, 21 aa, Entamoeba invadens
YKFPEELNIHLTIYNTNKLKD

SEQ ID NO: 2977075 - protein, 21 aa, Entamoeba invadens
YKFPWKIADFVMSGKRLERKE

SEQ ID NO: 2977076 - protein, 17 aa, Entamoeba invadens
YKGDFDEVFSLLKGKTD

SEQ ID NO: 2977077 - protein, 28 aa, Entamoeba invadens
YKGDPCYRLKDSISMLHRVLKKYGTDNF

SEQ ID NO: 2977078 - protein, 19 aa, Entamoeba invadens
YKGETGIIDSLKDDEVFVL

SEQ ID NO: 2977079 - protein, 18 aa, Entamoeba invadens
YKGFPISVVKKYMKSLLT

SEQ ID NO: 2977080 - protein, 18 aa, Entamoeba invadens
YKGHQLEITFGIPNDVPW

SEQ ID NO: 2977081 - protein, 17 aa, Entamoeba invadens
YKGIYRGNCVAIKKMKE

SEQ ID NO: 2977082 - protein, 26 aa, Entamoeba invadens
YKGKKCFKCGKYGHKGKECPESLKSG

SEQ ID NO: 2977083 - protein, 17 aa, Entamoeba invadens
YKGKVILTKNNLLEKGK

SEQ ID NO: 2977084 - protein, 21 aa, Entamoeba invadens
YKGNMLKFHFNPIPLTPEILP

SEQ ID NO: 2977085 - protein, 25 aa, Entamoeba invadens
YKGNYRLALELIMEFYSCSDPPQFP

SEQ ID NO: 2977086 - protein, 22 aa, Entamoeba invadens
YKGPESASSFGKYVKTKLRGIV

SEQ ID NO: 2977087 - protein, 19 aa, Entamoeba invadens
YKGSDKWDKIALKVTGKTK

SEQ ID NO: 2977088 - protein, 22 aa, Entamoeba invadens
YKGSENIFWQDFIFNKKINPTQ

SEQ ID NO: 2977089 - protein, 21 aa, Entamoeba invadens
YKGSPLFIAPEIMLRTPYSSK

SEQ ID NO: 2977090 - protein, 23 aa, Entamoeba invadens
YKHSIAFPELVCNTVKSLKKIIR

SEQ ID NO: 2977091 - protein, 37 aa, Entamoeba invadens
YKHTNFCGFTRQLTLYGFKKVCINNAFQSNNYKQTED

SEQ ID NO: 2977092 - protein, 22 aa, Entamoeba invadens
YKIEIVSVADRKAAEGLMSRFK

SEQ ID NO: 2977093 - protein, 17 aa, Entamoeba invadens
YKIGETISNMFANGSEN

SEQ ID NO: 2977094 - protein, 26 aa, Entamoeba invadens
YKIIQEYIPVFFRKLTNHVAKEGVDS

SEQ ID NO: 2977095 - protein, 17 aa, Entamoeba invadens
YKIIRMIGIPPSALLEK

SEQ ID NO: 2977096 - protein, 17 aa, Entamoeba invadens
YKIKCIVKKEGIETEFL

SEQ ID NO: 2977097 - protein, 25 aa, Entamoeba invadens
YKIKMIYKPFHLEIGIDDFKRTKVT

SEQ ID NO: 2977098 - protein, 17 aa, Entamoeba invadens
YKILKRVVQDWSNQDFI

SEQ ID NO: 2977099 - protein, 20 aa, Entamoeba invadens
YKINCTEIGTATSVLASTNN

SEQ ID NO: 2977100 - protein, 17 aa, Entamoeba invadens
YKINFFFPSEKQSKTQT

SEQ ID NO: 2977101 - protein, 22 aa, Entamoeba invadens
YKINFNIEVIGCFARVTATHFV

SEQ ID NO: 2977102 - protein, 30 aa, Entamoeba invadens
YKIPEMVPLICVWDKIALSRPIGNRWSPFL

SEQ ID NO: 2977103 - protein, 23 aa, Entamoeba invadens
YKIPRKPQPVVLIEEDPKEDKRP

SEQ ID NO: 2977104 - protein, 19 aa, Entamoeba invadens
YKKAIDCLVAHKKTEHNEK

SEQ ID NO: 2977105 - protein, 17 aa, Entamoeba invadens
YKKCCVFGDIHGNYRGL

SEQ ID NO: 2977106 - protein, 21 aa, Entamoeba invadens
YKKDIAEITVRAETLEKNIQM

SEQ ID NO: 2977107 - protein, 20 aa, Entamoeba invadens
YKKDVYIPKDIIERYLPKLN

SEQ ID NO: 2977108 - protein, 23 aa, Entamoeba invadens
YKKELLNTLFILHLLWMQYEGDW

SEQ ID NO: 2977109 - protein, 20 aa, Entamoeba invadens
YKKETCKFKDIPLGTNSHEK

SEQ ID NO: 2977110 - protein, 17 aa, Entamoeba invadens
YKKGCTKDVYKNRRMSW

SEQ ID NO: 2977111 - protein, 21 aa, Entamoeba invadens
YKKHTICVPLLSGVKEAIELA

SEQ ID NO: 2977112 - protein, 20 aa, Entamoeba invadens
YKKIFKKNVEDWEETTITFP

SEQ ID NO: 2977113 - protein, 18 aa, Entamoeba invadens
YKKIGVLLINEEYEKAAK

SEQ ID NO: 2977114 - protein, 22 aa, Entamoeba invadens
YKKKYVTCHCILFSDICVFAKY

SEQ ID NO: 2977115 - protein, 18 aa, Entamoeba invadens
YKKLFTIIEVPSSVTKIC

SEQ ID NO: 2977116 - protein, 17 aa, Entamoeba invadens
YKKLQIIGPDWSIYSEE

SEQ ID NO: 2977117 - protein, 20 aa, Entamoeba invadens
YKKNCLYGLFRILQILHKES

SEQ ID NO: 2977118 - protein, 23 aa, Entamoeba invadens
YKKTEMIVVCAITLLFNLITNNQ

SEQ ID NO: 2977119 - protein, 20 aa, Entamoeba invadens
YKKTLGYSFLPTLTKKEVTL

SEQ ID NO: 2977120 - protein, 21 aa, Entamoeba invadens
YKKTNGMKGIRVISKTIEVAD

SEQ ID NO: 2977121 - protein, 18 aa, Entamoeba invadens
YKKVLFLVPFKKITDKNI

SEQ ID NO: 2977122 - protein, 21 aa, Entamoeba invadens
YKKVLNTMPVHFTKDKNDFED

SEQ ID NO: 2977123 - protein, 24 aa, Entamoeba invadens
YKKYFPKPATIYISQNVKGVRGIK

SEQ ID NO: 2977124 - protein, 27 aa, Entamoeba invadens
YKKYNYVCALKIVFKKQLAKCGMGLQM

SEQ ID NO: 2977125 - protein, 20 aa, Entamoeba invadens
YKLASTYPSLVYVPKTADET

SEQ ID NO: 2977126 - protein, 23 aa, Entamoeba invadens
YKLEDSSVFSTIRYQEGSKIIFV

SEQ ID NO: 2977127 - protein, 23 aa, Entamoeba invadens
YKLFAVNDFQTFPALKNDHIQFL

SEQ ID NO: 2977128 - protein, 19 aa, Entamoeba invadens
YKLFTGIKTMEWFFRVEKL

SEQ ID NO: 2977129 - protein, 17 aa, Entamoeba invadens
YKLGVIGIISKFDKTLT

SEQ ID NO: 2977130 - protein, 21 aa, Entamoeba invadens
YKLHNIILCTKPVYSEDNDEE

SEQ ID NO: 2977131 - protein, 19 aa, Entamoeba invadens
YKLISNCWAHNKEDRITIE

SEQ ID NO: 2977132 - protein, 30 aa, Entamoeba invadens
YKLKCDSVKIFWRLSKEEIISEEFNYEFYG

SEQ ID NO: 2977133 - protein, 17 aa, Entamoeba invadens
YKLKMTVEKSLKCVARF

SEQ ID NO: 2977134 - protein, 19 aa, Entamoeba invadens
YKLKTNSFFHSRKSQKSET

SEQ ID NO: 2977135 - protein, 18 aa, Entamoeba invadens
YKLLDYMGEEFTKKYVKR

SEQ ID NO: 2977136 - protein, 20 aa, Entamoeba invadens
YKLLLPEMVSFYEFDEDQFT

SEQ ID NO: 2977137 - protein, 21 aa, Entamoeba invadens
YKLNDKWLIDNVDIYITKVPF

SEQ ID NO: 2977138 - protein, 20 aa, Entamoeba invadens
YKLNSFGAYVGLYFHQISEL

SEQ ID NO: 2977139 - protein, 25 aa, Entamoeba invadens
YKLPDEPVTPGFRRMEVKDAKEVTE

SEQ ID NO: 2977140 - protein, 17 aa, Entamoeba invadens
YKLQRFVEDNSNIMNET

SEQ ID NO: 2977141 - protein, 17 aa, Entamoeba invadens
YKLSDTRKWSSTNALPS

SEQ ID NO: 2977142 - protein, 18 aa, Entamoeba invadens
YKLTELRNSTAKNKKKIV

SEQ ID NO: 2977143 - protein, 20 aa, Entamoeba invadens
YKLTPDFFKNERNILQYLTP

SEQ ID NO: 2977144 - protein, 25 aa, Entamoeba invadens
YKLVFKKLPKIIAEFVEELTELFFL

SEQ ID NO: 2977145 - protein, 19 aa, Entamoeba invadens
YKLVKKRGGKRGGRGRPAA

SEQ ID NO: 2977146 - protein, 19 aa, Entamoeba invadens
YKLYVTFTHSIRVFNFGEI

SEQ ID NO: 2977147 - protein, 21 aa, Entamoeba invadens
YKMDVKFGQSGLIMKNSNITN

SEQ ID NO: 2977148 - protein, 21 aa, Entamoeba invadens
YKMHKEVNPPFLIQMKVEKNE

SEQ ID NO: 2977149 - protein, 18 aa, Entamoeba invadens
YKMIVGNSEAVLAAMADI

SEQ ID NO: 2977150 - protein, 21 aa, Entamoeba invadens
YKMIVWCLVDYNLTQIWEYNN

SEQ ID NO: 2977151 - protein, 17 aa, Entamoeba invadens
YKMLHTLSLEWSCMSFD

SEQ ID NO: 2977152 - protein, 23 aa, Entamoeba invadens
YKMLRLSVLNHIGFGGVSLPLTP

SEQ ID NO: 2977153 - protein, 33 aa, Entamoeba invadens
YKMPCDIYSLAISFFEIIGWAEPFPKKRFEHPW

SEQ ID NO: 2977154 - protein, 33 aa, Entamoeba invadens
YKMPCDIYSLAISFFEIIGWAEPFPKKRFKYAW

SEQ ID NO: 2977155 - protein, 17 aa, Entamoeba invadens
YKMPSDIFSFAITMYEC

SEQ ID NO: 2977156 - protein, 18 aa, Entamoeba invadens
YKMSRVVLHEGLTLLGKY

SEQ ID NO: 2977157 - protein, 25 aa, Entamoeba invadens
YKMTRSAICPLELDNTIIDVKNGIT

SEQ ID NO: 2977158 - protein, 20 aa, Entamoeba invadens
YKMVTGVFPKMNFSTTSGVS

SEQ ID NO: 2977159 - protein, 21 aa, Entamoeba invadens
YKNADGFIVVFSLDKEESFEN

SEQ ID NO: 2977160 - protein, 17 aa, Entamoeba invadens
YKNCTQTICGVDGSVIF

SEQ ID NO: 2977161 - protein, 27 aa, Entamoeba invadens
YKNEILETFPSYYYRDVYYGKNDCNIT

SEQ ID NO: 2977162 - protein, 19 aa, Entamoeba invadens
YKNEWAVIIQDNFGAHLQN

SEQ ID NO: 2977163 - protein, 19 aa, Entamoeba invadens
YKNFKTKMLCWTGKELWAF

SEQ ID NO: 2977164 - protein, 22 aa, Entamoeba invadens
YKNFPILLKRVSSFIQGALSTL

SEQ ID NO: 2977165 - protein, 19 aa, Entamoeba invadens
YKNKELFSLDKEDDRRVLF

SEQ ID NO: 2977166 - protein, 19 aa, Entamoeba invadens
YKNLQFLKMEMAYVTNYNN

SEQ ID NO: 2977167 - protein, 17 aa, Entamoeba invadens
YKNMFFLDSTNYYKDEN

SEQ ID NO: 2977168 - protein, 20 aa, Entamoeba invadens
YKNMLLMALIEDLKTNKVIT

SEQ ID NO: 2977169 - protein, 24 aa, Entamoeba invadens
YKNTPKGGVDFILKNSASAPVKTI

SEQ ID NO: 2977170 - protein, 17 aa, Entamoeba invadens
YKNYLWKLLKALFDDYT

SEQ ID NO: 2977171 - protein, 17 aa, Entamoeba invadens
YKPALVIMDEVDGMSSG

SEQ ID NO: 2977172 - protein, 20 aa, Entamoeba invadens
YKPERLEIQKNVFNPRFKYG

SEQ ID NO: 2977173 - protein, 21 aa, Entamoeba invadens
YKPETGAVYELYDKVLEMKNV

SEQ ID NO: 2977174 - protein, 18 aa, Entamoeba invadens
YKPKKRTFPGRKGAKKDE

SEQ ID NO: 2977175 - protein, 24 aa, Entamoeba invadens
YKPLFKASTLFLTKKKDLENGIVG

SEQ ID NO: 2977176 - protein, 23 aa, Entamoeba invadens
YKPLKQPAVCFDCKQKVVRFAYH

SEQ ID NO: 2977177 - protein, 21 aa, Entamoeba invadens
YKPNDKWDLNAEINKANGGKV

SEQ ID NO: 2977178 - protein, 17 aa, Entamoeba invadens
YKPTYFRPMSIKYERML

SEQ ID NO: 2977179 - protein, 27 aa, Entamoeba invadens
YKQILHCAEALPVQAFTPVETMRQTAE

SEQ ID NO: 2977180 - protein, 17 aa, Entamoeba invadens
YKQTFDFTNIISDLKNS

SEQ ID NO: 2977181 - protein, 26 aa, Entamoeba invadens
YKQYVYRYSVDYSFFLAHNCENCDFR

SEQ ID NO: 2977182 - protein, 20 aa, Entamoeba invadens
YKRKTKRMESGVAKKHQEIV

SEQ ID NO: 2977183 - protein, 26 aa, Entamoeba invadens
YKRKYEYYRNPEILAFIRKLNVRYLA

SEQ ID NO: 2977184 - protein, 19 aa, Entamoeba invadens
YKRRSGRVERMMRRRRIAK

SEQ ID NO: 2977185 - protein, 28 aa, Entamoeba invadens
YKRSLCYHLLRNGCYFVLTTKDSLNSSV

SEQ ID NO: 2977186 - protein, 20 aa, Entamoeba invadens
YKRTVMVSGSSEYRIDNKVV

SEQ ID NO: 2977187 - protein, 17 aa, Entamoeba invadens
YKSCTNIVDGLKQSGID

SEQ ID NO: 2977188 - protein, 27 aa, Entamoeba invadens
YKSDVWSVGCVLWCVLNGREMKEYRAK

SEQ ID NO: 2977189 - protein, 17 aa, Entamoeba invadens
YKSGFSICAVNYNNRSI

SEQ ID NO: 2977190 - protein, 20 aa, Entamoeba invadens
YKSGTCFQLPKSVTCLTLKG

SEQ ID NO: 2977191 - protein, 21 aa, Entamoeba invadens
YKSIGKRTVDAFQIVSHNFIV

SEQ ID NO: 2977192 - protein, 22 aa, Entamoeba invadens
YKSIPMQLFYTISFKEKVEVIK

SEQ ID NO: 2977193 - protein, 17 aa, Entamoeba invadens
YKSKGYDLNNMMDREKA

SEQ ID NO: 2977194 - protein, 25 aa, Entamoeba invadens
YKSRADFCLAATYALNGILGTGVQQ

SEQ ID NO: 2977195 - protein, 19 aa, Entamoeba invadens
YKSTLGMDLMVKEIQAGTE

SEQ ID NO: 2977196 - protein, 21 aa, Entamoeba invadens
YKSVIGVGVARNIPNSLRSVM

SEQ ID NO: 2977197 - protein, 26 aa, Entamoeba invadens
YKSVSFKWGNKILRMNFWDTPRLMNG

SEQ ID NO: 2977198 - protein, 25 aa, Entamoeba invadens
YKSYKPKRLLSLNVKVECDNLCTAL

SEQ ID NO: 2977199 - protein, 25 aa, Entamoeba invadens
YKTFCMDTFMCLTRLLTSIQTSQKS

SEQ ID NO: 2977200 - protein, 21 aa, Entamoeba invadens
YKTICLRTHIPLDGKNGTEAL

SEQ ID NO: 2977201 - protein, 26 aa, Entamoeba invadens
YKTIGTFLRTFGRVVSYRIRCVARDV

SEQ ID NO: 2977202 - protein, 24 aa, Entamoeba invadens
YKTKGIEVLCLFHHSEMLGHVLVP

SEQ ID NO: 2977203 - protein, 17 aa, Entamoeba invadens
YKTKVLMVHDLPKNLVP

SEQ ID NO: 2977204 - protein, 17 aa, Entamoeba invadens
YKTLEDIAMKVNFRVSA

SEQ ID NO: 2977205 - protein, 24 aa, Entamoeba invadens
YKTLELYNKVVVWYEIDCGTYEKF

SEQ ID NO: 2977206 - protein, 21 aa, Entamoeba invadens
YKTQICIDWTNGLSYLKNLIL

SEQ ID NO: 2977207 - protein, 24 aa, Entamoeba invadens
YKTRLGDCRLFELYEFVLSKKHFV

SEQ ID NO: 2977208 - protein, 31 aa, Entamoeba invadens
YKTTGGSFFPYRYKPEFEIFGQYLAKAQIFS

SEQ ID NO: 2977209 - protein, 20 aa, Entamoeba invadens
YKTTYVFVMAFSMFLFQQPN

SEQ ID NO: 2977210 - protein, 17 aa, Entamoeba invadens
YKVDFMMKDNELLKTKM

SEQ ID NO: 2977211 - protein, 22 aa, Entamoeba invadens
YKVESCYNLNFTFLQRKSLNED

SEQ ID NO: 2977212 - protein, 20 aa, Entamoeba invadens
YKVLNCFFGYSPQYTSALVT

SEQ ID NO: 2977213 - protein, 25 aa, Entamoeba invadens
YKVMIAACDTFRAGAVDQLAVHAQR

SEQ ID NO: 2977214 - protein, 21 aa, Entamoeba invadens
YKVMLPVLICLKELKEVDHLS

SEQ ID NO: 2977215 - protein, 18 aa, Entamoeba invadens
YKVSLISIEPLLEVAPQI

SEQ ID NO: 2977216 - protein, 26 aa, Entamoeba invadens
YKVSQSCGIGFNWAMKTGPLCEEEMM

SEQ ID NO: 2977217 - protein, 20 aa, Entamoeba invadens
YKVTTAISFVDFLDLTSRGN

SEQ ID NO: 2977218 - protein, 18 aa, Entamoeba invadens
YKWKAMGPINKEKKKFKR

SEQ ID NO: 2977219 - protein, 26 aa, Entamoeba invadens
YKYACISCAVGYYLSNARCYLCSENC

SEQ ID NO: 2977220 - protein, 20 aa, Entamoeba invadens
YKYADLALLFVRDTHAKFNI

SEQ ID NO: 2977221 - protein, 20 aa, Entamoeba invadens
YKYALLSLRKKKSLDRQLEK

SEQ ID NO: 2977222 - protein, 17 aa, Entamoeba invadens
YKYHLVVPIDFPTTENI

SEQ ID NO: 2977223 - protein, 17 aa, Entamoeba invadens
YKYIPMGYKVIGGDQYR

SEQ ID NO: 2977224 - protein, 19 aa, Entamoeba invadens
YKYLDSVIVTGLQNLIHML

SEQ ID NO: 2977225 - protein, 17 aa, Entamoeba invadens
YKYMYCPGGTKDVEQMD

SEQ ID NO: 2977226 - protein, 24 aa, Entamoeba invadens
YKYRSDSKLLLLHYPQRSLCQCTL

SEQ ID NO: 2977227 - protein, 34 aa, Entamoeba invadens
YKYSFFPAMYDDFFFFKYSHLIPLSAKTQNYQHK

SEQ ID NO: 2977228 - protein, 17 aa, Entamoeba invadens
YKYSVIAILSFDEYIVG

SEQ ID NO: 2977229 - protein, 21 aa, Entamoeba invadens
YKYYKHRADILTRLERMRIAP

SEQ ID NO: 2977230 - protein, 24 aa, Entamoeba invadens
YLAFDRKTILPSDCEIFVNDLMKN

SEQ ID NO: 2977231 - protein, 19 aa, Entamoeba invadens
YLAFIRGAFKVDRQIALKQ

SEQ ID NO: 2977232 - protein, 18 aa, Entamoeba invadens
YLAMKKKYSFIILNKKRT

SEQ ID NO: 2977233 - protein, 17 aa, Entamoeba invadens
YLAQFMKGRLEECGFVF

SEQ ID NO: 2977234 - protein, 17 aa, Entamoeba invadens
YLARKVKKSGIDIQNDL

SEQ ID NO: 2977235 - protein, 18 aa, Entamoeba invadens
YLATFLLLQPVDFAEVLV

SEQ ID NO: 2977236 - protein, 26 aa, Entamoeba invadens
YLCDEMLRQSFICGSFPFNSNEMYTV

SEQ ID NO: 2977237 - protein, 24 aa, Entamoeba invadens
YLCDLKTMLLNGVCNVKNEKCETY

SEQ ID NO: 2977238 - protein, 19 aa, Entamoeba invadens
YLCENCEWKTEIVKEKYHA

SEQ ID NO: 2977239 - protein, 20 aa, Entamoeba invadens
YLCERDCPIGYLNIYGVCTK

SEQ ID NO: 2977240 - protein, 21 aa, Entamoeba invadens
YLCKETGHTFKDCKFKDDAEK

SEQ ID NO: 2977241 - protein, 24 aa, Entamoeba invadens
YLCKKGAGMFATIRRACFLKEIIV

SEQ ID NO: 2977242 - protein, 19 aa, Entamoeba invadens
YLCNYKLIPNEKMIFMRYS

SEQ ID NO: 2977243 - protein, 19 aa, Entamoeba invadens
YLCPLSYSIYCEKKIKYKN

SEQ ID NO: 2977244 - protein, 26 aa, Entamoeba invadens
YLCRLVPNFTRRARWNDDFDFSQPNP

SEQ ID NO: 2977245 - protein, 24 aa, Entamoeba invadens
YLCSTLCWVGSFLVQSLENERNEK

SEQ ID NO: 2977246 - protein, 19 aa, Entamoeba invadens
YLCVLPVLQALIITTQKEF

SEQ ID NO: 2977247 - protein, 23 aa, Entamoeba invadens
YLDCSLTLEAIEYFSSDIQVLFE

SEQ ID NO: 2977248 - protein, 18 aa, Entamoeba invadens
YLDFSVPTLPSFKNIQLV

SEQ ID NO: 2977249 - protein, 17 aa, Entamoeba invadens
YLDISLSGIEVLEVEHF

SEQ ID NO: 2977250 - protein, 19 aa, Entamoeba invadens
YLDKIHLFCKVLSSYKQSH

SEQ ID NO: 2977251 - protein, 19 aa, Entamoeba invadens
YLDKNLFVINNFEKPHALV

SEQ ID NO: 2977252 - protein, 19 aa, Entamoeba invadens
YLDNGKVCVRFIYRKQEFF

SEQ ID NO: 2977253 - protein, 32 aa, Entamoeba invadens
YLDSLKCYNFCFKLCQLFCSYGRQIEIQGEIG

SEQ ID NO: 2977254 - protein, 19 aa, Entamoeba invadens
YLEAIRVKPEFRFMFQCSS

SEQ ID NO: 2977255 - protein, 24 aa, Entamoeba invadens
YLEALYLEKCMKISGEGINVLSTL

SEQ ID NO: 2977256 - protein, 19 aa, Entamoeba invadens
YLEDFLHCRMNCFEFQSFI

SEQ ID NO: 2977257 - protein, 20 aa, Entamoeba invadens
YLEDKFLYLVFEYCDQDLYQ

SEQ ID NO: 2977258 - protein, 25 aa, Entamoeba invadens
YLEECLLQLTLIFSHEPKVAEYPIY

SEQ ID NO: 2977259 - protein, 19 aa, Entamoeba invadens
YLEEIKLVLVNTEGSEELV

SEQ ID NO: 2977260 - protein, 27 aa, Entamoeba invadens
YLEERVSSLVLKFLRKYEQIPFEMYSG

SEQ ID NO: 2977261 - protein, 23 aa, Entamoeba invadens
YLEFRRYQEYLIYCKESQLRHIT

SEQ ID NO: 2977262 - protein, 18 aa, Entamoeba invadens
YLEIAKQYNIITIGNERF

SEQ ID NO: 2977263 - protein, 23 aa, Entamoeba invadens
YLEKCCLKPSCYATRSKNVKGLS

SEQ ID NO: 2977264 - protein, 20 aa, Entamoeba invadens
YLEKEPKTTGAMMVYHIALN

SEQ ID NO: 2977265 - protein, 19 aa, Entamoeba invadens
YLEMKGFKVITLSKMMETC

SEQ ID NO: 2977266 - protein, 19 aa, Entamoeba invadens
YLENFVCAMFKGASNLQKP

SEQ ID NO: 2977267 - protein, 19 aa, Entamoeba invadens
YLEPYHRPLTLGVSSVTLT

SEQ ID NO: 2977268 - protein, 19 aa, Entamoeba invadens
YLETIKLSKVCQDIIVYGI

SEQ ID NO: 2977269 - protein, 26 aa, Entamoeba invadens
YLETPRLYIKWVEKIAQEHGVRQHYL

SEQ ID NO: 2977270 - protein, 32 aa, Entamoeba invadens
YLEYSRSHFYPHLFTLILRHVHSLPTTLQIMI

SEQ ID NO: 2977271 - protein, 18 aa, Entamoeba invadens
YLFAGNAMRAETLINAGI

SEQ ID NO: 2977272 - protein, 24 aa, Entamoeba invadens
YLFDTGKSLTVFYGKECNKSRRQK

SEQ ID NO: 2977273 - protein, 25 aa, Entamoeba invadens
YLFEEGYCKTGKIAVTQPRRVAAMS

SEQ ID NO: 2977274 - protein, 20 aa, Entamoeba invadens
YLFGTGFCWGVVEDNLTVLY

SEQ ID NO: 2977275 - protein, 23 aa, Entamoeba invadens
YLFKPKGSESFSIEEDHLAQFME

SEQ ID NO: 2977276 - protein, 23 aa, Entamoeba invadens
YLFLGCTFLKTVEGIEKITSFGD

SEQ ID NO: 2977277 - protein, 18 aa, Entamoeba invadens
YLFLYPFALLKLSVYKTH

SEQ ID NO: 2977278 - protein, 17 aa, Entamoeba invadens
YLFQFLVGINYLHKTGI

SEQ ID NO: 2977279 - protein, 17 aa, Entamoeba invadens
YLFQILQVVNGIEQNGL

SEQ ID NO: 2977280 - protein, 24 aa, Entamoeba invadens
YLGAKKEDCLIGFGNGHDIHVHKK

SEQ ID NO: 2977281 - protein, 17 aa, Entamoeba invadens
YLGCERIIRRRFGGVKF

SEQ ID NO: 2977282 - protein, 17 aa, Entamoeba invadens
YLGGDLAVINGFAKMVT

SEQ ID NO: 2977283 - protein, 19 aa, Entamoeba invadens
YLGKCALYQHFEEVHVANL

SEQ ID NO: 2977284 - protein, 23 aa, Entamoeba invadens
YLGKRCAYIYKVAVKKGSKKPAV

SEQ ID NO: 2977285 - protein, 18 aa, Entamoeba invadens
YLGLYYNTFHQWTGMTAP

SEQ ID NO: 2977286 - protein, 21 aa, Entamoeba invadens
YLGNFSRSILTDEVIQKELAE

SEQ ID NO: 2977287 - protein, 18 aa, Entamoeba invadens
YLGTLAFDNCEELVEIDI

SEQ ID NO: 2977288 - protein, 17 aa, Entamoeba invadens
YLGTVFLVSYLYTEGTV

SEQ ID NO: 2977289 - protein, 26 aa, Entamoeba invadens
YLHAKKICHRDIKLENVLLCEKNAIQ

SEQ ID NO: 2977290 - protein, 19 aa, Entamoeba invadens
YLHDQNITGLVFVGDEVPT

SEQ ID NO: 2977291 - protein, 20 aa, Entamoeba invadens
YLHEFVKRMKDVILAQQKSV

SEQ ID NO: 2977292 - protein, 25 aa, Entamoeba invadens
YLHEKICIGYLCIWCSHETSSFQSY

SEQ ID NO: 2977293 - protein, 22 aa, Entamoeba invadens
YLHLGEFYQVFMRRCAIYKDSM

SEQ ID NO: 2977294 - protein, 40 aa, Entamoeba invadens
YLHLKYDGIHLVLFGTRWLRLLFDREFLVNDVLNIWDAIF

SEQ ID NO: 2977295 - protein, 18 aa, Entamoeba invadens
YLHMEGNPYRDRIYMKYP

SEQ ID NO: 2977296 - protein, 24 aa, Entamoeba invadens
YLHRCKTQELFFCMHELDTSELPK

SEQ ID NO: 2977297 - protein, 18 aa, Entamoeba invadens
YLHSAGIVHRDIKPSNLL

SEQ ID NO: 2977298 - protein, 17 aa, Entamoeba invadens
YLHSLGVIHRDIKPENV

SEQ ID NO: 2977299 - protein, 24 aa, Entamoeba invadens
YLHSLTPPIVHRDIKVENVLFSED

SEQ ID NO: 2977300 - protein, 19 aa, Entamoeba invadens
YLIHLKIAFVSSSSAQSLQ

SEQ ID NO: 2977301 - protein, 17 aa, Entamoeba invadens
YLILPIQRIPRYVMLIE

SEQ ID NO: 2977302 - protein, 24 aa, Entamoeba invadens
YLINDNFHFFFAHWSDVVRDFYHH

SEQ ID NO: 2977303 - protein, 21 aa, Entamoeba invadens
YLINEIGCFCVFATHFHEVTA

SEQ ID NO: 2977304 - protein, 25 aa, Entamoeba invadens
YLIQTFKGSCLLRIVETAINVLRSI

SEQ ID NO: 2977305 - protein, 24 aa, Entamoeba invadens
YLISFKSGEVFLGNVVERYKSSTH

SEQ ID NO: 2977306 - protein, 19 aa, Entamoeba invadens
YLIVFRGNVVADWMKQKLE

SEQ ID NO: 2977307 - protein, 20 aa, Entamoeba invadens
YLKAEMYGLHPLFYAICNAL

SEQ ID NO: 2977308 - protein, 18 aa, Entamoeba invadens
YLKCIDFYVQNLLNNERD

SEQ ID NO: 2977309 - protein, 17 aa, Entamoeba invadens
YLKEIGDYCFQQSNFNY

SEQ ID NO: 2977310 - protein, 17 aa, Entamoeba invadens
YLKFDCASRGTEICKNV

SEQ ID NO: 2977311 - protein, 18 aa, Entamoeba invadens
YLKFDYRLLHQIGESVSY

SEQ ID NO: 2977312 - protein, 23 aa, Entamoeba invadens
YLKHPFLSRRGDDLVVNKNVFLD

SEQ ID NO: 2977313 - protein, 18 aa, Entamoeba invadens
YLKIKALKDVLSKKLLAE

SEQ ID NO: 2977314 - protein, 23 aa, Entamoeba invadens
YLKKRPRVSKEFIGAKEEPISPS

SEQ ID NO: 2977315 - protein, 27 aa, Entamoeba invadens
YLKNQYCVACAIHGRIVRVRSHEDRKI

SEQ ID NO: 2977316 - protein, 23 aa, Entamoeba invadens
YLKSNLSGLMFANYVLHKNVREI

SEQ ID NO: 2977317 - protein, 38 aa, Entamoeba invadens
YLKTIKFIPQRPFRTPRELQIWIWKEIFQETKRFNVDE

SEQ ID NO: 2977318 - protein, 19 aa, Entamoeba invadens
YLKTMPIEKSFVYKTSQKE

SEQ ID NO: 2977319 - protein, 18 aa, Entamoeba invadens
YLLEDHFSIIVGVKSDSQ

SEQ ID NO: 2977320 - protein, 17 aa, Entamoeba invadens
YLLEGLKAIGLENKNYT

SEQ ID NO: 2977321 - protein, 21 aa, Entamoeba invadens
YLLEHCVRILQDLVIAIKDDK

SEQ ID NO: 2977322 - protein, 20 aa, Entamoeba invadens
YLLEHSIGYVWTGKRNPIIR

SEQ ID NO: 2977323 - protein, 19 aa, Entamoeba invadens
YLLESCLKNPSFSLSSRLV

SEQ ID NO: 2977324 - protein, 24 aa, Entamoeba invadens
YLLGENFPLKGFTGYNGGLDVKFN

SEQ ID NO: 2977325 - protein, 17 aa, Entamoeba invadens
YLLKFLLIGDSSVGKTS

SEQ ID NO: 2977326 - protein, 24 aa, Entamoeba invadens
YLLKRFNAHINVECCSGLIDSEDE

SEQ ID NO: 2977327 - protein, 18 aa, Entamoeba invadens
YLLKVVFYFDTKEQLQRF

SEQ ID NO: 2977328 - protein, 21 aa, Entamoeba invadens
YLLKVVMKFLTKEDLLTFMSV

SEQ ID NO: 2977329 - protein, 17 aa, Entamoeba invadens
YLLPGIVHLLNKPLAQS

SEQ ID NO: 2977330 - protein, 20 aa, Entamoeba invadens
YLLQRLNQRLAQYYYENDQC

SEQ ID NO: 2977331 - protein, 18 aa, Entamoeba invadens
YLLSVVLHFEYKEDLQTF

SEQ ID NO: 2977332 - protein, 18 aa, Entamoeba invadens
YLLSYSLGDLLLKLKSTF

SEQ ID NO: 2977333 - protein, 32 aa, Entamoeba invadens
YLLTEKYKYLPISLEGNDLFNALSDGVLLYHL

SEQ ID NO: 2977334 - protein, 25 aa, Entamoeba invadens
YLMKDDRLFVSSCLLIESILEQREH

SEQ ID NO: 2977335 - protein, 19 aa, Entamoeba invadens
YLMKDKFPGVKGSVNEKLF

SEQ ID NO: 2977336 - protein, 17 aa, Entamoeba invadens
YLMRGCKHPHKVYFHHY

SEQ ID NO: 2977337 - protein, 22 aa, Entamoeba invadens
YLMSLNCRAGRSFNDLSQYYIF

SEQ ID NO: 2977338 - protein, 28 aa, Entamoeba invadens
YLNDMVIQCVIKFGGLKTDQEKEKFLNI

SEQ ID NO: 2977339 - protein, 24 aa, Entamoeba invadens
YLNGELYFIGIIDILMDYTTRKKL

SEQ ID NO: 2977340 - protein, 20 aa, Entamoeba invadens
YLNIMWRMTKDLNEKRGLCE

SEQ ID NO: 2977341 - protein, 19 aa, Entamoeba invadens
YLNKGFGFEVYKEGVDVHV

SEQ ID NO: 2977342 - protein, 17 aa, Entamoeba invadens
YLNNCKFLIDAEEKKDF

SEQ ID NO: 2977343 - protein, 26 aa, Entamoeba invadens
YLNSSLQCLLHIPSFVNYFQNVTWQS

SEQ ID NO: 2977344 - protein, 25 aa, Entamoeba invadens
YLNTIWECISEVKLKHQHKLDNVNI

SEQ ID NO: 2977345 - protein, 21 aa, Entamoeba invadens
YLNTTCFVLCFSLVDQTSFDE

SEQ ID NO: 2977346 - protein, 19 aa, Entamoeba invadens
YLPEPTINPISPVSHPELR

SEQ ID NO: 2977347 - protein, 18 aa, Entamoeba invadens
YLPFELDYDLSFLETLGT

SEQ ID NO: 2977348 - protein, 19 aa, Entamoeba invadens
YLPNPRKEPVIKLKIGTKE

SEQ ID NO: 2977349 - protein, 21 aa, Entamoeba invadens
YLPSVCDYLHISLAKQTPQST

SEQ ID NO: 2977350 - protein, 18 aa, Entamoeba invadens
YLQAILKQKQKHLLRLQK

SEQ ID NO: 2977351 - protein, 24 aa, Entamoeba invadens
YLQFLPYHFLLAIDSIRDQQPVLS

SEQ ID NO: 2977352 - protein, 20 aa, Entamoeba invadens
YLQFRAIHGSYVYTKGKVYK

SEQ ID NO: 2977353 - protein, 17 aa, Entamoeba invadens
YLQFYYNDEEIIRELER

SEQ ID NO: 2977354 - protein, 20 aa, Entamoeba invadens
YLQKVLVILLNWLASVTDAD

SEQ ID NO: 2977355 - protein, 17 aa, Entamoeba invadens
YLQLLGVMKQLLETKRG

SEQ ID NO: 2977356 - protein, 36 aa, Entamoeba invadens
YLQLRMLFWKIAKREIIVFDGKFDWTGFKGQKSEDR

SEQ ID NO: 2977357 - protein, 17 aa, Entamoeba invadens
YLQLYFQSFLMLRKSLV

SEQ ID NO: 2977358 - protein, 18 aa, Entamoeba invadens
YLQPALMSYMYAFPSKST

SEQ ID NO: 2977359 - protein, 20 aa, Entamoeba invadens
YLQQRLVGFFKLDLHRQKMV

SEQ ID NO: 2977360 - protein, 24 aa, Entamoeba invadens
YLQRKPCRKEVAKVIAKLDANKDG

SEQ ID NO: 2977361 - protein, 20 aa, Entamoeba invadens
YLQYDLTMWESFKALHQKVN

SEQ ID NO: 2977362 - protein, 19 aa, Entamoeba invadens
YLRDFPFMRMNKELAKVDI

SEQ ID NO: 2977363 - protein, 18 aa, Entamoeba invadens
YLREELENLVVVKKEVVK

SEQ ID NO: 2977364 - protein, 30 aa, Entamoeba invadens
YLRELPNPLIPFNFYNDFVVIGRLGGKNKE

SEQ ID NO: 2977365 - protein, 21 aa, Entamoeba invadens
YLREWKKRKRITKEAAEAVLS

SEQ ID NO: 2977366 - protein, 32 aa, Entamoeba invadens
YLRILESSIYQDEWKYLLVLMKSVTSSGAFLK

SEQ ID NO: 2977367 - protein, 17 aa, Entamoeba invadens
YLRKMVTYFDGFTTHPL

SEQ ID NO: 2977368 - protein, 19 aa, Entamoeba invadens
YLRKNSLLVKSFYGVAENI

SEQ ID NO: 2977369 - protein, 23 aa, Entamoeba invadens
YLRLKTKRTGRGIKHQILKMHHF

SEQ ID NO: 2977370 - protein, 26 aa, Entamoeba invadens
YLRLPRLPLASKWNVTFHELYDMTQN

SEQ ID NO: 2977371 - protein, 19 aa, Entamoeba invadens
YLRNDFNVFMQQRRLKTLS

SEQ ID NO: 2977372 - protein, 22 aa, Entamoeba invadens
YLRYKYMERDGVGSFPELVDDV

SEQ ID NO: 2977373 - protein, 20 aa, Entamoeba invadens
YLSALRDATTFILINKKCQQ

SEQ ID NO: 2977374 - protein, 24 aa, Entamoeba invadens
YLSEFKTNQIIQPRLRKAKNCGSG

SEQ ID NO: 2977375 - protein, 22 aa, Entamoeba invadens
YLSEFYDLFRVFHVGEIPLKYC

SEQ ID NO: 2977376 - protein, 24 aa, Entamoeba invadens
YLSEPRNAIKPGLFRIPPNQSVLD

SEQ ID NO: 2977377 - protein, 18 aa, Entamoeba invadens
YLSFAEKYSESFELHVTW

SEQ ID NO: 2977378 - protein, 25 aa, Entamoeba invadens
YLSGLKYNAMPPFKRFHDLEQLSGG

SEQ ID NO: 2977379 - protein, 21 aa, Entamoeba invadens
YLSKIMKRLGLAKGNTLKSGL

SEQ ID NO: 2977380 - protein, 21 aa, Entamoeba invadens
YLSLEMKKALMNSSHFATSIQ

SEQ ID NO: 2977381 - protein, 22 aa, Entamoeba invadens
YLSRISEMLAHDASYEKAIRKA

SEQ ID NO: 2977382 - protein, 18 aa, Entamoeba invadens
YLSSHGIEVVSLPVNNEG

SEQ ID NO: 2977383 - protein, 18 aa, Entamoeba invadens
YLSWPIEFGLVMSPYFKI

SEQ ID NO: 2977384 - protein, 17 aa, Entamoeba invadens
YLTCGDLAILDVQQMAC

SEQ ID NO: 2977385 - protein, 21 aa, Entamoeba invadens
YLTETAICFQYFLKDKKTELP

SEQ ID NO: 2977386 - protein, 17 aa, Entamoeba invadens
YLTIPSIVQVISEQCFD

SEQ ID NO: 2977387 - protein, 18 aa, Entamoeba invadens
YLTVGIFRTSASYKDTGR

SEQ ID NO: 2977388 - protein, 28 aa, Entamoeba invadens
YLVCWDLRHTIANIGWRVPTHSAITDII

SEQ ID NO: 2977389 - protein, 19 aa, Entamoeba invadens
YLVDERYLDVAVKFFIVDN

SEQ ID NO: 2977390 - protein, 17 aa, Entamoeba invadens
YLVDMKSLLLVSKTTLS

SEQ ID NO: 2977391 - protein, 19 aa, Entamoeba invadens
YLVFIGFTRCQLPVSGISP

SEQ ID NO: 2977392 - protein, 18 aa, Entamoeba invadens
YLVKKGADFHTWKKRWFV

SEQ ID NO: 2977393 - protein, 25 aa, Entamoeba invadens
YLVVKGGVELYRFRAMSFCLVLGKL

SEQ ID NO: 2977394 - protein, 26 aa, Entamoeba invadens
YLWMNDLKQFFPYLMFLDNKNISNCQ

SEQ ID NO: 2977395 - protein, 21 aa, Entamoeba invadens
YLWVVWDRALELCLLQINNHC

SEQ ID NO: 2977396 - protein, 17 aa, Entamoeba invadens
YLYAIVVPNEIAIRSEY

SEQ ID NO: 2977397 - protein, 21 aa, Entamoeba invadens
YLYCNSTMFIYVFDVTDNNDF

SEQ ID NO: 2977398 - protein, 17 aa, Entamoeba invadens
YLYDAYNYLSLKNLLGL

SEQ ID NO: 2977399 - protein, 25 aa, Entamoeba invadens
YLYEHYALDILKLFPNIQTLYLPFY

SEQ ID NO: 2977400 - protein, 30 aa, Entamoeba invadens
YLYLHCWELELVRCQHCFIEIATKQRHSQK

SEQ ID NO: 2977401 - protein, 25 aa, Entamoeba invadens
YLYNKGCTTHGLFRETSNASTRDVE

SEQ ID NO: 2977402 - protein, 25 aa, Entamoeba invadens
YLYNKGCTTKGIFREIYSAPLKEVE

SEQ ID NO: 2977403 - protein, 19 aa, Entamoeba invadens
YLYTSGIDSEGLFRVSSTP

SEQ ID NO: 2977404 - protein, 24 aa, Entamoeba invadens
YMAPEILEGLKYTKSSDVFSFGIT

SEQ ID NO: 2977405 - protein, 17 aa, Entamoeba invadens
YMASCSVKVVDEKSKVT

SEQ ID NO: 2977406 - protein, 25 aa, Entamoeba invadens
YMCLSGYCCFYNCYDLSSITIPSSV

SEQ ID NO: 2977407 - protein, 19 aa, Entamoeba invadens
YMCSCKQRSYEFIGASNAL

SEQ ID NO: 2977408 - protein, 18 aa, Entamoeba invadens
YMDDNGFVSVVILSKMLG

SEQ ID NO: 2977409 - protein, 18 aa, Entamoeba invadens
YMDICAALEKDPNNPALL

SEQ ID NO: 2977410 - protein, 22 aa, Entamoeba invadens
YMDKYRTLVCKMFSSPFKENEE

SEQ ID NO: 2977411 - protein, 19 aa, Entamoeba invadens
YMESLENLKSIALPTTLTK

SEQ ID NO: 2977412 - protein, 25 aa, Entamoeba invadens
YMESPRFDSNTSLIAKIAQLEDICK

SEQ ID NO: 2977413 - protein, 17 aa, Entamoeba invadens
YMETIICCTPIDNTVRI

SEQ ID NO: 2977414 - protein, 17 aa, Entamoeba invadens
YMGCGKTYLSEESLTRH

SEQ ID NO: 2977415 - protein, 23 aa, Entamoeba invadens
YMGTNCFIICFSLVDKKSYQEVG

SEQ ID NO: 2977416 - protein, 21 aa, Entamoeba invadens
YMHKFFPVYMELLIRLITPGN

SEQ ID NO: 2977417 - protein, 17 aa, Entamoeba invadens
YMKALPCVLENIQEMGS

SEQ ID NO: 2977418 - protein, 34 aa, Entamoeba invadens
YMKMKKIGYSFVYKWIVLLFRRDFTPKKCKRIWD

SEQ ID NO: 2977419 - protein, 19 aa, Entamoeba invadens
YMLDKFRSEYIVHFYGAVF

SEQ ID NO: 2977420 - protein, 17 aa, Entamoeba invadens
YMLLNYCFNLTTVNILK

SEQ ID NO: 2977421 - protein, 23 aa, Entamoeba invadens
YMLSEIQIPLGITRIGSECFSHC

SEQ ID NO: 2977422 - protein, 23 aa, Entamoeba invadens
YMMLVCKYFQSFDDFIRVMSVSK

SEQ ID NO: 2977423 - protein, 21 aa, Entamoeba invadens
YMNGKRVKLEFSETHEDSPSA

SEQ ID NO: 2977424 - protein, 33 aa, Entamoeba invadens
YMNVTCEVCLRKCCIGCSLHTTIAPTLIMGIMD

SEQ ID NO: 2977425 - protein, 17 aa, Entamoeba invadens
YMPDQKLGVILGGGEGF

SEQ ID NO: 2977426 - protein, 33 aa, Entamoeba invadens
YMPIGCKSDVWALGCLIYKCLMLETPFEESPMK

SEQ ID NO: 2977427 - protein, 29 aa, Entamoeba invadens
YMPSCDVSHLLKKCFFSLFPENFGTNHLI

SEQ ID NO: 2977428 - protein, 18 aa, Entamoeba invadens
YMQGECYMNGDGVRASTW

SEQ ID NO: 2977429 - protein, 21 aa, Entamoeba invadens
YMRIKSLDFGDGEILVVNEFL

SEQ ID NO: 2977430 - protein, 19 aa, Entamoeba invadens
YMSDFVCMLYGNPGAYGVV

SEQ ID NO: 2977431 - protein, 27 aa, Entamoeba invadens
YMSLSKFLFHMITLYTSSLVLRNESTK

SEQ ID NO: 2977432 - protein, 21 aa, Entamoeba invadens
YMSRLLRTCGYIYRTSQEMEL

SEQ ID NO: 2977433 - protein, 17 aa, Entamoeba invadens
YMTASGLTIQEKKPVNL

SEQ ID NO: 2977434 - protein, 30 aa, Entamoeba invadens
YMVKDMKNGCCYRADHILKTFYEKQMEDPK

SEQ ID NO: 2977435 - protein, 34 aa, Entamoeba invadens
YMVKRGHIIRNWLQRWFVLTSDILYYFDAEKLHL

SEQ ID NO: 2977436 - protein, 26 aa, Entamoeba invadens
YMYLLFKSKYPYVFSDAMFMADFNLL

SEQ ID NO: 2977437 - protein, 24 aa, Entamoeba invadens
YNAFKTTGYWKLRILDNPWAPEVS

SEQ ID NO: 2977438 - protein, 25 aa, Entamoeba invadens
YNAFRDCAFIDFSIEKKVLINELVF

SEQ ID NO: 2977439 - protein, 17 aa, Entamoeba invadens
YNAIHLTPLQPIGPSGS

SEQ ID NO: 2977440 - protein, 25 aa, Entamoeba invadens
YNAKKDFFPSISIESFEKLEINWGQ

SEQ ID NO: 2977441 - protein, 20 aa, Entamoeba invadens
YNALSCSEKVLKFVPDMSDL

SEQ ID NO: 2977442 - protein, 19 aa, Entamoeba invadens
YNAQVGRWVYNKILKDEIN

SEQ ID NO: 2977443 - protein, 21 aa, Entamoeba invadens
YNARGKTGRQFCESVSVALLQ

SEQ ID NO: 2977444 - protein, 22 aa, Entamoeba invadens
YNASFYWKTPLRKTPRETPRQR

SEQ ID NO: 2977445 - protein, 20 aa, Entamoeba invadens
YNAVCGLSNIMTLVVTDKGY

SEQ ID NO: 2977446 - protein, 19 aa, Entamoeba invadens
YNCAIDIWSAGCICAEMVL

SEQ ID NO: 2977447 - protein, 22 aa, Entamoeba invadens
YNCHYCHKPFCKRCITQHDCKA

SEQ ID NO: 2977448 - protein, 24 aa, Entamoeba invadens
YNCLKAKTCVLFKMDLKGKQELYK

SEQ ID NO: 2977449 - protein, 25 aa, Entamoeba invadens
YNCYISLDICMVFGVMQLYRKRGLY

SEQ ID NO: 2977450 - protein, 21 aa, Entamoeba invadens
YNDFDVWECVAKCENEGDLDA

SEQ ID NO: 2977451 - protein, 20 aa, Entamoeba invadens
YNDICAGAKVYSRLSTFNLF

SEQ ID NO: 2977452 - protein, 41 aa, Entamoeba invadens
YNDIFKFLWRVKCLRISINKVFKRMFPFFVSSALIDGIPVF

SEQ ID NO: 2977453 - protein, 25 aa, Entamoeba invadens
YNDKSVFWKLYYKSTVYNNEHVLLT

SEQ ID NO: 2977454 - protein, 22 aa, Entamoeba invadens
YNDLPIDYARKLLMTNSDDELN

SEQ ID NO: 2977455 - protein, 21 aa, Entamoeba invadens
YNDRFIINIPLQYIENYNFTP

SEQ ID NO: 2977456 - protein, 19 aa, Entamoeba invadens
YNDTSCWNEGVFRGHTHNV

SEQ ID NO: 2977457 - protein, 20 aa, Entamoeba invadens
YNEDTPLSCCTFEVSNKNVN

SEQ ID NO: 2977458 - protein, 18 aa, Entamoeba invadens
YNEFEVHQLRPLKQLKNV

SEQ ID NO: 2977459 - protein, 20 aa, Entamoeba invadens
YNELRMDAMNRMPIPENLHQ

SEQ ID NO: 2977460 - protein, 19 aa, Entamoeba invadens
YNETRMWELCCLRGHTSIV

SEQ ID NO: 2977461 - protein, 19 aa, Entamoeba invadens
YNFEECVHKLLNLKMKEDD

SEQ ID NO: 2977462 - protein, 18 aa, Entamoeba invadens
YNFQPEVIYGYSREHPEM

SEQ ID NO: 2977463 - protein, 18 aa, Entamoeba invadens
YNGALIMKGSEIIYESRL

SEQ ID NO: 2977464 - protein, 17 aa, Entamoeba invadens
YNGDIFYEMNILDKSFQ

SEQ ID NO: 2977465 - protein, 20 aa, Entamoeba invadens
YNGFGFSCCNIYNPGTKKTW

SEQ ID NO: 2977466 - protein, 25 aa, Entamoeba invadens
YNGRINYDFCKLVKQNIRFEDVVYD

SEQ ID NO: 2977467 - protein, 26 aa, Entamoeba invadens
YNGVSSCLICSMGYYPLSGTCVACSA

SEQ ID NO: 2977468 - protein, 17 aa, Entamoeba invadens
YNHICIVTELLGTDLYH

SEQ ID NO: 2977469 - protein, 19 aa, Entamoeba invadens
YNHKLAVYNYDWRYMCIEC

SEQ ID NO: 2977470 - protein, 20 aa, Entamoeba invadens
YNIGGSSWVASTARLEIPKN

SEQ ID NO: 2977471 - protein, 20 aa, Entamoeba invadens
YNIHVLKRYYNYLVNVDVSV

SEQ ID NO: 2977472 - protein, 33 aa, Entamoeba invadens
YNIKEKRASFAFCAESRFTTKLLDVGNGDIKVA

SEQ ID NO: 2977473 - protein, 21 aa, Entamoeba invadens
YNIKKSDGFIIMYSVTSEESF

SEQ ID NO: 2977474 - protein, 32 aa, Entamoeba invadens
YNIKTACVKNAFCVGTREGRKLCEVGNGDLKV

SEQ ID NO: 2977475 - protein, 19 aa, Entamoeba invadens
YNILDCLLNNFYQLQVKEN

SEQ ID NO: 2977476 - protein, 28 aa, Entamoeba invadens
YNILRPGGKICCFCPCIEQIQRSCEELK

SEQ ID NO: 2977477 - protein, 21 aa, Entamoeba invadens
YNIPSLASFLVKFQASKSEHI

SEQ ID NO: 2977478 - protein, 23 aa, Entamoeba invadens
YNITRGYMWIGLNQMYLVKRLRK

SEQ ID NO: 2977479 - protein, 19 aa, Entamoeba invadens
YNKDIRTGQEFNSPENDDV

SEQ ID NO: 2977480 - protein, 28 aa, Entamoeba invadens
YNKEHLDPKAFRVYCANNNLTPYKYDLD

SEQ ID NO: 2977481 - protein, 39 aa, Entamoeba invadens
YNKFIELFRTLPLCVYLSLPLGNFFLCHGGLSPSLHSVN

SEQ ID NO: 2977482 - protein, 25 aa, Entamoeba invadens
YNKGEYRWAATVLNHLVFADVNNKK

SEQ ID NO: 2977483 - protein, 18 aa, Entamoeba invadens
YNKISFYLLINILENIDI

SEQ ID NO: 2977484 - protein, 23 aa, Entamoeba invadens
YNKKLIKYEVWDAAGQERYRSLS

SEQ ID NO: 2977485 - protein, 32 aa, Entamoeba invadens
YNKMPKRILLLWKRGEALIWTEEVCGYITRIE

SEQ ID NO: 2977486 - protein, 20 aa, Entamoeba invadens
YNKSLFERLLECGLNVTLLT

SEQ ID NO: 2977487 - protein, 22 aa, Entamoeba invadens
YNKTNAMLGWFQSSIGYHSDDG

SEQ ID NO: 2977488 - protein, 24 aa, Entamoeba invadens
YNKYGKDCAYDFLCDLPHNAVCYF

SEQ ID NO: 2977489 - protein, 18 aa, Entamoeba invadens
YNLAAGDFPPIDVYKERL

SEQ ID NO: 2977490 - protein, 18 aa, Entamoeba invadens
YNLFFRNVLSETFIVFHC

SEQ ID NO: 2977491 - protein, 28 aa, Entamoeba invadens
YNLLELKPSFEFSKTFDIKTRENFTRKI

SEQ ID NO: 2977492 - protein, 26 aa, Entamoeba invadens
YNLLFKMIDMLGMPPVSMLDKGTRTK

SEQ ID NO: 2977493 - protein, 17 aa, Entamoeba invadens
YNLLQFGYSFSINISRI

SEQ ID NO: 2977494 - protein, 32 aa, Entamoeba invadens
YNLREMCLPGFPGVQRCSYVAMKMIKKYHTSI

SEQ ID NO: 2977495 - protein, 19 aa, Entamoeba invadens
YNLTFLIANGLMFGEHQTV

SEQ ID NO: 2977496 - protein, 20 aa, Entamoeba invadens
YNLVFCFIDYTVIDEENKLS

SEQ ID NO: 2977497 - protein, 20 aa, Entamoeba invadens
YNLVICLNIIIKKIIEYNTE

SEQ ID NO: 2977498 - protein, 19 aa, Entamoeba invadens
YNMAYCLLNGFGCATNKAR

SEQ ID NO: 2977499 - protein, 24 aa, Entamoeba invadens
YNMIYKFINMIGLPPTSLLNKGTK

SEQ ID NO: 2977500 - protein, 19 aa, Entamoeba invadens
YNMRFFKTFPENYVVKNIY

SEQ ID NO: 2977501 - protein, 25 aa, Entamoeba invadens
YNNFSFDLTHNFVFPTTITKIKNHN

SEQ ID NO: 2977502 - protein, 25 aa, Entamoeba invadens
YNNFSFDLTHNFVFPTTITKIRNHN

SEQ ID NO: 2977503 - protein, 26 aa, Entamoeba invadens
YNNIVKLRFESFISCHDKDYERMIKS

SEQ ID NO: 2977504 - protein, 19 aa, Entamoeba invadens
YNNQLAMLYHFNTMYNESV

SEQ ID NO: 2977505 - protein, 19 aa, Entamoeba invadens
YNNRGRWGMDIHETNNNVM

SEQ ID NO: 2977506 - protein, 20 aa, Entamoeba invadens
YNNVLYNFFVSRTMADDLKV

SEQ ID NO: 2977507 - protein, 17 aa, Entamoeba invadens
YNPELYSAVVISDETFN

SEQ ID NO: 2977508 - protein, 24 aa, Entamoeba invadens
YNPHVRYGAALALGIAGCGSNNSQ

SEQ ID NO: 2977509 - protein, 24 aa, Entamoeba invadens
YNPICLHSHFNFFSNVETYHFYKK

SEQ ID NO: 2977510 - protein, 23 aa, Entamoeba invadens
YNPICLYSHFNFFSNVETYHYYK

SEQ ID NO: 2977511 - protein, 26 aa, Entamoeba invadens
YNPIPVTSTRLFPCMETQYLYTDNDV

SEQ ID NO: 2977512 - protein, 19 aa, Entamoeba invadens
YNPIQVRCKRLFPYMETQH

SEQ ID NO: 2977513 - protein, 18 aa, Entamoeba invadens
YNPKIGMDSLQVFPESKQ

SEQ ID NO: 2977514 - protein, 19 aa, Entamoeba invadens
YNPRATVISHHCEIQNKKF

SEQ ID NO: 2977515 - protein, 24 aa, Entamoeba invadens
YNPTDLKQFCCVLRNQKTKEYSLK

SEQ ID NO: 2977516 - protein, 21 aa, Entamoeba invadens
YNPTSCRLPLDASHQSKGFGF

SEQ ID NO: 2977517 - protein, 26 aa, Entamoeba invadens
YNQLKFSIKFFPNIETVSSTYSEIEK

SEQ ID NO: 2977518 - protein, 36 aa, Entamoeba invadens
YNQNCCDCGSAVIKCVDLDFGCFLCVKCMKDHKLFG

SEQ ID NO: 2977519 - protein, 18 aa, Entamoeba invadens
YNQSLCNLSTIIKKGLDF

SEQ ID NO: 2977520 - protein, 26 aa, Entamoeba invadens
YNRDTIGYFCCHILNSPSFNGDEAES

SEQ ID NO: 2977521 - protein, 28 aa, Entamoeba invadens
YNRHNYPFCLPYPLKLPKRNFTKGFEKM

SEQ ID NO: 2977522 - protein, 18 aa, Entamoeba invadens
YNRKAFSHYCMKEYHKAM

SEQ ID NO: 2977523 - protein, 17 aa, Entamoeba invadens
YNRLLRIYQALVNLFGE

SEQ ID NO: 2977524 - protein, 17 aa, Entamoeba invadens
YNSCPFSVFTKEDRIAF

SEQ ID NO: 2977525 - protein, 17 aa, Entamoeba invadens
YNSCPLSIFTKEDRIAF

SEQ ID NO: 2977526 - protein, 17 aa, Entamoeba invadens
YNSLRIVVYRNLLDFVF

SEQ ID NO: 2977527 - protein, 30 aa, Entamoeba invadens
YNSNGSKIKKCFICGNYGHKTSMCPQREEH

SEQ ID NO: 2977528 - protein, 23 aa, Entamoeba invadens
YNSPCREVLDFVITRDNGKVGCG

SEQ ID NO: 2977529 - protein, 18 aa, Entamoeba invadens
YNSPVFPLFLNFVKDVKK

SEQ ID NO: 2977530 - protein, 43 aa, Entamoeba invadens
YNSTIYNEFIELFKTLPLCVLLSLSLGNFFLCHGGISPSLQFI

SEQ ID NO: 2977531 - protein, 17 aa, Entamoeba invadens
  misc_feature (9)..(10): Xaa can be any naturally occurring amino acid
YNSTYIWYXXSWGYLSS

SEQ ID NO: 2977532 - protein, 28 aa, Entamoeba invadens
YNSYSEPSFQYWIYFLRMNISVLNNLRK

SEQ ID NO: 2977533 - protein, 18 aa, Entamoeba invadens
YNTIIDWAIENGKFVKIY

SEQ ID NO: 2977534 - protein, 17 aa, Entamoeba invadens
YNTIPFAVCLPLMRLEG

SEQ ID NO: 2977535 - protein, 25 aa, Entamoeba invadens
YNTMAKDLVKYCCHQFGGYTAQKVA

SEQ ID NO: 2977536 - protein, 21 aa, Entamoeba invadens
YNTRVDFKFTPNIFLQLLNEK

SEQ ID NO: 2977537 - protein, 23 aa, Entamoeba invadens
YNTSRPFGVICLFNEQKQCKVIS

SEQ ID NO: 2977538 - protein, 22 aa, Entamoeba invadens
YNTTRACLVFNISEISLQDDVC

SEQ ID NO: 2977539 - protein, 25 aa, Entamoeba invadens
YNTVSRKTLSWAFWSMKTGKYRDHV

SEQ ID NO: 2977540 - protein, 25 aa, Entamoeba invadens
YNVLDRFSDGMWKLLNEQKKTLQKI

SEQ ID NO: 2977541 - protein, 32 aa, Entamoeba invadens
YNVNVCPFGADFNCGIYTKYIFKTEKKDYYLG

SEQ ID NO: 2977542 - protein, 17 aa, Entamoeba invadens
YNVTDVVRCCHPSYDKK

SEQ ID NO: 2977543 - protein, 18 aa, Entamoeba invadens
YNVVLFRLYVLRSDNLIF

SEQ ID NO: 2977544 - protein, 33 aa, Entamoeba invadens
YNYECNKCDEEGRLTKCYGIGGVKEYTDFTMRG

SEQ ID NO: 2977545 - protein, 19 aa, Entamoeba invadens
YNYFGWRDSVQIVDYNNFK

SEQ ID NO: 2977546 - protein, 22 aa, Entamoeba invadens
YNYHLCQDGWKSYMLNTQDAID

SEQ ID NO: 2977547 - protein, 28 aa, Entamoeba invadens
YNYTSLKDFCMRVPFRISSKDKERKDEF

SEQ ID NO: 2977548 - protein, 28 aa, Entamoeba invadens
YPACSTIACRVRFCISAAHTDADMEKAF

SEQ ID NO: 2977549 - protein, 17 aa, Entamoeba invadens
YPAIYVFTHDSIGVGED

SEQ ID NO: 2977550 - protein, 21 aa, Entamoeba invadens
YPCDIYSFGMTMYFTFTKIDP

SEQ ID NO: 2977551 - protein, 26 aa, Entamoeba invadens
YPCYTSITLPPGFSFGRYQNRATVID

SEQ ID NO: 2977552 - protein, 17 aa, Entamoeba invadens
YPDCEYVSVVMSSCLEC

SEQ ID NO: 2977553 - protein, 17 aa, Entamoeba invadens
YPDCISCDIKCSLCNNG

SEQ ID NO: 2977554 - protein, 18 aa, Entamoeba invadens
YPDFETAPKVVKKTFQIP

SEQ ID NO: 2977555 - protein, 21 aa, Entamoeba invadens
YPDFLKIYYATILNNIHPIMN

SEQ ID NO: 2977556 - protein, 21 aa, Entamoeba invadens
YPDQVCWHMVYWWMENNENAS

SEQ ID NO: 2977557 - protein, 26 aa, Entamoeba invadens
YPDTWRLRIGQFITFPNYQRKKLGRY

SEQ ID NO: 2977558 - protein, 19 aa, Entamoeba invadens
YPDTYCVIYEGIAMTITQT

SEQ ID NO: 2977559 - protein, 18 aa, Entamoeba invadens
YPDVCKILKGIVKGKETL

SEQ ID NO: 2977560 - protein, 17 aa, Entamoeba invadens
YPDYFGRSEIIGITNKM

SEQ ID NO: 2977561 - protein, 24 aa, Entamoeba invadens
YPEGLEMVAKYVFGNVLIAEDEET

SEQ ID NO: 2977562 - protein, 20 aa, Entamoeba invadens
YPEILERIGNNTIEPILREE

SEQ ID NO: 2977563 - protein, 17 aa, Entamoeba invadens
YPELEIVTVYFTTLAEV

SEQ ID NO: 2977564 - protein, 17 aa, Entamoeba invadens
YPELIPHVSTARSPIAC

SEQ ID NO: 2977565 - protein, 23 aa, Entamoeba invadens
YPELYRCSSELSIDENLYNYYGN

SEQ ID NO: 2977566 - protein, 26 aa, Entamoeba invadens
YPEQWKLKLYQSIERWYCAITQQMDN

SEQ ID NO: 2977567 - protein, 19 aa, Entamoeba invadens
YPETLSFRKGDEITVRTVN

SEQ ID NO: 2977568 - protein, 19 aa, Entamoeba invadens
YPFCRPTPLTLPKHNYNII

SEQ ID NO: 2977569 - protein, 25 aa, Entamoeba invadens
YPFEVAMIRSLHLCQIPSTPSNFFV

SEQ ID NO: 2977570 - protein, 17 aa, Entamoeba invadens
YPFPDHHNPTLIVLCHI

SEQ ID NO: 2977571 - protein, 26 aa, Entamoeba invadens
YPFSRIVMFLLECFRSNMEKPTVFHV

SEQ ID NO: 2977572 - protein, 27 aa, Entamoeba invadens
YPFTTFKFPWKIAEFVTAGKRLERREN

SEQ ID NO: 2977573 - protein, 19 aa, Entamoeba invadens
YPFYSYKMSLIMYQNGIIP

SEQ ID NO: 2977574 - protein, 28 aa, Entamoeba invadens
YPGNIRVSPQTALRFMRIFDTQRTGHLG

SEQ ID NO: 2977575 - protein, 17 aa, Entamoeba invadens
YPGQKVCQMVFMRMEGN

SEQ ID NO: 2977576 - protein, 21 aa, Entamoeba invadens
YPGTTAEFQVMDFDKKSKDDP

SEQ ID NO: 2977577 - protein, 20 aa, Entamoeba invadens
YPHKILPKRSTAFTYKCSMC

SEQ ID NO: 2977578 - protein, 18 aa, Entamoeba invadens
YPHLLRFGQGLLARNGIL

SEQ ID NO: 2977579 - protein, 24 aa, Entamoeba invadens
YPHYFRLAFYILRNTPQMKENAFK

SEQ ID NO: 2977580 - protein, 18 aa, Entamoeba invadens
YPIATFMCGHSFHMKEGC

SEQ ID NO: 2977581 - protein, 23 aa, Entamoeba invadens
YPIDLKKKFLFFATGSDRSPPGG

SEQ ID NO: 2977582 - protein, 18 aa, Entamoeba invadens
YPIVVRLIVCGMRQLSGE

SEQ ID NO: 2977583 - protein, 19 aa, Entamoeba invadens
YPKADAAFHHLLKYSEQGA

SEQ ID NO: 2977584 - protein, 22 aa, Entamoeba invadens
YPKEKFNFPWKIAEFVNEGNRL

SEQ ID NO: 2977585 - protein, 23 aa, Entamoeba invadens
YPKEMFKFPWNIAEMVTSGKRLE

SEQ ID NO: 2977586 - protein, 18 aa, Entamoeba invadens
YPKLKCSLDGKRVAVSAV

SEQ ID NO: 2977587 - protein, 18 aa, Entamoeba invadens
YPKLSDHAIEYLCDEMLR

SEQ ID NO: 2977588 - protein, 22 aa, Entamoeba invadens
YPKNLVKYLIGNKVDLCSEQTK

SEQ ID NO: 2977589 - protein, 19 aa, Entamoeba invadens
YPKRMYFTGEFVLDNKKVP

SEQ ID NO: 2977590 - protein, 23 aa, Entamoeba invadens
YPKSAKECLIEFNNFNVCPFSVF

SEQ ID NO: 2977591 - protein, 33 aa, Entamoeba invadens
YPLACAVSKSGWRFPLPIYRAIEYLMNTKGYLT

SEQ ID NO: 2977592 - protein, 32 aa, Entamoeba invadens
YPLACAVSKSGWRFPLPVYRSIEYLTTTQGYL

SEQ ID NO: 2977593 - protein, 26 aa, Entamoeba invadens
YPLEVYLDFIYCGFITIKMPFDEFIK

SEQ ID NO: 2977594 - protein, 25 aa, Entamoeba invadens
YPLFQSRYNIPIAISNLKEFCTYIE

SEQ ID NO: 2977595 - protein, 24 aa, Entamoeba invadens
YPLGNRKLKTNFVEILKRVDESKS

SEQ ID NO: 2977596 - protein, 18 aa, Entamoeba invadens
YPLIEEFKDYAFYCEADD

SEQ ID NO: 2977597 - protein, 18 aa, Entamoeba invadens
YPLIPNAMYSMISVRGKQ

SEQ ID NO: 2977598 - protein, 17 aa, Entamoeba invadens
YPLKELYSLFFKSGVAS

SEQ ID NO: 2977599 - protein, 20 aa, Entamoeba invadens
YPLLPGKRGSLSLHDMNTPC

SEQ ID NO: 2977600 - protein, 32 aa, Entamoeba invadens
YPLRLAILKSGWRYPIPIFRTIQYLKYNKAHL

SEQ ID NO: 2977601 - protein, 19 aa, Entamoeba invadens
YPLRTFLKHNIKVTFNTDN

SEQ ID NO: 2977602 - protein, 19 aa, Entamoeba invadens
YPLTKCDWVALPDFECGAM

SEQ ID NO: 2977603 - protein, 20 aa, Entamoeba invadens
YPLTSSHSFVLIPHTAARLG

SEQ ID NO: 2977604 - protein, 18 aa, Entamoeba invadens
YPLVARILQRVCSMLNDP

SEQ ID NO: 2977605 - protein, 17 aa, Entamoeba invadens
YPLWMLVLLESVGKLGK

SEQ ID NO: 2977606 - protein, 21 aa, Entamoeba invadens
YPMQYWPYMYMQGNQGKQKAT

SEQ ID NO: 2977607 - protein, 19 aa, Entamoeba invadens
YPNCRCVSFVIDLADSERT

SEQ ID NO: 2977608 - protein, 21 aa, Entamoeba invadens
YPNLLEGWVGYLYGRLKDESA

SEQ ID NO: 2977609 - protein, 17 aa, Entamoeba invadens
YPNNLVSLKCRHSQLPK

SEQ ID NO: 2977610 - protein, 22 aa, Entamoeba invadens
YPNPFLRKLTRDVWKTNPDFVF

SEQ ID NO: 2977611 - protein, 21 aa, Entamoeba invadens
YPNRIRLFLNEYVMIPILISA

SEQ ID NO: 2977612 - protein, 17 aa, Entamoeba invadens
YPNRYGITQEKREEIKK

SEQ ID NO: 2977613 - protein, 17 aa, Entamoeba invadens
YPNWEYTNTSTITDRIY

SEQ ID NO: 2977614 - protein, 18 aa, Entamoeba invadens
YPPEFAAGHVKDAINVWN

SEQ ID NO: 2977615 - protein, 18 aa, Entamoeba invadens
YPPIRPLTRHPASNPRTT

SEQ ID NO: 2977616 - protein, 19 aa, Entamoeba invadens
YPPNPSRVFIRNGNIITKS

SEQ ID NO: 2977617 - protein, 20 aa, Entamoeba invadens
YPPQRGGFPSGGYQQPVQPQ

SEQ ID NO: 2977618 - protein, 24 aa, Entamoeba invadens
YPQKEFPFPWVIAQFVTSGKRLPH

SEQ ID NO: 2977619 - protein, 19 aa, Entamoeba invadens
YPQKLFLAMIHTMPNKIQN

SEQ ID NO: 2977620 - protein, 17 aa, Entamoeba invadens
YPQQVIKMFTSIDFYTQ

SEQ ID NO: 2977621 - protein, 21 aa, Entamoeba invadens
YPQYRIVVVDKLDYCASLNNL

SEQ ID NO: 2977622 - protein, 26 aa, Entamoeba invadens
YPRRVEKYFGALVMKNAKKIYLKKIE

SEQ ID NO: 2977623 - protein, 24 aa, Entamoeba invadens
YPSAMKRLYLVEGLPMVMTDNQLN

SEQ ID NO: 2977624 - protein, 20 aa, Entamoeba invadens
YPSCGVCGSGYVCTTSGRCQ

SEQ ID NO: 2977625 - protein, 17 aa, Entamoeba invadens
YPSKIIGFVRNGNRLPI

SEQ ID NO: 2977626 - protein, 17 aa, Entamoeba invadens
YPSLKGSVIPTPKSQSQ

SEQ ID NO: 2977627 - protein, 17 aa, Entamoeba invadens
YPSSYFIAGYRFKCKIG

SEQ ID NO: 2977628 - protein, 23 aa, Entamoeba invadens
YPSTRIAIFSTFFFEKIRRAFLD

SEQ ID NO: 2977629 - protein, 25 aa, Entamoeba invadens
YPSTYMSLHLPRYVVVVPSLNTMFD

SEQ ID NO: 2977630 - protein, 19 aa, Entamoeba invadens
YPSYNCALLPPGWSMGMDY

SEQ ID NO: 2977631 - protein, 24 aa, Entamoeba invadens
YPTIPSGEYMYLLAQINFSEMPKL

SEQ ID NO: 2977632 - protein, 19 aa, Entamoeba invadens
YPTQIEFVGNGIDMSQMQL

SEQ ID NO: 2977633 - protein, 17 aa, Entamoeba invadens
YPVEMILCVLFGVDMFD

SEQ ID NO: 2977634 - protein, 17 aa, Entamoeba invadens
YPVIPIIYKKFQDGESY

SEQ ID NO: 2977635 - protein, 17 aa, Entamoeba invadens
YPVSLINIFKTGGFAKM

SEQ ID NO: 2977636 - protein, 18 aa, Entamoeba invadens
YPVVKCVLQCPVSDRDFG

SEQ ID NO: 2977637 - protein, 22 aa, Entamoeba invadens
YPWQKATVIIKIFELHEEYISY

SEQ ID NO: 2977638 - protein, 23 aa, Entamoeba invadens
YPYKLSSRFYVVAALYHSPTSDG

SEQ ID NO: 2977639 - protein, 19 aa, Entamoeba invadens
YPYTFLANSTMTFKKELKN

SEQ ID NO: 2977640 - protein, 20 aa, Entamoeba invadens
YQAFFKCPLLKEVVIPQTVL

SEQ ID NO: 2977641 - protein, 20 aa, Entamoeba invadens
YQCKEPVSLPSRPSAMDRLR

SEQ ID NO: 2977642 - protein, 17 aa, Entamoeba invadens
YQDILCLGEMDRVIQRM

SEQ ID NO: 2977643 - protein, 25 aa, Entamoeba invadens
YQDIPQLLLKVSLKLDEVNKIEKTT

SEQ ID NO: 2977644 - protein, 26 aa, Entamoeba invadens
YQDIPQLLLKVSLKLDEVNKIEKTTA

SEQ ID NO: 2977645 - protein, 24 aa, Entamoeba invadens
YQDPCTELPSIPSINTKAKPPKKK

SEQ ID NO: 2977646 - protein, 24 aa, Entamoeba invadens
YQDRRIVLEIKRIMRETEAVDASL

SEQ ID NO: 2977647 - protein, 20 aa, Entamoeba invadens
YQEFLEGCCGVLEEHTGELS

SEQ ID NO: 2977648 - protein, 23 aa, Entamoeba invadens
YQENSFDRYNEWVVKYAKGQITK

SEQ ID NO: 2977649 - protein, 21 aa, Entamoeba invadens
YQFADLFWGHFSGSWRKFVIC

SEQ ID NO: 2977650 - protein, 20 aa, Entamoeba invadens
YQFFGCKKFAVLADVLCGLC

SEQ ID NO: 2977651 - protein, 31 aa, Entamoeba invadens
YQFGEFEFAHFFGAEFGCTFFYNTNKSNTHY

SEQ ID NO: 2977652 - protein, 36 aa, Entamoeba invadens
YQFICVSKAYGKECNKHFPSRIELIAQYDDTFLRQR

SEQ ID NO: 2977653 - protein, 24 aa, Entamoeba invadens
YQFYCPDFAKASPRKHAVMFMDVC

SEQ ID NO: 2977654 - protein, 17 aa, Entamoeba invadens
YQGTSFADYSAFAAKKS

SEQ ID NO: 2977655 - protein, 18 aa, Entamoeba invadens
YQHGDKWAKGEWKLTELK

SEQ ID NO: 2977656 - protein, 40 aa, Entamoeba invadens
YQHKLGVSWKSEFISLYIRRRCYICGGVKNYNAKTIFTTE

SEQ ID NO: 2977657 - protein, 28 aa, Entamoeba invadens
YQHNALYWKVWLYRSETKRVYKVLSAFK

SEQ ID NO: 2977658 - protein, 17 aa, Entamoeba invadens
YQIEDRLGCGMFGQVFK

SEQ ID NO: 2977659 - protein, 35 aa, Entamoeba invadens
YQIGICIEVFKSLKLWENTVCELFNIGKHTLSKEK

SEQ ID NO: 2977660 - protein, 18 aa, Entamoeba invadens
YQIGKGSLFVKIGEIEKT

SEQ ID NO: 2977661 - protein, 25 aa, Entamoeba invadens
YQIGKTGIFPDWLEVFPEKLEIEKT

SEQ ID NO: 2977662 - protein, 25 aa, Entamoeba invadens
YQILDDVFFQFPLDETRCLQCIQYI

SEQ ID NO: 2977663 - protein, 19 aa, Entamoeba invadens
YQIMMFNFSQYFGEKNFDE

SEQ ID NO: 2977664 - protein, 22 aa, Entamoeba invadens
YQIRKMVGFALMLTNMRYSKEM

SEQ ID NO: 2977665 - protein, 17 aa, Entamoeba invadens
YQIVIPLLLKYNTNNAW

SEQ ID NO: 2977666 - protein, 19 aa, Entamoeba invadens
YQKAMLCAENAGRNYVTNG

SEQ ID NO: 2977667 - protein, 28 aa, Entamoeba invadens
YQKDDVRFKFAWGIADFITSGKRLENIT

SEQ ID NO: 2977668 - protein, 25 aa, Entamoeba invadens
YQKDGILLVCFKKKYVPCHCILFSD

SEQ ID NO: 2977669 - protein, 25 aa, Entamoeba invadens
YQKLVECPMVLPYLMHLLTHCLTIQ

SEQ ID NO: 2977670 - protein, 20 aa, Entamoeba invadens
YQKYCARKIINPHTQPTTFL

SEQ ID NO: 2977671 - protein, 22 aa, Entamoeba invadens
YQLANAICYLHSLTPPIVHRDI

SEQ ID NO: 2977672 - protein, 17 aa, Entamoeba invadens
YQLDRPKVFPSLNYFGA

SEQ ID NO: 2977673 - protein, 28 aa, Entamoeba invadens
YQLDRPKVFPSLNYFGAAVPICKYTEHL

SEQ ID NO: 2977674 - protein, 27 aa, Entamoeba invadens
YQLDRPKVFPSLNYFGASVPICKYTEH

SEQ ID NO: 2977675 - protein, 22 aa, Entamoeba invadens
YQLIKRNVVNKIKMLQNSHNIC

SEQ ID NO: 2977676 - protein, 26 aa, Entamoeba invadens
YQLKYYYYHNMSWPTLTFLAENAEGK

SEQ ID NO: 2977677 - protein, 17 aa, Entamoeba invadens
YQLNLIIYDSVYRTDNI

SEQ ID NO: 2977678 - protein, 18 aa, Entamoeba invadens
YQLPEFTFVGSLTNVVDF

SEQ ID NO: 2977679 - protein, 36 aa, Entamoeba invadens
YQLPIVISRLALFGIPIPDILNWAGIDVTTQQGEMK

SEQ ID NO: 2977680 - protein, 19 aa, Entamoeba invadens
YQLVVVQAIKLCNKKFQSE

SEQ ID NO: 2977681 - protein, 19 aa, Entamoeba invadens
YQMFGCAKFGVLADVLCGL

SEQ ID NO: 2977682 - protein, 23 aa, Entamoeba invadens
YQMGNAFPLNYMTPLFQMFGAQM

SEQ ID NO: 2977683 - protein, 18 aa, Entamoeba invadens
YQMIYDWVVRGQFTDPHH

SEQ ID NO: 2977684 - protein, 24 aa, Entamoeba invadens
YQMLTDGFLKILFAVEPTFNLGSP

SEQ ID NO: 2977685 - protein, 19 aa, Entamoeba invadens
YQNAVTCIFLYDVSNKDSF

SEQ ID NO: 2977686 - protein, 25 aa, Entamoeba invadens
YQNKWRTQPCLFYQRYGFCRKGDEC

SEQ ID NO: 2977687 - protein, 17 aa, Entamoeba invadens
YQNLLKCFVLNELHKRP

SEQ ID NO: 2977688 - protein, 22 aa, Entamoeba invadens
YQNQSICFVELLYTNYNIVDTK

SEQ ID NO: 2977689 - protein, 23 aa, Entamoeba invadens
YQNSWVFGVGYGYHIRSEGKSYI

SEQ ID NO: 2977690 - protein, 18 aa, Entamoeba invadens
YQNVSCVIEQTALDNIKK

SEQ ID NO: 2977691 - protein, 32 aa, Entamoeba invadens
YQPFANPGLFKWKYMTHWTIDYGIKEYGYYGD

SEQ ID NO: 2977692 - protein, 22 aa, Entamoeba invadens
YQPFRPTVCSKYNLKMFSIGQP

SEQ ID NO: 2977693 - protein, 17 aa, Entamoeba invadens
YQPMMFPQQFPPFHQQC

SEQ ID NO: 2977694 - protein, 26 aa, Entamoeba invadens
YQPNIRRKFNLEFEYLYASCIVKALN

SEQ ID NO: 2977695 - protein, 18 aa, Entamoeba invadens
YQPSLFGFKMYTGEISKL

SEQ ID NO: 2977696 - protein, 22 aa, Entamoeba invadens
YQQPVCPFVTPPLLPLKPSQPV

SEQ ID NO: 2977697 - protein, 17 aa, Entamoeba invadens
YQQQCPQNVYPQQMAGS

SEQ ID NO: 2977698 - protein, 20 aa, Entamoeba invadens
YQQTCDILLFSVLILLATNG

SEQ ID NO: 2977699 - protein, 19 aa, Entamoeba invadens
YQRCFVYRKADVVIKKYRN

SEQ ID NO: 2977700 - protein, 17 aa, Entamoeba invadens
YQRFQLRTLDILAGCLV

SEQ ID NO: 2977701 - protein, 27 aa, Entamoeba invadens
YQRTLGLFTRIAGKWIALSEFRTAFLA

SEQ ID NO: 2977702 - protein, 20 aa, Entamoeba invadens
YQSFGLPLIITRGNNVFGPH

SEQ ID NO: 2977703 - protein, 20 aa, Entamoeba invadens
YQSFGLPLIITRGNNVYGPH

SEQ ID NO: 2977704 - protein, 18 aa, Entamoeba invadens
YQSYMSFYNTRDVSARSK

SEQ ID NO: 2977705 - protein, 18 aa, Entamoeba invadens
YQTICLCWKTNPKERLTA

SEQ ID NO: 2977706 - protein, 17 aa, Entamoeba invadens
YQTILLRKIVTEIPEFF

SEQ ID NO: 2977707 - protein, 25 aa, Entamoeba invadens
YQTYCCSICGRPLTVFTTQDGQIYF

SEQ ID NO: 2977708 - protein, 29 aa, Entamoeba invadens
YQVIFRFLFDLEYHRYLLARTMKKMTNTS

SEQ ID NO: 2977709 - protein, 22 aa, Entamoeba invadens
YQVTSLPAFVFFQDQKVAKKAP

SEQ ID NO: 2977710 - protein, 22 aa, Entamoeba invadens
YQVTSLPTFVLFQDQKVVKKAP

SEQ ID NO: 2977711 - protein, 18 aa, Entamoeba invadens
YQYAPIFCQYDFKNQNES

SEQ ID NO: 2977712 - protein, 27 aa, Entamoeba invadens
YRADIKAHQNFPCIPFFGVYLQDLTFI

SEQ ID NO: 2977713 - protein, 18 aa, Entamoeba invadens
YRAGLKYFVEHTDDFAIE

SEQ ID NO: 2977714 - protein, 20 aa, Entamoeba invadens
YRAPEMINLYDYKPIGRKAD

SEQ ID NO: 2977715 - protein, 21 aa, Entamoeba invadens
YRATIGVDFAVKFEKVDDKEV

SEQ ID NO: 2977716 - protein, 18 aa, Entamoeba invadens
YRCEIGMGITGYAAAIYL

SEQ ID NO: 2977717 - protein, 17 aa, Entamoeba invadens
YRCPYRAVREFCASIIM

SEQ ID NO: 2977718 - protein, 26 aa, Entamoeba invadens
YRDKVCLNDGCLECIGNFNFSELTTL

SEQ ID NO: 2977719 - protein, 17 aa, Entamoeba invadens
YRDSFILGLFDALSGHV

SEQ ID NO: 2977720 - protein, 43 aa, Entamoeba invadens
YRDVEWIKESILSQMIPQLRIKRFKTKFQFDGEEDPFPMEYTT

SEQ ID NO: 2977721 - protein, 19 aa, Entamoeba invadens
YRDYDMGRYMPPRDQRIPF

SEQ ID NO: 2977722 - protein, 18 aa, Entamoeba invadens
YREDKCVLSNEYLCLHCS

SEQ ID NO: 2977723 - protein, 18 aa, Entamoeba invadens
YREEWKGDWQSRITVDKI

SEQ ID NO: 2977724 - protein, 21 aa, Entamoeba invadens
YREKLDELLKCIDRSVKEYST

SEQ ID NO: 2977725 - protein, 17 aa, Entamoeba invadens
YREVKWAVPGSSVIGSF

SEQ ID NO: 2977726 - protein, 20 aa, Entamoeba invadens
YRFAPNVFAPDMKEMFQHVI

SEQ ID NO: 2977727 - protein, 17 aa, Entamoeba invadens
YRFYLRELPLMFRKIYA

SEQ ID NO: 2977728 - protein, 20 aa, Entamoeba invadens
YRGANATIFFYSVNKKESFQ

SEQ ID NO: 2977729 - protein, 17 aa, Entamoeba invadens
YRGIFSQKGMMWLDQIY

SEQ ID NO: 2977730 - protein, 23 aa, Entamoeba invadens
YRGISFEVIEDLLIELGGGENSK

SEQ ID NO: 2977731 - protein, 19 aa, Entamoeba invadens
YRGIYPFTVVQFDYFFLML

SEQ ID NO: 2977732 - protein, 20 aa, Entamoeba invadens
YRGSKCVIIVFDLTSTESYL

SEQ ID NO: 2977733 - protein, 26 aa, Entamoeba invadens
YRGTMFRAIVELELKRRDGVNEALYS

SEQ ID NO: 2977734 - protein, 18 aa, Entamoeba invadens
YRGYKLEDSSVFSTIRYQ

SEQ ID NO: 2977735 - protein, 26 aa, Entamoeba invadens
YRIEMFYKAGGGWGPLQNGMLVDGSK

SEQ ID NO: 2977736 - protein, 23 aa, Entamoeba invadens
YRIEVPESVFGHIEFIKVVNMND

SEQ ID NO: 2977737 - protein, 25 aa, Entamoeba invadens
YRIINCTTDGASVCSGLDGGLSVEM

SEQ ID NO: 2977738 - protein, 19 aa, Entamoeba invadens
YRIIVWFYVGFEIVDRNKS

SEQ ID NO: 2977739 - protein, 22 aa, Entamoeba invadens
YRIKCEKGKHLLNIVQSDLMSI

SEQ ID NO: 2977740 - protein, 18 aa, Entamoeba invadens
YRIPRSVGNDVFTLRHIL

SEQ ID NO: 2977741 - protein, 17 aa, Entamoeba invadens
YRISDLLAENQNLKKQL

SEQ ID NO: 2977742 - protein, 21 aa, Entamoeba invadens
YRISEELALTIVDRLIAVTEE

SEQ ID NO: 2977743 - protein, 19 aa, Entamoeba invadens
YRITQLVKLNIKYMEVAYD

SEQ ID NO: 2977744 - protein, 25 aa, Entamoeba invadens
YRKFIFPFSYLTWLNEDDFKIEEST

SEQ ID NO: 2977745 - protein, 26 aa, Entamoeba invadens
YRKGYSSPCLWILTKDNILFFKNEQS

SEQ ID NO: 2977746 - protein, 21 aa, Entamoeba invadens
YRKKIIDRRIELLNTIENYKS

SEQ ID NO: 2977747 - protein, 22 aa, Entamoeba invadens
YRKKSFQRKALGDTLEETVLNV

SEQ ID NO: 2977748 - protein, 20 aa, Entamoeba invadens
YRKLLLRNSLDKLLCDSDFI

SEQ ID NO: 2977749 - protein, 24 aa, Entamoeba invadens
YRKLTWKAGHIWVGNVTIQRPRTL

SEQ ID NO: 2977750 - protein, 19 aa, Entamoeba invadens
YRKMCSFYMRTSREENAMV

SEQ ID NO: 2977751 - protein, 21 aa, Entamoeba invadens
YRKSTLLKHRTFYKTFIQLVK

SEQ ID NO: 2977752 - protein, 20 aa, Entamoeba invadens
YRKVKEMKKTMTVEEYEKIK

SEQ ID NO: 2977753 - protein, 25 aa, Entamoeba invadens
YRLDEACLVREVFEYENVDEIICVD

SEQ ID NO: 2977754 - protein, 22 aa, Entamoeba invadens
YRLDVLSGKSTVVFGYQSKILG

SEQ ID NO: 2977755 - protein, 25 aa, Entamoeba invadens
YRLINKRALEAIRCLKVNPRSIYLG

SEQ ID NO: 2977756 - protein, 17 aa, Entamoeba invadens
YRLKGSNKHLAMAYYTL

SEQ ID NO: 2977757 - protein, 21 aa, Entamoeba invadens
YRLLFGCEVLCGVDIEHSQIK

SEQ ID NO: 2977758 - protein, 20 aa, Entamoeba invadens
YRLNKFIVTLFPEYKDVFSG

SEQ ID NO: 2977759 - protein, 17 aa, Entamoeba invadens
YRLPQSCVLQIDALLIK

SEQ ID NO: 2977760 - protein, 22 aa, Entamoeba invadens
YRLSELYPFNRIHKVFPKIETF

SEQ ID NO: 2977761 - protein, 21 aa, Entamoeba invadens
YRLSELYPFNRIINDNIKKTD

SEQ ID NO: 2977762 - protein, 17 aa, Entamoeba invadens
YRMMPKIEVTAVGKMAK

SEQ ID NO: 2977763 - protein, 33 aa, Entamoeba invadens
YRMNNHIILEFSLRLCADMLYLVVLTPEKYTEI

SEQ ID NO: 2977764 - protein, 20 aa, Entamoeba invadens
YRMNVVKAEMKVSGFNDDIS

SEQ ID NO: 2977765 - protein, 17 aa, Entamoeba invadens
YRMRETIKMKQQQRESI

SEQ ID NO: 2977766 - protein, 18 aa, Entamoeba invadens
YRNCLIPLVVLQLRKGIY

SEQ ID NO: 2977767 - protein, 26 aa, Entamoeba invadens
YRNDKICISDGFLVVYSITDSSSFDN

SEQ ID NO: 2977768 - protein, 17 aa, Entamoeba invadens
YRNGRFLPFLMAGNPIN

SEQ ID NO: 2977769 - protein, 17 aa, Entamoeba invadens
YRNIKHFITLKKELFSS

SEQ ID NO: 2977770 - protein, 25 aa, Entamoeba invadens
YRNRMPRDMFKFISSHIETYDVGQP

SEQ ID NO: 2977771 - protein, 25 aa, Entamoeba invadens
YRNSMPRDMFKFISSHIETYDVDQP

SEQ ID NO: 2977772 - protein, 24 aa, Entamoeba invadens
YRNSMPRDMFKFISSHIETYDVGQ

SEQ ID NO: 2977773 - protein, 25 aa, Entamoeba invadens
YRNSMPRDMFKFISSHIETYDVNQP

SEQ ID NO: 2977774 - protein, 24 aa, Entamoeba invadens
YRNSMPRDMFKFISSHIKTYDVGQ

SEQ ID NO: 2977775 - protein, 20 aa, Entamoeba invadens
YRNSQVLPFLLRQLQTQNGE

SEQ ID NO: 2977776 - protein, 30 aa, Entamoeba invadens
YRNVLYEVQFSFGLTKSGFSMWCQNVYYPY

SEQ ID NO: 2977777 - protein, 21 aa, Entamoeba invadens
YRNVMPIYFRDCDGAIVVFDL

SEQ ID NO: 2977778 - protein, 17 aa, Entamoeba invadens
YRNYFGIPLKKLIDDEN

SEQ ID NO: 2977779 - protein, 17 aa, Entamoeba invadens
YRPKASIFQIDTTKETQ

SEQ ID NO: 2977780 - protein, 21 aa, Entamoeba invadens
YRPKIPSDVYILFSHGNGLDM

SEQ ID NO: 2977781 - protein, 23 aa, Entamoeba invadens
YRPKIPSDVYILFSHGNGLDMGQ

SEQ ID NO: 2977782 - protein, 20 aa, Entamoeba invadens
YRPLTALPTQIDPILEIFLP

SEQ ID NO: 2977783 - protein, 17 aa, Entamoeba invadens
YRPNMLHNFSLYLDGKW

SEQ ID NO: 2977784 - protein, 23 aa, Entamoeba invadens
YRPPELILGNGFYGTEIDMWSVG

SEQ ID NO: 2977785 - protein, 20 aa, Entamoeba invadens
YRPVLQYNPHLFLMGVNQPG

SEQ ID NO: 2977786 - protein, 17 aa, Entamoeba invadens
YRPVPLQQTFFGVTEKK

SEQ ID NO: 2977787 - protein, 24 aa, Entamoeba invadens
YRQEVLKQLLIFSAAKNPLLQILR

SEQ ID NO: 2977788 - protein, 19 aa, Entamoeba invadens
YRQIFEMLHFNPVPINNKT

SEQ ID NO: 2977789 - protein, 20 aa, Entamoeba invadens
YRQVWKRKGLSRNKRDLIYT

SEQ ID NO: 2977790 - protein, 30 aa, Entamoeba invadens
YRRFCTRRLKRLRQKVGLVSHWKKTTSTTT

SEQ ID NO: 2977791 - protein, 17 aa, Entamoeba invadens
YRRGTIIAKSTEPDLTR

SEQ ID NO: 2977792 - protein, 18 aa, Entamoeba invadens
YRRRILKSKPSFNTSDEY

SEQ ID NO: 2977793 - protein, 25 aa, Entamoeba invadens
YRRRPKDLVLLAWYYAPNLVVGYYN

SEQ ID NO: 2977794 - protein, 17 aa, Entamoeba invadens
YRRTLVMVFATAAYQTF

SEQ ID NO: 2977795 - protein, 18 aa, Entamoeba invadens
YRRYMKNTDIYVHADIHG

SEQ ID NO: 2977796 - protein, 17 aa, Entamoeba invadens
YRSELLISKRRKHNSFY

SEQ ID NO: 2977797 - protein, 23 aa, Entamoeba invadens
YRSISEMYYRGSAGALVVFDVTD

SEQ ID NO: 2977798 - protein, 23 aa, Entamoeba invadens
YRSKGRFPVLTWFNDKMGSALLR

SEQ ID NO: 2977799 - protein, 19 aa, Entamoeba invadens
YRSLIPNYIRGSSVVLIVY

SEQ ID NO: 2977800 - protein, 20 aa, Entamoeba invadens
YRSLIPSYIRDSAAAVVVYD

SEQ ID NO: 2977801 - protein, 35 aa, Entamoeba invadens
YRSLLKCLSYSMGEAFIPSFEGILLPMLQAVLTTN

SEQ ID NO: 2977802 - protein, 18 aa, Entamoeba invadens
YRSLLPMYYRGANATIFF

SEQ ID NO: 2977803 - protein, 21 aa, Entamoeba invadens
YRTAFPGMVHFVVIDYTKGWT

SEQ ID NO: 2977804 - protein, 19 aa, Entamoeba invadens
YRTAFSVCKKWLENELGKS

SEQ ID NO: 2977805 - protein, 18 aa, Entamoeba invadens
YRTAIFADEHLFARVEKV

SEQ ID NO: 2977806 - protein, 20 aa, Entamoeba invadens
YRTATVGGWPSKFTPERIDA

SEQ ID NO: 2977807 - protein, 23 aa, Entamoeba invadens
YRTEKDDALVLIRRGVVERITRF

SEQ ID NO: 2977808 - protein, 30 aa, Entamoeba invadens
YRTKPCKYFFTTGTCRKGDNCNYSHDVSVC

SEQ ID NO: 2977809 - protein, 22 aa, Entamoeba invadens
YRTKRFPPKHVPRSEDVKLLTV

SEQ ID NO: 2977810 - protein, 21 aa, Entamoeba invadens
YRTLDELIMRIPMKLSDNPLD

SEQ ID NO: 2977811 - protein, 27 aa, Entamoeba invadens
YRTLSHVELCYYLRELLKALDYTHSMG

SEQ ID NO: 2977812 - protein, 18 aa, Entamoeba invadens
YRTNLDYRIYKFLIKNYK

SEQ ID NO: 2977813 - protein, 19 aa, Entamoeba invadens
YRTSQEMELVRAIKENVCY

SEQ ID NO: 2977814 - protein, 19 aa, Entamoeba invadens
YRTTMFEHYFLSHFHSDHY

SEQ ID NO: 2977815 - protein, 24 aa, Entamoeba invadens
YRVIRECAPRAFIIGNIGAVQLTE

SEQ ID NO: 2977816 - protein, 17 aa, Entamoeba invadens
YRVLDVLRETCDIPVCY

SEQ ID NO: 2977817 - protein, 17 aa, Entamoeba invadens
YRVLDVLRETCDIPVWH

SEQ ID NO: 2977818 - protein, 19 aa, Entamoeba invadens
YRVLVCASTNVAVDRVLES

SEQ ID NO: 2977819 - protein, 18 aa, Entamoeba invadens
YRVRSVFGMYLVASSDGG

SEQ ID NO: 2977820 - protein, 19 aa, Entamoeba invadens
YRYLERTNCLAVLDDDLIT

SEQ ID NO: 2977821 - protein, 17 aa, Entamoeba invadens
YSAEFLKDPTIENKGDF

SEQ ID NO: 2977822 - protein, 17 aa, Entamoeba invadens
YSAKYFISPGVIRMTVD

SEQ ID NO: 2977823 - protein, 17 aa, Entamoeba invadens
YSALCKFEGSGVHNAVK

SEQ ID NO: 2977824 - protein, 20 aa, Entamoeba invadens
YSAQVDWWTFGILMYEILYG

SEQ ID NO: 2977825 - protein, 19 aa, Entamoeba invadens
YSASFIYQPFCPIQSTLNL

SEQ ID NO: 2977826 - protein, 23 aa, Entamoeba invadens
YSAYLKKYCVDLLNATSVSLLNF

SEQ ID NO: 2977827 - protein, 22 aa, Entamoeba invadens
YSCAGYCVATYILGIGDRHSDN

SEQ ID NO: 2977828 - protein, 18 aa, Entamoeba invadens
YSCFKNCHNLSKITIPLN

SEQ ID NO: 2977829 - protein, 20 aa, Entamoeba invadens
YSCFSECYMLADMKMEEIEI

SEQ ID NO: 2977830 - protein, 25 aa, Entamoeba invadens
YSCKYAPDCPGVYSVDIDLKNDTHD

SEQ ID NO: 2977831 - protein, 18 aa, Entamoeba invadens
YSCRRKTYRWNIRVLYDM

SEQ ID NO: 2977832 - protein, 20 aa, Entamoeba invadens
YSDAFYFYVYPEELHVLTYD

SEQ ID NO: 2977833 - protein, 23 aa, Entamoeba invadens
YSDKFLIKFCELKNIEIGREVTK

SEQ ID NO: 2977834 - protein, 25 aa, Entamoeba invadens
YSDKGDMLFGFGGGYDIGVAKKGVD

SEQ ID NO: 2977835 - protein, 17 aa, Entamoeba invadens
YSDKGYKNNLLISPTTI

SEQ ID NO: 2977836 - protein, 19 aa, Entamoeba invadens
YSDKLTLMMVLFKAMDSDG

SEQ ID NO: 2977837 - protein, 23 aa, Entamoeba invadens
YSDNYCEWIYRFLLIAQEPLDST

SEQ ID NO: 2977838 - protein, 17 aa, Entamoeba invadens
YSDPVLVSSEAKFPANV

SEQ ID NO: 2977839 - protein, 22 aa, Entamoeba invadens
YSDWWKNQQFYLRIGDSTRIVV

SEQ ID NO: 2977840 - protein, 23 aa, Entamoeba invadens
YSECMSNRNGFVLVISTKGFDTI

SEQ ID NO: 2977841 - protein, 21 aa, Entamoeba invadens
YSEDPFNWRVIRLRERSNEYS

SEQ ID NO: 2977842 - protein, 24 aa, Entamoeba invadens
YSEKDFYAVFGAVFKKNSKWSLIK

SEQ ID NO: 2977843 - protein, 18 aa, Entamoeba invadens
YSELKRNTFGKIEKLEKQ

SEQ ID NO: 2977844 - protein, 24 aa, Entamoeba invadens
YSEPAVKRYVPFALALTSIGKPKV

SEQ ID NO: 2977845 - protein, 24 aa, Entamoeba invadens
YSEQFSYPIAHIFFSIDHVSQTLL

SEQ ID NO: 2977846 - protein, 28 aa, Entamoeba invadens
YSERKGWDNWQFLLAGFVSLKGVFEMES

SEQ ID NO: 2977847 - protein, 37 aa, Entamoeba invadens
YSERMSPEVWYFVFNEIFFKILESIGYVHHTTHPLTE

SEQ ID NO: 2977848 - protein, 25 aa, Entamoeba invadens
YSESTLKYMYDPVLINGVLLGTLVI

SEQ ID NO: 2977849 - protein, 24 aa, Entamoeba invadens
YSFAITIYECFGWCEAYSKDAFKF

SEQ ID NO: 2977850 - protein, 17 aa, Entamoeba invadens
YSFAITMFECFGWCEAY

SEQ ID NO: 2977851 - protein, 44 aa, Entamoeba invadens
YSFAITMYEVFGWKEAYSIQTFKFPWKIAEFVTAGQHLENRDNI

SEQ ID NO: 2977852 - protein, 32 aa, Entamoeba invadens
YSFAITMYEVFGWKEAYSVQTFKFPWKIAEFV

SEQ ID NO: 2977853 - protein, 25 aa, Entamoeba invadens
YSFALTMYECFGWCFAYDNDDFTYP

SEQ ID NO: 2977854 - protein, 17 aa, Entamoeba invadens
YSFAVTMFECFKWGEIY

SEQ ID NO: 2977855 - protein, 23 aa, Entamoeba invadens
YSFECLSSLFIPSTVVLNGTNAV

SEQ ID NO: 2977856 - protein, 20 aa, Entamoeba invadens
YSFENCGFDQVFFMKNLKEF

SEQ ID NO: 2977857 - protein, 26 aa, Entamoeba invadens
YSFGVTMCQCFKWGDVYLNKHFKFPW

SEQ ID NO: 2977858 - protein, 18 aa, Entamoeba invadens
YSFRGCGNLSNITIHSKV

SEQ ID NO: 2977859 - protein, 17 aa, Entamoeba invadens
YSFVLTRPKKTVVKSVL

SEQ ID NO: 2977860 - protein, 19 aa, Entamoeba invadens
YSFYFDFVSNCLGIKALGQ

SEQ ID NO: 2977861 - protein, 20 aa, Entamoeba invadens
YSFYSSSLLFVYDWNTEKAD

SEQ ID NO: 2977862 - protein, 37 aa, Entamoeba invadens
YSGIKLDKYIPGFNDGKGFLALCHAYTKLTGENTFDY

SEQ ID NO: 2977863 - protein, 17 aa, Entamoeba invadens
YSGKTSLIQRFVTEEFV

SEQ ID NO: 2977864 - protein, 28 aa, Entamoeba invadens
YSGMEFNFSWKIAEFVIFGHRLDNNRNI

SEQ ID NO: 2977865 - protein, 17 aa, Entamoeba invadens
YSGSPRARKPAMYRGTP

SEQ ID NO: 2977866 - protein, 22 aa, Entamoeba invadens
YSGVGNCGGFGNTSSYSDNSYG

SEQ ID NO: 2977867 - protein, 29 aa, Entamoeba invadens
YSHDVSVCYLFTYGHFAIRTEFIRVEELR

SEQ ID NO: 2977868 - protein, 18 aa, Entamoeba invadens
YSHFRDSDVFVFVYSVHD

SEQ ID NO: 2977869 - protein, 25 aa, Entamoeba invadens
YSHTLKMIFTSGAFERDVYNPLTKI

SEQ ID NO: 2977870 - protein, 17 aa, Entamoeba invadens
YSHTRFVLNVGGDHSIG

SEQ ID NO: 2977871 - protein, 20 aa, Entamoeba invadens
YSHYQICEWHSKELKVAKIP

SEQ ID NO: 2977872 - protein, 23 aa, Entamoeba invadens
YSIASLPTFVFFQNQKVIIKRLA

SEQ ID NO: 2977873 - protein, 22 aa, Entamoeba invadens
YSIASLPTFVFFQNQNVVKKAP

SEQ ID NO: 2977874 - protein, 23 aa, Entamoeba invadens
YSIASLPTFVFFQNQNVVKKATG

SEQ ID NO: 2977875 - protein, 18 aa, Entamoeba invadens
YSIHLKGGLVLFITILIN

SEQ ID NO: 2977876 - protein, 17 aa, Entamoeba invadens
YSIHLLVKLGDALILRF

SEQ ID NO: 2977877 - protein, 17 aa, Entamoeba invadens
YSIHLLVKLGDAMILRF

SEQ ID NO: 2977878 - protein, 17 aa, Entamoeba invadens
YSIHLLVKLSDAMILRF

SEQ ID NO: 2977879 - protein, 17 aa, Entamoeba invadens
YSIHLLVKLSDAMILSD

SEQ ID NO: 2977880 - protein, 19 aa, Entamoeba invadens
YSIRDVVFYMFERDSTRFL

SEQ ID NO: 2977881 - protein, 25 aa, Entamoeba invadens
YSIRSVYKYLPYVKNYFIVTDDQVP

SEQ ID NO: 2977882 - protein, 19 aa, Entamoeba invadens
YSKEENSKLLVKITELEKE

SEQ ID NO: 2977883 - protein, 28 aa, Entamoeba invadens
YSKEFSRLGLTAQNGFKMADNRDGTISP

SEQ ID NO: 2977884 - protein, 26 aa, Entamoeba invadens
YSKGEYRWAATVLNHLVFFNYNNEKA

SEQ ID NO: 2977885 - protein, 23 aa, Entamoeba invadens
YSKHPLTEYVFIVIKMDLDNMNE

SEQ ID NO: 2977886 - protein, 17 aa, Entamoeba invadens
YSKIAVIVKQAYLFTKT

SEQ ID NO: 2977887 - protein, 18 aa, Entamoeba invadens
YSKIVFKNLVYTVSDRFI

SEQ ID NO: 2977888 - protein, 17 aa, Entamoeba invadens
YSKKVFVYFRDGIVAFM

SEQ ID NO: 2977889 - protein, 17 aa, Entamoeba invadens
YSKMVDAVFPKNLRCNG

SEQ ID NO: 2977890 - protein, 20 aa, Entamoeba invadens
YSKNKSIFIQNFFIDTLLEK

SEQ ID NO: 2977891 - protein, 31 aa, Entamoeba invadens
YSKSRESIKHYWKNVIVNSGVLKKIGSTSTD

SEQ ID NO: 2977892 - protein, 22 aa, Entamoeba invadens
YSKYCCVPFRLIFCCNCKHTCC

SEQ ID NO: 2977893 - protein, 17 aa, Entamoeba invadens
YSLDIYNKCITLFDSLP

SEQ ID NO: 2977894 - protein, 23 aa, Entamoeba invadens
YSLEKLMSLITFSGAIFQSVKKP

SEQ ID NO: 2977895 - protein, 25 aa, Entamoeba invadens
YSLFAYPALENFAGVKYPLEWISKF

SEQ ID NO: 2977896 - protein, 23 aa, Entamoeba invadens
YSLGITIWEIFYMRRPFEEYFHL

SEQ ID NO: 2977897 - protein, 17 aa, Entamoeba invadens
YSLKGMVSGFKDVFKKE

SEQ ID NO: 2977898 - protein, 17 aa, Entamoeba invadens
YSLLLFKLIERIKTHAI

SEQ ID NO: 2977899 - protein, 26 aa, Entamoeba invadens
YSLLPGCGDVGCKVGGYTVNLYDPDN

SEQ ID NO: 2977900 - protein, 25 aa, Entamoeba invadens
YSLNKFCFYNCYALSSVVISESVKF

SEQ ID NO: 2977901 - protein, 20 aa, Entamoeba invadens
YSLNVLKLFPNIKTLYLPSY

SEQ ID NO: 2977902 - protein, 26 aa, Entamoeba invadens
YSLPDRVYRYFGKVLYPSLTKAAQKK

SEQ ID NO: 2977903 - protein, 22 aa, Entamoeba invadens
YSLQCIANIQTLRIFKANNTAL

SEQ ID NO: 2977904 - protein, 19 aa, Entamoeba invadens
YSLSIRWVDRKPTGVAYLC

SEQ ID NO: 2977905 - protein, 24 aa, Entamoeba invadens
YSLTKVCLKLPYYGINKYKLLGLL

SEQ ID NO: 2977906 - protein, 19 aa, Entamoeba invadens
YSLVVYVPFNSVSKELSEY

SEQ ID NO: 2977907 - protein, 19 aa, Entamoeba invadens
YSLYCIFDGHGGRTASQHA

SEQ ID NO: 2977908 - protein, 21 aa, Entamoeba invadens
YSLYIRPCFISTYPHVGVSAP

SEQ ID NO: 2977909 - protein, 20 aa, Entamoeba invadens
YSMCLDLLGVLFGRPDTEGC

SEQ ID NO: 2977910 - protein, 24 aa, Entamoeba invadens
YSMRSVFMYLPYIKNYFLITDNQI

SEQ ID NO: 2977911 - protein, 17 aa, Entamoeba invadens
YSMWEIYMSAFFPTKTV

SEQ ID NO: 2977912 - protein, 17 aa, Entamoeba invadens
YSNEFPLTGEFSGLENI

SEQ ID NO: 2977913 - protein, 25 aa, Entamoeba invadens
YSNEIDLMLSRRKEVNVSRKNELMT

SEQ ID NO: 2977914 - protein, 19 aa, Entamoeba invadens
YSNELYSRFYEIISNGLPL

SEQ ID NO: 2977915 - protein, 18 aa, Entamoeba invadens
YSNFPGFAGLGKVQESTI

SEQ ID NO: 2977916 - protein, 21 aa, Entamoeba invadens
YSNGIHVLRGWKRVGDNSQAG

SEQ ID NO: 2977917 - protein, 31 aa, Entamoeba invadens
YSNIKEFFCKGIMQKEKLCILIEDNLNNKFG

SEQ ID NO: 2977918 - protein, 31 aa, Entamoeba invadens
YSNNFRKESVCFMALQVIERLRNQIDERARQ

SEQ ID NO: 2977919 - protein, 26 aa, Entamoeba invadens
YSNNNCLFTSLIMRLMVSLGSEPSQL

SEQ ID NO: 2977920 - protein, 21 aa, Entamoeba invadens
YSNRLKILVQFVQPEQPLTEQ

SEQ ID NO: 2977921 - protein, 23 aa, Entamoeba invadens
YSNTRFLYIATIFNMVFDNLNEL

SEQ ID NO: 2977922 - protein, 19 aa, Entamoeba invadens
YSNVCFSTYPVIKGVKFGK

SEQ ID NO: 2977923 - protein, 24 aa, Entamoeba invadens
YSPDCAKCKASAPMMDKLADEHTN

SEQ ID NO: 2977924 - protein, 24 aa, Entamoeba invadens
YSPECAKCEASAPMMDKLDEKHTN

SEQ ID NO: 2977925 - protein, 25 aa, Entamoeba invadens
YSPECAKCKARAPMMDKLAEKHTNL

SEQ ID NO: 2977926 - protein, 24 aa, Entamoeba invadens
YSPECAQCKASAPMFEKLSEEHKN

SEQ ID NO: 2977927 - protein, 24 aa, Entamoeba invadens
YSPECATCKASAPMMDKLADEHTN

SEQ ID NO: 2977928 - protein, 19 aa, Entamoeba invadens
YSPELKYQFRSSISAFRPC

SEQ ID NO: 2977929 - protein, 18 aa, Entamoeba invadens
YSPLQLCCLSGNYTNLSD

SEQ ID NO: 2977930 - protein, 21 aa, Entamoeba invadens
YSPMAFAIIRRFFGVSDREMM

SEQ ID NO: 2977931 - protein, 17 aa, Entamoeba invadens
YSPPWSVQFPEWSKLPL

SEQ ID NO: 2977932 - protein, 18 aa, Entamoeba invadens
YSPPWSVQFPEWSKLPLT

SEQ ID NO: 2977933 - protein, 20 aa, Entamoeba invadens
YSPRTLMSILSPRKSRSKIV

SEQ ID NO: 2977934 - protein, 17 aa, Entamoeba invadens
YSQILVLWRLKNDLFGY

SEQ ID NO: 2977935 - protein, 20 aa, Entamoeba invadens
YSQKDFSHFVFSLQNTSNCP

SEQ ID NO: 2977936 - protein, 17 aa, Entamoeba invadens
YSQKVFCIISEVAVTFY

SEQ ID NO: 2977937 - protein, 25 aa, Entamoeba invadens
YSQSEVYEYFRVCSTNQGYYIQAGL

SEQ ID NO: 2977938 - protein, 23 aa, Entamoeba invadens
YSQVPWILAPVLKTSKRMFSHKE

SEQ ID NO: 2977939 - protein, 22 aa, Entamoeba invadens
YSRANLYLVGMLYAATSPDADV

SEQ ID NO: 2977940 - protein, 23 aa, Entamoeba invadens
YSRDARSSLEFSTEESVELRRVK

SEQ ID NO: 2977941 - protein, 24 aa, Entamoeba invadens
YSRKIAMECMDIYLFTLSTSDDTR

SEQ ID NO: 2977942 - protein, 20 aa, Entamoeba invadens
YSRNPTKFDGVDDMSQLTQL

SEQ ID NO: 2977943 - protein, 21 aa, Entamoeba invadens
YSRVFKLIKHIGVYGNGTLDD

SEQ ID NO: 2977944 - protein, 26 aa, Entamoeba invadens
YSRYKGVPLYLEWAPERLFNEEAKST

SEQ ID NO: 2977945 - protein, 18 aa, Entamoeba invadens
YSRYQKIKLIDEVSKSCN

SEQ ID NO: 2977946 - protein, 18 aa, Entamoeba invadens
YSRYQKIKLIDKVSKSCN

SEQ ID NO: 2977947 - protein, 25 aa, Entamoeba invadens
YSSCPSCVIPFKITNDLELTEIQRR

SEQ ID NO: 2977948 - protein, 17 aa, Entamoeba invadens
YSSFSNLFETKWLPPKI

SEQ ID NO: 2977949 - protein, 22 aa, Entamoeba invadens
YSSKYPKMFSTVLIESIATSIV

SEQ ID NO: 2977950 - protein, 17 aa, Entamoeba invadens
YSSTLSFFYKVGKLYAG

SEQ ID NO: 2977951 - protein, 19 aa, Entamoeba invadens
YSSVCLGLGKKATKLAIND

SEQ ID NO: 2977952 - protein, 28 aa, Entamoeba invadens
YSSYDFLKCFILHYFISFSSNLFIDNNK

SEQ ID NO: 2977953 - protein, 24 aa, Entamoeba invadens
YSSYRDFRMPVVFDKKKSLEEVDK

SEQ ID NO: 2977954 - protein, 19 aa, Entamoeba invadens
YSTCLKCSEGTYPSGFKTC

SEQ ID NO: 2977955 - protein, 17 aa, Entamoeba invadens
YSTELLARGEIALRGRK

SEQ ID NO: 2977956 - protein, 25 aa, Entamoeba invadens
YSTLKMLLHYLRLVCDASAINKMNV

SEQ ID NO: 2977957 - protein, 17 aa, Entamoeba invadens
YSTRVTSLVAKYLYTFG

SEQ ID NO: 2977958 - protein, 25 aa, Entamoeba invadens
YSVDVIACVLKCFLQNLKKHVFPTM

SEQ ID NO: 2977959 - protein, 24 aa, Entamoeba invadens
YSVEVLCLLYALKVKYPDCVYIVR

SEQ ID NO: 2977960 - protein, 19 aa, Entamoeba invadens
YSVFARYLWAQFRYSNQKE

SEQ ID NO: 2977961 - protein, 25 aa, Entamoeba invadens
YSVGNGNGFFTVWKVGMKESSCRNL

SEQ ID NO: 2977962 - protein, 24 aa, Entamoeba invadens
YSVIKQRMALYLVRNKYHFDEEKG

SEQ ID NO: 2977963 - protein, 34 aa, Entamoeba invadens
YSVILREFINSVMAFKRVYIFGINGCVRNSIMES

SEQ ID NO: 2977964 - protein, 29 aa, Entamoeba invadens
YSVKFLLQVCAKLRALGIVVECKTNLVSL

SEQ ID NO: 2977965 - protein, 17 aa, Entamoeba invadens
YSVKMPLTIANRDWVNM

SEQ ID NO: 2977966 - protein, 17 aa, Entamoeba invadens
YSVLLQKILQFHKDYSF

SEQ ID NO: 2977967 - protein, 21 aa, Entamoeba invadens
YSVRFPQPFPTAPNVVVCVLF

SEQ ID NO: 2977968 - protein, 22 aa, Entamoeba invadens
YSVRGRLVDLMLYFAQKDVNTF

SEQ ID NO: 2977969 - protein, 17 aa, Entamoeba invadens
YSVVSIGNFCFNECSNL

SEQ ID NO: 2977970 - protein, 21 aa, Entamoeba invadens
YSYAEINAFCKMQKVGVQAIM

SEQ ID NO: 2977971 - protein, 25 aa, Entamoeba invadens
YSYFLPEFLALTGLSEKMEKDKQLN

SEQ ID NO: 2977972 - protein, 27 aa, Entamoeba invadens
YSYGIILWELVYRLIYQKYQRPFQEFP

SEQ ID NO: 2977973 - protein, 17 aa, Entamoeba invadens
YSYGITAWEIFYQEEPY

SEQ ID NO: 2977974 - protein, 17 aa, Entamoeba invadens
YSYGITAWEIFYQQEPY

SEQ ID NO: 2977975 - protein, 19 aa, Entamoeba invadens
YSYKLEILDTVDLDIYNTI

SEQ ID NO: 2977976 - protein, 24 aa, Entamoeba invadens
YSYRDPHIFETLDIYKQIPELIEH

SEQ ID NO: 2977977 - protein, 21 aa, Entamoeba invadens
YSYRVICKLVNRGYVRYSNEL

SEQ ID NO: 2977978 - protein, 24 aa, Entamoeba invadens
YTAECICDAYAPPEMLGIYDNETT

SEQ ID NO: 2977979 - protein, 17 aa, Entamoeba invadens
YTAELVLALLHLHSLGV

SEQ ID NO: 2977980 - protein, 17 aa, Entamoeba invadens
YTALTLFDNSVDTFIPL

SEQ ID NO: 2977981 - protein, 23 aa, Entamoeba invadens
YTCKDCEFFKGMLPSNITNLKTI

SEQ ID NO: 2977982 - protein, 30 aa, Entamoeba invadens
YTCLTCSEGSVKYCKDCFDFEFHQKHRIQE

SEQ ID NO: 2977983 - protein, 25 aa, Entamoeba invadens
YTCPICLQKYCSVPCFKTHKEHCKK

SEQ ID NO: 2977984 - protein, 18 aa, Entamoeba invadens
YTCRRRISRWNVRILYDL

SEQ ID NO: 2977985 - protein, 25 aa, Entamoeba invadens
YTDAGRCTRPLFTVSNNNGELGINL

SEQ ID NO: 2977986 - protein, 32 aa, Entamoeba invadens
YTDDNPIFWDNFLKLIYDRGILCGILGDQLSE

SEQ ID NO: 2977987 - protein, 21 aa, Entamoeba invadens
YTDVKKCFERMQIKKHQYVSL

SEQ ID NO: 2977988 - protein, 26 aa, Entamoeba invadens
YTEAGGTLGWAEFCRDKNLARPLHTN

SEQ ID NO: 2977989 - protein, 17 aa, Entamoeba invadens
YTECIGFQTNEDIYTAV

SEQ ID NO: 2977990 - protein, 19 aa, Entamoeba invadens
YTEDFMKIVHNYYKNLPSP

SEQ ID NO: 2977991 - protein, 17 aa, Entamoeba invadens
YTEIINFTINYEKPIVT

SEQ ID NO: 2977992 - protein, 26 aa, Entamoeba invadens
YTEIRSYIKPCWIKNDVERILREWLT

SEQ ID NO: 2977993 - protein, 33 aa, Entamoeba invadens
YTFGDYLEVVWRLPLTLFCRMLDGNTTNVQTIP

SEQ ID NO: 2977994 - protein, 31 aa, Entamoeba invadens
YTFLEEFKRQGVSEMWRVCDINTKYTTVPTY

SEQ ID NO: 2977995 - protein, 17 aa, Entamoeba invadens
YTGRRKEEVAPHVYAIA

SEQ ID NO: 2977996 - protein, 18 aa, Entamoeba invadens
YTHFLPANVMPLAKVLNY

SEQ ID NO: 2977997 - protein, 18 aa, Entamoeba invadens
YTHIKRISVENVIATIGR

SEQ ID NO: 2977998 - protein, 17 aa, Entamoeba invadens
YTIIKQPMCIETIKQTL

SEQ ID NO: 2977999 - protein, 20 aa, Entamoeba invadens
YTIKHIKPLLIVSTHYHQLC

SEQ ID NO: 2978000 - protein, 18 aa, Entamoeba invadens
YTILKSKPQALARLLNSV

SEQ ID NO: 2978001 - protein, 26 aa, Entamoeba invadens
YTKAGAFCGSCKRPGGHEAKKYYLED

SEQ ID NO: 2978002 - protein, 28 aa, Entamoeba invadens
YTKDLFKFPWKIAEYVIAGNRPIQNKNI

SEQ ID NO: 2978003 - protein, 17 aa, Entamoeba invadens
YTKFEILTKYFITPLRN

SEQ ID NO: 2978004 - protein, 25 aa, Entamoeba invadens
YTKGVCKLLSYYYEKKTFVLIMTTM

SEQ ID NO: 2978005 - protein, 17 aa, Entamoeba invadens
YTKGVLLFPPKPLPFPE

SEQ ID NO: 2978006 - protein, 26 aa, Entamoeba invadens
YTKHQFRFPWKIAEFVINGKRVEKKD

SEQ ID NO: 2978007 - protein, 26 aa, Entamoeba invadens
YTKHQFRFPWKIAEFVINGKRVKKKE

SEQ ID NO: 2978008 - protein, 17 aa, Entamoeba invadens
YTKKEIDAILKESDEYT

SEQ ID NO: 2978009 - protein, 19 aa, Entamoeba invadens
YTKPVSWILLKRVAQGRDW

SEQ ID NO: 2978010 - protein, 20 aa, Entamoeba invadens
YTKTKRSPCLLAVKNTISNT

SEQ ID NO: 2978011 - protein, 21 aa, Entamoeba invadens
YTKYCCVPCRLLLCCDTKHTC

SEQ ID NO: 2978012 - protein, 18 aa, Entamoeba invadens
YTLACQRFDFKAKSLFTA

SEQ ID NO: 2978013 - protein, 19 aa, Entamoeba invadens
YTLCGVGKHAFRGTTPSLV

SEQ ID NO: 2978014 - protein, 20 aa, Entamoeba invadens
YTLCVSSLYFQESLKEWDCQ

SEQ ID NO: 2978015 - protein, 29 aa, Entamoeba invadens
YTLFIGGLPPKFDVAALKKLFANYDASNF

SEQ ID NO: 2978016 - protein, 21 aa, Entamoeba invadens
YTLHFPGKRLKTVSVSNTSST

SEQ ID NO: 2978017 - protein, 19 aa, Entamoeba invadens
YTLIVPRSYPDAKISELQK

SEQ ID NO: 2978018 - protein, 17 aa, Entamoeba invadens
YTLKDPSGYVVRNSPPN

SEQ ID NO: 2978019 - protein, 24 aa, Entamoeba invadens
YTLKNRHEFSGVAIGSILSSKNEK

SEQ ID NO: 2978020 - protein, 17 aa, Entamoeba invadens
YTLKPIVRTAVTLPQNV

SEQ ID NO: 2978021 - protein, 17 aa, Entamoeba invadens
YTLMPSVMMEYSPNSEN

SEQ ID NO: 2978022 - protein, 17 aa, Entamoeba invadens
YTLPDGRQISIGIERYI

SEQ ID NO: 2978023 - protein, 19 aa, Entamoeba invadens
YTLPDGRTVSINCCDVIEP

SEQ ID NO: 2978024 - protein, 19 aa, Entamoeba invadens
YTLTEKVVRAFTQVISEFN

SEQ ID NO: 2978025 - protein, 17 aa, Entamoeba invadens
YTLYFKKLKLFLNNIKI

SEQ ID NO: 2978026 - protein, 19 aa, Entamoeba invadens
YTLYSSLRPFGCSLLVGGY

SEQ ID NO: 2978027 - protein, 24 aa, Entamoeba invadens
YTMVKKICIVLGPSPLFMPKKLGQ

SEQ ID NO: 2978028 - protein, 24 aa, Entamoeba invadens
YTNDRRFDLVKGIVGDEPLKKVVG

SEQ ID NO: 2978029 - protein, 26 aa, Entamoeba invadens
YTNEGAVFVIWFKRVQVRNGEMYKDP

SEQ ID NO: 2978030 - protein, 18 aa, Entamoeba invadens
YTNFILPDFLSDEIQSNV

SEQ ID NO: 2978031 - protein, 17 aa, Entamoeba invadens
YTNFKVKIIEEIQDKIN

SEQ ID NO: 2978032 - protein, 18 aa, Entamoeba invadens
YTNFNMHLGWECYSIGYN

SEQ ID NO: 2978033 - protein, 25 aa, Entamoeba invadens
YTNGEYRWAATVLNHLVFSDKTNTE

SEQ ID NO: 2978034 - protein, 26 aa, Entamoeba invadens
YTNHAYQFYIMFHVAPLLPLLEEDEQ

SEQ ID NO: 2978035 - protein, 19 aa, Entamoeba invadens
YTNSFGFNLCSGMCEEFDT

SEQ ID NO: 2978036 - protein, 23 aa, Entamoeba invadens
YTNSRIEMFPGILDFLKEYRSLG

SEQ ID NO: 2978037 - protein, 23 aa, Entamoeba invadens
YTNVIDWWGIGIMTFEMLHGQAP

SEQ ID NO: 2978038 - protein, 26 aa, Entamoeba invadens
YTPFKTTRCIPHLQTLIKSNEGVLGE

SEQ ID NO: 2978039 - protein, 23 aa, Entamoeba invadens
YTPKELGGLGMLSMGHVLIPQSD

SEQ ID NO: 2978040 - protein, 24 aa, Entamoeba invadens
YTPKHAVESFVIFNESAFAFCVPY

SEQ ID NO: 2978041 - protein, 22 aa, Entamoeba invadens
YTPPQMISLIFSDLAVFTPSAV

SEQ ID NO: 2978042 - protein, 23 aa, Entamoeba invadens
YTPQAKWNIWSWWSQPPKEYSDA

SEQ ID NO: 2978043 - protein, 19 aa, Entamoeba invadens
YTPTIEFVQRVQPKVFRSN

SEQ ID NO: 2978044 - protein, 18 aa, Entamoeba invadens
YTPTPRGVGIVDGVTNLG

SEQ ID NO: 2978045 - protein, 22 aa, Entamoeba invadens
YTPVYPKYLISKLAEHKDEILA

SEQ ID NO: 2978046 - protein, 23 aa, Entamoeba invadens
YTQGKKCFISWKRNPNSRDPKKS

SEQ ID NO: 2978047 - protein, 17 aa, Entamoeba invadens
YTQHDWCEAGFFVSALM

SEQ ID NO: 2978048 - protein, 18 aa, Entamoeba invadens
YTQHIPIILVGNKCDLES

SEQ ID NO: 2978049 - protein, 25 aa, Entamoeba invadens
YTQKERYNRLFAFGCNYINDYDIGV

SEQ ID NO: 2978050 - protein, 22 aa, Entamoeba invadens
YTQLFPCITMFIERASCVNKEG

SEQ ID NO: 2978051 - protein, 20 aa, Entamoeba invadens
YTQRFFFIFNDVSQVVRDTM

SEQ ID NO: 2978052 - protein, 18 aa, Entamoeba invadens
YTQVFLMDYLRLSLKPTM

SEQ ID NO: 2978053 - protein, 26 aa, Entamoeba invadens
YTREHLESFVIPPRPTYLVKSEEESL

SEQ ID NO: 2978054 - protein, 18 aa, Entamoeba invadens
YTRQLLFYSHEFEPEKIL

SEQ ID NO: 2978055 - protein, 26 aa, Entamoeba invadens
YTRVLTRTMFALGFKDFDALNDIAFV

SEQ ID NO: 2978056 - protein, 18 aa, Entamoeba invadens
YTSELKFVEKFLAKTQLK

SEQ ID NO: 2978057 - protein, 28 aa, Entamoeba invadens
YTSFEKRCSFPFGFGLSYTEFEYSVPIV

SEQ ID NO: 2978058 - protein, 18 aa, Entamoeba invadens
YTSGCAILQKILSNPSQE

SEQ ID NO: 2978059 - protein, 28 aa, Entamoeba invadens
YTSNSLLLCCWCFFVYNELSKCFQPYSE

SEQ ID NO: 2978060 - protein, 17 aa, Entamoeba invadens
YTSTIFLDVLDTFRPIC

SEQ ID NO: 2978061 - protein, 17 aa, Entamoeba invadens
YTTCPYSFANEILADLI

SEQ ID NO: 2978062 - protein, 26 aa, Entamoeba invadens
YTTFEDFKKYLLKGLEETVRVLPLID

SEQ ID NO: 2978063 - protein, 18 aa, Entamoeba invadens
YTTLKLSLIDLLKAKYPS

SEQ ID NO: 2978064 - protein, 18 aa, Entamoeba invadens
YTTSCVDLAGNVPQAIMG

SEQ ID NO: 2978065 - protein, 18 aa, Entamoeba invadens
YTVCCNGKILRVESLESL

SEQ ID NO: 2978066 - protein, 17 aa, Entamoeba invadens
YTVCVSTLDDFRLFEDE

SEQ ID NO: 2978067 - protein, 29 aa, Entamoeba invadens
YTVEFRFGKIKIFFKVGVLAEIEEIRENR

SEQ ID NO: 2978068 - protein, 19 aa, Entamoeba invadens
YTVGDMKAAYLMTMEQDKY

SEQ ID NO: 2978069 - protein, 17 aa, Entamoeba invadens
YTVHFYGAVFIPNKVCM

SEQ ID NO: 2978070 - protein, 24 aa, Entamoeba invadens
YTVPDVICELGPYCFSMCSNLSKI

SEQ ID NO: 2978071 - protein, 19 aa, Entamoeba invadens
YTVVKQCNFLIVLNSNLTA

SEQ ID NO: 2978072 - protein, 20 aa, Entamoeba invadens
YTVVPTLHFPLLTPDWGADE

SEQ ID NO: 2978073 - protein, 23 aa, Entamoeba invadens
YTYHSSTLFKYKIDYSEPVTSKR

SEQ ID NO: 2978074 - protein, 22 aa, Entamoeba invadens
YTYQKRHICCMETIKHDDNEVH

SEQ ID NO: 2978075 - protein, 19 aa, Entamoeba invadens
YVAAISCQALKYKSLIPYR

SEQ ID NO: 2978076 - protein, 17 aa, Entamoeba invadens
YVAAVKWLNTHYSVNGC

SEQ ID NO: 2978077 - protein, 17 aa, Entamoeba invadens
YVAEIPENIKLLSPTVI

SEQ ID NO: 2978078 - protein, 19 aa, Entamoeba invadens
YVAIKVLKNRPAYFKQSLI

SEQ ID NO: 2978079 - protein, 18 aa, Entamoeba invadens
YVCDDCKKTLRFFDNDDS

SEQ ID NO: 2978080 - protein, 24 aa, Entamoeba invadens
YVDCFKLVNWANVDMRCMAIRCAI

SEQ ID NO: 2978081 - protein, 20 aa, Entamoeba invadens
YVDHSVAFKSLLYVTFPLTL

SEQ ID NO: 2978082 - protein, 17 aa, Entamoeba invadens
YVDKCCVLDDSRFVGEV

SEQ ID NO: 2978083 - protein, 18 aa, Entamoeba invadens
YVDKLREVMENENEFGEY

SEQ ID NO: 2978084 - protein, 25 aa, Entamoeba invadens
YVDRGEFGVELVLMLFSLKISSPKR

SEQ ID NO: 2978085 - protein, 24 aa, Entamoeba invadens
YVDSQCLLYGLPMIEGGTMGTKGN

SEQ ID NO: 2978086 - protein, 23 aa, Entamoeba invadens
YVDTDCFILCFAMNDQNSFDKIQ

SEQ ID NO: 2978087 - protein, 18 aa, Entamoeba invadens
YVECCKTDPTLYRNYFGI

SEQ ID NO: 2978088 - protein, 19 aa, Entamoeba invadens
YVECYLINDMLWLVTELMN

SEQ ID NO: 2978089 - protein, 20 aa, Entamoeba invadens
YVELFHSCRIIVHYFLISLS

SEQ ID NO: 2978090 - protein, 24 aa, Entamoeba invadens
YVENDRKSFAFSFVNPYDHEPIRY

SEQ ID NO: 2978091 - protein, 24 aa, Entamoeba invadens
YVEQEVPFFLAPHAMVIFQTGQYL

SEQ ID NO: 2978092 - protein, 27 aa, Entamoeba invadens
YVERCYKCGKPLVGKYLVVDGHNYHDT

SEQ ID NO: 2978093 - protein, 17 aa, Entamoeba invadens
YVESGIMLYLISLIEFP

SEQ ID NO: 2978094 - protein, 22 aa, Entamoeba invadens
YVESVIGSWAIVRVNETKYIYP

SEQ ID NO: 2978095 - protein, 23 aa, Entamoeba invadens
YVEWKFYCEYCFKELKENSKISC

SEQ ID NO: 2978096 - protein, 17 aa, Entamoeba invadens
YVFLNGVYIDYSTNQKK

SEQ ID NO: 2978097 - protein, 17 aa, Entamoeba invadens
YVFPNERLPIGKYNPSD

SEQ ID NO: 2978098 - protein, 21 aa, Entamoeba invadens
YVFYCVGACPFVIKDQFHTFK

SEQ ID NO: 2978099 - protein, 23 aa, Entamoeba invadens
YVGEKGAVGFWYLFQERMEEEFL

SEQ ID NO: 2978100 - protein, 17 aa, Entamoeba invadens
YVGFSFAPLASPPADQT

SEQ ID NO: 2978101 - protein, 21 aa, Entamoeba invadens
YVGGFCFDGCNSLSNVTIPSS

SEQ ID NO: 2978102 - protein, 18 aa, Entamoeba invadens
YVGPLKFYVTLSDTNHNN

SEQ ID NO: 2978103 - protein, 22 aa, Entamoeba invadens
YVGRGCFCQCHSLTSVNLPSKV

SEQ ID NO: 2978104 - protein, 25 aa, Entamoeba invadens
YVGWEKGGSCSFGPKTEEVVLPGYM

SEQ ID NO: 2978105 - protein, 34 aa, Entamoeba invadens
YVHLPLECFQYFKALKTVNVWSHKEFQDIFNYYL

SEQ ID NO: 2978106 - protein, 23 aa, Entamoeba invadens
YVHSPEFGQFLVAKMINAERSAQ

SEQ ID NO: 2978107 - protein, 18 aa, Entamoeba invadens
YVICCRETYSLVNSLFEK

SEQ ID NO: 2978108 - protein, 23 aa, Entamoeba invadens
YVIDCGYCKINEYNSRTGMESLL

SEQ ID NO: 2978109 - protein, 22 aa, Entamoeba invadens
YVILVRMCKGRTFKTFPLVTQI

SEQ ID NO: 2978110 - protein, 18 aa, Entamoeba invadens
YVINLFALTMYWADDTHF

SEQ ID NO: 2978111 - protein, 17 aa, Entamoeba invadens
YVIQHLLEFGSQPIRDE

SEQ ID NO: 2978112 - protein, 23 aa, Entamoeba invadens
YVKAATCGAALFSVPKKEDTKEV

SEQ ID NO: 2978113 - protein, 17 aa, Entamoeba invadens
YVKEPPTIVPVKHIEPK

SEQ ID NO: 2978114 - protein, 24 aa, Entamoeba invadens
YVKGDENHFMFTLKNPYKIPPTRF

SEQ ID NO: 2978115 - protein, 27 aa, Entamoeba invadens
YVKHMEEILVLALRYMPSCDVSHLLKK

SEQ ID NO: 2978116 - protein, 19 aa, Entamoeba invadens
YVKIEFITPLFPFIKMMLR

SEQ ID NO: 2978117 - protein, 17 aa, Entamoeba invadens
YVKNEGVTKDVSMETLV

SEQ ID NO: 2978118 - protein, 25 aa, Entamoeba invadens
YVKRLNDFQTLYLPLALSLLQNDKV

SEQ ID NO: 2978119 - protein, 27 aa, Entamoeba invadens
YVKTRFLSLECVFRWVYNNYDNITIFL

SEQ ID NO: 2978120 - protein, 18 aa, Entamoeba invadens
YVKVFILQYLRPMKKVDS

SEQ ID NO: 2978121 - protein, 39 aa, Entamoeba invadens
YVKYLELRFVFIIKFPFFDGALKIAKKVPEEFYTDKRSL

SEQ ID NO: 2978122 - protein, 18 aa, Entamoeba invadens
YVLCDSSRSLNNLQKSKK

SEQ ID NO: 2978123 - protein, 21 aa, Entamoeba invadens
YVLKAISFANEFSKEIEKEEK

SEQ ID NO: 2978124 - protein, 17 aa, Entamoeba invadens
YVLLMLLIYTSFKEETK

SEQ ID NO: 2978125 - protein, 24 aa, Entamoeba invadens
YVLREFRCGVLLYNGENSVVNNKI

SEQ ID NO: 2978126 - protein, 51 aa, Entamoeba invadens
YVLSSFWVCGLLQYNSTPVLCFWNTEKTLALHIFNTFCLIFQNSQEYKYDM

SEQ ID NO: 2978127 - protein, 21 aa, Entamoeba invadens
YVMHGIVFKFVEDKSNDKVSV

SEQ ID NO: 2978128 - protein, 22 aa, Entamoeba invadens
YVMRGGEIYRVIEVTKVKINGV

SEQ ID NO: 2978129 - protein, 24 aa, Entamoeba invadens
YVNCLKCYNRRFVVGTTDRLVLSY

SEQ ID NO: 2978130 - protein, 23 aa, Entamoeba invadens
YVNDSRFSKYFISRLNEEFYQKN

SEQ ID NO: 2978131 - protein, 24 aa, Entamoeba invadens
YVNEKLGIVYIKYGVKDTSFLSLI

SEQ ID NO: 2978132 - protein, 22 aa, Entamoeba invadens
YVNEPFFGLVLFYLKSSTDSGL

SEQ ID NO: 2978133 - protein, 25 aa, Entamoeba invadens
YVNHLWRKCYEDERCTNFLDVRYPL

SEQ ID NO: 2978134 - protein, 24 aa, Entamoeba invadens
YVNIPNVRWVFYIKECEDKNYEEE

SEQ ID NO: 2978135 - protein, 24 aa, Entamoeba invadens
YVNPIGFPSIEAFHQKFGEGKTAD

SEQ ID NO: 2978136 - protein, 18 aa, Entamoeba invadens
YVNVCLTQTIPTHQLMEL

SEQ ID NO: 2978137 - protein, 17 aa, Entamoeba invadens
YVNYAMCINFDKINFFD

SEQ ID NO: 2978138 - protein, 25 aa, Entamoeba invadens
YVPFKPSLKFTKIVSLKCKVLDSLR

SEQ ID NO: 2978139 - protein, 23 aa, Entamoeba invadens
YVPKCVLYHPTLPCVLADISLDT

SEQ ID NO: 2978140 - protein, 18 aa, Entamoeba invadens
YVPQAICVFSRVNCYVQM

SEQ ID NO: 2978141 - protein, 25 aa, Entamoeba invadens
YVPRAARVFPLMQGYVTFSERTLIY

SEQ ID NO: 2978142 - protein, 26 aa, Entamoeba invadens
YVQKERYLREKWDKKAEKTTAKSLGT

SEQ ID NO: 2978143 - protein, 19 aa, Entamoeba invadens
YVQKIVEVRVTGFLSGYLY

SEQ ID NO: 2978144 - protein, 17 aa, Entamoeba invadens
YVQRLDPRWDQVKAEMR

SEQ ID NO: 2978145 - protein, 18 aa, Entamoeba invadens
YVRAVAALYLRLVSSSEE

SEQ ID NO: 2978146 - protein, 26 aa, Entamoeba invadens
YVRDKCTTCCRIIIASFYNYDQNRAF

SEQ ID NO: 2978147 - protein, 21 aa, Entamoeba invadens
YVREMLQMRLIITPQNLINDD

SEQ ID NO: 2978148 - protein, 23 aa, Entamoeba invadens
YVRSYNLFDVYPFMEKKDYPKLV

SEQ ID NO: 2978149 - protein, 25 aa, Entamoeba invadens
YVSAVECFKRSGMMGSKEGMYNLAV

SEQ ID NO: 2978150 - protein, 23 aa, Entamoeba invadens
YVSEKMITFFISNCASTSDSEQQ

SEQ ID NO: 2978151 - protein, 24 aa, Entamoeba invadens
YVSELKTKLLIVLEEGRFNVKDDG

SEQ ID NO: 2978152 - protein, 21 aa, Entamoeba invadens
YVSHFCKFITRLAMLKDDAVK

SEQ ID NO: 2978153 - protein, 24 aa, Entamoeba invadens
YVSKRIPIFSGINFISERKMVGLN

SEQ ID NO: 2978154 - protein, 19 aa, Entamoeba invadens
YVSRSCKIAILMIRTNPNY

SEQ ID NO: 2978155 - protein, 18 aa, Entamoeba invadens
YVSSLPFNKVLPEKKGDY

SEQ ID NO: 2978156 - protein, 25 aa, Entamoeba invadens
YVSVESWTFKSLKPEEHDTFKKIAE

SEQ ID NO: 2978157 - protein, 17 aa, Entamoeba invadens
YVSWDFKFIEWRDTDYL

SEQ ID NO: 2978158 - protein, 20 aa, Entamoeba invadens
YVTFTEIPAFFTAEKVKEFF

SEQ ID NO: 2978159 - protein, 23 aa, Entamoeba invadens
YVTGDLTGLIPWNKELFKETQKP

SEQ ID NO: 2978160 - protein, 18 aa, Entamoeba invadens
YVTIECRFQNDFSDFDFF

SEQ ID NO: 2978161 - protein, 19 aa, Entamoeba invadens
YVTKISICNKEFVQKEKQF

SEQ ID NO: 2978162 - protein, 19 aa, Entamoeba invadens
YVTLYKYWWDGLKEKVDIE

SEQ ID NO: 2978163 - protein, 20 aa, Entamoeba invadens
YVTPIVFQIRYFRQHSTRYD

SEQ ID NO: 2978164 - protein, 24 aa, Entamoeba invadens
YVTSLGVCESCYRSPMMKDNSPFK

SEQ ID NO: 2978165 - protein, 31 aa, Entamoeba invadens
YVVDRAIEIYPEFRIPAELAKPSGKRHRKVF

SEQ ID NO: 2978166 - protein, 18 aa, Entamoeba invadens
YVVEFFLRGIESVQYYQR

SEQ ID NO: 2978167 - protein, 20 aa, Entamoeba invadens
YVVEHTRGFDLFDSVFQEYF

SEQ ID NO: 2978168 - protein, 18 aa, Entamoeba invadens
YVVFGCTYQPNIRRKFNL

SEQ ID NO: 2978169 - protein, 19 aa, Entamoeba invadens
YVVGDCIQGFISITTKRRA

SEQ ID NO: 2978170 - protein, 20 aa, Entamoeba invadens
YVVKARSELQVAAAAGMGLL

SEQ ID NO: 2978171 - protein, 21 aa, Entamoeba invadens
YVVKEIFAIIKMWNKKLENHK

SEQ ID NO: 2978172 - protein, 20 aa, Entamoeba invadens
YVVLRVKWESIPSGYNVYAT

SEQ ID NO: 2978173 - protein, 25 aa, Entamoeba invadens
YVVNSGKCQLCLSGKYYNPNSKSCQ

SEQ ID NO: 2978174 - protein, 19 aa, Entamoeba invadens
YVVPFSFSVQNNFKTVKTN

SEQ ID NO: 2978175 - protein, 19 aa, Entamoeba invadens
YVVTKCGVFVRKEEKYTPI

SEQ ID NO: 2978176 - protein, 37 aa, Entamoeba invadens
YVVVDIRGWALGYVFDRFAFAQVLPYVNLKVSIESQL

SEQ ID NO: 2978177 - protein, 27 aa, Entamoeba invadens
YVWFNKRLMGYEEMYGKIFPKRWRVGE

SEQ ID NO: 2978178 - protein, 17 aa, Entamoeba invadens
YVYDLPKYKQNPFSIKS

SEQ ID NO: 2978179 - protein, 18 aa, Entamoeba invadens
YWAMKRTNMAGSLNPVDS

SEQ ID NO: 2978180 - protein, 25 aa, Entamoeba invadens
YWDSPFREKLCDEILKKIENRMPSQ

SEQ ID NO: 2978181 - protein, 23 aa, Entamoeba invadens
YWEEVQVEIGVEFQRGILKFFLN

SEQ ID NO: 2978182 - protein, 21 aa, Entamoeba invadens
YWEQAIFKYLRCDPQDHYFLL

SEQ ID NO: 2978183 - protein, 22 aa, Entamoeba invadens
YWEYLQSVVLPFGIKEIQNSSF

SEQ ID NO: 2978184 - protein, 18 aa, Entamoeba invadens
YWGGHSYISPKSFKTAIG

SEQ ID NO: 2978185 - protein, 31 aa, Entamoeba invadens
YWKDYSMKAVAEMKCVNALFTYLMNNIADFI

SEQ ID NO: 2978186 - protein, 17 aa, Entamoeba invadens
YWLAEEYWGHGIMPRAV

SEQ ID NO: 2978187 - protein, 18 aa, Entamoeba invadens
YWLIGEKMMIGFYHFIED

SEQ ID NO: 2978188 - protein, 23 aa, Entamoeba invadens
YWMKEVIEGVIYLHQQKVIHRDL

SEQ ID NO: 2978189 - protein, 22 aa, Entamoeba invadens
YWNQLYCLATYCNLSSTNVINI

SEQ ID NO: 2978190 - protein, 17 aa, Entamoeba invadens
YWNVPAMSKGEVVYDIL

SEQ ID NO: 2978191 - protein, 20 aa, Entamoeba invadens
YWRGTQMTFQSPMTFSELVN

SEQ ID NO: 2978192 - protein, 21 aa, Entamoeba invadens
YWRIKRVMMRKLIVSTILNTN

SEQ ID NO: 2978193 - protein, 30 aa, Entamoeba invadens
YWRSKMVMWPDLAKAALRYTTLLCVSTPSE

SEQ ID NO: 2978194 - protein, 23 aa, Entamoeba invadens
YWSLFPAAAKKYGLHYETVHCNM

SEQ ID NO: 2978195 - protein, 26 aa, Entamoeba invadens
YWTEKEKIAFEKIVRYFNYTSSKGLN

SEQ ID NO: 2978196 - protein, 29 aa, Entamoeba invadens
YWTGCKSNVFSNEIEKIYNLRSKLKKEGN

SEQ ID NO: 2978197 - protein, 19 aa, Entamoeba invadens
YWTIKRTNMAGVLNPVDSS

SEQ ID NO: 2978198 - protein, 25 aa, Entamoeba invadens
YWVCQRLQLEILMNVIDLDNLVKKV

SEQ ID NO: 2978199 - protein, 18 aa, Entamoeba invadens
YWWDGLKEKVDIERWSYD

SEQ ID NO: 2978200 - protein, 27 aa, Entamoeba invadens
YYAAMTRVYFSGAISALVVCDITSKDS

SEQ ID NO: 2978201 - protein, 22 aa, Entamoeba invadens
YYAEERFFYCFFQGNEYKYDIK

SEQ ID NO: 2978202 - protein, 24 aa, Entamoeba invadens
YYAFSRSKCDVTLFDIRTQKRLKS

SEQ ID NO: 2978203 - protein, 19 aa, Entamoeba invadens
YYAQLDLKIRVTGGGQVSQ

SEQ ID NO: 2978204 - protein, 26 aa, Entamoeba invadens
YYCEICGGCGYKGRKNYEKHFEEAKH

SEQ ID NO: 2978205 - protein, 21 aa, Entamoeba invadens
YYCKIEEIELPNGVKEVEDGA

SEQ ID NO: 2978206 - protein, 24 aa, Entamoeba invadens
YYCSDRFVPVYLEKKGDFEDRVKQ

SEQ ID NO: 2978207 - protein, 17 aa, Entamoeba invadens
YYDEKRNEVSLFKEQVN

SEQ ID NO: 2978208 - protein, 24 aa, Entamoeba invadens
YYDETGICWEVLLSDVVACEATHD

SEQ ID NO: 2978209 - protein, 19 aa, Entamoeba invadens
YYDGTLFHRVIPKFMMQGG

SEQ ID NO: 2978210 - protein, 19 aa, Entamoeba invadens
YYDNVSFALFFAAFCDFQA

SEQ ID NO: 2978211 - protein, 18 aa, Entamoeba invadens
YYDRFPKKIDLNEDYYDD

SEQ ID NO: 2978212 - protein, 30 aa, Entamoeba invadens
YYDRRREIICGNPLKPEEVVGYTPNTECPP

SEQ ID NO: 2978213 - protein, 17 aa, Entamoeba invadens
YYDVIFTRVCNLRTHTD

SEQ ID NO: 2978214 - protein, 18 aa, Entamoeba invadens
YYDVLGFCQFDMNRAVVE

SEQ ID NO: 2978215 - protein, 19 aa, Entamoeba invadens
YYEIVVWFSVDYETVDKNN

SEQ ID NO: 2978216 - protein, 21 aa, Entamoeba invadens
YYELFSLIKTMEFVGDLDKVK

SEQ ID NO: 2978217 - protein, 19 aa, Entamoeba invadens
YYENVVCEYTNRLFVNIVD

SEQ ID NO: 2978218 - protein, 25 aa, Entamoeba invadens
YYFDELRAQPQFSLLNEYPYKDYNI

SEQ ID NO: 2978219 - protein, 22 aa, Entamoeba invadens
YYFGEFEFLHFLVQNLVAIVFY

SEQ ID NO: 2978220 - protein, 18 aa, Entamoeba invadens
YYFLQVVVNYNCDPTFFL

SEQ ID NO: 2978221 - protein, 23 aa, Entamoeba invadens
YYFSGKQHLCYIELSKFIEYYQQ

SEQ ID NO: 2978222 - protein, 24 aa, Entamoeba invadens
YYGDGYWGDDGFYYVYDYETKRYY

SEQ ID NO: 2978223 - protein, 29 aa, Entamoeba invadens
YYGLVAERLCVLFNKFKDSFSIKFEEVYK

SEQ ID NO: 2978224 - protein, 19 aa, Entamoeba invadens
YYGNCKFRQYMPSKPGKYG

SEQ ID NO: 2978225 - protein, 25 aa, Entamoeba invadens
YYGYKNSCVVKGCFITFKKYADGPF

SEQ ID NO: 2978226 - protein, 19 aa, Entamoeba invadens
YYHTYAQVEWEFFKLVRNA

SEQ ID NO: 2978227 - protein, 17 aa, Entamoeba invadens
YYICNTISDVVQVELYY

SEQ ID NO: 2978228 - protein, 25 aa, Entamoeba invadens
YYIHKGVWFLMDFLRDEFKAAQSEL

SEQ ID NO: 2978229 - protein, 20 aa, Entamoeba invadens
YYIKEIESIITAECPHKLCY

SEQ ID NO: 2978230 - protein, 24 aa, Entamoeba invadens
YYIPEGMLTSGSWVGLFDAHETTT

SEQ ID NO: 2978231 - protein, 23 aa, Entamoeba invadens
YYIPRKEVLCGNETTFKREQSVN

SEQ ID NO: 2978232 - protein, 18 aa, Entamoeba invadens
YYIPRKEVLCGNETTFKS

SEQ ID NO: 2978233 - protein, 24 aa, Entamoeba invadens
YYKFENMFLPAFFRKHGSDYTISA

SEQ ID NO: 2978234 - protein, 22 aa, Entamoeba invadens
YYKNSVVMIMEFVKKQSSFLQK

SEQ ID NO: 2978235 - protein, 17 aa, Entamoeba invadens
YYKSEADKMCKKCTDKC

SEQ ID NO: 2978236 - protein, 22 aa, Entamoeba invadens
YYKVLQCYLEVGKYIADNNGIN

SEQ ID NO: 2978237 - protein, 18 aa, Entamoeba invadens
YYKYIPMGYKVIGSDRYQ

SEQ ID NO: 2978238 - protein, 19 aa, Entamoeba invadens
YYLDEEMCGASVFNNTIYP

SEQ ID NO: 2978239 - protein, 29 aa, Entamoeba invadens
YYLEASYPYWILRLVWKRKDHTFTVIRKD

SEQ ID NO: 2978240 - protein, 17 aa, Entamoeba invadens
YYLLEPFIDIVTMRNEA

SEQ ID NO: 2978241 - protein, 27 aa, Entamoeba invadens
YYLLHVFPLEYIPSVIKNVIIETSQNN

SEQ ID NO: 2978242 - protein, 18 aa, Entamoeba invadens
YYLNNGFSIPYDIFSMLL

SEQ ID NO: 2978243 - protein, 17 aa, Entamoeba invadens
YYLPTVLETTCFNVFVK

SEQ ID NO: 2978244 - protein, 27 aa, Entamoeba invadens
YYLQCFTEEWGWFSVTVHKLYRPTDVA

SEQ ID NO: 2978245 - protein, 25 aa, Entamoeba invadens
YYLSPEICKGLPYGYKSDMWSLGCI

SEQ ID NO: 2978246 - protein, 19 aa, Entamoeba invadens
YYMDALCAAIVKNPTKFDV

SEQ ID NO: 2978247 - protein, 20 aa, Entamoeba invadens
YYMKSGLIPYFVKLLQDQNS

SEQ ID NO: 2978248 - protein, 19 aa, Entamoeba invadens
YYMRICHVTVSMIIDEMFE

SEQ ID NO: 2978249 - protein, 17 aa, Entamoeba invadens
YYMSIEYLIGRSLVNSI

SEQ ID NO: 2978250 - protein, 23 aa, Entamoeba invadens
YYNDIKIAIDLSNLHIKKLTLIS

SEQ ID NO: 2978251 - protein, 19 aa, Entamoeba invadens
YYNPFPFVDVRSSDFQISS

SEQ ID NO: 2978252 - protein, 21 aa, Entamoeba invadens
YYNTFHQWTGMTAPRVIFECR

SEQ ID NO: 2978253 - protein, 19 aa, Entamoeba invadens
YYNTLKLLIHYLSLVVGAS

SEQ ID NO: 2978254 - protein, 17 aa, Entamoeba invadens
YYPHYQITEDTTCVDTH

SEQ ID NO: 2978255 - protein, 18 aa, Entamoeba invadens
YYPIFQLAGFTGFDGAFN

SEQ ID NO: 2978256 - protein, 22 aa, Entamoeba invadens
YYPKQGLCVPCDYGCTTCSSAT

SEQ ID NO: 2978257 - protein, 21 aa, Entamoeba invadens
YYPKTFGDYKCQKCDSTCLTC

SEQ ID NO: 2978258 - protein, 18 aa, Entamoeba invadens
YYPPLDLSLMTSLKRFEC

SEQ ID NO: 2978259 - protein, 21 aa, Entamoeba invadens
YYQLCGVVQYVFFNTEMEGKI

SEQ ID NO: 2978260 - protein, 19 aa, Entamoeba invadens
YYRGSDVVFLVFDLTNQSS

SEQ ID NO: 2978261 - protein, 21 aa, Entamoeba invadens
YYRKCSERCSALTHGEPLISV

SEQ ID NO: 2978262 - protein, 18 aa, Entamoeba invadens
YYRMNSLVTTQFPGITNT

SEQ ID NO: 2978263 - protein, 20 aa, Entamoeba invadens
YYRRRFRPSIVCDGMGEIDV

SEQ ID NO: 2978264 - protein, 26 aa, Entamoeba invadens
YYSCNEFLANFVVDLFGPKAAVDFME

SEQ ID NO: 2978265 - protein, 24 aa, Entamoeba invadens
YYSKDVEGVFRLCAAKSSIEQYIK

SEQ ID NO: 2978266 - protein, 19 aa, Entamoeba invadens
YYSNVLIDVWYFIGNIVYY

SEQ ID NO: 2978267 - protein, 21 aa, Entamoeba invadens
YYSVKMPFTISNRDWVNMRSW

SEQ ID NO: 2978268 - protein, 29 aa, Entamoeba invadens
YYTECDYWSVGCILFEMLAGYPPFVSDDS

SEQ ID NO: 2978269 - protein, 17 aa, Entamoeba invadens
YYTFENMEIPDFEIINR

SEQ ID NO: 2978270 - protein, 17 aa, Entamoeba invadens
YYTGVIFEAVMVVGNTS

SEQ ID NO: 2978271 - protein, 18 aa, Entamoeba invadens
YYTKEGIVTFEVMQNLLN

SEQ ID NO: 2978272 - protein, 20 aa, Entamoeba invadens
YYTQFLGKFFNGMVKAFESA

SEQ ID NO: 2978273 - protein, 30 aa, Entamoeba invadens
YYTYLLKRLVNIFHLCLLKKSDVKSQIWYV

SEQ ID NO: 2978274 - protein, 24 aa, Entamoeba invadens
YYVDDLRFLSTLSLILTQHNIHWK

SEQ ID NO: 2978275 - protein, 23 aa, Entamoeba invadens
YYVDLLCESMADKSVSFSQMNLL

SEQ ID NO: 2978276 - protein, 19 aa, Entamoeba invadens
YYWTGCKSNMFSNEIEKIY

SEQ ID NO: 2978277 - protein, 29 aa, Entamoeba invadens
YYWTGCKSNVFSNEIEKIYNLRSQLKKES

SEQ ID NO: 2978278 - protein, 18 aa, Entamoeba invadens
YYYALSFLPQYRDVTTFL

SEQ ID NO: 2978279 - protein, 18 aa, Entamoeba invadens
YYYLGSKELRGFRRRGCV

SEQ ID NO: 2978280 - protein, 19 aa, Entamoeba invadens
YYYYTYRGTTFYVKVFEDG

SEQ ID NO: 2978281 - protein, 17 aa, Entamoeba invadens
RCPEALFQPSFLGMEAS

SEQ ID NO: 2978282 - protein, 24 aa, Entamoeba invadens
GWLSWIMKILELMDADLIKCIGAC

SEQ ID NO: 2978283 - protein, 19 aa, Entamoeba invadens
CNWDPSFVLENEWVLADSG

SEQ ID NO: 2978284 - protein, 24 aa, Entamoeba invadens
HLCAFKGKIWAKVFIKSKPQRYGI

SEQ ID NO: 2978285 - protein, 23 aa, Entamoeba invadens
NLQSRLVVRLTLFNITKQTICNL

SEQ ID NO: 2978286 - protein, 23 aa, Entamoeba invadens
ATSLLRPFPCGEVGEIIFSESLM

SEQ ID NO: 2978287 - protein, 17 aa, Entamoeba invadens
CGHQFCWLCMADYTNTH

SEQ ID NO: 2978288 - protein, 17 aa, Entamoeba invadens
CGSCPKAGGKYCKKYYL

SEQ ID NO: 2978289 - protein, 20 aa, Entamoeba invadens
DRMMYKLGYVDRVMDVLKRR

SEQ ID NO: 2978290 - protein, 28 aa, Entamoeba invadens
ITFVAIFIRVCMKFDFYECPLLLSEYYG

SEQ ID NO: 2978291 - protein, 20 aa, Entamoeba invadens
KAVCCSHGPVLRTNIKENIE

SEQ ID NO: 2978292 - protein, 22 aa, Entamoeba invadens
KGEYRWAATVLNHLVFADVNNM

SEQ ID NO: 2978293 - protein, 19 aa, Entamoeba invadens
KLAGQFGLKCKREIQRVHF

SEQ ID NO: 2978294 - protein, 21 aa, Entamoeba invadens
KQLRCNGVLEGIRITRLGYPN

SEQ ID NO: 2978295 - protein, 20 aa, Entamoeba invadens
KRAKISFGCFEGCVGLTSLE

SEQ ID NO: 2978296 - protein, 18 aa, Entamoeba invadens
LRMKACRILHNVPSSQGG

SEQ ID NO: 2978297 - protein, 22 aa, Entamoeba invadens
MGKGSFKYAWVLDNLKAERERG

SEQ ID NO: 2978298 - protein, 22 aa, Entamoeba invadens
NPLRKSTCFEIFEEYHLKEYEL

SEQ ID NO: 2978299 - protein, 17 aa, Entamoeba invadens
RTCWPRVRGVAMNPVEH

SEQ ID NO: 2978300 - protein, 24 aa, Entamoeba invadens
SGKDWRAGRCAACNIIPATTGAAK

SEQ ID NO: 2978301 - protein, 18 aa, Entamoeba invadens
SHIKSVGYYSCFSCANLK

SEQ ID NO: 2978302 - protein, 21 aa, Entamoeba invadens
YKLRLGKGFTLAELRAAHIDA

SEQ ID NO: 2978303 - protein, 18 aa, Entamoeba invadens
YLKQCIKSGSLIVTGPFK

SEQ ID NO: 2978304 - protein, 17 aa, Entamoeba invadens
YNYKLRLGKGFTLAELR

SEQ ID NO: 2978305 - protein, 17 aa, Entamoeba invadens
YRIIVWFNVDFETVDRN

SEQ ID NO: 2978306 - protein, 24 aa, Entamoeba invadens
AFVPVQCLPSFFSVENNVSNTFGR

SEQ ID NO: 2978307 - protein, 17 aa, Entamoeba invadens
AHADVLVPIVTRSEYTI

SEQ ID NO: 2978308 - protein, 18 aa, Entamoeba invadens
AHRGLRHYWGLRVRGQHT

SEQ ID NO: 2978309 - protein, 23 aa, Entamoeba invadens
AVKTWKKRWFVLKENRLWYFASK

SEQ ID NO: 2978310 - protein, 17 aa, Entamoeba invadens
AYQSSWFKPVGGILEES

SEQ ID NO: 2978311 - protein, 19 aa, Entamoeba invadens
CEALESLRCESVLTFLEYQ

SEQ ID NO: 2978312 - protein, 19 aa, Entamoeba invadens
CLEAIKMLHINSYIDVSSY

SEQ ID NO: 2978313 - protein, 25 aa, Entamoeba invadens
CQYEPEVFPGLVFRMTQPKVTLLVF

SEQ ID NO: 2978314 - protein, 19 aa, Entamoeba invadens
CVAAELFLGIPLFPGENEY

SEQ ID NO: 2978315 - protein, 18 aa, Entamoeba invadens
DAMILRFAIPSRKMTKED

SEQ ID NO: 2978316 - protein, 19 aa, Entamoeba invadens
DMRPGMIIKNLKLRRPIFQ

SEQ ID NO: 2978317 - protein, 17 aa, Entamoeba invadens
DRYKGFIYVGASKTGKT

SEQ ID NO: 2978318 - protein, 20 aa, Entamoeba invadens
EASLPFLHFFDGFKTGYALQ

SEQ ID NO: 2978319 - protein, 17 aa, Entamoeba invadens
ECFRLFFCEEIANNLLL

SEQ ID NO: 2978320 - protein, 20 aa, Entamoeba invadens
ECYGKLLAFDLEKYIKAFYI

SEQ ID NO: 2978321 - protein, 17 aa, Entamoeba invadens
EELRKIVKMQMKDIVAR

SEQ ID NO: 2978322 - protein, 23 aa, Entamoeba invadens
EGDLKLILGLLWVLILKYQIAAN

SEQ ID NO: 2978323 - protein, 22 aa, Entamoeba invadens
EGREITRLQGFYTKSTPKEGEK

SEQ ID NO: 2978324 - protein, 25 aa, Entamoeba invadens
EHLCAFKGKIWAKVFIKSKPQRYGI

SEQ ID NO: 2978325 - protein, 24 aa, Entamoeba invadens
EHVVLKMCKRCFVMSKKPEIVTQI

SEQ ID NO: 2978326 - protein, 18 aa, Entamoeba invadens
EHYKSVVFHTKFALNTLF

SEQ ID NO: 2978327 - protein, 20 aa, Entamoeba invadens
EIKKKWRMCHSLKDYKRKEM

SEQ ID NO: 2978328 - protein, 23 aa, Entamoeba invadens
EIKMLKILCQWFCRKRRLSDYNQ

SEQ ID NO: 2978329 - protein, 22 aa, Entamoeba invadens
EIQRPNCEYAWVFEKTKGEKWE

SEQ ID NO: 2978330 - protein, 23 aa, Entamoeba invadens
EKDDGKCGLQFFSKSFKTMKIKS

SEQ ID NO: 2978331 - protein, 22 aa, Entamoeba invadens
ELEFGFKCIFILVKGSVEKSNK

SEQ ID NO: 2978332 - protein, 17 aa, Entamoeba invadens
ELLIRDMLRDVGKDFPD

SEQ ID NO: 2978333 - protein, 25 aa, Entamoeba invadens
EPEIFLVKVFIKWFCKKSRLNDYNT

SEQ ID NO: 2978334 - protein, 18 aa, Entamoeba invadens
EYNFGYLIYCEFTSLSIK

SEQ ID NO: 2978335 - protein, 19 aa, Entamoeba invadens
FAERADMIILVFDAHKLDI

SEQ ID NO: 2978336 - protein, 22 aa, Entamoeba invadens
FCLSKFRLPLGIRHLPESLFAL

SEQ ID NO: 2978337 - protein, 17 aa, Entamoeba invadens
FEMTARVALGMEDGKEK

SEQ ID NO: 2978338 - protein, 17 aa, Entamoeba invadens
FGSACFENSTLYSYIQS

SEQ ID NO: 2978339 - protein, 22 aa, Entamoeba invadens
FKESRMKVALCLSVETLSTLLF

SEQ ID NO: 2978340 - protein, 18 aa, Entamoeba invadens
FKTPYGITVHDILKGIDI

SEQ ID NO: 2978341 - protein, 19 aa, Entamoeba invadens
FLISDVFLGCVEFDLTHLK

SEQ ID NO: 2978342 - protein, 17 aa, Entamoeba invadens
FLPRGSGIVTRRPLIVQ

SEQ ID NO: 2978343 - protein, 18 aa, Entamoeba invadens
FMFVKGCQKVCDYPSFDK

SEQ ID NO: 2978344 - protein, 17 aa, Entamoeba invadens
FNFKQECLWKYNTQIYD

SEQ ID NO: 2978345 - protein, 21 aa, Entamoeba invadens
FRFGKTKIFFKVGVLAEIEEI

SEQ ID NO: 2978346 - protein, 27 aa, Entamoeba invadens
FSVPSVFRKEFSALKRKGEISWDDLVK

SEQ ID NO: 2978347 - protein, 17 aa, Entamoeba invadens
FTVDFMFVKGCQKVCDY

SEQ ID NO: 2978348 - protein, 17 aa, Entamoeba invadens
FYIHSCLSYLAMKKKYS

SEQ ID NO: 2978349 - protein, 21 aa, Entamoeba invadens
FYLPEFKAIFVADNFASCMHN

SEQ ID NO: 2978350 - protein, 24 aa, Entamoeba invadens
GCIAAEFFIGIPLFPGSSEYNQIY

SEQ ID NO: 2978351 - protein, 18 aa, Entamoeba invadens
GCNARPSVCPCWSVEPKL

SEQ ID NO: 2978352 - protein, 17 aa, Entamoeba invadens
GDKEIKSQYLIQNSDYT

SEQ ID NO: 2978353 - protein, 29 aa, Entamoeba invadens
GITFVAIFIRVCMKFDFYECPLLLSEYYG

SEQ ID NO: 2978354 - protein, 19 aa, Entamoeba invadens
GRRVICPQIIYTDTYEYHA

SEQ ID NO: 2978355 - protein, 17 aa, Entamoeba invadens
GTRPCLYVPQTAFENLI

SEQ ID NO: 2978356 - protein, 19 aa, Entamoeba invadens
GVCAVWRIIKDVNFIEHVV

SEQ ID NO: 2978357 - protein, 17 aa, Entamoeba invadens
GYYSCFSCANLKEVVLP

SEQ ID NO: 2978358 - protein, 17 aa, Entamoeba invadens
HDVRCRFGIIKRRALRL

SEQ ID NO: 2978359 - protein, 17 aa, Entamoeba invadens
HFFDGFRTSHEIQKIHQ

SEQ ID NO: 2978360 - protein, 18 aa, Entamoeba invadens
HGMKECLPLILIMRNRLH

SEQ ID NO: 2978361 - protein, 22 aa, Entamoeba invadens
HKGAVWGVCWSHPRFGVLATCG

SEQ ID NO: 2978362 - protein, 17 aa, Entamoeba invadens
IDMIKFLLGKAENQFTH

SEQ ID NO: 2978363 - protein, 21 aa, Entamoeba invadens
IGEKCFYCCVELSAITLGEVL

SEQ ID NO: 2978364 - protein, 24 aa, Entamoeba invadens
IGERRKAFEWHFLDLTKPKQQPPQ

SEQ ID NO: 2978365 - protein, 22 aa, Entamoeba invadens
IKCPRYRWDYESHFTEEIKSIW

SEQ ID NO: 2978366 - protein, 23 aa, Entamoeba invadens
ILNPHFCKLIAWYDNEWGYSTRL

SEQ ID NO: 2978367 - protein, 18 aa, Entamoeba invadens
INKEFLFNVVFAAADAFR

SEQ ID NO: 2978368 - protein, 18 aa, Entamoeba invadens
IRHTFKFYYDRFPSYMPN

SEQ ID NO: 2978369 - protein, 22 aa, Entamoeba invadens
IRKELRSTCEFVMGKNTLIRKA

SEQ ID NO: 2978370 - protein, 24 aa, Entamoeba invadens
IRKYSNDAFKCFETITLNKESQND

SEQ ID NO: 2978371 - protein, 23 aa, Entamoeba invadens
IVSLCAWKLPKYVLRDVYESNSV

SEQ ID NO: 2978372 - protein, 18 aa, Entamoeba invadens
IWNCTHPTFLSSIETQIE

SEQ ID NO: 2978373 - protein, 17 aa, Entamoeba invadens
KATYSFTRWCYIYKNVE

SEQ ID NO: 2978374 - protein, 18 aa, Entamoeba invadens
KDFLEKLETVFGLQEEGY

SEQ ID NO: 2978375 - protein, 18 aa, Entamoeba invadens
KETLKEIACISQGYEDNK

SEQ ID NO: 2978376 - protein, 23 aa, Entamoeba invadens
KFHKYIKWGVCVDAYSCYMDDFL

SEQ ID NO: 2978377 - protein, 24 aa, Entamoeba invadens
KGPSLYCVLPLVGSEKMQFPFLLN

SEQ ID NO: 2978378 - protein, 20 aa, Entamoeba invadens
KIETLQCYDYMLGNNDKLVH

SEQ ID NO: 2978379 - protein, 20 aa, Entamoeba invadens
KILYSLGVAFEFFDLKYSDL

SEQ ID NO: 2978380 - protein, 23 aa, Entamoeba invadens
KKCFECLQSLFINPLINLEIETF

SEQ ID NO: 2978381 - protein, 22 aa, Entamoeba invadens
KKEFFRIIVWFNVDFKTVDRNK

SEQ ID NO: 2978382 - protein, 24 aa, Entamoeba invadens
KPSSENWLKWIVSVGEEFEFDFKK

SEQ ID NO: 2978383 - protein, 18 aa, Entamoeba invadens
KSNVFSNEIEKIYNLRSQ

SEQ ID NO: 2978384 - protein, 20 aa, Entamoeba invadens
KTRFLSLECVFRWVYNNYDN

SEQ ID NO: 2978385 - protein, 20 aa, Entamoeba invadens
KYIRDIICGIMFLHEQGIVH

SEQ ID NO: 2978386 - protein, 22 aa, Entamoeba invadens
LCMGNLRLAHYLAQYGSTLLGT

SEQ ID NO: 2978387 - protein, 23 aa, Entamoeba invadens
LCMGNLRLAHYLAQYGSTLLGTV

SEQ ID NO: 2978388 - protein, 23 aa, Entamoeba invadens
LEHIKGNVGFIFTKGDLHALKDK

SEQ ID NO: 2978389 - protein, 18 aa, Entamoeba invadens
LFLGYPLFGATSEYNLLY

SEQ ID NO: 2978390 - protein, 22 aa, Entamoeba invadens
LGFCIASLFGVMLGKKEFKKVE

SEQ ID NO: 2978391 - protein, 20 aa, Entamoeba invadens
LGTACGRYFGVSVLSIVDAG

SEQ ID NO: 2978392 - protein, 21 aa, Entamoeba invadens
LIDFGSACFENYTLYSYIQSR

SEQ ID NO: 2978393 - protein, 19 aa, Entamoeba invadens
LKYDSCFLAEYGINKCIKK

SEQ ID NO: 2978394 - protein, 24 aa, Entamoeba invadens
LNPLKLYINWCTIRNSTLETINVV

SEQ ID NO: 2978395 - protein, 18 aa, Entamoeba invadens
LNRDIPILLVGLKSDLRE

SEQ ID NO: 2978396 - protein, 20 aa, Entamoeba invadens
LPGCGDVGCKVGGYTVNLYD

SEQ ID NO: 2978397 - protein, 20 aa, Entamoeba invadens
LPKEIPFSVPSVFRKEFSAL

SEQ ID NO: 2978398 - protein, 22 aa, Entamoeba invadens
LQLRPSFEFTKDFKIKSRSQFC

SEQ ID NO: 2978399 - protein, 17 aa, Entamoeba invadens
LRKIVKMQMKDIVARIK

SEQ ID NO: 2978400 - protein, 19 aa, Entamoeba invadens
LSILFGRPMYQVSFGELGT

SEQ ID NO: 2978401 - protein, 20 aa, Entamoeba invadens
MATQLFGKRMVCAMTSGCSS

SEQ ID NO: 2978402 - protein, 17 aa, Entamoeba invadens
MCECLRNIVKINGVDSF

SEQ ID NO: 2978403 - protein, 17 aa, Entamoeba invadens
MDEFFRKPLLSLAEQKV

SEQ ID NO: 2978404 - protein, 25 aa, Entamoeba invadens
MEKCTPHAIRVCGYTGKQLVLNDEK

SEQ ID NO: 2978405 - protein, 19 aa, Entamoeba invadens
MLIKACSVVQYVRFMNTLD

SEQ ID NO: 2978406 - protein, 18 aa, Entamoeba invadens
MTCPKCHGEWCWMCRGDW

SEQ ID NO: 2978407 - protein, 20 aa, Entamoeba invadens
NAGLCKRALVQLSYAIGLSH

SEQ ID NO: 2978408 - protein, 18 aa, Entamoeba invadens
NDFPKLGTFVLRDNGKIA

SEQ ID NO: 2978409 - protein, 20 aa, Entamoeba invadens
NFFCSLRLAHYLAQCGSTLL

SEQ ID NO: 2978410 - protein, 22 aa, Entamoeba invadens
NFFCSLRLAHYLAQYGSTLLGT

SEQ ID NO: 2978411 - protein, 18 aa, Entamoeba invadens
NGNLKGIRPHDAVEKSGN

SEQ ID NO: 2978412 - protein, 24 aa, Entamoeba invadens
NLLELKPSFEFSKTFDIKTRENFT

SEQ ID NO: 2978413 - protein, 24 aa, Entamoeba invadens
NLLELRPSFEFDKQFNIKTREHFT

SEQ ID NO: 2978414 - protein, 20 aa, Entamoeba invadens
NLRELPAFCFSDCKKLREVV

SEQ ID NO: 2978415 - protein, 18 aa, Entamoeba invadens
NLSKHIICLSKLNESETC

SEQ ID NO: 2978416 - protein, 24 aa, Entamoeba invadens
NSSNWCFAHLTALVGVSMMKSAEG

SEQ ID NO: 2978417 - protein, 21 aa, Entamoeba invadens
NYEKGIAFPCCISLNNCCGYY

SEQ ID NO: 2978418 - protein, 18 aa, Entamoeba invadens
PKVFPSLNYFGASVPICK

SEQ ID NO: 2978419 - protein, 22 aa, Entamoeba invadens
PRELAVKFVEAFGGVEKTLEIG

SEQ ID NO: 2978420 - protein, 17 aa, Entamoeba invadens
PTGSFMFLGPSGVGKTE

SEQ ID NO: 2978421 - protein, 23 aa, Entamoeba invadens
QLYRFGQTVSVCFWTDNWKPFSY

SEQ ID NO: 2978422 - protein, 20 aa, Entamoeba invadens
QMKRMWKWYMMNQMYNRPPP

SEQ ID NO: 2978423 - protein, 19 aa, Entamoeba invadens
QMRKGDCQIAIIGDEDSVT

SEQ ID NO: 2978424 - protein, 22 aa, Entamoeba invadens
QPLCPASFLLRCDTLKEYTGNY

SEQ ID NO: 2978425 - protein, 18 aa, Entamoeba invadens
QTPECLRVYVSSFWEQPF

SEQ ID NO: 2978426 - protein, 22 aa, Entamoeba invadens
RDCSRTGLRFSSRGGDINGNVS

SEQ ID NO: 2978427 - protein, 19 aa, Entamoeba invadens
RFEEFRNYFTFELKTQLPE

SEQ ID NO: 2978428 - protein, 21 aa, Entamoeba invadens
RFMLPCGMFKFTVHNTTELEM

SEQ ID NO: 2978429 - protein, 18 aa, Entamoeba invadens
RIYTRVGLEFNDETEKKI

SEQ ID NO: 2978430 - protein, 19 aa, Entamoeba invadens
RLDLSHVMFFGSQYDMTFL

SEQ ID NO: 2978431 - protein, 17 aa, Entamoeba invadens
RQLEVIKIPASVCLVDR

SEQ ID NO: 2978432 - protein, 18 aa, Entamoeba invadens
RVDIPSVNTYVFKGVKYE

SEQ ID NO: 2978433 - protein, 18 aa, Entamoeba invadens
RYPWEVVNFITGGRRLDK

SEQ ID NO: 2978434 - protein, 23 aa, Entamoeba invadens
SFDAICWKVAFSVDAEQLAVSLE

SEQ ID NO: 2978435 - protein, 19 aa, Entamoeba invadens
SLMEFIGYFESLKGIMPPV

SEQ ID NO: 2978436 - protein, 18 aa, Entamoeba invadens
SLVSLLLCEGMEDKDSIR

SEQ ID NO: 2978437 - protein, 18 aa, Entamoeba invadens
SNLIKLWFRELPKPILNV

SEQ ID NO: 2978438 - protein, 19 aa, Entamoeba invadens
SPCNPRIPMVVDMEKILKE

SEQ ID NO: 2978439 - protein, 17 aa, Entamoeba invadens
SRLTSIGSLCFYGCYSL

SEQ ID NO: 2978440 - protein, 18 aa, Entamoeba invadens
SSNWCFAHLTALVGVSMM

SEQ ID NO: 2978441 - protein, 20 aa, Entamoeba invadens
STNFKGWEWFIIEKSPEKKM

SEQ ID NO: 2978442 - protein, 19 aa, Entamoeba invadens
SVGYYSCFSCVNLKEVVLP

SEQ ID NO: 2978443 - protein, 18 aa, Entamoeba invadens
TCSCGHQFCWLCMADYTN

SEQ ID NO: 2978444 - protein, 19 aa, Entamoeba invadens
TDMCIVMGCDGVWDVLTNE

SEQ ID NO: 2978445 - protein, 19 aa, Entamoeba invadens
TLRALRLATSMTFLSNSSI

SEQ ID NO: 2978446 - protein, 19 aa, Entamoeba invadens
TMFECFKWGEIYPKKDFQF

SEQ ID NO: 2978447 - protein, 22 aa, Entamoeba invadens
VCLIEVRLILPFSVEKLIEKIP

SEQ ID NO: 2978448 - protein, 19 aa, Entamoeba invadens
VDLSLLNCHCDVKLGEAKL

SEQ ID NO: 2978449 - protein, 18 aa, Entamoeba invadens
VECFRLFFCEEITNNLLL

SEQ ID NO: 2978450 - protein, 18 aa, Entamoeba invadens
VKFPYGYPILENFNITSH

SEQ ID NO: 2978451 - protein, 18 aa, Entamoeba invadens
VKLSLKYNVLSKYTTFVA

SEQ ID NO: 2978452 - protein, 17 aa, Entamoeba invadens
VMSECYGKLLAFDLEKY

SEQ ID NO: 2978453 - protein, 17 aa, Entamoeba invadens
VQLYVKFFVKVRNAMLV

SEQ ID NO: 2978454 - protein, 20 aa, Entamoeba invadens
VVLARPGFRVARRKRGQNRI

SEQ ID NO: 2978455 - protein, 18 aa, Entamoeba invadens
WLSWIMKILELMDADLIK

SEQ ID NO: 2978456 - protein, 17 aa, Entamoeba invadens
WRMCHSLKDYKRKEMKK

SEQ ID NO: 2978457 - protein, 17 aa, Entamoeba invadens
YDGEMNALFGMDKCTGT

SEQ ID NO: 2978458 - protein, 18 aa, Entamoeba invadens
YDKLRIIRDLCLPFVKTN

SEQ ID NO: 2978459 - protein, 18 aa, Entamoeba invadens
YETFGWREAYPVNTFKFP

SEQ ID NO: 2978460 - protein, 19 aa, Entamoeba invadens
YGCPAHADVLVPIVTRSEY

SEQ ID NO: 2978461 - protein, 17 aa, Entamoeba invadens
YKRSGVVGVNIGKIKRM

SEQ ID NO: 2978462 - protein, 23 aa, Entamoeba invadens
YLCKKLEVPYCIVKGKARLGKII

SEQ ID NO: 2978463 - protein, 18 aa, Entamoeba invadens
YLGGCCFNCCESLVEVEL

SEQ ID NO: 2978464 - protein, 19 aa, Entamoeba invadens
YNEFLKRYFFLGTNINKKT

SEQ ID NO: 2978465 - protein, 22 aa, Entamoeba invadens
YNPKRFAGAIMRISSPKSTALI

SEQ ID NO: 2978466 - protein, 20 aa, Entamoeba invadens
AAAHCPFNFVSKIIDSNPGA

SEQ ID NO: 2978467 - protein, 25 aa, Entamoeba invadens
AAEFYWKRHEDVLKEIRRTVEILVF

SEQ ID NO: 2978468 - protein, 20 aa, Entamoeba invadens
AAFDYKCVLVLGICDNPIIE

SEQ ID NO: 2978469 - protein, 17 aa, Entamoeba invadens
AAFEMVKVLLMDRESTS

SEQ ID NO: 2978470 - protein, 17 aa, Entamoeba invadens
AAGCVLAQMIIRPKPLF

SEQ ID NO: 2978471 - protein, 19 aa, Entamoeba invadens
AAILWRISRFNGMTQQTIT

SEQ ID NO: 2978472 - protein, 19 aa, Entamoeba invadens
AAKENRWVAAYVLKETDLN

SEQ ID NO: 2978473 - protein, 19 aa, Entamoeba invadens
AALCRRSISLLNCLQFSPH

SEQ ID NO: 2978474 - protein, 19 aa, Entamoeba invadens
AALDDFKSLLILLKRKCED

SEQ ID NO: 2978475 - protein, 18 aa, Entamoeba invadens
AALSLSLLTRIDFCEVKY

SEQ ID NO: 2978476 - protein, 17 aa, Entamoeba invadens
AALTFNWLVDYAEQNGF

SEQ ID NO: 2978477 - protein, 18 aa, Entamoeba invadens
AALVFVGPVWCWDLCAPL

SEQ ID NO: 2978478 - protein, 18 aa, Entamoeba invadens
AANCFRKYTGVDMIKIPK

SEQ ID NO: 2978479 - protein, 19 aa, Entamoeba invadens
AAPILKFAVSVPFFATLSE

SEQ ID NO: 2978480 - protein, 17 aa, Entamoeba invadens
AATELKREYLLLESATE

SEQ ID NO: 2978481 - protein, 18 aa, Entamoeba invadens
AATTFDWGTVVSNTSDVT

SEQ ID NO: 2978482 - protein, 19 aa, Entamoeba invadens
ACFLKEIIVEINVDQVAVN

SEQ ID NO: 2978483 - protein, 20 aa, Entamoeba invadens
ACFMKEILEESGLSSQVYLY

SEQ ID NO: 2978484 - protein, 23 aa, Entamoeba invadens
ACFMKEILEESGLSSQVYLYTKK

SEQ ID NO: 2978485 - protein, 17 aa, Entamoeba invadens
ACFRGCNSLVLLILPQK

SEQ ID NO: 2978486 - protein, 17 aa, Entamoeba invadens
ACFYMNLEIMQFLINAG

SEQ ID NO: 2978487 - protein, 19 aa, Entamoeba invadens
ACGRTPLHIAVIMNDALSV

SEQ ID NO: 2978488 - protein, 21 aa, Entamoeba invadens
ACLTTPLSMCFLDYYYSNDNI

SEQ ID NO: 2978489 - protein, 17 aa, Entamoeba invadens
ACMDEVPVHVGMEEDDT

SEQ ID NO: 2978490 - protein, 18 aa, Entamoeba invadens
ACPCSICKKAVLYTSTPQ

SEQ ID NO: 2978491 - protein, 20 aa, Entamoeba invadens
ACSIARPFVSLALNGSTDCI

SEQ ID NO: 2978492 - protein, 19 aa, Entamoeba invadens
ACVLPGASVLLWEGDDFVL

SEQ ID NO: 2978493 - protein, 18 aa, Entamoeba invadens
ACWMKEMIDKAVLDVDEY

SEQ ID NO: 2978494 - protein, 17 aa, Entamoeba invadens
ACYKCDVSYVWFKAVKE

SEQ ID NO: 2978495 - protein, 25 aa, Entamoeba invadens
ADFCYAATVALNWSLCVGVSMCGGA

SEQ ID NO: 2978496 - protein, 23 aa, Entamoeba invadens
ADFEKRKKLEIARHAEKIENILK

SEQ ID NO: 2978497 - protein, 17 aa, Entamoeba invadens
ADFPPYAFVKFTDEKSA

SEQ ID NO: 2978498 - protein, 19 aa, Entamoeba invadens
ADGFLMKFLFASETPFEKF

SEQ ID NO: 2978499 - protein, 20 aa, Entamoeba invadens
ADGTKRWNRSVVDMGYEILV

SEQ ID NO: 2978500 - protein, 20 aa, Entamoeba invadens
ADGTRFLYRLCEDVYIVVIT

SEQ ID NO: 2978501 - protein, 18 aa, Entamoeba invadens
ADHRRLNVALTRARKGLV

SEQ ID NO: 2978502 - protein, 20 aa, Entamoeba invadens
ADICGGLWYLHFNKHVLHRD

SEQ ID NO: 2978503 - protein, 21 aa, Entamoeba invadens
ADIFKYKFIFLPLHTSSHFSL

SEQ ID NO: 2978504 - protein, 17 aa, Entamoeba invadens
ADIKAHQNFPCIPFFGV

SEQ ID NO: 2978505 - protein, 17 aa, Entamoeba invadens
ADKGGNCYYVVNNDVYS

SEQ ID NO: 2978506 - protein, 20 aa, Entamoeba invadens
ADLGARCLCYSTIGIYQLLA

SEQ ID NO: 2978507 - protein, 17 aa, Entamoeba invadens
ADLIKIWPGIGPIQVIG

SEQ ID NO: 2978508 - protein, 18 aa, Entamoeba invadens
ADLLAGVLKKFVRNLPSM

SEQ ID NO: 2978509 - protein, 21 aa, Entamoeba invadens
ADLLIKMGIEYKDEVAIVPPM

SEQ ID NO: 2978510 - protein, 17 aa, Entamoeba invadens
ADLLRYFFHFVKSTCPY

SEQ ID NO: 2978511 - protein, 17 aa, Entamoeba invadens
ADLLVMITYIEKMDMFY

SEQ ID NO: 2978512 - protein, 17 aa, Entamoeba invadens
ADLVVCLYIDKDYYFNT

SEQ ID NO: 2978513 - protein, 23 aa, Entamoeba invadens
ADNLLDLRVCEQLVKCLTENVAD

SEQ ID NO: 2978514 - protein, 20 aa, Entamoeba invadens
ADSCLWEFDLLRYHINPDVR

SEQ ID NO: 2978515 - protein, 17 aa, Entamoeba invadens
ADTLVLWLDCDREGENI

SEQ ID NO: 2978516 - protein, 18 aa, Entamoeba invadens
ADVWSLGMICYFIATGDH

SEQ ID NO: 2978517 - protein, 20 aa, Entamoeba invadens
AEALMWVFLLRQSFIGFYDP

SEQ ID NO: 2978518 - protein, 18 aa, Entamoeba invadens
AECFKFSDIYPIEQTDVN

SEQ ID NO: 2978519 - protein, 17 aa, Entamoeba invadens
AECKIVYVTRLLVINDD

SEQ ID NO: 2978520 - protein, 17 aa, Entamoeba invadens
AECTLQFANERTLHAVT

SEQ ID NO: 2978521 - protein, 18 aa, Entamoeba invadens
AEDPATRPEYKWIVDTLN

SEQ ID NO: 2978522 - protein, 20 aa, Entamoeba invadens
AEEAHKIWGGLDMFAIDIIM

SEQ ID NO: 2978523 - protein, 23 aa, Entamoeba invadens
AEEHGAVCFCHWFQPLTSKSAKK

SEQ ID NO: 2978524 - protein, 24 aa, Entamoeba invadens
AEEIWKFVATFSELEQENHAEGKD

SEQ ID NO: 2978525 - protein, 22 aa, Entamoeba invadens
AEELRYLVGLVFLYEKVKKEIG

SEQ ID NO: 2978526 - protein, 24 aa, Entamoeba invadens
AEERRLKGQYGYQWVRTPSEQAAL

SEQ ID NO: 2978527 - protein, 22 aa, Entamoeba invadens
AEFDRRLMPIISYLDDELGKYL

SEQ ID NO: 2978528 - protein, 17 aa, Entamoeba invadens
AEFFLTIPLQLEVQNSH

SEQ ID NO: 2978529 - protein, 17 aa, Entamoeba invadens
AEFKRLGCYFVNDEEKA

SEQ ID NO: 2978530 - protein, 20 aa, Entamoeba invadens
AEFLLHVAHAIHWSDRKEVG

SEQ ID NO: 2978531 - protein, 17 aa, Entamoeba invadens
AEFLLQVTVDFLVRSND

SEQ ID NO: 2978532 - protein, 23 aa, Entamoeba invadens
AEFWRAHVLDLPKLCGLAKNYYS

SEQ ID NO: 2978533 - protein, 23 aa, Entamoeba invadens
AEGLLRMGLHPTIIVDGYRAGLK

SEQ ID NO: 2978534 - protein, 17 aa, Entamoeba invadens
AEIFKANVVAWEYPGYT

SEQ ID NO: 2978535 - protein, 18 aa, Entamoeba invadens
AEIFPNMVLHYNFTPTLF

SEQ ID NO: 2978536 - protein, 23 aa, Entamoeba invadens
AEIIYKWCFRNCKSLKEITLPKN

SEQ ID NO: 2978537 - protein, 25 aa, Entamoeba invadens
AEIIYKWCFRNCKSLKEITLPKNLC

SEQ ID NO: 2978538 - protein, 18 aa, Entamoeba invadens
AEIVFRFSPSPTHQPPKE

SEQ ID NO: 2978539 - protein, 17 aa, Entamoeba invadens
AEKCKLFLLSGVDCAAC

SEQ ID NO: 2978540 - protein, 17 aa, Entamoeba invadens
AEKCKLFLLSGVDCATC

SEQ ID NO: 2978541 - protein, 25 aa, Entamoeba invadens
AEKIFKERFYHIALHSGFYQKLSLL

SEQ ID NO: 2978542 - protein, 21 aa, Entamoeba invadens
AEKLFKRWCDVVTSDMEKIGN

SEQ ID NO: 2978543 - protein, 20 aa, Entamoeba invadens
AELFKFPQYVQFWGYVKKYI

SEQ ID NO: 2978544 - protein, 20 aa, Entamoeba invadens
AELFVGIPIFPGNSEYNMIY

SEQ ID NO: 2978545 - protein, 22 aa, Entamoeba invadens
AELKVLLKWREFVLRKIKIAQN

SEQ ID NO: 2978546 - protein, 20 aa, Entamoeba invadens
AELMTGVLLYHERVDIKPTT

SEQ ID NO: 2978547 - protein, 17 aa, Entamoeba invadens
AELRSALKSKFTKDFQK

SEQ ID NO: 2978548 - protein, 17 aa, Entamoeba invadens
AELWSLFDFVYPGKLGT

SEQ ID NO: 2978549 - protein, 18 aa, Entamoeba invadens
AEPLFFPIRVLRKVQSKV

SEQ ID NO: 2978550 - protein, 21 aa, Entamoeba invadens
AEQKKLVVINMNFLQYEMSTD

SEQ ID NO: 2978551 - protein, 20 aa, Entamoeba invadens
AESIANWFEIYSWWKNNIEA

SEQ ID NO: 2978552 - protein, 21 aa, Entamoeba invadens
AESLRPVLGYDLLQYLDVLPV

SEQ ID NO: 2978553 - protein, 20 aa, Entamoeba invadens
AEVAFVWEVRKMRVVPKNKR

SEQ ID NO: 2978554 - protein, 19 aa, Entamoeba invadens
AEVLRTCIIYQLNDFLDTV

SEQ ID NO: 2978555 - protein, 17 aa, Entamoeba invadens
AEWGVVCKFIKAVSTNY

SEQ ID NO: 2978556 - protein, 17 aa, Entamoeba invadens
AEYFIRVAFKLEKQRMF

SEQ ID NO: 2978557 - protein, 24 aa, Entamoeba invadens
AEYIKVVICKKCFACTKKKTMETK

SEQ ID NO: 2978558 - protein, 17 aa, Entamoeba invadens
AFAKFYLNDAFKCHVCK

SEQ ID NO: 2978559 - protein, 21 aa, Entamoeba invadens
AFAPSCVFIKALIPEVTAQLL

SEQ ID NO: 2978560 - protein, 19 aa, Entamoeba invadens
AFCHLKMLVNLNVSCNKIP

SEQ ID NO: 2978561 - protein, 18 aa, Entamoeba invadens
AFCIIKHVIQYQGVYSQR

SEQ ID NO: 2978562 - protein, 27 aa, Entamoeba invadens
AFDLANHFCEWCGFECNWDSYPNQETQ

SEQ ID NO: 2978563 - protein, 24 aa, Entamoeba invadens
AFEEILEVPRRCQLLCKKNKISTV

SEQ ID NO: 2978564 - protein, 18 aa, Entamoeba invadens
AFEFKGDLLIFLLDSLYD

SEQ ID NO: 2978565 - protein, 19 aa, Entamoeba invadens
AFELFKWNKEKGVCKGVSA

SEQ ID NO: 2978566 - protein, 19 aa, Entamoeba invadens
AFENCLRLVLKIQEKDVIL

SEQ ID NO: 2978567 - protein, 18 aa, Entamoeba invadens
AFEVIPFTLAENAGLNPM

SEQ ID NO: 2978568 - protein, 22 aa, Entamoeba invadens
AFFKACVIVPFRAILTEYVANG

SEQ ID NO: 2978569 - protein, 25 aa, Entamoeba invadens
AFFPNPNCAEAFHLFLRRGADLNAR

SEQ ID NO: 2978570 - protein, 21 aa, Entamoeba invadens
AFFVFCDECVFGFYSESQTLY

SEQ ID NO: 2978571 - protein, 25 aa, Entamoeba invadens
AFGACLACGVLMNFTRTLLIKNGLI

SEQ ID NO: 2978572 - protein, 18 aa, Entamoeba invadens
AFGAFSLVDENVYTTVIE

SEQ ID NO: 2978573 - protein, 19 aa, Entamoeba invadens
AFIFFGVVCESYFLLNTQI

SEQ ID NO: 2978574 - protein, 18 aa, Entamoeba invadens
AFKARGGILVVVSFSSAE

SEQ ID NO: 2978575 - protein, 17 aa, Entamoeba invadens
AFKSCKSFENFVIPNTV

SEQ ID NO: 2978576 - protein, 19 aa, Entamoeba invadens
AFKSIGVVIDEEFCRFEDV

SEQ ID NO: 2978577 - protein, 23 aa, Entamoeba invadens
AFNGYCYLEELVIPKSVTKIGNG

SEQ ID NO: 2978578 - protein, 19 aa, Entamoeba invadens
AFQALPTWKRATLKKQKKL

SEQ ID NO: 2978579 - protein, 21 aa, Entamoeba invadens
AFRCTEPFFQPSLIGKEMAGL

SEQ ID NO: 2978580 - protein, 21 aa, Entamoeba invadens
AFTEFGFLLSFEKVGIKGNTK

SEQ ID NO: 2978581 - protein, 21 aa, Entamoeba invadens
AFTMLRINPFYSLKTLNEEMK

SEQ ID NO: 2978582 - protein, 19 aa, Entamoeba invadens
AFTSMIDWAFAPSCIFSKA

SEQ ID NO: 2978583 - protein, 18 aa, Entamoeba invadens
AFTTKWFYVDRMFVKAQF

SEQ ID NO: 2978584 - protein, 21 aa, Entamoeba invadens
AFVKNDWKHFVFMFEGKNQIG

SEQ ID NO: 2978585 - protein, 17 aa, Entamoeba invadens
AFYASLCMKHFQIPFGV

SEQ ID NO: 2978586 - protein, 19 aa, Entamoeba invadens
AGCVFCHASGFLACNKTFE

SEQ ID NO: 2978587 - protein, 24 aa, Entamoeba invadens
AGDLPRLLKHLSIVRKVGQDISCL

SEQ ID NO: 2978588 - protein, 18 aa, Entamoeba invadens
AGEFKYLFDVMRVDNSMR

SEQ ID NO: 2978589 - protein, 23 aa, Entamoeba invadens
AGEGYLQCLQRLLGTNAGYEMFV

SEQ ID NO: 2978590 - protein, 19 aa, Entamoeba invadens
AGFFGCQGRNIFKQNPLTI

SEQ ID NO: 2978591 - protein, 19 aa, Entamoeba invadens
AGFKPSYLSNPVWVETLMD

SEQ ID NO: 2978592 - protein, 22 aa, Entamoeba invadens
AGFKRPNGGFGDFVIRKIKDRI

SEQ ID NO: 2978593 - protein, 18 aa, Entamoeba invadens
AGGTLGWAEFCRDKNLAR

SEQ ID NO: 2978594 - protein, 22 aa, Entamoeba invadens
AGKKLECKQCYEREFEEEEGKK

SEQ ID NO: 2978595 - protein, 23 aa, Entamoeba invadens
AGLGRSGTFIGVLRVVEEHVEKL

SEQ ID NO: 2978596 - protein, 20 aa, Entamoeba invadens
AGNVLRRFSATKVISKQITP

SEQ ID NO: 2978597 - protein, 22 aa, Entamoeba invadens
AGRTRPGKCFRLYTEKGFEESL

SEQ ID NO: 2978598 - protein, 17 aa, Entamoeba invadens
AGTDIIGCIEIICFILT

SEQ ID NO: 2978599 - protein, 17 aa, Entamoeba invadens
AGVKKMRESLCFSNEPN

SEQ ID NO: 2978600 - protein, 17 aa, Entamoeba invadens
AGVLVCLVALCFFFDDK

SEQ ID NO: 2978601 - protein, 19 aa, Entamoeba invadens
AHAEEIWNFVNLFSSLEQE

SEQ ID NO: 2978602 - protein, 22 aa, Entamoeba invadens
AHGMCLIKLPFIKEVKKLQLKY

SEQ ID NO: 2978603 - protein, 17 aa, Entamoeba invadens
AHIEGIFRVSGSKEKIE

SEQ ID NO: 2978604 - protein, 22 aa, Entamoeba invadens
AHLELAYLPRFFLGAFKAFVNL

SEQ ID NO: 2978605 - protein, 20 aa, Entamoeba invadens
AHLHEWIDLIFGYKQQGEAA

SEQ ID NO: 2978606 - protein, 19 aa, Entamoeba invadens
AHLTERLIRIQSISKQNTT

SEQ ID NO: 2978607 - protein, 19 aa, Entamoeba invadens
AHPKLFVLIDFLRKIENKT

SEQ ID NO: 2978608 - protein, 19 aa, Entamoeba invadens
AHVTIFPCFWDKEEQIAIV

SEQ ID NO: 2978609 - protein, 17 aa, Entamoeba invadens
AIAWRYLPTTLKLKGTT

SEQ ID NO: 2978610 - protein, 20 aa, Entamoeba invadens
AICDGCGWGSASCLAAQSAL

SEQ ID NO: 2978611 - protein, 18 aa, Entamoeba invadens
AICLLYVKGEFNVEYNPT

SEQ ID NO: 2978612 - protein, 23 aa, Entamoeba invadens
AIDRLTGLGFSKAQAIQAYVACD

SEQ ID NO: 2978613 - protein, 19 aa, Entamoeba invadens
AIEKVCCNLVRLFDITTAI

SEQ ID NO: 2978614 - protein, 20 aa, Entamoeba invadens
AIEYCGLGDWFGVSEYMGTR

SEQ ID NO: 2978615 - protein, 18 aa, Entamoeba invadens
AIGNRLTFNYVFNKKYDK

SEQ ID NO: 2978616 - protein, 18 aa, Entamoeba invadens
AIHFRFLMRYAEEPCNSL

SEQ ID NO: 2978617 - protein, 17 aa, Entamoeba invadens
AILIRNGFYIKIKRLYK

SEQ ID NO: 2978618 - protein, 18 aa, Entamoeba invadens
AIPMEIGSLLSLEYLNIS

SEQ ID NO: 2978619 - protein, 26 aa, Entamoeba invadens
AIPPTKRWGALIPIGFITPEADCPVT

SEQ ID NO: 2978620 - protein, 19 aa, Entamoeba invadens
AITMLWCITWTDPFPQTVY

SEQ ID NO: 2978621 - protein, 26 aa, Entamoeba invadens
AITMYEVFGWKEAYSIQTFKFPWKIA

SEQ ID NO: 2978622 - protein, 25 aa, Entamoeba invadens
AITQFKLILVLAIDKVRINTAYTLF

SEQ ID NO: 2978623 - protein, 19 aa, Entamoeba invadens
AIVCFARLVGHEGVKSDVY

SEQ ID NO: 2978624 - protein, 19 aa, Entamoeba invadens
AIVYRKLRATRRCSICETN

SEQ ID NO: 2978625 - protein, 24 aa, Entamoeba invadens
AKAEEIWKFVQIFSDLDQENHASG

SEQ ID NO: 2978626 - protein, 31 aa, Entamoeba invadens
AKAISQRKLIEWKLDEQIVIIVIQDTIHIWY

SEQ ID NO: 2978627 - protein, 20 aa, Entamoeba invadens
AKAKAFAALNRKVSEESDDE

SEQ ID NO: 2978628 - protein, 17 aa, Entamoeba invadens
AKCQFCSLMFPMKELSR

SEQ ID NO: 2978629 - protein, 17 aa, Entamoeba invadens
AKDVLGFPNLLDPKETA

SEQ ID NO: 2978630 - protein, 20 aa, Entamoeba invadens
AKEFSCQIIIDWSSARKNML

SEQ ID NO: 2978631 - protein, 18 aa, Entamoeba invadens
AKEGLPIILCGTASETTV

SEQ ID NO: 2978632 - protein, 18 aa, Entamoeba invadens
AKEIKECFSEFVEGGKTA

SEQ ID NO: 2978633 - protein, 18 aa, Entamoeba invadens
AKEKMWKDKLETMEKQND

SEQ ID NO: 2978634 - protein, 19 aa, Entamoeba invadens
AKERLGIVSYGRKIKETLR

SEQ ID NO: 2978635 - protein, 24 aa, Entamoeba invadens
AKEVFRILLTLVFFYCKKMTVFCL

SEQ ID NO: 2978636 - protein, 17 aa, Entamoeba invadens
AKFRFGPLSPEALKKIM

SEQ ID NO: 2978637 - protein, 17 aa, Entamoeba invadens
AKFRSAKILEFFNLKNS

SEQ ID NO: 2978638 - protein, 23 aa, Entamoeba invadens
AKFWPGALTIIFPRAKGVPDEVT

SEQ ID NO: 2978639 - protein, 20 aa, Entamoeba invadens
AKHHVAYRMLKKCGNLQELE

SEQ ID NO: 2978640 - protein, 19 aa, Entamoeba invadens
AKHHVAYRMLKKCNTIEEM

SEQ ID NO: 2978641 - protein, 20 aa, Entamoeba invadens
AKIPVSLCEWFICEVGRSTK

SEQ ID NO: 2978642 - protein, 17 aa, Entamoeba invadens
AKKDFFPSISIESFEKL

SEQ ID NO: 2978643 - protein, 18 aa, Entamoeba invadens
AKKFGKAVVFDFVGTLDG

SEQ ID NO: 2978644 - protein, 19 aa, Entamoeba invadens
AKKNDCWAIGIILYQVFTG

SEQ ID NO: 2978645 - protein, 19 aa, Entamoeba invadens
AKLGLTFNIFFLCELKDDS

SEQ ID NO: 2978646 - protein, 18 aa, Entamoeba invadens
AKLKIAIINKGWEYSDTF

SEQ ID NO: 2978647 - protein, 23 aa, Entamoeba invadens
AKLKRKCFICGNYGHSKDECPQR

SEQ ID NO: 2978648 - protein, 17 aa, Entamoeba invadens
AKLLFLSLISRVYKREP

SEQ ID NO: 2978649 - protein, 19 aa, Entamoeba invadens
AKLRCCLFKLDLKRVENII

SEQ ID NO: 2978650 - protein, 22 aa, Entamoeba invadens
AKLYMRIGNAFYKQSKFTEALE

SEQ ID NO: 2978651 - protein, 18 aa, Entamoeba invadens
AKMALRIQIVNKMKSYCN

SEQ ID NO: 2978652 - protein, 21 aa, Entamoeba invadens
AKMGCCIDLLAPLFTFVGYQL

SEQ ID NO: 2978653 - protein, 19 aa, Entamoeba invadens
AKMTPLEDAVEEWKNEMSA

SEQ ID NO: 2978654 - protein, 18 aa, Entamoeba invadens
AKNCGSGMIVTKNVGIAQ

SEQ ID NO: 2978655 - protein, 18 aa, Entamoeba invadens
AKNGFLLYDCYGVLKYES

SEQ ID NO: 2978656 - protein, 21 aa, Entamoeba invadens
AKNKANICFIFFDDQNNVFGA

SEQ ID NO: 2978657 - protein, 19 aa, Entamoeba invadens
AKNSAPCVIFFDELDALAP

SEQ ID NO: 2978658 - protein, 20 aa, Entamoeba invadens
AKQRSVCLSDFYQSQKAFNI

SEQ ID NO: 2978659 - protein, 19 aa, Entamoeba invadens
AKQYGYRARSAFKLIQMNK

SEQ ID NO: 2978660 - protein, 27 aa, Entamoeba invadens
AKRPEMMGELLPYCLFVIKDKLQFPSI

SEQ ID NO: 2978661 - protein, 21 aa, Entamoeba invadens
AKRVGSLFLKDPGLLPEPQEL

SEQ ID NO: 2978662 - protein, 22 aa, Entamoeba invadens
AKRVGVLAIETWISLSEKGGCD

SEQ ID NO: 2978663 - protein, 18 aa, Entamoeba invadens
AKSCGVVYGMLKQLEKFR

SEQ ID NO: 2978664 - protein, 17 aa, Entamoeba invadens
AKTCVLFKMDLKGKQKL

SEQ ID NO: 2978665 - protein, 21 aa, Entamoeba invadens
AKTEIFRDLQFGIYMKSRIGL

SEQ ID NO: 2978666 - protein, 18 aa, Entamoeba invadens
AKTMWTVVCVFYIAIHCV

SEQ ID NO: 2978667 - protein, 21 aa, Entamoeba invadens
AKVCDCYGCFGVPLEIAVAYG

SEQ ID NO: 2978668 - protein, 17 aa, Entamoeba invadens
AKVGYGFFSLGVIDQLN

SEQ ID NO: 2978669 - protein, 18 aa, Entamoeba invadens
AKVLPWRTMRFNECVCTP

SEQ ID NO: 2978670 - protein, 17 aa, Entamoeba invadens
AKVPFRIAQLLLKNNVK

SEQ ID NO: 2978671 - protein, 17 aa, Entamoeba invadens
AKVVLSSFFVLRKDYSV

SEQ ID NO: 2978672 - protein, 17 aa, Entamoeba invadens
AKYALDFFHYVNCLEKN

SEQ ID NO: 2978673 - protein, 22 aa, Entamoeba invadens
AKYCNAKEFFKYQCENDKVIVS

SEQ ID NO: 2978674 - protein, 23 aa, Entamoeba invadens
AKYKYLQLCMTLRSYGMNIYAGG

SEQ ID NO: 2978675 - protein, 18 aa, Entamoeba invadens
ALAGLKFHGMGVVVQECT

SEQ ID NO: 2978676 - protein, 25 aa, Entamoeba invadens
ALAKTFCTKCAVLALDEPTINLDAD

SEQ ID NO: 2978677 - protein, 19 aa, Entamoeba invadens
ALAQFLVRMLNIWNRGDVS

SEQ ID NO: 2978678 - protein, 17 aa, Entamoeba invadens
ALCAWKKATLLSLIVRH

SEQ ID NO: 2978679 - protein, 20 aa, Entamoeba invadens
ALCGLMFPRDVEIRMFQFIQ

SEQ ID NO: 2978680 - protein, 20 aa, Entamoeba invadens
ALCLPRLVGCGISLDTIFCL

SEQ ID NO: 2978681 - protein, 19 aa, Entamoeba invadens
ALDKVPFDVCVTDPEDEEI

SEQ ID NO: 2978682 - protein, 18 aa, Entamoeba invadens
ALEAWGWDVYKRELSERY

SEQ ID NO: 2978683 - protein, 27 aa, Entamoeba invadens
ALEMPRLKVLFMKKCFLHGDCLEMDLT

SEQ ID NO: 2978684 - protein, 17 aa, Entamoeba invadens
ALFVPGYIGLECDGIHE

SEQ ID NO: 2978685 - protein, 18 aa, Entamoeba invadens
ALGTTRGFCVFGIEQTRL

SEQ ID NO: 2978686 - protein, 23 aa, Entamoeba invadens
ALIFFRKHIKKICALSKTRFYIV

SEQ ID NO: 2978687 - protein, 17 aa, Entamoeba invadens
ALIKCVYVESGNTFEAT

SEQ ID NO: 2978688 - protein, 26 aa, Entamoeba invadens
ALKILLRICSMFPRVKECVVGDETFR

SEQ ID NO: 2978689 - protein, 22 aa, Entamoeba invadens
ALKKEWGYILSLMMQYPTKVRP

SEQ ID NO: 2978690 - protein, 22 aa, Entamoeba invadens
ALKRYIKLFLFDGVKYRVAALP

SEQ ID NO: 2978691 - protein, 17 aa, Entamoeba invadens
ALLIRRAYDIAGCNPGK

SEQ ID NO: 2978692 - protein, 23 aa, Entamoeba invadens
ALLKDWALFFLRCIHHMSVQKMQ

SEQ ID NO: 2978693 - protein, 24 aa, Entamoeba invadens
ALLRFGVRIPDIFTYILPLNEEFL

SEQ ID NO: 2978694 - protein, 19 aa, Entamoeba invadens
ALMKKIYAIFGFKTDIALS

SEQ ID NO: 2978695 - protein, 24 aa, Entamoeba invadens
ALNAFLKFDVETFIAFQKSINKQE

SEQ ID NO: 2978696 - protein, 21 aa, Entamoeba invadens
ALNCTAEGPGLNEAETKTPAP

SEQ ID NO: 2978697 - protein, 19 aa, Entamoeba invadens
ALNRYRLEVLIGKVPLWCR

SEQ ID NO: 2978698 - protein, 17 aa, Entamoeba invadens
ALPVSAFEIVWTIIEKY

SEQ ID NO: 2978699 - protein, 23 aa, Entamoeba invadens
ALRAYHIAIEWVRQSLFNERILP

SEQ ID NO: 2978700 - protein, 18 aa, Entamoeba invadens
ALRLFPLIVNKFWGDKSV

SEQ ID NO: 2978701 - protein, 22 aa, Entamoeba invadens
ALRPETLGELALFAMSLVPPKQ

SEQ ID NO: 2978702 - protein, 17 aa, Entamoeba invadens
ALSCVKMSCKVKCVEDY

SEQ ID NO: 2978703 - protein, 17 aa, Entamoeba invadens
ALTDLLFLSGYLFNVKQ

SEQ ID NO: 2978704 - protein, 20 aa, Entamoeba invadens
ALTLILRSPIALKRLDLGNI

SEQ ID NO: 2978705 - protein, 18 aa, Entamoeba invadens
ALVPPEFAFEFYKENTAL

SEQ ID NO: 2978706 - protein, 22 aa, Entamoeba invadens
ALWREAICLYAAIKSPITVKYE

SEQ ID NO: 2978707 - protein, 18 aa, Entamoeba invadens
ALYDLGFIYPTEIQKFAI

SEQ ID NO: 2978708 - protein, 19 aa, Entamoeba invadens
ALYKRAVLLNSQFNTLLVT

SEQ ID NO: 2978709 - protein, 19 aa, Entamoeba invadens
AMAAIRYFIEMIRAGKGEL

SEQ ID NO: 2978710 - protein, 17 aa, Entamoeba invadens
AMCAWDWKMRSIEGDER

SEQ ID NO: 2978711 - protein, 18 aa, Entamoeba invadens
AMDLFFRLGADIEATNKN

SEQ ID NO: 2978712 - protein, 25 aa, Entamoeba invadens
AMEYFKFPLFCLISQPVLSLLSTGK

SEQ ID NO: 2978713 - protein, 22 aa, Entamoeba invadens
AMFDEAWFPYAHFHPFYASFHS

SEQ ID NO: 2978714 - protein, 20 aa, Entamoeba invadens
AMFLIKACKPLIEKNTADNK

SEQ ID NO: 2978715 - protein, 24 aa, Entamoeba invadens
AMFPCSHCFHLLCIKNEFKQHPTA

SEQ ID NO: 2978716 - protein, 20 aa, Entamoeba invadens
AMKLERRWSVEDFSRAYYCN

SEQ ID NO: 2978717 - protein, 18 aa, Entamoeba invadens
AMKNEFFFEMLLKEMGKS

SEQ ID NO: 2978718 - protein, 17 aa, Entamoeba invadens
AMKTIFIDSVLKCAECT

SEQ ID NO: 2978719 - protein, 21 aa, Entamoeba invadens
AMMRCGDGIFSLHDKSSTARF

SEQ ID NO: 2978720 - protein, 17 aa, Entamoeba invadens
AMPDCRIVFLLFSLIPS

SEQ ID NO: 2978721 - protein, 18 aa, Entamoeba invadens
AMSARVALEIGIGSLHIT

SEQ ID NO: 2978722 - protein, 18 aa, Entamoeba invadens
ANAFRSSIAIAREPLIIP

SEQ ID NO: 2978723 - protein, 17 aa, Entamoeba invadens
ANCELHMVFYLISVLKI

SEQ ID NO: 2978724 - protein, 18 aa, Entamoeba invadens
ANCGKRLLGIDADGVKKF

SEQ ID NO: 2978725 - protein, 20 aa, Entamoeba invadens
ANCRPSVLNIFYCKADMSCI

SEQ ID NO: 2978726 - protein, 18 aa, Entamoeba invadens
ANIIIEFCDGGTLQNFFE

SEQ ID NO: 2978727 - protein, 25 aa, Entamoeba invadens
ANKLRYEVAWCFVNILSILDEEEIT

SEQ ID NO: 2978728 - protein, 23 aa, Entamoeba invadens
ANKVAQCCICFTGDFMSPEEKIY

SEQ ID NO: 2978729 - protein, 21 aa, Entamoeba invadens
ANLKIRLRFMTSVNIQETALH

SEQ ID NO: 2978730 - protein, 21 aa, Entamoeba invadens
ANLYASCFYRSMLNNQSLKIE

SEQ ID NO: 2978731 - protein, 21 aa, Entamoeba invadens
ANNGFKGMLLVSAKTGYNLDE

SEQ ID NO: 2978732 - protein, 19 aa, Entamoeba invadens
ANPFPMFLCPEVDDKQEKV

SEQ ID NO: 2978733 - protein, 18 aa, Entamoeba invadens
ANQKMTWNLLLRVIFTSL

SEQ ID NO: 2978734 - protein, 18 aa, Entamoeba invadens
ANRCKYVGIGGGKSSNEI

SEQ ID NO: 2978735 - protein, 18 aa, Entamoeba invadens
ANTLLTHCFMASPLTSQM

SEQ ID NO: 2978736 - protein, 18 aa, Entamoeba invadens
ANVVAWEYPGYTVGSSYS

SEQ ID NO: 2978737 - protein, 23 aa, Entamoeba invadens
ANVWPYIRFSIDYNIAQTELKFL

SEQ ID NO: 2978738 - protein, 17 aa, Entamoeba invadens
ANVYFSVCKSFLEYWGD

SEQ ID NO: 2978739 - protein, 24 aa, Entamoeba invadens
APAFPECFPHLFGKQKIRCLIPCA

SEQ ID NO: 2978740 - protein, 17 aa, Entamoeba invadens
APAKMKSQFYVTYWMLL

SEQ ID NO: 2978741 - protein, 19 aa, Entamoeba invadens
APANMMLYFSEFEALYGAD

SEQ ID NO: 2978742 - protein, 19 aa, Entamoeba invadens
APEAFGYELYTKCPNAKEK

SEQ ID NO: 2978743 - protein, 17 aa, Entamoeba invadens
APFNACCHHGKIKPHDM

SEQ ID NO: 2978744 - protein, 17 aa, Entamoeba invadens
APFSIPVARNFFKQLLS

SEQ ID NO: 2978745 - protein, 17 aa, Entamoeba invadens
APFVCLEPWFGRCDTEY

SEQ ID NO: 2978746 - protein, 17 aa, Entamoeba invadens
APLRMPLFIAHGNNDEI

SEQ ID NO: 2978747 - protein, 23 aa, Entamoeba invadens
APPKRRVGVPVTRNSLITPPNEN

SEQ ID NO: 2978748 - protein, 18 aa, Entamoeba invadens
APQLCIRKFVTVVCDNFF

SEQ ID NO: 2978749 - protein, 17 aa, Entamoeba invadens
APWEMRYSLPLCEKYKQ

SEQ ID NO: 2978750 - protein, 18 aa, Entamoeba invadens
AQALYIYWKSRDIARSGE

SEQ ID NO: 2978751 - protein, 22 aa, Entamoeba invadens
AQFKSLLKMEGFVFETNDQLLS

SEQ ID NO: 2978752 - protein, 17 aa, Entamoeba invadens
AQFQRLSLRKCTIDSLT

SEQ ID NO: 2978753 - protein, 20 aa, Entamoeba invadens
AQFSELKWSPKGNLVICKAQ

SEQ ID NO: 2978754 - protein, 23 aa, Entamoeba invadens
AQFSNGKWRSEWTVTLNGSKASI

SEQ ID NO: 2978755 - protein, 22 aa, Entamoeba invadens
AQGFPKLIGCLTHMDEFKKSKG

SEQ ID NO: 2978756 - protein, 17 aa, Entamoeba invadens
AQILKRYLPVSLDSDKL

SEQ ID NO: 2978757 - protein, 18 aa, Entamoeba invadens
AQKAFGILLRLFTSKEAE

SEQ ID NO: 2978758 - protein, 19 aa, Entamoeba invadens
AQKVFAEMFLNDEIDLDEM

SEQ ID NO: 2978759 - protein, 24 aa, Entamoeba invadens
AQNLRIKYPFPLRRAPLLNKLAYM

SEQ ID NO: 2978760 - protein, 18 aa, Entamoeba invadens
AQNSFGWSPVALNSVPNQ

SEQ ID NO: 2978761 - protein, 25 aa, Entamoeba invadens
AQPIRFPILLPVLLELVFKQICPLD

SEQ ID NO: 2978762 - protein, 22 aa, Entamoeba invadens
AQPKFYLTGAFLFSLMYAGSNI

SEQ ID NO: 2978763 - protein, 24 aa, Entamoeba invadens
AQPKPFRAVPCQPKPLKIDQQDVQ

SEQ ID NO: 2978764 - protein, 26 aa, Entamoeba invadens
AQRDPKKWWKFAFTATRDYLRQKEED

SEQ ID NO: 2978765 - protein, 18 aa, Entamoeba invadens
AQVAHTWGVFGYPIECAV

SEQ ID NO: 2978766 - protein, 17 aa, Entamoeba invadens
AQVGFIFKNYGKTSFCT

SEQ ID NO: 2978767 - protein, 23 aa, Entamoeba invadens
ARAEELWSLVSLFASLEQENGKE

SEQ ID NO: 2978768 - protein, 24 aa, Entamoeba invadens
ARDCSIAVPFLCKGVTVSLDIISQ

SEQ ID NO: 2978769 - protein, 20 aa, Entamoeba invadens
ARESLGMFAPCAFSIYRRFK

SEQ ID NO: 2978770 - protein, 19 aa, Entamoeba invadens
ARGAAPCVLFFDEEAGEEI

SEQ ID NO: 2978771 - protein, 20 aa, Entamoeba invadens
ARGTFDWCTLKSISLPGNVT

SEQ ID NO: 2978772 - protein, 17 aa, Entamoeba invadens
ARHNEFRQTVGMATNSL

SEQ ID NO: 2978773 - protein, 17 aa, Entamoeba invadens
ARHQCEFLIYGKKQPSL

SEQ ID NO: 2978774 - protein, 21 aa, Entamoeba invadens
ARKAFGCAIGYTQKDDVFEKY

SEQ ID NO: 2978775 - protein, 22 aa, Entamoeba invadens
ARKRLQPEFAEKLPPKKVVKSE

SEQ ID NO: 2978776 - protein, 20 aa, Entamoeba invadens
ARLETCIVCNKHIDGEFVNA

SEQ ID NO: 2978777 - protein, 18 aa, Entamoeba invadens
ARLQIFQKHFEVYIRNEM

SEQ ID NO: 2978778 - protein, 17 aa, Entamoeba invadens
ARLTVPILKSFLMASHV

SEQ ID NO: 2978779 - protein, 19 aa, Entamoeba invadens
ARMLDVFVVLSLVNKKSKS

SEQ ID NO: 2978780 - protein, 17 aa, Entamoeba invadens
ARNSRLWIHAMETENNI

SEQ ID NO: 2978781 - protein, 19 aa, Entamoeba invadens
ARPSVCPCWSVEPKLGTNP

SEQ ID NO: 2978782 - protein, 19 aa, Entamoeba invadens
ARQNAPCVIFFDEIDGMLG

SEQ ID NO: 2978783 - protein, 19 aa, Entamoeba invadens
ARSGLWLNYNSVLKSIKAD

SEQ ID NO: 2978784 - protein, 19 aa, Entamoeba invadens
ARVALEIGIGSLHITVVNK

SEQ ID NO: 2978785 - protein, 25 aa, Entamoeba invadens
ARVILFRFVFCRLVLFSLKLPADAG

SEQ ID NO: 2978786 - protein, 18 aa, Entamoeba invadens
ASAEPKCSLFLQNEKVKF

SEQ ID NO: 2978787 - protein, 18 aa, Entamoeba invadens
ASEILKCYLELFREVRKM

SEQ ID NO: 2978788 - protein, 18 aa, Entamoeba invadens
ASFKAVVVSIYLENDTRD

SEQ ID NO: 2978789 - protein, 25 aa, Entamoeba invadens
ASFKRGGVVIRMIDNRMRIYISIND

SEQ ID NO: 2978790 - protein, 22 aa, Entamoeba invadens
ASFKRSGVVGVNIGKIKRMFVS

SEQ ID NO: 2978791 - protein, 18 aa, Entamoeba invadens
ASFLKARCDTMYYSDLKS

SEQ ID NO: 2978792 - protein, 18 aa, Entamoeba invadens
ASGLWYLHFCKHIIHRDL

SEQ ID NO: 2978793 - protein, 17 aa, Entamoeba invadens
ASHCLLKYWVLRKHERP

SEQ ID NO: 2978794 - protein, 18 aa, Entamoeba invadens
ASHSFILQYGMRNVDQNV

SEQ ID NO: 2978795 - protein, 19 aa, Entamoeba invadens
ASISLVLKSRMLKDDTQTI

SEQ ID NO: 2978796 - protein, 23 aa, Entamoeba invadens
ASLLQRWSNAIGRFPITFNDEEE

SEQ ID NO: 2978797 - protein, 19 aa, Entamoeba invadens
ASLPFLHFFDGFRTSHEIQ

SEQ ID NO: 2978798 - protein, 19 aa, Entamoeba invadens
ASLVFPLIVAKTFAVTKRN

SEQ ID NO: 2978799 - protein, 18 aa, Entamoeba invadens
ASMKTCLVKRNFKGNKKI

SEQ ID NO: 2978800 - protein, 24 aa, Entamoeba invadens
ASNCTLCGYNLCFICNNNFILNNE

SEQ ID NO: 2978801 - protein, 21 aa, Entamoeba invadens
ASQFPECFASILGKNTQTSIE

SEQ ID NO: 2978802 - protein, 19 aa, Entamoeba invadens
ASRSLGELMVNTRNNSIVP

SEQ ID NO: 2978803 - protein, 19 aa, Entamoeba invadens
ASYFPFKGVSLAVVVFNSQ

SEQ ID NO: 2978804 - protein, 22 aa, Entamoeba invadens
ASYKRSGVVGVNIGKIKRMFVS

SEQ ID NO: 2978805 - protein, 17 aa, Entamoeba invadens
ATACRWAKEIVRCNEDE

SEQ ID NO: 2978806 - protein, 23 aa, Entamoeba invadens
ATAGLKRSASFSGYVQAIKPTLQ

SEQ ID NO: 2978807 - protein, 19 aa, Entamoeba invadens
ATCTEAGMFALRERRSHVT

SEQ ID NO: 2978808 - protein, 21 aa, Entamoeba invadens
ATEGLKLQRLVVMVTSTSEAV

SEQ ID NO: 2978809 - protein, 17 aa, Entamoeba invadens
ATFALAMKCMYESPKNL

SEQ ID NO: 2978810 - protein, 19 aa, Entamoeba invadens
ATFCKTRFNSCCKSLETAL

SEQ ID NO: 2978811 - protein, 17 aa, Entamoeba invadens
ATIPLKIIISLKKDMVN

SEQ ID NO: 2978812 - protein, 17 aa, Entamoeba invadens
ATIVKRDSKLVAEEDNS

SEQ ID NO: 2978813 - protein, 18 aa, Entamoeba invadens
ATKALSSFCMLAVQYMYY

SEQ ID NO: 2978814 - protein, 20 aa, Entamoeba invadens
ATKELLKWDVVFWSEPESNV

SEQ ID NO: 2978815 - protein, 17 aa, Entamoeba invadens
ATKRFSAYILFYQKVIP

SEQ ID NO: 2978816 - protein, 23 aa, Entamoeba invadens
ATKRLCGYLGLFPPSAREERAKQ

SEQ ID NO: 2978817 - protein, 23 aa, Entamoeba invadens
ATLKGESGVTCFGTIAKSNGIVI

SEQ ID NO: 2978818 - protein, 17 aa, Entamoeba invadens
ATLPPFITAKSCILVVV

SEQ ID NO: 2978819 - protein, 21 aa, Entamoeba invadens
ATPRYLLGVGEKFQKSVYEKA

SEQ ID NO: 2978820 - protein, 23 aa, Entamoeba invadens
ATSLLRPFPCGEVGEIIFFRKFN

SEQ ID NO: 2978821 - protein, 24 aa, Entamoeba invadens
ATTFFRLCCYIPVFISKLSKTPSA

SEQ ID NO: 2978822 - protein, 23 aa, Entamoeba invadens
ATTTQPFAGFDFNKTNLADSANS

SEQ ID NO: 2978823 - protein, 20 aa, Entamoeba invadens
ATVCPKCWPLLVSASNLLNF

SEQ ID NO: 2978824 - protein, 20 aa, Entamoeba invadens
ATVELFCFKINRNLVNEMKY

SEQ ID NO: 2978825 - protein, 17 aa, Entamoeba invadens
ATWSTKLSNIWSESAAI

SEQ ID NO: 2978826 - protein, 18 aa, Entamoeba invadens
AVAEMKCVNALFTYLMNN

SEQ ID NO: 2978827 - protein, 27 aa, Entamoeba invadens
AVAVLRKFFFERIVEWKLLEKKALNYL

SEQ ID NO: 2978828 - protein, 17 aa, Entamoeba invadens
AVCAWDWKMREQVGSDK

SEQ ID NO: 2978829 - protein, 19 aa, Entamoeba invadens
AVCQARLGPYYVNKEMNKV

SEQ ID NO: 2978830 - protein, 18 aa, Entamoeba invadens
AVDELEFVRTTWRIDNAV

SEQ ID NO: 2978831 - protein, 22 aa, Entamoeba invadens
AVDPRLPIALSQTVGTAPLEPL

SEQ ID NO: 2978832 - protein, 17 aa, Entamoeba invadens
AVEGVIFRSYHSCCDVV

SEQ ID NO: 2978833 - protein, 27 aa, Entamoeba invadens
AVFKKEFFRIIVWFNVDFETVDKYNNG

SEQ ID NO: 2978834 - protein, 17 aa, Entamoeba invadens
AVFRASQSIIRFDLPHL

SEQ ID NO: 2978835 - protein, 18 aa, Entamoeba invadens
AVFTKMFYQIVVWFNVDY

SEQ ID NO: 2978836 - protein, 19 aa, Entamoeba invadens
AVGKTCLLISYSIKKFPED

SEQ ID NO: 2978837 - protein, 26 aa, Entamoeba invadens
AVIQGEADLAFVRAKMTPLEDAVEEW

SEQ ID NO: 2978838 - protein, 18 aa, Entamoeba invadens
AVKKCFEKVWSIEKMELA

SEQ ID NO: 2978839 - protein, 24 aa, Entamoeba invadens
AVKTWKKRWFVLKENRLWYFASKT

SEQ ID NO: 2978840 - protein, 21 aa, Entamoeba invadens
AVLKRKFFCVIVWFNVDFETV

SEQ ID NO: 2978841 - protein, 19 aa, Entamoeba invadens
AVLRYCYLWFNFMPLTRGT

SEQ ID NO: 2978842 - protein, 20 aa, Entamoeba invadens
AVLVFDCGSSFIKIGAAGEE

SEQ ID NO: 2978843 - protein, 18 aa, Entamoeba invadens
AVNISRERLNWIVVGESQ

SEQ ID NO: 2978844 - protein, 25 aa, Entamoeba invadens
AVRGKGGICFLFLRKGIYTCQAVAT

SEQ ID NO: 2978845 - protein, 18 aa, Entamoeba invadens
AVSCRFPFKGIIPSQIDE

SEQ ID NO: 2978846 - protein, 18 aa, Entamoeba invadens
AWKSLEFEEIIRLEFDTI

SEQ ID NO: 2978847 - protein, 17 aa, Entamoeba invadens
AWLGIAVGQKIYDQGLT

SEQ ID NO: 2978848 - protein, 25 aa, Entamoeba invadens
AWQWKSFSSKSAFCFASTKDNHEFM

SEQ ID NO: 2978849 - protein, 19 aa, Entamoeba invadens
AYATWDWARNPVMLGVSDD

SEQ ID NO: 2978850 - protein, 17 aa, Entamoeba invadens
AYCRLPLGIYVTTHRYD

SEQ ID NO: 2978851 - protein, 19 aa, Entamoeba invadens
AYEKYSQELFKYIFGDTDV

SEQ ID NO: 2978852 - protein, 17 aa, Entamoeba invadens
AYFLGYMTNHFLSVYTG

SEQ ID NO: 2978853 - protein, 18 aa, Entamoeba invadens
AYLDIFPKCRGYQLPSLF

SEQ ID NO: 2978854 - protein, 25 aa, Entamoeba invadens
AYLFTFPFSTLKNFDWKSYQNELTE

SEQ ID NO: 2978855 - protein, 17 aa, Entamoeba invadens
AYLKGLINYGCVDNMKS

SEQ ID NO: 2978856 - protein, 17 aa, Entamoeba invadens
AYLPVCESFGFTADLRS

SEQ ID NO: 2978857 - protein, 25 aa, Entamoeba invadens
AYPKQSFKFPWKIAEFVMSKKRLVK

SEQ ID NO: 2978858 - protein, 23 aa, Entamoeba invadens
AYTKIVFELCPFCHIPKEYCEFG

SEQ ID NO: 2978859 - protein, 24 aa, Entamoeba invadens
AYVKKCFEKGLPVVSMAWLDECLK

SEQ ID NO: 2978860 - protein, 19 aa, Entamoeba invadens
AYVRLRYLLRVVILAKSPI

SEQ ID NO: 2978861 - protein, 19 aa, Entamoeba invadens
CAECGQPLGPQRITALGRN

SEQ ID NO: 2978862 - protein, 23 aa, Entamoeba invadens
CAFFVFCDECVFGFYSESQTLYL

SEQ ID NO: 2978863 - protein, 23 aa, Entamoeba invadens
CAFFVFCEECVFGFYSESQTLYL

SEQ ID NO: 2978864 - protein, 20 aa, Entamoeba invadens
CAFGRWPVKSCNFILKLIKS

SEQ ID NO: 2978865 - protein, 21 aa, Entamoeba invadens
CAFGRWPVKSCNFILKLIKSA

SEQ ID NO: 2978866 - protein, 19 aa, Entamoeba invadens
CAFLSLSESCFKNFELIQS

SEQ ID NO: 2978867 - protein, 17 aa, Entamoeba invadens
CAGCSCVFGKRKRKNFC

SEQ ID NO: 2978868 - protein, 19 aa, Entamoeba invadens
CAHTAATCLSHWNSSYLLF

SEQ ID NO: 2978869 - protein, 23 aa, Entamoeba invadens
CAICMTCGCFLCYKDGKRRDDNV

SEQ ID NO: 2978870 - protein, 18 aa, Entamoeba invadens
CAIDEVILSFHHRVLSKE

SEQ ID NO: 2978871 - protein, 18 aa, Entamoeba invadens
CAINLFFKNCNDVISIAS

SEQ ID NO: 2978872 - protein, 18 aa, Entamoeba invadens
CAIPEFLLKICRQIELRK

SEQ ID NO: 2978873 - protein, 17 aa, Entamoeba invadens
CALIKKYIREISEPIWP

SEQ ID NO: 2978874 - protein, 20 aa, Entamoeba invadens
CANCGCTGCASKSKCKDEDN

SEQ ID NO: 2978875 - protein, 17 aa, Entamoeba invadens
CANDIFPQISMKFIESR

SEQ ID NO: 2978876 - protein, 19 aa, Entamoeba invadens
CANRSMFCYSCKMLTPIEL

SEQ ID NO: 2978877 - protein, 17 aa, Entamoeba invadens
CAPMWFQFMTNLKIEVA

SEQ ID NO: 2978878 - protein, 19 aa, Entamoeba invadens
CAQCGKRICNGALSNSSKC

SEQ ID NO: 2978879 - protein, 21 aa, Entamoeba invadens
CASTPCPLDAPSVLGIAAVKK

SEQ ID NO: 2978880 - protein, 20 aa, Entamoeba invadens
CAVFSEAFLRLCEKQAIVGD

SEQ ID NO: 2978881 - protein, 26 aa, Entamoeba invadens
CCGKFKKRVKLSLTMDTVVDLVFQDR

SEQ ID NO: 2978882 - protein, 17 aa, Entamoeba invadens
CCIFRIELKNAKLLKSV

SEQ ID NO: 2978883 - protein, 19 aa, Entamoeba invadens
CCINCSALSLVIEDFANTF

SEQ ID NO: 2978884 - protein, 21 aa, Entamoeba invadens
CCKRFNLKTSKRVAAVRLAKS

SEQ ID NO: 2978885 - protein, 17 aa, Entamoeba invadens
CCRVCGSIHHLERDCPK

SEQ ID NO: 2978886 - protein, 23 aa, Entamoeba invadens
CCSAFWLDRICNVTIHPYIQKFF

SEQ ID NO: 2978887 - protein, 19 aa, Entamoeba invadens
CDAKHHFSHGICLPNNPNC

SEQ ID NO: 2978888 - protein, 23 aa, Entamoeba invadens
CDEKCLFPDAAGWVIERIQDILK

SEQ ID NO: 2978889 - protein, 17 aa, Entamoeba invadens
CDFGVDFMKRFLKTQMF

SEQ ID NO: 2978890 - protein, 20 aa, Entamoeba invadens
CDFPHGYICLEYCQNGNLES

SEQ ID NO: 2978891 - protein, 20 aa, Entamoeba invadens
CDGYLAKFCHLKSIEVKSSV

SEQ ID NO: 2978892 - protein, 21 aa, Entamoeba invadens
CDLLICCGDFSSGGKKETVES

SEQ ID NO: 2978893 - protein, 18 aa, Entamoeba invadens
CDLQKFQINWGFLESHHN

SEQ ID NO: 2978894 - protein, 23 aa, Entamoeba invadens
CDLRSSVPLKFVSIFGDDKKSPL

SEQ ID NO: 2978895 - protein, 20 aa, Entamoeba invadens
CDLSFPIQETFSLSSSSLLF

SEQ ID NO: 2978896 - protein, 18 aa, Entamoeba invadens
CDVSYVWFKAVKEIGDFC

SEQ ID NO: 2978897 - protein, 21 aa, Entamoeba invadens
CEACLLCLGAYVFQKDDLPSS

SEQ ID NO: 2978898 - protein, 17 aa, Entamoeba invadens
CECVLKKARICMSLLLR

SEQ ID NO: 2978899 - protein, 21 aa, Entamoeba invadens
CEELVRLGLLVPEKGNFLHNQ

SEQ ID NO: 2978900 - protein, 23 aa, Entamoeba invadens
CEICGGCGYKGRKNYEKHFEEAK

SEQ ID NO: 2978901 - protein, 17 aa, Entamoeba invadens
CEKCVEISPSFAKGFGR

SEQ ID NO: 2978902 - protein, 17 aa, Entamoeba invadens
CELHMVFYLISVLKIEI

SEQ ID NO: 2978903 - protein, 20 aa, Entamoeba invadens
CELLDFFFKRTVQVCVVKYE

SEQ ID NO: 2978904 - protein, 17 aa, Entamoeba invadens
CELLRCFVKYLKRLRDA

SEQ ID NO: 2978905 - protein, 17 aa, Entamoeba invadens
CEMCCKCAALSGCLSSI

SEQ ID NO: 2978906 - protein, 19 aa, Entamoeba invadens
CERENRLGKYVTMLQNEYI

SEQ ID NO: 2978907 - protein, 21 aa, Entamoeba invadens
CESEFFKQWLTSILSTRLISI

SEQ ID NO: 2978908 - protein, 17 aa, Entamoeba invadens
CESGLPPTVPKEVQSMM

SEQ ID NO: 2978909 - protein, 19 aa, Entamoeba invadens
CESIGWLGGALQEFADLLI

SEQ ID NO: 2978910 - protein, 25 aa, Entamoeba invadens
CESLCVYIAMFSRFVQFSVRKYVNN

SEQ ID NO: 2978911 - protein, 17 aa, Entamoeba invadens
CETKFLPEFFKFLREAF

SEQ ID NO: 2978912 - protein, 17 aa, Entamoeba invadens
CETKGKEIGVCWFECGT

SEQ ID NO: 2978913 - protein, 18 aa, Entamoeba invadens
CETLWKILYIPLVKEGLY

SEQ ID NO: 2978914 - protein, 24 aa, Entamoeba invadens
CETRNRLVILLPWLEQRLSEGSPD

SEQ ID NO: 2978915 - protein, 18 aa, Entamoeba invadens
CEVDCLKLPVLLNELIID

SEQ ID NO: 2978916 - protein, 18 aa, Entamoeba invadens
CFCDVKRLIGLKMTDTEI

SEQ ID NO: 2978917 - protein, 22 aa, Entamoeba invadens
CFCKGEMFFLSGFQLFSKKLNK

SEQ ID NO: 2978918 - protein, 18 aa, Entamoeba invadens
CFDGCAFSSILLPSTLEH

SEQ ID NO: 2978919 - protein, 17 aa, Entamoeba invadens
CFDHCLFSSIVLPSTLE

SEQ ID NO: 2978920 - protein, 18 aa, Entamoeba invadens
CFDLKLRPDKVFESLKSG

SEQ ID NO: 2978921 - protein, 18 aa, Entamoeba invadens
CFDNCAKLAVINLCEHLD

SEQ ID NO: 2978922 - protein, 17 aa, Entamoeba invadens
CFEEFDLKYFVDLPLEK

SEQ ID NO: 2978923 - protein, 17 aa, Entamoeba invadens
CFEYCPLDGEKVFRIPP

SEQ ID NO: 2978924 - protein, 17 aa, Entamoeba invadens
CFFNCQILSEIVFNEKL

SEQ ID NO: 2978925 - protein, 19 aa, Entamoeba invadens
CFKRMSRGYACSHCLEDHQ

SEQ ID NO: 2978926 - protein, 17 aa, Entamoeba invadens
CFKRMSRGYACYHCIEE

SEQ ID NO: 2978927 - protein, 19 aa, Entamoeba invadens
CFLNDLYLPYGLTKIGYGA

SEQ ID NO: 2978928 - protein, 17 aa, Entamoeba invadens
CFMKEILEKVGLTCKQF

SEQ ID NO: 2978929 - protein, 17 aa, Entamoeba invadens
CFPGLKLDKPLSLQQYY

SEQ ID NO: 2978930 - protein, 20 aa, Entamoeba invadens
CFQLFLSVEIFYNILTFSNK

SEQ ID NO: 2978931 - protein, 17 aa, Entamoeba invadens
CFQVIKCICTLFEGDEQ

SEQ ID NO: 2978932 - protein, 20 aa, Entamoeba invadens
CFQYFKALKTVNVWSHKEFQ

SEQ ID NO: 2978933 - protein, 17 aa, Entamoeba invadens
CFRECHMLKNITLPHQL

SEQ ID NO: 2978934 - protein, 20 aa, Entamoeba invadens
CFRTPSSIFRRNSIFTRIIR

SEQ ID NO: 2978935 - protein, 19 aa, Entamoeba invadens
CFRYLGILLYMGAHHDVIN

SEQ ID NO: 2978936 - protein, 17 aa, Entamoeba invadens
CFSAFWVFKDGNVIINP

SEQ ID NO: 2978937 - protein, 18 aa, Entamoeba invadens
CFSGCIWIKSVVLNRKVS

SEQ ID NO: 2978938 - protein, 18 aa, Entamoeba invadens
CFVDCKDLKISSSDTTHV

SEQ ID NO: 2978939 - protein, 17 aa, Entamoeba invadens
CFYKCCRLNIVTISFGV

SEQ ID NO: 2978940 - protein, 18 aa, Entamoeba invadens
CGCGFNYCSMECQKKAYD

SEQ ID NO: 2978941 - protein, 25 aa, Entamoeba invadens
CGCWGDCCYYYYPCQEIVYEQAELS

SEQ ID NO: 2978942 - protein, 18 aa, Entamoeba invadens
CGDRGCFCIGIVYNYFEK

SEQ ID NO: 2978943 - protein, 17 aa, Entamoeba invadens
CGFACEFEIFLTPYCTM

SEQ ID NO: 2978944 - protein, 17 aa, Entamoeba invadens
CGFERLIIPSSIYVIEN

SEQ ID NO: 2978945 - protein, 17 aa, Entamoeba invadens
CGFLINKKMVFFTRNGS

SEQ ID NO: 2978946 - protein, 22 aa, Entamoeba invadens
CGGCDGKVLFFWVDNGEEIGRL

SEQ ID NO: 2978947 - protein, 17 aa, Entamoeba invadens
CGGDITPAMNFVRSKGL

SEQ ID NO: 2978948 - protein, 18 aa, Entamoeba invadens
CGGSIYPGHGMMFVRNDG

SEQ ID NO: 2978949 - protein, 17 aa, Entamoeba invadens
CGGVQLFKCKKLEQLDT

SEQ ID NO: 2978950 - protein, 21 aa, Entamoeba invadens
CGHSFCDSCFAIWCKKFSYCP

SEQ ID NO: 2978951 - protein, 17 aa, Entamoeba invadens
CGIEFFDVIRRCQKSGL

SEQ ID NO: 2978952 - protein, 20 aa, Entamoeba invadens
CGKAACWMKTLLDKNSLEIS

SEQ ID NO: 2978953 - protein, 21 aa, Entamoeba invadens
CGKLKRFLMPKSKALAIAEFI

SEQ ID NO: 2978954 - protein, 23 aa, Entamoeba invadens
CGKQYFCTLCLLNHPDFDITTFS

SEQ ID NO: 2978955 - protein, 19 aa, Entamoeba invadens
CGKYTFFLNPSFFDQKISL

SEQ ID NO: 2978956 - protein, 18 aa, Entamoeba invadens
CGLINMMINYVGFDNFMN

SEQ ID NO: 2978957 - protein, 18 aa, Entamoeba invadens
CGMFYKGEFRCCQRHNKI

SEQ ID NO: 2978958 - protein, 17 aa, Entamoeba invadens
CGNLLIGAVFVFCCGET

SEQ ID NO: 2978959 - protein, 17 aa, Entamoeba invadens
CGPGQLKSGLSIEELFM

SEQ ID NO: 2978960 - protein, 18 aa, Entamoeba invadens
CGRLESFTGRGVVCVGYH

SEQ ID NO: 2978961 - protein, 23 aa, Entamoeba invadens
CGSESALCLACFLEKMTIPPVDH

SEQ ID NO: 2978962 - protein, 18 aa, Entamoeba invadens
CGTLLLNRFIEIIKTKDI

SEQ ID NO: 2978963 - protein, 27 aa, Entamoeba invadens
CGTTLRKCFICGMYGHKSQDCLEKKGT

SEQ ID NO: 2978964 - protein, 17 aa, Entamoeba invadens
CGVCAMTKIALVAGGSL

SEQ ID NO: 2978965 - protein, 19 aa, Entamoeba invadens
CGVVYGMLKQLEKFRECKK

SEQ ID NO: 2978966 - protein, 18 aa, Entamoeba invadens
CGYLLGAAMEFKAEEAYI

SEQ ID NO: 2978967 - protein, 22 aa, Entamoeba invadens
CHFKNCKWLTSFDIPSSVTHIG

SEQ ID NO: 2978968 - protein, 19 aa, Entamoeba invadens
CHGEWCWMCRGDWKTHGEK

SEQ ID NO: 2978969 - protein, 19 aa, Entamoeba invadens
CHKSAEIIRMFPTDISEKF

SEQ ID NO: 2978970 - protein, 17 aa, Entamoeba invadens
CHNLEKIVIPSTVTKIN

SEQ ID NO: 2978971 - protein, 23 aa, Entamoeba invadens
CHPPCLRASVFALPKVIDYLSIF

SEQ ID NO: 2978972 - protein, 17 aa, Entamoeba invadens
CHRIWTFLSSEEFYRSE

SEQ ID NO: 2978973 - protein, 21 aa, Entamoeba invadens
CHRNKLCLSFARLVAHIKMGA

SEQ ID NO: 2978974 - protein, 23 aa, Entamoeba invadens
CIAAEFFLGIPLFAGTSEYNLLF

SEQ ID NO: 2978975 - protein, 20 aa, Entamoeba invadens
CIALLNKYCSFSFKQPAKKS

SEQ ID NO: 2978976 - protein, 17 aa, Entamoeba invadens
CIDGRLTSAWNWCSSLD

SEQ ID NO: 2978977 - protein, 17 aa, Entamoeba invadens
CIECIPSDFWQKPGDLS

SEQ ID NO: 2978978 - protein, 31 aa, Entamoeba invadens
CIHCGLCVCNGCYKGRFVFNGVNKRGCDRCM

SEQ ID NO: 2978979 - protein, 19 aa, Entamoeba invadens
CIIAVQLLMRFEIIHSKNV

SEQ ID NO: 2978980 - protein, 18 aa, Entamoeba invadens
CILELPNLINLLANELNS

SEQ ID NO: 2978981 - protein, 24 aa, Entamoeba invadens
CILYWCFANLYLIALEMKADVDFR

SEQ ID NO: 2978982 - protein, 17 aa, Entamoeba invadens
CIMDCVIPLDKKYIEVR

SEQ ID NO: 2978983 - protein, 21 aa, Entamoeba invadens
CINCYKLVSAMVCEKCKKPIE

SEQ ID NO: 2978984 - protein, 18 aa, Entamoeba invadens
CIPLNITEMRSWCFACCG

SEQ ID NO: 2978985 - protein, 23 aa, Entamoeba invadens
CISGCGCLYSFMKKVIGAEYTRM

SEQ ID NO: 2978986 - protein, 17 aa, Entamoeba invadens
CKAAEKLAKEPNEKKIK

SEQ ID NO: 2978987 - protein, 19 aa, Entamoeba invadens
CKACGLPLPAKGIAKTKIG

SEQ ID NO: 2978988 - protein, 18 aa, Entamoeba invadens
CKAPFPRGQFYNLDGKPV

SEQ ID NO: 2978989 - protein, 20 aa, Entamoeba invadens
CKCGAEGKCEYCCCCKEGKC

SEQ ID NO: 2978990 - protein, 20 aa, Entamoeba invadens
CKDILKRLRRVLSSKPDEHH

SEQ ID NO: 2978991 - protein, 18 aa, Entamoeba invadens
CKDQAFWLGKASRAKYFQ

SEQ ID NO: 2978992 - protein, 22 aa, Entamoeba invadens
CKEDKVVIRWGISDKVCDDEKD

SEQ ID NO: 2978993 - protein, 19 aa, Entamoeba invadens
CKFLNFPTMNVFNNVIHLV

SEQ ID NO: 2978994 - protein, 19 aa, Entamoeba invadens
CKHLTQLVLRNCVAKDAFP

SEQ ID NO: 2978995 - protein, 18 aa, Entamoeba invadens
CKIGEVWLIDNGFCSRCA

SEQ ID NO: 2978996 - protein, 18 aa, Entamoeba invadens
CKIQAIRFLTVWISNFSN

SEQ ID NO: 2978997 - protein, 20 aa, Entamoeba invadens
CKKCKFKIRNIYKHVYKKSM

SEQ ID NO: 2978998 - protein, 20 aa, Entamoeba invadens
CKKCKSYVCQKCWNNSQKCC

SEQ ID NO: 2978999 - protein, 17 aa, Entamoeba invadens
CKKQICVKCFCDSVKAN

SEQ ID NO: 2979000 - protein, 19 aa, Entamoeba invadens
CKLDFVLRLLKSIHKLSKM

SEQ ID NO: 2979001 - protein, 21 aa, Entamoeba invadens
CKLHEWCGASSYHLYFDSRIG

SEQ ID NO: 2979002 - protein, 19 aa, Entamoeba invadens
CKLMISRGYSKGFGFVEYE

SEQ ID NO: 2979003 - protein, 20 aa, Entamoeba invadens
CKLPELYKDLNLFVTSPSEW

SEQ ID NO: 2979004 - protein, 17 aa, Entamoeba invadens
CKMGIELLWVHPFFKRR

SEQ ID NO: 2979005 - protein, 21 aa, Entamoeba invadens
CKNCNRLSKIMWVGNVICAVA

SEQ ID NO: 2979006 - protein, 20 aa, Entamoeba invadens
CKNLECVNIPLGVTKIKNFS

SEQ ID NO: 2979007 - protein, 19 aa, Entamoeba invadens
CKSLKLWENTVCELFNINK

SEQ ID NO: 2979008 - protein, 19 aa, Entamoeba invadens
CKTCDLAKFVIHAIKPNGE

SEQ ID NO: 2979009 - protein, 20 aa, Entamoeba invadens
CKTMFKRFSSGVFRNVSTLA

SEQ ID NO: 2979010 - protein, 18 aa, Entamoeba invadens
CKTNHPWNAPKYLKTKKD

SEQ ID NO: 2979011 - protein, 22 aa, Entamoeba invadens
CKTRHPPLCFICYDCKTMKHFD

SEQ ID NO: 2979012 - protein, 19 aa, Entamoeba invadens
CKVMKEFLTTLLSHLTNKP

SEQ ID NO: 2979013 - protein, 22 aa, Entamoeba invadens
CKYGNECVEIFLSDLDNNSVVY

SEQ ID NO: 2979014 - protein, 19 aa, Entamoeba invadens
CKYPVPRRLLVITSLIKTN

SEQ ID NO: 2979015 - protein, 22 aa, Entamoeba invadens
CLAFIKSFLKACGYRYDTCLRI

SEQ ID NO: 2979016 - protein, 18 aa, Entamoeba invadens
CLDGGILIDQICKMILNK

SEQ ID NO: 2979017 - protein, 22 aa, Entamoeba invadens
CLEGKCKFCELGMIKIESNKNF

SEQ ID NO: 2979018 - protein, 19 aa, Entamoeba invadens
CLEKRYFRCYNYSTKQYDT

SEQ ID NO: 2979019 - protein, 23 aa, Entamoeba invadens
CLEPLEVYEFWEGYGMSITPKVV

SEQ ID NO: 2979020 - protein, 18 aa, Entamoeba invadens
CLFFIAIQIWRGIPAQIK

SEQ ID NO: 2979021 - protein, 18 aa, Entamoeba invadens
CLKANYPKRVFLLRGNHE

SEQ ID NO: 2979022 - protein, 17 aa, Entamoeba invadens
CLKCSRTKIGIYTLNPL

SEQ ID NO: 2979023 - protein, 20 aa, Entamoeba invadens
CLKIKFPDRFFLLRGNHEVG

SEQ ID NO: 2979024 - protein, 20 aa, Entamoeba invadens
CLKIKFPDRFFLLRGNHEVQ

SEQ ID NO: 2979025 - protein, 18 aa, Entamoeba invadens
CLKPRLPQPPTVKVITQH

SEQ ID NO: 2979026 - protein, 17 aa, Entamoeba invadens
CLLCIESSPSFLVVELF

SEQ ID NO: 2979027 - protein, 20 aa, Entamoeba invadens
CLLHQCCWRVLKESTTLKDY

SEQ ID NO: 2979028 - protein, 19 aa, Entamoeba invadens
CLLLSRISLDFGIHPGVPY

SEQ ID NO: 2979029 - protein, 17 aa, Entamoeba invadens
CLMCGCEILPPSEYYNC

SEQ ID NO: 2979030 - protein, 25 aa, Entamoeba invadens
CLMGRIGVLVPLNFKNEAEFFVNLE

SEQ ID NO: 2979031 - protein, 18 aa, Entamoeba invadens
CLQLPIKLTLPVVSFAFN

SEQ ID NO: 2979032 - protein, 17 aa, Entamoeba invadens
CLRKMVDVFKAEWWFGG

SEQ ID NO: 2979033 - protein, 18 aa, Entamoeba invadens
CLSFARLVAHIKMGAKEK

SEQ ID NO: 2979034 - protein, 19 aa, Entamoeba invadens
CLSVRCLLCETNVCVTLYT

SEQ ID NO: 2979035 - protein, 20 aa, Entamoeba invadens
CLTCGKIFLANRLKTRDLSN

SEQ ID NO: 2979036 - protein, 25 aa, Entamoeba invadens
CLVDFRCAYCGMVVHSNCIPNAPLK

SEQ ID NO: 2979037 - protein, 18 aa, Entamoeba invadens
CMCFPYNKVETIVPLIKT

SEQ ID NO: 2979038 - protein, 21 aa, Entamoeba invadens
CMKKEEMDGFLGIFDTLASVQ

SEQ ID NO: 2979039 - protein, 19 aa, Entamoeba invadens
CMMMCGYGVILLSDNVTST

SEQ ID NO: 2979040 - protein, 17 aa, Entamoeba invadens
CMNRFKLLVTYLRDSYG

SEQ ID NO: 2979041 - protein, 18 aa, Entamoeba invadens
CMTAELFLGYPLFGATSE

SEQ ID NO: 2979042 - protein, 21 aa, Entamoeba invadens
CMWLYPVSFCKAMYFNPMVPD

SEQ ID NO: 2979043 - protein, 20 aa, Entamoeba invadens
CNALFTTFFRKHHCRKCGLC

SEQ ID NO: 2979044 - protein, 20 aa, Entamoeba invadens
CNAQSPLLYSNLCFIRDFDK

SEQ ID NO: 2979045 - protein, 22 aa, Entamoeba invadens
CNCTEKPIFVCFDCNKRMLQNN

SEQ ID NO: 2979046 - protein, 23 aa, Entamoeba invadens
CNEWKENLCFLKQQTFMINMEKF

SEQ ID NO: 2979047 - protein, 21 aa, Entamoeba invadens
CNFGHIRGCSMIDIHETEFVQ

SEQ ID NO: 2979048 - protein, 19 aa, Entamoeba invadens
CNFLLRFAEINLIGPKGEI

SEQ ID NO: 2979049 - protein, 18 aa, Entamoeba invadens
CNFLPITIDYFLKPIHIR

SEQ ID NO: 2979050 - protein, 20 aa, Entamoeba invadens
CNGKDMYGCLTTTHLKNASY

SEQ ID NO: 2979051 - protein, 18 aa, Entamoeba invadens
CNIIPFRAKHCGAQVAFI

SEQ ID NO: 2979052 - protein, 19 aa, Entamoeba invadens
CNKHFPSRIELIAQYDDTF

SEQ ID NO: 2979053 - protein, 19 aa, Entamoeba invadens
CNLCGIILDKNCGNDGEYP

SEQ ID NO: 2979054 - protein, 19 aa, Entamoeba invadens
CNPNHPISLPLKNPEDKVV

SEQ ID NO: 2979055 - protein, 24 aa, Entamoeba invadens
CNQCKWCKDCLLDIIVQESGGYRN

SEQ ID NO: 2979056 - protein, 25 aa, Entamoeba invadens
CNRLLEFVQRLGFTFIQRGTRSTKY

SEQ ID NO: 2979057 - protein, 23 aa, Entamoeba invadens
CNVCVNGVLTMCYGVDGVPAYVD

SEQ ID NO: 2979058 - protein, 23 aa, Entamoeba invadens
CNVFATNMFLTFSVANALSKTVS

SEQ ID NO: 2979059 - protein, 17 aa, Entamoeba invadens
CNYNLFVYMISFIKEVL

SEQ ID NO: 2979060 - protein, 22 aa, Entamoeba invadens
CPCCRKYLNRFGCNSKICEKCN

SEQ ID NO: 2979061 - protein, 18 aa, Entamoeba invadens
CPCPLCTSPTNIIIKKNT

SEQ ID NO: 2979062 - protein, 24 aa, Entamoeba invadens
CPEHIPMFCCVCGNDFTTAFARTL

SEQ ID NO: 2979063 - protein, 17 aa, Entamoeba invadens
CPEPALILLDFLVATLK

SEQ ID NO: 2979064 - protein, 18 aa, Entamoeba invadens
CPFEDFLAVGRYKGVSTL

SEQ ID NO: 2979065 - protein, 21 aa, Entamoeba invadens
CPKDKRIGWNWIKCSTTKGSH

SEQ ID NO: 2979066 - protein, 20 aa, Entamoeba invadens
CPKFKITNARLFKFFRPSMW

SEQ ID NO: 2979067 - protein, 17 aa, Entamoeba invadens
CPLYHGFSQTTLVVRCI

SEQ ID NO: 2979068 - protein, 21 aa, Entamoeba invadens
CPNNCKRCVNQKCVLCEDNYS

SEQ ID NO: 2979069 - protein, 20 aa, Entamoeba invadens
CPNPKCGRAIVVLSSEQTSN

SEQ ID NO: 2979070 - protein, 17 aa, Entamoeba invadens
CPPEDLSTVFLGFDDVF

SEQ ID NO: 2979071 - protein, 19 aa, Entamoeba invadens
CPSCRGLRVVQEEKILEIV

SEQ ID NO: 2979072 - protein, 17 aa, Entamoeba invadens
CQAIRRLSRNIVEPQLF

SEQ ID NO: 2979073 - protein, 18 aa, Entamoeba invadens
CQDGKCCCDFKCKCGAEG

SEQ ID NO: 2979074 - protein, 18 aa, Entamoeba invadens
CQELCSMPSTFTLLCDLC

SEQ ID NO: 2979075 - protein, 17 aa, Entamoeba invadens
CQEYGHIARICPKKEEI

SEQ ID NO: 2979076 - protein, 24 aa, Entamoeba invadens
CQFCGKLLCKSCCSTIKISSEREV

SEQ ID NO: 2979077 - protein, 19 aa, Entamoeba invadens
CQFPTLGFVIDRYYQIKSF

SEQ ID NO: 2979078 - protein, 20 aa, Entamoeba invadens
CQFTFKHVYFDLGMNPSLEV

SEQ ID NO: 2979079 - protein, 25 aa, Entamoeba invadens
CQHKYCKSCVLSLCKERVNSLQEIF

SEQ ID NO: 2979080 - protein, 20 aa, Entamoeba invadens
CQIDGWLPCIGTYAISPELP

SEQ ID NO: 2979081 - protein, 27 aa, Entamoeba invadens
CQIKPDLRWAWDKIIEEWTQFEDEVKN

SEQ ID NO: 2979082 - protein, 17 aa, Entamoeba invadens
CQIMRKHLTDICGVREH

SEQ ID NO: 2979083 - protein, 20 aa, Entamoeba invadens
CQKCSVNGCKRCSDGETCDM

SEQ ID NO: 2979084 - protein, 18 aa, Entamoeba invadens
CQKCSVSGCKRCSDGETC

SEQ ID NO: 2979085 - protein, 25 aa, Entamoeba invadens
CQLRCNGVLEGIRITRLGYPNRIIY

SEQ ID NO: 2979086 - protein, 18 aa, Entamoeba invadens
CQYCKALHFKCEASKNKN

SEQ ID NO: 2979087 - protein, 19 aa, Entamoeba invadens
CRALCAFEGKLLAGIGTTL

SEQ ID NO: 2979088 - protein, 21 aa, Entamoeba invadens
CRERSRFGIKIAGTRCAGVLT

SEQ ID NO: 2979089 - protein, 20 aa, Entamoeba invadens
CRGFGASVARGFVKQILETL

SEQ ID NO: 2979090 - protein, 25 aa, Entamoeba invadens
CRKCGLCVCADCSKQSIVINKKKER

SEQ ID NO: 2979091 - protein, 19 aa, Entamoeba invadens
CRKLSGIVIDVHRMKQVSY

SEQ ID NO: 2979092 - protein, 24 aa, Entamoeba invadens
CRLCKNEKCSICDNNFILNNEGSC

SEQ ID NO: 2979093 - protein, 26 aa, Entamoeba invadens
CRLVCKRWKEILFFFPLKHTLFTKNS

SEQ ID NO: 2979094 - protein, 18 aa, Entamoeba invadens
CRNLKNLDIFHLNNAICG

SEQ ID NO: 2979095 - protein, 18 aa, Entamoeba invadens
CRRVICPFKTYSMCQDKG

SEQ ID NO: 2979096 - protein, 18 aa, Entamoeba invadens
CRRYILSGVCKFMTIEED

SEQ ID NO: 2979097 - protein, 25 aa, Entamoeba invadens
CRSMIRLQPFAGMLWTEMSERCFEV

SEQ ID NO: 2979098 - protein, 17 aa, Entamoeba invadens
CRSNVFEMVFARNFCKI

SEQ ID NO: 2979099 - protein, 20 aa, Entamoeba invadens
CRTYLEKHFETFKTLDKNQL

SEQ ID NO: 2979100 - protein, 18 aa, Entamoeba invadens
CRVEEICIKDGYPEGTVL

SEQ ID NO: 2979101 - protein, 20 aa, Entamoeba invadens
CRYCPKCGNAILGDPNTPEI

SEQ ID NO: 2979102 - protein, 19 aa, Entamoeba invadens
CSAKSAVISLELMRNQIVT

SEQ ID NO: 2979103 - protein, 17 aa, Entamoeba invadens
CSALLGINVDTIFKISL

SEQ ID NO: 2979104 - protein, 18 aa, Entamoeba invadens
CSALRKGGYVVIKGRPCK

SEQ ID NO: 2979105 - protein, 20 aa, Entamoeba invadens
CSCCPSVYCSECFKLVNNTL

SEQ ID NO: 2979106 - protein, 20 aa, Entamoeba invadens
CSCCYECFYVVTNSITTTQS

SEQ ID NO: 2979107 - protein, 17 aa, Entamoeba invadens
CSCGHQFCWLCMADYTN

SEQ ID NO: 2979108 - protein, 22 aa, Entamoeba invadens
CSDAFWKFMDLIAVKKEQKNWG

SEQ ID NO: 2979109 - protein, 20 aa, Entamoeba invadens
CSDLSCSVCELGSLLNHTGP

SEQ ID NO: 2979110 - protein, 19 aa, Entamoeba invadens
CSFEKGCFENCRNVTIIKN

SEQ ID NO: 2979111 - protein, 17 aa, Entamoeba invadens
CSFPEHLCVVPIQKQLH

SEQ ID NO: 2979112 - protein, 17 aa, Entamoeba invadens
CSHGPVLRTHIKENIER

SEQ ID NO: 2979113 - protein, 20 aa, Entamoeba invadens
CSIGEKWLVDIGVCQKSSEK

SEQ ID NO: 2979114 - protein, 20 aa, Entamoeba invadens
CSKFDIVCGMMYIKVDQNFE

SEQ ID NO: 2979115 - protein, 18 aa, Entamoeba invadens
CSKLRVLYKLNWPVDVIK

SEQ ID NO: 2979116 - protein, 19 aa, Entamoeba invadens
CSLELKFPQNLVGRFAELW

SEQ ID NO: 2979117 - protein, 21 aa, Entamoeba invadens
CSLGKCYFCGEGVKEDKSKGV

SEQ ID NO: 2979118 - protein, 17 aa, Entamoeba invadens
CSLRKTPLLEIIQIEPA

SEQ ID NO: 2979119 - protein, 19 aa, Entamoeba invadens
CSLYPIAIHMLKLASGKPI

SEQ ID NO: 2979120 - protein, 19 aa, Entamoeba invadens
CSPAFFKFMALIGNKTELL

SEQ ID NO: 2979121 - protein, 17 aa, Entamoeba invadens
CSPEFYILFHISAWIGM

SEQ ID NO: 2979122 - protein, 17 aa, Entamoeba invadens
CSRITGIVLDYVLNNNL

SEQ ID NO: 2979123 - protein, 19 aa, Entamoeba invadens
CSSCGLSVHSQCSQNCYLF

SEQ ID NO: 2979124 - protein, 18 aa, Entamoeba invadens
CSSVRCGRANVATFLPGG

SEQ ID NO: 2979125 - protein, 19 aa, Entamoeba invadens
CSTCIACVSLDGAFVTPAI

SEQ ID NO: 2979126 - protein, 18 aa, Entamoeba invadens
CSTIKYSTVMACEDYLFP

SEQ ID NO: 2979127 - protein, 26 aa, Entamoeba invadens
CSTIPERVYWKWFLRLSEIPRPSYHC

SEQ ID NO: 2979128 - protein, 20 aa, Entamoeba invadens
CSYCDGFLALFIRPLMWSTG

SEQ ID NO: 2979129 - protein, 18 aa, Entamoeba invadens
CTAGVVVIFGRFLICGNV

SEQ ID NO: 2979130 - protein, 18 aa, Entamoeba invadens
CTCSMCKKLFVVPITLNC

SEQ ID NO: 2979131 - protein, 19 aa, Entamoeba invadens
CTGTFKISPIFPTNDTDFA

SEQ ID NO: 2979132 - protein, 24 aa, Entamoeba invadens
CTIPLKGKGTAVCWNEKGDEFYSA

SEQ ID NO: 2979133 - protein, 17 aa, Entamoeba invadens
CTKGRITSYVGWEKGGS

SEQ ID NO: 2979134 - protein, 18 aa, Entamoeba invadens
CTRRVGIVGCDWDDLSAQ

SEQ ID NO: 2979135 - protein, 20 aa, Entamoeba invadens
CTSCGVSSCETCVTSPTNKC

SEQ ID NO: 2979136 - protein, 20 aa, Entamoeba invadens
CTSLRRFLIPQGLLYMDSLV

SEQ ID NO: 2979137 - protein, 19 aa, Entamoeba invadens
CTSLRRFVIPQGLLYMDSL

SEQ ID NO: 2979138 - protein, 19 aa, Entamoeba invadens
CTTCGISYCFNCRVEYHDG

SEQ ID NO: 2979139 - protein, 20 aa, Entamoeba invadens
CVAVGLIRRSECDYTVSIQN

SEQ ID NO: 2979140 - protein, 19 aa, Entamoeba invadens
CVCANCSKGKITVSKKCGM

SEQ ID NO: 2979141 - protein, 17 aa, Entamoeba invadens
CVCKKCQIAIISVYINP

SEQ ID NO: 2979142 - protein, 19 aa, Entamoeba invadens
CVEDLKFIDWRGIVGNLTV

SEQ ID NO: 2979143 - protein, 24 aa, Entamoeba invadens
CVGCGLCCKECMCCVLKLESGKVY

SEQ ID NO: 2979144 - protein, 19 aa, Entamoeba invadens
CVGCTNASCPYSLPSTMVM

SEQ ID NO: 2979145 - protein, 25 aa, Entamoeba invadens
CVIKEFLRRLPLPVFHPLLEFLNPD

SEQ ID NO: 2979146 - protein, 19 aa, Entamoeba invadens
CVIMTKFAFLYSDFGKEKK

SEQ ID NO: 2979147 - protein, 20 aa, Entamoeba invadens
CVIPELFGTIPLFAANSAKK

SEQ ID NO: 2979148 - protein, 19 aa, Entamoeba invadens
CVKCGLKVNPGQPCSTLSG

SEQ ID NO: 2979149 - protein, 23 aa, Entamoeba invadens
CVKKRSSAVFVYRKIKIEKDPTK

SEQ ID NO: 2979150 - protein, 20 aa, Entamoeba invadens
CVKLCDFGSCKLLTQTGNYP

SEQ ID NO: 2979151 - protein, 17 aa, Entamoeba invadens
CVKMKKKAIKREKKRKT

SEQ ID NO: 2979152 - protein, 19 aa, Entamoeba invadens
CVNPSWVSLCHELLNNSGV

SEQ ID NO: 2979153 - protein, 21 aa, Entamoeba invadens
CVPEDISLLAFLISKSVKQNI

SEQ ID NO: 2979154 - protein, 19 aa, Entamoeba invadens
CVQSSVLLEEFCKMNNMKC

SEQ ID NO: 2979155 - protein, 24 aa, Entamoeba invadens
CVRLLQDLLVEFGFIVCFEKETVD

SEQ ID NO: 2979156 - protein, 20 aa, Entamoeba invadens
CVSGIEMVHPVFFDSNNAPM

SEQ ID NO: 2979157 - protein, 19 aa, Entamoeba invadens
CVTCAFGYYYDRTSNDCIY

SEQ ID NO: 2979158 - protein, 18 aa, Entamoeba invadens
CVVAELFFGITLFAGSSE

SEQ ID NO: 2979159 - protein, 19 aa, Entamoeba invadens
CVVGLCKLLSLPQFTPVVV

SEQ ID NO: 2979160 - protein, 23 aa, Entamoeba invadens
CVYLSLPLGNFFLCHGGLSPSLH

SEQ ID NO: 2979161 - protein, 17 aa, Entamoeba invadens
CWCFYNFDLMPSRLSVL

SEQ ID NO: 2979162 - protein, 24 aa, Entamoeba invadens
CWDAEIRMSYGWVECVGHADRGDY

SEQ ID NO: 2979163 - protein, 17 aa, Entamoeba invadens
CWERCLSSLLRVERIHM

SEQ ID NO: 2979164 - protein, 20 aa, Entamoeba invadens
CWFKEAMTGINFIQRRGKYY

SEQ ID NO: 2979165 - protein, 17 aa, Entamoeba invadens
CWGDVGIGMFFIEPDKL

SEQ ID NO: 2979166 - protein, 17 aa, Entamoeba invadens
CWIHPDIEYHLFEMKNG

SEQ ID NO: 2979167 - protein, 19 aa, Entamoeba invadens
CWKGVPWHFRPKVWRILTN

SEQ ID NO: 2979168 - protein, 17 aa, Entamoeba invadens
CWSSLKLPEESWTDTTI

SEQ ID NO: 2979169 - protein, 19 aa, Entamoeba invadens
CWWKEGVVYQIYCRSFKDT

SEQ ID NO: 2979170 - protein, 17 aa, Entamoeba invadens
CYCFQRWRVLMEKNSKF

SEQ ID NO: 2979171 - protein, 19 aa, Entamoeba invadens
CYESLCVRGVYGLVHKGIY

SEQ ID NO: 2979172 - protein, 17 aa, Entamoeba invadens
CYFCNFVAAASFIKELT

SEQ ID NO: 2979173 - protein, 17 aa, Entamoeba invadens
CYFGTKILNGFNVPTSV

SEQ ID NO: 2979174 - protein, 18 aa, Entamoeba invadens
CYHALGFYKYEIATENGK

SEQ ID NO: 2979175 - protein, 17 aa, Entamoeba invadens
CYKFDGFGLPKCDGVGC

SEQ ID NO: 2979176 - protein, 23 aa, Entamoeba invadens
CYKGMLRLHGRMNLLLTQIEKKE

SEQ ID NO: 2979177 - protein, 19 aa, Entamoeba invadens
CYKLDLVDVVMKFVDGEIK

SEQ ID NO: 2979178 - protein, 25 aa, Entamoeba invadens
CYNTFYVCVKQLLKYAVTQDVIDYV

SEQ ID NO: 2979179 - protein, 21 aa, Entamoeba invadens
CYRKGSFPLISIFEPHQKEPM

SEQ ID NO: 2979180 - protein, 18 aa, Entamoeba invadens
CYSLRWAVLPTIHGEEFF

SEQ ID NO: 2979181 - protein, 17 aa, Entamoeba invadens
CYSSFWIKKNKQIEFNV

SEQ ID NO: 2979182 - protein, 17 aa, Entamoeba invadens
DAALRYLATLGFDKLNI

SEQ ID NO: 2979183 - protein, 24 aa, Entamoeba invadens
DAEIKRKESELVERLNELETNKKL

SEQ ID NO: 2979184 - protein, 18 aa, Entamoeba invadens
DAEKYEIPVGKYVSYITS

SEQ ID NO: 2979185 - protein, 20 aa, Entamoeba invadens
DAFKFPWKIAEFVTARKRLE

SEQ ID NO: 2979186 - protein, 22 aa, Entamoeba invadens
DAFVGSFARCWAKGIDFVNSAK

SEQ ID NO: 2979187 - protein, 20 aa, Entamoeba invadens
DAGRCTRPLFTVSNNNGELG

SEQ ID NO: 2979188 - protein, 19 aa, Entamoeba invadens
DAIMGMKFMKEARKKEVEQ

SEQ ID NO: 2979189 - protein, 22 aa, Entamoeba invadens
DALCFKMARFEFKAQEFIINSL

SEQ ID NO: 2979190 - protein, 24 aa, Entamoeba invadens
DALDVIEIFKIASLTGIGGIANTP

SEQ ID NO: 2979191 - protein, 23 aa, Entamoeba invadens
DALHLGHLIPFIFTQYLQEAFNA

SEQ ID NO: 2979192 - protein, 18 aa, Entamoeba invadens
DALKRPNVSVIFQTENAV

SEQ ID NO: 2979193 - protein, 19 aa, Entamoeba invadens
DALKYLLLMKLMQKKPGEI

SEQ ID NO: 2979194 - protein, 22 aa, Entamoeba invadens
DALRPAIVMFVGFYHKKFERTV

SEQ ID NO: 2979195 - protein, 19 aa, Entamoeba invadens
DALYILGVMYFKGENVCED

SEQ ID NO: 2979196 - protein, 18 aa, Entamoeba invadens
DAMILRFAIPSRKMTKKD

SEQ ID NO: 2979197 - protein, 17 aa, Entamoeba invadens
DAMKRCVAIALMALINV

SEQ ID NO: 2979198 - protein, 20 aa, Entamoeba invadens
DAPDIAMCWDNGKGTKDGCV

SEQ ID NO: 2979199 - protein, 19 aa, Entamoeba invadens
DATGILDIFGFDIATSQKE

SEQ ID NO: 2979200 - protein, 17 aa, Entamoeba invadens
DAVIVFDCGSSFIKVGT

SEQ ID NO: 2979201 - protein, 17 aa, Entamoeba invadens
DAVTWFWCRTIQEGYYY

SEQ ID NO: 2979202 - protein, 19 aa, Entamoeba invadens
DAYCKFRIYEELKKLCSDL

SEQ ID NO: 2979203 - protein, 22 aa, Entamoeba invadens
DAYCREFYPKGAGVVMPKDANS

SEQ ID NO: 2979204 - protein, 19 aa, Entamoeba invadens
DAYCVWRCANFMVFCVCDG

SEQ ID NO: 2979205 - protein, 20 aa, Entamoeba invadens
DAYGPRAAINWGKLLGDMLA

SEQ ID NO: 2979206 - protein, 19 aa, Entamoeba invadens
DAYIRFGIFERAMSVIQKY

SEQ ID NO: 2979207 - protein, 19 aa, Entamoeba invadens
DCCSLCLINFNFNELNKLK

SEQ ID NO: 2979208 - protein, 17 aa, Entamoeba invadens
DCEYCFAEGYSVSEEFI

SEQ ID NO: 2979209 - protein, 19 aa, Entamoeba invadens
DCFKIKAGIRTKVKLQGTV

SEQ ID NO: 2979210 - protein, 19 aa, Entamoeba invadens
DCGVPLLAMHSIREIGGVF

SEQ ID NO: 2979211 - protein, 18 aa, Entamoeba invadens
DCIEFLKPNCEYAYVFEK

SEQ ID NO: 2979212 - protein, 17 aa, Entamoeba invadens
DCIIKLTPLVPTFDILE

SEQ ID NO: 2979213 - protein, 21 aa, Entamoeba invadens
DCINCVLSIDCEICDKFEFKD

SEQ ID NO: 2979214 - protein, 19 aa, Entamoeba invadens
DCIRGKFGITGGVNCCHAS

SEQ ID NO: 2979215 - protein, 18 aa, Entamoeba invadens
DCKKQWRLSASFLGSSGG

SEQ ID NO: 2979216 - protein, 18 aa, Entamoeba invadens
DCLFSIWRVLLDCLSKLD

SEQ ID NO: 2979217 - protein, 18 aa, Entamoeba invadens
DCVVCGFVKPIISEKEEN

SEQ ID NO: 2979218 - protein, 17 aa, Entamoeba invadens
DDAKAKAFAALNRKVSE

SEQ ID NO: 2979219 - protein, 24 aa, Entamoeba invadens
DDDGMILAVRWAFYIREKSGSISP

SEQ ID NO: 2979220 - protein, 19 aa, Entamoeba invadens
DDEFCCFLFNDYLVFAKVR

SEQ ID NO: 2979221 - protein, 17 aa, Entamoeba invadens
DDEMSFRHVYNWLSEAR

SEQ ID NO: 2979222 - protein, 22 aa, Entamoeba invadens
DDFLGNCFWYVPQMRTSEKRKE

SEQ ID NO: 2979223 - protein, 20 aa, Entamoeba invadens
DDFMWKGDCQVVKRDTKLRV

SEQ ID NO: 2979224 - protein, 24 aa, Entamoeba invadens
DDFRCVCLPPPTGKGMRSSKEKTV

SEQ ID NO: 2979225 - protein, 23 aa, Entamoeba invadens
DDFRCVCLPPPTGKGVRSSKEKT

SEQ ID NO: 2979226 - protein, 26 aa, Entamoeba invadens
DDGACGLQFFLNCFKNLQIKRKTRAS

SEQ ID NO: 2979227 - protein, 24 aa, Entamoeba invadens
DDIFDIILYNGRWDAVNRKYVKQR

SEQ ID NO: 2979228 - protein, 25 aa, Entamoeba invadens
DDIQPRFALFAAHYRYVFLSYDQSL

SEQ ID NO: 2979229 - protein, 17 aa, Entamoeba invadens
DDIYCLIQPKATQAVHP

SEQ ID NO: 2979230 - protein, 17 aa, Entamoeba invadens
DDKCFKCITRDTVQYYL

SEQ ID NO: 2979231 - protein, 23 aa, Entamoeba invadens
DDKKEKKKVFGIFKKKDKHADED

SEQ ID NO: 2979232 - protein, 22 aa, Entamoeba invadens
DDLEFPLCFTVFGATKYSLNNE

SEQ ID NO: 2979233 - protein, 18 aa, Entamoeba invadens
DDLLCVIEYLVSKIKRSA

SEQ ID NO: 2979234 - protein, 19 aa, Entamoeba invadens
DDLRPLFKINYCLLHRLSI

SEQ ID NO: 2979235 - protein, 21 aa, Entamoeba invadens
DDLRQDCLILRAFQLFDDIWK

SEQ ID NO: 2979236 - protein, 20 aa, Entamoeba invadens
DDVINCWDISTGVPLRRITF

SEQ ID NO: 2979237 - protein, 26 aa, Entamoeba invadens
DDVIRVCFVFEKLFLVSKIKTFQGKV

SEQ ID NO: 2979238 - protein, 18 aa, Entamoeba invadens
DDVLPFKVFADRVGVNFV

SEQ ID NO: 2979239 - protein, 22 aa, Entamoeba invadens
DDVLRINCKLVRVADECPECSK

SEQ ID NO: 2979240 - protein, 22 aa, Entamoeba invadens
DDVRFKFAWGIADFITSGKRLE

SEQ ID NO: 2979241 - protein, 18 aa, Entamoeba invadens
DEEFVGMTVAGLKQKIQQ

SEQ ID NO: 2979242 - protein, 18 aa, Entamoeba invadens
DEFLSCVEQLILVDKEWM

SEQ ID NO: 2979243 - protein, 17 aa, Entamoeba invadens
DEFRWIASNVKSWGNKL

SEQ ID NO: 2979244 - protein, 19 aa, Entamoeba invadens
DEFSRRAFLQSISKTKLPP

SEQ ID NO: 2979245 - protein, 25 aa, Entamoeba invadens
DEILRINPNLAEFVNFYYTTNHDET

SEQ ID NO: 2979246 - protein, 24 aa, Entamoeba invadens
DEIRRKLCCGFVFKDTDRAMEMIK

SEQ ID NO: 2979247 - protein, 20 aa, Entamoeba invadens
DEKKSSVIPTDFTKTEKNVV

SEQ ID NO: 2979248 - protein, 19 aa, Entamoeba invadens
DEKRAVIYISPFEEDAQKA

SEQ ID NO: 2979249 - protein, 18 aa, Entamoeba invadens
DELKTCFQWGVDFATALK

SEQ ID NO: 2979250 - protein, 18 aa, Entamoeba invadens
DELLRSIYSFGFDKPSAI

SEQ ID NO: 2979251 - protein, 18 aa, Entamoeba invadens
DEMLRLVVFLNNVSAEYK

SEQ ID NO: 2979252 - protein, 24 aa, Entamoeba invadens
DERFKTLTTLAAWELKTTDFKIIF

SEQ ID NO: 2979253 - protein, 21 aa, Entamoeba invadens
DERLLSCFSAFWVFKDGNVII

SEQ ID NO: 2979254 - protein, 23 aa, Entamoeba invadens
DEVILKMRIKLILDTAKGIQYLH

SEQ ID NO: 2979255 - protein, 20 aa, Entamoeba invadens
DEVKEFLSDFNIRKVTQIIK

SEQ ID NO: 2979256 - protein, 22 aa, Entamoeba invadens
DEVKRLKLLILKQEDSQTEIVS

SEQ ID NO: 2979257 - protein, 17 aa, Entamoeba invadens
DEWKYSELEVMKAGGNA

SEQ ID NO: 2979258 - protein, 24 aa, Entamoeba invadens
DFCARPDVFLSFKYQSPSQNLEIE

SEQ ID NO: 2979259 - protein, 17 aa, Entamoeba invadens
DFCLVRIGGKLMCVPHN

SEQ ID NO: 2979260 - protein, 24 aa, Entamoeba invadens
DFEKVCGVDSFLKLDEELSRAKHV

SEQ ID NO: 2979261 - protein, 17 aa, Entamoeba invadens
DFFEIIFAFALPLKPNA

SEQ ID NO: 2979262 - protein, 18 aa, Entamoeba invadens
DFFESCITLFPLIFPDEY

SEQ ID NO: 2979263 - protein, 19 aa, Entamoeba invadens
DFFLLHGFYCIRLEDALKE

SEQ ID NO: 2979264 - protein, 22 aa, Entamoeba invadens
DFGESFVSMFPFYNSTYLFNAS

SEQ ID NO: 2979265 - protein, 22 aa, Entamoeba invadens
DFLYSYCFPFLVYKQRILTNQT

SEQ ID NO: 2979266 - protein, 17 aa, Entamoeba invadens
DFMCCLCAVSGDEKLSD

SEQ ID NO: 2979267 - protein, 20 aa, Entamoeba invadens
DFNNMFGMDFMFGNNFANNQ

SEQ ID NO: 2979268 - protein, 18 aa, Entamoeba invadens
DFPISFGVFQKFLKNGVQ

SEQ ID NO: 2979269 - protein, 23 aa, Entamoeba invadens
DFPLLGLMRKWLKALYEVKVESN

SEQ ID NO: 2979270 - protein, 24 aa, Entamoeba invadens
DFRFPDEKVRLFALKCIDAMKDHE

SEQ ID NO: 2979271 - protein, 17 aa, Entamoeba invadens
DFRLLPLPIQGRKNVGV

SEQ ID NO: 2979272 - protein, 19 aa, Entamoeba invadens
DFRVQPGFLQRTFYATKHH

SEQ ID NO: 2979273 - protein, 18 aa, Entamoeba invadens
DFSRLPFFIFEWHYLWFI

SEQ ID NO: 2979274 - protein, 20 aa, Entamoeba invadens
DFYKRLIVYEVDYTTSTYKE

SEQ ID NO: 2979275 - protein, 22 aa, Entamoeba invadens
DFYRYEVIPGFIKRLNELLSTA

SEQ ID NO: 2979276 - protein, 18 aa, Entamoeba invadens
DGAFCESIGWLGGALQEF

SEQ ID NO: 2979277 - protein, 19 aa, Entamoeba invadens
DGCCRGCINLTSVTIPLSV

SEQ ID NO: 2979278 - protein, 18 aa, Entamoeba invadens
DGCFRGCYVLSSVTIPSS

SEQ ID NO: 2979279 - protein, 19 aa, Entamoeba invadens
DGCGIGSAPKKAAWSAGQT

SEQ ID NO: 2979280 - protein, 21 aa, Entamoeba invadens
DGCTWATHFSRLFKNLHQLAT

SEQ ID NO: 2979281 - protein, 18 aa, Entamoeba invadens
DGFFPMKNYEFMTWSDNV

SEQ ID NO: 2979282 - protein, 17 aa, Entamoeba invadens
DGFKYACDFMVYKKNPK

SEQ ID NO: 2979283 - protein, 18 aa, Entamoeba invadens
DGIHLVLFGTRWLRLLFD

SEQ ID NO: 2979284 - protein, 17 aa, Entamoeba invadens
DGILAFERGVFGFKGEF

SEQ ID NO: 2979285 - protein, 21 aa, Entamoeba invadens
DGKIFHSRCFNLWKKQQQLEQ

SEQ ID NO: 2979286 - protein, 21 aa, Entamoeba invadens
DGKIVDKIVCTRCWYTNTETI

SEQ ID NO: 2979287 - protein, 18 aa, Entamoeba invadens
DGKLVLKCTHEFEGAVYA

SEQ ID NO: 2979288 - protein, 21 aa, Entamoeba invadens
DGLEHCFWLAFFFKYATVGEG

SEQ ID NO: 2979289 - protein, 20 aa, Entamoeba invadens
DGLEILLVMCLWKIVCPEYI

SEQ ID NO: 2979290 - protein, 18 aa, Entamoeba invadens
DGLFDFLIELFMITTDDN

SEQ ID NO: 2979291 - protein, 18 aa, Entamoeba invadens
DGNEFIPKRIRVFQLSDS

SEQ ID NO: 2979292 - protein, 24 aa, Entamoeba invadens
DGNLKLILGLLWTLILKYQISKNK

SEQ ID NO: 2979293 - protein, 19 aa, Entamoeba invadens
DGPFRVCVIGAKSSGKSTF

SEQ ID NO: 2979294 - protein, 21 aa, Entamoeba invadens
DGRNALNFVEKVYLYYTKFNI

SEQ ID NO: 2979295 - protein, 20 aa, Entamoeba invadens
DGRSVLQFREFRCERDVIDQ

SEQ ID NO: 2979296 - protein, 23 aa, Entamoeba invadens
DHALLFIKRFIKAWSDCQKAEFF

SEQ ID NO: 2979297 - protein, 18 aa, Entamoeba invadens
DHASIKFPALGFEIPSTA

SEQ ID NO: 2979298 - protein, 25 aa, Entamoeba invadens
DHFKLSFRITFQFNDNVFLKGNDVC

SEQ ID NO: 2979299 - protein, 20 aa, Entamoeba invadens
DHFLCHGGMRTVEFKIVDVD

SEQ ID NO: 2979300 - protein, 19 aa, Entamoeba invadens
DHWLCPGLDKNDWDVKKKV

SEQ ID NO: 2979301 - protein, 17 aa, Entamoeba invadens
DIACCPWDVSTFATASS

SEQ ID NO: 2979302 - protein, 18 aa, Entamoeba invadens
DICDYKNWFVCDFEELKN

SEQ ID NO: 2979303 - protein, 17 aa, Entamoeba invadens
DICLRSSAAPTYFEPYQ

SEQ ID NO: 2979304 - protein, 20 aa, Entamoeba invadens
DIEKAFCFEVVYNKQYVFMC

SEQ ID NO: 2979305 - protein, 19 aa, Entamoeba invadens
DIELIKSCEGYFKNWIQLT

SEQ ID NO: 2979306 - protein, 22 aa, Entamoeba invadens
DIFPKCRGYQLPSLFDTQRGDS

SEQ ID NO: 2979307 - protein, 24 aa, Entamoeba invadens
DIFPKCRGYQLPSLFNYQPTMDRA

SEQ ID NO: 2979308 - protein, 17 aa, Entamoeba invadens
DIFSFGVTLFVSMCGYY

SEQ ID NO: 2979309 - protein, 19 aa, Entamoeba invadens
DIFYRTTVVLAENVKILGK

SEQ ID NO: 2979310 - protein, 18 aa, Entamoeba invadens
DIHFLVAITYCLKTIDID

SEQ ID NO: 2979311 - protein, 20 aa, Entamoeba invadens
DILESVFLWFVGKDKKFMSL

SEQ ID NO: 2979312 - protein, 18 aa, Entamoeba invadens
DILGEFGFFCEVNATKGK

SEQ ID NO: 2979313 - protein, 18 aa, Entamoeba invadens
DILHKLTFICYGNSVKSG

SEQ ID NO: 2979314 - protein, 21 aa, Entamoeba invadens
DIPKEIKYIFARLRTAVEKKF

SEQ ID NO: 2979315 - protein, 17 aa, Entamoeba invadens
DIREFRCELPFQLFKSG

SEQ ID NO: 2979316 - protein, 18 aa, Entamoeba invadens
DIRMKLRVKMMLDCFKGI

SEQ ID NO: 2979317 - protein, 19 aa, Entamoeba invadens
DIRMKLRVKMMLDCSKGIL

SEQ ID NO: 2979318 - protein, 25 aa, Entamoeba invadens
DIRVKLQPIVTCVNALPLHTDLNRL

SEQ ID NO: 2979319 - protein, 23 aa, Entamoeba invadens
DISIEEFNAFLAVTIIQGQFKDN

SEQ ID NO: 2979320 - protein, 24 aa, Entamoeba invadens
DISIEEFNAFLAVTIIQGQFKDNK

SEQ ID NO: 2979321 - protein, 23 aa, Entamoeba invadens
DISLEIGRLFLMTPIENRRLLLA

SEQ ID NO: 2979322 - protein, 19 aa, Entamoeba invadens
DISRKGCDFSMTKISKSDL

SEQ ID NO: 2979323 - protein, 18 aa, Entamoeba invadens
DKAVLFPKDLELMSIIIN

SEQ ID NO: 2979324 - protein, 25 aa, Entamoeba invadens
DKCSKLCSVCGCDEYLEKMKKEKEE

SEQ ID NO: 2979325 - protein, 18 aa, Entamoeba invadens
DKEHFVFRVKDGKATKYM

SEQ ID NO: 2979326 - protein, 24 aa, Entamoeba invadens
DKETRRKLLLCGMARAGKDQVKEM

SEQ ID NO: 2979327 - protein, 18 aa, Entamoeba invadens
DKFPCGRCGETLTKNDFV

SEQ ID NO: 2979328 - protein, 23 aa, Entamoeba invadens
DKGACARLTVDLHMTLKDEGKEF

SEQ ID NO: 2979329 - protein, 17 aa, Entamoeba invadens
DKGKRTSLVTFLPERND

SEQ ID NO: 2979330 - protein, 23 aa, Entamoeba invadens
DKIEVCSGLEGFKHFPTAALNEL

SEQ ID NO: 2979331 - protein, 24 aa, Entamoeba invadens
DKIKRIQCIPLRLFVETERDDEIR

SEQ ID NO: 2979332 - protein, 25 aa, Entamoeba invadens
DKIMKSLEYHYFEAVWTALKMQVIE

SEQ ID NO: 2979333 - protein, 18 aa, Entamoeba invadens
DKKAWVIDLNFMFTGEKK

SEQ ID NO: 2979334 - protein, 22 aa, Entamoeba invadens
DKKWEKKEMKHFCKCKPREMRY

SEQ ID NO: 2979335 - protein, 19 aa, Entamoeba invadens
DKLMFVIKMSEGWQFGFYS

SEQ ID NO: 2979336 - protein, 18 aa, Entamoeba invadens
DKMCKFIILLKVLQVPYR

SEQ ID NO: 2979337 - protein, 19 aa, Entamoeba invadens
DKPCYKCGKYGHISKDCPD

SEQ ID NO: 2979338 - protein, 24 aa, Entamoeba invadens
DKSCKEFSNAIAISYRSAPGDVLK

SEQ ID NO: 2979339 - protein, 25 aa, Entamoeba invadens
DKSNGLKCAICWDVSDDVVTTQCGH

SEQ ID NO: 2979340 - protein, 20 aa, Entamoeba invadens
DKTIKCWDLTSKHSIKTYTH

SEQ ID NO: 2979341 - protein, 30 aa, Entamoeba invadens
DKVDDFCLFFYLSFCVMKETKLDDNLEIKR

SEQ ID NO: 2979342 - protein, 23 aa, Entamoeba invadens
DKWFYTLFCHWNFYVRQAFQHIV

SEQ ID NO: 2979343 - protein, 21 aa, Entamoeba invadens
DKYDSVFRFVLNNTLIVDTLK

SEQ ID NO: 2979344 - protein, 22 aa, Entamoeba invadens
DKYEWLKLELIEDATKLIQDCE

SEQ ID NO: 2979345 - protein, 19 aa, Entamoeba invadens
DLACLALICREGTAKGRDG

SEQ ID NO: 2979346 - protein, 19 aa, Entamoeba invadens
DLAHEWKVLFFETSAKNKI

SEQ ID NO: 2979347 - protein, 22 aa, Entamoeba invadens
DLANKFAFCLFGNTVHYTTHEL

SEQ ID NO: 2979348 - protein, 20 aa, Entamoeba invadens
DLFKFPWKIAEYVIAGNRPI

SEQ ID NO: 2979349 - protein, 20 aa, Entamoeba invadens
DLIDLLSAFIPLPPEMIQVK

SEQ ID NO: 2979350 - protein, 23 aa, Entamoeba invadens
DLKEGMEPFVFRYERPFKIIFGG

SEQ ID NO: 2979351 - protein, 21 aa, Entamoeba invadens
DLKLTEIVKMRWKKEDENRFN

SEQ ID NO: 2979352 - protein, 19 aa, Entamoeba invadens
DLKPRKSVYHWSRQETGLF

SEQ ID NO: 2979353 - protein, 18 aa, Entamoeba invadens
DLQMCISEKFLAIVSNVS

SEQ ID NO: 2979354 - protein, 20 aa, Entamoeba invadens
DLREGRKTIIVWTALEDGIL

SEQ ID NO: 2979355 - protein, 21 aa, Entamoeba invadens
DLRVGEIIHIIFLEERFTYIL

SEQ ID NO: 2979356 - protein, 23 aa, Entamoeba invadens
DLTIPNCYSGIVGNVESPRPGLS

SEQ ID NO: 2979357 - protein, 18 aa, Entamoeba invadens
DLYPLGVCLYRLMTHKIP

SEQ ID NO: 2979358 - protein, 26 aa, Entamoeba invadens
DLYSIGVCLFRLCTCQFPFGSTEAEF

SEQ ID NO: 2979359 - protein, 18 aa, Entamoeba invadens
DMHLIDYSLLVGVHQLSD

SEQ ID NO: 2979360 - protein, 17 aa, Entamoeba invadens
DMKEYFYPWALKTLDIM

SEQ ID NO: 2979361 - protein, 22 aa, Entamoeba invadens
DMKLRIKMCFDAAKRLSYLHKN

SEQ ID NO: 2979362 - protein, 21 aa, Entamoeba invadens
DMLRAKFGMYGVIEKITRIEN

SEQ ID NO: 2979363 - protein, 18 aa, Entamoeba invadens
DMLSRDGGSLGIKEALYQ

SEQ ID NO: 2979364 - protein, 26 aa, Entamoeba invadens
DMMKKRLLDMSAEFKKAIVTIESLPK

SEQ ID NO: 2979365 - protein, 18 aa, Entamoeba invadens
DMMLSEKCYIQWIEEHPL

SEQ ID NO: 2979366 - protein, 24 aa, Entamoeba invadens
DMRVVWVCWIFKMKDFRIERNNYF

SEQ ID NO: 2979367 - protein, 23 aa, Entamoeba invadens
DMSEMKLKLEAFEQAAKTYKQSK

SEQ ID NO: 2979368 - protein, 18 aa, Entamoeba invadens
DNELKLFLKEIVAIVQKF

SEQ ID NO: 2979369 - protein, 17 aa, Entamoeba invadens
DNFKFLTKFVVYFIDEV

SEQ ID NO: 2979370 - protein, 22 aa, Entamoeba invadens
DNGIVSFDCCFTIKKDKKIYVQ

SEQ ID NO: 2979371 - protein, 22 aa, Entamoeba invadens
DNIMKCPSRKNVPLPKGRKRMT

SEQ ID NO: 2979372 - protein, 22 aa, Entamoeba invadens
DNIPCGLAWPLLIGEKGIGIHM

SEQ ID NO: 2979373 - protein, 17 aa, Entamoeba invadens
DNKRINVFIIRDGIEQF

SEQ ID NO: 2979374 - protein, 26 aa, Entamoeba invadens
DNKWNLAIESCIKRSTLASFIVRSEN

SEQ ID NO: 2979375 - protein, 18 aa, Entamoeba invadens
DNLFCSAIVHFTSDDALN

SEQ ID NO: 2979376 - protein, 24 aa, Entamoeba invadens
DNLKRFFGAFCVRGDLRSVIFSNP

SEQ ID NO: 2979377 - protein, 19 aa, Entamoeba invadens
DNPNFFLAMLFVVREDIKK

SEQ ID NO: 2979378 - protein, 20 aa, Entamoeba invadens
DNQYELICECWKQNPIERIT

SEQ ID NO: 2979379 - protein, 21 aa, Entamoeba invadens
DNTCLPCTLIGCFKCTKFECL

SEQ ID NO: 2979380 - protein, 22 aa, Entamoeba invadens
DNVKEFVKWVSGHLINGYNNAF

SEQ ID NO: 2979381 - protein, 19 aa, Entamoeba invadens
DPEWCGGLITHLIKEDPDF

SEQ ID NO: 2979382 - protein, 19 aa, Entamoeba invadens
DPFCKVKIPGATLVYRSRN

SEQ ID NO: 2979383 - protein, 17 aa, Entamoeba invadens
DPFEFLNKLLLFVDKVE

SEQ ID NO: 2979384 - protein, 19 aa, Entamoeba invadens
DPFGRLSFYGMKAVVSPNG

SEQ ID NO: 2979385 - protein, 19 aa, Entamoeba invadens
DPICILVFLPGMAEIEEMR

SEQ ID NO: 2979386 - protein, 17 aa, Entamoeba invadens
DPMSLSFALFIITKLSK

SEQ ID NO: 2979387 - protein, 17 aa, Entamoeba invadens
DPSGHKMILTEDKFDSD

SEQ ID NO: 2979388 - protein, 18 aa, Entamoeba invadens
DPSIVKCLIDHGASIVSI

SEQ ID NO: 2979389 - protein, 23 aa, Entamoeba invadens
DPSKCLMAGPGLKTGEVLVPQVF

SEQ ID NO: 2979390 - protein, 20 aa, Entamoeba invadens
DPTLLKHCMIVLKKMVEKYN

SEQ ID NO: 2979391 - protein, 19 aa, Entamoeba invadens
DPYFGRLKTVYAFAREKYN

SEQ ID NO: 2979392 - protein, 17 aa, Entamoeba invadens
DQAVWMLNAMWLKEKDA

SEQ ID NO: 2979393 - protein, 21 aa, Entamoeba invadens
DQEFKPLCSMPKGDEIFKQLI

SEQ ID NO: 2979394 - protein, 19 aa, Entamoeba invadens
DRALALTAMSAFKDKEFKT

SEQ ID NO: 2979395 - protein, 25 aa, Entamoeba invadens
DRAVYIFGFHVMRCLFLDPHTVQPA

SEQ ID NO: 2979396 - protein, 17 aa, Entamoeba invadens
DRFLVLACDGVWDVMSN

SEQ ID NO: 2979397 - protein, 17 aa, Entamoeba invadens
DRFRLLIVDSVTSLFRV

SEQ ID NO: 2979398 - protein, 18 aa, Entamoeba invadens
DRIIKFGAANIFGKDEGE

SEQ ID NO: 2979399 - protein, 24 aa, Entamoeba invadens
DRIWFRARMQIVNVMLPDGSQKKM

SEQ ID NO: 2979400 - protein, 25 aa, Entamoeba invadens
DRKIFGIAIPECVNSLGESCYTNTK

SEQ ID NO: 2979401 - protein, 21 aa, Entamoeba invadens
DRLKEAVLFSYRFPAKAEDVR

SEQ ID NO: 2979402 - protein, 21 aa, Entamoeba invadens
DRMMYKLGYVDRVMDVLKRRQ

SEQ ID NO: 2979403 - protein, 20 aa, Entamoeba invadens
DRRILLAYRIYWFEKNVEQK

SEQ ID NO: 2979404 - protein, 24 aa, Entamoeba invadens
DRRREIICGNPLKPEEVVGYTPNT

SEQ ID NO: 2979405 - protein, 20 aa, Entamoeba invadens
DRSVYSLECCKNWMGKMSVV

SEQ ID NO: 2979406 - protein, 19 aa, Entamoeba invadens
DRTDPIWREPIFSIILNSG

SEQ ID NO: 2979407 - protein, 23 aa, Entamoeba invadens
DRVKRIQAALLYVWSITLILKNA

SEQ ID NO: 2979408 - protein, 21 aa, Entamoeba invadens
DRYDIKDGYYLIVYKASSSLN

SEQ ID NO: 2979409 - protein, 17 aa, Entamoeba invadens
DSAVDWWSFGILTYEMM

SEQ ID NO: 2979410 - protein, 22 aa, Entamoeba invadens
DSETKFNLFFSYHYYVDLLCES

SEQ ID NO: 2979411 - protein, 22 aa, Entamoeba invadens
DSFHLFNAIALFIGNIAFVNNN

SEQ ID NO: 2979412 - protein, 17 aa, Entamoeba invadens
DSFKLFTVVVLNFEFPS

SEQ ID NO: 2979413 - protein, 17 aa, Entamoeba invadens
DSFSYFCMCVRDKIANF

SEQ ID NO: 2979414 - protein, 19 aa, Entamoeba invadens
DSGEMKVALALYPVSMKQI

SEQ ID NO: 2979415 - protein, 24 aa, Entamoeba invadens
DSGIYRRTQCLDFLSTSPTFLSSM

SEQ ID NO: 2979416 - protein, 17 aa, Entamoeba invadens
DSHPMFWEIVIVFQDKA

SEQ ID NO: 2979417 - protein, 20 aa, Entamoeba invadens
DSIKTLGFRCFKNCTRLSKV

SEQ ID NO: 2979418 - protein, 19 aa, Entamoeba invadens
DSKVSYGLVKKVLEQKGLL

SEQ ID NO: 2979419 - protein, 18 aa, Entamoeba invadens
DSLCFLSRLFFGCVDESF

SEQ ID NO: 2979420 - protein, 24 aa, Entamoeba invadens
DSLILKERFNVFMYQSHIDKKNKE

SEQ ID NO: 2979421 - protein, 18 aa, Entamoeba invadens
DSLKRLTVISSEFVYLPE

SEQ ID NO: 2979422 - protein, 24 aa, Entamoeba invadens
DSNFPTFFPSFLITEVFGRSEWVV

SEQ ID NO: 2979423 - protein, 21 aa, Entamoeba invadens
DSPNCKFCFRILNLSNSEVDL

SEQ ID NO: 2979424 - protein, 22 aa, Entamoeba invadens
DSRFCIEFIYRLVSLDSNDKYV

SEQ ID NO: 2979425 - protein, 24 aa, Entamoeba invadens
DSTCLPCTVTNCFKCTEFECLGCQ

SEQ ID NO: 2979426 - protein, 20 aa, Entamoeba invadens
DSVGECFQRFIPFLKVYKLF

SEQ ID NO: 2979427 - protein, 19 aa, Entamoeba invadens
DSVVYSFNYMKGMYFVEQG

SEQ ID NO: 2979428 - protein, 20 aa, Entamoeba invadens
DSVVYSFNYMKGMYFVEQGF

SEQ ID NO: 2979429 - protein, 20 aa, Entamoeba invadens
DSVWMRGYWLIFSQDQAVKG

SEQ ID NO: 2979430 - protein, 21 aa, Entamoeba invadens
DSVWMRGYWLIFSQDQAVKGN

SEQ ID NO: 2979431 - protein, 25 aa, Entamoeba invadens
DSYGKRILVPLGFYNMMLRTKQPNY

SEQ ID NO: 2979432 - protein, 18 aa, Entamoeba invadens
DSYRRFVSLFGRIALGVE

SEQ ID NO: 2979433 - protein, 23 aa, Entamoeba invadens
DSYSEFKRLALLLTNLPTKRLRD

SEQ ID NO: 2979434 - protein, 19 aa, Entamoeba invadens
DTCRIILPLLFSASYSGIT

SEQ ID NO: 2979435 - protein, 17 aa, Entamoeba invadens
DTFKLGVKMLMATAYLP

SEQ ID NO: 2979436 - protein, 23 aa, Entamoeba invadens
DTFPEFWKFFIASAALHTSTHYK

SEQ ID NO: 2979437 - protein, 29 aa, Entamoeba invadens
DTGMCYKRTDGLFEWTYRDYFAMKHNTQK

SEQ ID NO: 2979438 - protein, 28 aa, Entamoeba invadens
DTIHIWYHFRNWVWFRLFQKVRPILKKR

SEQ ID NO: 2979439 - protein, 24 aa, Entamoeba invadens
DTIKRIQDLLVMWEKDMEKKVKRV

SEQ ID NO: 2979440 - protein, 18 aa, Entamoeba invadens
DTLKLVLRFKDFLDPQTL

SEQ ID NO: 2979441 - protein, 19 aa, Entamoeba invadens
DTLLCILLLFGTSAIHRLK

SEQ ID NO: 2979442 - protein, 22 aa, Entamoeba invadens
DTLRLLTILFKYGKYQEVEEAI

SEQ ID NO: 2979443 - protein, 23 aa, Entamoeba invadens
DTLRLLTILFKYGKYQEVEEAIV

SEQ ID NO: 2979444 - protein, 23 aa, Entamoeba invadens
DTLRLLTLLFKFGKFREVEHAVT

SEQ ID NO: 2979445 - protein, 18 aa, Entamoeba invadens
DTRYPIIMWCQYLQNIRT

SEQ ID NO: 2979446 - protein, 19 aa, Entamoeba invadens
DTSRFCLINGPNMGGKSTY

SEQ ID NO: 2979447 - protein, 23 aa, Entamoeba invadens
DTTKTAECKIIYVTRLSVVDDNL

SEQ ID NO: 2979448 - protein, 23 aa, Entamoeba invadens
DTTKTAECKIVYVTRLLVINDDL

SEQ ID NO: 2979449 - protein, 23 aa, Entamoeba invadens
DTTRKFLKFSWVIFLLIVKSINT

SEQ ID NO: 2979450 - protein, 18 aa, Entamoeba invadens
DTVLCIMLLFGTSAIHRL

SEQ ID NO: 2979451 - protein, 23 aa, Entamoeba invadens
DTWRLRIGQFITFPNYQRKKLGR

SEQ ID NO: 2979452 - protein, 18 aa, Entamoeba invadens
DTYAFSLVIYQIFTQRLI

SEQ ID NO: 2979453 - protein, 18 aa, Entamoeba invadens
DTYFKFKLILADFPIGQE

SEQ ID NO: 2979454 - protein, 23 aa, Entamoeba invadens
DTYPFKCFIDFSITESHSAAREW

SEQ ID NO: 2979455 - protein, 25 aa, Entamoeba invadens
DVASIAICYKSRMLRDDTQTLSSIN

SEQ ID NO: 2979456 - protein, 18 aa, Entamoeba invadens
DVCMPFSFTKKTIIIDST

SEQ ID NO: 2979457 - protein, 24 aa, Entamoeba invadens
DVDMKLRFKMCLDATKGVSYLHKN

SEQ ID NO: 2979458 - protein, 22 aa, Entamoeba invadens
DVDRLPVFFPILFNNKDDWKVF

SEQ ID NO: 2979459 - protein, 19 aa, Entamoeba invadens
DVESFKMFFSLADSDENGA

SEQ ID NO: 2979460 - protein, 25 aa, Entamoeba invadens
DVFKSDLKGFVWKKIIYMLFMEKNL

SEQ ID NO: 2979461 - protein, 17 aa, Entamoeba invadens
DVFKSIAVSKEFIGKYI

SEQ ID NO: 2979462 - protein, 20 aa, Entamoeba invadens
DVFWILKSIMEFMGVFYRKD

SEQ ID NO: 2979463 - protein, 18 aa, Entamoeba invadens
DVGLLLRLVLCLTSALSY

SEQ ID NO: 2979464 - protein, 22 aa, Entamoeba invadens
DVGNSVLGWFGLSTDNFAVNQD

SEQ ID NO: 2979465 - protein, 18 aa, Entamoeba invadens
DVILKFLLQSVVCCYCKR

SEQ ID NO: 2979466 - protein, 22 aa, Entamoeba invadens
DVISFRYKPNWNAKQLSLLRGG

SEQ ID NO: 2979467 - protein, 20 aa, Entamoeba invadens
DVIVLYGRVGWKVMKPVILL

SEQ ID NO: 2979468 - protein, 20 aa, Entamoeba invadens
DVKLRGSLRMKLYTEGIQSL

SEQ ID NO: 2979469 - protein, 22 aa, Entamoeba invadens
DVKNIRCAYHIDGIPDEKLMTT

SEQ ID NO: 2979470 - protein, 22 aa, Entamoeba invadens
DVKRVIEFLAVFLMNLTESIIP

SEQ ID NO: 2979471 - protein, 24 aa, Entamoeba invadens
DVKYRMRYSWIIFSLLIKGIIGYY

SEQ ID NO: 2979472 - protein, 18 aa, Entamoeba invadens
DVLLLEFCQYCELNSLVV

SEQ ID NO: 2979473 - protein, 21 aa, Entamoeba invadens
DVLRINCQLIEIADGCERCHQ

SEQ ID NO: 2979474 - protein, 17 aa, Entamoeba invadens
DVLSRWLLSYGKNLFSV

SEQ ID NO: 2979475 - protein, 22 aa, Entamoeba invadens
DVLYFRDCESFVGAYRTIANKT

SEQ ID NO: 2979476 - protein, 18 aa, Entamoeba invadens
DVLYLFGIINDFVMQKIK

SEQ ID NO: 2979477 - protein, 25 aa, Entamoeba invadens
DVNFSFCLHHHKWLLSENEKDHSSY

SEQ ID NO: 2979478 - protein, 24 aa, Entamoeba invadens
DVPKFPGFELFKMDIFRLVSIKLK

SEQ ID NO: 2979479 - protein, 24 aa, Entamoeba invadens
DVSFKEGFKYLVIYFGDIFEKCAT

SEQ ID NO: 2979480 - protein, 20 aa, Entamoeba invadens
DVSLRLQFMKAFDENKSLTW

SEQ ID NO: 2979481 - protein, 18 aa, Entamoeba invadens
DVSQRLNVIVSFIRTTRE

SEQ ID NO: 2979482 - protein, 19 aa, Entamoeba invadens
DVVKFIKKRCDALTAIMCD

SEQ ID NO: 2979483 - protein, 18 aa, Entamoeba invadens
DVVLKNFLLAKAREDYSK

SEQ ID NO: 2979484 - protein, 17 aa, Entamoeba invadens
DVVVPWTHLYSKPIILR

SEQ ID NO: 2979485 - protein, 27 aa, Entamoeba invadens
DVYKWAVKLDKMFDGFWKLAFDDKKVV

SEQ ID NO: 2979486 - protein, 22 aa, Entamoeba invadens
DVYWLKAKIFGGVCSLEALRTT

SEQ ID NO: 2979487 - protein, 19 aa, Entamoeba invadens
DWRAGRCAAHNIIPATTGA

SEQ ID NO: 2979488 - protein, 19 aa, Entamoeba invadens
DYFGGIIFENNVKKYFKVW

SEQ ID NO: 2979489 - protein, 19 aa, Entamoeba invadens
DYFLINSMMMYNIYKNKEI

SEQ ID NO: 2979490 - protein, 17 aa, Entamoeba invadens
DYIVCLLKIVSTPEYKA

SEQ ID NO: 2979491 - protein, 23 aa, Entamoeba invadens
DYKCDLWSLGGLLYFLRTHVYPL

SEQ ID NO: 2979492 - protein, 18 aa, Entamoeba invadens
DYLAPEILKGVGHGVGVD

SEQ ID NO: 2979493 - protein, 18 aa, Entamoeba invadens
DYLSFGIEVPHCVNTIGT

SEQ ID NO: 2979494 - protein, 18 aa, Entamoeba invadens
DYMYGCYINGITHLVTEH

SEQ ID NO: 2979495 - protein, 24 aa, Entamoeba invadens
DYNCNFAFYSWCDFAQSPVFSVMS

SEQ ID NO: 2979496 - protein, 18 aa, Entamoeba invadens
DYQLRPNFLITLVEAPSM

SEQ ID NO: 2979497 - protein, 21 aa, Entamoeba invadens
DYSEFKRLTLLLTKLPRKRLR

SEQ ID NO: 2979498 - protein, 25 aa, Entamoeba invadens
DYSKHFAERGWGVFVQQDGKILQPE

SEQ ID NO: 2979499 - protein, 18 aa, Entamoeba invadens
DYWSVGCILFEMLAGYPP

SEQ ID NO: 2979500 - protein, 17 aa, Entamoeba invadens
DYYDLYRSFSLYFFKDK

SEQ ID NO: 2979501 - protein, 23 aa, Entamoeba invadens
EACCYACSYYSYKYAEVIEADAF

SEQ ID NO: 2979502 - protein, 18 aa, Entamoeba invadens
EADKNLGCLLSFGTTTSP

SEQ ID NO: 2979503 - protein, 20 aa, Entamoeba invadens
EAFDYVITCFFIDTAHNIIE

SEQ ID NO: 2979504 - protein, 17 aa, Entamoeba invadens
EAFMKCKHLRSIVFENG

SEQ ID NO: 2979505 - protein, 18 aa, Entamoeba invadens
EAFSKCYYLTQLVFSKNL

SEQ ID NO: 2979506 - protein, 28 aa, Entamoeba invadens
EAHSTLRCPVCLGVTGGFFLRIKKEEKD

SEQ ID NO: 2979507 - protein, 17 aa, Entamoeba invadens
EAIKVLIRMVKEGKETV

SEQ ID NO: 2979508 - protein, 20 aa, Entamoeba invadens
EAISGLPLIKICLNNNPIQD

SEQ ID NO: 2979509 - protein, 17 aa, Entamoeba invadens
EAISSKFLWVFVGTNTQ

SEQ ID NO: 2979510 - protein, 26 aa, Entamoeba invadens
EAKAKFIVYFCKLLKLNKLPQFLRAH

SEQ ID NO: 2979511 - protein, 18 aa, Entamoeba invadens
EAKFNYTELMYKFETEKK

SEQ ID NO: 2979512 - protein, 18 aa, Entamoeba invadens
EAKKRCSISDALQDPWVK

SEQ ID NO: 2979513 - protein, 22 aa, Entamoeba invadens
EALKCGFEVISIIWSKMPEDGE

SEQ ID NO: 2979514 - protein, 18 aa, Entamoeba invadens
EALKHVSIELFVEIDETL

SEQ ID NO: 2979515 - protein, 18 aa, Entamoeba invadens
EALSLFIPMLNVYKLYVG

SEQ ID NO: 2979516 - protein, 18 aa, Entamoeba invadens
EAMAPCFMELASALAVYD

SEQ ID NO: 2979517 - protein, 18 aa, Entamoeba invadens
EAMARCYADLIYQFVTLT

SEQ ID NO: 2979518 - protein, 18 aa, Entamoeba invadens
EAMKTIFIDSVLKCAECT

SEQ ID NO: 2979519 - protein, 22 aa, Entamoeba invadens
EANELVCSLFLLAQVFLDKNIV

SEQ ID NO: 2979520 - protein, 19 aa, Entamoeba invadens
EANMKYAVLLSASRAAEER

SEQ ID NO: 2979521 - protein, 17 aa, Entamoeba invadens
EAPTLFFFFKGNLLNIV

SEQ ID NO: 2979522 - protein, 22 aa, Entamoeba invadens
EARAKMELRPLISVDDAKEAIR

SEQ ID NO: 2979523 - protein, 18 aa, Entamoeba invadens
EARFSSIVPVEINEAEII

SEQ ID NO: 2979524 - protein, 19 aa, Entamoeba invadens
EATCSILFVFGKLICANPV

SEQ ID NO: 2979525 - protein, 20 aa, Entamoeba invadens
EATEMLRFFPKMSLKTLQNK

SEQ ID NO: 2979526 - protein, 19 aa, Entamoeba invadens
EAVCAISYLVARLKEGFIV

SEQ ID NO: 2979527 - protein, 18 aa, Entamoeba invadens
EAVLLNFRVVSKSCLDAI

SEQ ID NO: 2979528 - protein, 18 aa, Entamoeba invadens
EAVMYRVNVGKEFEDFRF

SEQ ID NO: 2979529 - protein, 18 aa, Entamoeba invadens
EAVSCYIASCGDLCKIRV

SEQ ID NO: 2979530 - protein, 18 aa, Entamoeba invadens
EAVVKWKANIDDRVLFNE

SEQ ID NO: 2979531 - protein, 20 aa, Entamoeba invadens
EAWRCWKANIPWKVQGLPEP

SEQ ID NO: 2979532 - protein, 24 aa, Entamoeba invadens
ECACCRKFLKRASCPDTVLCAMCN

SEQ ID NO: 2979533 - protein, 18 aa, Entamoeba invadens
ECACPKCKECGKSIEGKI

SEQ ID NO: 2979534 - protein, 18 aa, Entamoeba invadens
ECCECVQHELELNSNEEV

SEQ ID NO: 2979535 - protein, 17 aa, Entamoeba invadens
ECDCLLCKMQEVIQHNR

SEQ ID NO: 2979536 - protein, 22 aa, Entamoeba invadens
ECDERIDALWLWVNGTDPTWIS

SEQ ID NO: 2979537 - protein, 17 aa, Entamoeba invadens
ECFFGMFVLYSMQGAAA

SEQ ID NO: 2979538 - protein, 17 aa, Entamoeba invadens
ECFRLFFCEEITNNLLL

SEQ ID NO: 2979539 - protein, 17 aa, Entamoeba invadens
ECGGCTYQSMGYPHQLK

SEQ ID NO: 2979540 - protein, 18 aa, Entamoeba invadens
ECGLKFKGQFLTQFSPCW

SEQ ID NO: 2979541 - protein, 20 aa, Entamoeba invadens
ECGYFRMSICQPPEIVRGWV

SEQ ID NO: 2979542 - protein, 20 aa, Entamoeba invadens
ECIEKCLFLSPVVDFNYVIE

SEQ ID NO: 2979543 - protein, 18 aa, Entamoeba invadens
ECIGWYGKEFLCYEFYAE

SEQ ID NO: 2979544 - protein, 21 aa, Entamoeba invadens
ECKHLRFVVEMDDFSSYVPTT

SEQ ID NO: 2979545 - protein, 17 aa, Entamoeba invadens
ECLAVAMDECWKINEIV

SEQ ID NO: 2979546 - protein, 22 aa, Entamoeba invadens
ECLKTVIYPIEWVSTYNMNLQR

SEQ ID NO: 2979547 - protein, 19 aa, Entamoeba invadens
ECLLKNFLYEEGIYYTKFE

SEQ ID NO: 2979548 - protein, 17 aa, Entamoeba invadens
ECLLPFFQGVFLGQLPK

SEQ ID NO: 2979549 - protein, 19 aa, Entamoeba invadens
ECLNFRTLQRLRFVNKKIF

SEQ ID NO: 2979550 - protein, 18 aa, Entamoeba invadens
ECLWMVLSTEESRTVFLS

SEQ ID NO: 2979551 - protein, 18 aa, Entamoeba invadens
ECLYDFLCRCLAYDPKDR

SEQ ID NO: 2979552 - protein, 18 aa, Entamoeba invadens
ECQKCLTPCAGGCCTKVS

SEQ ID NO: 2979553 - protein, 22 aa, Entamoeba invadens
ECRDALTMLRGCYGNMFDKFKH

SEQ ID NO: 2979554 - protein, 17 aa, Entamoeba invadens
ECSKIVMYHMQFLNKDI

SEQ ID NO: 2979555 - protein, 18 aa, Entamoeba invadens
ECVCKKCQIAIISVYINP

SEQ ID NO: 2979556 - protein, 20 aa, Entamoeba invadens
ECVLGFRGVEEFISRNVPRL

SEQ ID NO: 2979557 - protein, 22 aa, Entamoeba invadens
ECVLKIGSIYGFLLFSCDKERV

SEQ ID NO: 2979558 - protein, 23 aa, Entamoeba invadens
EDADFPFLFILKVIYALTREEDN

SEQ ID NO: 2979559 - protein, 23 aa, Entamoeba invadens
EDAKVCILSCPFEPPKTKTTTNM

SEQ ID NO: 2979560 - protein, 18 aa, Entamoeba invadens
EDALCFGSLVLVNKDDKS

SEQ ID NO: 2979561 - protein, 21 aa, Entamoeba invadens
EDCFFKYRFGRICEKEKNVKL

SEQ ID NO: 2979562 - protein, 18 aa, Entamoeba invadens
EDCIKWADTIQCFVVGPG

SEQ ID NO: 2979563 - protein, 17 aa, Entamoeba invadens
EDDRPPLVVDHSSESIE

SEQ ID NO: 2979564 - protein, 21 aa, Entamoeba invadens
EDEFPCWFEGPPFKFKKSMRD

SEQ ID NO: 2979565 - protein, 18 aa, Entamoeba invadens
EDERRLNVAITRAKRALC

SEQ ID NO: 2979566 - protein, 20 aa, Entamoeba invadens
EDFIKCGLLDFYVKIVQNFI

SEQ ID NO: 2979567 - protein, 20 aa, Entamoeba invadens
EDHDALLICLFMNVRHAKSR

SEQ ID NO: 2979568 - protein, 22 aa, Entamoeba invadens
EDIKARCDLVNWVIAISQKYNL

SEQ ID NO: 2979569 - protein, 17 aa, Entamoeba invadens
EDKCPLKVYGRINESGL

SEQ ID NO: 2979570 - protein, 23 aa, Entamoeba invadens
EDKIKIVGFEALNHIDEMEITEI

SEQ ID NO: 2979571 - protein, 20 aa, Entamoeba invadens
EDKIRVGMLYALKYEEKCSE

SEQ ID NO: 2979572 - protein, 23 aa, Entamoeba invadens
EDLAEPCLFLGIGTTDGVCYGFR

SEQ ID NO: 2979573 - protein, 17 aa, Entamoeba invadens
EDLCGFNIWPYAYMDKS

SEQ ID NO: 2979574 - protein, 23 aa, Entamoeba invadens
EDLECISILYGLIARLVKYAQIH

SEQ ID NO: 2979575 - protein, 24 aa, Entamoeba invadens
EDLKRVFQLIFDRVPESFTHHLDH

SEQ ID NO: 2979576 - protein, 18 aa, Entamoeba invadens
EDQIECIMCKLKNANKKD

SEQ ID NO: 2979577 - protein, 23 aa, Entamoeba invadens
EDQLSVYLWRFERDGEFDVWRCF

SEQ ID NO: 2979578 - protein, 19 aa, Entamoeba invadens
EDSFGIVFKGIFRGNIVAI

SEQ ID NO: 2979579 - protein, 22 aa, Entamoeba invadens
EDVIFAFNFFKGIGMIELAKVL

SEQ ID NO: 2979580 - protein, 20 aa, Entamoeba invadens
EDVTLCAGCSCVFGKRKRKN

SEQ ID NO: 2979581 - protein, 18 aa, Entamoeba invadens
EECFKRAFIVNSDRHPTC

SEQ ID NO: 2979582 - protein, 19 aa, Entamoeba invadens
EECLLQLTLIFSHEPKVAE

SEQ ID NO: 2979583 - protein, 17 aa, Entamoeba invadens
EEEGRIVLTWGKGELVG

SEQ ID NO: 2979584 - protein, 21 aa, Entamoeba invadens
EEERKRLSLQLEDKESANLEM

SEQ ID NO: 2979585 - protein, 23 aa, Entamoeba invadens
EEEVPFKLCWDGLAKVSFSYLIF

SEQ ID NO: 2979586 - protein, 22 aa, Entamoeba invadens
EEFKRQGVSEMWRVCDINTKYT

SEQ ID NO: 2979587 - protein, 17 aa, Entamoeba invadens
EEFNKVMKLLEQFTSSY

SEQ ID NO: 2979588 - protein, 17 aa, Entamoeba invadens
EEIFKWDLKNGITQKTA

SEQ ID NO: 2979589 - protein, 18 aa, Entamoeba invadens
EEIKLRTDDIVKEKTELC

SEQ ID NO: 2979590 - protein, 22 aa, Entamoeba invadens
EEILRRIGFNLPFNNEFCERSR

SEQ ID NO: 2979591 - protein, 19 aa, Entamoeba invadens
EEIRLLFIKKERDMLIYGF

SEQ ID NO: 2979592 - protein, 24 aa, Entamoeba invadens
EEITRLEIPMAMFHFGGTFTHIIG

SEQ ID NO: 2979593 - protein, 30 aa, Entamoeba invadens
EEITRLEIPMAMFHFGGTFTHIIGEKPVEM

SEQ ID NO: 2979594 - protein, 17 aa, Entamoeba invadens
EEIWIVMEFCFYGSVAD

SEQ ID NO: 2979595 - protein, 19 aa, Entamoeba invadens
EELFKGYFDFVVFGHEHMC

SEQ ID NO: 2979596 - protein, 17 aa, Entamoeba invadens
EELGECEICKNGVMEVE

SEQ ID NO: 2979597 - protein, 20 aa, Entamoeba invadens
EELNVLFLAYLVNKYPDQYK

SEQ ID NO: 2979598 - protein, 31 aa, Entamoeba invadens
EELPEMLVFHLKRFVYNDVFEIVKYNGYFEY

SEQ ID NO: 2979599 - protein, 20 aa, Entamoeba invadens
EELQWCKAYLIGLLILCETR

SEQ ID NO: 2979600 - protein, 17 aa, Entamoeba invadens
EELRLSSLQVLLKGILS

SEQ ID NO: 2979601 - protein, 20 aa, Entamoeba invadens
EELTELFFLISQHAETNKMS

SEQ ID NO: 2979602 - protein, 20 aa, Entamoeba invadens
EELYRFPVNIRERARFIPLR

SEQ ID NO: 2979603 - protein, 18 aa, Entamoeba invadens
EEMFRLEIHLEYGEVSLE

SEQ ID NO: 2979604 - protein, 22 aa, Entamoeba invadens
EEMPLGLAIQFLAPRKRDIVCD

SEQ ID NO: 2979605 - protein, 24 aa, Entamoeba invadens
EEMRFLQDILFEFGYYVEISSETI

SEQ ID NO: 2979606 - protein, 17 aa, Entamoeba invadens
EEMSHLFAVFLCPRYNA

SEQ ID NO: 2979607 - protein, 24 aa, Entamoeba invadens
EENRRLKLRIGELVNNKENYESTE

SEQ ID NO: 2979608 - protein, 17 aa, Entamoeba invadens
EEREKWKKLELVAKNDE

SEQ ID NO: 2979609 - protein, 22 aa, Entamoeba invadens
EERTAAVLACEWVDEVVDGITW

SEQ ID NO: 2979610 - protein, 24 aa, Entamoeba invadens
EESEIFWLLKLVMDIMEKFYVHQS

SEQ ID NO: 2979611 - protein, 20 aa, Entamoeba invadens
EESFLLPQFVHAMFDRLFID

SEQ ID NO: 2979612 - protein, 23 aa, Entamoeba invadens
EETKKWNCLLMKLQRRDKRPNLV

SEQ ID NO: 2979613 - protein, 22 aa, Entamoeba invadens
EETLKIIAIRGIIAGSPIITDV

SEQ ID NO: 2979614 - protein, 18 aa, Entamoeba invadens
EETVCVKCGLKVNPGQPC

SEQ ID NO: 2979615 - protein, 26 aa, Entamoeba invadens
EETYNCSFCPFTFCVECYKHLCLTLG

SEQ ID NO: 2979616 - protein, 22 aa, Entamoeba invadens
EEVKGLFWIWGDLWRRVYSALL

SEQ ID NO: 2979617 - protein, 18 aa, Entamoeba invadens
EEVTWNFVMLIQQNIELQ

SEQ ID NO: 2979618 - protein, 19 aa, Entamoeba invadens
EEVYYRILLVADDRIKVGD

SEQ ID NO: 2979619 - protein, 18 aa, Entamoeba invadens
EEWTGLKFQKVLFDSEVD

SEQ ID NO: 2979620 - protein, 24 aa, Entamoeba invadens
EEYFRFLWELRLLFNKEMTQLQDL

SEQ ID NO: 2979621 - protein, 18 aa, Entamoeba invadens
EEYHPYLLFCKENREKVK

SEQ ID NO: 2979622 - protein, 21 aa, Entamoeba invadens
EEYLREGIEWTRQNFGNDLQP

SEQ ID NO: 2979623 - protein, 22 aa, Entamoeba invadens
EEYLREGIEWTRQNFGNDLQPV

SEQ ID NO: 2979624 - protein, 19 aa, Entamoeba invadens
EFAHFFGAEFGCTFFYNTN

SEQ ID NO: 2979625 - protein, 21 aa, Entamoeba invadens
EFAHYFKVYKMIVGNSEAVLA

SEQ ID NO: 2979626 - protein, 24 aa, Entamoeba invadens
EFCITAEPCARVKLEVECMSGVYH

SEQ ID NO: 2979627 - protein, 24 aa, Entamoeba invadens
EFCSDEVFNLFGLLEKVTTALFEI

SEQ ID NO: 2979628 - protein, 17 aa, Entamoeba invadens
EFERCLKYYLISKTHPE

SEQ ID NO: 2979629 - protein, 17 aa, Entamoeba invadens
EFFECLTPIIAVEKNTI

SEQ ID NO: 2979630 - protein, 19 aa, Entamoeba invadens
EFFRIIVWFNVDFKTVDRN

SEQ ID NO: 2979631 - protein, 23 aa, Entamoeba invadens
EFIARFLQYWALKKIEVDYLIVC

SEQ ID NO: 2979632 - protein, 18 aa, Entamoeba invadens
EFIDWLLKTVCSYDTYIK

SEQ ID NO: 2979633 - protein, 19 aa, Entamoeba invadens
EFKENVFIFTNIVKSNKIT

SEQ ID NO: 2979634 - protein, 21 aa, Entamoeba invadens
EFKMRVSFRVQHEPVLGLRII

SEQ ID NO: 2979635 - protein, 21 aa, Entamoeba invadens
EFLCFEWYYLASWYQNKKQIE

SEQ ID NO: 2979636 - protein, 18 aa, Entamoeba invadens
EFLFPILLSLVAQQPSAF

SEQ ID NO: 2979637 - protein, 17 aa, Entamoeba invadens
EFLGNVKLICELYKMKV

SEQ ID NO: 2979638 - protein, 20 aa, Entamoeba invadens
EFLKKFILEKKWMELEENDS

SEQ ID NO: 2979639 - protein, 23 aa, Entamoeba invadens
EFPKLPPTCGFNFSNNQIATLSL

SEQ ID NO: 2979640 - protein, 26 aa, Entamoeba invadens
EFSMKRADAKFVIHSPAVFKLPGSEQ

SEQ ID NO: 2979641 - protein, 23 aa, Entamoeba invadens
EFTRKTSVASFVLFKGDIVMRDI

SEQ ID NO: 2979642 - protein, 22 aa, Entamoeba invadens
EFYILSMQCCIDFFYTTLKDDR

SEQ ID NO: 2979643 - protein, 19 aa, Entamoeba invadens
EFYNLVGLMLLVFDNTKDS

SEQ ID NO: 2979644 - protein, 19 aa, Entamoeba invadens
EFYRIIVWFSVDFETFDRN

SEQ ID NO: 2979645 - protein, 23 aa, Entamoeba invadens
EGDTFKLGVKMLMATAYLPEDVI

SEQ ID NO: 2979646 - protein, 23 aa, Entamoeba invadens
EGEFCPLRELIALKKIYGFYLYI

SEQ ID NO: 2979647 - protein, 18 aa, Entamoeba invadens
EGEISIRFCEKSLKSKQH

SEQ ID NO: 2979648 - protein, 17 aa, Entamoeba invadens
EGFCINFDFEVDVLYFN

SEQ ID NO: 2979649 - protein, 18 aa, Entamoeba invadens
EGGGWKSWKRRWFALNGN

SEQ ID NO: 2979650 - protein, 23 aa, Entamoeba invadens
EGGKAWKGKEMMFRIDGKYPKKP

SEQ ID NO: 2979651 - protein, 20 aa, Entamoeba invadens
EGGKWSFLFECPRDYPNNPP

SEQ ID NO: 2979652 - protein, 19 aa, Entamoeba invadens
EGIGTVFTKLSYFLKMYSN

SEQ ID NO: 2979653 - protein, 25 aa, Entamoeba invadens
EGILKKEWFASLLLYTDSLEIESGK

SEQ ID NO: 2979654 - protein, 23 aa, Entamoeba invadens
EGKLKRKTECMGCHFVSEQTESF

SEQ ID NO: 2979655 - protein, 17 aa, Entamoeba invadens
EGKPCVQSSVLLEEFCK

SEQ ID NO: 2979656 - protein, 19 aa, Entamoeba invadens
EGKYIWKFGQFEVESIRDL

SEQ ID NO: 2979657 - protein, 18 aa, Entamoeba invadens
EGLNISHFAFRWLTCCLS

SEQ ID NO: 2979658 - protein, 20 aa, Entamoeba invadens
EGLQQFGVFCLAKLFSYDSS

SEQ ID NO: 2979659 - protein, 19 aa, Entamoeba invadens
EGLQQFGVFCLAKVFSYDA

SEQ ID NO: 2979660 - protein, 17 aa, Entamoeba invadens
EGMKLGVIGYHKKKTGS

SEQ ID NO: 2979661 - protein, 22 aa, Entamoeba invadens
EGPIRWYCCGPTVYDDSHLGHA

SEQ ID NO: 2979662 - protein, 17 aa, Entamoeba invadens
EGPRIEEMFTLLPTSDD

SEQ ID NO: 2979663 - protein, 23 aa, Entamoeba invadens
EGQFCPLRELIALKKIYGFYLYI

SEQ ID NO: 2979664 - protein, 19 aa, Entamoeba invadens
EGRFAWKDDVGGFVCADCV

SEQ ID NO: 2979665 - protein, 21 aa, Entamoeba invadens
EGRGVCLRFPRFIKKRDDKKC

SEQ ID NO: 2979666 - protein, 23 aa, Entamoeba invadens
EGRSRFARLGLFVHITASFMNPG

SEQ ID NO: 2979667 - protein, 20 aa, Entamoeba invadens
EGRVRYALCEMALNLKQFPS

SEQ ID NO: 2979668 - protein, 21 aa, Entamoeba invadens
EGSVKYCKDCFDFEFHQKHRI

SEQ ID NO: 2979669 - protein, 18 aa, Entamoeba invadens
EGVFKWHVTMLITPEQRA

SEQ ID NO: 2979670 - protein, 21 aa, Entamoeba invadens
EGYEYLRLLFGPVKIPFPPGT

SEQ ID NO: 2979671 - protein, 22 aa, Entamoeba invadens
EGYKNVLGMLFSLYRMFCVKNY

SEQ ID NO: 2979672 - protein, 17 aa, Entamoeba invadens
EGYNCTFFAYGQTGTGK

SEQ ID NO: 2979673 - protein, 25 aa, Entamoeba invadens
EGYVIKRWVLRYVIVKHNFLIYFVS

SEQ ID NO: 2979674 - protein, 20 aa, Entamoeba invadens
EHANKWLSYGCRLTDYYCRE

SEQ ID NO: 2979675 - protein, 17 aa, Entamoeba invadens
EHCIAWASQIAWDNATI

SEQ ID NO: 2979676 - protein, 24 aa, Entamoeba invadens
EHFESWKPKIFFIATENINVINSH

SEQ ID NO: 2979677 - protein, 24 aa, Entamoeba invadens
EHGEGFKIFFLHKVVNACRTVIKC

SEQ ID NO: 2979678 - protein, 21 aa, Entamoeba invadens
EHIIKLKPEFESVRDKQKNGT

SEQ ID NO: 2979679 - protein, 18 aa, Entamoeba invadens
EHIKRVCVIYSLEHMDLQ

SEQ ID NO: 2979680 - protein, 21 aa, Entamoeba invadens
EHLKRTGGIFVTRFPPEPNGY

SEQ ID NO: 2979681 - protein, 26 aa, Entamoeba invadens
EHLKYLTLRLCRGVTFSSEMKCLKQI

SEQ ID NO: 2979682 - protein, 18 aa, Entamoeba invadens
EHTWKFPDCVSTYGLFAT

SEQ ID NO: 2979683 - protein, 24 aa, Entamoeba invadens
EHVVLKMCKRCFVMTKKPKIITQK

SEQ ID NO: 2979684 - protein, 26 aa, Entamoeba invadens
EHVVLKMCKRCFVMWIKPEIVTQIKC

SEQ ID NO: 2979685 - protein, 18 aa, Entamoeba invadens
EHWCGLKHANLSVEKLRM

SEQ ID NO: 2979686 - protein, 19 aa, Entamoeba invadens
EHWLPRFGIEVDLVDTSDL

SEQ ID NO: 2979687 - protein, 23 aa, Entamoeba invadens
EHWRREICEWTEMNVVVYLGSKE

SEQ ID NO: 2979688 - protein, 19 aa, Entamoeba invadens
EIAEKFCGAVFKLKNGKKS

SEQ ID NO: 2979689 - protein, 20 aa, Entamoeba invadens
EIAKILPCLQFGTDCKLDGA

SEQ ID NO: 2979690 - protein, 20 aa, Entamoeba invadens
EICGRFAYLGIPGRCVDTAK

SEQ ID NO: 2979691 - protein, 19 aa, Entamoeba invadens
EICKGVIDLAKFADLNGEK

SEQ ID NO: 2979692 - protein, 18 aa, Entamoeba invadens
EICKHLFLGSAMAASNIE

SEQ ID NO: 2979693 - protein, 19 aa, Entamoeba invadens
EIDEALRLVFEAFVMGGES

SEQ ID NO: 2979694 - protein, 19 aa, Entamoeba invadens
EIDLSIFLRKCIGSSFYNK

SEQ ID NO: 2979695 - protein, 24 aa, Entamoeba invadens
EIEAGFRPGWYYNRISKGLEWIDD

SEQ ID NO: 2979696 - protein, 21 aa, Entamoeba invadens
EIEWLKKKIAVREKLDEKKKL

SEQ ID NO: 2979697 - protein, 17 aa, Entamoeba invadens
EIFEFFISVACECLEIS

SEQ ID NO: 2979698 - protein, 17 aa, Entamoeba invadens
EIFEFFISVAYECLEIS

SEQ ID NO: 2979699 - protein, 19 aa, Entamoeba invadens
EIFERLGIEVLNVMKSKCV

SEQ ID NO: 2979700 - protein, 19 aa, Entamoeba invadens
EIFKETKFLFGNVVYTKKD

SEQ ID NO: 2979701 - protein, 17 aa, Entamoeba invadens
EIFLGSTQEVVWKRLKK

SEQ ID NO: 2979702 - protein, 22 aa, Entamoeba invadens
EIFPECRFYAGLAMLHGFGVKK

SEQ ID NO: 2979703 - protein, 19 aa, Entamoeba invadens
EIFTKLKLSQFFKEVEIAL

SEQ ID NO: 2979704 - protein, 17 aa, Entamoeba invadens
EIGAFCFKNCSKLEQLD

SEQ ID NO: 2979705 - protein, 17 aa, Entamoeba invadens
EIGANCFLGCKSLCKLK

SEQ ID NO: 2979706 - protein, 18 aa, Entamoeba invadens
EIGETFPKFEVLRSDGNN

SEQ ID NO: 2979707 - protein, 18 aa, Entamoeba invadens
EIGGKLWVLSGEKQTINI

SEQ ID NO: 2979708 - protein, 20 aa, Entamoeba invadens
EIGPRLCLRLIKILMGCFQG

SEQ ID NO: 2979709 - protein, 17 aa, Entamoeba invadens
EIIKSFFEQAGIVLTRK

SEQ ID NO: 2979710 - protein, 24 aa, Entamoeba invadens
EIIKTTLFAIEWFVSANFGDSITS

SEQ ID NO: 2979711 - protein, 19 aa, Entamoeba invadens
EIILKKDFDGIVVWFEVIY

SEQ ID NO: 2979712 - protein, 24 aa, Entamoeba invadens
EIILPFEVPYIFDLIQSLVLDKDE

SEQ ID NO: 2979713 - protein, 19 aa, Entamoeba invadens
EIITPLALFLGGSGGGHAN

SEQ ID NO: 2979714 - protein, 19 aa, Entamoeba invadens
EIKIKIGNYYGEGDAKSWV

SEQ ID NO: 2979715 - protein, 21 aa, Entamoeba invadens
EIKKSVSICKFPNDWNIKIDE

SEQ ID NO: 2979716 - protein, 23 aa, Entamoeba invadens
EIKMLKILCQWFCRKRKSSDYNQ

SEQ ID NO: 2979717 - protein, 21 aa, Entamoeba invadens
EIKMLKILCQWFCRKRSMSDY

SEQ ID NO: 2979718 - protein, 18 aa, Entamoeba invadens
EIKNFVVWYEVSFSHTKR

SEQ ID NO: 2979719 - protein, 17 aa, Entamoeba invadens
EIKNKRISAKVSLKKRV

SEQ ID NO: 2979720 - protein, 19 aa, Entamoeba invadens
EIKVLWKLENDTLIPAVLS

SEQ ID NO: 2979721 - protein, 18 aa, Entamoeba invadens
EILDCIKMPNAVKEEQRI

SEQ ID NO: 2979722 - protein, 18 aa, Entamoeba invadens
EILEESGLSSQVYLYTKK

SEQ ID NO: 2979723 - protein, 24 aa, Entamoeba invadens
EILGPWLRREVLLFESVSLCESIK

SEQ ID NO: 2979724 - protein, 17 aa, Entamoeba invadens
EILLLIRCTLKIKSEVL

SEQ ID NO: 2979725 - protein, 20 aa, Entamoeba invadens
EILNLILNWVHFKKYKCLFQ

SEQ ID NO: 2979726 - protein, 23 aa, Entamoeba invadens
EILRINPNLAEFVNFYYTTNHDE

SEQ ID NO: 2979727 - protein, 18 aa, Entamoeba invadens
EIMPLFLDIQVKNFETIQ

SEQ ID NO: 2979728 - protein, 24 aa, Entamoeba invadens
EIMRILGLCSICFAFKDITYVFKN

SEQ ID NO: 2979729 - protein, 19 aa, Entamoeba invadens
EINEGIFLTFDFGRGTLET

SEQ ID NO: 2979730 - protein, 21 aa, Entamoeba invadens
EINKERSLCVGSKRFDNPKKE

SEQ ID NO: 2979731 - protein, 22 aa, Entamoeba invadens
EIPACVVCKFLAMNGIIMEKMG

SEQ ID NO: 2979732 - protein, 21 aa, Entamoeba invadens
EIPACVVCRFLAMNGIIMEKM

SEQ ID NO: 2979733 - protein, 19 aa, Entamoeba invadens
EIPETIQLFSTMKKVSFSN

SEQ ID NO: 2979734 - protein, 21 aa, Entamoeba invadens
EIPHLKEIVLFYTLFECIGYD

SEQ ID NO: 2979735 - protein, 17 aa, Entamoeba invadens
EIPNCCFDDFLVYDKLL

SEQ ID NO: 2979736 - protein, 17 aa, Entamoeba invadens
EIRFETITFSKASKDQQ

SEQ ID NO: 2979737 - protein, 23 aa, Entamoeba invadens
EISFKLKEMYYLLTQGGVAELEL

SEQ ID NO: 2979738 - protein, 24 aa, Entamoeba invadens
EIVESLNLKCWVKFGPRHNQLLPI

SEQ ID NO: 2979739 - protein, 21 aa, Entamoeba invadens
EIWLRGYWLIFAHDQIVRGKV

SEQ ID NO: 2979740 - protein, 19 aa, Entamoeba invadens
EIWNICFVCAHILQIKEKC

SEQ ID NO: 2979741 - protein, 17 aa, Entamoeba invadens
EIYKFEVSYTFYLQMKN

SEQ ID NO: 2979742 - protein, 19 aa, Entamoeba invadens
EIYKFWRDMILTGQVNELL

SEQ ID NO: 2979743 - protein, 25 aa, Entamoeba invadens
EIYPKKDFQFAWSIADFVSAGKRVQ

SEQ ID NO: 2979744 - protein, 23 aa, Entamoeba invadens
EKAKIGVCQFCISPPKTNMEGNV

SEQ ID NO: 2979745 - protein, 20 aa, Entamoeba invadens
EKAKKFFGKKWDQMKKGMKD

SEQ ID NO: 2979746 - protein, 27 aa, Entamoeba invadens
EKCGVPFFWVRLLYKLGLFMSYTPSDD

SEQ ID NO: 2979747 - protein, 18 aa, Entamoeba invadens
EKCYIQWIEEHPLDIENI

SEQ ID NO: 2979748 - protein, 23 aa, Entamoeba invadens
EKDDGKCGLQFFFKNKTRKGDTA

SEQ ID NO: 2979749 - protein, 19 aa, Entamoeba invadens
EKDIAEIIVRAETLEKKSK

SEQ ID NO: 2979750 - protein, 23 aa, Entamoeba invadens
EKEFFRIIIWFNVDFETVDRNKS

SEQ ID NO: 2979751 - protein, 18 aa, Entamoeba invadens
EKEFGWKAEMGLDEMCED

SEQ ID NO: 2979752 - protein, 27 aa, Entamoeba invadens
EKEFLSKLVMFLKERFDVLKKSKSFEC

SEQ ID NO: 2979753 - protein, 19 aa, Entamoeba invadens
EKEKPKSALSFTIKKDPKV

SEQ ID NO: 2979754 - protein, 22 aa, Entamoeba invadens
EKEKTRLGMLFIMNNYAFIMNV

SEQ ID NO: 2979755 - protein, 19 aa, Entamoeba invadens
EKEMRVIESLAHLDNEGVK

SEQ ID NO: 2979756 - protein, 22 aa, Entamoeba invadens
EKFFKEKFVFFDLIDEMNAECP

SEQ ID NO: 2979757 - protein, 24 aa, Entamoeba invadens
EKFGFKNECIWKYDDAVYNAILSL

SEQ ID NO: 2979758 - protein, 21 aa, Entamoeba invadens
EKFKMAWDIADFVAAGSVLPK

SEQ ID NO: 2979759 - protein, 20 aa, Entamoeba invadens
EKFLCVWDYAAASLIVEEAG

SEQ ID NO: 2979760 - protein, 21 aa, Entamoeba invadens
EKFLMKHVIGINKEFKKYEEE

SEQ ID NO: 2979761 - protein, 20 aa, Entamoeba invadens
EKFNLPILWSRECAGGDTSV

SEQ ID NO: 2979762 - protein, 24 aa, Entamoeba invadens
EKFPEIPFGIFFVFTRNFFGFHVR

SEQ ID NO: 2979763 - protein, 20 aa, Entamoeba invadens
EKFRACVFTQQFIKLIVSVY

SEQ ID NO: 2979764 - protein, 22 aa, Entamoeba invadens
EKFRALFSYSIRLMITLVKSIS

SEQ ID NO: 2979765 - protein, 18 aa, Entamoeba invadens
EKFSVFLGLRLLKTEDVL

SEQ ID NO: 2979766 - protein, 23 aa, Entamoeba invadens
EKGEMTCFFPFFGTCDDKKNLVD

SEQ ID NO: 2979767 - protein, 18 aa, Entamoeba invadens
EKHFETFKTLDKNQLVKQ

SEQ ID NO: 2979768 - protein, 24 aa, Entamoeba invadens
EKIFKERFYHIALHSGFYQKLSFG

SEQ ID NO: 2979769 - protein, 25 aa, Entamoeba invadens
EKIFKERFYRIALHSGFYQKLSLLE

SEQ ID NO: 2979770 - protein, 21 aa, Entamoeba invadens
EKIFRIYLCFMMSEAGNVESI

SEQ ID NO: 2979771 - protein, 22 aa, Entamoeba invadens
EKIKPCFICGSLTHKTLTCPQH

SEQ ID NO: 2979772 - protein, 22 aa, Entamoeba invadens
EKIKSHMWWNGFNWDDLYQKKI

SEQ ID NO: 2979773 - protein, 23 aa, Entamoeba invadens
EKIRKEMFENIVISGGNTSFKNF

SEQ ID NO: 2979774 - protein, 17 aa, Entamoeba invadens
EKIRMCGFELLKKFYNE

SEQ ID NO: 2979775 - protein, 19 aa, Entamoeba invadens
EKITPCFWEYVMSASCRFI

SEQ ID NO: 2979776 - protein, 18 aa, Entamoeba invadens
EKKFLWDKVRVEGGAYDG

SEQ ID NO: 2979777 - protein, 21 aa, Entamoeba invadens
EKKIPFIIRRRLPNGSYEDWK

SEQ ID NO: 2979778 - protein, 23 aa, Entamoeba invadens
EKKKGCFLINCYIRKEDTKFHRD

SEQ ID NO: 2979779 - protein, 20 aa, Entamoeba invadens
EKKKGGGFMSLFKKKKEEEE

SEQ ID NO: 2979780 - protein, 20 aa, Entamoeba invadens
EKKLFCSMCKEFGHTSTDCY

SEQ ID NO: 2979781 - protein, 20 aa, Entamoeba invadens
EKKLPVSKWINFVSEQLSKT

SEQ ID NO: 2979782 - protein, 20 aa, Entamoeba invadens
EKKRFNICHFVKYTKTDREK

SEQ ID NO: 2979783 - protein, 21 aa, Entamoeba invadens
EKKRFNVCRFVKYTKEDRLKY

SEQ ID NO: 2979784 - protein, 17 aa, Entamoeba invadens
EKLEEIGAFCFCNCVSL

SEQ ID NO: 2979785 - protein, 17 aa, Entamoeba invadens
EKLFLWDKVRVEGGAYG

SEQ ID NO: 2979786 - protein, 22 aa, Entamoeba invadens
EKLIGGVFYDFFPRKGKRGGAC

SEQ ID NO: 2979787 - protein, 21 aa, Entamoeba invadens
EKLKSNCLLGEWQITKDAMFL

SEQ ID NO: 2979788 - protein, 18 aa, Entamoeba invadens
EKLLFMAFEWMKQSVALS

SEQ ID NO: 2979789 - protein, 20 aa, Entamoeba invadens
EKLRLLLPMRCDEFENQKRC

SEQ ID NO: 2979790 - protein, 19 aa, Entamoeba invadens
EKMGIPFLLRCCSDCANAL

SEQ ID NO: 2979791 - protein, 17 aa, Entamoeba invadens
EKMLCVFNRMISDFAKE

SEQ ID NO: 2979792 - protein, 25 aa, Entamoeba invadens
EKNLKMIFEISMLFPHKTVQQIIMR

SEQ ID NO: 2979793 - protein, 23 aa, Entamoeba invadens
EKNLKPSWLFDSIILGKIQPRKQ

SEQ ID NO: 2979794 - protein, 23 aa, Entamoeba invadens
EKPRLPLDFIYSDVLDICYAPNK

SEQ ID NO: 2979795 - protein, 21 aa, Entamoeba invadens
EKQLICIARALLKGSKILIMD

SEQ ID NO: 2979796 - protein, 17 aa, Entamoeba invadens
EKRFPPREQRYMDRPQE

SEQ ID NO: 2979797 - protein, 18 aa, Entamoeba invadens
EKRFTFKGSDKIRCTNFN

SEQ ID NO: 2979798 - protein, 22 aa, Entamoeba invadens
EKRGEIQYSLLPKITAPTIPKT

SEQ ID NO: 2979799 - protein, 21 aa, Entamoeba invadens
EKRKTGGLVLEFIDSIECVNG

SEQ ID NO: 2979800 - protein, 26 aa, Entamoeba invadens
EKRLNYPIKVFLKRTSSTIVDLTGFT

SEQ ID NO: 2979801 - protein, 25 aa, Entamoeba invadens
EKRSFKGAPVFCFFCGGEGHTFRDC

SEQ ID NO: 2979802 - protein, 25 aa, Entamoeba invadens
EKRYSLFDVEAFLPVITRVEYSKLL

SEQ ID NO: 2979803 - protein, 20 aa, Entamoeba invadens
EKSGWGFSSLVNKMNTSINE

SEQ ID NO: 2979804 - protein, 17 aa, Entamoeba invadens
EKSIFGRKFVKMETVEV

SEQ ID NO: 2979805 - protein, 19 aa, Entamoeba invadens
EKSIPCGSLMCAVIPQKTF

SEQ ID NO: 2979806 - protein, 23 aa, Entamoeba invadens
EKSLTRPLFCSAIKGKKSVVLLM

SEQ ID NO: 2979807 - protein, 18 aa, Entamoeba invadens
EKSVKLFFDTCINLSVFG

SEQ ID NO: 2979808 - protein, 17 aa, Entamoeba invadens
EKTEKYLAAALNEEVEA

SEQ ID NO: 2979809 - protein, 30 aa, Entamoeba invadens
EKTHAFAIAVEWYRVLKVLCWSSIQNSINE

SEQ ID NO: 2979810 - protein, 17 aa, Entamoeba invadens
EKVGICLTLGDKSQYIA

SEQ ID NO: 2979811 - protein, 20 aa, Entamoeba invadens
EKVPLRNGLPYPLVDCLEYF

SEQ ID NO: 2979812 - protein, 22 aa, Entamoeba invadens
EKWRKERREVYKLVNVIVDITD

SEQ ID NO: 2979813 - protein, 20 aa, Entamoeba invadens
EKYKFAYILIEGYNGSIPKD

SEQ ID NO: 2979814 - protein, 19 aa, Entamoeba invadens
EKYKRIGDIIVDFLNQIVS

SEQ ID NO: 2979815 - protein, 21 aa, Entamoeba invadens
EKYLPTCFLLRQYLLLIQKPS

SEQ ID NO: 2979816 - protein, 23 aa, Entamoeba invadens
EKYQERMCCLLIAIIFEITDIEK

SEQ ID NO: 2979817 - protein, 24 aa, Entamoeba invadens
ELAAWRSGVVDTYLKSVFSKMEKK

SEQ ID NO: 2979818 - protein, 20 aa, Entamoeba invadens
ELATEFILFISSEVADVSNN

SEQ ID NO: 2979819 - protein, 17 aa, Entamoeba invadens
ELCDICLSEILKRTQLT

SEQ ID NO: 2979820 - protein, 29 aa, Entamoeba invadens
ELCIAALKFAVNFLRKGGWFISKVFRSQD

SEQ ID NO: 2979821 - protein, 18 aa, Entamoeba invadens
ELCKLMKYKNGYYSVNRE

SEQ ID NO: 2979822 - protein, 18 aa, Entamoeba invadens
ELCLKIGRYADALVMTEG

SEQ ID NO: 2979823 - protein, 18 aa, Entamoeba invadens
ELCVECVCRRKCILKHFC

SEQ ID NO: 2979824 - protein, 21 aa, Entamoeba invadens
ELCVKAAIIAGGIFDGVGVET

SEQ ID NO: 2979825 - protein, 22 aa, Entamoeba invadens
ELCYGCLPLEFLKKEEYLNLMM

SEQ ID NO: 2979826 - protein, 19 aa, Entamoeba invadens
ELDCIGCTCTIVYVWEEDG

SEQ ID NO: 2979827 - protein, 22 aa, Entamoeba invadens
ELEFGFKCIFILVRGSVTQANK

SEQ ID NO: 2979828 - protein, 23 aa, Entamoeba invadens
ELEFVMCNLIFKGIMKSQLYHEH

SEQ ID NO: 2979829 - protein, 24 aa, Entamoeba invadens
ELFGGEVMYRFAMSQVMDTWKKEY

SEQ ID NO: 2979830 - protein, 25 aa, Entamoeba invadens
ELFGKLLGCLFIKKYIDLSVIIDKA

SEQ ID NO: 2979831 - protein, 18 aa, Entamoeba invadens
ELFLMKFTDAVFKKDQDT

SEQ ID NO: 2979832 - protein, 18 aa, Entamoeba invadens
ELHMKLLLKIDGFVGLNE

SEQ ID NO: 2979833 - protein, 21 aa, Entamoeba invadens
ELIKRIGMNAGIFKELCEDTF

SEQ ID NO: 2979834 - protein, 21 aa, Entamoeba invadens
ELKDFILRKLINGERMSLFSP

SEQ ID NO: 2979835 - protein, 17 aa, Entamoeba invadens
ELKKLCRLTSCGYQLEA

SEQ ID NO: 2979836 - protein, 18 aa, Entamoeba invadens
ELKKRASNQFNWATLYMR

SEQ ID NO: 2979837 - protein, 18 aa, Entamoeba invadens
ELKSCKHPQLLAEAALYK

SEQ ID NO: 2979838 - protein, 20 aa, Entamoeba invadens
ELKSRIALKLAMLMEENHMC

SEQ ID NO: 2979839 - protein, 19 aa, Entamoeba invadens
ELKVDPSGHKMILTEDKFD

SEQ ID NO: 2979840 - protein, 19 aa, Entamoeba invadens
ELLEICEPFLAYKIGGYVR

SEQ ID NO: 2979841 - protein, 22 aa, Entamoeba invadens
ELLELLRICLNFGNILNAKSPS

SEQ ID NO: 2979842 - protein, 19 aa, Entamoeba invadens
ELLEQPVVMPPELQSISQM

SEQ ID NO: 2979843 - protein, 17 aa, Entamoeba invadens
ELLKICRDILLGERAYS

SEQ ID NO: 2979844 - protein, 20 aa, Entamoeba invadens
ELLKLSIKFFNAVVDKKKFN

SEQ ID NO: 2979845 - protein, 19 aa, Entamoeba invadens
ELLLRLRISYCEGITYNET

SEQ ID NO: 2979846 - protein, 17 aa, Entamoeba invadens
ELLRGFCDGRLFDRLHI

SEQ ID NO: 2979847 - protein, 20 aa, Entamoeba invadens
ELLSRFKINFAKELEMTQEK

SEQ ID NO: 2979848 - protein, 23 aa, Entamoeba invadens
ELLWKKRCIRFRKVANKKMDEEA

SEQ ID NO: 2979849 - protein, 19 aa, Entamoeba invadens
ELMKQICEKDGKSYTEEFQ

SEQ ID NO: 2979850 - protein, 19 aa, Entamoeba invadens
ELNGLLVHRAIYFTALLLQ

SEQ ID NO: 2979851 - protein, 22 aa, Entamoeba invadens
ELNLKAAVGWSVLMELEGGAFR

SEQ ID NO: 2979852 - protein, 24 aa, Entamoeba invadens
ELNSLCVMMVFSLLISRDAKLKQI

SEQ ID NO: 2979853 - protein, 17 aa, Entamoeba invadens
ELPATLLFSKFVVSETV

SEQ ID NO: 2979854 - protein, 17 aa, Entamoeba invadens
ELPGFKTPFLSGVTATE

SEQ ID NO: 2979855 - protein, 21 aa, Entamoeba invadens
ELPPLEIFDTLTLNNISISNN

SEQ ID NO: 2979856 - protein, 17 aa, Entamoeba invadens
ELQGLYLSRQKLISQKN

SEQ ID NO: 2979857 - protein, 19 aa, Entamoeba invadens
ELRARLDVIEKREAEVAQK

SEQ ID NO: 2979858 - protein, 18 aa, Entamoeba invadens
ELRFHKIRSRDSVYEIFQ

SEQ ID NO: 2979859 - protein, 19 aa, Entamoeba invadens
ELRLSGFTHILTRLDNTIF

SEQ ID NO: 2979860 - protein, 19 aa, Entamoeba invadens
ELRPVLIVVPNILKLQWRM

SEQ ID NO: 2979861 - protein, 17 aa, Entamoeba invadens
ELSKACELWGCEPEALR

SEQ ID NO: 2979862 - protein, 22 aa, Entamoeba invadens
ELSKACELWGCEPEALRKALIQ

SEQ ID NO: 2979863 - protein, 19 aa, Entamoeba invadens
ELSMIGLDFVKRGVKRVSI

SEQ ID NO: 2979864 - protein, 18 aa, Entamoeba invadens
ELSRLGGMQILLKLLDEL

SEQ ID NO: 2979865 - protein, 20 aa, Entamoeba invadens
ELTKRIPLIFSTALSTWIDD

SEQ ID NO: 2979866 - protein, 18 aa, Entamoeba invadens
ELVRDAAFGPIRELNSNN

SEQ ID NO: 2979867 - protein, 18 aa, Entamoeba invadens
ELWEVIWKDYAAWENEVE

SEQ ID NO: 2979868 - protein, 18 aa, Entamoeba invadens
ELYFINWNKKYTTWIDPR

SEQ ID NO: 2979869 - protein, 19 aa, Entamoeba invadens
ELYLPRYVGSVAMDITSFT

SEQ ID NO: 2979870 - protein, 18 aa, Entamoeba invadens
EMCAVWKLIEMGYREDIA

SEQ ID NO: 2979871 - protein, 17 aa, Entamoeba invadens
EMCDLRFFESGLSTKEI

SEQ ID NO: 2979872 - protein, 24 aa, Entamoeba invadens
EMERDCMISHGMSALLRERLFLAS

SEQ ID NO: 2979873 - protein, 19 aa, Entamoeba invadens
EMFEVLYIVSYEFKSNFKD

SEQ ID NO: 2979874 - protein, 19 aa, Entamoeba invadens
EMIDRWLCFIQQTTQKEWE

SEQ ID NO: 2979875 - protein, 18 aa, Entamoeba invadens
EMKDTFGIFSIYRNVAMR

SEQ ID NO: 2979876 - protein, 17 aa, Entamoeba invadens
EMKEAWVPDNLAKNCML

SEQ ID NO: 2979877 - protein, 20 aa, Entamoeba invadens
EMKKEIPIFVKYMKENVSQV

SEQ ID NO: 2979878 - protein, 20 aa, Entamoeba invadens
EMKRIKGFELLNLFIYKKAK

SEQ ID NO: 2979879 - protein, 22 aa, Entamoeba invadens
EMKTCPKGYVGQSIKNYEAEIS

SEQ ID NO: 2979880 - protein, 19 aa, Entamoeba invadens
EMMPSFKYLFSHLIDLVST

SEQ ID NO: 2979881 - protein, 21 aa, Entamoeba invadens
EMPADMKFVFDKFTEFYNENQ

SEQ ID NO: 2979882 - protein, 24 aa, Entamoeba invadens
EMPCLYPMAVALTFSREVFQKIAS

SEQ ID NO: 2979883 - protein, 17 aa, Entamoeba invadens
EMQCIPCEVPLKKNKMC

SEQ ID NO: 2979884 - protein, 18 aa, Entamoeba invadens
EMREEFKPKIEVVKKEKV

SEQ ID NO: 2979885 - protein, 18 aa, Entamoeba invadens
EMRSGIVGMKFYNPETKK

SEQ ID NO: 2979886 - protein, 25 aa, Entamoeba invadens
EMSADMKTFSEISGKIRGQNEAIMK

SEQ ID NO: 2979887 - protein, 19 aa, Entamoeba invadens
EMSFFCFYLLVSAFLTSNL

SEQ ID NO: 2979888 - protein, 19 aa, Entamoeba invadens
EMVLGIPLFPGNSEYDQLY

SEQ ID NO: 2979889 - protein, 17 aa, Entamoeba invadens
EMVLRARIPRIGMKSKR

SEQ ID NO: 2979890 - protein, 29 aa, Entamoeba invadens
EMVSKYCKGRFGMFSQIYEIPEYVDVQGI

SEQ ID NO: 2979891 - protein, 24 aa, Entamoeba invadens
EMWFFKNIFLVFGLQLGNNKTLII

SEQ ID NO: 2979892 - protein, 19 aa, Entamoeba invadens
EMYNTLCLMQYVVKRSVKL

SEQ ID NO: 2979893 - protein, 19 aa, Entamoeba invadens
ENAFLLGRFHGFKFFEAGE

SEQ ID NO: 2979894 - protein, 18 aa, Entamoeba invadens
ENATCDMKTVNMCHVNVK

SEQ ID NO: 2979895 - protein, 23 aa, Entamoeba invadens
ENCAAMFLPFVVQFLEKFDNFAD

SEQ ID NO: 2979896 - protein, 19 aa, Entamoeba invadens
ENDMKRLSEELGKEKEKRE

SEQ ID NO: 2979897 - protein, 22 aa, Entamoeba invadens
ENDPRLGYVSAMAVAPSGEYCI

SEQ ID NO: 2979898 - protein, 25 aa, Entamoeba invadens
ENELKEKKEEIVVCTKDIQEKEKHL

SEQ ID NO: 2979899 - protein, 17 aa, Entamoeba invadens
ENFCSMHVLLLGNGNEK

SEQ ID NO: 2979900 - protein, 17 aa, Entamoeba invadens
ENFPRSGLLQFFLFPNR

SEQ ID NO: 2979901 - protein, 17 aa, Entamoeba invadens
ENFSALLLENSDKIPTH

SEQ ID NO: 2979902 - protein, 18 aa, Entamoeba invadens
ENGCFYCAFYLKEINIPD

SEQ ID NO: 2979903 - protein, 19 aa, Entamoeba invadens
ENGCFYCAFYLKEINIPDT

SEQ ID NO: 2979904 - protein, 26 aa, Entamoeba invadens
ENGFVFSCIGAFWIMQDWKLYIQQNV

SEQ ID NO: 2979905 - protein, 24 aa, Entamoeba invadens
ENGKRIVECFVRVGGNLVKKMKII

SEQ ID NO: 2979906 - protein, 18 aa, Entamoeba invadens
ENKECLWMVLSTEESRTV

SEQ ID NO: 2979907 - protein, 24 aa, Entamoeba invadens
ENKEGTGFMCYGRWRRVGNNRIEI

SEQ ID NO: 2979908 - protein, 20 aa, Entamoeba invadens
ENKRARWILDLLKTDEKEKK

SEQ ID NO: 2979909 - protein, 19 aa, Entamoeba invadens
ENKRLQLQLSELITTTNHY

SEQ ID NO: 2979910 - protein, 23 aa, Entamoeba invadens
ENLQKCFICGSLDHAAKDCYYKK

SEQ ID NO: 2979911 - protein, 22 aa, Entamoeba invadens
ENLRFRFLQKLVIKKSVNDKLK

SEQ ID NO: 2979912 - protein, 24 aa, Entamoeba invadens
ENMKSMIFPLEWCNVCIDILPYSL

SEQ ID NO: 2979913 - protein, 30 aa, Entamoeba invadens
ENPLYQHGCSWAWKLMDGYAPLMFNENTIE

SEQ ID NO: 2979914 - protein, 19 aa, Entamoeba invadens
ENPMLIAIREFCFKPKKLV

SEQ ID NO: 2979915 - protein, 25 aa, Entamoeba invadens
ENPWVKEMTRISIFGTQQEKEEAYE

SEQ ID NO: 2979916 - protein, 24 aa, Entamoeba invadens
ENQQRLITCLSLEHRVVIRLRKVE

SEQ ID NO: 2979917 - protein, 22 aa, Entamoeba invadens
ENRCGSLNRFLFENSSQECDKQ

SEQ ID NO: 2979918 - protein, 20 aa, Entamoeba invadens
ENSRPCPKCGTFIEKNGGCQ

SEQ ID NO: 2979919 - protein, 20 aa, Entamoeba invadens
ENVYKLVLYFARALENEGTE

SEQ ID NO: 2979920 - protein, 18 aa, Entamoeba invadens
ENWMLDKRIVVLPVVHNR

SEQ ID NO: 2979921 - protein, 22 aa, Entamoeba invadens
ENYTCLKYMIALLYHLSLSEKS

SEQ ID NO: 2979922 - protein, 23 aa, Entamoeba invadens
EPAECLRVWDFFFAYPKRKLYLF

SEQ ID NO: 2979923 - protein, 17 aa, Entamoeba invadens
EPFLGFVRLRIDYNKEE

SEQ ID NO: 2979924 - protein, 17 aa, Entamoeba invadens
EPFMCPALYLISPSQES

SEQ ID NO: 2979925 - protein, 28 aa, Entamoeba invadens
EPKCVGCSFFIKCFLCNKMLNYNMVTQS

SEQ ID NO: 2979926 - protein, 23 aa, Entamoeba invadens
EPKKWWKFAFEATRIKYTHTLFR

SEQ ID NO: 2979927 - protein, 19 aa, Entamoeba invadens
EPLAQVVLCLDHIRYELAV

SEQ ID NO: 2979928 - protein, 20 aa, Entamoeba invadens
EPRMFSLFVNIMFLVAPMWE

SEQ ID NO: 2979929 - protein, 19 aa, Entamoeba invadens
EPRPLCLKELVSVTKIEKK

SEQ ID NO: 2979930 - protein, 18 aa, Entamoeba invadens
EPRPRGAVLSDFPISAFC

SEQ ID NO: 2979931 - protein, 20 aa, Entamoeba invadens
EPTRKCFRLVNGVMVERTAS

SEQ ID NO: 2979932 - protein, 23 aa, Entamoeba invadens
EPVMLPNKCHLFICGIEGNEEYI

SEQ ID NO: 2979933 - protein, 20 aa, Entamoeba invadens
EQAHYILHKRVHDVSMISSA

SEQ ID NO: 2979934 - protein, 23 aa, Entamoeba invadens
EQALKFIVADGIKLVNIDAQNIF

SEQ ID NO: 2979935 - protein, 18 aa, Entamoeba invadens
EQEFAFFLNPPCQKQIFT

SEQ ID NO: 2979936 - protein, 20 aa, Entamoeba invadens
EQEFRLGMVEFYKFGPLNSK

SEQ ID NO: 2979937 - protein, 23 aa, Entamoeba invadens
EQESSCLFDRLLAIQQELLKNDK

SEQ ID NO: 2979938 - protein, 26 aa, Entamoeba invadens
EQILRFELLCSFCLKCYWKNTENNEL

SEQ ID NO: 2979939 - protein, 24 aa, Entamoeba invadens
EQLEKRRITALKRMRQSEEITSAP

SEQ ID NO: 2979940 - protein, 19 aa, Entamoeba invadens
EQLFSCAFSGTKLRNLKLP

SEQ ID NO: 2979941 - protein, 21 aa, Entamoeba invadens
EQPIHKYSCLFDVEQPALPQP

SEQ ID NO: 2979942 - protein, 25 aa, Entamoeba invadens
EQQVLSLRCPISFTRIKIPVRGKRC

SEQ ID NO: 2979943 - protein, 24 aa, Entamoeba invadens
EQSYVVGVDACFYIRANCPSHVPS

SEQ ID NO: 2979944 - protein, 24 aa, Entamoeba invadens
EQVVLKMCKRCFVMSKKPENITQI

SEQ ID NO: 2979945 - protein, 19 aa, Entamoeba invadens
EQYRKIWLDWYVYYCGKLG

SEQ ID NO: 2979946 - protein, 21 aa, Entamoeba invadens
ERALKIHLWVVDWDENGFVNN

SEQ ID NO: 2979947 - protein, 21 aa, Entamoeba invadens
ERALKLLCRFLDLGPWACDQA

SEQ ID NO: 2979948 - protein, 23 aa, Entamoeba invadens
ERAYTLKICRAIQKSGCNVLLVQ

SEQ ID NO: 2979949 - protein, 22 aa, Entamoeba invadens
ERDEFRCQFSFLKFGDETYSDL

SEQ ID NO: 2979950 - protein, 23 aa, Entamoeba invadens
EREKGRVCAFVFAMILDFLKQSL

SEQ ID NO: 2979951 - protein, 17 aa, Entamoeba invadens
ERFDVLKKSKSFECESF

SEQ ID NO: 2979952 - protein, 18 aa, Entamoeba invadens
ERFVELLGVVSFFKAKTH

SEQ ID NO: 2979953 - protein, 17 aa, Entamoeba invadens
ERGVLCWCFEFKLFVHS

SEQ ID NO: 2979954 - protein, 22 aa, Entamoeba invadens
ERHLPVTLPFLFHVLITTFFGV

SEQ ID NO: 2979955 - protein, 21 aa, Entamoeba invadens
ERIGQFAFFWCRSLLIFNGGD

SEQ ID NO: 2979956 - protein, 19 aa, Entamoeba invadens
ERKAPVLPTRGQVVPPKSE

SEQ ID NO: 2979957 - protein, 20 aa, Entamoeba invadens
ERKKRCFINNLLIDYASMIG

SEQ ID NO: 2979958 - protein, 18 aa, Entamoeba invadens
ERKMGGILGSRRGRRVAQ

SEQ ID NO: 2979959 - protein, 24 aa, Entamoeba invadens
ERKQIFKWSGRRVGNIVFDSEVNA

SEQ ID NO: 2979960 - protein, 18 aa, Entamoeba invadens
ERKSFRLSKGHDVTLELQ

SEQ ID NO: 2979961 - protein, 18 aa, Entamoeba invadens
ERLCFPTKVQSIGSNCFM

SEQ ID NO: 2979962 - protein, 17 aa, Entamoeba invadens
ERLDAIFYNGNFVMGAT

SEQ ID NO: 2979963 - protein, 17 aa, Entamoeba invadens
ERLEKEIMEKKHIQDDY

SEQ ID NO: 2979964 - protein, 23 aa, Entamoeba invadens
ERLLLRYPDWRVMEEFEIENETE

SEQ ID NO: 2979965 - protein, 18 aa, Entamoeba invadens
ERLVWFVTFVFEKRIRRE

SEQ ID NO: 2979966 - protein, 24 aa, Entamoeba invadens
ERMSPEVWYFVFNEIFFKILESIG

SEQ ID NO: 2979967 - protein, 20 aa, Entamoeba invadens
ERPFELFNSLGICRVVEDNK

SEQ ID NO: 2979968 - protein, 23 aa, Entamoeba invadens
ERRRVVFDFPDFVDSPLMQKFPE

SEQ ID NO: 2979969 - protein, 22 aa, Entamoeba invadens
ERSMCGTSPFLLACAYGQLEMA

SEQ ID NO: 2979970 - protein, 20 aa, Entamoeba invadens
ERWDGIFLAIYLTRRKELMR

SEQ ID NO: 2979971 - protein, 21 aa, Entamoeba invadens
ERYCGSLLFVVHFGKIVMSSS

SEQ ID NO: 2979972 - protein, 18 aa, Entamoeba invadens
ERYFYSICEIIMGTWKDT

SEQ ID NO: 2979973 - protein, 20 aa, Entamoeba invadens
ERYNRLFAFGCNYINDYDIG

SEQ ID NO: 2979974 - protein, 18 aa, Entamoeba invadens
ERYRELVGLIMINLDEPN

SEQ ID NO: 2979975 - protein, 19 aa, Entamoeba invadens
ESAFRVMFPLDEFVQTMLS

SEQ ID NO: 2979976 - protein, 18 aa, Entamoeba invadens
ESCFKELLKEAALLSTSD

SEQ ID NO: 2979977 - protein, 20 aa, Entamoeba invadens
ESCNACACFSAIVNESLARD

SEQ ID NO: 2979978 - protein, 20 aa, Entamoeba invadens
ESDLKFWDCSCDLAMLDQIK

SEQ ID NO: 2979979 - protein, 24 aa, Entamoeba invadens
ESEKEIFMRLGIKVLNVMKSEEIV

SEQ ID NO: 2979980 - protein, 20 aa, Entamoeba invadens
ESFKQEIKAIVPLDRKKEIE

SEQ ID NO: 2979981 - protein, 18 aa, Entamoeba invadens
ESFWLHGLWPQFILNRNM

SEQ ID NO: 2979982 - protein, 17 aa, Entamoeba invadens
ESGEKYGVFAFGRNIQE

SEQ ID NO: 2979983 - protein, 17 aa, Entamoeba invadens
ESGEYQWAITLLNHVVF

SEQ ID NO: 2979984 - protein, 24 aa, Entamoeba invadens
ESGFGDFCSYIFKAAQLKNDFGLV

SEQ ID NO: 2979985 - protein, 19 aa, Entamoeba invadens
ESGLFKMEFCKSKEMSTIE

SEQ ID NO: 2979986 - protein, 18 aa, Entamoeba invadens
ESHWIFAVQDAFYISVFP

SEQ ID NO: 2979987 - protein, 25 aa, Entamoeba invadens
ESIKWLMTSCEIFPPEPLPHVKVSP

SEQ ID NO: 2979988 - protein, 18 aa, Entamoeba invadens
ESISCLKVNPWFTAKEDI

SEQ ID NO: 2979989 - protein, 24 aa, Entamoeba invadens
ESKEVQCLYTIYSQYVVHFHEFNS

SEQ ID NO: 2979990 - protein, 23 aa, Entamoeba invadens
ESKEVRCLYTIYSQYVVHFHEFN

SEQ ID NO: 2979991 - protein, 18 aa, Entamoeba invadens
ESKKFFGEVAFDYITFLQ

SEQ ID NO: 2979992 - protein, 17 aa, Entamoeba invadens
ESLDTWKAEFIKGACPS

SEQ ID NO: 2979993 - protein, 19 aa, Entamoeba invadens
ESLGMLVSMGFDQKSSEIC

SEQ ID NO: 2979994 - protein, 23 aa, Entamoeba invadens
ESLGYKEGTHFVVIVKKQALKTG

SEQ ID NO: 2979995 - protein, 17 aa, Entamoeba invadens
ESLQVIGSFCFTQNNKI

SEQ ID NO: 2979996 - protein, 17 aa, Entamoeba invadens
ESLRLKARTDFLCVCDC

SEQ ID NO: 2979997 - protein, 27 aa, Entamoeba invadens
ESLRVYAKYILKCPYFLDVFPVFSQSQ

SEQ ID NO: 2979998 - protein, 17 aa, Entamoeba invadens
ESLSISFGGSPPVRQSP

SEQ ID NO: 2979999 - protein, 19 aa, Entamoeba invadens
ESMKFPWYSAVSYFKAAFV

SEQ ID NO: 2980000 - protein, 21 aa, Entamoeba invadens
ESPRLKSSFPLKTSKITHMTP

SEQ ID NO: 2980001 - protein, 19 aa, Entamoeba invadens
ESQFCGFCAVNIYDIKQDL

SEQ ID NO: 2980002 - protein, 18 aa, Entamoeba invadens
ESTKFCGIDTLTNCTKLS

SEQ ID NO: 2980003 - protein, 24 aa, Entamoeba invadens
ESTWFKLGTEWFKTSPLVSSERVT

SEQ ID NO: 2980004 - protein, 20 aa, Entamoeba invadens
ESVAKEWNCLIVGMFELGND

SEQ ID NO: 2980005 - protein, 24 aa, Entamoeba invadens
ESVEFRLGAVFSFLNTLQPYFSHL

SEQ ID NO: 2980006 - protein, 23 aa, Entamoeba invadens
ESVEIKAPLLLFLSGGKFSVDVH

SEQ ID NO: 2980007 - protein, 20 aa, Entamoeba invadens
ESVSPGIEWGCGDGMMGYPQ

SEQ ID NO: 2980008 - protein, 22 aa, Entamoeba invadens
ESYTEFKRLALLLTNLPTKRLR

SEQ ID NO: 2980009 - protein, 22 aa, Entamoeba invadens
ETARPLYAAALWYLDQWDDFGR

SEQ ID NO: 2980010 - protein, 23 aa, Entamoeba invadens
ETARPLYAAALWYLDRWDDFGKI

SEQ ID NO: 2980011 - protein, 19 aa, Entamoeba invadens
ETCRECIDGAYLDNGHCFK

SEQ ID NO: 2980012 - protein, 18 aa, Entamoeba invadens
ETDIAMRVMKLWITNKDR

SEQ ID NO: 2980013 - protein, 22 aa, Entamoeba invadens
ETECLTCKTGFYLNNEKLCSPC

SEQ ID NO: 2980014 - protein, 22 aa, Entamoeba invadens
ETERKERCPVLFLEGNDDMAKY

SEQ ID NO: 2980015 - protein, 21 aa, Entamoeba invadens
ETFEWRECFNVDASMNNICWA

SEQ ID NO: 2980016 - protein, 20 aa, Entamoeba invadens
ETFKIIGKFTFKNCFTLESL

SEQ ID NO: 2980017 - protein, 17 aa, Entamoeba invadens
ETFQFIQRKFITSEDPT

SEQ ID NO: 2980018 - protein, 18 aa, Entamoeba invadens
ETHMIFFISRFVSGGDVF

SEQ ID NO: 2980019 - protein, 17 aa, Entamoeba invadens
ETIPHCAFFRCYKLSEI

SEQ ID NO: 2980020 - protein, 25 aa, Entamoeba invadens
ETIVLLRRRRLVILKSIEQLAKSLK

SEQ ID NO: 2980021 - protein, 25 aa, Entamoeba invadens
ETIVLLRRRRLVILKSVEQLAKSLK

SEQ ID NO: 2980022 - protein, 20 aa, Entamoeba invadens
ETKKSGSITSFFTAKAKKDV

SEQ ID NO: 2980023 - protein, 25 aa, Entamoeba invadens
ETKYGIKVPFMYGTMVECVRAALTA

SEQ ID NO: 2980024 - protein, 18 aa, Entamoeba invadens
ETLCDNCDLIIQNIEKTL

SEQ ID NO: 2980025 - protein, 19 aa, Entamoeba invadens
ETLRRLEVSIVRKYSIEAN

SEQ ID NO: 2980026 - protein, 23 aa, Entamoeba invadens
ETLWKSERLCLVESSTPNIYKRK

SEQ ID NO: 2980027 - protein, 18 aa, Entamoeba invadens
ETNPLFVKHATLPLNIGK

SEQ ID NO: 2980028 - protein, 22 aa, Entamoeba invadens
ETTDCIFICFSINDWNQFERTK

SEQ ID NO: 2980029 - protein, 23 aa, Entamoeba invadens
ETVAECLRCLSLMCRSKNAIPAI

SEQ ID NO: 2980030 - protein, 19 aa, Entamoeba invadens
ETVLRKNVRVFFKKMTTED

SEQ ID NO: 2980031 - protein, 22 aa, Entamoeba invadens
ETYAPLCVLSFPSSNPKLINEN

SEQ ID NO: 2980032 - protein, 24 aa, Entamoeba invadens
ETYASLLCQFGWKSFVPPSEKIQR

SEQ ID NO: 2980033 - protein, 17 aa, Entamoeba invadens
ETYCVLDSPKIDDCPAF

SEQ ID NO: 2980034 - protein, 22 aa, Entamoeba invadens
ETYKFKSVHNFKFFDENFDKFN

SEQ ID NO: 2980035 - protein, 24 aa, Entamoeba invadens
ETYYYCFLHDKWLTKSGMSDHIKK

SEQ ID NO: 2980036 - protein, 23 aa, Entamoeba invadens
EVDGFRIAVDFARREEARDKTPG

SEQ ID NO: 2980037 - protein, 24 aa, Entamoeba invadens
EVDPEFKRTVLINTKFDNRVKELT

SEQ ID NO: 2980038 - protein, 17 aa, Entamoeba invadens
EVECPYWLAPEVISEHR

SEQ ID NO: 2980039 - protein, 25 aa, Entamoeba invadens
EVEKVWPWGCSHMMSGLQGWNNNTK

SEQ ID NO: 2980040 - protein, 17 aa, Entamoeba invadens
EVFEYLGTVYLVSYLYT

SEQ ID NO: 2980041 - protein, 17 aa, Entamoeba invadens
EVFSSVCGMNLQLVLDA

SEQ ID NO: 2980042 - protein, 18 aa, Entamoeba invadens
EVFTMVFIGVNGVGKSTS

SEQ ID NO: 2980043 - protein, 21 aa, Entamoeba invadens
EVFYKCGFVSFTFPKASISLE

SEQ ID NO: 2980044 - protein, 25 aa, Entamoeba invadens
EVFYKCGFVSFTFPKSVNFIGKSLF

SEQ ID NO: 2980045 - protein, 19 aa, Entamoeba invadens
EVHPEMTWQAFCKDKSLIR

SEQ ID NO: 2980046 - protein, 17 aa, Entamoeba invadens
EVINFKVPFSAIQNQEE

SEQ ID NO: 2980047 - protein, 19 aa, Entamoeba invadens
EVISFRCAMARVKSEFKES

SEQ ID NO: 2980048 - protein, 23 aa, Entamoeba invadens
EVISLKCLVGLCMLKNPVRSRYC

SEQ ID NO: 2980049 - protein, 24 aa, Entamoeba invadens
EVIVKKWECGATWVKVVNGEDRVH

SEQ ID NO: 2980050 - protein, 19 aa, Entamoeba invadens
EVKESFLGIDLMRDNLYTP

SEQ ID NO: 2980051 - protein, 18 aa, Entamoeba invadens
EVKPEWLRLLIPKNQIPV

SEQ ID NO: 2980052 - protein, 19 aa, Entamoeba invadens
EVKRWCSLFDDWRVYEFPQ

SEQ ID NO: 2980053 - protein, 19 aa, Entamoeba invadens
EVLFYLLAHKICYPTKVYM

SEQ ID NO: 2980054 - protein, 21 aa, Entamoeba invadens
EVLGNLFSFPLRVISKADGKK

SEQ ID NO: 2980055 - protein, 24 aa, Entamoeba invadens
EVLNRYLCVLIDFLSGLELSNEQS

SEQ ID NO: 2980056 - protein, 17 aa, Entamoeba invadens
EVLPLLYLFIANSNAPA

SEQ ID NO: 2980057 - protein, 24 aa, Entamoeba invadens
EVLSRVSWVGVFPLYGDKKNNYIT

SEQ ID NO: 2980058 - protein, 21 aa, Entamoeba invadens
EVLTMYLVFCISKDEKLQEVD

SEQ ID NO: 2980059 - protein, 17 aa, Entamoeba invadens
EVPILFCIADMVNYPVK

SEQ ID NO: 2980060 - protein, 20 aa, Entamoeba invadens
EVPLCKYCDFIYTAVTEEIK

SEQ ID NO: 2980061 - protein, 20 aa, Entamoeba invadens
EVPLCQTCLVMQLKMKEVIC

SEQ ID NO: 2980062 - protein, 18 aa, Entamoeba invadens
EVPRFLKEIGDFAFCRCT

SEQ ID NO: 2980063 - protein, 18 aa, Entamoeba invadens
EVSFDVFCGVVLNDGQVE

SEQ ID NO: 2980064 - protein, 23 aa, Entamoeba invadens
EVSFDVFCGVVLYDGHIEMLSFV

SEQ ID NO: 2980065 - protein, 19 aa, Entamoeba invadens
EVTLLGCWFHFKQAIFKKV

SEQ ID NO: 2980066 - protein, 21 aa, Entamoeba invadens
EVTRLFIPILVYRYLCSPTPY

SEQ ID NO: 2980067 - protein, 17 aa, Entamoeba invadens
EVTRLFYKAAIMENTVL

SEQ ID NO: 2980068 - protein, 20 aa, Entamoeba invadens
EVVMKLRIKFLLDGAKGIQY

SEQ ID NO: 2980069 - protein, 24 aa, Entamoeba invadens
EVVWRLPLTLFCRMLDGNTTNVQT

SEQ ID NO: 2980070 - protein, 19 aa, Entamoeba invadens
EVWIGLYFWYWHSDGRPYQ

SEQ ID NO: 2980071 - protein, 24 aa, Entamoeba invadens
EVWRYIKGLKFPSGKEMVYKEFIK

SEQ ID NO: 2980072 - protein, 18 aa, Entamoeba invadens
EVYNRCEICIKRSKNEEL

SEQ ID NO: 2980073 - protein, 20 aa, Entamoeba invadens
EWDKRLPSIFGQFRPDTIFS

SEQ ID NO: 2980074 - protein, 22 aa, Entamoeba invadens
EWRLEAPDKYRLIYQNKTSPNE

SEQ ID NO: 2980075 - protein, 19 aa, Entamoeba invadens
EWYRVKVVNWKVCQEEYSC

SEQ ID NO: 2980076 - protein, 22 aa, Entamoeba invadens
EYETWKANTIYLYSFLTTYETP

SEQ ID NO: 2980077 - protein, 18 aa, Entamoeba invadens
EYFDSCYVVAVAKNPMFS

SEQ ID NO: 2980078 - protein, 20 aa, Entamoeba invadens
EYFMLWFSRCFPLEVELKIL

SEQ ID NO: 2980079 - protein, 21 aa, Entamoeba invadens
EYFRFEWELRLVFNNELTQFS

SEQ ID NO: 2980080 - protein, 24 aa, Entamoeba invadens
EYHELFWGCIKKYIENNSETDKDG

SEQ ID NO: 2980081 - protein, 24 aa, Entamoeba invadens
EYHLKLCLCPLCKHGMEVFGAKRP

SEQ ID NO: 2980082 - protein, 19 aa, Entamoeba invadens
EYHLKYIFLNGFYKVPQHE

SEQ ID NO: 2980083 - protein, 17 aa, Entamoeba invadens
EYIANLFAGLISILDNP

SEQ ID NO: 2980084 - protein, 18 aa, Entamoeba invadens
EYIWKTCGLVAELDVENG

SEQ ID NO: 2980085 - protein, 24 aa, Entamoeba invadens
EYLKRNRVTVGFPIKGYEECLVLD

SEQ ID NO: 2980086 - protein, 18 aa, Entamoeba invadens
EYLNRLWAAGIYAETIQK

SEQ ID NO: 2980087 - protein, 19 aa, Entamoeba invadens
EYMSALGYLPARYKTLKEA

SEQ ID NO: 2980088 - protein, 23 aa, Entamoeba invadens
EYPRPDFWAKLFNYLKKGLIDIS

SEQ ID NO: 2980089 - protein, 21 aa, Entamoeba invadens
EYRHLFCYIVSFIKKLKILGE

SEQ ID NO: 2980090 - protein, 24 aa, Entamoeba invadens
EYRLLWFRFDIRKLYLLRHGEPLE

SEQ ID NO: 2980091 - protein, 19 aa, Entamoeba invadens
EYRWAATVLNHLVFSDKTN

SEQ ID NO: 2980092 - protein, 19 aa, Entamoeba invadens
EYSAWLAVIPLGMKCNEIF

SEQ ID NO: 2980093 - protein, 24 aa, Entamoeba invadens
EYVYRSQLKLGEFAEYLVNMYKKV

SEQ ID NO: 2980094 - protein, 17 aa, Entamoeba invadens
FAALLARFCQTPEELKE

SEQ ID NO: 2980095 - protein, 17 aa, Entamoeba invadens
FACTRFLIENYKEVFDT

SEQ ID NO: 2980096 - protein, 25 aa, Entamoeba invadens
FADFKQIWINSGFPLVLQFEGISHD

SEQ ID NO: 2980097 - protein, 18 aa, Entamoeba invadens
FAERRLAVIMQRRKMVDT

SEQ ID NO: 2980098 - protein, 21 aa, Entamoeba invadens
FAKTLRPGRCDGCDKVAEVIS

SEQ ID NO: 2980099 - protein, 22 aa, Entamoeba invadens
FAKWAEGSLMFSDDIDSQELLL

SEQ ID NO: 2980100 - protein, 17 aa, Entamoeba invadens
FALIPMRMREMYPINFE

SEQ ID NO: 2980101 - protein, 17 aa, Entamoeba invadens
FALMKWPKLERNVGKGY

SEQ ID NO: 2980102 - protein, 22 aa, Entamoeba invadens
FANKFNVGMAFIRKSRSFEDTH

SEQ ID NO: 2980103 - protein, 17 aa, Entamoeba invadens
FANRFNVGMAFIRKSRS

SEQ ID NO: 2980104 - protein, 17 aa, Entamoeba invadens
FAQICGVFMKIYADYMR

SEQ ID NO: 2980105 - protein, 23 aa, Entamoeba invadens
FASKRLDVLSAICGVQTLKKYSI

SEQ ID NO: 2980106 - protein, 17 aa, Entamoeba invadens
FAVNDFQTFPALKNDHI

SEQ ID NO: 2980107 - protein, 18 aa, Entamoeba invadens
FCCCFSHSRDIKKKKIVN

SEQ ID NO: 2980108 - protein, 20 aa, Entamoeba invadens
FCFAKCFSLFSVELPKHLNT

SEQ ID NO: 2980109 - protein, 19 aa, Entamoeba invadens
FCFDNCKKLATIDFESIEF

SEQ ID NO: 2980110 - protein, 24 aa, Entamoeba invadens
FCFFCGGEGHTFRDCPFKSHHNET

SEQ ID NO: 2980111 - protein, 26 aa, Entamoeba invadens
FCGCFPRRHFENFIKICNVFNVQEKS

SEQ ID NO: 2980112 - protein, 21 aa, Entamoeba invadens
FCGFTRQLTLYGFKKVCINNA

SEQ ID NO: 2980113 - protein, 25 aa, Entamoeba invadens
FCHKCCAVFICDKCRGNPEVFSLIT

SEQ ID NO: 2980114 - protein, 18 aa, Entamoeba invadens
FCKEYKYLLEVTLSVTDE

SEQ ID NO: 2980115 - protein, 23 aa, Entamoeba invadens
FCKKGEARLVEWKKKLPKDVTAI

SEQ ID NO: 2980116 - protein, 22 aa, Entamoeba invadens
FCLPLCIMFPFDYPLTPPLFFT

SEQ ID NO: 2980117 - protein, 22 aa, Entamoeba invadens
FCPFCKRCLRRTCRSTHYTNSH

SEQ ID NO: 2980118 - protein, 17 aa, Entamoeba invadens
FCRLYFINFCVTENGLS

SEQ ID NO: 2980119 - protein, 17 aa, Entamoeba invadens
FCTKCLSSFVISQNTKC

SEQ ID NO: 2980120 - protein, 18 aa, Entamoeba invadens
FCYSCKMLTPIELEKHTK

SEQ ID NO: 2980121 - protein, 19 aa, Entamoeba invadens
FDAAPCFPPDYSLRDVYLI

SEQ ID NO: 2980122 - protein, 17 aa, Entamoeba invadens
FDALKVCDTYKAKQAKT

SEQ ID NO: 2980123 - protein, 19 aa, Entamoeba invadens
FDALKYRIVPMLLTVVVVP

SEQ ID NO: 2980124 - protein, 18 aa, Entamoeba invadens
FDCLLSFTVIDSIQSFPL

SEQ ID NO: 2980125 - protein, 21 aa, Entamoeba invadens
FDCPEIFKKALLKRFNQKFTR

SEQ ID NO: 2980126 - protein, 20 aa, Entamoeba invadens
FDCPIKICAMTSLRTLDLSY

SEQ ID NO: 2980127 - protein, 19 aa, Entamoeba invadens
FDDCKGLTCLPDMSQMTGL

SEQ ID NO: 2980128 - protein, 18 aa, Entamoeba invadens
FDDDRLIPVFGFGDKTTG

SEQ ID NO: 2980129 - protein, 25 aa, Entamoeba invadens
FDDFFECFNGFFVREKSVIHCVDLN

SEQ ID NO: 2980130 - protein, 18 aa, Entamoeba invadens
FDDNWLFENSDIFVVKIP

SEQ ID NO: 2980131 - protein, 17 aa, Entamoeba invadens
FDDSFALNQSQKVSEIV

SEQ ID NO: 2980132 - protein, 23 aa, Entamoeba invadens
FDFRCVYCGMCLHPECIPKAPHI

SEQ ID NO: 2980133 - protein, 20 aa, Entamoeba invadens
FDGCGHVLCRSCMIKHIAEQ

SEQ ID NO: 2980134 - protein, 20 aa, Entamoeba invadens
FDILRLAIFMSVQVKKDKPF

SEQ ID NO: 2980135 - protein, 17 aa, Entamoeba invadens
FDIPQTCGFVFDFQIRK

SEQ ID NO: 2980136 - protein, 18 aa, Entamoeba invadens
FDLIKTVWVDKQFVGQSV

SEQ ID NO: 2980137 - protein, 17 aa, Entamoeba invadens
FDLKTGRKYAIKIVDKQ

SEQ ID NO: 2980138 - protein, 17 aa, Entamoeba invadens
FDMGVTWSPVVEKKKEL

SEQ ID NO: 2980139 - protein, 18 aa, Entamoeba invadens
FDMHAALCQRLHDPAQII

SEQ ID NO: 2980140 - protein, 17 aa, Entamoeba invadens
FDNVRLFIGYIQMLQYS

SEQ ID NO: 2980141 - protein, 17 aa, Entamoeba invadens
FDPPLGCVIDLDDIEKM

SEQ ID NO: 2980142 - protein, 19 aa, Entamoeba invadens
FDRGLLLGFFRFMEVMKGM

SEQ ID NO: 2980143 - protein, 23 aa, Entamoeba invadens
FDRRPICELSKWLESITMKNELI

SEQ ID NO: 2980144 - protein, 22 aa, Entamoeba invadens
FDSSMCFLCVLGTNNGMEDPLK

SEQ ID NO: 2980145 - protein, 17 aa, Entamoeba invadens
FDTFSFKISKYYCKISS

SEQ ID NO: 2980146 - protein, 23 aa, Entamoeba invadens
FDTRCIPNLPGINLNLSYTNDFN

SEQ ID NO: 2980147 - protein, 22 aa, Entamoeba invadens
FDWAINFVKFLKEMVVYIKQYH

SEQ ID NO: 2980148 - protein, 19 aa, Entamoeba invadens
FDYLQEWIDDVSMYCPQGV

SEQ ID NO: 2980149 - protein, 17 aa, Entamoeba invadens
FEAGIAIAKEIGDVAMV

SEQ ID NO: 2980150 - protein, 20 aa, Entamoeba invadens
FEAGVDFNSIDWSKCGPKIE

SEQ ID NO: 2980151 - protein, 31 aa, Entamoeba invadens
FEALILCFLRFVEVFKIYAFFINNHQKSHKM

SEQ ID NO: 2980152 - protein, 29 aa, Entamoeba invadens
FEDSVCGLMKCWSTLRLTVEHQFGGQDSE

SEQ ID NO: 2980153 - protein, 24 aa, Entamoeba invadens
FEEGLKLTVDWYLSHKKNWERTDE

SEQ ID NO: 2980154 - protein, 18 aa, Entamoeba invadens
FEEGVGCAIRYGDLSSYA

SEQ ID NO: 2980155 - protein, 17 aa, Entamoeba invadens
FEEVKIREALKETKGDV

SEQ ID NO: 2980156 - protein, 20 aa, Entamoeba invadens
FEFIARWLLMLFKREFKRNL

SEQ ID NO: 2980157 - protein, 19 aa, Entamoeba invadens
FEFPHPFCVIRSDKSRVDA

SEQ ID NO: 2980158 - protein, 17 aa, Entamoeba invadens
FEGMCLNFAIGDINEES

SEQ ID NO: 2980159 - protein, 19 aa, Entamoeba invadens
FEGNIFVCGHSLKKLPNCP

SEQ ID NO: 2980160 - protein, 21 aa, Entamoeba invadens
FEGRQGWTLSFIPVSERVENV

SEQ ID NO: 2980161 - protein, 21 aa, Entamoeba invadens
FEHIIKLKLEFESVRNKQKMV

SEQ ID NO: 2980162 - protein, 22 aa, Entamoeba invadens
FEHNFKPFLALMTQLQKKTFPC

SEQ ID NO: 2980163 - protein, 18 aa, Entamoeba invadens
FEHPFLKKHFDNFVETPI

SEQ ID NO: 2980164 - protein, 17 aa, Entamoeba invadens
FEIIFAFALPLKPNARE

SEQ ID NO: 2980165 - protein, 17 aa, Entamoeba invadens
FEILLTLKCTTKFNENI

SEQ ID NO: 2980166 - protein, 18 aa, Entamoeba invadens
FEIPISVVDLSFIESITD

SEQ ID NO: 2980167 - protein, 19 aa, Entamoeba invadens
FEIVDPVAFSKEILPKYYK

SEQ ID NO: 2980168 - protein, 23 aa, Entamoeba invadens
FEKGEYRWAATILNHIVFANKTN

SEQ ID NO: 2980169 - protein, 25 aa, Entamoeba invadens
FEKILSLTCSLDFFKAFASTFVNEK

SEQ ID NO: 2980170 - protein, 17 aa, Entamoeba invadens
FEKLCSFEDNYKNLRNQ

SEQ ID NO: 2980171 - protein, 18 aa, Entamoeba invadens
FEKMCCKSLLVGGDDRNF

SEQ ID NO: 2980172 - protein, 20 aa, Entamoeba invadens
FEKNRFGVYLTRKITDSNTF

SEQ ID NO: 2980173 - protein, 17 aa, Entamoeba invadens
FELFQKRIVAFEITCIN

SEQ ID NO: 2980174 - protein, 17 aa, Entamoeba invadens
FELGIPFKPVEQLMSVL

SEQ ID NO: 2980175 - protein, 24 aa, Entamoeba invadens
FELKFGVPASDTWNVISFSSKPVE

SEQ ID NO: 2980176 - protein, 18 aa, Entamoeba invadens
FELNLPNVCVAFWDGLVW

SEQ ID NO: 2980177 - protein, 20 aa, Entamoeba invadens
FELVKHPWLSTAQVRLDVDE

SEQ ID NO: 2980178 - protein, 17 aa, Entamoeba invadens
FELYMKFYLENKTNKIP

SEQ ID NO: 2980179 - protein, 20 aa, Entamoeba invadens
FEMFNCLSLIKAIVTDSPLC

SEQ ID NO: 2980180 - protein, 20 aa, Entamoeba invadens
FEMVCGFPPFLSDDAVQTCL

SEQ ID NO: 2980181 - protein, 19 aa, Entamoeba invadens
FENATCDMKTMNMCHVNVR

SEQ ID NO: 2980182 - protein, 17 aa, Entamoeba invadens
FENCDWLTAVTLGGISE

SEQ ID NO: 2980183 - protein, 17 aa, Entamoeba invadens
FENCKKITILNTILQSN

SEQ ID NO: 2980184 - protein, 17 aa, Entamoeba invadens
FENLHFGQIEFQENTVF

SEQ ID NO: 2980185 - protein, 17 aa, Entamoeba invadens
FENLLSCRLVCKRWKEI

SEQ ID NO: 2980186 - protein, 18 aa, Entamoeba invadens
FENTHLWLANKIQTSTAK

SEQ ID NO: 2980187 - protein, 18 aa, Entamoeba invadens
FERKCLICESSFYTSANG

SEQ ID NO: 2980188 - protein, 18 aa, Entamoeba invadens
FERPFLWIARKLTGNPNL

SEQ ID NO: 2980189 - protein, 17 aa, Entamoeba invadens
FESLKGIMPPVVGGEEW

SEQ ID NO: 2980190 - protein, 17 aa, Entamoeba invadens
FESRSLFSIIRNSVLKM

SEQ ID NO: 2980191 - protein, 17 aa, Entamoeba invadens
FESYGFSYYCLKWEPES

SEQ ID NO: 2980192 - protein, 18 aa, Entamoeba invadens
FETCHSRRVDMDRFHDSV

SEQ ID NO: 2980193 - protein, 17 aa, Entamoeba invadens
FEVFITPHCTLNFNDNF

SEQ ID NO: 2980194 - protein, 23 aa, Entamoeba invadens
FEVKKLYALGVYLSWNYKLTLKK

SEQ ID NO: 2980195 - protein, 24 aa, Entamoeba invadens
FEVLREFMDLIAFSEEEKINTEIH

SEQ ID NO: 2980196 - protein, 19 aa, Entamoeba invadens
FEVTFIKKCFCIYHHKIRR

SEQ ID NO: 2980197 - protein, 23 aa, Entamoeba invadens
FEWFDEKEMFLAIVDNLAKDMKK

SEQ ID NO: 2980198 - protein, 22 aa, Entamoeba invadens
FEYFMLWFCRKFPVELEVRVLD

SEQ ID NO: 2980199 - protein, 21 aa, Entamoeba invadens
FEYIIKFIFSFIAKDKQHEQL

SEQ ID NO: 2980200 - protein, 18 aa, Entamoeba invadens
FFALAGICQTCFNGVCFD

SEQ ID NO: 2980201 - protein, 18 aa, Entamoeba invadens
FFALRGALDIQKEVTAKE

SEQ ID NO: 2980202 - protein, 17 aa, Entamoeba invadens
FFCKRIVVRVEYEAFWD

SEQ ID NO: 2980203 - protein, 26 aa, Entamoeba invadens
FFCLHWFITKCHSFMIIIFDTISNPI

SEQ ID NO: 2980204 - protein, 18 aa, Entamoeba invadens
FFCRVIWYEVDFAHYCNT

SEQ ID NO: 2980205 - protein, 19 aa, Entamoeba invadens
FFCSLRLAHYLAQYGSTLL

SEQ ID NO: 2980206 - protein, 24 aa, Entamoeba invadens
FFDLTDWYIGYLIRSYRSGDTTIP

SEQ ID NO: 2980207 - protein, 21 aa, Entamoeba invadens
FFDPLKIDMCDGLVSLRPHPF

SEQ ID NO: 2980208 - protein, 18 aa, Entamoeba invadens
FFDRFGVGIIQFRNVLLD

SEQ ID NO: 2980209 - protein, 17 aa, Entamoeba invadens
FFDTVVVSYTFYLQMKA

SEQ ID NO: 2980210 - protein, 18 aa, Entamoeba invadens
FFEIIGWAEPFPKKRFEH

SEQ ID NO: 2980211 - protein, 18 aa, Entamoeba invadens
FFEIIGWAEPFPKKRFKY

SEQ ID NO: 2980212 - protein, 18 aa, Entamoeba invadens
FFFKRTVQVCVVKYEGFL

SEQ ID NO: 2980213 - protein, 17 aa, Entamoeba invadens
FFGGGAYGNCSNESYWN

SEQ ID NO: 2980214 - protein, 18 aa, Entamoeba invadens
FFGGGGFGFGGRQRSGPR

SEQ ID NO: 2980215 - protein, 19 aa, Entamoeba invadens
FFGNYCFFKCLSLEEINFP

SEQ ID NO: 2980216 - protein, 19 aa, Entamoeba invadens
FFIKMNQIIGGSRDLHLSL

SEQ ID NO: 2980217 - protein, 21 aa, Entamoeba invadens
FFIRPWRKFVLETQVDLLFKD

SEQ ID NO: 2980218 - protein, 19 aa, Entamoeba invadens
FFKFPWKIAEFVISNKRLE

SEQ ID NO: 2980219 - protein, 19 aa, Entamoeba invadens
FFKHPCVLLNISIPLTQIA

SEQ ID NO: 2980220 - protein, 19 aa, Entamoeba invadens
FFKKDFQTISSFFPDIVEH

SEQ ID NO: 2980221 - protein, 18 aa, Entamoeba invadens
FFLECLRKVAQNGMKQTD

SEQ ID NO: 2980222 - protein, 19 aa, Entamoeba invadens
FFLKYKKIRHWLGDADIFK

SEQ ID NO: 2980223 - protein, 17 aa, Entamoeba invadens
FFLRPCWSPEATQMLLV

SEQ ID NO: 2980224 - protein, 24 aa, Entamoeba invadens
FFPHPRPVTSVAFHPSEHIMATAC

SEQ ID NO: 2980225 - protein, 25 aa, Entamoeba invadens
FFPYRYKEEFSIFGNILLKHKYSVH

SEQ ID NO: 2980226 - protein, 23 aa, Entamoeba invadens
FFPYRYKPEFEIFGQYLAKAQIF

SEQ ID NO: 2980227 - protein, 19 aa, Entamoeba invadens
FFRIIVWFNVDFETVDRNK

SEQ ID NO: 2980228 - protein, 23 aa, Entamoeba invadens
FFRTRELLLRDGFAFISKQEIID

SEQ ID NO: 2980229 - protein, 17 aa, Entamoeba invadens
FFRVKIRIMPKCALCGF

SEQ ID NO: 2980230 - protein, 17 aa, Entamoeba invadens
FFRVKVTVLIADKPIGE

SEQ ID NO: 2980231 - protein, 17 aa, Entamoeba invadens
FFSLKYDAHWFVTDHWY

SEQ ID NO: 2980232 - protein, 23 aa, Entamoeba invadens
FFTEMRIELPFPLKKTHHLLFSI

SEQ ID NO: 2980233 - protein, 19 aa, Entamoeba invadens
FFVFCDECVFGFYSESQTF

SEQ ID NO: 2980234 - protein, 18 aa, Entamoeba invadens
FFVINLCGQFHLRNMKGV

SEQ ID NO: 2980235 - protein, 17 aa, Entamoeba invadens
FFWDLMHFIPYPLVEKL

SEQ ID NO: 2980236 - protein, 17 aa, Entamoeba invadens
FGAAWCFRPAERMIKSL

SEQ ID NO: 2980237 - protein, 25 aa, Entamoeba invadens
FGCMAAELFVGIPIFPGNCEYNMLY

SEQ ID NO: 2980238 - protein, 25 aa, Entamoeba invadens
FGCMAAELFVGIPIFPGNSEYNMLY

SEQ ID NO: 2980239 - protein, 22 aa, Entamoeba invadens
FGCSICRIGGLAFCECKSLVDV

SEQ ID NO: 2980240 - protein, 21 aa, Entamoeba invadens
FGCVKCSRKLGADFVTFDNLA

SEQ ID NO: 2980241 - protein, 17 aa, Entamoeba invadens
FGDFMFQTMIINREKYD

SEQ ID NO: 2980242 - protein, 17 aa, Entamoeba invadens
FGEALTLILRSPIALKR

SEQ ID NO: 2980243 - protein, 17 aa, Entamoeba invadens
FGECGYFRMSICQPPEI

SEQ ID NO: 2980244 - protein, 21 aa, Entamoeba invadens
FGELNLYCCVSLLTYFKSDLM

SEQ ID NO: 2980245 - protein, 17 aa, Entamoeba invadens
FGFDRAFGPSSTQEIIF

SEQ ID NO: 2980246 - protein, 24 aa, Entamoeba invadens
FGFGFGFGHFGSFGRFTSFGPTSY

SEQ ID NO: 2980247 - protein, 24 aa, Entamoeba invadens
FGGCTFGFSRGCSMIDIHETEFVQ

SEQ ID NO: 2980248 - protein, 22 aa, Entamoeba invadens
FGGEIYELWDAIFAYPKHKLQY

SEQ ID NO: 2980249 - protein, 17 aa, Entamoeba invadens
FGGGHAIGVFKKGSLSR

SEQ ID NO: 2980250 - protein, 17 aa, Entamoeba invadens
FGGIFSCKVVPEKKYGF

SEQ ID NO: 2980251 - protein, 17 aa, Entamoeba invadens
FGGMGMPQGGMPNVQGL

SEQ ID NO: 2980252 - protein, 17 aa, Entamoeba invadens
FGGSDFIFWVGQAKPPK

SEQ ID NO: 2980253 - protein, 21 aa, Entamoeba invadens
FGGWPHAGCGIGLERITMLYL

SEQ ID NO: 2980254 - protein, 17 aa, Entamoeba invadens
FGGYIHRRVRELNVDVE

SEQ ID NO: 2980255 - protein, 17 aa, Entamoeba invadens
FGHLYNCEHNFVFADAR

SEQ ID NO: 2980256 - protein, 22 aa, Entamoeba invadens
FGIKIGFCYQDGFVVGFMINVK

SEQ ID NO: 2980257 - protein, 17 aa, Entamoeba invadens
FGKECFCKCRVSSIAFS

SEQ ID NO: 2980258 - protein, 21 aa, Entamoeba invadens
FGKEINDFFLGRVLQTGSETF

SEQ ID NO: 2980259 - protein, 22 aa, Entamoeba invadens
FGKHCFRGCTKILGNVKIPLHC

SEQ ID NO: 2980260 - protein, 18 aa, Entamoeba invadens
FGKIKIFSKVGVLAEIEE

SEQ ID NO: 2980261 - protein, 18 aa, Entamoeba invadens
FGLSCFEFNTLLVSITLS

SEQ ID NO: 2980262 - protein, 18 aa, Entamoeba invadens
FGLSCFEYNTLLVSITLS

SEQ ID NO: 2980263 - protein, 19 aa, Entamoeba invadens
FGMKRIDAITLGRGTSNPD

SEQ ID NO: 2980264 - protein, 20 aa, Entamoeba invadens
FGNAKLVFESILSLKYISNT

SEQ ID NO: 2980265 - protein, 20 aa, Entamoeba invadens
FGNGFAIFSFRFEDVGYDDS

SEQ ID NO: 2980266 - protein, 23 aa, Entamoeba invadens
FGPHPLEVFAMIAAMKILCSKNF

SEQ ID NO: 2980267 - protein, 20 aa, Entamoeba invadens
FGRIKMVFKFTREKYLKDFV

SEQ ID NO: 2980268 - protein, 17 aa, Entamoeba invadens
FGSACFENSTLYTYIQS

SEQ ID NO: 2980269 - protein, 17 aa, Entamoeba invadens
FGSACFERSTLYSYIQS

SEQ ID NO: 2980270 - protein, 17 aa, Entamoeba invadens
FGSACFERSTLYTYIQS

SEQ ID NO: 2980271 - protein, 20 aa, Entamoeba invadens
FGTRWLRLLFDREFLVNDVL

SEQ ID NO: 2980272 - protein, 17 aa, Entamoeba invadens
FGTSRPRINTMLRNMMN

SEQ ID NO: 2980273 - protein, 21 aa, Entamoeba invadens
FGVDFMKRFLKTQMFEDWRKT

SEQ ID NO: 2980274 - protein, 17 aa, Entamoeba invadens
FGVKCVHISFVAGGEIM

SEQ ID NO: 2980275 - protein, 17 aa, Entamoeba invadens
FGVRCIEPFVPYETSTV

SEQ ID NO: 2980276 - protein, 18 aa, Entamoeba invadens
FGVSCFESMSSLVAITLS

SEQ ID NO: 2980277 - protein, 17 aa, Entamoeba invadens
FGWKEAYPINTFKFPWK

SEQ ID NO: 2980278 - protein, 17 aa, Entamoeba invadens
FHEFPKVYLALAKEKLL

SEQ ID NO: 2980279 - protein, 24 aa, Entamoeba invadens
FHEKCTLCSPPLCRQASLPVDFYT

SEQ ID NO: 2980280 - protein, 17 aa, Entamoeba invadens
FHGFPYNFNRSVAKQLL

SEQ ID NO: 2980281 - protein, 17 aa, Entamoeba invadens
FHGMGVVVQECTEEDSN

SEQ ID NO: 2980282 - protein, 17 aa, Entamoeba invadens
FHKWITFCHIIFTDSSS

SEQ ID NO: 2980283 - protein, 17 aa, Entamoeba invadens
FHLDSRFYLDAMVTSVG

SEQ ID NO: 2980284 - protein, 17 aa, Entamoeba invadens
FHLGCKLLRMGVGEILN

SEQ ID NO: 2980285 - protein, 19 aa, Entamoeba invadens
FHLKILRLFTDSVLHYGLP

SEQ ID NO: 2980286 - protein, 23 aa, Entamoeba invadens
FHLKMQMKFVLGCRVGQTPNSNT

SEQ ID NO: 2980287 - protein, 17 aa, Entamoeba invadens
FHLRCIINLFGDGPGSL

SEQ ID NO: 2980288 - protein, 17 aa, Entamoeba invadens
FHPTRNWVLTSLHNGKV

SEQ ID NO: 2980289 - protein, 17 aa, Entamoeba invadens
FHSPLCFGGKKSFDQKF

SEQ ID NO: 2980290 - protein, 17 aa, Entamoeba invadens
FHTKCSEDLFSDLHVKK

SEQ ID NO: 2980291 - protein, 23 aa, Entamoeba invadens
FHYNPICLRSHFKFFPNVETYYI

SEQ ID NO: 2980292 - protein, 17 aa, Entamoeba invadens
FIACSLLQFGVSIPNSL

SEQ ID NO: 2980293 - protein, 24 aa, Entamoeba invadens
FIAFCPLLKMYMDYVAKFNLKVKA

SEQ ID NO: 2980294 - protein, 17 aa, Entamoeba invadens
FIAKSVRVIDDMVVDMN

SEQ ID NO: 2980295 - protein, 22 aa, Entamoeba invadens
FICCVSCLLLVLTDKYYRTYEG

SEQ ID NO: 2980296 - protein, 20 aa, Entamoeba invadens
FIDFKFKYRRGLPMKLKGIN

SEQ ID NO: 2980297 - protein, 24 aa, Entamoeba invadens
FIEECWKGVFAMLYIGGIDENMNV

SEQ ID NO: 2980298 - protein, 23 aa, Entamoeba invadens
FIELLAYYKRFWIEKIGTKRWSQ

SEQ ID NO: 2980299 - protein, 18 aa, Entamoeba invadens
FIFGSLPPNFGITLYNTA

SEQ ID NO: 2980300 - protein, 30 aa, Entamoeba invadens
FIFYKTRFDFFLTWLFCRLYFINFCVTENG

SEQ ID NO: 2980301 - protein, 19 aa, Entamoeba invadens
FIGDQAFEWCFNFKEIVLK

SEQ ID NO: 2980302 - protein, 18 aa, Entamoeba invadens
FIGNFAFEMCIQLKELVF

SEQ ID NO: 2980303 - protein, 18 aa, Entamoeba invadens
FIGSFAFSNAKLVDVTIP

SEQ ID NO: 2980304 - protein, 17 aa, Entamoeba invadens
FIHLCGSPAQLQDAAVV

SEQ ID NO: 2980305 - protein, 18 aa, Entamoeba invadens
FIIDCSWFSFQQIENEQL

SEQ ID NO: 2980306 - protein, 18 aa, Entamoeba invadens
FIIFFALSMILTVTGKYN

SEQ ID NO: 2980307 - protein, 18 aa, Entamoeba invadens
FIKKLWGLHVNKYYKDGY

SEQ ID NO: 2980308 - protein, 20 aa, Entamoeba invadens
FIKKRCDALTAIMCDEGVKI

SEQ ID NO: 2980309 - protein, 20 aa, Entamoeba invadens
FINHLKRIVGFEKLKRIQQN

SEQ ID NO: 2980310 - protein, 17 aa, Entamoeba invadens
FINKEAMARCYADLIYQ

SEQ ID NO: 2980311 - protein, 18 aa, Entamoeba invadens
FINVPGLVFILSKVIVMN

SEQ ID NO: 2980312 - protein, 20 aa, Entamoeba invadens
FIPKHLMSLLGKYKKANLNE

SEQ ID NO: 2980313 - protein, 17 aa, Entamoeba invadens
FIPVDGFEGENLSTLSL

SEQ ID NO: 2980314 - protein, 22 aa, Entamoeba invadens
FIRSGLLMKVCRKFNKERYFYL

SEQ ID NO: 2980315 - protein, 17 aa, Entamoeba invadens
FISRLVLPLTRLLPNEI

SEQ ID NO: 2980316 - protein, 18 aa, Entamoeba invadens
FISRVAGYQKLVFIFISQ

SEQ ID NO: 2980317 - protein, 18 aa, Entamoeba invadens
FITFKIVLKKTCLCKSIE

SEQ ID NO: 2980318 - protein, 18 aa, Entamoeba invadens
FITFRPSSALLFATFDGR

SEQ ID NO: 2980319 - protein, 20 aa, Entamoeba invadens
FITLKFLWKYFCNGLCDSLI

SEQ ID NO: 2980320 - protein, 19 aa, Entamoeba invadens
FIVCSKSSVFGCFNGAQLP

SEQ ID NO: 2980321 - protein, 23 aa, Entamoeba invadens
FIYNRYKFGVLYAGIGQTKEREF

SEQ ID NO: 2980322 - protein, 18 aa, Entamoeba invadens
FKAVKEIGDFCFAESVFR

SEQ ID NO: 2980323 - protein, 17 aa, Entamoeba invadens
FKCDAKHHFSHGICLPN

SEQ ID NO: 2980324 - protein, 17 aa, Entamoeba invadens
FKCTVSFPRFAPETPQL

SEQ ID NO: 2980325 - protein, 18 aa, Entamoeba invadens
FKCVYSFREIRNYQSEQE

SEQ ID NO: 2980326 - protein, 23 aa, Entamoeba invadens
FKDCRRLKEVVLPPNLNQVSSHC

SEQ ID NO: 2980327 - protein, 18 aa, Entamoeba invadens
FKDIKGVLLVFQIDRQES

SEQ ID NO: 2980328 - protein, 23 aa, Entamoeba invadens
FKDNLKAVILFPEYYKNPFTIVP

SEQ ID NO: 2980329 - protein, 17 aa, Entamoeba invadens
FKEFKWSATNFENLELL

SEQ ID NO: 2980330 - protein, 19 aa, Entamoeba invadens
FKELQRLYVAGGRNKEYIL

SEQ ID NO: 2980331 - protein, 19 aa, Entamoeba invadens
FKEQFTLIIDDLMSNSYIQ

SEQ ID NO: 2980332 - protein, 18 aa, Entamoeba invadens
FKFKAIGMLPPIANFASI

SEQ ID NO: 2980333 - protein, 17 aa, Entamoeba invadens
FKFLNVVWTCFSSKENE

SEQ ID NO: 2980334 - protein, 17 aa, Entamoeba invadens
FKFLTKFVVYFIDEVEE

SEQ ID NO: 2980335 - protein, 21 aa, Entamoeba invadens
FKFPWKIAEFISSGKRLKKID

SEQ ID NO: 2980336 - protein, 17 aa, Entamoeba invadens
FKGDLLIFLLDSLYDCQ

SEQ ID NO: 2980337 - protein, 18 aa, Entamoeba invadens
FKGIKNGIAYQFFVGTNS

SEQ ID NO: 2980338 - protein, 18 aa, Entamoeba invadens
FKGLCEIIEKLFLWDKVR

SEQ ID NO: 2980339 - protein, 17 aa, Entamoeba invadens
FKIACFLFPPERDKYLN

SEQ ID NO: 2980340 - protein, 23 aa, Entamoeba invadens
FKILREIAVGLAFVQTVAHVFHG

SEQ ID NO: 2980341 - protein, 17 aa, Entamoeba invadens
FKKAKDVLGFPNLLDPK

SEQ ID NO: 2980342 - protein, 18 aa, Entamoeba invadens
FKKCPKLRSVFFDGDVIE

SEQ ID NO: 2980343 - protein, 19 aa, Entamoeba invadens
FKKCVPPVIQARRQPEVKT

SEQ ID NO: 2980344 - protein, 24 aa, Entamoeba invadens
FKKEFFRIIVWFNVDFETVDKYNN

SEQ ID NO: 2980345 - protein, 20 aa, Entamoeba invadens
FKKEFLRVSLEMVFAKYDEI

SEQ ID NO: 2980346 - protein, 19 aa, Entamoeba invadens
FKKEVAMLAKFVSPYVIRF

SEQ ID NO: 2980347 - protein, 17 aa, Entamoeba invadens
FKKFSFTGCIGITGVFL

SEQ ID NO: 2980348 - protein, 20 aa, Entamoeba invadens
FKKKRIDGVDYFFNAFFRPN

SEQ ID NO: 2980349 - protein, 24 aa, Entamoeba invadens
FKKLETPTGFCFRHDSFIADHPEL

SEQ ID NO: 2980350 - protein, 18 aa, Entamoeba invadens
FKKSIPWNQPEKVDFVKQ

SEQ ID NO: 2980351 - protein, 20 aa, Entamoeba invadens
FKKTEVESGIFIFENDDRLY

SEQ ID NO: 2980352 - protein, 17 aa, Entamoeba invadens
FKKTMALQLEKLKTHFV

SEQ ID NO: 2980353 - protein, 26 aa, Entamoeba invadens
FKLDLFIQCCLGVQWFHEILKLVHGN

SEQ ID NO: 2980354 - protein, 19 aa, Entamoeba invadens
FKLFIDFRCNSHFPQFISA

SEQ ID NO: 2980355 - protein, 18 aa, Entamoeba invadens
FKLFPGIKTLVINSSYFR

SEQ ID NO: 2980356 - protein, 19 aa, Entamoeba invadens
FKLLRAPFDLEIKKLEDAK

SEQ ID NO: 2980357 - protein, 19 aa, Entamoeba invadens
FKLSPQFTYSLITYDNKEV

SEQ ID NO: 2980358 - protein, 17 aa, Entamoeba invadens
FKLYIEKGISFLNNYIK

SEQ ID NO: 2980359 - protein, 19 aa, Entamoeba invadens
FKLYLPIIVPVLLNELSRL

SEQ ID NO: 2980360 - protein, 17 aa, Entamoeba invadens
FKNCRKLEDVVMKEGIH

SEQ ID NO: 2980361 - protein, 19 aa, Entamoeba invadens
FKNEFKFVGDVVFVKSETI

SEQ ID NO: 2980362 - protein, 18 aa, Entamoeba invadens
FKNLKCLVIDEADRILEA

SEQ ID NO: 2980363 - protein, 20 aa, Entamoeba invadens
FKNQCFRGCVLLELTVPKTV

SEQ ID NO: 2980364 - protein, 17 aa, Entamoeba invadens
FKNSFFFRSDAQKSDLK

SEQ ID NO: 2980365 - protein, 20 aa, Entamoeba invadens
FKNSLSFAFYRFPRSVSNIG

SEQ ID NO: 2980366 - protein, 17 aa, Entamoeba invadens
FKNSVFLVASNFNAVES

SEQ ID NO: 2980367 - protein, 20 aa, Entamoeba invadens
FKNVECFICKGYGHKQWDCP

SEQ ID NO: 2980368 - protein, 17 aa, Entamoeba invadens
FKPIAAFMKAWRDAVEQ

SEQ ID NO: 2980369 - protein, 17 aa, Entamoeba invadens
FKPIVLKDVMCRGSVGE

SEQ ID NO: 2980370 - protein, 28 aa, Entamoeba invadens
FKPQVALRFGLPFDRPFYLVHRNTFLES

SEQ ID NO: 2980371 - protein, 17 aa, Entamoeba invadens
FKPSLKFTKIVSLKCKV

SEQ ID NO: 2980372 - protein, 33 aa, Entamoeba invadens
FKPYCIAQGYFVWSCKVVESFKGINPMLDQKFN

SEQ ID NO: 2980373 - protein, 20 aa, Entamoeba invadens
FKQECLWKYNTQIYDEFMNT

SEQ ID NO: 2980374 - protein, 20 aa, Entamoeba invadens
FKQECLWKYNTQIYDEIMNT

SEQ ID NO: 2980375 - protein, 24 aa, Entamoeba invadens
FKQLRCGLELNLLYGKQSANSRYS

SEQ ID NO: 2980376 - protein, 20 aa, Entamoeba invadens
FKQNSKCLIGMFASKKDTED

SEQ ID NO: 2980377 - protein, 19 aa, Entamoeba invadens
FKQPEIFTQISTGLQTEYQ

SEQ ID NO: 2980378 - protein, 24 aa, Entamoeba invadens
FKQRLPRFVQMLMILSRRPNKNTE

SEQ ID NO: 2980379 - protein, 18 aa, Entamoeba invadens
FKRCLISAVALLKIVMHA

SEQ ID NO: 2980380 - protein, 17 aa, Entamoeba invadens
FKRLTLLMTNLPNKRLR

SEQ ID NO: 2980381 - protein, 19 aa, Entamoeba invadens
FKRSSCLVLEYSLKSSTMI

SEQ ID NO: 2980382 - protein, 19 aa, Entamoeba invadens
FKSDILMYLGKLFEAGAKG

SEQ ID NO: 2980383 - protein, 22 aa, Entamoeba invadens
FKSFCDFLRRRGHTDMLEQLVM

SEQ ID NO: 2980384 - protein, 20 aa, Entamoeba invadens
FKSGCTEKPFLLEFNAVIKQ

SEQ ID NO: 2980385 - protein, 17 aa, Entamoeba invadens
FKSIERWLSELKDNADP

SEQ ID NO: 2980386 - protein, 17 aa, Entamoeba invadens
FKSKFFYVKRYEYLDQI

SEQ ID NO: 2980387 - protein, 18 aa, Entamoeba invadens
FKSLKLWENTVCELFNIG

SEQ ID NO: 2980388 - protein, 17 aa, Entamoeba invadens
FKSLLILLKRKCEDDGK

SEQ ID NO: 2980389 - protein, 18 aa, Entamoeba invadens
FKSLQLAAVIGKTAFCVH

SEQ ID NO: 2980390 - protein, 17 aa, Entamoeba invadens
FKSLSFPDLLSCRLVCK

SEQ ID NO: 2980391 - protein, 22 aa, Entamoeba invadens
FKSPNYRKALLDAFNHCNLIES

SEQ ID NO: 2980392 - protein, 21 aa, Entamoeba invadens
FKSSLTLSWVFLKRGVELTKR

SEQ ID NO: 2980393 - protein, 21 aa, Entamoeba invadens
FKSSRCTFALFKNMLEVGMTN

SEQ ID NO: 2980394 - protein, 24 aa, Entamoeba invadens
FKTEFRTSCGTIRAGTTKIVNLNY

SEQ ID NO: 2980395 - protein, 20 aa, Entamoeba invadens
FKTGFPVFGLNGFWKMVEHN

SEQ ID NO: 2980396 - protein, 26 aa, Entamoeba invadens
FKTNLRFSFKLMKGIVLYCNSDDGDM

SEQ ID NO: 2980397 - protein, 25 aa, Entamoeba invadens
FKTSIFWKLCCVYDHIVVHTLIRYC

SEQ ID NO: 2980398 - protein, 20 aa, Entamoeba invadens
FKTTFGHKFECYESELKTVG

SEQ ID NO: 2980399 - protein, 17 aa, Entamoeba invadens
FKVEFFERVWSKTTPED

SEQ ID NO: 2980400 - protein, 17 aa, Entamoeba invadens
FKVERMLLGFTIAEPNF

SEQ ID NO: 2980401 - protein, 17 aa, Entamoeba invadens
FKVERMLLGFTVAEPNF

SEQ ID NO: 2980402 - protein, 18 aa, Entamoeba invadens
FKVFRTSEEIHFIDYFEK

SEQ ID NO: 2980403 - protein, 20 aa, Entamoeba invadens
FKVTCVRSVYHSAFPNQIPQ

SEQ ID NO: 2980404 - protein, 21 aa, Entamoeba invadens
FKVTVCRKCGLMGYCGYCKYC

SEQ ID NO: 2980405 - protein, 21 aa, Entamoeba invadens
FKWQIPTIRPKTGLLASLSYN

SEQ ID NO: 2980406 - protein, 17 aa, Entamoeba invadens
FKYATSFTNNVKKLTII

SEQ ID NO: 2980407 - protein, 24 aa, Entamoeba invadens
FKYECLYCQSGFIVGNPVKITTKV

SEQ ID NO: 2980408 - protein, 20 aa, Entamoeba invadens
FKYFPSLITLRFPIDKIRLF

SEQ ID NO: 2980409 - protein, 27 aa, Entamoeba invadens
FKYGKFKLKRICAIPSFIVTFVAEIDT

SEQ ID NO: 2980410 - protein, 19 aa, Entamoeba invadens
FKYIEKYGRVVSAVQNINV

SEQ ID NO: 2980411 - protein, 19 aa, Entamoeba invadens
FKYIEVFENLHFGQIEFQE

SEQ ID NO: 2980412 - protein, 18 aa, Entamoeba invadens
FKYIEVFENLYFDEIAFK

SEQ ID NO: 2980413 - protein, 17 aa, Entamoeba invadens
FKYKYNYVMDIRTWSPL

SEQ ID NO: 2980414 - protein, 18 aa, Entamoeba invadens
FKYPWKIADFVNGGNRLQ

SEQ ID NO: 2980415 - protein, 17 aa, Entamoeba invadens
FKYSSCMFSIIPSAIGL

SEQ ID NO: 2980416 - protein, 19 aa, Entamoeba invadens
FKYYKEFYQILVWYEVDYF

SEQ ID NO: 2980417 - protein, 17 aa, Entamoeba invadens
FLAGTTWFYCEPESKEL

SEQ ID NO: 2980418 - protein, 18 aa, Entamoeba invadens
FLAKYGIEICIKKDGKTM

SEQ ID NO: 2980419 - protein, 17 aa, Entamoeba invadens
FLAKYGINTCIKKDSKT

SEQ ID NO: 2980420 - protein, 17 aa, Entamoeba invadens
FLALTGLSEKMEKDKQL

SEQ ID NO: 2980421 - protein, 18 aa, Entamoeba invadens
FLANFVVDLFGPKAAVDF

SEQ ID NO: 2980422 - protein, 17 aa, Entamoeba invadens
FLCDSCSSLKRVEVSKK

SEQ ID NO: 2980423 - protein, 22 aa, Entamoeba invadens
FLCQRASHVFGVFVAEELVMKN

SEQ ID NO: 2980424 - protein, 17 aa, Entamoeba invadens
FLDCVHILIAQFPNLFE

SEQ ID NO: 2980425 - protein, 18 aa, Entamoeba invadens
FLEEKGRWDSIEFESGMR

SEQ ID NO: 2980426 - protein, 18 aa, Entamoeba invadens
FLEFLKFGLTLKEALSYT

SEQ ID NO: 2980427 - protein, 18 aa, Entamoeba invadens
FLEFSCKFLNFPTMNVFN

SEQ ID NO: 2980428 - protein, 21 aa, Entamoeba invadens
FLFDACFEFGFFFESKMSKNS

SEQ ID NO: 2980429 - protein, 18 aa, Entamoeba invadens
FLFDIGMLVSDGYGTSET

SEQ ID NO: 2980430 - protein, 17 aa, Entamoeba invadens
FLFNIPEGVQRACMEYK

SEQ ID NO: 2980431 - protein, 17 aa, Entamoeba invadens
FLFSPQIHKIVFYDVVF

SEQ ID NO: 2980432 - protein, 25 aa, Entamoeba invadens
FLFTRRSHLNWARFDKWENDMIKKQ

SEQ ID NO: 2980433 - protein, 20 aa, Entamoeba invadens
FLGFSFKYATSFTNNVKKLT

SEQ ID NO: 2980434 - protein, 17 aa, Entamoeba invadens
FLHKSSVYQIQFEGSKG

SEQ ID NO: 2980435 - protein, 20 aa, Entamoeba invadens
FLHLPKYRIIPGWSETLTNY

SEQ ID NO: 2980436 - protein, 24 aa, Entamoeba invadens
FLHYKNRMGLIVWKVNLLNNMASI

SEQ ID NO: 2980437 - protein, 21 aa, Entamoeba invadens
FLICFSVVLPPSFDNVSSKWQ

SEQ ID NO: 2980438 - protein, 22 aa, Entamoeba invadens
FLIFHFGYDWKEVVEAPQGGNL

SEQ ID NO: 2980439 - protein, 22 aa, Entamoeba invadens
FLIFHFGYDWKEVVNAPQGGNI

SEQ ID NO: 2980440 - protein, 25 aa, Entamoeba invadens
FLKCKAEILSIFLFYIQLQFFNTTL

SEQ ID NO: 2980441 - protein, 22 aa, Entamoeba invadens
FLKDLLLKMGFKITQNEAINLA

SEQ ID NO: 2980442 - protein, 24 aa, Entamoeba invadens
FLKPSIIFNIRFYFEYAVPTQSEH

SEQ ID NO: 2980443 - protein, 22 aa, Entamoeba invadens
FLKQSGCETGIFVNDFIDLFEW

SEQ ID NO: 2980444 - protein, 19 aa, Entamoeba invadens
FLLCCLKLTFPNQFVLLRG

SEQ ID NO: 2980445 - protein, 22 aa, Entamoeba invadens
FLLCTRAGGFGINLSEADTVII

SEQ ID NO: 2980446 - protein, 23 aa, Entamoeba invadens
FLLCTRAGGIGINLSEADTVIIY

SEQ ID NO: 2980447 - protein, 18 aa, Entamoeba invadens
FLLDVCLIDCELFADELS

SEQ ID NO: 2980448 - protein, 20 aa, Entamoeba invadens
FLLLRVMWMFVKFSFTKPDN

SEQ ID NO: 2980449 - protein, 17 aa, Entamoeba invadens
FLLQVTVDFLVRSNDTT

SEQ ID NO: 2980450 - protein, 19 aa, Entamoeba invadens
FLLRCCSDCANALMYLSSH

SEQ ID NO: 2980451 - protein, 19 aa, Entamoeba invadens
FLLRVVLEFTMKEELINFM

SEQ ID NO: 2980452 - protein, 19 aa, Entamoeba invadens
FLLSTRAGGLGINLTSADT

SEQ ID NO: 2980453 - protein, 18 aa, Entamoeba invadens
FLLYCWSRPDLRGYLNSQ

SEQ ID NO: 2980454 - protein, 23 aa, Entamoeba invadens
FLNCPRLRFVYLSKKVRKVGKSA

SEQ ID NO: 2980455 - protein, 24 aa, Entamoeba invadens
FLNELCEAWKLLVELPWTDKQFYT

SEQ ID NO: 2980456 - protein, 17 aa, Entamoeba invadens
FLNVVWTCFSSKENELW

SEQ ID NO: 2980457 - protein, 17 aa, Entamoeba invadens
FLPEQMNIFALRNTLLG

SEQ ID NO: 2980458 - protein, 21 aa, Entamoeba invadens
FLPRRESYFWLLDALDMYKPV

SEQ ID NO: 2980459 - protein, 21 aa, Entamoeba invadens
FLQVCSLITAVFCEKYVDMLM

SEQ ID NO: 2980460 - protein, 21 aa, Entamoeba invadens
FLRKFMRQIECIVSYYMDPMV

SEQ ID NO: 2980461 - protein, 19 aa, Entamoeba invadens
FLSCLPLIITIVLQSQKYF

SEQ ID NO: 2980462 - protein, 17 aa, Entamoeba invadens
FLSLIEFEWIMLGHRFQ

SEQ ID NO: 2980463 - protein, 18 aa, Entamoeba invadens
FLSLPSFLRDLMQKVMKL

SEQ ID NO: 2980464 - protein, 18 aa, Entamoeba invadens
FLTRFKAEFDSIKNEKEE

SEQ ID NO: 2980465 - protein, 18 aa, Entamoeba invadens
FLTSRWGALVLLDEGDAL

SEQ ID NO: 2980466 - protein, 23 aa, Entamoeba invadens
FLVAIQRWLKLKIKSAMKIALLT

SEQ ID NO: 2980467 - protein, 23 aa, Entamoeba invadens
FLVCLKMIICLVGTDSLQPERIG

SEQ ID NO: 2980468 - protein, 19 aa, Entamoeba invadens
FLVDAFRYNVEYVKTQKRV

SEQ ID NO: 2980469 - protein, 25 aa, Entamoeba invadens
FLVKWKRRYCVLAPNVIALFNCAKD

SEQ ID NO: 2980470 - protein, 17 aa, Entamoeba invadens
FLWDKVRVEGGAYDGSL

SEQ ID NO: 2980471 - protein, 18 aa, Entamoeba invadens
FMEACLFAGTKINPEYIN

SEQ ID NO: 2980472 - protein, 17 aa, Entamoeba invadens
FMFCARLQIFQKHFEVY

SEQ ID NO: 2980473 - protein, 17 aa, Entamoeba invadens
FMFDGCTSLKTVDGLDN

SEQ ID NO: 2980474 - protein, 17 aa, Entamoeba invadens
FMFKSDILMYLGKLFEA

SEQ ID NO: 2980475 - protein, 25 aa, Entamoeba invadens
FMFNHWCFFCQTFVESGEQKIKKVD

SEQ ID NO: 2980476 - protein, 17 aa, Entamoeba invadens
FMLRVITYTSYFINTAS

SEQ ID NO: 2980477 - protein, 19 aa, Entamoeba invadens
FMMKRVVYDFGRIDYITSD

SEQ ID NO: 2980478 - protein, 24 aa, Entamoeba invadens
FMQRVFKCFMPFAGNLQARNWHGM

SEQ ID NO: 2980479 - protein, 17 aa, Entamoeba invadens
FMRCREFVSWGFFVDLE

SEQ ID NO: 2980480 - protein, 19 aa, Entamoeba invadens
FMREVLEGLSYLHSQNLVY

SEQ ID NO: 2980481 - protein, 22 aa, Entamoeba invadens
FMTKKLRNVRVFTKFLSNNTNE

SEQ ID NO: 2980482 - protein, 17 aa, Entamoeba invadens
FMVLKFLGFKVDKWVPL

SEQ ID NO: 2980483 - protein, 19 aa, Entamoeba invadens
FMWDWKKGKVLKCYTKAHN

SEQ ID NO: 2980484 - protein, 17 aa, Entamoeba invadens
FMYCILIVRVARIVDSG

SEQ ID NO: 2980485 - protein, 21 aa, Entamoeba invadens
FMYKHFICIMMVSKSKKKEAA

SEQ ID NO: 2980486 - protein, 20 aa, Entamoeba invadens
FNCPICYKPLPVSEIVVDRK

SEQ ID NO: 2980487 - protein, 19 aa, Entamoeba invadens
FNEFCTWLQYFVMNKTIPQ

SEQ ID NO: 2980488 - protein, 22 aa, Entamoeba invadens
FNELFFTYTICQNVNDPFMLMF

SEQ ID NO: 2980489 - protein, 18 aa, Entamoeba invadens
FNEWDALFLMKRTINEYL

SEQ ID NO: 2980490 - protein, 17 aa, Entamoeba invadens
FNFFKINVWFEVDYKMY

SEQ ID NO: 2980491 - protein, 17 aa, Entamoeba invadens
FNFFKIRIEKSFTEKCV

SEQ ID NO: 2980492 - protein, 19 aa, Entamoeba invadens
FNFILEWEFNVSFKGSHAQ

SEQ ID NO: 2980493 - protein, 19 aa, Entamoeba invadens
FNFNKLRIMYNVVMNVINY

SEQ ID NO: 2980494 - protein, 17 aa, Entamoeba invadens
FNFSWKIAEFVIFGHRL

SEQ ID NO: 2980495 - protein, 17 aa, Entamoeba invadens
FNFVCCGKFKKRVKLSL

SEQ ID NO: 2980496 - protein, 17 aa, Entamoeba invadens
FNGDEHKNFFGIFDGYS

SEQ ID NO: 2980497 - protein, 17 aa, Entamoeba invadens
FNGEWNEPFHILPNKME

SEQ ID NO: 2980498 - protein, 18 aa, Entamoeba invadens
FNHLFDFLGVCMEPISVE

SEQ ID NO: 2980499 - protein, 25 aa, Entamoeba invadens
FNLHTCKFLTGFELEELVNLFDIIV

SEQ ID NO: 2980500 - protein, 25 aa, Entamoeba invadens
FNLHTCKFLTVFELEELVSLFDTIV

SEQ ID NO: 2980501 - protein, 24 aa, Entamoeba invadens
FNLPDFFDCFSFSLPTFMEVIVNI

SEQ ID NO: 2980502 - protein, 21 aa, Entamoeba invadens
FNNEVKYVFKLLDLGVIKTEV

SEQ ID NO: 2980503 - protein, 21 aa, Entamoeba invadens
FNPRFKYGRLMTDEDFKEEMR

SEQ ID NO: 2980504 - protein, 25 aa, Entamoeba invadens
FNPVFKQPFCFNAFDYSLGEFFSQL

SEQ ID NO: 2980505 - protein, 17 aa, Entamoeba invadens
FNQIRGFDKMSEIVVLP

SEQ ID NO: 2980506 - protein, 24 aa, Entamoeba invadens
FNQLLDFRIKEFLRKLMSGKKVEV

SEQ ID NO: 2980507 - protein, 24 aa, Entamoeba invadens
FNSLWCELCGIEVCKYQQTSTPQM

SEQ ID NO: 2980508 - protein, 17 aa, Entamoeba invadens
FNTDFRMAVNFIQINKK

SEQ ID NO: 2980509 - protein, 26 aa, Entamoeba invadens
FNTMKAAELFSAFGRILHIWVDTKKQ

SEQ ID NO: 2980510 - protein, 24 aa, Entamoeba invadens
FNVDVWRKFCWVFGYLPVAALIDS

SEQ ID NO: 2980511 - protein, 25 aa, Entamoeba invadens
FNVDVWRKFCWVFGYLPVAALIDSS

SEQ ID NO: 2980512 - protein, 23 aa, Entamoeba invadens
FNVKRPDDFITFLLDFLQKTVTR

SEQ ID NO: 2980513 - protein, 17 aa, Entamoeba invadens
FPAAASFIRKEVEESKV

SEQ ID NO: 2980514 - protein, 17 aa, Entamoeba invadens
FPDIELSKKISYLYNDT

SEQ ID NO: 2980515 - protein, 19 aa, Entamoeba invadens
FPEEFEWGSIVGSTTTCTY

SEQ ID NO: 2980516 - protein, 23 aa, Entamoeba invadens
FPEIKRYALEKVLTFSMENLSDA

SEQ ID NO: 2980517 - protein, 18 aa, Entamoeba invadens
FPEIYLLDGGFKCIYEQI

SEQ ID NO: 2980518 - protein, 22 aa, Entamoeba invadens
FPERIPFRLTRMIVNAMDVSGI

SEQ ID NO: 2980519 - protein, 23 aa, Entamoeba invadens
FPERIPFRLTRMIVNAMDVSGIE

SEQ ID NO: 2980520 - protein, 20 aa, Entamoeba invadens
FPFFDGALKIAKKVPEEFYT

SEQ ID NO: 2980521 - protein, 20 aa, Entamoeba invadens
FPFGVSLWFSKYFEKAGKFE

SEQ ID NO: 2980522 - protein, 17 aa, Entamoeba invadens
FPFYFEAGIAIAKEIGD

SEQ ID NO: 2980523 - protein, 19 aa, Entamoeba invadens
FPHGGACTVVLRGSSKQLL

SEQ ID NO: 2980524 - protein, 19 aa, Entamoeba invadens
FPHKFQLIEVFPLLINEED

SEQ ID NO: 2980525 - protein, 17 aa, Entamoeba invadens
FPKEPWWKVHFGSDEGK

SEQ ID NO: 2980526 - protein, 35 aa, Entamoeba invadens
FPKFPGDTFMSAYFPGYRFKPEFTKQRALELNQFL

SEQ ID NO: 2980527 - protein, 22 aa, Entamoeba invadens
FPKRWRVGEELVLEFVSSTKVA

SEQ ID NO: 2980528 - protein, 24 aa, Entamoeba invadens
FPKTIYLRFKWFFLVSDILSPTDT

SEQ ID NO: 2980529 - protein, 21 aa, Entamoeba invadens
FPLQFKFDLKGSLYGRKADEN

SEQ ID NO: 2980530 - protein, 19 aa, Entamoeba invadens
FPNIETLYIWSRKDETFGN

SEQ ID NO: 2980531 - protein, 20 aa, Entamoeba invadens
FPNSSFLHLEWLCNFKGLYG

SEQ ID NO: 2980532 - protein, 19 aa, Entamoeba invadens
FPPEMCWTLLTIFLKKLPV

SEQ ID NO: 2980533 - protein, 18 aa, Entamoeba invadens
FPPLRALFLITTKGIPPL

SEQ ID NO: 2980534 - protein, 17 aa, Entamoeba invadens
FPRSGLLQFFLFPNRTL

SEQ ID NO: 2980535 - protein, 21 aa, Entamoeba invadens
FPRSTRFVVPFNFALLTDAEL

SEQ ID NO: 2980536 - protein, 17 aa, Entamoeba invadens
FPRSVIINFTYDNERLI

SEQ ID NO: 2980537 - protein, 20 aa, Entamoeba invadens
FPRYTEMFNIITVMKSPLYN

SEQ ID NO: 2980538 - protein, 17 aa, Entamoeba invadens
FPSCLKELVIEDLSRKP

SEQ ID NO: 2980539 - protein, 17 aa, Entamoeba invadens
FPSFLTVVPPVVTQTRN

SEQ ID NO: 2980540 - protein, 17 aa, Entamoeba invadens
FPTHTFLQVFPLEKNSE

SEQ ID NO: 2980541 - protein, 21 aa, Entamoeba invadens
FPVNIRERARFIPLRITQAER

SEQ ID NO: 2980542 - protein, 17 aa, Entamoeba invadens
FPYIWPPSIEVMEGKQM

SEQ ID NO: 2980543 - protein, 19 aa, Entamoeba invadens
FQCIQIPVLLVFATQDQYV

SEQ ID NO: 2980544 - protein, 22 aa, Entamoeba invadens
FQCLKSRMFYERFPIERKIANA

SEQ ID NO: 2980545 - protein, 17 aa, Entamoeba invadens
FQCQIAIDWSVLIDSDY

SEQ ID NO: 2980546 - protein, 17 aa, Entamoeba invadens
FQFKLVGVLIHLGSLDS

SEQ ID NO: 2980547 - protein, 25 aa, Entamoeba invadens
FQILARGCAQLSFYAKAVAANSSVV

SEQ ID NO: 2980548 - protein, 19 aa, Entamoeba invadens
FQISELFAMDLLQYVKSQY

SEQ ID NO: 2980549 - protein, 20 aa, Entamoeba invadens
FQLILRYRLFNIKFKMTDFS

SEQ ID NO: 2980550 - protein, 18 aa, Entamoeba invadens
FQNAQMCFMFLDEREQAL

SEQ ID NO: 2980551 - protein, 20 aa, Entamoeba invadens
FQNPRPWWMRRMRGHMFEPF

SEQ ID NO: 2980552 - protein, 19 aa, Entamoeba invadens
FQPQKGVPYLGRLMKELLT

SEQ ID NO: 2980553 - protein, 18 aa, Entamoeba invadens
FQPYCLTEAITPEAALQY

SEQ ID NO: 2980554 - protein, 17 aa, Entamoeba invadens
FQSFKVFFNWAKNISGF

SEQ ID NO: 2980555 - protein, 23 aa, Entamoeba invadens
FQTKIRVCIHFEISFATKLQLEK

SEQ ID NO: 2980556 - protein, 19 aa, Entamoeba invadens
FQVGSVYFIYCRQFKEKKD

SEQ ID NO: 2980557 - protein, 20 aa, Entamoeba invadens
FRASQSIIRFDLPHLDHILH

SEQ ID NO: 2980558 - protein, 18 aa, Entamoeba invadens
FRCELPFQLFKSGFKLIP

SEQ ID NO: 2980559 - protein, 19 aa, Entamoeba invadens
FREVFGWMVEKIFIELHNG

SEQ ID NO: 2980560 - protein, 22 aa, Entamoeba invadens
FRFGKIKIFFKVGVLAEIEEIR

SEQ ID NO: 2980561 - protein, 17 aa, Entamoeba invadens
FRGEALYSIAAMAEVEV

SEQ ID NO: 2980562 - protein, 18 aa, Entamoeba invadens
FRGTPRYAAPNVHLGNAP

SEQ ID NO: 2980563 - protein, 17 aa, Entamoeba invadens
FRGVEEFISRNVPRLLW

SEQ ID NO: 2980564 - protein, 19 aa, Entamoeba invadens
FRIIVWFNVDFETVDRNNS

SEQ ID NO: 2980565 - protein, 17 aa, Entamoeba invadens
FRILTGFLERNFDDYKK

SEQ ID NO: 2980566 - protein, 18 aa, Entamoeba invadens
FRIPGERKLADAMVKMIE

SEQ ID NO: 2980567 - protein, 21 aa, Entamoeba invadens
FRIRYKKIWSFIQENFTVFPK

SEQ ID NO: 2980568 - protein, 17 aa, Entamoeba invadens
FRIWKKEYLSSFTRKCP

SEQ ID NO: 2980569 - protein, 17 aa, Entamoeba invadens
FRKAMTLMFHGFFDDSS

SEQ ID NO: 2980570 - protein, 18 aa, Entamoeba invadens
FRKCCMHPNELVAMGAVD

SEQ ID NO: 2980571 - protein, 18 aa, Entamoeba invadens
FRKEVAMLAKFVSPYLIR

SEQ ID NO: 2980572 - protein, 20 aa, Entamoeba invadens
FRKHHCRNCGKVICSNCRVK

SEQ ID NO: 2980573 - protein, 23 aa, Entamoeba invadens
FRKLETQSGFCFRHESFIADHPE

SEQ ID NO: 2980574 - protein, 17 aa, Entamoeba invadens
FRKPRVASTAGHFEFDI

SEQ ID NO: 2980575 - protein, 18 aa, Entamoeba invadens
FRKPRVASTAGHFEFDII

SEQ ID NO: 2980576 - protein, 20 aa, Entamoeba invadens
FRKVWPCPTVILFNPDSFRN

SEQ ID NO: 2980577 - protein, 17 aa, Entamoeba invadens
FRLAICPHIPIEDVAEF

SEQ ID NO: 2980578 - protein, 17 aa, Entamoeba invadens
FRLCEYATICIRSASIL

SEQ ID NO: 2980579 - protein, 19 aa, Entamoeba invadens
FRLFFEEITNNFLLFSNKK

SEQ ID NO: 2980580 - protein, 21 aa, Entamoeba invadens
FRLKLGCMIHLAKFLNYDRDG

SEQ ID NO: 2980581 - protein, 17 aa, Entamoeba invadens
FRMLQKLVIKKSINEKL

SEQ ID NO: 2980582 - protein, 20 aa, Entamoeba invadens
FRNRHCILFTYDITKRETLE

SEQ ID NO: 2980583 - protein, 21 aa, Entamoeba invadens
FRPEEVTAFLVQRLLGKLEEI

SEQ ID NO: 2980584 - protein, 17 aa, Entamoeba invadens
FRPLSYPSTDIFLLCFN

SEQ ID NO: 2980585 - protein, 20 aa, Entamoeba invadens
FRPNTLFCLSKFKPPLSPRP

SEQ ID NO: 2980586 - protein, 20 aa, Entamoeba invadens
FRPPVGYTWQFPAGLIDDGE

SEQ ID NO: 2980587 - protein, 19 aa, Entamoeba invadens
FRQAMQWLLHEAERTTARQ

SEQ ID NO: 2980588 - protein, 17 aa, Entamoeba invadens
FRQPLLFKIINEEKAGR

SEQ ID NO: 2980589 - protein, 20 aa, Entamoeba invadens
FRTMFFYKLIQQVVSVYTGK

SEQ ID NO: 2980590 - protein, 17 aa, Entamoeba invadens
FRTMMMVRYNKCLVNPG

SEQ ID NO: 2980591 - protein, 17 aa, Entamoeba invadens
FRTSEEIHFIDYFEKIP

SEQ ID NO: 2980592 - protein, 17 aa, Entamoeba invadens
FRVIFCVINGGKIQDFL

SEQ ID NO: 2980593 - protein, 21 aa, Entamoeba invadens
FRVKGCLIVLIGNGPFKNALF

SEQ ID NO: 2980594 - protein, 19 aa, Entamoeba invadens
FRVPVYVCTGTFKISPIFP

SEQ ID NO: 2980595 - protein, 17 aa, Entamoeba invadens
FRVSPVFEWLKRVKEQL

SEQ ID NO: 2980596 - protein, 18 aa, Entamoeba invadens
FRVYCYKAKNSFLNSKKV

SEQ ID NO: 2980597 - protein, 19 aa, Entamoeba invadens
FRWINCCLLREFSLKSAVR

SEQ ID NO: 2980598 - protein, 18 aa, Entamoeba invadens
FRYAPLISRVLGFIERVC

SEQ ID NO: 2980599 - protein, 19 aa, Entamoeba invadens
FRYAPLVVRSLMFLCRVIW

SEQ ID NO: 2980600 - protein, 17 aa, Entamoeba invadens
FRYERPFKIIFGGKLQI

SEQ ID NO: 2980601 - protein, 17 aa, Entamoeba invadens
FRYEVIQDFLYRSLKNS

SEQ ID NO: 2980602 - protein, 20 aa, Entamoeba invadens
FRYPWEVVNFITGGRRLDKP

SEQ ID NO: 2980603 - protein, 17 aa, Entamoeba invadens
FSAAVLWAGFSSSLPIM

SEQ ID NO: 2980604 - protein, 17 aa, Entamoeba invadens
FSALNYHKSFCSFCPHK

SEQ ID NO: 2980605 - protein, 24 aa, Entamoeba invadens
FSAYRIDHILGFFRIWSIPAGHRT

SEQ ID NO: 2980606 - protein, 25 aa, Entamoeba invadens
FSDCDWSVFQICKWLNLLVEHKRYV

SEQ ID NO: 2980607 - protein, 21 aa, Entamoeba invadens
FSDECIFKLLSYVSEHKNQEM

SEQ ID NO: 2980608 - protein, 24 aa, Entamoeba invadens
FSDEIRKGVQFVFGNAILCNTAEE

SEQ ID NO: 2980609 - protein, 25 aa, Entamoeba invadens
FSDEQLKFFFLYLITRLEPISNTNF

SEQ ID NO: 2980610 - protein, 17 aa, Entamoeba invadens
FSEFLAIHVDPKILENI

SEQ ID NO: 2980611 - protein, 17 aa, Entamoeba invadens
FSFDNVRLFIGYIQMLQ

SEQ ID NO: 2980612 - protein, 18 aa, Entamoeba invadens
FSFFLVDFCDLRSAQTSL

SEQ ID NO: 2980613 - protein, 21 aa, Entamoeba invadens
FSFGGSDAFDIFNMMFGGGSG

SEQ ID NO: 2980614 - protein, 17 aa, Entamoeba invadens
FSGEYFFSLPFPYCVIS

SEQ ID NO: 2980615 - protein, 18 aa, Entamoeba invadens
FSGLCFCRSSIERASKVQ

SEQ ID NO: 2980616 - protein, 20 aa, Entamoeba invadens
FSGVKWIFWDVCGQQKFRNL

SEQ ID NO: 2980617 - protein, 17 aa, Entamoeba invadens
FSHKIFPRSPKKGHSYV

SEQ ID NO: 2980618 - protein, 18 aa, Entamoeba invadens
FSIKEICILTDLTKDVVI

SEQ ID NO: 2980619 - protein, 18 aa, Entamoeba invadens
FSIPSVVLNSDFPRDIRT

SEQ ID NO: 2980620 - protein, 20 aa, Entamoeba invadens
FSIPVARNFFKQLLSGVKYC

SEQ ID NO: 2980621 - protein, 23 aa, Entamoeba invadens
FSKECVINAFKLIALYASGNEKI

SEQ ID NO: 2980622 - protein, 18 aa, Entamoeba invadens
FSKFFVCAHWNDFVKEKY

SEQ ID NO: 2980623 - protein, 18 aa, Entamoeba invadens
FSLFELCYYYDDDLKKCA

SEQ ID NO: 2980624 - protein, 20 aa, Entamoeba invadens
FSLLCCALLFDGVRKNYLRV

SEQ ID NO: 2980625 - protein, 23 aa, Entamoeba invadens
FSLLRFTVIFAEQFFVTIDPKNL

SEQ ID NO: 2980626 - protein, 23 aa, Entamoeba invadens
FSLSCSPSFFIKYLRAFDKEVRR

SEQ ID NO: 2980627 - protein, 17 aa, Entamoeba invadens
FSNKKLWAFPNMEKEDE

SEQ ID NO: 2980628 - protein, 20 aa, Entamoeba invadens
FSNKNRVVFVFGSNAAGHFG

SEQ ID NO: 2980629 - protein, 17 aa, Entamoeba invadens
FSQEVPNSFYLVKANVE

SEQ ID NO: 2980630 - protein, 18 aa, Entamoeba invadens
FSQVGGCDFGYVVDFQPS

SEQ ID NO: 2980631 - protein, 19 aa, Entamoeba invadens
FSRCFPLEVELKILDLILM

SEQ ID NO: 2980632 - protein, 20 aa, Entamoeba invadens
FSRKCKVCAIGFYPDETSGK

SEQ ID NO: 2980633 - protein, 17 aa, Entamoeba invadens
FSRMFFYIRDLMKYLQT

SEQ ID NO: 2980634 - protein, 17 aa, Entamoeba invadens
FSSGVFRNVSTLAACDE

SEQ ID NO: 2980635 - protein, 19 aa, Entamoeba invadens
FSSNCTLILLSLPYDVKNS

SEQ ID NO: 2980636 - protein, 17 aa, Entamoeba invadens
FSTDLLKTWTVFDDILP

SEQ ID NO: 2980637 - protein, 18 aa, Entamoeba invadens
FSTIDAWLLLSVPGKFHG

SEQ ID NO: 2980638 - protein, 19 aa, Entamoeba invadens
FSTPQKWQIVDNIFSSEPR

SEQ ID NO: 2980639 - protein, 19 aa, Entamoeba invadens
FSTRFFCLHWFITKCHSFM

SEQ ID NO: 2980640 - protein, 17 aa, Entamoeba invadens
FSTSIRVLYGFRKVWPC

SEQ ID NO: 2980641 - protein, 20 aa, Entamoeba invadens
FSTSMTLRFTVGATNGPSRP

SEQ ID NO: 2980642 - protein, 20 aa, Entamoeba invadens
FSVCFRWIVLLFKREFRREE

SEQ ID NO: 2980643 - protein, 19 aa, Entamoeba invadens
FSVCGGAFWIGKKNAAVRG

SEQ ID NO: 2980644 - protein, 23 aa, Entamoeba invadens
FSVFKCFPERCVPSLDTMTEYLL

SEQ ID NO: 2980645 - protein, 18 aa, Entamoeba invadens
FSVVCPKELVEVNNKFEM

SEQ ID NO: 2980646 - protein, 17 aa, Entamoeba invadens
FSVYGIEHMRLKERFKR

SEQ ID NO: 2980647 - protein, 23 aa, Entamoeba invadens
FSWNSWNGWIPNWVVNKCSKYMI

SEQ ID NO: 2980648 - protein, 20 aa, Entamoeba invadens
FSYFCMCVRDKIANFVREIF

SEQ ID NO: 2980649 - protein, 24 aa, Entamoeba invadens
FTARKCILCSLIGKNLFRELKYFQ

SEQ ID NO: 2980650 - protein, 18 aa, Entamoeba invadens
FTCFSAFWIKTNQMVSIN

SEQ ID NO: 2980651 - protein, 26 aa, Entamoeba invadens
FTDCEGFIACLMKLYNDTEIDSLLCK

SEQ ID NO: 2980652 - protein, 17 aa, Entamoeba invadens
FTDFVAWNECVEIISYH

SEQ ID NO: 2980653 - protein, 22 aa, Entamoeba invadens
FTEYCVLCYILALSKAEDLNNR

SEQ ID NO: 2980654 - protein, 19 aa, Entamoeba invadens
FTFCRRIFVNLGQKTDQYC

SEQ ID NO: 2980655 - protein, 17 aa, Entamoeba invadens
FTGCIGITGVFLNKVAK

SEQ ID NO: 2980656 - protein, 22 aa, Entamoeba invadens
FTIEIYASLLFNVKKDFVVTLT

SEQ ID NO: 2980657 - protein, 20 aa, Entamoeba invadens
FTKMELTGNFALNLKVLVIY

SEQ ID NO: 2980658 - protein, 23 aa, Entamoeba invadens
FTLHKNAICAISLLKARSGIDSM

SEQ ID NO: 2980659 - protein, 21 aa, Entamoeba invadens
FTLLVPRRFYIGGEIMTYNKK

SEQ ID NO: 2980660 - protein, 23 aa, Entamoeba invadens
FTLSVCLKDFFDLRGIQFSFSSF

SEQ ID NO: 2980661 - protein, 22 aa, Entamoeba invadens
FTMRIKEWYSWHFPELYNILSH

SEQ ID NO: 2980662 - protein, 29 aa, Entamoeba invadens
FTPRPLEGVFRCCAEAKALPWYNKLIGGM

SEQ ID NO: 2980663 - protein, 22 aa, Entamoeba invadens
FTRKCLVCLDGFYLDATNHTCE

SEQ ID NO: 2980664 - protein, 17 aa, Entamoeba invadens
FTSRSKLRWVEFEYCLK

SEQ ID NO: 2980665 - protein, 24 aa, Entamoeba invadens
FTTTCPYFNCLFALLSQLSEIGYR

SEQ ID NO: 2980666 - protein, 21 aa, Entamoeba invadens
FTVAPKNVWKFVLATNIAETS

SEQ ID NO: 2980667 - protein, 18 aa, Entamoeba invadens
FTVKKCELLFAMLYARFV

SEQ ID NO: 2980668 - protein, 21 aa, Entamoeba invadens
FTVNLRLLLSLTDKTALPKSL

SEQ ID NO: 2980669 - protein, 23 aa, Entamoeba invadens
FTYNRYKFGVLYAAPGQTKEMEF

SEQ ID NO: 2980670 - protein, 23 aa, Entamoeba invadens
FTYQRYKFGVLYGSPGQTKEMDF

SEQ ID NO: 2980671 - protein, 19 aa, Entamoeba invadens
FVATLWLKSIFELHLSYLM

SEQ ID NO: 2980672 - protein, 17 aa, Entamoeba invadens
FVCCGGVYVIENMNTPP

SEQ ID NO: 2980673 - protein, 17 aa, Entamoeba invadens
FVCCGKFKKRVKLSLTM

SEQ ID NO: 2980674 - protein, 21 aa, Entamoeba invadens
FVCHRCRESALALRKNPLYPT

SEQ ID NO: 2980675 - protein, 17 aa, Entamoeba invadens
FVCKEGWFEYATHKDAK

SEQ ID NO: 2980676 - protein, 20 aa, Entamoeba invadens
FVDIIELCFVSKRFHMMITK

SEQ ID NO: 2980677 - protein, 17 aa, Entamoeba invadens
FVDMCYICSNIVAYQPT

SEQ ID NO: 2980678 - protein, 20 aa, Entamoeba invadens
FVDNRYLIWAGFTTDKHKTK

SEQ ID NO: 2980679 - protein, 20 aa, Entamoeba invadens
FVDVFPCDFIVFSVYFSDGG

SEQ ID NO: 2980680 - protein, 18 aa, Entamoeba invadens
FVDYLFLAMVIYIREPIL

SEQ ID NO: 2980681 - protein, 18 aa, Entamoeba invadens
FVECPFWLPPEVISNRKW

SEQ ID NO: 2980682 - protein, 22 aa, Entamoeba invadens
FVEKCLPCGTLIVTEDNAISTL

SEQ ID NO: 2980683 - protein, 18 aa, Entamoeba invadens
FVFFPRLNTLTGNLNLIC

SEQ ID NO: 2980684 - protein, 19 aa, Entamoeba invadens
FVFQICLEISRLLEYNKVR

SEQ ID NO: 2980685 - protein, 24 aa, Entamoeba invadens
FVFVWKWFIKDGCYYLILESVNST

SEQ ID NO: 2980686 - protein, 17 aa, Entamoeba invadens
FVGKTCFFKRFSVGQFE

SEQ ID NO: 2980687 - protein, 18 aa, Entamoeba invadens
FVGSFAFKNCEQLDELNF

SEQ ID NO: 2980688 - protein, 18 aa, Entamoeba invadens
FVIECVGGMIVTDVNDEQ

SEQ ID NO: 2980689 - protein, 17 aa, Entamoeba invadens
FVIIITHADVFLKKFLN

SEQ ID NO: 2980690 - protein, 17 aa, Entamoeba invadens
FVILPYKLKVRMLFDTA

SEQ ID NO: 2980691 - protein, 18 aa, Entamoeba invadens
FVKPHGAFYFFPKIEEGN

SEQ ID NO: 2980692 - protein, 18 aa, Entamoeba invadens
FVLCRKCENPETVMIVKN

SEQ ID NO: 2980693 - protein, 17 aa, Entamoeba invadens
FVLEFNQLYALNSTELF

SEQ ID NO: 2980694 - protein, 19 aa, Entamoeba invadens
FVLSCLGFFAIKQTGCKIN

SEQ ID NO: 2980695 - protein, 18 aa, Entamoeba invadens
FVMVCGYPPFSDGDDGGN

SEQ ID NO: 2980696 - protein, 18 aa, Entamoeba invadens
FVNCQLLKKFVCKNIKKC

SEQ ID NO: 2980697 - protein, 19 aa, Entamoeba invadens
FVNKVPFFLARKVVKNPKM

SEQ ID NO: 2980698 - protein, 17 aa, Entamoeba invadens
FVPAYGGRIKRGIYGFS

SEQ ID NO: 2980699 - protein, 17 aa, Entamoeba invadens
FVPQLPSCVARKGVDST

SEQ ID NO: 2980700 - protein, 22 aa, Entamoeba invadens
FVPVQCLPSFFSVENNISNTFG

SEQ ID NO: 2980701 - protein, 23 aa, Entamoeba invadens
FVPVQCLPSFFSVENNISNTFGR

SEQ ID NO: 2980702 - protein, 22 aa, Entamoeba invadens
FVPVQCLPSFFSVENNVSNTFG

SEQ ID NO: 2980703 - protein, 23 aa, Entamoeba invadens
FVPVQCLPSFFSVENNVSNTFGK

SEQ ID NO: 2980704 - protein, 18 aa, Entamoeba invadens
FVPYIKEIVMRMSNNDVP

SEQ ID NO: 2980705 - protein, 17 aa, Entamoeba invadens
FVPYKIVYTDGFLFFYK

SEQ ID NO: 2980706 - protein, 18 aa, Entamoeba invadens
FVQVASWIGKKNCVKLAK

SEQ ID NO: 2980707 - protein, 21 aa, Entamoeba invadens
FVREIFCVIMTKFAFLYSDFG

SEQ ID NO: 2980708 - protein, 19 aa, Entamoeba invadens
FVRNRFYSFIGHCQEQPTT

SEQ ID NO: 2980709 - protein, 24 aa, Entamoeba invadens
FVSKNCRDAVEMLYRNPCTTVDTP

SEQ ID NO: 2980710 - protein, 20 aa, Entamoeba invadens
FVSRLFLFVKALLFIPDEAL

SEQ ID NO: 2980711 - protein, 24 aa, Entamoeba invadens
FVSSLEVFYTLCLVEYLVVNVNHF

SEQ ID NO: 2980712 - protein, 19 aa, Entamoeba invadens
FVTKLFKILGFQKEEREHI

SEQ ID NO: 2980713 - protein, 19 aa, Entamoeba invadens
FVTKRCEAVVGFYLTNARK

SEQ ID NO: 2980714 - protein, 22 aa, Entamoeba invadens
FVTPLCCYECLLSLKCLENATC

SEQ ID NO: 2980715 - protein, 18 aa, Entamoeba invadens
FVTRIGIRSFEYCVSLKT

SEQ ID NO: 2980716 - protein, 17 aa, Entamoeba invadens
FVVCLPLVTPNVIQTRI

SEQ ID NO: 2980717 - protein, 23 aa, Entamoeba invadens
FVVLFFKHYVAIPFIKFAPFKTA

SEQ ID NO: 2980718 - protein, 17 aa, Entamoeba invadens
FVVPWMVVLFKRDFNRE

SEQ ID NO: 2980719 - protein, 17 aa, Entamoeba invadens
FVYKYGMLCNIMLSDPE

SEQ ID NO: 2980720 - protein, 19 aa, Entamoeba invadens
FWDKITFKFEVEIIGKIKL

SEQ ID NO: 2980721 - protein, 17 aa, Entamoeba invadens
FWFEVTFIKKCFCIYHH

SEQ ID NO: 2980722 - protein, 17 aa, Entamoeba invadens
FWLAFFFKYATVGEGEE

SEQ ID NO: 2980723 - protein, 19 aa, Entamoeba invadens
FWLNYVIKAYGDSMEKEAN

SEQ ID NO: 2980724 - protein, 19 aa, Entamoeba invadens
FWMAYCPMIPKSEKLTQIV

SEQ ID NO: 2980725 - protein, 17 aa, Entamoeba invadens
FWMCCDCGSGMVINLQM

SEQ ID NO: 2980726 - protein, 17 aa, Entamoeba invadens
FYAQERPIFIGGVPLVM

SEQ ID NO: 2980727 - protein, 21 aa, Entamoeba invadens
FYCKKCLNFVCLKCFDSTNGC

SEQ ID NO: 2980728 - protein, 18 aa, Entamoeba invadens
FYDAIRFVLCDEKFGNLR

SEQ ID NO: 2980729 - protein, 18 aa, Entamoeba invadens
FYFPEKFVFLKGGRPIHP

SEQ ID NO: 2980730 - protein, 18 aa, Entamoeba invadens
FYFVRRLDEILPMTNDRV

SEQ ID NO: 2980731 - protein, 19 aa, Entamoeba invadens
FYGCEMLDAIDFLKYVKKV

SEQ ID NO: 2980732 - protein, 18 aa, Entamoeba invadens
FYHRELFENLPLKDFYFC

SEQ ID NO: 2980733 - protein, 24 aa, Entamoeba invadens
FYIIYCLRKGLPVTSMITIMNIIG

SEQ ID NO: 2980734 - protein, 20 aa, Entamoeba invadens
FYKKRSGVYCKQRSIRMVYD

SEQ ID NO: 2980735 - protein, 28 aa, Entamoeba invadens
FYKNKTAKCPFHWMDVYKCIDDVDLALL

SEQ ID NO: 2980736 - protein, 17 aa, Entamoeba invadens
FYKTVVWFRVHYEDTLD

SEQ ID NO: 2980737 - protein, 20 aa, Entamoeba invadens
FYKWISCAKFEVLYDSERPI

SEQ ID NO: 2980738 - protein, 20 aa, Entamoeba invadens
FYLKGSFKFFGYLEIEIKNG

SEQ ID NO: 2980739 - protein, 23 aa, Entamoeba invadens
FYLKRPGKTFCVWPSNHQMMVFG

SEQ ID NO: 2980740 - protein, 17 aa, Entamoeba invadens
FYLNSMIEPVVPFNQSR

SEQ ID NO: 2980741 - protein, 19 aa, Entamoeba invadens
FYLREVRMLSSLKREPNIA

SEQ ID NO: 2980742 - protein, 17 aa, Entamoeba invadens
FYLTGAFYFALLYSGSN

SEQ ID NO: 2980743 - protein, 18 aa, Entamoeba invadens
FYMKCFTENFILQKVDKK

SEQ ID NO: 2980744 - protein, 19 aa, Entamoeba invadens
FYPEYPINFQPKYVQTSLF

SEQ ID NO: 2980745 - protein, 18 aa, Entamoeba invadens
FYPLWKFEVIYMAHNSTF

SEQ ID NO: 2980746 - protein, 18 aa, Entamoeba invadens
FYPSILFHVVMKKKLGEV

SEQ ID NO: 2980747 - protein, 19 aa, Entamoeba invadens
FYRAPEICIGYPYTSAIDM

SEQ ID NO: 2980748 - protein, 20 aa, Entamoeba invadens
FYRIIVWFTVDFETVYINKS

SEQ ID NO: 2980749 - protein, 18 aa, Entamoeba invadens
FYRIIVWYCVDFETVNRN

SEQ ID NO: 2980750 - protein, 22 aa, Entamoeba invadens
FYRSVFSEHRFKQILRVIRFDK

SEQ ID NO: 2980751 - protein, 17 aa, Entamoeba invadens
FYSSYLLIVTPMRILLI

SEQ ID NO: 2980752 - protein, 18 aa, Entamoeba invadens
FYTVLLLSFETFKTHKIF

SEQ ID NO: 2980753 - protein, 20 aa, Entamoeba invadens
FYVKECVLMGKKLHYEIDMI

SEQ ID NO: 2980754 - protein, 21 aa, Entamoeba invadens
FYVKGDAFILVYSIDNLNSFH

SEQ ID NO: 2980755 - protein, 20 aa, Entamoeba invadens
FYYFGWNSWNGWIPAWCVNK

SEQ ID NO: 2980756 - protein, 19 aa, Entamoeba invadens
GAAKCPLWDVGIMLSEVVC

SEQ ID NO: 2980757 - protein, 18 aa, Entamoeba invadens
GAAVDWWSLGILIYEMIV

SEQ ID NO: 2980758 - protein, 21 aa, Entamoeba invadens
GAEKRVLFLLSDCLLLTKRED

SEQ ID NO: 2980759 - protein, 22 aa, Entamoeba invadens
GAFLAYSVGYDWVKGVEGTLPP

SEQ ID NO: 2980760 - protein, 20 aa, Entamoeba invadens
GAKHPVCLYVSGSNTQVIAF

SEQ ID NO: 2980761 - protein, 24 aa, Entamoeba invadens
GAKRPVSWILICRVIIYSLMELHK

SEQ ID NO: 2980762 - protein, 23 aa, Entamoeba invadens
GAKRPVSWIMICRVILYSLMEIH

SEQ ID NO: 2980763 - protein, 22 aa, Entamoeba invadens
GAKSVYLYSLFLARVAAGLVCE

SEQ ID NO: 2980764 - protein, 19 aa, Entamoeba invadens
GAMKVMFPKTLGKVSKRKG

SEQ ID NO: 2980765 - protein, 17 aa, Entamoeba invadens
GANCYRDTANLVEIIIP

SEQ ID NO: 2980766 - protein, 22 aa, Entamoeba invadens
GAPAAAICRVHFPFYDHKIDSS

SEQ ID NO: 2980767 - protein, 23 aa, Entamoeba invadens
GAPAAAICRVHFPFYDSKIDPQQ

SEQ ID NO: 2980768 - protein, 18 aa, Entamoeba invadens
GAPLPFNFVNSLPKPNRN

SEQ ID NO: 2980769 - protein, 19 aa, Entamoeba invadens
GAQAKCISCVRLLFEDSYI

SEQ ID NO: 2980770 - protein, 20 aa, Entamoeba invadens
GARLKIIWDRAFEKMDFKSI

SEQ ID NO: 2980771 - protein, 20 aa, Entamoeba invadens
GAVDCLRQIVSLFITKKEEN

SEQ ID NO: 2980772 - protein, 19 aa, Entamoeba invadens
GAYFARALTDIGIDTTYIL

SEQ ID NO: 2980773 - protein, 17 aa, Entamoeba invadens
GAYKMCIGRIVDIVVSK

SEQ ID NO: 2980774 - protein, 17 aa, Entamoeba invadens
GCCRGCINLTSVTIPLS

SEQ ID NO: 2980775 - protein, 20 aa, Entamoeba invadens
GCDRCMKKALTMNKIVVDDE

SEQ ID NO: 2980776 - protein, 17 aa, Entamoeba invadens
GCFEVCSRLSSVDIPPS

SEQ ID NO: 2980777 - protein, 19 aa, Entamoeba invadens
GCFKGCLSLDVVVPNTIIT

SEQ ID NO: 2980778 - protein, 18 aa, Entamoeba invadens
GCFQRCKFLMKSRIFIKG

SEQ ID NO: 2980779 - protein, 19 aa, Entamoeba invadens
GCFYGCRLLSSIKLPHNFS

SEQ ID NO: 2980780 - protein, 22 aa, Entamoeba invadens
GCKLREFLNVVAQFCYSYVDHV

SEQ ID NO: 2980781 - protein, 19 aa, Entamoeba invadens
GCLIYKCLMLETPFEESPM

SEQ ID NO: 2980782 - protein, 24 aa, Entamoeba invadens
GCRGFGVNVARTFLQQILQTLIVL

SEQ ID NO: 2980783 - protein, 18 aa, Entamoeba invadens
GCSCVFGKRKRKNFCKKC

SEQ ID NO: 2980784 - protein, 19 aa, Entamoeba invadens
GCSMPWITRFCSMPGHEYF

SEQ ID NO: 2980785 - protein, 20 aa, Entamoeba invadens
GCSRSRIYPSIGFAEGVEMC

SEQ ID NO: 2980786 - protein, 18 aa, Entamoeba invadens
GCTSLTCLVVPKINGIIK

SEQ ID NO: 2980787 - protein, 19 aa, Entamoeba invadens
GCTSLTCLVVPKINGIIKN

SEQ ID NO: 2980788 - protein, 22 aa, Entamoeba invadens
GCVFFKNKSRAFGFFFDTNKKK

SEQ ID NO: 2980789 - protein, 20 aa, Entamoeba invadens
GDANGIFRIWDLRTKKTTKA

SEQ ID NO: 2980790 - protein, 18 aa, Entamoeba invadens
GDDLRDITGFFVDNKGII

SEQ ID NO: 2980791 - protein, 20 aa, Entamoeba invadens
GDEFKFPWSIANFVASGKRL

SEQ ID NO: 2980792 - protein, 23 aa, Entamoeba invadens
GDEKSKMCPFGFCNISLEKFEKL

SEQ ID NO: 2980793 - protein, 18 aa, Entamoeba invadens
GDFACKVPSIAVRNIVGH

SEQ ID NO: 2980794 - protein, 17 aa, Entamoeba invadens
GDFFLFYKTHEIFDKSV

SEQ ID NO: 2980795 - protein, 23 aa, Entamoeba invadens
GDFKGEILISLSTFCYLLPQTEQ

SEQ ID NO: 2980796 - protein, 17 aa, Entamoeba invadens
GDGCFRKCVSLNSIELP

SEQ ID NO: 2980797 - protein, 17 aa, Entamoeba invadens
GDIAMRAPMNWSLTKNY

SEQ ID NO: 2980798 - protein, 21 aa, Entamoeba invadens
GDICRRMSNEAAWVIASSIRD

SEQ ID NO: 2980799 - protein, 25 aa, Entamoeba invadens
GDKKRLRVGYTLNFIFEENEWFPDI

SEQ ID NO: 2980800 - protein, 18 aa, Entamoeba invadens
GDKMIGVAFVQRNGQIQT

SEQ ID NO: 2980801 - protein, 17 aa, Entamoeba invadens
GDLELVLLLMKYGANKS

SEQ ID NO: 2980802 - protein, 19 aa, Entamoeba invadens
GDLPRLLNHLSIVREVSEG

SEQ ID NO: 2980803 - protein, 23 aa, Entamoeba invadens
GDMKEGCSFGWYKADQIFERMAV

SEQ ID NO: 2980804 - protein, 22 aa, Entamoeba invadens
GDMRLKFIIQMCACALNGRDMI

SEQ ID NO: 2980805 - protein, 28 aa, Entamoeba invadens
GDNRLCFNCGRTGTAFIVTDFNIFVCTS

SEQ ID NO: 2980806 - protein, 17 aa, Entamoeba invadens
GDNRTKILLSYRGSAWF

SEQ ID NO: 2980807 - protein, 19 aa, Entamoeba invadens
GDNWAMKKANGFCKTFKGE

SEQ ID NO: 2980808 - protein, 19 aa, Entamoeba invadens
GDPCYRLKDSISMLHRVLK

SEQ ID NO: 2980809 - protein, 19 aa, Entamoeba invadens
GDPITCKYCQSILSYLDTV

SEQ ID NO: 2980810 - protein, 20 aa, Entamoeba invadens
GDPLEHLIWLHAWKYSIEGK

SEQ ID NO: 2980811 - protein, 19 aa, Entamoeba invadens
GDQEIFCVFVLLVQGKRVY

SEQ ID NO: 2980812 - protein, 18 aa, Entamoeba invadens
GDQVIFCVFVRLVKGKPV

SEQ ID NO: 2980813 - protein, 19 aa, Entamoeba invadens
GDRAIEISKAFTLPNEQFK

SEQ ID NO: 2980814 - protein, 22 aa, Entamoeba invadens
GDRRSGFGGGRFGGDRNNGDRN

SEQ ID NO: 2980815 - protein, 19 aa, Entamoeba invadens
GDSALNCLCNASLNIEALE

SEQ ID NO: 2980816 - protein, 25 aa, Entamoeba invadens
GDSMKRVFSSFAFKLFAQDFNMFIG

SEQ ID NO: 2980817 - protein, 21 aa, Entamoeba invadens
GDTHYLLYICDLMRNECLEQN

SEQ ID NO: 2980818 - protein, 21 aa, Entamoeba invadens
GDVRYAINVLQTFCKCGMSIG

SEQ ID NO: 2980819 - protein, 18 aa, Entamoeba invadens
GEACEFEILLTLKCITKM

SEQ ID NO: 2980820 - protein, 18 aa, Entamoeba invadens
GEACELEILLTLKCTTKM

SEQ ID NO: 2980821 - protein, 18 aa, Entamoeba invadens
GECKFTFKTLQELNVKKA

SEQ ID NO: 2980822 - protein, 20 aa, Entamoeba invadens
GECYPVIGGSVFADVDKNGK

SEQ ID NO: 2980823 - protein, 17 aa, Entamoeba invadens
GEDCIRGKFGITGGVNC

SEQ ID NO: 2980824 - protein, 18 aa, Entamoeba invadens
GEEFPSFLTVVPPVVTQT

SEQ ID NO: 2980825 - protein, 24 aa, Entamoeba invadens
GEFAHKAGEVFKDFEDIKKEIENE

SEQ ID NO: 2980826 - protein, 20 aa, Entamoeba invadens
GEFWKGCKASIIPDVTDAIQ

SEQ ID NO: 2980827 - protein, 20 aa, Entamoeba invadens
GEGWRPLYQRTFTTFAKLWK

SEQ ID NO: 2980828 - protein, 20 aa, Entamoeba invadens
GEIKKGLLLYFGINEADDEK

SEQ ID NO: 2980829 - protein, 19 aa, Entamoeba invadens
GEILRVFCGITLYKNKKIE

SEQ ID NO: 2980830 - protein, 18 aa, Entamoeba invadens
GEILYNFVMHHIGETWTS

SEQ ID NO: 2980831 - protein, 19 aa, Entamoeba invadens
GEIVMKMRIKLMLDTAKGI

SEQ ID NO: 2980832 - protein, 23 aa, Entamoeba invadens
GELEVFSGLPLFSVFDRDAYVKW

SEQ ID NO: 2980833 - protein, 17 aa, Entamoeba invadens
GELFPEFLPAIFEMIHT

SEQ ID NO: 2980834 - protein, 21 aa, Entamoeba invadens
GELFPEHTCPYVFVYQSNFSS

SEQ ID NO: 2980835 - protein, 19 aa, Entamoeba invadens
GELFTVWFNSWFVKDNTLV

SEQ ID NO: 2980836 - protein, 19 aa, Entamoeba invadens
GELLIKFNPTFKVNLMDVF

SEQ ID NO: 2980837 - protein, 19 aa, Entamoeba invadens
GELYFIGIIDILMDYTTRK

SEQ ID NO: 2980838 - protein, 22 aa, Entamoeba invadens
GEMYLDCLLRDIRLMFGEFEMR

SEQ ID NO: 2980839 - protein, 23 aa, Entamoeba invadens
GENYCPGHLLVLHLPTLSHLEAY

SEQ ID NO: 2980840 - protein, 21 aa, Entamoeba invadens
GESCFKLCISLSVINIPDGVN

SEQ ID NO: 2980841 - protein, 25 aa, Entamoeba invadens
GESTTRKFMCCGPMYWIPNLQEPPK

SEQ ID NO: 2980842 - protein, 22 aa, Entamoeba invadens
GETLDAFAFRYIEIYTSPYTKQ

SEQ ID NO: 2980843 - protein, 20 aa, Entamoeba invadens
GEVIYYWCIFQNKGKEAKNG

SEQ ID NO: 2980844 - protein, 17 aa, Entamoeba invadens
GEVLEFIYANDFDDEYK

SEQ ID NO: 2980845 - protein, 18 aa, Entamoeba invadens
GEVLMRFMWEGDAPSTQP

SEQ ID NO: 2980846 - protein, 18 aa, Entamoeba invadens
GEVMGCGYLADKKMIFFT

SEQ ID NO: 2980847 - protein, 20 aa, Entamoeba invadens
GEYFFSLPFPYCVISTAEQS

SEQ ID NO: 2980848 - protein, 19 aa, Entamoeba invadens
GEYLFKTNLDFTYNLLRGI

SEQ ID NO: 2980849 - protein, 20 aa, Entamoeba invadens
GEYRWAATVLNHLVFADVNN

SEQ ID NO: 2980850 - protein, 20 aa, Entamoeba invadens
GEYRWAATVLNHLVFANYKN

SEQ ID NO: 2980851 - protein, 21 aa, Entamoeba invadens
GEYRWAATVLNHLVFFNYNNE

SEQ ID NO: 2980852 - protein, 21 aa, Entamoeba invadens
GEYRWASTILNYVVFADKTNQ

SEQ ID NO: 2980853 - protein, 17 aa, Entamoeba invadens
GFASGFNFRLLNTLPSL

SEQ ID NO: 2980854 - protein, 19 aa, Entamoeba invadens
GFDLIKTVWVEKQYVGQSV

SEQ ID NO: 2980855 - protein, 23 aa, Entamoeba invadens
GFEELRLEFCRLMVKYYSHEMNY

SEQ ID NO: 2980856 - protein, 23 aa, Entamoeba invadens
GFEKFAFVKLVFKLRIPPSQVDG

SEQ ID NO: 2980857 - protein, 17 aa, Entamoeba invadens
GFFRVNFNVPRETEEGT

SEQ ID NO: 2980858 - protein, 30 aa, Entamoeba invadens
GFFTKWCELCGAQICKKCSLVGEIYDTRSK

SEQ ID NO: 2980859 - protein, 19 aa, Entamoeba invadens
GFGGFGVLVVHFWALGKGG

SEQ ID NO: 2980860 - protein, 19 aa, Entamoeba invadens
GFGQPGGWSYVIGIYLDDN

SEQ ID NO: 2980861 - protein, 19 aa, Entamoeba invadens
GFHGFPYNFNRSVAKQLLH

SEQ ID NO: 2980862 - protein, 25 aa, Entamoeba invadens
GFHKLECRNGLCFSHDFFVKSQPLL

SEQ ID NO: 2980863 - protein, 18 aa, Entamoeba invadens
GFIAFNIGFLLPRDEEIN

SEQ ID NO: 2980864 - protein, 17 aa, Entamoeba invadens
GFIKKVYVCTGVANVEL

SEQ ID NO: 2980865 - protein, 28 aa, Entamoeba invadens
GFISYLLCCPRLEEWTDYSIAVVTILDD

SEQ ID NO: 2980866 - protein, 24 aa, Entamoeba invadens
GFLKRLQKAMPIFVMETTAEITLD

SEQ ID NO: 2980867 - protein, 23 aa, Entamoeba invadens
GFSTLNMFCCLSLLERYKATLLT

SEQ ID NO: 2980868 - protein, 18 aa, Entamoeba invadens
GFSYLRTLMRAVSELTHG

SEQ ID NO: 2980869 - protein, 17 aa, Entamoeba invadens
GFTEFIIFFALSMILTV

SEQ ID NO: 2980870 - protein, 19 aa, Entamoeba invadens
GFYPVGFTDFVAWNECVEI

SEQ ID NO: 2980871 - protein, 18 aa, Entamoeba invadens
GFYSWFFRVDKRALYSVL

SEQ ID NO: 2980872 - protein, 19 aa, Entamoeba invadens
GGCFWCMVKPFDTYPGVKS

SEQ ID NO: 2980873 - protein, 19 aa, Entamoeba invadens
GGEKLVYCTVGVMLRKVLG

SEQ ID NO: 2980874 - protein, 20 aa, Entamoeba invadens
GGGCAICKVGYYKVEKDCDA

SEQ ID NO: 2980875 - protein, 24 aa, Entamoeba invadens
GGGEIKFLLGLLFQVFMMFHKSDL

SEQ ID NO: 2980876 - protein, 24 aa, Entamoeba invadens
GGGWKSWKKRFFVLDGATLTYYKD

SEQ ID NO: 2980877 - protein, 20 aa, Entamoeba invadens
GGKFVWKYLSEIEHLKRLDL

SEQ ID NO: 2980878 - protein, 21 aa, Entamoeba invadens
GGKLSQFVIRFVLDRIRLGRE

SEQ ID NO: 2980879 - protein, 26 aa, Entamoeba invadens
GGKWKTWKRRFFVLKDRKLWYFEAPD

SEQ ID NO: 2980880 - protein, 19 aa, Entamoeba invadens
GGLPPKFDVAALKKLFANY

SEQ ID NO: 2980881 - protein, 24 aa, Entamoeba invadens
GGLYIRLALPILLRRGIFNNPNYT

SEQ ID NO: 2980882 - protein, 17 aa, Entamoeba invadens
GGMGMVGMGMGMAGFNP

SEQ ID NO: 2980883 - protein, 18 aa, Entamoeba invadens
GGMLEVWKDLISDFTFKT

SEQ ID NO: 2980884 - protein, 25 aa, Entamoeba invadens
GGNDWNLLFKKRHCFCGYYIFVEFS

SEQ ID NO: 2980885 - protein, 22 aa, Entamoeba invadens
GGNYKCPLCGVMLTEDDISRND

SEQ ID NO: 2980886 - protein, 18 aa, Entamoeba invadens
GGQLRKGQSLLFNQEKRK

SEQ ID NO: 2980887 - protein, 17 aa, Entamoeba invadens
GGRVCIGASFPFPTTGA

SEQ ID NO: 2980888 - protein, 18 aa, Entamoeba invadens
GGSGRPALMFDEMLMASS

SEQ ID NO: 2980889 - protein, 26 aa, Entamoeba invadens
GGSWKSWKRRWFVIKDKKMWYFSGKN

SEQ ID NO: 2980890 - protein, 19 aa, Entamoeba invadens
GGVALLHCLVNNPLVQYFD

SEQ ID NO: 2980891 - protein, 18 aa, Entamoeba invadens
GGVDLFSDVEMELLGKKM

SEQ ID NO: 2980892 - protein, 18 aa, Entamoeba invadens
GGVGLNLIGCSRLILFDP

SEQ ID NO: 2980893 - protein, 22 aa, Entamoeba invadens
GGWRMRISIAKAIYMKPDLLLL

SEQ ID NO: 2980894 - protein, 19 aa, Entamoeba invadens
GGYCPAFSHGGTWGSGVPL

SEQ ID NO: 2980895 - protein, 17 aa, Entamoeba invadens
GHCFVDFKDDISMNKAL

SEQ ID NO: 2980896 - protein, 22 aa, Entamoeba invadens
GHDELKTRLGLVEDDFTKIEDE

SEQ ID NO: 2980897 - protein, 22 aa, Entamoeba invadens
GHFCPVCFELLIKRYQCAICGM

SEQ ID NO: 2980898 - protein, 24 aa, Entamoeba invadens
GHLFCSECLEVLLNTQGVHYCPIC

SEQ ID NO: 2980899 - protein, 17 aa, Entamoeba invadens
GHLLLGICRIYTRKVKY

SEQ ID NO: 2980900 - protein, 28 aa, Entamoeba invadens
GHSLGGLYLRQAIPLLVKRGVFNSTCIP

SEQ ID NO: 2980901 - protein, 19 aa, Entamoeba invadens
GHTFCLTCIRKIFREDNVC

SEQ ID NO: 2980902 - protein, 18 aa, Entamoeba invadens
GHTFCYDCIAEWVRRTEN

SEQ ID NO: 2980903 - protein, 18 aa, Entamoeba invadens
GHTLRFLSLPSFLRDLMQ

SEQ ID NO: 2980904 - protein, 18 aa, Entamoeba invadens
GHTLRLFDHFVFYNHICI

SEQ ID NO: 2980905 - protein, 20 aa, Entamoeba invadens
GHYIACIFGSSSMGYCVIHH

SEQ ID NO: 2980906 - protein, 21 aa, Entamoeba invadens
GICCFNECKWLKGKINAPDNC

SEQ ID NO: 2980907 - protein, 21 aa, Entamoeba invadens
GICGKYGHIGVMKWKQQELVS

SEQ ID NO: 2980908 - protein, 17 aa, Entamoeba invadens
GICIEVFKSLKLWENTV

SEQ ID NO: 2980909 - protein, 22 aa, Entamoeba invadens
GICVFKSLFGIRMVETVVEKGT

SEQ ID NO: 2980910 - protein, 17 aa, Entamoeba invadens
GIDFIWDKEYFKALTQL

SEQ ID NO: 2980911 - protein, 17 aa, Entamoeba invadens
GIDLRLSPIRVRPKSPK

SEQ ID NO: 2980912 - protein, 19 aa, Entamoeba invadens
GIEASAWYFGPVILALKDP

SEQ ID NO: 2980913 - protein, 26 aa, Entamoeba invadens
GIFHLKLWRLLTVVLFAIQDALLLST

SEQ ID NO: 2980914 - protein, 19 aa, Entamoeba invadens
GIFRNCTKLDEIIGLENVV

SEQ ID NO: 2980915 - protein, 18 aa, Entamoeba invadens
GIFRSRFQRYLLHLYSSP

SEQ ID NO: 2980916 - protein, 25 aa, Entamoeba invadens
GIFYGFWLKKTMGFIIDGEIGNFFG

SEQ ID NO: 2980917 - protein, 23 aa, Entamoeba invadens
GIKKPKLRAAMSILKGEVKDTLF

SEQ ID NO: 2980918 - protein, 23 aa, Entamoeba invadens
GIKKRITIFMARLTFLIKAVEYS

SEQ ID NO: 2980919 - protein, 24 aa, Entamoeba invadens
GIKVLPNFCFRGCSSLHDIKIPTN

SEQ ID NO: 2980920 - protein, 19 aa, Entamoeba invadens
GILFLKKWKILMSDEGALN

SEQ ID NO: 2980921 - protein, 19 aa, Entamoeba invadens
GILKFFLNLCEEFDKKLKS

SEQ ID NO: 2980922 - protein, 26 aa, Entamoeba invadens
GIPAFWFCVLRNSMLFDSAMGSEADI

SEQ ID NO: 2980923 - protein, 22 aa, Entamoeba invadens
GIPIPDILNWAGIDVTTQQGEM

SEQ ID NO: 2980924 - protein, 17 aa, Entamoeba invadens
GIVECFVVMFDRFSKTV

SEQ ID NO: 2980925 - protein, 20 aa, Entamoeba invadens
GIVFWEIFRRVVFGAYTKPW

SEQ ID NO: 2980926 - protein, 17 aa, Entamoeba invadens
GIVPLLREWLSVIEQII

SEQ ID NO: 2980927 - protein, 19 aa, Entamoeba invadens
GIVWKGYVAVVLVQCGIND

SEQ ID NO: 2980928 - protein, 19 aa, Entamoeba invadens
GKCAICLTGTYYLYSACKS

SEQ ID NO: 2980929 - protein, 20 aa, Entamoeba invadens
GKCCFKECVLLSHVIIEGED

SEQ ID NO: 2980930 - protein, 23 aa, Entamoeba invadens
GKCSPRTPRSCRELTDSPLESPR

SEQ ID NO: 2980931 - protein, 19 aa, Entamoeba invadens
GKCSVVFALFWKGGLFGVF

SEQ ID NO: 2980932 - protein, 17 aa, Entamoeba invadens
GKDALRCYPLSDRYGQT

SEQ ID NO: 2980933 - protein, 24 aa, Entamoeba invadens
GKDFLRRRACLMMYPMCKEYPDAL

SEQ ID NO: 2980934 - protein, 21 aa, Entamoeba invadens
GKEGWNLELEKFFKGMGEQFK

SEQ ID NO: 2980935 - protein, 18 aa, Entamoeba invadens
GKELQSLCAKEYINKCLD

SEQ ID NO: 2980936 - protein, 24 aa, Entamoeba invadens
GKEMLKMLFLLKGMLLNIKDTATL

SEQ ID NO: 2980937 - protein, 19 aa, Entamoeba invadens
GKEPFVFTNYFHGWRIAAK

SEQ ID NO: 2980938 - protein, 17 aa, Entamoeba invadens
GKFFKEGIPLFVADSNS

SEQ ID NO: 2980939 - protein, 18 aa, Entamoeba invadens
GKFTHTWPPVTSEGNLHD

SEQ ID NO: 2980940 - protein, 19 aa, Entamoeba invadens
GKGKLGFIGTIQQFLEIGK

SEQ ID NO: 2980941 - protein, 25 aa, Entamoeba invadens
GKHVIVWDRRFIKGVKYFDIKPTTA

SEQ ID NO: 2980942 - protein, 17 aa, Entamoeba invadens
GKIKGIYVVGGCDGVRK

SEQ ID NO: 2980943 - protein, 18 aa, Entamoeba invadens
GKILKGDVPGIVDLFCND

SEQ ID NO: 2980944 - protein, 23 aa, Entamoeba invadens
GKISYKNICLFDFERRMNYNTIP

SEQ ID NO: 2980945 - protein, 18 aa, Entamoeba invadens
GKIYDCWSSLALPLEVWT

SEQ ID NO: 2980946 - protein, 22 aa, Entamoeba invadens
GKKCFKCGKYGHKGKECPESLK

SEQ ID NO: 2980947 - protein, 19 aa, Entamoeba invadens
GKLKDIWWMLLVTSQMTDL

SEQ ID NO: 2980948 - protein, 19 aa, Entamoeba invadens
GKLKEGASFRWYKADQIID

SEQ ID NO: 2980949 - protein, 19 aa, Entamoeba invadens
GKLKEGASFRWYKNEQIID

SEQ ID NO: 2980950 - protein, 19 aa, Entamoeba invadens
GKLKTVFAFARTKFVKAFE

SEQ ID NO: 2980951 - protein, 20 aa, Entamoeba invadens
GKLVNAWKVLLDKYWGGYSV

SEQ ID NO: 2980952 - protein, 17 aa, Entamoeba invadens
GKMDFSWVPEVTVIEIY

SEQ ID NO: 2980953 - protein, 17 aa, Entamoeba invadens
GKMILKHCVRSIEMFVE

SEQ ID NO: 2980954 - protein, 19 aa, Entamoeba invadens
GKMTLDFHLQMLPKITRDQ

SEQ ID NO: 2980955 - protein, 24 aa, Entamoeba invadens
GKNSFKGYCLHSIFENGMNPYQRV

SEQ ID NO: 2980956 - protein, 17 aa, Entamoeba invadens
GKNTILFVDEIHSLNKL

SEQ ID NO: 2980957 - protein, 24 aa, Entamoeba invadens
GKNWREIYKSLLVLDNVLKNGSEE

SEQ ID NO: 2980958 - protein, 22 aa, Entamoeba invadens
GKPDVCVGCVNFELSLMPFPSI

SEQ ID NO: 2980959 - protein, 17 aa, Entamoeba invadens
GKPDVVFILGFSHSAHF

SEQ ID NO: 2980960 - protein, 20 aa, Entamoeba invadens
GKPFSFPKMEFKIYNDQAYH

SEQ ID NO: 2980961 - protein, 20 aa, Entamoeba invadens
GKQQCVWGKMSFVDSVQKVV

SEQ ID NO: 2980962 - protein, 23 aa, Entamoeba invadens
GKRLRPLSILAFYKAAGGRMEQD

SEQ ID NO: 2980963 - protein, 21 aa, Entamoeba invadens
GKSCFRGDIGIIGGRLPYNIK

SEQ ID NO: 2980964 - protein, 18 aa, Entamoeba invadens
GKSKICVMVFHKNGVFGY

SEQ ID NO: 2980965 - protein, 18 aa, Entamoeba invadens
GKTFWNKRVINVYNGCLY

SEQ ID NO: 2980966 - protein, 18 aa, Entamoeba invadens
GKTGMGINDGMNWIVSHC

SEQ ID NO: 2980967 - protein, 26 aa, Entamoeba invadens
GKTQINLRCPLSFQMIQIPVRGCECK

SEQ ID NO: 2980968 - protein, 20 aa, Entamoeba invadens
GKVCIKREFFLSQKTRRIVI

SEQ ID NO: 2980969 - protein, 20 aa, Entamoeba invadens
GKVLLRVCYRVSQNANCVFV

SEQ ID NO: 2980970 - protein, 19 aa, Entamoeba invadens
GKYECRVFCKQSCYGKMKV

SEQ ID NO: 2980971 - protein, 22 aa, Entamoeba invadens
GKYFCVGTVFGALRTSYPPTSK

SEQ ID NO: 2980972 - protein, 17 aa, Entamoeba invadens
GKYFISYTLPAVKGDYN

SEQ ID NO: 2980973 - protein, 18 aa, Entamoeba invadens
GKYKGDFPLNVAFQNPHC

SEQ ID NO: 2980974 - protein, 17 aa, Entamoeba invadens
GKYRLERMVVAFLEVQK

SEQ ID NO: 2980975 - protein, 18 aa, Entamoeba invadens
GLEGLKFTRYRRSTVNRI

SEQ ID NO: 2980976 - protein, 21 aa, Entamoeba invadens
GLEILKAVYLEPMMKVASKND

SEQ ID NO: 2980977 - protein, 17 aa, Entamoeba invadens
GLEKLYIPESVRVIQKY

SEQ ID NO: 2980978 - protein, 25 aa, Entamoeba invadens
GLFDKKRLYNFYGLYNSAYVPGIVK

SEQ ID NO: 2980979 - protein, 19 aa, Entamoeba invadens
GLFDYLLCFQFFEYSKIEV

SEQ ID NO: 2980980 - protein, 18 aa, Entamoeba invadens
GLFGPKLRSVTIPTTLTS

SEQ ID NO: 2980981 - protein, 23 aa, Entamoeba invadens
GLIEFMPTFKICIGEGTYKGNRI

SEQ ID NO: 2980982 - protein, 19 aa, Entamoeba invadens
GLISICFDYEYSFDIFPLY

SEQ ID NO: 2980983 - protein, 18 aa, Entamoeba invadens
GLLDFYVKIVQNFIPDRM

SEQ ID NO: 2980984 - protein, 23 aa, Entamoeba invadens
GLLDKIMFCYGVGYKKARKENGP

SEQ ID NO: 2980985 - protein, 17 aa, Entamoeba invadens
GLLKIIPLPITVESYGA

SEQ ID NO: 2980986 - protein, 18 aa, Entamoeba invadens
GLLREFDDSFALNQSQKV

SEQ ID NO: 2980987 - protein, 18 aa, Entamoeba invadens
GLMKLAFKITMYKDINMM

SEQ ID NO: 2980988 - protein, 20 aa, Entamoeba invadens
GLMLAPRLKVKPHFKEQKNK

SEQ ID NO: 2980989 - protein, 28 aa, Entamoeba invadens
GLNKSLRPLAWRIFLGVLPSEFGEGWEK

SEQ ID NO: 2980990 - protein, 18 aa, Entamoeba invadens
GLNTLGFCRCFQLCETLE

SEQ ID NO: 2980991 - protein, 20 aa, Entamoeba invadens
GLNTRLPLTLTFDRLPQNVE

SEQ ID NO: 2980992 - protein, 23 aa, Entamoeba invadens
GLREVNDPIPLFVAKMLRKKGVR

SEQ ID NO: 2980993 - protein, 20 aa, Entamoeba invadens
GLRGRIPFFDVVDVGQSYFM

SEQ ID NO: 2980994 - protein, 21 aa, Entamoeba invadens
GLSHPEFTCLFDIKRSLDNMK

SEQ ID NO: 2980995 - protein, 17 aa, Entamoeba invadens
GLSLTHRHGILLGEELS

SEQ ID NO: 2980996 - protein, 18 aa, Entamoeba invadens
GLSVLLDVCLRLCETYLL

SEQ ID NO: 2980997 - protein, 25 aa, Entamoeba invadens
GLTRILKFLLPFVVDKLPIVFGKFI

SEQ ID NO: 2980998 - protein, 17 aa, Entamoeba invadens
GLVPLLRLEWNKVDPNF

SEQ ID NO: 2980999 - protein, 21 aa, Entamoeba invadens
GLVVFCVYNFVGPMEELLFEY

SEQ ID NO: 2981000 - protein, 23 aa, Entamoeba invadens
GMDEGWFFPGLFELYVLKKMQSG

SEQ ID NO: 2981001 - protein, 22 aa, Entamoeba invadens
GMFQYKVCYRVTYKMANAILKA

SEQ ID NO: 2981002 - protein, 17 aa, Entamoeba invadens
GMGEIDVGWGLKKFEFD

SEQ ID NO: 2981003 - protein, 17 aa, Entamoeba invadens
GMKRRFAKELKRIAPAN

SEQ ID NO: 2981004 - protein, 19 aa, Entamoeba invadens
GMLDYCLNNCYWNCPICEK

SEQ ID NO: 2981005 - protein, 18 aa, Entamoeba invadens
GMLELKKALLLTVVGAPT

SEQ ID NO: 2981006 - protein, 17 aa, Entamoeba invadens
GMLLVSAKTGYNLDETM

SEQ ID NO: 2981007 - protein, 24 aa, Entamoeba invadens
GMNAWSRREMIIFNGLFVLYNETS

SEQ ID NO: 2981008 - protein, 18 aa, Entamoeba invadens
GMRDCAFEEVMKARMDIK

SEQ ID NO: 2981009 - protein, 26 aa, Entamoeba invadens
GMRIREWYGWHFPELSKFVADQLSYC

SEQ ID NO: 2981010 - protein, 23 aa, Entamoeba invadens
GMYRYTPLWIFKIMMWLRKLLYP

SEQ ID NO: 2981011 - protein, 18 aa, Entamoeba invadens
GNAFPLNYMTPLFQMFGA

SEQ ID NO: 2981012 - protein, 25 aa, Entamoeba invadens
GNAPKFAVCIQMEFCSGGDLSQMIK

SEQ ID NO: 2981013 - protein, 18 aa, Entamoeba invadens
GNCLRYGTPNALYLLPKY

SEQ ID NO: 2981014 - protein, 20 aa, Entamoeba invadens
GNDINCIVFGFPNEVQSYNI

SEQ ID NO: 2981015 - protein, 24 aa, Entamoeba invadens
GNEFLKRRYLLLCYIKTFDIDDFT

SEQ ID NO: 2981016 - protein, 18 aa, Entamoeba invadens
GNESFGFYNSDMVPVASG

SEQ ID NO: 2981017 - protein, 19 aa, Entamoeba invadens
GNETFKIVIQIGRNSEKQR

SEQ ID NO: 2981018 - protein, 23 aa, Entamoeba invadens
GNFYRLKKVLSFEGKILNECPFQ

SEQ ID NO: 2981019 - protein, 19 aa, Entamoeba invadens
GNIDLAINILRRGRNAVDC

SEQ ID NO: 2981020 - protein, 18 aa, Entamoeba invadens
GNIILWDYFVNVPLITFT

SEQ ID NO: 2981021 - protein, 18 aa, Entamoeba invadens
GNIKVCFRPSSVVASKVN

SEQ ID NO: 2981022 - protein, 22 aa, Entamoeba invadens
GNKFCEFIKFQLNFPNPGCFPE

SEQ ID NO: 2981023 - protein, 24 aa, Entamoeba invadens
GNLDCFVQFAISLGVKVYGINGTD

SEQ ID NO: 2981024 - protein, 23 aa, Entamoeba invadens
GNLKKPLLHNGIRITMCSVFECQ

SEQ ID NO: 2981025 - protein, 18 aa, Entamoeba invadens
GNMKCVNFLLKHTKTVLS

SEQ ID NO: 2981026 - protein, 18 aa, Entamoeba invadens
GNMMKFLFDVADDKNLNI

SEQ ID NO: 2981027 - protein, 24 aa, Entamoeba invadens
GNSEMWKMCCELFDFLALSAVIDN

SEQ ID NO: 2981028 - protein, 18 aa, Entamoeba invadens
GNTLRMVDHFVFHNHICI

SEQ ID NO: 2981029 - protein, 20 aa, Entamoeba invadens
GNVCFLNIMKGEFNSIYIGD

SEQ ID NO: 2981030 - protein, 21 aa, Entamoeba invadens
GNYRLALELIMEFYSCSDPPQ

SEQ ID NO: 2981031 - protein, 17 aa, Entamoeba invadens
GPCKVPLTTPLKDMKME

SEQ ID NO: 2981032 - protein, 18 aa, Entamoeba invadens
GPDVCCFENYLALQHVLL

SEQ ID NO: 2981033 - protein, 17 aa, Entamoeba invadens
GPFSEKGFKEFGVGVIG

SEQ ID NO: 2981034 - protein, 18 aa, Entamoeba invadens
GPFTLRSGTGYNLDCVNC

SEQ ID NO: 2981035 - protein, 20 aa, Entamoeba invadens
GPIMTRFFLDEAIPYEKRYE

SEQ ID NO: 2981036 - protein, 23 aa, Entamoeba invadens
GPKKERVRCGFDYTAQEQGELTF

SEQ ID NO: 2981037 - protein, 18 aa, Entamoeba invadens
GPLAKVWIAAHWEGKLTK

SEQ ID NO: 2981038 - protein, 18 aa, Entamoeba invadens
GPNCLMLFVLSRWSNKEF

SEQ ID NO: 2981039 - protein, 18 aa, Entamoeba invadens
GPTKDFWVVFGDELMMSL

SEQ ID NO: 2981040 - protein, 18 aa, Entamoeba invadens
GPVFELYRSTGLAKMPSV

SEQ ID NO: 2981041 - protein, 23 aa, Entamoeba invadens
GQAFPQCVFDHWQLMNGDINDVS

SEQ ID NO: 2981042 - protein, 17 aa, Entamoeba invadens
GQAGVSVDAVIQGEADL

SEQ ID NO: 2981043 - protein, 17 aa, Entamoeba invadens
GQGAIWFMQREVTEKKK

SEQ ID NO: 2981044 - protein, 17 aa, Entamoeba invadens
GQLICGFAMETQDLIKN

SEQ ID NO: 2981045 - protein, 18 aa, Entamoeba invadens
GQSCFRDCTLLKTFDIPS

SEQ ID NO: 2981046 - protein, 17 aa, Entamoeba invadens
GQTEFKREVDILAAETA

SEQ ID NO: 2981047 - protein, 22 aa, Entamoeba invadens
GQVCPYGQYAPIFFQFLDCVHI

SEQ ID NO: 2981048 - protein, 24 aa, Entamoeba invadens
GQVLEPYSAIGLFRGERSVIIGDL

SEQ ID NO: 2981049 - protein, 17 aa, Entamoeba invadens
GQVLRYLNRETIVILDS

SEQ ID NO: 2981050 - protein, 27 aa, Entamoeba invadens
GRAGRCMAGYCYRMYSSAMYHDTFTQF

SEQ ID NO: 2981051 - protein, 21 aa, Entamoeba invadens
GRFCFFNCGFVHFPEINVNVK

SEQ ID NO: 2981052 - protein, 21 aa, Entamoeba invadens
GRFCFFNCGFVHFSEINLKVN

SEQ ID NO: 2981053 - protein, 23 aa, Entamoeba invadens
GRGRTGTIITCFLQYIKKCNSPQ

SEQ ID NO: 2981054 - protein, 18 aa, Entamoeba invadens
GRGVMVVSIPEGFGFGWC

SEQ ID NO: 2981055 - protein, 21 aa, Entamoeba invadens
GRHRRDVCEFVYYTGEPKPES

SEQ ID NO: 2981056 - protein, 23 aa, Entamoeba invadens
GRIKSVLCTGNLCGKETYDILRT

SEQ ID NO: 2981057 - protein, 21 aa, Entamoeba invadens
GRILCPHHIVVLWENGTLTST

SEQ ID NO: 2981058 - protein, 17 aa, Entamoeba invadens
GRKILRICPLKLNYDIG

SEQ ID NO: 2981059 - protein, 19 aa, Entamoeba invadens
GRLFYCYTYLVKNKAGEEH

SEQ ID NO: 2981060 - protein, 19 aa, Entamoeba invadens
GRLKTVFAFARTKFVKAFE

SEQ ID NO: 2981061 - protein, 17 aa, Entamoeba invadens
GRLYTWGSFSFGQLGIP

SEQ ID NO: 2981062 - protein, 18 aa, Entamoeba invadens
GRMRLSLGKNIQLSPPRQ

SEQ ID NO: 2981063 - protein, 20 aa, Entamoeba invadens
GRNCFKGCVLLPSITLPLTV

SEQ ID NO: 2981064 - protein, 20 aa, Entamoeba invadens
GRPNPWDGPVFITRKEEKMN

SEQ ID NO: 2981065 - protein, 20 aa, Entamoeba invadens
GRSRSACIIAAYIMQTYKVK

SEQ ID NO: 2981066 - protein, 19 aa, Entamoeba invadens
GRSYSFTEVVRWFAERADM

SEQ ID NO: 2981067 - protein, 19 aa, Entamoeba invadens
GRTCKKCHISNCLQCSEKE

SEQ ID NO: 2981068 - protein, 17 aa, Entamoeba invadens
GRTGLHYAVLGGHLDVV

SEQ ID NO: 2981069 - protein, 17 aa, Entamoeba invadens
GRTSPTYQLMFKPVDND

SEQ ID NO: 2981070 - protein, 19 aa, Entamoeba invadens
GRVGWKVMKPVILLYDSTP

SEQ ID NO: 2981071 - protein, 20 aa, Entamoeba invadens
GRVKLRIAYDKVRHSAGDVY

SEQ ID NO: 2981072 - protein, 17 aa, Entamoeba invadens
GRVLLSFWYIYKKCGNY

SEQ ID NO: 2981073 - protein, 19 aa, Entamoeba invadens
GRYGIKFWTGMALNLQMYC

SEQ ID NO: 2981074 - protein, 23 aa, Entamoeba invadens
GRYLAIGVGYDWSYGVYGSSLMK

SEQ ID NO: 2981075 - protein, 17 aa, Entamoeba invadens
GSARTSLDIGIAQNDVK

SEQ ID NO: 2981076 - protein, 18 aa, Entamoeba invadens
GSDSFLSLFIRQMTEAAT

SEQ ID NO: 2981077 - protein, 25 aa, Entamoeba invadens
GSETWEWLFWMGFRDIFIWKKGSEY

SEQ ID NO: 2981078 - protein, 18 aa, Entamoeba invadens
GSFGIVFKGMFKGNSVAI

SEQ ID NO: 2981079 - protein, 19 aa, Entamoeba invadens
GSFGIVFKGMFRNNVVAIK

SEQ ID NO: 2981080 - protein, 18 aa, Entamoeba invadens
GSFGIVFLGEFRGNKVAI

SEQ ID NO: 2981081 - protein, 21 aa, Entamoeba invadens
GSFLFEMFTSFALQYNGQVAK

SEQ ID NO: 2981082 - protein, 17 aa, Entamoeba invadens
GSFRQCCHYGKVLLPKL

SEQ ID NO: 2981083 - protein, 22 aa, Entamoeba invadens
GSKVCTGIGFAIYGTEEDAHKT

SEQ ID NO: 2981084 - protein, 20 aa, Entamoeba invadens
GSLPLVFPIPVRRDLHYFVA

SEQ ID NO: 2981085 - protein, 17 aa, Entamoeba invadens
GSMPPMAPMPHPQINPD

SEQ ID NO: 2981086 - protein, 17 aa, Entamoeba invadens
GSPKLGLDRSFRLETLL

SEQ ID NO: 2981087 - protein, 17 aa, Entamoeba invadens
GSQRFVQVASWIGKKNC

SEQ ID NO: 2981088 - protein, 20 aa, Entamoeba invadens
GSSCTKPPFNFGMGDSYEDP

SEQ ID NO: 2981089 - protein, 22 aa, Entamoeba invadens
GSSFIICLCNTFGMRDSVYEIL

SEQ ID NO: 2981090 - protein, 18 aa, Entamoeba invadens
GSVKLWRVAFNVFIEDLY

SEQ ID NO: 2981091 - protein, 25 aa, Entamoeba invadens
GSVKSWKKRFFVLKNKNLWYFESET

SEQ ID NO: 2981092 - protein, 29 aa, Entamoeba invadens
GSVKSWKKRWFVLKPNKLWYFTSKSATTA

SEQ ID NO: 2981093 - protein, 23 aa, Entamoeba invadens
GSVRILFLFLKRMIDLSHAKYRL

SEQ ID NO: 2981094 - protein, 18 aa, Entamoeba invadens
GSVYRPEILNGVEPKNCI

SEQ ID NO: 2981095 - protein, 17 aa, Entamoeba invadens
GSYFSGWVGKVFLSCLI

SEQ ID NO: 2981096 - protein, 26 aa, Entamoeba invadens
GTEEFKFGKIKIFFKVADNQRLQNGI

SEQ ID NO: 2981097 - protein, 20 aa, Entamoeba invadens
GTFCGSCLQAGGKHPKKYYL

SEQ ID NO: 2981098 - protein, 17 aa, Entamoeba invadens
GTISWMPLCLSDFNEKA

SEQ ID NO: 2981099 - protein, 24 aa, Entamoeba invadens
GTKYPLKRIKLFADKHHCFITFYT

SEQ ID NO: 2981100 - protein, 18 aa, Entamoeba invadens
GTLCYAALNIHFGKSPSR

SEQ ID NO: 2981101 - protein, 17 aa, Entamoeba invadens
GTNCIKLLQIVYGASFK

SEQ ID NO: 2981102 - protein, 26 aa, Entamoeba invadens
GTNIRKCFVCGKFGHKSQDCPEKESE

SEQ ID NO: 2981103 - protein, 26 aa, Entamoeba invadens
GTPFGWNWIPGISWYFYRGFLEPIVS

SEQ ID NO: 2981104 - protein, 18 aa, Entamoeba invadens
GTPYKRLCEVSRKSYADY

SEQ ID NO: 2981105 - protein, 18 aa, Entamoeba invadens
GTQYRVECCLKRVSEDFE

SEQ ID NO: 2981106 - protein, 21 aa, Entamoeba invadens
  misc_feature (18)..(19): Xaa can be any naturally occurring amino acid
GTSWPTCPLITFRNSPRXXQE

SEQ ID NO: 2981107 - protein, 17 aa, Entamoeba invadens
GTWWFPLLSSIGIDQYQ

SEQ ID NO: 2981108 - protein, 19 aa, Entamoeba invadens
GTYCFKDCRSLKEFSIPIG

SEQ ID NO: 2981109 - protein, 17 aa, Entamoeba invadens
GTYCVDPPLLINGQVLF

SEQ ID NO: 2981110 - protein, 21 aa, Entamoeba invadens
GVACCYECKFLNKIEIPDKIT

SEQ ID NO: 2981111 - protein, 19 aa, Entamoeba invadens
GVCNVPFDTGFNVTSQWDK

SEQ ID NO: 2981112 - protein, 17 aa, Entamoeba invadens
GVCYRLYTKEAFIKELP

SEQ ID NO: 2981113 - protein, 19 aa, Entamoeba invadens
GVFGDKEHFVFRVKDGKAT

SEQ ID NO: 2981114 - protein, 18 aa, Entamoeba invadens
GVFYYSYYDLVYMDDKGD

SEQ ID NO: 2981115 - protein, 19 aa, Entamoeba invadens
GVGCAYSKCIACSKKIVEE

SEQ ID NO: 2981116 - protein, 18 aa, Entamoeba invadens
GVIEIRYASFSKKDVERI

SEQ ID NO: 2981117 - protein, 17 aa, Entamoeba invadens
GVINFNFVMKDLYAFYS

SEQ ID NO: 2981118 - protein, 18 aa, Entamoeba invadens
GVIVYWKLLNSFFYIEHF

SEQ ID NO: 2981119 - protein, 18 aa, Entamoeba invadens
GVLDCINFAMSEVTRTIC

SEQ ID NO: 2981120 - protein, 17 aa, Entamoeba invadens
GVLEIWDYVALTKIRSY

SEQ ID NO: 2981121 - protein, 22 aa, Entamoeba invadens
GVLFKISLGNFFLFEKDGVEYQ

SEQ ID NO: 2981122 - protein, 25 aa, Entamoeba invadens
GVLKIGFPMAMFLSGIGYDKYGDSD

SEQ ID NO: 2981123 - protein, 26 aa, Entamoeba invadens
GVLKREFFRIIVWFNVDFETVDRNIN

SEQ ID NO: 2981124 - protein, 26 aa, Entamoeba invadens
GVLKREFFRIIVWFNVDFETVDRNKN

SEQ ID NO: 2981125 - protein, 20 aa, Entamoeba invadens
GVLLAMKIGEGFAHEKSDLF

SEQ ID NO: 2981126 - protein, 17 aa, Entamoeba invadens
GVLLLQHFECDGGILQV

SEQ ID NO: 2981127 - protein, 21 aa, Entamoeba invadens
GVMRMPLGLLPQRQPITQPQR

SEQ ID NO: 2981128 - protein, 17 aa, Entamoeba invadens
GVQWLHNRFNLIHRNIK

SEQ ID NO: 2981129 - protein, 23 aa, Entamoeba invadens
GVTPRGKIVLMLREVQKDLVSQG

SEQ ID NO: 2981130 - protein, 19 aa, Entamoeba invadens
GVYHARWEIISDIKKRVAI

SEQ ID NO: 2981131 - protein, 24 aa, Entamoeba invadens
GVYKSQRGYTHFWKMTGSRYVDVK

SEQ ID NO: 2981132 - protein, 17 aa, Entamoeba invadens
GWALGYVFDRFAFAQVL

SEQ ID NO: 2981133 - protein, 25 aa, Entamoeba invadens
GWLGWIMKILELMDADLIKCIGACF

SEQ ID NO: 2981134 - protein, 19 aa, Entamoeba invadens
GWLGWIMKMLELMDVDLIK

SEQ ID NO: 2981135 - protein, 24 aa, Entamoeba invadens
GWLSWIMKILELMDADFIKCIGAC

SEQ ID NO: 2981136 - protein, 20 aa, Entamoeba invadens
GWSEAYKGTAILINDSITFS

SEQ ID NO: 2981137 - protein, 25 aa, Entamoeba invadens
GWVFCKIGTRFGFVPKKYIERIDFT

SEQ ID NO: 2981138 - protein, 19 aa, Entamoeba invadens
GYESFPWFIKRAHSPSRGL

SEQ ID NO: 2981139 - protein, 17 aa, Entamoeba invadens
GYFKRLELKRENVKENE

SEQ ID NO: 2981140 - protein, 18 aa, Entamoeba invadens
GYFKYVIKYEIDYQKYLK

SEQ ID NO: 2981141 - protein, 18 aa, Entamoeba invadens
GYFRISLCQHPDVFKDCI

SEQ ID NO: 2981142 - protein, 18 aa, Entamoeba invadens
GYFSLKYDVHWFIVDHWY

SEQ ID NO: 2981143 - protein, 18 aa, Entamoeba invadens
GYGIFPVEGCTSVPYQSD

SEQ ID NO: 2981144 - protein, 19 aa, Entamoeba invadens
GYITLCFDDPIFVTSIAVE

SEQ ID NO: 2981145 - protein, 23 aa, Entamoeba invadens
GYKFELIKLISFVVVVDAREGGP

SEQ ID NO: 2981146 - protein, 18 aa, Entamoeba invadens
GYLALMRMLSHFGHYSQQ

SEQ ID NO: 2981147 - protein, 17 aa, Entamoeba invadens
GYLIELAKVFKINFNPH

SEQ ID NO: 2981148 - protein, 17 aa, Entamoeba invadens
GYMRYALNVIGKFDNGN

SEQ ID NO: 2981149 - protein, 18 aa, Entamoeba invadens
GYPKIPITAMWMGEVIRF

SEQ ID NO: 2981150 - protein, 19 aa, Entamoeba invadens
GYQSFPWVRYMTFAGDYCF

SEQ ID NO: 2981151 - protein, 18 aa, Entamoeba invadens
GYSLGRGCGYGIGFVYME

SEQ ID NO: 2981152 - protein, 21 aa, Entamoeba invadens
GYSSPCLWILTKDNILFFKNE

SEQ ID NO: 2981153 - protein, 22 aa, Entamoeba invadens
GYWLKGDTSFIFSLVRNGELNP

SEQ ID NO: 2981154 - protein, 20 aa, Entamoeba invadens
HAFFPIPDVLYFDRRTLKSK

SEQ ID NO: 2981155 - protein, 19 aa, Entamoeba invadens
HAFSYRNELVFGEIVLSFD

SEQ ID NO: 2981156 - protein, 21 aa, Entamoeba invadens
HAGQCGIVFCFSRKDCEKMDE

SEQ ID NO: 2981157 - protein, 18 aa, Entamoeba invadens
HALVWLEEVLKTWEGTIL

SEQ ID NO: 2981158 - protein, 18 aa, Entamoeba invadens
HAVYKCLLCNKVVGVCFS

SEQ ID NO: 2981159 - protein, 19 aa, Entamoeba invadens
HCFDCCGKLSQIEFCHSIT

SEQ ID NO: 2981160 - protein, 23 aa, Entamoeba invadens
HCRFCGKCVCDGCTKMRVPLPPL

SEQ ID NO: 2981161 - protein, 20 aa, Entamoeba invadens
HCRRCGKVFCSSCCVDFVLM

SEQ ID NO: 2981162 - protein, 18 aa, Entamoeba invadens
HCWCLFKTPAGELPWPSI

SEQ ID NO: 2981163 - protein, 20 aa, Entamoeba invadens
HDCTKCTIGLHYDNDNNHCE

SEQ ID NO: 2981164 - protein, 17 aa, Entamoeba invadens
HDFKEVFNIGGRLPDTN

SEQ ID NO: 2981165 - protein, 17 aa, Entamoeba invadens
HDFPKLGTFVLRDNGNI

SEQ ID NO: 2981166 - protein, 17 aa, Entamoeba invadens
HDFPTLLQLLSSYTSIP

SEQ ID NO: 2981167 - protein, 21 aa, Entamoeba invadens
HDGELPLKYCLEEWTEQLWDE

SEQ ID NO: 2981168 - protein, 17 aa, Entamoeba invadens
HDISLLVPEIWSKMRRY

SEQ ID NO: 2981169 - protein, 18 aa, Entamoeba invadens
HDKYPFLQEGWRWEQKGC

SEQ ID NO: 2981170 - protein, 19 aa, Entamoeba invadens
HDLKELFSIAGTPPETTFV

SEQ ID NO: 2981171 - protein, 24 aa, Entamoeba invadens
HDWKCLELLLKFLADSSVYLDTER

SEQ ID NO: 2981172 - protein, 18 aa, Entamoeba invadens
HECLFGFGGGHAIGVFKK

SEQ ID NO: 2981173 - protein, 23 aa, Entamoeba invadens
HECLRTSTVYGFMRECSWKYSES

SEQ ID NO: 2981174 - protein, 17 aa, Entamoeba invadens
HEFCPGISQVFFECEIP

SEQ ID NO: 2981175 - protein, 17 aa, Entamoeba invadens
HELRSVFDIQTYVNSGK

SEQ ID NO: 2981176 - protein, 26 aa, Entamoeba invadens
HELSKKIPCYWGRILNISDLNYNNLA

SEQ ID NO: 2981177 - protein, 19 aa, Entamoeba invadens
HEVDLSILPEEQFATTPTV

SEQ ID NO: 2981178 - protein, 22 aa, Entamoeba invadens
HFCSFKGKIWAKVFIKSKPGLY

SEQ ID NO: 2981179 - protein, 19 aa, Entamoeba invadens
HFDEIDWSYGYTLLKDMMC

SEQ ID NO: 2981180 - protein, 26 aa, Entamoeba invadens
HFLGDILLELGFQFSVKWSPGKHNTE

SEQ ID NO: 2981181 - protein, 25 aa, Entamoeba invadens
HFPPQMQIYFGYRFLALHSPEEKRI

SEQ ID NO: 2981182 - protein, 22 aa, Entamoeba invadens
HFPTFKVSYAIARDVLSDTEQN

SEQ ID NO: 2981183 - protein, 24 aa, Entamoeba invadens
HFTEYCVLCYILALSKSEDIYHNF

SEQ ID NO: 2981184 - protein, 20 aa, Entamoeba invadens
HFTTICLLQLKTLDAQTPTN

SEQ ID NO: 2981185 - protein, 18 aa, Entamoeba invadens
HFYTKIIVHFAVKSETIA

SEQ ID NO: 2981186 - protein, 23 aa, Entamoeba invadens
HGDESYLRYCVKPLEKLLTNYKR

SEQ ID NO: 2981187 - protein, 19 aa, Entamoeba invadens
HGDVCPLNWVPGKDTMKPT

SEQ ID NO: 2981188 - protein, 23 aa, Entamoeba invadens
HGEGEGCWWGCVIKGAHVIDIKR

SEQ ID NO: 2981189 - protein, 18 aa, Entamoeba invadens
HGFTDLCSLLDVLLKLSL

SEQ ID NO: 2981190 - protein, 25 aa, Entamoeba invadens
HGKLPQLFWWAFRRQIMINDKGELL

SEQ ID NO: 2981191 - protein, 19 aa, Entamoeba invadens
HGVGVDWWSLGILIYEMLV

SEQ ID NO: 2981192 - protein, 18 aa, Entamoeba invadens
HHCRFCGGCVCDSCSKNR

SEQ ID NO: 2981193 - protein, 26 aa, Entamoeba invadens
HHLYRCQGCGYALCSGCVKKTPPCRC

SEQ ID NO: 2981194 - protein, 19 aa, Entamoeba invadens
HHNDIMFYRGYKFVISLKV

SEQ ID NO: 2981195 - protein, 25 aa, Entamoeba invadens
HHSGIKVEGFWPVVMAKALSKANVE

SEQ ID NO: 2981196 - protein, 23 aa, Entamoeba invadens
HIACFKCKTCGLKLNNSNFYYDQ

SEQ ID NO: 2981197 - protein, 24 aa, Entamoeba invadens
HIACFKCKTCGLKLNTSNFLYDHD

SEQ ID NO: 2981198 - protein, 17 aa, Entamoeba invadens
HICMLRAKMAKYRKELL

SEQ ID NO: 2981199 - protein, 18 aa, Entamoeba invadens
HIEYVWRFITKKLGQSPN

SEQ ID NO: 2981200 - protein, 20 aa, Entamoeba invadens
HIFCRECMIHLFSNNESVHC

SEQ ID NO: 2981201 - protein, 24 aa, Entamoeba invadens
HINRYFRVVSEFALEAGDFSTVVI

SEQ ID NO: 2981202 - protein, 22 aa, Entamoeba invadens
HIPKEFKILVGETAKQGFANVR

SEQ ID NO: 2981203 - protein, 18 aa, Entamoeba invadens
HIVPRPVQVLSILRLADE

SEQ ID NO: 2981204 - protein, 19 aa, Entamoeba invadens
HKFKVWKAEMERVVLGEKG

SEQ ID NO: 2981205 - protein, 22 aa, Entamoeba invadens
HKGRFIPITNMCFFGKADRAQL

SEQ ID NO: 2981206 - protein, 18 aa, Entamoeba invadens
HKIARDFPTEDLKEKGTK

SEQ ID NO: 2981207 - protein, 18 aa, Entamoeba invadens
HKIFKPKIIELFLKKSTL

SEQ ID NO: 2981208 - protein, 17 aa, Entamoeba invadens
HKIKAVLMLYKSAEIDV

SEQ ID NO: 2981209 - protein, 17 aa, Entamoeba invadens
HKIKFIPVDGFEGENLS

SEQ ID NO: 2981210 - protein, 17 aa, Entamoeba invadens
HKIKFSAAFSFKIQKMM

SEQ ID NO: 2981211 - protein, 22 aa, Entamoeba invadens
HKILRKVFDIFFDKRHNCTIVR

SEQ ID NO: 2981212 - protein, 18 aa, Entamoeba invadens
HKKMLLSICEYLVDTGVT

SEQ ID NO: 2981213 - protein, 18 aa, Entamoeba invadens
HKKVCIDRAIQVISNSSW

SEQ ID NO: 2981214 - protein, 21 aa, Entamoeba invadens
HKPVICSASLYLQEFDKKKKA

SEQ ID NO: 2981215 - protein, 21 aa, Entamoeba invadens
HKRFSYFFFHWSDLIRNAFYH

SEQ ID NO: 2981216 - protein, 22 aa, Entamoeba invadens
HKSLEPFGGLIAWLRKYSNDDF

SEQ ID NO: 2981217 - protein, 20 aa, Entamoeba invadens
HKTEGFFPYRIPPRTIYGGQ

SEQ ID NO: 2981218 - protein, 23 aa, Entamoeba invadens
HLCAFKGKIWAKVFIKSKPQRYG

SEQ ID NO: 2981219 - protein, 24 aa, Entamoeba invadens
HLCAFKGKIWAKVFIKSKPQRYSI

SEQ ID NO: 2981220 - protein, 20 aa, Entamoeba invadens
HLCCLKCLRPKQGSNSVCIC

SEQ ID NO: 2981221 - protein, 20 aa, Entamoeba invadens
HLDPKAFRVYCANNNLTPYK

SEQ ID NO: 2981222 - protein, 18 aa, Entamoeba invadens
HLFTLILRHVHSLPTTLQ

SEQ ID NO: 2981223 - protein, 24 aa, Entamoeba invadens
HLKYRKSVLWPFLDFFLVNNNTPL

SEQ ID NO: 2981224 - protein, 19 aa, Entamoeba invadens
HLLKLKVCVENSVSEILYS

SEQ ID NO: 2981225 - protein, 19 aa, Entamoeba invadens
HLLWLRVYHKVVLEKDKKG

SEQ ID NO: 2981226 - protein, 17 aa, Entamoeba invadens
HLNFVWYDTYLVDDKKP

SEQ ID NO: 2981227 - protein, 19 aa, Entamoeba invadens
HLPLECFQYFKALKTVNVW

SEQ ID NO: 2981228 - protein, 18 aa, Entamoeba invadens
HMHGHRICFVWTFTGLDE

SEQ ID NO: 2981229 - protein, 18 aa, Entamoeba invadens
HMHLLASFAYRLMLLQKY

SEQ ID NO: 2981230 - protein, 20 aa, Entamoeba invadens
HNALYWKVWLYRSETKRVYK

SEQ ID NO: 2981231 - protein, 20 aa, Entamoeba invadens
HNFFQFGFFCLRSKRYILKH

SEQ ID NO: 2981232 - protein, 17 aa, Entamoeba invadens
HNNPRLFVQTNIEALES

SEQ ID NO: 2981233 - protein, 17 aa, Entamoeba invadens
HNVWPIEICEVLNKHPK

SEQ ID NO: 2981234 - protein, 19 aa, Entamoeba invadens
HNYPFCLPYPLKLPKRNFT

SEQ ID NO: 2981235 - protein, 17 aa, Entamoeba invadens
HPECKIGVLVKGSVGEA

SEQ ID NO: 2981236 - protein, 23 aa, Entamoeba invadens
HPEVFKFLLRVGSFDMKGDESIY

SEQ ID NO: 2981237 - protein, 18 aa, Entamoeba invadens
HPFWLPKFANAFYYTLPI

SEQ ID NO: 2981238 - protein, 18 aa, Entamoeba invadens
HPFWLPKFANGFYYTLPM

SEQ ID NO: 2981239 - protein, 18 aa, Entamoeba invadens
HPGFGCWLSSIDISTQQS

SEQ ID NO: 2981240 - protein, 18 aa, Entamoeba invadens
HPKFMVFEVFPVAPPAVR

SEQ ID NO: 2981241 - protein, 17 aa, Entamoeba invadens
HPKRKPLYFSFASQDFT

SEQ ID NO: 2981242 - protein, 20 aa, Entamoeba invadens
HPLFALRIVSRFLTPTTMPA

SEQ ID NO: 2981243 - protein, 17 aa, Entamoeba invadens
HPLLYVGCVDGTVLLLN

SEQ ID NO: 2981244 - protein, 21 aa, Entamoeba invadens
HPPYPRFSLFFTQTGTITDDI

SEQ ID NO: 2981245 - protein, 23 aa, Entamoeba invadens
HPSSEHLLCLKVNVGEENVRSVV

SEQ ID NO: 2981246 - protein, 25 aa, Entamoeba invadens
HPVWKLVCLPGLIGAIGEKDVYVFN

SEQ ID NO: 2981247 - protein, 21 aa, Entamoeba invadens
HQAHSMGYFFPVLPFQDPNTS

SEQ ID NO: 2981248 - protein, 23 aa, Entamoeba invadens
HQIKRIYFTGGFVSRNTVVWEGI

SEQ ID NO: 2981249 - protein, 18 aa, Entamoeba invadens
HQIKRLVLIYLESIQKTE

SEQ ID NO: 2981250 - protein, 17 aa, Entamoeba invadens
HQILCLINFLLSVKNNT

SEQ ID NO: 2981251 - protein, 18 aa, Entamoeba invadens
HQKIDYFLAVGISRKTSS

SEQ ID NO: 2981252 - protein, 24 aa, Entamoeba invadens
HQLSLRPLLSWKDARVIELAEKHN

SEQ ID NO: 2981253 - protein, 18 aa, Entamoeba invadens
HQRKGAWTGGKFGDLSGV

SEQ ID NO: 2981254 - protein, 17 aa, Entamoeba invadens
HQRVCIMDCVIPLDKKY

SEQ ID NO: 2981255 - protein, 20 aa, Entamoeba invadens
HRDCLRGCTALTRVAIQRDL

SEQ ID NO: 2981256 - protein, 21 aa, Entamoeba invadens
HRFSLRTGCGVTWAIDPLPSL

SEQ ID NO: 2981257 - protein, 22 aa, Entamoeba invadens
HRIPSLIYFCCVYLSEPRNAIK

SEQ ID NO: 2981258 - protein, 21 aa, Entamoeba invadens
HRKEYYSVPSMEELQKMDVES

SEQ ID NO: 2981259 - protein, 17 aa, Entamoeba invadens
HRLRIGGNFEGTLKNSV

SEQ ID NO: 2981260 - protein, 17 aa, Entamoeba invadens
HRNCYRTFVSFVRELVA

SEQ ID NO: 2981261 - protein, 18 aa, Entamoeba invadens
HRRLLIVSIDIHNSVSSV

SEQ ID NO: 2981262 - protein, 18 aa, Entamoeba invadens
HRSELRSVFNIKKLHIGH

SEQ ID NO: 2981263 - protein, 23 aa, Entamoeba invadens
HRSKGRFPVLTWFSNKNKAALLR

SEQ ID NO: 2981264 - protein, 17 aa, Entamoeba invadens
HRVEAISLFSILRVRVS

SEQ ID NO: 2981265 - protein, 18 aa, Entamoeba invadens
HSCKNCLTYNFSKDSDYF

SEQ ID NO: 2981266 - protein, 17 aa, Entamoeba invadens
HSFEIVDPVAFSKEILP

SEQ ID NO: 2981267 - protein, 18 aa, Entamoeba invadens
HSLKHFYHAISFAMSSES

SEQ ID NO: 2981268 - protein, 21 aa, Entamoeba invadens
HSMFICFAMLYLGSDANTKKQ

SEQ ID NO: 2981269 - protein, 18 aa, Entamoeba invadens
HSSISVRMNDMWRNNEKS

SEQ ID NO: 2981270 - protein, 17 aa, Entamoeba invadens
HSYSGVCNVVYVKVDSD

SEQ ID NO: 2981271 - protein, 18 aa, Entamoeba invadens
HTALKCKNAPRFINDILD

SEQ ID NO: 2981272 - protein, 17 aa, Entamoeba invadens
HTEPRCCLSVPQEDLII

SEQ ID NO: 2981273 - protein, 24 aa, Entamoeba invadens
HTFISCPFCKYRVARCDLLKHIGE

SEQ ID NO: 2981274 - protein, 18 aa, Entamoeba invadens
HTVFPFHVVQYFYQYLGI

SEQ ID NO: 2981275 - protein, 23 aa, Entamoeba invadens
HTWYQFRNWVWFRLFQKVRPTLK

SEQ ID NO: 2981276 - protein, 23 aa, Entamoeba invadens
HTYEVPLWVGLYFKTNKMCKVII

SEQ ID NO: 2981277 - protein, 21 aa, Entamoeba invadens
HVGEIPLKYCLEEWTEQLWEE

SEQ ID NO: 2981278 - protein, 19 aa, Entamoeba invadens
HVICRDCILSLMKVQKSYN

SEQ ID NO: 2981279 - protein, 17 aa, Entamoeba invadens
HVKICLKQDITTNRVTY

SEQ ID NO: 2981280 - protein, 17 aa, Entamoeba invadens
HVKSVGYYSCFSCVNLK

SEQ ID NO: 2981281 - protein, 22 aa, Entamoeba invadens
HVLHLRIKRILNNFLENRKNPI

SEQ ID NO: 2981282 - protein, 23 aa, Entamoeba invadens
HVNCFRCHYCLRVQIGDEINADF

SEQ ID NO: 2981283 - protein, 23 aa, Entamoeba invadens
HVPFPIILIFALNKWRQEHNTTG

SEQ ID NO: 2981284 - protein, 22 aa, Entamoeba invadens
HVQPRLALFNMFSIKHKDRGET

SEQ ID NO: 2981285 - protein, 17 aa, Entamoeba invadens
HWLPRFGVEVDLVDTSD

SEQ ID NO: 2981286 - protein, 18 aa, Entamoeba invadens
HWQYFVAPLRDLLGTNYI

SEQ ID NO: 2981287 - protein, 17 aa, Entamoeba invadens
HWWKGISFTPVKVKNDM

SEQ ID NO: 2981288 - protein, 21 aa, Entamoeba invadens
HYCKKCGYPFIQLDGSVPAQK

SEQ ID NO: 2981289 - protein, 26 aa, Entamoeba invadens
HYECPVCGFCYCELPVECKVCKANLI

SEQ ID NO: 2981290 - protein, 22 aa, Entamoeba invadens
HYEMIRFDLLTSLKFLNISNRQ

SEQ ID NO: 2981291 - protein, 22 aa, Entamoeba invadens
HYLSLYARFVYKDCTFEEKRLS

SEQ ID NO: 2981292 - protein, 18 aa, Entamoeba invadens
HYLYCGMLIYLLQQNQSG

SEQ ID NO: 2981293 - protein, 18 aa, Entamoeba invadens
IAAELILGIPIFPGSSEY

SEQ ID NO: 2981294 - protein, 26 aa, Entamoeba invadens
IAAELTEFFNGIVLVVVMKTINKKDE

SEQ ID NO: 2981295 - protein, 18 aa, Entamoeba invadens
IACKGCSNCTLNIDCELC

SEQ ID NO: 2981296 - protein, 24 aa, Entamoeba invadens
IADACLRSSAAVGYFPPYNGFADG

SEQ ID NO: 2981297 - protein, 25 aa, Entamoeba invadens
IAEDFATRCLYWFNFGYSEVGDIGA

SEQ ID NO: 2981298 - protein, 24 aa, Entamoeba invadens
IAEMRSRLAVLFVIYKMGLSETNK

SEQ ID NO: 2981299 - protein, 17 aa, Entamoeba invadens
IAFEIKDGLVINIVKVE

SEQ ID NO: 2981300 - protein, 28 aa, Entamoeba invadens
IAFLKEWLSAPSFQEWKERVCVDQALKF

SEQ ID NO: 2981301 - protein, 23 aa, Entamoeba invadens
IAKVCGAVCRHIYLSDKIALKNG

SEQ ID NO: 2981302 - protein, 22 aa, Entamoeba invadens
IALKGEDGINCMIQNNQLNIEG

SEQ ID NO: 2981303 - protein, 19 aa, Entamoeba invadens
IALRGRKALKINTTQKSQQ

SEQ ID NO: 2981304 - protein, 23 aa, Entamoeba invadens
IALTDFRCCMCGMVVHGSCIHSA

SEQ ID NO: 2981305 - protein, 17 aa, Entamoeba invadens
IAMLDCLFSIWRVLLDC

SEQ ID NO: 2981306 - protein, 20 aa, Entamoeba invadens
IAMRVMKLWITNKDRPMHMF

SEQ ID NO: 2981307 - protein, 20 aa, Entamoeba invadens
IAPGEMWRILQANILSYLSK

SEQ ID NO: 2981308 - protein, 18 aa, Entamoeba invadens
IAQARASIVWVIGEYSQM

SEQ ID NO: 2981309 - protein, 19 aa, Entamoeba invadens
IAQEIYVRWKTRKLVKERS

SEQ ID NO: 2981310 - protein, 20 aa, Entamoeba invadens
IARLNMFSHLSVFIENPYYN

SEQ ID NO: 2981311 - protein, 25 aa, Entamoeba invadens
IASGLKWVRFGAMCMVIANRKLNTF

SEQ ID NO: 2981312 - protein, 17 aa, Entamoeba invadens
IASRLGIWNSRGKEKFD

SEQ ID NO: 2981313 - protein, 18 aa, Entamoeba invadens
IATFSSFGDRVVVMDTRK

SEQ ID NO: 2981314 - protein, 24 aa, Entamoeba invadens
IATLPLEFSQLISLTKLHASDNKF

SEQ ID NO: 2981315 - protein, 17 aa, Entamoeba invadens
IAVPFLLKCCNDCANAL

SEQ ID NO: 2981316 - protein, 17 aa, Entamoeba invadens
ICADVDCACELARTLAG

SEQ ID NO: 2981317 - protein, 19 aa, Entamoeba invadens
ICAEFGWSDVGTWGSLYSL

SEQ ID NO: 2981318 - protein, 17 aa, Entamoeba invadens
ICDDVKPIFKLAGDAPF

SEQ ID NO: 2981319 - protein, 19 aa, Entamoeba invadens
ICDEFLYKTEESLEVFLPA

SEQ ID NO: 2981320 - protein, 20 aa, Entamoeba invadens
ICDFFFKIGACRHGDSCKKQ

SEQ ID NO: 2981321 - protein, 18 aa, Entamoeba invadens
ICDGCGWGELGKDASNIG

SEQ ID NO: 2981322 - protein, 17 aa, Entamoeba invadens
ICDYCFKNYNFLEEIVL

SEQ ID NO: 2981323 - protein, 17 aa, Entamoeba invadens
ICFKAMLGFSWVYSLCL

SEQ ID NO: 2981324 - protein, 18 aa, Entamoeba invadens
ICGDCSRGKIQLAPKGPE

SEQ ID NO: 2981325 - protein, 17 aa, Entamoeba invadens
ICGIKFLHEQGIVHMDI

SEQ ID NO: 2981326 - protein, 19 aa, Entamoeba invadens
ICKGCDLVDNFVEDIKNNK

SEQ ID NO: 2981327 - protein, 25 aa, Entamoeba invadens
ICKKEFKDLLIASGRRRDEEFIRAT

SEQ ID NO: 2981328 - protein, 17 aa, Entamoeba invadens
ICLKCTKGGVPFKRPIT

SEQ ID NO: 2981329 - protein, 17 aa, Entamoeba invadens
ICLRSAAAPSYYKPYQN

SEQ ID NO: 2981330 - protein, 19 aa, Entamoeba invadens
ICLVGDMSVGKTCVVNRLV

SEQ ID NO: 2981331 - protein, 23 aa, Entamoeba invadens
ICNKRIDVVWSWVNGTDPNWLES

SEQ ID NO: 2981332 - protein, 18 aa, Entamoeba invadens
ICNNRIDVVWSWVNGTDL

SEQ ID NO: 2981333 - protein, 22 aa, Entamoeba invadens
ICNNRIDVVWTWVNGTDPLWLS

SEQ ID NO: 2981334 - protein, 22 aa, Entamoeba invadens
ICQHCDLCLFSSLKAHLAKDEL

SEQ ID NO: 2981335 - protein, 19 aa, Entamoeba invadens
ICRKVKHVVFMSGTPAVNR

SEQ ID NO: 2981336 - protein, 22 aa, Entamoeba invadens
ICSCEIKDSIALFGIPFTITRM

SEQ ID NO: 2981337 - protein, 19 aa, Entamoeba invadens
ICTILKWFIHKEDTDYSTD

SEQ ID NO: 2981338 - protein, 20 aa, Entamoeba invadens
ICTTEFPFAIDIWSIGCVFY

SEQ ID NO: 2981339 - protein, 22 aa, Entamoeba invadens
ICVLDAMTFKKCYMSVKLKEHQ

SEQ ID NO: 2981340 - protein, 18 aa, Entamoeba invadens
ICVTFNFNCLLVLREGGE

SEQ ID NO: 2981341 - protein, 17 aa, Entamoeba invadens
ICWPWKYLIQSKMFSVG

SEQ ID NO: 2981342 - protein, 19 aa, Entamoeba invadens
ICYLSSYGPDVCCFENYLA

SEQ ID NO: 2981343 - protein, 19 aa, Entamoeba invadens
IDAALDFRNVSIIAHYIKE

SEQ ID NO: 2981344 - protein, 24 aa, Entamoeba invadens
IDALKMYKDRVVFLKNEQQKKLQT

SEQ ID NO: 2981345 - protein, 18 aa, Entamoeba invadens
IDCKKPLCVPSCPAGINI

SEQ ID NO: 2981346 - protein, 23 aa, Entamoeba invadens
IDFLKCWSSLTLKHKGAASTFLR

SEQ ID NO: 2981347 - protein, 17 aa, Entamoeba invadens
IDFSYGVTPFFVDKKKY

SEQ ID NO: 2981348 - protein, 19 aa, Entamoeba invadens
IDFTRPRILAMSQDTMPDS

SEQ ID NO: 2981349 - protein, 24 aa, Entamoeba invadens
IDFVFCPRFGFSIDEFCESGDCTS

SEQ ID NO: 2981350 - protein, 23 aa, Entamoeba invadens
IDGLKYKICFKMSYDQFTRLEGK

SEQ ID NO: 2981351 - protein, 17 aa, Entamoeba invadens
IDHVKVFLGDYVDRGKY

SEQ ID NO: 2981352 - protein, 18 aa, Entamoeba invadens
IDHVKVFLGDYVDRGKYS

SEQ ID NO: 2981353 - protein, 20 aa, Entamoeba invadens
IDIDICKKIAKESLPFALEY

SEQ ID NO: 2981354 - protein, 25 aa, Entamoeba invadens
IDIPRCPVCGALIKLDVVLFGEPLQ

SEQ ID NO: 2981355 - protein, 20 aa, Entamoeba invadens
IDIVEAFPLISAAWDLTTKE

SEQ ID NO: 2981356 - protein, 21 aa, Entamoeba invadens
IDLKCVIYGKGFQIQFVCDNA

SEQ ID NO: 2981357 - protein, 20 aa, Entamoeba invadens
IDLLEIRGGFDFESKYTEGK

SEQ ID NO: 2981358 - protein, 20 aa, Entamoeba invadens
IDLLLRIGCFLDLCKNKEQD

SEQ ID NO: 2981359 - protein, 18 aa, Entamoeba invadens
IDLSWFLSHFYLDTVDFD

SEQ ID NO: 2981360 - protein, 17 aa, Entamoeba invadens
IDNALGISNGVGAAKQA

SEQ ID NO: 2981361 - protein, 22 aa, Entamoeba invadens
IDNFPFDAVFAITGDMKEGCSF

SEQ ID NO: 2981362 - protein, 19 aa, Entamoeba invadens
IDPAMLRPGRLDRLISVEL

SEQ ID NO: 2981363 - protein, 28 aa, Entamoeba invadens
IDPCCLNSCVQWCFIKNFLVIFQFFPTL

SEQ ID NO: 2981364 - protein, 17 aa, Entamoeba invadens
IDPELNFEFNLRPSVTR

SEQ ID NO: 2981365 - protein, 20 aa, Entamoeba invadens
IDSILPIRAFYGLEKLSMKN

SEQ ID NO: 2981366 - protein, 20 aa, Entamoeba invadens
IDSKRLVGVYVELYKSECAI

SEQ ID NO: 2981367 - protein, 17 aa, Entamoeba invadens
IDSLLFYEEMKNCVFEE

SEQ ID NO: 2981368 - protein, 22 aa, Entamoeba invadens
IDTRCFVCFNMSMYLQHAGIKE

SEQ ID NO: 2981369 - protein, 17 aa, Entamoeba invadens
IDVPQSWVTNSAENLFH

SEQ ID NO: 2981370 - protein, 23 aa, Entamoeba invadens
IDVSLRYIEHWSNSALMKPTLVG

SEQ ID NO: 2981371 - protein, 21 aa, Entamoeba invadens
IDWSIIYQMNWFKTPINIRLF

SEQ ID NO: 2981372 - protein, 23 aa, Entamoeba invadens
IDWSIIYQMNWFKTPINIRLFND

SEQ ID NO: 2981373 - protein, 20 aa, Entamoeba invadens
IECFRLFFCEEIANNLLLFS

SEQ ID NO: 2981374 - protein, 18 aa, Entamoeba invadens
IECGLCARYAQILSTPFD

SEQ ID NO: 2981375 - protein, 26 aa, Entamoeba invadens
IECPEFICLVCELFARLSSVRSQTAA

SEQ ID NO: 2981376 - protein, 24 aa, Entamoeba invadens
IEEEIAYKCTYRFCARTTDHMRED

SEQ ID NO: 2981377 - protein, 24 aa, Entamoeba invadens
IEEVFDLIHRCIRRIITEGQPANK

SEQ ID NO: 2981378 - protein, 18 aa, Entamoeba invadens
IEHYKFGVIYAKPGQHDE

SEQ ID NO: 2981379 - protein, 18 aa, Entamoeba invadens
IEIFLQFLCNGWKNPTPQ

SEQ ID NO: 2981380 - protein, 22 aa, Entamoeba invadens
IEIPKSVTLLGFCSFKDCNNLK

SEQ ID NO: 2981381 - protein, 17 aa, Entamoeba invadens
IEISKAFTLPNEQFKYF

SEQ ID NO: 2981382 - protein, 19 aa, Entamoeba invadens
IEKGVSCLELARQDEKEAN

SEQ ID NO: 2981383 - protein, 24 aa, Entamoeba invadens
IEKILKKKIDSFFTEKERIKINDM

SEQ ID NO: 2981384 - protein, 22 aa, Entamoeba invadens
IELKGSTISIVFHDHFTPLRIY

SEQ ID NO: 2981385 - protein, 23 aa, Entamoeba invadens
IELKKRMSLSFIPEDLLVSFEIP

SEQ ID NO: 2981386 - protein, 17 aa, Entamoeba invadens
IELLKCFTHKETEKLQK

SEQ ID NO: 2981387 - protein, 17 aa, Entamoeba invadens
IELQSLRQNNDFNYQEF

SEQ ID NO: 2981388 - protein, 22 aa, Entamoeba invadens
IEMKEWRKLYKIDITILRALYD

SEQ ID NO: 2981389 - protein, 19 aa, Entamoeba invadens
IEMPEYWLEAGNPWEVMRA

SEQ ID NO: 2981390 - protein, 22 aa, Entamoeba invadens
IENCCFMCCKLLTSITLSNNLQ

SEQ ID NO: 2981391 - protein, 19 aa, Entamoeba invadens
IENYFSLRYDNRIFLYENE

SEQ ID NO: 2981392 - protein, 17 aa, Entamoeba invadens
IERENWFVALGITKYDL

SEQ ID NO: 2981393 - protein, 19 aa, Entamoeba invadens
IERKWIIAIFMEKENEIGK

SEQ ID NO: 2981394 - protein, 22 aa, Entamoeba invadens
IERLIKIAGFCFSYRNFDTLLC

SEQ ID NO: 2981395 - protein, 17 aa, Entamoeba invadens
IERLRLYNCKDITEVKM

SEQ ID NO: 2981396 - protein, 18 aa, Entamoeba invadens
IERRISLFDLARVTHLDI

SEQ ID NO: 2981397 - protein, 23 aa, Entamoeba invadens
IESDQLFGLLLEWCDKEEESTMV

SEQ ID NO: 2981398 - protein, 20 aa, Entamoeba invadens
IESIGLLYAMCDEILHLVCK

SEQ ID NO: 2981399 - protein, 17 aa, Entamoeba invadens
IESLRFACTGVYPPNSQ

SEQ ID NO: 2981400 - protein, 23 aa, Entamoeba invadens
IESNSSMITLKFIEPVQSGTTGD

SEQ ID NO: 2981401 - protein, 18 aa, Entamoeba invadens
IESSMCYIIFDLCDVDND

SEQ ID NO: 2981402 - protein, 18 aa, Entamoeba invadens
IETLQCVDFMLGDANKVI

SEQ ID NO: 2981403 - protein, 19 aa, Entamoeba invadens
IEVFSRMNFAYVLLSKRNL

SEQ ID NO: 2981404 - protein, 17 aa, Entamoeba invadens
IEVICLLYALKIRSPKQ

SEQ ID NO: 2981405 - protein, 20 aa, Entamoeba invadens
IEVLDIFKLKALKVLDVVNL

SEQ ID NO: 2981406 - protein, 17 aa, Entamoeba invadens
IEVRMPYHILAQANEQK

SEQ ID NO: 2981407 - protein, 26 aa, Entamoeba invadens
IEVSFFKGLEMRSTFQTNRQEELVKE

SEQ ID NO: 2981408 - protein, 18 aa, Entamoeba invadens
IFCKKCLEQIRMNTVDGI

SEQ ID NO: 2981409 - protein, 18 aa, Entamoeba invadens
IFDWAMKRITSFTHNIIY

SEQ ID NO: 2981410 - protein, 18 aa, Entamoeba invadens
IFELDFPNPVLLIKLKQL

SEQ ID NO: 2981411 - protein, 18 aa, Entamoeba invadens
IFERCIKEDIALLYTTFS

SEQ ID NO: 2981412 - protein, 18 aa, Entamoeba invadens
IFHFGGTFTHIINETPIE

SEQ ID NO: 2981413 - protein, 17 aa, Entamoeba invadens
IFHLRLVSQYSRQNLMD

SEQ ID NO: 2981414 - protein, 21 aa, Entamoeba invadens
IFIQFAFRWINCCLLREFSLK

SEQ ID NO: 2981415 - protein, 18 aa, Entamoeba invadens
IFKEMEFIEFVKSSTSLT

SEQ ID NO: 2981416 - protein, 22 aa, Entamoeba invadens
IFKKKFKRGFSFDSKQIDVEGT

SEQ ID NO: 2981417 - protein, 21 aa, Entamoeba invadens
IFKQEIKAIVPLDKKKEIIEL

SEQ ID NO: 2981418 - protein, 20 aa, Entamoeba invadens
IFKRLIRVYAHMFYSHMDDL

SEQ ID NO: 2981419 - protein, 18 aa, Entamoeba invadens
IFKRLKIEVLNRMNNKEI

SEQ ID NO: 2981420 - protein, 17 aa, Entamoeba invadens
IFLAICYDIQYPAFIRR

SEQ ID NO: 2981421 - protein, 17 aa, Entamoeba invadens
IFLEIVQAFKTLHDTGS

SEQ ID NO: 2981422 - protein, 26 aa, Entamoeba invadens
IFMKEVIQFFPFVDIIELCFVSKRFH

SEQ ID NO: 2981423 - protein, 22 aa, Entamoeba invadens
IFMKIQEGVFVWPHDVEVSDKL

SEQ ID NO: 2981424 - protein, 18 aa, Entamoeba invadens
IFMRLGIKVLNVMKSEEI

SEQ ID NO: 2981425 - protein, 21 aa, Entamoeba invadens
IFNELKIDVMFVREMQSKKKT

SEQ ID NO: 2981426 - protein, 25 aa, Entamoeba invadens
IFPSLKRLNCPLVYLSTITFNNQNE

SEQ ID NO: 2981427 - protein, 18 aa, Entamoeba invadens
IFRKDHRGLSVMTGNCTG

SEQ ID NO: 2981428 - protein, 20 aa, Entamoeba invadens
IFRMCPSRFAHFLVTGFVPL

SEQ ID NO: 2981429 - protein, 20 aa, Entamoeba invadens
IFSTRWFPPKIRKMRIKYLP

SEQ ID NO: 2981430 - protein, 23 aa, Entamoeba invadens
IFTDKRLADFVPWNKDSLEAIHT

SEQ ID NO: 2981431 - protein, 18 aa, Entamoeba invadens
IFVGIEFIEELYLLGCNC

SEQ ID NO: 2981432 - protein, 17 aa, Entamoeba invadens
IFYEMNEVLTLLNDCVV

SEQ ID NO: 2981433 - protein, 20 aa, Entamoeba invadens
IGCGPTLWLAREIQNGKMAK

SEQ ID NO: 2981434 - protein, 18 aa, Entamoeba invadens
IGCSLCASVCPVNAIQYQ

SEQ ID NO: 2981435 - protein, 18 aa, Entamoeba invadens
IGCTCTIVYVWEEDGEMY

SEQ ID NO: 2981436 - protein, 20 aa, Entamoeba invadens
IGDGCFRQCISLNKINLPSN

SEQ ID NO: 2981437 - protein, 19 aa, Entamoeba invadens
IGDYCFFECYSLINITITS

SEQ ID NO: 2981438 - protein, 20 aa, Entamoeba invadens
IGEIPEMYSCIAMFSADQKA

SEQ ID NO: 2981439 - protein, 19 aa, Entamoeba invadens
IGEKCFRYAPIADIVIPPT

SEQ ID NO: 2981440 - protein, 23 aa, Entamoeba invadens
IGETAEVGKWCRMYQEVTLGAIN

SEQ ID NO: 2981441 - protein, 18 aa, Entamoeba invadens
IGETFPLVQEIESKDGNS

SEQ ID NO: 2981442 - protein, 17 aa, Entamoeba invadens
IGEYGWKGILPRKTDKH

SEQ ID NO: 2981443 - protein, 18 aa, Entamoeba invadens
IGFCSRNVISLLLIKDKV

SEQ ID NO: 2981444 - protein, 18 aa, Entamoeba invadens
IGFSICFDVLLNSLKGDG

SEQ ID NO: 2981445 - protein, 20 aa, Entamoeba invadens
IGGLFLKLAPFLKIYGEYCK

SEQ ID NO: 2981446 - protein, 19 aa, Entamoeba invadens
IGGTSAWKASFALKDSTFG

SEQ ID NO: 2981447 - protein, 25 aa, Entamoeba invadens
IGHTLRLIDHFLFYNHICIVTEMLG

SEQ ID NO: 2981448 - protein, 19 aa, Entamoeba invadens
IGICLDRWAYVWDLRLRKP

SEQ ID NO: 2981449 - protein, 17 aa, Entamoeba invadens
IGKGCFYGCRLLSSIKL

SEQ ID NO: 2981450 - protein, 23 aa, Entamoeba invadens
IGKQGGKLWKWYKKNGKEKDKKD

SEQ ID NO: 2981451 - protein, 19 aa, Entamoeba invadens
IGLLFCGFGEFSLDSKSYN

SEQ ID NO: 2981452 - protein, 19 aa, Entamoeba invadens
IGLLFKYVYLFYLKSPLAM

SEQ ID NO: 2981453 - protein, 17 aa, Entamoeba invadens
IGRGSKTLHCFEVTDED

SEQ ID NO: 2981454 - protein, 17 aa, Entamoeba invadens
IGRLCFVNCQLLKKFVC

SEQ ID NO: 2981455 - protein, 18 aa, Entamoeba invadens
IGSGLWYLHFIKKLIHRD

SEQ ID NO: 2981456 - protein, 17 aa, Entamoeba invadens
IGSYAFRQCEKLEDINV

SEQ ID NO: 2981457 - protein, 18 aa, Entamoeba invadens
IGTSVAWDRTCAISSVVF

SEQ ID NO: 2981458 - protein, 17 aa, Entamoeba invadens
IGTVLSFDKIDEIYEYK

SEQ ID NO: 2981459 - protein, 19 aa, Entamoeba invadens
IGYNCFRGCISLSSVTIPS

SEQ ID NO: 2981460 - protein, 17 aa, Entamoeba invadens
IGYRNRMDFTFGDRMKG

SEQ ID NO: 2981461 - protein, 19 aa, Entamoeba invadens
IHFKPPFPIEKYAVSCPPS

SEQ ID NO: 2981462 - protein, 19 aa, Entamoeba invadens
IHFTFLWVKDMFTFLDLKP

SEQ ID NO: 2981463 - protein, 22 aa, Entamoeba invadens
IHIWYQFRNWFRLFKRTKKLKL

SEQ ID NO: 2981464 - protein, 19 aa, Entamoeba invadens
IHKRCCQNAFVANLYISAA

SEQ ID NO: 2981465 - protein, 25 aa, Entamoeba invadens
IHNCYRYVEKYGRLYVNAAMKINPP

SEQ ID NO: 2981466 - protein, 17 aa, Entamoeba invadens
IHPSRWYPLDVNCIKEG

SEQ ID NO: 2981467 - protein, 23 aa, Entamoeba invadens
IHRKMRCGFILSGGPAAGGHNVV

SEQ ID NO: 2981468 - protein, 17 aa, Entamoeba invadens
IHSALGVDVLLNTQNQC

SEQ ID NO: 2981469 - protein, 17 aa, Entamoeba invadens
IHSGFGLGRYGEELSGP

SEQ ID NO: 2981470 - protein, 17 aa, Entamoeba invadens
IHSIGFWRSKEHVFVRH

SEQ ID NO: 2981471 - protein, 23 aa, Entamoeba invadens
IHSWWRLGGWYYFYLQFEEDGKR

SEQ ID NO: 2981472 - protein, 25 aa, Entamoeba invadens
IHTWYQFRNWVWFRLFQKVRPTLKR

SEQ ID NO: 2981473 - protein, 25 aa, Entamoeba invadens
IIDEFKKAAAVQIVMLGGEYIGNKR

SEQ ID NO: 2981474 - protein, 19 aa, Entamoeba invadens
IIDFGSACFSTYTLYSYIQ

SEQ ID NO: 2981475 - protein, 23 aa, Entamoeba invadens
IIDNIPCGLAWPYLTGEKGIGID

SEQ ID NO: 2981476 - protein, 19 aa, Entamoeba invadens
IIGGVCLQIFPTIQRVEFV

SEQ ID NO: 2981477 - protein, 24 aa, Entamoeba invadens
IIGKDLRCGFCIESGDGVTQIGVM

SEQ ID NO: 2981478 - protein, 21 aa, Entamoeba invadens
IIKEIVLWKHMYNVGIVGEVF

SEQ ID NO: 2981479 - protein, 23 aa, Entamoeba invadens
IIKKGCKINEFITQLFTYESELL

SEQ ID NO: 2981480 - protein, 23 aa, Entamoeba invadens
IIKRGTEFFSFLISRDDNISPKI

SEQ ID NO: 2981481 - protein, 23 aa, Entamoeba invadens
IIKRTGCDLSKCRLNVVLTCPAY

SEQ ID NO: 2981482 - protein, 18 aa, Entamoeba invadens
IILWELVYRLIYQKYQRP

SEQ ID NO: 2981483 - protein, 17 aa, Entamoeba invadens
IIMPECQFISMQIGDKT

SEQ ID NO: 2981484 - protein, 19 aa, Entamoeba invadens
IINDIPVSYGFFIRMKTLG

SEQ ID NO: 2981485 - protein, 24 aa, Entamoeba invadens
IIPKEVWRLCGFIVPHLGEKNLFT

SEQ ID NO: 2981486 - protein, 17 aa, Entamoeba invadens
IIPKWCFAECIKLSRVN

SEQ ID NO: 2981487 - protein, 28 aa, Entamoeba invadens
IIPTIIVDIGSYIIRAGLSTTENDEPEV

SEQ ID NO: 2981488 - protein, 26 aa, Entamoeba invadens
IIQFAFRWFNCFLLREFSFKQGLRLW

SEQ ID NO: 2981489 - protein, 17 aa, Entamoeba invadens
IISRVALIPKIFSYAHI

SEQ ID NO: 2981490 - protein, 17 aa, Entamoeba invadens
IISWQHICRIILFSLTV

SEQ ID NO: 2981491 - protein, 20 aa, Entamoeba invadens
IISYSYKTGFSITAKVCNNS

SEQ ID NO: 2981492 - protein, 17 aa, Entamoeba invadens
IITEIFPSILFKIPDFI

SEQ ID NO: 2981493 - protein, 25 aa, Entamoeba invadens
IITEIYIIFDFLRHILIYKAITKRN

SEQ ID NO: 2981494 - protein, 17 aa, Entamoeba invadens
IITPLALFLGGSGGGHA

SEQ ID NO: 2981495 - protein, 18 aa, Entamoeba invadens
IITPLALFLGGSGGGHAN

SEQ ID NO: 2981496 - protein, 17 aa, Entamoeba invadens
IIWYSVNYLTYFQNTDR

SEQ ID NO: 2981497 - protein, 30 aa, Entamoeba invadens
IIYKLMELFITFKFSPTFLYFMSRALVELH

SEQ ID NO: 2981498 - protein, 25 aa, Entamoeba invadens
IIYNEFLKRYFFLGTNINKKTSDAM

SEQ ID NO: 2981499 - protein, 19 aa, Entamoeba invadens
IKALEALNKMVWDDKTDDE

SEQ ID NO: 2981500 - protein, 18 aa, Entamoeba invadens
IKAQCKLGLTATLVREDK

SEQ ID NO: 2981501 - protein, 19 aa, Entamoeba invadens
IKATYSFTRWCYIYKNVED

SEQ ID NO: 2981502 - protein, 22 aa, Entamoeba invadens
IKCAWINTSCRVITKKAFNVNI

SEQ ID NO: 2981503 - protein, 18 aa, Entamoeba invadens
IKCGYWFLMENVNFCNPT

SEQ ID NO: 2981504 - protein, 18 aa, Entamoeba invadens
IKCNLRYPLFATSCSVVN

SEQ ID NO: 2981505 - protein, 17 aa, Entamoeba invadens
IKDAFNRFVDVVDSTHD

SEQ ID NO: 2981506 - protein, 17 aa, Entamoeba invadens
IKDGAVVTVVFVTPKKI

SEQ ID NO: 2981507 - protein, 22 aa, Entamoeba invadens
IKDTGCLPVPMNIRNAATNLMG

SEQ ID NO: 2981508 - protein, 20 aa, Entamoeba invadens
IKEAFKFDSCETFNNEYFTL

SEQ ID NO: 2981509 - protein, 18 aa, Entamoeba invadens
IKEKGAHIEGIFRVSGSK

SEQ ID NO: 2981510 - protein, 20 aa, Entamoeba invadens
IKEKLLRLDIATIKTNAVFA

SEQ ID NO: 2981511 - protein, 22 aa, Entamoeba invadens
IKEKRVNEVLFWTVPGPEEENE

SEQ ID NO: 2981512 - protein, 17 aa, Entamoeba invadens
IKENVCYVALDYDAEMK

SEQ ID NO: 2981513 - protein, 19 aa, Entamoeba invadens
IKENVHLPILFVGNKSDLE

SEQ ID NO: 2981514 - protein, 18 aa, Entamoeba invadens
IKEQFGYVSLNFNQEVLN

SEQ ID NO: 2981515 - protein, 19 aa, Entamoeba invadens
IKFAGKRAHICYISTIGAA

SEQ ID NO: 2981516 - protein, 20 aa, Entamoeba invadens
IKFARPADCLPKVADLVGQI

SEQ ID NO: 2981517 - protein, 19 aa, Entamoeba invadens
IKFKFPWKIAEFVISGKRL

SEQ ID NO: 2981518 - protein, 18 aa, Entamoeba invadens
IKFLLRILKGVFRIGFSE

SEQ ID NO: 2981519 - protein, 17 aa, Entamoeba invadens
IKFLWNFLWGNAPRVRF

SEQ ID NO: 2981520 - protein, 21 aa, Entamoeba invadens
IKFPISFPIIYKTLRVDGDMS

SEQ ID NO: 2981521 - protein, 17 aa, Entamoeba invadens
IKFPQLFTDKRKPWTGI

SEQ ID NO: 2981522 - protein, 17 aa, Entamoeba invadens
IKFSELVSVYYLLESPI

SEQ ID NO: 2981523 - protein, 20 aa, Entamoeba invadens
IKGFPSILAVDVFKEYTKMK

SEQ ID NO: 2981524 - protein, 18 aa, Entamoeba invadens
IKGKIVMDVGCGLGILSL

SEQ ID NO: 2981525 - protein, 21 aa, Entamoeba invadens
IKGNRFGAAIFSRILHIAEPV

SEQ ID NO: 2981526 - protein, 20 aa, Entamoeba invadens
IKGYFPRADFVVFGHIKTIN

SEQ ID NO: 2981527 - protein, 20 aa, Entamoeba invadens
IKIELCNSVFSCLYPTPQNV

SEQ ID NO: 2981528 - protein, 18 aa, Entamoeba invadens
IKISEEFNVAVVITNQVM

SEQ ID NO: 2981529 - protein, 18 aa, Entamoeba invadens
IKKCPRCRAPVLKSYGCN

SEQ ID NO: 2981530 - protein, 21 aa, Entamoeba invadens
IKKGEGFILFYAINSKKSYLQ

SEQ ID NO: 2981531 - protein, 21 aa, Entamoeba invadens
IKKKEVCSVEKWLGALRKTFT

SEQ ID NO: 2981532 - protein, 22 aa, Entamoeba invadens
IKKLLTSFGIEWVKSKILPSVI

SEQ ID NO: 2981533 - protein, 21 aa, Entamoeba invadens
IKKLMSAWVYRGFIRTLNNSL

SEQ ID NO: 2981534 - protein, 18 aa, Entamoeba invadens
IKKPKLRAVMSVLKGDVK

SEQ ID NO: 2981535 - protein, 19 aa, Entamoeba invadens
IKKSIKWAVLIQDNCVSHI

SEQ ID NO: 2981536 - protein, 19 aa, Entamoeba invadens
IKKTLLEFVQFKNKFVSFS

SEQ ID NO: 2981537 - protein, 17 aa, Entamoeba invadens
IKLEEFDVLQLPRVLEV

SEQ ID NO: 2981538 - protein, 22 aa, Entamoeba invadens
IKLELIKVFGIIGAIDTYKYKL

SEQ ID NO: 2981539 - protein, 23 aa, Entamoeba invadens
IKLELMKGCTTFAAIYAEVAKYM

SEQ ID NO: 2981540 - protein, 20 aa, Entamoeba invadens
IKLKGAECTLQFANERTLHA

SEQ ID NO: 2981541 - protein, 20 aa, Entamoeba invadens
IKLKVGYCFVTFKNEEDTKK

SEQ ID NO: 2981542 - protein, 22 aa, Entamoeba invadens
IKLNELQLIFGRKSTIIGQYMD

SEQ ID NO: 2981543 - protein, 18 aa, Entamoeba invadens
IKMLKILCRWFCRKRRLS

SEQ ID NO: 2981544 - protein, 19 aa, Entamoeba invadens
IKNAAFCFSEASNAVVGNE

SEQ ID NO: 2981545 - protein, 17 aa, Entamoeba invadens
IKNEWDLLYVVGEGKQF

SEQ ID NO: 2981546 - protein, 17 aa, Entamoeba invadens
IKNEWYGLQGWRMSIDN

SEQ ID NO: 2981547 - protein, 20 aa, Entamoeba invadens
IKPPRGVLMYGPPGCGKTMI

SEQ ID NO: 2981548 - protein, 23 aa, Entamoeba invadens
IKQEEFHSILGFANRSETLKQTE

SEQ ID NO: 2981549 - protein, 17 aa, Entamoeba invadens
IKQFGFYVDGIRAAVMS

SEQ ID NO: 2981550 - protein, 19 aa, Entamoeba invadens
IKQLVYFIGEFELNKLTTL

SEQ ID NO: 2981551 - protein, 17 aa, Entamoeba invadens
IKRIHGFPETFTTNVAG

SEQ ID NO: 2981552 - protein, 22 aa, Entamoeba invadens
IKRTCAYCGNKFCYNCREKTWH

SEQ ID NO: 2981553 - protein, 20 aa, Entamoeba invadens
IKRVEPFCCCPLEVERFSKV

SEQ ID NO: 2981554 - protein, 18 aa, Entamoeba invadens
IKSCKLMISRGYSKGFGF

SEQ ID NO: 2981555 - protein, 17 aa, Entamoeba invadens
IKSEMFFFDAFYLAEKI

SEQ ID NO: 2981556 - protein, 20 aa, Entamoeba invadens
IKSKRAHPLPNWNKRTEILL

SEQ ID NO: 2981557 - protein, 21 aa, Entamoeba invadens
IKSKRKKRDWFVKRQKVEKPE

SEQ ID NO: 2981558 - protein, 18 aa, Entamoeba invadens
IKSLLPIVFNKSTQIGNS

SEQ ID NO: 2981559 - protein, 20 aa, Entamoeba invadens
IKSLSFCANCPLTTLYITNR

SEQ ID NO: 2981560 - protein, 20 aa, Entamoeba invadens
IKSWLSCLAEIFKANVVAWE

SEQ ID NO: 2981561 - protein, 19 aa, Entamoeba invadens
IKTHIWKTFLAIPHILSED

SEQ ID NO: 2981562 - protein, 17 aa, Entamoeba invadens
IKTMEWFFRVEKLCEMM

SEQ ID NO: 2981563 - protein, 21 aa, Entamoeba invadens
IKTMVECNALFKQRSEEGMRN

SEQ ID NO: 2981564 - protein, 22 aa, Entamoeba invadens
IKTPMVYQFLSFVFTQFNKLFP

SEQ ID NO: 2981565 - protein, 22 aa, Entamoeba invadens
IKTVPIRLCFDLKCIQRIDLSC

SEQ ID NO: 2981566 - protein, 18 aa, Entamoeba invadens
IKVAEEWGCLYFETSSKT

SEQ ID NO: 2981567 - protein, 22 aa, Entamoeba invadens
IKVLDFGSACFDNYTLYTYVQS

SEQ ID NO: 2981568 - protein, 17 aa, Entamoeba invadens
IKVSECRDNLTVIAVKV

SEQ ID NO: 2981569 - protein, 17 aa, Entamoeba invadens
IKVSEDLLPTVNVKDLV

SEQ ID NO: 2981570 - protein, 17 aa, Entamoeba invadens
IKVYSIWEFLRGECDCQ

SEQ ID NO: 2981571 - protein, 19 aa, Entamoeba invadens
IKYFCFNRCGNLTSFEFPK

SEQ ID NO: 2981572 - protein, 17 aa, Entamoeba invadens
IKYKIDIPNTWSEGPDF

SEQ ID NO: 2981573 - protein, 17 aa, Entamoeba invadens
IKYSTVMACEDYLFPTF

SEQ ID NO: 2981574 - protein, 18 aa, Entamoeba invadens
ILACDGYVVGSCEKNYNT

SEQ ID NO: 2981575 - protein, 26 aa, Entamoeba invadens
ILACGGRALMSWSFMPPQTFVSNFSS

SEQ ID NO: 2981576 - protein, 19 aa, Entamoeba invadens
ILAIECLHQLNVIYRDIKL

SEQ ID NO: 2981577 - protein, 18 aa, Entamoeba invadens
ILAIKYFCFNRCGNLTSF

SEQ ID NO: 2981578 - protein, 21 aa, Entamoeba invadens
ILCDIKEGMEIVKNHREVDEN

SEQ ID NO: 2981579 - protein, 17 aa, Entamoeba invadens
ILDEWRGSIVVFDLKTN

SEQ ID NO: 2981580 - protein, 23 aa, Entamoeba invadens
ILDFSFKTAYFFAAVKKRITVKL

SEQ ID NO: 2981581 - protein, 17 aa, Entamoeba invadens
ILDRFKLFRFNKYTFED

SEQ ID NO: 2981582 - protein, 23 aa, Entamoeba invadens
ILECTRLGLKTVWLGGTFTTSVF

SEQ ID NO: 2981583 - protein, 25 aa, Entamoeba invadens
ILECTRLGLKTVWLGGTFTTSVFTA

SEQ ID NO: 2981584 - protein, 23 aa, Entamoeba invadens
ILEEFPKRYDLWNVYLDMESRVG

SEQ ID NO: 2981585 - protein, 22 aa, Entamoeba invadens
ILEEIQKQLALLPTIMERISNF

SEQ ID NO: 2981586 - protein, 21 aa, Entamoeba invadens
ILEFSLRLCADMLYLVVLTPE

SEQ ID NO: 2981587 - protein, 17 aa, Entamoeba invadens
ILEGLAFCHHHEILHRD

SEQ ID NO: 2981588 - protein, 23 aa, Entamoeba invadens
ILEIPYSLLFTFRVPESVQEIHV

SEQ ID NO: 2981589 - protein, 23 aa, Entamoeba invadens
ILEKWCFRCCRSLRSIDIPINVK

SEQ ID NO: 2981590 - protein, 20 aa, Entamoeba invadens
ILELIKKFIFRMMGEKDEII

SEQ ID NO: 2981591 - protein, 22 aa, Entamoeba invadens
ILEMENCSWFDFVFPFHSLLEL

SEQ ID NO: 2981592 - protein, 17 aa, Entamoeba invadens
ILEQLCLKYCIFITLFV

SEQ ID NO: 2981593 - protein, 23 aa, Entamoeba invadens
ILERLKHPFLVNLYAEFESPKYH

SEQ ID NO: 2981594 - protein, 18 aa, Entamoeba invadens
ILFLYALRHPACGYVQGL

SEQ ID NO: 2981595 - protein, 19 aa, Entamoeba invadens
ILFSLSFVETLCRYGEDLQ

SEQ ID NO: 2981596 - protein, 18 aa, Entamoeba invadens
ILGCSMCICRAAASFKKL

SEQ ID NO: 2981597 - protein, 17 aa, Entamoeba invadens
ILGIPLFPGNSEYNELY

SEQ ID NO: 2981598 - protein, 25 aa, Entamoeba invadens
ILGKCCLSIFRRCEETIKETLKKGN

SEQ ID NO: 2981599 - protein, 17 aa, Entamoeba invadens
ILGRYKLPLFFGKITHP

SEQ ID NO: 2981600 - protein, 18 aa, Entamoeba invadens
ILGSYKFDGRSCVDLKDK

SEQ ID NO: 2981601 - protein, 18 aa, Entamoeba invadens
ILHHPHIINYYASYETSK

SEQ ID NO: 2981602 - protein, 24 aa, Entamoeba invadens
ILIANKRLQAILRDRRTEIKDLQS

SEQ ID NO: 2981603 - protein, 18 aa, Entamoeba invadens
ILIKKIPPVWARAVVEAA

SEQ ID NO: 2981604 - protein, 25 aa, Entamoeba invadens
ILIKLLLPYCDIVFCKPSKRTTTTF

SEQ ID NO: 2981605 - protein, 17 aa, Entamoeba invadens
ILIMKTLYNFCKAKEKT

SEQ ID NO: 2981606 - protein, 17 aa, Entamoeba invadens
ILIPLGLTRLFFADCKY

SEQ ID NO: 2981607 - protein, 19 aa, Entamoeba invadens
ILKGVGHGVGVDWWSLGIL

SEQ ID NO: 2981608 - protein, 28 aa, Entamoeba invadens
ILKRKDEVFRKACVLKRIEESARPQLEE

SEQ ID NO: 2981609 - protein, 24 aa, Entamoeba invadens
ILKSGWRYPIPIFRTIQYLKYNKA

SEQ ID NO: 2981610 - protein, 25 aa, Entamoeba invadens
ILKTCILRLFTIDVPQSWVTNSAEN

SEQ ID NO: 2981611 - protein, 17 aa, Entamoeba invadens
ILLKIVFLKVQESYGNN

SEQ ID NO: 2981612 - protein, 22 aa, Entamoeba invadens
ILMKGRCFNSYALNAALRKTLK

SEQ ID NO: 2981613 - protein, 23 aa, Entamoeba invadens
ILMQRRKLVILKSVEQLAKSLKS

SEQ ID NO: 2981614 - protein, 23 aa, Entamoeba invadens
ILNYDLFPLFSIILSSEIGKVGT

SEQ ID NO: 2981615 - protein, 17 aa, Entamoeba invadens
ILPTGAIVYEKCPACGN

SEQ ID NO: 2981616 - protein, 17 aa, Entamoeba invadens
ILQILLNLCEFMEREGI

SEQ ID NO: 2981617 - protein, 24 aa, Entamoeba invadens
ILQLKRQLLDFGFFAEVVGSDVNA

SEQ ID NO: 2981618 - protein, 19 aa, Entamoeba invadens
ILRKKICILPQEATLFSGT

SEQ ID NO: 2981619 - protein, 17 aa, Entamoeba invadens
ILRLCGSQEKMKWMKER

SEQ ID NO: 2981620 - protein, 17 aa, Entamoeba invadens
ILRRHFAEWGELEYIRV

SEQ ID NO: 2981621 - protein, 22 aa, Entamoeba invadens
ILRRLCVEFPDLLTKCNLFCGV

SEQ ID NO: 2981622 - protein, 19 aa, Entamoeba invadens
ILSDCANFAFLVGKERSTK

SEQ ID NO: 2981623 - protein, 17 aa, Entamoeba invadens
ILSEVHFIRGFQIYDYE

SEQ ID NO: 2981624 - protein, 18 aa, Entamoeba invadens
ILSLLFEWDALREDDLNE

SEQ ID NO: 2981625 - protein, 17 aa, Entamoeba invadens
ILSNILFRHDQLFDRFP

SEQ ID NO: 2981626 - protein, 17 aa, Entamoeba invadens
ILSPSVFNLCYLKSIEF

SEQ ID NO: 2981627 - protein, 24 aa, Entamoeba invadens
ILTSSFYRKCCGAFLVFDLNDRNS

SEQ ID NO: 2981628 - protein, 18 aa, Entamoeba invadens
ILVRMAINLVNSFYSTFL

SEQ ID NO: 2981629 - protein, 17 aa, Entamoeba invadens
ILYKLRLGENVTTIPTI

SEQ ID NO: 2981630 - protein, 22 aa, Entamoeba invadens
ILYLLIRTFEICVPRIPFDDTF

SEQ ID NO: 2981631 - protein, 21 aa, Entamoeba invadens
IMAKKCPRCKMYISKENGCNT

SEQ ID NO: 2981632 - protein, 19 aa, Entamoeba invadens
IMCGEVWCSSAFVEEERNS

SEQ ID NO: 2981633 - protein, 20 aa, Entamoeba invadens
IMCGEVWCSSAFVEEERNSG

SEQ ID NO: 2981634 - protein, 21 aa, Entamoeba invadens
IMEVKDSFVLRVLYRLKCQLS

SEQ ID NO: 2981635 - protein, 18 aa, Entamoeba invadens
IMFLCVLFSHLGEVPETF

SEQ ID NO: 2981636 - protein, 18 aa, Entamoeba invadens
IMGALKLTEWCTVDSVVI

SEQ ID NO: 2981637 - protein, 19 aa, Entamoeba invadens
IMKNRGGAVLNTFIECLAT

SEQ ID NO: 2981638 - protein, 18 aa, Entamoeba invadens
IMKSFRFLLEDDTNKNKS

SEQ ID NO: 2981639 - protein, 17 aa, Entamoeba invadens
IMKYCAKHSVFAGKKHV

SEQ ID NO: 2981640 - protein, 18 aa, Entamoeba invadens
IMTWGCILLLKGDFNLLP

SEQ ID NO: 2981641 - protein, 24 aa, Entamoeba invadens
INCFRCICCGRILEGDVLPDPTQL

SEQ ID NO: 2981642 - protein, 21 aa, Entamoeba invadens
INCLLERVGSNLGIDQSDNNR

SEQ ID NO: 2981643 - protein, 22 aa, Entamoeba invadens
INCPIDFPLFFDFLRITNSRLK

SEQ ID NO: 2981644 - protein, 17 aa, Entamoeba invadens
INDICWELPHIAIATNE

SEQ ID NO: 2981645 - protein, 18 aa, Entamoeba invadens
INECYKFFGKEIKGAEDV

SEQ ID NO: 2981646 - protein, 18 aa, Entamoeba invadens
INEYMVQSAMMFHSASKQ

SEQ ID NO: 2981647 - protein, 17 aa, Entamoeba invadens
INFNGCFITPINLHLEK

SEQ ID NO: 2981648 - protein, 20 aa, Entamoeba invadens
INFNLCFKDYYLAANSSKNP

SEQ ID NO: 2981649 - protein, 18 aa, Entamoeba invadens
INFSEFKKSGILPEDFGE

SEQ ID NO: 2981650 - protein, 17 aa, Entamoeba invadens
INGGLNWTKPIDGANNE

SEQ ID NO: 2981651 - protein, 17 aa, Entamoeba invadens
INKRALEEIRCLKVNSH

SEQ ID NO: 2981652 - protein, 23 aa, Entamoeba invadens
INKSCAKLACSMHINPVLISSVD

SEQ ID NO: 2981653 - protein, 23 aa, Entamoeba invadens
INLPRLGIKYGICEGKREVCELE

SEQ ID NO: 2981654 - protein, 17 aa, Entamoeba invadens
INNLEIYNTILLNTKLE

SEQ ID NO: 2981655 - protein, 22 aa, Entamoeba invadens
INNLKFLFKYYLLVSNYVAAVG

SEQ ID NO: 2981656 - protein, 19 aa, Entamoeba invadens
INPLRVVVRNVPRAVTNDE

SEQ ID NO: 2981657 - protein, 17 aa, Entamoeba invadens
INRCIPFTTEDGTSIQY

SEQ ID NO: 2981658 - protein, 25 aa, Entamoeba invadens
INSFCSLCGVSLFKWEKDILVLFGK

SEQ ID NO: 2981659 - protein, 17 aa, Entamoeba invadens
INSFTGSVKSMWDIIKD

SEQ ID NO: 2981660 - protein, 18 aa, Entamoeba invadens
INSGMPFYIYNLIEELDE

SEQ ID NO: 2981661 - protein, 19 aa, Entamoeba invadens
INSPVCFKLFPHIHTLNFY

SEQ ID NO: 2981662 - protein, 18 aa, Entamoeba invadens
INTFDCFDWYVVSGCQSG

SEQ ID NO: 2981663 - protein, 19 aa, Entamoeba invadens
INTLLAMKVFSSVFYGVRG

SEQ ID NO: 2981664 - protein, 23 aa, Entamoeba invadens
INVRAACWMKAMLDAKNLEINEF

SEQ ID NO: 2981665 - protein, 18 aa, Entamoeba invadens
INVSEWFYLKHVYIEPDQ

SEQ ID NO: 2981666 - protein, 19 aa, Entamoeba invadens
INVSLCALRDVIAAISSKA

SEQ ID NO: 2981667 - protein, 17 aa, Entamoeba invadens
INVWFEVDYKMYKTSEN

SEQ ID NO: 2981668 - protein, 17 aa, Entamoeba invadens
INYKGGLLLPFRSELYI

SEQ ID NO: 2981669 - protein, 20 aa, Entamoeba invadens
IPCLCFRGCVKLSSIELPYK

SEQ ID NO: 2981670 - protein, 17 aa, Entamoeba invadens
IPDCYKLLMFQDPSHLF

SEQ ID NO: 2981671 - protein, 21 aa, Entamoeba invadens
IPDDIIVCFDHSYVMAEDLQL

SEQ ID NO: 2981672 - protein, 22 aa, Entamoeba invadens
IPDPLCLMCYLFPEIVKKTITV

SEQ ID NO: 2981673 - protein, 18 aa, Entamoeba invadens
IPEFDSLFVFSCDHCERS

SEQ ID NO: 2981674 - protein, 17 aa, Entamoeba invadens
IPEQAEFFLTKGSKSDF

SEQ ID NO: 2981675 - protein, 19 aa, Entamoeba invadens
IPFECLFQFTSNKVVVPST

SEQ ID NO: 2981676 - protein, 18 aa, Entamoeba invadens
IPFPRWGSYQNFALFMAA

SEQ ID NO: 2981677 - protein, 20 aa, Entamoeba invadens
IPFSGLVSFKYPCDDDLIPE

SEQ ID NO: 2981678 - protein, 18 aa, Entamoeba invadens
IPGICFVEVSGKYFRMSE

SEQ ID NO: 2981679 - protein, 17 aa, Entamoeba invadens
IPGSVKVLREWTFAGCV

SEQ ID NO: 2981680 - protein, 17 aa, Entamoeba invadens
IPHHIYASSMAFEKLCV

SEQ ID NO: 2981681 - protein, 17 aa, Entamoeba invadens
IPIFVVCSCGKEQSLAH

SEQ ID NO: 2981682 - protein, 17 aa, Entamoeba invadens
IPILPLWMGDIIHAQTL

SEQ ID NO: 2981683 - protein, 26 aa, Entamoeba invadens
IPILVYRYLCSPTPYIMAATLEIYNS

SEQ ID NO: 2981684 - protein, 21 aa, Entamoeba invadens
IPKDKLEVIFLHFPDVSSIND

SEQ ID NO: 2981685 - protein, 17 aa, Entamoeba invadens
IPKEIWRLCDFVRPHLA

SEQ ID NO: 2981686 - protein, 18 aa, Entamoeba invadens
IPKETKLLFGNVVYTKKD

SEQ ID NO: 2981687 - protein, 21 aa, Entamoeba invadens
IPKFCFEKCYLLTTVVFAETV

SEQ ID NO: 2981688 - protein, 21 aa, Entamoeba invadens
IPKIRAFFLFQTPKMLSLLQR

SEQ ID NO: 2981689 - protein, 17 aa, Entamoeba invadens
IPKSLAVAFDFYTKFYT

SEQ ID NO: 2981690 - protein, 18 aa, Entamoeba invadens
IPKYCIAVGCADLIGQAI

SEQ ID NO: 2981691 - protein, 20 aa, Entamoeba invadens
IPLEVPMAIFHFGGTFTHII

SEQ ID NO: 2981692 - protein, 24 aa, Entamoeba invadens
IPLKSCDLHVFFALHRLFIEAKTA

SEQ ID NO: 2981693 - protein, 20 aa, Entamoeba invadens
IPLLKFNQIRGFDKMSEIVV

SEQ ID NO: 2981694 - protein, 17 aa, Entamoeba invadens
IPLQLSFEIVRIYLDSL

SEQ ID NO: 2981695 - protein, 22 aa, Entamoeba invadens
IPMADLTKWVKMRTNSTDVDFV

SEQ ID NO: 2981696 - protein, 18 aa, Entamoeba invadens
IPMLITLVMSRFSDQISH

SEQ ID NO: 2981697 - protein, 17 aa, Entamoeba invadens
IPNFPFVCVEEMSIKNL

SEQ ID NO: 2981698 - protein, 18 aa, Entamoeba invadens
IPNIACWCFYNFDLMPSR

SEQ ID NO: 2981699 - protein, 18 aa, Entamoeba invadens
IPNIVPIPSVPNVPTISL

SEQ ID NO: 2981700 - protein, 17 aa, Entamoeba invadens
IPNLSFEIIEVMKVFND

SEQ ID NO: 2981701 - protein, 23 aa, Entamoeba invadens
IPNYFFKNCTALAKIVNFDKITE

SEQ ID NO: 2981702 - protein, 24 aa, Entamoeba invadens
IPPKDALECIFNWTVADRSTVSMV

SEQ ID NO: 2981703 - protein, 17 aa, Entamoeba invadens
IPPKFACEFSLFLNPLC

SEQ ID NO: 2981704 - protein, 18 aa, Entamoeba invadens
IPPTISIFGDEVFSTCEK

SEQ ID NO: 2981705 - protein, 21 aa, Entamoeba invadens
IPPVRPHLRPQVKPVVPERRV

SEQ ID NO: 2981706 - protein, 17 aa, Entamoeba invadens
IPPVWARAVVEAAEAAD

SEQ ID NO: 2981707 - protein, 17 aa, Entamoeba invadens
IPQCDELGFLSPKCPQS

SEQ ID NO: 2981708 - protein, 20 aa, Entamoeba invadens
IPQLLLKVSLKLDEVNKIEK

SEQ ID NO: 2981709 - protein, 24 aa, Entamoeba invadens
IPQSMCYNCNLHLLTLPFGVTKIS

SEQ ID NO: 2981710 - protein, 21 aa, Entamoeba invadens
IPQTCGFVFDFQIRKHKPQTN

SEQ ID NO: 2981711 - protein, 17 aa, Entamoeba invadens
IPRSICVTFNFNCLLVL

SEQ ID NO: 2981712 - protein, 21 aa, Entamoeba invadens
IPSGLCWGCIRLTSVDFSFQL

SEQ ID NO: 2981713 - protein, 18 aa, Entamoeba invadens
IPSSWPFEVFPFILQHRS

SEQ ID NO: 2981714 - protein, 20 aa, Entamoeba invadens
IPSWCDRILWKTENRHHVEV

SEQ ID NO: 2981715 - protein, 19 aa, Entamoeba invadens
IPTHFVIVMSRLFKTVSKA

SEQ ID NO: 2981716 - protein, 21 aa, Entamoeba invadens
IPTTFGLRWVRMLFSREFTIE

SEQ ID NO: 2981717 - protein, 17 aa, Entamoeba invadens
IPVGLQFNERVDAWDDD

SEQ ID NO: 2981718 - protein, 19 aa, Entamoeba invadens
IPVLHLWLADLARISELPT

SEQ ID NO: 2981719 - protein, 17 aa, Entamoeba invadens
IPVLYAPQFDRVNRKEE

SEQ ID NO: 2981720 - protein, 18 aa, Entamoeba invadens
IPVNLYFNSLIFLNNLKR

SEQ ID NO: 2981721 - protein, 17 aa, Entamoeba invadens
IPYAWECFESMHATLTN

SEQ ID NO: 2981722 - protein, 17 aa, Entamoeba invadens
IPYLINVLLHFNFETAR

SEQ ID NO: 2981723 - protein, 23 aa, Entamoeba invadens
IQFKMRFARDCFGLFEVLCGDVN

SEQ ID NO: 2981724 - protein, 17 aa, Entamoeba invadens
IQFLSKVVMFFEITPQQ

SEQ ID NO: 2981725 - protein, 19 aa, Entamoeba invadens
IQHPLRYVLHLEQIVKSMP

SEQ ID NO: 2981726 - protein, 18 aa, Entamoeba invadens
IQIMPKCTLAGFNWFNAY

SEQ ID NO: 2981727 - protein, 25 aa, Entamoeba invadens
IQIMPKCTLCGFNWFNAYYTPGVSR

SEQ ID NO: 2981728 - protein, 25 aa, Entamoeba invadens
IQKRVYSALLWCCFVPTKICIVTEY

SEQ ID NO: 2981729 - protein, 17 aa, Entamoeba invadens
IQLKIKFLRAALKGDKK

SEQ ID NO: 2981730 - protein, 23 aa, Entamoeba invadens
IQMAECVFICFALNYEEQQKIAQ

SEQ ID NO: 2981731 - protein, 19 aa, Entamoeba invadens
IQMYFALRFMKKESAEEKR

SEQ ID NO: 2981732 - protein, 17 aa, Entamoeba invadens
IQMYRCLTSFLIDLKGF

SEQ ID NO: 2981733 - protein, 17 aa, Entamoeba invadens
IQNCPKLTHIEGIKQVA

SEQ ID NO: 2981734 - protein, 18 aa, Entamoeba invadens
IQPPEQFQIVSFVDEQQH

SEQ ID NO: 2981735 - protein, 20 aa, Entamoeba invadens
IQRFKTVYIDRIEKGMIDPK

SEQ ID NO: 2981736 - protein, 18 aa, Entamoeba invadens
IQRLPRYVLLFTDLMKHT

SEQ ID NO: 2981737 - protein, 22 aa, Entamoeba invadens
IRDRKLLLCKIRTVRKNLRKIS

SEQ ID NO: 2981738 - protein, 22 aa, Entamoeba invadens
IREIIYRNGMRVALINRNENTL

SEQ ID NO: 2981739 - protein, 17 aa, Entamoeba invadens
IRFCGLKLLGFMMTKHP

SEQ ID NO: 2981740 - protein, 18 aa, Entamoeba invadens
IRFGDLDWLIANVEIYPS

SEQ ID NO: 2981741 - protein, 20 aa, Entamoeba invadens
IRFLVCIDFLNAKKCRGLPV

SEQ ID NO: 2981742 - protein, 17 aa, Entamoeba invadens
IRIEKSFTEKCVKPLKN

SEQ ID NO: 2981743 - protein, 25 aa, Entamoeba invadens
IRIMPKCALCGFNWFNAYYTPGVSR

SEQ ID NO: 2981744 - protein, 18 aa, Entamoeba invadens
IRKRGFVSQNVYIFRKMT

SEQ ID NO: 2981745 - protein, 17 aa, Entamoeba invadens
IRKSALEVLDFFCTKMD

SEQ ID NO: 2981746 - protein, 19 aa, Entamoeba invadens
IRLGNPVTWSSWFGDDTGH

SEQ ID NO: 2981747 - protein, 20 aa, Entamoeba invadens
IRLLCLPLTIANKCIIQKTL

SEQ ID NO: 2981748 - protein, 17 aa, Entamoeba invadens
IRLSTFYKRGLKKMMVS

SEQ ID NO: 2981749 - protein, 18 aa, Entamoeba invadens
IRLTLAVAYRFLNDEQMA

SEQ ID NO: 2981750 - protein, 17 aa, Entamoeba invadens
IRMLLGYNKIVAMGIDV

SEQ ID NO: 2981751 - protein, 17 aa, Entamoeba invadens
IRNALLFYYRTGKTLSS

SEQ ID NO: 2981752 - protein, 19 aa, Entamoeba invadens
IRNWLQRWFVLTSDILYYF

SEQ ID NO: 2981753 - protein, 19 aa, Entamoeba invadens
IRPKFIIKNKVDEIPHFAS

SEQ ID NO: 2981754 - protein, 18 aa, Entamoeba invadens
IRPSCEFATVSSGNKVQF

SEQ ID NO: 2981755 - protein, 19 aa, Entamoeba invadens
IRQSQCFMIIYSINNKETF

SEQ ID NO: 2981756 - protein, 19 aa, Entamoeba invadens
IRRVTLLAGIYGDGTTLKP

SEQ ID NO: 2981757 - protein, 23 aa, Entamoeba invadens
IRSDKAMKAFLCFDQNSDELFAF

SEQ ID NO: 2981758 - protein, 18 aa, Entamoeba invadens
IRSGKCFEIDRTKSKIKG

SEQ ID NO: 2981759 - protein, 19 aa, Entamoeba invadens
IRVGMLYALKYEERAQEII

SEQ ID NO: 2981760 - protein, 18 aa, Entamoeba invadens
IRVKICLDGANGIEYLHT

SEQ ID NO: 2981761 - protein, 17 aa, Entamoeba invadens
IRVLCCIGGEEIDEQIK

SEQ ID NO: 2981762 - protein, 17 aa, Entamoeba invadens
IRVLYDMIDIAALNGYK

SEQ ID NO: 2981763 - protein, 19 aa, Entamoeba invadens
IRYNFAINYAFGFWDNQLF

SEQ ID NO: 2981764 - protein, 17 aa, Entamoeba invadens
ISACAAGELFFLFDSKV

SEQ ID NO: 2981765 - protein, 17 aa, Entamoeba invadens
ISAFRFAPVSSYEVTDW

SEQ ID NO: 2981766 - protein, 18 aa, Entamoeba invadens
ISALAMGCVAAFSKSEHG

SEQ ID NO: 2981767 - protein, 26 aa, Entamoeba invadens
ISALKRLFLLFGCFFMQIPFPKETET

SEQ ID NO: 2981768 - protein, 17 aa, Entamoeba invadens
ISALVLKYLYSIVQDNL

SEQ ID NO: 2981769 - protein, 19 aa, Entamoeba invadens
ISARLKRIFVPAKFSKIFR

SEQ ID NO: 2981770 - protein, 22 aa, Entamoeba invadens
ISCPSVKMIVPYVARLRLEKYV

SEQ ID NO: 2981771 - protein, 17 aa, Entamoeba invadens
ISDEWKRNGGVFRFEED

SEQ ID NO: 2981772 - protein, 17 aa, Entamoeba invadens
ISDTFVWYLNRFPIRVL

SEQ ID NO: 2981773 - protein, 17 aa, Entamoeba invadens
ISEEAKRVFGLKKTSAF

SEQ ID NO: 2981774 - protein, 19 aa, Entamoeba invadens
ISEFPSVSVVFPFNSSTGQ

SEQ ID NO: 2981775 - protein, 23 aa, Entamoeba invadens
ISEGISHLIFWARASGVKVANAC

SEQ ID NO: 2981776 - protein, 21 aa, Entamoeba invadens
ISELCFVVRGCLVLRGEFLDI

SEQ ID NO: 2981777 - protein, 17 aa, Entamoeba invadens
ISELYFWDSSQRENSSP

SEQ ID NO: 2981778 - protein, 22 aa, Entamoeba invadens
ISELYRALFICHLGGFVSNSAL

SEQ ID NO: 2981779 - protein, 17 aa, Entamoeba invadens
ISFGGSDFIFWVGQAKP

SEQ ID NO: 2981780 - protein, 22 aa, Entamoeba invadens
ISFKTKSSWGAQDFLDFLLSVP

SEQ ID NO: 2981781 - protein, 25 aa, Entamoeba invadens
ISFLYKRLNSVYLRRQCLESYITVN

SEQ ID NO: 2981782 - protein, 17 aa, Entamoeba invadens
ISFVYPKRVHDIRGGAA

SEQ ID NO: 2981783 - protein, 21 aa, Entamoeba invadens
ISFYCWEVFFRKLVMRADTCL

SEQ ID NO: 2981784 - protein, 18 aa, Entamoeba invadens
ISGFRFVIIITHADVFLK

SEQ ID NO: 2981785 - protein, 21 aa, Entamoeba invadens
ISGIYLGWLSRLVIRELMQKK

SEQ ID NO: 2981786 - protein, 22 aa, Entamoeba invadens
ISGKGGDCLILLETASATPVTV

SEQ ID NO: 2981787 - protein, 25 aa, Entamoeba invadens
ISHFAFRWLTCCLSREFSIKVILRL

SEQ ID NO: 2981788 - protein, 20 aa, Entamoeba invadens
ISHFCCCSLLIPPEVRDSCF

SEQ ID NO: 2981789 - protein, 23 aa, Entamoeba invadens
ISIGKYCFFHCFAIQKLVIPKSV

SEQ ID NO: 2981790 - protein, 22 aa, Entamoeba invadens
ISKCRCALCRYKVLCHMLTKPP

SEQ ID NO: 2981791 - protein, 24 aa, Entamoeba invadens
ISKELPSFIFFRWDHTHEDKEFKS

SEQ ID NO: 2981792 - protein, 24 aa, Entamoeba invadens
ISKKLCLEKACLVEVVMLMMNVSQ

SEQ ID NO: 2981793 - protein, 18 aa, Entamoeba invadens
ISKVLCEWYLMFVGQPIK

SEQ ID NO: 2981794 - protein, 19 aa, Entamoeba invadens
ISKVLCEWYLVFVGQPIKQ

SEQ ID NO: 2981795 - protein, 17 aa, Entamoeba invadens
ISLDFGIHPGVPYPFQD

SEQ ID NO: 2981796 - protein, 22 aa, Entamoeba invadens
ISLICPCGLLPRLAELAMSTDC

SEQ ID NO: 2981797 - protein, 26 aa, Entamoeba invadens
ISLLCCIKEIPFLCRCSKEAVLDIFH

SEQ ID NO: 2981798 - protein, 18 aa, Entamoeba invadens
ISMIDLWNKKGVVVGVDN

SEQ ID NO: 2981799 - protein, 24 aa, Entamoeba invadens
ISMMRMRFNLFWKPAQDLLAACIA

SEQ ID NO: 2981800 - protein, 21 aa, Entamoeba invadens
ISMYFVYQWLALLFKRDFGGE

SEQ ID NO: 2981801 - protein, 17 aa, Entamoeba invadens
ISPRILSNILFRHDQLF

SEQ ID NO: 2981802 - protein, 24 aa, Entamoeba invadens
ISRFCARFLGDYGFSIGISDVTPS

SEQ ID NO: 2981803 - protein, 23 aa, Entamoeba invadens
ISRKCDVWALGCLLFELATGVPP

SEQ ID NO: 2981804 - protein, 27 aa, Entamoeba invadens
ISSKIEVVFYFKISNFFGHQIDYSGVL

SEQ ID NO: 2981805 - protein, 20 aa, Entamoeba invadens
ISSKRIIKFVLWNIVDYKTF

SEQ ID NO: 2981806 - protein, 20 aa, Entamoeba invadens
ISSRCIKFRFNALPQETVFE

SEQ ID NO: 2981807 - protein, 17 aa, Entamoeba invadens
ISVFVIRRLFNKIGNDF

SEQ ID NO: 2981808 - protein, 17 aa, Entamoeba invadens
ISVGWRRYQTVATFSSE

SEQ ID NO: 2981809 - protein, 18 aa, Entamoeba invadens
ISVLRYGYGYDVFNEGLD

SEQ ID NO: 2981810 - protein, 26 aa, Entamoeba invadens
ITCIPKYCFHNCYGLEKINMKNCKEI

SEQ ID NO: 2981811 - protein, 19 aa, Entamoeba invadens
ITCSLRFPGQLNQDLKKLM

SEQ ID NO: 2981812 - protein, 23 aa, Entamoeba invadens
ITEIPAWCFGKCFSLRIVSLPKS

SEQ ID NO: 2981813 - protein, 19 aa, Entamoeba invadens
ITEKLFLWDKVRVEGGTYG

SEQ ID NO: 2981814 - protein, 24 aa, Entamoeba invadens
ITELKMYCCPVLKSFSLPQKVKNL

SEQ ID NO: 2981815 - protein, 20 aa, Entamoeba invadens
ITEMLQRFLLGFLQGETSNF

SEQ ID NO: 2981816 - protein, 23 aa, Entamoeba invadens
ITEVIRLLISFARDMGFDIKTKK

SEQ ID NO: 2981817 - protein, 22 aa, Entamoeba invadens
ITFIIEIAREFWIGKDGIYDHA

SEQ ID NO: 2981818 - protein, 23 aa, Entamoeba invadens
ITFPFKNKRLVSADVISELFFSL

SEQ ID NO: 2981819 - protein, 21 aa, Entamoeba invadens
ITFRFKFQFTDTVLLFQKGAF

SEQ ID NO: 2981820 - protein, 17 aa, Entamoeba invadens
ITICLRKDDGTQHQLVL

SEQ ID NO: 2981821 - protein, 18 aa, Entamoeba invadens
ITIPEIRQSTFFKSFKAE

SEQ ID NO: 2981822 - protein, 21 aa, Entamoeba invadens
ITIYECFKWGEAYPINEFKFP

SEQ ID NO: 2981823 - protein, 26 aa, Entamoeba invadens
ITKFGLRCFIHNRILRKITLSPNLHE

SEQ ID NO: 2981824 - protein, 18 aa, Entamoeba invadens
ITKIMNWMLKCLICHEEI

SEQ ID NO: 2981825 - protein, 19 aa, Entamoeba invadens
ITKPKLRASMSMLKGEMKN

SEQ ID NO: 2981826 - protein, 22 aa, Entamoeba invadens
ITKQEIIHVLSLLESVKIIKKV

SEQ ID NO: 2981827 - protein, 17 aa, Entamoeba invadens
ITKYRFGVVYVGPGQYQ

SEQ ID NO: 2981828 - protein, 17 aa, Entamoeba invadens
ITLIEIFFKELFLSQEN

SEQ ID NO: 2981829 - protein, 17 aa, Entamoeba invadens
ITLWAMFYKNTHLNLVI

SEQ ID NO: 2981830 - protein, 23 aa, Entamoeba invadens
ITMYEVFGWKEAYSVQTFKFPWK

SEQ ID NO: 2981831 - protein, 20 aa, Entamoeba invadens
ITNVLVCIDITPSVLSEAIS

SEQ ID NO: 2981832 - protein, 23 aa, Entamoeba invadens
ITRGYCLPSKYVIHTVGPIVEEQ

SEQ ID NO: 2981833 - protein, 17 aa, Entamoeba invadens
ITTEGKAGCSLVSKYSD

SEQ ID NO: 2981834 - protein, 20 aa, Entamoeba invadens
ITTTRSLFWSSFSKEYKCNK

SEQ ID NO: 2981835 - protein, 22 aa, Entamoeba invadens
ITVEPVMTFEGFAVYSREEKFN

SEQ ID NO: 2981836 - protein, 17 aa, Entamoeba invadens
ITVMLSFYTSVFDINSL

SEQ ID NO: 2981837 - protein, 19 aa, Entamoeba invadens
ITVSEVFKWCEAYSNENYK

SEQ ID NO: 2981838 - protein, 23 aa, Entamoeba invadens
IVCAFCPDRFFGFTFNDTITDHK

SEQ ID NO: 2981839 - protein, 18 aa, Entamoeba invadens
IVCGKIVHNGLYCSYCPA

SEQ ID NO: 2981840 - protein, 18 aa, Entamoeba invadens
IVCNFKFPLVSTSSSIVK

SEQ ID NO: 2981841 - protein, 22 aa, Entamoeba invadens
IVDEFPRYIWYPFLPQIITQMQ

SEQ ID NO: 2981842 - protein, 17 aa, Entamoeba invadens
IVDKITCTRCWYTNTET

SEQ ID NO: 2981843 - protein, 20 aa, Entamoeba invadens
IVDVKMRFNFIEFKNSNPTS

SEQ ID NO: 2981844 - protein, 18 aa, Entamoeba invadens
IVECIKAEEVPKCDCEVA

SEQ ID NO: 2981845 - protein, 18 aa, Entamoeba invadens
IVEGFAFVGCENLEELLF

SEQ ID NO: 2981846 - protein, 23 aa, Entamoeba invadens
IVFPIFLQLCTWTLTPKLSWNNS

SEQ ID NO: 2981847 - protein, 17 aa, Entamoeba invadens
IVGFRYLFAYYRQPDVK

SEQ ID NO: 2981848 - protein, 19 aa, Entamoeba invadens
IVIPFVMRVERNISRYLLL

SEQ ID NO: 2981849 - protein, 17 aa, Entamoeba invadens
IVKCLHAALPHAFLDCH

SEQ ID NO: 2981850 - protein, 19 aa, Entamoeba invadens
IVKQLRPGMSLDRVTLPTH

SEQ ID NO: 2981851 - protein, 21 aa, Entamoeba invadens
IVLKVGALLIKMATARMEANP

SEQ ID NO: 2981852 - protein, 21 aa, Entamoeba invadens
IVLRECIERVFSKSGVSVIPC

SEQ ID NO: 2981853 - protein, 17 aa, Entamoeba invadens
IVLRMICLHALLCAKME

SEQ ID NO: 2981854 - protein, 17 aa, Entamoeba invadens
IVMEFCFYGSVADMIDI

SEQ ID NO: 2981855 - protein, 17 aa, Entamoeba invadens
IVMKRYNLVAGDFPPID

SEQ ID NO: 2981856 - protein, 18 aa, Entamoeba invadens
IVPFRFTLNIRDCLGATK

SEQ ID NO: 2981857 - protein, 20 aa, Entamoeba invadens
IVPSRRGLRVVFADQSVAKH

SEQ ID NO: 2981858 - protein, 17 aa, Entamoeba invadens
IVQCLDYFDLVHLVINC

SEQ ID NO: 2981859 - protein, 17 aa, Entamoeba invadens
IVQFLGVVFPRALEVKW

SEQ ID NO: 2981860 - protein, 19 aa, Entamoeba invadens
IVQKYKIGAVLSFGPTPID

SEQ ID NO: 2981861 - protein, 17 aa, Entamoeba invadens
IVQWPVQHPELFAEYGQ

SEQ ID NO: 2981862 - protein, 24 aa, Entamoeba invadens
IVRARVVSILSYWANTIFPLLPEE

SEQ ID NO: 2981863 - protein, 21 aa, Entamoeba invadens
IVREQKLNIGRSIREITRESK

SEQ ID NO: 2981864 - protein, 18 aa, Entamoeba invadens
IVSAFNFHIGNLGRSGIG

SEQ ID NO: 2981865 - protein, 24 aa, Entamoeba invadens
IVSFKFEGLYGVKMLFDIGMKSDD

SEQ ID NO: 2981866 - protein, 23 aa, Entamoeba invadens
IVTHIPLKLFVSFFELVQVSDQD

SEQ ID NO: 2981867 - protein, 17 aa, Entamoeba invadens
IVTRLGVKCFEGCTNEV

SEQ ID NO: 2981868 - protein, 17 aa, Entamoeba invadens
IVTSRFIPDGTHLVKPL

SEQ ID NO: 2981869 - protein, 17 aa, Entamoeba invadens
IVVAPTFFWKKGEMQRQ

SEQ ID NO: 2981870 - protein, 24 aa, Entamoeba invadens
IVVKDVGKFDVAFDIGDNRMLLLH

SEQ ID NO: 2981871 - protein, 20 aa, Entamoeba invadens
IVVLKLRYTNPMSIDVTSMG

SEQ ID NO: 2981872 - protein, 17 aa, Entamoeba invadens
IVVLRCCCSVFANVGPY

SEQ ID NO: 2981873 - protein, 19 aa, Entamoeba invadens
IVVLYKVRFVELIMPKTVK

SEQ ID NO: 2981874 - protein, 19 aa, Entamoeba invadens
IVVLYKVRFVELIMSKTVK

SEQ ID NO: 2981875 - protein, 17 aa, Entamoeba invadens
IVVLYSMVTIDNSKQKF

SEQ ID NO: 2981876 - protein, 24 aa, Entamoeba invadens
IVVYLRFGANYNKFVSGKMPINVR

SEQ ID NO: 2981877 - protein, 18 aa, Entamoeba invadens
IVYRKLRATRRCSICETN

SEQ ID NO: 2981878 - protein, 19 aa, Entamoeba invadens
IVYSCLMGRIGVLVPLNFK

SEQ ID NO: 2981879 - protein, 17 aa, Entamoeba invadens
IVYSLGITQFFDGINDE

SEQ ID NO: 2981880 - protein, 17 aa, Entamoeba invadens
IWCEAVYYLVHSHQQSI

SEQ ID NO: 2981881 - protein, 19 aa, Entamoeba invadens
IWFKAVKEIGDYCFEDCDF

SEQ ID NO: 2981882 - protein, 20 aa, Entamoeba invadens
IWFKAVKEIGDYCFEDCDFR

SEQ ID NO: 2981883 - protein, 21 aa, Entamoeba invadens
IWFQIPIRLKKTRKRENEKTR

SEQ ID NO: 2981884 - protein, 23 aa, Entamoeba invadens
IWGKGCAFGPCSHPEFDVAVNKT

SEQ ID NO: 2981885 - protein, 17 aa, Entamoeba invadens
IWIKGNVIGNVIGKIFA

SEQ ID NO: 2981886 - protein, 18 aa, Entamoeba invadens
IWINFLLYRDWKNIIKPD

SEQ ID NO: 2981887 - protein, 22 aa, Entamoeba invadens
IWKSGIKMFGCKDIEEKGVKVS

SEQ ID NO: 2981888 - protein, 19 aa, Entamoeba invadens
IWRAMWRVVVYLDEHWSFD

SEQ ID NO: 2981889 - protein, 24 aa, Entamoeba invadens
IWTMEVKMAYNYRVLLINTNYSIV

SEQ ID NO: 2981890 - protein, 25 aa, Entamoeba invadens
IYCAICSFFMCLSELQFINQNPTLK

SEQ ID NO: 2981891 - protein, 19 aa, Entamoeba invadens
IYCYHCFYIRTNGLSKIDN

SEQ ID NO: 2981892 - protein, 18 aa, Entamoeba invadens
IYDIRVCRCEFKKSPELT

SEQ ID NO: 2981893 - protein, 19 aa, Entamoeba invadens
IYFKGEWDKPFHILPNKME

SEQ ID NO: 2981894 - protein, 21 aa, Entamoeba invadens
IYIAKRLKLGTAIESNCELMI

SEQ ID NO: 2981895 - protein, 17 aa, Entamoeba invadens
IYKHVGIDPPRGILLHG

SEQ ID NO: 2981896 - protein, 24 aa, Entamoeba invadens
IYKSKRIFYSWCFDVVFVTIEKTF

SEQ ID NO: 2981897 - protein, 18 aa, Entamoeba invadens
IYLFRLMLATGIPELQKV

SEQ ID NO: 2981898 - protein, 24 aa, Entamoeba invadens
IYLMLRGGLKYDLLTYLATPDCHA

SEQ ID NO: 2981899 - protein, 18 aa, Entamoeba invadens
IYMLGVDLGQAFGYSIIK

SEQ ID NO: 2981900 - protein, 17 aa, Entamoeba invadens
IYNSWLFECVPDVVKTN

SEQ ID NO: 2981901 - protein, 17 aa, Entamoeba invadens
IYPKKDFQFAWSIADFV

SEQ ID NO: 2981902 - protein, 20 aa, Entamoeba invadens
IYQCKYLKFVVKNNAQNQNF

SEQ ID NO: 2981903 - protein, 19 aa, Entamoeba invadens
IYQDEWKFVLQLVESVTSS

SEQ ID NO: 2981904 - protein, 18 aa, Entamoeba invadens
IYQDEWKYLLVLMKSVTS

SEQ ID NO: 2981905 - protein, 17 aa, Entamoeba invadens
IYQEIIHTVTLYTTKLN

SEQ ID NO: 2981906 - protein, 17 aa, Entamoeba invadens
IYRLDGFGGNLLNIKII

SEQ ID NO: 2981907 - protein, 22 aa, Entamoeba invadens
IYSKCFFELKIAGAVVTQDSKW

SEQ ID NO: 2981908 - protein, 22 aa, Entamoeba invadens
IYSQRLDKVWSLKDDVKVKISY

SEQ ID NO: 2981909 - protein, 23 aa, Entamoeba invadens
IYVLRFDKRFALFCSGTKSVYEA

SEQ ID NO: 2981910 - protein, 19 aa, Entamoeba invadens
IYYDVLDYFTIVKDPMDLY

SEQ ID NO: 2981911 - protein, 17 aa, Entamoeba invadens
IYYKRFWLEKIDCSNWC

SEQ ID NO: 2981912 - protein, 17 aa, Entamoeba invadens
KAAEALRQQCTVQGLQD

SEQ ID NO: 2981913 - protein, 18 aa, Entamoeba invadens
KAAPFLPRSKSLQLEEEK

SEQ ID NO: 2981914 - protein, 17 aa, Entamoeba invadens
KADFCFFIFGECDQTNQ

SEQ ID NO: 2981915 - protein, 22 aa, Entamoeba invadens
KAEGAGQGAIWFMQREVTEKKK

SEQ ID NO: 2981916 - protein, 17 aa, Entamoeba invadens
KAEGCSFVLIDQQVDVV

SEQ ID NO: 2981917 - protein, 25 aa, Entamoeba invadens
KAFGIPLTISFTFEYPISAPEILCD

SEQ ID NO: 2981918 - protein, 19 aa, Entamoeba invadens
KAFIPRWANISSEVTYYIT

SEQ ID NO: 2981919 - protein, 22 aa, Entamoeba invadens
KAFKDTDWLSAIRMYSAALGHL

SEQ ID NO: 2981920 - protein, 18 aa, Entamoeba invadens
KAFLGMGFAERGEAFDFS

SEQ ID NO: 2981921 - protein, 18 aa, Entamoeba invadens
KAFSEFEFEYSLMSTNDD

SEQ ID NO: 2981922 - protein, 17 aa, Entamoeba invadens
KAFYKIIVWFNVDFETV

SEQ ID NO: 2981923 - protein, 17 aa, Entamoeba invadens
KAFYKIIVWFNVNFETV

SEQ ID NO: 2981924 - protein, 22 aa, Entamoeba invadens
KAGCGKTSLAQRFFSSNIEVDS

SEQ ID NO: 2981925 - protein, 19 aa, Entamoeba invadens
KAGFVLPNLRLFRADVSNV

SEQ ID NO: 2981926 - protein, 20 aa, Entamoeba invadens
KAHSRFTDFIFTLETILDPE

SEQ ID NO: 2981927 - protein, 18 aa, Entamoeba invadens
KAIFPVTFIAKFFSYLPK

SEQ ID NO: 2981928 - protein, 22 aa, Entamoeba invadens
KAIKFCIEISFAGLSRNALNRA

SEQ ID NO: 2981929 - protein, 23 aa, Entamoeba invadens
KAIKLCIEISFAGLSRNSLNRAK

SEQ ID NO: 2981930 - protein, 20 aa, Entamoeba invadens
KAIQLVKEWSEFSEMFPYND

SEQ ID NO: 2981931 - protein, 19 aa, Entamoeba invadens
KAKCFCPKGTLTEFNLEDF

SEQ ID NO: 2981932 - protein, 18 aa, Entamoeba invadens
KAKEVFRILFTLVSSLQE

SEQ ID NO: 2981933 - protein, 17 aa, Entamoeba invadens
KAKHCPRDILKKKEKEM

SEQ ID NO: 2981934 - protein, 22 aa, Entamoeba invadens
KAKVVFMNAFIKFLVKFNKDLS

SEQ ID NO: 2981935 - protein, 18 aa, Entamoeba invadens
KALAIKWNVGLIESSTKT

SEQ ID NO: 2981936 - protein, 17 aa, Entamoeba invadens
KALEEFNNLDAFFMKRN

SEQ ID NO: 2981937 - protein, 20 aa, Entamoeba invadens
KALIPRVDILFNFYDFSNQL

SEQ ID NO: 2981938 - protein, 18 aa, Entamoeba invadens
KALIPRVDTLHTFFEFSN

SEQ ID NO: 2981939 - protein, 17 aa, Entamoeba invadens
KALLKRFNQKFTRKQFT

SEQ ID NO: 2981940 - protein, 18 aa, Entamoeba invadens
KALLRFVAIRTVNEMSHK

SEQ ID NO: 2981941 - protein, 20 aa, Entamoeba invadens
KALNFLSMIYIRGGDIKTVN

SEQ ID NO: 2981942 - protein, 21 aa, Entamoeba invadens
KALPFPKCVFQTLGTCDKDSL

SEQ ID NO: 2981943 - protein, 23 aa, Entamoeba invadens
KAMWSPKFERVFQLGSLSGQIKA

SEQ ID NO: 2981944 - protein, 21 aa, Entamoeba invadens
KAQEYFFNWFRTVLKDTEQSK

SEQ ID NO: 2981945 - protein, 22 aa, Entamoeba invadens
KAQVCSWCPTNIGMLATGCFSE

SEQ ID NO: 2981946 - protein, 23 aa, Entamoeba invadens
KARQAAPCVLFFDELDSIGKARG

SEQ ID NO: 2981947 - protein, 17 aa, Entamoeba invadens
KARTCKTFESGKDFRKE

SEQ ID NO: 2981948 - protein, 17 aa, Entamoeba invadens
KATTLEVISITRFGGKL

SEQ ID NO: 2981949 - protein, 18 aa, Entamoeba invadens
KATYSFTRWCYIYKNVED

SEQ ID NO: 2981950 - protein, 17 aa, Entamoeba invadens
KAVKEIGDFCFAESVFR

SEQ ID NO: 2981951 - protein, 20 aa, Entamoeba invadens
KAVLSIAPFFPHKSIQQISL

SEQ ID NO: 2981952 - protein, 17 aa, Entamoeba invadens
KAVMVKTVPVFKYVPRS

SEQ ID NO: 2981953 - protein, 25 aa, Entamoeba invadens
KAWKYWPYSLHCHRLMWYANTVGKG

SEQ ID NO: 2981954 - protein, 19 aa, Entamoeba invadens
KAYFKAVGLTPQLPEVWYN

SEQ ID NO: 2981955 - protein, 24 aa, Entamoeba invadens
KAYQKRLWGLRFIQIVNNVRGSTT

SEQ ID NO: 2981956 - protein, 18 aa, Entamoeba invadens
KCCCDFKCKCGAEGKCEY

SEQ ID NO: 2981957 - protein, 19 aa, Entamoeba invadens
KCDEEGRLTKCYGIGGVKE

SEQ ID NO: 2981958 - protein, 22 aa, Entamoeba invadens
KCFGVKVLFYYSRLLNMRSMLE

SEQ ID NO: 2981959 - protein, 19 aa, Entamoeba invadens
KCFICGSTEHLARDCPKVT

SEQ ID NO: 2981960 - protein, 18 aa, Entamoeba invadens
KCFILHSFISFSSNLFID

SEQ ID NO: 2981961 - protein, 19 aa, Entamoeba invadens
KCFSMCVRLQFLYIPKGIT

SEQ ID NO: 2981962 - protein, 24 aa, Entamoeba invadens
KCGKYTFCLNPQFLNRSFIHTQLD

SEQ ID NO: 2981963 - protein, 20 aa, Entamoeba invadens
KCHGEWCWMCRGDWKNHGPK

SEQ ID NO: 2981964 - protein, 17 aa, Entamoeba invadens
KCIKNYYMDSGVCKYFD

SEQ ID NO: 2981965 - protein, 20 aa, Entamoeba invadens
KCISCVRLLFEDSYITKGGK

SEQ ID NO: 2981966 - protein, 19 aa, Entamoeba invadens
KCKTIKCGEKVEKLVVKSC

SEQ ID NO: 2981967 - protein, 24 aa, Entamoeba invadens
KCKVRAIKLLRSWCGQTDEIWNSM

SEQ ID NO: 2981968 - protein, 18 aa, Entamoeba invadens
KCLEQIRMNTVDGIELAG

SEQ ID NO: 2981969 - protein, 21 aa, Entamoeba invadens
KCLGCSMCTTKCCYGVLEKQG

SEQ ID NO: 2981970 - protein, 23 aa, Entamoeba invadens
KCLKENWTTLGFEALLLNKTEDA

SEQ ID NO: 2981971 - protein, 25 aa, Entamoeba invadens
KCPELLWRWYITRGRTDEGVLCLLK

SEQ ID NO: 2981972 - protein, 21 aa, Entamoeba invadens
KCPKCGALMKLDVVLFGEKLD

SEQ ID NO: 2981973 - protein, 20 aa, Entamoeba invadens
KCPRCGGKMTFNLREDDLFV

SEQ ID NO: 2981974 - protein, 24 aa, Entamoeba invadens
KCQKCSVSGCKRCSDGETCDMCNE

SEQ ID NO: 2981975 - protein, 19 aa, Entamoeba invadens
KCQMGGATHCVRAVSDKVC

SEQ ID NO: 2981976 - protein, 18 aa, Entamoeba invadens
KCQSFFCWVCMQITNDHQ

SEQ ID NO: 2981977 - protein, 20 aa, Entamoeba invadens
KCRNLSCIEISTSVIKFGYK

SEQ ID NO: 2981978 - protein, 21 aa, Entamoeba invadens
KCRSGIVQWIFSKSISSAIST

SEQ ID NO: 2981979 - protein, 25 aa, Entamoeba invadens
KCSALRALIKVDLATAVAYVVKKAE

SEQ ID NO: 2981980 - protein, 21 aa, Entamoeba invadens
KCSFPKYHFSVWKIDQFSRDP

SEQ ID NO: 2981981 - protein, 20 aa, Entamoeba invadens
KCSMCSRVNLYLFKKQVKTL

SEQ ID NO: 2981982 - protein, 21 aa, Entamoeba invadens
KCSRLTKMRVYKDFEVVDHYG

SEQ ID NO: 2981983 - protein, 18 aa, Entamoeba invadens
KCTTCCRIIIASFYNYDQ

SEQ ID NO: 2981984 - protein, 19 aa, Entamoeba invadens
KCTVETFYLLRKIVPPYKG

SEQ ID NO: 2981985 - protein, 17 aa, Entamoeba invadens
KCVCANCSKGKIPLPPK

SEQ ID NO: 2981986 - protein, 17 aa, Entamoeba invadens
KCVKSVYKYSDLKQIPQ

SEQ ID NO: 2981987 - protein, 18 aa, Entamoeba invadens
KCVLFDFDKKIEIYNSPV

SEQ ID NO: 2981988 - protein, 18 aa, Entamoeba invadens
KCYMKVTLVYPVVDSEPI

SEQ ID NO: 2981989 - protein, 17 aa, Entamoeba invadens
KDALEILHINPGFANKL

SEQ ID NO: 2981990 - protein, 27 aa, Entamoeba invadens
KDARAEELWKFVGLFSSLEQENGKEGC

SEQ ID NO: 2981991 - protein, 19 aa, Entamoeba invadens
KDARMAVLLANCRLPRDDE

SEQ ID NO: 2981992 - protein, 17 aa, Entamoeba invadens
KDCAYDFLCDLPHNAVC

SEQ ID NO: 2981993 - protein, 18 aa, Entamoeba invadens
KDDFPLLLLGNKVNCTDG

SEQ ID NO: 2981994 - protein, 19 aa, Entamoeba invadens
KDERVMGVFVGIYDMSNAD

SEQ ID NO: 2981995 - protein, 18 aa, Entamoeba invadens
KDESCVIIGKDVFKSIAV

SEQ ID NO: 2981996 - protein, 23 aa, Entamoeba invadens
KDFAELGFPFFGYEEIVKSLREK

SEQ ID NO: 2981997 - protein, 20 aa, Entamoeba invadens
KDFFKDFTFMSFYRDVEKKG

SEQ ID NO: 2981998 - protein, 20 aa, Entamoeba invadens
KDFFPSISIESFEKLEINWG

SEQ ID NO: 2981999 - protein, 21 aa, Entamoeba invadens
KDFKANPFVTLYALRVLDTFD

SEQ ID NO: 2982000 - protein, 17 aa, Entamoeba invadens
KDFLEKLETVFGLQEEG

SEQ ID NO: 2982001 - protein, 19 aa, Entamoeba invadens
KDFLEKLETVFGLQEEGYY

SEQ ID NO: 2982002 - protein, 22 aa, Entamoeba invadens
KDFLMKMSFSFDSDFPLEDMVG

SEQ ID NO: 2982003 - protein, 20 aa, Entamoeba invadens
KDFQFAWSIADFISAGKRVE

SEQ ID NO: 2982004 - protein, 23 aa, Entamoeba invadens
KDFREFGEIFGLRELVDAYIKQR

SEQ ID NO: 2982005 - protein, 21 aa, Entamoeba invadens
KDFRFAWNIADFTSSGKRLHI

SEQ ID NO: 2982006 - protein, 18 aa, Entamoeba invadens
KDFSGIFVDSVFGLGNML

SEQ ID NO: 2982007 - protein, 17 aa, Entamoeba invadens
KDFVLSCLGFFAIKQTG

SEQ ID NO: 2982008 - protein, 21 aa, Entamoeba invadens
KDGKLPCVFFIFSRKLVMDYA

SEQ ID NO: 2982009 - protein, 19 aa, Entamoeba invadens
KDGNMFYCYTYLVKNKSGE

SEQ ID NO: 2982010 - protein, 22 aa, Entamoeba invadens
KDIAELILLIVKFRVPRNNISL

SEQ ID NO: 2982011 - protein, 22 aa, Entamoeba invadens
KDIANLCLLTGMKNIYATGYKI

SEQ ID NO: 2982012 - protein, 17 aa, Entamoeba invadens
KDIGFSWYTGEQALQIA

SEQ ID NO: 2982013 - protein, 21 aa, Entamoeba invadens
KDIKLPLLPPLRPKTPKPTEE

SEQ ID NO: 2982014 - protein, 21 aa, Entamoeba invadens
KDILLLFKYDRWGCFKEQILG

SEQ ID NO: 2982015 - protein, 18 aa, Entamoeba invadens
KDIPALWFRSSIKTSVSK

SEQ ID NO: 2982016 - protein, 20 aa, Entamoeba invadens
KDITSTIGIDFRMKRMEFEG

SEQ ID NO: 2982017 - protein, 20 aa, Entamoeba invadens
KDKCLRCRDGFVFEGNNCVD

SEQ ID NO: 2982018 - protein, 19 aa, Entamoeba invadens
KDKFPFLQEGWRWEEVAEE

SEQ ID NO: 2982019 - protein, 20 aa, Entamoeba invadens
KDKTRCLVKWQKLGYNEATW

SEQ ID NO: 2982020 - protein, 17 aa, Entamoeba invadens
KDLDGKVFRTTKIKLVC

SEQ ID NO: 2982021 - protein, 18 aa, Entamoeba invadens
KDLIVMISYIGKMEIHYP

SEQ ID NO: 2982022 - protein, 18 aa, Entamoeba invadens
KDLIVMISYIGKMELYYD

SEQ ID NO: 2982023 - protein, 20 aa, Entamoeba invadens
KDLKALCGHFEVITDVANLF

SEQ ID NO: 2982024 - protein, 21 aa, Entamoeba invadens
KDLKYRVVFCQDDENGFGTFD

SEQ ID NO: 2982025 - protein, 17 aa, Entamoeba invadens
KDLWKGNVEEVVEVIED

SEQ ID NO: 2982026 - protein, 19 aa, Entamoeba invadens
KDMCLMVNMVVKYRGTMFR

SEQ ID NO: 2982027 - protein, 17 aa, Entamoeba invadens
KDMKDCVEWAYGKYQNY

SEQ ID NO: 2982028 - protein, 23 aa, Entamoeba invadens
KDMKDCVKWAFGKYQNYFVDSIQ

SEQ ID NO: 2982029 - protein, 17 aa, Entamoeba invadens
KDMKGRIFATLQLVELM

SEQ ID NO: 2982030 - protein, 19 aa, Entamoeba invadens
KDMKYSETFKVYTLDKESE

SEQ ID NO: 2982031 - protein, 23 aa, Entamoeba invadens
KDQRKIISAYIMYKADHVAYKKL

SEQ ID NO: 2982032 - protein, 19 aa, Entamoeba invadens
KDRLKAVVGNVQRLGITNT

SEQ ID NO: 2982033 - protein, 19 aa, Entamoeba invadens
KDRYCVLENGYLYVYNTLA

SEQ ID NO: 2982034 - protein, 18 aa, Entamoeba invadens
KDTNEIYCTIHLPQPKNL

SEQ ID NO: 2982035 - protein, 17 aa, Entamoeba invadens
KDTYLPIRLIKKLMSLV

SEQ ID NO: 2982036 - protein, 17 aa, Entamoeba invadens
KDVEILHPLKRVPLKDE

SEQ ID NO: 2982037 - protein, 20 aa, Entamoeba invadens
KDVLELWSGLGYNSRAKRLR

SEQ ID NO: 2982038 - protein, 23 aa, Entamoeba invadens
KDVLNWLVKLAWSMSKIYEMNLS

SEQ ID NO: 2982039 - protein, 18 aa, Entamoeba invadens
KDYAETLARMELRDLSVK

SEQ ID NO: 2982040 - protein, 17 aa, Entamoeba invadens
KDYPAVVGLLFELLDRL

SEQ ID NO: 2982041 - protein, 18 aa, Entamoeba invadens
KEAGGFICRAFAQENSSG

SEQ ID NO: 2982042 - protein, 24 aa, Entamoeba invadens
KEAHEIIENIKLLKNNLEEKVNTL

SEQ ID NO: 2982043 - protein, 17 aa, Entamoeba invadens
KEAIPFLPIQVDYLHLN

SEQ ID NO: 2982044 - protein, 21 aa, Entamoeba invadens
KEAKYRVTYKIGEHGAYTIHC

SEQ ID NO: 2982045 - protein, 18 aa, Entamoeba invadens
KEALFALREMQLAALKTA

SEQ ID NO: 2982046 - protein, 20 aa, Entamoeba invadens
KEAYRKLSLTSFLITPIQRL

SEQ ID NO: 2982047 - protein, 18 aa, Entamoeba invadens
KECGFMYMDVLKIIGTPD

SEQ ID NO: 2982048 - protein, 17 aa, Entamoeba invadens
KECRLMIYRGYSKGFGF

SEQ ID NO: 2982049 - protein, 22 aa, Entamoeba invadens
KEDAEKIIGWAIGKEISTSNEK

SEQ ID NO: 2982050 - protein, 21 aa, Entamoeba invadens
KEDMAPCVLQINILKLTSVKY

SEQ ID NO: 2982051 - protein, 21 aa, Entamoeba invadens
KEEICALFLERLYLTKTTLPF

SEQ ID NO: 2982052 - protein, 21 aa, Entamoeba invadens
KEEKCKILSELNALKGEKENV

SEQ ID NO: 2982053 - protein, 20 aa, Entamoeba invadens
KEERMCYLKCNFKESNNTQI

SEQ ID NO: 2982054 - protein, 21 aa, Entamoeba invadens
KEEWKTRAVLVLQALLKAKGD

SEQ ID NO: 2982055 - protein, 21 aa, Entamoeba invadens
KEFFRIIVWFDVDFETVDRNK

SEQ ID NO: 2982056 - protein, 22 aa, Entamoeba invadens
KEFFRIIVWFNVDFEIVDRNKS

SEQ ID NO: 2982057 - protein, 22 aa, Entamoeba invadens
KEFFRIIVWFNVDFETVDRNKN

SEQ ID NO: 2982058 - protein, 21 aa, Entamoeba invadens
KEFFRIIVWFSVNFKTVDRNK

SEQ ID NO: 2982059 - protein, 20 aa, Entamoeba invadens
KEFFRTIVWFNVDFETVDRN

SEQ ID NO: 2982060 - protein, 17 aa, Entamoeba invadens
KEFGEALTLILRSPIAL

SEQ ID NO: 2982061 - protein, 20 aa, Entamoeba invadens
KEFKADVLGFYIVKLESIDF

SEQ ID NO: 2982062 - protein, 17 aa, Entamoeba invadens
KEFKELFGFIQDPLTLH

SEQ ID NO: 2982063 - protein, 20 aa, Entamoeba invadens
KEFKGGMSIIDLRDKNNVLT

SEQ ID NO: 2982064 - protein, 19 aa, Entamoeba invadens
KEFPFPWVIAQFVTSGKRL

SEQ ID NO: 2982065 - protein, 17 aa, Entamoeba invadens
KEFYDWLSLNQNSSVIK

SEQ ID NO: 2982066 - protein, 22 aa, Entamoeba invadens
KEFYRIIVWFNVDFETVENNKS

SEQ ID NO: 2982067 - protein, 31 aa, Entamoeba invadens
KEGGIYLGDRWLRFDPPLGRIIKLDQIELIP

SEQ ID NO: 2982068 - protein, 20 aa, Entamoeba invadens
KEGKMELAWMFFNKAKDLVK

SEQ ID NO: 2982069 - protein, 24 aa, Entamoeba invadens
KEGKRVVGVLLGFIRRGVVDVMNS

SEQ ID NO: 2982070 - protein, 20 aa, Entamoeba invadens
KEGLPTGFKFEGFGNVGSLA

SEQ ID NO: 2982071 - protein, 20 aa, Entamoeba invadens
KEGLRPFLLFNYLENNCGND

SEQ ID NO: 2982072 - protein, 18 aa, Entamoeba invadens
KEGNAFVGRHRRDVCEFV

SEQ ID NO: 2982073 - protein, 20 aa, Entamoeba invadens
KEHEKLCGWNELLQRMRNNL

SEQ ID NO: 2982074 - protein, 18 aa, Entamoeba invadens
KEHFIVLLTLMYVLVWDK

SEQ ID NO: 2982075 - protein, 20 aa, Entamoeba invadens
KEHPERCVLFLQKIGMNEDR

SEQ ID NO: 2982076 - protein, 17 aa, Entamoeba invadens
KEIDQMYTKACFVFNAG

SEQ ID NO: 2982077 - protein, 18 aa, Entamoeba invadens
KEIKRTPTQLSFKKTLKL

SEQ ID NO: 2982078 - protein, 21 aa, Entamoeba invadens
KEILKIRIKICDVVASTLSKC

SEQ ID NO: 2982079 - protein, 17 aa, Entamoeba invadens
KEIPFELLSTFPPVDST

SEQ ID NO: 2982080 - protein, 21 aa, Entamoeba invadens
KEIQSTPILLVFTKTDLKPNF

SEQ ID NO: 2982081 - protein, 18 aa, Entamoeba invadens
KEIRRTVEILVFHLNSLQ

SEQ ID NO: 2982082 - protein, 20 aa, Entamoeba invadens
KEISEVFGFSAIPADKLVGV

SEQ ID NO: 2982083 - protein, 24 aa, Entamoeba invadens
KEIYKFEVSYTFYLQMKNIPIYCE

SEQ ID NO: 2982084 - protein, 19 aa, Entamoeba invadens
KEKCWKNNKAMVMVESVIE

SEQ ID NO: 2982085 - protein, 23 aa, Entamoeba invadens
KEKFKGRLFISAFTFCMEMLNSK

SEQ ID NO: 2982086 - protein, 20 aa, Entamoeba invadens
KEKFLNIRIDNMVNAYKGLE

SEQ ID NO: 2982087 - protein, 22 aa, Entamoeba invadens
KEKRASFAFCAESRFTTKLLDV

SEQ ID NO: 2982088 - protein, 25 aa, Entamoeba invadens
KEKTEVYSGISLRVIFPAFGGDAKT

SEQ ID NO: 2982089 - protein, 22 aa, Entamoeba invadens
KEKWKIKHIMNLDDWKSVGVTD

SEQ ID NO: 2982090 - protein, 20 aa, Entamoeba invadens
KELCKGMVNLAKYADLDGKK

SEQ ID NO: 2982091 - protein, 21 aa, Entamoeba invadens
KELKDFIARCFVFDFKQRPSC

SEQ ID NO: 2982092 - protein, 26 aa, Entamoeba invadens
KELKISVKTGRHWCLCLPSSLVVLTI

SEQ ID NO: 2982093 - protein, 17 aa, Entamoeba invadens
KELKKLIGVDVDDETEE

SEQ ID NO: 2982094 - protein, 18 aa, Entamoeba invadens
KELKVLVCTWNINQGVFS

SEQ ID NO: 2982095 - protein, 17 aa, Entamoeba invadens
KELNIHFVLGERSAYEM

SEQ ID NO: 2982096 - protein, 17 aa, Entamoeba invadens
KELPIYDGYLFHAIDKE

SEQ ID NO: 2982097 - protein, 17 aa, Entamoeba invadens
KELRRYGPFKGKVPRII

SEQ ID NO: 2982098 - protein, 21 aa, Entamoeba invadens
KELTRRISIVSSDKEKMYQGE

SEQ ID NO: 2982099 - protein, 23 aa, Entamoeba invadens
KELVTRFFIVLSLYRLFIAQKQN

SEQ ID NO: 2982100 - protein, 17 aa, Entamoeba invadens
KELYKANVEFIRSLKED

SEQ ID NO: 2982101 - protein, 20 aa, Entamoeba invadens
KELYKLYADYVLKDPFIILE

SEQ ID NO: 2982102 - protein, 20 aa, Entamoeba invadens
KELYKNGGIYFITSRILISD

SEQ ID NO: 2982103 - protein, 18 aa, Entamoeba invadens
KEMAINYLKRMVCSDESN

SEQ ID NO: 2982104 - protein, 26 aa, Entamoeba invadens
KEMMRRESLEYSRVKTTVCKSVVAKL

SEQ ID NO: 2982105 - protein, 19 aa, Entamoeba invadens
KENCKLLWALSEMKGFDEM

SEQ ID NO: 2982106 - protein, 17 aa, Entamoeba invadens
KENELWDILKKCYVNWI

SEQ ID NO: 2982107 - protein, 22 aa, Entamoeba invadens
KENEWKKNFIVLNNQQLEDSRN

SEQ ID NO: 2982108 - protein, 19 aa, Entamoeba invadens
KENICVFPYNSVIYTLSFI

SEQ ID NO: 2982109 - protein, 18 aa, Entamoeba invadens
KENKICWESGEDQRLLSP

SEQ ID NO: 2982110 - protein, 19 aa, Entamoeba invadens
KENLFLFLVDFIRIPTQPV

SEQ ID NO: 2982111 - protein, 20 aa, Entamoeba invadens
KENRNVLKWMSLHHPQLSGV

SEQ ID NO: 2982112 - protein, 20 aa, Entamoeba invadens
KEQIEFWGFLGAVKVFYEKH

SEQ ID NO: 2982113 - protein, 24 aa, Entamoeba invadens
KEQLIPRIWKAVSMFNPTRISLPF

SEQ ID NO: 2982114 - protein, 18 aa, Entamoeba invadens
KERDMLIYGFNYLDILSI

SEQ ID NO: 2982115 - protein, 23 aa, Entamoeba invadens
KERFRFPWKIAEFIMSGNRLEKP

SEQ ID NO: 2982116 - protein, 19 aa, Entamoeba invadens
KERIEGIAAISGVKEAISS

SEQ ID NO: 2982117 - protein, 19 aa, Entamoeba invadens
KERLMNVLAFCGLEQANQT

SEQ ID NO: 2982118 - protein, 17 aa, Entamoeba invadens
KERVCVDQALKFDVKHP

SEQ ID NO: 2982119 - protein, 21 aa, Entamoeba invadens
KESHGFWALVQWIFSFICQKI

SEQ ID NO: 2982120 - protein, 17 aa, Entamoeba invadens
KESKWLFVFGNSKSKEY

SEQ ID NO: 2982121 - protein, 24 aa, Entamoeba invadens
KESLRLCVCYEQLLSFAMLFGISE

SEQ ID NO: 2982122 - protein, 20 aa, Entamoeba invadens
KESPCFRVSLGNLRIDSVDA

SEQ ID NO: 2982123 - protein, 19 aa, Entamoeba invadens
KETIDIAAILMDWDMDYSK

SEQ ID NO: 2982124 - protein, 17 aa, Entamoeba invadens
KETINCLLERVGSNLGI

SEQ ID NO: 2982125 - protein, 18 aa, Entamoeba invadens
KETMKVLVEMSVRMEKAP

SEQ ID NO: 2982126 - protein, 21 aa, Entamoeba invadens
KETRGILALAIYDSVKLDLPR

SEQ ID NO: 2982127 - protein, 17 aa, Entamoeba invadens
KEVCFRLNNTQGEKMAK

SEQ ID NO: 2982128 - protein, 19 aa, Entamoeba invadens
KEVEKRLGTVVGVDDVLDK

SEQ ID NO: 2982129 - protein, 18 aa, Entamoeba invadens
KEVFPVFLDSKGVVMSLP

SEQ ID NO: 2982130 - protein, 17 aa, Entamoeba invadens
KEVLKLGFRVEDITFSQ

SEQ ID NO: 2982131 - protein, 19 aa, Entamoeba invadens
KEVPPQVGFEVSQVQKIDL

SEQ ID NO: 2982132 - protein, 20 aa, Entamoeba invadens
KEVQKWLPSISVGLMGGTKE

SEQ ID NO: 2982133 - protein, 18 aa, Entamoeba invadens
KEVVAFLFCVRRGTNDQE

SEQ ID NO: 2982134 - protein, 18 aa, Entamoeba invadens
KEVYRLGSISQHVVMVPD

SEQ ID NO: 2982135 - protein, 23 aa, Entamoeba invadens
KEVYRPTLVNAFRVTTQCITMAL

SEQ ID NO: 2982136 - protein, 17 aa, Entamoeba invadens
KEWTAIIPMMYKDEFMT

SEQ ID NO: 2982137 - protein, 19 aa, Entamoeba invadens
KEYAQCFSIAVQLLEFQTD

SEQ ID NO: 2982138 - protein, 26 aa, Entamoeba invadens
KEYLKRNRISVGFPIKGYKEALVLDI

SEQ ID NO: 2982139 - protein, 18 aa, Entamoeba invadens
KFAAAIVKFLMWVEKKFG

SEQ ID NO: 2982140 - protein, 18 aa, Entamoeba invadens
KFAASIFKFLIKVEKKFG

SEQ ID NO: 2982141 - protein, 17 aa, Entamoeba invadens
KFAKFLKLRTTAVFGGM

SEQ ID NO: 2982142 - protein, 17 aa, Entamoeba invadens
KFFHAYATWDWARNPVM

SEQ ID NO: 2982143 - protein, 23 aa, Entamoeba invadens
KFGIEPKSTFLLVIDDVTEKPQK

SEQ ID NO: 2982144 - protein, 18 aa, Entamoeba invadens
KFGKCCKVSKAKIEESPN

SEQ ID NO: 2982145 - protein, 21 aa, Entamoeba invadens
KFGNAKLVFESILSLKYISNT

SEQ ID NO: 2982146 - protein, 19 aa, Entamoeba invadens
KFGSEFSIIITRDILEECC

SEQ ID NO: 2982147 - protein, 18 aa, Entamoeba invadens
KFHPDSMMKSKLEHRNSI

SEQ ID NO: 2982148 - protein, 19 aa, Entamoeba invadens
KFICGGPVYIIANMIEKPT

SEQ ID NO: 2982149 - protein, 21 aa, Entamoeba invadens
KFKAAGALSCIQRQRNNTYLK

SEQ ID NO: 2982150 - protein, 19 aa, Entamoeba invadens
KFKGIAMLVCRTRKSVIKY

SEQ ID NO: 2982151 - protein, 18 aa, Entamoeba invadens
KFKKVCLGSSSFTKRLNE

SEQ ID NO: 2982152 - protein, 24 aa, Entamoeba invadens
KFKPIRKHCECIPTDIPCKESAIK

SEQ ID NO: 2982153 - protein, 21 aa, Entamoeba invadens
KFLGHLVKLFGHFFSDKDDFA

SEQ ID NO: 2982154 - protein, 17 aa, Entamoeba invadens
KFLGRIPLDPVIARSCD

SEQ ID NO: 2982155 - protein, 23 aa, Entamoeba invadens
KFLLAICYDVRFPVFLRNKESDL

SEQ ID NO: 2982156 - protein, 17 aa, Entamoeba invadens
KFNVCEWKGYIGNGCFS

SEQ ID NO: 2982157 - protein, 18 aa, Entamoeba invadens
KFPFVLRIRSAYGMNQFS

SEQ ID NO: 2982158 - protein, 21 aa, Entamoeba invadens
KFPSPRLGLIEVVKGDPNKQN

SEQ ID NO: 2982159 - protein, 19 aa, Entamoeba invadens
KFQRRSHRYVKKQKSAKVV

SEQ ID NO: 2982160 - protein, 18 aa, Entamoeba invadens
KFQYAWSIADFVTSGKHL

SEQ ID NO: 2982161 - protein, 19 aa, Entamoeba invadens
KFSAAFSFKIQKMMSDLQV

SEQ ID NO: 2982162 - protein, 24 aa, Entamoeba invadens
KFSYELFNILPLSFFHEYLRGQNI

SEQ ID NO: 2982163 - protein, 24 aa, Entamoeba invadens
KFVCWTGKELWAFKDVVNGETVVY

SEQ ID NO: 2982164 - protein, 17 aa, Entamoeba invadens
KFVKAFEIFDAMFVLCC

SEQ ID NO: 2982165 - protein, 17 aa, Entamoeba invadens
KFVPLLFAKQGDGDYRY

SEQ ID NO: 2982166 - protein, 17 aa, Entamoeba invadens
KFYEFLNCVGHVIGDGK

SEQ ID NO: 2982167 - protein, 22 aa, Entamoeba invadens
KFYELLKLYGYKMPLFDKLKSW

SEQ ID NO: 2982168 - protein, 20 aa, Entamoeba invadens
KGAFRLTGKIGETFALPEDR

SEQ ID NO: 2982169 - protein, 19 aa, Entamoeba invadens
KGAGCGVSLYIAYKQKVSK

SEQ ID NO: 2982170 - protein, 18 aa, Entamoeba invadens
KGAMIFWFAYMPLQGTRK

SEQ ID NO: 2982171 - protein, 22 aa, Entamoeba invadens
KGARYTLQLAFFDRIKDLDAYG

SEQ ID NO: 2982172 - protein, 24 aa, Entamoeba invadens
KGDMRLKFIIQMCACALNGRDMIY

SEQ ID NO: 2982173 - protein, 20 aa, Entamoeba invadens
KGEACEFEILLTIKCTTKID

SEQ ID NO: 2982174 - protein, 20 aa, Entamoeba invadens
KGEMLGLVIGKRVYKLTKID

SEQ ID NO: 2982175 - protein, 17 aa, Entamoeba invadens
KGEVDFNAFFNVEAKPG

SEQ ID NO: 2982176 - protein, 20 aa, Entamoeba invadens
KGFAFGLFLGNWFKESNNIY

SEQ ID NO: 2982177 - protein, 17 aa, Entamoeba invadens
KGFEIGLRKKEVFGKEI

SEQ ID NO: 2982178 - protein, 17 aa, Entamoeba invadens
KGFGRLAVARVKLGKLN

SEQ ID NO: 2982179 - protein, 20 aa, Entamoeba invadens
KGFKDPIKWNTKRNVKCGIC

SEQ ID NO: 2982180 - protein, 23 aa, Entamoeba invadens
KGFKEDRFSVLIATDVVARGIDI

SEQ ID NO: 2982181 - protein, 18 aa, Entamoeba invadens
KGFVCEFEVFITPHCTLN

SEQ ID NO: 2982182 - protein, 21 aa, Entamoeba invadens
KGGELRPGKGFNLQPHPFVQN

SEQ ID NO: 2982183 - protein, 17 aa, Entamoeba invadens
KGGSCSFGPKTEEVVLP

SEQ ID NO: 2982184 - protein, 19 aa, Entamoeba invadens
KGILSWLIHNVWITKKLNT

SEQ ID NO: 2982185 - protein, 19 aa, Entamoeba invadens
KGKEIGVCWFECGTNNISL

SEQ ID NO: 2982186 - protein, 22 aa, Entamoeba invadens
KGKEWRLCVLFNDIFVIGKVDI

SEQ ID NO: 2982187 - protein, 21 aa, Entamoeba invadens
KGKFMTCCMMYRGDVAPHDVS

SEQ ID NO: 2982188 - protein, 18 aa, Entamoeba invadens
KGKKFFFSRIFQLKPLNR

SEQ ID NO: 2982189 - protein, 25 aa, Entamoeba invadens
KGKLRMGVSVTRKFVCCGGVYVIEN

SEQ ID NO: 2982190 - protein, 17 aa, Entamoeba invadens
KGKNCWNMWKQNPSDKK

SEQ ID NO: 2982191 - protein, 17 aa, Entamoeba invadens
KGKSAFVKNDWKHFVFM

SEQ ID NO: 2982192 - protein, 22 aa, Entamoeba invadens
KGLKLRLAVLILKQVGESLDVL

SEQ ID NO: 2982193 - protein, 18 aa, Entamoeba invadens
KGLLRLGADPNKGNSDGV

SEQ ID NO: 2982194 - protein, 18 aa, Entamoeba invadens
KGMCYTRVKFKCVVVKDP

SEQ ID NO: 2982195 - protein, 22 aa, Entamoeba invadens
KGMTKVDVCFRVFKNGKILYDQ

SEQ ID NO: 2982196 - protein, 17 aa, Entamoeba invadens
KGNIRVFCRVRPIIFAP

SEQ ID NO: 2982197 - protein, 18 aa, Entamoeba invadens
KGNSFGYFPGEYCQVIGG

SEQ ID NO: 2982198 - protein, 18 aa, Entamoeba invadens
KGPVCDPAKYYGCGPTSN

SEQ ID NO: 2982199 - protein, 17 aa, Entamoeba invadens
KGRFRDVVDIQKVEELW

SEQ ID NO: 2982200 - protein, 20 aa, Entamoeba invadens
KGRIPAISWRGEKNQTISRS

SEQ ID NO: 2982201 - protein, 22 aa, Entamoeba invadens
KGSEYKFLFCVKGGGSANKSYL

SEQ ID NO: 2982202 - protein, 19 aa, Entamoeba invadens
KGSIVYKGINAMQQYTNTT

SEQ ID NO: 2982203 - protein, 19 aa, Entamoeba invadens
KGSLCFSCVTIPQVKKITA

SEQ ID NO: 2982204 - protein, 20 aa, Entamoeba invadens
KGSVCIEGFVATSIINKIIE

SEQ ID NO: 2982205 - protein, 19 aa, Entamoeba invadens
KGTVFKCFVPQSVLDGKDK

SEQ ID NO: 2982206 - protein, 18 aa, Entamoeba invadens
KGVCGNLFIKDAQPMVWE

SEQ ID NO: 2982207 - protein, 20 aa, Entamoeba invadens
KGVFRTANWSVFGLSERTNN

SEQ ID NO: 2982208 - protein, 21 aa, Entamoeba invadens
KGVGCLFIRAGRPIIPLLHGG

SEQ ID NO: 2982209 - protein, 17 aa, Entamoeba invadens
KGVLCKTGFVLNEQFEC

SEQ ID NO: 2982210 - protein, 27 aa, Entamoeba invadens
KGVLKREFFRIIVWFNVDFETVDRNKN

SEQ ID NO: 2982211 - protein, 27 aa, Entamoeba invadens
KGVLKREFFRIIVWFSVNFEIVNRNKN

SEQ ID NO: 2982212 - protein, 19 aa, Entamoeba invadens
KGVMFKFTICQEAVVYEGF

SEQ ID NO: 2982213 - protein, 21 aa, Entamoeba invadens
KGVYYKVSWGREYCMKGQLFD

SEQ ID NO: 2982214 - protein, 22 aa, Entamoeba invadens
KGWDKLRWDDFLALKEEMQDDF

SEQ ID NO: 2982215 - protein, 20 aa, Entamoeba invadens
KGWDNWQFLLAGFVSLKGVF

SEQ ID NO: 2982216 - protein, 19 aa, Entamoeba invadens
KHATLPLNIGKSIKSEGII

SEQ ID NO: 2982217 - protein, 19 aa, Entamoeba invadens
KHCCFRVARNNMWELHIYT

SEQ ID NO: 2982218 - protein, 20 aa, Entamoeba invadens
KHCWLPFSLLLASIKQVGAD

SEQ ID NO: 2982219 - protein, 31 aa, Entamoeba invadens
KHFYCGQLLCLYGCYHKNRIFSLLKKGEVSK

SEQ ID NO: 2982220 - protein, 17 aa, Entamoeba invadens
KHKTCIEIDMKLRVKYM

SEQ ID NO: 2982221 - protein, 17 aa, Entamoeba invadens
KHLKYLFTFEEYKNCGF

SEQ ID NO: 2982222 - protein, 24 aa, Entamoeba invadens
KHLTLLNVLKFIKIKAVVVKGTSI

SEQ ID NO: 2982223 - protein, 22 aa, Entamoeba invadens
KHQFRFPWKIAEFVINGKRVEK

SEQ ID NO: 2982224 - protein, 22 aa, Entamoeba invadens
KHQFRFPWKIAEFVINGKRVKK

SEQ ID NO: 2982225 - protein, 17 aa, Entamoeba invadens
KHSSGWWFATNDKGQSG

SEQ ID NO: 2982226 - protein, 18 aa, Entamoeba invadens
KHVNLRFDPYVFISLQLP

SEQ ID NO: 2982227 - protein, 18 aa, Entamoeba invadens
KICGVCGKAVMTMVEISE

SEQ ID NO: 2982228 - protein, 24 aa, Entamoeba invadens
KIEAKPRRPTCVQPGKKKMTKAGF

SEQ ID NO: 2982229 - protein, 18 aa, Entamoeba invadens
KIEIPFPLLQSHYLLFDV

SEQ ID NO: 2982230 - protein, 20 aa, Entamoeba invadens
KIETLQCYDYMLGNDDKLVY

SEQ ID NO: 2982231 - protein, 22 aa, Entamoeba invadens
KIETRSGLKFEKVIFDGEKDDF

SEQ ID NO: 2982232 - protein, 23 aa, Entamoeba invadens
KIFKRLFRVYAHMFYNHMEHMEQ

SEQ ID NO: 2982233 - protein, 22 aa, Entamoeba invadens
KIFKRLFRVYAHMFYSHEKHLK

SEQ ID NO: 2982234 - protein, 18 aa, Entamoeba invadens
KIFLHLVETVALLHSSDS

SEQ ID NO: 2982235 - protein, 17 aa, Entamoeba invadens
KIFNKWISAGIFSSKKL

SEQ ID NO: 2982236 - protein, 30 aa, Entamoeba invadens
KIFSSVCWDKSGAVSFLLEEVVVFLIGNAS

SEQ ID NO: 2982237 - protein, 19 aa, Entamoeba invadens
KIFSVKNYVVWYPVCYSHA

SEQ ID NO: 2982238 - protein, 20 aa, Entamoeba invadens
KIGKYCFGCCNNLGKVNIVA

SEQ ID NO: 2982239 - protein, 19 aa, Entamoeba invadens
KIGRECFEYCPLDGEKVFR

SEQ ID NO: 2982240 - protein, 21 aa, Entamoeba invadens
KIGSSNFFWAFPSASIVERRT

SEQ ID NO: 2982241 - protein, 17 aa, Entamoeba invadens
KIGVLWFHYLVGLESTI

SEQ ID NO: 2982242 - protein, 17 aa, Entamoeba invadens
KIHCIRIRSSWVMTCAY

SEQ ID NO: 2982243 - protein, 26 aa, Entamoeba invadens
KIIKMCGGEVRILYPIVPYKVVENNE

SEQ ID NO: 2982244 - protein, 18 aa, Entamoeba invadens
KIILRNAAGKTCWGVQSA

SEQ ID NO: 2982245 - protein, 18 aa, Entamoeba invadens
KIIWLCLKNGIAARDKWV

SEQ ID NO: 2982246 - protein, 19 aa, Entamoeba invadens
KIKDCELDKTMNQINEMIN

SEQ ID NO: 2982247 - protein, 17 aa, Entamoeba invadens
KIKFCFRIILQKYFNEE

SEQ ID NO: 2982248 - protein, 22 aa, Entamoeba invadens
KIKLKPLRLCKNGDPDLVTCAR

SEQ ID NO: 2982249 - protein, 17 aa, Entamoeba invadens
KIKRYQIGKVYRRDQPY

SEQ ID NO: 2982250 - protein, 20 aa, Entamoeba invadens
KIKSGLLILEMFWRNEMYIL

SEQ ID NO: 2982251 - protein, 19 aa, Entamoeba invadens
KIKVEIQRSFGFKEGTDEM

SEQ ID NO: 2982252 - protein, 19 aa, Entamoeba invadens
KIKVENLRAFILVDDKGND

SEQ ID NO: 2982253 - protein, 19 aa, Entamoeba invadens
KILFLETISSFLMNKVMIR

SEQ ID NO: 2982254 - protein, 18 aa, Entamoeba invadens
KILFLHDFFELMRDLHAK

SEQ ID NO: 2982255 - protein, 18 aa, Entamoeba invadens
KILICTDTHLGALEKSES

SEQ ID NO: 2982256 - protein, 22 aa, Entamoeba invadens
KILRLLKILNEFPLFKNDDQLR

SEQ ID NO: 2982257 - protein, 19 aa, Entamoeba invadens
KILYSLGVAFEFFDLKYSD

SEQ ID NO: 2982258 - protein, 19 aa, Entamoeba invadens
KILYSLGVAFEFFDLKYSE

SEQ ID NO: 2982259 - protein, 23 aa, Entamoeba invadens
KIMKICALREDFDMFIFPSEEKR

SEQ ID NO: 2982260 - protein, 19 aa, Entamoeba invadens
KIMLQDMFETMGMKEFTAK

SEQ ID NO: 2982261 - protein, 20 aa, Entamoeba invadens
KIMNFVRTWLKNAWKDFEGK

SEQ ID NO: 2982262 - protein, 18 aa, Entamoeba invadens
KIMNLTWGFTMKKIIKKE

SEQ ID NO: 2982263 - protein, 24 aa, Entamoeba invadens
KINGRSGVMIIVFPTLYEPFGCFI

SEQ ID NO: 2982264 - protein, 21 aa, Entamoeba invadens
KIPKFCFNFCFSMKHIEIPNT

SEQ ID NO: 2982265 - protein, 21 aa, Entamoeba invadens
KIPRGCFENCFGLKEVVSSEF

SEQ ID NO: 2982266 - protein, 19 aa, Entamoeba invadens
KIQCDEILKEMAINYLKRM

SEQ ID NO: 2982267 - protein, 23 aa, Entamoeba invadens
KIREAMKFILKYYNIEGVIIDGF

SEQ ID NO: 2982268 - protein, 19 aa, Entamoeba invadens
KIRERAICIIGRLTKYNPA

SEQ ID NO: 2982269 - protein, 21 aa, Entamoeba invadens
KIRGRKSLYFIIFDSNLNVFG

SEQ ID NO: 2982270 - protein, 17 aa, Entamoeba invadens
KIRLGFIVLSLLLSNYS

SEQ ID NO: 2982271 - protein, 19 aa, Entamoeba invadens
KISCLRALFGNIYSHLKLM

SEQ ID NO: 2982272 - protein, 18 aa, Entamoeba invadens
KISFHLNKFRAMVSTKKI

SEQ ID NO: 2982273 - protein, 21 aa, Entamoeba invadens
KISLCGLMLFHILIQTESGKI

SEQ ID NO: 2982274 - protein, 18 aa, Entamoeba invadens
KITLGIFFQIVFQSFKIN

SEQ ID NO: 2982275 - protein, 17 aa, Entamoeba invadens
KIVCVSCDFGVRVCQEL

SEQ ID NO: 2982276 - protein, 21 aa, Entamoeba invadens
KIVIWFRVFYELTFKKSKVDI

SEQ ID NO: 2982277 - protein, 20 aa, Entamoeba invadens
KIVLWPKIWPVFASQVNAKL

SEQ ID NO: 2982278 - protein, 24 aa, Entamoeba invadens
KIVRPRGASLFGNFDPTQKPLRKS

SEQ ID NO: 2982279 - protein, 18 aa, Entamoeba invadens
KIYLRKSVRSELDSIKKS

SEQ ID NO: 2982280 - protein, 19 aa, Entamoeba invadens
KIYMVKGCVKFDECLLEVI

SEQ ID NO: 2982281 - protein, 19 aa, Entamoeba invadens
KIYMVKGCVKFDECMLEIV

SEQ ID NO: 2982282 - protein, 19 aa, Entamoeba invadens
KKAERLVDCDMSFLSQMRR

SEQ ID NO: 2982283 - protein, 26 aa, Entamoeba invadens
KKAFSIPFWVSLRFYQSFMFDMSKLS

SEQ ID NO: 2982284 - protein, 23 aa, Entamoeba invadens
KKAFYRIVVWFGVDFETVDKNKG

SEQ ID NO: 2982285 - protein, 23 aa, Entamoeba invadens
KKCARCGKLLTVRDFLRDSMYCK

SEQ ID NO: 2982286 - protein, 17 aa, Entamoeba invadens
KKCCSAVHFQHENAFYL

SEQ ID NO: 2982287 - protein, 26 aa, Entamoeba invadens
KKCDVWPRLVHLYHYFGEKYTTFLDV

SEQ ID NO: 2982288 - protein, 23 aa, Entamoeba invadens
KKCFCGKGRVRVCCYIESASCGE

SEQ ID NO: 2982289 - protein, 21 aa, Entamoeba invadens
KKCFECFQSLFINPLINLEIE

SEQ ID NO: 2982290 - protein, 20 aa, Entamoeba invadens
KKCFICGEVHDSANCPHKND

SEQ ID NO: 2982291 - protein, 17 aa, Entamoeba invadens
KKCFVCGKKGHLSGSCP

SEQ ID NO: 2982292 - protein, 25 aa, Entamoeba invadens
KKCGWRFPLPIYRSIQFLKQKDRFV

SEQ ID NO: 2982293 - protein, 18 aa, Entamoeba invadens
KKCNSCGFHYFYNAAAAS

SEQ ID NO: 2982294 - protein, 21 aa, Entamoeba invadens
KKDFGGLLWRPQPKNLIKDDL

SEQ ID NO: 2982295 - protein, 20 aa, Entamoeba invadens
KKDFNVAILMLRQQNVEVFD

SEQ ID NO: 2982296 - protein, 18 aa, Entamoeba invadens
KKDSGPCFDSEEIEKIGE

SEQ ID NO: 2982297 - protein, 18 aa, Entamoeba invadens
KKEAFCVGVLNSSCLFTA

SEQ ID NO: 2982298 - protein, 22 aa, Entamoeba invadens
KKEEELMMWKGQTVGQYLRSTF

SEQ ID NO: 2982299 - protein, 18 aa, Entamoeba invadens
KKEFAIVISLDYQVFMDL

SEQ ID NO: 2982300 - protein, 23 aa, Entamoeba invadens
KKEFFRIIVWFNVDFETVDRNKN

SEQ ID NO: 2982301 - protein, 21 aa, Entamoeba invadens
KKEGGILFAFGYDSFFPKTDL

SEQ ID NO: 2982302 - protein, 19 aa, Entamoeba invadens
KKEGNAFVGRHRRDVCEFV

SEQ ID NO: 2982303 - protein, 19 aa, Entamoeba invadens
KKEREVSCIAGEELAVKIR

SEQ ID NO: 2982304 - protein, 25 aa, Entamoeba invadens
KKERKHKCFICKSTGHLTKECPNKV

SEQ ID NO: 2982305 - protein, 21 aa, Entamoeba invadens
KKETVEFAFKYYITPYVIEHL

SEQ ID NO: 2982306 - protein, 26 aa, Entamoeba invadens
KKFCFPGLILHDIILRFIPEQAEFFL

SEQ ID NO: 2982307 - protein, 22 aa, Entamoeba invadens
KKFECIDCSHILINPKLIRSNF

SEQ ID NO: 2982308 - protein, 22 aa, Entamoeba invadens
KKFIRLLCVLYRLMDIDQEYFI

SEQ ID NO: 2982309 - protein, 23 aa, Entamoeba invadens
KKFKSGGVFCHKCCAVFICDKCR

SEQ ID NO: 2982310 - protein, 19 aa, Entamoeba invadens
KKFLERWEVFYDLVESLWP

SEQ ID NO: 2982311 - protein, 21 aa, Entamoeba invadens
KKFLEYDIEWFPSQWKVNFAK

SEQ ID NO: 2982312 - protein, 21 aa, Entamoeba invadens
KKFLSVCWCGQGSQDKLKTKF

SEQ ID NO: 2982313 - protein, 19 aa, Entamoeba invadens
KKFRLKIFMGDYAYDDRDG

SEQ ID NO: 2982314 - protein, 17 aa, Entamoeba invadens
KKFTIGVEFATRTIEYD

SEQ ID NO: 2982315 - protein, 23 aa, Entamoeba invadens
KKGEFTLSFQFCKYIATHHLIID

SEQ ID NO: 2982316 - protein, 19 aa, Entamoeba invadens
KKGKCVLVSGHDLFDMKKI

SEQ ID NO: 2982317 - protein, 22 aa, Entamoeba invadens
KKGLRPGVFAAISGMYLSNTKW

SEQ ID NO: 2982318 - protein, 20 aa, Entamoeba invadens
KKIFECVLLLFSDTVLICKR

SEQ ID NO: 2982319 - protein, 19 aa, Entamoeba invadens
KKIFKQWGCEDVDTYLYTL

SEQ ID NO: 2982320 - protein, 17 aa, Entamoeba invadens
KKIKNIQVILSFLPILY

SEQ ID NO: 2982321 - protein, 18 aa, Entamoeba invadens
KKILFSKGFRVFGGDSRR

SEQ ID NO: 2982322 - protein, 17 aa, Entamoeba invadens
KKISIEFCVNQRISTQD

SEQ ID NO: 2982323 - protein, 18 aa, Entamoeba invadens
KKISLLVLRSNTFAKQFY

SEQ ID NO: 2982324 - protein, 25 aa, Entamoeba invadens
KKISSVYFFRCPKLNSFTFPKSLKL

SEQ ID NO: 2982325 - protein, 19 aa, Entamoeba invadens
KKITYSMCRHFDEIKTLQN

SEQ ID NO: 2982326 - protein, 28 aa, Entamoeba invadens
KKKIGELAEFVWRVPYVKIDSFGFDGNN

SEQ ID NO: 2982327 - protein, 17 aa, Entamoeba invadens
KKKILKYIVTFRGDLTQ

SEQ ID NO: 2982328 - protein, 17 aa, Entamoeba invadens
KKKVDMCVTISGNGNTT

SEQ ID NO: 2982329 - protein, 17 aa, Entamoeba invadens
KKKVVIYKLCLPDSGEK

SEQ ID NO: 2982330 - protein, 19 aa, Entamoeba invadens
KKLFGHFIFFVYDKMEEEE

SEQ ID NO: 2982331 - protein, 22 aa, Entamoeba invadens
KKLFYRIIVWFGVDFETVDKNK

SEQ ID NO: 2982332 - protein, 24 aa, Entamoeba invadens
KKLKFEVVFFWKFIDDNTLYFYDN

SEQ ID NO: 2982333 - protein, 18 aa, Entamoeba invadens
KKLKGYRHVNKKARDQYK

SEQ ID NO: 2982334 - protein, 17 aa, Entamoeba invadens
KKLKYPLEFYAFVRQDV

SEQ ID NO: 2982335 - protein, 22 aa, Entamoeba invadens
KKLNKCKEACILKDKEGGETAL

SEQ ID NO: 2982336 - protein, 19 aa, Entamoeba invadens
KKLPLGFPYIQHIKEEHFE

SEQ ID NO: 2982337 - protein, 17 aa, Entamoeba invadens
KKLPSLFIPRGSDIPSA

SEQ ID NO: 2982338 - protein, 17 aa, Entamoeba invadens
KKLSLFEWAGWIEVCVS

SEQ ID NO: 2982339 - protein, 19 aa, Entamoeba invadens
KKLSTIVIISLMKYDQVTP

SEQ ID NO: 2982340 - protein, 20 aa, Entamoeba invadens
KKLTICFKELLLILRYTPRV

SEQ ID NO: 2982341 - protein, 24 aa, Entamoeba invadens
KKLYETRHAFSLSISSEVSDELST

SEQ ID NO: 2982342 - protein, 19 aa, Entamoeba invadens
KKMFKWVYNRIVMVKLGIR

SEQ ID NO: 2982343 - protein, 18 aa, Entamoeba invadens
KKMVPCYVCGEVGHAQKF

SEQ ID NO: 2982344 - protein, 18 aa, Entamoeba invadens
KKNIFWRIVKILKNGGMK

SEQ ID NO: 2982345 - protein, 22 aa, Entamoeba invadens
KKNKGCAFVKFKTSEEAQQCLS

SEQ ID NO: 2982346 - protein, 19 aa, Entamoeba invadens
KKPDLLGMESLQVEPLSNP

SEQ ID NO: 2982347 - protein, 22 aa, Entamoeba invadens
KKPKFLCSISFGQLEHFLSDAD

SEQ ID NO: 2982348 - protein, 24 aa, Entamoeba invadens
KKQKCGECGFAAKLVGDVSGIVLK

SEQ ID NO: 2982349 - protein, 18 aa, Entamoeba invadens
KKQVLVCQCSGKYRSCSY

SEQ ID NO: 2982350 - protein, 17 aa, Entamoeba invadens
KKRCVILPDMLNVEKVE

SEQ ID NO: 2982351 - protein, 21 aa, Entamoeba invadens
KKRFNICPFVKYTKEDRKKYG

SEQ ID NO: 2982352 - protein, 19 aa, Entamoeba invadens
KKRFNICPYVKYTKEDREK

SEQ ID NO: 2982353 - protein, 17 aa, Entamoeba invadens
KKRLKTLRRLRIMNHRL

SEQ ID NO: 2982354 - protein, 18 aa, Entamoeba invadens
KKRLPICMYEDNLTHTSL

SEQ ID NO: 2982355 - protein, 23 aa, Entamoeba invadens
KKRMKAKGGIVFNGRVYGSMQVS

SEQ ID NO: 2982356 - protein, 18 aa, Entamoeba invadens
KKRSSGCIAKYNEKFLLG

SEQ ID NO: 2982357 - protein, 17 aa, Entamoeba invadens
KKRTLIMPWNPHQNDEV

SEQ ID NO: 2982358 - protein, 19 aa, Entamoeba invadens
KKRVVLYCMEILISDVLKE

SEQ ID NO: 2982359 - protein, 19 aa, Entamoeba invadens
KKSDCKDCCDCCCDCDCDC

SEQ ID NO: 2982360 - protein, 24 aa, Entamoeba invadens
KKSGWRFPLPLYRCIDYLERNNGA

SEQ ID NO: 2982361 - protein, 20 aa, Entamoeba invadens
KKSKACGFVKFRRVADAMKC

SEQ ID NO: 2982362 - protein, 26 aa, Entamoeba invadens
KKSLFKIKWFLPHLFSRNRSKTEMKK

SEQ ID NO: 2982363 - protein, 21 aa, Entamoeba invadens
KKSRISKLFGRDESFIALSNF

SEQ ID NO: 2982364 - protein, 20 aa, Entamoeba invadens
KKSSFKRGRTPLRERPLPPL

SEQ ID NO: 2982365 - protein, 21 aa, Entamoeba invadens
KKTECPFRINLNFKAKLGKWK

SEQ ID NO: 2982366 - protein, 24 aa, Entamoeba invadens
KKTNGRIAQFKSLQTSPLQLVKKD

SEQ ID NO: 2982367 - protein, 19 aa, Entamoeba invadens
KKTYTRWVVLKRKCMMFFK

SEQ ID NO: 2982368 - protein, 19 aa, Entamoeba invadens
KKVHPKCLLVLFRMTVILL

SEQ ID NO: 2982369 - protein, 25 aa, Entamoeba invadens
KKVILAMCTGCWVLNSLWIDKCIEK

SEQ ID NO: 2982370 - protein, 20 aa, Entamoeba invadens
KKVNLEVMRAWVTSKVVEIL

SEQ ID NO: 2982371 - protein, 23 aa, Entamoeba invadens
KKWFVCTIPETWNKGTVESKLAT

SEQ ID NO: 2982372 - protein, 21 aa, Entamoeba invadens
KKYIRDIICGIMFLHEQGIVH

SEQ ID NO: 2982373 - protein, 21 aa, Entamoeba invadens
KKYKVKISPILPVALVNQIDV

SEQ ID NO: 2982374 - protein, 24 aa, Entamoeba invadens
KKYNCFDGRFQFVTGTTFPDHLNN

SEQ ID NO: 2982375 - protein, 23 aa, Entamoeba invadens
KLADYRFNLWPAYSDTFEEEMYD

SEQ ID NO: 2982376 - protein, 26 aa, Entamoeba invadens
KLAKYCFRCGYPLRGYKVLYPTITYK

SEQ ID NO: 2982377 - protein, 25 aa, Entamoeba invadens
KLALYLNLAICFIKVSKFNKALDNA

SEQ ID NO: 2982378 - protein, 23 aa, Entamoeba invadens
KLAPEDVKVLFGIFKFVYTEYID

SEQ ID NO: 2982379 - protein, 18 aa, Entamoeba invadens
KLCENIRVGRIFQEKLIT

SEQ ID NO: 2982380 - protein, 29 aa, Entamoeba invadens
KLCIFCCARFSFRIGEVFYSQSEDKIIQQ

SEQ ID NO: 2982381 - protein, 19 aa, Entamoeba invadens
KLDDMRGAEEFFLDNKTEQ

SEQ ID NO: 2982382 - protein, 23 aa, Entamoeba invadens
KLDKLKTLFVFKGYQITFKKIDN

SEQ ID NO: 2982383 - protein, 20 aa, Entamoeba invadens
KLDSIKMSFSSFMASTEKYI

SEQ ID NO: 2982384 - protein, 19 aa, Entamoeba invadens
KLEKLFVRFAEKIGEDVTH

SEQ ID NO: 2982385 - protein, 21 aa, Entamoeba invadens
KLELIKVFGIIGAIDTYRYKL

SEQ ID NO: 2982386 - protein, 17 aa, Entamoeba invadens
KLEMFKKIYTFRNVLLG

SEQ ID NO: 2982387 - protein, 19 aa, Entamoeba invadens
KLERFRKIVILKRGLSCDN

SEQ ID NO: 2982388 - protein, 24 aa, Entamoeba invadens
KLFFKTVAVSYAFYLQMKAFGYTF

SEQ ID NO: 2982389 - protein, 18 aa, Entamoeba invadens
KLFKEIIEKLVIYIDTVK

SEQ ID NO: 2982390 - protein, 20 aa, Entamoeba invadens
KLFPNVCVYISYLSDIILDP

SEQ ID NO: 2982391 - protein, 18 aa, Entamoeba invadens
KLFSGKWVPEEKIVLFKA

SEQ ID NO: 2982392 - protein, 17 aa, Entamoeba invadens
KLFVKREFHALKVNPKG

SEQ ID NO: 2982393 - protein, 18 aa, Entamoeba invadens
KLGEALSLFIPMLNVYKL

SEQ ID NO: 2982394 - protein, 18 aa, Entamoeba invadens
KLGIKFLVIRSLSDVPSA

SEQ ID NO: 2982395 - protein, 19 aa, Entamoeba invadens
KLGKGVTFPDEWKNPPKDA

SEQ ID NO: 2982396 - protein, 19 aa, Entamoeba invadens
KLHFKGCQNISVTTQNVIN

SEQ ID NO: 2982397 - protein, 21 aa, Entamoeba invadens
KLIDFGSACFENFTMNTYIQS

SEQ ID NO: 2982398 - protein, 20 aa, Entamoeba invadens
KLIGEMDGILAFERGVFGFK

SEQ ID NO: 2982399 - protein, 18 aa, Entamoeba invadens
KLIPGISCVSTRSGELFY

SEQ ID NO: 2982400 - protein, 18 aa, Entamoeba invadens
KLIQTWAALCSKINASVQ

SEQ ID NO: 2982401 - protein, 19 aa, Entamoeba invadens
KLIRFCPTVAFNNIVKCKL

SEQ ID NO: 2982402 - protein, 17 aa, Entamoeba invadens
KLIRRLTPIKVRSEKSP

SEQ ID NO: 2982403 - protein, 18 aa, Entamoeba invadens
KLKIRMLFDTAKGMQFLH

SEQ ID NO: 2982404 - protein, 19 aa, Entamoeba invadens
KLKKGRWSGYRVYDPATEG

SEQ ID NO: 2982405 - protein, 19 aa, Entamoeba invadens
KLKKMVIEWEMNVKPFDKK

SEQ ID NO: 2982406 - protein, 20 aa, Entamoeba invadens
KLKMAGRCLGMKTFRKVLLG

SEQ ID NO: 2982407 - protein, 20 aa, Entamoeba invadens
KLKSLVEVMAYFFENFQTIA

SEQ ID NO: 2982408 - protein, 17 aa, Entamoeba invadens
KLLEHIRIPKSVHFIGE

SEQ ID NO: 2982409 - protein, 20 aa, Entamoeba invadens
KLLFFWKQMFLLVSNASCVS

SEQ ID NO: 2982410 - protein, 18 aa, Entamoeba invadens
KLLLSDLFEHTKFKDVDY

SEQ ID NO: 2982411 - protein, 20 aa, Entamoeba invadens
KLLVKECLRELTIDMNSIEV

SEQ ID NO: 2982412 - protein, 18 aa, Entamoeba invadens
KLMEAFCNKQGLNMSSVR

SEQ ID NO: 2982413 - protein, 24 aa, Entamoeba invadens
KLNVELHLEWKRLACEVVNIPTGS

SEQ ID NO: 2982414 - protein, 21 aa, Entamoeba invadens
KLPAMDFFIAKGFASKLSDTF

SEQ ID NO: 2982415 - protein, 17 aa, Entamoeba invadens
KLPEMQFYLSLYGHNLP

SEQ ID NO: 2982416 - protein, 25 aa, Entamoeba invadens
KLPESWKILLREAGVKKRDLQNPDT

SEQ ID NO: 2982417 - protein, 20 aa, Entamoeba invadens
KLPPNVCVYISYLSDIILDP

SEQ ID NO: 2982418 - protein, 20 aa, Entamoeba invadens
KLPPNVCVYISYLSDIILEP

SEQ ID NO: 2982419 - protein, 19 aa, Entamoeba invadens
KLPPNVCVYISYLSDTILD

SEQ ID NO: 2982420 - protein, 18 aa, Entamoeba invadens
KLPTEFMYLFDLYQNNEI

SEQ ID NO: 2982421 - protein, 19 aa, Entamoeba invadens
KLQPWWIVRTCLTDQEGKV

SEQ ID NO: 2982422 - protein, 19 aa, Entamoeba invadens
KLQRDFCKILEANNTENIA

SEQ ID NO: 2982423 - protein, 19 aa, Entamoeba invadens
KLQVKFLFCSPVNKGVELV

SEQ ID NO: 2982424 - protein, 18 aa, Entamoeba invadens
KLRECFHEGNGFVIALLY

SEQ ID NO: 2982425 - protein, 18 aa, Entamoeba invadens
KLRLERLKDILLIQRDFI

SEQ ID NO: 2982426 - protein, 20 aa, Entamoeba invadens
KLRMTTPHFIRCILPNTQKR

SEQ ID NO: 2982427 - protein, 20 aa, Entamoeba invadens
KLSLKEVFVPSLVIPNANFF

SEQ ID NO: 2982428 - protein, 17 aa, Entamoeba invadens
KLSLKYNVLSKYTTFVA

SEQ ID NO: 2982429 - protein, 29 aa, Entamoeba invadens
KLSSLCLYTRLSAVRWAFYLNMSVRYKHV

SEQ ID NO: 2982430 - protein, 18 aa, Entamoeba invadens
KLTKRFVGGYIIGLRDRH

SEQ ID NO: 2982431 - protein, 17 aa, Entamoeba invadens
KLTWKAGHIWVGNVTIQ

SEQ ID NO: 2982432 - protein, 20 aa, Entamoeba invadens
KLVECYKLILDVAAWINEKK

SEQ ID NO: 2982433 - protein, 26 aa, Entamoeba invadens
KLVYLCVFAGCDYCKSLRGVGIKKAL

SEQ ID NO: 2982434 - protein, 20 aa, Entamoeba invadens
KLWDTYSFYLAKDVETIKRQ

SEQ ID NO: 2982435 - protein, 20 aa, Entamoeba invadens
KLWEISDFVILWGGNNGDTQ

SEQ ID NO: 2982436 - protein, 18 aa, Entamoeba invadens
KLYFEIAFETNFDAFLFV

SEQ ID NO: 2982437 - protein, 18 aa, Entamoeba invadens
KMCLLDVNKSCCYKSEKQ

SEQ ID NO: 2982438 - protein, 20 aa, Entamoeba invadens
KMCLQMLNWIIADKSVAAFM

SEQ ID NO: 2982439 - protein, 18 aa, Entamoeba invadens
KMDAAVVLFPCQRVLLVI

SEQ ID NO: 2982440 - protein, 17 aa, Entamoeba invadens
KMFREMIHRLKVAHPDI

SEQ ID NO: 2982441 - protein, 17 aa, Entamoeba invadens
KMFWECASVVLQQTDTV

SEQ ID NO: 2982442 - protein, 18 aa, Entamoeba invadens
KMGCCIDLLAPLFTFVGY

SEQ ID NO: 2982443 - protein, 23 aa, Entamoeba invadens
KMGGLRPTWEIAYYSWEEAVLNA

SEQ ID NO: 2982444 - protein, 18 aa, Entamoeba invadens
KMILRLYKGVPISVRQSL

SEQ ID NO: 2982445 - protein, 25 aa, Entamoeba invadens
KMITWPKRVTFFLQLLLLRKINMVL

SEQ ID NO: 2982446 - protein, 24 aa, Entamoeba invadens
KMKCAMCRNLAAFLLKKIRRDRLS

SEQ ID NO: 2982447 - protein, 24 aa, Entamoeba invadens
KMLCWTGKELWAFKEQNAGKTAVG

SEQ ID NO: 2982448 - protein, 18 aa, Entamoeba invadens
KMLSCKTGSFGSSTLERM

SEQ ID NO: 2982449 - protein, 20 aa, Entamoeba invadens
KMMHSGELPKAFDSDDLLGL

SEQ ID NO: 2982450 - protein, 23 aa, Entamoeba invadens
KMMRELHPVFPILARYVYTIGEL

SEQ ID NO: 2982451 - protein, 19 aa, Entamoeba invadens
KMMTEYRASVELETVLTGQ

SEQ ID NO: 2982452 - protein, 20 aa, Entamoeba invadens
KMRDCTKCSFVLAQSSRVWS

SEQ ID NO: 2982453 - protein, 20 aa, Entamoeba invadens
KMRFARDCFGLFEVLCGDEK

SEQ ID NO: 2982454 - protein, 19 aa, Entamoeba invadens
KMRVIACSNIGYYENMNDP

SEQ ID NO: 2982455 - protein, 21 aa, Entamoeba invadens
KMTVKWGFHNECIWKYNNEIY

SEQ ID NO: 2982456 - protein, 18 aa, Entamoeba invadens
KMVCCLTEISKILRGKDA

SEQ ID NO: 2982457 - protein, 17 aa, Entamoeba invadens
KMVLKYMYPDGIYDYNI

SEQ ID NO: 2982458 - protein, 17 aa, Entamoeba invadens
KMYDVFESIYFVFVVSH

SEQ ID NO: 2982459 - protein, 18 aa, Entamoeba invadens
KNCDCFVFIYSILSIDSF

SEQ ID NO: 2982460 - protein, 17 aa, Entamoeba invadens
KNCTSLVTLCCPSNLKL

SEQ ID NO: 2982461 - protein, 18 aa, Entamoeba invadens
KNDFNFVCCGKFKKRVKL

SEQ ID NO: 2982462 - protein, 18 aa, Entamoeba invadens
KNDWRMCFLFNDVFIVAN

SEQ ID NO: 2982463 - protein, 18 aa, Entamoeba invadens
KNDYIVKYFCSFKDTSLG

SEQ ID NO: 2982464 - protein, 19 aa, Entamoeba invadens
KNECQTLLSLKGFTEQGKT

SEQ ID NO: 2982465 - protein, 23 aa, Entamoeba invadens
KNEFAVKIVDEFVENKRKEVTQK

SEQ ID NO: 2982466 - protein, 24 aa, Entamoeba invadens
KNEKGGCLCNNFIPLFVIFDQLYH

SEQ ID NO: 2982467 - protein, 20 aa, Entamoeba invadens
KNENCPVCDVLLNGPEHMNV

SEQ ID NO: 2982468 - protein, 25 aa, Entamoeba invadens
KNETRLRIAVMFLRKLYSDALNSKA

SEQ ID NO: 2982469 - protein, 19 aa, Entamoeba invadens
KNFEIISVFVIRRLFNKIG

SEQ ID NO: 2982470 - protein, 18 aa, Entamoeba invadens
KNFFEGIEYGKLKKRDTA

SEQ ID NO: 2982471 - protein, 17 aa, Entamoeba invadens
KNFFWKKFGFSIEEAPR

SEQ ID NO: 2982472 - protein, 17 aa, Entamoeba invadens
KNHITSVILLQMNSKIK

SEQ ID NO: 2982473 - protein, 20 aa, Entamoeba invadens
KNIFFKALIFWLGRSASLLH

SEQ ID NO: 2982474 - protein, 22 aa, Entamoeba invadens
KNIRSAKTIQHWECNHKINQKI

SEQ ID NO: 2982475 - protein, 24 aa, Entamoeba invadens
KNKKDDFAGLSFEAEIANFNKQLK

SEQ ID NO: 2982476 - protein, 24 aa, Entamoeba invadens
KNKKDDFAGLSFETEIAKIKKQQD

SEQ ID NO: 2982477 - protein, 42 aa, Entamoeba invadens
KNKRISAKVSLKKRVKNVLQRMLDCVKNVKVIWPNDDDETKP

SEQ ID NO: 2982478 - protein, 18 aa, Entamoeba invadens
KNKYDILAELSMQQQQES

SEQ ID NO: 2982479 - protein, 22 aa, Entamoeba invadens
KNLCMKEYFGGYEEFCIDFDPT

SEQ ID NO: 2982480 - protein, 17 aa, Entamoeba invadens
KNLGCLLSFGTTTSPGI

SEQ ID NO: 2982481 - protein, 17 aa, Entamoeba invadens
KNLKRVCLENCTDVDII

SEQ ID NO: 2982482 - protein, 30 aa, Entamoeba invadens
KNLLKMTGEFKLEFFGQFGLPKNSVFEDFH

SEQ ID NO: 2982483 - protein, 19 aa, Entamoeba invadens
KNLLNYRAFSYTHFNNIFD

SEQ ID NO: 2982484 - protein, 25 aa, Entamoeba invadens
KNLRAFCYWAGCLFLRAKWYEQASS

SEQ ID NO: 2982485 - protein, 24 aa, Entamoeba invadens
KNLRKISLLKVRLIAQMRRGLDMV

SEQ ID NO: 2982486 - protein, 19 aa, Entamoeba invadens
KNMLNARIAGIQAKLDEER

SEQ ID NO: 2982487 - protein, 20 aa, Entamoeba invadens
KNMLNARIAGIQAQPDEERQ

SEQ ID NO: 2982488 - protein, 19 aa, Entamoeba invadens
KNMLNARIAGIQTQLDEER

SEQ ID NO: 2982489 - protein, 19 aa, Entamoeba invadens
KNQEMQLLFAAAKGEVEVA

SEQ ID NO: 2982490 - protein, 17 aa, Entamoeba invadens
KNQWAREMKEFGLTRID

SEQ ID NO: 2982491 - protein, 22 aa, Entamoeba invadens
KNQYCVACAIHGRIVRVRSHED

SEQ ID NO: 2982492 - protein, 19 aa, Entamoeba invadens
KNRSSFCFAPLLLEIRKAI

SEQ ID NO: 2982493 - protein, 22 aa, Entamoeba invadens
KNSKSCYCLLPVTKYYTCLTCS

SEQ ID NO: 2982494 - protein, 20 aa, Entamoeba invadens
KNSWEGVDFTLVLRVEKAIF

SEQ ID NO: 2982495 - protein, 19 aa, Entamoeba invadens
KNTCFEVAYFVFCCNSNLS

SEQ ID NO: 2982496 - protein, 23 aa, Entamoeba invadens
KNTFKDWSCLSTFMQRDAYLMWG

SEQ ID NO: 2982497 - protein, 21 aa, Entamoeba invadens
KNVFCCLEKYFSEDFVVDQDQ

SEQ ID NO: 2982498 - protein, 18 aa, Entamoeba invadens
KNVKNFVCVGSRNVDLKG

SEQ ID NO: 2982499 - protein, 22 aa, Entamoeba invadens
KNVKSFGAFCFYNSVPKENVLF

SEQ ID NO: 2982500 - protein, 19 aa, Entamoeba invadens
KNVRLRYYLRVTVNKKYSS

SEQ ID NO: 2982501 - protein, 17 aa, Entamoeba invadens
KNVSIYFDLKFGTNTFE

SEQ ID NO: 2982502 - protein, 23 aa, Entamoeba invadens
KNVYCFAETLILDKIGVFSPLRC

SEQ ID NO: 2982503 - protein, 17 aa, Entamoeba invadens
KPAFGMDNNDVFPVLPD

SEQ ID NO: 2982504 - protein, 19 aa, Entamoeba invadens
KPATIFFFFFEKLMNEKKV

SEQ ID NO: 2982505 - protein, 23 aa, Entamoeba invadens
KPCMKSPKIPLLVIKGQQPGSGH

SEQ ID NO: 2982506 - protein, 26 aa, Entamoeba invadens
KPDGYFSWEIGKFIHRHFCKNGYDFD

SEQ ID NO: 2982507 - protein, 20 aa, Entamoeba invadens
KPDGYFSWEIRKFVHHHFCK

SEQ ID NO: 2982508 - protein, 17 aa, Entamoeba invadens
KPECVFKLKKRCKKKKR

SEQ ID NO: 2982509 - protein, 18 aa, Entamoeba invadens
KPEKEQLVSIFLSSMSKL

SEQ ID NO: 2982510 - protein, 21 aa, Entamoeba invadens
KPFCKNCFVLKFAKLCATCGK

SEQ ID NO: 2982511 - protein, 19 aa, Entamoeba invadens
KPFGPRFVSISADRSIQIW

SEQ ID NO: 2982512 - protein, 18 aa, Entamoeba invadens
KPFLFLHCHILREYLSKT

SEQ ID NO: 2982513 - protein, 18 aa, Entamoeba invadens
KPFPNVFYLNDFVGTFVE

SEQ ID NO: 2982514 - protein, 17 aa, Entamoeba invadens
KPFPPARIRKLMKIATD

SEQ ID NO: 2982515 - protein, 20 aa, Entamoeba invadens
KPFVCLEYVKKMLLQNLSFS

SEQ ID NO: 2982516 - protein, 18 aa, Entamoeba invadens
KPGKYGMKVWTMVDNISG

SEQ ID NO: 2982517 - protein, 18 aa, Entamoeba invadens
KPKEAFTHLKIQDNVVNS

SEQ ID NO: 2982518 - protein, 21 aa, Entamoeba invadens
KPKKPMGISMGGGMMGMPAIT

SEQ ID NO: 2982519 - protein, 17 aa, Entamoeba invadens
KPLFFFIGLSLKQDTHF

SEQ ID NO: 2982520 - protein, 18 aa, Entamoeba invadens
KPLRLIIMSATLRVSEFL

SEQ ID NO: 2982521 - protein, 23 aa, Entamoeba invadens
KPNDCKRWFWELVQNAKDSISQT

SEQ ID NO: 2982522 - protein, 23 aa, Entamoeba invadens
KPNDCKRWFWELVQNAKDSLSQT

SEQ ID NO: 2982523 - protein, 22 aa, Entamoeba invadens
KPPPRYRVIMLFEADSLSYEAQ

SEQ ID NO: 2982524 - protein, 23 aa, Entamoeba invadens
KPPTCPRVLFSFVGSAFETDEQF

SEQ ID NO: 2982525 - protein, 17 aa, Entamoeba invadens
KPRLSIYIEGFCKVFKT

SEQ ID NO: 2982526 - protein, 19 aa, Entamoeba invadens
KPRMAGILGGNRARKVEEV

SEQ ID NO: 2982527 - protein, 19 aa, Entamoeba invadens
KPSELRRAFTQFKRLNSID

SEQ ID NO: 2982528 - protein, 22 aa, Entamoeba invadens
KPSPLFCLGSRFSIVENDKEDF

SEQ ID NO: 2982529 - protein, 18 aa, Entamoeba invadens
KPSRRISNGLPFIIHVNA

SEQ ID NO: 2982530 - protein, 25 aa, Entamoeba invadens
KPSSENWLKWIVSVGEEFEFDFKKC

SEQ ID NO: 2982531 - protein, 26 aa, Entamoeba invadens
KPSVEAFKAFYGLGVTYNFISNFVAI

SEQ ID NO: 2982532 - protein, 20 aa, Entamoeba invadens
KPTLSEWFRKMCDLEEKDTK

SEQ ID NO: 2982533 - protein, 22 aa, Entamoeba invadens
KPVEFKPKFNLFDRQEEERKGK

SEQ ID NO: 2982534 - protein, 24 aa, Entamoeba invadens
KPVEIEFFKPLTLIQGPNGAGKTT

SEQ ID NO: 2982535 - protein, 19 aa, Entamoeba invadens
KPVLRRLLLAYSIYNYNIG

SEQ ID NO: 2982536 - protein, 17 aa, Entamoeba invadens
KPVWKTTCEEIIRTIVL

SEQ ID NO: 2982537 - protein, 17 aa, Entamoeba invadens
KQANCLEIAMKLSEEAM

SEQ ID NO: 2982538 - protein, 17 aa, Entamoeba invadens
KQANCLLEQLKAFKKEK

SEQ ID NO: 2982539 - protein, 20 aa, Entamoeba invadens
KQCFKGCGLLKIIPLPITVE

SEQ ID NO: 2982540 - protein, 24 aa, Entamoeba invadens
KQCPNPLSFCSFVFVFRTALDKNY

SEQ ID NO: 2982541 - protein, 33 aa, Entamoeba invadens
KQEIIDCPYPFFIFEWQYLWFIHAFNIETSLRV

SEQ ID NO: 2982542 - protein, 17 aa, Entamoeba invadens
KQFLRYLIVREIEDNFR

SEQ ID NO: 2982543 - protein, 21 aa, Entamoeba invadens
KQGHSKFRYMCLEYLNINVDK

SEQ ID NO: 2982544 - protein, 19 aa, Entamoeba invadens
KQGVFGFKIEAVWLNAPSA

SEQ ID NO: 2982545 - protein, 17 aa, Entamoeba invadens
KQILIRRCEVGGIPSDI

SEQ ID NO: 2982546 - protein, 18 aa, Entamoeba invadens
KQKVNVVVPFSMHIAAKS

SEQ ID NO: 2982547 - protein, 17 aa, Entamoeba invadens
KQLKAMCFFLTTDGDLY

SEQ ID NO: 2982548 - protein, 21 aa, Entamoeba invadens
KQLKTLWRLRIMDHRLRHLKH

SEQ ID NO: 2982549 - protein, 17 aa, Entamoeba invadens
KQLPQICANCMRSYTDY

SEQ ID NO: 2982550 - protein, 18 aa, Entamoeba invadens
KQQQVLCRFEAKDVFLQA

SEQ ID NO: 2982551 - protein, 24 aa, Entamoeba invadens
KQQTYRWFVCLFSREFHYHMTFAI

SEQ ID NO: 2982552 - protein, 18 aa, Entamoeba invadens
KQRSLCVFGEKDICIGKR

SEQ ID NO: 2982553 - protein, 21 aa, Entamoeba invadens
KQRVVPIVLHFSYLFKETVLS

SEQ ID NO: 2982554 - protein, 24 aa, Entamoeba invadens
KQRWKQMEMCVNKMWASPLIIFEK

SEQ ID NO: 2982555 - protein, 20 aa, Entamoeba invadens
KQSYETFVAFPIIKTNFATN

SEQ ID NO: 2982556 - protein, 19 aa, Entamoeba invadens
KQVYPFTALPSFTVAPLNV

SEQ ID NO: 2982557 - protein, 23 aa, Entamoeba invadens
KQYDCIWIQWSILYLRDEDLVNM

SEQ ID NO: 2982558 - protein, 21 aa, Entamoeba invadens
KRAEELWNLVVLFSSLELENG

SEQ ID NO: 2982559 - protein, 20 aa, Entamoeba invadens
KRAEVWRRFFNYIAKNDSYY

SEQ ID NO: 2982560 - protein, 18 aa, Entamoeba invadens
KRAKLKKSDFETIKVIGR

SEQ ID NO: 2982561 - protein, 19 aa, Entamoeba invadens
KRCCGDCVLRKVIIPELIG

SEQ ID NO: 2982562 - protein, 27 aa, Entamoeba invadens
KRCEMCGQRMCKKCCLKGFVLNFNNNQ

SEQ ID NO: 2982563 - protein, 18 aa, Entamoeba invadens
KRCLECGIINRPDKGLFY

SEQ ID NO: 2982564 - protein, 24 aa, Entamoeba invadens
KREIDLRVGFAFTRLSTSLLTTQF

SEQ ID NO: 2982565 - protein, 19 aa, Entamoeba invadens
KREMCYKIAFEVFAAVAHK

SEQ ID NO: 2982566 - protein, 19 aa, Entamoeba invadens
KRESFEIVEIDNLAKIGGD

SEQ ID NO: 2982567 - protein, 18 aa, Entamoeba invadens
KRFRAIFVDLCNNETSHL

SEQ ID NO: 2982568 - protein, 21 aa, Entamoeba invadens
KRGFSSLDINEMFYHRYSKYY

SEQ ID NO: 2982569 - protein, 20 aa, Entamoeba invadens
KRGGIKIHVKFEVSNFTMYD

SEQ ID NO: 2982570 - protein, 18 aa, Entamoeba invadens
KRGITILKNLICTFEKLY

SEQ ID NO: 2982571 - protein, 18 aa, Entamoeba invadens
KRGMKEGEEYSRIIEVVG

SEQ ID NO: 2982572 - protein, 23 aa, Entamoeba invadens
KRHCAMCSKCVCANCSKGKIPLP

SEQ ID NO: 2982573 - protein, 21 aa, Entamoeba invadens
KRHEFRMNPLLSIFGVTEQKT

SEQ ID NO: 2982574 - protein, 17 aa, Entamoeba invadens
KRIEWCQNKSTALEILG

SEQ ID NO: 2982575 - protein, 20 aa, Entamoeba invadens
KRIKEMPVDVKVELNKNSAD

SEQ ID NO: 2982576 - protein, 20 aa, Entamoeba invadens
KRIKKAGGFVDAAGRVSGLR

SEQ ID NO: 2982577 - protein, 17 aa, Entamoeba invadens
KRILNKRVQVLSGGELQ

SEQ ID NO: 2982578 - protein, 17 aa, Entamoeba invadens
KRINVFIIRDGIEQFSF

SEQ ID NO: 2982579 - protein, 22 aa, Entamoeba invadens
KRIPWTTICKIVLVALENIEKK

SEQ ID NO: 2982580 - protein, 20 aa, Entamoeba invadens
KRISLDFIMNEYFLDLLCTL

SEQ ID NO: 2982581 - protein, 17 aa, Entamoeba invadens
KRITLIAGIFANNTTLK

SEQ ID NO: 2982582 - protein, 18 aa, Entamoeba invadens
KRIVELFITSGLPVSNSE

SEQ ID NO: 2982583 - protein, 22 aa, Entamoeba invadens
KRKEIISSFEFYSDRLLDLYTL

SEQ ID NO: 2982584 - protein, 21 aa, Entamoeba invadens
KRKEKIVRCDFINDKNKKFNE

SEQ ID NO: 2982585 - protein, 20 aa, Entamoeba invadens
KRKITPFAVITTMTNNVTIK

SEQ ID NO: 2982586 - protein, 17 aa, Entamoeba invadens
KRKLDSIKMSFSSFMAS

SEQ ID NO: 2982587 - protein, 20 aa, Entamoeba invadens
KRKRGVLVHCECGISRSASI

SEQ ID NO: 2982588 - protein, 21 aa, Entamoeba invadens
KRKRQAFNFKFIRDGSSSVDD

SEQ ID NO: 2982589 - protein, 22 aa, Entamoeba invadens
KRKSRHCCFCQNKLAIGYDDGI

SEQ ID NO: 2982590 - protein, 17 aa, Entamoeba invadens
KRLFLFYLSTVQRVDEA

SEQ ID NO: 2982591 - protein, 17 aa, Entamoeba invadens
KRLQTLVTMALGCAHLV

SEQ ID NO: 2982592 - protein, 22 aa, Entamoeba invadens
KRLRPLGLLSFYIGGGGQLTDP

SEQ ID NO: 2982593 - protein, 19 aa, Entamoeba invadens
KRLSEELGKEKEKRESAER

SEQ ID NO: 2982594 - protein, 19 aa, Entamoeba invadens
KRNLVLRLWDAFFAFPDER

SEQ ID NO: 2982595 - protein, 20 aa, Entamoeba invadens
KRNMRWGESLIFFSKENPKF

SEQ ID NO: 2982596 - protein, 23 aa, Entamoeba invadens
KRNSEILKHVLALCGKIISNPES

SEQ ID NO: 2982597 - protein, 19 aa, Entamoeba invadens
KRPSCYFCADIVAPTDSLS

SEQ ID NO: 2982598 - protein, 21 aa, Entamoeba invadens
KRQPLSLPFVLLFLTNLIGDE

SEQ ID NO: 2982599 - protein, 21 aa, Entamoeba invadens
KRRCKEMENVYILKGASQKTA

SEQ ID NO: 2982600 - protein, 24 aa, Entamoeba invadens
KRRKPVVGCFFELLVLKTQGVIDL

SEQ ID NO: 2982601 - protein, 18 aa, Entamoeba invadens
KRRRVFSVQEMLEDEKEE

SEQ ID NO: 2982602 - protein, 23 aa, Entamoeba invadens
KRSCKACVFNNFIPGYDCKIADA

SEQ ID NO: 2982603 - protein, 18 aa, Entamoeba invadens
KRSVVCPNPGFIIQLYQF

SEQ ID NO: 2982604 - protein, 26 aa, Entamoeba invadens
KRTIPRLRGVYNFVKWLEEADRSHKM

SEQ ID NO: 2982605 - protein, 21 aa, Entamoeba invadens
KRVDSLICGGFVLDLTSITQH

SEQ ID NO: 2982606 - protein, 18 aa, Entamoeba invadens
KRVMFALGTVLYCVANKG

SEQ ID NO: 2982607 - protein, 20 aa, Entamoeba invadens
KRVNVTLGFKDKECAKKFVD

SEQ ID NO: 2982608 - protein, 20 aa, Entamoeba invadens
KRVWCKPELFGNGSKIVLIA

SEQ ID NO: 2982609 - protein, 23 aa, Entamoeba invadens
KRVYRPRASTVFVDARTDTKTKT

SEQ ID NO: 2982610 - protein, 18 aa, Entamoeba invadens
KRWFQTTPRNPFRLDYYT

SEQ ID NO: 2982611 - protein, 19 aa, Entamoeba invadens
KRWRVGEELVLEFVSSTKV

SEQ ID NO: 2982612 - protein, 19 aa, Entamoeba invadens
KRWSQFFVENRTKNFCEGF

SEQ ID NO: 2982613 - protein, 19 aa, Entamoeba invadens
KRYADHLLELTLFAQAKTK

SEQ ID NO: 2982614 - protein, 26 aa, Entamoeba invadens
KRYDFLVQFLPKWGSGWEKLSSDHRN

SEQ ID NO: 2982615 - protein, 17 aa, Entamoeba invadens
KRYEFFDNLCLFESNYK

SEQ ID NO: 2982616 - protein, 23 aa, Entamoeba invadens
KRYFGRLKTVFAFARTKFVKEFE

SEQ ID NO: 2982617 - protein, 23 aa, Entamoeba invadens
KRYFVLKDKMIWYYASRHDLIAK

SEQ ID NO: 2982618 - protein, 20 aa, Entamoeba invadens
KRYGFPEALFNLAVIDITAE

SEQ ID NO: 2982619 - protein, 18 aa, Entamoeba invadens
KRYGTILRLCIQNFDKKR

SEQ ID NO: 2982620 - protein, 19 aa, Entamoeba invadens
KRYLELCGFKKEGLYNVGR

SEQ ID NO: 2982621 - protein, 17 aa, Entamoeba invadens
KSAFLRMLKAAFYEAPD

SEQ ID NO: 2982622 - protein, 22 aa, Entamoeba invadens
KSAILVALAICFGAKAQFTSRG

SEQ ID NO: 2982623 - protein, 19 aa, Entamoeba invadens
KSALEVLDFFCTKMDEKEA

SEQ ID NO: 2982624 - protein, 20 aa, Entamoeba invadens
KSAWRFPTPIFRSIQYLRYN

SEQ ID NO: 2982625 - protein, 20 aa, Entamoeba invadens
KSCKSFENFVIPNTVVEFGM

SEQ ID NO: 2982626 - protein, 17 aa, Entamoeba invadens
KSCRRYILSGVCKFMTI

SEQ ID NO: 2982627 - protein, 20 aa, Entamoeba invadens
KSDFKYAWSIADFVATGKHL

SEQ ID NO: 2982628 - protein, 18 aa, Entamoeba invadens
KSDFLLKEARVMRLCVHP

SEQ ID NO: 2982629 - protein, 22 aa, Entamoeba invadens
KSDLCKRSGLHIAIIYNDGISV

SEQ ID NO: 2982630 - protein, 22 aa, Entamoeba invadens
KSDLRLEQIWTFVDNYDVFSFF

SEQ ID NO: 2982631 - protein, 18 aa, Entamoeba invadens
KSDRGVVFVTRWLGENKV

SEQ ID NO: 2982632 - protein, 19 aa, Entamoeba invadens
KSEECWNVVLGIVKKMKEN

SEQ ID NO: 2982633 - protein, 19 aa, Entamoeba invadens
KSELRRCTKLNSPRKSKKS

SEQ ID NO: 2982634 - protein, 21 aa, Entamoeba invadens
KSELYKTDFVFDEQKFANLIY

SEQ ID NO: 2982635 - protein, 21 aa, Entamoeba invadens
KSEMKIPLFSLFGKIPVEKVQ

SEQ ID NO: 2982636 - protein, 19 aa, Entamoeba invadens
KSEVFEKVFTCSRKNDNFI

SEQ ID NO: 2982637 - protein, 17 aa, Entamoeba invadens
KSFDIFCAINYIVYNKQ

SEQ ID NO: 2982638 - protein, 25 aa, Entamoeba invadens
KSFDYCFPRFLVLLFPNELTSTFWQ

SEQ ID NO: 2982639 - protein, 23 aa, Entamoeba invadens
KSFLEKYPKIMFFKTSLQNPDEM

SEQ ID NO: 2982640 - protein, 21 aa, Entamoeba invadens
KSGDISFRISIEVDNSARIKV

SEQ ID NO: 2982641 - protein, 17 aa, Entamoeba invadens
KSGEAVIHLSCYGLKER

SEQ ID NO: 2982642 - protein, 23 aa, Entamoeba invadens
KSGRGRMNIMLSGGMTIINFGLS

SEQ ID NO: 2982643 - protein, 17 aa, Entamoeba invadens
KSGRTGLHYAVLGGHLD

SEQ ID NO: 2982644 - protein, 21 aa, Entamoeba invadens
KSGVEILCLLFALKLKYPDNI

SEQ ID NO: 2982645 - protein, 18 aa, Entamoeba invadens
KSGVFWCCNSFVMFDNFG

SEQ ID NO: 2982646 - protein, 20 aa, Entamoeba invadens
KSGVPFCFSEISTGAVEPVN

SEQ ID NO: 2982647 - protein, 21 aa, Entamoeba invadens
KSHECLFGFGGGHAIGVFKKG

SEQ ID NO: 2982648 - protein, 21 aa, Entamoeba invadens
KSIDLLKCYGLRLECRKGVVT

SEQ ID NO: 2982649 - protein, 17 aa, Entamoeba invadens
KSIKFARPADCLPKVAD

SEQ ID NO: 2982650 - protein, 17 aa, Entamoeba invadens
KSIPCKESKTFVTDQDN

SEQ ID NO: 2982651 - protein, 23 aa, Entamoeba invadens
KSKESNFFCCICADGQTLPLYHV

SEQ ID NO: 2982652 - protein, 17 aa, Entamoeba invadens
KSKGEVFTMVFIGVNGV

SEQ ID NO: 2982653 - protein, 19 aa, Entamoeba invadens
KSKITLPFFTVIKIESDEE

SEQ ID NO: 2982654 - protein, 23 aa, Entamoeba invadens
KSKKTECPFRINLNFQTKTGRWN

SEQ ID NO: 2982655 - protein, 21 aa, Entamoeba invadens
KSKPQRYGIKFWKEENQGFRV

SEQ ID NO: 2982656 - protein, 18 aa, Entamoeba invadens
KSLCSVGIQTFCRCGLVT

SEQ ID NO: 2982657 - protein, 21 aa, Entamoeba invadens
KSLEGLCIKGGLRGDMFKCDQ

SEQ ID NO: 2982658 - protein, 17 aa, Entamoeba invadens
KSLIPGCLAVRGNFVGD

SEQ ID NO: 2982659 - protein, 20 aa, Entamoeba invadens
KSLPLCLSRGEIFLKTQNKD

SEQ ID NO: 2982660 - protein, 28 aa, Entamoeba invadens
KSLSTFGFLCFKERLALLNDEKFYLEIL

SEQ ID NO: 2982661 - protein, 18 aa, Entamoeba invadens
KSLWVFRMRVLRRLLAKY

SEQ ID NO: 2982662 - protein, 17 aa, Entamoeba invadens
KSLYPSIIMEFAVCFTN

SEQ ID NO: 2982663 - protein, 25 aa, Entamoeba invadens
KSMIFPFEWCNICIDLIPYSLLDYL

SEQ ID NO: 2982664 - protein, 24 aa, Entamoeba invadens
KSMMFDPRLQAIVLNIVDVSYGGL

SEQ ID NO: 2982665 - protein, 18 aa, Entamoeba invadens
KSMMRWSYIKLVDLVPSP

SEQ ID NO: 2982666 - protein, 18 aa, Entamoeba invadens
KSMRRPTRKGGRKPPTKE

SEQ ID NO: 2982667 - protein, 24 aa, Entamoeba invadens
KSNCAAMFLPFVVQFLEKFDDFVS

SEQ ID NO: 2982668 - protein, 20 aa, Entamoeba invadens
KSNDSFPCFYNVQKYFSNRN

SEQ ID NO: 2982669 - protein, 18 aa, Entamoeba invadens
KSNSRIVVCVDRVVVIKK

SEQ ID NO: 2982670 - protein, 21 aa, Entamoeba invadens
KSPKAECPFFHLSQLLLDPHE

SEQ ID NO: 2982671 - protein, 24 aa, Entamoeba invadens
KSPRGINAWYVWKILPNINGNDKC

SEQ ID NO: 2982672 - protein, 19 aa, Entamoeba invadens
KSRGFAIIEFAAKVSVLKA

SEQ ID NO: 2982673 - protein, 21 aa, Entamoeba invadens
KSRKSVTITICFNTVATVGLT

SEQ ID NO: 2982674 - protein, 22 aa, Entamoeba invadens
KSRPCLPGDLLMKSGEDAVNEM

SEQ ID NO: 2982675 - protein, 17 aa, Entamoeba invadens
KSSCEAFKYRVLLDVSR

SEQ ID NO: 2982676 - protein, 24 aa, Entamoeba invadens
KSSEFYKKMFVKFVMCIKKEIEDT

SEQ ID NO: 2982677 - protein, 22 aa, Entamoeba invadens
KSSFYKVCFVSAAFVDQGKVFR

SEQ ID NO: 2982678 - protein, 23 aa, Entamoeba invadens
KSSITIRFCYNRFSGSYDPTLED

SEQ ID NO: 2982679 - protein, 19 aa, Entamoeba invadens
KSSSWSLKCEVCINDDKEE

SEQ ID NO: 2982680 - protein, 23 aa, Entamoeba invadens
KSSWRFPIPLFRSIQYLIENDAQ

SEQ ID NO: 2982681 - protein, 20 aa, Entamoeba invadens
KSTFALRFCHQVFVKINEPS

SEQ ID NO: 2982682 - protein, 18 aa, Entamoeba invadens
KSVEELRKTFGIVNDFTK

SEQ ID NO: 2982683 - protein, 20 aa, Entamoeba invadens
KSVFWKLYYKSTVYNNEHVL

SEQ ID NO: 2982684 - protein, 18 aa, Entamoeba invadens
KSVGRFCFYNSVGKENVI

SEQ ID NO: 2982685 - protein, 23 aa, Entamoeba invadens
KSWKFRITKEFVFNLDVELVNVQ

SEQ ID NO: 2982686 - protein, 18 aa, Entamoeba invadens
KSWYKRIGINATLSSLTQ

SEQ ID NO: 2982687 - protein, 19 aa, Entamoeba invadens
KSYAFSCCLHLKCVKNMNQ

SEQ ID NO: 2982688 - protein, 21 aa, Entamoeba invadens
KTAECKIIYVTRPFRCRRQFS

SEQ ID NO: 2982689 - protein, 17 aa, Entamoeba invadens
KTAECKIVYVTRLLVIN

SEQ ID NO: 2982690 - protein, 21 aa, Entamoeba invadens
KTAELMTGALLEAKRIEIAPT

SEQ ID NO: 2982691 - protein, 23 aa, Entamoeba invadens
KTCFKCSVCKKVLSGSNFAKNHG

SEQ ID NO: 2982692 - protein, 25 aa, Entamoeba invadens
KTDLYATVMSIEFLENLFVKSLIDY

SEQ ID NO: 2982693 - protein, 18 aa, Entamoeba invadens
KTDVWSAGVLMFVMSTKE

SEQ ID NO: 2982694 - protein, 20 aa, Entamoeba invadens
KTECPFRINLNYRANSNTWN

SEQ ID NO: 2982695 - protein, 18 aa, Entamoeba invadens
KTFCRVCLSNYQNRLVGI

SEQ ID NO: 2982696 - protein, 19 aa, Entamoeba invadens
KTGSALFCYVNEKLGIVYI

SEQ ID NO: 2982697 - protein, 19 aa, Entamoeba invadens
KTHRGLRKVACVGAWHPAR

SEQ ID NO: 2982698 - protein, 17 aa, Entamoeba invadens
KTIKAYAFYNCKSLVTL

SEQ ID NO: 2982699 - protein, 19 aa, Entamoeba invadens
KTILCFIRFGDLVERYDVT

SEQ ID NO: 2982700 - protein, 18 aa, Entamoeba invadens
KTKCFICGLEGHLEGDCP

SEQ ID NO: 2982701 - protein, 18 aa, Entamoeba invadens
KTKGAMVDLCHLIESLNL

SEQ ID NO: 2982702 - protein, 23 aa, Entamoeba invadens
KTKGFCFSLFLSFVMEQANVQQQ

SEQ ID NO: 2982703 - protein, 18 aa, Entamoeba invadens
KTKLLIVLEEGRFNVKDD

SEQ ID NO: 2982704 - protein, 26 aa, Entamoeba invadens
KTKLPPLFCRYKLLPFYLDLFRSNMP

SEQ ID NO: 2982705 - protein, 19 aa, Entamoeba invadens
KTLALHIFNTFCLIFQNSQ

SEQ ID NO: 2982706 - protein, 19 aa, Entamoeba invadens
KTLDRLAGVPLRDQLDELP

SEQ ID NO: 2982707 - protein, 22 aa, Entamoeba invadens
KTLPLHKLRESIGMVGQEPVLF

SEQ ID NO: 2982708 - protein, 17 aa, Entamoeba invadens
KTLRPVHRLDRMTSGIL

SEQ ID NO: 2982709 - protein, 18 aa, Entamoeba invadens
KTLRRLLASKSRWNVRVT

SEQ ID NO: 2982710 - protein, 17 aa, Entamoeba invadens
KTLSVAFQWFVGDSGDN

SEQ ID NO: 2982711 - protein, 17 aa, Entamoeba invadens
KTLSWAFWSMKTGKYRD

SEQ ID NO: 2982712 - protein, 17 aa, Entamoeba invadens
KTMKFPIVSSVLRVIEQ

SEQ ID NO: 2982713 - protein, 24 aa, Entamoeba invadens
KTNPICINSFFKPLKIRSVVAMNW

SEQ ID NO: 2982714 - protein, 18 aa, Entamoeba invadens
KTPLGLKMLNFFQEYTNL

SEQ ID NO: 2982715 - protein, 19 aa, Entamoeba invadens
KTPRYLFRRVYKFIPINQR

SEQ ID NO: 2982716 - protein, 20 aa, Entamoeba invadens
KTPVLEVGYFYSLTFEEMCS

SEQ ID NO: 2982717 - protein, 19 aa, Entamoeba invadens
KTQIKLRFCQGIFVENYNP

SEQ ID NO: 2982718 - protein, 19 aa, Entamoeba invadens
KTRCVLQFYIPSFRKLGFG

SEQ ID NO: 2982719 - protein, 25 aa, Entamoeba invadens
KTSEVFVIHLKRFLEANGNLTEKVT

SEQ ID NO: 2982720 - protein, 17 aa, Entamoeba invadens
KTSLIKRYVQGIEVKEY

SEQ ID NO: 2982721 - protein, 18 aa, Entamoeba invadens
KTVCKMGIELLWVHPFFK

SEQ ID NO: 2982722 - protein, 19 aa, Entamoeba invadens
KTVSCGFIFVTYYDIRASR

SEQ ID NO: 2982723 - protein, 21 aa, Entamoeba invadens
KTYKIGVLYGRQGQQSEDEMY

SEQ ID NO: 2982724 - protein, 19 aa, Entamoeba invadens
KTYRWNIRVLYDMIDIAAL

SEQ ID NO: 2982725 - protein, 17 aa, Entamoeba invadens
KVAFTLNDVDVWKIEHP

SEQ ID NO: 2982726 - protein, 17 aa, Entamoeba invadens
KVCKFMNRQEKFMTNQM

SEQ ID NO: 2982727 - protein, 21 aa, Entamoeba invadens
KVCLCSVCGGEMCLSLLQNKY

SEQ ID NO: 2982728 - protein, 20 aa, Entamoeba invadens
KVEILDWKRLVVVLENAPIR

SEQ ID NO: 2982729 - protein, 17 aa, Entamoeba invadens
KVELLRCDNLNFKMLSN

SEQ ID NO: 2982730 - protein, 20 aa, Entamoeba invadens
KVELTNMKFIFTTFKTIIAE

SEQ ID NO: 2982731 - protein, 17 aa, Entamoeba invadens
KVELTNMNFIFTTFKTI

SEQ ID NO: 2982732 - protein, 18 aa, Entamoeba invadens
KVEYSFCYKWIVLLFKRD

SEQ ID NO: 2982733 - protein, 18 aa, Entamoeba invadens
KVFGCYCADIVPLPQYIN

SEQ ID NO: 2982734 - protein, 19 aa, Entamoeba invadens
KVFLLRDFFSLILKTASSE

SEQ ID NO: 2982735 - protein, 27 aa, Entamoeba invadens
KVFVCTVCNIYIHKKCIDKFRKDPTSC

SEQ ID NO: 2982736 - protein, 20 aa, Entamoeba invadens
KVGDFCFYKSLGVKNIKFED

SEQ ID NO: 2982737 - protein, 23 aa, Entamoeba invadens
KVGPKRAIQIIKMFDTPEQFAKV

SEQ ID NO: 2982738 - protein, 19 aa, Entamoeba invadens
KVHFVCRVGVVYLTHFDSF

SEQ ID NO: 2982739 - protein, 17 aa, Entamoeba invadens
KVICFSTKVLKRMKEVS

SEQ ID NO: 2982740 - protein, 17 aa, Entamoeba invadens
KVICPQITFSLRDLQNG

SEQ ID NO: 2982741 - protein, 18 aa, Entamoeba invadens
KVIDRMSNGIWKGQIQDQ

SEQ ID NO: 2982742 - protein, 20 aa, Entamoeba invadens
KVIFNRLTIAPAFRITGSLL

SEQ ID NO: 2982743 - protein, 18 aa, Entamoeba invadens
KVIGCKMTMYLLEKSRIV

SEQ ID NO: 2982744 - protein, 17 aa, Entamoeba invadens
KVIGDFCFRGCEKLLSL

SEQ ID NO: 2982745 - protein, 17 aa, Entamoeba invadens
KVILKKEGREIATLISC

SEQ ID NO: 2982746 - protein, 19 aa, Entamoeba invadens
KVILRFKGINIPGGKGLGK

SEQ ID NO: 2982747 - protein, 17 aa, Entamoeba invadens
KVINCGSLVPDIVHYTI

SEQ ID NO: 2982748 - protein, 17 aa, Entamoeba invadens
KVIRLSTFYKRGLKKMM

SEQ ID NO: 2982749 - protein, 17 aa, Entamoeba invadens
KVKACGIHGGMRQDERT

SEQ ID NO: 2982750 - protein, 20 aa, Entamoeba invadens
KVKVKALEFFLRLDEKQEEL

SEQ ID NO: 2982751 - protein, 18 aa, Entamoeba invadens
KVLFEMFTFVFNDYKTSE

SEQ ID NO: 2982752 - protein, 19 aa, Entamoeba invadens
KVLLDKYWGGYSVLSPREF

SEQ ID NO: 2982753 - protein, 21 aa, Entamoeba invadens
KVLLEGHLLRYGTSDKIYCHV

SEQ ID NO: 2982754 - protein, 18 aa, Entamoeba invadens
KVLLIRRGCDLFESLFVV

SEQ ID NO: 2982755 - protein, 23 aa, Entamoeba invadens
KVLNKWCFRNCKALKEITLPKTL

SEQ ID NO: 2982756 - protein, 19 aa, Entamoeba invadens
KVLYFDVAIQFSKTYQYRI

SEQ ID NO: 2982757 - protein, 17 aa, Entamoeba invadens
KVMKEIKKFSARVEPEL

SEQ ID NO: 2982758 - protein, 22 aa, Entamoeba invadens
KVMYLVRWEKFSYLEATWILEK

SEQ ID NO: 2982759 - protein, 25 aa, Entamoeba invadens
KVNPNVCLFIKFDVFIPYSKCTSRA

SEQ ID NO: 2982760 - protein, 18 aa, Entamoeba invadens
KVNYVGKCAFFFCSNLEE

SEQ ID NO: 2982761 - protein, 20 aa, Entamoeba invadens
KVPIGGFGMPCMLIAEELNK

SEQ ID NO: 2982762 - protein, 19 aa, Entamoeba invadens
KVPIYFMMKKVESIEPRQS

SEQ ID NO: 2982763 - protein, 21 aa, Entamoeba invadens
KVPLCNPLSFFSLRKLKEAEV

SEQ ID NO: 2982764 - protein, 20 aa, Entamoeba invadens
KVQFCCAVSYLAQCRTIYQL

SEQ ID NO: 2982765 - protein, 17 aa, Entamoeba invadens
KVRKLRILWNEIDTVAK

SEQ ID NO: 2982766 - protein, 21 aa, Entamoeba invadens
KVSFLICCGDFQSLRTEADFD

SEQ ID NO: 2982767 - protein, 23 aa, Entamoeba invadens
KVSIELYKRFNIWTIFKESDLRV

SEQ ID NO: 2982768 - protein, 19 aa, Entamoeba invadens
KVSPFRGCHHVKIMVMLYE

SEQ ID NO: 2982769 - protein, 20 aa, Entamoeba invadens
KVTYILSEKVKYVYRAVEDV

SEQ ID NO: 2982770 - protein, 18 aa, Entamoeba invadens
KVVHSSHCQFFFENSHLK

SEQ ID NO: 2982771 - protein, 24 aa, Entamoeba invadens
KVVLKKCKNCFVLSKQRENVEQTE

SEQ ID NO: 2982772 - protein, 23 aa, Entamoeba invadens
KVWIKRLNVIISVLRDMRLIERN

SEQ ID NO: 2982773 - protein, 25 aa, Entamoeba invadens
KVYELRLLQTLKLEYLIDGSIELSQ

SEQ ID NO: 2982774 - protein, 20 aa, Entamoeba invadens
KWGQSCIILPNFLILPVQRL

SEQ ID NO: 2982775 - protein, 17 aa, Entamoeba invadens
KWKDMFKDFDLIQTLWK

SEQ ID NO: 2982776 - protein, 18 aa, Entamoeba invadens
KWPDFIYTSGVPKVISAL

SEQ ID NO: 2982777 - protein, 25 aa, Entamoeba invadens
KWQLPNNCDFCFSLRSLFSKSPTLL

SEQ ID NO: 2982778 - protein, 19 aa, Entamoeba invadens
KWSSCKLDKVLFDTSVDSA

SEQ ID NO: 2982779 - protein, 24 aa, Entamoeba invadens
KYASVFGFKCIFILVRQTVQKSHK

SEQ ID NO: 2982780 - protein, 19 aa, Entamoeba invadens
KYCLVKWGGGLSYTEATWE

SEQ ID NO: 2982781 - protein, 20 aa, Entamoeba invadens
KYDCWSSLVLPKEEWTEHAE

SEQ ID NO: 2982782 - protein, 21 aa, Entamoeba invadens
KYEDGYFYWVYKNYVVFKTLN

SEQ ID NO: 2982783 - protein, 22 aa, Entamoeba invadens
KYFPNNECDLIFLNDHKYMMVV

SEQ ID NO: 2982784 - protein, 19 aa, Entamoeba invadens
KYGTVFLLKCCSDCANALL

SEQ ID NO: 2982785 - protein, 18 aa, Entamoeba invadens
KYIFELSEGFSIHENGEV

SEQ ID NO: 2982786 - protein, 21 aa, Entamoeba invadens
KYIPCCAFLRCYRLNEIKVPQ

SEQ ID NO: 2982787 - protein, 20 aa, Entamoeba invadens
KYIRDIICGIKFLHEQGIVH

SEQ ID NO: 2982788 - protein, 17 aa, Entamoeba invadens
KYITWHITCAAVINKMD

SEQ ID NO: 2982789 - protein, 18 aa, Entamoeba invadens
KYKDSSIVKLCMEYHTHT

SEQ ID NO: 2982790 - protein, 18 aa, Entamoeba invadens
KYKRVVCIESVWDKANAV

SEQ ID NO: 2982791 - protein, 18 aa, Entamoeba invadens
KYLAAALNEEVEAANEKL

SEQ ID NO: 2982792 - protein, 23 aa, Entamoeba invadens
KYLEKRLKAISARYGGKVDDLNN

SEQ ID NO: 2982793 - protein, 26 aa, Entamoeba invadens
KYLELRFVFIIKFPFFDGALKIAKKV

SEQ ID NO: 2982794 - protein, 18 aa, Entamoeba invadens
KYLKCVLQHFLAMLNEIQ

SEQ ID NO: 2982795 - protein, 18 aa, Entamoeba invadens
KYMHAESFVIAKNNITRK

SEQ ID NO: 2982796 - protein, 21 aa, Entamoeba invadens
KYPAFQPMALFPLNMVLSTNR

SEQ ID NO: 2982797 - protein, 19 aa, Entamoeba invadens
KYPKGICKFAVTFEITANG

SEQ ID NO: 2982798 - protein, 19 aa, Entamoeba invadens
KYQKYRMAFILALHDKAGV

SEQ ID NO: 2982799 - protein, 22 aa, Entamoeba invadens
KYQLKSSIMAYCITHESYCSDL

SEQ ID NO: 2982800 - protein, 18 aa, Entamoeba invadens
KYRDCVFKKPLIEKCDEA

SEQ ID NO: 2982801 - protein, 18 aa, Entamoeba invadens
KYRIKKRIEWCQNKSTAL

SEQ ID NO: 2982802 - protein, 18 aa, Entamoeba invadens
KYSICLISFYCWEVFFRK

SEQ ID NO: 2982803 - protein, 20 aa, Entamoeba invadens
KYTAEVFLEYQLRESRFKSI

SEQ ID NO: 2982804 - protein, 24 aa, Entamoeba invadens
KYTGIPVFWGRIVKALPFFQPTAE

SEQ ID NO: 2982805 - protein, 23 aa, Entamoeba invadens
KYTKLCQYLDAFTFAYGSITTAH

SEQ ID NO: 2982806 - protein, 17 aa, Entamoeba invadens
LAFLSIFFYYLANFSEL

SEQ ID NO: 2982807 - protein, 19 aa, Entamoeba invadens
LAGKWPFWLSPRQIMVATV

SEQ ID NO: 2982808 - protein, 17 aa, Entamoeba invadens
LAGSNGFDYCDSTTTPT

SEQ ID NO: 2982809 - protein, 17 aa, Entamoeba invadens
LAHIYCMMAIFATSMAV

SEQ ID NO: 2982810 - protein, 17 aa, Entamoeba invadens
LAICPHIPIEDVAEFVL

SEQ ID NO: 2982811 - protein, 20 aa, Entamoeba invadens
LAIDMIKFLLGKAENQFTHP

SEQ ID NO: 2982812 - protein, 20 aa, Entamoeba invadens
LALKFWKLDFGKEWCDKNMT

SEQ ID NO: 2982813 - protein, 18 aa, Entamoeba invadens
LALYKRGLCAASNPNTTV

SEQ ID NO: 2982814 - protein, 17 aa, Entamoeba invadens
LANKHFVCHSVDYLINN

SEQ ID NO: 2982815 - protein, 20 aa, Entamoeba invadens
LANKHHLCWTDKRGVHEPNY

SEQ ID NO: 2982816 - protein, 21 aa, Entamoeba invadens
LANKHHLCWTDKRGVHEPNYY

SEQ ID NO: 2982817 - protein, 19 aa, Entamoeba invadens
LANPKWKATFVQLLATLPA

SEQ ID NO: 2982818 - protein, 17 aa, Entamoeba invadens
LAPFYIEDMHAFVVKKD

SEQ ID NO: 2982819 - protein, 19 aa, Entamoeba invadens
LARLRLEKIGFVFQTYNLL

SEQ ID NO: 2982820 - protein, 24 aa, Entamoeba invadens
LARPARLPFLSLLLDLPPDVNDGT

SEQ ID NO: 2982821 - protein, 22 aa, Entamoeba invadens
LARSETWQWLGRREAEDRIAKD

SEQ ID NO: 2982822 - protein, 18 aa, Entamoeba invadens
LASCVIMANYNMKRGSAF

SEQ ID NO: 2982823 - protein, 19 aa, Entamoeba invadens
LASEQCIDCIATLAKVQDQ

SEQ ID NO: 2982824 - protein, 17 aa, Entamoeba invadens
LASFAYRLMLLQKYPYP

SEQ ID NO: 2982825 - protein, 19 aa, Entamoeba invadens
LASLIKFVLGWIRDIPQSL

SEQ ID NO: 2982826 - protein, 19 aa, Entamoeba invadens
LATALAVAVLRKFFFERIV

SEQ ID NO: 2982827 - protein, 19 aa, Entamoeba invadens
LATMEFVKFLKGLVSNSQF

SEQ ID NO: 2982828 - protein, 17 aa, Entamoeba invadens
LAVCGPVFEHLRLTHVY

SEQ ID NO: 2982829 - protein, 23 aa, Entamoeba invadens
LAYCKACGKLEWVTRQAKKKVEL

SEQ ID NO: 2982830 - protein, 26 aa, Entamoeba invadens
LCAIKGESAGECWKATKKEVPKIDAD

SEQ ID NO: 2982831 - protein, 24 aa, Entamoeba invadens
LCDKFGHICLLYFIRHVDDKALLK

SEQ ID NO: 2982832 - protein, 21 aa, Entamoeba invadens
LCECQRNALPQVYQLLFEHIE

SEQ ID NO: 2982833 - protein, 17 aa, Entamoeba invadens
LCEVSRKSYADYIFEIQ

SEQ ID NO: 2982834 - protein, 17 aa, Entamoeba invadens
LCFHHFYKLNKIVFSSN

SEQ ID NO: 2982835 - protein, 18 aa, Entamoeba invadens
LCFYKGRMCAKVFIKSKP

SEQ ID NO: 2982836 - protein, 19 aa, Entamoeba invadens
LCGIKCSRILLDGDGLVQN

SEQ ID NO: 2982837 - protein, 22 aa, Entamoeba invadens
LCGSRGDYLFAFGGQKCDIAVY

SEQ ID NO: 2982838 - protein, 19 aa, Entamoeba invadens
LCIGCDYYAFAHIDGNITV

SEQ ID NO: 2982839 - protein, 17 aa, Entamoeba invadens
LCIQLQIVETLPMEDLL

SEQ ID NO: 2982840 - protein, 17 aa, Entamoeba invadens
LCISLSVINIPDGVNTI

SEQ ID NO: 2982841 - protein, 17 aa, Entamoeba invadens
LCLRPARHFSGIPTPLK

SEQ ID NO: 2982842 - protein, 22 aa, Entamoeba invadens
LCMGNLRLAHYLAQYGSTMLGT

SEQ ID NO: 2982843 - protein, 21 aa, Entamoeba invadens
LCPECLDALLPLVLKSDGVTI

SEQ ID NO: 2982844 - protein, 28 aa, Entamoeba invadens
LCPEIVWTPSMKRLFCLIVECFKNKEPA

SEQ ID NO: 2982845 - protein, 17 aa, Entamoeba invadens
LCRCSKEAVLDIFHNIQ

SEQ ID NO: 2982846 - protein, 18 aa, Entamoeba invadens
LCSGPLFIVEKVMEPPKK

SEQ ID NO: 2982847 - protein, 17 aa, Entamoeba invadens
LCTPRFLGITKQLSDSL

SEQ ID NO: 2982848 - protein, 21 aa, Entamoeba invadens
LCVLLSLSLGNFFLCHGGISP

SEQ ID NO: 2982849 - protein, 18 aa, Entamoeba invadens
LCVPGCPFQPQAILPQLI

SEQ ID NO: 2982850 - protein, 21 aa, Entamoeba invadens
LCVSEAGWVFGCFTTTAVSNN

SEQ ID NO: 2982851 - protein, 19 aa, Entamoeba invadens
LCVWLRLLGYDAKGSKDYE

SEQ ID NO: 2982852 - protein, 17 aa, Entamoeba invadens
LDAIKMVRRTPPIKYNQ

SEQ ID NO: 2982853 - protein, 17 aa, Entamoeba invadens
LDCGHSFCDSCFAIWCK

SEQ ID NO: 2982854 - protein, 19 aa, Entamoeba invadens
LDCLCPLKYSHFSRAPAEY

SEQ ID NO: 2982855 - protein, 18 aa, Entamoeba invadens
LDCLKRFAHLTLIQNIKF

SEQ ID NO: 2982856 - protein, 19 aa, Entamoeba invadens
LDCYSEMYMWVGGRLAKDR

SEQ ID NO: 2982857 - protein, 21 aa, Entamoeba invadens
LDDRFLAILVHFYTEMTSVFK

SEQ ID NO: 2982858 - protein, 17 aa, Entamoeba invadens
LDEEYTRELKIKRVEEV

SEQ ID NO: 2982859 - protein, 23 aa, Entamoeba invadens
LDELKHYLCFIFLDEFTVWAPKS

SEQ ID NO: 2982860 - protein, 17 aa, Entamoeba invadens
LDEVEAFLAKKSEEGET

SEQ ID NO: 2982861 - protein, 17 aa, Entamoeba invadens
LDIFKVLGKKECERPTH

SEQ ID NO: 2982862 - protein, 17 aa, Entamoeba invadens
LDILNLISLTFASKTNV

SEQ ID NO: 2982863 - protein, 19 aa, Entamoeba invadens
LDINEMFYHRYSKYYYIDW

SEQ ID NO: 2982864 - protein, 18 aa, Entamoeba invadens
LDINVCNTFTYKSSKITT

SEQ ID NO: 2982865 - protein, 19 aa, Entamoeba invadens
LDINVCNTFTYKSSKITTV

SEQ ID NO: 2982866 - protein, 25 aa, Entamoeba invadens
LDIPESVRANAFWNICRLDNYHIVS

SEQ ID NO: 2982867 - protein, 19 aa, Entamoeba invadens
LDIPQRLLAAIVCKNSVLD

SEQ ID NO: 2982868 - protein, 17 aa, Entamoeba invadens
LDLPKLCGLAKNYYSVK

SEQ ID NO: 2982869 - protein, 18 aa, Entamoeba invadens
LDLSHVISFGSQYNMTRL

SEQ ID NO: 2982870 - protein, 18 aa, Entamoeba invadens
LDLSHVISFGTQHFMTCL

SEQ ID NO: 2982871 - protein, 19 aa, Entamoeba invadens
LDLSHVISFGTQRFMTCLT

SEQ ID NO: 2982872 - protein, 20 aa, Entamoeba invadens
LDLVCFKKSFGVEETYKVCE

SEQ ID NO: 2982873 - protein, 19 aa, Entamoeba invadens
LDMFLELFLNPTVQSSVFR

SEQ ID NO: 2982874 - protein, 24 aa, Entamoeba invadens
LDPFLPIFLELFFDVSFVVFNDKT

SEQ ID NO: 2982875 - protein, 18 aa, Entamoeba invadens
LDPIVFLKKCVTILSSKQ

SEQ ID NO: 2982876 - protein, 23 aa, Entamoeba invadens
LDQFRLSFIYRLYADGISKDHIN

SEQ ID NO: 2982877 - protein, 20 aa, Entamoeba invadens
LDRIKLLYDRAFHINEESTQ

SEQ ID NO: 2982878 - protein, 20 aa, Entamoeba invadens
LDTATLWSILKGRRNIMIVI

SEQ ID NO: 2982879 - protein, 24 aa, Entamoeba invadens
LDTLLPRLLVCWFGFDALKDTYIR

SEQ ID NO: 2982880 - protein, 25 aa, Entamoeba invadens
LDTNVLCLLKLFLLEKRVLVVASRE

SEQ ID NO: 2982881 - protein, 24 aa, Entamoeba invadens
LDTPRLYLKWIEKISEEHSVRQHY

SEQ ID NO: 2982882 - protein, 24 aa, Entamoeba invadens
LDVLKEWMECYPLDFLNIKSGEQS

SEQ ID NO: 2982883 - protein, 18 aa, Entamoeba invadens
LDVLSGKSTVVFGYQSKI

SEQ ID NO: 2982884 - protein, 23 aa, Entamoeba invadens
LDYKVFCILTYKLGQVTILKNSL

SEQ ID NO: 2982885 - protein, 17 aa, Entamoeba invadens
LECGICIESGDGITQFS

SEQ ID NO: 2982886 - protein, 21 aa, Entamoeba invadens
LECRRGVIYLTFFDALYSKEI

SEQ ID NO: 2982887 - protein, 18 aa, Entamoeba invadens
LECTRLGLKTVWLGGTFT

SEQ ID NO: 2982888 - protein, 22 aa, Entamoeba invadens
LEDAVEEWKNEMSADMKTFSEI

SEQ ID NO: 2982889 - protein, 17 aa, Entamoeba invadens
LEDCLRRDFTINGLFYR

SEQ ID NO: 2982890 - protein, 18 aa, Entamoeba invadens
LEDFCMRVPFRVGARDES

SEQ ID NO: 2982891 - protein, 17 aa, Entamoeba invadens
LEDLCKIGEVWLIDNGF

SEQ ID NO: 2982892 - protein, 24 aa, Entamoeba invadens
LEDSIQFAAAVGMKSDETAFFEII

SEQ ID NO: 2982893 - protein, 18 aa, Entamoeba invadens
LEECCLSVFQRCEETINK

SEQ ID NO: 2982894 - protein, 25 aa, Entamoeba invadens
LEEFVRSGVEWAVLCEKYPRGLINV

SEQ ID NO: 2982895 - protein, 20 aa, Entamoeba invadens
LEEIGAFCFCNCVSLQTIEI

SEQ ID NO: 2982896 - protein, 18 aa, Entamoeba invadens
LEELCWKFRTTVEQYIIK

SEQ ID NO: 2982897 - protein, 22 aa, Entamoeba invadens
LEERLKEIVLWATGSAKDAQKM

SEQ ID NO: 2982898 - protein, 21 aa, Entamoeba invadens
LEEVHPLFCYSVRDVARHITV

SEQ ID NO: 2982899 - protein, 22 aa, Entamoeba invadens
LEEVKQFLKWVDNFPSLQYVCF

SEQ ID NO: 2982900 - protein, 19 aa, Entamoeba invadens
LEEWTGLKFQKVLFDSEVD

SEQ ID NO: 2982901 - protein, 22 aa, Entamoeba invadens
LEEYRIQLILNHILFAGIDGQF

SEQ ID NO: 2982902 - protein, 20 aa, Entamoeba invadens
LEFPKLPSLLTELGSFAFLN

SEQ ID NO: 2982903 - protein, 17 aa, Entamoeba invadens
LEFRRFVVQCADIPFER

SEQ ID NO: 2982904 - protein, 18 aa, Entamoeba invadens
LEFVRLAVLLKEYTLALK

SEQ ID NO: 2982905 - protein, 18 aa, Entamoeba invadens
LEGFLSLIEFEWIMLGHR

SEQ ID NO: 2982906 - protein, 17 aa, Entamoeba invadens
LEHCVRILQDLVIAIKD

SEQ ID NO: 2982907 - protein, 22 aa, Entamoeba invadens
LEHIDCPYLFPYRNWKYTPPEV

SEQ ID NO: 2982908 - protein, 20 aa, Entamoeba invadens
LEHRNSISFSQQFKSRVDLK

SEQ ID NO: 2982909 - protein, 19 aa, Entamoeba invadens
LEHRVVIRLRKVEIKEEST

SEQ ID NO: 2982910 - protein, 21 aa, Entamoeba invadens
LEHTMRLAGFYVMKQTTEESL

SEQ ID NO: 2982911 - protein, 18 aa, Entamoeba invadens
LEHWERYKGGLDVKKNCT

SEQ ID NO: 2982912 - protein, 19 aa, Entamoeba invadens
LEIFHFYSLKSFILQFKSS

SEQ ID NO: 2982913 - protein, 17 aa, Entamoeba invadens
LEIFKLYLPALHVSDCQ

SEQ ID NO: 2982914 - protein, 23 aa, Entamoeba invadens
LEILGHIKCEFEVAMTKIKHMDC

SEQ ID NO: 2982915 - protein, 18 aa, Entamoeba invadens
LEIPRFVLGPNLKELEIR

SEQ ID NO: 2982916 - protein, 17 aa, Entamoeba invadens
LEIWDYVALTKIRSYEI

SEQ ID NO: 2982917 - protein, 22 aa, Entamoeba invadens
LEKFLPHLIEYMVRIYKEAQVN

SEQ ID NO: 2982918 - protein, 20 aa, Entamoeba invadens
LEKGELVAGCIKKVIFERQS

SEQ ID NO: 2982919 - protein, 20 aa, Entamoeba invadens
LEKNCCVIASGFLRDEETTE

SEQ ID NO: 2982920 - protein, 17 aa, Entamoeba invadens
LEKRFETCHSRRVDMDR

SEQ ID NO: 2982921 - protein, 27 aa, Entamoeba invadens
LEKRVCLICGKILCPGCSVDHFQKCSM

SEQ ID NO: 2982922 - protein, 19 aa, Entamoeba invadens
LELFKDLYLSKALEVIPDD

SEQ ID NO: 2982923 - protein, 19 aa, Entamoeba invadens
LELFLFKICDLLVLKARTI

SEQ ID NO: 2982924 - protein, 17 aa, Entamoeba invadens
LELFPVLSCLLDTIHSV

SEQ ID NO: 2982925 - protein, 17 aa, Entamoeba invadens
LELGESMAIIIQPQSVD

SEQ ID NO: 2982926 - protein, 21 aa, Entamoeba invadens
LELKAACGAILYASPYFPDHT

SEQ ID NO: 2982927 - protein, 18 aa, Entamoeba invadens
LELKKIYNVLGLRHKVLK

SEQ ID NO: 2982928 - protein, 20 aa, Entamoeba invadens
LELKTVLSFFAFQLPVVGQI

SEQ ID NO: 2982929 - protein, 21 aa, Entamoeba invadens
LELLGRWNARGALICVTEYGA

SEQ ID NO: 2982930 - protein, 17 aa, Entamoeba invadens
LELLRVSCCNLRKIPED

SEQ ID NO: 2982931 - protein, 18 aa, Entamoeba invadens
LEMLWEMNSNFTLEPNDQ

SEQ ID NO: 2982932 - protein, 22 aa, Entamoeba invadens
LEPLKTYVFRQVQLREFRTRNM

SEQ ID NO: 2982933 - protein, 17 aa, Entamoeba invadens
LEPSLLCVKLFAESLFS

SEQ ID NO: 2982934 - protein, 19 aa, Entamoeba invadens
LEPTAAFYFYGIRNHGFNI

SEQ ID NO: 2982935 - protein, 25 aa, Entamoeba invadens
LEQALKFIVADGIKLVNIDAQNIFE

SEQ ID NO: 2982936 - protein, 23 aa, Entamoeba invadens
LEQKLRGAIPFDPKVFAKNLWGD

SEQ ID NO: 2982937 - protein, 26 aa, Entamoeba invadens
LEQLEWKWGICMAIGLSEFIDIRLNK

SEQ ID NO: 2982938 - protein, 20 aa, Entamoeba invadens
LERITSIFLNNTWIMDKEQI

SEQ ID NO: 2982939 - protein, 20 aa, Entamoeba invadens
LERYKKYSFCLGFVIVEAEE

SEQ ID NO: 2982940 - protein, 18 aa, Entamoeba invadens
LESFSFQFCDSITSIQFT

SEQ ID NO: 2982941 - protein, 20 aa, Entamoeba invadens
LESSTKCFISFVLESQKFER

SEQ ID NO: 2982942 - protein, 24 aa, Entamoeba invadens
LETESFKLGPFLDESLKMKEESFD

SEQ ID NO: 2982943 - protein, 23 aa, Entamoeba invadens
LETKETLCFTMSLNTLVTAFKPQ

SEQ ID NO: 2982944 - protein, 21 aa, Entamoeba invadens
LETLGRCVVLYPFRAEHSDEL

SEQ ID NO: 2982945 - protein, 20 aa, Entamoeba invadens
LETLRLPYSVLIKIHETYPL

SEQ ID NO: 2982946 - protein, 23 aa, Entamoeba invadens
LETPRLYIKWVEKIAQEHGVRQH

SEQ ID NO: 2982947 - protein, 19 aa, Entamoeba invadens
LETRWTIYRALYAKLQENS

SEQ ID NO: 2982948 - protein, 21 aa, Entamoeba invadens
LEVDGAFTLRFPLLDEVCEIS

SEQ ID NO: 2982949 - protein, 19 aa, Entamoeba invadens
LEVGLIPPLWEAHAQTKLE

SEQ ID NO: 2982950 - protein, 19 aa, Entamoeba invadens
LEVKWRFEISTQRPLIQNT

SEQ ID NO: 2982951 - protein, 20 aa, Entamoeba invadens
LEVLASLLFRSMMHQRLSEN

SEQ ID NO: 2982952 - protein, 25 aa, Entamoeba invadens
LEVQEIKASIAMYEWGMSVRSSVQR

SEQ ID NO: 2982953 - protein, 24 aa, Entamoeba invadens
LEYKRIRECGGYVIGSRTNGNLAI

SEQ ID NO: 2982954 - protein, 17 aa, Entamoeba invadens
LEYMWLTQLEFVRTVRG

SEQ ID NO: 2982955 - protein, 19 aa, Entamoeba invadens
LFAFLKRIIPTITLSPTNF

SEQ ID NO: 2982956 - protein, 17 aa, Entamoeba invadens
LFASIPMWIFNDSLRRH

SEQ ID NO: 2982957 - protein, 19 aa, Entamoeba invadens
LFDFHAYIFQKPCICTYID

SEQ ID NO: 2982958 - protein, 17 aa, Entamoeba invadens
LFDREFLVNDVLNIWDA

SEQ ID NO: 2982959 - protein, 18 aa, Entamoeba invadens
LFEFGRCIEKIMSEVSEV

SEQ ID NO: 2982960 - protein, 21 aa, Entamoeba invadens
LFEFLKLKPLVFLALQPIVGD

SEQ ID NO: 2982961 - protein, 18 aa, Entamoeba invadens
LFEIFKIPFVPLAIDSNK

SEQ ID NO: 2982962 - protein, 18 aa, Entamoeba invadens
LFEKSVAVSLVLPVMSNP

SEQ ID NO: 2982963 - protein, 18 aa, Entamoeba invadens
LFEPLKWSKALYHQCITS

SEQ ID NO: 2982964 - protein, 17 aa, Entamoeba invadens
LFFCEEIANNLLLFSNK

SEQ ID NO: 2982965 - protein, 19 aa, Entamoeba invadens
LFFDISAFELFKWNKEKGV

SEQ ID NO: 2982966 - protein, 19 aa, Entamoeba invadens
LFFKTVAVSYAFYLQMKAF

SEQ ID NO: 2982967 - protein, 25 aa, Entamoeba invadens
LFFQFAFRWINCFLLRELSPEQGMR

SEQ ID NO: 2982968 - protein, 17 aa, Entamoeba invadens
LFFRFLEKYGFDATALT

SEQ ID NO: 2982969 - protein, 19 aa, Entamoeba invadens
LFGFDGWSSCITNLNVDYV

SEQ ID NO: 2982970 - protein, 18 aa, Entamoeba invadens
LFGTIPLFAANSAKKITT

SEQ ID NO: 2982971 - protein, 20 aa, Entamoeba invadens
LFHCPFCLKFVVLRNQIGMG

SEQ ID NO: 2982972 - protein, 24 aa, Entamoeba invadens
LFIACSYIGARICTLYDSLGDESL

SEQ ID NO: 2982973 - protein, 19 aa, Entamoeba invadens
LFIDYGIVDVRLLYQPIVV

SEQ ID NO: 2982974 - protein, 23 aa, Entamoeba invadens
LFKEWKSGMPLAMVFVSSFNSVI

SEQ ID NO: 2982975 - protein, 23 aa, Entamoeba invadens
LFKEWKSGMPLPMVFVSSFNSVI

SEQ ID NO: 2982976 - protein, 18 aa, Entamoeba invadens
LFKFPWKIAEYVIAGNRP

SEQ ID NO: 2982977 - protein, 20 aa, Entamoeba invadens
LFKQFFPKVRFLDIDDDVIV

SEQ ID NO: 2982978 - protein, 20 aa, Entamoeba invadens
LFKRRCEALKKAYNKKPKKL

SEQ ID NO: 2982979 - protein, 24 aa, Entamoeba invadens
LFLGKRPDGVLILMDAFNSINFKA

SEQ ID NO: 2982980 - protein, 18 aa, Entamoeba invadens
LFLNRFQLAMSIDTTLSR

SEQ ID NO: 2982981 - protein, 17 aa, Entamoeba invadens
LFLSRSGINLNIENSKN

SEQ ID NO: 2982982 - protein, 18 aa, Entamoeba invadens
LFNSLGICRVVEDNKLGI

SEQ ID NO: 2982983 - protein, 24 aa, Entamoeba invadens
LFPPYNFYMCFTLSAVTLPSTLKS

SEQ ID NO: 2982984 - protein, 19 aa, Entamoeba invadens
LFPSCKIFVVYPYKKNKAT

SEQ ID NO: 2982985 - protein, 17 aa, Entamoeba invadens
LFPVACDGLGRIIDGVS

SEQ ID NO: 2982986 - protein, 18 aa, Entamoeba invadens
LFQKRLIKVIPNAQVEPL

SEQ ID NO: 2982987 - protein, 17 aa, Entamoeba invadens
LFREMKRIKGFELLNLF

SEQ ID NO: 2982988 - protein, 22 aa, Entamoeba invadens
LFRKAAAVQIVMLGGEFVAQKK

SEQ ID NO: 2982989 - protein, 19 aa, Entamoeba invadens
LFRTCDYFKFSAKIEFQAL

SEQ ID NO: 2982990 - protein, 17 aa, Entamoeba invadens
LFRTKFVLSEKMISEIK

SEQ ID NO: 2982991 - protein, 21 aa, Entamoeba invadens
LFSHFDFFKSVEWQNTELYVS

SEQ ID NO: 2982992 - protein, 21 aa, Entamoeba invadens
LFTMCGFEVRILPKCRANEEE

SEQ ID NO: 2982993 - protein, 18 aa, Entamoeba invadens
LFVFPSRVWDYFKEKMRM

SEQ ID NO: 2982994 - protein, 17 aa, Entamoeba invadens
LFVMTVLKFIRLIQKST

SEQ ID NO: 2982995 - protein, 19 aa, Entamoeba invadens
LFVRRCSKLFMNVKLPHEL

SEQ ID NO: 2982996 - protein, 22 aa, Entamoeba invadens
LFVTCLKLGVLTSELERITPKG

SEQ ID NO: 2982997 - protein, 19 aa, Entamoeba invadens
LFYRGKLKMQLKMFEKEKK

SEQ ID NO: 2982998 - protein, 17 aa, Entamoeba invadens
LGCGHYFCSNCWNERIS

SEQ ID NO: 2982999 - protein, 20 aa, Entamoeba invadens
LGCWFHFKQAIFKKVSKLGL

SEQ ID NO: 2983000 - protein, 20 aa, Entamoeba invadens
LGDAMILRFAIPSRKMTKED

SEQ ID NO: 2983001 - protein, 21 aa, Entamoeba invadens
LGDCHLWRFEALKEVGAVDAH

SEQ ID NO: 2983002 - protein, 17 aa, Entamoeba invadens
LGDFCFFNCQILSEIVF

SEQ ID NO: 2983003 - protein, 20 aa, Entamoeba invadens
LGDNCFRCCSSLSSIAIPSS

SEQ ID NO: 2983004 - protein, 22 aa, Entamoeba invadens
LGDRWLRFDPPLGCVIDLDDIE

SEQ ID NO: 2983005 - protein, 18 aa, Entamoeba invadens
LGENLFLYVEKYTKADEE

SEQ ID NO: 2983006 - protein, 20 aa, Entamoeba invadens
LGFLSPRSRKGISILKKRSS

SEQ ID NO: 2983007 - protein, 17 aa, Entamoeba invadens
LGGVKFFFCSAKNGEGV

SEQ ID NO: 2983008 - protein, 17 aa, Entamoeba invadens
LGIQWVHNRFDIIHKDI

SEQ ID NO: 2983009 - protein, 18 aa, Entamoeba invadens
LGKCFRRSKVDGSEIEFK

SEQ ID NO: 2983010 - protein, 24 aa, Entamoeba invadens
LGKYAVLCAIEFSMTLCIPIGNYS

SEQ ID NO: 2983011 - protein, 24 aa, Entamoeba invadens
LGLSRLSLMGARPSIMRSMVKGDE

SEQ ID NO: 2983012 - protein, 17 aa, Entamoeba invadens
LGLWKFTDPIAVAMVTQ

SEQ ID NO: 2983013 - protein, 17 aa, Entamoeba invadens
LGLYCFRRFKLKNYTSL

SEQ ID NO: 2983014 - protein, 23 aa, Entamoeba invadens
LGNCPSELGLFCQDWEAARECPN

SEQ ID NO: 2983015 - protein, 18 aa, Entamoeba invadens
LGNMCFCGCSSLKSFDLS

SEQ ID NO: 2983016 - protein, 19 aa, Entamoeba invadens
LGNPCIPYFGSFQNIFEKV

SEQ ID NO: 2983017 - protein, 18 aa, Entamoeba invadens
LGSSLDWSREVFTMDETR

SEQ ID NO: 2983018 - protein, 18 aa, Entamoeba invadens
LGTTHGFSVYGIDQNHLR

SEQ ID NO: 2983019 - protein, 21 aa, Entamoeba invadens
LGVSFGNLFGFEAMTVAYSGL

SEQ ID NO: 2983020 - protein, 17 aa, Entamoeba invadens
LGVYLSWNYKLTLKKFV

SEQ ID NO: 2983021 - protein, 17 aa, Entamoeba invadens
LGYKYTWIIESKKVGTA

SEQ ID NO: 2983022 - protein, 21 aa, Entamoeba invadens
LHCAEALPVQAFTPVETMRQT

SEQ ID NO: 2983023 - protein, 18 aa, Entamoeba invadens
LHFPRCVCNLTTLKTLFL

SEQ ID NO: 2983024 - protein, 25 aa, Entamoeba invadens
LHGLLYWKHRPCIEFKDMMSNFKKF

SEQ ID NO: 2983025 - protein, 26 aa, Entamoeba invadens
LHHYRPTPIYVMDEIDAALDFRNVSI

SEQ ID NO: 2983026 - protein, 23 aa, Entamoeba invadens
LHKGEACGFGLFIAPLCSCHIND

SEQ ID NO: 2983027 - protein, 22 aa, Entamoeba invadens
LHKGEIISVVWVYNEWGIGINE

SEQ ID NO: 2983028 - protein, 22 aa, Entamoeba invadens
LHKKEMYYTLCLTDYLVKQAKD

SEQ ID NO: 2983029 - protein, 22 aa, Entamoeba invadens
LHKYAQYAFHCFTDDYEALFYI

SEQ ID NO: 2983030 - protein, 17 aa, Entamoeba invadens
LHLAILFDAFDFFEDLK

SEQ ID NO: 2983031 - protein, 17 aa, Entamoeba invadens
LHLKRIVIWSEQIGGVN

SEQ ID NO: 2983032 - protein, 18 aa, Entamoeba invadens
LHLLLSFSTNCLKTNLTI

SEQ ID NO: 2983033 - protein, 21 aa, Entamoeba invadens
LHLWDIRCGKGKFAEMKPHKS

SEQ ID NO: 2983034 - protein, 17 aa, Entamoeba invadens
LHMVFYLISVLKIEIDV

SEQ ID NO: 2983035 - protein, 22 aa, Entamoeba invadens
LHNFKLVRLFFFTRFYQTTQEK

SEQ ID NO: 2983036 - protein, 19 aa, Entamoeba invadens
LHNPRVVFVFYDFEFTQFQ

SEQ ID NO: 2983037 - protein, 17 aa, Entamoeba invadens
LHPEAFENLGIDPPKGV

SEQ ID NO: 2983038 - protein, 17 aa, Entamoeba invadens
LHPSKFIIDRLVEELKV

SEQ ID NO: 2983039 - protein, 18 aa, Entamoeba invadens
LHRPELKYMLSLDSTSIT

SEQ ID NO: 2983040 - protein, 21 aa, Entamoeba invadens
LHRSPRNSINFNFEKKNEKEK

SEQ ID NO: 2983041 - protein, 17 aa, Entamoeba invadens
LHSGSCTALGPALLVST

SEQ ID NO: 2983042 - protein, 18 aa, Entamoeba invadens
LHSGSCTALGPALLVSTV

SEQ ID NO: 2983043 - protein, 20 aa, Entamoeba invadens
LHVLRLLPYDSIGEVDEQIL

SEQ ID NO: 2983044 - protein, 19 aa, Entamoeba invadens
LHYCDRAGIVVLRVPSTFD

SEQ ID NO: 2983045 - protein, 18 aa, Entamoeba invadens
LIAGYLLHPAYLREWKGA

SEQ ID NO: 2983046 - protein, 18 aa, Entamoeba invadens
LICECWKQNPIERITIET

SEQ ID NO: 2983047 - protein, 19 aa, Entamoeba invadens
LIEIFKARILYFSHKLAVI

SEQ ID NO: 2983048 - protein, 17 aa, Entamoeba invadens
LIEPITLLKKCFMGKRN

SEQ ID NO: 2983049 - protein, 19 aa, Entamoeba invadens
LIGILGMICSFHLFVTSHV

SEQ ID NO: 2983050 - protein, 19 aa, Entamoeba invadens
LIGNFSFKNCCSLRHLTFP

SEQ ID NO: 2983051 - protein, 20 aa, Entamoeba invadens
LIHRSRRFKILGIELPKQKK

SEQ ID NO: 2983052 - protein, 17 aa, Entamoeba invadens
LIIKFPIENQIFIRRLL

SEQ ID NO: 2983053 - protein, 19 aa, Entamoeba invadens
LIIKYRKIEMEKMRQKVSF

SEQ ID NO: 2983054 - protein, 17 aa, Entamoeba invadens
LIIRYAIDYNVPLYVPP

SEQ ID NO: 2983055 - protein, 17 aa, Entamoeba invadens
LIKADFCFFIFGECDQT

SEQ ID NO: 2983056 - protein, 24 aa, Entamoeba invadens
LIKEMLKREGLTFMEKVLLDTSLE

SEQ ID NO: 2983057 - protein, 24 aa, Entamoeba invadens
LIKFKGACDILFRSARRRLKSENS

SEQ ID NO: 2983058 - protein, 17 aa, Entamoeba invadens
LIKPCVIESTFLDDVLK

SEQ ID NO: 2983059 - protein, 25 aa, Entamoeba invadens
LILEMFWRNEMYILKFAPFCRFLSS

SEQ ID NO: 2983060 - protein, 18 aa, Entamoeba invadens
LIMKCTKLEVSISAVDMI

SEQ ID NO: 2983061 - protein, 19 aa, Entamoeba invadens
LIMLKRYLDYIIDIVRPRK

SEQ ID NO: 2983062 - protein, 17 aa, Entamoeba invadens
LIMRGYRVVVKKPKIAK

SEQ ID NO: 2983063 - protein, 19 aa, Entamoeba invadens
LINKRALEAIRCLKVNPRS

SEQ ID NO: 2983064 - protein, 22 aa, Entamoeba invadens
LIPFVKRYVVWFTVSLTDSYSL

SEQ ID NO: 2983065 - protein, 24 aa, Entamoeba invadens
LIPKEAIPMFFLWDDALDAKGDDE

SEQ ID NO: 2983066 - protein, 18 aa, Entamoeba invadens
LIPTVPFLANNSANTHIA

SEQ ID NO: 2983067 - protein, 24 aa, Entamoeba invadens
LIQKRIRGFCVRKLPEVCGLKERK

SEQ ID NO: 2983068 - protein, 20 aa, Entamoeba invadens
LIRRGCDLFESLFVVLNYKK

SEQ ID NO: 2983069 - protein, 17 aa, Entamoeba invadens
LIRRLHISIVRKLVKST

SEQ ID NO: 2983070 - protein, 20 aa, Entamoeba invadens
LISDCYKCYLNSPISGDCKQ

SEQ ID NO: 2983071 - protein, 24 aa, Entamoeba invadens
LISLLAKHCCVRFIVTHPLQSTLA

SEQ ID NO: 2983072 - protein, 18 aa, Entamoeba invadens
LITAVFCEKYVDMLMKCK

SEQ ID NO: 2983073 - protein, 17 aa, Entamoeba invadens
LITCVKFSPKFPLLAVG

SEQ ID NO: 2983074 - protein, 24 aa, Entamoeba invadens
LITDPFIFCGSIKLQMVVFIKAKP

SEQ ID NO: 2983075 - protein, 19 aa, Entamoeba invadens
LIVCYDFCVKLAQNLFFDV

SEQ ID NO: 2983076 - protein, 22 aa, Entamoeba invadens
LIVICYDLRFPAFIRYSETNDY

SEQ ID NO: 2983077 - protein, 17 aa, Entamoeba invadens
LIVPYLFLGAVNATKDP

SEQ ID NO: 2983078 - protein, 18 aa, Entamoeba invadens
LIWAKGGLFLDKILYLRN

SEQ ID NO: 2983079 - protein, 27 aa, Entamoeba invadens
LKADEIFDRMKLEWDKLTFSENVQGNY

SEQ ID NO: 2983080 - protein, 18 aa, Entamoeba invadens
LKAKCVKFTVAHAQFIAE

SEQ ID NO: 2983081 - protein, 18 aa, Entamoeba invadens
LKAKRYVECSSKSYETTH

SEQ ID NO: 2983082 - protein, 17 aa, Entamoeba invadens
LKAPHPFAKFIADQMSH

SEQ ID NO: 2983083 - protein, 17 aa, Entamoeba invadens
LKCCSDCANALLYLSSH

SEQ ID NO: 2983084 - protein, 19 aa, Entamoeba invadens
LKCSICGQLGHTHQNCTCT

SEQ ID NO: 2983085 - protein, 22 aa, Entamoeba invadens
LKDEIYIGGVFIRILNKNPSSP

SEQ ID NO: 2983086 - protein, 20 aa, Entamoeba invadens
LKDFCFRECRALQEVVLPPT

SEQ ID NO: 2983087 - protein, 19 aa, Entamoeba invadens
LKDFCMRVPFRISSKDKER

SEQ ID NO: 2983088 - protein, 19 aa, Entamoeba invadens
LKDSPRWIGFGDHYMSTPY

SEQ ID NO: 2983089 - protein, 21 aa, Entamoeba invadens
LKEAIKFFGTICQHKIAKGAT

SEQ ID NO: 2983090 - protein, 18 aa, Entamoeba invadens
LKEEIVWECAKDVEVVET

SEQ ID NO: 2983091 - protein, 17 aa, Entamoeba invadens
LKEIFTWSRLCKRTNKK

SEQ ID NO: 2983092 - protein, 24 aa, Entamoeba invadens
LKEKGCLIERYFGRIKMVFKFTRE

SEQ ID NO: 2983093 - protein, 20 aa, Entamoeba invadens
LKEKLHPLGMFSNVEALPNV

SEQ ID NO: 2983094 - protein, 21 aa, Entamoeba invadens
LKELRLENIFRLSVLKLPPQV

SEQ ID NO: 2983095 - protein, 20 aa, Entamoeba invadens
LKEVPLCFTNLMKLKNIYLS

SEQ ID NO: 2983096 - protein, 18 aa, Entamoeba invadens
LKFISAFLVDIDITKVNK

SEQ ID NO: 2983097 - protein, 17 aa, Entamoeba invadens
LKFIYHRLFVFIVEQVN

SEQ ID NO: 2983098 - protein, 21 aa, Entamoeba invadens
LKFKFPDGIEVIRTFSPQQRQ

SEQ ID NO: 2983099 - protein, 23 aa, Entamoeba invadens
LKFKHLDCNQAYQVRKGVKFTTY

SEQ ID NO: 2983100 - protein, 20 aa, Entamoeba invadens
LKFKKVCLGSSSFTKRLNEL

SEQ ID NO: 2983101 - protein, 18 aa, Entamoeba invadens
LKFLKLLVLYSNDPQDKY

SEQ ID NO: 2983102 - protein, 17 aa, Entamoeba invadens
LKFLQKRIEGLDMISIL

SEQ ID NO: 2983103 - protein, 17 aa, Entamoeba invadens
LKFPGQFDIAFPVEVDN

SEQ ID NO: 2983104 - protein, 17 aa, Entamoeba invadens
LKFSYKVHFDFEPNEFF

SEQ ID NO: 2983105 - protein, 17 aa, Entamoeba invadens
LKFVLKYVKLFDQSIFE

SEQ ID NO: 2983106 - protein, 19 aa, Entamoeba invadens
LKGALNIPYAENWKEEVQK

SEQ ID NO: 2983107 - protein, 18 aa, Entamoeba invadens
LKGDYITVVVKDFKTLNE

SEQ ID NO: 2983108 - protein, 19 aa, Entamoeba invadens
LKGGVFWCCNSLIKFDNFR

SEQ ID NO: 2983109 - protein, 17 aa, Entamoeba invadens
LKGNFSIDIIKDGIAKL

SEQ ID NO: 2983110 - protein, 21 aa, Entamoeba invadens
LKGNPLSGFNVFEEQVPTAPQ

SEQ ID NO: 2983111 - protein, 20 aa, Entamoeba invadens
LKGNPLVSCDVFAPTSETIQ

SEQ ID NO: 2983112 - protein, 19 aa, Entamoeba invadens
LKGQCGLCFTKLSKDELMK

SEQ ID NO: 2983113 - protein, 21 aa, Entamoeba invadens
LKHFIPLIWAKGGLFLDKILY

SEQ ID NO: 2983114 - protein, 18 aa, Entamoeba invadens
LKHYGHKGIMEYESTLSR

SEQ ID NO: 2983115 - protein, 18 aa, Entamoeba invadens
LKIDKCDNVSCYVNEKCA

SEQ ID NO: 2983116 - protein, 21 aa, Entamoeba invadens
LKIIRIVSGFTRFEENLLHEK

SEQ ID NO: 2983117 - protein, 20 aa, Entamoeba invadens
LKIKIGEFWGRSTAKNLTKW

SEQ ID NO: 2983118 - protein, 17 aa, Entamoeba invadens
LKIKRNRLTELEMMEKS

SEQ ID NO: 2983119 - protein, 18 aa, Entamoeba invadens
LKILEEIRFAPSASNKQE

SEQ ID NO: 2983120 - protein, 20 aa, Entamoeba invadens
LKIRVESIIDNFAIECNTRK

SEQ ID NO: 2983121 - protein, 17 aa, Entamoeba invadens
LKIRVLCCIGGEEIDEQ

SEQ ID NO: 2983122 - protein, 20 aa, Entamoeba invadens
LKIVFMFRTDFEINTKLIPT

SEQ ID NO: 2983123 - protein, 23 aa, Entamoeba invadens
LKIYKFILPFLFKHNNLEYLVRM

SEQ ID NO: 2983124 - protein, 21 aa, Entamoeba invadens
LKKAYRKLALKWHPDRNPNNK

SEQ ID NO: 2983125 - protein, 23 aa, Entamoeba invadens
LKKEFFKIIVWFNVDFETVDRNK

SEQ ID NO: 2983126 - protein, 17 aa, Entamoeba invadens
LKKEPKVSMLLKENLKL

SEQ ID NO: 2983127 - protein, 18 aa, Entamoeba invadens
LKKFEIMDGIVIKGEKIP

SEQ ID NO: 2983128 - protein, 22 aa, Entamoeba invadens
LKKHFWKTMGILPKQVKAKSFS

SEQ ID NO: 2983129 - protein, 17 aa, Entamoeba invadens
LKKHVWRCDGTCRDKPP

SEQ ID NO: 2983130 - protein, 18 aa, Entamoeba invadens
LKKKKYRLAYDCLEFIQP

SEQ ID NO: 2983131 - protein, 20 aa, Entamoeba invadens
LKKKRSVLVSSDLLEIDVEK

SEQ ID NO: 2983132 - protein, 19 aa, Entamoeba invadens
LKKLCVSPGKLCWVVYVDA

SEQ ID NO: 2983133 - protein, 17 aa, Entamoeba invadens
LKKLIGVDVDDETEETT

SEQ ID NO: 2983134 - protein, 22 aa, Entamoeba invadens
LKKLPVPLLYPLDKFVTEKETP

SEQ ID NO: 2983135 - protein, 19 aa, Entamoeba invadens
LKKLRIFFPNIIDLKEVTS

SEQ ID NO: 2983136 - protein, 20 aa, Entamoeba invadens
LKKRVTAICRFNLFVVVGLA

SEQ ID NO: 2983137 - protein, 26 aa, Entamoeba invadens
LKKSLCDGVVLAKLMNYLRPNTVDVS

SEQ ID NO: 2983138 - protein, 21 aa, Entamoeba invadens
LKKVCSVLMLLSVSYGEKVGE

SEQ ID NO: 2983139 - protein, 18 aa, Entamoeba invadens
LKKVMMCLYDIIKRYSLG

SEQ ID NO: 2983140 - protein, 19 aa, Entamoeba invadens
LKLDLPFVDPCLYLQRFGE

SEQ ID NO: 2983141 - protein, 17 aa, Entamoeba invadens
LKLFAVFTVGKLEKAVM

SEQ ID NO: 2983142 - protein, 17 aa, Entamoeba invadens
LKLFLKEIVAIVQKFMK

SEQ ID NO: 2983143 - protein, 19 aa, Entamoeba invadens
LKLGIPFFMWEIGQCVLLT

SEQ ID NO: 2983144 - protein, 18 aa, Entamoeba invadens
LKLGTAIESNCELMIQLA

SEQ ID NO: 2983145 - protein, 17 aa, Entamoeba invadens
LKLIIKLDVLLRNIAQM

SEQ ID NO: 2983146 - protein, 21 aa, Entamoeba invadens
LKLKCSIVPTAFCKEDVPKVL

SEQ ID NO: 2983147 - protein, 24 aa, Entamoeba invadens
LKLKIREVFAVPSIYYLHLITQGI

SEQ ID NO: 2983148 - protein, 17 aa, Entamoeba invadens
LKLLIMIFSEWTKTSEG

SEQ ID NO: 2983149 - protein, 17 aa, Entamoeba invadens
LKLPVIQAQLFSLIGDF

SEQ ID NO: 2983150 - protein, 17 aa, Entamoeba invadens
LKLSDCIVCYNQNKTLP

SEQ ID NO: 2983151 - protein, 19 aa, Entamoeba invadens
LKLTEIVKMRWKKEDENRF

SEQ ID NO: 2983152 - protein, 19 aa, Entamoeba invadens
LKLTPGFIYTHFILLDTET

SEQ ID NO: 2983153 - protein, 17 aa, Entamoeba invadens
LKLYIDIFYVVKLLESA

SEQ ID NO: 2983154 - protein, 17 aa, Entamoeba invadens
LKLYIPFVLLKDKILFE

SEQ ID NO: 2983155 - protein, 19 aa, Entamoeba invadens
LKMAGLEMCVSHFLVYSSA

SEQ ID NO: 2983156 - protein, 19 aa, Entamoeba invadens
LKMDYFRLKLGCMIHLAKF

SEQ ID NO: 2983157 - protein, 22 aa, Entamoeba invadens
LKMFKFQIVKEFTFNADVTLEV

SEQ ID NO: 2983158 - protein, 20 aa, Entamoeba invadens
LKMMISAIIVALKMANPKYE

SEQ ID NO: 2983159 - protein, 20 aa, Entamoeba invadens
LKNDCINYILTIVMKLSPEQ

SEQ ID NO: 2983160 - protein, 19 aa, Entamoeba invadens
LKNEIKIKDCELDKTMNQI

SEQ ID NO: 2983161 - protein, 17 aa, Entamoeba invadens
LKNSIAARDAWVKEDPK

SEQ ID NO: 2983162 - protein, 17 aa, Entamoeba invadens
LKNSIAAREAWVKEDPK

SEQ ID NO: 2983163 - protein, 19 aa, Entamoeba invadens
LKNSWKLVLSLLCTDPTVS

SEQ ID NO: 2983164 - protein, 23 aa, Entamoeba invadens
LKNYKFPVTFLIRGFVLLVNESK

SEQ ID NO: 2983165 - protein, 19 aa, Entamoeba invadens
LKPGYACEFEIFIKPLCTC

SEQ ID NO: 2983166 - protein, 25 aa, Entamoeba invadens
LKPLQCVGGFLILRLICPAIMQPNK

SEQ ID NO: 2983167 - protein, 25 aa, Entamoeba invadens
LKQAFKRLYCLKVIHLEGNPIAEDD

SEQ ID NO: 2983168 - protein, 17 aa, Entamoeba invadens
LKQIVSINFKRYFKLVY

SEQ ID NO: 2983169 - protein, 19 aa, Entamoeba invadens
LKREFFRIIVWFNVDFETV

SEQ ID NO: 2983170 - protein, 21 aa, Entamoeba invadens
LKRKFDMLPSCQIYKDYEITD

SEQ ID NO: 2983171 - protein, 18 aa, Entamoeba invadens
LKRLIAIFDQCEKENVPP

SEQ ID NO: 2983172 - protein, 19 aa, Entamoeba invadens
LKRRLEAIAQSKEFQDAKQ

SEQ ID NO: 2983173 - protein, 19 aa, Entamoeba invadens
LKRRRCTYRRYFRKLNYYY

SEQ ID NO: 2983174 - protein, 17 aa, Entamoeba invadens
LKRVFSFSKQKGNKEDK

SEQ ID NO: 2983175 - protein, 21 aa, Entamoeba invadens
LKSAGVIFIQFAFRWINCCLL

SEQ ID NO: 2983176 - protein, 19 aa, Entamoeba invadens
LKSDVFAFGASFTTEKEHT

SEQ ID NO: 2983177 - protein, 34 aa, Entamoeba invadens
LKSHNTGVCKFHLGMCYRKGCGVLESATKSAECY

SEQ ID NO: 2983178 - protein, 18 aa, Entamoeba invadens
LKSIMEFMGVFYRKDEKR

SEQ ID NO: 2983179 - protein, 18 aa, Entamoeba invadens
LKSKGFRVGKYHAGMSAS

SEQ ID NO: 2983180 - protein, 18 aa, Entamoeba invadens
LKSLIPGCIAIRGNFVGD

SEQ ID NO: 2983181 - protein, 25 aa, Entamoeba invadens
LKSWKFRITKEFVFNLDVELVNVQQ

SEQ ID NO: 2983182 - protein, 17 aa, Entamoeba invadens
LKTEIRSFLTILSLVCF

SEQ ID NO: 2983183 - protein, 20 aa, Entamoeba invadens
LKTGETFGCYQKCPMSFEQK

SEQ ID NO: 2983184 - protein, 17 aa, Entamoeba invadens
LKTIFGIKDEIKCFLRK

SEQ ID NO: 2983185 - protein, 21 aa, Entamoeba invadens
LKTIGKFAFKNCVSLESVTFP

SEQ ID NO: 2983186 - protein, 21 aa, Entamoeba invadens
LKTIGKFAFKNCYSLESLTFP

SEQ ID NO: 2983187 - protein, 19 aa, Entamoeba invadens
LKTIGKFVFKNCVSLESIT

SEQ ID NO: 2983188 - protein, 19 aa, Entamoeba invadens
LKTKFVYYSRDWEDFLKKN

SEQ ID NO: 2983189 - protein, 20 aa, Entamoeba invadens
LKTKVSGFVSESSILNAELD

SEQ ID NO: 2983190 - protein, 21 aa, Entamoeba invadens
LKTLCYRCHRIWCFLSSVDYY

SEQ ID NO: 2983191 - protein, 18 aa, Entamoeba invadens
LKTLFGLADTARCFLRRE

SEQ ID NO: 2983192 - protein, 18 aa, Entamoeba invadens
LKTPFPGLINYFLYTAKN

SEQ ID NO: 2983193 - protein, 17 aa, Entamoeba invadens
LKTQCPMRVRTKREKRM

SEQ ID NO: 2983194 - protein, 19 aa, Entamoeba invadens
LKTVPYFACISAMTEEGID

SEQ ID NO: 2983195 - protein, 17 aa, Entamoeba invadens
LKTVVLYSEDFRIDRDA

SEQ ID NO: 2983196 - protein, 17 aa, Entamoeba invadens
LKTVYAFAREKYNKDTV

SEQ ID NO: 2983197 - protein, 22 aa, Entamoeba invadens
LKVCDGMRKMGYAKRNLEDIIQ

SEQ ID NO: 2983198 - protein, 18 aa, Entamoeba invadens
LKVGKCALHPSGIEECPF

SEQ ID NO: 2983199 - protein, 17 aa, Entamoeba invadens
LKVGYAFDSLIHKCIDD

SEQ ID NO: 2983200 - protein, 17 aa, Entamoeba invadens
LKVLIFMKPDSNIGLIY

SEQ ID NO: 2983201 - protein, 19 aa, Entamoeba invadens
LKVLPLWGVNPDDPTHTYI

SEQ ID NO: 2983202 - protein, 19 aa, Entamoeba invadens
LKVLRSWAFYNVNHLKEIE

SEQ ID NO: 2983203 - protein, 22 aa, Entamoeba invadens
LKVVTAICLGRWVVNEEWIQEC

SEQ ID NO: 2983204 - protein, 20 aa, Entamoeba invadens
LKWSPKGNLVICKAQTSVDS

SEQ ID NO: 2983205 - protein, 24 aa, Entamoeba invadens
LKYCFSSSCTLCYETIQDIDTLSG

SEQ ID NO: 2983206 - protein, 21 aa, Entamoeba invadens
LKYDCCFLAKYGINTCIKKDS

SEQ ID NO: 2983207 - protein, 19 aa, Entamoeba invadens
LKYDSCFLAKYGIEICIKK

SEQ ID NO: 2983208 - protein, 18 aa, Entamoeba invadens
LKYDSCFSAKYGIETCIK

SEQ ID NO: 2983209 - protein, 20 aa, Entamoeba invadens
LKYFRVESVSGKTPYLHIQN

SEQ ID NO: 2983210 - protein, 20 aa, Entamoeba invadens
LKYSVLFPKIFSAVPNLYTY

SEQ ID NO: 2983211 - protein, 17 aa, Entamoeba invadens
LLAELGCGFDCASIDEI

SEQ ID NO: 2983212 - protein, 25 aa, Entamoeba invadens
LLARLEIKWILSVCDVVPFYQRKYR

SEQ ID NO: 2983213 - protein, 17 aa, Entamoeba invadens
LLASRYGKIGIYSLKTT

SEQ ID NO: 2983214 - protein, 17 aa, Entamoeba invadens
LLCYDRLLWVIPLGSNR

SEQ ID NO: 2983215 - protein, 20 aa, Entamoeba invadens
LLECDVWISLIFDQLEKIRK

SEQ ID NO: 2983216 - protein, 25 aa, Entamoeba invadens
LLEDKKRLFSMLVVRYEALLKNQKT

SEQ ID NO: 2983217 - protein, 19 aa, Entamoeba invadens
LLEKDYRGILGLPPKKIHM

SEQ ID NO: 2983218 - protein, 22 aa, Entamoeba invadens
LLELKPSFEFDKQFNIKTREHF

SEQ ID NO: 2983219 - protein, 17 aa, Entamoeba invadens
LLEPIALPAEVVDKKIR

SEQ ID NO: 2983220 - protein, 17 aa, Entamoeba invadens
LLEPKWRKSQIDVNHKK

SEQ ID NO: 2983221 - protein, 17 aa, Entamoeba invadens
LLERVWNNILLKSKEQQ

SEQ ID NO: 2983222 - protein, 18 aa, Entamoeba invadens
LLEYRKLLTILLNYGTGA

SEQ ID NO: 2983223 - protein, 22 aa, Entamoeba invadens
LLFCLKLQFPDRVSLLRGNHEC

SEQ ID NO: 2983224 - protein, 20 aa, Entamoeba invadens
LLFEFIWPPAYGDRIDTKEL

SEQ ID NO: 2983225 - protein, 20 aa, Entamoeba invadens
LLFKCWELIYLIDFSQDVSK

SEQ ID NO: 2983226 - protein, 19 aa, Entamoeba invadens
LLFQRKWIDGKRIFVGILG

SEQ ID NO: 2983227 - protein, 22 aa, Entamoeba invadens
LLFWKDEFLRNACTSLGDDRKY

SEQ ID NO: 2983228 - protein, 17 aa, Entamoeba invadens
LLGFSKLTSLKCRMIPQ

SEQ ID NO: 2983229 - protein, 18 aa, Entamoeba invadens
LLGGIFYDFFPRKGKRSG

SEQ ID NO: 2983230 - protein, 26 aa, Entamoeba invadens
LLGLLYLLFRRYRLDVIKNEEGTEKG

SEQ ID NO: 2983231 - protein, 18 aa, Entamoeba invadens
LLGNGYGFAVDWWSYGTL

SEQ ID NO: 2983232 - protein, 26 aa, Entamoeba invadens
LLHDLKDGLVLAKFLRNLSCKNIPTI

SEQ ID NO: 2983233 - protein, 19 aa, Entamoeba invadens
LLHFKGEYFGGAVTAVCDC

SEQ ID NO: 2983234 - protein, 18 aa, Entamoeba invadens
LLHLFNWSLFVLLNKQTY

SEQ ID NO: 2983235 - protein, 18 aa, Entamoeba invadens
LLHPEIYKHVGIDPPRGI

SEQ ID NO: 2983236 - protein, 22 aa, Entamoeba invadens
LLICLKLQFPDRIHLLRGNHEC

SEQ ID NO: 2983237 - protein, 21 aa, Entamoeba invadens
LLIQYCEAFNCLNRVEFDLSL

SEQ ID NO: 2983238 - protein, 23 aa, Entamoeba invadens
LLKEWKSGMPLPMVFVSTSNSVI

SEQ ID NO: 2983239 - protein, 17 aa, Entamoeba invadens
LLKKCFFSLFPENFGTN

SEQ ID NO: 2983240 - protein, 25 aa, Entamoeba invadens
LLKKICPHITFSFVINKLQQRVESL

SEQ ID NO: 2983241 - protein, 18 aa, Entamoeba invadens
LLKLYESFCYLISGRERE

SEQ ID NO: 2983242 - protein, 17 aa, Entamoeba invadens
LLLCEKIVFPLTKTIRT

SEQ ID NO: 2983243 - protein, 19 aa, Entamoeba invadens
LLLCQYCKIELGQPSKKSV

SEQ ID NO: 2983244 - protein, 20 aa, Entamoeba invadens
LLLDCFKTDINIRASSKELL

SEQ ID NO: 2983245 - protein, 18 aa, Entamoeba invadens
LLLEYSVFAKNENVKIAL

SEQ ID NO: 2983246 - protein, 18 aa, Entamoeba invadens
LLLKCFTHSIYIFEDETR

SEQ ID NO: 2983247 - protein, 23 aa, Entamoeba invadens
LLLKHLKCEIKWFNILPTNKVKT

SEQ ID NO: 2983248 - protein, 19 aa, Entamoeba invadens
LLLKLGDAMILRFAIPSRK

SEQ ID NO: 2983249 - protein, 24 aa, Entamoeba invadens
LLLKLSDAMILRFAIPSRKMTKED

SEQ ID NO: 2983250 - protein, 25 aa, Entamoeba invadens
LLLLEVIEPFEWVHLLITHLPSSMK

SEQ ID NO: 2983251 - protein, 24 aa, Entamoeba invadens
LLLQRLCGIYKSFCNTCTQYQQKQ

SEQ ID NO: 2983252 - protein, 19 aa, Entamoeba invadens
LLLRAVPWNEFRAREEMAD

SEQ ID NO: 2983253 - protein, 34 aa, Entamoeba invadens
LLNEYKYGLSLNEWQVAFVFKEMVMGLAYLHGNG

SEQ ID NO: 2983254 - protein, 22 aa, Entamoeba invadens
LLNGTVCIGNFFATEKRVDTLS

SEQ ID NO: 2983255 - protein, 26 aa, Entamoeba invadens
LLNRKHHCALCNKIFCDNCAKKKVIS

SEQ ID NO: 2983256 - protein, 17 aa, Entamoeba invadens
LLNSFFYIEHFAVFSEF

SEQ ID NO: 2983257 - protein, 18 aa, Entamoeba invadens
LLNYFGLLFKCWELIYLI

SEQ ID NO: 2983258 - protein, 17 aa, Entamoeba invadens
LLPFLCSRWQMPIPSVP

SEQ ID NO: 2983259 - protein, 17 aa, Entamoeba invadens
LLPHISHFDEVFRTRKS

SEQ ID NO: 2983260 - protein, 23 aa, Entamoeba invadens
LLPKHIYRFVGIFIYMGAHHNTK

SEQ ID NO: 2983261 - protein, 23 aa, Entamoeba invadens
LLPKHIYRFVGILIYMGAHHDTK

SEQ ID NO: 2983262 - protein, 18 aa, Entamoeba invadens
LLPNEAFEVSTAVEESGM

SEQ ID NO: 2983263 - protein, 24 aa, Entamoeba invadens
LLPNEFLKLLSLVFFVIKKDTKNS

SEQ ID NO: 2983264 - protein, 17 aa, Entamoeba invadens
LLQEIFKGTGLSPRGFV

SEQ ID NO: 2983265 - protein, 19 aa, Entamoeba invadens
LLQVCAKLRALGIVVECKT

SEQ ID NO: 2983266 - protein, 24 aa, Entamoeba invadens
LLREFLIEKCVNFADAAREAANRR

SEQ ID NO: 2983267 - protein, 18 aa, Entamoeba invadens
LLRIPCPLYHGFSQTTLV

SEQ ID NO: 2983268 - protein, 21 aa, Entamoeba invadens
LLRMAEGIGYNFKRRSTKPAK

SEQ ID NO: 2983269 - protein, 17 aa, Entamoeba invadens
LLRNRMSPINFTVQTKL

SEQ ID NO: 2983270 - protein, 18 aa, Entamoeba invadens
LLRPELFKKGSLTKRSKG

SEQ ID NO: 2983271 - protein, 19 aa, Entamoeba invadens
LLRREIDVMKKLSNHPNVV

SEQ ID NO: 2983272 - protein, 18 aa, Entamoeba invadens
LLRRVLMGLFMRPHMLNF

SEQ ID NO: 2983273 - protein, 19 aa, Entamoeba invadens
LLSCFSAFWVETNGDVNFN

SEQ ID NO: 2983274 - protein, 21 aa, Entamoeba invadens
LLSRMILFFKHCFKSECVDIL

SEQ ID NO: 2983275 - protein, 20 aa, Entamoeba invadens
LLTFHICHPLLVFIPKDVNK

SEQ ID NO: 2983276 - protein, 24 aa, Entamoeba invadens
LLTIIPIMWRFYRNPTISVDTKFN

SEQ ID NO: 2983277 - protein, 26 aa, Entamoeba invadens
LLTPEFKAVLKAAGMKRKDLCNPETV

SEQ ID NO: 2983278 - protein, 17 aa, Entamoeba invadens
LLVKNARSGFGFLEDIN

SEQ ID NO: 2983279 - protein, 17 aa, Entamoeba invadens
LLVQFLVVFSQTYTYDY

SEQ ID NO: 2983280 - protein, 20 aa, Entamoeba invadens
LLVRCVFKIPEAFVSELDFL

SEQ ID NO: 2983281 - protein, 19 aa, Entamoeba invadens
LLYCIKYGLTLVVPLNPPE

SEQ ID NO: 2983282 - protein, 18 aa, Entamoeba invadens
LLYFKSDVVYKWLKRYAD

SEQ ID NO: 2983283 - protein, 18 aa, Entamoeba invadens
LLYPWKIYVYDALTEVYV

SEQ ID NO: 2983284 - protein, 19 aa, Entamoeba invadens
LMAYLCCILQGYFIISDLY

SEQ ID NO: 2983285 - protein, 21 aa, Entamoeba invadens
LMCDRAALFGGRRDFTKMTAF

SEQ ID NO: 2983286 - protein, 18 aa, Entamoeba invadens
LMCGHYFLTPLVVKFSPP

SEQ ID NO: 2983287 - protein, 18 aa, Entamoeba invadens
LMCTLSFHLTYISGIEIV

SEQ ID NO: 2983288 - protein, 26 aa, Entamoeba invadens
LMDDKKFECPFCFQDMKNAKDLQKHV

SEQ ID NO: 2983289 - protein, 19 aa, Entamoeba invadens
LMDEFFRKPLLSLAEQKVV

SEQ ID NO: 2983290 - protein, 17 aa, Entamoeba invadens
LMGWKKSLLLVSHDTSF

SEQ ID NO: 2983291 - protein, 19 aa, Entamoeba invadens
LMIKQCINLAVSDDTTAKK

SEQ ID NO: 2983292 - protein, 23 aa, Entamoeba invadens
LMILKKEMDALCPLDPVEVTKYL

SEQ ID NO: 2983293 - protein, 19 aa, Entamoeba invadens
LMKSIFFCPPFWMRTSNDV

SEQ ID NO: 2983294 - protein, 21 aa, Entamoeba invadens
LMLLHCARVVLGNGLRLLGLE

SEQ ID NO: 2983295 - protein, 20 aa, Entamoeba invadens
LMPTSGLFKLGITTFYGQTK

SEQ ID NO: 2983296 - protein, 21 aa, Entamoeba invadens
LMRHCTLLAFNGGVFKLCNLS

SEQ ID NO: 2983297 - protein, 17 aa, Entamoeba invadens
LMTKFGLAFTALPDAYS

SEQ ID NO: 2983298 - protein, 19 aa, Entamoeba invadens
LMWMSMEFMDGGCLTDILE

SEQ ID NO: 2983299 - protein, 20 aa, Entamoeba invadens
LNALHIFKNFFEGIEYGKLK

SEQ ID NO: 2983300 - protein, 20 aa, Entamoeba invadens
LNCCLYSLNFRFGVTKISSF

SEQ ID NO: 2983301 - protein, 19 aa, Entamoeba invadens
LNDFQTLYLPLALSLLQND

SEQ ID NO: 2983302 - protein, 18 aa, Entamoeba invadens
LNDKIGRIYAWKAEEAKS

SEQ ID NO: 2983303 - protein, 18 aa, Entamoeba invadens
LNDLACWDDIKFLLDNKV

SEQ ID NO: 2983304 - protein, 17 aa, Entamoeba invadens
LNEELGIENVYLMCSNK

SEQ ID NO: 2983305 - protein, 24 aa, Entamoeba invadens
LNEFLPRRLHFVLTETLNPLARTS

SEQ ID NO: 2983306 - protein, 23 aa, Entamoeba invadens
LNEGKRLCDFCPFLMESFENKKE

SEQ ID NO: 2983307 - protein, 19 aa, Entamoeba invadens
LNEGYAFWITKIMKEALDE

SEQ ID NO: 2983308 - protein, 21 aa, Entamoeba invadens
LNELLKLIWWYDDERSKKYII

SEQ ID NO: 2983309 - protein, 21 aa, Entamoeba invadens
LNELRYGCVMIMADQDYDGSH

SEQ ID NO: 2983310 - protein, 21 aa, Entamoeba invadens
LNFLFTEGFLRSSCQHFGSST

SEQ ID NO: 2983311 - protein, 21 aa, Entamoeba invadens
LNGCTNLRCLTFAGDNNIFNN

SEQ ID NO: 2983312 - protein, 18 aa, Entamoeba invadens
LNGIGIVFEGMYIESNPL

SEQ ID NO: 2983313 - protein, 25 aa, Entamoeba invadens
LNIIGIRCLFGYGTLCSVEIPPSVS

SEQ ID NO: 2983314 - protein, 19 aa, Entamoeba invadens
LNIPELFPFDGEEKPPKGY

SEQ ID NO: 2983315 - protein, 21 aa, Entamoeba invadens
LNIWKGEGFDSVYSQTDEINS

SEQ ID NO: 2983316 - protein, 23 aa, Entamoeba invadens
LNKLKNCKFIAGDVLKVLDSLKE

SEQ ID NO: 2983317 - protein, 24 aa, Entamoeba invadens
LNKVLTCRCEICIENNCISSIRVI

SEQ ID NO: 2983318 - protein, 18 aa, Entamoeba invadens
LNLCGCTRITPAFLSTLL

SEQ ID NO: 2983319 - protein, 18 aa, Entamoeba invadens
LNLEKERRLNALSYHNVP

SEQ ID NO: 2983320 - protein, 27 aa, Entamoeba invadens
LNLFLTDFKACFKHSMPHISTHHSERT

SEQ ID NO: 2983321 - protein, 22 aa, Entamoeba invadens
LNMPMNFVFRGNIDFTIYDVLK

SEQ ID NO: 2983322 - protein, 19 aa, Entamoeba invadens
LNPCFRQRILSSVLNYNHM

SEQ ID NO: 2983323 - protein, 19 aa, Entamoeba invadens
LNPDWKKTLFIYGDDQSTD

SEQ ID NO: 2983324 - protein, 21 aa, Entamoeba invadens
LNPHFCKLIAWYDNEWGYSTR

SEQ ID NO: 2983325 - protein, 21 aa, Entamoeba invadens
LNPHFCKLISWYDNEWGYSTR

SEQ ID NO: 2983326 - protein, 22 aa, Entamoeba invadens
LNPHFCKLVSWYDNEWGYSTRL

SEQ ID NO: 2983327 - protein, 17 aa, Entamoeba invadens
LNPVVSCDGFVFKVIPG

SEQ ID NO: 2983328 - protein, 19 aa, Entamoeba invadens
LNREQCIKLTPPQDQIQTT

SEQ ID NO: 2983329 - protein, 25 aa, Entamoeba invadens
LNTLFTHLLRLCFKIAQNEKINSMG

SEQ ID NO: 2983330 - protein, 26 aa, Entamoeba invadens
LNTRAWQCFFNYIAIHNAYFKKEGDI

SEQ ID NO: 2983331 - protein, 18 aa, Entamoeba invadens
LNVIELNSFIGFLLYMGV

SEQ ID NO: 2983332 - protein, 17 aa, Entamoeba invadens
LNVIVSFIRTTREKREI

SEQ ID NO: 2983333 - protein, 19 aa, Entamoeba invadens
LNVSLTRARLGMYIVGNVE

SEQ ID NO: 2983334 - protein, 25 aa, Entamoeba invadens
LNVVIKWNICTAIHTLLNWNIMFNN

SEQ ID NO: 2983335 - protein, 18 aa, Entamoeba invadens
LPAYFFKNCVSLTLDNIN

SEQ ID NO: 2983336 - protein, 17 aa, Entamoeba invadens
LPCECLTTGFETRTGIM

SEQ ID NO: 2983337 - protein, 25 aa, Entamoeba invadens
LPCPINCLHCVKGKCVLCDKEYIVD

SEQ ID NO: 2983338 - protein, 21 aa, Entamoeba invadens
LPDRVYRYFGKVLYPSLTKAA

SEQ ID NO: 2983339 - protein, 25 aa, Entamoeba invadens
LPEIFNLPKGWGMGCDRGELYFINW

SEQ ID NO: 2983340 - protein, 20 aa, Entamoeba invadens
LPETCKKWLLSATINDDVET

SEQ ID NO: 2983341 - protein, 18 aa, Entamoeba invadens
LPFGRRFYVAIPLRGKCV

SEQ ID NO: 2983342 - protein, 19 aa, Entamoeba invadens
LPFLSGLLLIHFKNFFKLS

SEQ ID NO: 2983343 - protein, 17 aa, Entamoeba invadens
LPFSTFRMNLCDTTPYN

SEQ ID NO: 2983344 - protein, 18 aa, Entamoeba invadens
LPGVRPALIKGLADMMCL

SEQ ID NO: 2983345 - protein, 21 aa, Entamoeba invadens
LPHKRLRDVATRVKFIEYTEA

SEQ ID NO: 2983346 - protein, 23 aa, Entamoeba invadens
LPHQRVAIKWLWEHHNDTKIHGC

SEQ ID NO: 2983347 - protein, 24 aa, Entamoeba invadens
LPIKHPELFESLGIAQPKGVLLYG

SEQ ID NO: 2983348 - protein, 17 aa, Entamoeba invadens
LPIMPITKMDVYIENSQ

SEQ ID NO: 2983349 - protein, 17 aa, Entamoeba invadens
LPIPPSRFRPLNRFGNM

SEQ ID NO: 2983350 - protein, 20 aa, Entamoeba invadens
LPISIKLGATFPLKKDDFIE

SEQ ID NO: 2983351 - protein, 23 aa, Entamoeba invadens
LPIWRRLVWHGGYSIEIEEQSYL

SEQ ID NO: 2983352 - protein, 20 aa, Entamoeba invadens
LPKAYGFHVCVTKWLSLVQL

SEQ ID NO: 2983353 - protein, 21 aa, Entamoeba invadens
LPKIRRYDCVFSQQHGGLAMF

SEQ ID NO: 2983354 - protein, 19 aa, Entamoeba invadens
LPKKLVIVTSLCFPTYTKV

SEQ ID NO: 2983355 - protein, 23 aa, Entamoeba invadens
LPKSDVFMAFYFHYTKFIYFTVK

SEQ ID NO: 2983356 - protein, 20 aa, Entamoeba invadens
LPKSLKLIGKEAFEYCVSLT

SEQ ID NO: 2983357 - protein, 19 aa, Entamoeba invadens
LPKSLPFVLKIDSFKKGVF

SEQ ID NO: 2983358 - protein, 17 aa, Entamoeba invadens
LPKVLGLLEAYRILYLL

SEQ ID NO: 2983359 - protein, 17 aa, Entamoeba invadens
LPLASKWNVTFHELYDM

SEQ ID NO: 2983360 - protein, 18 aa, Entamoeba invadens
LPLDTAVDLLHQFYPQPN

SEQ ID NO: 2983361 - protein, 19 aa, Entamoeba invadens
LPLDYRLSKLVFFGLYFGI

SEQ ID NO: 2983362 - protein, 17 aa, Entamoeba invadens
LPLEAIVAIEERAEIPY

SEQ ID NO: 2983363 - protein, 17 aa, Entamoeba invadens
LPLFFGTVTFSLPQMIY

SEQ ID NO: 2983364 - protein, 17 aa, Entamoeba invadens
LPLFPLKYLKTGSLLRG

SEQ ID NO: 2983365 - protein, 17 aa, Entamoeba invadens
LPLHKLRKPIGMVGQKP

SEQ ID NO: 2983366 - protein, 17 aa, Entamoeba invadens
LPLKQIVSINFKRYFKL

SEQ ID NO: 2983367 - protein, 18 aa, Entamoeba invadens
LPLNHIVDWTKFYKVNSV

SEQ ID NO: 2983368 - protein, 17 aa, Entamoeba invadens
LPLTIANKCIIQKTLSL

SEQ ID NO: 2983369 - protein, 17 aa, Entamoeba invadens
LPLTLTFDRLPQNVETM

SEQ ID NO: 2983370 - protein, 21 aa, Entamoeba invadens
LPMIRRLEINASRHAFDLKYL

SEQ ID NO: 2983371 - protein, 18 aa, Entamoeba invadens
LPMKVRVSESFIACNALS

SEQ ID NO: 2983372 - protein, 19 aa, Entamoeba invadens
LPMQACTKLLCLLNGKAWN

SEQ ID NO: 2983373 - protein, 18 aa, Entamoeba invadens
LPMSYKLWHTFLLSSERD

SEQ ID NO: 2983374 - protein, 25 aa, Entamoeba invadens
LPNKFFKRGFEFVRDYVVKNCTKAS

SEQ ID NO: 2983375 - protein, 22 aa, Entamoeba invadens
LPNLRRLEIKAGRVALNENLPI

SEQ ID NO: 2983376 - protein, 17 aa, Entamoeba invadens
LPPEFRVFPQVVYTPKR

SEQ ID NO: 2983377 - protein, 17 aa, Entamoeba invadens
LPPKTVHWFKNFDSYEY

SEQ ID NO: 2983378 - protein, 17 aa, Entamoeba invadens
LPPLRALFLITTKGIPP

SEQ ID NO: 2983379 - protein, 20 aa, Entamoeba invadens
LPPNCYIFFLAINKKYCDAS

SEQ ID NO: 2983380 - protein, 25 aa, Entamoeba invadens
LPQEQCVFCFRTAAPLTQRTPKDYQ

SEQ ID NO: 2983381 - protein, 22 aa, Entamoeba invadens
LPQKCFRYDYSITCIEIPTTIT

SEQ ID NO: 2983382 - protein, 20 aa, Entamoeba invadens
LPRKRLRDVSSRLEYYKAVE

SEQ ID NO: 2983383 - protein, 20 aa, Entamoeba invadens
LPRMCFYCCVSLKKAVITKG

SEQ ID NO: 2983384 - protein, 19 aa, Entamoeba invadens
LPSLCTFGNLPFRKTAKRY

SEQ ID NO: 2983385 - protein, 20 aa, Entamoeba invadens
LPSLLTELGSFAFLNCKKLT

SEQ ID NO: 2983386 - protein, 19 aa, Entamoeba invadens
LPSNFLIEMFFTIYSKASK

SEQ ID NO: 2983387 - protein, 19 aa, Entamoeba invadens
LPSPELYKALNLSKTISTP

SEQ ID NO: 2983388 - protein, 18 aa, Entamoeba invadens
LPTDCFRNCFSLSSVKLP

SEQ ID NO: 2983389 - protein, 19 aa, Entamoeba invadens
LPTTIKFVGERCFENCYSL

SEQ ID NO: 2983390 - protein, 19 aa, Entamoeba invadens
LPTTISKIGKYCFGCCNNL

SEQ ID NO: 2983391 - protein, 19 aa, Entamoeba invadens
LPVCESFGFTADLRSHTSG

SEQ ID NO: 2983392 - protein, 18 aa, Entamoeba invadens
LPVGWAMGYFRNERYFFN

SEQ ID NO: 2983393 - protein, 19 aa, Entamoeba invadens
LPWDIGQAVVIVRTKYGKV

SEQ ID NO: 2983394 - protein, 19 aa, Entamoeba invadens
LPYPHWLLTFGRDYFASNL

SEQ ID NO: 2983395 - protein, 17 aa, Entamoeba invadens
LQAFEFCDFILKTSSPL

SEQ ID NO: 2983396 - protein, 19 aa, Entamoeba invadens
LQALFFPDFFLRKTERNLR

SEQ ID NO: 2983397 - protein, 18 aa, Entamoeba invadens
LQCKSGCEPTKWSLKKGK

SEQ ID NO: 2983398 - protein, 23 aa, Entamoeba invadens
LQELRVMSWLGFIGGAKGVFYYS

SEQ ID NO: 2983399 - protein, 23 aa, Entamoeba invadens
LQFIVNEIFIRYFVLKGTNVSVT

SEQ ID NO: 2983400 - protein, 19 aa, Entamoeba invadens
LQFQWWFPLVESVTAVEFH

SEQ ID NO: 2983401 - protein, 18 aa, Entamoeba invadens
LQHFEIIKEISFVSKTVN

SEQ ID NO: 2983402 - protein, 20 aa, Entamoeba invadens
LQHFKDALVLFKEMLYNEKR

SEQ ID NO: 2983403 - protein, 20 aa, Entamoeba invadens
LQKKNCGILLLGEHGSGKST

SEQ ID NO: 2983404 - protein, 18 aa, Entamoeba invadens
LQKLRVLWIQSCEDVKFY

SEQ ID NO: 2983405 - protein, 21 aa, Entamoeba invadens
LQLCLCPLCLNGIPPCADTKT

SEQ ID NO: 2983406 - protein, 17 aa, Entamoeba invadens
LQLKFFFSILDGEMMEN

SEQ ID NO: 2983407 - protein, 21 aa, Entamoeba invadens
LQLRPSFEFTKDFRIKSRSQF

SEQ ID NO: 2983408 - protein, 20 aa, Entamoeba invadens
LQLRWDRGFRAKVVDRDYKL

SEQ ID NO: 2983409 - protein, 17 aa, Entamoeba invadens
LQLSFEIVRIYLDSLTD

SEQ ID NO: 2983410 - protein, 17 aa, Entamoeba invadens
LQLYLDRLEFEGNNLNI

SEQ ID NO: 2983411 - protein, 17 aa, Entamoeba invadens
LQMADKFGCVFYEISAK

SEQ ID NO: 2983412 - protein, 19 aa, Entamoeba invadens
LQMFSLRALIPQAFSPIIQ

SEQ ID NO: 2983413 - protein, 22 aa, Entamoeba invadens
LQQRAIEFSQFFNYNELRMDAM

SEQ ID NO: 2983414 - protein, 19 aa, Entamoeba invadens
LQRIKLLLCNQHKDCFKIK

SEQ ID NO: 2983415 - protein, 22 aa, Entamoeba invadens
LQRIPTCMGMALSTRAKLQKIA

SEQ ID NO: 2983416 - protein, 17 aa, Entamoeba invadens
LQRLCWKGVPWHFRPKV

SEQ ID NO: 2983417 - protein, 18 aa, Entamoeba invadens
LQRVFPFSSVVVIGNKLD

SEQ ID NO: 2983418 - protein, 20 aa, Entamoeba invadens
LQRYRNYVGYSWVADKEEMV

SEQ ID NO: 2983419 - protein, 19 aa, Entamoeba invadens
LQSICWPLLLSAKNVFATS

SEQ ID NO: 2983420 - protein, 18 aa, Entamoeba invadens
LQTLLEILCEWSQNGGVP

SEQ ID NO: 2983421 - protein, 17 aa, Entamoeba invadens
LQTLVTMALGCAHLVMH

SEQ ID NO: 2983422 - protein, 17 aa, Entamoeba invadens
LQTVWKYFFLFSDVLVV

SEQ ID NO: 2983423 - protein, 21 aa, Entamoeba invadens
LQVLMKLRFQFELRYFNCDQT

SEQ ID NO: 2983424 - protein, 20 aa, Entamoeba invadens
LRAKRFLPMMAEANKGVTVG

SEQ ID NO: 2983425 - protein, 17 aa, Entamoeba invadens
LRAQVGFIFKNYGKTSF

SEQ ID NO: 2983426 - protein, 18 aa, Entamoeba invadens
LRARIPRIGMKSKRILEY

SEQ ID NO: 2983427 - protein, 18 aa, Entamoeba invadens
LRASMSMLKGEMKNEIFK

SEQ ID NO: 2983428 - protein, 18 aa, Entamoeba invadens
LRAVCVFCGNKASFSMRT

SEQ ID NO: 2983429 - protein, 19 aa, Entamoeba invadens
LRAYNCIIKRGWERLERSK

SEQ ID NO: 2983430 - protein, 19 aa, Entamoeba invadens
LRCFSGYYLADRMCVKCEY

SEQ ID NO: 2983431 - protein, 19 aa, Entamoeba invadens
LRCKSCDSFIIGKHSFDRR

SEQ ID NO: 2983432 - protein, 19 aa, Entamoeba invadens
LRCVYIPQNVKLLGNVPFK

SEQ ID NO: 2983433 - protein, 19 aa, Entamoeba invadens
LRDFSSLYPWNAFVSTFNV

SEQ ID NO: 2983434 - protein, 23 aa, Entamoeba invadens
LREFPFTFGNCVFKPINETNEVK

SEQ ID NO: 2983435 - protein, 17 aa, Entamoeba invadens
LRFCHQVFVKINEPSDL

SEQ ID NO: 2983436 - protein, 17 aa, Entamoeba invadens
LRFDPYVFISLQLPNKM

SEQ ID NO: 2983437 - protein, 24 aa, Entamoeba invadens
LRFLENFRLWIGLRRFNVLFDESI

SEQ ID NO: 2983438 - protein, 22 aa, Entamoeba invadens
LRFNFWDKITFKFEVDAIGKIK

SEQ ID NO: 2983439 - protein, 19 aa, Entamoeba invadens
LRFNFWDKITFKFEVEIIG

SEQ ID NO: 2983440 - protein, 20 aa, Entamoeba invadens
LRFPKDSKFRECTIECFLCR

SEQ ID NO: 2983441 - protein, 19 aa, Entamoeba invadens
LRFPNKRATVFEQFMTIEK

SEQ ID NO: 2983442 - protein, 19 aa, Entamoeba invadens
LRFPPDFFTDIKIYRVHSE

SEQ ID NO: 2983443 - protein, 19 aa, Entamoeba invadens
LRFRFLQKLVIKKSVNDKL

SEQ ID NO: 2983444 - protein, 18 aa, Entamoeba invadens
LRFSLAWLCNVDQTTNQL

SEQ ID NO: 2983445 - protein, 17 aa, Entamoeba invadens
LRFTPKVLVCVGDPMQL

SEQ ID NO: 2983446 - protein, 19 aa, Entamoeba invadens
LRGSEAFKEIGNYFEQFVY

SEQ ID NO: 2983447 - protein, 20 aa, Entamoeba invadens
LRHALKYDLTLRVGVDKPDF

SEQ ID NO: 2983448 - protein, 17 aa, Entamoeba invadens
LRHPQLFKNIGIKPPRG

SEQ ID NO: 2983449 - protein, 17 aa, Entamoeba invadens
LRHPQLFQAIGIKPPKG

SEQ ID NO: 2983450 - protein, 18 aa, Entamoeba invadens
LRIDSCPIFTLSSLANLK

SEQ ID NO: 2983451 - protein, 17 aa, Entamoeba invadens
LRIKFLLDGAKGIQYLH

SEQ ID NO: 2983452 - protein, 19 aa, Entamoeba invadens
LRIPSPFPLFQDFYNTFDF

SEQ ID NO: 2983453 - protein, 21 aa, Entamoeba invadens
LRKACLTWNRITHMVVKNKYY

SEQ ID NO: 2983454 - protein, 19 aa, Entamoeba invadens
LRKEIKVSEDLLPTVNVKD

SEQ ID NO: 2983455 - protein, 19 aa, Entamoeba invadens
LRKELPYSYSQILSQLRKT

SEQ ID NO: 2983456 - protein, 21 aa, Entamoeba invadens
LRKFCFCDCKVLSEVVLPKYL

SEQ ID NO: 2983457 - protein, 23 aa, Entamoeba invadens
LRKLRLSSIYNFFVVNIWYPVDY

SEQ ID NO: 2983458 - protein, 23 aa, Entamoeba invadens
LRKLWWKAMDYLSAKTMNKRKKE

SEQ ID NO: 2983459 - protein, 18 aa, Entamoeba invadens
LRKTFGIVNDFTKEEEEE

SEQ ID NO: 2983460 - protein, 20 aa, Entamoeba invadens
LRKVACVGAWHPARVGWTVA

SEQ ID NO: 2983461 - protein, 18 aa, Entamoeba invadens
LRKVELCDISSKTNPDSL

SEQ ID NO: 2983462 - protein, 17 aa, Entamoeba invadens
LRLFGVKIFCFEELTNV

SEQ ID NO: 2983463 - protein, 17 aa, Entamoeba invadens
LRLGKLVLDKGSFNNNQ

SEQ ID NO: 2983464 - protein, 19 aa, Entamoeba invadens
LRLLIPIEIAVKMEDREMV

SEQ ID NO: 2983465 - protein, 17 aa, Entamoeba invadens
LRLLRCLLREGPFKENQ

SEQ ID NO: 2983466 - protein, 18 aa, Entamoeba invadens
LRLLYGQCLYRTHRYDEC

SEQ ID NO: 2983467 - protein, 21 aa, Entamoeba invadens
LRLRCLPHLRYLNLKKVQVGF

SEQ ID NO: 2983468 - protein, 18 aa, Entamoeba invadens
LRLRHWIEFGFSEFGDLG

SEQ ID NO: 2983469 - protein, 17 aa, Entamoeba invadens
LRLRSRSIHPLIDTVDE

SEQ ID NO: 2983470 - protein, 17 aa, Entamoeba invadens
LRLSSLQVLLKGILSAE

SEQ ID NO: 2983471 - protein, 22 aa, Entamoeba invadens
LRLTLHMYGCRVVQKAVEYAAM

SEQ ID NO: 2983472 - protein, 25 aa, Entamoeba invadens
LRLTRLRLGNGYVFVYLSAQGSVGY

SEQ ID NO: 2983473 - protein, 20 aa, Entamoeba invadens
LRLVLCLTSALSYDGDRRLR

SEQ ID NO: 2983474 - protein, 19 aa, Entamoeba invadens
LRLYIPFILLKDRLLIELS

SEQ ID NO: 2983475 - protein, 18 aa, Entamoeba invadens
LRMTTPHFIRCILPNTQK

SEQ ID NO: 2983476 - protein, 19 aa, Entamoeba invadens
LRNGIYFAQMMHWNDYLIV

SEQ ID NO: 2983477 - protein, 18 aa, Entamoeba invadens
LRNLEVPHYIPLPVANEE

SEQ ID NO: 2983478 - protein, 17 aa, Entamoeba invadens
LRNLSCKNIPTIIRKPT

SEQ ID NO: 2983479 - protein, 17 aa, Entamoeba invadens
LRNSIELSKRFREMCVN

SEQ ID NO: 2983480 - protein, 20 aa, Entamoeba invadens
LRNTLYFNLSLAFQKFMTQE

SEQ ID NO: 2983481 - protein, 21 aa, Entamoeba invadens
LRPGGKICCFCPCIEQIQRSC

SEQ ID NO: 2983482 - protein, 17 aa, Entamoeba invadens
LRPSFEFTKDFRIKSRS

SEQ ID NO: 2983483 - protein, 20 aa, Entamoeba invadens
LRRYGPFKGKVPRIICGTKA

SEQ ID NO: 2983484 - protein, 17 aa, Entamoeba invadens
LRSGDFLEFLKNAYKTV

SEQ ID NO: 2983485 - protein, 18 aa, Entamoeba invadens
LRSKRYILKHMILFKNAI

SEQ ID NO: 2983486 - protein, 21 aa, Entamoeba invadens
LRSRIPFSDVVDVGQSYFMDH

SEQ ID NO: 2983487 - protein, 18 aa, Entamoeba invadens
LRTDDIVKEKTELCKQLG

SEQ ID NO: 2983488 - protein, 17 aa, Entamoeba invadens
LRTELYGNIVLANGSTM

SEQ ID NO: 2983489 - protein, 20 aa, Entamoeba invadens
LRTIGSFAFSGCINLLEIPL

SEQ ID NO: 2983490 - protein, 24 aa, Entamoeba invadens
LRTRKRISLSMARQFDLEQLFKFQ

SEQ ID NO: 2983491 - protein, 18 aa, Entamoeba invadens
LRVKMCLDAIKGIVYLHT

SEQ ID NO: 2983492 - protein, 18 aa, Entamoeba invadens
LRVLKLRKIRQRQLTEVT

SEQ ID NO: 2983493 - protein, 17 aa, Entamoeba invadens
LRVLYKLNWPVDVIKHN

SEQ ID NO: 2983494 - protein, 21 aa, Entamoeba invadens
LRVNCWREIITVICYVIEEGF

SEQ ID NO: 2983495 - protein, 19 aa, Entamoeba invadens
LRVSYLVLRYAQMKKYEIN

SEQ ID NO: 2983496 - protein, 18 aa, Entamoeba invadens
LRWEKPRALVLYNCSLWV

SEQ ID NO: 2983497 - protein, 19 aa, Entamoeba invadens
LRYDMEIARWSERFRALKS

SEQ ID NO: 2983498 - protein, 17 aa, Entamoeba invadens
LRYGTPNALYLLPKYAE

SEQ ID NO: 2983499 - protein, 27 aa, Entamoeba invadens
LRYIGGIKVVWLRHEFDFIGGSLGCAE

SEQ ID NO: 2983500 - protein, 20 aa, Entamoeba invadens
LRYILLVDALNFCFWPTANF

SEQ ID NO: 2983501 - protein, 22 aa, Entamoeba invadens
LRYYFPILFACFGRVEKLFNLE

SEQ ID NO: 2983502 - protein, 23 aa, Entamoeba invadens
LSAACSENFCGLVANCAKSQDVH

SEQ ID NO: 2983503 - protein, 18 aa, Entamoeba invadens
LSCFSAFWIETNGNVNFN

SEQ ID NO: 2983504 - protein, 18 aa, Entamoeba invadens
LSCFSAFWVETNGNVNFN

SEQ ID NO: 2983505 - protein, 19 aa, Entamoeba invadens
LSCYSSFWITKNGQIGFNL

SEQ ID NO: 2983506 - protein, 17 aa, Entamoeba invadens
LSDCIVCYNQNKTLPIF

SEQ ID NO: 2983507 - protein, 24 aa, Entamoeba invadens
LSDKELNQIIGFRKLATYSDWRPN

SEQ ID NO: 2983508 - protein, 20 aa, Entamoeba invadens
LSDLRIVFVVSFHSALMWWN

SEQ ID NO: 2983509 - protein, 17 aa, Entamoeba invadens
LSDNLLFFFVKDAKSSK

SEQ ID NO: 2983510 - protein, 17 aa, Entamoeba invadens
LSDWRFKKVLNETLKNI

SEQ ID NO: 2983511 - protein, 18 aa, Entamoeba invadens
LSEAIKRMRALDERTSKM

SEQ ID NO: 2983512 - protein, 25 aa, Entamoeba invadens
LSEFCPIYRGLKFRRLPIPPQDDIF

SEQ ID NO: 2983513 - protein, 20 aa, Entamoeba invadens
LSEFKFPISDCGKLDNVENV

SEQ ID NO: 2983514 - protein, 18 aa, Entamoeba invadens
LSETLRYWDFFFLDLDNF

SEQ ID NO: 2983515 - protein, 22 aa, Entamoeba invadens
LSFDEFDAFIGMLLFNGVAHDN

SEQ ID NO: 2983516 - protein, 18 aa, Entamoeba invadens
LSFEGMWWYGRKENSFGY

SEQ ID NO: 2983517 - protein, 17 aa, Entamoeba invadens
LSFLRVCVVTKPNMNPF

SEQ ID NO: 2983518 - protein, 17 aa, Entamoeba invadens
LSFNWLVKYVEQYGYIL

SEQ ID NO: 2983519 - protein, 27 aa, Entamoeba invadens
LSGGCPKRLCFWLSTVLRVYAWTCMSK

SEQ ID NO: 2983520 - protein, 19 aa, Entamoeba invadens
LSHAVYIYWRAKEMVKTKE

SEQ ID NO: 2983521 - protein, 17 aa, Entamoeba invadens
LSHPELYEEIGIKPPKG

SEQ ID NO: 2983522 - protein, 21 aa, Entamoeba invadens
LSIGRECFKQCLSLSSIKIPN

SEQ ID NO: 2983523 - protein, 19 aa, Entamoeba invadens
LSILHCFTSNFVLQEGVDL

SEQ ID NO: 2983524 - protein, 17 aa, Entamoeba invadens
LSILILRSLHCLNPQKD

SEQ ID NO: 2983525 - protein, 18 aa, Entamoeba invadens
LSKGRLYTWGSFSFGQLG

SEQ ID NO: 2983526 - protein, 26 aa, Entamoeba invadens
LSKMFLVVSCLLELYELFFPLNETSK

SEQ ID NO: 2983527 - protein, 22 aa, Entamoeba invadens
LSKYHCCRELYGNVGYNVKSQY

SEQ ID NO: 2983528 - protein, 19 aa, Entamoeba invadens
LSKYHCCRGLYGNVGFNVK

SEQ ID NO: 2983529 - protein, 23 aa, Entamoeba invadens
LSLFRNVMKLCFKIHMYKDANLM

SEQ ID NO: 2983530 - protein, 19 aa, Entamoeba invadens
LSLHMYGCRVVQKAIEFVD

SEQ ID NO: 2983531 - protein, 17 aa, Entamoeba invadens
LSLKRIKSFPVNFTPVK

SEQ ID NO: 2983532 - protein, 21 aa, Entamoeba invadens
LSLKVDFVFFVPSHILRKLGA

SEQ ID NO: 2983533 - protein, 20 aa, Entamoeba invadens
LSLLKFPLKFSNLKNAKKAA

SEQ ID NO: 2983534 - protein, 25 aa, Entamoeba invadens
LSLMPFPSIIEGWFYLRPLAFTDNV

SEQ ID NO: 2983535 - protein, 21 aa, Entamoeba invadens
LSLRIFLKYKKAEMVVFQQQN

SEQ ID NO: 2983536 - protein, 19 aa, Entamoeba invadens
LSLSIPMKRIHTVSIDGIN

SEQ ID NO: 2983537 - protein, 17 aa, Entamoeba invadens
LSLYKCGMSEYDPEKVV

SEQ ID NO: 2983538 - protein, 25 aa, Entamoeba invadens
LSMGKGCFFNCCFLETISIPSSVTS

SEQ ID NO: 2983539 - protein, 19 aa, Entamoeba invadens
LSPEFKNSVFLVASNFNAV

SEQ ID NO: 2983540 - protein, 18 aa, Entamoeba invadens
LSPKRLQTLVTMALGCAH

SEQ ID NO: 2983541 - protein, 17 aa, Entamoeba invadens
LSRLDFDLSCGRYECTL

SEQ ID NO: 2983542 - protein, 18 aa, Entamoeba invadens
LSRSAFFLAYLVQNPMKR

SEQ ID NO: 2983543 - protein, 17 aa, Entamoeba invadens
LSSACPYVARLVDSTVI

SEQ ID NO: 2983544 - protein, 20 aa, Entamoeba invadens
LSSFQKWTGYSHCKLIFDTA

SEQ ID NO: 2983545 - protein, 17 aa, Entamoeba invadens
LSSIRLLLIPSYNIKIS

SEQ ID NO: 2983546 - protein, 24 aa, Entamoeba invadens
LSSKAGGCGLNLIGGANLVMFDPD

SEQ ID NO: 2983547 - protein, 21 aa, Entamoeba invadens
LSSKCIFTASGMRADMNELTD

SEQ ID NO: 2983548 - protein, 25 aa, Entamoeba invadens
LSSTSWRVLRMLGRIIHRLLHNKNY

SEQ ID NO: 2983549 - protein, 17 aa, Entamoeba invadens
LSSVIFPPHLESINECA

SEQ ID NO: 2983550 - protein, 17 aa, Entamoeba invadens
LSTAKVFRYRPFSLILT

SEQ ID NO: 2983551 - protein, 20 aa, Entamoeba invadens
LSTCKCGKCEKSQINMLWLL

SEQ ID NO: 2983552 - protein, 18 aa, Entamoeba invadens
LSTFYKRGLKKMMVSNLV

SEQ ID NO: 2983553 - protein, 18 aa, Entamoeba invadens
LSTLRLDKDWSPLVTLNH

SEQ ID NO: 2983554 - protein, 31 aa, Entamoeba invadens
LSTSTKKKSGWRFPIPLYRSIEYIKKKEGLK

SEQ ID NO: 2983555 - protein, 18 aa, Entamoeba invadens
LSTVSGWKRRWVVLCRGF

SEQ ID NO: 2983556 - protein, 19 aa, Entamoeba invadens
LSVFSAFWVLKTGEVYVHQ

SEQ ID NO: 2983557 - protein, 19 aa, Entamoeba invadens
LSVIYKWVDEMLKDIQHNE

SEQ ID NO: 2983558 - protein, 19 aa, Entamoeba invadens
LSVSMVNEWAYEKGTTQRK

SEQ ID NO: 2983559 - protein, 17 aa, Entamoeba invadens
LSYQYVMTAMCFKANDI

SEQ ID NO: 2983560 - protein, 17 aa, Entamoeba invadens
LSYYRRDECAFRIGKDT

SEQ ID NO: 2983561 - protein, 18 aa, Entamoeba invadens
LTAVGPRAGVFVKAVGMF

SEQ ID NO: 2983562 - protein, 18 aa, Entamoeba invadens
LTCLVKFWEVKGHIIKML

SEQ ID NO: 2983563 - protein, 19 aa, Entamoeba invadens
LTCYFKLSSGGVFLTKNDD

SEQ ID NO: 2983564 - protein, 20 aa, Entamoeba invadens
LTCYSAFWLTSSRKVYLHQL

SEQ ID NO: 2983565 - protein, 22 aa, Entamoeba invadens
LTEIFKRLDFENLLSCRLVCKR

SEQ ID NO: 2983566 - protein, 20 aa, Entamoeba invadens
LTELYVRWSKLLVFRGKFDE

SEQ ID NO: 2983567 - protein, 23 aa, Entamoeba invadens
LTENCFICGKFGHLKDDCPEADK

SEQ ID NO: 2983568 - protein, 19 aa, Entamoeba invadens
LTESLIFYCGDLVMTDNTQ

SEQ ID NO: 2983569 - protein, 25 aa, Entamoeba invadens
LTEYLALGTVMVWSCFTAADDKFKV

SEQ ID NO: 2983570 - protein, 23 aa, Entamoeba invadens
LTFHSGYDFGYFLKLLTCEKLPS

SEQ ID NO: 2983571 - protein, 17 aa, Entamoeba invadens
LTFIKALSPSTFIVGDD

SEQ ID NO: 2983572 - protein, 24 aa, Entamoeba invadens
LTFWRICQTFDYFFVKTVVREYTD

SEQ ID NO: 2983573 - protein, 17 aa, Entamoeba invadens
LTIAPAFRITGSLLENE

SEQ ID NO: 2983574 - protein, 17 aa, Entamoeba invadens
LTIECLRSVYLHVDPRL

SEQ ID NO: 2983575 - protein, 20 aa, Entamoeba invadens
LTIPLWTGYYLKYSHPDIAR

SEQ ID NO: 2983576 - protein, 18 aa, Entamoeba invadens
LTKCYGIGGVKEYTDFTM

SEQ ID NO: 2983577 - protein, 22 aa, Entamoeba invadens
LTKRLTGCFVELSLHMYGCRVV

SEQ ID NO: 2983578 - protein, 17 aa, Entamoeba invadens
LTLCYDLLPTVFKKPLS

SEQ ID NO: 2983579 - protein, 22 aa, Entamoeba invadens
LTLKELFNVLGITQIDLHALNV

SEQ ID NO: 2983580 - protein, 17 aa, Entamoeba invadens
LTLLDVFMLWKTTTIPR

SEQ ID NO: 2983581 - protein, 19 aa, Entamoeba invadens
LTLPSCGDGGIILKSDGAI

SEQ ID NO: 2983582 - protein, 19 aa, Entamoeba invadens
LTLPSCGNGGIILKSDGAI

SEQ ID NO: 2983583 - protein, 17 aa, Entamoeba invadens
LTLRLALDGSKVAEAIL

SEQ ID NO: 2983584 - protein, 19 aa, Entamoeba invadens
LTLWWNIMRQMPFLWIMTD

SEQ ID NO: 2983585 - protein, 18 aa, Entamoeba invadens
LTNFRIVKLIGIGNVGRV

SEQ ID NO: 2983586 - protein, 21 aa, Entamoeba invadens
LTNMLFDFALEYGYFFNSKLA

SEQ ID NO: 2983587 - protein, 26 aa, Entamoeba invadens
LTNMRLRPRFLLKYLDAEGDWVTLCD

SEQ ID NO: 2983588 - protein, 18 aa, Entamoeba invadens
LTPDEINEFLAIVKSANN

SEQ ID NO: 2983589 - protein, 19 aa, Entamoeba invadens
LTPEFKNSVFLVASNFNAV

SEQ ID NO: 2983590 - protein, 23 aa, Entamoeba invadens
LTPIAGACVVEWINSTNLSLEVF

SEQ ID NO: 2983591 - protein, 23 aa, Entamoeba invadens
LTQKVLRSEALVNHIKGIATTAI

SEQ ID NO: 2983592 - protein, 20 aa, Entamoeba invadens
LTRCRKCIFHLPSTLTKLSL

SEQ ID NO: 2983593 - protein, 22 aa, Entamoeba invadens
LTRSGCYYRLLGGVRGDGAVIQ

SEQ ID NO: 2983594 - protein, 17 aa, Entamoeba invadens
LTSFGFGAFCGAKNLVK

SEQ ID NO: 2983595 - protein, 20 aa, Entamoeba invadens
LTSIGSLCFYGCYSLTSVKF

SEQ ID NO: 2983596 - protein, 20 aa, Entamoeba invadens
LTSIGSLCFYGCYSLTSVNR

SEQ ID NO: 2983597 - protein, 24 aa, Entamoeba invadens
LTSLRCVWCGITLHQGCINLAPRK

SEQ ID NO: 2983598 - protein, 18 aa, Entamoeba invadens
LTSSFKEFFFKKITFGTA

SEQ ID NO: 2983599 - protein, 18 aa, Entamoeba invadens
LTTFKNIEKWVAMIKNKL

SEQ ID NO: 2983600 - protein, 17 aa, Entamoeba invadens
LTTQIIHFICYYIIEEL

SEQ ID NO: 2983601 - protein, 19 aa, Entamoeba invadens
LTTSFPIWIGKSVRSCVLL

SEQ ID NO: 2983602 - protein, 18 aa, Entamoeba invadens
LTVPFARYIASNGVKKIK

SEQ ID NO: 2983603 - protein, 21 aa, Entamoeba invadens
LTVPLKYPIKRGIIIDFDLMD

SEQ ID NO: 2983604 - protein, 17 aa, Entamoeba invadens
LVCYLVWLFNEESKKFG

SEQ ID NO: 2983605 - protein, 22 aa, Entamoeba invadens
LVDCVKCVKATHIVPTVVNPDQ

SEQ ID NO: 2983606 - protein, 18 aa, Entamoeba invadens
LVDGHKWYMGCGFEGLEN

SEQ ID NO: 2983607 - protein, 19 aa, Entamoeba invadens
LVDMLKLKGVVEAWGTVVK

SEQ ID NO: 2983608 - protein, 17 aa, Entamoeba invadens
LVFCWMKILVVDEKKTF

SEQ ID NO: 2983609 - protein, 17 aa, Entamoeba invadens
LVFKKLPKIIAEFVEEL

SEQ ID NO: 2983610 - protein, 17 aa, Entamoeba invadens
LVFWKWANEHILAIVTA

SEQ ID NO: 2983611 - protein, 17 aa, Entamoeba invadens
LVGVYVELYKSECAIHM

SEQ ID NO: 2983612 - protein, 17 aa, Entamoeba invadens
LVHCYRTIFTFWKEMNK

SEQ ID NO: 2983613 - protein, 19 aa, Entamoeba invadens
LVIRYAWISANLGKLAKKL

SEQ ID NO: 2983614 - protein, 30 aa, Entamoeba invadens
LVKHEVINIFAIKWIKMMFAREFLLNDVVI

SEQ ID NO: 2983615 - protein, 23 aa, Entamoeba invadens
LVKMGHCVLCDFGLAIRDQEPYD

SEQ ID NO: 2983616 - protein, 19 aa, Entamoeba invadens
LVKTLSCLDPLKVYKSFVT

SEQ ID NO: 2983617 - protein, 19 aa, Entamoeba invadens
LVLECFEEFDLKYFVDLPL

SEQ ID NO: 2983618 - protein, 24 aa, Entamoeba invadens
LVLFKAICIMCHIIASHSDVNLMN

SEQ ID NO: 2983619 - protein, 19 aa, Entamoeba invadens
LVLKEGYKLIFPKTKKENS

SEQ ID NO: 2983620 - protein, 24 aa, Entamoeba invadens
LVLKREMYFVLKLIDFLVTSSEKF

SEQ ID NO: 2983621 - protein, 18 aa, Entamoeba invadens
LVLQHLFRLCMSSNIDDL

SEQ ID NO: 2983622 - protein, 18 aa, Entamoeba invadens
LVNLKIVVLYSMVTIDNS

SEQ ID NO: 2983623 - protein, 18 aa, Entamoeba invadens
LVPFKVILIVTIKHINEV

SEQ ID NO: 2983624 - protein, 18 aa, Entamoeba invadens
LVPKAVIHFLVFKTRDSI

SEQ ID NO: 2983625 - protein, 22 aa, Entamoeba invadens
LVPNCRFTDFWNGYGCGQVPDK

SEQ ID NO: 2983626 - protein, 18 aa, Entamoeba invadens
LVPRCLELLFQKKQRNLE

SEQ ID NO: 2983627 - protein, 17 aa, Entamoeba invadens
LVRAIKENVCYVALDYD

SEQ ID NO: 2983628 - protein, 18 aa, Entamoeba invadens
LVRNALWFSPLTMNEMEN

SEQ ID NO: 2983629 - protein, 17 aa, Entamoeba invadens
LVSAIAYLHSLNIVHRD

SEQ ID NO: 2983630 - protein, 18 aa, Entamoeba invadens
LVSCINCFTSLKYEVVHQ

SEQ ID NO: 2983631 - protein, 17 aa, Entamoeba invadens
LVSKVLLINKMFKNVQK

SEQ ID NO: 2983632 - protein, 17 aa, Entamoeba invadens
LVSLCCTKIPSLKVLNL

SEQ ID NO: 2983633 - protein, 24 aa, Entamoeba invadens
LVSNELFVALALLRFGVRIPDIFT

SEQ ID NO: 2983634 - protein, 17 aa, Entamoeba invadens
LVSNGIRYDHIVKCGGK

SEQ ID NO: 2983635 - protein, 18 aa, Entamoeba invadens
LVTLGDYLAAIALAENNL

SEQ ID NO: 2983636 - protein, 18 aa, Entamoeba invadens
LVVKRLVSAIAYLHSLNI

SEQ ID NO: 2983637 - protein, 24 aa, Entamoeba invadens
LVVYCYSCTVFLPPHIEMLVLNSA

SEQ ID NO: 2983638 - protein, 19 aa, Entamoeba invadens
LWALLQFLLPGIFRISQLD

SEQ ID NO: 2983639 - protein, 24 aa, Entamoeba invadens
LWDELPRSWKILVADQVALKVISS

SEQ ID NO: 2983640 - protein, 17 aa, Entamoeba invadens
LWDLRSGLKKEAQVMKG

SEQ ID NO: 2983641 - protein, 20 aa, Entamoeba invadens
LWFRELPKPILNVLSSDQIF

SEQ ID NO: 2983642 - protein, 19 aa, Entamoeba invadens
LWLEMSIGRSRHCTVGFTG

SEQ ID NO: 2983643 - protein, 21 aa, Entamoeba invadens
LWLKSIFELHLSYLMSVKEVH

SEQ ID NO: 2983644 - protein, 19 aa, Entamoeba invadens
LWMKEVFEGNGFVVQNVKY

SEQ ID NO: 2983645 - protein, 21 aa, Entamoeba invadens
LWPIPQFFKYDGKKCVGQPLC

SEQ ID NO: 2983646 - protein, 17 aa, Entamoeba invadens
LWSGLGYNSRAKRLRDL

SEQ ID NO: 2983647 - protein, 19 aa, Entamoeba invadens
LWTLLNYVNPIGFPSIEAF

SEQ ID NO: 2983648 - protein, 17 aa, Entamoeba invadens
LWVPLKMEILEEEIEED

SEQ ID NO: 2983649 - protein, 18 aa, Entamoeba invadens
LYAEEYEFIVLKRDEPLH

SEQ ID NO: 2983650 - protein, 18 aa, Entamoeba invadens
LYATVYLLYCCIINNHGE

SEQ ID NO: 2983651 - protein, 17 aa, Entamoeba invadens
LYCFRRFKLKNYTSLLP

SEQ ID NO: 2983652 - protein, 17 aa, Entamoeba invadens
LYCTTKILFGFWNEDLA

SEQ ID NO: 2983653 - protein, 22 aa, Entamoeba invadens
LYDPKRLFGLVLDYIPKDEKKS

SEQ ID NO: 2983654 - protein, 17 aa, Entamoeba invadens
LYDPVTVMFFFRKKHIQ

SEQ ID NO: 2983655 - protein, 20 aa, Entamoeba invadens
LYERVVKWLNCDAAPVTLRD

SEQ ID NO: 2983656 - protein, 17 aa, Entamoeba invadens
LYFAHLVLFVARNNTSS

SEQ ID NO: 2983657 - protein, 22 aa, Entamoeba invadens
LYFNGKWVVSRSVTWEINEYDA

SEQ ID NO: 2983658 - protein, 18 aa, Entamoeba invadens
LYFSLKKDVYWFISDHWY

SEQ ID NO: 2983659 - protein, 19 aa, Entamoeba invadens
LYGDLKVKACSMLKDSVNV

SEQ ID NO: 2983660 - protein, 24 aa, Entamoeba invadens
LYGKGAGCGPTLYLAYKIQKQLKT

SEQ ID NO: 2983661 - protein, 18 aa, Entamoeba invadens
LYIEKGISFLNNYIKANK

SEQ ID NO: 2983662 - protein, 20 aa, Entamoeba invadens
LYILCYYLKIDVPKIKQHTD

SEQ ID NO: 2983663 - protein, 23 aa, Entamoeba invadens
LYIRQCKNFRIGLMSKTKIVDIV

SEQ ID NO: 2983664 - protein, 19 aa, Entamoeba invadens
LYIVMEFMESGSLLNIVKQ

SEQ ID NO: 2983665 - protein, 23 aa, Entamoeba invadens
LYKCKDCKKLIAFSAMTGTVKSS

SEQ ID NO: 2983666 - protein, 18 aa, Entamoeba invadens
LYKKFGIYTPAGILLYGP

SEQ ID NO: 2983667 - protein, 18 aa, Entamoeba invadens
LYLFKKYILFGSVPENAH

SEQ ID NO: 2983668 - protein, 21 aa, Entamoeba invadens
LYLLFKKYRMAVAKIVDQSGR

SEQ ID NO: 2983669 - protein, 18 aa, Entamoeba invadens
LYLQRFGEDLAFEKTADV

SEQ ID NO: 2983670 - protein, 17 aa, Entamoeba invadens
LYLSLLLEPKWRKSQID

SEQ ID NO: 2983671 - protein, 19 aa, Entamoeba invadens
LYLYLPRPVNYFGQYKTIL

SEQ ID NO: 2983672 - protein, 17 aa, Entamoeba invadens
LYLYLTYFVINGNNQEN

SEQ ID NO: 2983673 - protein, 23 aa, Entamoeba invadens
LYNKGCTTHGLFRETSNASTRDV

SEQ ID NO: 2983674 - protein, 18 aa, Entamoeba invadens
LYNLRLRYMKDIIHTYSG

SEQ ID NO: 2983675 - protein, 18 aa, Entamoeba invadens
LYNSFGWSLLNEVEGGYF

SEQ ID NO: 2983676 - protein, 18 aa, Entamoeba invadens
LYNSVMLIKACSVVQYVR

SEQ ID NO: 2983677 - protein, 21 aa, Entamoeba invadens
LYPKFLACASTYYSEKFTNQN

SEQ ID NO: 2983678 - protein, 20 aa, Entamoeba invadens
LYPLLGVVFAMTFCKSAHVV

SEQ ID NO: 2983679 - protein, 17 aa, Entamoeba invadens
LYPQMKMIGLGSRLTTL

SEQ ID NO: 2983680 - protein, 17 aa, Entamoeba invadens
LYPRKWGLGPFAQQKKK

SEQ ID NO: 2983681 - protein, 20 aa, Entamoeba invadens
LYSFWLYDFCDVFLEASKPT

SEQ ID NO: 2983682 - protein, 19 aa, Entamoeba invadens
LYTKGCGTYGIFRDTTQKM

SEQ ID NO: 2983683 - protein, 23 aa, Entamoeba invadens
LYTRGVDHFGIFFAPLRQGITPE

SEQ ID NO: 2983684 - protein, 17 aa, Entamoeba invadens
LYTWGSFSFGQLGIPDA

SEQ ID NO: 2983685 - protein, 20 aa, Entamoeba invadens
LYTWSEAVLLNFRVVSKSCL

SEQ ID NO: 2983686 - protein, 18 aa, Entamoeba invadens
LYVGYKWMRGVSEKYKEI

SEQ ID NO: 2983687 - protein, 18 aa, Entamoeba invadens
LYVKGCYTNGIFRENSLA

SEQ ID NO: 2983688 - protein, 18 aa, Entamoeba invadens
LYVRRVFIMDDCRELIPE

SEQ ID NO: 2983689 - protein, 17 aa, Entamoeba invadens
LYYLTAHLFEGCIKLTN

SEQ ID NO: 2983690 - protein, 22 aa, Entamoeba invadens
LYYRFAAGVFIVFSINDTTSFS

SEQ ID NO: 2983691 - protein, 17 aa, Entamoeba invadens
LYYRQSIIYGRYQTPLN

SEQ ID NO: 2983692 - protein, 22 aa, Entamoeba invadens
LYYRVLVTIACCFIKQTSRPVL

SEQ ID NO: 2983693 - protein, 18 aa, Entamoeba invadens
LYYYVVMECSAYGSLYNF

SEQ ID NO: 2983694 - protein, 17 aa, Entamoeba invadens
MAARIAISMMRMRFNLF

SEQ ID NO: 2983695 - protein, 19 aa, Entamoeba invadens
MACLKCEFSEFIELQGQII

SEQ ID NO: 2983696 - protein, 18 aa, Entamoeba invadens
MADKFGCVFYEISAKNNT

SEQ ID NO: 2983697 - protein, 18 aa, Entamoeba invadens
MALSEMKPAFGMDNNDVF

SEQ ID NO: 2983698 - protein, 20 aa, Entamoeba invadens
MASCFKIFFNCVDKKLVWKA

SEQ ID NO: 2983699 - protein, 17 aa, Entamoeba invadens
MASRLTVVLGYILCILY

SEQ ID NO: 2983700 - protein, 25 aa, Entamoeba invadens
MAVAECFRGILKVCVECNGFSKVLE

SEQ ID NO: 2983701 - protein, 18 aa, Entamoeba invadens
MCCLLNYFLMLRDRHADN

SEQ ID NO: 2983702 - protein, 19 aa, Entamoeba invadens
MCCSQCLQLKNLVLPNSIP

SEQ ID NO: 2983703 - protein, 22 aa, Entamoeba invadens
MCDYRKICLWTKMTNFEQIGKS

SEQ ID NO: 2983704 - protein, 19 aa, Entamoeba invadens
MCELFRIDLFGSIVYSILI

SEQ ID NO: 2983705 - protein, 17 aa, Entamoeba invadens
MCFDMCSSLWGFKMPMN

SEQ ID NO: 2983706 - protein, 18 aa, Entamoeba invadens
MCFKCLEGKCKFCELGMI

SEQ ID NO: 2983707 - protein, 17 aa, Entamoeba invadens
MCGCEILPPSEYYNCSV

SEQ ID NO: 2983708 - protein, 21 aa, Entamoeba invadens
MCLNESLALKADFDFQEQLIA

SEQ ID NO: 2983709 - protein, 21 aa, Entamoeba invadens
MCRRSELLLTRYAIHRLSPDV

SEQ ID NO: 2983710 - protein, 18 aa, Entamoeba invadens
MCVRLQFLYIPKGITTIG

SEQ ID NO: 2983711 - protein, 21 aa, Entamoeba invadens
MDALKKLTIVYGFNISPSSLE

SEQ ID NO: 2983712 - protein, 21 aa, Entamoeba invadens
MDCPEFFAVCIFRILDKNFEA

SEQ ID NO: 2983713 - protein, 23 aa, Entamoeba invadens
MDETRLVSVFTRIIIHRVFPYIW

SEQ ID NO: 2983714 - protein, 17 aa, Entamoeba invadens
MDIFRLVSIKLKEEAPL

SEQ ID NO: 2983715 - protein, 19 aa, Entamoeba invadens
MDIKVCYDLGQNSVEKPDV

SEQ ID NO: 2983716 - protein, 18 aa, Entamoeba invadens
MDITFEVLQKIALQTDES

SEQ ID NO: 2983717 - protein, 24 aa, Entamoeba invadens
MDKKWRFSNKFGKWVTQAQSGWME

SEQ ID NO: 2983718 - protein, 17 aa, Entamoeba invadens
MDLRNGIYFAQMMHWND

SEQ ID NO: 2983719 - protein, 24 aa, Entamoeba invadens
MDPQRFSKFLSCIANTIIAVQTTS

SEQ ID NO: 2983720 - protein, 22 aa, Entamoeba invadens
MECPEMICGLFINTVMDDFTTI

SEQ ID NO: 2983721 - protein, 22 aa, Entamoeba invadens
MEDEHYCALAFNGDEHKNFFGI

SEQ ID NO: 2983722 - protein, 18 aa, Entamoeba invadens
MEELRALIFYLMDRPYVM

SEQ ID NO: 2983723 - protein, 19 aa, Entamoeba invadens
MEELRALIFYLMDRPYVMV

SEQ ID NO: 2983724 - protein, 21 aa, Entamoeba invadens
MEEWKIPPCISNWKNKNGYTI

SEQ ID NO: 2983725 - protein, 17 aa, Entamoeba invadens
MEFVTKRCEAVVGFYLT

SEQ ID NO: 2983726 - protein, 18 aa, Entamoeba invadens
MEIHKFAVALYDFEGESR

SEQ ID NO: 2983727 - protein, 17 aa, Entamoeba invadens
MEIPNVVELPQKVIPME

SEQ ID NO: 2983728 - protein, 19 aa, Entamoeba invadens
MELCYRAICKLVNRPYVRF

SEQ ID NO: 2983729 - protein, 18 aa, Entamoeba invadens
MEQFGVRCIEPFVPYETS

SEQ ID NO: 2983730 - protein, 23 aa, Entamoeba invadens
MESRWNPDICGFVGSVAEEFNVH

SEQ ID NO: 2983731 - protein, 19 aa, Entamoeba invadens
METFKWPECFTEEMKENGF

SEQ ID NO: 2983732 - protein, 17 aa, Entamoeba invadens
MEVKMAYNYRVLLTNTN

SEQ ID NO: 2983733 - protein, 19 aa, Entamoeba invadens
MFAKLPFLISNVVEILDMP

SEQ ID NO: 2983734 - protein, 20 aa, Entamoeba invadens
MFECFGIKKHCMCVSMRERD

SEQ ID NO: 2983735 - protein, 24 aa, Entamoeba invadens
MFECFSWKDAYPITTFKFPWKIAE

SEQ ID NO: 2983736 - protein, 23 aa, Entamoeba invadens
MFERFKTPLLYFSMQPILSLFAA

SEQ ID NO: 2983737 - protein, 18 aa, Entamoeba invadens
MFGEFCFYWCDKLSAITL

SEQ ID NO: 2983738 - protein, 18 aa, Entamoeba invadens
MFHFGGTFTHIIGEKPVE

SEQ ID NO: 2983739 - protein, 22 aa, Entamoeba invadens
MFIDLCILLGCDYCETIKGIGP

SEQ ID NO: 2983740 - protein, 20 aa, Entamoeba invadens
MFKKIYTFRNVLLGAFKVRS

SEQ ID NO: 2983741 - protein, 17 aa, Entamoeba invadens
MFKPTVIGNEWSDDEEQ

SEQ ID NO: 2983742 - protein, 17 aa, Entamoeba invadens
MFLMKHCPMKVGERSRR

SEQ ID NO: 2983743 - protein, 18 aa, Entamoeba invadens
MFSCSLWYLVETVLDKMK

SEQ ID NO: 2983744 - protein, 17 aa, Entamoeba invadens
MFWRYLRMFLYLKYNIK

SEQ ID NO: 2983745 - protein, 25 aa, Entamoeba invadens
MFYHRYSKYYYIDWKTKQLFYHIGP

SEQ ID NO: 2983746 - protein, 18 aa, Entamoeba invadens
MFYRGYKFVISLKVSGVA

SEQ ID NO: 2983747 - protein, 21 aa, Entamoeba invadens
MGCDRGELYFINWNKKYTTWI

SEQ ID NO: 2983748 - protein, 17 aa, Entamoeba invadens
MGGMPGMNPYGMQQPGM

SEQ ID NO: 2983749 - protein, 19 aa, Entamoeba invadens
MGIELLWVHPFFKRRGFGK

SEQ ID NO: 2983750 - protein, 20 aa, Entamoeba invadens
MGKMRKCLPIWKEDLPNLKQ

SEQ ID NO: 2983751 - protein, 17 aa, Entamoeba invadens
MGLTKCVGVFFTHGHFD

SEQ ID NO: 2983752 - protein, 19 aa, Entamoeba invadens
MGMSLRFISVGGISVSMSN

SEQ ID NO: 2983753 - protein, 18 aa, Entamoeba invadens
MGPFSEKGFKEFGVGVIG

SEQ ID NO: 2983754 - protein, 25 aa, Entamoeba invadens
MGVGSCKLECLPIGQTVTKDVQLNT

SEQ ID NO: 2983755 - protein, 21 aa, Entamoeba invadens
MHCTVCLFESILFIGLINGKC

SEQ ID NO: 2983756 - protein, 19 aa, Entamoeba invadens
MHHLCLLRAKLVKYKKELA

SEQ ID NO: 2983757 - protein, 25 aa, Entamoeba invadens
MHKRAVELNSRFNVLFVKFIDTAQE

SEQ ID NO: 2983758 - protein, 21 aa, Entamoeba invadens
MICGGGCVEMELSLAVEEAAK

SEQ ID NO: 2983759 - protein, 18 aa, Entamoeba invadens
MIDRWLCFIQQTTQKEWE

SEQ ID NO: 2983760 - protein, 19 aa, Entamoeba invadens
MIESFLVMYKDFFFVGQSN

SEQ ID NO: 2983761 - protein, 20 aa, Entamoeba invadens
MIGHFLKYYLNQMVEPVIPY

SEQ ID NO: 2983762 - protein, 20 aa, Entamoeba invadens
MIHPRVTHELVLFIEVAIHI

SEQ ID NO: 2983763 - protein, 19 aa, Entamoeba invadens
MIIVWPFKLFIYIRLKTIY

SEQ ID NO: 2983764 - protein, 18 aa, Entamoeba invadens
MIKDRLTIINTYLTVFRP

SEQ ID NO: 2983765 - protein, 17 aa, Entamoeba invadens
MIKKNCIVFPLKKPEES

SEQ ID NO: 2983766 - protein, 20 aa, Entamoeba invadens
MIKQKRNWGMFVFQLHQQHR

SEQ ID NO: 2983767 - protein, 26 aa, Entamoeba invadens
MINFLIFYFGYDWKEVVNAPQGGNTE

SEQ ID NO: 2983768 - protein, 19 aa, Entamoeba invadens
MIRPNMRNSAYGYDQSQRF

SEQ ID NO: 2983769 - protein, 19 aa, Entamoeba invadens
MISLLKWLIQRHIEQQKRG

SEQ ID NO: 2983770 - protein, 20 aa, Entamoeba invadens
MITSFSWKPLMGVIQNEDEN

SEQ ID NO: 2983771 - protein, 18 aa, Entamoeba invadens
MKAALVGMFCYIANNSED

SEQ ID NO: 2983772 - protein, 17 aa, Entamoeba invadens
MKACAALETLACYIKFD

SEQ ID NO: 2983773 - protein, 19 aa, Entamoeba invadens
MKAKAGEVLTVIEKSVRIG

SEQ ID NO: 2983774 - protein, 18 aa, Entamoeba invadens
MKALKRVVSGGAYGDYAA

SEQ ID NO: 2983775 - protein, 19 aa, Entamoeba invadens
MKATLRFSSTVALFSQMVL

SEQ ID NO: 2983776 - protein, 18 aa, Entamoeba invadens
MKAVVAASVYQFAEILSN

SEQ ID NO: 2983777 - protein, 22 aa, Entamoeba invadens
MKDLTQFYAICFSRDSSILSIR

SEQ ID NO: 2983778 - protein, 17 aa, Entamoeba invadens
MKECKPIKFSIVNYTGN

SEQ ID NO: 2983779 - protein, 21 aa, Entamoeba invadens
MKEIKKFSARVEPELPNVKRV

SEQ ID NO: 2983780 - protein, 23 aa, Entamoeba invadens
MKEVRREKEMIGMQLEEAKNENE

SEQ ID NO: 2983781 - protein, 17 aa, Entamoeba invadens
MKFPKMIFLRKCDANMW

SEQ ID NO: 2983782 - protein, 17 aa, Entamoeba invadens
MKFPMTLYIAFKRIFDG

SEQ ID NO: 2983783 - protein, 22 aa, Entamoeba invadens
MKGGDLYSGMLLSGITKSEQTE

SEQ ID NO: 2983784 - protein, 17 aa, Entamoeba invadens
MKIALGWVVPDVFDESG

SEQ ID NO: 2983785 - protein, 17 aa, Entamoeba invadens
MKILELMDADLIKCIGA

SEQ ID NO: 2983786 - protein, 18 aa, Entamoeba invadens
MKILELMDADLIKCIGAY

SEQ ID NO: 2983787 - protein, 19 aa, Entamoeba invadens
MKITCSLAKIVIKDLEKKG

SEQ ID NO: 2983788 - protein, 19 aa, Entamoeba invadens
MKIWCFNAGHILGAAMFCL

SEQ ID NO: 2983789 - protein, 19 aa, Entamoeba invadens
MKKDKRLTVQMLQEKLLRA

SEQ ID NO: 2983790 - protein, 22 aa, Entamoeba invadens
MKKEVICVEPAIVKKSHMSRSL

SEQ ID NO: 2983791 - protein, 25 aa, Entamoeba invadens
MKKIGYSFVYKWIVLLFRRDFTPKK

SEQ ID NO: 2983792 - protein, 21 aa, Entamoeba invadens
MKKMFKLLLEYSVFAKNENVK

SEQ ID NO: 2983793 - protein, 19 aa, Entamoeba invadens
MKKNFLLKMDYFRLKLGCM

SEQ ID NO: 2983794 - protein, 19 aa, Entamoeba invadens
MKKYFGVLFMKLGSENTND

SEQ ID NO: 2983795 - protein, 17 aa, Entamoeba invadens
MKLKLYIPFVLLKDKIL

SEQ ID NO: 2983796 - protein, 20 aa, Entamoeba invadens
MKLKRYAYKVLRRENKDRTL

SEQ ID NO: 2983797 - protein, 17 aa, Entamoeba invadens
MKLVAKCYMEWQHHNIS

SEQ ID NO: 2983798 - protein, 21 aa, Entamoeba invadens
MKMGEMFGGEILYNFVMHHIG

SEQ ID NO: 2983799 - protein, 18 aa, Entamoeba invadens
MKNAISIGNRLSEYIKSL

SEQ ID NO: 2983800 - protein, 17 aa, Entamoeba invadens
MKNCNFVTVFVFGIVNS

SEQ ID NO: 2983801 - protein, 20 aa, Entamoeba invadens
MKQKDILGVIGKMWKDLSES

SEQ ID NO: 2983802 - protein, 19 aa, Entamoeba invadens
MKQKQCLSGLCDTEKLGIK

SEQ ID NO: 2983803 - protein, 24 aa, Entamoeba invadens
MKRKEEWHPYLLFCKQHREELKQE

SEQ ID NO: 2983804 - protein, 20 aa, Entamoeba invadens
MKRNRFCIIDELITTEERYV

SEQ ID NO: 2983805 - protein, 17 aa, Entamoeba invadens
MKRPWAIFEEARKKAVD

SEQ ID NO: 2983806 - protein, 17 aa, Entamoeba invadens
MKRRTSISSSFVNTKQI

SEQ ID NO: 2983807 - protein, 19 aa, Entamoeba invadens
MKRVIPVLFRIASMCYGEP

SEQ ID NO: 2983808 - protein, 25 aa, Entamoeba invadens
MKRVYKYLIYWLLNGTVCIGNFFAT

SEQ ID NO: 2983809 - protein, 18 aa, Entamoeba invadens
MKSPRKSMMFIFDSSQNA

SEQ ID NO: 2983810 - protein, 19 aa, Entamoeba invadens
MKSRSVGMIKTGRVEKQEK

SEQ ID NO: 2983811 - protein, 18 aa, Entamoeba invadens
MKTMNMCHVNVRSRKYAK

SEQ ID NO: 2983812 - protein, 17 aa, Entamoeba invadens
MKVLEIFIKEKRVNEVL

SEQ ID NO: 2983813 - protein, 18 aa, Entamoeba invadens
MKWAEWFNSVVYCAISKL

SEQ ID NO: 2983814 - protein, 20 aa, Entamoeba invadens
MKWKKKRQIGSTVMTLILLK

SEQ ID NO: 2983815 - protein, 18 aa, Entamoeba invadens
MKYAEGWETRAVITNDCV

SEQ ID NO: 2983816 - protein, 20 aa, Entamoeba invadens
MLCLPLKYYSVDQCTIEQPT

SEQ ID NO: 2983817 - protein, 20 aa, Entamoeba invadens
MLCNLPFSLVTRRHHCRKCG

SEQ ID NO: 2983818 - protein, 17 aa, Entamoeba invadens
MLFKVLFKITSKTGEVL

SEQ ID NO: 2983819 - protein, 21 aa, Entamoeba invadens
MLFSLYRMFCVKNYERNHKGT

SEQ ID NO: 2983820 - protein, 17 aa, Entamoeba invadens
MLFVIGCALPLRRHLFN

SEQ ID NO: 2983821 - protein, 20 aa, Entamoeba invadens
MLGHFRYYFDVSKDGGTGFN

SEQ ID NO: 2983822 - protein, 17 aa, Entamoeba invadens
MLGHYLGEFSITYKPVT

SEQ ID NO: 2983823 - protein, 18 aa, Entamoeba invadens
MLGYCGMPKTEIHDDNYN

SEQ ID NO: 2983824 - protein, 20 aa, Entamoeba invadens
MLIMLKRYLDYIIDIVRPRK

SEQ ID NO: 2983825 - protein, 19 aa, Entamoeba invadens
MLKQFAIDGLNHWGSDSKG

SEQ ID NO: 2983826 - protein, 30 aa, Entamoeba invadens
MLKRVAENPLFLFKKCYQENSFDRYNEWVV

SEQ ID NO: 2983827 - protein, 17 aa, Entamoeba invadens
MLLCSYVLPQYGSIEEN

SEQ ID NO: 2983828 - protein, 17 aa, Entamoeba invadens
MLLHGLMYWKHRPNVEF

SEQ ID NO: 2983829 - protein, 18 aa, Entamoeba invadens
MLLKRCWNDFTWNGDFHS

SEQ ID NO: 2983830 - protein, 18 aa, Entamoeba invadens
MLNCIILNLFMEGKTTRE

SEQ ID NO: 2983831 - protein, 18 aa, Entamoeba invadens
MLNCILLNLFMEGQTTRE

SEQ ID NO: 2983832 - protein, 19 aa, Entamoeba invadens
MMCLYDIIKRYSLGNSFIF

SEQ ID NO: 2983833 - protein, 18 aa, Entamoeba invadens
MMFKNCVKLKHIFGMENV

SEQ ID NO: 2983834 - protein, 17 aa, Entamoeba invadens
MMGCIKYLMGKDVDALQ

SEQ ID NO: 2983835 - protein, 17 aa, Entamoeba invadens
MMGRPGLKIKLTLDKIK

SEQ ID NO: 2983836 - protein, 24 aa, Entamoeba invadens
MMIYGVVCAILYSRIRKIQSDITS

SEQ ID NO: 2983837 - protein, 18 aa, Entamoeba invadens
MMYKRPFDGLSHLEHYIN

SEQ ID NO: 2983838 - protein, 23 aa, Entamoeba invadens
MNALWCLFVMLLIGVSSEKCEAG

SEQ ID NO: 2983839 - protein, 18 aa, Entamoeba invadens
MNEVLTLLNDCVVSLCQN

SEQ ID NO: 2983840 - protein, 22 aa, Entamoeba invadens
MNFFKINICFGQWKEEEIPKET

SEQ ID NO: 2983841 - protein, 18 aa, Entamoeba invadens
MNFICSFSVYANFTPPKE

SEQ ID NO: 2983842 - protein, 18 aa, Entamoeba invadens
MNFIRIWMKNAWKDFEAK

SEQ ID NO: 2983843 - protein, 25 aa, Entamoeba invadens
MNGKMAGKIAVEWDSVCAAITCNEI

SEQ ID NO: 2983844 - protein, 24 aa, Entamoeba invadens
MNIKCSFCGAFHFKAEKSKNGSFR

SEQ ID NO: 2983845 - protein, 18 aa, Entamoeba invadens
MNMAFGFYVECLKKLDEE

SEQ ID NO: 2983846 - protein, 20 aa, Entamoeba invadens
MNMPCVWELIPLLLAGNGMR

SEQ ID NO: 2983847 - protein, 18 aa, Entamoeba invadens
MNQYGAMGGMPGQQMGAM

SEQ ID NO: 2983848 - protein, 24 aa, Entamoeba invadens
MNTNICYWEYLALIQKYYTFDKKP

SEQ ID NO: 2983849 - protein, 17 aa, Entamoeba invadens
MNVQIPWGLEKALKYLF

SEQ ID NO: 2983850 - protein, 17 aa, Entamoeba invadens
MPAYCRLPLGIYVTTHR

SEQ ID NO: 2983851 - protein, 26 aa, Entamoeba invadens
MPELSVRVKLCLDIAKGLNFIHKNNV

SEQ ID NO: 2983852 - protein, 18 aa, Entamoeba invadens
MPGMPIDYSARVSLTRFH

SEQ ID NO: 2983853 - protein, 17 aa, Entamoeba invadens
MPGSVKVLREWTFAGCV

SEQ ID NO: 2983854 - protein, 18 aa, Entamoeba invadens
MPIRGCSFLTGQIDVRTT

SEQ ID NO: 2983855 - protein, 19 aa, Entamoeba invadens
MPNSLKIVEGFAFVGCENL

SEQ ID NO: 2983856 - protein, 19 aa, Entamoeba invadens
MPQRSVLRVNRLVQKGQKQ

SEQ ID NO: 2983857 - protein, 25 aa, Entamoeba invadens
MPRAICPNCFMDLQFIQDALTVTTL

SEQ ID NO: 2983858 - protein, 18 aa, Entamoeba invadens
MPSYRSNGIVPMIRPNMR

SEQ ID NO: 2983859 - protein, 21 aa, Entamoeba invadens
MPTIGACYFRYSVQIPNYKCT

SEQ ID NO: 2983860 - protein, 22 aa, Entamoeba invadens
MRCGTPFSLFFRKHHCRNCGKV

SEQ ID NO: 2983861 - protein, 22 aa, Entamoeba invadens
MRDYMKASSFSLVSAKYTAGEF

SEQ ID NO: 2983862 - protein, 17 aa, Entamoeba invadens
MRIAYELSDKLKMNVFI

SEQ ID NO: 2983863 - protein, 17 aa, Entamoeba invadens
MRIITCSNIGLYDHMND

SEQ ID NO: 2983864 - protein, 17 aa, Entamoeba invadens
MRISNEVFLKIDHIKVQ

SEQ ID NO: 2983865 - protein, 23 aa, Entamoeba invadens
MRMKKCCAAPMAPRMAAPMMMCD

SEQ ID NO: 2983866 - protein, 18 aa, Entamoeba invadens
MRPKRSYRAMVFTSESEE

SEQ ID NO: 2983867 - protein, 20 aa, Entamoeba invadens
MRRFASIFVIIGFDEDENEL

SEQ ID NO: 2983868 - protein, 17 aa, Entamoeba invadens
MRRMRGHMFEPFPGHPP

SEQ ID NO: 2983869 - protein, 17 aa, Entamoeba invadens
MRTARLCEGTLFTDDYP

SEQ ID NO: 2983870 - protein, 31 aa, Entamoeba invadens
MRTKCAMCTAIRYCNYCTFTSETCRECIDGA

SEQ ID NO: 2983871 - protein, 17 aa, Entamoeba invadens
MRTKLGERIFLFHNESF

SEQ ID NO: 2983872 - protein, 17 aa, Entamoeba invadens
MRTKYGWVFDEFCEDCN

SEQ ID NO: 2983873 - protein, 18 aa, Entamoeba invadens
MRTLCVHLGYLSGTGAHM

SEQ ID NO: 2983874 - protein, 17 aa, Entamoeba invadens
MRVPFNSVFAMKGKLKE

SEQ ID NO: 2983875 - protein, 17 aa, Entamoeba invadens
MRVYTGIMLNHLDDEEI

SEQ ID NO: 2983876 - protein, 19 aa, Entamoeba invadens
MSAAPRFGFVTIRTSHGKF

SEQ ID NO: 2983877 - protein, 20 aa, Entamoeba invadens
MSAFGFKKKRIDGVDYFFNA

SEQ ID NO: 2983878 - protein, 17 aa, Entamoeba invadens
MSCYKCHSFFCWVCMQV

SEQ ID NO: 2983879 - protein, 17 aa, Entamoeba invadens
MSCYKCQSFFCWVCMQI

SEQ ID NO: 2983880 - protein, 25 aa, Entamoeba invadens
MSDSRFNFTFSHFKPISSVLAKSDK

SEQ ID NO: 2983881 - protein, 17 aa, Entamoeba invadens
MSECLVVCLAEGMNDDK

SEQ ID NO: 2983882 - protein, 19 aa, Entamoeba invadens
MSFVIAFLLYKGVIVRELT

SEQ ID NO: 2983883 - protein, 17 aa, Entamoeba invadens
MSHLFAVFLCPRYNADT

SEQ ID NO: 2983884 - protein, 23 aa, Entamoeba invadens
MSIKRLEKLSGLLLSSNQFSTFP

SEQ ID NO: 2983885 - protein, 18 aa, Entamoeba invadens
MSKSWAEFNEEFKQLEKA

SEQ ID NO: 2983886 - protein, 17 aa, Entamoeba invadens
MSNEAAWVIASSIRDIA

SEQ ID NO: 2983887 - protein, 20 aa, Entamoeba invadens
MSPMDAFLCVRGMKTLPLRM

SEQ ID NO: 2983888 - protein, 17 aa, Entamoeba invadens
MSRQCVLLLPGHEHYVM

SEQ ID NO: 2983889 - protein, 19 aa, Entamoeba invadens
MSVDLCGPGVLTSQKVMYP

SEQ ID NO: 2983890 - protein, 23 aa, Entamoeba invadens
MTCANCGYQFCWLCMAPYTSNHF

SEQ ID NO: 2983891 - protein, 17 aa, Entamoeba invadens
MTERFELFILKREIANA

SEQ ID NO: 2983892 - protein, 24 aa, Entamoeba invadens
MTFKEFFNGAAIERGRLKDSLHNH

SEQ ID NO: 2983893 - protein, 24 aa, Entamoeba invadens
MTKPWYLRFEYWKLILPLTRSIGE

SEQ ID NO: 2983894 - protein, 23 aa, Entamoeba invadens
MTKVMRATENWKRRVSGKEEILF

SEQ ID NO: 2983895 - protein, 17 aa, Entamoeba invadens
MTLLWVFFLRQACLKNW

SEQ ID NO: 2983896 - protein, 25 aa, Entamoeba invadens
MTLNLRFSLTFLRMLLGKRTEVEDL

SEQ ID NO: 2983897 - protein, 22 aa, Entamoeba invadens
MTMADCLSSLFAKSVREDIMDQ

SEQ ID NO: 2983898 - protein, 25 aa, Entamoeba invadens
MTMFRKSRVFKLAGSNGFDYCDSTT

SEQ ID NO: 2983899 - protein, 17 aa, Entamoeba invadens
MTRRKGVLDGMGLPGKL

SEQ ID NO: 2983900 - protein, 26 aa, Entamoeba invadens
MTVDEFPRPLAISRLVKGAFIIQKKL

SEQ ID NO: 2983901 - protein, 22 aa, Entamoeba invadens
MTVEKSLKCVARFADLNLGIAI

SEQ ID NO: 2983902 - protein, 17 aa, Entamoeba invadens
MTVKITNEWLVGKEDDE

SEQ ID NO: 2983903 - protein, 17 aa, Entamoeba invadens
MTYYARISCRSFLRQTL

SEQ ID NO: 2983904 - protein, 23 aa, Entamoeba invadens
MVCIRWMMGAMFLIKACKPLIEK

SEQ ID NO: 2983905 - protein, 18 aa, Entamoeba invadens
MVIERKGKSLLLVNDFFK

SEQ ID NO: 2983906 - protein, 22 aa, Entamoeba invadens
MVIQCVIKFGGLKTDQEKEKFL

SEQ ID NO: 2983907 - protein, 25 aa, Entamoeba invadens
MVKDMKNGCCYRADHILKTFYEKQM

SEQ ID NO: 2983908 - protein, 22 aa, Entamoeba invadens
MVKSARGKIEWNEDVEEYVNKL

SEQ ID NO: 2983909 - protein, 20 aa, Entamoeba invadens
MVMCLCCKQWLCSQNCVEIH

SEQ ID NO: 2983910 - protein, 18 aa, Entamoeba invadens
MVPFSEKGFKEFGVGVIG

SEQ ID NO: 2983911 - protein, 24 aa, Entamoeba invadens
MVRVSGKMYMKWRVIDKSPDALNS

SEQ ID NO: 2983912 - protein, 18 aa, Entamoeba invadens
MWMFVKFSFTKPDNVDDF

SEQ ID NO: 2983913 - protein, 19 aa, Entamoeba invadens
MWYDAVIDYGRINWTILRD

SEQ ID NO: 2983914 - protein, 29 aa, Entamoeba invadens
MYEPMLAYHCYEFAFQFGVKTDEVNYKKT

SEQ ID NO: 2983915 - protein, 17 aa, Entamoeba invadens
MYGCRVIQKIVEYSSSE

SEQ ID NO: 2983916 - protein, 20 aa, Entamoeba invadens
MYIEGLKFLIPMNAETMKKD

SEQ ID NO: 2983917 - protein, 23 aa, Entamoeba invadens
MYKDGFCFRLFPIDFVRFNIVSK

SEQ ID NO: 2983918 - protein, 19 aa, Entamoeba invadens
MYNSIRFVWNTPILILEKI

SEQ ID NO: 2983919 - protein, 17 aa, Entamoeba invadens
MYPDGIYDYNILKEDYI

SEQ ID NO: 2983920 - protein, 17 aa, Entamoeba invadens
MYPVICGPMYIIPQQQT

SEQ ID NO: 2983921 - protein, 20 aa, Entamoeba invadens
MYQTFKWKEPYPINVFEHSW

SEQ ID NO: 2983922 - protein, 19 aa, Entamoeba invadens
MYVVYCYYSTYLLSCNASV

SEQ ID NO: 2983923 - protein, 19 aa, Entamoeba invadens
NADLRLVDFAVFYELSASF

SEQ ID NO: 2983924 - protein, 18 aa, Entamoeba invadens
NAEFKRLTLLMTNLPNKR

SEQ ID NO: 2983925 - protein, 18 aa, Entamoeba invadens
NAFCSFTFEKPAKKSKVT

SEQ ID NO: 2983926 - protein, 21 aa, Entamoeba invadens
NAFLRSSLRAVYAPSGIPVVG

SEQ ID NO: 2983927 - protein, 17 aa, Entamoeba invadens
NAIDFLLSRKIDRFIKY

SEQ ID NO: 2983928 - protein, 21 aa, Entamoeba invadens
NAIKYKPGWARGYSRKAFALV

SEQ ID NO: 2983929 - protein, 24 aa, Entamoeba invadens
NAKLEHIGAFCFFNCTNLLDINKI

SEQ ID NO: 2983930 - protein, 17 aa, Entamoeba invadens
NAKRLNVAITRARNNLI

SEQ ID NO: 2983931 - protein, 25 aa, Entamoeba invadens
NALKSSLCYKKFLGVVISLGNYMNG

SEQ ID NO: 2983932 - protein, 20 aa, Entamoeba invadens
NALNGALCGIELLTGTHYLP

SEQ ID NO: 2983933 - protein, 17 aa, Entamoeba invadens
NALRFYPIVPMADSDLT

SEQ ID NO: 2983934 - protein, 22 aa, Entamoeba invadens
NAMCCFCFSAPFHAQFMTRGQI

SEQ ID NO: 2983935 - protein, 20 aa, Entamoeba invadens
NARGALICVTEYGAIFRKGG

SEQ ID NO: 2983936 - protein, 21 aa, Entamoeba invadens
NARISIPPQFRRKSSHKLMRQ

SEQ ID NO: 2983937 - protein, 17 aa, Entamoeba invadens
NASRLAELPSWMGKYSM

SEQ ID NO: 2983938 - protein, 17 aa, Entamoeba invadens
NAYRIDHILGFFRIWSI

SEQ ID NO: 2983939 - protein, 21 aa, Entamoeba invadens
NCCKLKCICLPQQISNLASCV

SEQ ID NO: 2983940 - protein, 20 aa, Entamoeba invadens
NCFEVAYFVFCCNLNLSLQQ

SEQ ID NO: 2983941 - protein, 19 aa, Entamoeba invadens
NCFLFTLKVDGKVQFQKFE

SEQ ID NO: 2983942 - protein, 17 aa, Entamoeba invadens
NCFRECPHLSSITLSSN

SEQ ID NO: 2983943 - protein, 19 aa, Entamoeba invadens
NCFSCCPKLSSITYQQDTE

SEQ ID NO: 2983944 - protein, 21 aa, Entamoeba invadens
NCGIGSLLLRMAINAAIEVYG

SEQ ID NO: 2983945 - protein, 19 aa, Entamoeba invadens
NCKLCGKPFSFPKMEFKIY

SEQ ID NO: 2983946 - protein, 23 aa, Entamoeba invadens
NCKYGDDCVFDFLSDLDSNSVVY

SEQ ID NO: 2983947 - protein, 19 aa, Entamoeba invadens
NCLFFIAIQIWRGIPAQIK

SEQ ID NO: 2983948 - protein, 20 aa, Entamoeba invadens
NCPKCAAALSISRLSEAEGQ

SEQ ID NO: 2983949 - protein, 17 aa, Entamoeba invadens
NCRCMIELQSLRQNNDF

SEQ ID NO: 2983950 - protein, 18 aa, Entamoeba invadens
NCSICGQLGHTHENCICI

SEQ ID NO: 2983951 - protein, 20 aa, Entamoeba invadens
NCSKGKITVSKKCGMERVCD

SEQ ID NO: 2983952 - protein, 21 aa, Entamoeba invadens
NDAFKCPVCGLYFKELKRHTE

SEQ ID NO: 2983953 - protein, 23 aa, Entamoeba invadens
NDDAVCFCILYGLARRLVKYQKI

SEQ ID NO: 2983954 - protein, 27 aa, Entamoeba invadens
NDDFRLKLLLSHLCKFFSFHTRQKLQF

SEQ ID NO: 2983955 - protein, 24 aa, Entamoeba invadens
NDDKFRVGISFGKDGVHLYTETFK

SEQ ID NO: 2983956 - protein, 18 aa, Entamoeba invadens
NDELKVLPLWGVNPDDPT

SEQ ID NO: 2983957 - protein, 18 aa, Entamoeba invadens
NDGCLRLSNIYFDDIFSN

SEQ ID NO: 2983958 - protein, 22 aa, Entamoeba invadens
NDGKGFLALCHAYTKLTGENTF

SEQ ID NO: 2983959 - protein, 19 aa, Entamoeba invadens
NDHCFRECYNLSSVKIPSS

SEQ ID NO: 2983960 - protein, 21 aa, Entamoeba invadens
NDKICISDGFLVVYSITDSSS

SEQ ID NO: 2983961 - protein, 23 aa, Entamoeba invadens
NDLKISESLGFILEKFTPVNENE

SEQ ID NO: 2983962 - protein, 22 aa, Entamoeba invadens
NDMCISFAKGPFVKQRNLSLFK

SEQ ID NO: 2983963 - protein, 20 aa, Entamoeba invadens
NDMFLVLACDGVWDVLSNEC

SEQ ID NO: 2983964 - protein, 23 aa, Entamoeba invadens
NDPIWMCMDGFKLWINMSECIEI

SEQ ID NO: 2983965 - protein, 18 aa, Entamoeba invadens
NDSPMCWAATSANIIDWY

SEQ ID NO: 2983966 - protein, 23 aa, Entamoeba invadens
NDYKIAMNVLRYFVDFTALNNVC

SEQ ID NO: 2983967 - protein, 22 aa, Entamoeba invadens
NECKTCVLCGGIFSMGNRKRHC

SEQ ID NO: 2983968 - protein, 22 aa, Entamoeba invadens
NECVKPRGIICLSDKSEFELLP

SEQ ID NO: 2983969 - protein, 18 aa, Entamoeba invadens
NECYRLNGEIEKHKKQIE

SEQ ID NO: 2983970 - protein, 27 aa, Entamoeba invadens
NEDGWYKEKVEMFDFLDDVKRFEGVYK

SEQ ID NO: 2983971 - protein, 23 aa, Entamoeba invadens
NEESRISGNFSRDYVDNGEKLCS

SEQ ID NO: 2983972 - protein, 26 aa, Entamoeba invadens
NEFIELFKTLPLCVLLSLSLGNFFLC

SEQ ID NO: 2983973 - protein, 17 aa, Entamoeba invadens
NEFKAIFSMCDGCSLFH

SEQ ID NO: 2983974 - protein, 23 aa, Entamoeba invadens
NEGLLSIGNYCFKNCTSLTEVEL

SEQ ID NO: 2983975 - protein, 23 aa, Entamoeba invadens
NEICLKNSFALREKWIAAKPERA

SEQ ID NO: 2983976 - protein, 17 aa, Entamoeba invadens
NEIKDFLFDIGMLVSDG

SEQ ID NO: 2983977 - protein, 23 aa, Entamoeba invadens
NEIKSNCFVFFKLVKNNFKSNKM

SEQ ID NO: 2983978 - protein, 22 aa, Entamoeba invadens
NEILETFPSYYYRDVYYGKNDC

SEQ ID NO: 2983979 - protein, 17 aa, Entamoeba invadens
NEKVCGRKNLLIVAVSG

SEQ ID NO: 2983980 - protein, 26 aa, Entamoeba invadens
NELGLCFICGEFGHPAFRCPLKKSEE

SEQ ID NO: 2983981 - protein, 23 aa, Entamoeba invadens
NELKRLNELYGPLLQEKNEKDKQ

SEQ ID NO: 2983982 - protein, 22 aa, Entamoeba invadens
NELLETIPLLGYVTKKSVKSNE

SEQ ID NO: 2983983 - protein, 17 aa, Entamoeba invadens
NELPLFFGTVTFSLPQM

SEQ ID NO: 2983984 - protein, 21 aa, Entamoeba invadens
NELRFSKKLNFVGKGVFLKCS

SEQ ID NO: 2983985 - protein, 20 aa, Entamoeba invadens
NELVCTLFLLAQVFLDGNVI

SEQ ID NO: 2983986 - protein, 18 aa, Entamoeba invadens
NELYQRFVTSFGVDHVFL

SEQ ID NO: 2983987 - protein, 17 aa, Entamoeba invadens
NEMKLEWTPIAYNNPDV

SEQ ID NO: 2983988 - protein, 17 aa, Entamoeba invadens
NEMSRLLFVKKSVVDDL

SEQ ID NO: 2983989 - protein, 21 aa, Entamoeba invadens
NENAFKIISEWEEDKNVMDML

SEQ ID NO: 2983990 - protein, 24 aa, Entamoeba invadens
NENVKVCGRRSCLSNIFISCNGIG

SEQ ID NO: 2983991 - protein, 20 aa, Entamoeba invadens
NEPALRITFVNSFTNSDESE

SEQ ID NO: 2983992 - protein, 24 aa, Entamoeba invadens
NEPFPDFFIVGGFEEMCYSVNFMG

SEQ ID NO: 2983993 - protein, 22 aa, Entamoeba invadens
NERMKFGLIYTWNSWHANEKGR

SEQ ID NO: 2983994 - protein, 18 aa, Entamoeba invadens
NESWECFDIEKVLSEMEE

SEQ ID NO: 2983995 - protein, 21 aa, Entamoeba invadens
NETRVAWKFAVQHKTGPTLLI

SEQ ID NO: 2983996 - protein, 17 aa, Entamoeba invadens
NEVLKFLNVLELGSDID

SEQ ID NO: 2983997 - protein, 19 aa, Entamoeba invadens
NEWFCCYIAAVKRNIWKRL

SEQ ID NO: 2983998 - protein, 19 aa, Entamoeba invadens
NEYCTRFGISKAPIKELEK

SEQ ID NO: 2983999 - protein, 17 aa, Entamoeba invadens
NEYLIGIEKCWLYENRV

SEQ ID NO: 2984000 - protein, 18 aa, Entamoeba invadens
NFAKSVFKKDCQLSITLK

SEQ ID NO: 2984001 - protein, 21 aa, Entamoeba invadens
NFCERRRGTVFVGYTADDVKN

SEQ ID NO: 2984002 - protein, 27 aa, Entamoeba invadens
NFCSYYELIELPTLFRSNFIEICSAMQ

SEQ ID NO: 2984003 - protein, 19 aa, Entamoeba invadens
NFELFWKLHEFFIQYFDYF

SEQ ID NO: 2984004 - protein, 18 aa, Entamoeba invadens
NFESCVVTGFGFRPKPIL

SEQ ID NO: 2984005 - protein, 22 aa, Entamoeba invadens
NFFCSLRFAHYLAQYGSTLLGT

SEQ ID NO: 2984006 - protein, 22 aa, Entamoeba invadens
NFFCSLRLAHYLAQCGSTLLGT

SEQ ID NO: 2984007 - protein, 22 aa, Entamoeba invadens
NFFCSLRLAHYLAQCGSTLLVI

SEQ ID NO: 2984008 - protein, 20 aa, Entamoeba invadens
NFFCSLRLAHYLAQYGSTLL

SEQ ID NO: 2984009 - protein, 24 aa, Entamoeba invadens
NFFCSLRLVHYLAQYGSTLLGTVR

SEQ ID NO: 2984010 - protein, 19 aa, Entamoeba invadens
NFGHIRGCSMIDIHETEFV

SEQ ID NO: 2984011 - protein, 23 aa, Entamoeba invadens
NFIPTVVIALVFYYLYPEESVEF

SEQ ID NO: 2984012 - protein, 25 aa, Entamoeba invadens
NFIWIDSIWKWKEVCVSTPEEHQKY

SEQ ID NO: 2984013 - protein, 18 aa, Entamoeba invadens
NFKEFKEQFTLIIDDLMS

SEQ ID NO: 2984014 - protein, 19 aa, Entamoeba invadens
NFKKFGLLHFLVFYYDQDW

SEQ ID NO: 2984015 - protein, 20 aa, Entamoeba invadens
NFKLPYFLKTWLRFIHLCGS

SEQ ID NO: 2984016 - protein, 18 aa, Entamoeba invadens
NFLKNCTEKVVLKNINDK

SEQ ID NO: 2984017 - protein, 25 aa, Entamoeba invadens
NFLLKCPDLFRLASHFVNLPNFQFS

SEQ ID NO: 2984018 - protein, 20 aa, Entamoeba invadens
NFLYRVALVFDKRNIRMDGC

SEQ ID NO: 2984019 - protein, 20 aa, Entamoeba invadens
NFPLFCLISQPVLSLLSTGK

SEQ ID NO: 2984020 - protein, 25 aa, Entamoeba invadens
NFPREEIPTLLGLIASLYKENCKLK

SEQ ID NO: 2984021 - protein, 25 aa, Entamoeba invadens
NFRKESVCFMALQVIERLRNQIDER

SEQ ID NO: 2984022 - protein, 22 aa, Entamoeba invadens
NFTPTLFCCAYFIALDPSINAL

SEQ ID NO: 2984023 - protein, 21 aa, Entamoeba invadens
NGCPCNIEFFDVIRRCQKNGL

SEQ ID NO: 2984024 - protein, 17 aa, Entamoeba invadens
NGDYCCFDFESWNIESK

SEQ ID NO: 2984025 - protein, 17 aa, Entamoeba invadens
NGFHYKVRIVENMVDDK

SEQ ID NO: 2984026 - protein, 18 aa, Entamoeba invadens
NGGFSFGGSDAFDIFNMM

SEQ ID NO: 2984027 - protein, 18 aa, Entamoeba invadens
NGGRSCWGVELKDEFCGM

SEQ ID NO: 2984028 - protein, 21 aa, Entamoeba invadens
NGICVSLKLANPDFEDTTLSV

SEQ ID NO: 2984029 - protein, 23 aa, Entamoeba invadens
NGKRFKPCFVCGKLGHNTNKCPQ

SEQ ID NO: 2984030 - protein, 23 aa, Entamoeba invadens
NGKRLFSKFLYIFIQMCKTTQIG

SEQ ID NO: 2984031 - protein, 22 aa, Entamoeba invadens
NGLKDLIVYIGIDYTASNSRAS

SEQ ID NO: 2984032 - protein, 17 aa, Entamoeba invadens
NGLNIFSKYAWELKKTK

SEQ ID NO: 2984033 - protein, 26 aa, Entamoeba invadens
NGMYIRARWDKGLCVIDSEFLLFNKT

SEQ ID NO: 2984034 - protein, 19 aa, Entamoeba invadens
NGRLAICKVLKTLTGSNMD

SEQ ID NO: 2984035 - protein, 18 aa, Entamoeba invadens
NGSLSFKGKFDGSVESIQ

SEQ ID NO: 2984036 - protein, 17 aa, Entamoeba invadens
NGTCFPKRFVATRICVL

SEQ ID NO: 2984037 - protein, 18 aa, Entamoeba invadens
NGTKRLPLVFVVTNITPG

SEQ ID NO: 2984038 - protein, 22 aa, Entamoeba invadens
NGVDFVHRFGRDMGDQPPYNTE

SEQ ID NO: 2984039 - protein, 24 aa, Entamoeba invadens
NGVKECFRQLGGFTFYQRFYAKWG

SEQ ID NO: 2984040 - protein, 18 aa, Entamoeba invadens
NHKYFGIVRMYGDVQLSQ

SEQ ID NO: 2984041 - protein, 23 aa, Entamoeba invadens
NIEIFCVYSAFTIDKHSKMEWYE

SEQ ID NO: 2984042 - protein, 22 aa, Entamoeba invadens
NIFGPCVYWKDYSIKSINDVRC

SEQ ID NO: 2984043 - protein, 17 aa, Entamoeba invadens
NIGKSIKSEGIIRINDN

SEQ ID NO: 2984044 - protein, 18 aa, Entamoeba invadens
NIIKGLCCNEVNMGVIRD

SEQ ID NO: 2984045 - protein, 20 aa, Entamoeba invadens
NIKFRYGCFEEITMGNAENI

SEQ ID NO: 2984046 - protein, 18 aa, Entamoeba invadens
NIKLKNCQNIEIMVLSGV

SEQ ID NO: 2984047 - protein, 17 aa, Entamoeba invadens
NILRLFGVKIFCFEELT

SEQ ID NO: 2984048 - protein, 17 aa, Entamoeba invadens
NILRLLESISLYDKRND

SEQ ID NO: 2984049 - protein, 21 aa, Entamoeba invadens
NILWLLIRFLRKVTDNTELTQ

SEQ ID NO: 2984050 - protein, 17 aa, Entamoeba invadens
NINFLFVFFPRLNTLTG

SEQ ID NO: 2984051 - protein, 17 aa, Entamoeba invadens
NINTRYGYVISIKDKTA

SEQ ID NO: 2984052 - protein, 24 aa, Entamoeba invadens
NINVSLCALGTVIAAIANKEGHVP

SEQ ID NO: 2984053 - protein, 18 aa, Entamoeba invadens
NIPKCAFFVFCDECVFGF

SEQ ID NO: 2984054 - protein, 22 aa, Entamoeba invadens
NISRCFGDLFILLPDDLETLYI

SEQ ID NO: 2984055 - protein, 19 aa, Entamoeba invadens
NISVCLGLSVLVSKTDLQA

SEQ ID NO: 2984056 - protein, 17 aa, Entamoeba invadens
NITLCFFYANSFRIQKD

SEQ ID NO: 2984057 - protein, 18 aa, Entamoeba invadens
NIYCCLCAGKAKLQEDKK

SEQ ID NO: 2984058 - protein, 19 aa, Entamoeba invadens
NIYGEGIGTVFTKLSYFLK

SEQ ID NO: 2984059 - protein, 20 aa, Entamoeba invadens
NKCLDCFCCVGGDSIQHATQ

SEQ ID NO: 2984060 - protein, 18 aa, Entamoeba invadens
NKCYICGEYGHLKTQCPM

SEQ ID NO: 2984061 - protein, 17 aa, Entamoeba invadens
NKEFCATLVRLPCVVET

SEQ ID NO: 2984062 - protein, 20 aa, Entamoeba invadens
NKEFPFGVVVNVEKKDVAEQ

SEQ ID NO: 2984063 - protein, 21 aa, Entamoeba invadens
NKFCFYNCYALSSVVISESVK

SEQ ID NO: 2984064 - protein, 25 aa, Entamoeba invadens
NKFIELFRTLPLCVYLSLPLGNFFL

SEQ ID NO: 2984065 - protein, 21 aa, Entamoeba invadens
NKFNRWSSVFYSRMSEESPLS

SEQ ID NO: 2984066 - protein, 19 aa, Entamoeba invadens
NKFYVCYRLEPLTQASEKS

SEQ ID NO: 2984067 - protein, 24 aa, Entamoeba invadens
NKGITGKVFLEWYKKSVTKYCGDI

SEQ ID NO: 2984068 - protein, 17 aa, Entamoeba invadens
NKIKVFGARAFAGCRLL

SEQ ID NO: 2984069 - protein, 21 aa, Entamoeba invadens
NKIMCCIPCKSTLGDKMYFMA

SEQ ID NO: 2984070 - protein, 20 aa, Entamoeba invadens
NKIRGCSYCYGFAGVDEFLK

SEQ ID NO: 2984071 - protein, 18 aa, Entamoeba invadens
NKISDEWITIGLRDYLAE

SEQ ID NO: 2984072 - protein, 22 aa, Entamoeba invadens
NKKCKRFAMTLSRTLNAEIFKI

SEQ ID NO: 2984073 - protein, 23 aa, Entamoeba invadens
NKKCSSCLSGLYINPFIDVSVQS

SEQ ID NO: 2984074 - protein, 18 aa, Entamoeba invadens
NKKCWPKDCRMRLMKHDV

SEQ ID NO: 2984075 - protein, 22 aa, Entamoeba invadens
NKKDDFAGLSFETEIGDIKKQQ

SEQ ID NO: 2984076 - protein, 17 aa, Entamoeba invadens
NKKFYLALRRLRDTHQL

SEQ ID NO: 2984077 - protein, 21 aa, Entamoeba invadens
NKKGTICFVVLGTKEITEYPT

SEQ ID NO: 2984078 - protein, 19 aa, Entamoeba invadens
NKKLLAFYMNMFYEFCTMS

SEQ ID NO: 2984079 - protein, 22 aa, Entamoeba invadens
NKKNEIEAILALTNNQLENNEK

SEQ ID NO: 2984080 - protein, 18 aa, Entamoeba invadens
NKKRCCRGLYGSLNHNIK

SEQ ID NO: 2984081 - protein, 18 aa, Entamoeba invadens
NKKVFKDQAIWMLNAVWP

SEQ ID NO: 2984082 - protein, 26 aa, Entamoeba invadens
NKLKAWRHSLPYKRVVISPFYSSINY

SEQ ID NO: 2984083 - protein, 17 aa, Entamoeba invadens
NKLPGGPFINGKIVCSE

SEQ ID NO: 2984084 - protein, 19 aa, Entamoeba invadens
NKMFFKIIVWYPVTFKVSK

SEQ ID NO: 2984085 - protein, 23 aa, Entamoeba invadens
NKMPKRILLLWKRGEALIWTEEV

SEQ ID NO: 2984086 - protein, 20 aa, Entamoeba invadens
NKMTCSICKEKFDISEDGNF

SEQ ID NO: 2984087 - protein, 18 aa, Entamoeba invadens
NKMWASPLIIFEKFNQLA

SEQ ID NO: 2984088 - protein, 21 aa, Entamoeba invadens
NKNCLWYIFDYLNLVVKHNEV

SEQ ID NO: 2984089 - protein, 23 aa, Entamoeba invadens
NKNEPFMSWGCLTTPATSSTETK

SEQ ID NO: 2984090 - protein, 19 aa, Entamoeba invadens
NKQCLLCQCLFLNKIPIKD

SEQ ID NO: 2984091 - protein, 20 aa, Entamoeba invadens
NKRARWILDLLKTDEKEKKT

SEQ ID NO: 2984092 - protein, 17 aa, Entamoeba invadens
NKRATVFEQFMTIEKMW

SEQ ID NO: 2984093 - protein, 19 aa, Entamoeba invadens
NKRTIACFGGFGKEVGKFC

SEQ ID NO: 2984094 - protein, 21 aa, Entamoeba invadens
NKRVFPVVVCHLSQIGNDVNL

SEQ ID NO: 2984095 - protein, 22 aa, Entamoeba invadens
NKRVFPVVVCHLSQIKINTNLP

SEQ ID NO: 2984096 - protein, 25 aa, Entamoeba invadens
NKRVMELGCGQALPSILLKLNGATV

SEQ ID NO: 2984097 - protein, 18 aa, Entamoeba invadens
NKVFPCGLIQLSIDQQTI

SEQ ID NO: 2984098 - protein, 20 aa, Entamoeba invadens
NKVGVLIIRRIEVITQSHVD

SEQ ID NO: 2984099 - protein, 18 aa, Entamoeba invadens
NKYTRLFTILGMKSAFTK

SEQ ID NO: 2984100 - protein, 24 aa, Entamoeba invadens
NLDEFTVDFIIDFERIFDNDITTW

SEQ ID NO: 2984101 - protein, 21 aa, Entamoeba invadens
NLDNLKTLFIYQGNRLTFSKK

SEQ ID NO: 2984102 - protein, 18 aa, Entamoeba invadens
NLERLVCHYNYITILPLS

SEQ ID NO: 2984103 - protein, 19 aa, Entamoeba invadens
NLFDPFGVVLKFYVIENGG

SEQ ID NO: 2984104 - protein, 19 aa, Entamoeba invadens
NLFEVCLTFTLSGDNRTKI

SEQ ID NO: 2984105 - protein, 17 aa, Entamoeba invadens
NLFNMFGGMGMPQGGMP

SEQ ID NO: 2984106 - protein, 19 aa, Entamoeba invadens
NLIIRAGIYQDFWENTVNL

SEQ ID NO: 2984107 - protein, 20 aa, Entamoeba invadens
NLKAACYMKSILDANNIIYE

SEQ ID NO: 2984108 - protein, 22 aa, Entamoeba invadens
NLKLKSVIILPQLMDEYYPRFK

SEQ ID NO: 2984109 - protein, 25 aa, Entamoeba invadens
NLKNCSFLSLKLCCVHLVIENCLMD

SEQ ID NO: 2984110 - protein, 24 aa, Entamoeba invadens
NLLELKHSFEFSKTFDIKTRENFT

SEQ ID NO: 2984111 - protein, 24 aa, Entamoeba invadens
NLLELKPSFEFGKTFDIKTRENFT

SEQ ID NO: 2984112 - protein, 19 aa, Entamoeba invadens
NLLEVFKAASLPLAQNYLQ

SEQ ID NO: 2984113 - protein, 18 aa, Entamoeba invadens
NLLGWLFNLMIEVSKNRD

SEQ ID NO: 2984114 - protein, 23 aa, Entamoeba invadens
NLLIDMLLEFGFFFESKMAKKST

SEQ ID NO: 2984115 - protein, 25 aa, Entamoeba invadens
NLLPKFCLIVRKFLEEKVKNGTSLE

SEQ ID NO: 2984116 - protein, 24 aa, Entamoeba invadens
NLLQFRLSFEFTKDFRIKSISQFC

SEQ ID NO: 2984117 - protein, 23 aa, Entamoeba invadens
NLPHKRLRDVAARVKYMKYREVH

SEQ ID NO: 2984118 - protein, 23 aa, Entamoeba invadens
NLPSELLTMISFIGKMEDEYPAI

SEQ ID NO: 2984119 - protein, 20 aa, Entamoeba invadens
NLPWPNYIQFLFALTQEQNI

SEQ ID NO: 2984120 - protein, 19 aa, Entamoeba invadens
NLQIIIKILLEFHQGIGDD

SEQ ID NO: 2984121 - protein, 18 aa, Entamoeba invadens
NLRCNGLFDKKRLYNFYG

SEQ ID NO: 2984122 - protein, 18 aa, Entamoeba invadens
NLRKVIGFCGFPNVGKSS

SEQ ID NO: 2984123 - protein, 17 aa, Entamoeba invadens
NLRRANLVFSFFPNEFR

SEQ ID NO: 2984124 - protein, 22 aa, Entamoeba invadens
NLSFKGGFGLLKYGPSVDTSRL

SEQ ID NO: 2984125 - protein, 22 aa, Entamoeba invadens
NLSGSTPLHWAVRSTPEIVDML

SEQ ID NO: 2984126 - protein, 19 aa, Entamoeba invadens
NLSKHIICLSKLNESETCE

SEQ ID NO: 2984127 - protein, 17 aa, Entamoeba invadens
NLSWIIMLVSSWKAMGP

SEQ ID NO: 2984128 - protein, 19 aa, Entamoeba invadens
NLVIPEFVKDLSVSLYTHE

SEQ ID NO: 2984129 - protein, 17 aa, Entamoeba invadens
NMFKLYIEKGISFLNNY

SEQ ID NO: 2984130 - protein, 19 aa, Entamoeba invadens
NMFPFGVTVSIVLDIFANR

SEQ ID NO: 2984131 - protein, 20 aa, Entamoeba invadens
NMLYKFINMIGMPPRSLLDR

SEQ ID NO: 2984132 - protein, 25 aa, Entamoeba invadens
NMNVSDLFIKLNILLNNELNKLSPN

SEQ ID NO: 2984133 - protein, 23 aa, Entamoeba invadens
NMVCPTCHKVLLVKNYEKHQETH

SEQ ID NO: 2984134 - protein, 23 aa, Entamoeba invadens
NMVPFPRLHFFSSSIAPLSSALA

SEQ ID NO: 2984135 - protein, 25 aa, Entamoeba invadens
NNCLFGIGGANGWIAVHKPKFDTSR

SEQ ID NO: 2984136 - protein, 27 aa, Entamoeba invadens
NNCYWNCPICEKPCYFSMITIDQHLKT

SEQ ID NO: 2984137 - protein, 21 aa, Entamoeba invadens
NNFPGAMPVNFGRTSFEIIQK

SEQ ID NO: 2984138 - protein, 22 aa, Entamoeba invadens
NNFYCVLSAFGLSCPLNDERSG

SEQ ID NO: 2984139 - protein, 23 aa, Entamoeba invadens
NNIVKLRFESFISCHDKDYERMI

SEQ ID NO: 2984140 - protein, 18 aa, Entamoeba invadens
NNIYKLVLYFANALEKEN

SEQ ID NO: 2984141 - protein, 17 aa, Entamoeba invadens
NNKCFWGCCGLLSVTIP

SEQ ID NO: 2984142 - protein, 17 aa, Entamoeba invadens
NNKIVVMLVNFFKDLYH

SEQ ID NO: 2984143 - protein, 24 aa, Entamoeba invadens
NNLFKKREHPSFAFRVLEEPSGSH

SEQ ID NO: 2984144 - protein, 24 aa, Entamoeba invadens
NNMFQCIWLCLSFSGKNLAQSVFK

SEQ ID NO: 2984145 - protein, 22 aa, Entamoeba invadens
NNNCLFTSLIMRLMVSLGSEPS

SEQ ID NO: 2984146 - protein, 22 aa, Entamoeba invadens
NNNNCKFVWLSLLRNSFYTHCK

SEQ ID NO: 2984147 - protein, 17 aa, Entamoeba invadens
NNNWTDLYWRDVMNDEA

SEQ ID NO: 2984148 - protein, 20 aa, Entamoeba invadens
NNQFWRVIKAYALSNTNQEE

SEQ ID NO: 2984149 - protein, 18 aa, Entamoeba invadens
NNSDCFACTRFLIENYKE

SEQ ID NO: 2984150 - protein, 21 aa, Entamoeba invadens
NNSLLKSARLLGVKLNLTASE

SEQ ID NO: 2984151 - protein, 19 aa, Entamoeba invadens
NPEEICFPVKIIARRPSDD

SEQ ID NO: 2984152 - protein, 25 aa, Entamoeba invadens
NPGLFKWKYMTHWTIDYGIKEYGYY

SEQ ID NO: 2984153 - protein, 22 aa, Entamoeba invadens
NPIDPRFAPPIQISQVSPIQNQ

SEQ ID NO: 2984154 - protein, 21 aa, Entamoeba invadens
NPKLWWKYIYNVKLDEIKEKN

SEQ ID NO: 2984155 - protein, 21 aa, Entamoeba invadens
NPKRFGALIIRITNPKTTALV

SEQ ID NO: 2984156 - protein, 19 aa, Entamoeba invadens
NPLLWYRLASCVIMANYNM

SEQ ID NO: 2984157 - protein, 17 aa, Entamoeba invadens
NPLSFSIKDIVTVYSVN

SEQ ID NO: 2984158 - protein, 24 aa, Entamoeba invadens
NPPLCQIIPFVISEPIISVTDITN

SEQ ID NO: 2984159 - protein, 17 aa, Entamoeba invadens
NPPRVLRYIPFLRKYIP

SEQ ID NO: 2984160 - protein, 18 aa, Entamoeba invadens
NPRISWIRLQVLDLSFNE

SEQ ID NO: 2984161 - protein, 23 aa, Entamoeba invadens
NPRLQFQWWFPLVLTLTGNDYRE

SEQ ID NO: 2984162 - protein, 19 aa, Entamoeba invadens
NPSIRCCVLSIAPYTLQQQ

SEQ ID NO: 2984163 - protein, 27 aa, Entamoeba invadens
NPTLKCLNCFECFFTIKKLLEHTKVCR

SEQ ID NO: 2984164 - protein, 18 aa, Entamoeba invadens
NPYFPQIPFFKLKNQDKK

SEQ ID NO: 2984165 - protein, 17 aa, Entamoeba invadens
NPYGAMGGMPGMNPYGM

SEQ ID NO: 2984166 - protein, 23 aa, Entamoeba invadens
NQIGTALFKFAGVLNIYKLFVSN

SEQ ID NO: 2984167 - protein, 20 aa, Entamoeba invadens
NQIKELICELMIMGGVDAVL

SEQ ID NO: 2984168 - protein, 18 aa, Entamoeba invadens
NQLFILLPNRVMYRVIEN

SEQ ID NO: 2984169 - protein, 23 aa, Entamoeba invadens
NQLKFSIKFFPNIETVSSTYSEI

SEQ ID NO: 2984170 - protein, 19 aa, Entamoeba invadens
NQNLRLVLINGKYYLQAET

SEQ ID NO: 2984171 - protein, 20 aa, Entamoeba invadens
NQYCVACAIHGRIVRVRSHE

SEQ ID NO: 2984172 - protein, 21 aa, Entamoeba invadens
NQYCVACAIHGRIVRVRSHED

SEQ ID NO: 2984173 - protein, 17 aa, Entamoeba invadens
NRFGCVITEKVEREATW

SEQ ID NO: 2984174 - protein, 20 aa, Entamoeba invadens
NRFNFEIPKQVVAEVNTEKG

SEQ ID NO: 2984175 - protein, 20 aa, Entamoeba invadens
NRFNVGMAFIRKSRSFEDTH

SEQ ID NO: 2984176 - protein, 18 aa, Entamoeba invadens
NRFPVCVRYYYATLSKEL

SEQ ID NO: 2984177 - protein, 20 aa, Entamoeba invadens
NRIGHQFFWFLKAELHDNRV

SEQ ID NO: 2984178 - protein, 23 aa, Entamoeba invadens
NRIPSWCDRVLWKCENGHYVQSM

SEQ ID NO: 2984179 - protein, 23 aa, Entamoeba invadens
NRIPSWCDRVLWKIENRHNVECV

SEQ ID NO: 2984180 - protein, 23 aa, Entamoeba invadens
NRKEFAKDMVLVFENAMNYNEKK

SEQ ID NO: 2984181 - protein, 23 aa, Entamoeba invadens
NRKRFGNDIPICITSIDNECFIN

SEQ ID NO: 2984182 - protein, 19 aa, Entamoeba invadens
NRLREAVQWPLKYKDQLDL

SEQ ID NO: 2984183 - protein, 17 aa, Entamoeba invadens
NRLSVLISEVITFNTSI

SEQ ID NO: 2984184 - protein, 19 aa, Entamoeba invadens
NRMLAFIIKNNFAIFPSAK

SEQ ID NO: 2984185 - protein, 17 aa, Entamoeba invadens
NRPASALPLKISAAKLE

SEQ ID NO: 2984186 - protein, 17 aa, Entamoeba invadens
NRPDCIDPAMLRPGRLD

SEQ ID NO: 2984187 - protein, 22 aa, Entamoeba invadens
NRVFFFRRAFVFFSSEGKGISV

SEQ ID NO: 2984188 - protein, 18 aa, Entamoeba invadens
NRYRICITFSTQCMIILF

SEQ ID NO: 2984189 - protein, 20 aa, Entamoeba invadens
NSALMSRCNLVVLKRLTDED

SEQ ID NO: 2984190 - protein, 23 aa, Entamoeba invadens
NSDWSACFSELFTTLPVVNEITP

SEQ ID NO: 2984191 - protein, 22 aa, Entamoeba invadens
NSEVFQFLFGRLEKIYKSLQMM

SEQ ID NO: 2984192 - protein, 18 aa, Entamoeba invadens
NSFPRTYLPTVFDNYLTT

SEQ ID NO: 2984193 - protein, 27 aa, Entamoeba invadens
NSISKIFLRFCPFFAIYQHFLINHDNA

SEQ ID NO: 2984194 - protein, 18 aa, Entamoeba invadens
NSKIRSGKCFEIDRTKSK

SEQ ID NO: 2984195 - protein, 25 aa, Entamoeba invadens
NSKTFPWKMCLGVFKNFPKSFDDNL

SEQ ID NO: 2984196 - protein, 17 aa, Entamoeba invadens
NSLCLTAVFSLLVEKNT

SEQ ID NO: 2984197 - protein, 18 aa, Entamoeba invadens
NSLISMCYVYDLKLNGST

SEQ ID NO: 2984198 - protein, 17 aa, Entamoeba invadens
NSLKVIGDFCFRGCEKL

SEQ ID NO: 2984199 - protein, 19 aa, Entamoeba invadens
NSLQFIGSFAFSNAKLVDV

SEQ ID NO: 2984200 - protein, 17 aa, Entamoeba invadens
NSMPRDMFKFISSHIET

SEQ ID NO: 2984201 - protein, 17 aa, Entamoeba invadens
NSPYPRRSASSESGEKE

SEQ ID NO: 2984202 - protein, 18 aa, Entamoeba invadens
NSRKMWYVKYVVWKLTKN

SEQ ID NO: 2984203 - protein, 17 aa, Entamoeba invadens
NSSCFQCCTALVRIEIP

SEQ ID NO: 2984204 - protein, 18 aa, Entamoeba invadens
NSVFFKVKIVMKYNEELV

SEQ ID NO: 2984205 - protein, 18 aa, Entamoeba invadens
NTCKLLFAPIQTVVLQLY

SEQ ID NO: 2984206 - protein, 18 aa, Entamoeba invadens
NTFFLSFNDICFDKIFNE

SEQ ID NO: 2984207 - protein, 18 aa, Entamoeba invadens
NTHLKFWALNMVLTEKYK

SEQ ID NO: 2984208 - protein, 24 aa, Entamoeba invadens
NTIPEWVLQFLLSFFIPGLLDFFG

SEQ ID NO: 2984209 - protein, 24 aa, Entamoeba invadens
NTKCYICGGAHPVAFCPKKNEINP

SEQ ID NO: 2984210 - protein, 21 aa, Entamoeba invadens
NTLCQCGSCSSDITTHLQSPQ

SEQ ID NO: 2984211 - protein, 25 aa, Entamoeba invadens
NTLFWLLKLVMDFLQPFYFCGNDVI

SEQ ID NO: 2984212 - protein, 21 aa, Entamoeba invadens
NTLPPQWRFWESMTQDFCATS

SEQ ID NO: 2984213 - protein, 23 aa, Entamoeba invadens
NTLSDLFLIFSLFKKINTLSFPT

SEQ ID NO: 2984214 - protein, 23 aa, Entamoeba invadens
NTMAKDLVKYCCHQFGGYTAQKV

SEQ ID NO: 2984215 - protein, 26 aa, Entamoeba invadens
NTPEFPRRFYLFVLKFFSKIFKTDFV

SEQ ID NO: 2984216 - protein, 18 aa, Entamoeba invadens
NTPPKFPVVSMVPPKTQK

SEQ ID NO: 2984217 - protein, 26 aa, Entamoeba invadens
NVALCFKLIIKQCIFLCQMLRTSLKQ

SEQ ID NO: 2984218 - protein, 19 aa, Entamoeba invadens
NVCFLTIMKGEFNSIYIGD

SEQ ID NO: 2984219 - protein, 18 aa, Entamoeba invadens
NVCKICIGRGHMAKCCPS

SEQ ID NO: 2984220 - protein, 18 aa, Entamoeba invadens
NVEFKWQIPTIRPKTGLL

SEQ ID NO: 2984221 - protein, 19 aa, Entamoeba invadens
NVFVKPKFFAHPDISSLNF

SEQ ID NO: 2984222 - protein, 23 aa, Entamoeba invadens
NVGGCGKGYCYVCSKLCDHFSPH

SEQ ID NO: 2984223 - protein, 20 aa, Entamoeba invadens
NVIDGLLFVFGRRGKQIRQS

SEQ ID NO: 2984224 - protein, 17 aa, Entamoeba invadens
NVISWQYICRVIFYCLS

SEQ ID NO: 2984225 - protein, 21 aa, Entamoeba invadens
NVITIYSWVFRNCVGLNSVVI

SEQ ID NO: 2984226 - protein, 19 aa, Entamoeba invadens
NVKAACWMKKMLDAKNLEI

SEQ ID NO: 2984227 - protein, 19 aa, Entamoeba invadens
NVKLPNWSIVWAKQKGYPW

SEQ ID NO: 2984228 - protein, 18 aa, Entamoeba invadens
NVLCPYKPLEVYFFTEFS

SEQ ID NO: 2984229 - protein, 19 aa, Entamoeba invadens
NVLDIPITICLRKDDGTQH

SEQ ID NO: 2984230 - protein, 18 aa, Entamoeba invadens
NVLKGHIALIQFEEMIDH

SEQ ID NO: 2984231 - protein, 21 aa, Entamoeba invadens
NVLRYPRPVSATSEILFQPSY

SEQ ID NO: 2984232 - protein, 19 aa, Entamoeba invadens
NVLSCYGTFVFGNRGYISV

SEQ ID NO: 2984233 - protein, 18 aa, Entamoeba invadens
NVLYEVQFSFGLTKSGFS

SEQ ID NO: 2984234 - protein, 19 aa, Entamoeba invadens
NVPCPKVLFCNQLDIVMEY

SEQ ID NO: 2984235 - protein, 18 aa, Entamoeba invadens
NVPSFKVFVFYSQDMNAP

SEQ ID NO: 2984236 - protein, 24 aa, Entamoeba invadens
NVSSRKFICCGPLIALDNMNDPPV

SEQ ID NO: 2984237 - protein, 24 aa, Entamoeba invadens
NVTCDICLKKCCVGCSVNTTIAPT

SEQ ID NO: 2984238 - protein, 25 aa, Entamoeba invadens
NVTCEVCLRKCCIGCSLHTTIAPTL

SEQ ID NO: 2984239 - protein, 19 aa, Entamoeba invadens
NVYIFPKFVVSVVKTIMKI

SEQ ID NO: 2984240 - protein, 17 aa, Entamoeba invadens
NWENIAFVQSFDSKNYF

SEQ ID NO: 2984241 - protein, 18 aa, Entamoeba invadens
NWRFVEWLLEHGADATKR

SEQ ID NO: 2984242 - protein, 19 aa, Entamoeba invadens
NYCKKCSTANCAICNTNNV

SEQ ID NO: 2984243 - protein, 18 aa, Entamoeba invadens
NYFCGRYVNLGAYLIIKN

SEQ ID NO: 2984244 - protein, 23 aa, Entamoeba invadens
NYFGGKVPPIFVVHSLKHVPKEI

SEQ ID NO: 2984245 - protein, 24 aa, Entamoeba invadens
NYGFKTECIWKYSLDIYNKCITLF

SEQ ID NO: 2984246 - protein, 20 aa, Entamoeba invadens
NYGLCHVCVVASIIKGKNTR

SEQ ID NO: 2984247 - protein, 22 aa, Entamoeba invadens
NYHAICGIVFSFVRINDIETLK

SEQ ID NO: 2984248 - protein, 26 aa, Entamoeba invadens
NYKNCCLYCLKALFPNESNTYTSVFN

SEQ ID NO: 2984249 - protein, 18 aa, Entamoeba invadens
NYLFDWRDGMIVKSIGGE

SEQ ID NO: 2984250 - protein, 18 aa, Entamoeba invadens
NYLLDIFEPIIFGLSSGG

SEQ ID NO: 2984251 - protein, 18 aa, Entamoeba invadens
NYLVSQCGYTFVFLNEKR

SEQ ID NO: 2984252 - protein, 17 aa, Entamoeba invadens
NYRDVIMALNISPLLVP

SEQ ID NO: 2984253 - protein, 17 aa, Entamoeba invadens
NYVALSFNFADLKFKLD

SEQ ID NO: 2984254 - protein, 22 aa, Entamoeba invadens
NYYCLPYNFLICDYKTIKPEKL

SEQ ID NO: 2984255 - protein, 20 aa, Entamoeba invadens
NYYRGVMGIAMIYDVTSKES

SEQ ID NO: 2984256 - protein, 17 aa, Entamoeba invadens
PAIRRLARRGGVKRING

SEQ ID NO: 2984257 - protein, 18 aa, Entamoeba invadens
PAIRVCVERIYPTRYKFS

SEQ ID NO: 2984258 - protein, 19 aa, Entamoeba invadens
PAKNLKAAFSALSLVDDIE

SEQ ID NO: 2984259 - protein, 20 aa, Entamoeba invadens
PAKNLKAAFSALSLVDDIED

SEQ ID NO: 2984260 - protein, 24 aa, Entamoeba invadens
PANPPVTPAFEFLEGSSLSHTSGS

SEQ ID NO: 2984261 - protein, 22 aa, Entamoeba invadens
PARVLPFVIPKYFFLSQDVDRL

SEQ ID NO: 2984262 - protein, 18 aa, Entamoeba invadens
PASFAFGFNMMGNDMPQF

SEQ ID NO: 2984263 - protein, 23 aa, Entamoeba invadens
PATSLRLLIKMTQIITQVHSVGL

SEQ ID NO: 2984264 - protein, 20 aa, Entamoeba invadens
PAVFKLPGAEQFVIYGEPKN

SEQ ID NO: 2984265 - protein, 17 aa, Entamoeba invadens
PCKSIAPVFEDLANKNP

SEQ ID NO: 2984266 - protein, 18 aa, Entamoeba invadens
PCNSLLCCKCCELNLFYY

SEQ ID NO: 2984267 - protein, 22 aa, Entamoeba invadens
PCPLPMLFRLFLRKDYTVEVFS

SEQ ID NO: 2984268 - protein, 18 aa, Entamoeba invadens
PCSVCVSSDVKICEKKMP

SEQ ID NO: 2984269 - protein, 21 aa, Entamoeba invadens
PCVLPEFGERLIVGLLCVEKK

SEQ ID NO: 2984270 - protein, 18 aa, Entamoeba invadens
PDAACSFVRIGNMELLDR

SEQ ID NO: 2984271 - protein, 20 aa, Entamoeba invadens
PDCFKCPLCHAVIGAKDYKI

SEQ ID NO: 2984272 - protein, 18 aa, Entamoeba invadens
PDEAISWGKIKVGAPYVK

SEQ ID NO: 2984273 - protein, 24 aa, Entamoeba invadens
PDEWWSSVCLTSFMRMSNYILQHP

SEQ ID NO: 2984274 - protein, 17 aa, Entamoeba invadens
PDFFISVAYIYTFAFLK

SEQ ID NO: 2984275 - protein, 19 aa, Entamoeba invadens
PDFPKSVPIGSQITPTATN

SEQ ID NO: 2984276 - protein, 21 aa, Entamoeba invadens
PDFPSRLAIYLSVALDQKQIV

SEQ ID NO: 2984277 - protein, 24 aa, Entamoeba invadens
PDGYFSWEIGKFVHRHFCKNGYDF

SEQ ID NO: 2984278 - protein, 20 aa, Entamoeba invadens
PDIFGVFGFEIELNTKFAEF

SEQ ID NO: 2984279 - protein, 24 aa, Entamoeba invadens
PDIKLRMCVEMALGISWLNNVVGV

SEQ ID NO: 2984280 - protein, 18 aa, Entamoeba invadens
PDLAIPLWYSFGTVVILL

SEQ ID NO: 2984281 - protein, 17 aa, Entamoeba invadens
PDLKADFILLAQPAVTH

SEQ ID NO: 2984282 - protein, 26 aa, Entamoeba invadens
PDLKLCFVRSCGIHFSSFFKYFIFLC

SEQ ID NO: 2984283 - protein, 17 aa, Entamoeba invadens
PDLLALNLSHNGIRNGG

SEQ ID NO: 2984284 - protein, 24 aa, Entamoeba invadens
PDPRLPKPLFAWNLPKGYEAVLKK

SEQ ID NO: 2984285 - protein, 20 aa, Entamoeba invadens
PDQFKILLIFLKTFFSEESS

SEQ ID NO: 2984286 - protein, 19 aa, Entamoeba invadens
PDRECLVFRSAMTKANIRH

SEQ ID NO: 2984287 - protein, 21 aa, Entamoeba invadens
PDSRVSYGLVKKVLEQQHLLP

SEQ ID NO: 2984288 - protein, 24 aa, Entamoeba invadens
PDTYIKDVLRLGAEMLPQDYLQRL

SEQ ID NO: 2984289 - protein, 19 aa, Entamoeba invadens
PDVRFVIHHSLPKTLEGYY

SEQ ID NO: 2984290 - protein, 17 aa, Entamoeba invadens
PDVVFILGFSHSAHFEY

SEQ ID NO: 2984291 - protein, 20 aa, Entamoeba invadens
PDYQLRPNFLIALVEAPSLF

SEQ ID NO: 2984292 - protein, 22 aa, Entamoeba invadens
PEAVTFIGSYAFKNCVNLTCFK

SEQ ID NO: 2984293 - protein, 22 aa, Entamoeba invadens
PEAYTLTFGDRWLNVFEWVLRG

SEQ ID NO: 2984294 - protein, 17 aa, Entamoeba invadens
PECATCKASAPMMDKLA

SEQ ID NO: 2984295 - protein, 19 aa, Entamoeba invadens
PECQNTFCFKCREMWHKDF

SEQ ID NO: 2984296 - protein, 17 aa, Entamoeba invadens
PEDIGFIIAPTFHVKSI

SEQ ID NO: 2984297 - protein, 17 aa, Entamoeba invadens
PEDLSTVFLGFDDVFRI

SEQ ID NO: 2984298 - protein, 24 aa, Entamoeba invadens
PEEPVLRKEIKVIGTNHLPLNKVQ

SEQ ID NO: 2984299 - protein, 22 aa, Entamoeba invadens
PEEWKSQFLIPLEVYATAHPEH

SEQ ID NO: 2984300 - protein, 20 aa, Entamoeba invadens
PEFAKYFTFLDTFNFYEEFN

SEQ ID NO: 2984301 - protein, 18 aa, Entamoeba invadens
PEFDPARCLDEFYDRNYV

SEQ ID NO: 2984302 - protein, 17 aa, Entamoeba invadens
PEFKNSFFFRSDAQKSD

SEQ ID NO: 2984303 - protein, 20 aa, Entamoeba invadens
PEFPRTSFGKVYLPKLREMV

SEQ ID NO: 2984304 - protein, 21 aa, Entamoeba invadens
PEGFLKLKSLRLISLCHSQFE

SEQ ID NO: 2984305 - protein, 21 aa, Entamoeba invadens
PEHKYRPLSVILPTKSGRIDL

SEQ ID NO: 2984306 - protein, 20 aa, Entamoeba invadens
PEHLAILLKIVFLKVQESYG

SEQ ID NO: 2984307 - protein, 21 aa, Entamoeba invadens
PEHLIRIPILGSFACGKTSLR

SEQ ID NO: 2984308 - protein, 20 aa, Entamoeba invadens
PEIFPGVVYRLAEPKMVLLI

SEQ ID NO: 2984309 - protein, 22 aa, Entamoeba invadens
PEIYRNTAFFTFSFCESTKNEK

SEQ ID NO: 2984310 - protein, 20 aa, Entamoeba invadens
PEKIKIFINFGVVPSVKTIS

SEQ ID NO: 2984311 - protein, 22 aa, Entamoeba invadens
PEKKMECKIKMGFKTKKKPVVI

SEQ ID NO: 2984312 - protein, 24 aa, Entamoeba invadens
PELCGMRLCKLAVMLVALGGVPHL

SEQ ID NO: 2984313 - protein, 19 aa, Entamoeba invadens
PELGNFVEWIFWYINTKQE

SEQ ID NO: 2984314 - protein, 18 aa, Entamoeba invadens
PELMLGMLVQVVLQMYSM

SEQ ID NO: 2984315 - protein, 20 aa, Entamoeba invadens
PELQRRIIINLAPPVCTHFF

SEQ ID NO: 2984316 - protein, 20 aa, Entamoeba invadens
PELRKRLILFDCEDPNTCSD

SEQ ID NO: 2984317 - protein, 17 aa, Entamoeba invadens
PELYKKFGIYTPAGILL

SEQ ID NO: 2984318 - protein, 19 aa, Entamoeba invadens
PEMLGHYLGEFSITYKPVT

SEQ ID NO: 2984319 - protein, 22 aa, Entamoeba invadens
PENRIWPGLIDIVSRNLLMFSS

SEQ ID NO: 2984320 - protein, 23 aa, Entamoeba invadens
PENYKNLVLFIVHFLKDFSKFSN

SEQ ID NO: 2984321 - protein, 18 aa, Entamoeba invadens
PEQMNIFALRNTLLGKVV

SEQ ID NO: 2984322 - protein, 26 aa, Entamoeba invadens
PEQNRIPLEVGITFSITLPLERNTFF

SEQ ID NO: 2984323 - protein, 18 aa, Entamoeba invadens
PERIRMVSPEFLFCSSVD

SEQ ID NO: 2984324 - protein, 17 aa, Entamoeba invadens
PERRDARCKDCRRNFVS

SEQ ID NO: 2984325 - protein, 18 aa, Entamoeba invadens
PESISYLGPFCFGGCTSL

SEQ ID NO: 2984326 - protein, 19 aa, Entamoeba invadens
PESLRITLTPAIKLKLCSE

SEQ ID NO: 2984327 - protein, 19 aa, Entamoeba invadens
PESVISLGDNCFKHCEDLE

SEQ ID NO: 2984328 - protein, 17 aa, Entamoeba invadens
PETFSLIGVSSFSHNKY

SEQ ID NO: 2984329 - protein, 18 aa, Entamoeba invadens
PETFSLIGVSSFSHNKYL

SEQ ID NO: 2984330 - protein, 22 aa, Entamoeba invadens
PETLAMCFACLAKGSQKNPHSP

SEQ ID NO: 2984331 - protein, 19 aa, Entamoeba invadens
PEVARLALIATIERTVLFD

SEQ ID NO: 2984332 - protein, 18 aa, Entamoeba invadens
PEVDRFLVTIQMETLPWV

SEQ ID NO: 2984333 - protein, 20 aa, Entamoeba invadens
PEVEARWILYQVVSALYYLH

SEQ ID NO: 2984334 - protein, 18 aa, Entamoeba invadens
PEVSIVLCGTHLGEQHEV

SEQ ID NO: 2984335 - protein, 21 aa, Entamoeba invadens
PEYRNFLSVIYKWVDEMLKDI

SEQ ID NO: 2984336 - protein, 21 aa, Entamoeba invadens
PEYVKELFLLKINPVVVEKAV

SEQ ID NO: 2984337 - protein, 20 aa, Entamoeba invadens
PFFKSRRGLLKTYGKDVENI

SEQ ID NO: 2984338 - protein, 17 aa, Entamoeba invadens
PFICFNCGGYGHKSSEC

SEQ ID NO: 2984339 - protein, 24 aa, Entamoeba invadens
PFIKDGWMKKNIIAYDFLLKKMIN

SEQ ID NO: 2984340 - protein, 18 aa, Entamoeba invadens
PFKFNRRASLIINDEMTP

SEQ ID NO: 2984341 - protein, 23 aa, Entamoeba invadens
PFKTTRCIPHLQTLIKSNEGVLG

SEQ ID NO: 2984342 - protein, 18 aa, Entamoeba invadens
PFLFSFDSVHSFNNILVQ

SEQ ID NO: 2984343 - protein, 23 aa, Entamoeba invadens
PFLLEMMSYYGICFSLSYKCAKS

SEQ ID NO: 2984344 - protein, 18 aa, Entamoeba invadens
PFPCRLVEFLERWKCSMD

SEQ ID NO: 2984345 - protein, 18 aa, Entamoeba invadens
PFRLCYFDPILDFEKEIE

SEQ ID NO: 2984346 - protein, 17 aa, Entamoeba invadens
PFRPHFDQFGLAPDTLA

SEQ ID NO: 2984347 - protein, 23 aa, Entamoeba invadens
PFRTPRELQIWIWKEIFQETKRF

SEQ ID NO: 2984348 - protein, 18 aa, Entamoeba invadens
PFWYKFDDNWLFENSDIF

SEQ ID NO: 2984349 - protein, 19 aa, Entamoeba invadens
PGDFSIIFNCVKGVRTHGQ

SEQ ID NO: 2984350 - protein, 19 aa, Entamoeba invadens
PGDVPKRICRMVNPGMTTL

SEQ ID NO: 2984351 - protein, 23 aa, Entamoeba invadens
PGEFACGVGRGSKKLLTSTGSGV

SEQ ID NO: 2984352 - protein, 22 aa, Entamoeba invadens
PGGEMYFRLTLEKSFSEERTQF

SEQ ID NO: 2984353 - protein, 19 aa, Entamoeba invadens
PGIFKALLPHISHFDEVFR

SEQ ID NO: 2984354 - protein, 17 aa, Entamoeba invadens
PGKIFVFDINRYDDTLL

SEQ ID NO: 2984355 - protein, 17 aa, Entamoeba invadens
PGLKIKLTLDKIKVPDQ

SEQ ID NO: 2984356 - protein, 18 aa, Entamoeba invadens
PGLLRYAKDITMNEIVVL

SEQ ID NO: 2984357 - protein, 19 aa, Entamoeba invadens
PGLYFKGNFGVRIENVCIV

SEQ ID NO: 2984358 - protein, 20 aa, Entamoeba invadens
PGLYPELFINTSLIADTEEM

SEQ ID NO: 2984359 - protein, 23 aa, Entamoeba invadens
PGMASELIGIFSAYGEVLNTVQP

SEQ ID NO: 2984360 - protein, 18 aa, Entamoeba invadens
PGMLFCNSLAKDMLTTYR

SEQ ID NO: 2984361 - protein, 24 aa, Entamoeba invadens
PGNIRVSPQTALRFMRIFDTQRTG

SEQ ID NO: 2984362 - protein, 17 aa, Entamoeba invadens
PGQILGIVGTNGIGKST

SEQ ID NO: 2984363 - protein, 17 aa, Entamoeba invadens
PHEGAFCDLMWSDPDDS

SEQ ID NO: 2984364 - protein, 20 aa, Entamoeba invadens
PHGGYGLGVERLVMWMLGED

SEQ ID NO: 2984365 - protein, 17 aa, Entamoeba invadens
PHHKAIFINIPVTKYRK

SEQ ID NO: 2984366 - protein, 17 aa, Entamoeba invadens
PHINKIFERCIKEDIAL

SEQ ID NO: 2984367 - protein, 18 aa, Entamoeba invadens
PHKVRLVGSFAFEKCEQL

SEQ ID NO: 2984368 - protein, 20 aa, Entamoeba invadens
PHLKVGFAFDSLLHRCIDDV

SEQ ID NO: 2984369 - protein, 18 aa, Entamoeba invadens
PHLYFYVQHCLKAFISSM

SEQ ID NO: 2984370 - protein, 17 aa, Entamoeba invadens
PHPPPGLYPELFINTSL

SEQ ID NO: 2984371 - protein, 19 aa, Entamoeba invadens
PHTRYFCHVCHSFVPDQQN

SEQ ID NO: 2984372 - protein, 19 aa, Entamoeba invadens
PHVANFFAIRAQYYNKLRK

SEQ ID NO: 2984373 - protein, 20 aa, Entamoeba invadens
PHYFRLAFYILRNTPQMKEN

SEQ ID NO: 2984374 - protein, 18 aa, Entamoeba invadens
PICECVKVIKQGKESVKI

SEQ ID NO: 2984375 - protein, 20 aa, Entamoeba invadens
PICSNCLTGTYAVEGASAFC

SEQ ID NO: 2984376 - protein, 22 aa, Entamoeba invadens
PIELKKFLSFAFTYNLEKSKQL

SEQ ID NO: 2984377 - protein, 24 aa, Entamoeba invadens
PIESNSSMITLKFIEPVQSGTTGD

SEQ ID NO: 2984378 - protein, 19 aa, Entamoeba invadens
PIIFPRISPLYSLNKLQGS

SEQ ID NO: 2984379 - protein, 17 aa, Entamoeba invadens
PIKRAYGKFLNKFEKAS

SEQ ID NO: 2984380 - protein, 19 aa, Entamoeba invadens
PILFKVVWRTEIDFEGMTM

SEQ ID NO: 2984381 - protein, 18 aa, Entamoeba invadens
PIPRLPRKFCSTIQIQMF

SEQ ID NO: 2984382 - protein, 22 aa, Entamoeba invadens
PIPRYPAAFPFGYDKNPRYPPA

SEQ ID NO: 2984383 - protein, 19 aa, Entamoeba invadens
PIQRIPRYVLLLKELKKNT

SEQ ID NO: 2984384 - protein, 18 aa, Entamoeba invadens
PISCAFCYAYNGHTSQVT

SEQ ID NO: 2984385 - protein, 24 aa, Entamoeba invadens
PITCAFPLIFGERGLGMDVKNTVC

SEQ ID NO: 2984386 - protein, 21 aa, Entamoeba invadens
PITKLRIDDMVKCFKNSTDHI

SEQ ID NO: 2984387 - protein, 24 aa, Entamoeba invadens
PIVLCGGDFFFGMFVRQLLEMNAK

SEQ ID NO: 2984388 - protein, 23 aa, Entamoeba invadens
PKCPLPSCGFDWCHQNPDLLCTW

SEQ ID NO: 2984389 - protein, 18 aa, Entamoeba invadens
PKDLVLLAWYYAPNLVVG

SEQ ID NO: 2984390 - protein, 21 aa, Entamoeba invadens
PKEIAALFFKKLMNQIKTKIP

SEQ ID NO: 2984391 - protein, 19 aa, Entamoeba invadens
PKEIYKFGWSIADLISIGK

SEQ ID NO: 2984392 - protein, 22 aa, Entamoeba invadens
PKEKFKHAWDVANFITTDKRPD

SEQ ID NO: 2984393 - protein, 19 aa, Entamoeba invadens
PKEKLDIIFSHFDDVLSFN

SEQ ID NO: 2984394 - protein, 18 aa, Entamoeba invadens
PKENCTFMLTSYWPSYVL

SEQ ID NO: 2984395 - protein, 24 aa, Entamoeba invadens
PKENFKFAWCIAEYVDKGGRPERV

SEQ ID NO: 2984396 - protein, 24 aa, Entamoeba invadens
PKENGAAIKACFRATDPIKTLVIT

SEQ ID NO: 2984397 - protein, 19 aa, Entamoeba invadens
PKFACEFSLFLNPLCTSTI

SEQ ID NO: 2984398 - protein, 17 aa, Entamoeba invadens
PKIPILPLWMGDIIHAQ

SEQ ID NO: 2984399 - protein, 25 aa, Entamoeba invadens
PKISTEVLQRWILELGASIKKTYKD

SEQ ID NO: 2984400 - protein, 22 aa, Entamoeba invadens
PKKDFQFAWSIADFVSAGKRVQ

SEQ ID NO: 2984401 - protein, 22 aa, Entamoeba invadens
PKKEMYYCLCLMDYLVENCPEF

SEQ ID NO: 2984402 - protein, 20 aa, Entamoeba invadens
PKLAECLMVLMGVDPSMFMK

SEQ ID NO: 2984403 - protein, 23 aa, Entamoeba invadens
PKLFYKVMFTFPITFKQTKKSLQ

SEQ ID NO: 2984404 - protein, 18 aa, Entamoeba invadens
PKLLRFVIMNCSSKYRKT

SEQ ID NO: 2984405 - protein, 17 aa, Entamoeba invadens
PKLPQRIPELYDFTSDE

SEQ ID NO: 2984406 - protein, 18 aa, Entamoeba invadens
PKLSLIGVQCFRRCSRLN

SEQ ID NO: 2984407 - protein, 19 aa, Entamoeba invadens
PKLSVFWDKHRAFLSSANS

SEQ ID NO: 2984408 - protein, 18 aa, Entamoeba invadens
PKMLRTIGSFAFSGCINL

SEQ ID NO: 2984409 - protein, 20 aa, Entamoeba invadens
PKNLKSLYVFGGTIQIANTK

SEQ ID NO: 2984410 - protein, 20 aa, Entamoeba invadens
PKQMRFAIRSDKAMKAFLCF

SEQ ID NO: 2984411 - protein, 18 aa, Entamoeba invadens
PKQVILTLLFRLADTNNS

SEQ ID NO: 2984412 - protein, 18 aa, Entamoeba invadens
PKRGEIIPLQINTTTQDY

SEQ ID NO: 2984413 - protein, 17 aa, Entamoeba invadens
PKSALSFTIKKDPKVDT

SEQ ID NO: 2984414 - protein, 21 aa, Entamoeba invadens
PKSEFKFAWDIVNFVTNGKRI

SEQ ID NO: 2984415 - protein, 23 aa, Entamoeba invadens
PKSICSLGAFTFAECCNLKIVKL

SEQ ID NO: 2984416 - protein, 21 aa, Entamoeba invadens
PKSKIMNLTWGFSLKKIIKKE

SEQ ID NO: 2984417 - protein, 18 aa, Entamoeba invadens
PKSLPFVLKIDSFKKGVF

SEQ ID NO: 2984418 - protein, 20 aa, Entamoeba invadens
PKSLSFLGANAFKNSKELTR

SEQ ID NO: 2984419 - protein, 24 aa, Entamoeba invadens
PKSLSYLPFCCFFKCVHLQMVKFP

SEQ ID NO: 2984420 - protein, 18 aa, Entamoeba invadens
PKSVILLGLCILEGCTSL

SEQ ID NO: 2984421 - protein, 18 aa, Entamoeba invadens
PKVFPSLNYFGAAVPICK

SEQ ID NO: 2984422 - protein, 22 aa, Entamoeba invadens
PKVKEMLRRVFPNRQLLDCEDG

SEQ ID NO: 2984423 - protein, 21 aa, Entamoeba invadens
PKYCFSNSVLREFVVPQSVRE

SEQ ID NO: 2984424 - protein, 17 aa, Entamoeba invadens
PKYCVRPSVVSFIDTME

SEQ ID NO: 2984425 - protein, 21 aa, Entamoeba invadens
PLCGWYHSHPSYKCWLSAIDV

SEQ ID NO: 2984426 - protein, 21 aa, Entamoeba invadens
PLCNLQFCSLKCKKAMEETHK

SEQ ID NO: 2984427 - protein, 20 aa, Entamoeba invadens
PLELKALFCGLPLCCVTSDS

SEQ ID NO: 2984428 - protein, 18 aa, Entamoeba invadens
PLEMCPLAFFPFQITMEQ

SEQ ID NO: 2984429 - protein, 19 aa, Entamoeba invadens
PLFNPVVMLCFKIVSVSVE

SEQ ID NO: 2984430 - protein, 20 aa, Entamoeba invadens
PLHMRYGIEEMKGLQIPNLQ

SEQ ID NO: 2984431 - protein, 24 aa, Entamoeba invadens
PLKFVLRCCVNLATALQYLSSEKI

SEQ ID NO: 2984432 - protein, 22 aa, Entamoeba invadens
PLKGHAWCGVPLMLEDYTTPLP

SEQ ID NO: 2984433 - protein, 17 aa, Entamoeba invadens
PLKSFVFHTKFPPNTNL

SEQ ID NO: 2984434 - protein, 20 aa, Entamoeba invadens
PLKTNYVGFGFNFVALDFAM

SEQ ID NO: 2984435 - protein, 17 aa, Entamoeba invadens
PLMFSMPKQAEWGLVGN

SEQ ID NO: 2984436 - protein, 18 aa, Entamoeba invadens
PLNILRKKICILPQEATL

SEQ ID NO: 2984437 - protein, 18 aa, Entamoeba invadens
PLPFFKDFITLVGSHKED

SEQ ID NO: 2984438 - protein, 25 aa, Entamoeba invadens
PLQPYEFLKLLTLYFIVMKKDKKNL

SEQ ID NO: 2984439 - protein, 18 aa, Entamoeba invadens
PLRLDFHSLPILPLLDLT

SEQ ID NO: 2984440 - protein, 19 aa, Entamoeba invadens
PLRVRVCPEVKSFSTSVTS

SEQ ID NO: 2984441 - protein, 19 aa, Entamoeba invadens
PLSLTRLGNYVVHDCLSLS

SEQ ID NO: 2984442 - protein, 18 aa, Entamoeba invadens
PLSRSLRPMRIDDVSHQK

SEQ ID NO: 2984443 - protein, 18 aa, Entamoeba invadens
PLSSLWKLLASTPMNTGP

SEQ ID NO: 2984444 - protein, 19 aa, Entamoeba invadens
PLSSVYLLFSLNQRKAVLT

SEQ ID NO: 2984445 - protein, 21 aa, Entamoeba invadens
PLTEYTLRWDVMKKELQNSYK

SEQ ID NO: 2984446 - protein, 23 aa, Entamoeba invadens
PLTRCKITFLKWVVPEVALKELS

SEQ ID NO: 2984447 - protein, 17 aa, Entamoeba invadens
PLVEFPVCLSRCVSLKT

SEQ ID NO: 2984448 - protein, 19 aa, Entamoeba invadens
PLVRPELFFSKLTQGAKGV

SEQ ID NO: 2984449 - protein, 17 aa, Entamoeba invadens
PLYQGKVLYDFVMKNSE

SEQ ID NO: 2984450 - protein, 19 aa, Entamoeba invadens
PLYYCPFCGSSMGKSSVRI

SEQ ID NO: 2984451 - protein, 17 aa, Entamoeba invadens
PMCVPVCPAHINIPQFI

SEQ ID NO: 2984452 - protein, 17 aa, Entamoeba invadens
PMDAFLCVRGMKTLPLR

SEQ ID NO: 2984453 - protein, 17 aa, Entamoeba invadens
PMLFLDMFRIFNSHYLL

SEQ ID NO: 2984454 - protein, 18 aa, Entamoeba invadens
PMQFWLYYVIDVEKHKLA

SEQ ID NO: 2984455 - protein, 17 aa, Entamoeba invadens
PMWKRGTFTLPFSYLNF

SEQ ID NO: 2984456 - protein, 24 aa, Entamoeba invadens
PMWRIADNGIMEWFQLRNFGDFEI

SEQ ID NO: 2984457 - protein, 19 aa, Entamoeba invadens
PNCIYRCVEYLKKHGKNCE

SEQ ID NO: 2984458 - protein, 17 aa, Entamoeba invadens
PNFELCHLFGAEKGINC

SEQ ID NO: 2984459 - protein, 20 aa, Entamoeba invadens
PNFKRMKCAVLNASCSSTEL

SEQ ID NO: 2984460 - protein, 22 aa, Entamoeba invadens
PNGDFASAMGFYSGKYKMYCVK

SEQ ID NO: 2984461 - protein, 23 aa, Entamoeba invadens
PNGFIFKYLMFFLTKVVEKSDIN

SEQ ID NO: 2984462 - protein, 17 aa, Entamoeba invadens
PNHIWKGAVTLLRPRTL

SEQ ID NO: 2984463 - protein, 18 aa, Entamoeba invadens
PNIETLYIWSRKDETFGN

SEQ ID NO: 2984464 - protein, 20 aa, Entamoeba invadens
PNILKLQWRMQLCDVLDVSD

SEQ ID NO: 2984465 - protein, 22 aa, Entamoeba invadens
PNIPLPIMFCKSVVMNGIANAT

SEQ ID NO: 2984466 - protein, 19 aa, Entamoeba invadens
PNKRAVVFEQFFRIDTVWN

SEQ ID NO: 2984467 - protein, 18 aa, Entamoeba invadens
PNKRPGFMEIYKRLEEVR

SEQ ID NO: 2984468 - protein, 18 aa, Entamoeba invadens
PNLVREENTLIALKKKLE

SEQ ID NO: 2984469 - protein, 18 aa, Entamoeba invadens
PNLYEGWGKKQGGAVKTW

SEQ ID NO: 2984470 - protein, 22 aa, Entamoeba invadens
PNNFYCCVFCANILEEEGRVEE

SEQ ID NO: 2984471 - protein, 25 aa, Entamoeba invadens
PNRCCKACFFNNFIPGYDCKIADAC

SEQ ID NO: 2984472 - protein, 23 aa, Entamoeba invadens
PNSLQFIGSFAFSNAKLVDVTIP

SEQ ID NO: 2984473 - protein, 18 aa, Entamoeba invadens
PNSWGFKQLFVYKLIKKQ

SEQ ID NO: 2984474 - protein, 20 aa, Entamoeba invadens
PNVECLWVFEGDVVTVYDIT

SEQ ID NO: 2984475 - protein, 18 aa, Entamoeba invadens
PNYSAAMDLFFRLGADIE

SEQ ID NO: 2984476 - protein, 17 aa, Entamoeba invadens
PPCIFGMRLESLNRLPR

SEQ ID NO: 2984477 - protein, 19 aa, Entamoeba invadens
PPEQRLPLYATDNDAYEFV

SEQ ID NO: 2984478 - protein, 22 aa, Entamoeba invadens
PPEVCAAVLKSYFRSMPDPLVD

SEQ ID NO: 2984479 - protein, 17 aa, Entamoeba invadens
PPFPYPSWRSVVLPQGF

SEQ ID NO: 2984480 - protein, 17 aa, Entamoeba invadens
PPHGFGCCGDGFPDGCP

SEQ ID NO: 2984481 - protein, 19 aa, Entamoeba invadens
PPIYWRYAFEEHVWSDPIP

SEQ ID NO: 2984482 - protein, 21 aa, Entamoeba invadens
PPKKCHCSLCQKKDVFQAEDP

SEQ ID NO: 2984483 - protein, 25 aa, Entamoeba invadens
PPLFFFRLPFIFNFFPNLSTLRGNL

SEQ ID NO: 2984484 - protein, 25 aa, Entamoeba invadens
PPLLPFIQKILFHWFKHEEKVKNVF

SEQ ID NO: 2984485 - protein, 17 aa, Entamoeba invadens
PPLSSAVLAEFVGGGPL

SEQ ID NO: 2984486 - protein, 19 aa, Entamoeba invadens
PPNNCWPARIFVQKLFTAA

SEQ ID NO: 2984487 - protein, 21 aa, Entamoeba invadens
PPPGMGMPGMMGGFGAPQVLN

SEQ ID NO: 2984488 - protein, 23 aa, Entamoeba invadens
PPPSGIFRPVFNPVGVEGQFVPY

SEQ ID NO: 2984489 - protein, 23 aa, Entamoeba invadens
PPQFPCVYHIPSYDEFPPSFYKK

SEQ ID NO: 2984490 - protein, 17 aa, Entamoeba invadens
PPTGGYCELMWSDPDEN

SEQ ID NO: 2984491 - protein, 19 aa, Entamoeba invadens
PPTHPIRLGLALNFSVFYY

SEQ ID NO: 2984492 - protein, 22 aa, Entamoeba invadens
PPTTEFFQWFTLMNEKYGEFKI

SEQ ID NO: 2984493 - protein, 17 aa, Entamoeba invadens
PPYHLAFVIGGTSAEKN

SEQ ID NO: 2984494 - protein, 18 aa, Entamoeba invadens
PQAWIVCAQYFQRRGNID

SEQ ID NO: 2984495 - protein, 22 aa, Entamoeba invadens
PQDLKGSFKLSVRRERSKTAVI

SEQ ID NO: 2984496 - protein, 17 aa, Entamoeba invadens
PQFLDMGVFAFDEQMEP

SEQ ID NO: 2984497 - protein, 20 aa, Entamoeba invadens
PQFVCGAQFEILHSTQKFTL

SEQ ID NO: 2984498 - protein, 17 aa, Entamoeba invadens
PQGNRGGNTYDFSSQKK

SEQ ID NO: 2984499 - protein, 18 aa, Entamoeba invadens
PQHPRLGLPKVPSKPPIS

SEQ ID NO: 2984500 - protein, 18 aa, Entamoeba invadens
PQKVRFVGSFAFKNCEQL

SEQ ID NO: 2984501 - protein, 21 aa, Entamoeba invadens
PQLFLLRWVRILFCQVFNTTD

SEQ ID NO: 2984502 - protein, 23 aa, Entamoeba invadens
PQNRWMIQFPRIFHVCRGKKENF

SEQ ID NO: 2984503 - protein, 23 aa, Entamoeba invadens
PQPKPEVLDGFRLDIRVGEIVEA

SEQ ID NO: 2984504 - protein, 26 aa, Entamoeba invadens
PQPPRKELNLLWASTKMILERDGLLQ

SEQ ID NO: 2984505 - protein, 18 aa, Entamoeba invadens
PQQAGACAQQPQGAAQTA

SEQ ID NO: 2984506 - protein, 19 aa, Entamoeba invadens
PQQRRFGGMLGNKQPRRIE

SEQ ID NO: 2984507 - protein, 30 aa, Entamoeba invadens
PQSCCDCTFPLFCFPVCYQCKKVVYNCSHQ

SEQ ID NO: 2984508 - protein, 25 aa, Entamoeba invadens
PQSPRFSLPSGLLVLRFDKPETQIN

SEQ ID NO: 2984509 - protein, 23 aa, Entamoeba invadens
PQTKLVCLFDWGFVQDCCPKTYE

SEQ ID NO: 2984510 - protein, 20 aa, Entamoeba invadens
PQTVRYVGWYAFSECYKLKH

SEQ ID NO: 2984511 - protein, 18 aa, Entamoeba invadens
PQVFSLFKKCDIIPIIYN

SEQ ID NO: 2984512 - protein, 20 aa, Entamoeba invadens
PQYLLCLIIYKSRYFSLTNA

SEQ ID NO: 2984513 - protein, 19 aa, Entamoeba invadens
PRCVCNLTTLKTLFLSNNL

SEQ ID NO: 2984514 - protein, 18 aa, Entamoeba invadens
PRDMFKFISSHIETYDVG

SEQ ID NO: 2984515 - protein, 20 aa, Entamoeba invadens
PRELAVKFVEAFGGVEKTLE

SEQ ID NO: 2984516 - protein, 17 aa, Entamoeba invadens
PREMFRYPWEVVNFITG

SEQ ID NO: 2984517 - protein, 18 aa, Entamoeba invadens
PREMFRYPWEVVNFITGG

SEQ ID NO: 2984518 - protein, 18 aa, Entamoeba invadens
PRFGDVGVEMAFKLEEMA

SEQ ID NO: 2984519 - protein, 21 aa, Entamoeba invadens
PRGQNGFGFDGCFVPNGYDKT

SEQ ID NO: 2984520 - protein, 19 aa, Entamoeba invadens
PRGSLLFEKFIPYFTKDQI

SEQ ID NO: 2984521 - protein, 20 aa, Entamoeba invadens
PRHFFCIIVWYKVSYEDAQI

SEQ ID NO: 2984522 - protein, 17 aa, Entamoeba invadens
PRHLLEFYRRYIPKQTG

SEQ ID NO: 2984523 - protein, 19 aa, Entamoeba invadens
PRHVVIPAFLIDSGKEPRV

SEQ ID NO: 2984524 - protein, 17 aa, Entamoeba invadens
PRIEEMFTLLPTSDDKT

SEQ ID NO: 2984525 - protein, 18 aa, Entamoeba invadens
PRIFGFDPMHLMLKQKSN

SEQ ID NO: 2984526 - protein, 17 aa, Entamoeba invadens
PRITSAFSVVDMDKYFI

SEQ ID NO: 2984527 - protein, 22 aa, Entamoeba invadens
PRKRGRLELMYGKEMQEESYTE

SEQ ID NO: 2984528 - protein, 18 aa, Entamoeba invadens
PRMPCFSVTLDFLKSLPK

SEQ ID NO: 2984529 - protein, 22 aa, Entamoeba invadens
PRNCKMCRECIRDQRQEFVKLG

SEQ ID NO: 2984530 - protein, 19 aa, Entamoeba invadens
PRPGTPILQMESIAGPSSV

SEQ ID NO: 2984531 - protein, 21 aa, Entamoeba invadens
PRSVTSIGLLCFDGCISLKEV

SEQ ID NO: 2984532 - protein, 19 aa, Entamoeba invadens
PRTPVPMIRMFNPRINTTD

SEQ ID NO: 2984533 - protein, 22 aa, Entamoeba invadens
PRVRHAAIVFALKVFKLYPKTQ

SEQ ID NO: 2984534 - protein, 19 aa, Entamoeba invadens
PRYKLLLEQLIKFTPPTHC

SEQ ID NO: 2984535 - protein, 20 aa, Entamoeba invadens
PSCMCANCIQTAVDITEGIP

SEQ ID NO: 2984536 - protein, 20 aa, Entamoeba invadens
PSDIFLFAIIIHKHLLGKNH

SEQ ID NO: 2984537 - protein, 22 aa, Entamoeba invadens
PSDLRKAALLCFGRTINQIEDI

SEQ ID NO: 2984538 - protein, 19 aa, Entamoeba invadens
PSGCLPRSLDVILRGDLVE

SEQ ID NO: 2984539 - protein, 20 aa, Entamoeba invadens
PSGICGVALYLAGRLHNEPR

SEQ ID NO: 2984540 - protein, 21 aa, Entamoeba invadens
PSHLSVLFKYIFNVSITQELY

SEQ ID NO: 2984541 - protein, 20 aa, Entamoeba invadens
PSKLKAHLTKLFSPFGVVLT

SEQ ID NO: 2984542 - protein, 18 aa, Entamoeba invadens
PSLFEGWAKKQGGAVKTW

SEQ ID NO: 2984543 - protein, 19 aa, Entamoeba invadens
PSLLCCLSQLVAVVSSNCD

SEQ ID NO: 2984544 - protein, 18 aa, Entamoeba invadens
PSLLEFWSSVPLEEYLSD

SEQ ID NO: 2984545 - protein, 20 aa, Entamoeba invadens
PSLLFGRPSVMAMFASGRPS

SEQ ID NO: 2984546 - protein, 18 aa, Entamoeba invadens
PSLWKLSLCDKIQFLDGP

SEQ ID NO: 2984547 - protein, 23 aa, Entamoeba invadens
PSNMKLTYLESWRVVELSNALFG

SEQ ID NO: 2984548 - protein, 18 aa, Entamoeba invadens
PSPLCSSGSFSRRSGTIK

SEQ ID NO: 2984549 - protein, 21 aa, Entamoeba invadens
PSQEMSLLWSLFDQEMKHRFL

SEQ ID NO: 2984550 - protein, 17 aa, Entamoeba invadens
PSQHVFLALSFRGKMNP

SEQ ID NO: 2984551 - protein, 18 aa, Entamoeba invadens
PSSALLFATFDGREELVA

SEQ ID NO: 2984552 - protein, 23 aa, Entamoeba invadens
PSSENWLKWIVSVGEEFEFDFKK

SEQ ID NO: 2984553 - protein, 24 aa, Entamoeba invadens
PSVCAFPFVFGERGLGIEMKNTVC

SEQ ID NO: 2984554 - protein, 18 aa, Entamoeba invadens
PSVIHRLKLATGKPIVIP

SEQ ID NO: 2984555 - protein, 23 aa, Entamoeba invadens
PSVKWQVPDSFSFAYKELKDEIY

SEQ ID NO: 2984556 - protein, 17 aa, Entamoeba invadens
PSWNLWSDVFAKRTTFF

SEQ ID NO: 2984557 - protein, 18 aa, Entamoeba invadens
PTCFIDFGKIVLIEKTPV

SEQ ID NO: 2984558 - protein, 18 aa, Entamoeba invadens
PTCIIDFSKIVLIEKTPV

SEQ ID NO: 2984559 - protein, 30 aa, Entamoeba invadens
PTDFVFGCAVPLCTSTGYFSLENVKEKTCG

SEQ ID NO: 2984560 - protein, 19 aa, Entamoeba invadens
PTEGFWLNYVIKAYGDSME

SEQ ID NO: 2984561 - protein, 17 aa, Entamoeba invadens
PTFIKRKIIESGNALKF

SEQ ID NO: 2984562 - protein, 18 aa, Entamoeba invadens
PTGISKLRIDSCPIFTLS

SEQ ID NO: 2984563 - protein, 17 aa, Entamoeba invadens
PTHPIRLGLALNFSVFY

SEQ ID NO: 2984564 - protein, 23 aa, Entamoeba invadens
PTIFKRSLDIIASFTHKMTNTLD

SEQ ID NO: 2984565 - protein, 19 aa, Entamoeba invadens
PTLIFPFTPTHTFFMRAHP

SEQ ID NO: 2984566 - protein, 20 aa, Entamoeba invadens
PTLRCLRILRGGATNEPLEP

SEQ ID NO: 2984567 - protein, 20 aa, Entamoeba invadens
PTPFPLILSFIVSCKLQHTN

SEQ ID NO: 2984568 - protein, 24 aa, Entamoeba invadens
PTPIIPTNCYDFFVSEEVVSDISN

SEQ ID NO: 2984569 - protein, 22 aa, Entamoeba invadens
PTSFCKLAIRLEEILGEEDKTK

SEQ ID NO: 2984570 - protein, 18 aa, Entamoeba invadens
PTTPRPGTPILQMESIAG

SEQ ID NO: 2984571 - protein, 18 aa, Entamoeba invadens
PTVDEVLRRLAVLDEDMK

SEQ ID NO: 2984572 - protein, 20 aa, Entamoeba invadens
PTVMFCDSIGFLSANFYAKN

SEQ ID NO: 2984573 - protein, 24 aa, Entamoeba invadens
PTYCLSCPPGFYISNNICKTNSEL

SEQ ID NO: 2984574 - protein, 20 aa, Entamoeba invadens
PVACAWPYLFGENGIGIDQK

SEQ ID NO: 2984575 - protein, 17 aa, Entamoeba invadens
PVEMVELFLGDKINEFL

SEQ ID NO: 2984576 - protein, 19 aa, Entamoeba invadens
PVFEHLRLTHVYSLDDIPS

SEQ ID NO: 2984577 - protein, 17 aa, Entamoeba invadens
PVIFRIFIFGSLPPNFG

SEQ ID NO: 2984578 - protein, 18 aa, Entamoeba invadens
PVIQAQLFSLIGDFKMNN

SEQ ID NO: 2984579 - protein, 17 aa, Entamoeba invadens
PVKSCNFILKLIKSAVD

SEQ ID NO: 2984580 - protein, 23 aa, Entamoeba invadens
PVLADDMFYFWIASCPILPSSEK

SEQ ID NO: 2984581 - protein, 19 aa, Entamoeba invadens
PVLVITFGFGKPVNFLDKS

SEQ ID NO: 2984582 - protein, 19 aa, Entamoeba invadens
PVNEYGISMIDLWNKKGVV

SEQ ID NO: 2984583 - protein, 19 aa, Entamoeba invadens
PVQRFPRYVLLLDSLIKAT

SEQ ID NO: 2984584 - protein, 24 aa, Entamoeba invadens
PVQRLPRYQLLLVDLFKNTPKDHE

SEQ ID NO: 2984585 - protein, 24 aa, Entamoeba invadens
PVQRLPRYRLLLTDLIKHTDDAFP

SEQ ID NO: 2984586 - protein, 20 aa, Entamoeba invadens
PVQRLPRYVLLLNELKKHTW

SEQ ID NO: 2984587 - protein, 19 aa, Entamoeba invadens
PVQRLPRYVLLLNELLKRT

SEQ ID NO: 2984588 - protein, 23 aa, Entamoeba invadens
PVQYRPRRSTVFADSKVDELNPK

SEQ ID NO: 2984589 - protein, 19 aa, Entamoeba invadens
PVRFFSLLLYYHIVTSLRS

SEQ ID NO: 2984590 - protein, 22 aa, Entamoeba invadens
PVSEFKGDVIIVQMTQKKKNLP

SEQ ID NO: 2984591 - protein, 24 aa, Entamoeba invadens
PVSTCVRLGPFIPRLMTYLKQVEF

SEQ ID NO: 2984592 - protein, 18 aa, Entamoeba invadens
PVTIRYIGDRVFKSCKKL

SEQ ID NO: 2984593 - protein, 22 aa, Entamoeba invadens
PVTNCSKCQILIHTSNCNHYAY

SEQ ID NO: 2984594 - protein, 18 aa, Entamoeba invadens
PVVILRPSIIYGQGDVTG

SEQ ID NO: 2984595 - protein, 22 aa, Entamoeba invadens
PWFNQEMMNFFLSKYLPDYPQM

SEQ ID NO: 2984596 - protein, 20 aa, Entamoeba invadens
PWHDLHCMIEGPAVFDVDRN

SEQ ID NO: 2984597 - protein, 21 aa, Entamoeba invadens
PWLQIKLFRLLAGVQLDEQQK

SEQ ID NO: 2984598 - protein, 18 aa, Entamoeba invadens
PYETKWLLLQKHVPDASQ

SEQ ID NO: 2984599 - protein, 18 aa, Entamoeba invadens
PYEVTSWMLKEWQKTRGS

SEQ ID NO: 2984600 - protein, 19 aa, Entamoeba invadens
PYEYAMRALNKFKLDDFNL

SEQ ID NO: 2984601 - protein, 17 aa, Entamoeba invadens
PYFIRLGTRSAKDAFSP

SEQ ID NO: 2984602 - protein, 19 aa, Entamoeba invadens
PYFVFCFTNVFSVGQIVGD

SEQ ID NO: 2984603 - protein, 18 aa, Entamoeba invadens
PYGPLPMYQPFPMCNPFQ

SEQ ID NO: 2984604 - protein, 17 aa, Entamoeba invadens
PYIQLMWALMKIRLEND

SEQ ID NO: 2984605 - protein, 20 aa, Entamoeba invadens
PYMAEWSVVCDFTLLKILAT

SEQ ID NO: 2984606 - protein, 24 aa, Entamoeba invadens
PYMFSNRFPQIFYDMLSRDGGSLG

SEQ ID NO: 2984607 - protein, 19 aa, Entamoeba invadens
PYNLPTMFMIPYSMNEIQQ

SEQ ID NO: 2984608 - protein, 24 aa, Entamoeba invadens
PYPKIRFKFAWDIVDFVVSGKRLK

SEQ ID NO: 2984609 - protein, 17 aa, Entamoeba invadens
PYPKSDFKYAWSIADFV

SEQ ID NO: 2984610 - protein, 19 aa, Entamoeba invadens
PYPSWRSVVLPQGFVMFYY

SEQ ID NO: 2984611 - protein, 18 aa, Entamoeba invadens
PYPYEFVAIITPPLNPLE

SEQ ID NO: 2984612 - protein, 18 aa, Entamoeba invadens
PYQFFPIYTHFMINKYTG

SEQ ID NO: 2984613 - protein, 20 aa, Entamoeba invadens
PYQFFPIYTPFMINKYTGRR

SEQ ID NO: 2984614 - protein, 23 aa, Entamoeba invadens
PYRDAFKYCRRWLEDSLQKSVSE

SEQ ID NO: 2984615 - protein, 19 aa, Entamoeba invadens
PYSIYTYRYFLRNWPNLCF

SEQ ID NO: 2984616 - protein, 18 aa, Entamoeba invadens
PYVHCFPDIFFVMKENFK

SEQ ID NO: 2984617 - protein, 26 aa, Entamoeba invadens
PYYNSIREEIEFNLLFTLEKRKQLFQ

SEQ ID NO: 2984618 - protein, 18 aa, Entamoeba invadens
QADAVAICFAIDPKESFE

SEQ ID NO: 2984619 - protein, 17 aa, Entamoeba invadens
QAFTFALELLKNVSQLD

SEQ ID NO: 2984620 - protein, 25 aa, Entamoeba invadens
QAIGKMCPICGCKFVDMERHMKYHQ

SEQ ID NO: 2984621 - protein, 19 aa, Entamoeba invadens
QAIRFLTVWISNFSNEIKK

SEQ ID NO: 2984622 - protein, 24 aa, Entamoeba invadens
QAKEYPVVVPVEFLVFLARVWTIR

SEQ ID NO: 2984623 - protein, 23 aa, Entamoeba invadens
QAKRLKYIGVMGTGFNNVDIDYC

SEQ ID NO: 2984624 - protein, 17 aa, Entamoeba invadens
QALLDFFIEKMICETEQ

SEQ ID NO: 2984625 - protein, 17 aa, Entamoeba invadens
QALLRPGRFDRILYVGL

SEQ ID NO: 2984626 - protein, 20 aa, Entamoeba invadens
QALSHPWFKGVSQITVTDGI

SEQ ID NO: 2984627 - protein, 25 aa, Entamoeba invadens
QALSRGCAQLAFYLKALAANSSVVL

SEQ ID NO: 2984628 - protein, 20 aa, Entamoeba invadens
QARMSWKFFESYSLYLSAQL

SEQ ID NO: 2984629 - protein, 17 aa, Entamoeba invadens
QATEIIAIIVTFGGIDI

SEQ ID NO: 2984630 - protein, 18 aa, Entamoeba invadens
QAVWMLNALWLKEKDAHA

SEQ ID NO: 2984631 - protein, 20 aa, Entamoeba invadens
QAYCASHLFLTLLPSNFNLK

SEQ ID NO: 2984632 - protein, 17 aa, Entamoeba invadens
QAYPGYPQQAGACAQQP

SEQ ID NO: 2984633 - protein, 20 aa, Entamoeba invadens
QCEPVFPIVVKDVGKFDVAF

SEQ ID NO: 2984634 - protein, 21 aa, Entamoeba invadens
QCFECGIKILYEFFLIFVNAE

SEQ ID NO: 2984635 - protein, 17 aa, Entamoeba invadens
QCFKNSLSFAFYRFPRS

SEQ ID NO: 2984636 - protein, 17 aa, Entamoeba invadens
QCFRRCSRLNLLELNSL

SEQ ID NO: 2984637 - protein, 18 aa, Entamoeba invadens
QCFSHKEVHLIFPTDHDI

SEQ ID NO: 2984638 - protein, 18 aa, Entamoeba invadens
QCGDGIWTLVQIDFGSNR

SEQ ID NO: 2984639 - protein, 19 aa, Entamoeba invadens
QCGSCYSFGSLASLEGRLL

SEQ ID NO: 2984640 - protein, 21 aa, Entamoeba invadens
QCIKCKLVMHKMCDPYNTAEM

SEQ ID NO: 2984641 - protein, 17 aa, Entamoeba invadens
QCIKCPLGTYSDTIGAI

SEQ ID NO: 2984642 - protein, 22 aa, Entamoeba invadens
QCKGCKKFLAGTTWFYCEPESK

SEQ ID NO: 2984643 - protein, 17 aa, Entamoeba invadens
QCLHSLSNIKGRLPTKA

SEQ ID NO: 2984644 - protein, 19 aa, Entamoeba invadens
QCYELLQYHFLNFNKIIES

SEQ ID NO: 2984645 - protein, 17 aa, Entamoeba invadens
QDCKAAEKLAKEPNEKK

SEQ ID NO: 2984646 - protein, 20 aa, Entamoeba invadens
QDGKMKWALLSRRIDQLDQL

SEQ ID NO: 2984647 - protein, 22 aa, Entamoeba invadens
QDLKVGVLVLEFFTDVMKSETK

SEQ ID NO: 2984648 - protein, 23 aa, Entamoeba invadens
QDMPSRCGWGIGQFLGWDQDGFK

SEQ ID NO: 2984649 - protein, 19 aa, Entamoeba invadens
QDTEVLFGITFKTRANAIT

SEQ ID NO: 2984650 - protein, 19 aa, Entamoeba invadens
QDVYKRLGINDVVTKLESI

SEQ ID NO: 2984651 - protein, 22 aa, Entamoeba invadens
QDYPCANSSCLGFLQQSEQQSQ

SEQ ID NO: 2984652 - protein, 21 aa, Entamoeba invadens
QEEPRVPFVPPEVTQVEATTN

SEQ ID NO: 2984653 - protein, 20 aa, Entamoeba invadens
QEGFGVKATPYWGYAYQNGQ

SEQ ID NO: 2984654 - protein, 22 aa, Entamoeba invadens
QEIDLRVGAAFTRLQTTFLKEK

SEQ ID NO: 2984655 - protein, 18 aa, Entamoeba invadens
QEIYIRWKTRKLIRERNY

SEQ ID NO: 2984656 - protein, 24 aa, Entamoeba invadens
QELDLRTGAAFTRFQTTLLKRQVP

SEQ ID NO: 2984657 - protein, 18 aa, Entamoeba invadens
QELECFGLIFGVGDKKVI

SEQ ID NO: 2984658 - protein, 18 aa, Entamoeba invadens
QELFPYVDADTIKSVLID

SEQ ID NO: 2984659 - protein, 17 aa, Entamoeba invadens
QELIPFWDALRDCLDSD

SEQ ID NO: 2984660 - protein, 17 aa, Entamoeba invadens
QELMLGFCFEPRPSAKA

SEQ ID NO: 2984661 - protein, 19 aa, Entamoeba invadens
QELRLKQQFFFTSASLQDI

SEQ ID NO: 2984662 - protein, 19 aa, Entamoeba invadens
QELYMRMSVTNFLEIPPDI

SEQ ID NO: 2984663 - protein, 25 aa, Entamoeba invadens
QELYWSGVVGLNFERFVFRGLSCQF

SEQ ID NO: 2984664 - protein, 20 aa, Entamoeba invadens
QENFSITLIEIFFKELFLSQ

SEQ ID NO: 2984665 - protein, 20 aa, Entamoeba invadens
QERPIFIGGVPLVMNVTLPL

SEQ ID NO: 2984666 - protein, 18 aa, Entamoeba invadens
QETLKLVIWYTVDYQSSL

SEQ ID NO: 2984667 - protein, 23 aa, Entamoeba invadens
QETLLKLMTFFGVEKKYMTVENV

SEQ ID NO: 2984668 - protein, 21 aa, Entamoeba invadens
QEVLRSEALVNHIKGIVTTEI

SEQ ID NO: 2984669 - protein, 17 aa, Entamoeba invadens
QEVPNSFYLVKANVEMI

SEQ ID NO: 2984670 - protein, 23 aa, Entamoeba invadens
QEVTEFLLLFGIECQRVSDPSLL

SEQ ID NO: 2984671 - protein, 17 aa, Entamoeba invadens
QFCNFFFERGRFMVVMD

SEQ ID NO: 2984672 - protein, 24 aa, Entamoeba invadens
QFDLPRFIGIGLFTDVGYSQGIRN

SEQ ID NO: 2984673 - protein, 30 aa, Entamoeba invadens
QFIDFRTAEVFGFGHLKGALNIPYAENWKE

SEQ ID NO: 2984674 - protein, 18 aa, Entamoeba invadens
QFKRYGTVESIEFKDKEE

SEQ ID NO: 2984675 - protein, 22 aa, Entamoeba invadens
QFMNCVKYLFGEVCDEKKTKSY

SEQ ID NO: 2984676 - protein, 20 aa, Entamoeba invadens
QFMWELRLVFSSGLTQLEEV

SEQ ID NO: 2984677 - protein, 21 aa, Entamoeba invadens
QFPGMGGMGAMPGMGMGGMPN

SEQ ID NO: 2984678 - protein, 17 aa, Entamoeba invadens
QFREISFQFDFFGVKKM

SEQ ID NO: 2984679 - protein, 23 aa, Entamoeba invadens
QFSLDYFKPHHKAIFINIPVTKY

SEQ ID NO: 2984680 - protein, 19 aa, Entamoeba invadens
QFTFKHVYLDLGMNPTLVV

SEQ ID NO: 2984681 - protein, 26 aa, Entamoeba invadens
QFWEVFISMMWRFYRNKSISYNTKRK

SEQ ID NO: 2984682 - protein, 24 aa, Entamoeba invadens
QFWKCSKCGKVFWVGSQTKNIVAS

SEQ ID NO: 2984683 - protein, 17 aa, Entamoeba invadens
QFYREIKYLSSLKHENI

SEQ ID NO: 2984684 - protein, 23 aa, Entamoeba invadens
QGCACLRSAAKVPILVNMRVKER

SEQ ID NO: 2984685 - protein, 23 aa, Entamoeba invadens
QGDIYYCMICEFRGKKTTAYNHS

SEQ ID NO: 2984686 - protein, 20 aa, Entamoeba invadens
QGESELCEWDVFKGYVKETT

SEQ ID NO: 2984687 - protein, 25 aa, Entamoeba invadens
QGFLLGILMCYDFTIKIRRLYKKGH

SEQ ID NO: 2984688 - protein, 17 aa, Entamoeba invadens
QGGLMLAPRLKVKPHFK

SEQ ID NO: 2984689 - protein, 21 aa, Entamoeba invadens
QGMLLCIGCIDLNSENNQAAF

SEQ ID NO: 2984690 - protein, 18 aa, Entamoeba invadens
QGMWFYPLVKSIRSEQFT

SEQ ID NO: 2984691 - protein, 20 aa, Entamoeba invadens
QGRCVVFKAPLLKIPNECFT

SEQ ID NO: 2984692 - protein, 19 aa, Entamoeba invadens
QGSPLMAGTSFVFDQSDFK

SEQ ID NO: 2984693 - protein, 25 aa, Entamoeba invadens
QHLRSGSCGIVFDFHTFRGLKVDWG

SEQ ID NO: 2984694 - protein, 19 aa, Entamoeba invadens
QIFAWSRRSVGRVLFDYAS

SEQ ID NO: 2984695 - protein, 19 aa, Entamoeba invadens
QIGGVPIEPEHPVEEQPVV

SEQ ID NO: 2984696 - protein, 18 aa, Entamoeba invadens
QIKDWISVLAEIFKANII

SEQ ID NO: 2984697 - protein, 35 aa, Entamoeba invadens
QIKVRENVPVMGSREGFESEVKRVLNIEESWGKMK

SEQ ID NO: 2984698 - protein, 17 aa, Entamoeba invadens
QILHCAEALPVQAFTPV

SEQ ID NO: 2984699 - protein, 18 aa, Entamoeba invadens
QINFRLDLVQSFVDNSPA

SEQ ID NO: 2984700 - protein, 20 aa, Entamoeba invadens
QIPLEVCIRSPDAELATSLH

SEQ ID NO: 2984701 - protein, 18 aa, Entamoeba invadens
QIRFRIAQLEFKKKEYKK

SEQ ID NO: 2984702 - protein, 18 aa, Entamoeba invadens
QISSAQILHWARKLNNLQ

SEQ ID NO: 2984703 - protein, 20 aa, Entamoeba invadens
QIVKDLKTIFGIKDEIKCFL

SEQ ID NO: 2984704 - protein, 22 aa, Entamoeba invadens
QIWKFCLAYGYRIVTTILPTKS

SEQ ID NO: 2984705 - protein, 17 aa, Entamoeba invadens
QKAFAFYRDVLKSPHVI

SEQ ID NO: 2984706 - protein, 20 aa, Entamoeba invadens
QKAFCTLDFALQLAQNPNRN

SEQ ID NO: 2984707 - protein, 17 aa, Entamoeba invadens
QKCHGAFLLFDLHSENS

SEQ ID NO: 2984708 - protein, 20 aa, Entamoeba invadens
QKCTMKWRKGLFPWNRGKEF

SEQ ID NO: 2984709 - protein, 24 aa, Entamoeba invadens
QKDVLRFKFAWDIADFTSAGKRLI

SEQ ID NO: 2984710 - protein, 23 aa, Entamoeba invadens
QKERLNNILSFCGFETDDQAEKC

SEQ ID NO: 2984711 - protein, 24 aa, Entamoeba invadens
QKGRGIELFGCIAKAIGKDAFRPY

SEQ ID NO: 2984712 - protein, 19 aa, Entamoeba invadens
QKKFRVMIVLPAWSEGELQ

SEQ ID NO: 2984713 - protein, 23 aa, Entamoeba invadens
QKKICGPNSLFYGTVKDALESYL

SEQ ID NO: 2984714 - protein, 18 aa, Entamoeba invadens
QKKVKFIGDFAFSGCINL

SEQ ID NO: 2984715 - protein, 26 aa, Entamoeba invadens
QKLLKFKWIDPFNELGFYLFGAGVIS

SEQ ID NO: 2984716 - protein, 22 aa, Entamoeba invadens
QKLRNDALFDFDFEPQQGETIH

SEQ ID NO: 2984717 - protein, 18 aa, Entamoeba invadens
QKNFPRCPWAVTLLYSLS

SEQ ID NO: 2984718 - protein, 24 aa, Entamoeba invadens
QKSHLKEILPFFVYLAGNKIIQKD

SEQ ID NO: 2984719 - protein, 19 aa, Entamoeba invadens
QKSKIVWRTMVEFSKRETG

SEQ ID NO: 2984720 - protein, 26 aa, Entamoeba invadens
QKSRLVFAEICWKKPHLLLLDEPTNH

SEQ ID NO: 2984721 - protein, 19 aa, Entamoeba invadens
QKYAAWRGGAIIANTEAIA

SEQ ID NO: 2984722 - protein, 17 aa, Entamoeba invadens
QKYRKTFKMNFEMKHVE

SEQ ID NO: 2984723 - protein, 20 aa, Entamoeba invadens
QLCLKYCIFITLFVDNTATL

SEQ ID NO: 2984724 - protein, 19 aa, Entamoeba invadens
QLEAFYRKQIDTLNNEKSQ

SEQ ID NO: 2984725 - protein, 22 aa, Entamoeba invadens
QLECLKCGFDTRYNIQKTPSMP

SEQ ID NO: 2984726 - protein, 24 aa, Entamoeba invadens
QLFKEWKSGMPLPMVFVSTSNSVI

SEQ ID NO: 2984727 - protein, 17 aa, Entamoeba invadens
QLFPRSTRFVVPFNFAL

SEQ ID NO: 2984728 - protein, 18 aa, Entamoeba invadens
QLFRKKSVLNWFDQEGKE

SEQ ID NO: 2984729 - protein, 20 aa, Entamoeba invadens
QLIQRPWFFQALEELEYFET

SEQ ID NO: 2984730 - protein, 17 aa, Entamoeba invadens
QLKIAHLKKKVCYVGTF

SEQ ID NO: 2984731 - protein, 21 aa, Entamoeba invadens
QLKMWLEDVLLQFIKSQNKNT

SEQ ID NO: 2984732 - protein, 18 aa, Entamoeba invadens
QLLPKKVVFVLDFCSDNP

SEQ ID NO: 2984733 - protein, 25 aa, Entamoeba invadens
QLLRLLRLVSMYEIHKSTRSQSTSR

SEQ ID NO: 2984734 - protein, 22 aa, Entamoeba invadens
QLLVCLPITYFLNVNKWDLNTM

SEQ ID NO: 2984735 - protein, 17 aa, Entamoeba invadens
QLPECIKEITFLNTTNV

SEQ ID NO: 2984736 - protein, 18 aa, Entamoeba invadens
QLPLRYFIIPALMSQQPR

SEQ ID NO: 2984737 - protein, 22 aa, Entamoeba invadens
QLQDKFPFCRGGTTNGRDFIIF

SEQ ID NO: 2984738 - protein, 18 aa, Entamoeba invadens
QLQFKVIIKKCEYTTSDN

SEQ ID NO: 2984739 - protein, 19 aa, Entamoeba invadens
QLRCNSILEGIRITRLGYP

SEQ ID NO: 2984740 - protein, 20 aa, Entamoeba invadens
QLRFARSVYEGMEFSVNVIT

SEQ ID NO: 2984741 - protein, 23 aa, Entamoeba invadens
QLRIKRFKTKFQFDGEEDPFPME

SEQ ID NO: 2984742 - protein, 21 aa, Entamoeba invadens
QLRPSFEFTKDFKIKSRSQFC

SEQ ID NO: 2984743 - protein, 19 aa, Entamoeba invadens
QLRYIVKYAHLYKPNTTFD

SEQ ID NO: 2984744 - protein, 27 aa, Entamoeba invadens
QLSAKAKSAGICPVCGNAHIDISSVEK

SEQ ID NO: 2984745 - protein, 19 aa, Entamoeba invadens
QLVDFFSHFFCKRIVVRVE

SEQ ID NO: 2984746 - protein, 18 aa, Entamoeba invadens
QLVSIFLSSMSKLLKEEI

SEQ ID NO: 2984747 - protein, 25 aa, Entamoeba invadens
QLYFKTRITTYIAFSKCLSKFSDVH

SEQ ID NO: 2984748 - protein, 21 aa, Entamoeba invadens
QLYRLGIISMYFDKTVETTVT

SEQ ID NO: 2984749 - protein, 17 aa, Entamoeba invadens
QMCHKMSKLRMMLTKIP

SEQ ID NO: 2984750 - protein, 21 aa, Entamoeba invadens
QMCVKRKRPLIIIADTIDGDA

SEQ ID NO: 2984751 - protein, 24 aa, Entamoeba invadens
QMIFKRLFRIYAHIYLHHLNQITQ

SEQ ID NO: 2984752 - protein, 21 aa, Entamoeba invadens
QMLEFGWEWMIQKIISENLVT

SEQ ID NO: 2984753 - protein, 20 aa, Entamoeba invadens
QMRLVCLSLPLGDSKSLRDW

SEQ ID NO: 2984754 - protein, 22 aa, Entamoeba invadens
QNCKEMKEGAFVVSFQNVVLEN

SEQ ID NO: 2984755 - protein, 17 aa, Entamoeba invadens
QNDREWHSFCAHVLQQP

SEQ ID NO: 2984756 - protein, 23 aa, Entamoeba invadens
QNFSRRILFFGAMYTLKLQITIA

SEQ ID NO: 2984757 - protein, 17 aa, Entamoeba invadens
QNITKFGLRCFIHNRIL

SEQ ID NO: 2984758 - protein, 17 aa, Entamoeba invadens
QNLKVIGGFAFYNCTGL

SEQ ID NO: 2984759 - protein, 20 aa, Entamoeba invadens
QNLYEWLSVNGFDFLDEIQL

SEQ ID NO: 2984760 - protein, 24 aa, Entamoeba invadens
QNPEYFKAYEIRLTIKDQIDRFNK

SEQ ID NO: 2984761 - protein, 27 aa, Entamoeba invadens
QNPLLLSVCELLKYYFCGEMRSVLLKA

SEQ ID NO: 2984762 - protein, 17 aa, Entamoeba invadens
QNREYFIAYEIRVTLND

SEQ ID NO: 2984763 - protein, 17 aa, Entamoeba invadens
QNRGFKFLIPKMIYLEA

SEQ ID NO: 2984764 - protein, 24 aa, Entamoeba invadens
QNVKLCLDAGYQLLNIPRLLDENY

SEQ ID NO: 2984765 - protein, 18 aa, Entamoeba invadens
QNWLRPGQTVSVRIFEMP

SEQ ID NO: 2984766 - protein, 23 aa, Entamoeba invadens
QPDKRLLVLYVIDMIVKLDVTRI

SEQ ID NO: 2984767 - protein, 22 aa, Entamoeba invadens
QPIKWCWPIGVIFDALHNGSLP

SEQ ID NO: 2984768 - protein, 18 aa, Entamoeba invadens
QPKELKFEDFVCVNNCEK

SEQ ID NO: 2984769 - protein, 17 aa, Entamoeba invadens
QPKSSWFGWGSKPLPQP

SEQ ID NO: 2984770 - protein, 22 aa, Entamoeba invadens
QPLCPASFLLRCDTLNEYTGNY

SEQ ID NO: 2984771 - protein, 17 aa, Entamoeba invadens
QPMLFAYCKIMIKGVEL

SEQ ID NO: 2984772 - protein, 21 aa, Entamoeba invadens
QPPLVICRETLDMFIERTKAN

SEQ ID NO: 2984773 - protein, 24 aa, Entamoeba invadens
QPSEFFSFITFHLWSYGEYTINYN

SEQ ID NO: 2984774 - protein, 21 aa, Entamoeba invadens
QPSMCLRLCFCPLCDKQQMLL

SEQ ID NO: 2984775 - protein, 18 aa, Entamoeba invadens
QPTCREFPDAIFGEDTAV

SEQ ID NO: 2984776 - protein, 23 aa, Entamoeba invadens
QPTTCPLCHFGLVQVKNKTTTET

SEQ ID NO: 2984777 - protein, 23 aa, Entamoeba invadens
QQDFLVLYLDWVVKMILDGGFIA

SEQ ID NO: 2984778 - protein, 17 aa, Entamoeba invadens
QQFQAQNSFGWSPVALN

SEQ ID NO: 2984779 - protein, 17 aa, Entamoeba invadens
QQGGFVIIDVFEKNVPK

SEQ ID NO: 2984780 - protein, 23 aa, Entamoeba invadens
QQILDCFNGFCARTKKRGDQAIG

SEQ ID NO: 2984781 - protein, 20 aa, Entamoeba invadens
QQKRRCGFSTKRLQRNWRNS

SEQ ID NO: 2984782 - protein, 19 aa, Entamoeba invadens
QQLELLVRCVFKIPEAFVS

SEQ ID NO: 2984783 - protein, 23 aa, Entamoeba invadens
QQLNEVRKLWAIIHNTKTVDKTK

SEQ ID NO: 2984784 - protein, 24 aa, Entamoeba invadens
QQQRTKFILKNCNPTWNETFEFHN

SEQ ID NO: 2984785 - protein, 17 aa, Entamoeba invadens
QRAESSMSLSLDMTTAK

SEQ ID NO: 2984786 - protein, 27 aa, Entamoeba invadens
QRASFKMCTFFGIIMPECQFISMQIGD

SEQ ID NO: 2984787 - protein, 24 aa, Entamoeba invadens
QRELEMRGTWGLPLLNASGMMRWA

SEQ ID NO: 2984788 - protein, 19 aa, Entamoeba invadens
QRELFCGSAAFFPTLTSKD

SEQ ID NO: 2984789 - protein, 18 aa, Entamoeba invadens
QRESWWLAYIMDQIEEEK

SEQ ID NO: 2984790 - protein, 20 aa, Entamoeba invadens
QREVAFLFGRVVKAVIAVVT

SEQ ID NO: 2984791 - protein, 17 aa, Entamoeba invadens
QRFKFSVQIQRNADEEM

SEQ ID NO: 2984792 - protein, 19 aa, Entamoeba invadens
QRFKIPAVKSFDGCLKNNA

SEQ ID NO: 2984793 - protein, 20 aa, Entamoeba invadens
QRGNLEMDYCRKMIGLTDAL

SEQ ID NO: 2984794 - protein, 18 aa, Entamoeba invadens
QRICHFCATTSRIRAMAF

SEQ ID NO: 2984795 - protein, 21 aa, Entamoeba invadens
QRITAAVFWKSMRGEYLIVGL

SEQ ID NO: 2984796 - protein, 17 aa, Entamoeba invadens
QRLEMFLPNELEFEFLS

SEQ ID NO: 2984797 - protein, 17 aa, Entamoeba invadens
QRLEVWTAASVALISTI

SEQ ID NO: 2984798 - protein, 20 aa, Entamoeba invadens
QRLKEITLFTCENGIYLLVT

SEQ ID NO: 2984799 - protein, 21 aa, Entamoeba invadens
QRLKGNFSIDVIKDGIAKLDE

SEQ ID NO: 2984800 - protein, 19 aa, Entamoeba invadens
QRLPRYKLLLSDLFEHTKF

SEQ ID NO: 2984801 - protein, 21 aa, Entamoeba invadens
QRMEKELALAKACMKKGDKTG

SEQ ID NO: 2984802 - protein, 25 aa, Entamoeba invadens
QRMFFMTKYFRTMAFWVFKAILEND

SEQ ID NO: 2984803 - protein, 20 aa, Entamoeba invadens
QRQLLCLARALLNGSKLLIM

SEQ ID NO: 2984804 - protein, 22 aa, Entamoeba invadens
QRRFLCNVIDWKIQMDIDISKQ

SEQ ID NO: 2984805 - protein, 34 aa, Entamoeba invadens
QRRLNMSELRLFKACCKQTTFNNYRNWMMRFVNG

SEQ ID NO: 2984806 - protein, 17 aa, Entamoeba invadens
QRVKMCVDVATGMSYLA

SEQ ID NO: 2984807 - protein, 23 aa, Entamoeba invadens
QRVYALLWRKYHGVEQICDEHKV

SEQ ID NO: 2984808 - protein, 25 aa, Entamoeba invadens
QRYGIKFWMCRVCESGMVINLQMYC

SEQ ID NO: 2984809 - protein, 18 aa, Entamoeba invadens
QRYKHMFRIVTSIGSVVE

SEQ ID NO: 2984810 - protein, 19 aa, Entamoeba invadens
QRYSQMFPYSITLIQTYRV

SEQ ID NO: 2984811 - protein, 22 aa, Entamoeba invadens
QSDGGWFSSWWKSESDELNMMK

SEQ ID NO: 2984812 - protein, 17 aa, Entamoeba invadens
QSFYKTVVWFRVHYEDT

SEQ ID NO: 2984813 - protein, 20 aa, Entamoeba invadens
QSKALILVFRKTMHEAHRDD

SEQ ID NO: 2984814 - protein, 28 aa, Entamoeba invadens
QSKKKVVCFLCGESHLFKDCPHKTEEMY

SEQ ID NO: 2984815 - protein, 17 aa, Entamoeba invadens
QSKRISLDFIMNEYFLD

SEQ ID NO: 2984816 - protein, 18 aa, Entamoeba invadens
QSRKSVVITVCFNTVSVA

SEQ ID NO: 2984817 - protein, 18 aa, Entamoeba invadens
QSVDLEFLVALQRIFDLI

SEQ ID NO: 2984818 - protein, 17 aa, Entamoeba invadens
QSWLANRVDGFFIVRLS

SEQ ID NO: 2984819 - protein, 17 aa, Entamoeba invadens
QTAFKCFNKIPSQRPRF

SEQ ID NO: 2984820 - protein, 17 aa, Entamoeba invadens
QTCLRRKNFKLIVTSAT

SEQ ID NO: 2984821 - protein, 19 aa, Entamoeba invadens
QTLKISYFNARFVSKEIRD

SEQ ID NO: 2984822 - protein, 19 aa, Entamoeba invadens
QTNCGKIRFEVWDTAGQEK

SEQ ID NO: 2984823 - protein, 18 aa, Entamoeba invadens
QTPECLRVYVSSFWDQPL

SEQ ID NO: 2984824 - protein, 22 aa, Entamoeba invadens
QTPEDLFDFGFEATPRMQETPE

SEQ ID NO: 2984825 - protein, 23 aa, Entamoeba invadens
QTQFPLNWCQKSGCLGAEVQPNC

SEQ ID NO: 2984826 - protein, 19 aa, Entamoeba invadens
QTRVRASVCSKMQEYEVAN

SEQ ID NO: 2984827 - protein, 17 aa, Entamoeba invadens
QTTDFVFHFGRKSNVKK

SEQ ID NO: 2984828 - protein, 22 aa, Entamoeba invadens
QVACGGLSLAEMIAAKQGNLKA

SEQ ID NO: 2984829 - protein, 23 aa, Entamoeba invadens
QVACPRLSIDWGDNYRQVLMTPY

SEQ ID NO: 2984830 - protein, 21 aa, Entamoeba invadens
QVCPICKKAIPINEMDKHMKI

SEQ ID NO: 2984831 - protein, 25 aa, Entamoeba invadens
QVGTPFPFHDWCVIENQSGTKTCRC

SEQ ID NO: 2984832 - protein, 17 aa, Entamoeba invadens
QVTSIGVNAFWGCVKLE

SEQ ID NO: 2984833 - protein, 21 aa, Entamoeba invadens
QVVFNMCWWIYTYGHSIEGIF

SEQ ID NO: 2984834 - protein, 19 aa, Entamoeba invadens
QWGVLYKRIAVLKNRKMDM

SEQ ID NO: 2984835 - protein, 24 aa, Entamoeba invadens
QWKEMIKLPIGFVSSCRITRFVLR

SEQ ID NO: 2984836 - protein, 25 aa, Entamoeba invadens
QYEPEVFPVLVFRTTQPKVTLLVFS

SEQ ID NO: 2984837 - protein, 17 aa, Entamoeba invadens
QYFGFTFQEVVKKKPEN

SEQ ID NO: 2984838 - protein, 20 aa, Entamoeba invadens
QYHFNPSIKLARRFLPHVQN

SEQ ID NO: 2984839 - protein, 25 aa, Entamoeba invadens
QYIKCGSCFIIIYSIDSLKSFEVAK

SEQ ID NO: 2984840 - protein, 22 aa, Entamoeba invadens
QYLIGLCLRGGWNQVKVYPKFA

SEQ ID NO: 2984841 - protein, 18 aa, Entamoeba invadens
QYMRCWIEHVTLFAKDDI

SEQ ID NO: 2984842 - protein, 17 aa, Entamoeba invadens
QYPELYKKFGIYTPAGI

SEQ ID NO: 2984843 - protein, 20 aa, Entamoeba invadens
QYVYRYSVDYSFFLAHNCEN

SEQ ID NO: 2984844 - protein, 19 aa, Entamoeba invadens
RAADGVGLFDARDRKLNRH

SEQ ID NO: 2984845 - protein, 17 aa, Entamoeba invadens
RAAIHLLIRLGYKDVVS

SEQ ID NO: 2984846 - protein, 18 aa, Entamoeba invadens
RAARCIGELVDLFENRIV

SEQ ID NO: 2984847 - protein, 17 aa, Entamoeba invadens
RACEWNCGLIAVAYQSI

SEQ ID NO: 2984848 - protein, 17 aa, Entamoeba invadens
RADFMVVLFIEFFRAID

SEQ ID NO: 2984849 - protein, 23 aa, Entamoeba invadens
RADYKVTIFLSRSCEEEVMKKLI

SEQ ID NO: 2984850 - protein, 23 aa, Entamoeba invadens
RAEGSRILFCFNMDNEPFALSNS

SEQ ID NO: 2984851 - protein, 19 aa, Entamoeba invadens
RAFLVFKLIRAMGEYFHLE

SEQ ID NO: 2984852 - protein, 25 aa, Entamoeba invadens
RAFVCSKRGFLRCFIPNEVTKIKDY

SEQ ID NO: 2984853 - protein, 19 aa, Entamoeba invadens
RAGECLVRKVLDKFPTKVI

SEQ ID NO: 2984854 - protein, 17 aa, Entamoeba invadens
RAGRCVVNLIQLLKNSR

SEQ ID NO: 2984855 - protein, 17 aa, Entamoeba invadens
RAHICYISTIGAALNRD

SEQ ID NO: 2984856 - protein, 21 aa, Entamoeba invadens
RAIEIYPEFRIPAELAKPSGK

SEQ ID NO: 2984857 - protein, 17 aa, Entamoeba invadens
RAIKENVCYVALDYDAE

SEQ ID NO: 2984858 - protein, 20 aa, Entamoeba invadens
RAIKESVCYVALDYDSEMKR

SEQ ID NO: 2984859 - protein, 22 aa, Entamoeba invadens
RAKGRFPIISWVGPNMQCLARS

SEQ ID NO: 2984860 - protein, 21 aa, Entamoeba invadens
RAKGRFPVLSWVGPKNQCLVR

SEQ ID NO: 2984861 - protein, 21 aa, Entamoeba invadens
RAKLFLPMYIEGLKFLIPMNA

SEQ ID NO: 2984862 - protein, 20 aa, Entamoeba invadens
RAKRALCVVGNIKTLRQVKV

SEQ ID NO: 2984863 - protein, 17 aa, Entamoeba invadens
RALRFIDCIIQMLQSTP

SEQ ID NO: 2984864 - protein, 20 aa, Entamoeba invadens
RAMCVPDPLKVVLTNVPDDY

SEQ ID NO: 2984865 - protein, 17 aa, Entamoeba invadens
RAMPIIVRMEELKGEWE

SEQ ID NO: 2984866 - protein, 25 aa, Entamoeba invadens
RARKQYKRFVAIQVLHRMKYINSDT

SEQ ID NO: 2984867 - protein, 17 aa, Entamoeba invadens
RATECGNGFVIVIDDIK

SEQ ID NO: 2984868 - protein, 18 aa, Entamoeba invadens
RATHCVVCRGVIVGASVS

SEQ ID NO: 2984869 - protein, 18 aa, Entamoeba invadens
RATLAINILNEFPEELIG

SEQ ID NO: 2984870 - protein, 17 aa, Entamoeba invadens
RATLPLFSVSGRNESGF

SEQ ID NO: 2984871 - protein, 20 aa, Entamoeba invadens
RAVIKFYAFYSFMINSDNFD

SEQ ID NO: 2984872 - protein, 22 aa, Entamoeba invadens
RAVSLLDQLACFFVNDHQSLYC

SEQ ID NO: 2984873 - protein, 18 aa, Entamoeba invadens
RAYNCIIKRGWERLERSK

SEQ ID NO: 2984874 - protein, 18 aa, Entamoeba invadens
RCAARYALDISNGILEKT

SEQ ID NO: 2984875 - protein, 19 aa, Entamoeba invadens
RCAIPEFLLKICRQIELRK

SEQ ID NO: 2984876 - protein, 19 aa, Entamoeba invadens
RCINCGKAIDISKDIMEDK

SEQ ID NO: 2984877 - protein, 21 aa, Entamoeba invadens
RCKQCGTVFHPECGLKFKGQF

SEQ ID NO: 2984878 - protein, 17 aa, Entamoeba invadens
RCLKCQLCSEAWPIRNS

SEQ ID NO: 2984879 - protein, 19 aa, Entamoeba invadens
RCLLLYNYSFLFAFETTPN

SEQ ID NO: 2984880 - protein, 21 aa, Entamoeba invadens
RCLSCSVASCSRCDTTGKCVE

SEQ ID NO: 2984881 - protein, 21 aa, Entamoeba invadens
RCMDCQAIGPVYVVINFGTFV

SEQ ID NO: 2984882 - protein, 19 aa, Entamoeba invadens
RCMKCYKCGCRLYSTSDIY

SEQ ID NO: 2984883 - protein, 18 aa, Entamoeba invadens
RCNFPKTNVVIFVVDSCD

SEQ ID NO: 2984884 - protein, 20 aa, Entamoeba invadens
RCPPEEFIPFVITDADANTK

SEQ ID NO: 2984885 - protein, 21 aa, Entamoeba invadens
RCSDLKRYTLLLTNLPHKRLR

SEQ ID NO: 2984886 - protein, 18 aa, Entamoeba invadens
RCSLDILNCRKVVLLNTK

SEQ ID NO: 2984887 - protein, 20 aa, Entamoeba invadens
RCSVYFGYKAVDSFFNENCI

SEQ ID NO: 2984888 - protein, 20 aa, Entamoeba invadens
RCVIGILDIFGFEIFPVNGF

SEQ ID NO: 2984889 - protein, 21 aa, Entamoeba invadens
RCVLLDWLFEVISFHFECTIE

SEQ ID NO: 2984890 - protein, 21 aa, Entamoeba invadens
RCYHLKYVILYGVKYLEKESF

SEQ ID NO: 2984891 - protein, 20 aa, Entamoeba invadens
RDADDIGCCFAIVFGGNELE

SEQ ID NO: 2984892 - protein, 18 aa, Entamoeba invadens
RDAKLFYERAFKHSIPGI

SEQ ID NO: 2984893 - protein, 17 aa, Entamoeba invadens
RDFRRCNVCSIDPPGCK

SEQ ID NO: 2984894 - protein, 21 aa, Entamoeba invadens
RDFWCKCAHFTTICLLQLKTL

SEQ ID NO: 2984895 - protein, 25 aa, Entamoeba invadens
RDGEPADCILFYSYRDKFVYERFLM

SEQ ID NO: 2984896 - protein, 18 aa, Entamoeba invadens
RDGWELRLYFGEKVSTGF

SEQ ID NO: 2984897 - protein, 19 aa, Entamoeba invadens
RDHYMCIVCFKRMSRGYAC

SEQ ID NO: 2984898 - protein, 23 aa, Entamoeba invadens
RDIKEILCYFALDFNEEMQKAAS

SEQ ID NO: 2984899 - protein, 18 aa, Entamoeba invadens
RDILAGLISICFDYEYSF

SEQ ID NO: 2984900 - protein, 24 aa, Entamoeba invadens
RDKRLLLDVTICYRKCYKGMDPTV

SEQ ID NO: 2984901 - protein, 23 aa, Entamoeba invadens
RDLKEVRKGICATIEIDSLSKKV

SEQ ID NO: 2984902 - protein, 23 aa, Entamoeba invadens
RDLLDWLFALLIKVSKHKDENKM

SEQ ID NO: 2984903 - protein, 27 aa, Entamoeba invadens
RDNISFFKRNLCVCFGRVALVNPNLVA

SEQ ID NO: 2984904 - protein, 17 aa, Entamoeba invadens
RDPHIFETLDIYKQIPE

SEQ ID NO: 2984905 - protein, 23 aa, Entamoeba invadens
RDPHIWLRRGLFFCHRDINPILD

SEQ ID NO: 2984906 - protein, 18 aa, Entamoeba invadens
RDRLSQILIYLFSGNVKD

SEQ ID NO: 2984907 - protein, 23 aa, Entamoeba invadens
RDSCSLVLFPMCRSGDMFDSQTL

SEQ ID NO: 2984908 - protein, 24 aa, Entamoeba invadens
RDSVYEIFQRFLIKKEKKEEKLIN

SEQ ID NO: 2984909 - protein, 20 aa, Entamoeba invadens
RDVLKRAGFKPSYLSNPVWV

SEQ ID NO: 2984910 - protein, 22 aa, Entamoeba invadens
RDVWRIVLFPAIDMGDLKKEFE

SEQ ID NO: 2984911 - protein, 25 aa, Entamoeba invadens
RDYLKRYRVSVGFPIKGYKECLVLD

SEQ ID NO: 2984912 - protein, 17 aa, Entamoeba invadens
REAMCAWDWKMRSIEGD

SEQ ID NO: 2984913 - protein, 25 aa, Entamoeba invadens
REAVPKIHINFCFKIFRVLPNALYL

SEQ ID NO: 2984914 - protein, 20 aa, Entamoeba invadens
RECAFKEWLLQKVFNGERAA

SEQ ID NO: 2984915 - protein, 23 aa, Entamoeba invadens
RECCLKMSVIYLIIKNSTFGNDL

SEQ ID NO: 2984916 - protein, 21 aa, Entamoeba invadens
RECKACAFTNLEKGYENEKLS

SEQ ID NO: 2984917 - protein, 18 aa, Entamoeba invadens
RECPCRKPIILLYDENGT

SEQ ID NO: 2984918 - protein, 19 aa, Entamoeba invadens
REECLELWDRIFAYPEREM

SEQ ID NO: 2984919 - protein, 17 aa, Entamoeba invadens
REEFNWSEVTRCVLSAV

SEQ ID NO: 2984920 - protein, 19 aa, Entamoeba invadens
REFFKVRVLYDFDYFESLK

SEQ ID NO: 2984921 - protein, 18 aa, Entamoeba invadens
REFFRIIVWFNVDFETFD

SEQ ID NO: 2984922 - protein, 19 aa, Entamoeba invadens
REFIKTIFVNKTYYSEETT

SEQ ID NO: 2984923 - protein, 17 aa, Entamoeba invadens
REFRCELPFQLFKSGFK

SEQ ID NO: 2984924 - protein, 17 aa, Entamoeba invadens
REFYRIIVWFDVNFETV

SEQ ID NO: 2984925 - protein, 18 aa, Entamoeba invadens
REFYRIIVWFNVDFETIN

SEQ ID NO: 2984926 - protein, 19 aa, Entamoeba invadens
REGGKWFKELQRLYVAGGR

SEQ ID NO: 2984927 - protein, 21 aa, Entamoeba invadens
REHARFPGIFIASGKEEQLLT

SEQ ID NO: 2984928 - protein, 17 aa, Entamoeba invadens
REHLELFVLPPRPTNLV

SEQ ID NO: 2984929 - protein, 17 aa, Entamoeba invadens
REHLELFVLPPRPTYLV

SEQ ID NO: 2984930 - protein, 21 aa, Entamoeba invadens
REHLRLQVCSSFSKDESVLYT

SEQ ID NO: 2984931 - protein, 23 aa, Entamoeba invadens
REIAKRCVLSFVAKMGRMVFLTQ

SEQ ID NO: 2984932 - protein, 17 aa, Entamoeba invadens
REIENINEWAKMNMLTP

SEQ ID NO: 2984933 - protein, 17 aa, Entamoeba invadens
REIIDWEAAPAYSASPM

SEQ ID NO: 2984934 - protein, 17 aa, Entamoeba invadens
REIIGFVDLKLSHIPFP

SEQ ID NO: 2984935 - protein, 17 aa, Entamoeba invadens
REIKWPMKIGVGVNSTT

SEQ ID NO: 2984936 - protein, 19 aa, Entamoeba invadens
REKRGICLVNRLISMLSAF

SEQ ID NO: 2984937 - protein, 17 aa, Entamoeba invadens
RELAVKFVEAFGGVEKT

SEQ ID NO: 2984938 - protein, 18 aa, Entamoeba invadens
RELCVGHIQEFLGLRLQK

SEQ ID NO: 2984939 - protein, 19 aa, Entamoeba invadens
RELECPFLITKRDQKKTNF

SEQ ID NO: 2984940 - protein, 19 aa, Entamoeba invadens
RELLKIAFKLGKRVIEELD

SEQ ID NO: 2984941 - protein, 20 aa, Entamoeba invadens
RELLNFPGPVVFTSNCLMKP

SEQ ID NO: 2984942 - protein, 17 aa, Entamoeba invadens
REMYYFICASILLENAP

SEQ ID NO: 2984943 - protein, 22 aa, Entamoeba invadens
REQTLRFKIRIMSNVYTQSKNV

SEQ ID NO: 2984944 - protein, 23 aa, Entamoeba invadens
RESELKASVLKCREDSIQQRESV

SEQ ID NO: 2984945 - protein, 19 aa, Entamoeba invadens
RESRFLLRWLNSTLSIKTV

SEQ ID NO: 2984946 - protein, 18 aa, Entamoeba invadens
REWCLFSKEIGNYCINLI

SEQ ID NO: 2984947 - protein, 17 aa, Entamoeba invadens
REYFIAYEIRVTLNDQI

SEQ ID NO: 2984948 - protein, 18 aa, Entamoeba invadens
RFALKHVKPPTVVEVNYD

SEQ ID NO: 2984949 - protein, 21 aa, Entamoeba invadens
RFEEFRNYFTFELKTQLPENR

SEQ ID NO: 2984950 - protein, 18 aa, Entamoeba invadens
RFETELELLHAQKFIQKL

SEQ ID NO: 2984951 - protein, 25 aa, Entamoeba invadens
RFEVAKARCAICEMVPSNYEILRTE

SEQ ID NO: 2984952 - protein, 18 aa, Entamoeba invadens
RFFGRLKTVFAFARTKFV

SEQ ID NO: 2984953 - protein, 19 aa, Entamoeba invadens
RFGDPMAKLFKRRKEKEES

SEQ ID NO: 2984954 - protein, 23 aa, Entamoeba invadens
RFHTKREVVEWIKSQPIYEDILL

SEQ ID NO: 2984955 - protein, 18 aa, Entamoeba invadens
RFKGINIPGGKGLGKGYK

SEQ ID NO: 2984956 - protein, 20 aa, Entamoeba invadens
RFKGRLHPYVSVPDSVIVEA

SEQ ID NO: 2984957 - protein, 18 aa, Entamoeba invadens
RFKYAWDIADFVGKGNHL

SEQ ID NO: 2984958 - protein, 21 aa, Entamoeba invadens
RFLMCTLSFHLTYISGMEIVK

SEQ ID NO: 2984959 - protein, 17 aa, Entamoeba invadens
RFLNFEVYTPSVITKID

SEQ ID NO: 2984960 - protein, 17 aa, Entamoeba invadens
RFLRPGEYIQMSGRAGR

SEQ ID NO: 2984961 - protein, 20 aa, Entamoeba invadens
RFLVCRAFPFILEFCYGFPC

SEQ ID NO: 2984962 - protein, 19 aa, Entamoeba invadens
RFLVEIGDYCFFNCVALEE

SEQ ID NO: 2984963 - protein, 23 aa, Entamoeba invadens
RFNKFIRRHFQVAAQQVMQQPPG

SEQ ID NO: 2984964 - protein, 20 aa, Entamoeba invadens
RFPKFLIPKYFAAFIKKLFA

SEQ ID NO: 2984965 - protein, 18 aa, Entamoeba invadens
RFQFLILQFGNFYEDKKA

SEQ ID NO: 2984966 - protein, 19 aa, Entamoeba invadens
RFQLCPTYPTVLVVPIELS

SEQ ID NO: 2984967 - protein, 18 aa, Entamoeba invadens
RFSFLLSVFGEFVTKKEL

SEQ ID NO: 2984968 - protein, 17 aa, Entamoeba invadens
RFSYIPIRRMKSCLDFI

SEQ ID NO: 2984969 - protein, 19 aa, Entamoeba invadens
RFVTEFKTAFPSILLTLLS

SEQ ID NO: 2984970 - protein, 17 aa, Entamoeba invadens
RFWLEKIDCSNWCQFCE

SEQ ID NO: 2984971 - protein, 19 aa, Entamoeba invadens
RFYGACFIPNRICMVTELA

SEQ ID NO: 2984972 - protein, 25 aa, Entamoeba invadens
RGAQARCISCVHLLFEDSYITKGGK

SEQ ID NO: 2984973 - protein, 19 aa, Entamoeba invadens
RGARFNCFEDIMADDRPSL

SEQ ID NO: 2984974 - protein, 19 aa, Entamoeba invadens
RGDSVLVHCSDGWDRTSQL

SEQ ID NO: 2984975 - protein, 19 aa, Entamoeba invadens
RGESWIASFGTRKDKDETN

SEQ ID NO: 2984976 - protein, 17 aa, Entamoeba invadens
RGFKFLIPKMIYLEAPQ

SEQ ID NO: 2984977 - protein, 17 aa, Entamoeba invadens
RGFSIKEICILTDLTKD

SEQ ID NO: 2984978 - protein, 22 aa, Entamoeba invadens
RGGKKCICVLCNDRYYIEDGES

SEQ ID NO: 2984979 - protein, 23 aa, Entamoeba invadens
RGLFRSMCFKTFLKDYKKGEETD

SEQ ID NO: 2984980 - protein, 18 aa, Entamoeba invadens
RGRCSVCGKVIQPNQQSV

SEQ ID NO: 2984981 - protein, 18 aa, Entamoeba invadens
RGTCWAHAVIGFVESDYR

SEQ ID NO: 2984982 - protein, 17 aa, Entamoeba invadens
RGTLCWSPTRNLLAVGT

SEQ ID NO: 2984983 - protein, 17 aa, Entamoeba invadens
RGVECLFGVLSLFLEHP

SEQ ID NO: 2984984 - protein, 17 aa, Entamoeba invadens
RGVIFIWNFLKQFQTEI

SEQ ID NO: 2984985 - protein, 25 aa, Entamoeba invadens
RGYKPSVVCADTFRAGAYEQLQMNA

SEQ ID NO: 2984986 - protein, 21 aa, Entamoeba invadens
RHDFKARVFQFYRSEDNELLC

SEQ ID NO: 2984987 - protein, 20 aa, Entamoeba invadens
RHFAKIWSYKFINVTNGVTP

SEQ ID NO: 2984988 - protein, 17 aa, Entamoeba invadens
RHFYFYILWVLKNIEVK

SEQ ID NO: 2984989 - protein, 19 aa, Entamoeba invadens
RHGRIAMRLANAFMEDGNI

SEQ ID NO: 2984990 - protein, 17 aa, Entamoeba invadens
RHIYMHFTAAAKIIKSA

SEQ ID NO: 2984991 - protein, 22 aa, Entamoeba invadens
RHLAEVLVALAFHKFKCTNLFS

SEQ ID NO: 2984992 - protein, 18 aa, Entamoeba invadens
RHPRVCGNVLKQSYIFST

SEQ ID NO: 2984993 - protein, 17 aa, Entamoeba invadens
RHQLLFNACERFDIEEF

SEQ ID NO: 2984994 - protein, 17 aa, Entamoeba invadens
RHVCIVFELLGKSLYEV

SEQ ID NO: 2984995 - protein, 17 aa, Entamoeba invadens
RHVLKWHESDVMSMMNQ

SEQ ID NO: 2984996 - protein, 18 aa, Entamoeba invadens
RIASIVGRYEEIDKKKAE

SEQ ID NO: 2984997 - protein, 19 aa, Entamoeba invadens
RICRYELLLSTILKDVQKE

SEQ ID NO: 2984998 - protein, 20 aa, Entamoeba invadens
  misc_feature (16)..(17): Xaa can be any naturally occurring amino acid
RIDQLFSWAFKQDIVXXQIL

SEQ ID NO: 2984999 - protein, 20 aa, Entamoeba invadens
RIEHVKPIRGIREDKEEKVE

SEQ ID NO: 2985000 - protein, 24 aa, Entamoeba invadens
RIEKIFRIYLCFMMSEAGNVESIF

SEQ ID NO: 2985001 - protein, 18 aa, Entamoeba invadens
RIEMKEMIERATKKITFN

SEQ ID NO: 2985002 - protein, 18 aa, Entamoeba invadens
RIEMKEMIERATKKITVN

SEQ ID NO: 2985003 - protein, 19 aa, Entamoeba invadens
RIICAAVYKFTGKKMEFLW

SEQ ID NO: 2985004 - protein, 18 aa, Entamoeba invadens
RIICFKQNVYLGAIEMEP

SEQ ID NO: 2985005 - protein, 17 aa, Entamoeba invadens
RIICRLTTYNLCFMMPS

SEQ ID NO: 2985006 - protein, 29 aa, Entamoeba invadens
RIIIHGKFLRRRFCVFVVMKLASICSVDM

SEQ ID NO: 2985007 - protein, 23 aa, Entamoeba invadens
RIISRKGCCLIPLDCSGRTVEYI

SEQ ID NO: 2985008 - protein, 17 aa, Entamoeba invadens
RILEFIKYVFLVKSEVE

SEQ ID NO: 2985009 - protein, 17 aa, Entamoeba invadens
RILKILFVMTSTGAVQQ

SEQ ID NO: 2985010 - protein, 19 aa, Entamoeba invadens
RILKTCLFFNFAYQIKHIM

SEQ ID NO: 2985011 - protein, 22 aa, Entamoeba invadens
RILLKLPIAYLFDVFAVSLDPT

SEQ ID NO: 2985012 - protein, 24 aa, Entamoeba invadens
RILPEVVMLKPFYACEFSIYLTPK

SEQ ID NO: 2985013 - protein, 17 aa, Entamoeba invadens
RILPRLVAQTIFSNVEQ

SEQ ID NO: 2985014 - protein, 18 aa, Entamoeba invadens
RILSGWDRIVSETLQTYE

SEQ ID NO: 2985015 - protein, 26 aa, Entamoeba invadens
RILSKYPKFKASVMNSRLTSKQQLTL

SEQ ID NO: 2985016 - protein, 18 aa, Entamoeba invadens
RINFCDELGPIIGTECAE

SEQ ID NO: 2985017 - protein, 18 aa, Entamoeba invadens
RINYYITLYLKVRLSKVL

SEQ ID NO: 2985018 - protein, 24 aa, Entamoeba invadens
RIPCGGPYLPLCCERSGGFVPSIF

SEQ ID NO: 2985019 - protein, 18 aa, Entamoeba invadens
RIPHTLVFQLKRFSFNTL

SEQ ID NO: 2985020 - protein, 19 aa, Entamoeba invadens
RIPQLLLGWDCLDFLDQSL

SEQ ID NO: 2985021 - protein, 21 aa, Entamoeba invadens
RIPRYRLLLTELLKTMTPQHG

SEQ ID NO: 2985022 - protein, 23 aa, Entamoeba invadens
RIPSWCDRVLWKTENCHFAETQK

SEQ ID NO: 2985023 - protein, 20 aa, Entamoeba invadens
RIQMKLNFIMDRSCKVKQDL

SEQ ID NO: 2985024 - protein, 25 aa, Entamoeba invadens
RISECYLRPLELMLSQGIIPVLHGD

SEQ ID NO: 2985025 - protein, 19 aa, Entamoeba invadens
RISICIKKADGLEVILLRR

SEQ ID NO: 2985026 - protein, 19 aa, Entamoeba invadens
RISNGLPFIIHVNAINNTR

SEQ ID NO: 2985027 - protein, 20 aa, Entamoeba invadens
RISRRAELSLSGFDIQCDGF

SEQ ID NO: 2985028 - protein, 19 aa, Entamoeba invadens
RIVERLGFIRRTIGIKSES

SEQ ID NO: 2985029 - protein, 18 aa, Entamoeba invadens
RIVHIFERLFDVAIGAME

SEQ ID NO: 2985030 - protein, 17 aa, Entamoeba invadens
RIVQTWGVLFPKQLFDY

SEQ ID NO: 2985031 - protein, 18 aa, Entamoeba invadens
RKAEWKKRQCVLKEEAEI

SEQ ID NO: 2985032 - protein, 21 aa, Entamoeba invadens
RKAKEVMKEFVVPGNEQASKF

SEQ ID NO: 2985033 - protein, 22 aa, Entamoeba invadens
RKCFKCLDGFYLLSGQCALCNK

SEQ ID NO: 2985034 - protein, 23 aa, Entamoeba invadens
RKCSPRVRHGICAMAAIRYFIEM

SEQ ID NO: 2985035 - protein, 18 aa, Entamoeba invadens
RKDILLVRPTFFGATPSF

SEQ ID NO: 2985036 - protein, 17 aa, Entamoeba invadens
RKEAVTILLRYFNIPHI

SEQ ID NO: 2985037 - protein, 18 aa, Entamoeba invadens
RKEILYAISTCRKNLHQM

SEQ ID NO: 2985038 - protein, 25 aa, Entamoeba invadens
RKEWEMLRLLASRVIMQMVSSRPSW

SEQ ID NO: 2985039 - protein, 23 aa, Entamoeba invadens
RKFIPDRLKIIIQLFVTAEFKVC

SEQ ID NO: 2985040 - protein, 20 aa, Entamoeba invadens
RKGKRGGACQEIVWRDYVKK

SEQ ID NO: 2985041 - protein, 17 aa, Entamoeba invadens
RKGMNLTRAELIYQRNV

SEQ ID NO: 2985042 - protein, 20 aa, Entamoeba invadens
RKIGKFFLCHGGISPKMAKI

SEQ ID NO: 2985043 - protein, 18 aa, Entamoeba invadens
RKITPFAVITTMTNNVTI

SEQ ID NO: 2985044 - protein, 19 aa, Entamoeba invadens
RKIVQARGFVIVIIAEENV

SEQ ID NO: 2985045 - protein, 17 aa, Entamoeba invadens
RKKFCIYRVQCFGSNKL

SEQ ID NO: 2985046 - protein, 19 aa, Entamoeba invadens
RKKFCKKCFKKFHENKYHS

SEQ ID NO: 2985047 - protein, 18 aa, Entamoeba invadens
RKKICALWIKLPPNVHDQ

SEQ ID NO: 2985048 - protein, 17 aa, Entamoeba invadens
RKKLGFKYSTLRKSRFL

SEQ ID NO: 2985049 - protein, 26 aa, Entamoeba invadens
RKKMYCKKCKLFVCPRCWNHDEKCCV

SEQ ID NO: 2985050 - protein, 20 aa, Entamoeba invadens
RKLSCCVPFGTPLVKMDNEW

SEQ ID NO: 2985051 - protein, 19 aa, Entamoeba invadens
RKLSSVIYPSFVSFINDMC

SEQ ID NO: 2985052 - protein, 20 aa, Entamoeba invadens
RKLVKLLLHQGAVYTKKHDM

SEQ ID NO: 2985053 - protein, 26 aa, Entamoeba invadens
RKMSGPLMKCTKCTLYFHEKCTLCSP

SEQ ID NO: 2985054 - protein, 19 aa, Entamoeba invadens
RKMVDVFKAEWWFGGITKD

SEQ ID NO: 2985055 - protein, 18 aa, Entamoeba invadens
RKNFQIYRLDGFGGNLLN

SEQ ID NO: 2985056 - protein, 24 aa, Entamoeba invadens
RKNLEMLLKWIELVHLPITAVGPI

SEQ ID NO: 2985057 - protein, 19 aa, Entamoeba invadens
RKPFPLPWRGLRDEKMSEV

SEQ ID NO: 2985058 - protein, 22 aa, Entamoeba invadens
RKQEFFIPIILLLRVYTGMSDR

SEQ ID NO: 2985059 - protein, 20 aa, Entamoeba invadens
RKQVFLRRNVLVWNLKSDFT

SEQ ID NO: 2985060 - protein, 19 aa, Entamoeba invadens
RKRMQDLLLSWTVIFKEQV

SEQ ID NO: 2985061 - protein, 23 aa, Entamoeba invadens
RKRRLEKILLYFLSIEETFDDDV

SEQ ID NO: 2985062 - protein, 18 aa, Entamoeba invadens
RKSKKTECPFRINLNFKA

SEQ ID NO: 2985063 - protein, 20 aa, Entamoeba invadens
RKSLKLEILESTDLLQTVKT

SEQ ID NO: 2985064 - protein, 19 aa, Entamoeba invadens
RKSLRSCFNVFGGKEEFMS

SEQ ID NO: 2985065 - protein, 18 aa, Entamoeba invadens
RKSMKVEYLYSVQRNFLK

SEQ ID NO: 2985066 - protein, 20 aa, Entamoeba invadens
RKTECTKAFTVHGDESSTLL

SEQ ID NO: 2985067 - protein, 27 aa, Entamoeba invadens
RKVEEICWKWRLGMAKDLKIVYFVFED

SEQ ID NO: 2985068 - protein, 17 aa, Entamoeba invadens
RKYRVVYVAPELLDMSS

SEQ ID NO: 2985069 - protein, 20 aa, Entamoeba invadens
RLAELPSWMGKYSMKVPGRI

SEQ ID NO: 2985070 - protein, 20 aa, Entamoeba invadens
RLATAKNLLNWAIKQQPGMA

SEQ ID NO: 2985071 - protein, 20 aa, Entamoeba invadens
RLCFVQCHLLELIILPSYMK

SEQ ID NO: 2985072 - protein, 22 aa, Entamoeba invadens
RLEGFFPLKGMDFVAWNDNVQI

SEQ ID NO: 2985073 - protein, 21 aa, Entamoeba invadens
RLEVKIADYGFCRVFNKSPEH

SEQ ID NO: 2985074 - protein, 23 aa, Entamoeba invadens
RLFNRIGLLFSYVFMMNNASIHS

SEQ ID NO: 2985075 - protein, 18 aa, Entamoeba invadens
RLHCTRFLTLGTDIPKEI

SEQ ID NO: 2985076 - protein, 18 aa, Entamoeba invadens
RLIAQMRRGLDMVSYENQ

SEQ ID NO: 2985077 - protein, 19 aa, Entamoeba invadens
RLICLPGYEIQDTCAQFYI

SEQ ID NO: 2985078 - protein, 17 aa, Entamoeba invadens
RLICTIPPTWGLEETKN

SEQ ID NO: 2985079 - protein, 19 aa, Entamoeba invadens
RLKIKLTVEKEVFKNTLIQ

SEQ ID NO: 2985080 - protein, 19 aa, Entamoeba invadens
RLKKIDCIPLYLFDIISSC

SEQ ID NO: 2985081 - protein, 23 aa, Entamoeba invadens
RLKWSEFFIHPFIQRCRDYKIDE

SEQ ID NO: 2985082 - protein, 20 aa, Entamoeba invadens
RLLLLYLFCRYNNLKMIRDM

SEQ ID NO: 2985083 - protein, 19 aa, Entamoeba invadens
RLLPYIPRMDTMFYTLNTK

SEQ ID NO: 2985084 - protein, 18 aa, Entamoeba invadens
RLLVIGGRPTINWYDLFK

SEQ ID NO: 2985085 - protein, 19 aa, Entamoeba invadens
RLMCELEIDLLRGFQNTSS

SEQ ID NO: 2985086 - protein, 17 aa, Entamoeba invadens
RLMLWGEESFFWLEKKS

SEQ ID NO: 2985087 - protein, 17 aa, Entamoeba invadens
RLNEIRGGMEIEKRAKI

SEQ ID NO: 2985088 - protein, 20 aa, Entamoeba invadens
RLNTFQVFMFGKPVWVAENL

SEQ ID NO: 2985089 - protein, 20 aa, Entamoeba invadens
RLNVAITRAKRALCVVGNIK

SEQ ID NO: 2985090 - protein, 27 aa, Entamoeba invadens
RLNVALTRARKGLVMVGDAYTLRHNCI

SEQ ID NO: 2985091 - protein, 17 aa, Entamoeba invadens
RLNVKFAKLKEGKSFSR

SEQ ID NO: 2985092 - protein, 23 aa, Entamoeba invadens
RLNWLPLKSKIGWEEYCRQNQKT

SEQ ID NO: 2985093 - protein, 19 aa, Entamoeba invadens
RLPCFSLFFLPTIFPAILN

SEQ ID NO: 2985094 - protein, 26 aa, Entamoeba invadens
RLPFFIFEWHYLWFIHALPFDFALKL

SEQ ID NO: 2985095 - protein, 20 aa, Entamoeba invadens
RLPMPRPGQILGIVGTNGIG

SEQ ID NO: 2985096 - protein, 18 aa, Entamoeba invadens
RLPRYRLLLKDLLKHLSD

SEQ ID NO: 2985097 - protein, 19 aa, Entamoeba invadens
RLPYGRCVAMLLKSETTAE

SEQ ID NO: 2985098 - protein, 20 aa, Entamoeba invadens
RLQFQWWFPLVESISAVEFH

SEQ ID NO: 2985099 - protein, 20 aa, Entamoeba invadens
RLQIYFKVFHDWVSKNAIDK

SEQ ID NO: 2985100 - protein, 25 aa, Entamoeba invadens
RLRCPKCSGLLRGASVLKCCGKSFC

SEQ ID NO: 2985101 - protein, 22 aa, Entamoeba invadens
RLREFPRALIFFSNLVNIKLQN

SEQ ID NO: 2985102 - protein, 20 aa, Entamoeba invadens
RLRREFKKTMALQLEKLKTH

SEQ ID NO: 2985103 - protein, 19 aa, Entamoeba invadens
RLSAEQIRALKRCTLVSHA

SEQ ID NO: 2985104 - protein, 18 aa, Entamoeba invadens
RLSEKQCSLLFNGKEKDG

SEQ ID NO: 2985105 - protein, 18 aa, Entamoeba invadens
RLSIIVCDMVKRIVLPHS

SEQ ID NO: 2985106 - protein, 18 aa, Entamoeba invadens
RLSLRKCTIDSLTVPPTL

SEQ ID NO: 2985107 - protein, 22 aa, Entamoeba invadens
RLSPVCALECYKLMNLRRLFIF

SEQ ID NO: 2985108 - protein, 19 aa, Entamoeba invadens
RLSVCLALIKTGRVTTSAT

SEQ ID NO: 2985109 - protein, 30 aa, Entamoeba invadens
RLTACGHLYCWKCLLQFFVLCPAPHKCPVC

SEQ ID NO: 2985110 - protein, 26 aa, Entamoeba invadens
RLTRIKCLLFPWAVRPQNNIFFTSVI

SEQ ID NO: 2985111 - protein, 17 aa, Entamoeba invadens
RLVNCPYDLTSLLHNTI

SEQ ID NO: 2985112 - protein, 17 aa, Entamoeba invadens
RLVNIFHLCLLKKSDVK

SEQ ID NO: 2985113 - protein, 20 aa, Entamoeba invadens
RLVTCFPRMDAVWNNNLTLY

SEQ ID NO: 2985114 - protein, 18 aa, Entamoeba invadens
RLVTYFPRMDAVWNNNLT

SEQ ID NO: 2985115 - protein, 25 aa, Entamoeba invadens
RLYGEYSHLCLLPYLRAVTKDIIQV

SEQ ID NO: 2985116 - protein, 26 aa, Entamoeba invadens
RLYGEYSHLCLLPYLRAVTRDIIQSL

SEQ ID NO: 2985117 - protein, 22 aa, Entamoeba invadens
RLYPHIKYVLGLECVKLDLKLI

SEQ ID NO: 2985118 - protein, 17 aa, Entamoeba invadens
RMIYKLGYVNRVMDILR

SEQ ID NO: 2985119 - protein, 30 aa, Entamoeba invadens
RMKLGYWSCFCKAKCAWKDVVVDTFIQGIV

SEQ ID NO: 2985120 - protein, 19 aa, Entamoeba invadens
RMKNLRYIQSFKHSIVNRY

SEQ ID NO: 2985121 - protein, 20 aa, Entamoeba invadens
RMLEPFCYALIYPKGQMGWQ

SEQ ID NO: 2985122 - protein, 17 aa, Entamoeba invadens
RMLRKYFSTTFVASSLI

SEQ ID NO: 2985123 - protein, 20 aa, Entamoeba invadens
RMLSGAIVFKMCKKIYDTTH

SEQ ID NO: 2985124 - protein, 20 aa, Entamoeba invadens
RMNVALTRARKGLVVVGNMR

SEQ ID NO: 2985125 - protein, 18 aa, Entamoeba invadens
RMPGCTRLIVPMISMLQQ

SEQ ID NO: 2985126 - protein, 17 aa, Entamoeba invadens
RNAPFWVIDELIECSTW

SEQ ID NO: 2985127 - protein, 18 aa, Entamoeba invadens
RNAVKCDVPFGWITFETN

SEQ ID NO: 2985128 - protein, 19 aa, Entamoeba invadens
RNCPVPEIVKVLKYYFPKC

SEQ ID NO: 2985129 - protein, 18 aa, Entamoeba invadens
RNDFLFQRCEILSEEVDA

SEQ ID NO: 2985130 - protein, 19 aa, Entamoeba invadens
RNFLLRKLINGGRMAEMAP

SEQ ID NO: 2985131 - protein, 30 aa, Entamoeba invadens
RNNLETISSFSLFYSFEWTTKVRNYIDIQN

SEQ ID NO: 2985132 - protein, 18 aa, Entamoeba invadens
RNPALGLVCFSKIMFPKI

SEQ ID NO: 2985133 - protein, 17 aa, Entamoeba invadens
RNPLLSIHFKKFLILDK

SEQ ID NO: 2985134 - protein, 22 aa, Entamoeba invadens
RNRKARIGVFAQHFVDQLNFKV

SEQ ID NO: 2985135 - protein, 17 aa, Entamoeba invadens
RNSIDWKAMKLPVKFGV

SEQ ID NO: 2985136 - protein, 24 aa, Entamoeba invadens
RNSMPLDMFKFISSHIKTYDMGQP

SEQ ID NO: 2985137 - protein, 19 aa, Entamoeba invadens
RNSYSIIFYDFWTHNLYKD

SEQ ID NO: 2985138 - protein, 17 aa, Entamoeba invadens
RNVELCINKECAKNITC

SEQ ID NO: 2985139 - protein, 20 aa, Entamoeba invadens
RNVETLRMFSLIQIGTKVKR

SEQ ID NO: 2985140 - protein, 19 aa, Entamoeba invadens
RNVISWQYICKVIFYCLSY

SEQ ID NO: 2985141 - protein, 21 aa, Entamoeba invadens
RNVIYKMCEIFAIKIRILMKF

SEQ ID NO: 2985142 - protein, 21 aa, Entamoeba invadens
RNVPRLLWRVKYIQGDVSGAV

SEQ ID NO: 2985143 - protein, 23 aa, Entamoeba invadens
RNYHAICGIVFAFIRIKEMDSFK

SEQ ID NO: 2985144 - protein, 19 aa, Entamoeba invadens
RPASKLSMESCCGRSISRE

SEQ ID NO: 2985145 - protein, 20 aa, Entamoeba invadens
RPELNMTWNYNFDKMTYFNE

SEQ ID NO: 2985146 - protein, 24 aa, Entamoeba invadens
RPEVVLKQAFKFVMDNFKKTNDYD

SEQ ID NO: 2985147 - protein, 21 aa, Entamoeba invadens
RPEYFFGKGFFGNCSNERYWE

SEQ ID NO: 2985148 - protein, 17 aa, Entamoeba invadens
RPFKCILDVGLARTTTG

SEQ ID NO: 2985149 - protein, 18 aa, Entamoeba invadens
RPIFNVPLSDVFFQAYLE

SEQ ID NO: 2985150 - protein, 24 aa, Entamoeba invadens
RPIFTIKIANTFLRKKVSTMLFGI

SEQ ID NO: 2985151 - protein, 24 aa, Entamoeba invadens
RPIMSSLLLCYTLYLDTVNDKWLQ

SEQ ID NO: 2985152 - protein, 20 aa, Entamoeba invadens
RPKELPFMPIIFNFPPEFAG

SEQ ID NO: 2985153 - protein, 17 aa, Entamoeba invadens
RPLEVLVNYCLEKAVEE

SEQ ID NO: 2985154 - protein, 20 aa, Entamoeba invadens
RPLPEYLVGFSLFMSITTYG

SEQ ID NO: 2985155 - protein, 20 aa, Entamoeba invadens
RPMLSQEIDFFFGNYSYFVN

SEQ ID NO: 2985156 - protein, 21 aa, Entamoeba invadens
RPMQVTCRFYQIGILMLFNEN

SEQ ID NO: 2985157 - protein, 19 aa, Entamoeba invadens
RPNLYEGWGKKQGGAVKTW

SEQ ID NO: 2985158 - protein, 18 aa, Entamoeba invadens
RPNPWEGPVFITRKEEKM

SEQ ID NO: 2985159 - protein, 17 aa, Entamoeba invadens
RPRSVLIGKVPPLSGKI

SEQ ID NO: 2985160 - protein, 19 aa, Entamoeba invadens
RPRTLRWSYSVVEGSSIIR

SEQ ID NO: 2985161 - protein, 18 aa, Entamoeba invadens
RPSVCPCWSVEPKLGTNP

SEQ ID NO: 2985162 - protein, 20 aa, Entamoeba invadens
RPTVRECLLFPFFSGKKRER

SEQ ID NO: 2985163 - protein, 18 aa, Entamoeba invadens
RPVLKVVEDFAALSKKFI

SEQ ID NO: 2985164 - protein, 23 aa, Entamoeba invadens
RQDEVFKMIAQWIVLIKTKAQSA

SEQ ID NO: 2985165 - protein, 20 aa, Entamoeba invadens
RQDYKVTVFLSRSCDGDVPK

SEQ ID NO: 2985166 - protein, 19 aa, Entamoeba invadens
RQEVLKQLLIFSAAKNPLL

SEQ ID NO: 2985167 - protein, 20 aa, Entamoeba invadens
RQGKTGKCYADFEDQETWLK

SEQ ID NO: 2985168 - protein, 18 aa, Entamoeba invadens
RQIAFARARRIRMKRNQK

SEQ ID NO: 2985169 - protein, 20 aa, Entamoeba invadens
RQIEFSKLIPGISCVSTRSG

SEQ ID NO: 2985170 - protein, 23 aa, Entamoeba invadens
RQLFCSLRLAHYLAQYGSTLLGS

SEQ ID NO: 2985171 - protein, 18 aa, Entamoeba invadens
RQNKSWKRLVTKATFVGE

SEQ ID NO: 2985172 - protein, 21 aa, Entamoeba invadens
RQRFFCVIFWYPVSYSTTRKY

SEQ ID NO: 2985173 - protein, 18 aa, Entamoeba invadens
RQTRCANCGQEFTDSESE

SEQ ID NO: 2985174 - protein, 18 aa, Entamoeba invadens
RQYFKVTVFLSRSCDDVV

SEQ ID NO: 2985175 - protein, 24 aa, Entamoeba invadens
RRAAIECWDVVAITVKEYALTLDN

SEQ ID NO: 2985176 - protein, 17 aa, Entamoeba invadens
RRCYICGGVKNYNAKTI

SEQ ID NO: 2985177 - protein, 22 aa, Entamoeba invadens
RRDARCKDCRRNFVSLGDKVKI

SEQ ID NO: 2985178 - protein, 18 aa, Entamoeba invadens
RREISFFILMKLFAILFE

SEQ ID NO: 2985179 - protein, 20 aa, Entamoeba invadens
RRELSLFKGITCFDCGSQIS

SEQ ID NO: 2985180 - protein, 20 aa, Entamoeba invadens
RRFAKELKRIAPANINVNIS

SEQ ID NO: 2985181 - protein, 19 aa, Entamoeba invadens
RRHFAEWGELEYIRVLPVR

SEQ ID NO: 2985182 - protein, 17 aa, Entamoeba invadens
RRHITMINRFFKTLTDL

SEQ ID NO: 2985183 - protein, 17 aa, Entamoeba invadens
RRIKIVIFRNDVIAKLI

SEQ ID NO: 2985184 - protein, 19 aa, Entamoeba invadens
RRIKLLDLFCCVGGDSIQH

SEQ ID NO: 2985185 - protein, 19 aa, Entamoeba invadens
RRKCDMSPCSLTSAENSFE

SEQ ID NO: 2985186 - protein, 23 aa, Entamoeba invadens
RRKEEWHPYLLFCKMNRESLSTE

SEQ ID NO: 2985187 - protein, 22 aa, Entamoeba invadens
RRLKTLSMCWVKGNIPVVLTHV

SEQ ID NO: 2985188 - protein, 20 aa, Entamoeba invadens
RRLLECLQYFSIEDVEFLET

SEQ ID NO: 2985189 - protein, 19 aa, Entamoeba invadens
RRLSVPGNLSFVLLENETA

SEQ ID NO: 2985190 - protein, 19 aa, Entamoeba invadens
RRMFAWREWLYPRRHLYDR

SEQ ID NO: 2985191 - protein, 17 aa, Entamoeba invadens
RRMKRINLPSGLKEIKL

SEQ ID NO: 2985192 - protein, 19 aa, Entamoeba invadens
RRMKSCLDFIAFEKTQHRA

SEQ ID NO: 2985193 - protein, 21 aa, Entamoeba invadens
RRMTSKFGFKEECIRKYDLEV

SEQ ID NO: 2985194 - protein, 17 aa, Entamoeba invadens
RRNSMELGQEVAEANEE

SEQ ID NO: 2985195 - protein, 19 aa, Entamoeba invadens
RRPDLLDAKFLSSGSASVN

SEQ ID NO: 2985196 - protein, 20 aa, Entamoeba invadens
RRPQLVPVLYKLEFVSLIIQ

SEQ ID NO: 2985197 - protein, 18 aa, Entamoeba invadens
RRPSGYVRSGLKSVEELR

SEQ ID NO: 2985198 - protein, 18 aa, Entamoeba invadens
RRRFEKRIYIGLPEAPAR

SEQ ID NO: 2985199 - protein, 21 aa, Entamoeba invadens
RRRFWFEKFHWFISSENFVII

SEQ ID NO: 2985200 - protein, 21 aa, Entamoeba invadens
RRRIGHNFFWFLKAEIHDARV

SEQ ID NO: 2985201 - protein, 20 aa, Entamoeba invadens
RRTKFPYSRVYEALLVLLHH

SEQ ID NO: 2985202 - protein, 19 aa, Entamoeba invadens
RRWILCSSQMFSLFGGDWR

SEQ ID NO: 2985203 - protein, 17 aa, Entamoeba invadens
RSAFRVCERLERIEMST

SEQ ID NO: 2985204 - protein, 20 aa, Entamoeba invadens
RSAVCYKENLIFLIITDTCT

SEQ ID NO: 2985205 - protein, 18 aa, Entamoeba invadens
RSAYVVKIVEDFCENMSK

SEQ ID NO: 2985206 - protein, 19 aa, Entamoeba invadens
RSDGLKMTFVFSKNDFLVN

SEQ ID NO: 2985207 - protein, 17 aa, Entamoeba invadens
RSDVPKEYGLFEHTGDK

SEQ ID NO: 2985208 - protein, 24 aa, Entamoeba invadens
RSEELCVLGNLFGIECFDDGLVSI

SEQ ID NO: 2985209 - protein, 21 aa, Entamoeba invadens
RSEGLQKLFTCLCAEINETFP

SEQ ID NO: 2985210 - protein, 17 aa, Entamoeba invadens
RSEGLSVVGQFAPLTLG

SEQ ID NO: 2985211 - protein, 19 aa, Entamoeba invadens
RSEMVQGFYGRKKRGGYKG

SEQ ID NO: 2985212 - protein, 19 aa, Entamoeba invadens
RSERSSICKPRISTVPVTQ

SEQ ID NO: 2985213 - protein, 17 aa, Entamoeba invadens
RSGLLQFFLFPNRTLGL

SEQ ID NO: 2985214 - protein, 18 aa, Entamoeba invadens
RSGSKLKFVLMVYKSAEN

SEQ ID NO: 2985215 - protein, 17 aa, Entamoeba invadens
RSGVVGVNIGKIKRMFF

SEQ ID NO: 2985216 - protein, 17 aa, Entamoeba invadens
RSGVVGVNIGKIKRMFV

SEQ ID NO: 2985217 - protein, 17 aa, Entamoeba invadens
RSGYVMCCLIKLSKASH

SEQ ID NO: 2985218 - protein, 17 aa, Entamoeba invadens
RSHFKFFPNVETYYIYK

SEQ ID NO: 2985219 - protein, 18 aa, Entamoeba invadens
RSHFYPHLFTLILRHVHS

SEQ ID NO: 2985220 - protein, 22 aa, Entamoeba invadens
RSIGEKCFRWCGSLSSVNIPSS

SEQ ID NO: 2985221 - protein, 17 aa, Entamoeba invadens
RSIRRVTLLAGIYGDGT

SEQ ID NO: 2985222 - protein, 23 aa, Entamoeba invadens
RSIVAYAPWIKRIFLVTDGEVPD

SEQ ID NO: 2985223 - protein, 24 aa, Entamoeba invadens
RSLLEKWSGLKFRKVLFDSTKDDY

SEQ ID NO: 2985224 - protein, 19 aa, Entamoeba invadens
RSLLKCLSYSMGEAFIPSF

SEQ ID NO: 2985225 - protein, 19 aa, Entamoeba invadens
RSLLKFSIKGVLCDEVILT

SEQ ID NO: 2985226 - protein, 23 aa, Entamoeba invadens
RSLPSGQHKILWGVIMKYIVSLD

SEQ ID NO: 2985227 - protein, 17 aa, Entamoeba invadens
RSNFVFKGSIDYTIYKA

SEQ ID NO: 2985228 - protein, 19 aa, Entamoeba invadens
RSPTIWHLYGIVAREQKDY

SEQ ID NO: 2985229 - protein, 20 aa, Entamoeba invadens
RSRISWASIEVFRKRYVNLI

SEQ ID NO: 2985230 - protein, 17 aa, Entamoeba invadens
RSRRCTFALLKNILVVA

SEQ ID NO: 2985231 - protein, 20 aa, Entamoeba invadens
RSTGCGFGIYTIDDDVEDIT

SEQ ID NO: 2985232 - protein, 18 aa, Entamoeba invadens
RSTSKFILCGKGQRGILN

SEQ ID NO: 2985233 - protein, 24 aa, Entamoeba invadens
RSTWPVLQAMNWKSYALKYPELYG

SEQ ID NO: 2985234 - protein, 17 aa, Entamoeba invadens
RSVCPFTHLGLVVCATC

SEQ ID NO: 2985235 - protein, 17 aa, Entamoeba invadens
RTHPRFRTLRADAKQED

SEQ ID NO: 2985236 - protein, 17 aa, Entamoeba invadens
RTIFKRSSCLVLEYSLK

SEQ ID NO: 2985237 - protein, 18 aa, Entamoeba invadens
RTILNFFSSFLLQRAGIE

SEQ ID NO: 2985238 - protein, 17 aa, Entamoeba invadens
RTKFVKAFENFDAMFVL

SEQ ID NO: 2985239 - protein, 26 aa, Entamoeba invadens
RTKILLSYRGSAWFVMKVTPASNKFN

SEQ ID NO: 2985240 - protein, 20 aa, Entamoeba invadens
RTKSTLLLWDIWQLQLNGDG

SEQ ID NO: 2985241 - protein, 24 aa, Entamoeba invadens
RTLFKKDFLALDWRQKIRVFDCTF

SEQ ID NO: 2985242 - protein, 17 aa, Entamoeba invadens
RTNYRLVDRFCFPCTTI

SEQ ID NO: 2985243 - protein, 17 aa, Entamoeba invadens
RTPIFLKLEEVVFGSFC

SEQ ID NO: 2985244 - protein, 18 aa, Entamoeba invadens
RTQCKLCQEYGHIARICP

SEQ ID NO: 2985245 - protein, 21 aa, Entamoeba invadens
RTTPEFFPLLTLEEDLEMASR

SEQ ID NO: 2985246 - protein, 19 aa, Entamoeba invadens
RTVCDACLLAMYTKQQEAL

SEQ ID NO: 2985247 - protein, 17 aa, Entamoeba invadens
RTVCLAVIMAQMGMRCT

SEQ ID NO: 2985248 - protein, 25 aa, Entamoeba invadens
RTVEVPRLTSLVAHSSASYFVVGSS

SEQ ID NO: 2985249 - protein, 20 aa, Entamoeba invadens
RVAAFVKRLLLLMLNCDASI

SEQ ID NO: 2985250 - protein, 21 aa, Entamoeba invadens
RVAKFSSQCTTEWMWSNDNAS

SEQ ID NO: 2985251 - protein, 23 aa, Entamoeba invadens
RVARAGRIGTCYNFVQTEEMGYL

SEQ ID NO: 2985252 - protein, 18 aa, Entamoeba invadens
RVCRCEFKKSPELTEPSI

SEQ ID NO: 2985253 - protein, 25 aa, Entamoeba invadens
RVDSCPWGFLLRLLDRYKLRVPVKG

SEQ ID NO: 2985254 - protein, 18 aa, Entamoeba invadens
RVEARVGDQITFELCSKV

SEQ ID NO: 2985255 - protein, 17 aa, Entamoeba invadens
RVECFIDDFSLYNPESL

SEQ ID NO: 2985256 - protein, 23 aa, Entamoeba invadens
RVEIAEAIFVRWKTRKLMKERDI

SEQ ID NO: 2985257 - protein, 18 aa, Entamoeba invadens
RVFHLLKIKTILMNMCAL

SEQ ID NO: 2985258 - protein, 20 aa, Entamoeba invadens
RVFRELFYTYTLSVVINNPE

SEQ ID NO: 2985259 - protein, 22 aa, Entamoeba invadens
RVGLCCECLLFFLANLHDAIVS

SEQ ID NO: 2985260 - protein, 24 aa, Entamoeba invadens
RVIRGFLTRRVCTFKMISKRKKVF

SEQ ID NO: 2985261 - protein, 19 aa, Entamoeba invadens
RVKLPFALKSSGMNIFWES

SEQ ID NO: 2985262 - protein, 19 aa, Entamoeba invadens
RVKREFVLGILMYVGIPPD

SEQ ID NO: 2985263 - protein, 18 aa, Entamoeba invadens
RVKTTVCKSVVAKLQAYY

SEQ ID NO: 2985264 - protein, 25 aa, Entamoeba invadens
RVKWIAIKTTMSWEDYCENIKTSVV

SEQ ID NO: 2985265 - protein, 20 aa, Entamoeba invadens
RVLLDFLKKIFVMDPEQRMT

SEQ ID NO: 2985266 - protein, 17 aa, Entamoeba invadens
RVLNIEESWGKMKKELE

SEQ ID NO: 2985267 - protein, 21 aa, Entamoeba invadens
RVLTCDGCVFVASYDNPNSLD

SEQ ID NO: 2985268 - protein, 19 aa, Entamoeba invadens
RVLVWKDYIAFLIESEHAN

SEQ ID NO: 2985269 - protein, 18 aa, Entamoeba invadens
RVLYGFRKVWPCPTVILF

SEQ ID NO: 2985270 - protein, 23 aa, Entamoeba invadens
RVNIGEVLIRFDAFDDKQFLEIV

SEQ ID NO: 2985271 - protein, 19 aa, Entamoeba invadens
RVNYCFVEFVHHSDAERAA

SEQ ID NO: 2985272 - protein, 18 aa, Entamoeba invadens
RVPRYRLLLEDLLKNTPD

SEQ ID NO: 2985273 - protein, 25 aa, Entamoeba invadens
RVPYYDFRWGMTIDDFPELKEEDNK

SEQ ID NO: 2985274 - protein, 17 aa, Entamoeba invadens
RVSKKCRRVLSLFEYNP

SEQ ID NO: 2985275 - protein, 18 aa, Entamoeba invadens
RVTLYFCPACNSHLDPST

SEQ ID NO: 2985276 - protein, 17 aa, Entamoeba invadens
RVTRCDGFVIVVEAADE

SEQ ID NO: 2985277 - protein, 17 aa, Entamoeba invadens
RVVEFLVVKGFATKEEN

SEQ ID NO: 2985278 - protein, 19 aa, Entamoeba invadens
RVYPLKLGYIGVVNRSQQD

SEQ ID NO: 2985279 - protein, 20 aa, Entamoeba invadens
RVYPLKLGYIGVVNRSQQDI

SEQ ID NO: 2985280 - protein, 24 aa, Entamoeba invadens
RYCAFTKHCALVCLNDGIDFGRDE

SEQ ID NO: 2985281 - protein, 17 aa, Entamoeba invadens
RYDECRVLLSPMTQTEQ

SEQ ID NO: 2985282 - protein, 21 aa, Entamoeba invadens
RYDTCLRIANFLVELNAATDF

SEQ ID NO: 2985283 - protein, 19 aa, Entamoeba invadens
RYDTYFGVIGRIRYFIRTT

SEQ ID NO: 2985284 - protein, 19 aa, Entamoeba invadens
RYEAVNTWTGLRYAIGTSI

SEQ ID NO: 2985285 - protein, 21 aa, Entamoeba invadens
RYENSRGWFGFGYQIPQLDEK

SEQ ID NO: 2985286 - protein, 25 aa, Entamoeba invadens
RYFVKELPWVLAIQIKRFGWDERKI

SEQ ID NO: 2985287 - protein, 18 aa, Entamoeba invadens
RYGPFKGKVPRIICGTKA

SEQ ID NO: 2985288 - protein, 19 aa, Entamoeba invadens
RYICPAIIQPLEWGLAYEP

SEQ ID NO: 2985289 - protein, 19 aa, Entamoeba invadens
RYIFGFRVSRNYQAEQQAI

SEQ ID NO: 2985290 - protein, 19 aa, Entamoeba invadens
RYILKHMILFKNAIYGLFE

SEQ ID NO: 2985291 - protein, 17 aa, Entamoeba invadens
RYKGVPLYLEWAPERLF

SEQ ID NO: 2985292 - protein, 17 aa, Entamoeba invadens
RYLETLTGFAITSESLN

SEQ ID NO: 2985293 - protein, 19 aa, Entamoeba invadens
RYLKFPVVESNILKKRVSD

SEQ ID NO: 2985294 - protein, 19 aa, Entamoeba invadens
RYLLWKGMTLYLFDKKGTK

SEQ ID NO: 2985295 - protein, 18 aa, Entamoeba invadens
RYMVRSCGSEEVFNVYCE

SEQ ID NO: 2985296 - protein, 19 aa, Entamoeba invadens
RYPRYGYYISNFNFNIRND

SEQ ID NO: 2985297 - protein, 22 aa, Entamoeba invadens
RYQCAICGMNVHKKCIKKLAIP

SEQ ID NO: 2985298 - protein, 19 aa, Entamoeba invadens
RYSIEYDIIVDYWKMMKQS

SEQ ID NO: 2985299 - protein, 19 aa, Entamoeba invadens
RYSSEIGYWLAEEYWGHGI

SEQ ID NO: 2985300 - protein, 21 aa, Entamoeba invadens
RYTYIDLFAKLKMMFVAKLEG

SEQ ID NO: 2985301 - protein, 20 aa, Entamoeba invadens
RYVQLYVKFFVKVRNAMLVV

SEQ ID NO: 2985302 - protein, 22 aa, Entamoeba invadens
RYYYIHACMNYMALARNYQFIV

SEQ ID NO: 2985303 - protein, 18 aa, Entamoeba invadens
SACAICDGAVPIFRNKVL

SEQ ID NO: 2985304 - protein, 20 aa, Entamoeba invadens
SACFKACFRLSKIHFESKIS

SEQ ID NO: 2985305 - protein, 18 aa, Entamoeba invadens
SADAKFAISSSWDHTLRL

SEQ ID NO: 2985306 - protein, 21 aa, Entamoeba invadens
SAECDCMKTTIAELEEELQKE

SEQ ID NO: 2985307 - protein, 23 aa, Entamoeba invadens
SAFAFCVPYAFAIGINGVSTISP

SEQ ID NO: 2985308 - protein, 22 aa, Entamoeba invadens
SAFCSGCDFIRAEGFVFGHVAD

SEQ ID NO: 2985309 - protein, 17 aa, Entamoeba invadens
SAFFLAYLVQNPMKREQ

SEQ ID NO: 2985310 - protein, 20 aa, Entamoeba invadens
SAFLKRFMKGDIKIVHKCFE

SEQ ID NO: 2985311 - protein, 18 aa, Entamoeba invadens
SAFPRYLALLNFERIKVI

SEQ ID NO: 2985312 - protein, 21 aa, Entamoeba invadens
SAGMGLMWWMQRELTEKKKYM

SEQ ID NO: 2985313 - protein, 23 aa, Entamoeba invadens
SAKLADFGLAWVIGNHKINCKCE

SEQ ID NO: 2985314 - protein, 22 aa, Entamoeba invadens
SAKRFCSHLSLFAQPIRQEKAR

SEQ ID NO: 2985315 - protein, 21 aa, Entamoeba invadens
SAKRLFPNFVFLDAPFNKKYY

SEQ ID NO: 2985316 - protein, 18 aa, Entamoeba invadens
SASFILCLSKIIDAVYST

SEQ ID NO: 2985317 - protein, 19 aa, Entamoeba invadens
SASLRSPLMFSMPKQAEWG

SEQ ID NO: 2985318 - protein, 25 aa, Entamoeba invadens
SASVLRLAFGLDFCYFEVCANQSNS

SEQ ID NO: 2985319 - protein, 18 aa, Entamoeba invadens
SAVGLRFAGEQGPMLQSV

SEQ ID NO: 2985320 - protein, 23 aa, Entamoeba invadens
SAVIKNEVKGMIPIIQSGEYDIS

SEQ ID NO: 2985321 - protein, 23 aa, Entamoeba invadens
SAVRCVNCGLVVHAKKCEEKLKK

SEQ ID NO: 2985322 - protein, 18 aa, Entamoeba invadens
SCAVLEILLCYKGCGEIE

SEQ ID NO: 2985323 - protein, 18 aa, Entamoeba invadens
SCFKCCAMLSSVKFPLHL

SEQ ID NO: 2985324 - protein, 20 aa, Entamoeba invadens
SCFKSCGRLESFTGRGVVCV

SEQ ID NO: 2985325 - protein, 19 aa, Entamoeba invadens
SCFLDCHMLKNISLPLQLQ

SEQ ID NO: 2985326 - protein, 19 aa, Entamoeba invadens
SCFRECHMLKNIALHHQLQ

SEQ ID NO: 2985327 - protein, 17 aa, Entamoeba invadens
SCFRNCFLQEVVLSDSL

SEQ ID NO: 2985328 - protein, 20 aa, Entamoeba invadens
SCFSCCFKYTIPILPESFQV

SEQ ID NO: 2985329 - protein, 18 aa, Entamoeba invadens
SCGMAFVFKYIEAATQAG

SEQ ID NO: 2985330 - protein, 20 aa, Entamoeba invadens
SCHLCKNDSYLLGGNCEIIN

SEQ ID NO: 2985331 - protein, 17 aa, Entamoeba invadens
SCLGGLYINPFIDVSVQ

SEQ ID NO: 2985332 - protein, 17 aa, Entamoeba invadens
SCLNGLYINPFIDVAVQ

SEQ ID NO: 2985333 - protein, 17 aa, Entamoeba invadens
SCMEWLLQLLKTVKSNE

SEQ ID NO: 2985334 - protein, 17 aa, Entamoeba invadens
SCNEFLANFVVDLFGPK

SEQ ID NO: 2985335 - protein, 24 aa, Entamoeba invadens
SCPFPKTCWMLRNIVHFYNEAFRV

SEQ ID NO: 2985336 - protein, 18 aa, Entamoeba invadens
SCSCQKCIDGPPDQREGG

SEQ ID NO: 2985337 - protein, 18 aa, Entamoeba invadens
SCVVKGCFITFKKYADGP

SEQ ID NO: 2985338 - protein, 18 aa, Entamoeba invadens
SCYLQFPTVCKFESSRYV

SEQ ID NO: 2985339 - protein, 22 aa, Entamoeba invadens
SDACPICYSIFYLHTTTIPNVA

SEQ ID NO: 2985340 - protein, 26 aa, Entamoeba invadens
SDAFACAKLILVFRVDSTFDESLGFV

SEQ ID NO: 2985341 - protein, 22 aa, Entamoeba invadens
SDALKLNALFLLPPASSISDLK

SEQ ID NO: 2985342 - protein, 20 aa, Entamoeba invadens
SDCSPAFWNFLNLIGAKIEL

SEQ ID NO: 2985343 - protein, 29 aa, Entamoeba invadens
SDDEIFVSIEYLFFDALWVPLKMEILEEE

SEQ ID NO: 2985344 - protein, 22 aa, Entamoeba invadens
SDDMAKCFPILNSIIKLNKSEP

SEQ ID NO: 2985345 - protein, 17 aa, Entamoeba invadens
SDELKYMETIICCTPID

SEQ ID NO: 2985346 - protein, 18 aa, Entamoeba invadens
SDFFPLFWDIVSKNLEST

SEQ ID NO: 2985347 - protein, 17 aa, Entamoeba invadens
SDFKSVLAGFYLQMVNE

SEQ ID NO: 2985348 - protein, 18 aa, Entamoeba invadens
SDFWKVLFGLDHLKGNDQ

SEQ ID NO: 2985349 - protein, 17 aa, Entamoeba invadens
SDGCFRGCFALSSVSLC

SEQ ID NO: 2985350 - protein, 21 aa, Entamoeba invadens
SDGLKRFAFEGEQWNKVVRRM

SEQ ID NO: 2985351 - protein, 23 aa, Entamoeba invadens
SDHLNEWIDLIFGYKQRGEMAEK

SEQ ID NO: 2985352 - protein, 21 aa, Entamoeba invadens
SDICLRSAAAPTYFHPYQNYV

SEQ ID NO: 2985353 - protein, 20 aa, Entamoeba invadens
SDIFPSFGLLVVLYQSLEKE

SEQ ID NO: 2985354 - protein, 22 aa, Entamoeba invadens
SDIWSCGVMLFNMCCSKEFERC

SEQ ID NO: 2985355 - protein, 19 aa, Entamoeba invadens
SDIYVALLMKWMKKGEKES

SEQ ID NO: 2985356 - protein, 20 aa, Entamoeba invadens
SDKGGRCIGIGYLVFPCKEA

SEQ ID NO: 2985357 - protein, 17 aa, Entamoeba invadens
SDKRLRVFLSILTAPFT

SEQ ID NO: 2985358 - protein, 21 aa, Entamoeba invadens
SDKSSICSYSIDLYKTLISLE

SEQ ID NO: 2985359 - protein, 17 aa, Entamoeba invadens
SDNCCAHPFNFCTAENS

SEQ ID NO: 2985360 - protein, 24 aa, Entamoeba invadens
SDNKCAKCQSGYWVDTLTNTCVDH

SEQ ID NO: 2985361 - protein, 23 aa, Entamoeba invadens
SDRHPTCFAFGIGYDIGAMIVDG

SEQ ID NO: 2985362 - protein, 22 aa, Entamoeba invadens
SDVKEIFKSKGIQLSEEDLVDA

SEQ ID NO: 2985363 - protein, 22 aa, Entamoeba invadens
SDVRFVVHWNIPKNIEGFIQEA

SEQ ID NO: 2985364 - protein, 20 aa, Entamoeba invadens
SDVWALGCLIYKCLMLETPF

SEQ ID NO: 2985365 - protein, 19 aa, Entamoeba invadens
SDVWSCGVMAYRIAVGKGP

SEQ ID NO: 2985366 - protein, 24 aa, Entamoeba invadens
SDYIKEFLFKIGLVVTDGYGTSET

SEQ ID NO: 2985367 - protein, 18 aa, Entamoeba invadens
SEALKKLQTEFERKTSED

SEQ ID NO: 2985368 - protein, 23 aa, Entamoeba invadens
SEECLKVYLGVGLDWAPVNSIVG

SEQ ID NO: 2985369 - protein, 18 aa, Entamoeba invadens
SEECQRMAFLIGLLNANG

SEQ ID NO: 2985370 - protein, 21 aa, Entamoeba invadens
SEEFKNRFEPILIVTQKLVAE

SEQ ID NO: 2985371 - protein, 19 aa, Entamoeba invadens
SEEVINVFIDFGGRTEEVR

SEQ ID NO: 2985372 - protein, 21 aa, Entamoeba invadens
SEFIEKLCVISPFQRKTRLFG

SEQ ID NO: 2985373 - protein, 19 aa, Entamoeba invadens
SEFKFTECLTRIFNKGFLI

SEQ ID NO: 2985374 - protein, 20 aa, Entamoeba invadens
SEFLLRIGVSSFRKCSNLRN

SEQ ID NO: 2985375 - protein, 21 aa, Entamoeba invadens
SEFMVKWSPVMWTYLRDENVS

SEQ ID NO: 2985376 - protein, 21 aa, Entamoeba invadens
SEFRKRKGFEIGLRKKEVFGK

SEQ ID NO: 2985377 - protein, 20 aa, Entamoeba invadens
SEHFFLRFSPNLIKPTFDSV

SEQ ID NO: 2985378 - protein, 17 aa, Entamoeba invadens
SEHRLRIGGNFEGTLKN

SEQ ID NO: 2985379 - protein, 23 aa, Entamoeba invadens
SEHWLIMRCCTYIVSLLSYLCTL

SEQ ID NO: 2985380 - protein, 18 aa, Entamoeba invadens
SEILKVFKRFGFRYTSVK

SEQ ID NO: 2985381 - protein, 25 aa, Entamoeba invadens
SEILLRLNYTLTYRKTRGTSIILKM

SEQ ID NO: 2985382 - protein, 18 aa, Entamoeba invadens
SEILPIRKGEFVMLRGPS

SEQ ID NO: 2985383 - protein, 17 aa, Entamoeba invadens
SEIRKMFIGQFGTTLVA

SEQ ID NO: 2985384 - protein, 18 aa, Entamoeba invadens
SEIYTLICMCWQQEPKNR

SEQ ID NO: 2985385 - protein, 20 aa, Entamoeba invadens
SEKNVECIFVASSDISSEYM

SEQ ID NO: 2985386 - protein, 17 aa, Entamoeba invadens
SEKSKWILLKPFIQCFG

SEQ ID NO: 2985387 - protein, 19 aa, Entamoeba invadens
SELISLAFVCFKKKNETMK

SEQ ID NO: 2985388 - protein, 19 aa, Entamoeba invadens
SELYPGELVELIISDVLVP

SEQ ID NO: 2985389 - protein, 23 aa, Entamoeba invadens
SENLRLIGQYAFSGCLSLKSFYF

SEQ ID NO: 2985390 - protein, 24 aa, Entamoeba invadens
SEPNCTRQGFSFCLTCSKIYCESH

SEQ ID NO: 2985391 - protein, 20 aa, Entamoeba invadens
SEPPFQYWIFFLRMNISVLN

SEQ ID NO: 2985392 - protein, 20 aa, Entamoeba invadens
SEPWEVQSFFAICNNCIHKS

SEQ ID NO: 2985393 - protein, 24 aa, Entamoeba invadens
SEQWEWLFWVGFRDIFVWKKGSEY

SEQ ID NO: 2985394 - protein, 20 aa, Entamoeba invadens
SERGKCLSCLLAQTKKSSKN

SEQ ID NO: 2985395 - protein, 17 aa, Entamoeba invadens
SESLMECCGYRDGVVLY

SEQ ID NO: 2985396 - protein, 18 aa, Entamoeba invadens
SESLYIKFALLFQTLPLA

SEQ ID NO: 2985397 - protein, 18 aa, Entamoeba invadens
SETLVFVGNLAFAATDDD

SEQ ID NO: 2985398 - protein, 23 aa, Entamoeba invadens
SEVCIKLRIKIMLDAANKISYLH

SEQ ID NO: 2985399 - protein, 18 aa, Entamoeba invadens
SEVFSRFPPRSVDVSELV

SEQ ID NO: 2985400 - protein, 21 aa, Entamoeba invadens
SEVFTKFIIRQEIDEMMTYAK

SEQ ID NO: 2985401 - protein, 17 aa, Entamoeba invadens
SEVMRLTLLIGEPPSAV

SEQ ID NO: 2985402 - protein, 22 aa, Entamoeba invadens
SEVPWILSPILRTVRWLNKMNT

SEQ ID NO: 2985403 - protein, 17 aa, Entamoeba invadens
SEWFRKQFHPIELRERR

SEQ ID NO: 2985404 - protein, 18 aa, Entamoeba invadens
SEYGIRLLLLTGKTDERS

SEQ ID NO: 2985405 - protein, 20 aa, Entamoeba invadens
SEYLIEIFFWRLVKYKIDQQ

SEQ ID NO: 2985406 - protein, 20 aa, Entamoeba invadens
SEYNFGYLIYCEFTSLSIKM

SEQ ID NO: 2985407 - protein, 23 aa, Entamoeba invadens
SFDCATPLLIQWTYQAMINEFLG

SEQ ID NO: 2985408 - protein, 21 aa, Entamoeba invadens
SFDEMMKWITLMDAIKNDAEH

SEQ ID NO: 2985409 - protein, 20 aa, Entamoeba invadens
SFDGACMFSALSLFQSHSVL

SEQ ID NO: 2985410 - protein, 18 aa, Entamoeba invadens
SFEIPKSVILLGLCILEG

SEQ ID NO: 2985411 - protein, 20 aa, Entamoeba invadens
SFFKNWKRRYAVLAKNVIAL

SEQ ID NO: 2985412 - protein, 19 aa, Entamoeba invadens
SFFSDVDCAIFVTSLAEYD

SEQ ID NO: 2985413 - protein, 25 aa, Entamoeba invadens
SFHLKCFKCDVCGAQLGGKFGLKGT

SEQ ID NO: 2985414 - protein, 23 aa, Entamoeba invadens
SFITLRELFKWADRHASSYEELA

SEQ ID NO: 2985415 - protein, 21 aa, Entamoeba invadens
SFKRSGVVGVNLGRVKRMFVS

SEQ ID NO: 2985416 - protein, 23 aa, Entamoeba invadens
SFLNRINKAFVEMKIPIEIENFD

SEQ ID NO: 2985417 - protein, 20 aa, Entamoeba invadens
SFMFKNCRSLTGVKLPNSIK

SEQ ID NO: 2985418 - protein, 17 aa, Entamoeba invadens
SFMSKWVVVLFRRDFSH

SEQ ID NO: 2985419 - protein, 18 aa, Entamoeba invadens
SFNMKREIVFNVIQNDEM

SEQ ID NO: 2985420 - protein, 21 aa, Entamoeba invadens
SFNRKNLRYCVKPKTKNVIDD

SEQ ID NO: 2985421 - protein, 21 aa, Entamoeba invadens
SFRELLAFKECHESVLMILFV

SEQ ID NO: 2985422 - protein, 21 aa, Entamoeba invadens
SFRTPCLFCKEFNDLDKVLEH

SEQ ID NO: 2985423 - protein, 18 aa, Entamoeba invadens
SFTDWKFVDAVPYFATQT

SEQ ID NO: 2985424 - protein, 21 aa, Entamoeba invadens
SFVCAEAFGAFSLVDENVYTT

SEQ ID NO: 2985425 - protein, 19 aa, Entamoeba invadens
SFVKECLDGGILIDQICKM

SEQ ID NO: 2985426 - protein, 23 aa, Entamoeba invadens
SFVPVQCLPSFFSVENNVSNTFR

SEQ ID NO: 2985427 - protein, 17 aa, Entamoeba invadens
SFWPGFNTFDFDFAFSE

SEQ ID NO: 2985428 - protein, 21 aa, Entamoeba invadens
SGAFMRLKYVLRVNILSKSPS

SEQ ID NO: 2985429 - protein, 17 aa, Entamoeba invadens
SGCGLSGCQECEEGYYL

SEQ ID NO: 2985430 - protein, 19 aa, Entamoeba invadens
SGCHWCLSFAWKNVDLEYF

SEQ ID NO: 2985431 - protein, 19 aa, Entamoeba invadens
SGEACEFEILLTLKCTTKF

SEQ ID NO: 2985432 - protein, 19 aa, Entamoeba invadens
SGEACEFEILLTLKCTTKI

SEQ ID NO: 2985433 - protein, 17 aa, Entamoeba invadens
SGFACEFEVFITPYCTM

SEQ ID NO: 2985434 - protein, 22 aa, Entamoeba invadens
SGFFRFKKLYQMGVKIGMGTDV

SEQ ID NO: 2985435 - protein, 20 aa, Entamoeba invadens
SGGCKCCICMDVVRKLVDDY

SEQ ID NO: 2985436 - protein, 20 aa, Entamoeba invadens
SGHLDCWSSLVMPKDEYNEN

SEQ ID NO: 2985437 - protein, 17 aa, Entamoeba invadens
SGHPDCVQSLITIDRNT

SEQ ID NO: 2985438 - protein, 19 aa, Entamoeba invadens
SGKCPQYATSIPISGETVK

SEQ ID NO: 2985439 - protein, 24 aa, Entamoeba invadens
SGKDWRAGRCAACNIIPASTGAAK

SEQ ID NO: 2985440 - protein, 18 aa, Entamoeba invadens
SGKDWRAGRCAAHNIIPA

SEQ ID NO: 2985441 - protein, 23 aa, Entamoeba invadens
SGKIWRMRACCVIYVNFANTEEE

SEQ ID NO: 2985442 - protein, 19 aa, Entamoeba invadens
SGKLFQEFFLKKLINAERM

SEQ ID NO: 2985443 - protein, 24 aa, Entamoeba invadens
SGKYAKFTICFSSVISDELLDYFA

SEQ ID NO: 2985444 - protein, 19 aa, Entamoeba invadens
SGLHGWAFTLDKFAKMWSE

SEQ ID NO: 2985445 - protein, 17 aa, Entamoeba invadens
SGLKWPEYHPFKVNHYF

SEQ ID NO: 2985446 - protein, 24 aa, Entamoeba invadens
SGLNKVCFSKCVFKTNYNIDDNNE

SEQ ID NO: 2985447 - protein, 24 aa, Entamoeba invadens
SGQTCCWCGLEIDKAHIVECSLCH

SEQ ID NO: 2985448 - protein, 20 aa, Entamoeba invadens
SGSFLPTLIPYILHPFSEKK

SEQ ID NO: 2985449 - protein, 18 aa, Entamoeba invadens
SGSKLSFLVPSFMKKKKR

SEQ ID NO: 2985450 - protein, 19 aa, Entamoeba invadens
SGTFSGIFKVCVTPQEDCK

SEQ ID NO: 2985451 - protein, 18 aa, Entamoeba invadens
SGWCQGKVKLLFLSDERK

SEQ ID NO: 2985452 - protein, 19 aa, Entamoeba invadens
SHFPDFFPFPCFQLERLER

SEQ ID NO: 2985453 - protein, 17 aa, Entamoeba invadens
SHIFYSRVNLFSPFITN

SEQ ID NO: 2985454 - protein, 18 aa, Entamoeba invadens
SHIKSVGYYSCFSCVNLK

SEQ ID NO: 2985455 - protein, 24 aa, Entamoeba invadens
SHISIKCFCCIAAKAPEIDLSIFL

SEQ ID NO: 2985456 - protein, 17 aa, Entamoeba invadens
SHLLPMWSDDLLYKDLE

SEQ ID NO: 2985457 - protein, 17 aa, Entamoeba invadens
SHMKRFFKIYTEDFMKI

SEQ ID NO: 2985458 - protein, 24 aa, Entamoeba invadens
SHPALCLRTALKLSTKAFQKKNVD

SEQ ID NO: 2985459 - protein, 19 aa, Entamoeba invadens
SHPTLPISICLRDNGCLIL

SEQ ID NO: 2985460 - protein, 18 aa, Entamoeba invadens
SHSACPMWSITLNRSSTI

SEQ ID NO: 2985461 - protein, 18 aa, Entamoeba invadens
SHVFCLWNSNSMYRTLLL

SEQ ID NO: 2985462 - protein, 18 aa, Entamoeba invadens
SIADLRKIEEWTSMKATD

SEQ ID NO: 2985463 - protein, 21 aa, Entamoeba invadens
SICKKCFYECYSLNSVTIPSS

SEQ ID NO: 2985464 - protein, 17 aa, Entamoeba invadens
SICKPRISTVPVTQKDF

SEQ ID NO: 2985465 - protein, 26 aa, Entamoeba invadens
SICREIKPYKSFICLLLVKQAATDEP

SEQ ID NO: 2985466 - protein, 17 aa, Entamoeba invadens
SIDAFKVLLDPSVGGNE

SEQ ID NO: 2985467 - protein, 18 aa, Entamoeba invadens
SIEIPKLVQAIGYNTFKT

SEQ ID NO: 2985468 - protein, 21 aa, Entamoeba invadens
SIEVCVPLECVMIGGNVEAQI

SEQ ID NO: 2985469 - protein, 25 aa, Entamoeba invadens
SIFAFPSRRFHLFIASTILIMNAKS

SEQ ID NO: 2985470 - protein, 19 aa, Entamoeba invadens
SIGAYRYIECSALSQVNLE

SEQ ID NO: 2985471 - protein, 17 aa, Entamoeba invadens
SIGCMLFQFLTGEFPFR

SEQ ID NO: 2985472 - protein, 21 aa, Entamoeba invadens
SIGDYCFFECYSLINITIPSN

SEQ ID NO: 2985473 - protein, 23 aa, Entamoeba invadens
SIGEACFCRCCFLKNVVILSSVK

SEQ ID NO: 2985474 - protein, 23 aa, Entamoeba invadens
SIGRCCFCKCISLSSVTIPSSVN

SEQ ID NO: 2985475 - protein, 19 aa, Entamoeba invadens
SIIDWCFYECISLSSITIP

SEQ ID NO: 2985476 - protein, 17 aa, Entamoeba invadens
SIIIWKWSCEDLDLSDL

SEQ ID NO: 2985477 - protein, 21 aa, Entamoeba invadens
SIKGPELLTMWFGESEGNVRE

SEQ ID NO: 2985478 - protein, 20 aa, Entamoeba invadens
SIKHYWKNVIVNSGVLKKIG

SEQ ID NO: 2985479 - protein, 25 aa, Entamoeba invadens
SIKKFKICAVMPCRMATVISALLDP

SEQ ID NO: 2985480 - protein, 18 aa, Entamoeba invadens
SILPKIYPSTSIVFKSSD

SEQ ID NO: 2985481 - protein, 22 aa, Entamoeba invadens
SILYKLRLGEIVTTIPTIGFNA

SEQ ID NO: 2985482 - protein, 18 aa, Entamoeba invadens
SILYKLRLGENVTTIPTI

SEQ ID NO: 2985483 - protein, 24 aa, Entamoeba invadens
SILYKSRLPLIVVFTKTDVSPATK

SEQ ID NO: 2985484 - protein, 17 aa, Entamoeba invadens
SISFLNIYCKVEITTLN

SEQ ID NO: 2985485 - protein, 19 aa, Entamoeba invadens
SISYSTAEFVKWMDDREKL

SEQ ID NO: 2985486 - protein, 24 aa, Entamoeba invadens
SITANCGYALFGLKHHCELYRCSS

SEQ ID NO: 2985487 - protein, 18 aa, Entamoeba invadens
SIYSFGFDKPSAIQQRAI

SEQ ID NO: 2985488 - protein, 20 aa, Entamoeba invadens
SKACELWGCEPEALRKALIQ

SEQ ID NO: 2985489 - protein, 17 aa, Entamoeba invadens
SKAEFFLTIPLQLEVQN

SEQ ID NO: 2985490 - protein, 17 aa, Entamoeba invadens
SKAGKFISCKIVSHPTD

SEQ ID NO: 2985491 - protein, 24 aa, Entamoeba invadens
SKDRFRLLYTFLRKYKGKKMIVFM

SEQ ID NO: 2985492 - protein, 17 aa, Entamoeba invadens
SKECGLFGLKISSTMWD

SEQ ID NO: 2985493 - protein, 21 aa, Entamoeba invadens
SKEGFFPKVFAVYKLETQKRG

SEQ ID NO: 2985494 - protein, 20 aa, Entamoeba invadens
SKELFLLLLTFLKHAFDYKT

SEQ ID NO: 2985495 - protein, 20 aa, Entamoeba invadens
SKELYEFFMPFAKAMLEKVV

SEQ ID NO: 2985496 - protein, 18 aa, Entamoeba invadens
SKFPPARKEFYTFLEEFK

SEQ ID NO: 2985497 - protein, 20 aa, Entamoeba invadens
SKFRSCVMSSSSITLRGKAK

SEQ ID NO: 2985498 - protein, 17 aa, Entamoeba invadens
SKFVFKHNWHLVELDRK

SEQ ID NO: 2985499 - protein, 19 aa, Entamoeba invadens
SKGRCFGVVGLGKIEKTGN

SEQ ID NO: 2985500 - protein, 20 aa, Entamoeba invadens
SKGRIPAMSWWNYEKKMYLL

SEQ ID NO: 2985501 - protein, 24 aa, Entamoeba invadens
SKHILKERIEAIVVNSLKESQEWS

SEQ ID NO: 2985502 - protein, 19 aa, Entamoeba invadens
SKIFCLGDFFLFYKTHEIF

SEQ ID NO: 2985503 - protein, 23 aa, Entamoeba invadens
SKIGKTCFRYCIFLHDIKLPIGL

SEQ ID NO: 2985504 - protein, 23 aa, Entamoeba invadens
SKIGKTCFRYCIFLQDIKLLGLK

SEQ ID NO: 2985505 - protein, 19 aa, Entamoeba invadens
SKIKFFFYKALPTRRKVVE

SEQ ID NO: 2985506 - protein, 21 aa, Entamoeba invadens
SKIKKCFICGNYGHKTSMCPQ

SEQ ID NO: 2985507 - protein, 17 aa, Entamoeba invadens
SKILIKFDHECLKCRDH

SEQ ID NO: 2985508 - protein, 18 aa, Entamoeba invadens
SKINYCYLPSAHVFDNEI

SEQ ID NO: 2985509 - protein, 20 aa, Entamoeba invadens
SKLDLLIFFSEIRIFSNTIV

SEQ ID NO: 2985510 - protein, 22 aa, Entamoeba invadens
SKLGRTTVCFGEWFEGLDDRVI

SEQ ID NO: 2985511 - protein, 18 aa, Entamoeba invadens
SKLKGVVISHEILLSVLE

SEQ ID NO: 2985512 - protein, 21 aa, Entamoeba invadens
SKLKKAMVVPDSFYQKVDFKK

SEQ ID NO: 2985513 - protein, 20 aa, Entamoeba invadens
SKMFNLRWINFIGNPIDDKG

SEQ ID NO: 2985514 - protein, 24 aa, Entamoeba invadens
SKNVKCPVLFLWGNYYGDVEFVKQ

SEQ ID NO: 2985515 - protein, 17 aa, Entamoeba invadens
SKPIFLLVVDLIDLLSA

SEQ ID NO: 2985516 - protein, 21 aa, Entamoeba invadens
SKPRFQIDLSIGIFNSKVNKG

SEQ ID NO: 2985517 - protein, 22 aa, Entamoeba invadens
SKPRPTVTVTLYLFPEVNPKQE

SEQ ID NO: 2985518 - protein, 25 aa, Entamoeba invadens
SKREIDLRVGFAFTRLSTSLLRTQF

SEQ ID NO: 2985519 - protein, 20 aa, Entamoeba invadens
SKRGILFLSEAMRWIVDETC

SEQ ID NO: 2985520 - protein, 20 aa, Entamoeba invadens
SKSAFCWFLRNLFVIDDVGM

SEQ ID NO: 2985521 - protein, 18 aa, Entamoeba invadens
SKSVVFCGCFPRRHFENF

SEQ ID NO: 2985522 - protein, 17 aa, Entamoeba invadens
SKTLHCFEVTDEDPYVF

SEQ ID NO: 2985523 - protein, 17 aa, Entamoeba invadens
SKTLRWIFVGGKGGVGK

SEQ ID NO: 2985524 - protein, 19 aa, Entamoeba invadens
SKTPFIFLVDAFRYNVEYV

SEQ ID NO: 2985525 - protein, 24 aa, Entamoeba invadens
SKTRYSLKCLFNIIKDALGVKNVV

SEQ ID NO: 2985526 - protein, 17 aa, Entamoeba invadens
SKVCLSALCSLKVNPVF

SEQ ID NO: 2985527 - protein, 17 aa, Entamoeba invadens
SKVPLWLSKIFNKSGIT

SEQ ID NO: 2985528 - protein, 22 aa, Entamoeba invadens
SKVTRIYLPFCFTSYSYELKNE

SEQ ID NO: 2985529 - protein, 22 aa, Entamoeba invadens
SKVYWKWFLALSEVPRRSGNRL

SEQ ID NO: 2985530 - protein, 21 aa, Entamoeba invadens
SKWAGECLILPNFLILPVQRF

SEQ ID NO: 2985531 - protein, 20 aa, Entamoeba invadens
SKYCKVKCLYPFLENQVVRV

SEQ ID NO: 2985532 - protein, 22 aa, Entamoeba invadens
SKYHYKAFCFLKSLFSKNVEYR

SEQ ID NO: 2985533 - protein, 18 aa, Entamoeba invadens
SKYLCCFGPVTSWHDGNN

SEQ ID NO: 2985534 - protein, 17 aa, Entamoeba invadens
SLAKWKRLQLHYLHIPV

SEQ ID NO: 2985535 - protein, 19 aa, Entamoeba invadens
SLCELIRPFFDNIGEHKET

SEQ ID NO: 2985536 - protein, 17 aa, Entamoeba invadens
SLCLFGHQCFVFCAQLS

SEQ ID NO: 2985537 - protein, 21 aa, Entamoeba invadens
SLCMKHFQIPFGVTRLCTQSF

SEQ ID NO: 2985538 - protein, 17 aa, Entamoeba invadens
SLCPLVMYLRQDAVDRI

SEQ ID NO: 2985539 - protein, 19 aa, Entamoeba invadens
SLCTLKCAMFVNNWYVPME

SEQ ID NO: 2985540 - protein, 21 aa, Entamoeba invadens
SLDVKEIYPFIKIVNLEILEE

SEQ ID NO: 2985541 - protein, 19 aa, Entamoeba invadens
SLECLKIVTLNSIYQEPIS

SEQ ID NO: 2985542 - protein, 17 aa, Entamoeba invadens
SLERLRKDILLVRPTFF

SEQ ID NO: 2985543 - protein, 17 aa, Entamoeba invadens
SLESLGIYCFNRCSSLN

SEQ ID NO: 2985544 - protein, 24 aa, Entamoeba invadens
SLEVPKHITAIMSYCFAYHSDLIS

SEQ ID NO: 2985545 - protein, 19 aa, Entamoeba invadens
SLFADLAMIVMKLIPQKPQ

SEQ ID NO: 2985546 - protein, 21 aa, Entamoeba invadens
SLFPQSFVQFLAWQRLLQIYS

SEQ ID NO: 2985547 - protein, 19 aa, Entamoeba invadens
SLFSFKMTSDFGINKNGDG

SEQ ID NO: 2985548 - protein, 19 aa, Entamoeba invadens
SLGFALSRFVCDSITGTEG

SEQ ID NO: 2985549 - protein, 24 aa, Entamoeba invadens
SLGFFCCKLCKQLHLKKNPTKSSE

SEQ ID NO: 2985550 - protein, 24 aa, Entamoeba invadens
SLGQRQLICLARALLKNSKILIMD

SEQ ID NO: 2985551 - protein, 20 aa, Entamoeba invadens
SLIISCCLHFNKNLNIENGT

SEQ ID NO: 2985552 - protein, 24 aa, Entamoeba invadens
SLINYCMFNYYAGVTMLIKNMTVE

SEQ ID NO: 2985553 - protein, 23 aa, Entamoeba invadens
SLIPEELKFLGIHRVVAPTLVYP

SEQ ID NO: 2985554 - protein, 21 aa, Entamoeba invadens
SLITLRFPIDKIRLFEKEEIN

SEQ ID NO: 2985555 - protein, 22 aa, Entamoeba invadens
SLKRRLSATLGIGRRDKAKEKD

SEQ ID NO: 2985556 - protein, 18 aa, Entamoeba invadens
SLKTLGKYCFKNCIKITS

SEQ ID NO: 2985557 - protein, 24 aa, Entamoeba invadens
SLKVKLCDFGLCIKATESMDSLVG

SEQ ID NO: 2985558 - protein, 17 aa, Entamoeba invadens
SLKVLKQIIEPFLDQNG

SEQ ID NO: 2985559 - protein, 18 aa, Entamoeba invadens
SLLIMPIQRIPRYVLLLK

SEQ ID NO: 2985560 - protein, 20 aa, Entamoeba invadens
SLLKCFQRAAGVAVKEMKEL

SEQ ID NO: 2985561 - protein, 22 aa, Entamoeba invadens
SLLKFPFVIPVNYKMKFLHQEA

SEQ ID NO: 2985562 - protein, 22 aa, Entamoeba invadens
SLLLCCWCFFVYNELSKCFQPY

SEQ ID NO: 2985563 - protein, 26 aa, Entamoeba invadens
SLLYYETCAWMWRRGFTMTFKENNEF

SEQ ID NO: 2985564 - protein, 18 aa, Entamoeba invadens
SLMLNRWLFSKKHCPLYM

SEQ ID NO: 2985565 - protein, 20 aa, Entamoeba invadens
SLPFYMIIIWLLKSINLQLI

SEQ ID NO: 2985566 - protein, 18 aa, Entamoeba invadens
SLPHFLVTVFQFYESQAY

SEQ ID NO: 2985567 - protein, 20 aa, Entamoeba invadens
SLPLFPTRISPLFSTLGIDG

SEQ ID NO: 2985568 - protein, 20 aa, Entamoeba invadens
SLPPRNKKLLAFYMNMFYEF

SEQ ID NO: 2985569 - protein, 19 aa, Entamoeba invadens
SLRFKSSRFFSTFTGTFDG

SEQ ID NO: 2985570 - protein, 23 aa, Entamoeba invadens
SLRFLQKRFVCVASSKVEYIGNT

SEQ ID NO: 2985571 - protein, 18 aa, Entamoeba invadens
SLRLEGIPEMSASIIGVH

SEQ ID NO: 2985572 - protein, 25 aa, Entamoeba invadens
SLRMLRFCFRAENKTELGFDISLQV

SEQ ID NO: 2985573 - protein, 19 aa, Entamoeba invadens
SLRSSCLIHLKRDDIIKKA

SEQ ID NO: 2985574 - protein, 24 aa, Entamoeba invadens
SLRYRVPFKQVYFFDTFNCFVSSE

SEQ ID NO: 2985575 - protein, 26 aa, Entamoeba invadens
SLSIKPHTCYKFAVFNLGCNESVNIA

SEQ ID NO: 2985576 - protein, 17 aa, Entamoeba invadens
SLTKIGVFAFRGCESLK

SEQ ID NO: 2985577 - protein, 17 aa, Entamoeba invadens
SLTRLVHVLDFYKSKGY

SEQ ID NO: 2985578 - protein, 17 aa, Entamoeba invadens
SLVCGRDVFLDCPNLVK

SEQ ID NO: 2985579 - protein, 23 aa, Entamoeba invadens
SLVLRISSDFSFDYIIPQHLPHK

SEQ ID NO: 2985580 - protein, 22 aa, Entamoeba invadens
SLWRKVQTGGFIKVQLDDDNFT

SEQ ID NO: 2985581 - protein, 24 aa, Entamoeba invadens
SLYFKSQETILCFIQVNKKCLLSV

SEQ ID NO: 2985582 - protein, 17 aa, Entamoeba invadens
SLYTEVYCQLLVRSWQI

SEQ ID NO: 2985583 - protein, 17 aa, Entamoeba invadens
SMCKLLFALDKVVCTQP

SEQ ID NO: 2985584 - protein, 18 aa, Entamoeba invadens
SMCVAGFFAKSAIDISMY

SEQ ID NO: 2985585 - protein, 19 aa, Entamoeba invadens
SMGQKALASLIIRIALAKT

SEQ ID NO: 2985586 - protein, 17 aa, Entamoeba invadens
SMKTLSVAFQWFVGDSG

SEQ ID NO: 2985587 - protein, 19 aa, Entamoeba invadens
SMYECFVWGNAYPKEKFNF

SEQ ID NO: 2985588 - protein, 18 aa, Entamoeba invadens
SNAESFIFIGFFNGKVKR

SEQ ID NO: 2985589 - protein, 18 aa, Entamoeba invadens
SNAFLKPAWLSFIEENNF

SEQ ID NO: 2985590 - protein, 17 aa, Entamoeba invadens
SNCRSTSWTQCYATSAI

SEQ ID NO: 2985591 - protein, 17 aa, Entamoeba invadens
SNCSFDVFLLCFSVVQR

SEQ ID NO: 2985592 - protein, 23 aa, Entamoeba invadens
SNEIQSRLAICLQRTQRIIDGVT

SEQ ID NO: 2985593 - protein, 23 aa, Entamoeba invadens
SNFLKMLCCQIVPNRYTLLDYAD

SEQ ID NO: 2985594 - protein, 19 aa, Entamoeba invadens
SNGCVISYLAKTIVNRASR

SEQ ID NO: 2985595 - protein, 21 aa, Entamoeba invadens
SNHCKFMWLYMLRNAFYKNCK

SEQ ID NO: 2985596 - protein, 24 aa, Entamoeba invadens
SNIKEFFCKGIMQKEKLCILIEDN

SEQ ID NO: 2985597 - protein, 17 aa, Entamoeba invadens
SNILKFGVSCFESMSSL

SEQ ID NO: 2985598 - protein, 22 aa, Entamoeba invadens
SNINTILAMKVFSSVFYGVRGK

SEQ ID NO: 2985599 - protein, 18 aa, Entamoeba invadens
SNLLMSICCNLIYDPKDP

SEQ ID NO: 2985600 - protein, 18 aa, Entamoeba invadens
SNLSGLMFANYVLHKNVR

SEQ ID NO: 2985601 - protein, 23 aa, Entamoeba invadens
SNMCLEFDPLMACFVSTVEDQLM

SEQ ID NO: 2985602 - protein, 18 aa, Entamoeba invadens
SNMICLSKFYPGDFSIIF

SEQ ID NO: 2985603 - protein, 19 aa, Entamoeba invadens
SNMKIVWRLLVEKAEKYIA

SEQ ID NO: 2985604 - protein, 19 aa, Entamoeba invadens
SNMKQGYCKSALKEFESKS

SEQ ID NO: 2985605 - protein, 30 aa, Entamoeba invadens
SNMNLSFDVLKLCIENGVLIDETSPSVIAE

SEQ ID NO: 2985606 - protein, 18 aa, Entamoeba invadens
SNRCLKCSNGYLLSEGHC

SEQ ID NO: 2985607 - protein, 22 aa, Entamoeba invadens
SNRFSEDLGRIFIKMQPYLKVY

SEQ ID NO: 2985608 - protein, 17 aa, Entamoeba invadens
SNRHPVFFVPGILASTL

SEQ ID NO: 2985609 - protein, 26 aa, Entamoeba invadens
SNRLRRFRMIFGFDKFVLVSKIEEME

SEQ ID NO: 2985610 - protein, 18 aa, Entamoeba invadens
SNRYEWYVSQFAMQRQGI

SEQ ID NO: 2985611 - protein, 18 aa, Entamoeba invadens
SNSSCICSLCFSEGNHVG

SEQ ID NO: 2985612 - protein, 17 aa, Entamoeba invadens
SNVFSNEIEKIYNLRSK

SEQ ID NO: 2985613 - protein, 17 aa, Entamoeba invadens
SNVYPALPFEYISVDDY

SEQ ID NO: 2985614 - protein, 23 aa, Entamoeba invadens
SPAVFKLPGSEQYVVYGEPRNEI

SEQ ID NO: 2985615 - protein, 23 aa, Entamoeba invadens
SPCKNCVFDLKMIGGQIRSVVKE

SEQ ID NO: 2985616 - protein, 17 aa, Entamoeba invadens
SPCREVLDFVITRDNGK

SEQ ID NO: 2985617 - protein, 23 aa, Entamoeba invadens
SPELKEILKAAGVKPRHLAEKEV

SEQ ID NO: 2985618 - protein, 17 aa, Entamoeba invadens
SPEMWKMCCDLFDMLSL

SEQ ID NO: 2985619 - protein, 18 aa, Entamoeba invadens
SPEPSFWVSYTISANVPA

SEQ ID NO: 2985620 - protein, 24 aa, Entamoeba invadens
SPFLKEQFKQFVFFTVKTQYETNV

SEQ ID NO: 2985621 - protein, 18 aa, Entamoeba invadens
SPIALKRLDLGNIGLTEE

SEQ ID NO: 2985622 - protein, 17 aa, Entamoeba invadens
SPICPICKSNGRPNATL

SEQ ID NO: 2985623 - protein, 18 aa, Entamoeba invadens
SPIKFGMEHVMKFFEVST

SEQ ID NO: 2985624 - protein, 24 aa, Entamoeba invadens
SPKCAVCGKSLCGQYCIVNGQNMH

SEQ ID NO: 2985625 - protein, 22 aa, Entamoeba invadens
SPKDLKIGFPIAQELTVIKNQL

SEQ ID NO: 2985626 - protein, 17 aa, Entamoeba invadens
SPLEEWKEATARLFDGK

SEQ ID NO: 2985627 - protein, 24 aa, Entamoeba invadens
SPLFLSCFSAFWVRKSGDINFNLC

SEQ ID NO: 2985628 - protein, 20 aa, Entamoeba invadens
SPLLKRIFLIASRPDRQNDR

SEQ ID NO: 2985629 - protein, 17 aa, Entamoeba invadens
SPLLKTYCEVFVKPEGC

SEQ ID NO: 2985630 - protein, 23 aa, Entamoeba invadens
SPLPKIRGADCFKDCKLLNLKLD

SEQ ID NO: 2985631 - protein, 19 aa, Entamoeba invadens
SPLPMIFRLFLRKDYTFEV

SEQ ID NO: 2985632 - protein, 17 aa, Entamoeba invadens
SPLSNFFELKRFIFQFE

SEQ ID NO: 2985633 - protein, 18 aa, Entamoeba invadens
SPMAFAIIRRFFGVSDRE

SEQ ID NO: 2985634 - protein, 21 aa, Entamoeba invadens
SPMKLPVIFTCPISINEIKQR

SEQ ID NO: 2985635 - protein, 24 aa, Entamoeba invadens
SPPQIRYSFYFSYILQVLRETQSE

SEQ ID NO: 2985636 - protein, 22 aa, Entamoeba invadens
SQDTICVGYKCGTIKYINSDNQ

SEQ ID NO: 2985637 - protein, 22 aa, Entamoeba invadens
SQEAKLRFAFQVYDVDSDGFIS

SEQ ID NO: 2985638 - protein, 17 aa, Entamoeba invadens
SQEKMKWMKERLQFGDT

SEQ ID NO: 2985639 - protein, 19 aa, Entamoeba invadens
SQELRCWRENKIENAIRLN

SEQ ID NO: 2985640 - protein, 17 aa, Entamoeba invadens
SQFFFKPILPAVSENLL

SEQ ID NO: 2985641 - protein, 19 aa, Entamoeba invadens
SQFSICWECADGFKLSDNK

SEQ ID NO: 2985642 - protein, 17 aa, Entamoeba invadens
SQFYLLSLFGFISDQLL

SEQ ID NO: 2985643 - protein, 22 aa, Entamoeba invadens
SQIPRFSGLIPFLDGNTQPPPN

SEQ ID NO: 2985644 - protein, 25 aa, Entamoeba invadens
SQLFKTKWFPPKIRKMRIIAQEMEM

SEQ ID NO: 2985645 - protein, 18 aa, Entamoeba invadens
SQMGLPLPNKNFLQNFNV

SEQ ID NO: 2985646 - protein, 24 aa, Entamoeba invadens
SQNISARYRLSFFKNIKKAVKRSK

SEQ ID NO: 2985647 - protein, 17 aa, Entamoeba invadens
SQPCFKKGLKYSEFEDL

SEQ ID NO: 2985648 - protein, 23 aa, Entamoeba invadens
SQQVRWVLSRSFVVWVPLTVVGK

SEQ ID NO: 2985649 - protein, 21 aa, Entamoeba invadens
SQRLVSCIKPHFSKEKTESVI

SEQ ID NO: 2985650 - protein, 19 aa, Entamoeba invadens
SQSDLPFRIVIIGAGGCTL

SEQ ID NO: 2985651 - protein, 20 aa, Entamoeba invadens
SQSLSIRPSCEFATVSSGNK

SEQ ID NO: 2985652 - protein, 24 aa, Entamoeba invadens
SQWFERGGLCALVMAPTRELAQQI

SEQ ID NO: 2985653 - protein, 21 aa, Entamoeba invadens
SQWRFPLPLYRSLQYLENHKG

SEQ ID NO: 2985654 - protein, 24 aa, Entamoeba invadens
SQYECTRVIVLFNMFFPEDLNNEQ

SEQ ID NO: 2985655 - protein, 23 aa, Entamoeba invadens
SQYKSGVPCFWLHVLKNSEIFED

SEQ ID NO: 2985656 - protein, 19 aa, Entamoeba invadens
SRADFCLAATYALNGILGT

SEQ ID NO: 2985657 - protein, 21 aa, Entamoeba invadens
SRAKKGCIVLGDLKTLNTRAW

SEQ ID NO: 2985658 - protein, 20 aa, Entamoeba invadens
SRCGHCIKRVEPFCCCPLEV

SEQ ID NO: 2985659 - protein, 22 aa, Entamoeba invadens
SRCKFLRVCRIEFQNVSCWENC

SEQ ID NO: 2985660 - protein, 18 aa, Entamoeba invadens
SRFDLWLSKYYPFGEAIL

SEQ ID NO: 2985661 - protein, 18 aa, Entamoeba invadens
SRFNLSCFEYGDKTEDLL

SEQ ID NO: 2985662 - protein, 22 aa, Entamoeba invadens
SRIKWDVDKGIFLCDKRSTMSV

SEQ ID NO: 2985663 - protein, 20 aa, Entamoeba invadens
SRILLAYIIRVGVYIRKRKV

SEQ ID NO: 2985664 - protein, 20 aa, Entamoeba invadens
SRKEMLSSYYNSVITSLYVP

SEQ ID NO: 2985665 - protein, 19 aa, Entamoeba invadens
SRLAPWLGGSIIASIENNG

SEQ ID NO: 2985666 - protein, 18 aa, Entamoeba invadens
SRLFEIMLVYGLKNIKEN

SEQ ID NO: 2985667 - protein, 23 aa, Entamoeba invadens
SRLKCLKLKWTTYFLNYNLECLE

SEQ ID NO: 2985668 - protein, 21 aa, Entamoeba invadens
SRLTSIGSLCFYTFKTFYQKL

SEQ ID NO: 2985669 - protein, 17 aa, Entamoeba invadens
SRNLKFLGGEGFCECTT

SEQ ID NO: 2985670 - protein, 18 aa, Entamoeba invadens
SRNRLDWVYCFQNDTFVK

SEQ ID NO: 2985671 - protein, 20 aa, Entamoeba invadens
SRPFHKIGLIYVMNNQTDQY

SEQ ID NO: 2985672 - protein, 19 aa, Entamoeba invadens
SRPKKGWVVTRPTLSMSNG

SEQ ID NO: 2985673 - protein, 22 aa, Entamoeba invadens
SRPKLLFELFAPLFRFKDQALT

SEQ ID NO: 2985674 - protein, 18 aa, Entamoeba invadens
SRPMIRWAKTFLNQIEEI

SEQ ID NO: 2985675 - protein, 17 aa, Entamoeba invadens
SRRCIICNTGFYPNDSG

SEQ ID NO: 2985676 - protein, 18 aa, Entamoeba invadens
SRRFKRKVKPMLANTVPY

SEQ ID NO: 2985677 - protein, 21 aa, Entamoeba invadens
SRRFLCCGPLYLVVNLVSRPT

SEQ ID NO: 2985678 - protein, 17 aa, Entamoeba invadens
SRRLICFDMDSTLIETE

SEQ ID NO: 2985679 - protein, 25 aa, Entamoeba invadens
SRSCRSALCGFNWFNAYYTPGVSRI

SEQ ID NO: 2985680 - protein, 20 aa, Entamoeba invadens
SRSKKWRMGAVLSILGVEMP

SEQ ID NO: 2985681 - protein, 19 aa, Entamoeba invadens
SRSKLRWVEFEYCLKYPLR

SEQ ID NO: 2985682 - protein, 21 aa, Entamoeba invadens
SRTLLDWLFDLMIEVSHNREV

SEQ ID NO: 2985683 - protein, 24 aa, Entamoeba invadens
SRVLKYKFCQDIAKAMEFLQSSQI

SEQ ID NO: 2985684 - protein, 17 aa, Entamoeba invadens
SRYPITCPLVLLDNVIP

SEQ ID NO: 2985685 - protein, 19 aa, Entamoeba invadens
SSDFLAARFMIGWNEYIAV

SEQ ID NO: 2985686 - protein, 18 aa, Entamoeba invadens
SSDGKFAITSSWDQSLRL

SEQ ID NO: 2985687 - protein, 19 aa, Entamoeba invadens
SSEKFTCFYKKQIVKAPSN

SEQ ID NO: 2985688 - protein, 21 aa, Entamoeba invadens
SSFFPHCYSDFCVSTKRFDCE

SEQ ID NO: 2985689 - protein, 22 aa, Entamoeba invadens
SSFKYCPKCGSPEFVVSTFKSK

SEQ ID NO: 2985690 - protein, 20 aa, Entamoeba invadens
SSFPSLLIMKCFKSLETKEQ

SEQ ID NO: 2985691 - protein, 22 aa, Entamoeba invadens
SSFSCDFWSLGIILFSMAFGDS

SEQ ID NO: 2985692 - protein, 24 aa, Entamoeba invadens
SSGKRFSICLCCLSSNTQIQKRIK

SEQ ID NO: 2985693 - protein, 17 aa, Entamoeba invadens
SSKCFLCQAKLFTNFVE

SEQ ID NO: 2985694 - protein, 20 aa, Entamoeba invadens
SSLKEIYCTSSLHFPVSSLY

SEQ ID NO: 2985695 - protein, 18 aa, Entamoeba invadens
SSLKLCFKIAKNSFINAM

SEQ ID NO: 2985696 - protein, 20 aa, Entamoeba invadens
SSLPCAAICLGLDLETTQKM

SEQ ID NO: 2985697 - protein, 19 aa, Entamoeba invadens
SSLPFLHFFDGFRTSHEIQ

SEQ ID NO: 2985698 - protein, 17 aa, Entamoeba invadens
SSLRGEVVIGDIANVDK

SEQ ID NO: 2985699 - protein, 22 aa, Entamoeba invadens
SSLRNTIKYVMVVGNGYHLNAI

SEQ ID NO: 2985700 - protein, 17 aa, Entamoeba invadens
SSLWKWVSCLDFGAENG

SEQ ID NO: 2985701 - protein, 19 aa, Entamoeba invadens
SSMQFRAKLFLPMYIEGLK

SEQ ID NO: 2985702 - protein, 17 aa, Entamoeba invadens
SSMSLSLDMTTAKETNP

SEQ ID NO: 2985703 - protein, 24 aa, Entamoeba invadens
SSQLFPERWFDLVVVLRTDNTVLY

SEQ ID NO: 2985704 - protein, 19 aa, Entamoeba invadens
SSRCIPGTYIAQLGDLMDD

SEQ ID NO: 2985705 - protein, 23 aa, Entamoeba invadens
SSRIRWPLLQILKLKYCQLTELE

SEQ ID NO: 2985706 - protein, 23 aa, Entamoeba invadens
SSRRLKTEFLVRLDGAGTTTDER

SEQ ID NO: 2985707 - protein, 20 aa, Entamoeba invadens
SSSLVLRKRFLADFVKKNCP

SEQ ID NO: 2985708 - protein, 19 aa, Entamoeba invadens
SSSNCLRARALFWGLRERC

SEQ ID NO: 2985709 - protein, 20 aa, Entamoeba invadens
SSTQQKVCWEDAFKSVKPQL

SEQ ID NO: 2985710 - protein, 24 aa, Entamoeba invadens
SSTRGDLFIKFTVIFPKIEEIQKN

SEQ ID NO: 2985711 - protein, 25 aa, Entamoeba invadens
SSVCGFCGIGFICLECSKIVMYHMQ

SEQ ID NO: 2985712 - protein, 19 aa, Entamoeba invadens
SSVCKIAGMLLCVVGEDSG

SEQ ID NO: 2985713 - protein, 19 aa, Entamoeba invadens
SSVFSPCYCGPLFPMETPY

SEQ ID NO: 2985714 - protein, 24 aa, Entamoeba invadens
SSVGLRASVKFPFEIEPQVTKLTF

SEQ ID NO: 2985715 - protein, 23 aa, Entamoeba invadens
SSWLRWIACRLVMLEKREHDLVF

SEQ ID NO: 2985716 - protein, 25 aa, Entamoeba invadens
SSYEKALCCAMFFCKKSGGVISVGE

SEQ ID NO: 2985717 - protein, 20 aa, Entamoeba invadens
STCFLEFFIDFCELPSSIAS

SEQ ID NO: 2985718 - protein, 24 aa, Entamoeba invadens
STCIFKATVLRFVAQLIRCSPEKL

SEQ ID NO: 2985719 - protein, 21 aa, Entamoeba invadens
STEIKYGRLSSILNDKPPLQQ

SEQ ID NO: 2985720 - protein, 24 aa, Entamoeba invadens
STFGDIYFWFDVCAPNITYFVSEK

SEQ ID NO: 2985721 - protein, 17 aa, Entamoeba invadens
STFKLSPQFTYSLITYD

SEQ ID NO: 2985722 - protein, 18 aa, Entamoeba invadens
STFQLGLVLFHFPVVTIQ

SEQ ID NO: 2985723 - protein, 23 aa, Entamoeba invadens
STGSLGLQFPSLSGSTLGSLNNG

SEQ ID NO: 2985724 - protein, 18 aa, Entamoeba invadens
STIKCIRYSDAFFTGGVD

SEQ ID NO: 2985725 - protein, 23 aa, Entamoeba invadens
STKTYLDFCEMFGPELQAVSFPK

SEQ ID NO: 2985726 - protein, 22 aa, Entamoeba invadens
STKYIVKVLCEYLTVQGIVFEQ

SEQ ID NO: 2985727 - protein, 21 aa, Entamoeba invadens
STLCDCNPCFLGQRDTIATAK

SEQ ID NO: 2985728 - protein, 18 aa, Entamoeba invadens
STLKRWTPFESFERIYDS

SEQ ID NO: 2985729 - protein, 17 aa, Entamoeba invadens
STLYFKIISMYKVPLNI

SEQ ID NO: 2985730 - protein, 23 aa, Entamoeba invadens
STMKLYLGRKILRICPLKLNYDI

SEQ ID NO: 2985731 - protein, 20 aa, Entamoeba invadens
STNILPRFLEQVLLSRDKVT

SEQ ID NO: 2985732 - protein, 26 aa, Entamoeba invadens
STNMIKVFWLFFFKRVFNELLTTIPV

SEQ ID NO: 2985733 - protein, 19 aa, Entamoeba invadens
STPSFSYDLLKAFRTKISF

SEQ ID NO: 2985734 - protein, 23 aa, Entamoeba invadens
STQISKWSLVRCNCCGTDCALIS

SEQ ID NO: 2985735 - protein, 17 aa, Entamoeba invadens
STQPSLFAPQPVYPQTP

SEQ ID NO: 2985736 - protein, 23 aa, Entamoeba invadens
STTRFGFCFFEKVGPDNLHVSDK

SEQ ID NO: 2985737 - protein, 20 aa, Entamoeba invadens
STVPLFLSQCFEIFNMYNTS

SEQ ID NO: 2985738 - protein, 18 aa, Entamoeba invadens
STVSMAFVFTDTEIAQVS

SEQ ID NO: 2985739 - protein, 22 aa, Entamoeba invadens
STWPVLQAMNWKSYAPKYPELY

SEQ ID NO: 2985740 - protein, 22 aa, Entamoeba invadens
SVCAHLKHPLLYVGCVDGTVLL

SEQ ID NO: 2985741 - protein, 18 aa, Entamoeba invadens
SVCLSCLGDAGGGLPALR

SEQ ID NO: 2985742 - protein, 25 aa, Entamoeba invadens
SVDILRFKFLISIFGKFYLNKNQFL

SEQ ID NO: 2985743 - protein, 19 aa, Entamoeba invadens
SVDVIACVLKCFLQNLKKH

SEQ ID NO: 2985744 - protein, 22 aa, Entamoeba invadens
SVEEIDAMLALLIRDFSQVLVG

SEQ ID NO: 2985745 - protein, 17 aa, Entamoeba invadens
SVEFCLSANNSKCIKCD

SEQ ID NO: 2985746 - protein, 24 aa, Entamoeba invadens
SVEFLRRRAIFIFNSRLVNSFNSN

SEQ ID NO: 2985747 - protein, 23 aa, Entamoeba invadens
SVFFGTDCVVCWVNKEVILRTKN

SEQ ID NO: 2985748 - protein, 17 aa, Entamoeba invadens
SVFLKFTPFLKMYSDYC

SEQ ID NO: 2985749 - protein, 17 aa, Entamoeba invadens
SVFNGCIQLEYVNIPES

SEQ ID NO: 2985750 - protein, 28 aa, Entamoeba invadens
SVFPRGKFIFSVKCLKGGLPNYMTPYID

SEQ ID NO: 2985751 - protein, 18 aa, Entamoeba invadens
SVFQVRFTPLVGFENSAP

SEQ ID NO: 2985752 - protein, 17 aa, Entamoeba invadens
SVFTFLYNRLLRIYQAL

SEQ ID NO: 2985753 - protein, 19 aa, Entamoeba invadens
SVGDYCFRKCISLKSITFN

SEQ ID NO: 2985754 - protein, 17 aa, Entamoeba invadens
SVISLCFQPLIEWKIGT

SEQ ID NO: 2985755 - protein, 18 aa, Entamoeba invadens
SVIWLHTRCDIVHRNLQP

SEQ ID NO: 2985756 - protein, 22 aa, Entamoeba invadens
SVKFTGLCDGFFDVRYFPSLDN

SEQ ID NO: 2985757 - protein, 17 aa, Entamoeba invadens
SVNPFWCEVFQVDATLG

SEQ ID NO: 2985758 - protein, 17 aa, Entamoeba invadens
SVRLSFRIMEIMGMVAV

SEQ ID NO: 2985759 - protein, 24 aa, Entamoeba invadens
SVRMSPSVMCWVPFNENWGQFDTS

SEQ ID NO: 2985760 - protein, 18 aa, Entamoeba invadens
SVSFDRRVFVVIKINKKQ

SEQ ID NO: 2985761 - protein, 18 aa, Entamoeba invadens
SVSFIGRFCFFNCGFVHF

SEQ ID NO: 2985762 - protein, 24 aa, Entamoeba invadens
SVSLEVFGKIAFRQVYSSKLSEVL

SEQ ID NO: 2985763 - protein, 18 aa, Entamoeba invadens
SVSVKQRYKVVESKGRPS

SEQ ID NO: 2985764 - protein, 18 aa, Entamoeba invadens
SVVYSFNYMKGMYFVKQG

SEQ ID NO: 2985765 - protein, 19 aa, Entamoeba invadens
SVWMRGYWLIFSQDQAVKG

SEQ ID NO: 2985766 - protein, 20 aa, Entamoeba invadens
SVWMRGYWLIFSQDQAVKGK

SEQ ID NO: 2985767 - protein, 19 aa, Entamoeba invadens
SVYKYLPYVKNYFIVTDDQ

SEQ ID NO: 2985768 - protein, 25 aa, Entamoeba invadens
SWGEYKLRLSNWIIPHVGIIKNTPY

SEQ ID NO: 2985769 - protein, 25 aa, Entamoeba invadens
SWKLRYEECKEVYYKKMHDLYLTKT

SEQ ID NO: 2985770 - protein, 24 aa, Entamoeba invadens
SYDFLKCFILHYFISFSSNLFIDN

SEQ ID NO: 2985771 - protein, 18 aa, Entamoeba invadens
SYDPKVWGKKQCPPPFPL

SEQ ID NO: 2985772 - protein, 22 aa, Entamoeba invadens
SYEELRLIILTDFFKHAFDGSG

SEQ ID NO: 2985773 - protein, 22 aa, Entamoeba invadens
SYEKAKCLSVFTGQLSQIHAIF

SEQ ID NO: 2985774 - protein, 21 aa, Entamoeba invadens
SYFFCYKWNALLFKRFFKTED

SEQ ID NO: 2985775 - protein, 24 aa, Entamoeba invadens
SYFTRLKTVFAFARTKFVKAFENF

SEQ ID NO: 2985776 - protein, 19 aa, Entamoeba invadens
SYFTYKWDEMMALDAFDLF

SEQ ID NO: 2985777 - protein, 17 aa, Entamoeba invadens
SYFYREFYRIIVYEEVD

SEQ ID NO: 2985778 - protein, 25 aa, Entamoeba invadens
SYGFKAECAWKYSDSIYDLFISLFQ

SEQ ID NO: 2985779 - protein, 17 aa, Entamoeba invadens
SYGKHLFYLFGVSEVII

SEQ ID NO: 2985780 - protein, 19 aa, Entamoeba invadens
SYIRGGLPYRRPVGYMRYA

SEQ ID NO: 2985781 - protein, 22 aa, Entamoeba invadens
SYITKMHVCLEVYKPKLQANLS

SEQ ID NO: 2985782 - protein, 20 aa, Entamoeba invadens
SYKLPKPLGLIISQKQVETY

SEQ ID NO: 2985783 - protein, 17 aa, Entamoeba invadens
SYLKMEIPNVVELPQKV

SEQ ID NO: 2985784 - protein, 23 aa, Entamoeba invadens
SYLSHGTCAWVFGEKHFYYNVNN

SEQ ID NO: 2985785 - protein, 19 aa, Entamoeba invadens
SYNILKLCVSRILDCISVN

SEQ ID NO: 2985786 - protein, 22 aa, Entamoeba invadens
SYSEPSFQYWIYFLRMNISVLN

SEQ ID NO: 2985787 - protein, 21 aa, Entamoeba invadens
SYSSSCGRKPSPPKYGNVSPN

SEQ ID NO: 2985788 - protein, 24 aa, Entamoeba invadens
SYTTYRVPLVFPRSVQLDAVDDAV

SEQ ID NO: 2985789 - protein, 19 aa, Entamoeba invadens
SYYIICIEKNYILPEQFLD

SEQ ID NO: 2985790 - protein, 18 aa, Entamoeba invadens
TAAFSLRTNPLVDFQDFV

SEQ ID NO: 2985791 - protein, 18 aa, Entamoeba invadens
TAEFKFLFEVFQMEVDGR

SEQ ID NO: 2985792 - protein, 17 aa, Entamoeba invadens
TAKSCAARYYFSDVELS

SEQ ID NO: 2985793 - protein, 19 aa, Entamoeba invadens
TALEIPHVFSPWEAEAQCA

SEQ ID NO: 2985794 - protein, 17 aa, Entamoeba invadens
TALLLGEKEELGGVKDN

SEQ ID NO: 2985795 - protein, 18 aa, Entamoeba invadens
TAMPHVKPCFAVKCCPEP

SEQ ID NO: 2985796 - protein, 19 aa, Entamoeba invadens
TAVLCVLKLYCMNPQLIEQ

SEQ ID NO: 2985797 - protein, 20 aa, Entamoeba invadens
TAYHLYNMFSLFGSISKVNV

SEQ ID NO: 2985798 - protein, 20 aa, Entamoeba invadens
TCCINCSALSLVIEDFANTI

SEQ ID NO: 2985799 - protein, 21 aa, Entamoeba invadens
TCCINCSALSLVIEDFANTIS

SEQ ID NO: 2985800 - protein, 21 aa, Entamoeba invadens
TCCVNCSALSLVIEDFANTII

SEQ ID NO: 2985801 - protein, 21 aa, Entamoeba invadens
TCEYKKLLVLRHAKFTLKQNK

SEQ ID NO: 2985802 - protein, 20 aa, Entamoeba invadens
TCGGCKAGGCGCNNTNSYTQ

SEQ ID NO: 2985803 - protein, 27 aa, Entamoeba invadens
TCGNPILFCRSVGYTGVFYLKNVNGHT

SEQ ID NO: 2985804 - protein, 23 aa, Entamoeba invadens
TCKCGCIFCWTCGKDVTNDDTHF

SEQ ID NO: 2985805 - protein, 23 aa, Entamoeba invadens
TCKCGYQFCWLCMQKYTSTHFLS

SEQ ID NO: 2985806 - protein, 17 aa, Entamoeba invadens
TCLFFNFAYQIKHIMIK

SEQ ID NO: 2985807 - protein, 17 aa, Entamoeba invadens
TCLSRAGAEISYIVSGG

SEQ ID NO: 2985808 - protein, 17 aa, Entamoeba invadens
TCMPSMFEPSGLVQQES

SEQ ID NO: 2985809 - protein, 17 aa, Entamoeba invadens
TCQCDIWSLGVIAYLAI

SEQ ID NO: 2985810 - protein, 20 aa, Entamoeba invadens
TCSCGHQFCWLCMADYTNTH

SEQ ID NO: 2985811 - protein, 18 aa, Entamoeba invadens
TCVFKIFKALLLSINKEN

SEQ ID NO: 2985812 - protein, 20 aa, Entamoeba invadens
TCVICKAPLFDGQSVTVLPC

SEQ ID NO: 2985813 - protein, 19 aa, Entamoeba invadens
TCVTELFRTAGIALADEFA

SEQ ID NO: 2985814 - protein, 19 aa, Entamoeba invadens
TDDNPIFWDNFLKLIYDRG

SEQ ID NO: 2985815 - protein, 20 aa, Entamoeba invadens
TDFKIHPSILPKIYPSTSIV

SEQ ID NO: 2985816 - protein, 23 aa, Entamoeba invadens
TDFPDVFHLISFVSQQDSNYRKR

SEQ ID NO: 2985817 - protein, 17 aa, Entamoeba invadens
TDFPWEMFFVVFGELLE

SEQ ID NO: 2985818 - protein, 17 aa, Entamoeba invadens
TDFRQAMQWLLHEAERT

SEQ ID NO: 2985819 - protein, 19 aa, Entamoeba invadens
TDHEVKRLFLFYLSTVQRV

SEQ ID NO: 2985820 - protein, 23 aa, Entamoeba invadens
TDKFKLVVLLGMTVDYGKGLTGA

SEQ ID NO: 2985821 - protein, 23 aa, Entamoeba invadens
TDKLCKNCEVVALPVVKQLLDHY

SEQ ID NO: 2985822 - protein, 17 aa, Entamoeba invadens
TDKRILVDLTFFEAVKD

SEQ ID NO: 2985823 - protein, 20 aa, Entamoeba invadens
TDLAHEWKVLFFETSAKNKI

SEQ ID NO: 2985824 - protein, 17 aa, Entamoeba invadens
TDLLKTWTVFDDILPDI

SEQ ID NO: 2985825 - protein, 23 aa, Entamoeba invadens
TDLPRTGNSFTIIPQPFHLNLSA

SEQ ID NO: 2985826 - protein, 20 aa, Entamoeba invadens
TDPDFNWKYLFLLYDSYTQM

SEQ ID NO: 2985827 - protein, 18 aa, Entamoeba invadens
TDSFLGNVLTLWKKDSTL

SEQ ID NO: 2985828 - protein, 21 aa, Entamoeba invadens
TDTRIALGIVKRSDFGFDETI

SEQ ID NO: 2985829 - protein, 18 aa, Entamoeba invadens
TDWWKIRQSSFYHLSQEA

SEQ ID NO: 2985830 - protein, 22 aa, Entamoeba invadens
TDYAGLIQSCWKQEGSERPTFD

SEQ ID NO: 2985831 - protein, 17 aa, Entamoeba invadens
TDYPYCFDYELPPETKL

SEQ ID NO: 2985832 - protein, 18 aa, Entamoeba invadens
TECFRYATDLTLTYPVNG

SEQ ID NO: 2985833 - protein, 17 aa, Entamoeba invadens
TECRGWELFSIVTTSRE

SEQ ID NO: 2985834 - protein, 26 aa, Entamoeba invadens
TEEFKFGKIKIFFKVGVLAEIEERRR

SEQ ID NO: 2985835 - protein, 24 aa, Entamoeba invadens
TEEHEIFWLFKLVMDVISPYYLHD

SEQ ID NO: 2985836 - protein, 18 aa, Entamoeba invadens
TEFIGGLELLKKGKVSDS

SEQ ID NO: 2985837 - protein, 17 aa, Entamoeba invadens
TEFKFDIYSRWSGKLDA

SEQ ID NO: 2985838 - protein, 19 aa, Entamoeba invadens
TEFKWIYNILDGVSEQENV

SEQ ID NO: 2985839 - protein, 20 aa, Entamoeba invadens
TEFLRYCPLYENIYQTLSES

SEQ ID NO: 2985840 - protein, 23 aa, Entamoeba invadens
TEFSACMPFLFRYNTFLSQHASQ

SEQ ID NO: 2985841 - protein, 22 aa, Entamoeba invadens
TEIARKYFIHFFASGVSDIQEL

SEQ ID NO: 2985842 - protein, 19 aa, Entamoeba invadens
TEIFEFFISVACECLEISE

SEQ ID NO: 2985843 - protein, 17 aa, Entamoeba invadens
TEIPYFRTILLAHFSCP

SEQ ID NO: 2985844 - protein, 21 aa, Entamoeba invadens
TEIRSFLTILSLVCFSLKKIK

SEQ ID NO: 2985845 - protein, 19 aa, Entamoeba invadens
TEKCRKCGMYFPSNELKTH

SEQ ID NO: 2985846 - protein, 23 aa, Entamoeba invadens
TEKFEFGEILSLFEEMKYILIED

SEQ ID NO: 2985847 - protein, 22 aa, Entamoeba invadens
TEKGCLYRQGLIDLIIPLFTLL

SEQ ID NO: 2985848 - protein, 20 aa, Entamoeba invadens
TEKKFAAAIVKFLMWAEKKF

SEQ ID NO: 2985849 - protein, 19 aa, Entamoeba invadens
TELICGLHMCAKAFAQRKL

SEQ ID NO: 2985850 - protein, 25 aa, Entamoeba invadens
TELLNVISYRFYKVLFLRDLDYDQV

SEQ ID NO: 2985851 - protein, 20 aa, Entamoeba invadens
TELNFKVILFYTANYTTADP

SEQ ID NO: 2985852 - protein, 19 aa, Entamoeba invadens
TELSCVFWIAYLPTKVKPK

SEQ ID NO: 2985853 - protein, 17 aa, Entamoeba invadens
TELSVSMVNEWAYEKGT

SEQ ID NO: 2985854 - protein, 17 aa, Entamoeba invadens
TEMPLHLLLSFSTNCLK

SEQ ID NO: 2985855 - protein, 27 aa, Entamoeba invadens
TEMRSWCFACCGSLKRVVIMAQLSSLP

SEQ ID NO: 2985856 - protein, 20 aa, Entamoeba invadens
TEMSEGFAIYIKNLPPYKNE

SEQ ID NO: 2985857 - protein, 17 aa, Entamoeba invadens
TEMSGFCCYFDCFFDHH

SEQ ID NO: 2985858 - protein, 19 aa, Entamoeba invadens
TENFYVFGFADEFSEPIIR

SEQ ID NO: 2985859 - protein, 19 aa, Entamoeba invadens
TEPYIKWDYDFRIQKIGNH

SEQ ID NO: 2985860 - protein, 21 aa, Entamoeba invadens
TEQALKFIIADGVHLVNIDAQ

SEQ ID NO: 2985861 - protein, 18 aa, Entamoeba invadens
TERKCLFVRKSIMPVNRY

SEQ ID NO: 2985862 - protein, 23 aa, Entamoeba invadens
TESCGGCTSCLPNMNDPNVISCG

SEQ ID NO: 2985863 - protein, 21 aa, Entamoeba invadens
TESFIRLSLLFSLDQCDRPVV

SEQ ID NO: 2985864 - protein, 21 aa, Entamoeba invadens
TESKGIFSYFFGKTDEYEQAP

SEQ ID NO: 2985865 - protein, 20 aa, Entamoeba invadens
TESSMPQEYFEILSGLEGVG

SEQ ID NO: 2985866 - protein, 22 aa, Entamoeba invadens
TETEMFLWLGNNGELRCEEHVR

SEQ ID NO: 2985867 - protein, 24 aa, Entamoeba invadens
TFAISFMGTELWKDIVAAIQEEHD

SEQ ID NO: 2985868 - protein, 19 aa, Entamoeba invadens
TFDGFGILIEKEWCLIGHK

SEQ ID NO: 2985869 - protein, 19 aa, Entamoeba invadens
TFEVPLWLARTLQRNGYVR

SEQ ID NO: 2985870 - protein, 23 aa, Entamoeba invadens
TFGCFVCSDCGRIHRYFTNKPQV

SEQ ID NO: 2985871 - protein, 22 aa, Entamoeba invadens
TFGDLWVEFLLRESGSLDSGTS

SEQ ID NO: 2985872 - protein, 17 aa, Entamoeba invadens
TFGQVLKCIDLKDGKYV

SEQ ID NO: 2985873 - protein, 23 aa, Entamoeba invadens
TFIRGRCLSYPFVVKDVDTLIQK

SEQ ID NO: 2985874 - protein, 25 aa, Entamoeba invadens
TFKAYPMVRWFWMVEYSGGYFGFQT

SEQ ID NO: 2985875 - protein, 22 aa, Entamoeba invadens
TFKGCTKLPVVVFPSISVGVMQ

SEQ ID NO: 2985876 - protein, 18 aa, Entamoeba invadens
TFKNCGFKSVKVPITSSY

SEQ ID NO: 2985877 - protein, 19 aa, Entamoeba invadens
TFLEHFVALCLQICKNPTS

SEQ ID NO: 2985878 - protein, 17 aa, Entamoeba invadens
TFLKAVEFMGEFEEAIP

SEQ ID NO: 2985879 - protein, 20 aa, Entamoeba invadens
TFPCGHSFCLGCSRDTVTTQ

SEQ ID NO: 2985880 - protein, 20 aa, Entamoeba invadens
TFPVPQWLPLLFAIELSKPE

SEQ ID NO: 2985881 - protein, 17 aa, Entamoeba invadens
TFQGVLQLDGWFCNNSE

SEQ ID NO: 2985882 - protein, 17 aa, Entamoeba invadens
TFRLEFMYDGFSYQNST

SEQ ID NO: 2985883 - protein, 18 aa, Entamoeba invadens
TFTVFGRGRIDKVPFKKA

SEQ ID NO: 2985884 - protein, 19 aa, Entamoeba invadens
TFVTCNWLYGWNLPTITTA

SEQ ID NO: 2985885 - protein, 23 aa, Entamoeba invadens
TFYQRFYAKWGWDMSTVPQHVDD

SEQ ID NO: 2985886 - protein, 18 aa, Entamoeba invadens
TGDFRYAPLISRVLGFIE

SEQ ID NO: 2985887 - protein, 19 aa, Entamoeba invadens
TGDSFWRFCLFLRKLCENI

SEQ ID NO: 2985888 - protein, 17 aa, Entamoeba invadens
TGFPRLKKVKIHDSNNV

SEQ ID NO: 2985889 - protein, 17 aa, Entamoeba invadens
TGICFRKHVAEIPPDDL

SEQ ID NO: 2985890 - protein, 23 aa, Entamoeba invadens
TGKEVYCGCCVIKSEGKQEVYPF

SEQ ID NO: 2985891 - protein, 23 aa, Entamoeba invadens
TGKLIEMFQFLLSIDFVDDAFNL

SEQ ID NO: 2985892 - protein, 23 aa, Entamoeba invadens
TGKRYKKCFALIISDAVIFLTNK

SEQ ID NO: 2985893 - protein, 17 aa, Entamoeba invadens
TGKWRKSLLDALNHSSH

SEQ ID NO: 2985894 - protein, 24 aa, Entamoeba invadens
TGLCLPLPLIRSFKYIEAQNFKVE

SEQ ID NO: 2985895 - protein, 21 aa, Entamoeba invadens
TGLPLSCWIRFLYSHPAMVEK

SEQ ID NO: 2985896 - protein, 22 aa, Entamoeba invadens
TGLVCSCVLLALGVVSDAKEAL

SEQ ID NO: 2985897 - protein, 25 aa, Entamoeba invadens
TGLVCSCVVMALGLYSNATEALEFF

SEQ ID NO: 2985898 - protein, 21 aa, Entamoeba invadens
TGNDGRCALCFGYHNKKPIYI

SEQ ID NO: 2985899 - protein, 20 aa, Entamoeba invadens
TGRVRWQWFDGKLFIDYPDN

SEQ ID NO: 2985900 - protein, 19 aa, Entamoeba invadens
TGRWKYLIYRYDKPKPNHI

SEQ ID NO: 2985901 - protein, 20 aa, Entamoeba invadens
TGVACGLAYIELRDKFQHPA

SEQ ID NO: 2985902 - protein, 19 aa, Entamoeba invadens
TGYCSSCSIGLVYTNPQSQ

SEQ ID NO: 2985903 - protein, 24 aa, Entamoeba invadens
THEPCLFCGMALLHSRFHRVFFIY

SEQ ID NO: 2985904 - protein, 19 aa, Entamoeba invadens
THFTSCCFQGCKHLKQGDV

SEQ ID NO: 2985905 - protein, 18 aa, Entamoeba invadens
THFYFKLKFGKLYNLNYF

SEQ ID NO: 2985906 - protein, 17 aa, Entamoeba invadens
THGEGGLGFSGKSSSTA

SEQ ID NO: 2985907 - protein, 21 aa, Entamoeba invadens
THLYSRFGFVQSIDYDVHSFF

SEQ ID NO: 2985908 - protein, 18 aa, Entamoeba invadens
THNFHFFIAAAIVMVQHE

SEQ ID NO: 2985909 - protein, 24 aa, Entamoeba invadens
THNKFRITVFFQYERMMYRAFDLF

SEQ ID NO: 2985910 - protein, 22 aa, Entamoeba invadens
THPCKLRFLANLSQTAFVFVDV

SEQ ID NO: 2985911 - protein, 21 aa, Entamoeba invadens
TIALRKCVGCFGTEDLLTTQV

SEQ ID NO: 2985912 - protein, 22 aa, Entamoeba invadens
TIDDCVWAIMAIKEVGGKLQKT

SEQ ID NO: 2985913 - protein, 18 aa, Entamoeba invadens
TIDQISFCISRNCEITSE

SEQ ID NO: 2985914 - protein, 17 aa, Entamoeba invadens
TIELHYGKEYDLLESDN

SEQ ID NO: 2985915 - protein, 22 aa, Entamoeba invadens
TIFFCMWWDMFYIKSLDESYDK

SEQ ID NO: 2985916 - protein, 24 aa, Entamoeba invadens
TIGAMGLRFPGKVSNDFKVFLSSC

SEQ ID NO: 2985917 - protein, 19 aa, Entamoeba invadens
TIGRKCFRGSASLINIVIG

SEQ ID NO: 2985918 - protein, 17 aa, Entamoeba invadens
TIIPTFCMEGSGEVQVN

SEQ ID NO: 2985919 - protein, 21 aa, Entamoeba invadens
TIKFKLAVIIAKWEIDNDLDE

SEQ ID NO: 2985920 - protein, 22 aa, Entamoeba invadens
TILKYSSCWELLFNTKSDDEIQ

SEQ ID NO: 2985921 - protein, 23 aa, Entamoeba invadens
TILKYSSCWELLFNTKSDDEIQQ

SEQ ID NO: 2985922 - protein, 17 aa, Entamoeba invadens
TIMELFVVWLLPNPSKL

SEQ ID NO: 2985923 - protein, 18 aa, Entamoeba invadens
TIPNALEFAKWIAKIHDQ

SEQ ID NO: 2985924 - protein, 24 aa, Entamoeba invadens
TIRFKSNVCVIVFDNRNSIFGGYY

SEQ ID NO: 2985925 - protein, 22 aa, Entamoeba invadens
TIRNELLTGMKIYVGGKTKIQN

SEQ ID NO: 2985926 - protein, 19 aa, Entamoeba invadens
TIRVWIRMTCYSVKYDSTI

SEQ ID NO: 2985927 - protein, 21 aa, Entamoeba invadens
TIVLGFLWQFIDKVFEKSLKR

SEQ ID NO: 2985928 - protein, 22 aa, Entamoeba invadens
TIVLLKIRIWRMSSNRRVLIKA

SEQ ID NO: 2985929 - protein, 17 aa, Entamoeba invadens
TIVRLGLAGFDRVSGIN

SEQ ID NO: 2985930 - protein, 21 aa, Entamoeba invadens
TIYFQWEWEEEKGFLFSSSWT

SEQ ID NO: 2985931 - protein, 17 aa, Entamoeba invadens
TKCLSCKYGFYMGENYL

SEQ ID NO: 2985932 - protein, 20 aa, Entamoeba invadens
TKCVLFKLADSVPYPPFPIS

SEQ ID NO: 2985933 - protein, 20 aa, Entamoeba invadens
TKDCKGFGFVELYTKDATNM

SEQ ID NO: 2985934 - protein, 22 aa, Entamoeba invadens
TKDEVMGAFGMGRNDEKAARIV

SEQ ID NO: 2985935 - protein, 23 aa, Entamoeba invadens
TKEEIKEAVPLNFNGNEEVKKMI

SEQ ID NO: 2985936 - protein, 23 aa, Entamoeba invadens
TKEIRRILCERVDKMLEKKKSVY

SEQ ID NO: 2985937 - protein, 21 aa, Entamoeba invadens
TKEKWKVKAFLLSDWKMKEFK

SEQ ID NO: 2985938 - protein, 25 aa, Entamoeba invadens
TKEKYKPCVIEMGALPRSSDLLASR

SEQ ID NO: 2985939 - protein, 20 aa, Entamoeba invadens
TKEMCFRVVFKLVDTDCKGV

SEQ ID NO: 2985940 - protein, 18 aa, Entamoeba invadens
TKESSFKSIERWLSELKD

SEQ ID NO: 2985941 - protein, 18 aa, Entamoeba invadens
TKETRPYAVLAYQTTVTY

SEQ ID NO: 2985942 - protein, 18 aa, Entamoeba invadens
TKEYGVVVPLVLMNSFST

SEQ ID NO: 2985943 - protein, 19 aa, Entamoeba invadens
TKFECLECQTGFYLNDNKL

SEQ ID NO: 2985944 - protein, 22 aa, Entamoeba invadens
TKFEIANGLYLPVTISEPKKVN

SEQ ID NO: 2985945 - protein, 17 aa, Entamoeba invadens
TKFQCQIAIDWSVLIDS

SEQ ID NO: 2985946 - protein, 24 aa, Entamoeba invadens
TKGLKEVFTYFGLEEKIKYSYILS

SEQ ID NO: 2985947 - protein, 24 aa, Entamoeba invadens
TKGPSLYCVFPLVGSEQLQLPFLL

SEQ ID NO: 2985948 - protein, 18 aa, Entamoeba invadens
TKGVCKLLSYYNEKKKLV

SEQ ID NO: 2985949 - protein, 17 aa, Entamoeba invadens
TKGVCKLVSYYNEKKKL

SEQ ID NO: 2985950 - protein, 20 aa, Entamoeba invadens
TKICDFAFCGCKSIERLCFP

SEQ ID NO: 2985951 - protein, 21 aa, Entamoeba invadens
TKIFRARCITFDYPGYGLNKN

SEQ ID NO: 2985952 - protein, 17 aa, Entamoeba invadens
TKIGLPVPQGFVITTEQ

SEQ ID NO: 2985953 - protein, 17 aa, Entamoeba invadens
TKIGYKCFTGCPLDGEK

SEQ ID NO: 2985954 - protein, 17 aa, Entamoeba invadens
TKIIVHFAVKSETIAKI

SEQ ID NO: 2985955 - protein, 24 aa, Entamoeba invadens
TKISCAVLYCWCVSILLERLNVSE

SEQ ID NO: 2985956 - protein, 25 aa, Entamoeba invadens
TKKSKGCGFVKFVYRDDAVSCYNYH

SEQ ID NO: 2985957 - protein, 18 aa, Entamoeba invadens
TKKSSFESVERWLNELHE

SEQ ID NO: 2985958 - protein, 23 aa, Entamoeba invadens
TKKTIAWYPIFFFKTMKSPNITF

SEQ ID NO: 2985959 - protein, 21 aa, Entamoeba invadens
TKKYVKRWVAMSGPFLGAAKT

SEQ ID NO: 2985960 - protein, 17 aa, Entamoeba invadens
TKLFAFLKRIIPTITLS

SEQ ID NO: 2985961 - protein, 22 aa, Entamoeba invadens
TKLKEMIRLFLFDGKKYEVEKI

SEQ ID NO: 2985962 - protein, 22 aa, Entamoeba invadens
TKLKPSCFIFLKFFVKEKSTNN

SEQ ID NO: 2985963 - protein, 25 aa, Entamoeba invadens
TKLLRFLRLLLKFNQFKDNEGLVQS

SEQ ID NO: 2985964 - protein, 23 aa, Entamoeba invadens
TKLPIYCFRCCYNLQHVTFPSHI

SEQ ID NO: 2985965 - protein, 17 aa, Entamoeba invadens
TKLRFKKFYSVLYVVMG

SEQ ID NO: 2985966 - protein, 18 aa, Entamoeba invadens
TKLSNIWSESAAISKSEL

SEQ ID NO: 2985967 - protein, 23 aa, Entamoeba invadens
TKMFSEYFVRLVAMYNSLGIVIE

SEQ ID NO: 2985968 - protein, 20 aa, Entamoeba invadens
TKMLAVCFGHFFAETVLFIG

SEQ ID NO: 2985969 - protein, 18 aa, Entamoeba invadens
TKNVFLFNMNNFVFKNTF

SEQ ID NO: 2985970 - protein, 18 aa, Entamoeba invadens
TKQDGVCLVTKDAIFVLL

SEQ ID NO: 2985971 - protein, 22 aa, Entamoeba invadens
TKRFRVTRLYNVYGELLFTEDK

SEQ ID NO: 2985972 - protein, 21 aa, Entamoeba invadens
TKRGICINAEMATSAEVNNLV

SEQ ID NO: 2985973 - protein, 18 aa, Entamoeba invadens
TKSNNDWGFDYDSGASGS

SEQ ID NO: 2985974 - protein, 17 aa, Entamoeba invadens
TKSSIILDTKFCDLLST

SEQ ID NO: 2985975 - protein, 20 aa, Entamoeba invadens
TKVYGLLKCTNFTPNNIVSF

SEQ ID NO: 2985976 - protein, 20 aa, Entamoeba invadens
TKYHCQRCGFIVCYRCSTKR

SEQ ID NO: 2985977 - protein, 22 aa, Entamoeba invadens
TKYKIVVFIPMQFPRFSTMVGK

SEQ ID NO: 2985978 - protein, 23 aa, Entamoeba invadens
TKYLGDLKIEFCEVVGSGWRPSP

SEQ ID NO: 2985979 - protein, 26 aa, Entamoeba invadens
TLAIELCKHFPPAIGEFRKLIPNMLN

SEQ ID NO: 2985980 - protein, 19 aa, Entamoeba invadens
TLCSIKDFIPISFKETKNV

SEQ ID NO: 2985981 - protein, 18 aa, Entamoeba invadens
TLCSLKILPSVIIINNKK

SEQ ID NO: 2985982 - protein, 22 aa, Entamoeba invadens
TLCVLPDFIGDVLFIVNEITNL

SEQ ID NO: 2985983 - protein, 24 aa, Entamoeba invadens
TLFECLRFSVEFNMTRKTGFEILK

SEQ ID NO: 2985984 - protein, 24 aa, Entamoeba invadens
TLFEMFKRRCDLWPEEFCLSYRKK

SEQ ID NO: 2985985 - protein, 17 aa, Entamoeba invadens
TLFGAAWCFRPAERMIK

SEQ ID NO: 2985986 - protein, 17 aa, Entamoeba invadens
TLFIRKYFYLHSNEYIF

SEQ ID NO: 2985987 - protein, 22 aa, Entamoeba invadens
TLFLRPEIREMISACFPEAASL

SEQ ID NO: 2985988 - protein, 17 aa, Entamoeba invadens
TLGTFLIEFRRKTLSST

SEQ ID NO: 2985989 - protein, 17 aa, Entamoeba invadens
TLIAVAFYFRFIIFTQK

SEQ ID NO: 2985990 - protein, 17 aa, Entamoeba invadens
TLIPRFYGMYRIKPKHG

SEQ ID NO: 2985991 - protein, 18 aa, Entamoeba invadens
TLISLNIKDVFLSKIPLS

SEQ ID NO: 2985992 - protein, 22 aa, Entamoeba invadens
TLKCSPKFFFEFVTKYEQSGGC

SEQ ID NO: 2985993 - protein, 20 aa, Entamoeba invadens
TLKFVKVMQRKVCDYVMNGE

SEQ ID NO: 2985994 - protein, 22 aa, Entamoeba invadens
TLKTIGKFAFKNCYSLESLTFP

SEQ ID NO: 2985995 - protein, 19 aa, Entamoeba invadens
TLLLFHVWANGFFKESIGT

SEQ ID NO: 2985996 - protein, 23 aa, Entamoeba invadens
TLMSCLNLKCVFVDFPDLSLNDV

SEQ ID NO: 2985997 - protein, 24 aa, Entamoeba invadens
TLNGEIYGRCAIDFKTYGAVVTVS

SEQ ID NO: 2985998 - protein, 21 aa, Entamoeba invadens
TLPEFALKFLVSIAQQITTFS

SEQ ID NO: 2985999 - protein, 17 aa, Entamoeba invadens
TLPIISFETTFVGGENI

SEQ ID NO: 2986000 - protein, 22 aa, Entamoeba invadens
TLPKCCFKQCFALKTLVIPFTV

SEQ ID NO: 2986001 - protein, 19 aa, Entamoeba invadens
TLPPFKNLQTVIGVQQNVP

SEQ ID NO: 2986002 - protein, 18 aa, Entamoeba invadens
TLPVVRNLLIGFNDVVNS

SEQ ID NO: 2986003 - protein, 19 aa, Entamoeba invadens
TLRALQYIHEFGFIHRDIK

SEQ ID NO: 2986004 - protein, 19 aa, Entamoeba invadens
TLRFNFWDKITFKFEVDEI

SEQ ID NO: 2986005 - protein, 20 aa, Entamoeba invadens
TLTLTFRWNIPIYTSKKTGT

SEQ ID NO: 2986006 - protein, 19 aa, Entamoeba invadens
TLTSLPPYCFRFCSALSSF

SEQ ID NO: 2986007 - protein, 20 aa, Entamoeba invadens
TLWYFCEFLHQIILKKDINK

SEQ ID NO: 2986008 - protein, 30 aa, Entamoeba invadens
TLYPHFLEFYALWFCRVFNGDLSMWVLDLV

SEQ ID NO: 2986009 - protein, 17 aa, Entamoeba invadens
TMFALGFKDFDALNDIA

SEQ ID NO: 2986010 - protein, 19 aa, Entamoeba invadens
TMLECFKWGEVYPKSEFKF

SEQ ID NO: 2986011 - protein, 18 aa, Entamoeba invadens
TMLSCFAWDNSFPKTIYP

SEQ ID NO: 2986012 - protein, 18 aa, Entamoeba invadens
TMLSFLFQFINSCTKELM

SEQ ID NO: 2986013 - protein, 17 aa, Entamoeba invadens
TMPFKDSHPMFWEIVIV

SEQ ID NO: 2986014 - protein, 17 aa, Entamoeba invadens
TMSRSQMGLPLPNKNFL

SEQ ID NO: 2986015 - protein, 17 aa, Entamoeba invadens
TMTLEILEWLKSDQEGY

SEQ ID NO: 2986016 - protein, 20 aa, Entamoeba invadens
TMYECFKWGEAYPINEFKFP

SEQ ID NO: 2986017 - protein, 17 aa, Entamoeba invadens
TMYECFTWSDAFPKDVY

SEQ ID NO: 2986018 - protein, 19 aa, Entamoeba invadens
TMYRVKWPGTIDVFVSDEV

SEQ ID NO: 2986019 - protein, 17 aa, Entamoeba invadens
TNAEIVWAKSVFECTRD

SEQ ID NO: 2986020 - protein, 19 aa, Entamoeba invadens
TNAFRKARLKEEFDQKELE

SEQ ID NO: 2986021 - protein, 23 aa, Entamoeba invadens
TNCGHGFCSFRVATARTNFCRER

SEQ ID NO: 2986022 - protein, 23 aa, Entamoeba invadens
TNCKRLREKIGYKILFSLNIEEL

SEQ ID NO: 2986023 - protein, 23 aa, Entamoeba invadens
TNFSNEVPLHFAVNKKRLDLVLL

SEQ ID NO: 2986024 - protein, 18 aa, Entamoeba invadens
TNFVFSVYSAFWILSDGT

SEQ ID NO: 2986025 - protein, 20 aa, Entamoeba invadens
TNHCLFCLYTHTALFGEEKF

SEQ ID NO: 2986026 - protein, 18 aa, Entamoeba invadens
TNHYRKALLDAFNHCQMI

SEQ ID NO: 2986027 - protein, 17 aa, Entamoeba invadens
TNIFLEAAGHKILIGTL

SEQ ID NO: 2986028 - protein, 22 aa, Entamoeba invadens
TNIKNLLGLTDFLARPARLPFL

SEQ ID NO: 2986029 - protein, 23 aa, Entamoeba invadens
TNIPQQCKICFETKPILDKVPIS

SEQ ID NO: 2986030 - protein, 24 aa, Entamoeba invadens
TNIPYCIIEGLTFPEISQRLSRFE

SEQ ID NO: 2986031 - protein, 21 aa, Entamoeba invadens
TNKYCEMFHNMIKKRTAQPKR

SEQ ID NO: 2986032 - protein, 22 aa, Entamoeba invadens
TNLSTLCLFKLVTKFLPTANIN

SEQ ID NO: 2986033 - protein, 20 aa, Entamoeba invadens
TNMELLCMKIAMSVNSESMT

SEQ ID NO: 2986034 - protein, 18 aa, Entamoeba invadens
TNPDFVFFVDAFDEEVMS

SEQ ID NO: 2986035 - protein, 17 aa, Entamoeba invadens
TNPKCWDIPKVAAVPPI

SEQ ID NO: 2986036 - protein, 19 aa, Entamoeba invadens
TNPTFCFDLINGIIGYCRS

SEQ ID NO: 2986037 - protein, 26 aa, Entamoeba invadens
TNRALEVLRLTSEFLATIEQTESVVK

SEQ ID NO: 2986038 - protein, 17 aa, Entamoeba invadens
TNTLFCLSKFKPPQSPL

SEQ ID NO: 2986039 - protein, 22 aa, Entamoeba invadens
TNYAAFCAIGIPVHHVAFTNTG

SEQ ID NO: 2986040 - protein, 17 aa, Entamoeba invadens
TNYFGFNLCMGMCTEFN

SEQ ID NO: 2986041 - protein, 24 aa, Entamoeba invadens
TNYIKWFCKMMELMVKYFEECHSE

SEQ ID NO: 2986042 - protein, 22 aa, Entamoeba invadens
TNYMCLKAMFYVCDENKDDKLS

SEQ ID NO: 2986043 - protein, 21 aa, Entamoeba invadens
TPDMFSWFPFFFPIQPPIDLK

SEQ ID NO: 2986044 - protein, 24 aa, Entamoeba invadens
TPDNFFFFRLPRFTPFDGKLLEPY

SEQ ID NO: 2986045 - protein, 25 aa, Entamoeba invadens
TPEVYSQIVSLIWQLLIIDLQKRIS

SEQ ID NO: 2986046 - protein, 25 aa, Entamoeba invadens
TPEYVKIVLCKKCYLATRRKSEKTR

SEQ ID NO: 2986047 - protein, 22 aa, Entamoeba invadens
TPFCVIAICLNSIFGAKENGIL

SEQ ID NO: 2986048 - protein, 17 aa, Entamoeba invadens
TPFPAATTFDWGTVVSN

SEQ ID NO: 2986049 - protein, 18 aa, Entamoeba invadens
TPGLFAFQILVVVATSNK

SEQ ID NO: 2986050 - protein, 24 aa, Entamoeba invadens
TPIEKIMYMFCSFKILEQLIHYHF

SEQ ID NO: 2986051 - protein, 24 aa, Entamoeba invadens
TPIKCPICQSVFCSVCLQGNHVGS

SEQ ID NO: 2986052 - protein, 17 aa, Entamoeba invadens
TPIKVVLNKGGITLDIV

SEQ ID NO: 2986053 - protein, 23 aa, Entamoeba invadens
TPIYRYKHEWLYGSFKKTLFFKS

SEQ ID NO: 2986054 - protein, 23 aa, Entamoeba invadens
TPKKCKRIWDAIFAFKEKKLVFF

SEQ ID NO: 2986055 - protein, 25 aa, Entamoeba invadens
TPKTSFKECVVFCMGTDETLKKKVN

SEQ ID NO: 2986056 - protein, 18 aa, Entamoeba invadens
TPLELSMVIPLPELKKKI

SEQ ID NO: 2986057 - protein, 22 aa, Entamoeba invadens
TPPQRRLEFFVMFDGTNCWYLD

SEQ ID NO: 2986058 - protein, 18 aa, Entamoeba invadens
TPQIKWLNPMTGMGKLAF

SEQ ID NO: 2986059 - protein, 24 aa, Entamoeba invadens
TPRFAVSCSLELMSQLSALASKKD

SEQ ID NO: 2986060 - protein, 21 aa, Entamoeba invadens
TPRLKSLELFSTFSEMQKKEN

SEQ ID NO: 2986061 - protein, 23 aa, Entamoeba invadens
TPRNHLFDGWSFLTKIQIVKKLA

SEQ ID NO: 2986062 - protein, 22 aa, Entamoeba invadens
TPSHLFIQTPFFEYKPNQQFHI

SEQ ID NO: 2986063 - protein, 24 aa, Entamoeba invadens
TQCFVNLFSVRGCDLISLNVNCCP

SEQ ID NO: 2986064 - protein, 17 aa, Entamoeba invadens
TQCIWRCVQRCGLSMYY

SEQ ID NO: 2986065 - protein, 18 aa, Entamoeba invadens
TQFKYPWVIAKFVIEGKR

SEQ ID NO: 2986066 - protein, 17 aa, Entamoeba invadens
TQFNHCFVIVGFDTTQK

SEQ ID NO: 2986067 - protein, 19 aa, Entamoeba invadens
TQIALSICDEFLYKTEESL

SEQ ID NO: 2986068 - protein, 17 aa, Entamoeba invadens
TQKEISEVFGFSAIPAD

SEQ ID NO: 2986069 - protein, 24 aa, Entamoeba invadens
TQKPKGCGFVKFMTHEDAKRCVEE

SEQ ID NO: 2986070 - protein, 17 aa, Entamoeba invadens
TQKVCKVAPVAGQTKVW

SEQ ID NO: 2986071 - protein, 18 aa, Entamoeba invadens
TQKYICWSEQFKRRAIFI

SEQ ID NO: 2986072 - protein, 17 aa, Entamoeba invadens
TQLFKLIPLLAHKYQDQ

SEQ ID NO: 2986073 - protein, 19 aa, Entamoeba invadens
TQLGWKVFKFLNKQEIAVS

SEQ ID NO: 2986074 - protein, 22 aa, Entamoeba invadens
TQLRLLFLLQSWDTVINFSDTA

SEQ ID NO: 2986075 - protein, 22 aa, Entamoeba invadens
TQLSVWGRRSVKDIVFDSEKDP

SEQ ID NO: 2986076 - protein, 24 aa, Entamoeba invadens
TQNRKSILLCFGRMIKKLIDPRSV

SEQ ID NO: 2986077 - protein, 18 aa, Entamoeba invadens
TQYRMHPQIAKFPNDNFY

SEQ ID NO: 2986078 - protein, 19 aa, Entamoeba invadens
TRASLKLIRAILLATNGKA

SEQ ID NO: 2986079 - protein, 18 aa, Entamoeba invadens
TRAVLCPKGGITLQLSIK

SEQ ID NO: 2986080 - protein, 23 aa, Entamoeba invadens
TRCTNILLPHCLKIIGMFTGTEH

SEQ ID NO: 2986081 - protein, 20 aa, Entamoeba invadens
TRCVIKRPFLQRMTNDCCKS

SEQ ID NO: 2986082 - protein, 17 aa, Entamoeba invadens
TRELFCASAPVRPLVTS

SEQ ID NO: 2986083 - protein, 18 aa, Entamoeba invadens
TRELKIKRVEEVQKSNKK

SEQ ID NO: 2986084 - protein, 24 aa, Entamoeba invadens
TRELLWKFLVTMKMTYLTKLVTMN

SEQ ID NO: 2986085 - protein, 19 aa, Entamoeba invadens
TRFCLICNYISRILPPISS

SEQ ID NO: 2986086 - protein, 20 aa, Entamoeba invadens
TRFIQMCCAIVDYLKEAEKF

SEQ ID NO: 2986087 - protein, 18 aa, Entamoeba invadens
TRGKEWWMKSAIKEKSKT

SEQ ID NO: 2986088 - protein, 20 aa, Entamoeba invadens
TRIGAFSFRKCVALKKIEIP

SEQ ID NO: 2986089 - protein, 21 aa, Entamoeba invadens
TRIGKFAFKHCISLTSFNSES

SEQ ID NO: 2986090 - protein, 19 aa, Entamoeba invadens
TRKDFPISRPEVVDDVVLN

SEQ ID NO: 2986091 - protein, 17 aa, Entamoeba invadens
TRLANKCFFEMGQLQNV

SEQ ID NO: 2986092 - protein, 21 aa, Entamoeba invadens
TRLEFISGVFLEMWNPSQGFL

SEQ ID NO: 2986093 - protein, 20 aa, Entamoeba invadens
TRLGLKTVWLGGTFTTSFFT

SEQ ID NO: 2986094 - protein, 22 aa, Entamoeba invadens
TRLYCFNNYFIFSIRILKFENV

SEQ ID NO: 2986095 - protein, 18 aa, Entamoeba invadens
TRNIEIGETFPLVQEIES

SEQ ID NO: 2986096 - protein, 19 aa, Entamoeba invadens
TRNPIVISVGWRRYQTVAT

SEQ ID NO: 2986097 - protein, 18 aa, Entamoeba invadens
TRPVCWHLFPSLKCSFII

SEQ ID NO: 2986098 - protein, 28 aa, Entamoeba invadens
TRRFPSYILVCPFPIDLMTILRRVEKGE

SEQ ID NO: 2986099 - protein, 17 aa, Entamoeba invadens
TRRLKRLRQKVGLVSHW

SEQ ID NO: 2986100 - protein, 19 aa, Entamoeba invadens
TRRMICPRVFFSYTNKHDI

SEQ ID NO: 2986101 - protein, 17 aa, Entamoeba invadens
TRTCCIELLGLIHLSFS

SEQ ID NO: 2986102 - protein, 21 aa, Entamoeba invadens
TRTGIQFGAFKKFILTGKKRG

SEQ ID NO: 2986103 - protein, 18 aa, Entamoeba invadens
TRTKFNSFISVLFDQLTK

SEQ ID NO: 2986104 - protein, 18 aa, Entamoeba invadens
TRTMFKKRMEVLRKTYNE

SEQ ID NO: 2986105 - protein, 23 aa, Entamoeba invadens
TRVARYWPMFPRTFALFKKLFTE

SEQ ID NO: 2986106 - protein, 23 aa, Entamoeba invadens
TRVQIPLQLAWAISIHKSQGMTL

SEQ ID NO: 2986107 - protein, 20 aa, Entamoeba invadens
TRVYFSGAISALVVCDITSK

SEQ ID NO: 2986108 - protein, 21 aa, Entamoeba invadens
TRYYAFLCHACYLASKGDHSG

SEQ ID NO: 2986109 - protein, 21 aa, Entamoeba invadens
TSAYWKKLVVIISDASVPGEG

SEQ ID NO: 2986110 - protein, 20 aa, Entamoeba invadens
TSAYWKKLVVIISDSSVPGE

SEQ ID NO: 2986111 - protein, 18 aa, Entamoeba invadens
TSCFPWFSSKTETKCFES

SEQ ID NO: 2986112 - protein, 20 aa, Entamoeba invadens
TSDENFFVFSLLRGGVPVYG

SEQ ID NO: 2986113 - protein, 23 aa, Entamoeba invadens
TSDLPCMSRIFLPGITDLVVVNH

SEQ ID NO: 2986114 - protein, 20 aa, Entamoeba invadens
TSEGYPMIAQMAVSKSQQQQ

SEQ ID NO: 2986115 - protein, 17 aa, Entamoeba invadens
TSEKFWKTWNWTPCEEV

SEQ ID NO: 2986116 - protein, 25 aa, Entamoeba invadens
TSFEKRCSFPFGFGLSYTEFEYSVP

SEQ ID NO: 2986117 - protein, 19 aa, Entamoeba invadens
TSFGMNCFDCCFNLKTRKH

SEQ ID NO: 2986118 - protein, 17 aa, Entamoeba invadens
TSFPEYKKATGKVCKVV

SEQ ID NO: 2986119 - protein, 18 aa, Entamoeba invadens
TSGGVGFVFSWVSYLSNI

SEQ ID NO: 2986120 - protein, 17 aa, Entamoeba invadens
TSHRCTLDITLDQIERP

SEQ ID NO: 2986121 - protein, 17 aa, Entamoeba invadens
TSICADVDCACELARTL

SEQ ID NO: 2986122 - protein, 23 aa, Entamoeba invadens
TSIKEVKRILGVAFKDDSIVNIK

SEQ ID NO: 2986123 - protein, 17 aa, Entamoeba invadens
TSITKIGVHNIWYGVPR

SEQ ID NO: 2986124 - protein, 23 aa, Entamoeba invadens
TSKRVATMLVEIFAVTALHVRDL

SEQ ID NO: 2986125 - protein, 20 aa, Entamoeba invadens
TSKTPLLFQIVWTTIKSNKL

SEQ ID NO: 2986126 - protein, 17 aa, Entamoeba invadens
TSKVFSFIGSVRKRRAT

SEQ ID NO: 2986127 - protein, 27 aa, Entamoeba invadens
TSKYIGIPCFWGRLFVIEKLSEDGDFE

SEQ ID NO: 2986128 - protein, 23 aa, Entamoeba invadens
TSLFLRWEYFIIISIPPQKVQSS

SEQ ID NO: 2986129 - protein, 18 aa, Entamoeba invadens
TSLRRFVIPQGLLYIDSL

SEQ ID NO: 2986130 - protein, 18 aa, Entamoeba invadens
TSNGKLWYTIGILNENEE

SEQ ID NO: 2986131 - protein, 24 aa, Entamoeba invadens
TSPKFRISSSISYIGHFVPDNEYD

SEQ ID NO: 2986132 - protein, 18 aa, Entamoeba invadens
TSRWNVRILYDLLDIAAL

SEQ ID NO: 2986133 - protein, 24 aa, Entamoeba invadens
TSSKNVFCFLEFARHSSALNAMKN

SEQ ID NO: 2986134 - protein, 17 aa, Entamoeba invadens
TSSLFAHGIPNTLKKIG

SEQ ID NO: 2986135 - protein, 23 aa, Entamoeba invadens
TSSLPKYEFMWTFSTDDSDFIEI

SEQ ID NO: 2986136 - protein, 25 aa, Entamoeba invadens
TSWVCLGAFIFLRYICPAIIQPLEW

SEQ ID NO: 2986137 - protein, 18 aa, Entamoeba invadens
TSYFPFSGVHGVFLVYKF

SEQ ID NO: 2986138 - protein, 25 aa, Entamoeba invadens
TSYFRNRHVILFCFDLSASGSLSSV

SEQ ID NO: 2986139 - protein, 18 aa, Entamoeba invadens
TSYLRYSIEYDIIVDYWK

SEQ ID NO: 2986140 - protein, 19 aa, Entamoeba invadens
TTAMEAFRFFATTETAKGV

SEQ ID NO: 2986141 - protein, 17 aa, Entamoeba invadens
TTCSFCLTGKPIDFEKK

SEQ ID NO: 2986142 - protein, 23 aa, Entamoeba invadens
TTDWKSLMDFEWNIYKLNLLRNP

SEQ ID NO: 2986143 - protein, 24 aa, Entamoeba invadens
TTEEIRMLWTYRAMVMKTKPRALS

SEQ ID NO: 2986144 - protein, 18 aa, Entamoeba invadens
TTFDCLKLIVSMGDVCFT

SEQ ID NO: 2986145 - protein, 22 aa, Entamoeba invadens
TTKCPHCGHLLNFEFQVLPSII

SEQ ID NO: 2986146 - protein, 19 aa, Entamoeba invadens
TTLIFLRFLFVPFLATPSL

SEQ ID NO: 2986147 - protein, 20 aa, Entamoeba invadens
TTLKGYRKWFSSGIDTASLL

SEQ ID NO: 2986148 - protein, 23 aa, Entamoeba invadens
TTLPEHFEVFKLLCKMFGEIINQ

SEQ ID NO: 2986149 - protein, 23 aa, Entamoeba invadens
TTNKPGWCFDDFDGAGTIKPKIY

SEQ ID NO: 2986150 - protein, 23 aa, Entamoeba invadens
TTNLCGIGWRIGDYVYPLNMVVF

SEQ ID NO: 2986151 - protein, 20 aa, Entamoeba invadens
TTNVIRFGDKLGFVENELTI

SEQ ID NO: 2986152 - protein, 17 aa, Entamoeba invadens
TTREAMCAWDWKMRSIE

SEQ ID NO: 2986153 - protein, 19 aa, Entamoeba invadens
TTRPLLYERVVKWLNCDAA

SEQ ID NO: 2986154 - protein, 18 aa, Entamoeba invadens
TTRRIVCSYADEVIASLS

SEQ ID NO: 2986155 - protein, 22 aa, Entamoeba invadens
TTSARGGFFGSFFSSKDKERKE

SEQ ID NO: 2986156 - protein, 23 aa, Entamoeba invadens
TTTDFKGFEGFNFGNTTHETNKG

SEQ ID NO: 2986157 - protein, 17 aa, Entamoeba invadens
TTTKGWDKLRWDDFLAL

SEQ ID NO: 2986158 - protein, 17 aa, Entamoeba invadens
TTWPWYKLISAIKLFTF

SEQ ID NO: 2986159 - protein, 17 aa, Entamoeba invadens
TTYSDTRWCYIYKNLDD

SEQ ID NO: 2986160 - protein, 18 aa, Entamoeba invadens
TVCLQCGDGIWTLVQIDF

SEQ ID NO: 2986161 - protein, 20 aa, Entamoeba invadens
TVCPLCANRSMFCYSCKMLT

SEQ ID NO: 2986162 - protein, 19 aa, Entamoeba invadens
TVDVLYIWVGSKCAVQTRK

SEQ ID NO: 2986163 - protein, 17 aa, Entamoeba invadens
TVFRYFIELAVKISKGP

SEQ ID NO: 2986164 - protein, 19 aa, Entamoeba invadens
TVIITWGFIKGEFQASPSF

SEQ ID NO: 2986165 - protein, 20 aa, Entamoeba invadens
TVIPKECFKGCVHLQDVKIP

SEQ ID NO: 2986166 - protein, 19 aa, Entamoeba invadens
TVKCLKRVIPMLNENDFRG

SEQ ID NO: 2986167 - protein, 20 aa, Entamoeba invadens
TVKLFLKRENGFFMKEALVF

SEQ ID NO: 2986168 - protein, 18 aa, Entamoeba invadens
TVKPCFAVKCNPEPHLVE

SEQ ID NO: 2986169 - protein, 23 aa, Entamoeba invadens
TVLDCCGFLKILRCNPLACRNLS

SEQ ID NO: 2986170 - protein, 23 aa, Entamoeba invadens
TVLPFKCFYCCRNLKEIDLYYVT

SEQ ID NO: 2986171 - protein, 24 aa, Entamoeba invadens
TVLPKMFYKIVVWFNVDFGTVDKN

SEQ ID NO: 2986172 - protein, 22 aa, Entamoeba invadens
TVLPLRIKRVFLDGVTVKELNF

SEQ ID NO: 2986173 - protein, 24 aa, Entamoeba invadens
TVPEIASDCLYTFVHLSVQFEYLN

SEQ ID NO: 2986174 - protein, 23 aa, Entamoeba invadens
TVPRLEKFINFEVDYEQYLNDKK

SEQ ID NO: 2986175 - protein, 20 aa, Entamoeba invadens
TVSLFTHWLPRFGVEVDLVD

SEQ ID NO: 2986176 - protein, 19 aa, Entamoeba invadens
TWAALCSKINASVQTYIDS

SEQ ID NO: 2986177 - protein, 23 aa, Entamoeba invadens
TWEINCYSFAPAGVFSREIAGCP

SEQ ID NO: 2986178 - protein, 21 aa, Entamoeba invadens
TWKSSEFQTVMSYTNDRRFDL

SEQ ID NO: 2986179 - protein, 17 aa, Entamoeba invadens
TYCDTMYPALGFSTCYS

SEQ ID NO: 2986180 - protein, 20 aa, Entamoeba invadens
TYGMWRNKECVFDHINKKTF

SEQ ID NO: 2986181 - protein, 22 aa, Entamoeba invadens
TYKGCGFHRVIKDFMIQGGDFT

SEQ ID NO: 2986182 - protein, 17 aa, Entamoeba invadens
TYLPTVFDNYLTTVKFK

SEQ ID NO: 2986183 - protein, 18 aa, Entamoeba invadens
TYMKLQFLGILEGLLSLG

SEQ ID NO: 2986184 - protein, 19 aa, Entamoeba invadens
TYNRLKVLIFMKPDSNIGL

SEQ ID NO: 2986185 - protein, 23 aa, Entamoeba invadens
TYRKCALMRKHWRQSLYSEHTSD

SEQ ID NO: 2986186 - protein, 17 aa, Entamoeba invadens
TYRWNIRVLYDMIDTAA

SEQ ID NO: 2986187 - protein, 25 aa, Entamoeba invadens
TYVQWGRLFSLWIAYQIVREKDEER

SEQ ID NO: 2986188 - protein, 17 aa, Entamoeba invadens
VAAELPDLLALNLSHNG

SEQ ID NO: 2986189 - protein, 18 aa, Entamoeba invadens
VAEDVWLRLMLTCIGETF

SEQ ID NO: 2986190 - protein, 18 aa, Entamoeba invadens
VAEKEGKKKAAVRMTGNE

SEQ ID NO: 2986191 - protein, 18 aa, Entamoeba invadens
VAELLKWYGYDERSVICL

SEQ ID NO: 2986192 - protein, 18 aa, Entamoeba invadens
VAFEIKDKISVIGIDTTY

SEQ ID NO: 2986193 - protein, 18 aa, Entamoeba invadens
VAFYFRFIIFTQKDGTNE

SEQ ID NO: 2986194 - protein, 19 aa, Entamoeba invadens
VAGGFLVQFDYGGLVLDSV

SEQ ID NO: 2986195 - protein, 22 aa, Entamoeba invadens
VAHPKLFVLIDFLRKIENKTKK

SEQ ID NO: 2986196 - protein, 24 aa, Entamoeba invadens
VAIFIRVCMKFDFYECPLLLSEYF

SEQ ID NO: 2986197 - protein, 18 aa, Entamoeba invadens
VAKIFAMGIIGNVLNRED

SEQ ID NO: 2986198 - protein, 20 aa, Entamoeba invadens
VAKVLLRWNACLFHKNQHGF

SEQ ID NO: 2986199 - protein, 19 aa, Entamoeba invadens
VAKYFLYRCDFINVICVCK

SEQ ID NO: 2986200 - protein, 18 aa, Entamoeba invadens
VAMDECWKINEIVQKIRE

SEQ ID NO: 2986201 - protein, 22 aa, Entamoeba invadens
VAPKKIMYCLSIHVTTLKRTSN

SEQ ID NO: 2986202 - protein, 23 aa, Entamoeba invadens
VAQKEFYMPFVFVDGAADKAQVD

SEQ ID NO: 2986203 - protein, 23 aa, Entamoeba invadens
VAQRMTCMMLRYGLEKKNWPKGV

SEQ ID NO: 2986204 - protein, 17 aa, Entamoeba invadens
VARCFFLKVGKTFIKRY

SEQ ID NO: 2986205 - protein, 20 aa, Entamoeba invadens
VARKDNWENIAFVQSFDSKN

SEQ ID NO: 2986206 - protein, 20 aa, Entamoeba invadens
VASRTRWLEIVKHIRDIEEN

SEQ ID NO: 2986207 - protein, 23 aa, Entamoeba invadens
VATIQRLCCSVVFRQKIHKTLVQ

SEQ ID NO: 2986208 - protein, 18 aa, Entamoeba invadens
VAVSYAFYLQMKAFGYTF

SEQ ID NO: 2986209 - protein, 27 aa, Entamoeba invadens
VAWKKKWKYRIDWSLILEFSHPQLLNE

SEQ ID NO: 2986210 - protein, 25 aa, Entamoeba invadens
VCDKLRRLSLTYAFEIKSEPEKNID

SEQ ID NO: 2986211 - protein, 20 aa, Entamoeba invadens
VCGDIPWSEFFFGCGEQSSE

SEQ ID NO: 2986212 - protein, 17 aa, Entamoeba invadens
VCGGEMCLSLLQNKYSC

SEQ ID NO: 2986213 - protein, 22 aa, Entamoeba invadens
VCKYLKLFRDVRNLVLVSKKNS

SEQ ID NO: 2986214 - protein, 17 aa, Entamoeba invadens
VCLAVIMAQMGMRCTAE

SEQ ID NO: 2986215 - protein, 22 aa, Entamoeba invadens
VCLKRIYVPIVRYLRAYFSKNT

SEQ ID NO: 2986216 - protein, 17 aa, Entamoeba invadens
VCLNDGCLECIGNFNFS

SEQ ID NO: 2986217 - protein, 24 aa, Entamoeba invadens
VCLPSSLCALNFKDVVLTDSTQKT

SEQ ID NO: 2986218 - protein, 20 aa, Entamoeba invadens
VCLSALCSLKVNPVFMTESS

SEQ ID NO: 2986219 - protein, 17 aa, Entamoeba invadens
VCVFLVSFLRRMKSSIF

SEQ ID NO: 2986220 - protein, 18 aa, Entamoeba invadens
VCYLFTYGHFAIRTEFIR

SEQ ID NO: 2986221 - protein, 18 aa, Entamoeba invadens
VCYSRCYRELAPYQLDNA

SEQ ID NO: 2986222 - protein, 17 aa, Entamoeba invadens
VDCAIFVTSLAEYDMKL

SEQ ID NO: 2986223 - protein, 17 aa, Entamoeba invadens
VDCNQKLCKKCFENTHA

SEQ ID NO: 2986224 - protein, 17 aa, Entamoeba invadens
VDDACGWPADPNSHLLA

SEQ ID NO: 2986225 - protein, 18 aa, Entamoeba invadens
VDDFCFYNSIPIENIIFE

SEQ ID NO: 2986226 - protein, 24 aa, Entamoeba invadens
VDELRFKSFWNFKKIDVTLLEQAE

SEQ ID NO: 2986227 - protein, 18 aa, Entamoeba invadens
VDFGEAFVRAFLQTNCFH

SEQ ID NO: 2986228 - protein, 17 aa, Entamoeba invadens
VDFRAGSVVKTYAAHEG

SEQ ID NO: 2986229 - protein, 17 aa, Entamoeba invadens
VDGKWLCFNDRTVSESD

SEQ ID NO: 2986230 - protein, 17 aa, Entamoeba invadens
VDGLNALHIFKNFFEGI

SEQ ID NO: 2986231 - protein, 18 aa, Entamoeba invadens
VDICKCIFHNAFSSDKLL

SEQ ID NO: 2986232 - protein, 22 aa, Entamoeba invadens
VDIDICELFSFIANGQINSFVL

SEQ ID NO: 2986233 - protein, 17 aa, Entamoeba invadens
VDIILGMIVCKAKNFTV

SEQ ID NO: 2986234 - protein, 18 aa, Entamoeba invadens
VDIPSSIAFLKRAQNVIK

SEQ ID NO: 2986235 - protein, 19 aa, Entamoeba invadens
VDKEWKGFVGLKLTVNSAV

SEQ ID NO: 2986236 - protein, 22 aa, Entamoeba invadens
VDKPDECDFVFSIQRHGKVVNK

SEQ ID NO: 2986237 - protein, 17 aa, Entamoeba invadens
VDLCHLIESLNLQCEDD

SEQ ID NO: 2986238 - protein, 18 aa, Entamoeba invadens
VDLDFGCFLCVKCMKDHK

SEQ ID NO: 2986239 - protein, 22 aa, Entamoeba invadens
VDLFYQCCLGIQWLHNKLNIIH

SEQ ID NO: 2986240 - protein, 18 aa, Entamoeba invadens
VDLKRFQFLILQFGNFYE

SEQ ID NO: 2986241 - protein, 23 aa, Entamoeba invadens
VDLWKIIFFIAVKYIEINGKPKD

SEQ ID NO: 2986242 - protein, 24 aa, Entamoeba invadens
VDNKEGLCFKHEFFQRDHPELLQK

SEQ ID NO: 2986243 - protein, 17 aa, Entamoeba invadens
VDNYTVAIIIANFFFCV

SEQ ID NO: 2986244 - protein, 17 aa, Entamoeba invadens
VDPNFIATFAMDSDKVT

SEQ ID NO: 2986245 - protein, 17 aa, Entamoeba invadens
VDRAIEIYPEFRIPAEL

SEQ ID NO: 2986246 - protein, 19 aa, Entamoeba invadens
VDRNKFILCGNGFVKKLNY

SEQ ID NO: 2986247 - protein, 18 aa, Entamoeba invadens
VDSLECLTIAKAQLDKII

SEQ ID NO: 2986248 - protein, 22 aa, Entamoeba invadens
VDSWGVAAVMCYLFGTNITKKS

SEQ ID NO: 2986249 - protein, 17 aa, Entamoeba invadens
VDTENFDIFGFLPNVFS

SEQ ID NO: 2986250 - protein, 19 aa, Entamoeba invadens
VDVCNDFFKTFKMPETPIL

SEQ ID NO: 2986251 - protein, 18 aa, Entamoeba invadens
VDVLRLFSEYSFFKNEDV

SEQ ID NO: 2986252 - protein, 18 aa, Entamoeba invadens
VDVSFAFAAMRRIPQQYI

SEQ ID NO: 2986253 - protein, 19 aa, Entamoeba invadens
VEACGLFSAVFTVTVGDIS

SEQ ID NO: 2986254 - protein, 17 aa, Entamoeba invadens
VEAFEIFESRGILQVVL

SEQ ID NO: 2986255 - protein, 20 aa, Entamoeba invadens
VEAFTWLIAHDVLIRVRKYL

SEQ ID NO: 2986256 - protein, 23 aa, Entamoeba invadens
VEALKIVGAFVFLRLLNPVLLTP

SEQ ID NO: 2986257 - protein, 17 aa, Entamoeba invadens
VEALSILFGRPMYQVSF

SEQ ID NO: 2986258 - protein, 18 aa, Entamoeba invadens
VEAPRLFNRIVIKPVDHP

SEQ ID NO: 2986259 - protein, 22 aa, Entamoeba invadens
VEARLNFLPTFKINQNGEYNDK

SEQ ID NO: 2986260 - protein, 19 aa, Entamoeba invadens
VECFRLFFCEEITNNLLLF

SEQ ID NO: 2986261 - protein, 21 aa, Entamoeba invadens
VECKTFPPGFTYFMSKVSQEL

SEQ ID NO: 2986262 - protein, 18 aa, Entamoeba invadens
VECPICGITKVVTVRPKF

SEQ ID NO: 2986263 - protein, 21 aa, Entamoeba invadens
VEFRIKLYFDEFKVCVNSANC

SEQ ID NO: 2986264 - protein, 19 aa, Entamoeba invadens
VEGRKSLGLNYNFISRNHF

SEQ ID NO: 2986265 - protein, 18 aa, Entamoeba invadens
VEHIKFLVQVMSQALNTY

SEQ ID NO: 2986266 - protein, 18 aa, Entamoeba invadens
VEIKETFEPILVLTKQIV

SEQ ID NO: 2986267 - protein, 18 aa, Entamoeba invadens
VEIKNWLEHDFGDDDDQE

SEQ ID NO: 2986268 - protein, 17 aa, Entamoeba invadens
VEIVKFLKNVFGDVGNK

SEQ ID NO: 2986269 - protein, 17 aa, Entamoeba invadens
VEIWLYRGAWQEYEVYR

SEQ ID NO: 2986270 - protein, 18 aa, Entamoeba invadens
VEKLRFGFDRAFGPSSTQ

SEQ ID NO: 2986271 - protein, 23 aa, Entamoeba invadens
VEKRLTKVVTRWYLELRSVVDTI

SEQ ID NO: 2986272 - protein, 17 aa, Entamoeba invadens
VEKSGYQSFPWVRYMTF

SEQ ID NO: 2986273 - protein, 17 aa, Entamoeba invadens
VEKYFGALVMKNAKKIY

SEQ ID NO: 2986274 - protein, 18 aa, Entamoeba invadens
VELFELWEGLWFMLQETC

SEQ ID NO: 2986275 - protein, 18 aa, Entamoeba invadens
VELFFKYIRILNSIRPKE

SEQ ID NO: 2986276 - protein, 20 aa, Entamoeba invadens
VELKTNVLVITNFQEKQMRD

SEQ ID NO: 2986277 - protein, 18 aa, Entamoeba invadens
VEMIFNFLVTYIGDAIWF

SEQ ID NO: 2986278 - protein, 20 aa, Entamoeba invadens
VEMLSALFLQRKVFIKSANR

SEQ ID NO: 2986279 - protein, 17 aa, Entamoeba invadens
VEPEGMLGIIFLKNKEA

SEQ ID NO: 2986280 - protein, 19 aa, Entamoeba invadens
VEPRFVKDLVYFVVSSSLK

SEQ ID NO: 2986281 - protein, 19 aa, Entamoeba invadens
VEQFTGFLLDKSFVGMTAP

SEQ ID NO: 2986282 - protein, 18 aa, Entamoeba invadens
VEQLKLTINEKVDLEKTI

SEQ ID NO: 2986283 - protein, 22 aa, Entamoeba invadens
VERCYKCGKPLVGKYLVVDGHN

SEQ ID NO: 2986284 - protein, 18 aa, Entamoeba invadens
VERILSLVLFKMIDKDGN

SEQ ID NO: 2986285 - protein, 21 aa, Entamoeba invadens
VERKILRFCGAKELRSLKEKT

SEQ ID NO: 2986286 - protein, 23 aa, Entamoeba invadens
VESFSWKVGNDIIQIDGRPISIE

SEQ ID NO: 2986287 - protein, 23 aa, Entamoeba invadens
VESKKALAISCRRIHTIVSSIAN

SEQ ID NO: 2986288 - protein, 21 aa, Entamoeba invadens
VESLKHLKSFVFGRTDVGQIE

SEQ ID NO: 2986289 - protein, 18 aa, Entamoeba invadens
VESSEKFFLYGYNNNTEN

SEQ ID NO: 2986290 - protein, 22 aa, Entamoeba invadens
VETLKFYFTFVIARHLEQRAFS

SEQ ID NO: 2986291 - protein, 18 aa, Entamoeba invadens
VETLKWIIENVLRPITEG

SEQ ID NO: 2986292 - protein, 24 aa, Entamoeba invadens
VETMKCYTCGLFGHTTKYCPNSQE

SEQ ID NO: 2986293 - protein, 24 aa, Entamoeba invadens
VETYWGIKFGDIFFNKKQIDSKGR

SEQ ID NO: 2986294 - protein, 17 aa, Entamoeba invadens
VEVFKLFDRSPEKTGDA

SEQ ID NO: 2986295 - protein, 23 aa, Entamoeba invadens
VEVKGLECVITFKTFAFGGHTKL

SEQ ID NO: 2986296 - protein, 20 aa, Entamoeba invadens
VEVYLKLGLDISDIEKKRFL

SEQ ID NO: 2986297 - protein, 17 aa, Entamoeba invadens
VFADRVGVNFVSYRDEA

SEQ ID NO: 2986298 - protein, 17 aa, Entamoeba invadens
VFAFLSFYKDYEVDCGL

SEQ ID NO: 2986299 - protein, 17 aa, Entamoeba invadens
VFCCRNLGIASVYNNDV

SEQ ID NO: 2986300 - protein, 17 aa, Entamoeba invadens
VFCSAIFTRKIVQARGF

SEQ ID NO: 2986301 - protein, 19 aa, Entamoeba invadens
VFDICCPFKQLDFSSRSFY

SEQ ID NO: 2986302 - protein, 21 aa, Entamoeba invadens
VFDRLGALTSRVVKLTEIVQN

SEQ ID NO: 2986303 - protein, 22 aa, Entamoeba invadens
VFDSACIYEWLKAKNPNESELK

SEQ ID NO: 2986304 - protein, 24 aa, Entamoeba invadens
VFELFEFIGNLSLRQHEQHDQNTN

SEQ ID NO: 2986305 - protein, 20 aa, Entamoeba invadens
VFERRMVLVTSNKVIEMKMK

SEQ ID NO: 2986306 - protein, 18 aa, Entamoeba invadens
VFGARAFAGCRLLEKIDI

SEQ ID NO: 2986307 - protein, 17 aa, Entamoeba invadens
VFIYKNVCYEVMRFCFV

SEQ ID NO: 2986308 - protein, 24 aa, Entamoeba invadens
VFKCSRLAYCFDYFLASKPFKDLT

SEQ ID NO: 2986309 - protein, 24 aa, Entamoeba invadens
VFKKKECKVIEGFEKSYECQTTVV

SEQ ID NO: 2986310 - protein, 17 aa, Entamoeba invadens
VFKREYIYRSSLRSGDF

SEQ ID NO: 2986311 - protein, 27 aa, Entamoeba invadens
VFLFKHFPLLLSFSFRLSQIDTIPFTL

SEQ ID NO: 2986312 - protein, 17 aa, Entamoeba invadens
VFLQKKLESKHMSDKRY

SEQ ID NO: 2986313 - protein, 17 aa, Entamoeba invadens
VFMKFTLHKNAICAISL

SEQ ID NO: 2986314 - protein, 18 aa, Entamoeba invadens
VFMSFEMADYLLSFLEHL

SEQ ID NO: 2986315 - protein, 19 aa, Entamoeba invadens
VFNEIFFKILESIGYVHHT

SEQ ID NO: 2986316 - protein, 18 aa, Entamoeba invadens
VFNLCWWIYTFGNRTEGI

SEQ ID NO: 2986317 - protein, 17 aa, Entamoeba invadens
VFPFCFSEGDALLKQRS

SEQ ID NO: 2986318 - protein, 23 aa, Entamoeba invadens
VFPKEVLKGFLLYIQQFNPFMKV

SEQ ID NO: 2986319 - protein, 20 aa, Entamoeba invadens
VFPTSYCILKGLDIKEITFN

SEQ ID NO: 2986320 - protein, 17 aa, Entamoeba invadens
VFQKIRFDLVMNSLKEM

SEQ ID NO: 2986321 - protein, 24 aa, Entamoeba invadens
VFRFLPEFLSAFFYNAHVYLYPQK

SEQ ID NO: 2986322 - protein, 19 aa, Entamoeba invadens
VFRTLPLCCLITSQHKKYL

SEQ ID NO: 2986323 - protein, 25 aa, Entamoeba invadens
VFRWLTLLCCMEFPLSETLRYWDFF

SEQ ID NO: 2986324 - protein, 24 aa, Entamoeba invadens
VFSILAIQCVGQWVVFLVQSNAMR

SEQ ID NO: 2986325 - protein, 20 aa, Entamoeba invadens
VFSSLCDREYLATKESNDLK

SEQ ID NO: 2986326 - protein, 17 aa, Entamoeba invadens
VFVDCRDAFAIGENFVV

SEQ ID NO: 2986327 - protein, 20 aa, Entamoeba invadens
VFVGYCILIMKTLYNFCKAK

SEQ ID NO: 2986328 - protein, 23 aa, Entamoeba invadens
VFVLRVKFRIRKGVEERLWVEKT

SEQ ID NO: 2986329 - protein, 19 aa, Entamoeba invadens
VFYTPRFLYGALFPTGETI

SEQ ID NO: 2986330 - protein, 17 aa, Entamoeba invadens
VGAFCFKDCYSLKSASF

SEQ ID NO: 2986331 - protein, 18 aa, Entamoeba invadens
VGDQITFELCSKVGRDKL

SEQ ID NO: 2986332 - protein, 17 aa, Entamoeba invadens
VGFYFNYIKGMTFLNQP

SEQ ID NO: 2986333 - protein, 17 aa, Entamoeba invadens
VGGEHFKPFVSYEAEGM

SEQ ID NO: 2986334 - protein, 22 aa, Entamoeba invadens
VGHARSSTFLATNRKATFGEKV

SEQ ID NO: 2986335 - protein, 22 aa, Entamoeba invadens
VGIKECWAAHMIGHELTAYYGV

SEQ ID NO: 2986336 - protein, 20 aa, Entamoeba invadens
VGIKRECCKAIASIINECKT

SEQ ID NO: 2986337 - protein, 19 aa, Entamoeba invadens
VGKFRFRMMLERSQVHTVF

SEQ ID NO: 2986338 - protein, 17 aa, Entamoeba invadens
VGKLCFFAPEVLQDVRL

SEQ ID NO: 2986339 - protein, 18 aa, Entamoeba invadens
VGKLYAGLVEGVFPSQLG

SEQ ID NO: 2986340 - protein, 17 aa, Entamoeba invadens
VGMGLTFNRHVLRQLLE

SEQ ID NO: 2986341 - protein, 18 aa, Entamoeba invadens
VGMLCLKLSKQLVPFEGK

SEQ ID NO: 2986342 - protein, 25 aa, Entamoeba invadens
VGNGEFWSGVRFGYFTIADINVKNS

SEQ ID NO: 2986343 - protein, 17 aa, Entamoeba invadens
VGPVWCWDLCAPLKNAC

SEQ ID NO: 2986344 - protein, 18 aa, Entamoeba invadens
VGRCPFQLLQMDTFSALQ

SEQ ID NO: 2986345 - protein, 19 aa, Entamoeba invadens
VGRCPFQLLQMDTFSALQA

SEQ ID NO: 2986346 - protein, 17 aa, Entamoeba invadens
VGRRICPLFVTKGFDRI

SEQ ID NO: 2986347 - protein, 24 aa, Entamoeba invadens
VGVFPEVFEKLVFANVLMPETEII

SEQ ID NO: 2986348 - protein, 17 aa, Entamoeba invadens
VGVKWMYELYKQGGGGI

SEQ ID NO: 2986349 - protein, 17 aa, Entamoeba invadens
VGWTMKVLEIFIKEKRV

SEQ ID NO: 2986350 - protein, 18 aa, Entamoeba invadens
VGYYSCFSCANLKEVVLP

SEQ ID NO: 2986351 - protein, 18 aa, Entamoeba invadens
VHFHFPLDFDSFIIHRKT

SEQ ID NO: 2986352 - protein, 18 aa, Entamoeba invadens
VHGCKRVWFGFNLSEETV

SEQ ID NO: 2986353 - protein, 23 aa, Entamoeba invadens
VHLLMDIGHRFGWDVETTREENC

SEQ ID NO: 2986354 - protein, 17 aa, Entamoeba invadens
VHLPDVISFSVIIDNKR

SEQ ID NO: 2986355 - protein, 18 aa, Entamoeba invadens
VHRKVCLDLSQYTFLSEI

SEQ ID NO: 2986356 - protein, 18 aa, Entamoeba invadens
VHVLDFYKSKGYDLNNMM

SEQ ID NO: 2986357 - protein, 18 aa, Entamoeba invadens
VHVSLRFGVSSATRYERT

SEQ ID NO: 2986358 - protein, 18 aa, Entamoeba invadens
VIDLAKFADLNGEKKDCQ

SEQ ID NO: 2986359 - protein, 19 aa, Entamoeba invadens
VIFKEYFHDLAVKDENFIE

SEQ ID NO: 2986360 - protein, 18 aa, Entamoeba invadens
VIHLKRFGSVGGSVRDKI

SEQ ID NO: 2986361 - protein, 17 aa, Entamoeba invadens
VIIGKDVFKSIAVSKEF

SEQ ID NO: 2986362 - protein, 19 aa, Entamoeba invadens
VIIRMCWISSFLGKLGKKL

SEQ ID NO: 2986363 - protein, 17 aa, Entamoeba invadens
VIKERMTSLVIGKIKTF

SEQ ID NO: 2986364 - protein, 20 aa, Entamoeba invadens
VILECTKPVFTSALKETMFD

SEQ ID NO: 2986365 - protein, 19 aa, Entamoeba invadens
VILPIKFPQLFTDKRKPWT

SEQ ID NO: 2986366 - protein, 19 aa, Entamoeba invadens
VINLEFYSSYLLIVTPMRI

SEQ ID NO: 2986367 - protein, 26 aa, Entamoeba invadens
VIPLDCPWFICYFSGRPHINFSCKSQ

SEQ ID NO: 2986368 - protein, 25 aa, Entamoeba invadens
VISFYNFWYGFKTWREMAPEEMYDI

SEQ ID NO: 2986369 - protein, 19 aa, Entamoeba invadens
VITIPIFFNLALKDHLNIG

SEQ ID NO: 2986370 - protein, 19 aa, Entamoeba invadens
VITKERYALIVSFFKDNNC

SEQ ID NO: 2986371 - protein, 24 aa, Entamoeba invadens
VITLLRFKVVISMDFVINTINGNV

SEQ ID NO: 2986372 - protein, 23 aa, Entamoeba invadens
VIWPMLRPDIFTGLRAPPKGILL

SEQ ID NO: 2986373 - protein, 18 aa, Entamoeba invadens
VKAACWMKEMLDKKRLEV

SEQ ID NO: 2986374 - protein, 18 aa, Entamoeba invadens
VKAACWMKEMLDKKSLEV

SEQ ID NO: 2986375 - protein, 19 aa, Entamoeba invadens
VKADSRFKVLQSLKGECKF

SEQ ID NO: 2986376 - protein, 18 aa, Entamoeba invadens
VKAGECFALLKMMEKKSP

SEQ ID NO: 2986377 - protein, 18 aa, Entamoeba invadens
VKALKEFFEIASKECVDS

SEQ ID NO: 2986378 - protein, 18 aa, Entamoeba invadens
VKATPYWGYAYQNGQAVF

SEQ ID NO: 2986379 - protein, 24 aa, Entamoeba invadens
VKCKLCGFSIHKTCVENCFTLCRG

SEQ ID NO: 2986380 - protein, 18 aa, Entamoeba invadens
VKCLKMLVENGIVNAIMD

SEQ ID NO: 2986381 - protein, 20 aa, Entamoeba invadens
VKCRGSCLQLVITENSNGGR

SEQ ID NO: 2986382 - protein, 18 aa, Entamoeba invadens
VKDAFYLTNNSFKIIEKF

SEQ ID NO: 2986383 - protein, 23 aa, Entamoeba invadens
VKDGVEFTLKCNYDTFIEASNVG

SEQ ID NO: 2986384 - protein, 21 aa, Entamoeba invadens
VKDKKCFLCGKTGHISLVCPE

SEQ ID NO: 2986385 - protein, 19 aa, Entamoeba invadens
VKDLMKLFCEKYKKQAKSE

SEQ ID NO: 2986386 - protein, 21 aa, Entamoeba invadens
VKEFKRLGGALIRDDNIVKIA

SEQ ID NO: 2986387 - protein, 17 aa, Entamoeba invadens
VKEGFCINFDFEVDVLY

SEQ ID NO: 2986388 - protein, 19 aa, Entamoeba invadens
VKEHYKAFMNYSLEHIRED

SEQ ID NO: 2986389 - protein, 20 aa, Entamoeba invadens
VKERMKAVVIDVRDIDLTNE

SEQ ID NO: 2986390 - protein, 18 aa, Entamoeba invadens
VKEWCIIPLYKLVMHDDH

SEQ ID NO: 2986391 - protein, 21 aa, Entamoeba invadens
VKFLREFKLFPGIKTLVINSS

SEQ ID NO: 2986392 - protein, 17 aa, Entamoeba invadens
VKFVEAFGGVEKTLEIG

SEQ ID NO: 2986393 - protein, 17 aa, Entamoeba invadens
VKGFADFSLKLVMRQSA

SEQ ID NO: 2986394 - protein, 17 aa, Entamoeba invadens
VKGKCVLCDKEYIVDVN

SEQ ID NO: 2986395 - protein, 22 aa, Entamoeba invadens
VKGKSIKICWKLSKEEISNEEF

SEQ ID NO: 2986396 - protein, 19 aa, Entamoeba invadens
VKGRRARELYKWGLRSVDD

SEQ ID NO: 2986397 - protein, 23 aa, Entamoeba invadens
VKGSEYKLDFAYHPVPFSFFLQN

SEQ ID NO: 2986398 - protein, 21 aa, Entamoeba invadens
VKGTLPIKAFKTMVNETHDQL

SEQ ID NO: 2986399 - protein, 17 aa, Entamoeba invadens
VKHFLGFVQQYYEVPQR

SEQ ID NO: 2986400 - protein, 18 aa, Entamoeba invadens
VKHLKLFPNMDVLLLYNP

SEQ ID NO: 2986401 - protein, 17 aa, Entamoeba invadens
VKIARALIRCFTTLNLQ

SEQ ID NO: 2986402 - protein, 17 aa, Entamoeba invadens
VKIFWRLSKEEIISEEF

SEQ ID NO: 2986403 - protein, 17 aa, Entamoeba invadens
VKILNYCYIEFRAPYIH

SEQ ID NO: 2986404 - protein, 30 aa, Entamoeba invadens
VKILPHKFCWRVKNDLYICVKDITVFTHLN

SEQ ID NO: 2986405 - protein, 18 aa, Entamoeba invadens
VKITNEWLVGKEDDEDLD

SEQ ID NO: 2986406 - protein, 18 aa, Entamoeba invadens
VKIWAIVCFARLVDHEGV

SEQ ID NO: 2986407 - protein, 18 aa, Entamoeba invadens
VKIWAIVCFARLVGHEGV

SEQ ID NO: 2986408 - protein, 25 aa, Entamoeba invadens
VKKCNWRFPIPVFRSIEYLEKNGGK

SEQ ID NO: 2986409 - protein, 20 aa, Entamoeba invadens
VKKLMKQICEKYKKDGKPRV

SEQ ID NO: 2986410 - protein, 23 aa, Entamoeba invadens
VKKMKCFICGEIGHSNHRCPNKD

SEQ ID NO: 2986411 - protein, 20 aa, Entamoeba invadens
VKKMRESLCFSNEPNKLTSY

SEQ ID NO: 2986412 - protein, 20 aa, Entamoeba invadens
VKKPIFLFLLKIVKKLILHF

SEQ ID NO: 2986413 - protein, 22 aa, Entamoeba invadens
VKKRIVSMVCKFFTVFPGDFYV

SEQ ID NO: 2986414 - protein, 19 aa, Entamoeba invadens
VKLFTCVSLQTTIKKLKKL

SEQ ID NO: 2986415 - protein, 17 aa, Entamoeba invadens
VKLKEIIHVLESDLTQT

SEQ ID NO: 2986416 - protein, 19 aa, Entamoeba invadens
VKLRECFHEGNGFVIALLY

SEQ ID NO: 2986417 - protein, 17 aa, Entamoeba invadens
VKLYVQFFIYIRSLMQR

SEQ ID NO: 2986418 - protein, 17 aa, Entamoeba invadens
VKMAYNYRVLLTNTNYS

SEQ ID NO: 2986419 - protein, 21 aa, Entamoeba invadens
VKNIFLWKLFEVHHLSTNMRS

SEQ ID NO: 2986420 - protein, 18 aa, Entamoeba invadens
VKNYVVWYPVCYSHAKSY

SEQ ID NO: 2986421 - protein, 17 aa, Entamoeba invadens
VKPQWFWYLIEEHFREN

SEQ ID NO: 2986422 - protein, 17 aa, Entamoeba invadens
VKPRGQNGFGFDGCFVP

SEQ ID NO: 2986423 - protein, 22 aa, Entamoeba invadens
VKQWLLRKLNSFQAKKTDLDNQ

SEQ ID NO: 2986424 - protein, 22 aa, Entamoeba invadens
VKRAGEILPTFPWPKEFEKSVF

SEQ ID NO: 2986425 - protein, 19 aa, Entamoeba invadens
VKRAIAFIKKKYVPVKKTA

SEQ ID NO: 2986426 - protein, 17 aa, Entamoeba invadens
VKRGCKRVVLQFPEGLI

SEQ ID NO: 2986427 - protein, 20 aa, Entamoeba invadens
VKRIREMWLLIFKFLDHPLQ

SEQ ID NO: 2986428 - protein, 19 aa, Entamoeba invadens
VKRISCIKPTLPKLLINLM

SEQ ID NO: 2986429 - protein, 23 aa, Entamoeba invadens
VKRNCLTKELFCFSFIDFFSTID

SEQ ID NO: 2986430 - protein, 23 aa, Entamoeba invadens
VKRSFYKTVVWFRVPYENTLDPA

SEQ ID NO: 2986431 - protein, 26 aa, Entamoeba invadens
VKRYGLECPGLWLKNLVIKFMLSKLG

SEQ ID NO: 2986432 - protein, 20 aa, Entamoeba invadens
VKSEGIVLFDYVGKNPHELT

SEQ ID NO: 2986433 - protein, 17 aa, Entamoeba invadens
VKSLCCGCFENTLLVAC

SEQ ID NO: 2986434 - protein, 20 aa, Entamoeba invadens
VKSVGRFCFYNSVGKENVIF

SEQ ID NO: 2986435 - protein, 23 aa, Entamoeba invadens
VKTHDIYDLFALYARDAVNEQLA

SEQ ID NO: 2986436 - protein, 19 aa, Entamoeba invadens
VKTLKICSDKGYSFTMNSM

SEQ ID NO: 2986437 - protein, 21 aa, Entamoeba invadens
VKTLRIIFRFTAIVSVNLDNT

SEQ ID NO: 2986438 - protein, 19 aa, Entamoeba invadens
VKVFSCLYGKYLANLDVKR

SEQ ID NO: 2986439 - protein, 25 aa, Entamoeba invadens
VKVKELDKALAFFLRRNEYIKVLEV

SEQ ID NO: 2986440 - protein, 22 aa, Entamoeba invadens
VKVLKYYFPKCGNFDDDEVDLL

SEQ ID NO: 2986441 - protein, 22 aa, Entamoeba invadens
VKVVECIFLFVTECFKQYDIKP

SEQ ID NO: 2986442 - protein, 23 aa, Entamoeba invadens
VKWKEVNALIALGAFKKVFINYG

SEQ ID NO: 2986443 - protein, 25 aa, Entamoeba invadens
VKYEYSGMVLEVFLRRTKSSEIEKR

SEQ ID NO: 2986444 - protein, 17 aa, Entamoeba invadens
VKYFVCFNDFVHLQMSC

SEQ ID NO: 2986445 - protein, 17 aa, Entamoeba invadens
VKYLLNVDHYFKIDKIT

SEQ ID NO: 2986446 - protein, 24 aa, Entamoeba invadens
VLATKELISWIMFRLFNLLEKTAA

SEQ ID NO: 2986447 - protein, 25 aa, Entamoeba invadens
VLCCKKFTFKKGIKFECMLVDVQEE

SEQ ID NO: 2986448 - protein, 17 aa, Entamoeba invadens
VLCFLRDSFRCQIVKDT

SEQ ID NO: 2986449 - protein, 18 aa, Entamoeba invadens
VLCYKCFEHCSSLSSINI

SEQ ID NO: 2986450 - protein, 18 aa, Entamoeba invadens
VLDCMGYSFVLTRPKKTV

SEQ ID NO: 2986451 - protein, 25 aa, Entamoeba invadens
VLDLFGGLCLKCMDAVKYFETVSVY

SEQ ID NO: 2986452 - protein, 18 aa, Entamoeba invadens
VLDPRVGNFVSRTQVSNH

SEQ ID NO: 2986453 - protein, 25 aa, Entamoeba invadens
VLETYRGKMEWFIGIKFEQIFPDME

SEQ ID NO: 2986454 - protein, 23 aa, Entamoeba invadens
VLFCAKYAFKHCSALQQMCLNQN

SEQ ID NO: 2986455 - protein, 23 aa, Entamoeba invadens
VLFFKLLFRRIDGFIGDNPTPNH

SEQ ID NO: 2986456 - protein, 18 aa, Entamoeba invadens
VLFGITFKTRANAITKRA

SEQ ID NO: 2986457 - protein, 18 aa, Entamoeba invadens
VLFIVYWKKIHGIPKINS

SEQ ID NO: 2986458 - protein, 17 aa, Entamoeba invadens
VLHGLSYLHQMKMIHRD

SEQ ID NO: 2986459 - protein, 18 aa, Entamoeba invadens
VLILQEFVKYVDVIQKIP

SEQ ID NO: 2986460 - protein, 17 aa, Entamoeba invadens
VLIVSSLRLKKDVTKYH

SEQ ID NO: 2986461 - protein, 18 aa, Entamoeba invadens
VLKFLGFKVDKWVPLASY

SEQ ID NO: 2986462 - protein, 23 aa, Entamoeba invadens
VLKRITFKYEILREAVPKIHINF

SEQ ID NO: 2986463 - protein, 19 aa, Entamoeba invadens
VLKRKCMMFFKELGQAKAE

SEQ ID NO: 2986464 - protein, 17 aa, Entamoeba invadens
VLLKEAVSFIVLNCTNV

SEQ ID NO: 2986465 - protein, 24 aa, Entamoeba invadens
VLLRSESPIIFFEFKKVNNLLLVV

SEQ ID NO: 2986466 - protein, 17 aa, Entamoeba invadens
VLMGWGVQYITFVDNGT

SEQ ID NO: 2986467 - protein, 23 aa, Entamoeba invadens
VLMSELRKVPGLIINELIQYYYE

SEQ ID NO: 2986468 - protein, 23 aa, Entamoeba invadens
VLNIYYKFYWVMVNVSGYKKYSS

SEQ ID NO: 2986469 - protein, 18 aa, Entamoeba invadens
VLNLRWFNMRLIRAEYFP

SEQ ID NO: 2986470 - protein, 18 aa, Entamoeba invadens
VLNSFNFLKDYAKNDIEE

SEQ ID NO: 2986471 - protein, 17 aa, Entamoeba invadens
VLPECVNTLLLIADRSQ

SEQ ID NO: 2986472 - protein, 22 aa, Entamoeba invadens
VLPGYMFGAAPNWAFYNNATKC

SEQ ID NO: 2986473 - protein, 22 aa, Entamoeba invadens
VLPRLLKKISIIDCTGKINMKN

SEQ ID NO: 2986474 - protein, 18 aa, Entamoeba invadens
VLQLCFTLKVIVEYWQND

SEQ ID NO: 2986475 - protein, 25 aa, Entamoeba invadens
VLQMTELFDRWALLKVAREKLVNGV

SEQ ID NO: 2986476 - protein, 21 aa, Entamoeba invadens
VLRAICGDCDMTCRHIQHARF

SEQ ID NO: 2986477 - protein, 21 aa, Entamoeba invadens
VLRCFYVQFPLNSVNIETLVS

SEQ ID NO: 2986478 - protein, 28 aa, Entamoeba invadens
VLRGEFKPTITLLFYIMYRYRLNDVPVR

SEQ ID NO: 2986479 - protein, 18 aa, Entamoeba invadens
VLSEVMWKCRSIGAYYGE

SEQ ID NO: 2986480 - protein, 19 aa, Entamoeba invadens
VLSPREFKSAIGEFAPQFS

SEQ ID NO: 2986481 - protein, 23 aa, Entamoeba invadens
VLSQICEICYKLDLNSDYYKGFG

SEQ ID NO: 2986482 - protein, 25 aa, Entamoeba invadens
VLTKEFFCIIVWFAVDFKTVNTNKS

SEQ ID NO: 2986483 - protein, 24 aa, Entamoeba invadens
VLTRIFPILMMFRRELTYPAMTMT

SEQ ID NO: 2986484 - protein, 18 aa, Entamoeba invadens
VLVGFGYSAQVDWWTFGI

SEQ ID NO: 2986485 - protein, 19 aa, Entamoeba invadens
VLWSFRILRKVRIILRDET

SEQ ID NO: 2986486 - protein, 17 aa, Entamoeba invadens
VLYEVLRYTIGIYGVIG

SEQ ID NO: 2986487 - protein, 21 aa, Entamoeba invadens
VLYLPRLLDVFIFSQVNHTAS

SEQ ID NO: 2986488 - protein, 21 aa, Entamoeba invadens
VLYNLRLRYMKDIIHTYSGLF

SEQ ID NO: 2986489 - protein, 23 aa, Entamoeba invadens
VLYRLKCQLSLRFTQISQSVNMN

SEQ ID NO: 2986490 - protein, 22 aa, Entamoeba invadens
VLYSFFVCYSLREDGMKLYEMC

SEQ ID NO: 2986491 - protein, 18 aa, Entamoeba invadens
VMADLSLEGGEPAHSDIS

SEQ ID NO: 2986492 - protein, 17 aa, Entamoeba invadens
VMAETQCECVLKKARIC

SEQ ID NO: 2986493 - protein, 18 aa, Entamoeba invadens
VMCAWDWKMRSLIGDERF

SEQ ID NO: 2986494 - protein, 25 aa, Entamoeba invadens
VMCRSESGKVFGFFSGGKVPETTEM

SEQ ID NO: 2986495 - protein, 24 aa, Entamoeba invadens
VMGFVRSWVKWRFIDFEDVDMRSN

SEQ ID NO: 2986496 - protein, 19 aa, Entamoeba invadens
VMIPDFFKEECGIYTGRFR

SEQ ID NO: 2986497 - protein, 22 aa, Entamoeba invadens
VMKDVIKLLGFDLLIKKVVPIS

SEQ ID NO: 2986498 - protein, 21 aa, Entamoeba invadens
VMKFKKWLESWKNVIPDRQAV

SEQ ID NO: 2986499 - protein, 17 aa, Entamoeba invadens
VMLCFKIVSVSVETCVA

SEQ ID NO: 2986500 - protein, 18 aa, Entamoeba invadens
VMLDAFFDMCYDRLKHLE

SEQ ID NO: 2986501 - protein, 24 aa, Entamoeba invadens
VMLIKACSVVQYFRFMNTLDNVHQ

SEQ ID NO: 2986502 - protein, 18 aa, Entamoeba invadens
VMMACYFNPMTKLMIYPN

SEQ ID NO: 2986503 - protein, 18 aa, Entamoeba invadens
VMPSFSVDYLLLVFVLST

SEQ ID NO: 2986504 - protein, 20 aa, Entamoeba invadens
VMTCGRLFECIVMNNTQMYW

SEQ ID NO: 2986505 - protein, 17 aa, Entamoeba invadens
VMVKLYFQICGYEGVSA

SEQ ID NO: 2986506 - protein, 17 aa, Entamoeba invadens
VMVKRLLEHGADVNQLD

SEQ ID NO: 2986507 - protein, 18 aa, Entamoeba invadens
VNCLRWSPDGELLAAGTD

SEQ ID NO: 2986508 - protein, 26 aa, Entamoeba invadens
VNEKAIKIILTWGQLYPDELCEYTVL

SEQ ID NO: 2986509 - protein, 24 aa, Entamoeba invadens
VNFFKDLYHGFEFSFTISDCNFKS

SEQ ID NO: 2986510 - protein, 20 aa, Entamoeba invadens
VNGTLCWAMYFALVQAANNY

SEQ ID NO: 2986511 - protein, 18 aa, Entamoeba invadens
VNIGESVGFLGVHITGIP

SEQ ID NO: 2986512 - protein, 17 aa, Entamoeba invadens
VNILQFIALVPMNNTRL

SEQ ID NO: 2986513 - protein, 21 aa, Entamoeba invadens
VNIMCFRKGMRLVHEDVVKLR

SEQ ID NO: 2986514 - protein, 18 aa, Entamoeba invadens
VNKACCSNAFLSQESDYK

SEQ ID NO: 2986515 - protein, 23 aa, Entamoeba invadens
VNKKCKTAIEMLRINPGLASEGI

SEQ ID NO: 2986516 - protein, 17 aa, Entamoeba invadens
VNKRVNVTLGFKDKECA

SEQ ID NO: 2986517 - protein, 23 aa, Entamoeba invadens
VNLPFKLLLKFFGYIVDKLRHAG

SEQ ID NO: 2986518 - protein, 19 aa, Entamoeba invadens
VNLPLVFPVEVPRCDNVTE

SEQ ID NO: 2986519 - protein, 19 aa, Entamoeba invadens
VNLQLPLVLSKSVVYKTVL

SEQ ID NO: 2986520 - protein, 18 aa, Entamoeba invadens
VNRMKICLEREKNAIEKV

SEQ ID NO: 2986521 - protein, 19 aa, Entamoeba invadens
VNRNIAGVVKFDLQKTEDE

SEQ ID NO: 2986522 - protein, 18 aa, Entamoeba invadens
VNYIFWRYVDPLSNVRDE

SEQ ID NO: 2986523 - protein, 19 aa, Entamoeba invadens
VNYYLSFVFEDEEGLKYNA

SEQ ID NO: 2986524 - protein, 23 aa, Entamoeba invadens
VPEDFAARCLYWYNFGFSEVGDI

SEQ ID NO: 2986525 - protein, 26 aa, Entamoeba invadens
VPERKLRIFHGLTFRVGYCGVTERTL

SEQ ID NO: 2986526 - protein, 21 aa, Entamoeba invadens
VPEVRKAVCNKLEFLGVELDS

SEQ ID NO: 2986527 - protein, 26 aa, Entamoeba invadens
VPEYFWKCVLRISPLLRNQDKHEFYF

SEQ ID NO: 2986528 - protein, 17 aa, Entamoeba invadens
VPFNSVFAMKGKLKEGA

SEQ ID NO: 2986529 - protein, 22 aa, Entamoeba invadens
VPFPRVHFAMMSYAPIVTPEKA

SEQ ID NO: 2986530 - protein, 23 aa, Entamoeba invadens
VPKRMFYQIVVWFDVDYVTINDE

SEQ ID NO: 2986531 - protein, 17 aa, Entamoeba invadens
VPLICVWDKIALSRPIG

SEQ ID NO: 2986532 - protein, 20 aa, Entamoeba invadens
VPLRLFLKIAGVIVSFSKVA

SEQ ID NO: 2986533 - protein, 19 aa, Entamoeba invadens
VPLYLEWAPERLFNEEAKS

SEQ ID NO: 2986534 - protein, 35 aa, Entamoeba invadens
VPNGQKKECVQILQLLNAHRRTIDWMNTTAEEISQ

SEQ ID NO: 2986535 - protein, 17 aa, Entamoeba invadens
VPSKCFANCFSLENINI

SEQ ID NO: 2986536 - protein, 17 aa, Entamoeba invadens
VPSMIKAAALRKSQRPK

SEQ ID NO: 2986537 - protein, 24 aa, Entamoeba invadens
VPTEYKGKCLFMSVLFLTKLQGYF

SEQ ID NO: 2986538 - protein, 24 aa, Entamoeba invadens
VPVNIRVALCFTPLFTTAAHFQID

SEQ ID NO: 2986539 - protein, 17 aa, Entamoeba invadens
VPWKRIQIENVNKGTYV

SEQ ID NO: 2986540 - protein, 22 aa, Entamoeba invadens
VQDGWKVVCQWISDINNTPNKT

SEQ ID NO: 2986541 - protein, 23 aa, Entamoeba invadens
VQELGRLGGMKGLLTILDVLCTE

SEQ ID NO: 2986542 - protein, 23 aa, Entamoeba invadens
VQERACFFLAILRQFETLREQHI

SEQ ID NO: 2986543 - protein, 17 aa, Entamoeba invadens
VQFCLKKKALMGGDAVV

SEQ ID NO: 2986544 - protein, 18 aa, Entamoeba invadens
VQFIPKWFKALTDCGVPV

SEQ ID NO: 2986545 - protein, 19 aa, Entamoeba invadens
VQIAFPLNLRKLFLTNAKI

SEQ ID NO: 2986546 - protein, 23 aa, Entamoeba invadens
VQIKAAEVFTHFSSFQNFAPLLP

SEQ ID NO: 2986547 - protein, 28 aa, Entamoeba invadens
VQIPRSVTRIGVWCFHRCTALSEMHIPD

SEQ ID NO: 2986548 - protein, 18 aa, Entamoeba invadens
VQIPYSFQVVRPVFQSSF

SEQ ID NO: 2986549 - protein, 23 aa, Entamoeba invadens
VQKLKLIGKFVWILLRNGSVKVY

SEQ ID NO: 2986550 - protein, 24 aa, Entamoeba invadens
VQKRLSLKPELWKFVNPFFPYINS

SEQ ID NO: 2986551 - protein, 18 aa, Entamoeba invadens
VQLSPRFDVAHMHVRKSI

SEQ ID NO: 2986552 - protein, 17 aa, Entamoeba invadens
VQMGIAFIKFSGKDLNA

SEQ ID NO: 2986553 - protein, 19 aa, Entamoeba invadens
VQMKPVFANIVFSDYENSL

SEQ ID NO: 2986554 - protein, 23 aa, Entamoeba invadens
VQMLKRILIIYSIIHTNRGYFQG

SEQ ID NO: 2986555 - protein, 17 aa, Entamoeba invadens
VQMPIHFIEYCPNRTIL

SEQ ID NO: 2986556 - protein, 22 aa, Entamoeba invadens
VQRLPRYSLLLADLIKHTSKDH

SEQ ID NO: 2986557 - protein, 23 aa, Entamoeba invadens
VQSFSVCDPCFFTSFRDACLSKR

SEQ ID NO: 2986558 - protein, 23 aa, Entamoeba invadens
VQSWRCCLFYGLALVNSPTNYSY

SEQ ID NO: 2986559 - protein, 25 aa, Entamoeba invadens
VQYINCLPLQFIEKLCKRRLPTFSK

SEQ ID NO: 2986560 - protein, 17 aa, Entamoeba invadens
VRCIEPFVPYETSTVEI

SEQ ID NO: 2986561 - protein, 23 aa, Entamoeba invadens
VRCRKGAACKLCERPFDVYRWHM

SEQ ID NO: 2986562 - protein, 20 aa, Entamoeba invadens
VRCSLDILNCRKVVLINTKY

SEQ ID NO: 2986563 - protein, 17 aa, Entamoeba invadens
VRDIGLFLGKYIGQYLV

SEQ ID NO: 2986564 - protein, 23 aa, Entamoeba invadens
VREGWQKLCVMCMGLHPQDHTTT

SEQ ID NO: 2986565 - protein, 22 aa, Entamoeba invadens
VREWSDDVFLEYFHERLSQKGS

SEQ ID NO: 2986566 - protein, 25 aa, Entamoeba invadens
VRFLLSICFDIKFPVFLRNTKLEYD

SEQ ID NO: 2986567 - protein, 17 aa, Entamoeba invadens
VRIHLCHAIHLIASKYP

SEQ ID NO: 2986568 - protein, 27 aa, Entamoeba invadens
VRIIDFSRWFRFVLKITNPLFDLKSEF

SEQ ID NO: 2986569 - protein, 23 aa, Entamoeba invadens
VRIKEVYGGWTFLQQEFEYDFEK

SEQ ID NO: 2986570 - protein, 19 aa, Entamoeba invadens
VRIKRGIVGSGVVKVVPAI

SEQ ID NO: 2986571 - protein, 21 aa, Entamoeba invadens
VRIYNCFFCYFGGSLQFWIIM

SEQ ID NO: 2986572 - protein, 18 aa, Entamoeba invadens
VRKNWRMMRGIKHETLKL

SEQ ID NO: 2986573 - protein, 18 aa, Entamoeba invadens
VRKTAVLCVLKLYCMNPQ

SEQ ID NO: 2986574 - protein, 19 aa, Entamoeba invadens
VRLEDCLACSGCITSAESI

SEQ ID NO: 2986575 - protein, 17 aa, Entamoeba invadens
VRLSKVLQMARMGSNDT

SEQ ID NO: 2986576 - protein, 18 aa, Entamoeba invadens
VRMSLHVYRILRPFRLLE

SEQ ID NO: 2986577 - protein, 19 aa, Entamoeba invadens
VRNAVNFNLCDSVIGQQAI

SEQ ID NO: 2986578 - protein, 18 aa, Entamoeba invadens
VRNLKCVLFDFDKKIEIY

SEQ ID NO: 2986579 - protein, 20 aa, Entamoeba invadens
VRNVWRMACYVLLIEKDEKL

SEQ ID NO: 2986580 - protein, 23 aa, Entamoeba invadens
VRQCLNCMYGAYDLMRDICTQYV

SEQ ID NO: 2986581 - protein, 23 aa, Entamoeba invadens
VRSIGQFCFRWCGNLSSITIPSS

SEQ ID NO: 2986582 - protein, 23 aa, Entamoeba invadens
VRSKCYIEYIFAYSVVDMNLMAK

SEQ ID NO: 2986583 - protein, 23 aa, Entamoeba invadens
VRTAELMTGVLLYHERVDIKPTT

SEQ ID NO: 2986584 - protein, 18 aa, Entamoeba invadens
VRTFPGHCFVDFKDDISM

SEQ ID NO: 2986585 - protein, 22 aa, Entamoeba invadens
VRTVKRCFLCYRPCCKNHSINL

SEQ ID NO: 2986586 - protein, 24 aa, Entamoeba invadens
VRVKGKEKIICWSLTKEQQDSNDF

SEQ ID NO: 2986587 - protein, 18 aa, Entamoeba invadens
VRVKRYVKNEGVTKDVSM

SEQ ID NO: 2986588 - protein, 24 aa, Entamoeba invadens
VRVMGANCLIDLYLLSHKKVTNEI

SEQ ID NO: 2986589 - protein, 22 aa, Entamoeba invadens
VRYWPEDTFSVFFDRSRLQSVI

SEQ ID NO: 2986590 - protein, 19 aa, Entamoeba invadens
VSCDFGVRVCQELCSMPST

SEQ ID NO: 2986591 - protein, 19 aa, Entamoeba invadens
VSDAFKIPEDFFYLTDKGG

SEQ ID NO: 2986592 - protein, 20 aa, Entamoeba invadens
VSDVSCPWCYVGRRRLINAI

SEQ ID NO: 2986593 - protein, 22 aa, Entamoeba invadens
VSELKTYLARCLSIDSLPLRLK

SEQ ID NO: 2986594 - protein, 19 aa, Entamoeba invadens
VSENILYFAHLVLFVARNN

SEQ ID NO: 2986595 - protein, 24 aa, Entamoeba invadens
VSEQRFQIRLSREVEFQRGKKFTV

SEQ ID NO: 2986596 - protein, 17 aa, Entamoeba invadens
VSFALRLFGRFYPIIPL

SEQ ID NO: 2986597 - protein, 17 aa, Entamoeba invadens
VSFLPIVFTKAAEVVSG

SEQ ID NO: 2986598 - protein, 22 aa, Entamoeba invadens
VSIGGFKLRYSVECVDEFNMAL

SEQ ID NO: 2986599 - protein, 22 aa, Entamoeba invadens
VSIKGPELLTMWFGESEANVRN

SEQ ID NO: 2986600 - protein, 17 aa, Entamoeba invadens
VSIKVGATFPMKKDDFI

SEQ ID NO: 2986601 - protein, 17 aa, Entamoeba invadens
VSIPLFYCFAEETTQLW

SEQ ID NO: 2986602 - protein, 22 aa, Entamoeba invadens
VSIWKAEIVNLVFDSVKDIIQY

SEQ ID NO: 2986603 - protein, 17 aa, Entamoeba invadens
VSKEPFPDVFFKDISDD

SEQ ID NO: 2986604 - protein, 25 aa, Entamoeba invadens
VSKSGWRFPLPIYRAIEYLMNTKGY

SEQ ID NO: 2986605 - protein, 24 aa, Entamoeba invadens
VSKSGWRFPLPVYRSIEYLTTTQG

SEQ ID NO: 2986606 - protein, 23 aa, Entamoeba invadens
VSLFNHWLPRFGIQVDFVDTSDV

SEQ ID NO: 2986607 - protein, 18 aa, Entamoeba invadens
VSLFPYSVCARSRDSDVV

SEQ ID NO: 2986608 - protein, 19 aa, Entamoeba invadens
VSLFSFGLCMNEFIDTFMT

SEQ ID NO: 2986609 - protein, 17 aa, Entamoeba invadens
VSLHKIRCLQSLHFSAS

SEQ ID NO: 2986610 - protein, 18 aa, Entamoeba invadens
VSLLHFLVYYFGQDWQKV

SEQ ID NO: 2986611 - protein, 17 aa, Entamoeba invadens
VSLVKMFPDYSIKVMGH

SEQ ID NO: 2986612 - protein, 17 aa, Entamoeba invadens
VSMAFDWLQSESSNTLY

SEQ ID NO: 2986613 - protein, 24 aa, Entamoeba invadens
VSMKASGWVKVRWDINNNENRYRY

SEQ ID NO: 2986614 - protein, 19 aa, Entamoeba invadens
VSMKPERHFAFIATPTRSD

SEQ ID NO: 2986615 - protein, 20 aa, Entamoeba invadens
VSMLYKFRCDYIVHFYGAVF

SEQ ID NO: 2986616 - protein, 24 aa, Entamoeba invadens
VSMWEIPKAFFLVDAHRRYFDAAF

SEQ ID NO: 2986617 - protein, 17 aa, Entamoeba invadens
VSNEFKETLPPTVPDVT

SEQ ID NO: 2986618 - protein, 19 aa, Entamoeba invadens
VSNLNEFPCETIANTLKRF

SEQ ID NO: 2986619 - protein, 17 aa, Entamoeba invadens
VSPVFEWLKRVKEQLDS

SEQ ID NO: 2986620 - protein, 17 aa, Entamoeba invadens
VSPVLHFDFGMPDNETK

SEQ ID NO: 2986621 - protein, 23 aa, Entamoeba invadens
VSRGCLKRGVAVVGVGYPACSIT

SEQ ID NO: 2986622 - protein, 22 aa, Entamoeba invadens
VSRGCLKRGVAVVTVGYPACST

SEQ ID NO: 2986623 - protein, 22 aa, Entamoeba invadens
VSSEIILPCLMKIMANPLTRLV

SEQ ID NO: 2986624 - protein, 22 aa, Entamoeba invadens
VSTRLKEFILFKATYTPESFVQ

SEQ ID NO: 2986625 - protein, 23 aa, Entamoeba invadens
VSVDDIINAWAILIKVKDSMQVG

SEQ ID NO: 2986626 - protein, 19 aa, Entamoeba invadens
VSVESWTFKSLKPEEHDTF

SEQ ID NO: 2986627 - protein, 23 aa, Entamoeba invadens
VSVKWSIPDGFSFGYKELENETC

SEQ ID NO: 2986628 - protein, 20 aa, Entamoeba invadens
VSVQDKWKWISVLRAVSINS

SEQ ID NO: 2986629 - protein, 23 aa, Entamoeba invadens
VSYKKVLSGLLWKPNGIVKGPLD

SEQ ID NO: 2986630 - protein, 24 aa, Entamoeba invadens
VSYLKMVCKMVNLDWEVGRKKFDL

SEQ ID NO: 2986631 - protein, 20 aa, Entamoeba invadens
VTCAFPMLFGKTGNVNVRPQ

SEQ ID NO: 2986632 - protein, 27 aa, Entamoeba invadens
VTCAIRFVKLFRMFVNFLGGDIVDIES

SEQ ID NO: 2986633 - protein, 20 aa, Entamoeba invadens
VTCWHLYALILKLEKNYEES

SEQ ID NO: 2986634 - protein, 24 aa, Entamoeba invadens
VTEFPRGCLVPCTLSGSYPSRDPY

SEQ ID NO: 2986635 - protein, 24 aa, Entamoeba invadens
VTEIPRSEAFIFIGYDEDTINTYT

SEQ ID NO: 2986636 - protein, 17 aa, Entamoeba invadens
VTELFLQMFSLRALIPQ

SEQ ID NO: 2986637 - protein, 18 aa, Entamoeba invadens
VTEYGAIFRKGGVGLVVK

SEQ ID NO: 2986638 - protein, 18 aa, Entamoeba invadens
VTFFACVRLSELVLPLSL

SEQ ID NO: 2986639 - protein, 19 aa, Entamoeba invadens
VTFPSYLLTIWDRCFEFCM

SEQ ID NO: 2986640 - protein, 17 aa, Entamoeba invadens
VTFRMMYNSIRFVWNTP

SEQ ID NO: 2986641 - protein, 19 aa, Entamoeba invadens
VTGLVRFEGFVTVLKQGFM

SEQ ID NO: 2986642 - protein, 21 aa, Entamoeba invadens
VTGRFGFPFTCEYKYDGERGQ

SEQ ID NO: 2986643 - protein, 20 aa, Entamoeba invadens
VTIGKYCFFNCFAIEEVVIP

SEQ ID NO: 2986644 - protein, 17 aa, Entamoeba invadens
VTKGKCFRLCLNPFDSE

SEQ ID NO: 2986645 - protein, 18 aa, Entamoeba invadens
VTKIGAFAFRKCLSLTTF

SEQ ID NO: 2986646 - protein, 24 aa, Entamoeba invadens
VTKLEMPFCFNLTCPANLIELTLG

SEQ ID NO: 2986647 - protein, 25 aa, Entamoeba invadens
VTKVRLVLCPYNFITNPSIRSTSSI

SEQ ID NO: 2986648 - protein, 18 aa, Entamoeba invadens
VTLFMVLKFLGFKVDKWV

SEQ ID NO: 2986649 - protein, 17 aa, Entamoeba invadens
VTLFRLTTAIARQIADI

SEQ ID NO: 2986650 - protein, 24 aa, Entamoeba invadens
VTLHFKRFPFFFAYLKEAAGSELV

SEQ ID NO: 2986651 - protein, 23 aa, Entamoeba invadens
VTLKAPHPFSIFFKTQMKSAPQH

SEQ ID NO: 2986652 - protein, 17 aa, Entamoeba invadens
VTLKTGETFGCYQKCPM

SEQ ID NO: 2986653 - protein, 17 aa, Entamoeba invadens
VTLPSFQPFKTFFPLVT

SEQ ID NO: 2986654 - protein, 18 aa, Entamoeba invadens
VTLYECFSWKMAYQKDDV

SEQ ID NO: 2986655 - protein, 19 aa, Entamoeba invadens
VTLYEVFGWSEAYQNDIFK

SEQ ID NO: 2986656 - protein, 17 aa, Entamoeba invadens
VTSAFGFWKTQLFDDNS

SEQ ID NO: 2986657 - protein, 24 aa, Entamoeba invadens
VTSLGYNCFRECFSLSSVKIPLSV

SEQ ID NO: 2986658 - protein, 22 aa, Entamoeba invadens
VTWGLKLPHLFNYAGDMLGLTQ

SEQ ID NO: 2986659 - protein, 17 aa, Entamoeba invadens
VVCDFTLLKILATCGID

SEQ ID NO: 2986660 - protein, 17 aa, Entamoeba invadens
VVDCFDCKRFESLIEKT

SEQ ID NO: 2986661 - protein, 19 aa, Entamoeba invadens
VVELFDFYAVNSFKEMNYV

SEQ ID NO: 2986662 - protein, 22 aa, Entamoeba invadens
VVFADDCAFGYYSESGSTSMFY

SEQ ID NO: 2986663 - protein, 18 aa, Entamoeba invadens
VVFAMTFCKSAHVVQAFR

SEQ ID NO: 2986664 - protein, 19 aa, Entamoeba invadens
VVGLLDMLICFVTYASSHD

SEQ ID NO: 2986665 - protein, 23 aa, Entamoeba invadens
VVGSGWRPSPVLNEIKKCVPIQT

SEQ ID NO: 2986666 - protein, 17 aa, Entamoeba invadens
VVHHFNRKISFDYYPFI

SEQ ID NO: 2986667 - protein, 22 aa, Entamoeba invadens
VVHIRYSYFPGMTKKRSGPSMF

SEQ ID NO: 2986668 - protein, 19 aa, Entamoeba invadens
VVIFGRFLICGNVGDTEIL

SEQ ID NO: 2986669 - protein, 18 aa, Entamoeba invadens
VVIWYEVYYKTSVIKKSS

SEQ ID NO: 2986670 - protein, 19 aa, Entamoeba invadens
VVLECLDRYISIVGSVYDP

SEQ ID NO: 2986671 - protein, 23 aa, Entamoeba invadens
VVLPRLLKKISILDCTGKINMKN

SEQ ID NO: 2986672 - protein, 23 aa, Entamoeba invadens
VVNSGKCQLCLSGKYYNPNSKSC

SEQ ID NO: 2986673 - protein, 19 aa, Entamoeba invadens
VVPEFSESVILSYTNEKYV

SEQ ID NO: 2986674 - protein, 18 aa, Entamoeba invadens
VVQIPQYRSGRMNEQLAL

SEQ ID NO: 2986675 - protein, 18 aa, Entamoeba invadens
VVQLIAIKEEVDWDYFLK

SEQ ID NO: 2986676 - protein, 18 aa, Entamoeba invadens
VVTGFGFRPKPILEQIER

SEQ ID NO: 2986677 - protein, 17 aa, Entamoeba invadens
VVVKALFFLVGCKCQFI

SEQ ID NO: 2986678 - protein, 17 aa, Entamoeba invadens
VVVPLVLMNSFSTQVDT

SEQ ID NO: 2986679 - protein, 23 aa, Entamoeba invadens
VVYCVGCSNVGGSIPKWIVNSMS

SEQ ID NO: 2986680 - protein, 17 aa, Entamoeba invadens
VVYLVLISSEFVRYTFK

SEQ ID NO: 2986681 - protein, 24 aa, Entamoeba invadens
VWCRKGGVELVDFSFCHKPYVSHS

SEQ ID NO: 2986682 - protein, 17 aa, Entamoeba invadens
VWCSSAFVEEERNSGFL

SEQ ID NO: 2986683 - protein, 20 aa, Entamoeba invadens
VWGPNLVWRSWLEASEVDTV

SEQ ID NO: 2986684 - protein, 22 aa, Entamoeba invadens
VWKAMVVTLFAWLKKNSDFSER

SEQ ID NO: 2986685 - protein, 18 aa, Entamoeba invadens
VWMRGYWLIFSQDQAVKG

SEQ ID NO: 2986686 - protein, 18 aa, Entamoeba invadens
VYCVIPFIRPLDVYICLS

SEQ ID NO: 2986687 - protein, 19 aa, Entamoeba invadens
VYCVLEFLSISDIKKISFI

SEQ ID NO: 2986688 - protein, 24 aa, Entamoeba invadens
VYEAKGGMCGIVYPYTWISNDVTV

SEQ ID NO: 2986689 - protein, 18 aa, Entamoeba invadens
VYIQKAFCTLDFALQLAQ

SEQ ID NO: 2986690 - protein, 22 aa, Entamoeba invadens
VYKEQRLSLIFNKAENSNTQIE

SEQ ID NO: 2986691 - protein, 18 aa, Entamoeba invadens
VYKGIFRKEIVAIKKMRE

SEQ ID NO: 2986692 - protein, 20 aa, Entamoeba invadens
VYLDTRFEWDIGTVITDYIV

SEQ ID NO: 2986693 - protein, 19 aa, Entamoeba invadens
VYLDYFGFRACFDPSEVDH

SEQ ID NO: 2986694 - protein, 17 aa, Entamoeba invadens
VYLHLSINNFDRIGNGN

SEQ ID NO: 2986695 - protein, 18 aa, Entamoeba invadens
VYLSWNYKLTLKKFVNAP

SEQ ID NO: 2986696 - protein, 19 aa, Entamoeba invadens
VYLSYILNCPYFVSRFPVF

SEQ ID NO: 2986697 - protein, 19 aa, Entamoeba invadens
VYNFFKIRIEKSFTEKCVK

SEQ ID NO: 2986698 - protein, 18 aa, Entamoeba invadens
VYPELMRDLAMNISEKHF

SEQ ID NO: 2986699 - protein, 17 aa, Entamoeba invadens
VYQCFKLAPPLHAHNST

SEQ ID NO: 2986700 - protein, 18 aa, Entamoeba invadens
VYRMLNVLYTNGWNTKGI

SEQ ID NO: 2986701 - protein, 21 aa, Entamoeba invadens
VYRPHSPVTFSVMQNTMANQQ

SEQ ID NO: 2986702 - protein, 17 aa, Entamoeba invadens
VYSLVALLWERGVFDVK

SEQ ID NO: 2986703 - protein, 22 aa, Entamoeba invadens
VYSVEYLRGFSLFALKQWFESK

SEQ ID NO: 2986704 - protein, 17 aa, Entamoeba invadens
VYVHRWGKLSSEVVAFM

SEQ ID NO: 2986705 - protein, 19 aa, Entamoeba invadens
VYVKYCWNVLYQTMMKIER

SEQ ID NO: 2986706 - protein, 20 aa, Entamoeba invadens
VYYPRIVPILQILLRSVEDK

SEQ ID NO: 2986707 - protein, 18 aa, Entamoeba invadens
VYYRKLLFGLGVAFATQM

SEQ ID NO: 2986708 - protein, 19 aa, Entamoeba invadens
WADTIQCFVVGPGLGRDQY

SEQ ID NO: 2986709 - protein, 19 aa, Entamoeba invadens
WAEELGATCFTHWFQPLSS

SEQ ID NO: 2986710 - protein, 21 aa, Entamoeba invadens
WAKRIVKDYGLNVTGKDSFRD

SEQ ID NO: 2986711 - protein, 17 aa, Entamoeba invadens
WAMKRKCQVILLTDGQI

SEQ ID NO: 2986712 - protein, 23 aa, Entamoeba invadens
WANYFKLRLRCVDLNTRSSYLQK

SEQ ID NO: 2986713 - protein, 19 aa, Entamoeba invadens
WAQEEWKRYKMRNDSIITT

SEQ ID NO: 2986714 - protein, 17 aa, Entamoeba invadens
WATKINFFSYEKVLIPI

SEQ ID NO: 2986715 - protein, 22 aa, Entamoeba invadens
WCASEIRLFLTINYTIKTNTTI

SEQ ID NO: 2986716 - protein, 17 aa, Entamoeba invadens
WDDIKFLLDNKVKVETP

SEQ ID NO: 2986717 - protein, 19 aa, Entamoeba invadens
WDEIPNPFLSYGYSSSQVP

SEQ ID NO: 2986718 - protein, 17 aa, Entamoeba invadens
WDILKKCYVNWITNKTV

SEQ ID NO: 2986719 - protein, 18 aa, Entamoeba invadens
WDKEYFKALTQLEGVNNV

SEQ ID NO: 2986720 - protein, 22 aa, Entamoeba invadens
WDLTLKHLVDWKVFDRVRKANK

SEQ ID NO: 2986721 - protein, 19 aa, Entamoeba invadens
WDLYTGKCVQCYTQHKKGV

SEQ ID NO: 2986722 - protein, 19 aa, Entamoeba invadens
WDNFLKLIYDRGILCGILG

SEQ ID NO: 2986723 - protein, 25 aa, Entamoeba invadens
WDRNRLFDRIACLILYEDALDKVKQ

SEQ ID NO: 2986724 - protein, 17 aa, Entamoeba invadens
WDWHFTFHIDHFEQLLG

SEQ ID NO: 2986725 - protein, 19 aa, Entamoeba invadens
WEEEKGFLFSSSWTPYHRN

SEQ ID NO: 2986726 - protein, 19 aa, Entamoeba invadens
WEEFCVTCQFQPFQLPSTQ

SEQ ID NO: 2986727 - protein, 20 aa, Entamoeba invadens
WEIVNKLKLLAFYKQSEIEK

SEQ ID NO: 2986728 - protein, 17 aa, Entamoeba invadens
WELFCLEHGILPDGTPA

SEQ ID NO: 2986729 - protein, 19 aa, Entamoeba invadens
WEMRYSLPLCEKYKQMLTD

SEQ ID NO: 2986730 - protein, 21 aa, Entamoeba invadens
WENEFMKWLGTERIPVKTGSS

SEQ ID NO: 2986731 - protein, 18 aa, Entamoeba invadens
WENTVCELFNIGKHTLSK

SEQ ID NO: 2986732 - protein, 20 aa, Entamoeba invadens
WETWPPHVITFFKKMSSEWD

SEQ ID NO: 2986733 - protein, 17 aa, Entamoeba invadens
WFIGIKFEQIFPDMEDK

SEQ ID NO: 2986734 - protein, 18 aa, Entamoeba invadens
WFKGYDWDGLFQKKITPP

SEQ ID NO: 2986735 - protein, 21 aa, Entamoeba invadens
WFPDMPSEFLLPADLPVKPVE

SEQ ID NO: 2986736 - protein, 18 aa, Entamoeba invadens
WFPKVQLLRLMKKDVQFT

SEQ ID NO: 2986737 - protein, 17 aa, Entamoeba invadens
WFPPKVRKIRLFTNEVL

SEQ ID NO: 2986738 - protein, 19 aa, Entamoeba invadens
WFPPKVRKLRILWNEIDTV

SEQ ID NO: 2986739 - protein, 19 aa, Entamoeba invadens
WFPPKVRKMRILWNEIDSV

SEQ ID NO: 2986740 - protein, 19 aa, Entamoeba invadens
WFRELPKPILNVLSSDQIF

SEQ ID NO: 2986741 - protein, 17 aa, Entamoeba invadens
WFYRKSDLFKCYEECHN

SEQ ID NO: 2986742 - protein, 18 aa, Entamoeba invadens
WFYYQLLVKFCFENLEKI

SEQ ID NO: 2986743 - protein, 20 aa, Entamoeba invadens
WGALRLANSVALIVETTEND

SEQ ID NO: 2986744 - protein, 17 aa, Entamoeba invadens
WGGYSVLSPREFKSAIG

SEQ ID NO: 2986745 - protein, 18 aa, Entamoeba invadens
WGMPSFRAATKACDSVLD

SEQ ID NO: 2986746 - protein, 17 aa, Entamoeba invadens
WGYFPLKDDFVAAQCVD

SEQ ID NO: 2986747 - protein, 17 aa, Entamoeba invadens
WHFPELYNILSHDNAMF

SEQ ID NO: 2986748 - protein, 25 aa, Entamoeba invadens
WHLFPSLKCSFIIRYSVKIDLTRSF

SEQ ID NO: 2986749 - protein, 17 aa, Entamoeba invadens
WHPILSFVTVSERNMAF

SEQ ID NO: 2986750 - protein, 17 aa, Entamoeba invadens
WHVTMLITPEQRAYHAL

SEQ ID NO: 2986751 - protein, 19 aa, Entamoeba invadens
WIDSCPRKSAMFLMIAANQ

SEQ ID NO: 2986752 - protein, 22 aa, Entamoeba invadens
WILDCLYGVFVPVFGFFNGDDD

SEQ ID NO: 2986753 - protein, 18 aa, Entamoeba invadens
WILGWPVLLWCQFNQMIR

SEQ ID NO: 2986754 - protein, 17 aa, Entamoeba invadens
WILLKPFIQCFGIPPSF

SEQ ID NO: 2986755 - protein, 17 aa, Entamoeba invadens
WISKRMSLVLSKNREIL

SEQ ID NO: 2986756 - protein, 21 aa, Entamoeba invadens
WKDGLAFCALIHKFHPEAIDF

SEQ ID NO: 2986757 - protein, 21 aa, Entamoeba invadens
WKEALRICVELGLPKEALNCC

SEQ ID NO: 2986758 - protein, 17 aa, Entamoeba invadens
WKELVEGIITILMKGRC

SEQ ID NO: 2986759 - protein, 17 aa, Entamoeba invadens
WKERCFEAEKCIDMDEI

SEQ ID NO: 2986760 - protein, 20 aa, Entamoeba invadens
WKFLNGYVVPKLQVFSETSK

SEQ ID NO: 2986761 - protein, 17 aa, Entamoeba invadens
WKGFVGLKLTVNSAVNL

SEQ ID NO: 2986762 - protein, 18 aa, Entamoeba invadens
WKGVVPFLKLLPMKIRII

SEQ ID NO: 2986763 - protein, 19 aa, Entamoeba invadens
WKHGIIVGTEFVFAENIDT

SEQ ID NO: 2986764 - protein, 19 aa, Entamoeba invadens
WKIPLPLYRFIPFLEDMGY

SEQ ID NO: 2986765 - protein, 18 aa, Entamoeba invadens
WKKGVGMEEFYCIPCSLN

SEQ ID NO: 2986766 - protein, 17 aa, Entamoeba invadens
WKKLELVAKNDEKDKNE

SEQ ID NO: 2986767 - protein, 19 aa, Entamoeba invadens
WKKRWCVLTPTGMIFYFKD

SEQ ID NO: 2986768 - protein, 18 aa, Entamoeba invadens
WKKVEFRDSFYYTVNGLS

SEQ ID NO: 2986769 - protein, 18 aa, Entamoeba invadens
WKNPYLRIKIHKFLNLDS

SEQ ID NO: 2986770 - protein, 17 aa, Entamoeba invadens
WKNVHVVNEIVLKTEDV

SEQ ID NO: 2986771 - protein, 17 aa, Entamoeba invadens
WKQGRCVVFKAPLLKIP

SEQ ID NO: 2986772 - protein, 19 aa, Entamoeba invadens
WKRHSPVLFPIVGSLWGGK

SEQ ID NO: 2986773 - protein, 24 aa, Entamoeba invadens
WKRMPAWCDRVLFRIHNLYQLSLH

SEQ ID NO: 2986774 - protein, 22 aa, Entamoeba invadens
WKSEFISLYIRRRCYICGGVKN

SEQ ID NO: 2986775 - protein, 22 aa, Entamoeba invadens
WKSWKRRWFALNGNSLMYYKDQ

SEQ ID NO: 2986776 - protein, 18 aa, Entamoeba invadens
WKSWKRRYFDLVEDNLSY

SEQ ID NO: 2986777 - protein, 19 aa, Entamoeba invadens
WKTKQLFYHIGPIENTPRV

SEQ ID NO: 2986778 - protein, 18 aa, Entamoeba invadens
WKTTCEEIIRTIVLSQSV

SEQ ID NO: 2986779 - protein, 19 aa, Entamoeba invadens
WKVLLNFSRSMFRVLSKVM

SEQ ID NO: 2986780 - protein, 17 aa, Entamoeba invadens
WKYFCSKLEFYDKLPNN

SEQ ID NO: 2986781 - protein, 17 aa, Entamoeba invadens
WLANRVDGFFIVRLSSK

SEQ ID NO: 2986782 - protein, 21 aa, Entamoeba invadens
WLCNFKGLYGYVLITHTNAYL

SEQ ID NO: 2986783 - protein, 19 aa, Entamoeba invadens
WLDIGNHLGRICVTTPGTN

SEQ ID NO: 2986784 - protein, 17 aa, Entamoeba invadens
WLKNLVIKFMLSKLGYT

SEQ ID NO: 2986785 - protein, 22 aa, Entamoeba invadens
WLLQFVCGAALKKGGIERSIES

SEQ ID NO: 2986786 - protein, 17 aa, Entamoeba invadens
WLPSISVGLMGGTKESR

SEQ ID NO: 2986787 - protein, 23 aa, Entamoeba invadens
WLSWIMKILELMDADLIKCIGAC

SEQ ID NO: 2986788 - protein, 20 aa, Entamoeba invadens
WLTELLYPYQLVLSSIDKMM

SEQ ID NO: 2986789 - protein, 20 aa, Entamoeba invadens
WMLKCLICHEEIFDLSKKFC

SEQ ID NO: 2986790 - protein, 23 aa, Entamoeba invadens
WMNRSCGCAFGFGGKFVSYNENE

SEQ ID NO: 2986791 - protein, 20 aa, Entamoeba invadens
WNEEKRYFVQVIWQDNKKQK

SEQ ID NO: 2986792 - protein, 19 aa, Entamoeba invadens
WNKRYSALVALSLCVAPGK

SEQ ID NO: 2986793 - protein, 20 aa, Entamoeba invadens
WNMDICVSIVKNIFGEDKTN

SEQ ID NO: 2986794 - protein, 19 aa, Entamoeba invadens
WNRRWVVLKKNCLMIFKSA

SEQ ID NO: 2986795 - protein, 19 aa, Entamoeba invadens
WNSLHFEEVESLVFDTIIC

SEQ ID NO: 2986796 - protein, 19 aa, Entamoeba invadens
WNSWNGWIPAWCVNKATKT

SEQ ID NO: 2986797 - protein, 21 aa, Entamoeba invadens
WNTKCPIEIEVLLYYFNYVTF

SEQ ID NO: 2986798 - protein, 19 aa, Entamoeba invadens
  misc_feature (16)..(17): Xaa can be any naturally occurring amino acid
WNTQNCCWRLSIERTXXLS

SEQ ID NO: 2986799 - protein, 20 aa, Entamoeba invadens
WPCVAEILPQFVFNDRNPII

SEQ ID NO: 2986800 - protein, 26 aa, Entamoeba invadens
WPVSLRVGATWPLKREDIIEVPIEET

SEQ ID NO: 2986801 - protein, 20 aa, Entamoeba invadens
WQLGCVFLQMLLRSPPFKGH

SEQ ID NO: 2986802 - protein, 18 aa, Entamoeba invadens
WQLLCRAVMYSLSVLNAP

SEQ ID NO: 2986803 - protein, 22 aa, Entamoeba invadens
WQSKFLIPRTFLGKILRLLKIL

SEQ ID NO: 2986804 - protein, 19 aa, Entamoeba invadens
WRAGRCAGCNIIPATTGIG

SEQ ID NO: 2986805 - protein, 20 aa, Entamoeba invadens
WRFCLFLRKLCENIRVGRIF

SEQ ID NO: 2986806 - protein, 19 aa, Entamoeba invadens
WRIGFCKSVTASIETTSIQ

SEQ ID NO: 2986807 - protein, 19 aa, Entamoeba invadens
WRKFVICVIAWKISSSNCL

SEQ ID NO: 2986808 - protein, 23 aa, Entamoeba invadens
WRQVPEFTTYISFFLTSVPQIPE

SEQ ID NO: 2986809 - protein, 28 aa, Entamoeba invadens
WRVKCLRISINKVFKRMFPFFVSSALID

SEQ ID NO: 2986810 - protein, 19 aa, Entamoeba invadens
WRVPNVVYRCIEFMQKKNA

SEQ ID NO: 2986811 - protein, 20 aa, Entamoeba invadens
WSCLFSRWISYEIVRVKDLE

SEQ ID NO: 2986812 - protein, 17 aa, Entamoeba invadens
WSLLRTFPRDMLKRISN

SEQ ID NO: 2986813 - protein, 17 aa, Entamoeba invadens
WSTKLSNIWSESAAISK

SEQ ID NO: 2986814 - protein, 18 aa, Entamoeba invadens
WTGVGKIALWPADKPGKM

SEQ ID NO: 2986815 - protein, 26 aa, Entamoeba invadens
WTLHFSARLPFSFKYYIAYLNKVIAI

SEQ ID NO: 2986816 - protein, 18 aa, Entamoeba invadens
WTLPDMKVALSMRDMRLT

SEQ ID NO: 2986817 - protein, 17 aa, Entamoeba invadens
WTMEVKMAYNYRVLLTN

SEQ ID NO: 2986818 - protein, 20 aa, Entamoeba invadens
WTPDGCKIKEKMLFSATKAT

SEQ ID NO: 2986819 - protein, 17 aa, Entamoeba invadens
WTSFSIALWYYGFTKIQ

SEQ ID NO: 2986820 - protein, 17 aa, Entamoeba invadens
WTTLCRLAFLSIAETQE

SEQ ID NO: 2986821 - protein, 19 aa, Entamoeba invadens
WVEEEIPHIIILVTGRYST

SEQ ID NO: 2986822 - protein, 17 aa, Entamoeba invadens
WVFLLRQSFIGFYDPNE

SEQ ID NO: 2986823 - protein, 23 aa, Entamoeba invadens
WVPRLSELFPILHIEKSKTDMSP

SEQ ID NO: 2986824 - protein, 18 aa, Entamoeba invadens
WVVIGKLFGLRAVGNAQD

SEQ ID NO: 2986825 - protein, 18 aa, Entamoeba invadens
WVWPANNWCLLQFGFCGD

SEQ ID NO: 2986826 - protein, 17 aa, Entamoeba invadens
WWYGRKGNSFGYFPGEY

SEQ ID NO: 2986827 - protein, 34 aa, Entamoeba invadens
WYCLPRLIFISLRWKLEMWDCIKEVIIYCTKHIG

SEQ ID NO: 2986828 - protein, 20 aa, Entamoeba invadens
WYDPRFPTIQGLLRRGLTLE

SEQ ID NO: 2986829 - protein, 22 aa, Entamoeba invadens
WYHKEIFDLWGYSDKRGDEMKE

SEQ ID NO: 2986830 - protein, 21 aa, Entamoeba invadens
WYQFRNWVWFRLLQKVQPTLK

SEQ ID NO: 2986831 - protein, 18 aa, Entamoeba invadens
YADGEIKSAHILDPNVTL

SEQ ID NO: 2986832 - protein, 21 aa, Entamoeba invadens
YADRIPLHFFVLMERMKERMN

SEQ ID NO: 2986833 - protein, 29 aa, Entamoeba invadens
YAKLFLRFIRRLLCSKANYIFKENIEFGF

SEQ ID NO: 2986834 - protein, 18 aa, Entamoeba invadens
YAKSLLCSPTLATSGLSM

SEQ ID NO: 2986835 - protein, 21 aa, Entamoeba invadens
YALSIATVWLFCYEMELNDIP

SEQ ID NO: 2986836 - protein, 17 aa, Entamoeba invadens
YAMKLKLYIPFVLLKDK

SEQ ID NO: 2986837 - protein, 20 aa, Entamoeba invadens
YAQSVSLLWVKYDVMGDSVT

SEQ ID NO: 2986838 - protein, 24 aa, Entamoeba invadens
YAWWKGRLSQMAQYFNAYRIDHIL

SEQ ID NO: 2986839 - protein, 24 aa, Entamoeba invadens
YAWWKGRLSQMAQYFSAYRIDHIL

SEQ ID NO: 2986840 - protein, 18 aa, Entamoeba invadens
YCCYKCAKLDFVGLPMYL

SEQ ID NO: 2986841 - protein, 21 aa, Entamoeba invadens
YCDLCGCPLFIQIDLLDSQLQ

SEQ ID NO: 2986842 - protein, 17 aa, Entamoeba invadens
YCFFNCFAIEEVVIPKG

SEQ ID NO: 2986843 - protein, 18 aa, Entamoeba invadens
YCFRDCLALKEFSIPNGV

SEQ ID NO: 2986844 - protein, 26 aa, Entamoeba invadens
YCGFHLKYFEACLVEFTWAGVYSPSY

SEQ ID NO: 2986845 - protein, 17 aa, Entamoeba invadens
YCIAVGCADLIGQAISI

SEQ ID NO: 2986846 - protein, 17 aa, Entamoeba invadens
YCIDCAKLIKSSTLFEM

SEQ ID NO: 2986847 - protein, 24 aa, Entamoeba invadens
YCKCLYFGIKPVFVFDGNTNTFLK

SEQ ID NO: 2986848 - protein, 27 aa, Entamoeba invadens
YCKEQRTKIVLTFLCLKELRSKDFYEL

SEQ ID NO: 2986849 - protein, 26 aa, Entamoeba invadens
YCKKTWKCQVCSHVGQLAQMGLVKRR

SEQ ID NO: 2986850 - protein, 20 aa, Entamoeba invadens
YCKNEMRRSFEFITSELRRE

SEQ ID NO: 2986851 - protein, 20 aa, Entamoeba invadens
YCLYVYLTFFIMKDTHFEDN

SEQ ID NO: 2986852 - protein, 20 aa, Entamoeba invadens
YCMPEEAFLLPAFPQKPFVF

SEQ ID NO: 2986853 - protein, 20 aa, Entamoeba invadens
YCMSMKLCFGFPKYVIDEVV

SEQ ID NO: 2986854 - protein, 19 aa, Entamoeba invadens
YCPFLSNIELRMCTQITDN

SEQ ID NO: 2986855 - protein, 23 aa, Entamoeba invadens
YCPFLSQIELRMCTSITDNGVNI

SEQ ID NO: 2986856 - protein, 19 aa, Entamoeba invadens
YCQSLCLLSKMFLDHKTLY

SEQ ID NO: 2986857 - protein, 22 aa, Entamoeba invadens
YCSCGRFGFLISRPTDLTDQYI

SEQ ID NO: 2986858 - protein, 17 aa, Entamoeba invadens
YCVCCIPMPCPPGCCDG

SEQ ID NO: 2986859 - protein, 17 aa, Entamoeba invadens
YCVCYNCPNLRTVTLPD

SEQ ID NO: 2986860 - protein, 21 aa, Entamoeba invadens
YCVLDSPKIDDCPAFVISTSD

SEQ ID NO: 2986861 - protein, 17 aa, Entamoeba invadens
YDEACCFVLNTMKDMIL

SEQ ID NO: 2986862 - protein, 17 aa, Entamoeba invadens
YDFCDVFLEASKPTFRG

SEQ ID NO: 2986863 - protein, 20 aa, Entamoeba invadens
YDGVVTWYKKAVVLIHPDKN

SEQ ID NO: 2986864 - protein, 24 aa, Entamoeba invadens
YDIIKRYSLGNSFIFVPKNDDNTF

SEQ ID NO: 2986865 - protein, 22 aa, Entamoeba invadens
YDKATCFLICFSLINLDHFHSV

SEQ ID NO: 2986866 - protein, 24 aa, Entamoeba invadens
YDKCCELFCAFPICAVISTKKYKY

SEQ ID NO: 2986867 - protein, 24 aa, Entamoeba invadens
YDKELRLGFVLISFYDLRVSKKMF

SEQ ID NO: 2986868 - protein, 20 aa, Entamoeba invadens
YDLYRSFSLYFFKDKTLDKF

SEQ ID NO: 2986869 - protein, 19 aa, Entamoeba invadens
YDPECDIWSLGVITYVLLS

SEQ ID NO: 2986870 - protein, 19 aa, Entamoeba invadens
YDSVPSCKLDFVLRLLKSI

SEQ ID NO: 2986871 - protein, 24 aa, Entamoeba invadens
YDTFSFIGGLVFPVPADHLLLQQR

SEQ ID NO: 2986872 - protein, 20 aa, Entamoeba invadens
  misc_feature (16)..(17): Xaa can be any naturally occurring amino acid
YDTSGGVGFVFSWVSXXTTK

SEQ ID NO: 2986873 - protein, 17 aa, Entamoeba invadens
YDTSGGVGFVFSWVSYL

SEQ ID NO: 2986874 - protein, 19 aa, Entamoeba invadens
YECRLCLTIHVSEANYLAH

SEQ ID NO: 2986875 - protein, 18 aa, Entamoeba invadens
YEEISLLFSRNFYDVKST

SEQ ID NO: 2986876 - protein, 23 aa, Entamoeba invadens
YEELKRTIEISAIFFDWDSEYQK

SEQ ID NO: 2986877 - protein, 23 aa, Entamoeba invadens
YEELKVVCEVFKEVLTYKEFCRS

SEQ ID NO: 2986878 - protein, 24 aa, Entamoeba invadens
YEELLVKLLDGWLCIFSSELFLAK

SEQ ID NO: 2986879 - protein, 21 aa, Entamoeba invadens
YEIEAPLKLCVEFSHKQLRDE

SEQ ID NO: 2986880 - protein, 19 aa, Entamoeba invadens
YEIFQRFLIKKEKKEEKLI

SEQ ID NO: 2986881 - protein, 17 aa, Entamoeba invadens
YEIPEYVDVQGITMNYD

SEQ ID NO: 2986882 - protein, 18 aa, Entamoeba invadens
YEKGINWSSSLLYTEELG

SEQ ID NO: 2986883 - protein, 17 aa, Entamoeba invadens
YEKRYEIFAAFGDHKKM

SEQ ID NO: 2986884 - protein, 20 aa, Entamoeba invadens
YELFMKALLKHSWNNYEELN

SEQ ID NO: 2986885 - protein, 19 aa, Entamoeba invadens
YEMSALKCDGVFYVIDDVT

SEQ ID NO: 2986886 - protein, 19 aa, Entamoeba invadens
YEMSVLCPQCLVHGLIHLI

SEQ ID NO: 2986887 - protein, 19 aa, Entamoeba invadens
YEPKCRVMLVGTKTDCRND

SEQ ID NO: 2986888 - protein, 18 aa, Entamoeba invadens
YETFAWRAAYSKEKFKFE

SEQ ID NO: 2986889 - protein, 17 aa, Entamoeba invadens
YEVIQDFLYRSLKNSLE

SEQ ID NO: 2986890 - protein, 17 aa, Entamoeba invadens
YEVMGWGEAYSVDIFRF

SEQ ID NO: 2986891 - protein, 18 aa, Entamoeba invadens
YEVYRADLIVPMSINEIA

SEQ ID NO: 2986892 - protein, 20 aa, Entamoeba invadens
YFADGCVYQLFVLVAKGMLK

SEQ ID NO: 2986893 - protein, 21 aa, Entamoeba invadens
YFALQGICINDGYIFIEQAEF

SEQ ID NO: 2986894 - protein, 19 aa, Entamoeba invadens
YFANFTCSVWGYKFYLSHG

SEQ ID NO: 2986895 - protein, 18 aa, Entamoeba invadens
YFCTLCLLNHPDFDREKL

SEQ ID NO: 2986896 - protein, 17 aa, Entamoeba invadens
YFDSIVFENELFNENRL

SEQ ID NO: 2986897 - protein, 18 aa, Entamoeba invadens
YFFFKELQKIGGETNYEV

SEQ ID NO: 2986898 - protein, 19 aa, Entamoeba invadens
YFFKNCVSLTLDNINGFNQ

SEQ ID NO: 2986899 - protein, 17 aa, Entamoeba invadens
YFGLCAIVFAFHKIGDF

SEQ ID NO: 2986900 - protein, 17 aa, Entamoeba invadens
YFIIPALMSQQPRLMKL

SEQ ID NO: 2986901 - protein, 18 aa, Entamoeba invadens
YFIKEGFLTKQCRKVPKP

SEQ ID NO: 2986902 - protein, 18 aa, Entamoeba invadens
YFIPRLTFIKALSPSTFI

SEQ ID NO: 2986903 - protein, 18 aa, Entamoeba invadens
YFIRVAFKLEKQRMFNSS

SEQ ID NO: 2986904 - protein, 19 aa, Entamoeba invadens
YFKGLQLKFFFSILDGEMM

SEQ ID NO: 2986905 - protein, 22 aa, Entamoeba invadens
YFKKCMLRNLRLHYTDDQLIEI

SEQ ID NO: 2986906 - protein, 29 aa, Entamoeba invadens
YFKRCGVDYSFCFRWIVLLFKRDFETKLC

SEQ ID NO: 2986907 - protein, 24 aa, Entamoeba invadens
YFLEACCIFAQYVLMLQEEPEKAK

SEQ ID NO: 2986908 - protein, 17 aa, Entamoeba invadens
YFLLKLPFNYLFDYLAV

SEQ ID NO: 2986909 - protein, 18 aa, Entamoeba invadens
YFLPEFLALTGLSEKMEK

SEQ ID NO: 2986910 - protein, 18 aa, Entamoeba invadens
YFMKFGGIFSCKVVPEKK

SEQ ID NO: 2986911 - protein, 21 aa, Entamoeba invadens
YFRFLWELRMTFSRDLTQLEG

SEQ ID NO: 2986912 - protein, 18 aa, Entamoeba invadens
YFRPCLTGNISNVDKACE

SEQ ID NO: 2986913 - protein, 19 aa, Entamoeba invadens
YFTFCDLFDTFPLAALVTR

SEQ ID NO: 2986914 - protein, 22 aa, Entamoeba invadens
YFVKLLVCFYELKGKRESEVSE

SEQ ID NO: 2986915 - protein, 18 aa, Entamoeba invadens
YFVKSCLFTQELVSTQYF

SEQ ID NO: 2986916 - protein, 21 aa, Entamoeba invadens
YFVYNCIDLLFSKLSKSLETV

SEQ ID NO: 2986917 - protein, 18 aa, Entamoeba invadens
YFYPWALKTLDIMVKNLS

SEQ ID NO: 2986918 - protein, 17 aa, Entamoeba invadens
YGDSIPHHIKRVDSQCF

SEQ ID NO: 2986919 - protein, 21 aa, Entamoeba invadens
YGDSRLGYYIVMDLQGIDLST

SEQ ID NO: 2986920 - protein, 18 aa, Entamoeba invadens
YGEHQCKFIFALKKLSLT

SEQ ID NO: 2986921 - protein, 17 aa, Entamoeba invadens
YGGGIWNTWFDRDLGVS

SEQ ID NO: 2986922 - protein, 19 aa, Entamoeba invadens
YGGLLCIFDQFLVSGIRSI

SEQ ID NO: 2986923 - protein, 17 aa, Entamoeba invadens
YGISFSFPFLQSKPLSF

SEQ ID NO: 2986924 - protein, 17 aa, Entamoeba invadens
YGLECLLLLAALKLRFP

SEQ ID NO: 2986925 - protein, 17 aa, Entamoeba invadens
YGLYRLDVLSGKSTVVF

SEQ ID NO: 2986926 - protein, 23 aa, Entamoeba invadens
YGPCQFPVLFSCYKDFTNDANAI

SEQ ID NO: 2986927 - protein, 23 aa, Entamoeba invadens
YGPCQFPVLFSCYKDFTNDATST

SEQ ID NO: 2986928 - protein, 21 aa, Entamoeba invadens
YGQLFDCFKKVFNKKDESDDK

SEQ ID NO: 2986929 - protein, 18 aa, Entamoeba invadens
YGTVCLRSASIIETNAKQ

SEQ ID NO: 2986930 - protein, 18 aa, Entamoeba invadens
YGTVELVTILAKRPNYIT

SEQ ID NO: 2986931 - protein, 17 aa, Entamoeba invadens
YGVVVPLVLMNSFSTQV

SEQ ID NO: 2986932 - protein, 17 aa, Entamoeba invadens
YHGIRVWDCENLESFTE

SEQ ID NO: 2986933 - protein, 17 aa, Entamoeba invadens
YHILKMFHFLFEVGYAT

SEQ ID NO: 2986934 - protein, 27 aa, Entamoeba invadens
YHKHCLKFGKAFARFQQCLTKEPFKKM

SEQ ID NO: 2986935 - protein, 23 aa, Entamoeba invadens
YHLLEDFLFMFGIVIVGGKDERD

SEQ ID NO: 2986936 - protein, 18 aa, Entamoeba invadens
YHLRLCLCPLCKHGMEVF

SEQ ID NO: 2986937 - protein, 17 aa, Entamoeba invadens
YHRLSVSNLNEFPCETI

SEQ ID NO: 2986938 - protein, 18 aa, Entamoeba invadens
YHSAPVKRISCIKPTLPK

SEQ ID NO: 2986939 - protein, 17 aa, Entamoeba invadens
YHTCAVLSCLEQQSPDI

SEQ ID NO: 2986940 - protein, 19 aa, Entamoeba invadens
YHWQYPLGEFVRYCIQNDI

SEQ ID NO: 2986941 - protein, 18 aa, Entamoeba invadens
YIARRLIRFSSEDIGLAD

SEQ ID NO: 2986942 - protein, 17 aa, Entamoeba invadens
YICKVIFYCLSYIHKDN

SEQ ID NO: 2986943 - protein, 18 aa, Entamoeba invadens
YICRGAVRLFEFAGKKDA

SEQ ID NO: 2986944 - protein, 17 aa, Entamoeba invadens
YIEIFYRGLGVSLIETQ

SEQ ID NO: 2986945 - protein, 19 aa, Entamoeba invadens
YIGSCCFKGCISLTTLQVA

SEQ ID NO: 2986946 - protein, 17 aa, Entamoeba invadens
YIHAKIDVIGAWVDDQN

SEQ ID NO: 2986947 - protein, 17 aa, Entamoeba invadens
YIHSCVNYLVSQCGYTF

SEQ ID NO: 2986948 - protein, 18 aa, Entamoeba invadens
YIIELEFPKGCQDLLKNL

SEQ ID NO: 2986949 - protein, 17 aa, Entamoeba invadens
YIKSSGVLLMLLKELEC

SEQ ID NO: 2986950 - protein, 27 aa, Entamoeba invadens
YIMYRYRLNDVPVRIIDFSRWFRFVLK

SEQ ID NO: 2986951 - protein, 18 aa, Entamoeba invadens
YINECIKLAKERALKIHL

SEQ ID NO: 2986952 - protein, 20 aa, Entamoeba invadens
YINIEFIPFLIASIQQQSVQ

SEQ ID NO: 2986953 - protein, 21 aa, Entamoeba invadens
YIQYILCIMWFKTVTPQDRVF

SEQ ID NO: 2986954 - protein, 19 aa, Entamoeba invadens
YIRVFYKGVDFSFCLQHHC

SEQ ID NO: 2986955 - protein, 17 aa, Entamoeba invadens
YISPRAFLSCLSLSKID

SEQ ID NO: 2986956 - protein, 21 aa, Entamoeba invadens
YIYRSSLRSGDFLEFLKNAYK

SEQ ID NO: 2986957 - protein, 20 aa, Entamoeba invadens
YKAFIFVGPVWSWDLCAPLK

SEQ ID NO: 2986958 - protein, 17 aa, Entamoeba invadens
YKALRIINEDKRKLLEN

SEQ ID NO: 2986959 - protein, 17 aa, Entamoeba invadens
YKANVEFIRSLKEDIPD

SEQ ID NO: 2986960 - protein, 19 aa, Entamoeba invadens
YKARIQFCKDVMEKTENRI

SEQ ID NO: 2986961 - protein, 21 aa, Entamoeba invadens
YKCDVSYVWFKAVKEIGDFCF

SEQ ID NO: 2986962 - protein, 18 aa, Entamoeba invadens
YKDLEALFTFGAELIPVK

SEQ ID NO: 2986963 - protein, 19 aa, Entamoeba invadens
YKDLKVHVLFSVYSHQMYI

SEQ ID NO: 2986964 - protein, 23 aa, Entamoeba invadens
YKERIKGKMFDWVENIAKSDYKQ

SEQ ID NO: 2986965 - protein, 21 aa, Entamoeba invadens
YKESGVCLGRIRSKYLAKKCI

SEQ ID NO: 2986966 - protein, 20 aa, Entamoeba invadens
YKFEVSYTFYLQMKNIHINC

SEQ ID NO: 2986967 - protein, 19 aa, Entamoeba invadens
YKGGLLLPFRSELYIECNS

SEQ ID NO: 2986968 - protein, 22 aa, Entamoeba invadens
YKGGPCYKCLYPTMPAASLNAT

SEQ ID NO: 2986969 - protein, 25 aa, Entamoeba invadens
YKIEILETFPAYYYRAVYYGKNDCN

SEQ ID NO: 2986970 - protein, 18 aa, Entamoeba invadens
YKIIDTLIQFVCKTVALK

SEQ ID NO: 2986971 - protein, 17 aa, Entamoeba invadens
YKIIVWFNVDFETVDQN

SEQ ID NO: 2986972 - protein, 17 aa, Entamoeba invadens
YKIIVWFNVNFETVDQN

SEQ ID NO: 2986973 - protein, 22 aa, Entamoeba invadens
YKIKFKVIRAISGLALGVGYQN

SEQ ID NO: 2986974 - protein, 18 aa, Entamoeba invadens
YKIPEWFLKMLTITSKQD

SEQ ID NO: 2986975 - protein, 17 aa, Entamoeba invadens
YKIPSLFVLPSTFLTVL

SEQ ID NO: 2986976 - protein, 20 aa, Entamoeba invadens
YKISVNYIITFFKLADTDIL

SEQ ID NO: 2986977 - protein, 17 aa, Entamoeba invadens
YKKATGKVCKVVITEES

SEQ ID NO: 2986978 - protein, 21 aa, Entamoeba invadens
YKKDIAEIIVRAETLEKNIQM

SEQ ID NO: 2986979 - protein, 26 aa, Entamoeba invadens
YKKDYCAFCDVFIPPSLVGPFWVGIY

SEQ ID NO: 2986980 - protein, 17 aa, Entamoeba invadens
YKKIELFGSVQTEGTKL

SEQ ID NO: 2986981 - protein, 22 aa, Entamoeba invadens
YKKMKFGVCLNKIQLVLTNENK

SEQ ID NO: 2986982 - protein, 17 aa, Entamoeba invadens
YKKRSAPTFILDDKLVS

SEQ ID NO: 2986983 - protein, 21 aa, Entamoeba invadens
YKKRWKGEWSLYIYQSGNEVN

SEQ ID NO: 2986984 - protein, 19 aa, Entamoeba invadens
YKKTLKWLSERGLITIRRG

SEQ ID NO: 2986985 - protein, 18 aa, Entamoeba invadens
YKLCGSSITVKWTVTNPS

SEQ ID NO: 2986986 - protein, 17 aa, Entamoeba invadens
YKLDKFLFFGALTTGML

SEQ ID NO: 2986987 - protein, 23 aa, Entamoeba invadens
YKLKLCFCPFCQVGIKALGLDKP

SEQ ID NO: 2986988 - protein, 19 aa, Entamoeba invadens
YKLKLPRLSKIFLTSDDYS

SEQ ID NO: 2986989 - protein, 20 aa, Entamoeba invadens
YKLLCTINYLLRVKKNFQFT

SEQ ID NO: 2986990 - protein, 18 aa, Entamoeba invadens
YKLLLPKDMAVLRVGPEA

SEQ ID NO: 2986991 - protein, 18 aa, Entamoeba invadens
YKLLNEFLRRIHPIVRKS

SEQ ID NO: 2986992 - protein, 17 aa, Entamoeba invadens
YKMRISNEVFLKIDHIK

SEQ ID NO: 2986993 - protein, 24 aa, Entamoeba invadens
YKMTRSAICPLELDNTIIDVKNGI

SEQ ID NO: 2986994 - protein, 19 aa, Entamoeba invadens
YKNHLFKIYAFIPTNLQLK

SEQ ID NO: 2986995 - protein, 18 aa, Entamoeba invadens
YKNLPLKYVIHGTESTPE

SEQ ID NO: 2986996 - protein, 20 aa, Entamoeba invadens
YKNRCFKCSNGCLKCVKEGC

SEQ ID NO: 2986997 - protein, 20 aa, Entamoeba invadens
YKNVCYEVMRFCFVTRDEKM

SEQ ID NO: 2986998 - protein, 17 aa, Entamoeba invadens
YKNWFVCDFEELKNPQA

SEQ ID NO: 2986999 - protein, 17 aa, Entamoeba invadens
YKPLEVYFFTEFSENKT

SEQ ID NO: 2987000 - protein, 20 aa, Entamoeba invadens
YKQHFEVLKTIFSLPMKLAE

SEQ ID NO: 2987001 - protein, 17 aa, Entamoeba invadens
YKRFWLEKIDCSNWCQF

SEQ ID NO: 2987002 - protein, 19 aa, Entamoeba invadens
YKRSGVVGVNIGKIKRMFV

SEQ ID NO: 2987003 - protein, 21 aa, Entamoeba invadens
YKRTPICIIVYFFVYCYSVNT

SEQ ID NO: 2987004 - protein, 18 aa, Entamoeba invadens
YKSFIFIGPVWWWGINGP

SEQ ID NO: 2987005 - protein, 20 aa, Entamoeba invadens
YKTECMYCAKSIETKLLDTL

SEQ ID NO: 2987006 - protein, 17 aa, Entamoeba invadens
YKTGFSITAKVCNNSGC

SEQ ID NO: 2987007 - protein, 19 aa, Entamoeba invadens
YKTSWLFNALNACQTVPEG

SEQ ID NO: 2987008 - protein, 21 aa, Entamoeba invadens
YKWDEMMALDAFDLFVQNGLF

SEQ ID NO: 2987009 - protein, 18 aa, Entamoeba invadens
YKWISCAKFEVLYDSERP

SEQ ID NO: 2987010 - protein, 17 aa, Entamoeba invadens
YKYCRFCEGEPYETKVC

SEQ ID NO: 2987011 - protein, 24 aa, Entamoeba invadens
YKYEDGYFYWVYKNYVVFKTLNKQ

SEQ ID NO: 2987012 - protein, 23 aa, Entamoeba invadens
YKYKDLKAVVALFRQLDTQKQEL

SEQ ID NO: 2987013 - protein, 17 aa, Entamoeba invadens
YKYLDFLAVDGVFMYLN

SEQ ID NO: 2987014 - protein, 18 aa, Entamoeba invadens
YLACVIPYLGHWKDLLHF

SEQ ID NO: 2987015 - protein, 17 aa, Entamoeba invadens
YLALLNFERIKVIFKVI

SEQ ID NO: 2987016 - protein, 20 aa, Entamoeba invadens
YLAPEVLVGFGYSAQVDWWT

SEQ ID NO: 2987017 - protein, 26 aa, Entamoeba invadens
YLATFLKRRVEAFLKGKRQFVVKDKE

SEQ ID NO: 2987018 - protein, 18 aa, Entamoeba invadens
YLATLGFDKLNIPKQDYD

SEQ ID NO: 2987019 - protein, 19 aa, Entamoeba invadens
YLCNELLCLLTRGGFKVKE

SEQ ID NO: 2987020 - protein, 26 aa, Entamoeba invadens
YLEALRKCGCCPKCLAEAEKQQKKLK

SEQ ID NO: 2987021 - protein, 26 aa, Entamoeba invadens
YLERRKEVWIAPLFFEFPGYEQVMFK

SEQ ID NO: 2987022 - protein, 17 aa, Entamoeba invadens
YLFDFCEQLGFVFDSKR

SEQ ID NO: 2987023 - protein, 18 aa, Entamoeba invadens
YLFDKGLDKEGLFRLSST

SEQ ID NO: 2987024 - protein, 18 aa, Entamoeba invadens
YLFFWRYVIRMCNVERPI

SEQ ID NO: 2987025 - protein, 17 aa, Entamoeba invadens
YLFLESLLDLGSFERKA

SEQ ID NO: 2987026 - protein, 19 aa, Entamoeba invadens
YLFRLRKFISLSYMLYIEN

SEQ ID NO: 2987027 - protein, 17 aa, Entamoeba invadens
YLFRRVYKFIPINQRKR

SEQ ID NO: 2987028 - protein, 18 aa, Entamoeba invadens
YLGGCCFNCCESLVEVGL

SEQ ID NO: 2987029 - protein, 18 aa, Entamoeba invadens
YLICLTLVLPLPKEKISE

SEQ ID NO: 2987030 - protein, 19 aa, Entamoeba invadens
YLIKKECKDQAFWLGKASR

SEQ ID NO: 2987031 - protein, 17 aa, Entamoeba invadens
YLKCGVLEYTVRNYNEG

SEQ ID NO: 2987032 - protein, 25 aa, Entamoeba invadens
YLLDNCPAMERFLIAKEMVNFGDID

SEQ ID NO: 2987033 - protein, 17 aa, Entamoeba invadens
YLLGELLHLAGVLFPTK

SEQ ID NO: 2987034 - protein, 23 aa, Entamoeba invadens
YLLKIGTRVPICYQDQMYYKKMY

SEQ ID NO: 2987035 - protein, 17 aa, Entamoeba invadens
YLLKVVMKFLTKEDLLT

SEQ ID NO: 2987036 - protein, 21 aa, Entamoeba invadens
YLLRRWKERFVVVKNTFLFYF

SEQ ID NO: 2987037 - protein, 19 aa, Entamoeba invadens
YLMYFCVSMLLSVKEEIMS

SEQ ID NO: 2987038 - protein, 17 aa, Entamoeba invadens
YLNGVSIDFQQHVFNGT

SEQ ID NO: 2987039 - protein, 25 aa, Entamoeba invadens
YLPFFKCYFFYISHYDSVNKLLSKY

SEQ ID NO: 2987040 - protein, 18 aa, Entamoeba invadens
YLQNMIKQYFQFYYDDDT

SEQ ID NO: 2987041 - protein, 20 aa, Entamoeba invadens
YLQRMNMLPSRRFKRKVKPM

SEQ ID NO: 2987042 - protein, 17 aa, Entamoeba invadens
YLRPRLSSMHTMTCFMT

SEQ ID NO: 2987043 - protein, 27 aa, Entamoeba invadens
YLSSDLRLVLKIKPAIFPMEYPSSEES

SEQ ID NO: 2987044 - protein, 18 aa, Entamoeba invadens
YLTKGRPDVVFSFKEGNV

SEQ ID NO: 2987045 - protein, 18 aa, Entamoeba invadens
YMIDAGIVGCSWVKAPPK

SEQ ID NO: 2987046 - protein, 31 aa, Entamoeba invadens
YMIKEVYGVRVPIIYRQGCYELLNKHFCQMG

SEQ ID NO: 2987047 - protein, 17 aa, Entamoeba invadens
YMLEYFMLWFSRCFPLE

SEQ ID NO: 2987048 - protein, 18 aa, Entamoeba invadens
YNEFHVFESLFTLLENYL

SEQ ID NO: 2987049 - protein, 19 aa, Entamoeba invadens
YNEFLKRYFFLGTNINKKS

SEQ ID NO: 2987050 - protein, 17 aa, Entamoeba invadens
YNEVRFSNFNVHTIRSC

SEQ ID NO: 2987051 - protein, 19 aa, Entamoeba invadens
YNGWCWCGNAAYVDFINPK

SEQ ID NO: 2987052 - protein, 17 aa, Entamoeba invadens
YNKTHFIFTSWYDEKRT

SEQ ID NO: 2987053 - protein, 19 aa, Entamoeba invadens
YNLFCLLKSPILKMEKNYI

SEQ ID NO: 2987054 - protein, 18 aa, Entamoeba invadens
YNLLWWKGLVYVIDVGQA

SEQ ID NO: 2987055 - protein, 17 aa, Entamoeba invadens
YNLNKLRIMHGVVVDII

SEQ ID NO: 2987056 - protein, 20 aa, Entamoeba invadens
YNLQCIFCIYHFNRKSTQDK

SEQ ID NO: 2987057 - protein, 20 aa, Entamoeba invadens
YNLTFLIAHGLMFGPSQTVV

SEQ ID NO: 2987058 - protein, 17 aa, Entamoeba invadens
YNMGSLYVYHGQKEDAI

SEQ ID NO: 2987059 - protein, 17 aa, Entamoeba invadens
YNRHVCIVFELLGKSLY

SEQ ID NO: 2987060 - protein, 17 aa, Entamoeba invadens
YNRIVMVKLGIRIERTY

SEQ ID NO: 2987061 - protein, 18 aa, Entamoeba invadens
YPAVVGLLFELLDRLEKM

SEQ ID NO: 2987062 - protein, 17 aa, Entamoeba invadens
YPDSFCVKFIILMMYVY

SEQ ID NO: 2987063 - protein, 18 aa, Entamoeba invadens
YPEFFPFQINSKGTDEPT

SEQ ID NO: 2987064 - protein, 17 aa, Entamoeba invadens
YPELLGILLDLASNERT

SEQ ID NO: 2987065 - protein, 17 aa, Entamoeba invadens
YPFCRPTPLTLPKHNYN

SEQ ID NO: 2987066 - protein, 19 aa, Entamoeba invadens
YPGCNCFLMCFSLISQGSL

SEQ ID NO: 2987067 - protein, 20 aa, Entamoeba invadens
YPGTHCFLICFSIISRASFE

SEQ ID NO: 2987068 - protein, 22 aa, Entamoeba invadens
YPIDVLKCLPVFKIKRVPYGEI

SEQ ID NO: 2987069 - protein, 17 aa, Entamoeba invadens
YPIKRGIIIDFDLMDSI

SEQ ID NO: 2987070 - protein, 17 aa, Entamoeba invadens
YPITCPLVLLDNVIPTF

SEQ ID NO: 2987071 - protein, 20 aa, Entamoeba invadens
YPKNNCKTALFVKKTEYGNG

SEQ ID NO: 2987072 - protein, 18 aa, Entamoeba invadens
YPNALAFVFCYSITSSAS

SEQ ID NO: 2987073 - protein, 18 aa, Entamoeba invadens
YPNCINILIIRIEQFIDS

SEQ ID NO: 2987074 - protein, 18 aa, Entamoeba invadens
YPPMPDICGMDYSQQMQF

SEQ ID NO: 2987075 - protein, 23 aa, Entamoeba invadens
YPQSLPCYFQAPTLAMPNRLETP

SEQ ID NO: 2987076 - protein, 18 aa, Entamoeba invadens
YPVCEIINAVLSYLNGTN

SEQ ID NO: 2987077 - protein, 19 aa, Entamoeba invadens
YPVCTKSIFEGILITLKYF

SEQ ID NO: 2987078 - protein, 17 aa, Entamoeba invadens
YPVTCKSAFRRSAETGA

SEQ ID NO: 2987079 - protein, 19 aa, Entamoeba invadens
YPYKRPADYFAEMFKDDSH

SEQ ID NO: 2987080 - protein, 19 aa, Entamoeba invadens
YQCFYCYIRLESVTMTSNL

SEQ ID NO: 2987081 - protein, 19 aa, Entamoeba invadens
YQFRNWVWFRLFQKVRPTL

SEQ ID NO: 2987082 - protein, 18 aa, Entamoeba invadens
YQICTILLEYLCRDYRII

SEQ ID NO: 2987083 - protein, 25 aa, Entamoeba invadens
YQIRPSEFFGQAWAKVKYRYKAQHI

SEQ ID NO: 2987084 - protein, 17 aa, Entamoeba invadens
YQKIHLMTSKNFAMILG

SEQ ID NO: 2987085 - protein, 30 aa, Entamoeba invadens
YQLDCPRVFPSENYFGASIPKCQYTAFIAK

SEQ ID NO: 2987086 - protein, 25 aa, Entamoeba invadens
YQLMYKFRLGNCSVRMVDFTKWVKG

SEQ ID NO: 2987087 - protein, 18 aa, Entamoeba invadens
YQRGWKYNKDEFIIMNKS

SEQ ID NO: 2987088 - protein, 17 aa, Entamoeba invadens
YQRMGYLDMYPRIIFSN

SEQ ID NO: 2987089 - protein, 18 aa, Entamoeba invadens
YQSIPAMLFRNCLGAVVV

SEQ ID NO: 2987090 - protein, 18 aa, Entamoeba invadens
YQWAITLLNHVVFKNPKN

SEQ ID NO: 2987091 - protein, 18 aa, Entamoeba invadens
YQWAITLLNHVVFKNPRN

SEQ ID NO: 2987092 - protein, 17 aa, Entamoeba invadens
YQYSSPYLMIWIDMNEP

SEQ ID NO: 2987093 - protein, 18 aa, Entamoeba invadens
YRFQGGYYCMVNRADGKA

SEQ ID NO: 2987094 - protein, 19 aa, Entamoeba invadens
YRGIRFASKFTFTIEKNTW

SEQ ID NO: 2987095 - protein, 21 aa, Entamoeba invadens
YRIDHILGFFRIWSIPAQHRT

SEQ ID NO: 2987096 - protein, 19 aa, Entamoeba invadens
YRIGQCLFGVLAGDQHTVN

SEQ ID NO: 2987097 - protein, 17 aa, Entamoeba invadens
YRIVPMLLTVVVVPSIF

SEQ ID NO: 2987098 - protein, 17 aa, Entamoeba invadens
YRKIEMEKMRQKVSFLE

SEQ ID NO: 2987099 - protein, 23 aa, Entamoeba invadens
YRKKEMTFRLSVNNNYLKSTDSA

SEQ ID NO: 2987100 - protein, 25 aa, Entamoeba invadens
YRKVVMKRLVTWDGCELNEYISGVE

SEQ ID NO: 2987101 - protein, 20 aa, Entamoeba invadens
YRLEVLIGKVPLWCRGNPTP

SEQ ID NO: 2987102 - protein, 20 aa, Entamoeba invadens
YRLKDSISMLHRVLKKYGTD

SEQ ID NO: 2987103 - protein, 21 aa, Entamoeba invadens
YRLKLCFCPLCSHGFAAFGPT

SEQ ID NO: 2987104 - protein, 18 aa, Entamoeba invadens
YRLSKLVFFGLYFGIFTE

SEQ ID NO: 2987105 - protein, 18 aa, Entamoeba invadens
YRMKACGEHDGYVRKESE

SEQ ID NO: 2987106 - protein, 19 aa, Entamoeba invadens
YRNRMDFTFGDRMKGGELE

SEQ ID NO: 2987107 - protein, 18 aa, Entamoeba invadens
YRRSRRLICFDMDSTLIE

SEQ ID NO: 2987108 - protein, 20 aa, Entamoeba invadens
YRSNGIVPMIRPNMRNSAYG

SEQ ID NO: 2987109 - protein, 19 aa, Entamoeba invadens
YRVECCLKRVSEDFELFSP

SEQ ID NO: 2987110 - protein, 19 aa, Entamoeba invadens
YRYEDVNALCFQKEQISDE

SEQ ID NO: 2987111 - protein, 17 aa, Entamoeba invadens
YRYIECSALSQVNLENV

SEQ ID NO: 2987112 - protein, 17 aa, Entamoeba invadens
YRYKYKVIQQIRMCKDL

SEQ ID NO: 2987113 - protein, 18 aa, Entamoeba invadens
YSAFGDVCFWLDVHSPTF

SEQ ID NO: 2987114 - protein, 19 aa, Entamoeba invadens
YSALIFVGPVWCWDLCAPL

SEQ ID NO: 2987115 - protein, 18 aa, Entamoeba invadens
YSCFALGTTHGFSVYGID

SEQ ID NO: 2987116 - protein, 18 aa, Entamoeba invadens
YSCFALGTTRGFCVFGIE

SEQ ID NO: 2987117 - protein, 18 aa, Entamoeba invadens
YSELEVMKAGGNAQFALY

SEQ ID NO: 2987118 - protein, 18 aa, Entamoeba invadens
YSEMRIAYELSDKLKMNV

SEQ ID NO: 2987119 - protein, 23 aa, Entamoeba invadens
YSEPVDWWGFGVLIFEMIHGHAP

SEQ ID NO: 2987120 - protein, 24 aa, Entamoeba invadens
YSEYYYLKLYDGVIDDELFGKVRN

SEQ ID NO: 2987121 - protein, 17 aa, Entamoeba invadens
YSFCLGFVIVEAEEETA

SEQ ID NO: 2987122 - protein, 19 aa, Entamoeba invadens
YSFFPAMYDDFFFFKYSHL

SEQ ID NO: 2987123 - protein, 18 aa, Entamoeba invadens
YSFYKIVIWFRVFYELTF

SEQ ID NO: 2987124 - protein, 17 aa, Entamoeba invadens
YSGTFPTLVMKFIEKNI

SEQ ID NO: 2987125 - protein, 18 aa, Entamoeba invadens
YSIDQCVSHPFITGMEIT

SEQ ID NO: 2987126 - protein, 18 aa, Entamoeba invadens
YSIVCPKELVAFNEKFKS

SEQ ID NO: 2987127 - protein, 20 aa, Entamoeba invadens
YSKDMLLEMYEYAYDYKIMD

SEQ ID NO: 2987128 - protein, 20 aa, Entamoeba invadens
YSKWTIRMLLGYNKIVAMGI

SEQ ID NO: 2987129 - protein, 17 aa, Entamoeba invadens
YSLPSTMVMPCLKCSRT

SEQ ID NO: 2987130 - protein, 19 aa, Entamoeba invadens
YSQELFKYIFGDTDVSTLN

SEQ ID NO: 2987131 - protein, 17 aa, Entamoeba invadens
YSTVMACEDYLFPTFLP

SEQ ID NO: 2987132 - protein, 18 aa, Entamoeba invadens
YSVDYSFFLAHNCENCDF

SEQ ID NO: 2987133 - protein, 22 aa, Entamoeba invadens
YSWAKNCYHISFGMVMGMSTRR

SEQ ID NO: 2987134 - protein, 18 aa, Entamoeba invadens
YSYKHFLKCFHTFVDDLV

SEQ ID NO: 2987135 - protein, 23 aa, Entamoeba invadens
YSYKRSVAVPVVFDLVYSRQLTQ

SEQ ID NO: 2987136 - protein, 23 aa, Entamoeba invadens
YTADELIGFIALHTFTVCVLVKE

SEQ ID NO: 2987137 - protein, 17 aa, Entamoeba invadens
YTDVVPISLGILSYGVL

SEQ ID NO: 2987138 - protein, 18 aa, Entamoeba invadens
YTDYFYKRHEGLWEATAR

SEQ ID NO: 2987139 - protein, 18 aa, Entamoeba invadens
YTESRLKGISSYFEVSGN

SEQ ID NO: 2987140 - protein, 22 aa, Entamoeba invadens
YTIQLPYLFPGVQLTYIVKLPT

SEQ ID NO: 2987141 - protein, 17 aa, Entamoeba invadens
YTKLFALHRACMTVNDS

SEQ ID NO: 2987142 - protein, 19 aa, Entamoeba invadens
YTKLNGFKGIRVISKTVEI

SEQ ID NO: 2987143 - protein, 23 aa, Entamoeba invadens
YTKRLCLQKCRIKVFGDKVNLKT

SEQ ID NO: 2987144 - protein, 17 aa, Entamoeba invadens
YTLAVGIKECWAAHMIG

SEQ ID NO: 2987145 - protein, 19 aa, Entamoeba invadens
YTNNFIYMYDWFKSYFDED

SEQ ID NO: 2987146 - protein, 18 aa, Entamoeba invadens
YTPIPVMLVPFPLTSEQS

SEQ ID NO: 2987147 - protein, 23 aa, Entamoeba invadens
YTPKGVFCLMTFYGPACPNNSGL

SEQ ID NO: 2987148 - protein, 23 aa, Entamoeba invadens
YTSGCARCGFGFYYNLITQRCET

SEQ ID NO: 2987149 - protein, 24 aa, Entamoeba invadens
YTSGCARCGFGFYYNLITQRCETC

SEQ ID NO: 2987150 - protein, 25 aa, Entamoeba invadens
YTVDLRWACWYVWKVENRRYSDFLK

SEQ ID NO: 2987151 - protein, 21 aa, Entamoeba invadens
YTVGKYDWWSLTPAVMLSRFK

SEQ ID NO: 2987152 - protein, 17 aa, Entamoeba invadens
YTYKELFEFLNIEIISP

SEQ ID NO: 2987153 - protein, 18 aa, Entamoeba invadens
YVCGEVGHAQKFCPVAAQ

SEQ ID NO: 2987154 - protein, 18 aa, Entamoeba invadens
YVEKGIVFPPPIVRKDTH

SEQ ID NO: 2987155 - protein, 19 aa, Entamoeba invadens
YVESLRVYLSYILNCPYFV

SEQ ID NO: 2987156 - protein, 19 aa, Entamoeba invadens
YVHLDFMGVFGLKRNELIP

SEQ ID NO: 2987157 - protein, 17 aa, Entamoeba invadens
YVISIKEYARFVAGKSA

SEQ ID NO: 2987158 - protein, 19 aa, Entamoeba invadens
YVLGLECVKLDLKLITRYN

SEQ ID NO: 2987159 - protein, 17 aa, Entamoeba invadens
YVPLLLKYIESMTFYSN

SEQ ID NO: 2987160 - protein, 18 aa, Entamoeba invadens
YVPRAARVFPLMQGYVTF

SEQ ID NO: 2987161 - protein, 18 aa, Entamoeba invadens
YVQHCLKAFISSMYPPVT

SEQ ID NO: 2987162 - protein, 17 aa, Entamoeba invadens
YVRCGALTEIGRKMNKP

SEQ ID NO: 2987163 - protein, 21 aa, Entamoeba invadens
YVSENCYFPRMFMKIEDDCVR

SEQ ID NO: 2987164 - protein, 18 aa, Entamoeba invadens
YVSLVGVWCFKGCDSLVT

SEQ ID NO: 2987165 - protein, 25 aa, Entamoeba invadens
YVSRLKQFLEFYLAKALQIFPGDSI

SEQ ID NO: 2987166 - protein, 18 aa, Entamoeba invadens
YVVKTFLEFSCKFLNFPT

SEQ ID NO: 2987167 - protein, 17 aa, Entamoeba invadens
YWHSWALVNFEVVSYIE

SEQ ID NO: 2987168 - protein, 17 aa, Entamoeba invadens
YWLEAGNPWEVMRADVK

SEQ ID NO: 2987169 - protein, 24 aa, Entamoeba invadens
YWSSEEHILFLKAITWLNATSTKQ

SEQ ID NO: 2987170 - protein, 25 aa, Entamoeba invadens
YWTGCKSSVFSNEIEKIYNLRSQLK

SEQ ID NO: 2987171 - protein, 24 aa, Entamoeba invadens
YYCPFCSRCFLYACNKNHRNTCEK

SEQ ID NO: 2987172 - protein, 19 aa, Entamoeba invadens
YYERGCCLLRGLLVPMSEK

SEQ ID NO: 2987173 - protein, 18 aa, Entamoeba invadens
YYHNMSWPTLTFLAENAE

SEQ ID NO: 2987174 - protein, 18 aa, Entamoeba invadens
YYICCLRSPKMYSVDDKD

SEQ ID NO: 2987175 - protein, 17 aa, Entamoeba invadens
YYIVYQLGFCYSTVDGR

SEQ ID NO: 2987176 - protein, 17 aa, Entamoeba invadens
YYKFLAHVYKWVLILLA

SEQ ID NO: 2987177 - protein, 21 aa, Entamoeba invadens
YYLKGDAFVLVYSIDNKNSFH

SEQ ID NO: 2987178 - protein, 22 aa, Entamoeba invadens
YYLKGDGFVLVYSIENKASFLA

SEQ ID NO: 2987179 - protein, 17 aa, Entamoeba invadens
YYLQFVFSFIASTEITS

SEQ ID NO: 2987180 - protein, 17 aa, Entamoeba invadens
YYMDSGVCKYFDCGEGG

SEQ ID NO: 2987181 - protein, 19 aa, Entamoeba invadens
YYNGLMILTGLYLNVIRHY

SEQ ID NO: 2987182 - protein, 18 aa, Entamoeba invadens
YYPRFKLNKEHLVEQNIP

SEQ ID NO: 2987183 - protein, 26 aa, Entamoeba invadens
YYQGCQCWDWYFPYLYAPFIADVATY

SEQ ID NO: 2987184 - protein, 18 aa, Entamoeba invadens
YYRRGLKFSWDYISQGES

SEQ ID NO: 2987185 - protein, 17 aa, Entamoeba invadens
YYRVRSECLGPISSQKE

SEQ ID NO: 2987186 - protein, 17 aa, Entamoeba invadens
YYYGYNAVRSFLMNNDL

SEQ ID NO: 2987187 - protein, 23 aa, Entamoeba invadens
YYYQGCKGWGWFFPHNYAPFITD

SEQ ID NO: 2987188 - protein, 19 aa, Entamoeba invadens
PAMYVGIQAVLSLYASGRT

SEQ ID NO: 2987189 - protein, 26 aa, Entamoeba invadens
WDDMEKIWHHTFYNELRIAPEEHPVL

SEQ ID NO: 2987190 - protein, 19 aa, Entamoeba invadens
FCTLRLSHYLASCGCQLLG

SEQ ID NO: 2987191 - protein, 21 aa, Entamoeba invadens
LTDYLMKILTERGYAFTTTAE

SEQ ID NO: 2987192 - protein, 17 aa, Entamoeba invadens
MFETFNVPAMYVGIQAV

SEQ ID NO: 2987193 - protein, 18 aa, Entamoeba invadens
SHYLASCGCQLLGTMRIN

SEQ ID NO: 2987194 - protein, 30 aa, Entamoeba invadens
AGVSIYKGIKVILIGYFKDASVSAGQNSDA

SEQ ID NO: 2987195 - protein, 24 aa, Entamoeba invadens
RTNRWNIRALYDMIDIAALNAYKT

SEQ ID NO: 2987196 - protein, 25 aa, Entamoeba invadens
RTNRWNIRALYDMIDIAALNAYKTY

SEQ ID NO: 2987197 - protein, 28 aa, Entamoeba invadens
KLSKTSILRYLGILLYMGAHHDVINPVE

SEQ ID NO: 2987198 - protein, 20 aa, Entamoeba invadens
KREINQSRMPLLLETIRERQ

SEQ ID NO: 2987199 - protein, 18 aa, Entamoeba invadens
MFETFNVPAMYVGIQAVL

SEQ ID NO: 2987200 - protein, 23 aa, Entamoeba invadens
RSETRWLQTVLILDNMFENLPSL

SEQ ID NO: 2987201 - protein, 17 aa, Entamoeba invadens
SHYLASCGCQLLGTMRI

SEQ ID NO: 2987202 - protein, 18 aa, Entamoeba invadens
CTLRLSHYLASCGCQLLG

SEQ ID NO: 2987203 - protein, 21 aa, Entamoeba invadens
EKFHFNPIPLNSKTLGYFPNI

SEQ ID NO: 2987204 - protein, 17 aa, Entamoeba invadens
FDDFFVPNLIGVQTLTM

SEQ ID NO: 2987205 - protein, 24 aa, Entamoeba invadens
FSMKQKFLDLRKRAFKFPTMGKKA

SEQ ID NO: 2987206 - protein, 19 aa, Entamoeba invadens
GIKFWMCADCETGMTLNLQ

SEQ ID NO: 2987207 - protein, 20 aa, Entamoeba invadens
KRAFKFPTMGKKARLICIPT

SEQ ID NO: 2987208 - protein, 26 aa, Entamoeba invadens
NVNCKLFVACMFFTQIVLSKVKIIND

SEQ ID NO: 2987209 - protein, 29 aa, Entamoeba invadens
PFDIVTTFIKWLCNSTKLKEYYTFCNSNN

SEQ ID NO: 2987210 - protein, 20 aa, Entamoeba invadens
QEEKNQFPCLFNLVKKMNAK

SEQ ID NO: 2987211 - protein, 20 aa, Entamoeba invadens
SFVLENEWVLADSGYRGVGQ

SEQ ID NO: 2987212 - protein, 27 aa, Entamoeba invadens
TDARKRALRLFGNLLGNSLYDVNYTRN

SEQ ID NO: 2987213 - protein, 19 aa, Entamoeba invadens
TDYLMKILTERGYSFTTTA

SEQ ID NO: 2987214 - protein, 24 aa, Entamoeba invadens
TGVLKPGMFLTFAPTGVTSECKSV

SEQ ID NO: 2987215 - protein, 28 aa, Entamoeba invadens
VKIINDWLQTANLLYPVAYQRVEDLISN

SEQ ID NO: 2987216 - protein, 25 aa, Entamoeba invadens
VTKVFYEIIVWFNVNYDTVVKNDGQ

SEQ ID NO: 2987217 - protein, 26 aa, Entamoeba invadens
AGVAYHMYKAKRTCWPRVRGVAMNPV

SEQ ID NO: 2987218 - protein, 24 aa, Entamoeba invadens
AIVKYKLPKTYLKNQYCVACAIHG

SEQ ID NO: 2987219 - protein, 17 aa, Entamoeba invadens
AKVFIKSKPGRYGIKFW

SEQ ID NO: 2987220 - protein, 22 aa, Entamoeba invadens
APTEMMMYFPQLKAVCTAEEIN

SEQ ID NO: 2987221 - protein, 24 aa, Entamoeba invadens
AQAWNHAFYWNCMCGCGVKPSAEL

SEQ ID NO: 2987222 - protein, 24 aa, Entamoeba invadens
CMGQKYNYKLRLGKGFTLAELRAA

SEQ ID NO: 2987223 - protein, 21 aa, Entamoeba invadens
CSLYPSAINRLKLATGSPIVI

SEQ ID NO: 2987224 - protein, 25 aa, Entamoeba invadens
DAAGWLSWIMKILELMDADLIKCIG

SEQ ID NO: 2987225 - protein, 24 aa, Entamoeba invadens
DGESMCEWIFNALAFDINKEVLFP

SEQ ID NO: 2987226 - protein, 25 aa, Entamoeba invadens
DKELFICAEGIYSGQYIYCGAKASL

SEQ ID NO: 2987227 - protein, 25 aa, Entamoeba invadens
DKFRSEYIVHFYGAVFIPNKVCMVT

SEQ ID NO: 2987228 - protein, 20 aa, Entamoeba invadens
DPLELYKKLYDGESFNFNLL

SEQ ID NO: 2987229 - protein, 29 aa, Entamoeba invadens
DQKEAIIEKLILLKAFLVDLVAVIITKMG

SEQ ID NO: 2987230 - protein, 28 aa, Entamoeba invadens
EAYKHYFDCIFGPFKPYVLKGINLIETQ

SEQ ID NO: 2987231 - protein, 35 aa, Entamoeba invadens
EDYDRLRPLSYPQTDVFLICFSVVSPPSFDNVSSK

SEQ ID NO: 2987232 - protein, 24 aa, Entamoeba invadens
EISRQLIHFCKAPIGIDLIKFKGA

SEQ ID NO: 2987233 - protein, 23 aa, Entamoeba invadens
ELKRHNFYCSAGANFPAIVGKES

SEQ ID NO: 2987234 - protein, 27 aa, Entamoeba invadens
EMTSKQLDFALPMIKNMFPYTFTVTRQ

SEQ ID NO: 2987235 - protein, 24 aa, Entamoeba invadens
ERTQLSYLQCSLLAFISMNRRVVV

SEQ ID NO: 2987236 - protein, 17 aa, Entamoeba invadens
ETKVHTWFKQPFRAVRR

SEQ ID NO: 2987237 - protein, 19 aa, Entamoeba invadens
FCIGFTTRKPSQIKKTSYA

SEQ ID NO: 2987238 - protein, 36 aa, Entamoeba invadens
FEKVRGKFVVLLFYPLDWTFVCPTEMLGYSKLAEEM

SEQ ID NO: 2987239 - protein, 26 aa, Entamoeba invadens
FFCSLRLAHYLAQYGSTLLGTVRKNR

SEQ ID NO: 2987240 - protein, 25 aa, Entamoeba invadens
FILKKYSIHLLVKLSDAMILRFAIP

SEQ ID NO: 2987241 - protein, 18 aa, Entamoeba invadens
FMFSINSRNLKGPRVFFI

SEQ ID NO: 2987242 - protein, 18 aa, Entamoeba invadens
FPCLFNLVKKMNAKSPTT

SEQ ID NO: 2987243 - protein, 28 aa, Entamoeba invadens
GITFVAIFIRVCMKFDFYECPLLLSEYY

SEQ ID NO: 2987244 - protein, 27 aa, Entamoeba invadens
GKDCLMVFHSLKLTTDKLRSIVKKWCT

SEQ ID NO: 2987245 - protein, 30 aa, Entamoeba invadens
GSAMDAAKIMWLLYEHPEADFFSMKQKFLD

SEQ ID NO: 2987246 - protein, 26 aa, Entamoeba invadens
GYLADKKMIFFTKNGHFLLAVSYDRR

SEQ ID NO: 2987247 - protein, 18 aa, Entamoeba invadens
IKFWMCADCETGMTLNLQ

SEQ ID NO: 2987248 - protein, 27 aa, Entamoeba invadens
IKTKDGHFYWYKLDDKWLIDNVDIYIT

SEQ ID NO: 2987249 - protein, 18 aa, Entamoeba invadens
ITNNLLLFSNKKIAKEHK

SEQ ID NO: 2987250 - protein, 21 aa, Entamoeba invadens
KFESPKYYFTIIDAPGHRDFI

SEQ ID NO: 2987251 - protein, 26 aa, Entamoeba invadens
KIINDWLQTANLLYPVAYQRVEDLIS

SEQ ID NO: 2987252 - protein, 28 aa, Entamoeba invadens
KLPKDKLFSTSFFYTIIKRAVSQYTTKK

SEQ ID NO: 2987253 - protein, 25 aa, Entamoeba invadens
KRVSQHRLFIPKLESKLKLMTDSER

SEQ ID NO: 2987254 - protein, 25 aa, Entamoeba invadens
KRYINARFLPDKAIDLVDEACATLF

SEQ ID NO: 2987255 - protein, 21 aa, Entamoeba invadens
KSACRAMIGLIAGGGRTEKPI

SEQ ID NO: 2987256 - protein, 22 aa, Entamoeba invadens
KVHTWFKQPFRAVRRHQVRVTK

SEQ ID NO: 2987257 - protein, 28 aa, Entamoeba invadens
KVVLKKEFFRIIVWFNVDFETVDRNKNR

SEQ ID NO: 2987258 - protein, 26 aa, Entamoeba invadens
LDGVTNNPLPLRFGPKRASNIRKLFN

SEQ ID NO: 2987259 - protein, 34 aa, Entamoeba invadens
LLGEKIGESIYLASALLVFTMDYNISLKTWKEMK

SEQ ID NO: 2987260 - protein, 18 aa, Entamoeba invadens
LRVLQPYTFCQCNSLIDI

SEQ ID NO: 2987261 - protein, 31 aa, Entamoeba invadens
MSAEKKRYNAILKRYTLLKAHGVKVVSFADT

SEQ ID NO: 2987262 - protein, 32 aa, Entamoeba invadens
MSEYKGKFIVLLFYPLDWTFVCPTEMMGYSKL

SEQ ID NO: 2987263 - protein, 23 aa, Entamoeba invadens
NFGYLIYCEFTSLSIKMEYAEAF

SEQ ID NO: 2987264 - protein, 25 aa, Entamoeba invadens
NGQTREHILLSYTLGIKQMIVAVNK

SEQ ID NO: 2987265 - protein, 19 aa, Entamoeba invadens
NIIERKFYGVHCPAHRCNL

SEQ ID NO: 2987266 - protein, 25 aa, Entamoeba invadens
NSFEPKIVIWIKESINKIFLKARHE

SEQ ID NO: 2987267 - protein, 30 aa, Entamoeba invadens
QDALKGITKPAIRRLARRGGVKRINGLVYE

SEQ ID NO: 2987268 - protein, 17 aa, Entamoeba invadens
QKLTVIESAVRGCLVRR

SEQ ID NO: 2987269 - protein, 24 aa, Entamoeba invadens
QKVKFFNINVWFNVNYHTTQKEEN

SEQ ID NO: 2987270 - protein, 26 aa, Entamoeba invadens
RERGITIDISLWKFESPKYYFTIIDA

SEQ ID NO: 2987271 - protein, 25 aa, Entamoeba invadens
RLPDSLNKERCCRGLYGSLNHNIKS

SEQ ID NO: 2987272 - protein, 30 aa, Entamoeba invadens
RQKITMSINYFIYFIDFFEQYETRDNFKKI

SEQ ID NO: 2987273 - protein, 20 aa, Entamoeba invadens
RVVFRNPRQYGVDKELFICA

SEQ ID NO: 2987274 - protein, 19 aa, Entamoeba invadens
RVVRDMVLPMLCRGNKFTV

SEQ ID NO: 2987275 - protein, 31 aa, Entamoeba invadens
SAFLRKTNPRKVFWTAIYRQLNKKGLQQEVV

SEQ ID NO: 2987276 - protein, 26 aa, Entamoeba invadens
SGKREKIIFYLWTPAACSIKEKMVYS

SEQ ID NO: 2987277 - protein, 25 aa, Entamoeba invadens
SIKTRNPIIFSFHPSALKCSIAAAT

SEQ ID NO: 2987278 - protein, 20 aa, Entamoeba invadens
SKHPLTDYVFIVIEMDLDDI

SEQ ID NO: 2987279 - protein, 23 aa, Entamoeba invadens
SQTRLCILPDLIETTKCFGVYID

SEQ ID NO: 2987280 - protein, 21 aa, Entamoeba invadens
STLPPLIKTVPFDLLGDYSCN

SEQ ID NO: 2987281 - protein, 23 aa, Entamoeba invadens
STNKRIIIQPVNYTEIVSEVENS

SEQ ID NO: 2987282 - protein, 27 aa, Entamoeba invadens
TDAAGWLSWIMKILELMDADLIKCIGA

SEQ ID NO: 2987283 - protein, 25 aa, Entamoeba invadens
TKGTLYDSVYYYNVSFKGKKKNGGK

SEQ ID NO: 2987284 - protein, 31 aa, Entamoeba invadens
TLDLGDIHLKFIIQPFLHWPDTMMTVIEELK

SEQ ID NO: 2987285 - protein, 18 aa, Entamoeba invadens
VCDNFFCSLRLAHYLAQC

SEQ ID NO: 2987286 - protein, 17 aa, Entamoeba invadens
VCKAKRFGNKCFYDCED

SEQ ID NO: 2987287 - protein, 19 aa, Entamoeba invadens
VDDKRFRVARYPNYEYTDT

SEQ ID NO: 2987288 - protein, 26 aa, Entamoeba invadens
VECFRLFFCEEITNNLLLFSNKKIAK

SEQ ID NO: 2987289 - protein, 25 aa, Entamoeba invadens
VNCKLFVACMFFTQIVLSKVKIIND

SEQ ID NO: 2987290 - protein, 25 aa, Entamoeba invadens
VPVSKLPLMLYYIDVRMKAYFKSKT

SEQ ID NO: 2987291 - protein, 30 aa, Entamoeba invadens
YAAEYSIASLPTFVFFQNQKVVKKAPGSSE

SEQ ID NO: 2987292 - protein, 26 aa, Entamoeba invadens
YDGESFNFNLLQLRPSFEFTKDFKIK

SEQ ID NO: 2987293 - protein, 29 aa, Entamoeba invadens
YHISKKPLRKFPFYLFKRMADGDYSTPIG

SEQ ID NO: 2987294 - protein, 26 aa, Entamoeba invadens
YQVTSLPTFVFFQDQKVAKKAPGSPD

SEQ ID NO: 2987295 - protein, 25 aa, Entamoeba invadens
YSCQNLVRVVLPNNLRVLQPYTFCQ

SEQ ID NO: 2987296 - protein, 17 aa, Entamoeba invadens
YTIIKRAVSQYTTKKIT

SEQ ID NO: 2987297 - protein, 26 aa, Entamoeba invadens
YTREHLELFVLPPRPTYLVKSEEESL

SEQ ID NO: 2987298 - protein, 18 aa, Entamoeba invadens
YYFTIIDAPGHRDFIKNM

SEQ ID NO: 2987299 - protein, 28 aa, Entamoeba invadens
AAFTYVYNLRDLVIPSLVTYLHCGLFVN

SEQ ID NO: 2987300 - protein, 20 aa, Entamoeba invadens
AANEKLRITKNDLGRTKAEL

SEQ ID NO: 2987301 - protein, 34 aa, Entamoeba invadens
AATIILNPHFCKLIAWYDNEWGYSTRLVDLIQII

SEQ ID NO: 2987302 - protein, 27 aa, Entamoeba invadens
AECKIVYVTRLLVINDDLVLASTETVK

SEQ ID NO: 2987303 - protein, 21 aa, Entamoeba invadens
AEEDTLLLISKKNKKALSPND

SEQ ID NO: 2987304 - protein, 18 aa, Entamoeba invadens
AELTKRIEDGLNDSDMLK

SEQ ID NO: 2987305 - protein, 28 aa, Entamoeba invadens
AERRTNLQWFRVPPKIFFEPHAIRYLKE

SEQ ID NO: 2987306 - protein, 24 aa, Entamoeba invadens
AETLAKWLVSKLTDLGLICHRIVN

SEQ ID NO: 2987307 - protein, 18 aa, Entamoeba invadens
AEYFHKIEAWSVIGDGAA

SEQ ID NO: 2987308 - protein, 21 aa, Entamoeba invadens
AFQALLGFSKATGVKFPLADK

SEQ ID NO: 2987309 - protein, 28 aa, Entamoeba invadens
AHDVCPLEMVLFMPYLCKKLEVPYCIVK

SEQ ID NO: 2987310 - protein, 27 aa, Entamoeba invadens
AIDNRYCPIFSMWCMCHRLNLCVEECI

SEQ ID NO: 2987311 - protein, 26 aa, Entamoeba invadens
AIIDPMFTVSLPKRAIADTGLDVLVH

SEQ ID NO: 2987312 - protein, 19 aa, Entamoeba invadens
AIMSKHGRFNCNSKYYAIL

SEQ ID NO: 2987313 - protein, 17 aa, Entamoeba invadens
AINFTKNLKRIWGGAFW

SEQ ID NO: 2987314 - protein, 24 aa, Entamoeba invadens
AIPSAFVPVQCLPSFFSVENNISN

SEQ ID NO: 2987315 - protein, 24 aa, Entamoeba invadens
AISNGKFPIIIDDKFREVPFGNWE

SEQ ID NO: 2987316 - protein, 17 aa, Entamoeba invadens
AKKLTLNTLFASMTQEE

SEQ ID NO: 2987317 - protein, 24 aa, Entamoeba invadens
AKTLAKWLVDKITRLGLNCYRIIN

SEQ ID NO: 2987318 - protein, 25 aa, Entamoeba invadens
ALDARTYMLLYAKFESLLGLGYQVI

SEQ ID NO: 2987319 - protein, 32 aa, Entamoeba invadens
ALDSELIARQIVLDIFLPQSLYVKDEFSNEKV

SEQ ID NO: 2987320 - protein, 24 aa, Entamoeba invadens
ANEVWNLEIQLTSGAAKPIERDTR

SEQ ID NO: 2987321 - protein, 24 aa, Entamoeba invadens
APDQKIVFGKMKDLLTYDFGAPLH

SEQ ID NO: 2987322 - protein, 27 aa, Entamoeba invadens
AQPPPPPMGMMPPPPPNMPPPPSGGDA

SEQ ID NO: 2987323 - protein, 19 aa, Entamoeba invadens
ARVEYYAVLAKVNVVHYAG

SEQ ID NO: 2987324 - protein, 17 aa, Entamoeba invadens
ASTLTRLTNFHCTINDK

SEQ ID NO: 2987325 - protein, 26 aa, Entamoeba invadens
ATCTLKKVLSCQPHYFLKNNRCVGCD

SEQ ID NO: 2987326 - protein, 26 aa, Entamoeba invadens
ATSDNFVLFGRPNPWEGPVFITRKEE

SEQ ID NO: 2987327 - protein, 23 aa, Entamoeba invadens
AVDIYKKLAVSFRSARRRLKSEN

SEQ ID NO: 2987328 - protein, 22 aa, Entamoeba invadens
AVGDIPGVRFKVVCVAGVSLHG

SEQ ID NO: 2987329 - protein, 26 aa, Entamoeba invadens
AVIIRQRRTWRRKDGTTLYFEDNAAV

SEQ ID NO: 2987330 - protein, 27 aa, Entamoeba invadens
AVKTWKKRWFVLKENRLWYFASKTATS

SEQ ID NO: 2987331 - protein, 25 aa, Entamoeba invadens
AVSDDLFVFLKVYNPSLLDKINYLG

SEQ ID NO: 2987332 - protein, 25 aa, Entamoeba invadens
AYMNEMLYPVQIIAQRIRVSMHSNV

SEQ ID NO: 2987333 - protein, 26 aa, Entamoeba invadens
AYRNPLVDVLQFFETFHKGHYKVYNF

SEQ ID NO: 2987334 - protein, 24 aa, Entamoeba invadens
CECTFLTKINLPPHLTRIGAKCFV

SEQ ID NO: 2987335 - protein, 26 aa, Entamoeba invadens
CFECLQSLFINPLINLEIETFVLFKE

SEQ ID NO: 2987336 - protein, 19 aa, Entamoeba invadens
CFFSCDLLRDNSMIPKEAF

SEQ ID NO: 2987337 - protein, 19 aa, Entamoeba invadens
CFSECYALEQINIPKNVKE

SEQ ID NO: 2987338 - protein, 27 aa, Entamoeba invadens
CGFGRRPFYQPFYGYCPPPPPMMGQNP

SEQ ID NO: 2987339 - protein, 17 aa, Entamoeba invadens
CGTPLRCILEGKKYIRD

SEQ ID NO: 2987340 - protein, 25 aa, Entamoeba invadens
CIAAEFFIGIPLFPGSSEYNQIYKI

SEQ ID NO: 2987341 - protein, 21 aa, Entamoeba invadens
CIYVKPLYRKLVKESKNSVCI

SEQ ID NO: 2987342 - protein, 18 aa, Entamoeba invadens
CKIGYFPEEKRCSPCSKM

SEQ ID NO: 2987343 - protein, 18 aa, Entamoeba invadens
CLFHLNQAVYRMLGKVGL

SEQ ID NO: 2987344 - protein, 22 aa, Entamoeba invadens
CLRVYVSSFWEQPFKDTMFTSL

SEQ ID NO: 2987345 - protein, 25 aa, Entamoeba invadens
CRSDYKSILAMKKSAIVMLEASEKR

SEQ ID NO: 2987346 - protein, 27 aa, Entamoeba invadens
CSTNFKGWEWFIIEKSPEKKMYTIKTP

SEQ ID NO: 2987347 - protein, 17 aa, Entamoeba invadens
CTALGPALLVSTVAAGK

SEQ ID NO: 2987348 - protein, 18 aa, Entamoeba invadens
CVDKLCDFRFFNMKMLKS

SEQ ID NO: 2987349 - protein, 19 aa, Entamoeba invadens
CVLSIVRITLKNGCYHEDI

SEQ ID NO: 2987350 - protein, 27 aa, Entamoeba invadens
CYGYGSYLILTLVLEGPAVSTFSFGFV

SEQ ID NO: 2987351 - protein, 24 aa, Entamoeba invadens
DAALDPLNWTGHTGMAVLAPHLTK

SEQ ID NO: 2987352 - protein, 25 aa, Entamoeba invadens
DADRYLKKNFTLVKSMYDVSKNIRC

SEQ ID NO: 2987353 - protein, 25 aa, Entamoeba invadens
DAKYNLEMFLYRDSLMKGDHYILNI

SEQ ID NO: 2987354 - protein, 22 aa, Entamoeba invadens
DCANVYFSVCKSFLEYWGDMFT

SEQ ID NO: 2987355 - protein, 18 aa, Entamoeba invadens
DDFCFCWCNSLSSVTIPS

SEQ ID NO: 2987356 - protein, 18 aa, Entamoeba invadens
DDIKDTIYGILKHATVQL

SEQ ID NO: 2987357 - protein, 25 aa, Entamoeba invadens
DDNDKPFVLPLASMQYLKMTEAKEL

SEQ ID NO: 2987358 - protein, 27 aa, Entamoeba invadens
DDPNELFSLCGNAIFVQKKGILRGSCA

SEQ ID NO: 2987359 - protein, 24 aa, Entamoeba invadens
DDVEIFCVMLRLIKGRNCYSMPLL

SEQ ID NO: 2987360 - protein, 24 aa, Entamoeba invadens
DEELFNVPILFYLNKTDLPNALTK

SEQ ID NO: 2987361 - protein, 17 aa, Entamoeba invadens
DFEYFQMNGVTIGNHKY

SEQ ID NO: 2987362 - protein, 18 aa, Entamoeba invadens
DFIEPKKLVTYFKQTIKM

SEQ ID NO: 2987363 - protein, 30 aa, Entamoeba invadens
DGITFVAIFIRVCMKFDFYECPLLLSEYYG

SEQ ID NO: 2987364 - protein, 18 aa, Entamoeba invadens
DGTLKYVIKVRLLETYTS

SEQ ID NO: 2987365 - protein, 26 aa, Entamoeba invadens
DKFRSEYIVHFYGAVFIPNKICMVTE

SEQ ID NO: 2987366 - protein, 27 aa, Entamoeba invadens
DKFRSEYIVHFYGAVFIPSKICMVTEF

SEQ ID NO: 2987367 - protein, 33 aa, Entamoeba invadens
DKFVPGFFQYYVHYPIELSRYKKLNKKIKVICP

SEQ ID NO: 2987368 - protein, 26 aa, Entamoeba invadens
DKLLSSMFVNWIFLTSVKLPSNVVKI

SEQ ID NO: 2987369 - protein, 27 aa, Entamoeba invadens
DLEALGYMFVYFMKGSLPWQGIKGKKG

SEQ ID NO: 2987370 - protein, 17 aa, Entamoeba invadens
DMVLPMLCRGNKFTVVC

SEQ ID NO: 2987371 - protein, 17 aa, Entamoeba invadens
DNKVVMPSIFHKELQKI

SEQ ID NO: 2987372 - protein, 19 aa, Entamoeba invadens
DNTKFCGIKIFTNCTQLSS

SEQ ID NO: 2987373 - protein, 29 aa, Entamoeba invadens
DPQVGIYGMDFYVVLARPGFRVARRKRGQ

SEQ ID NO: 2987374 - protein, 17 aa, Entamoeba invadens
DQAPQGAFIPFGKYLHS

SEQ ID NO: 2987375 - protein, 28 aa, Entamoeba invadens
DQLTNLKIVSLCAWKLPKYVLRDVYESN

SEQ ID NO: 2987376 - protein, 25 aa, Entamoeba invadens
DRYLRKNSLLVKSFYDVAENIRCFE

SEQ ID NO: 2987377 - protein, 31 aa, Entamoeba invadens
DSNETLEILTYFLRCLISSSHLLKTDPKTAF

SEQ ID NO: 2987378 - protein, 26 aa, Entamoeba invadens
DTEFVRNTYWVALKFVNGINTCVTVD

SEQ ID NO: 2987379 - protein, 31 aa, Entamoeba invadens
DTLVNLPPVYTYFYLCVIVSSDGFVKISVLV

SEQ ID NO: 2987380 - protein, 23 aa, Entamoeba invadens
DTNIPFVLQLKKCVDIYKKILDI

SEQ ID NO: 2987381 - protein, 26 aa, Entamoeba invadens
DTNVGKTCLLLTYTTNAFPETYVPTV

SEQ ID NO: 2987382 - protein, 20 aa, Entamoeba invadens
DTSLVRSFARKWTSPEVAKE

SEQ ID NO: 2987383 - protein, 27 aa, Entamoeba invadens
DVEKRGPWLFYINNVIFTKKCWEDEVQ

SEQ ID NO: 2987384 - protein, 26 aa, Entamoeba invadens
DVTRALLIVLYNSYIAPVTCFVSKRP

SEQ ID NO: 2987385 - protein, 35 aa, Entamoeba invadens
DYDLQKQLYPYIKDWVPLPSIYYKSYIAANQDDRA

SEQ ID NO: 2987386 - protein, 17 aa, Entamoeba invadens
DYEIACEMFFKLSQYTT

SEQ ID NO: 2987387 - protein, 25 aa, Entamoeba invadens
EAACPHIMLNAFQALLGFSKATGVK

SEQ ID NO: 2987388 - protein, 21 aa, Entamoeba invadens
EAFIHNLVNNKYFTPSTTLSV

SEQ ID NO: 2987389 - protein, 20 aa, Entamoeba invadens
ECHLRLKALGYLFNNIKLTQ

SEQ ID NO: 2987390 - protein, 28 aa, Entamoeba invadens
ECIITFAFPIIQLVAPFVSFRVVKDFNE

SEQ ID NO: 2987391 - protein, 30 aa, Entamoeba invadens
ECNLFNRNFRVFGNGLLYKVTMENANYPRR

SEQ ID NO: 2987392 - protein, 24 aa, Entamoeba invadens
ECRKKGIISWLRPDAKTQVTLEYE

SEQ ID NO: 2987393 - protein, 25 aa, Entamoeba invadens
EDTKNFFITFFNATPNKKYHNPKTG

SEQ ID NO: 2987394 - protein, 27 aa, Entamoeba invadens
EEDMTILRQYALIGSKWCSIASCLNNR

SEQ ID NO: 2987395 - protein, 17 aa, Entamoeba invadens
EEYLKKKLPPLFNEFDI

SEQ ID NO: 2987396 - protein, 19 aa, Entamoeba invadens
EFGFKCIFILVKGSVEKSN

SEQ ID NO: 2987397 - protein, 26 aa, Entamoeba invadens
EFKLSHKWRYIIFKMNDKLTEVIIDK

SEQ ID NO: 2987398 - protein, 20 aa, Entamoeba invadens
EFSALKRKGEISWDDLVKLL

SEQ ID NO: 2987399 - protein, 21 aa, Entamoeba invadens
EGKALLMKYLGGIDAVPICID

SEQ ID NO: 2987400 - protein, 20 aa, Entamoeba invadens
EGKFYTLVSYVPVASFKGLL

SEQ ID NO: 2987401 - protein, 26 aa, Entamoeba invadens
EGLCKKYMKYLMKKYLKKNNLREWLR

SEQ ID NO: 2987402 - protein, 20 aa, Entamoeba invadens
EIACEMFFKLSQYTTTLLDI

SEQ ID NO: 2987403 - protein, 24 aa, Entamoeba invadens
EIDEKVFFNCFSLKSVTLPQSLKK

SEQ ID NO: 2987404 - protein, 19 aa, Entamoeba invadens
EIQRPNCEYAWVFEKTKGE

SEQ ID NO: 2987405 - protein, 33 aa, Entamoeba invadens
EISPRLLAEQLYVTDLYLIKKVSIGDFLSESAL

SEQ ID NO: 2987406 - protein, 19 aa, Entamoeba invadens
EIVDYFMQFSVVVSSLANA

SEQ ID NO: 2987407 - protein, 22 aa, Entamoeba invadens
EKFHFNPIPLTCKTIRFFLNIE

SEQ ID NO: 2987408 - protein, 27 aa, Entamoeba invadens
EKIFPIDNVYIRKVKILKSGKIDSLKL

SEQ ID NO: 2987409 - protein, 20 aa, Entamoeba invadens
ELMKRDIAIVTIMSIKPVCV

SEQ ID NO: 2987410 - protein, 23 aa, Entamoeba invadens
ENVTFLPPFHCDYGKYIQVGSTT

SEQ ID NO: 2987411 - protein, 17 aa, Entamoeba invadens
ENWLKWIVSVGEEFEFD

SEQ ID NO: 2987412 - protein, 17 aa, Entamoeba invadens
EPYITYGYPSLKTVSDL

SEQ ID NO: 2987413 - protein, 26 aa, Entamoeba invadens
EQIYRILDMEYTQHIPIILVGNKCDL

SEQ ID NO: 2987414 - protein, 26 aa, Entamoeba invadens
ERCSSLSKIILFDGLANIPHCAFFRC

SEQ ID NO: 2987415 - protein, 25 aa, Entamoeba invadens
ESVNVLYLVMSFGITTKSGAISVLQ

SEQ ID NO: 2987416 - protein, 20 aa, Entamoeba invadens
ETRWLQTVLILDNMFENLPS

SEQ ID NO: 2987417 - protein, 23 aa, Entamoeba invadens
EVCGTLRMRLVKWEMYRRKRVNT

SEQ ID NO: 2987418 - protein, 17 aa, Entamoeba invadens
EVIPLIDGILEEESKIN

SEQ ID NO: 2987419 - protein, 24 aa, Entamoeba invadens
EYASMLDQYFRNGHGFLIVYSVTD

SEQ ID NO: 2987420 - protein, 18 aa, Entamoeba invadens
FCIASLFGVMLGKKEFKK

SEQ ID NO: 2987421 - protein, 19 aa, Entamoeba invadens
FDCMSERRLLSINPYLINA

SEQ ID NO: 2987422 - protein, 19 aa, Entamoeba invadens
FEETKYKILDLLKLVRIKS

SEQ ID NO: 2987423 - protein, 17 aa, Entamoeba invadens
FELRRKVVLTDYLEKMK

SEQ ID NO: 2987424 - protein, 20 aa, Entamoeba invadens
FEMVLDRFRYNPIPVKSTKL

SEQ ID NO: 2987425 - protein, 42 aa, Entamoeba invadens
FENCFCLSKFRLPLGIRHLPESLFALCRNLYIIENLDDVEEV

SEQ ID NO: 2987426 - protein, 26 aa, Entamoeba invadens
FFCSLRLAHYLAQCGSTLLVIVRKNR

SEQ ID NO: 2987427 - protein, 25 aa, Entamoeba invadens
FHEGNGFVIALLYEQNVFGVVVTKK

SEQ ID NO: 2987428 - protein, 41 aa, Entamoeba invadens
FHPDTLNCNFLPISFDYLLKPIYIRNYIIEGPPEMIEKITP

SEQ ID NO: 2987429 - protein, 18 aa, Entamoeba invadens
FIHNLVNNKYFTPSTTLS

SEQ ID NO: 2987430 - protein, 17 aa, Entamoeba invadens
FKEFKLSHKWRYIIFKM

SEQ ID NO: 2987431 - protein, 18 aa, Entamoeba invadens
FKNMYWLDEISVPQNVVL

SEQ ID NO: 2987432 - protein, 27 aa, Entamoeba invadens
FKQRECLDNLFRALLGLPAENHMLLEG

SEQ ID NO: 2987433 - protein, 17 aa, Entamoeba invadens
FLKNVLFYLSTLDDVQS

SEQ ID NO: 2987434 - protein, 18 aa, Entamoeba invadens
FLLKICRQIELRKSKFMK

SEQ ID NO: 2987435 - protein, 20 aa, Entamoeba invadens
FLMNVVLYLDTFNTLTSFSC

SEQ ID NO: 2987436 - protein, 22 aa, Entamoeba invadens
FNMELYCKFYCNQDVRILKQGH

SEQ ID NO: 2987437 - protein, 29 aa, Entamoeba invadens
FNVDVWRKFCWVFGYLPVAALIDSSILCV

SEQ ID NO: 2987438 - protein, 27 aa, Entamoeba invadens
FRDYNTLFYSLRSVKMFAPYIKNYFLV

SEQ ID NO: 2987439 - protein, 18 aa, Entamoeba invadens
FRVTRDMVLPMLCRGFKT

SEQ ID NO: 2987440 - protein, 27 aa, Entamoeba invadens
FSDMIDWSIIYQMNWFKTPINIRLFND

SEQ ID NO: 2987441 - protein, 32 aa, Entamoeba invadens
FSEILKSFYRVRVFYPITYQDYLLNIKGVFMF

SEQ ID NO: 2987442 - protein, 30 aa, Entamoeba invadens
FSKNMILMDEFFRKPLLSLAEQKVVAASDV

SEQ ID NO: 2987443 - protein, 24 aa, Entamoeba invadens
FSRSLKMLFAVSYHFIRAIVCARD

SEQ ID NO: 2987444 - protein, 26 aa, Entamoeba invadens
FSSTENFPMFFASTLTRLTNFHCTIN

SEQ ID NO: 2987445 - protein, 27 aa, Entamoeba invadens
FVVAKSKFWMMLKKQQKIKKADASLLE

SEQ ID NO: 2987446 - protein, 19 aa, Entamoeba invadens
FVVYWLKEMKKFQKMFVRI

SEQ ID NO: 2987447 - protein, 32 aa, Entamoeba invadens
GALDSELIARQIVLDVFLPQSLYVKDEFSDVK

SEQ ID NO: 2987448 - protein, 22 aa, Entamoeba invadens
GCDSLAEIVLPKSIKVIGECCF

SEQ ID NO: 2987449 - protein, 29 aa, Entamoeba invadens
GCTVCNEGYYLLLGSCKMLSEIHCKFVVI

SEQ ID NO: 2987450 - protein, 20 aa, Entamoeba invadens
GCVLSIVRITLKNGCYHEDI

SEQ ID NO: 2987451 - protein, 23 aa, Entamoeba invadens
GDHYILNIDIPITPFYLKNREEI

SEQ ID NO: 2987452 - protein, 17 aa, Entamoeba invadens
GDKQKLIEAGYLALKEA

SEQ ID NO: 2987453 - protein, 18 aa, Entamoeba invadens
GFFETNFDTVSFTRSSLF

SEQ ID NO: 2987454 - protein, 23 aa, Entamoeba invadens
GFVNKLGYGILKTALRYESFVLK

SEQ ID NO: 2987455 - protein, 26 aa, Entamoeba invadens
GHVKLCAYYITYPYKDLNLNDFYYDQ

SEQ ID NO: 2987456 - protein, 26 aa, Entamoeba invadens
GIIKRRALRLDVGYFTWVSQAMTKTA

SEQ ID NO: 2987457 - protein, 20 aa, Entamoeba invadens
GIKFWMCADCETGMTLNLQM

SEQ ID NO: 2987458 - protein, 20 aa, Entamoeba invadens
GINVLRIINEPTAAAIAYGL

SEQ ID NO: 2987459 - protein, 18 aa, Entamoeba invadens
GIPYIITHDGRTIRYPHP

SEQ ID NO: 2987460 - protein, 23 aa, Entamoeba invadens
GKDIQIHFAGHGPALFGNERINK

SEQ ID NO: 2987461 - protein, 22 aa, Entamoeba invadens
GKGFLPKQPVIVRARFFSKTAQ

SEQ ID NO: 2987462 - protein, 26 aa, Entamoeba invadens
GKREKIIFYLWSPSKCSLKEKVIFSA

SEQ ID NO: 2987463 - protein, 24 aa, Entamoeba invadens
GKTFFFDRMLVPEKYRVIHKNLLS

SEQ ID NO: 2987464 - protein, 24 aa, Entamoeba invadens
GKTTILYHLKYYKYVNTIPTMGFN

SEQ ID NO: 2987465 - protein, 24 aa, Entamoeba invadens
GLNHRRTWFTSFHPDFFGKKGMRV

SEQ ID NO: 2987466 - protein, 24 aa, Entamoeba invadens
GNDIYDITYFPTYKRNFFQVNIWF

SEQ ID NO: 2987467 - protein, 37 aa, Entamoeba invadens
GNTKKFHFNPIPLTHKTNMLFPNIETLHLWSEKDENF

SEQ ID NO: 2987468 - protein, 20 aa, Entamoeba invadens
GPELVASFVSLLFVYTKEQD

SEQ ID NO: 2987469 - protein, 20 aa, Entamoeba invadens
GQPLILLCQINYSEMPKLEN

SEQ ID NO: 2987470 - protein, 27 aa, Entamoeba invadens
GRNCYSMPLLLRQYKGELDAETLAKWL

SEQ ID NO: 2987471 - protein, 40 aa, Entamoeba invadens
GTEMYGLHYFMFTSIIKNICKFFWNVSLIKMIVSNNDYIS

SEQ ID NO: 2987472 - protein, 27 aa, Entamoeba invadens
GVFKKEFFRIIVWFNVDFKTVDRNKNR

SEQ ID NO: 2987473 - protein, 27 aa, Entamoeba invadens
GVLKREFFRIIVWFNVDFETVDRNKNR

SEQ ID NO: 2987474 - protein, 23 aa, Entamoeba invadens
GVSAIYPGCFYDCNFINKVTIPP

SEQ ID NO: 2987475 - protein, 30 aa, Entamoeba invadens
GVTKEFFQIVIWFNVNYRTVVKNRGKNILF

SEQ ID NO: 2987476 - protein, 30 aa, Entamoeba invadens; identical to SEQ ID NO: 2517583

SEQ ID NO: 2987477 - protein, 26 aa, Entamoeba invadens
HDYVVRLIQALVVRFANPLRKSTCFE

SEQ ID NO: 2987478 - protein, 19 aa, Entamoeba invadens
HERLVKKLLKIKKATKADE

SEQ ID NO: 2987479 - protein, 24 aa, Entamoeba invadens
HIENIPMLQITNTTLRPLTFPHTE

SEQ ID NO: 2987480 - protein, 17 aa, Entamoeba invadens
HLLIYKSDYDTQLEMPL

SEQ ID NO: 2987481 - protein, 21 aa, Entamoeba invadens
HLRKSIVPGVICIIVAGKYAG

SEQ ID NO: 2987482 - protein, 25 aa, Entamoeba invadens
HMGRFIIWTESAFKRLNYIFGTQKA

SEQ ID NO: 2987483 - protein, 28 aa, Entamoeba invadens
HNTKISFFEILIWYKVSYTFTQHKKSTN

SEQ ID NO: 2987484 - protein, 23 aa, Entamoeba invadens
HQTERIFILPPTDTSVQLTPNVT

SEQ ID NO: 2987485 - protein, 22 aa, Entamoeba invadens
HRSGKIVVNLNGRLNKCAVISP

SEQ ID NO: 2987486 - protein, 19 aa, Entamoeba invadens
HSYLFPNAVPRYEMYRKGM

SEQ ID NO: 2987487 - protein, 25 aa, Entamoeba invadens
HVRVRIHPYHVLRINKMLSCAGADR

SEQ ID NO: 2987488 - protein, 32 aa, Entamoeba invadens
HYSLNVLKLFPNIKTLYLPSYRFKVPKSVTSQ

SEQ ID NO: 2987489 - protein, 32 aa, Entamoeba invadens
ICYMATIEASLPFLHFFDGFKTGYALQKVSTL

SEQ ID NO: 2987490 - protein, 24 aa, Entamoeba invadens
IDMSINRILAIPKHMSKLSNLTFI

SEQ ID NO: 2987491 - protein, 25 aa, Entamoeba invadens
IEIDGIAFEFIPTPNTEAPANMMFY

SEQ ID NO: 2987492 - protein, 24 aa, Entamoeba invadens
IELGQYFMAINIECFRPLKEFEKQ

SEQ ID NO: 2987493 - protein, 18 aa, Entamoeba invadens
IERFNLRSKMTDFDAFRV

SEQ ID NO: 2987494 - protein, 32 aa, Entamoeba invadens
IESNPFPIDRKTLKAFPALTTLNIWNTYDEHF

SEQ ID NO: 2987495 - protein, 25 aa, Entamoeba invadens
IFGNRNLFEFFINANVIMMDGTFKS

SEQ ID NO: 2987496 - protein, 25 aa, Entamoeba invadens
IGEKCFNWCSYLSSITIPLGVTSFS

SEQ ID NO: 2987497 - protein, 32 aa, Entamoeba invadens
IGVTKGYRYKMRVVYAHFPVNLVIADDKKSII

SEQ ID NO: 2987498 - protein, 19 aa, Entamoeba invadens
IIPAMITTTAVVSGLQCIE

SEQ ID NO: 2987499 - protein, 20 aa, Entamoeba invadens
IIPDGSYYRLVTPKGPLPKV

SEQ ID NO: 2987500 - protein, 23 aa, Entamoeba invadens
IISSKLFLQIMRDSFITFKGENL

SEQ ID NO: 2987501 - protein, 25 aa, Entamoeba invadens
IIVRRDYFHYIPKYNRYEKRHRNIA

SEQ ID NO: 2987502 - protein, 25 aa, Entamoeba invadens
IKHFPNIETLYIWSRKDETFGNEII

SEQ ID NO: 2987503 - protein, 31 aa, Entamoeba invadens
IKNCMANCDPKMFIPLIPIIVSRLGDKIPAV

SEQ ID NO: 2987504 - protein, 20 aa, Entamoeba invadens
IKNFGYIWDSKLCWQDERVV

SEQ ID NO: 2987505 - protein, 22 aa, Entamoeba invadens
IKNMFPYTFTVTRQYKYMYCPG

SEQ ID NO: 2987506 - protein, 27 aa, Entamoeba invadens
IKSGSLIVTGPFKLSGVPLLQINQRYV

SEQ ID NO: 2987507 - protein, 29 aa, Entamoeba invadens
IKTKFQELLIYYKRFWLEKIDCSNWCQFC

SEQ ID NO: 2987508 - protein, 21 aa, Entamoeba invadens
IKTPHLILCCCLNIGIDPPLN

SEQ ID NO: 2987509 - protein, 27 aa, Entamoeba invadens
ILTNPLNYKIPVWFLNRQKDIKDGKNC

SEQ ID NO: 2987510 - protein, 20 aa, Entamoeba invadens
IMIVSKYFATIKDFINLEMV

SEQ ID NO: 2987511 - protein, 17 aa, Entamoeba invadens
IMIVSKYLKTIKDFINL

SEQ ID NO: 2987512 - protein, 17 aa, Entamoeba invadens
IMIVSKYLKTINDFINL

SEQ ID NO: 2987513 - protein, 27 aa, Entamoeba invadens
INITIDRPCLFGHLYNCEHNFVFADAR

SEQ ID NO: 2987514 - protein, 23 aa, Entamoeba invadens
INKEVLFPLRKFIGSTQDGASAN

SEQ ID NO: 2987515 - protein, 26 aa, Entamoeba invadens
INNGELPKEIPFSVPSVFRKEFSALK

SEQ ID NO: 2987516 - protein, 27 aa, Entamoeba invadens
IPAVKGALFTVISYLLIHAQKEIFPYL

SEQ ID NO: 2987517 - protein, 38 aa, Entamoeba invadens
IRGQNVVVIGYYKKADPILPAKNLKAAFSALSLVDDIE

SEQ ID NO: 2987518 - protein, 19 aa, Entamoeba invadens
IRYAERVGYPLVFCSSYTG

SEQ ID NO: 2987519 - protein, 26 aa, Entamoeba invadens
ITPKTKNLFKFIQTQQFFSPFDMKLN

SEQ ID NO: 2987520 - protein, 26 aa, Entamoeba invadens
ITQKSNIVDLLFIKATNIFIETKPKY

SEQ ID NO: 2987521 - protein, 17 aa, Entamoeba invadens
ITSFCNMGLLQDGIVVS

SEQ ID NO: 2987522 - protein, 18 aa, Entamoeba invadens
IVAIRIRGINNVSPKIRK

SEQ ID NO: 2987523 - protein, 19 aa, Entamoeba invadens
IVFLGDSSVGKTCIIGRFM

SEQ ID NO: 2987524 - protein, 21 aa, Entamoeba invadens
IVLPPTIQTLGKRAFYNCKSL

SEQ ID NO: 2987525 - protein, 27 aa, Entamoeba invadens
IVTQNAQLYLLFEFVELYRSSKRIVIN

SEQ ID NO: 2987526 - protein, 18 aa, Entamoeba invadens
IVVQKNFFTIIRNTIRDY

SEQ ID NO: 2987527 - protein, 33 aa, Entamoeba invadens
IYGILKHATVQLKKFGKIILVGGGARIPGVKEA

SEQ ID NO: 2987528 - protein, 26 aa, Entamoeba invadens
KAEEEIFFMEMLGHTLIYSSCLPRLE

SEQ ID NO: 2987529 - protein, 24 aa, Entamoeba invadens
KCSNLSHIIIPPSVTLIGDFCFGR

SEQ ID NO: 2987530 - protein, 17 aa, Entamoeba invadens
KDCIYVKPLYRKLVKES

SEQ ID NO: 2987531 - protein, 19 aa, Entamoeba invadens
KDDVETMLSILFKNAINER

SEQ ID NO: 2987532 - protein, 23 aa, Entamoeba invadens
KDLPQFVDFLREPTLTQTIIQRA

SEQ ID NO: 2987533 - protein, 37 aa, Entamoeba invadens
KDNMDMFHANPIPLTLKTFKFFSKIETLNLWSEEDES

SEQ ID NO: 2987534 - protein, 27 aa, Entamoeba invadens
KECLPLILIMRNRLHYALNAREVQMIL

SEQ ID NO: 2987535 - protein, 18 aa, Entamoeba invadens
KEESILNVYWKRSEPMPQ

SEQ ID NO: 2987536 - protein, 24 aa, Entamoeba invadens
KEMTLYMHRFMHKEGFKHRAPKAI

SEQ ID NO: 2987537 - protein, 19 aa, Entamoeba invadens
KEVFSLKKIFFPQEYKRET

SEQ ID NO: 2987538 - protein, 24 aa, Entamoeba invadens
KFRSEFVVHFYGAVFARNKVCMVT

SEQ ID NO: 2987539 - protein, 27 aa, Entamoeba invadens
KGDHYFLDIDLPITPFYLKNREELNKY

SEQ ID NO: 2987540 - protein, 17 aa, Entamoeba invadens
KGEYRWAATVLNHLVFA

SEQ ID NO: 2987541 - protein, 25 aa, Entamoeba invadens
KGGIFNIWFNTWFIHDNHLEFSKME

SEQ ID NO: 2987542 - protein, 18 aa, Entamoeba invadens
KGKELKACSKAWIAAQKE

SEQ ID NO: 2987543 - protein, 28 aa, Entamoeba invadens
KGMNCAFGRWPVKSCNFILKLIKSAVDN

SEQ ID NO: 2987544 - protein, 17 aa, Entamoeba invadens
KIAVPTPRNVSCQKMEI

SEQ ID NO: 2987545 - protein, 20 aa, Entamoeba invadens
KIFPKRWRVGEELVLEFVSS

SEQ ID NO: 2987546 - protein, 34 aa, Entamoeba invadens
KIGISREPILIALFYNYGLSLLNNMTRRAAKFMN

SEQ ID NO: 2987547 - protein, 19 aa, Entamoeba invadens
KILDLLKLVRIKSENVRFI

SEQ ID NO: 2987548 - protein, 23 aa, Entamoeba invadens
KIVLPTHLQIIGKSAFMFCASLK

SEQ ID NO: 2987549 - protein, 29 aa, Entamoeba invadens
KKHVNKKVKLACLKLYSVTAEGKVERLRK

SEQ ID NO: 2987550 - protein, 25 aa, Entamoeba invadens
KKIKMFREMIHRLKVAHPDIEELKL

SEQ ID NO: 2987551 - protein, 36 aa, Entamoeba invadens
KKSFFYNPDDRILLLYLFFKYDKLRIIRDLCLPFVK

SEQ ID NO: 2987552 - protein, 25 aa, Entamoeba invadens
KKTRYDLQLIFKQCDYYTLMADSAM

SEQ ID NO: 2987553 - protein, 27 aa, Entamoeba invadens
KLGTNPLVFSFPSDEPFPYCLDCATSI

SEQ ID NO: 2987554 - protein, 23 aa, Entamoeba invadens
KLPEDLYFLMKRAVSIRKHLERN

SEQ ID NO: 2987555 - protein, 20 aa, Entamoeba invadens
KLSGVPLLQINQRYVIATSQ

SEQ ID NO: 2987556 - protein, 28 aa, Entamoeba invadens
KLSKTSILRYLGILLYMGAHHDIINPVE

SEQ ID NO: 2987557 - protein, 23 aa, Entamoeba invadens
KNGYDFEQIFRFLDVLNDTLETN

SEQ ID NO: 2987558 - protein, 24 aa, Entamoeba invadens
KNNIRLLLNFHIPQGGYLSKCAGT

SEQ ID NO: 2987559 - protein, 40 aa, Entamoeba invadens
KNTIKFETFLSQYITPIERQKLEEWTGLKFQKVLFDSEVD

SEQ ID NO: 2987560 - protein, 20 aa, Entamoeba invadens
KPFDDFYVPNLIGVQILNTD

SEQ ID NO: 2987561 - protein, 20 aa, Entamoeba invadens
KPFDDFYVPNLIGVQILSMS

SEQ ID NO: 2987562 - protein, 29 aa, Entamoeba invadens
KQFYDLICQAFGGHPKFRKPRVASTAGHF

SEQ ID NO: 2987563 - protein, 17 aa, Entamoeba invadens
KQLGFCIASLFGVMLGK

SEQ ID NO: 2987564 - protein, 26 aa, Entamoeba invadens
KQPIKGDLWLNLSVQGKLHINLDTLK

SEQ ID NO: 2987565 - protein, 19 aa, Entamoeba invadens
KRCAYIYKVAVKKGSKKPA

SEQ ID NO: 2987566 - protein, 19 aa, Entamoeba invadens
KRCTLVSHATLSRDSLEKA

SEQ ID NO: 2987567 - protein, 20 aa, Entamoeba invadens
KRECIHLLEDILFEDGFVVM

SEQ ID NO: 2987568 - protein, 21 aa, Entamoeba invadens
KRECIHLLEDILFEDGFVVMY

SEQ ID NO: 2987569 - protein, 19 aa, Entamoeba invadens
KRGLPHSHILVVLANDYKL

SEQ ID NO: 2987570 - protein, 23 aa, Entamoeba invadens
KSVNCVSFFPGSEVLKFVCGSSD

SEQ ID NO: 2987571 - protein, 19 aa, Entamoeba invadens
KTIAYFPNIETLNLWSTED

SEQ ID NO: 2987572 - protein, 22 aa, Entamoeba invadens
KTLAKWLVDKITRLGFNCYRII

SEQ ID NO: 2987573 - protein, 20 aa, Entamoeba invadens
KTRFMLPCGMFKFTVHNTTE

SEQ ID NO: 2987574 - protein, 30 aa, Entamoeba invadens
KTSSFILERFIVAYDYLFKDIGTITNKKFL

SEQ ID NO: 2987575 - protein, 26 aa, Entamoeba invadens
KVCLIEVRLILPFSVEKLIEKIPKTT

SEQ ID NO: 2987576 - protein, 22 aa, Entamoeba invadens
KVDYCQYGSGFFFINGEKLKKL

SEQ ID NO: 2987577 - protein, 21 aa, Entamoeba invadens
KVGEVFGPLDDYYFSVVPAEG

SEQ ID NO: 2987578 - protein, 31 aa, Entamoeba invadens
KVLDAKYQFFGCKKFAVLADVLCGLCIGKTV

SEQ ID NO: 2987579 - protein, 26 aa, Entamoeba invadens
KVLRILKLAGLAPKLPEDLYFLMKRA

SEQ ID NO: 2987580 - protein, 19 aa, Entamoeba invadens
KWFWNNMDMGFIKAERGDD

SEQ ID NO: 2987581 - protein, 23 aa, Entamoeba invadens
KYDDTFYNIKRFLGKTFEELQDE

SEQ ID NO: 2987582 - protein, 26 aa, Entamoeba invadens
KYEKIDLIVSSPFYRATQTAKCIAEE

SEQ ID NO: 2987583 - protein, 20 aa, Entamoeba invadens
KYMELANRVFRLPVKAVECT

SEQ ID NO: 2987584 - protein, 20 aa, Entamoeba invadens
KYMEYMLKYDTVHGKFPGTI

SEQ ID NO: 2987585 - protein, 23 aa, Entamoeba invadens
LANIPHCAFFRCYKLSEISVPNS

SEQ ID NO: 2987586 - protein, 27 aa, Entamoeba invadens
LAPLNPDWMYIRAAAIARQVYLNQGLG

SEQ ID NO: 2987587 - protein, 18 aa, Entamoeba invadens
LCGGDNFKLDKFAVFKLA

SEQ ID NO: 2987588 - protein, 27 aa, Entamoeba invadens
LCMGNLRLAHYLAQYGSTLLGTVRKNR

SEQ ID NO: 2987589 - protein, 18 aa, Entamoeba invadens
LDDIVVFTPLRQEELRKI

SEQ ID NO: 2987590 - protein, 25 aa, Entamoeba invadens
LDKFRSDFIVHFYGAVFIPNKVCMV

SEQ ID NO: 2987591 - protein, 27 aa, Entamoeba invadens
LDKFRSDYLVHFYGAVFIPNKICMVTE

SEQ ID NO: 2987592 - protein, 23 aa, Entamoeba invadens
LEKDMLFEMLKAATFMNIDMLVE

SEQ ID NO: 2987593 - protein, 21 aa, Entamoeba invadens
LENFPTEGLLQFFIGTDELYG

SEQ ID NO: 2987594 - protein, 28 aa, Entamoeba invadens
LESTDLLPSLFVLALPRSGSTFLHTILS

SEQ ID NO: 2987595 - protein, 25 aa, Entamoeba invadens
LEVAADLKYYAIPEAEKRLTELKNQ

SEQ ID NO: 2987596 - protein, 29 aa, Entamoeba invadens
LFENPLRYLDAISILYIKYNLQIKCARAN

SEQ ID NO: 2987597 - protein, 18 aa, Entamoeba invadens
LGHYLGEFSITYKPVTHG

SEQ ID NO: 2987598 - protein, 23 aa, Entamoeba invadens
LGTACGRYFGVSVLSIVDAGDSD

SEQ ID NO: 2987599 - protein, 18 aa, Entamoeba invadens
LHNKLCLRFEQDHIVKRF

SEQ ID NO: 2987600 - protein, 18 aa, Entamoeba invadens
LISNFPFERIVNSCWDGA

SEQ ID NO: 2987601 - protein, 20 aa, Entamoeba invadens
LKILCQWFCRKRRLSDYNQH

SEQ ID NO: 2987602 - protein, 24 aa, Entamoeba invadens
LKSCPVKKLTLNTLFALMSQEEKN

SEQ ID NO: 2987603 - protein, 28 aa, Entamoeba invadens
LKTRGNGTLFLLYGPPGTGKTLSVEALS

SEQ ID NO: 2987604 - protein, 18 aa, Entamoeba invadens
LLCQINYSEMPKLENFPT

SEQ ID NO: 2987605 - protein, 29 aa, Entamoeba invadens
LLNKENFGFIPNIFNLITSTVAIVNRTPQ

SEQ ID NO: 2987606 - protein, 19 aa, Entamoeba invadens
LLPSRHFGAIVYTTSMGIM

SEQ ID NO: 2987607 - protein, 21 aa, Entamoeba invadens
LMQVSLYLPTLSDVYTFIQVN

SEQ ID NO: 2987608 - protein, 18 aa, Entamoeba invadens
LMRVYGALMWSLGKVMQT

SEQ ID NO: 2987609 - protein, 19 aa, Entamoeba invadens
LNNFEYYKYIPMGYKVIGS

SEQ ID NO: 2987610 - protein, 19 aa, Entamoeba invadens
LNNYLLGMICCGYSGFVSS

SEQ ID NO: 2987611 - protein, 25 aa, Entamoeba invadens
LNQFPKMFGLRNLQKELYPYNYYTQ

SEQ ID NO: 2987612 - protein, 37 aa, Entamoeba invadens
LNYKNDWKTTLFSSQFLKAPQLFVMKDSSFINTLSQN

SEQ ID NO: 2987613 - protein, 34 aa, Entamoeba invadens
LPHVIRYNGVVPRKLAMWPKYSIYVADQRYQQLA

SEQ ID NO: 2987614 - protein, 18 aa, Entamoeba invadens
LPNQINIPTLKTLDLSSN

SEQ ID NO: 2987615 - protein, 24 aa, Entamoeba invadens
LPSKLTEICNFAFFKCYSLNKIVL

SEQ ID NO: 2987616 - protein, 19 aa, Entamoeba invadens
LQKTFKKLQFYVEPEMSFV

SEQ ID NO: 2987617 - protein, 25 aa, Entamoeba invadens
LQQQMKLLRSEKWLEKVSIETKAKV

SEQ ID NO: 2987618 - protein, 22 aa, Entamoeba invadens
LRNVVLYLPKLSDLATFVCINK

SEQ ID NO: 2987619 - protein, 20 aa, Entamoeba invadens
LRVFDIIMTTPFGTSYNSFL

SEQ ID NO: 2987620 - protein, 19 aa, Entamoeba invadens
LSHYLASCGCQLLGTMRIN

SEQ ID NO: 2987621 - protein, 23 aa, Entamoeba invadens
LSKYRQYYVHYPTPLHKCIKLNQ

SEQ ID NO: 2987622 - protein, 26 aa, Entamoeba invadens
LSVEALSILFGRPMYQVSFGELGTTI

SEQ ID NO: 2987623 - protein, 19 aa, Entamoeba invadens
LTIMDSALVAAASLSKRYI

SEQ ID NO: 2987624 - protein, 28 aa, Entamoeba invadens
LVGSEKMQFPFLLNSPDFEPESERQGLF

SEQ ID NO: 2987625 - protein, 25 aa, Entamoeba invadens
LYKTKNITYLPFLSEKELYRTVTKV

SEQ ID NO: 2987626 - protein, 30 aa, Entamoeba invadens
LYNEFKLSHKWRYILFKMNDKMTEIVVDKT

SEQ ID NO: 2987627 - protein, 19 aa, Entamoeba invadens
MADAKVGLKVLYKLMDADG

SEQ ID NO: 2987628 - protein, 24 aa, Entamoeba invadens
MAKFHYNPISLTPKTRRFFPNLNT

SEQ ID NO: 2987629 - protein, 22 aa, Entamoeba invadens
MCKTLFKEFPKYFNKVKSIGES

SEQ ID NO: 2987630 - protein, 24 aa, Entamoeba invadens
MCRKGHMYSPLKVYRKWQKKTPKQ

SEQ ID NO: 2987631 - protein, 25 aa, Entamoeba invadens
MDNGIRLVVPILGKENIIITLLENG

SEQ ID NO: 2987632 - protein, 30 aa, Entamoeba invadens
MERYVIDGQKFILNVLPKSPSDHLTIEANE

SEQ ID NO: 2987633 - protein, 24 aa, Entamoeba invadens
MFHMKSIILVTKTTLRVILHTRNL

SEQ ID NO: 2987634 - protein, 19 aa, Entamoeba invadens
MGNITKFHFNPIPLTPKTL

SEQ ID NO: 2987635 - protein, 17 aa, Entamoeba invadens
MGYKVIGSDRYQLPLYL

SEQ ID NO: 2987636 - protein, 19 aa, Entamoeba invadens
MIKAFRLACYKFPGRQKLL

SEQ ID NO: 2987637 - protein, 18 aa, Entamoeba invadens
MKVIGECAVLTDGQVMVV

SEQ ID NO: 2987638 - protein, 18 aa, Entamoeba invadens
MSVMNGMDGGWFFKGELS

SEQ ID NO: 2987639 - protein, 26 aa, Entamoeba invadens
MTCSCGHQFCWLCMADYTNTHFKSNT

SEQ ID NO: 2987640 - protein, 26 aa, Entamoeba invadens
MTVDRHIFLYFVSYTEFIEKNTNFEV

SEQ ID NO: 2987641 - protein, 26 aa, Entamoeba invadens
NADLKYEAMTFLKILEISASNRSITY

SEQ ID NO: 2987642 - protein, 31 aa, Entamoeba invadens
NAIIEVDASPFRLWFLKRFGKDIASKDYIKS

SEQ ID NO: 2987643 - protein, 21 aa, Entamoeba invadens
NAPHHWMLSKLGGTFAPKPSG

SEQ ID NO: 2987644 - protein, 26 aa, Entamoeba invadens
NAVSDDLFVFLKVYNPSLLDKINYLG

SEQ ID NO: 2987645 - protein, 24 aa, Entamoeba invadens
NDGTTACVLLVTPNEYYTAHVGDS

SEQ ID NO: 2987646 - protein, 24 aa, Entamoeba invadens
NDHDVKLLCFNLLLKMANNNSDEL

SEQ ID NO: 2987647 - protein, 30 aa, Entamoeba invadens
NDTILQKIICFGMVYMVFPPDHATNYTIDV

SEQ ID NO: 2987648 - protein, 23 aa, Entamoeba invadens
NECYRTHMRWIVNNFGITESKRN

SEQ ID NO: 2987649 - protein, 17 aa, Entamoeba invadens
NEKLRITKNDLGRTKAE

SEQ ID NO: 2987650 - protein, 23 aa, Entamoeba invadens
NERRRYVMLTLNPDDNDKPFVLP

SEQ ID NO: 2987651 - protein, 30 aa, Entamoeba invadens
NESELTEDQLFAVSFAVALQNKEIAFIQQQ

SEQ ID NO: 2987652 - protein, 25 aa, Entamoeba invadens
NETFPLLVISEVKHLFIGKTEYPVY

SEQ ID NO: 2987653 - protein, 17 aa, Entamoeba invadens
NEWVLADSGYRGVGQTL

SEQ ID NO: 2987654 - protein, 30 aa, Entamoeba invadens
NFDMRPGMIIKNLKLRRPIFQKTAAGGHFG

SEQ ID NO: 2987655 - protein, 21 aa, Entamoeba invadens
NFLAFKHLTSYFYREFYRIIV

SEQ ID NO: 2987656 - protein, 23 aa, Entamoeba invadens
NFQIVVKYFYFEDDFINSILICK

SEQ ID NO: 2987657 - protein, 23 aa, Entamoeba invadens
NGHFLLAVSYDRRRFRPSIVCDG

SEQ ID NO: 2987658 - protein, 24 aa, Entamoeba invadens
NGIATLPVYYVPVAISYVNNTPYA

SEQ ID NO: 2987659 - protein, 20 aa, Entamoeba invadens
NIFLEQCSENYFTAPNVLNL

SEQ ID NO: 2987660 - protein, 17 aa, Entamoeba invadens
NINIFLEQCSENYFTAP

SEQ ID NO: 2987661 - protein, 19 aa, Entamoeba invadens
NIPFNKINELPLKYATQID

SEQ ID NO: 2987662 - protein, 21 aa, Entamoeba invadens
NKEVLFPLRKFIGSTQDGASA

SEQ ID NO: 2987663 - protein, 26 aa, Entamoeba invadens
NKRPNRFFVPQFSQNVLFTLFGEKQN

SEQ ID NO: 2987664 - protein, 23 aa, Entamoeba invadens
NLEIETFVLFKEPREALYSSIFK

SEQ ID NO: 2987665 - protein, 24 aa, Entamoeba invadens
NLIKYIEKLIERDLLRRINGGYKI

SEQ ID NO: 2987666 - protein, 24 aa, Entamoeba invadens
NLPKDLIVMISYIGKMELYYDLIN

SEQ ID NO: 2987667 - protein, 18 aa, Entamoeba invadens
NLREWLRVVSDKNEGFVL

SEQ ID NO: 2987668 - protein, 20 aa, Entamoeba invadens
NLSDFIQFLLNEFSKEEQVV

SEQ ID NO: 2987669 - protein, 32 aa, Entamoeba invadens
NNAQNQNFLVFQDLNLFLTQKYKNLAKPTSRT

SEQ ID NO: 2987670 - protein, 24 aa, Entamoeba invadens
NNMSKFHFNPIRLTSKTINYFPSI

SEQ ID NO: 2987671 - protein, 18 aa, Entamoeba invadens
NPPPPRRGGAPRGGRGGG

SEQ ID NO: 2987672 - protein, 23 aa, Entamoeba invadens
NPQQKVCIVTFDSVVTILGDCTK

SEQ ID NO: 2987673 - protein, 17 aa, Entamoeba invadens
NQCKSLEFIKLPEKLNE

SEQ ID NO: 2987674 - protein, 19 aa, Entamoeba invadens
NQIKMEVPDLVRPNMFVGV

SEQ ID NO: 2987675 - protein, 28 aa, Entamoeba invadens
NQILFTKFHENRFMALAFKKSKKIKAQD

SEQ ID NO: 2987676 - protein, 23 aa, Entamoeba invadens
NSKYYYVHSCLSYLAMKKKYSFI

SEQ ID NO: 2987677 - protein, 29 aa, Entamoeba invadens
NTEAPANMMFYLPEFKAIFVADNFASCMH

SEQ ID NO: 2987678 - protein, 24 aa, Entamoeba invadens
NTQKRRHYFIDSTVLKQLRCNGVL

SEQ ID NO: 2987679 - protein, 21 aa, Entamoeba invadens
PCTVVFEPEKAIYACDDIFVE

SEQ ID NO: 2987680 - protein, 18 aa, Entamoeba invadens
PEFMIALNSCFLPEYEKV

SEQ ID NO: 2987681 - protein, 27 aa, Entamoeba invadens
PFSQIRNPFLVELLNFLDKSVVLSDEK

SEQ ID NO: 2987682 - protein, 18 aa, Entamoeba invadens
PIPLTKKTIAYFPNIETL

SEQ ID NO: 2987683 - protein, 25 aa, Entamoeba invadens
PKFREQFKCAPPTYVKTRFLSLECV

SEQ ID NO: 2987684 - protein, 19 aa, Entamoeba invadens
PKIFFEPHAIRYLKELKEL

SEQ ID NO: 2987685 - protein, 21 aa, Entamoeba invadens
PKYMEYMLKYDTVHGKFPGTV

SEQ ID NO: 2987686 - protein, 22 aa, Entamoeba invadens
PQGAFIPFGKYLHSAENILIFK

SEQ ID NO: 2987687 - protein, 28 aa, Entamoeba invadens
PREALYSSIFKFIIKAFPKIETLQCYDY

SEQ ID NO: 2987688 - protein, 29 aa, Entamoeba invadens
PRSIYLGYNFLFNFFPHLNTLTGNLNTMV

SEQ ID NO: 2987689 - protein, 29 aa, Entamoeba invadens
PTFRTQVCELSFLTLLQQVGKMRKVHTET

SEQ ID NO: 2987690 - protein, 25 aa, Entamoeba invadens
PTKSWVSLYMRPTVIPAVQGVKGFE

SEQ ID NO: 2987691 - protein, 24 aa, Entamoeba invadens
PTLQVFTMCPLYRSVHRSALEYII

SEQ ID NO: 2987692 - protein, 17 aa, Entamoeba invadens
PVRPVEISAIILSHVKK

SEQ ID NO: 2987693 - protein, 23 aa, Entamoeba invadens
PVVDVVVVDMWYATKRDAAVVRT

SEQ ID NO: 2987694 - protein, 17 aa, Entamoeba invadens
PVYMAPEILKKDKYKKP

SEQ ID NO: 2987695 - protein, 28 aa, Entamoeba invadens
PYERHMMDLLRRGLDKKALKYAKKQLGT

SEQ ID NO: 2987696 - protein, 25 aa, Entamoeba invadens
QDKIRPLWRHYYQNTQAIIFVVDSN

SEQ ID NO: 2987697 - protein, 25 aa, Entamoeba invadens
QEEKNQFPCLFNLVKKMNAKSPTTC

SEQ ID NO: 2987698 - protein, 24 aa, Entamoeba invadens
QEPKYLIEHGFLEAVPDVSYNGKT

SEQ ID NO: 2987699 - protein, 28 aa, Entamoeba invadens
QFSDINFYRRVYWRPVSYRIYLQPHDNV

SEQ ID NO: 2987700 - protein, 25 aa, Entamoeba invadens
QIESIKYPTYYVVAGSFSGVRNYEM

SEQ ID NO: 2987701 - protein, 21 aa, Entamoeba invadens
QKNFFTIIRNTIRDYKEGQYV

SEQ ID NO: 2987702 - protein, 19 aa, Entamoeba invadens
QLKNFGKVILVGGGARIPG

SEQ ID NO: 2987703 - protein, 24 aa, Entamoeba invadens
QLNQLTYFELSYPKKFNAKEINDI

SEQ ID NO: 2987704 - protein, 17 aa, Entamoeba invadens
QMKIIFQGLAGLQALKT

SEQ ID NO: 2987705 - protein, 17 aa, Entamoeba invadens
QNMIIGVTKGYRYKMRV

SEQ ID NO: 2987706 - protein, 25 aa, Entamoeba invadens
QPVFPPTKLIIWDDYQNKGIAELEY

SEQ ID NO: 2987707 - protein, 17 aa, Entamoeba invadens
QQFQMPPRGAPRGAPRG

SEQ ID NO: 2987708 - protein, 27 aa, Entamoeba invadens
QQIEFNIIRRYYWTGCKSNVFSNEIEK

SEQ ID NO: 2987709 - protein, 27 aa, Entamoeba invadens
QQIEYKIIRGYYWTGNKSDLLSNEMAK

SEQ ID NO: 2987710 - protein, 26 aa, Entamoeba invadens
QQIEYKIIRGYYWTGNKSDLLSNEMS

SEQ ID NO: 2987711 - protein, 27 aa, Entamoeba invadens
QQIEYKIIRGYYWTGNKSDLLSNEMSK

SEQ ID NO: 2987712 - protein, 20 aa, Entamoeba invadens
QQLMRHFIKNAKENGRLGLI

SEQ ID NO: 2987713 - protein, 20 aa, Entamoeba invadens
QQVFNVLLQVLDDGRLTDGR

SEQ ID NO: 2987714 - protein, 22 aa, Entamoeba invadens
QSMKVVVTHPVFFDQKQRDLTE

SEQ ID NO: 2987715 - protein, 25 aa, Entamoeba invadens
QTIRKFIQQILRALLVLAKGNIVHC

SEQ ID NO: 2987716 - protein, 19 aa, Entamoeba invadens
QVTLNKLRAFKKLNAKKFQ

SEQ ID NO: 2987717 - protein, 18 aa, Entamoeba invadens
RAARNMIEKYYPMLTLDF

SEQ ID NO: 2987718 - protein, 21 aa, Entamoeba invadens
RALARAGMKIGRIEDVTPIPT

SEQ ID NO: 2987719 - protein, 18 aa, Entamoeba invadens
RDKRNFLLSAHEGGEFTV

SEQ ID NO: 2987720 - protein, 26 aa, Entamoeba invadens
REINDKYPTFPFAISMLENEAKAKLG

SEQ ID NO: 2987721 - protein, 18 aa, Entamoeba invadens
RELMLTGKLYDSTVPDLI

SEQ ID NO: 2987722 - protein, 17 aa, Entamoeba invadens
RFGQTVSVCFWTDNWKP

SEQ ID NO: 2987723 - protein, 23 aa, Entamoeba invadens
RFNGPAFVIFYCVCVDHKFDLHN

SEQ ID NO: 2987724 - protein, 21 aa, Entamoeba invadens
RICQMIKDMQLNKLFIDCSEA

SEQ ID NO: 2987725 - protein, 17 aa, Entamoeba invadens
RKAYFKLAQKYHPDRNP

SEQ ID NO: 2987726 - protein, 19 aa, Entamoeba invadens
RLVAKCTCGVSKVVNCTHN

SEQ ID NO: 2987727 - protein, 19 aa, Entamoeba invadens
RMPVLPKMTVCALRFTKTA

SEQ ID NO: 2987728 - protein, 20 aa, Entamoeba invadens
RMRRRYKGTGPMPRIGYGSD

SEQ ID NO: 2987729 - protein, 23 aa, Entamoeba invadens
RQNKKIEILKYLEDNRGKAIVHC

SEQ ID NO: 2987730 - protein, 31 aa, Entamoeba invadens
RRTSRWNVRILYDLLDIAALNAYKVYHHHHD

SEQ ID NO: 2987731 - protein, 18 aa, Entamoeba invadens
RRTTLIGCIALSGDVLTP

SEQ ID NO: 2987732 - protein, 24 aa, Entamoeba invadens
RSETRWLQTVLILDNMFENLPSLQ

SEQ ID NO: 2987733 - protein, 17 aa, Entamoeba invadens
RTAIGNKWTRIAQELKG

SEQ ID NO: 2987734 - protein, 32 aa, Entamoeba invadens
RTKEYFRLLYNTKRRFCLVPLSKEQSTIKLCK

SEQ ID NO: 2987735 - protein, 30 aa, Entamoeba invadens
RTSRWNVRILYDLLDIAALNAYKVYHHHHD

SEQ ID NO: 2987736 - protein, 18 aa, Entamoeba invadens
RVTLPSSLKYIPSQTFKK

SEQ ID NO: 2987737 - protein, 18 aa, Entamoeba invadens
RVVLIKAGPFVNKLAVIV

SEQ ID NO: 2987738 - protein, 27 aa, Entamoeba invadens
SEDKLETFTVQLGIKYTKKNGGVYYRI

SEQ ID NO: 2987739 - protein, 17 aa, Entamoeba invadens
SEKTRLLKLGDELHKRV

SEQ ID NO: 2987740 - protein, 28 aa, Entamoeba invadens
SEYNQIYKIIRMIGIPPSALLEKGTKTD

SEQ ID NO: 2987741 - protein, 22 aa, Entamoeba invadens
SFENLRFRFLQKLVIKKSVNDK

SEQ ID NO: 2987742 - protein, 20 aa, Entamoeba invadens
SGMPFYIYNLIEELDEEGEY

SEQ ID NO: 2987743 - protein, 39 aa, Entamoeba invadens
SGQLYKQLKHLFLDTTHAPLPLKKPEAPTFKTPYGITVH

SEQ ID NO: 2987744 - protein, 21 aa, Entamoeba invadens
SGSCTALGPALLVSTVAAGKQ

SEQ ID NO: 2987745 - protein, 25 aa, Entamoeba invadens
SHGAWIKCAILGLLKLEPKAYHNIK

SEQ ID NO: 2987746 - protein, 19 aa, Entamoeba invadens
SHMYRWMPHFKRSVTRAYG

SEQ ID NO: 2987747 - protein, 22 aa, Entamoeba invadens
SIIKRLCCNAFDKDMKPTIGGP

SEQ ID NO: 2987748 - protein, 20 aa, Entamoeba invadens
SILNVYWKRSEPMPQNMLDT

SEQ ID NO: 2987749 - protein, 27 aa, Entamoeba invadens
SKLHSLQIPNFVTWLPDFCFENATDLT

SEQ ID NO: 2987750 - protein, 18 aa, Entamoeba invadens
SLERARVEYYAVLAKVNV

SEQ ID NO: 2987751 - protein, 19 aa, Entamoeba invadens
SLETGIVKLFKRQAGQWVD

SEQ ID NO: 2987752 - protein, 21 aa, Entamoeba invadens
SLKVNPWFTLTQDIERFYDLF

SEQ ID NO: 2987753 - protein, 23 aa, Entamoeba invadens
SLNTAYTKIYPILLANKKEEIGN

SEQ ID NO: 2987754 - protein, 36 aa, Entamoeba invadens
SMYGKGITSLKSALQLFLRQLPTDSTFDIVSFGSQF

SEQ ID NO: 2987755 - protein, 25 aa, Entamoeba invadens
SNITEIVLPPYLMTLGNYSFYNCIN

SEQ ID NO: 2987756 - protein, 24 aa, Entamoeba invadens
SNVIFKGIVEQWKKCVELEDEKKQ

SEQ ID NO: 2987757 - protein, 18 aa, Entamoeba invadens
SPKLKHERLVKKLLKIKK

SEQ ID NO: 2987758 - protein, 25 aa, Entamoeba invadens
SSIKLSDLILYIRDHNRFEPYSLSD

SEQ ID NO: 2987759 - protein, 19 aa, Entamoeba invadens
STCFMNCRALSAIKLPSNL

SEQ ID NO: 2987760 - protein, 31 aa, Entamoeba invadens
STFTSSQGLLLMPPNMFKIAGELLPAVIHVA

SEQ ID NO: 2987761 - protein, 30 aa, Entamoeba invadens
STRENKCFSCQDPYYLFNQTCLSCSSGTYN

SEQ ID NO: 2987762 - protein, 27 aa, Entamoeba invadens
STVVRIYNYCFFRCYNLSSLVIPSSVT

SEQ ID NO: 2987763 - protein, 26 aa, Entamoeba invadens
SVKQDLLNVLFYGNKLFLGDGGYAGC

SEQ ID NO: 2987764 - protein, 26 aa, Entamoeba invadens
SVTTASFWRCAIPEFLLKICRQIELR

SEQ ID NO: 2987765 - protein, 17 aa, Entamoeba invadens
SVVHCLVCIFPTSVSVE

SEQ ID NO: 2987766 - protein, 20 aa, Entamoeba invadens
SYFNFKQECLWKYNTQIYDE

SEQ ID NO: 2987767 - protein, 29 aa, Entamoeba invadens
SYKCKAFRDIVQLILRSVSPCLNSVYVKN

SEQ ID NO: 2987768 - protein, 25 aa, Entamoeba invadens
TDFASSMIFYSGKYKAYCIKEEVIV

SEQ ID NO: 2987769 - protein, 22 aa, Entamoeba invadens
TDFELILADLVYKTDFVEFTNT

SEQ ID NO: 2987770 - protein, 19 aa, Entamoeba invadens
TFRDNTLNLLLQAEKVRCD

SEQ ID NO: 2987771 - protein, 23 aa, Entamoeba invadens
TGLMSAAFLVYMLDALNAHEAID

SEQ ID NO: 2987772 - protein, 18 aa, Entamoeba invadens
THYARRQNLATLDPYNLS

SEQ ID NO: 2987773 - protein, 23 aa, Entamoeba invadens
TIDLPEFTKFHQAIAGIDMADAK

SEQ ID NO: 2987774 - protein, 20 aa, Entamoeba invadens
TKEHFVRQLVSGLIPCEIPE

SEQ ID NO: 2987775 - protein, 24 aa, Entamoeba invadens
TKKDLAIDMIKFLLGKAENQFTHP

SEQ ID NO: 2987776 - protein, 24 aa, Entamoeba invadens
TKKLSFDAICWKVAFSVDAEQLAV

SEQ ID NO: 2987777 - protein, 19 aa, Entamoeba invadens
TKRSLLKRRYEQSILNEVE

SEQ ID NO: 2987778 - protein, 19 aa, Entamoeba invadens
TLDPYNLSICQLYNTLITE

SEQ ID NO: 2987779 - protein, 26 aa, Entamoeba invadens
TLQDTLRLLTILFKYGKYQEVEEAIV

SEQ ID NO: 2987780 - protein, 20 aa, Entamoeba invadens
TLSRFFKDNTEWGTALTYAQ

SEQ ID NO: 2987781 - protein, 18 aa, Entamoeba invadens
TMQALRYIDMSINRILAI

SEQ ID NO: 2987782 - protein, 23 aa, Entamoeba invadens
TNSFDVIYTSPLQRALDTAKAIS

SEQ ID NO: 2987783 - protein, 20 aa, Entamoeba invadens
TPCFYMAMGNNQFPNAQLTS

SEQ ID NO: 2987784 - protein, 40 aa, Entamoeba invadens
TPHFGCFCDPNIMLRNSDLIKFLDGWIGFGEKYTFNKIDK

SEQ ID NO: 2987785 - protein, 22 aa, Entamoeba invadens
TQCRNKIILPNMIGSVIGVYNG

SEQ ID NO: 2987786 - protein, 30 aa, Entamoeba invadens
TRNVIVKYASYLRFLMERRLYKEKLESTDL

SEQ ID NO: 2987787 - protein, 23 aa, Entamoeba invadens
TRPEFDLVALNDPFMDPKYMEYM

SEQ ID NO: 2987788 - protein, 24 aa, Entamoeba invadens
TTAKLNVETTLTQKITQLETNEKI

SEQ ID NO: 2987789 - protein, 27 aa, Entamoeba invadens
TTHPVIHKFLEKLLSFQKIINLKYQAY

SEQ ID NO: 2987790 - protein, 25 aa, Entamoeba invadens
TTKYQSVLMFLLSQTTSFVVSLSSY

SEQ ID NO: 2987791 - protein, 25 aa, Entamoeba invadens
TVAKQLLLGRRIVLVRCEQLEVCGT

SEQ ID NO: 2987792 - protein, 19 aa, Entamoeba invadens
TVATLIQNMIIGVTKGYRY

SEQ ID NO: 2987793 - protein, 23 aa, Entamoeba invadens
TVDLREIITPLALFLGGSGGGHA

SEQ ID NO: 2987794 - protein, 25 aa, Entamoeba invadens
TVSVCFWTDNWKPFSYYQRIKTNRD

SEQ ID NO: 2987795 - protein, 27 aa, Entamoeba invadens
TYDFGAPLHCLLIPSPQIDDPELDHLN

SEQ ID NO: 2987796 - protein, 18 aa, Entamoeba invadens
VAAELFLGIPLFPGENEY

SEQ ID NO: 2987797 - protein, 23 aa, Entamoeba invadens
VASLFRHFILATRIMKKFNYTPQ

SEQ ID NO: 2987798 - protein, 18 aa, Entamoeba invadens
VCDNFFCSLRLAHYLAQY

SEQ ID NO: 2987799 - protein, 30 aa, Entamoeba invadens
VDEFEYLGTVFLVSYLYTEGTVIADLVLQC

SEQ ID NO: 2987800 - protein, 20 aa, Entamoeba invadens
VDIYKKLAVSFRSARRRLKS

SEQ ID NO: 2987801 - protein, 29 aa, Entamoeba invadens
VDRYTSPWKDQFPEWALLPKTSEELMKEE

SEQ ID NO: 2987802 - protein, 30 aa, Entamoeba invadens
VECFRLFFCEEIANNLLLFSNKKIAKEHKT

SEQ ID NO: 2987803 - protein, 22 aa, Entamoeba invadens
VEDKVRELIAVWGCFYPNELSE

SEQ ID NO: 2987804 - protein, 29 aa, Entamoeba invadens
VENHFGRLIILFKLMRNKYGLLKRDYESL

SEQ ID NO: 2987805 - protein, 18 aa, Entamoeba invadens
VFPSHIKSVGYYSCFSCA

SEQ ID NO: 2987806 - protein, 23 aa, Entamoeba invadens
VGFSPQYGARPMRRYLEKKIVTD

SEQ ID NO: 2987807 - protein, 24 aa, Entamoeba invadens
VGVKMLYTSYLPTGKARLGKTIKE

SEQ ID NO: 2987808 - protein, 18 aa, Entamoeba invadens
VHCSPAFRQLKEGDFVVF

SEQ ID NO: 2987809 - protein, 22 aa, Entamoeba invadens
VIKRDNQIADLEKAVAALKDQN

SEQ ID NO: 2987810 - protein, 18 aa, Entamoeba invadens
VKDYYYGPSILSNVKVKH

SEQ ID NO: 2987811 - protein, 21 aa, Entamoeba invadens
VKINTLVRLDGLKKAFVRLAP

SEQ ID NO: 2987812 - protein, 21 aa, Entamoeba invadens
VKKLHFDRLPPNDQFKKFNIT

SEQ ID NO: 2987813 - protein, 24 aa, Entamoeba invadens
VKKTSLVHYVLDNAFAQFAGKENT

SEQ ID NO: 2987814 - protein, 27 aa, Entamoeba invadens
VLAMIQITFPVYLLTKLDIPFQMKRNL

SEQ ID NO: 2987815 - protein, 26 aa, Entamoeba invadens
VLKKEFYRIIVWFNVDFETVDRNKNR

SEQ ID NO: 2987816 - protein, 21 aa, Entamoeba invadens
VLRQFVGPHVKFPLLHQKPTL

SEQ ID NO: 2987817 - protein, 19 aa, Entamoeba invadens
VMIVSKYFKTIRDLIKLEF

SEQ ID NO: 2987818 - protein, 18 aa, Entamoeba invadens
VMTQKKTFTKWANVQLAG

SEQ ID NO: 2987819 - protein, 17 aa, Entamoeba invadens
VNCKLFVACMFFTQIVL

SEQ ID NO: 2987820 - protein, 23 aa, Entamoeba invadens
VNGKYYYLYKNDSNYWTLSTRFD

SEQ ID NO: 2987821 - protein, 20 aa, Entamoeba invadens
VQHGLPFKSFHGKTGRVWNI

SEQ ID NO: 2987822 - protein, 26 aa, Entamoeba invadens
VQKAILRSFLISEHNLFKAAALKDMK

SEQ ID NO: 2987823 - protein, 18 aa, Entamoeba invadens
VSISFPETLLQNPKTRTT

SEQ ID NO: 2987824 - protein, 20 aa, Entamoeba invadens
VSRVKFPYGYPILENFNITS

SEQ ID NO: 2987825 - protein, 19 aa, Entamoeba invadens
VTTLNGCFDPLMSALHAYE

SEQ ID NO: 2987826 - protein, 21 aa, Entamoeba invadens
VVFHTKFALNTLFDYSQCYKT

SEQ ID NO: 2987827 - protein, 24 aa, Entamoeba invadens
VVKNFQIFLRYVSSGGIHNITKQY

SEQ ID NO: 2987828 - protein, 25 aa, Entamoeba invadens
VYEKYYEMISKFKSTPVYMHYSEFS

SEQ ID NO: 2987829 - protein, 18 aa, Entamoeba invadens
VYFNTVDTAYILWKEKRE

SEQ ID NO: 2987830 - protein, 30 aa, Entamoeba invadens
WASCFFNCKALCDVTLPHKAIYLADKCFVG

SEQ ID NO: 2987831 - protein, 17 aa, Entamoeba invadens
WCKDCIYVKPLYRKLVK

SEQ ID NO: 2987832 - protein, 26 aa, Entamoeba invadens
YDFTIITHPFSVLKIKPLQTTNQPTP

SEQ ID NO: 2987833 - protein, 21 aa, Entamoeba invadens
YDPQQYAAYAAAYQQQQQSAQ

SEQ ID NO: 2987834 - protein, 25 aa, Entamoeba invadens
YDSVWMRGYWLIFSQDQAVKGKIDK

SEQ ID NO: 2987835 - protein, 29 aa, Entamoeba invadens
YEPEVFPGLVFRMTQPKVTLLVFSTGKVV

SEQ ID NO: 2987836 - protein, 18 aa, Entamoeba invadens
YEYLPSPPMIKTPHLILC

SEQ ID NO: 2987837 - protein, 17 aa, Entamoeba invadens
YHIMMSIIGASPDFFEK

SEQ ID NO: 2987838 - protein, 29 aa, Entamoeba invadens
YHISKKPLRKFPFYLFKRMADGDYSTPVG

SEQ ID NO: 2987839 - protein, 17 aa, Entamoeba invadens
YIWDSKLCWQDERVVEL

SEQ ID NO: 2987840 - protein, 21 aa, Entamoeba invadens
YLMNVVLYINTFKSLLTFSTI

SEQ ID NO: 2987841 - protein, 22 aa, Entamoeba invadens
YLRKNSLLVKSFYDVAENIRCF

SEQ ID NO: 2987842 - protein, 19 aa, Entamoeba invadens
YMEYMLKYDTVHGKFPGTI

SEQ ID NO: 2987843 - protein, 18 aa, Entamoeba invadens
YNQQLQAGKTKTAALTSA

SEQ ID NO: 2987844 - protein, 29 aa, Entamoeba invadens
YNQQRRSALLLFVNSNWKVFGAFISNQQL

SEQ ID NO: 2987845 - protein, 18 aa, Entamoeba invadens
YREVHIDIAFWNHDLLIK

SEQ ID NO: 2987846 - protein, 34 aa, Entamoeba invadens
YSFGVSLFECAIWKDPYLDKQFKFAWDIVDFVVS

SEQ ID NO: 2987847 - protein, 18 aa, Entamoeba invadens
YTPFHLTIKTKDGHFYWY

SEQ ID NO: 2987848 - protein, 28 aa, Entamoeba invadens
YVQQTIPEPLFILELKISPYHYTEDLIH

SEQ ID NO: 2987849 - protein, 23 aa, Entamoeba invadens
AAAAVVPRLTLARARGLVAPAVQ

SEQ ID NO: 2987850 - protein, 24 aa, Entamoeba invadens
AAAGTTPVLPPKPAQLVKTDEKRE

SEQ ID NO: 2987851 - protein, 23 aa, Entamoeba invadens
AAAICRVHFPFYDSKIDPQQWGQ

SEQ ID NO: 2987852 - protein, 23 aa, Entamoeba invadens
AAAQRQIDWNPNCLTLVVSPDKN

SEQ ID NO: 2987853 - protein, 24 aa, Entamoeba invadens
AAASAGMGLMWWMQRELTEKKKYM

SEQ ID NO: 2987854 - protein, 36 aa, Entamoeba invadens
AAATIILNPHFCKLISWYDNEWGYSTRLVDLIQIIS

SEQ ID NO: 2987855 - protein, 35 aa, Entamoeba invadens
AAATIILNPHFCKLVSWYDNEWGYSTRLVDLIQII

SEQ ID NO: 2987856 - protein, 25 aa, Entamoeba invadens
AAATQLLFAIPEVVDYLVSHYDTFL

SEQ ID NO: 2987857 - protein, 29 aa, Entamoeba invadens
AAAVFLHRKIMNIVPIWTKTIEKYSTYKE

SEQ ID NO: 2987858 - protein, 33 aa, Entamoeba invadens
AACLECQVSLFPPAKTFPMCTIAAQPRLPEHCI

SEQ ID NO: 2987859 - protein, 31 aa, Entamoeba invadens
AACYATGLLMARRLLQKLNLDKTFVGVSDAK

SEQ ID NO: 2987860 - protein, 19 aa, Entamoeba invadens
AACYVREKIPLPAARQYEN

SEQ ID NO: 2987861 - protein, 25 aa, Entamoeba invadens
AADAYLDMIVPKRVLAAILTAIKQN

SEQ ID NO: 2987862 - protein, 17 aa, Entamoeba invadens
AADILGARAFVDARQIV

SEQ ID NO: 2987863 - protein, 23 aa, Entamoeba invadens
AADNMLHFLHNLVTLRGAKVRSG

SEQ ID NO: 2987864 - protein, 28 aa, Entamoeba invadens
AADNMLQFLHNLLTFRGAKVRSGKVWSK

SEQ ID NO: 2987865 - protein, 24 aa, Entamoeba invadens
AADQSDRRWKTNAPASVAQEEEKN

SEQ ID NO: 2987866 - protein, 20 aa, Entamoeba invadens
AAELFVGIPIFPGNCEYNML

SEQ ID NO: 2987867 - protein, 32 aa, Entamoeba invadens
AAEYELVSAGYILRHMKYLVKTLSDTSIERNV

SEQ ID NO: 2987868 - protein, 19 aa, Entamoeba invadens
AAFILGMQAILITQGYTVV

SEQ ID NO: 2987869 - protein, 19 aa, Entamoeba invadens
AAFLLDVLGRLKTSFFVVP

SEQ ID NO: 2987870 - protein, 19 aa, Entamoeba invadens
AAFLTKTLIVDKDTIKFEC

SEQ ID NO: 2987871 - protein, 28 aa, Entamoeba invadens
AAFTRLQTTFLKEKFPRMGDALVSFGPC

SEQ ID NO: 2987872 - protein, 24 aa, Entamoeba invadens
AAFTTKWFYVDRMFVKAQFWDTAG

SEQ ID NO: 2987873 - protein, 21 aa, Entamoeba invadens
AAGALLVYDISRKESFEKVPV

SEQ ID NO: 2987874 - protein, 17 aa, Entamoeba invadens
AAGIRQQALQLQHGLAR

SEQ ID NO: 2987875 - protein, 23 aa, Entamoeba invadens
AAGKVNYFALKEKVVDIRFDDYE

SEQ ID NO: 2987876 - protein, 22 aa, Entamoeba invadens
AAGLILVEPLIDLAFAGKEFIT

SEQ ID NO: 2987877 - protein, 22 aa, Entamoeba invadens
AAGLRQMFPKAKIVIVKDACHP

SEQ ID NO: 2987878 - protein, 18 aa, Entamoeba invadens
AAGPLASKGTWAATADIG

SEQ ID NO: 2987879 - protein, 24 aa, Entamoeba invadens
AAGTLFQPLVASILRCFLRNPVSP

SEQ ID NO: 2987880 - protein, 19 aa, Entamoeba invadens
AAHKLFLTGTPLQNTLHEL

SEQ ID NO: 2987881 - protein, 23 aa, Entamoeba invadens
AAIDGIIMKLLKMGVYDENGEKK

SEQ ID NO: 2987882 - protein, 28 aa, Entamoeba invadens
AAIEASGFIMMPFNPLFKAEQLAHFCNK

SEQ ID NO: 2987883 - protein, 23 aa, Entamoeba invadens
AAIELRNLDWKQPRPKGVPFNEY

SEQ ID NO: 2987884 - protein, 24 aa, Entamoeba invadens
AAIHTRMFIVKHFKIDWNEDAREL

SEQ ID NO: 2987885 - protein, 33 aa, Entamoeba invadens
AAIILNPHFSKLIAWYDNEWGYSTRLVDLIQII

SEQ ID NO: 2987886 - protein, 17 aa, Entamoeba invadens
AAIIRTAKTLGLEITCS

SEQ ID NO: 2987887 - protein, 21 aa, Entamoeba invadens
AAINNVIPRFKTIVDACNSYV

SEQ ID NO: 2987888 - protein, 25 aa, Entamoeba invadens
AAIVFALKVFKLYPKTQTILSGKIM

SEQ ID NO: 2987889 - protein, 20 aa, Entamoeba invadens
AAKAKKQAKQYARKVEEAER

SEQ ID NO: 2987890 - protein, 21 aa, Entamoeba invadens
AAKAKKQAKQYARKVEEAERK

SEQ ID NO: 2987891 - protein, 24 aa, Entamoeba invadens
AAKAKKQAKQYTRKVEEAERKLVE

SEQ ID NO: 2987892 - protein, 30 aa, Entamoeba invadens
AAKDLPSPVLQGMWFYPLVKSIRSEQFTKI

SEQ ID NO: 2987893 - protein, 25 aa, Entamoeba invadens
AAKGILHVLLDLGFSKKLHVFVTHF

SEQ ID NO: 2987894 - protein, 24 aa, Entamoeba invadens
AAKKAWLDAKEKKSPDTQKLNGVF

SEQ ID NO: 2987895 - protein, 18 aa, Entamoeba invadens
AAKLRPVCRRAETISFLF

SEQ ID NO: 2987896 - protein, 19 aa, Entamoeba invadens
AALCLKTMHSVEKKNVLIV

SEQ ID NO: 2987897 - protein, 22 aa, Entamoeba invadens
AALDIFPQIQLKFIDSRIKEVC

SEQ ID NO: 2987898 - protein, 30 aa, Entamoeba invadens
AALGPLMEGLLANVWPYIRFSIDYNIAQTE

SEQ ID NO: 2987899 - protein, 22 aa, Entamoeba invadens
AALIKIICKLFQEIIRKPKNSD

SEQ ID NO: 2987900 - protein, 19 aa, Entamoeba invadens
AALPGLGDTVTKLTSLPGL

SEQ ID NO: 2987901 - protein, 26 aa, Entamoeba invadens
AALVFVGPVWCWDLCAPLKNACKEVL

SEQ ID NO: 2987902 - protein, 25 aa, Entamoeba invadens
AAMANPAMMMSLMSDPKVGPVMTKL

SEQ ID NO: 2987903 - protein, 22 aa, Entamoeba invadens
AAMVTDLSYFINELKKKCLEDG

SEQ ID NO: 2987904 - protein, 20 aa, Entamoeba invadens
AANEKLRIAKTDLGRTKAEL

SEQ ID NO: 2987905 - protein, 20 aa, Entamoeba invadens
AANFLAYMMKAFNTEKHTFK

SEQ ID NO: 2987906 - protein, 25 aa, Entamoeba invadens
AANNGFKGMLLVSAKTGYNLDETMN

SEQ ID NO: 2987907 - protein, 27 aa, Entamoeba invadens
AANPTFFRRGVSTRPILLITNRNHDIS

SEQ ID NO: 2987908 - protein, 28 aa, Entamoeba invadens
AAPAAEQILVHRLLYQRQGSQKERLNNI

SEQ ID NO: 2987909 - protein, 25 aa, Entamoeba invadens
AAPGPMFMRQFGYQAPIPQQMQPAM

SEQ ID NO: 2987910 - protein, 19 aa, Entamoeba invadens
AAQASPLFRSGPSPYQMSS

SEQ ID NO: 2987911 - protein, 32 aa, Entamoeba invadens
AAQNMIIAADLLGLGALPIGIMKRAPQPWEHL

SEQ ID NO: 2987912 - protein, 26 aa, Entamoeba invadens
AAQNYPNLFLFYSPVMRNNFMKEIRH

SEQ ID NO: 2987913 - protein, 25 aa, Entamoeba invadens
AARKQILAVVFKFGDLYFSEIVSEI

SEQ ID NO: 2987914 - protein, 18 aa, Entamoeba invadens
AARLQLLKAEDAHIQKLV

SEQ ID NO: 2987915 - protein, 20 aa, Entamoeba invadens
AARVFTWKDSGKIWRMRACC

SEQ ID NO: 2987916 - protein, 18 aa, Entamoeba invadens
AASLLKDYLRQLPEPLIP

SEQ ID NO: 2987917 - protein, 18 aa, Entamoeba invadens
AASNIEWLEEENIHYIIN

SEQ ID NO: 2987918 - protein, 26 aa, Entamoeba invadens
AASPRALITMLFFPQQPEPDFPSRLA

SEQ ID NO: 2987919 - protein, 42 aa, Entamoeba invadens
AATERLKVMMFNDLNVPFLKIVNPALMALYAEGKETGIVVEI

SEQ ID NO: 2987920 - protein, 26 aa, Entamoeba invadens
AATGNDWMDKTLLPKVLQTRDWGKKG

SEQ ID NO: 2987921 - protein, 23 aa, Entamoeba invadens
AATKLLHYYAKYTRRVPEITKDV

SEQ ID NO: 2987922 - protein, 23 aa, Entamoeba invadens
AATNFKIQALDPTPIITPGEASM

SEQ ID NO: 2987923 - protein, 19 aa, Entamoeba invadens
AATPVREAKLYPSAVLYVE

SEQ ID NO: 2987924 - protein, 25 aa, Entamoeba invadens
AATQPLKPGLVSSLLPILDPLFLSS

SEQ ID NO: 2987925 - protein, 19 aa, Entamoeba invadens
AATWYTLMPSVMMEYSPNS

SEQ ID NO: 2987926 - protein, 24 aa, Entamoeba invadens
AATYDQFIADLPPKSARYAVYDLE

SEQ ID NO: 2987927 - protein, 27 aa, Entamoeba invadens
AAVAVRFVRFYKMFLDFLGGELVDLEK

SEQ ID NO: 2987928 - protein, 23 aa, Entamoeba invadens
AAVLRANYSFSDKVRIFVKKVDT

SEQ ID NO: 2987929 - protein, 26 aa, Entamoeba invadens
AAVMEQYAMVLLKYALLMTDNEDWCK

SEQ ID NO: 2987930 - protein, 18 aa, Entamoeba invadens
AAYGLWENIQQFIDKRIK

SEQ ID NO: 2987931 - protein, 23 aa, Entamoeba invadens
AAYLHDIGIKFVSAPALHCNGTE

SEQ ID NO: 2987932 - protein, 29 aa, Entamoeba invadens
AAYMAHVKGYLKLLVDYLTKEHPERVATF

SEQ ID NO: 2987933 - protein, 32 aa, Entamoeba invadens
AAYNYSLNNLPNGMIFFFDFGGGTLDTAVGEK

SEQ ID NO: 2987934 - protein, 17 aa, Entamoeba invadens
AAYRKVFGSIPVYGTLL

SEQ ID NO: 2987935 - protein, 19 aa, Entamoeba invadens
AAYTLRLDRLIRENIEKLM

SEQ ID NO: 2987936 - protein, 17 aa, Entamoeba invadens
ACALIKKYIREISEPIW

SEQ ID NO: 2987937 - protein, 25 aa, Entamoeba invadens
ACDKRLYYIFDNDCILGLQQLNDKL

SEQ ID NO: 2987938 - protein, 27 aa, Entamoeba invadens
ACDLEKYIYLQLPKVLETIDHSTFGKL

SEQ ID NO: 2987939 - protein, 28 aa, Entamoeba invadens
ACDQALEVGIFPYILKLLSSTTSVDYFE

SEQ ID NO: 2987940 - protein, 23 aa, Entamoeba invadens
ACEFEIFIQPLCTCKIEESVMIT

SEQ ID NO: 2987941 - protein, 23 aa, Entamoeba invadens
ACEFELFIKPLCSCQIKENIMAI

SEQ ID NO: 2987942 - protein, 24 aa, Entamoeba invadens
ACEKFAEYVIFKIGKKKTLDKAMD

SEQ ID NO: 2987943 - protein, 32 aa, Entamoeba invadens
ACELWGCEPEALRKALIQPSFKTGKEVIEKKY

SEQ ID NO: 2987944 - protein, 27 aa, Entamoeba invadens
ACETRNRLVILLPWLEQRLSEGSPDVP

SEQ ID NO: 2987945 - protein, 24 aa, Entamoeba invadens
ACETYGGGIWNTWFDRDLGVSGRV

SEQ ID NO: 2987946 - protein, 32 aa, Entamoeba invadens
ACFALLAMLDPFSWQGLFIPIVPPQLSDFLES

SEQ ID NO: 2987947 - protein, 27 aa, Entamoeba invadens
ACFKDLYPYLLVQKMESLFAVGQNAFD

SEQ ID NO: 2987948 - protein, 19 aa, Entamoeba invadens
ACFLGIEKFGFPLSVPKEK

SEQ ID NO: 2987949 - protein, 18 aa, Entamoeba invadens
ACFQFKRGIHFLKSETTD

SEQ ID NO: 2987950 - protein, 24 aa, Entamoeba invadens
ACGDAVRLYWAVDPKTNIVVNSTF

SEQ ID NO: 2987951 - protein, 23 aa, Entamoeba invadens
ACGKTSLRWCYMQNDGYEDMGAF

SEQ ID NO: 2987952 - protein, 19 aa, Entamoeba invadens
ACIFNKSGVYCENNFINVF

SEQ ID NO: 2987953 - protein, 31 aa, Entamoeba invadens
ACIRKQGSLFIYLFRLMLATGIPELQSEKDI

SEQ ID NO: 2987954 - protein, 22 aa, Entamoeba invadens
ACKENLVFVIQTEFDYIGFYQS

SEQ ID NO: 2987955 - protein, 27 aa, Entamoeba invadens
ACLGTLHVFPVLKRLLPFMKKTSEEYI

SEQ ID NO: 2987956 - protein, 26 aa, Entamoeba invadens
ACMPNKYMKVLLFTVKCAGKGYIFKD

SEQ ID NO: 2987957 - protein, 19 aa, Entamoeba invadens
ACNFGALKPIDPFDAIMEA

SEQ ID NO: 2987958 - protein, 27 aa, Entamoeba invadens
ACNLELFPCDILKLSNLRFLNLSANEI

SEQ ID NO: 2987959 - protein, 23 aa, Entamoeba invadens
ACNTALLDEYYICTCSPSITLYF

SEQ ID NO: 2987960 - protein, 23 aa, Entamoeba invadens
ACPPLKALLYIMANGSYNGMTIE

SEQ ID NO: 2987961 - protein, 26 aa, Entamoeba invadens
ACQQAVFIGLLNMFGYEIGIERVYKI

SEQ ID NO: 2987962 - protein, 25 aa, Entamoeba invadens
ACQQSLLIGLLNHYAKITIKRAKKA

SEQ ID NO: 2987963 - protein, 27 aa, Entamoeba invadens
ACRSIGVKRWPYRKILKVDREIQKNET

SEQ ID NO: 2987964 - protein, 23 aa, Entamoeba invadens
ACSKSEEVWLHAIRLSPDDMKAD

SEQ ID NO: 2987965 - protein, 29 aa, Entamoeba invadens
ACTACKLTKIVLWPKIWPVFASQVNAKLS

SEQ ID NO: 2987966 - protein, 25 aa, Entamoeba invadens
ACTKLGIKFLVIRSLSDVPSANAEN

SEQ ID NO: 2987967 - protein, 19 aa, Entamoeba invadens
ACVDYAFHIAIKDISTKPL

SEQ ID NO: 2987968 - protein, 23 aa, Entamoeba invadens
ACVVYYINTIVTSFGIFTKDKLV

SEQ ID NO: 2987969 - protein, 23 aa, Entamoeba invadens
ACYEVAPPMYIYVKPTVEEDKIC

SEQ ID NO: 2987970 - protein, 19 aa, Entamoeba invadens
ACYKCDVSYVWFKAVKEIG

SEQ ID NO: 2987971 - protein, 26 aa, Entamoeba invadens
ACYRKGSFPLISIFEPHQKEPMDLET

SEQ ID NO: 2987972 - protein, 20 aa, Entamoeba invadens
ADAGATGAFIAKLKAKYETE

SEQ ID NO: 2987973 - protein, 21 aa, Entamoeba invadens
ADALCVIPKVLAQNAAKDATE

SEQ ID NO: 2987974 - protein, 24 aa, Entamoeba invadens
ADAYLDQYLWFEGDKRNLFPNWVK

SEQ ID NO: 2987975 - protein, 29 aa, Entamoeba invadens
ADCACETLWKILYIPLVKEGLYNPLGQNP

SEQ ID NO: 2987976 - protein, 18 aa, Entamoeba invadens
ADCFSLVSITLPQTLKII

SEQ ID NO: 2987977 - protein, 22 aa, Entamoeba invadens
ADCGVEFIHILAAESKDVAGSA

SEQ ID NO: 2987978 - protein, 20 aa, Entamoeba invadens
ADCLAFIKSFLKACGYRYDT

SEQ ID NO: 2987979 - protein, 23 aa, Entamoeba invadens
ADDIDKVLTCKINKLKTEKVQLE

SEQ ID NO: 2987980 - protein, 33 aa, Entamoeba invadens
ADDIWISQSLSPIFRIQFINGVSLENLIFEYSI

SEQ ID NO: 2987981 - protein, 23 aa, Entamoeba invadens
ADELTRTIFVGNISFESTEEALL

SEQ ID NO: 2987982 - protein, 18 aa, Entamoeba invadens
ADEPMTRILTCANCGFGW

SEQ ID NO: 2987983 - protein, 25 aa, Entamoeba invadens
ADESSLQFLFRKLEKVFGDYVSFFE

SEQ ID NO: 2987984 - protein, 31 aa, Entamoeba invadens
ADFAKDLDVVFLPFALRSFEVILPLVKDVYD

SEQ ID NO: 2987985 - protein, 26 aa, Entamoeba invadens
ADFFKDPLINYPSLANSYFLPLKISA

SEQ ID NO: 2987986 - protein, 35 aa, Entamoeba invadens
ADFHTWKKRWFVMKDHYIYYFTKNSPNAVPKGIIE

SEQ ID NO: 2987987 - protein, 21 aa, Entamoeba invadens
ADFKMFKEWKSWRQQSEKQKS

SEQ ID NO: 2987988 - protein, 26 aa, Entamoeba invadens
ADFYYHPIQTILVSLNLFSLCSVWTE

SEQ ID NO: 2987989 - protein, 25 aa, Entamoeba invadens
ADGFMIGMGLLLNPGLCEGRLDDNF

SEQ ID NO: 2987990 - protein, 23 aa, Entamoeba invadens
ADGNAIIKLFGEPLAQVVLCLDH

SEQ ID NO: 2987991 - protein, 23 aa, Entamoeba invadens
ADGQLRSYMRTPTAYYVAQLMSA

SEQ ID NO: 2987992 - protein, 24 aa, Entamoeba invadens
ADGQYLQLMRQIAALYPDKDAMKK

SEQ ID NO: 2987993 - protein, 21 aa, Entamoeba invadens
ADGVLEFYLEILKIATKSDLK

SEQ ID NO: 2987994 - protein, 23 aa, Entamoeba invadens
ADHPLLARDLILQSVSPELCGMR

SEQ ID NO: 2987995 - protein, 21 aa, Entamoeba invadens
ADIFGQVVAPLYAVKEPIPIG

SEQ ID NO: 2987996 - protein, 27 aa, Entamoeba invadens
ADIHKTLCLGILFKALPSSHAEIMKEL

SEQ ID NO: 2987997 - protein, 23 aa, Entamoeba invadens
ADIKAICTEAGLLALRERRMKVT

SEQ ID NO: 2987998 - protein, 23 aa, Entamoeba invadens
ADILLLELTVAFYKINFYSSALA

SEQ ID NO: 2987999 - protein, 24 aa, Entamoeba invadens
ADIMTYIHKMLFNAITERDIVLFF

SEQ ID NO: 2988000 - protein, 18 aa, Entamoeba invadens
ADIPFGFRAIENSAFEDN

SEQ ID NO: 2988001 - protein, 22 aa, Entamoeba invadens
ADIRQSLFMNLVITGGSSMFDN

SEQ ID NO: 2988002 - protein, 25 aa, Entamoeba invadens
ADISAYLCALIPLFESDRVDVQRKI

SEQ ID NO: 2988003 - protein, 29 aa, Entamoeba invadens
ADIVPIKSCFYLYSTLSRLIVLYDSLAKK

SEQ ID NO: 2988004 - protein, 22 aa, Entamoeba invadens
ADIWALGCTVIELITGNAPYSD

SEQ ID NO: 2988005 - protein, 24 aa, Entamoeba invadens
ADKALPVTQYLMKDKFPGVKGSVN

SEQ ID NO: 2988006 - protein, 25 aa, Entamoeba invadens
ADKGHKIFFKLPLIRRIELEGQLIQ

SEQ ID NO: 2988007 - protein, 27 aa, Entamoeba invadens
ADKHPDLAIPLWYSFGTVVILLEEVVS

SEQ ID NO: 2988008 - protein, 20 aa, Entamoeba invadens
ADKILALNRPVILSNTSVFC

SEQ ID NO: 2988009 - protein, 18 aa, Entamoeba invadens
ADKKVVTTLYILIKDRVD

SEQ ID NO: 2988010 - protein, 26 aa, Entamoeba invadens
ADKLGTYFKKCMLRNLRLHYTDDQLI

SEQ ID NO: 2988011 - protein, 17 aa, Entamoeba invadens
ADKLLCVDLCTTGKPVE

SEQ ID NO: 2988012 - protein, 24 aa, Entamoeba invadens
ADKLYQLQNFQSLAAFYFGFEYPP

SEQ ID NO: 2988013 - protein, 19 aa, Entamoeba invadens
ADLAMIVMKLIPQKPQIES

SEQ ID NO: 2988014 - protein, 26 aa, Entamoeba invadens
ADLAYKQPHLLLLDEPSNHLDIETVE

SEQ ID NO: 2988015 - protein, 21 aa, Entamoeba invadens
ADLEQQLQDLEYRPRDNQIAD

SEQ ID NO: 2988016 - protein, 25 aa, Entamoeba invadens
ADLLIEKKFIKEFPQGLLDESINTA

SEQ ID NO: 2988017 - protein, 22 aa, Entamoeba invadens
ADLLSFIHVMYLKLEDILAKQD

SEQ ID NO: 2988018 - protein, 25 aa, Entamoeba invadens
ADLQGVFQDKWFYLTDPAVLSSTDD

SEQ ID NO: 2988019 - protein, 23 aa, Entamoeba invadens
ADLSLRIFLKYKKAEMVVFQQQN

SEQ ID NO: 2988020 - protein, 29 aa, Entamoeba invadens
ADNLAVCWTPVLFDLLDLLPKMKEVTEIV

SEQ ID NO: 2988021 - protein, 24 aa, Entamoeba invadens
ADNYRKVIFHFPSTDKQSFNEAWL

SEQ ID NO: 2988022 - protein, 20 aa, Entamoeba invadens
ADPEWVSLTLGVLICLECCG

SEQ ID NO: 2988023 - protein, 28 aa, Entamoeba invadens
ADPTWKNPYLRIKIHKFLNLDSLVVLVW

SEQ ID NO: 2988024 - protein, 23 aa, Entamoeba invadens
ADQLSWLELKIYNSFIIAIDAND

SEQ ID NO: 2988025 - protein, 26 aa, Entamoeba invadens
ADQSVAKHVMLLKTLTIAGRTCNLYD

SEQ ID NO: 2988026 - protein, 17 aa, Entamoeba invadens
ADQSVVIAKDFLMKMSF

SEQ ID NO: 2988027 - protein, 26 aa, Entamoeba invadens
ADRKQMFPIDVLLEPLSFPNETQLNH

SEQ ID NO: 2988028 - protein, 24 aa, Entamoeba invadens
ADRMGTEYLVNKLNTLLLQHIQKC

SEQ ID NO: 2988029 - protein, 25 aa, Entamoeba invadens
ADSFEILDFLYTLTTTRWSQREIGS

SEQ ID NO: 2988030 - protein, 25 aa, Entamoeba invadens
ADSRYPITCPLVLLDNVIPTFNLQS

SEQ ID NO: 2988031 - protein, 21 aa, Entamoeba invadens
ADSSYYWESYSHPGIHDEMLK

SEQ ID NO: 2988032 - protein, 23 aa, Entamoeba invadens
ADTAISCLSLAMKALEDEDQRRK

SEQ ID NO: 2988033 - protein, 25 aa, Entamoeba invadens
ADTIIMLYVKWRHSATAYSKLYDML

SEQ ID NO: 2988034 - protein, 20 aa, Entamoeba invadens
ADTLRELLIISLEAYDKNEI

SEQ ID NO: 2988035 - protein, 18 aa, Entamoeba invadens
ADTTLQPLLKKCEKENMV

SEQ ID NO: 2988036 - protein, 21 aa, Entamoeba invadens
ADVAPFNAIDWIETSTSTIIL

SEQ ID NO: 2988037 - protein, 26 aa, Entamoeba invadens
ADVEPFVVQLKAFLEKHDMDVKVKLR

SEQ ID NO: 2988038 - protein, 17 aa, Entamoeba invadens
ADVFLLNKEIFKQFSQY

SEQ ID NO: 2988039 - protein, 38 aa, Entamoeba invadens
ADVFSFSISLFECAIWKDPYLDKQFKFAWDIVDFVVSG

SEQ ID NO: 2988040 - protein, 27 aa, Entamoeba invadens
ADVLLPSFIYIVIRANLPHLSSTYSYL

SEQ ID NO: 2988041 - protein, 41 aa, Entamoeba invadens
ADVYSFAITMVECFLWSNAYPKTIYMYPWTIADDVASGKRP

SEQ ID NO: 2988042 - protein, 29 aa, Entamoeba invadens
ADVYSLAITLWELLYEKVPFCEYEKKCEK

SEQ ID NO: 2988043 - protein, 28 aa, Entamoeba invadens
ADVYSLAVTLFETLIWGEAYTGDEFKFP

SEQ ID NO: 2988044 - protein, 24 aa, Entamoeba invadens
ADVYYLQFRCMNALYWEMRIQKKK

SEQ ID NO: 2988045 - protein, 17 aa, Entamoeba invadens
ADWLFSELNLLISNFPF

SEQ ID NO: 2988046 - protein, 17 aa, Entamoeba invadens
ADWSKQLEIAENQDREA

SEQ ID NO: 2988047 - protein, 20 aa, Entamoeba invadens
ADYIIYTTLAWRNVKYGNCS

SEQ ID NO: 2988048 - protein, 19 aa, Entamoeba invadens
ADYLFLIDGVMLNNDMSFD

SEQ ID NO: 2988049 - protein, 21 aa, Entamoeba invadens
ADYLRSRQMLFRTSGERKSID

SEQ ID NO: 2988050 - protein, 19 aa, Entamoeba invadens
ADYVLKDPFIILEMPIRSK

SEQ ID NO: 2988051 - protein, 20 aa, Entamoeba invadens
ADYVNNQHICTACFAPYVTS

SEQ ID NO: 2988052 - protein, 21 aa, Entamoeba invadens
AEAFEVIPFTLAENAGLNPMQ

SEQ ID NO: 2988053 - protein, 38 aa, Entamoeba invadens
AEAIEVLTTLIFLRFLFVPFLATPSLLKCFQRAAGVAV

SEQ ID NO: 2988054 - protein, 25 aa, Entamoeba invadens
AEANHINCYLWEIQIDKKYVHQGFG

SEQ ID NO: 2988055 - protein, 23 aa, Entamoeba invadens
AEAPSEFVFYIPEFKAFCQAEEV

SEQ ID NO: 2988056 - protein, 25 aa, Entamoeba invadens
AEAQLQSYIFGFKGSIDILLKNDEG

SEQ ID NO: 2988057 - protein, 34 aa, Entamoeba invadens
AEASTQAMLKFIYHRLFVFIVEQVNRVMRKDGDT

SEQ ID NO: 2988058 - protein, 17 aa, Entamoeba invadens
AEAYLVGLFEDTNLCAI

SEQ ID NO: 2988059 - protein, 29 aa, Entamoeba invadens
AECLRVWDFFFAYPKRKLYLFFTSAIILE

SEQ ID NO: 2988060 - protein, 23 aa, Entamoeba invadens
AECPFFHLSQLLLDPHESPLNAF

SEQ ID NO: 2988061 - protein, 24 aa, Entamoeba invadens
AECQYYLGFYDANPANLNPLTPTK

SEQ ID NO: 2988062 - protein, 26 aa, Entamoeba invadens
AEDCRKMAKLVKNVFLWCEVEGNTLM

SEQ ID NO: 2988063 - protein, 27 aa, Entamoeba invadens
AEDERAKRERNKKVQIIQFGKKQSVVG

SEQ ID NO: 2988064 - protein, 17 aa, Entamoeba invadens
AEDITITFLAPSKTYNI

SEQ ID NO: 2988065 - protein, 23 aa, Entamoeba invadens
AEDKLEFSAFYYSDECVLYHFKS

SEQ ID NO: 2988066 - protein, 22 aa, Entamoeba invadens
AEDLFPVPMTTGESYFSISVGD

SEQ ID NO: 2988067 - protein, 23 aa, Entamoeba invadens
AEDMRRVLLFPNVSSFQMNVKGM

SEQ ID NO: 2988068 - protein, 25 aa, Entamoeba invadens
AEDPTLIDVFLFQQGHAKPLQDKFE

SEQ ID NO: 2988069 - protein, 26 aa, Entamoeba invadens
AEDRFRLLIVDSVTSLFRVDFSGRGE

SEQ ID NO: 2988070 - protein, 25 aa, Entamoeba invadens
AEDVLPFLLEFLRRNRLVENTLNLI

SEQ ID NO: 2988071 - protein, 26 aa, Entamoeba invadens
AEDVWETIWKSLSPLFKKCCLHPDED

SEQ ID NO: 2988072 - protein, 31 aa, Entamoeba invadens
AEDYESVLLSILKSKLLLRKVIEQRMYQDRI

SEQ ID NO: 2988073 - protein, 17 aa, Entamoeba invadens
AEEFLGYLLGIVESEGL

SEQ ID NO: 2988074 - protein, 19 aa, Entamoeba invadens
AEEIWKFVQIFSDLDQENH

SEQ ID NO: 2988075 - protein, 26 aa, Entamoeba invadens
AEELRYLVGLVFLYEKVKKEIGEMES

SEQ ID NO: 2988076 - protein, 32 aa, Entamoeba invadens
AEENSHWVITILSFIPGALFPAPLNLKEIGFT

SEQ ID NO: 2988077 - protein, 19 aa, Entamoeba invadens
AEFFVLIKCIALGDEGTSS

SEQ ID NO: 2988078 - protein, 20 aa, Entamoeba invadens
AEFGAYFLRNVERMTLKLPI

SEQ ID NO: 2988079 - protein, 25 aa, Entamoeba invadens
AEFIPKHLMSLLGKYKKANLNEKLV

SEQ ID NO: 2988080 - protein, 20 aa, Entamoeba invadens
AEFKLLLNDLRRGFRRSEIR

SEQ ID NO: 2988081 - protein, 22 aa, Entamoeba invadens
AEFVEELTELFFLISQHAETNK

SEQ ID NO: 2988082 - protein, 28 aa, Entamoeba invadens
AEGAGQGAIWFMQREVTEKKKFMPVSKG

SEQ ID NO: 2988083 - protein, 17 aa, Entamoeba invadens
AEGFQLPLLNDTNFIIN

SEQ ID NO: 2988084 - protein, 24 aa, Entamoeba invadens
AEGFVQIIHHLFMYIQNTEMLQKF

SEQ ID NO: 2988085 - protein, 25 aa, Entamoeba invadens
AEGGNITLCFFYANSFRIQKDFKEM

SEQ ID NO: 2988086 - protein, 31 aa, Entamoeba invadens
AEGIKTMKYSFYSSSLLFVYDWNTEKADCRW

SEQ ID NO: 2988087 - protein, 22 aa, Entamoeba invadens
AEGRFHKCFYKRSDSSFATMKF

SEQ ID NO: 2988088 - protein, 25 aa, Entamoeba invadens
AEIFHKWITFCHIIFTDSSSCKKAI

SEQ ID NO: 2988089 - protein, 20 aa, Entamoeba invadens
AEIHLSKIMKLPYIHTEDVK

SEQ ID NO: 2988090 - protein, 25 aa, Entamoeba invadens
AEIKCKTIIMATGVDCLLFTEVPCE

SEQ ID NO: 2988091 - protein, 24 aa, Entamoeba invadens
AEIKRKESELVERLNELETNKKLQ

SEQ ID NO: 2988092 - protein, 17 aa, Entamoeba invadens
AEILEMVGDLPFAEIKP

SEQ ID NO: 2988093 - protein, 63 aa, Entamoeba invadens
AEIMQHNTIYVLSSFWVCGLLQYNSTPVLCFWNTEKTLALHIFNTFCLIFQNSQEYKYDMSKG

SEQ ID NO: 2988094 - protein, 21 aa, Entamoeba invadens
AEINQLLSLIINAFYSNKDIF

SEQ ID NO: 2988095 - protein, 28 aa, Entamoeba invadens
AEINRIRRSFLKLLQQNLLTLDNNGGDA

SEQ ID NO: 2988096 - protein, 19 aa, Entamoeba invadens
AEITKPLELPCTIQTPFTA

SEQ ID NO: 2988097 - protein, 26 aa, Entamoeba invadens
AEKFSEYFLKAPIVRIPGRTYPVTIE

SEQ ID NO: 2988098 - protein, 23 aa, Entamoeba invadens
AEKHKLPCKVGITASAPGFFNCQ

SEQ ID NO: 2988099 - protein, 22 aa, Entamoeba invadens
AEKLLHFLSDFEGCKQLRIDGN

SEQ ID NO: 2988100 - protein, 18 aa, Entamoeba invadens
AEKLMFLGAPKVTLSDPS

SEQ ID NO: 2988101 - protein, 17 aa, Entamoeba invadens
AEKLRLVQYRQHQAELL

SEQ ID NO: 2988102 - protein, 17 aa, Entamoeba invadens
AEKLWRRFVEEKKGKWS

SEQ ID NO: 2988103 - protein, 18 aa, Entamoeba invadens
AEKLYTQGYISYPRTEST

SEQ ID NO: 2988104 - protein, 24 aa, Entamoeba invadens
AEKNYYEIVVWFSVDYETVDKNNG

SEQ ID NO: 2988105 - protein, 22 aa, Entamoeba invadens
AEKPKILIFGKHNSDKIQIIEA

SEQ ID NO: 2988106 - protein, 43 aa, Entamoeba invadens
AEKRDHRLIGRQQELFFFHTLSPGSCFWLPHGTRIYNKLIDMM

SEQ ID NO: 2988107 - protein, 25 aa, Entamoeba invadens
AEKVYLETVPAFRYELLGTEKFVEK

SEQ ID NO: 2988108 - protein, 22 aa, Entamoeba invadens
AEKVYWKNKLLGFYSTMDSTIA

SEQ ID NO: 2988109 - protein, 26 aa, Entamoeba invadens
AEKYNFKFIGTIPIEPKVCMSGETGT

SEQ ID NO: 2988110 - protein, 25 aa, Entamoeba invadens
AELEKIENVILLLKSTQQVIKKTKE

SEQ ID NO: 2988111 - protein, 18 aa, Entamoeba invadens
AELFLAGFAKSRRYYTNT

SEQ ID NO: 2988112 - protein, 18 aa, Entamoeba invadens
AELFTKMTQLFAGDYMED

SEQ ID NO: 2988113 - protein, 21 aa, Entamoeba invadens
AELFVGIPIFPGNSEYNMIYK

SEQ ID NO: 2988114 - protein, 27 aa, Entamoeba invadens
AELHAMRAIFMIPNAPPPKLMTPDDAT

SEQ ID NO: 2988115 - protein, 23 aa, Entamoeba invadens
AELLESLKTWLEEKWNVVEGQIV

SEQ ID NO: 2988116 - protein, 21 aa, Entamoeba invadens
AELLRLVKYLIDVFKCSRLAY

SEQ ID NO: 2988117 - protein, 24 aa, Entamoeba invadens
AELMTGVLLYHERVDIKPTTLLHL

SEQ ID NO: 2988118 - protein, 18 aa, Entamoeba invadens
AELSLFMLDGMKSVELPT

SEQ ID NO: 2988119 - protein, 27 aa, Entamoeba invadens
AELSYGYLLHLIVLYATSLNLKTVWLI

SEQ ID NO: 2988120 - protein, 25 aa, Entamoeba invadens
AELVKIIYVPTLLRYSVETFDRVRF

SEQ ID NO: 2988121 - protein, 18 aa, Entamoeba invadens
AELVKKIEDGLIDSDMLK

SEQ ID NO: 2988122 - protein, 31 aa, Entamoeba invadens
AEMCIKIKPDFIKGYNRKAFSHYCMKEYHKA

SEQ ID NO: 2988123 - protein, 27 aa, Entamoeba invadens
AEMDTAISALFQFCKLQHFNANFRLIE

SEQ ID NO: 2988124 - protein, 19 aa, Entamoeba invadens
AEMEMKMKLMGSQMNVPQR

SEQ ID NO: 2988125 - protein, 18 aa, Entamoeba invadens
AEMLFNVPFSSYLVDTEQ

SEQ ID NO: 2988126 - protein, 26 aa, Entamoeba invadens
AEMLPQDYLQRLISLSQRDVDLCLTA

SEQ ID NO: 2988127 - protein, 20 aa, Entamoeba invadens
AEMPAESGYPAYLAARLASF

SEQ ID NO: 2988128 - protein, 25 aa, Entamoeba invadens
AEMSNGYLELLIGHKFIADIKQTKS

SEQ ID NO: 2988129 - protein, 26 aa, Entamoeba invadens
AEMTERFELFILKREIANAYTELNNP

SEQ ID NO: 2988130 - protein, 29 aa, Entamoeba invadens
AEMVQLPQYLILNIKLFEQTYYGYSKKSD

SEQ ID NO: 2988131 - protein, 17 aa, Entamoeba invadens
AEMYKKAIKIHPEDEKV

SEQ ID NO: 2988132 - protein, 25 aa, Entamoeba invadens
AENKFEFNNFVFLDSQPYQVDTTES

SEQ ID NO: 2988133 - protein, 23 aa, Entamoeba invadens
AENQPLAFWVFDIKSVEDAINRW

SEQ ID NO: 2988134 - protein, 23 aa, Entamoeba invadens
AENVYKLVLYFARALENEGTEDD

SEQ ID NO: 2988135 - protein, 26 aa, Entamoeba invadens
AEPINDPLLMVIASKFPGLVKVDLRK

SEQ ID NO: 2988136 - protein, 27 aa, Entamoeba invadens
AEPNKDIFVIFINRLSVLISEVITFNT

SEQ ID NO: 2988137 - protein, 25 aa, Entamoeba invadens
AEPQKFLPNVLTPKTRRLLSCEAQM

SEQ ID NO: 2988138 - protein, 23 aa, Entamoeba invadens
AEQEFAFFLNPPCQKQIFTGPDM

SEQ ID NO: 2988139 - protein, 24 aa, Entamoeba invadens
AEQEKKAAQRKEWAKKEAAEQKAF

SEQ ID NO: 2988140 - protein, 26 aa, Entamoeba invadens
AEQETVLMALLLKVGVESFTLMCPRK

SEQ ID NO: 2988141 - protein, 17 aa, Entamoeba invadens
AEQFTLYSKWMAKPRNL

SEQ ID NO: 2988142 - protein, 24 aa, Entamoeba invadens
AERCGITVLTPLWQKDQREVLDEI

SEQ ID NO: 2988143 - protein, 20 aa, Entamoeba invadens
AERCHFLERKIETMERQLTK

SEQ ID NO: 2988144 - protein, 28 aa, Entamoeba invadens
AEREARNPVFYFLQKNHPNYQYFAQLCE

SEQ ID NO: 2988145 - protein, 17 aa, Entamoeba invadens
AEREVRMAFVDTALHTK

SEQ ID NO: 2988146 - protein, 17 aa, Entamoeba invadens
AERKVIFLETCYSSGLT

SEQ ID NO: 2988147 - protein, 27 aa, Entamoeba invadens
AERRNNLQWFRCPPKIFFEPHAIRYLK

SEQ ID NO: 2988148 - protein, 32 aa, Entamoeba invadens
AERRNNLQWFRVPPKIFFEPHAIRYLKELKEL

SEQ ID NO: 2988149 - protein, 27 aa, Entamoeba invadens
AERVEIAEAIFVRWKTRKLMKERDIEY

SEQ ID NO: 2988150 - protein, 27 aa, Entamoeba invadens
AERYLRKNSLLVKSFYDVAENIRCFEC

SEQ ID NO: 2988151 - protein, 25 aa, Entamoeba invadens
AESCVTCAFGYYYDRTSNDCIYVGE

SEQ ID NO: 2988152 - protein, 26 aa, Entamoeba invadens
AESHRVKFVLISWASESITKPKLRAS

SEQ ID NO: 2988153 - protein, 24 aa, Entamoeba invadens
AESLRPVLGYDLLQYLDVLPVTPE

SEQ ID NO: 2988154 - protein, 31 aa, Entamoeba invadens
AESQIQTHKLAVPLLLFHNGGNFNIDIDNQS

SEQ ID NO: 2988155 - protein, 24 aa, Entamoeba invadens
AESRYPITCPLVLLDDVIPTFNLQ

SEQ ID NO: 2988156 - protein, 29 aa, Entamoeba invadens
AESTRYRQKALLLLRQKKQVDQHRDMSDK

SEQ ID NO: 2988157 - protein, 23 aa, Entamoeba invadens
AETFDVYCWYGSQVSIAKRGVCS

SEQ ID NO: 2988158 - protein, 25 aa, Entamoeba invadens
AETRYPITCPLVLLDDVIPTFNLQS

SEQ ID NO: 2988159 - protein, 18 aa, Entamoeba invadens
AETVLRVLVKDAGEKWDP

SEQ ID NO: 2988160 - protein, 19 aa, Entamoeba invadens
AETYFPRVLNLYLTHLIEP

SEQ ID NO: 2988161 - protein, 17 aa, Entamoeba invadens
AEVFGFGHLKGALNIPY

SEQ ID NO: 2988162 - protein, 22 aa, Entamoeba invadens
AEVGIITVSPFPKTFDASVRDW

SEQ ID NO: 2988163 - protein, 21 aa, Entamoeba invadens
AEVLYPLTAALNLKTQYTLQA

SEQ ID NO: 2988164 - protein, 26 aa, Entamoeba invadens
AEVQNIIILYLCQFTELSVRKPSKQA

SEQ ID NO: 2988165 - protein, 23 aa, Entamoeba invadens
AEVTRLFYKAAILENTMLGDDET

SEQ ID NO: 2988166 - protein, 21 aa, Entamoeba invadens
AEWMLKLFKESCGIKILESSK

SEQ ID NO: 2988167 - protein, 17 aa, Entamoeba invadens
AEWSVVCDFTLLKILAT

SEQ ID NO: 2988168 - protein, 25 aa, Entamoeba invadens
AEYQYYLGFYDGNPANLNPLTPIKL

SEQ ID NO: 2988169 - protein, 28 aa, Entamoeba invadens
AEYSIASLPTFVFFQNQNVVKKAPGSSE

SEQ ID NO: 2988170 - protein, 32 aa, Entamoeba invadens
AEYTDLFSYYYHKVDYYFLLYAVDSRESFENI

SEQ ID NO: 2988171 - protein, 21 aa, Entamoeba invadens
AFAALLRMIRPYSSDVKNFIN

SEQ ID NO: 2988172 - protein, 18 aa, Entamoeba invadens
AFCRNLERVVLPKTTQRL

SEQ ID NO: 2988173 - protein, 23 aa, Entamoeba invadens
AFDEIFKVALARQVRMVKKQQDK

SEQ ID NO: 2988174 - protein, 27 aa, Entamoeba invadens
AFDEIINLFYFVYRNNFQPLPNTTLTS

SEQ ID NO: 2988175 - protein, 25 aa, Entamoeba invadens
AFDKSIYMPIFLSQSPNVTVIDSGD

SEQ ID NO: 2988176 - protein, 18 aa, Entamoeba invadens
AFDLKYLSTLEIIVLDKF

SEQ ID NO: 2988177 - protein, 25 aa, Entamoeba invadens
AFDLLKEFITLIEATNGDIEKQYSV

SEQ ID NO: 2988178 - protein, 24 aa, Entamoeba invadens
AFDNPHEFLLRIKRQLLTQRTFKE

SEQ ID NO: 2988179 - protein, 27 aa, Entamoeba invadens
AFDQKSKIWSLKLLDSIPSKFVKMFSS

SEQ ID NO: 2988180 - protein, 21 aa, Entamoeba invadens
AFDRFQVGSVYFIYCRQFKEK

SEQ ID NO: 2988181 - protein, 18 aa, Entamoeba invadens
AFDVLYLDGVDLMRKPLL

SEQ ID NO: 2988182 - protein, 27 aa, Entamoeba invadens
AFEERRGEVFFYRPLDKPNHGTIESHI

SEQ ID NO: 2988183 - protein, 18 aa, Entamoeba invadens
AFEFYIDFLPEEATEDKK

SEQ ID NO: 2988184 - protein, 17 aa, Entamoeba invadens
AFEIKTLFYRTFYVMNK

SEQ ID NO: 2988185 - protein, 19 aa, Entamoeba invadens
AFEKLLERLIVESKKAGGD

SEQ ID NO: 2988186 - protein, 24 aa, Entamoeba invadens
AFEKTLSEIIIPDSVTRLNYECFT

SEQ ID NO: 2988187 - protein, 26 aa, Entamoeba invadens
AFEMVNAKYFIIASACYVLALKYAGS

SEQ ID NO: 2988188 - protein, 24 aa, Entamoeba invadens
AFENIRSFFAYKEQYYEISYKMSH

SEQ ID NO: 2988189 - protein, 27 aa, Entamoeba invadens
AFENLYPILIIFIGKKIHNIIKSAIEN

SEQ ID NO: 2988190 - protein, 26 aa, Entamoeba invadens
AFENRGELCLYFLLELLDCVNCETFN

SEQ ID NO: 2988191 - protein, 32 aa, Entamoeba invadens
AFEPKRGFFSGLYQMIFHPIDFFTPEEKKVGT

SEQ ID NO: 2988192 - protein, 25 aa, Entamoeba invadens
AFETKKILPGILEDLLKENYESKDL

SEQ ID NO: 2988193 - protein, 27 aa, Entamoeba invadens
AFETLLYLKEIKLPNDLKFIGKNIFGL

SEQ ID NO: 2988194 - protein, 17 aa, Entamoeba invadens
AFFCSQLKEKKNKMKYT

SEQ ID NO: 2988195 - protein, 18 aa, Entamoeba invadens
AFFHCYNIKNVTTNGLKK

SEQ ID NO: 2988196 - protein, 21 aa, Entamoeba invadens
AFFLNNFALIIQRGFNSLVIK

SEQ ID NO: 2988197 - protein, 18 aa, Entamoeba invadens
AFFSSNIPHVIFINGTPG

SEQ ID NO: 2988198 - protein, 23 aa, Entamoeba invadens
AFGDLCFFLCSNLKKISISHVSY

SEQ ID NO: 2988199 - protein, 18 aa, Entamoeba invadens
AFGFERYIPQFMKFFEDN

SEQ ID NO: 2988200 - protein, 20 aa, Entamoeba invadens
AFGFSKFLRNVTLPNSLIWL

SEQ ID NO: 2988201 - protein, 21 aa, Entamoeba invadens
AFGRKIKMWTEVRGIELPIFK

SEQ ID NO: 2988202 - protein, 24 aa, Entamoeba invadens
AFGVFVRLMPFKLVNDYLASALQK

SEQ ID NO: 2988203 - protein, 17 aa, Entamoeba invadens
AFHLSFVFPKPDDDRRP

SEQ ID NO: 2988204 - protein, 19 aa, Entamoeba invadens
AFIADPFLDRGVAYVVRKV

SEQ ID NO: 2988205 - protein, 19 aa, Entamoeba invadens
AFIAKLKAKYETELEEIET

SEQ ID NO: 2988206 - protein, 19 aa, Entamoeba invadens
AFICIPHFAAPEHFLLVAI

SEQ ID NO: 2988207 - protein, 33 aa, Entamoeba invadens
AFIHEDPITDVFFLYEILVMMSIKFSNSVTSAA

SEQ ID NO: 2988208 - protein, 20 aa, Entamoeba invadens
AFIHNLVNNKYFTPSTTLLV

SEQ ID NO: 2988209 - protein, 19 aa, Entamoeba invadens
AFIHNLVNNKYFTPSTTLS

SEQ ID NO: 2988210 - protein, 29 aa, Entamoeba invadens
AFILATNVSITILLVDQIVMQKPAGGPKM

SEQ ID NO: 2988211 - protein, 19 aa, Entamoeba invadens
AFINVPGLVFILSKVIVMN

SEQ ID NO: 2988212 - protein, 20 aa, Entamoeba invadens
AFIPSFEGILLPMLQAVLTT

SEQ ID NO: 2988213 - protein, 28 aa, Entamoeba invadens
AFIVNSDRHPTCFAFGIGYDIGAMIVDG

SEQ ID NO: 2988214 - protein, 18 aa, Entamoeba invadens
AFIYTNCDMFFSTLLALT

SEQ ID NO: 2988215 - protein, 21 aa, Entamoeba invadens
AFKALREMYVLFSGNVLIGSE

SEQ ID NO: 2988216 - protein, 29 aa, Entamoeba invadens
AFKEQLQPLLPPFIESLLKRIDEIITSTD

SEQ ID NO: 2988217 - protein, 26 aa, Entamoeba invadens
AFKIPEDFFYLTDKGGRYKTTLRNGD

SEQ ID NO: 2988218 - protein, 20 aa, Entamoeba invadens
AFLIGMAASFGYQIDINKLY

SEQ ID NO: 2988219 - protein, 27 aa, Entamoeba invadens
AFLPLDTFVLCYSAIYDWNVTLPQVLH

SEQ ID NO: 2988220 - protein, 18 aa, Entamoeba invadens
AFLSFYKDYEVDCGLSDW

SEQ ID NO: 2988221 - protein, 18 aa, Entamoeba invadens
AFLSTLLQNTPKLKTLIL

SEQ ID NO: 2988222 - protein, 34 aa, Entamoeba invadens
AFMEHLRTFQKLPGPFLIVTPLSTLEHWRREICE

SEQ ID NO: 2988223 - protein, 24 aa, Entamoeba invadens
AFNDLPKEIKLARAKEMIKQKKNT

SEQ ID NO: 2988224 - protein, 20 aa, Entamoeba invadens
AFNGLFGRENYLMQILTNLI

SEQ ID NO: 2988225 - protein, 20 aa, Entamoeba invadens
AFNKRMFETRLLSVLIDIID

SEQ ID NO: 2988226 - protein, 18 aa, Entamoeba invadens
AFNNFYPSSYFIAGYRFK

SEQ ID NO: 2988227 - protein, 23 aa, Entamoeba invadens
AFNRFGFEQIKLDDIKIFCLEQT

SEQ ID NO: 2988228 - protein, 30 aa, Entamoeba invadens
AFNSINFKAISFYFNLFDPSHFLDDESDFD

SEQ ID NO: 2988229 - protein, 18 aa, Entamoeba invadens
AFNTFKVNLVLDLKANKE

SEQ ID NO: 2988230 - protein, 24 aa, Entamoeba invadens
AFNTHLRMLLSNLKKNQKLKDSIE

SEQ ID NO: 2988231 - protein, 19 aa, Entamoeba invadens
AFPDERLFMFVAAALMVEN

SEQ ID NO: 2988232 - protein, 27 aa, Entamoeba invadens
AFPEKLDPFTFKLLLPRLVLSQNEQTE

SEQ ID NO: 2988233 - protein, 32 aa, Entamoeba invadens
AFPGDIVTLGIFPPSLWKLSLCDKIQFLDGPF

SEQ ID NO: 2988234 - protein, 18 aa, Entamoeba invadens
AFPREMFRYPWEVVNFIT

SEQ ID NO: 2988235 - protein, 26 aa, Entamoeba invadens
AFQCLRLVLTERTDFSFLIPENAIFE

SEQ ID NO: 2988236 - protein, 24 aa, Entamoeba invadens
AFQHGFLLALINQNARITLKRPKK

SEQ ID NO: 2988237 - protein, 25 aa, Entamoeba invadens
AFQHIVLYKFLFTRRSHLNWARFDK

SEQ ID NO: 2988238 - protein, 21 aa, Entamoeba invadens
AFQRKAPYIVPMHMVQAILDD

SEQ ID NO: 2988239 - protein, 18 aa, Entamoeba invadens
AFQRLRRIKQLGAMDFVV

SEQ ID NO: 2988240 - protein, 26 aa, Entamoeba invadens
AFQSVRLYYLYYPRICVETTSVLSYY

SEQ ID NO: 2988241 - protein, 17 aa, Entamoeba invadens
AFQTADKLYMILEFVNG

SEQ ID NO: 2988242 - protein, 27 aa, Entamoeba invadens
AFQTKEKLYMIMDFANGGELFHHLKNE

SEQ ID NO: 2988243 - protein, 23 aa, Entamoeba invadens
AFRKGFLRVVTSPLILMMRPEEL

SEQ ID NO: 2988244 - protein, 19 aa, Entamoeba invadens
AFRLVMLGGGAVGKSAITV

SEQ ID NO: 2988245 - protein, 18 aa, Entamoeba invadens
AFRYFGYADERNLVRDDQ

SEQ ID NO: 2988246 - protein, 21 aa, Entamoeba invadens
AFSCCDFLTKVVFSQKLKNIK

SEQ ID NO: 2988247 - protein, 17 aa, Entamoeba invadens
AFSFFKQVFETQSESTV

SEQ ID NO: 2988248 - protein, 23 aa, Entamoeba invadens
AFSGTKLRNLKLPNKSIILEDSV

SEQ ID NO: 2988249 - protein, 26 aa, Entamoeba invadens
AFSNLIALHRPELKYMLSLDSTSITV

SEQ ID NO: 2988250 - protein, 24 aa, Entamoeba invadens
AFSRLMVVVLKIIEDWEIFSKWKV

SEQ ID NO: 2988251 - protein, 30 aa, Entamoeba invadens
AFSTNMIKVFWLFFFKRVFNELLTTIPVDD

SEQ ID NO: 2988252 - protein, 18 aa, Entamoeba invadens
AFTFAECCNLKIVKLPRF

SEQ ID NO: 2988253 - protein, 22 aa, Entamoeba invadens
AFTFCLFNLPFYFNPEDPVAGG

SEQ ID NO: 2988254 - protein, 24 aa, Entamoeba invadens
AFTTSFLPMILNLAFDVVPNVRLT

SEQ ID NO: 2988255 - protein, 20 aa, Entamoeba invadens
AFTYVYNLRDLVIPSLVTYL

SEQ ID NO: 2988256 - protein, 20 aa, Entamoeba invadens
AFVADANCFLFTLKVDGKVQ

SEQ ID NO: 2988257 - protein, 25 aa, Entamoeba invadens
AFVGCYSFDISLYTKQKKAEKGCSD

SEQ ID NO: 2988258 - protein, 20 aa, Entamoeba invadens
AFVGKTCFFKRFSVGQFEEN

SEQ ID NO: 2988259 - protein, 24 aa, Entamoeba invadens
AFVKNLFEVLKKSILLVYNEIEPK

SEQ ID NO: 2988260 - protein, 20 aa, Entamoeba invadens
AFVRAKMTPLEDAVEEWKNE

SEQ ID NO: 2988261 - protein, 30 aa, Entamoeba invadens
AFVTVPYLHQIVHILLPLANAYITQVEEIN

SEQ ID NO: 2988262 - protein, 41 aa, Entamoeba invadens
AFVVGDYFTFFNLYTTAITQFKLILVLAIDKVRINTAYTLF

SEQ ID NO: 2988263 - protein, 18 aa, Entamoeba invadens
AFVVYNFFKIRIEKSFTE

SEQ ID NO: 2988264 - protein, 30 aa, Entamoeba invadens
AFYNNFLPSLEMYYVLCLMDHIVKRENNFR

SEQ ID NO: 2988265 - protein, 28 aa, Entamoeba invadens
AGAFFECKKLTMLSFPDGVTKIPEQCCH

SEQ ID NO: 2988266 - protein, 23 aa, Entamoeba invadens
AGAQYRGQFEERLKAVLKEVKES

SEQ ID NO: 2988267 - protein, 23 aa, Entamoeba invadens
AGCAFDKVFFPKSVKEIKQGVFS

SEQ ID NO: 2988268 - protein, 19 aa, Entamoeba invadens
AGCFLGCKGFIDKISIPSK

SEQ ID NO: 2988269 - protein, 18 aa, Entamoeba invadens
AGCGPTLYLAYKIQKQLK

SEQ ID NO: 2988270 - protein, 17 aa, Entamoeba invadens
AGCKLLKTIEFPPGTSF

SEQ ID NO: 2988271 - protein, 17 aa, Entamoeba invadens
AGCLYLTAITVPSTITY

SEQ ID NO: 2988272 - protein, 17 aa, Entamoeba invadens
AGCNTFFHYGFTLSSPD

SEQ ID NO: 2988273 - protein, 26 aa, Entamoeba invadens
AGCVSLKEIVLPNNLCIIKKSVFSGC

SEQ ID NO: 2988274 - protein, 25 aa, Entamoeba invadens
AGCVSLKEIVLPNSLCIIKKSVFSG

SEQ ID NO: 2988275 - protein, 20 aa, Entamoeba invadens
AGCYLCGNTGHNGRDCPDAW

SEQ ID NO: 2988276 - protein, 24 aa, Entamoeba invadens
AGDIKFKFVEQRHPVFRRSGNDLY

SEQ ID NO: 2988277 - protein, 23 aa, Entamoeba invadens
AGDLNNLSFNTNLFGNTATTGIG

SEQ ID NO: 2988278 - protein, 20 aa, Entamoeba invadens
AGDPLRCKLLSEKYLTEVKQ

SEQ ID NO: 2988279 - protein, 24 aa, Entamoeba invadens
AGDTLLVHPKTISSLSFAQQLQIM

SEQ ID NO: 2988280 - protein, 29 aa, Entamoeba invadens
AGEDALQLWYYFYSLFQDVNTHPDDQCFE

SEQ ID NO: 2988281 - protein, 24 aa, Entamoeba invadens
AGEDPMEVMKRRTAERKAEREKAK

SEQ ID NO: 2988282 - protein, 25 aa, Entamoeba invadens
AGEDPMKLDLWLKKQPKKPQRQKKE

SEQ ID NO: 2988283 - protein, 30 aa, Entamoeba invadens
AGEIRRYFDKTLFFLTFKRLLETKEVQYHK

SEQ ID NO: 2988284 - protein, 24 aa, Entamoeba invadens
AGELPWPSIVKRIVDQRTVILEIL

SEQ ID NO: 2988285 - protein, 22 aa, Entamoeba invadens
AGERVVHLNGVKPSLLINMDES

SEQ ID NO: 2988286 - protein, 29 aa, Entamoeba invadens
AGFEKFAFVKLVFKLRIPPSQVDGWIVKY

SEQ ID NO: 2988287 - protein, 18 aa, Entamoeba invadens
AGFGFALTKTYPLEKDIQ

SEQ ID NO: 2988288 - protein, 22 aa, Entamoeba invadens
AGGFLVQFDYGGLVLDSVVKKP

SEQ ID NO: 2988289 - protein, 23 aa, Entamoeba invadens
AGGKVFNFHGWRVEGVLSVSRSI

SEQ ID NO: 2988290 - protein, 23 aa, Entamoeba invadens
AGGLKPVVLLKTPELVQGDTYMV

SEQ ID NO: 2988291 - protein, 27 aa, Entamoeba invadens
AGGYDYLLSMKIWTLTYERAKKLMEDC

SEQ ID NO: 2988292 - protein, 27 aa, Entamoeba invadens
AGHRGYYLKGWGFKLNQALINYATQFL

SEQ ID NO: 2988293 - protein, 23 aa, Entamoeba invadens
AGIADDFLTTSFLAANCPKFVCP

SEQ ID NO: 2988294 - protein, 17 aa, Entamoeba invadens
AGIFRSRFQRYLLHLYS

SEQ ID NO: 2988295 - protein, 19 aa, Entamoeba invadens
AGIILINPQIQNSSLCFSC

SEQ ID NO: 2988296 - protein, 19 aa, Entamoeba invadens
AGILNHPLTYKPTSKEFTT

SEQ ID NO: 2988297 - protein, 34 aa, Entamoeba invadens
AGIRSIEFGLFTADYFPVLMSLDMSRNEIETLDN

SEQ ID NO: 2988298 - protein, 17 aa, Entamoeba invadens
AGIVGCSWVKAPPKRYV

SEQ ID NO: 2988299 - protein, 24 aa, Entamoeba invadens
AGKGHGGIILATNGAIMSQVGMTI

SEQ ID NO: 2988300 - protein, 17 aa, Entamoeba invadens
AGKIYVMLSFSPHTLEI

SEQ ID NO: 2988301 - protein, 18 aa, Entamoeba invadens
AGKRNFVYSAPTSAGKTL

SEQ ID NO: 2988302 - protein, 28 aa, Entamoeba invadens
AGKSGSLFMFTKDSKYILKVIPKREEKI

SEQ ID NO: 2988303 - protein, 23 aa, Entamoeba invadens
AGKTLLSIALICGMQQMSIIICT

SEQ ID NO: 2988304 - protein, 24 aa, Entamoeba invadens
AGKTTILYQLKLKELVTTIPTIGI

SEQ ID NO: 2988305 - protein, 24 aa, Entamoeba invadens
AGLERYQSIPAMLFRNCLGAVVVY

SEQ ID NO: 2988306 - protein, 18 aa, Entamoeba invadens
AGLHYLHFNKRIVHRDLK

SEQ ID NO: 2988307 - protein, 25 aa, Entamoeba invadens
AGLKNAPLIFGAMKIVLEDVAFGEM

SEQ ID NO: 2988308 - protein, 17 aa, Entamoeba invadens
AGLLLLPMQRLPRYELL

SEQ ID NO: 2988309 - protein, 27 aa, Entamoeba invadens
AGLPLEFKTFLMYSRGLRFEEEPRYQF

SEQ ID NO: 2988310 - protein, 18 aa, Entamoeba invadens
AGLVLEILADSNRLVILN

SEQ ID NO: 2988311 - protein, 17 aa, Entamoeba invadens
AGMFLEKVLLTRSVSPM

SEQ ID NO: 2988312 - protein, 21 aa, Entamoeba invadens
AGMISLIVALYGRWLRDENEL

SEQ ID NO: 2988313 - protein, 18 aa, Entamoeba invadens
AGMLHMGNVCYVDGKDMA

SEQ ID NO: 2988314 - protein, 22 aa, Entamoeba invadens
AGMSWDEKMAIKARRKIMQKVD

SEQ ID NO: 2988315 - protein, 24 aa, Entamoeba invadens
AGNEIMITELLFSGAFTQLNAAQS

SEQ ID NO: 2988316 - protein, 27 aa, Entamoeba invadens
AGNGTKRYHMIWQWGRIGSSLKETTRQ

SEQ ID NO: 2988317 - protein, 26 aa, Entamoeba invadens
AGNILLAQPTPTLVRLRMLCDDKGVT

SEQ ID NO: 2988318 - protein, 17 aa, Entamoeba invadens
AGPPPRPHIKRIDPMQH

SEQ ID NO: 2988319 - protein, 27 aa, Entamoeba invadens
AGQEKFRSMIDLYFRKAAGAVVVYDVM

SEQ ID NO: 2988320 - protein, 28 aa, Entamoeba invadens
AGQEKYYCLFPVFYRNSSIVIIVYDPNN

SEQ ID NO: 2988321 - protein, 23 aa, Entamoeba invadens
AGQERFKNITSCYFRGAHGIMIV

SEQ ID NO: 2988322 - protein, 29 aa, Entamoeba invadens
AGQERYRAITNAYYRGALGALVVYDITKK

SEQ ID NO: 2988323 - protein, 28 aa, Entamoeba invadens
AGQIGYNLTFLIAHGLMFGPSQTVVLHL

SEQ ID NO: 2988324 - protein, 26 aa, Entamoeba invadens
AGQIGYNLTFLIANGLMFGEHQTVIL

SEQ ID NO: 2988325 - protein, 28 aa, Entamoeba invadens
AGQTKVWQYITLMKNIYLIDCPGVVHPS

SEQ ID NO: 2988326 - protein, 22 aa, Entamoeba invadens
AGRDVWEILKESARIYIVEKYE

SEQ ID NO: 2988327 - protein, 26 aa, Entamoeba invadens
AGRTRNYSCWLGAKVFATLPKFNETC

SEQ ID NO: 2988328 - protein, 17 aa, Entamoeba invadens
AGRYAVRPFRKVQCPIV

SEQ ID NO: 2988329 - protein, 26 aa, Entamoeba invadens
AGSYLLGGFQLLYNVGFMNEGIQIFE

SEQ ID NO: 2988330 - protein, 17 aa, Entamoeba invadens
AGTTQCMFWGLGSDGTV

SEQ ID NO: 2988331 - protein, 18 aa, Entamoeba invadens
AGTYPMQCSALRKGGYVV

SEQ ID NO: 2988332 - protein, 30 aa, Entamoeba invadens
AGVEIRLPTPAYLKPKKLWTGKQLYGLALR

SEQ ID NO: 2988333 - protein, 33 aa, Entamoeba invadens
AGVENFKRVSLLHFLVYYFGQDWQKVANAPQGD

SEQ ID NO: 2988334 - protein, 30 aa, Entamoeba invadens
AGVERYRSLLPMYYRGANATIFFYSVNKKE

SEQ ID NO: 2988335 - protein, 23 aa, Entamoeba invadens
AGVGKTCLLTRFADKTFTEEEEL

SEQ ID NO: 2988336 - protein, 21 aa, Entamoeba invadens
AGVKYPLEWISKFKAEKTGKN

SEQ ID NO: 2988337 - protein, 35 aa, Entamoeba invadens
AGVLKKFVRNLPSMLFSNLLAKDILIAFQASPTPE

SEQ ID NO: 2988338 - protein, 29 aa, Entamoeba invadens
AGYAKFESFPVWNLPLKHPVNVAYEAATA

SEQ ID NO: 2988339 - protein, 24 aa, Entamoeba invadens
AGYDLYSYIDFKISPHSWLAVPTG

SEQ ID NO: 2988340 - protein, 23 aa, Entamoeba invadens
AGYQKLVFIFISQQNDVFGFYHE

SEQ ID NO: 2988341 - protein, 28 aa, Entamoeba invadens
AGYQLDRPKVFPSLNYFGAAVPICKYTE

SEQ ID NO: 2988342 - protein, 28 aa, Entamoeba invadens
AGYQLDRPKVFPSLNYFGASVPICKYTE

SEQ ID NO: 2988343 - protein, 31 aa, Entamoeba invadens
AGYTKKNYLAQKKLLKFLKQQVVKENAALEE

SEQ ID NO: 2988344 - protein, 22 aa, Entamoeba invadens
AHAQPFLINSLQIIGKGYSFTK

SEQ ID NO: 2988345 - protein, 20 aa, Entamoeba invadens
AHASTTRLYLKKGKGESRIC

SEQ ID NO: 2988346 - protein, 30 aa, Entamoeba invadens
AHDDIYPFVTKHWAILGKLPQFSARNNWRK

SEQ ID NO: 2988347 - protein, 18 aa, Entamoeba invadens
AHDIVGWMESLLGGQEKE

SEQ ID NO: 2988348 - protein, 20 aa, Entamoeba invadens
AHDLVDANDKPKTNDKPVEN

SEQ ID NO: 2988349 - protein, 24 aa, Entamoeba invadens
AHEYKNMLLMALIEDLKTNKVITT

SEQ ID NO: 2988350 - protein, 19 aa, Entamoeba invadens
AHFEFSRIVFFQKGSKMMP

SEQ ID NO: 2988351 - protein, 18 aa, Entamoeba invadens
AHGVGSHFVLALLDKHWH

SEQ ID NO: 2988352 - protein, 17 aa, Entamoeba invadens
AHIDFGFVINLRPKFDA

SEQ ID NO: 2988353 - protein, 23 aa, Entamoeba invadens
AHILLPSLPPPKDNEKLVPPFIG

SEQ ID NO: 2988354 - protein, 23 aa, Entamoeba invadens
AHINRYFRVVSEFALEAGDFSTV

SEQ ID NO: 2988355 - protein, 19 aa, Entamoeba invadens
AHKINFDTVPLILQQAETM

SEQ ID NO: 2988356 - protein, 26 aa, Entamoeba invadens
AHKKQMLITVPFFRILTLENYGDPIF

SEQ ID NO: 2988357 - protein, 25 aa, Entamoeba invadens
AHKKQTLVTVPFFRILTIEDKDPIY

SEQ ID NO: 2988358 - protein, 25 aa, Entamoeba invadens
AHKQTLHFLTFLIHSELLTTTNGTM

SEQ ID NO: 2988359 - protein, 18 aa, Entamoeba invadens
AHKRTLQMWTNKKMYKVI

SEQ ID NO: 2988360 - protein, 27 aa, Entamoeba invadens
AHKYQLKFNVLVRLLDNFYQFQVKENA

SEQ ID NO: 2988361 - protein, 19 aa, Entamoeba invadens
AHLHEWIDLIFGYKQQGEA

SEQ ID NO: 2988362 - protein, 18 aa, Entamoeba invadens
AHMILCHCGINSFNYKDR

SEQ ID NO: 2988363 - protein, 18 aa, Entamoeba invadens
AHNLPPKAIGENVKVFLY

SEQ ID NO: 2988364 - protein, 30 aa, Entamoeba invadens
AHNPADLPAMTFCYILNPESEDVIKVNELG

SEQ ID NO: 2988365 - protein, 18 aa, Entamoeba invadens
AHNRVWGMLFNYLNKNNC

SEQ ID NO: 2988366 - protein, 21 aa, Entamoeba invadens
AHPFIGWATTSYFYKKYHNLP

SEQ ID NO: 2988367 - protein, 20 aa, Entamoeba invadens
AHPFVVDSFNFISMNNLQTK

SEQ ID NO: 2988368 - protein, 42 aa, Entamoeba invadens
AHQELMLGFCFEPRPSAKAIYYPPFLFIHEEANYFDYYIPYM

SEQ ID NO: 2988369 - protein, 29 aa, Entamoeba invadens
AHQIETVCLLLLMKVKYPDRIHLLRGNHE

SEQ ID NO: 2988370 - protein, 27 aa, Entamoeba invadens
AHQQGVFILLLCQYCKIELGQPSKKSV

SEQ ID NO: 2988371 - protein, 17 aa, Entamoeba invadens
AHREEILLSINKLELTL

SEQ ID NO: 2988372 - protein, 25 aa, Entamoeba invadens
AHSFLKINIWCDVSYSFTQMHKDSN

SEQ ID NO: 2988373 - protein, 18 aa, Entamoeba invadens
AHSLIDANLPFRSYYQVD

SEQ ID NO: 2988374 - protein, 21 aa, Entamoeba invadens
AHTLLLNRPPITQISSHTLRI

SEQ ID NO: 2988375 - protein, 32 aa, Entamoeba invadens
AHTWKRRYFVIKNNFIFYFPSSQPDSTPKGMI

SEQ ID NO: 2988376 - protein, 25 aa, Entamoeba invadens
AIAFFANTFLLKRMRNNPSYYNVNG

SEQ ID NO: 2988377 - protein, 23 aa, Entamoeba invadens
AIAIKYIWGFEETASVCRNVLGK

SEQ ID NO: 2988378 - protein, 17 aa, Entamoeba invadens
AIAMEVIPRTLAANCGV

SEQ ID NO: 2988379 - protein, 26 aa, Entamoeba invadens
AIAPVKLGIFPLLTKPEFTSKVSEIE

SEQ ID NO: 2988380 - protein, 24 aa, Entamoeba invadens
AIASTVFRYFIELAVKISKGPSLM

SEQ ID NO: 2988381 - protein, 33 aa, Entamoeba invadens
AIASYIKGLNYKTWFPFYNLYSNSYDGNKYGRV

SEQ ID NO: 2988382 - protein, 29 aa, Entamoeba invadens
AIAVSFRFQLSLPSIFSYPSYCVYVSDGS

SEQ ID NO: 2988383 - protein, 24 aa, Entamoeba invadens
AICGENLWVGTLAGLNVFNTFKKK

SEQ ID NO: 2988384 - protein, 27 aa, Entamoeba invadens
AICGKENIMIVIVAKDGSVFGSYNAAV

SEQ ID NO: 2988385 - protein, 29 aa, Entamoeba invadens
AICLGNMFPDFLHYVFPIVKEKFLGGIEG

SEQ ID NO: 2988386 - protein, 27 aa, Entamoeba invadens
AICYGAKLMIPGLLRYAKDITMNEIVV

SEQ ID NO: 2988387 - protein, 30 aa, Entamoeba invadens
AICYNMIFYSKHEFLLSNSPPIPVVKDLSV

SEQ ID NO: 2988388 - protein, 20 aa, Entamoeba invadens
AIDCKPFCELCARNVFQRKK

SEQ ID NO: 2988389 - protein, 23 aa, Entamoeba invadens
AIDGYALLHRGAYKDAKTLCEGK

SEQ ID NO: 2988390 - protein, 30 aa, Entamoeba invadens
AIDIWQLGCVFLQMLLRSPPFKGHSLSSIK

SEQ ID NO: 2988391 - protein, 28 aa, Entamoeba invadens
AIDMWSFGCIVAELLLGIPIFPGENEFN

SEQ ID NO: 2988392 - protein, 33 aa, Entamoeba invadens
AIDMWSLGCVVAELFFGITLFAGSSEYNQLVKI

SEQ ID NO: 2988393 - protein, 25 aa, Entamoeba invadens
AIDTMILYPDACFDHLLMKDLLTKV

SEQ ID NO: 2988394 - protein, 19 aa, Entamoeba invadens
AIEDLPEFLIPFCEFHKIC

SEQ ID NO: 2988395 - protein, 25 aa, Entamoeba invadens
AIEENILHYFLLNKKASEEVLRSES

SEQ ID NO: 2988396 - protein, 23 aa, Entamoeba invadens
AIEFMNFAFAEQPHLFPCDVDDN

SEQ ID NO: 2988397 - protein, 26 aa, Entamoeba invadens
AIEGVLVHHLFNEIWPPLIEENYKIH

SEQ ID NO: 2988398 - protein, 22 aa, Entamoeba invadens
AIEISMYLFRDSNMKGDHYFLD

SEQ ID NO: 2988399 - protein, 20 aa, Entamoeba invadens
AIEKLMRTKTELDEKQNECD

SEQ ID NO: 2988400 - protein, 19 aa, Entamoeba invadens
AIEMILKKKKLEPAEWNIN

SEQ ID NO: 2988401 - protein, 18 aa, Entamoeba invadens
AIFLNVKCLSQLQQKIRK

SEQ ID NO: 2988402 - protein, 17 aa, Entamoeba invadens
AIFYKIHDTFPTGAWKY

SEQ ID NO: 2988403 - protein, 29 aa, Entamoeba invadens
AIGGMVFSLPLFKPKFPIVFQSHCELTKD

SEQ ID NO: 2988404 - protein, 20 aa, Entamoeba invadens
AIGILCKDGILLAAKKKRVA

SEQ ID NO: 2988405 - protein, 25 aa, Entamoeba invadens
AIGKRGILTLTYPMQKDPVDFEKLG

SEQ ID NO: 2988406 - protein, 28 aa, Entamoeba invadens
AIGNNSFFFWLFPIQRKVDNKKHFIEFK

SEQ ID NO: 2988407 - protein, 26 aa, Entamoeba invadens
AIGNRLTFNYVFNKKYDKMGLSFDHG

SEQ ID NO: 2988408 - protein, 26 aa, Entamoeba invadens
AIGVKAILAPYKYPPGLDNLLEEVLQ

SEQ ID NO: 2988409 - protein, 21 aa, Entamoeba invadens
AIGYNTFKTCEALSKVFLHDE

SEQ ID NO: 2988410 - protein, 20 aa, Entamoeba invadens
AIHALFKKYSPISCDNPRYE

SEQ ID NO: 2988411 - protein, 20 aa, Entamoeba invadens
AIHFKGYFPKTNSDFYIMCK

SEQ ID NO: 2988412 - protein, 19 aa, Entamoeba invadens
AIHKLTVDVAQFFRTILKG

SEQ ID NO: 2988413 - protein, 19 aa, Entamoeba invadens
AIHLTPLQPIGPSGSAYSL

SEQ ID NO: 2988414 - protein, 19 aa, Entamoeba invadens
AIHRLKLATGKPILIPKNL

SEQ ID NO: 2988415 - protein, 25 aa, Entamoeba invadens
AIHTKTLFQFIKYISQVGIGRKVHF

SEQ ID NO: 2988416 - protein, 23 aa, Entamoeba invadens
AIHTLLNWNIMFNNGISFLIGSN

SEQ ID NO: 2988417 - protein, 18 aa, Entamoeba invadens
AIIELWASGSDCCLLVCD

SEQ ID NO: 2988418 - protein, 19 aa, Entamoeba invadens
AIIKFHPKIYKSLILSVQN

SEQ ID NO: 2988419 - protein, 20 aa, Entamoeba invadens
AIKCDGMPLMYKGDAYDTKL

SEQ ID NO: 2988420 - protein, 20 aa, Entamoeba invadens
AIKDDYLIQQFLRLVTSKLS

SEQ ID NO: 2988421 - protein, 29 aa, Entamoeba invadens
AIKDLMTKFGLAFTALPDAYSKFVEFTKS

SEQ ID NO: 2988422 - protein, 18 aa, Entamoeba invadens
AIKDTTPNWTCKRCSDYY

SEQ ID NO: 2988423 - protein, 24 aa, Entamoeba invadens
AIKHLTDRLVALEQLVHSLSTTST

SEQ ID NO: 2988424 - protein, 19 aa, Entamoeba invadens
AIKILKSKFSYFRQGMLEV

SEQ ID NO: 2988425 - protein, 29 aa, Entamoeba invadens
AIKKYPQANLIYPIYAETLYLTKNAKELH

SEQ ID NO: 2988426 - protein, 32 aa, Entamoeba invadens
AIKSEMFFFDAFYLAEKIILLGIQREEEFAAV

SEQ ID NO: 2988427 - protein, 23 aa, Entamoeba invadens
AIKTLYDIFIIFVKAETKLYRLH

SEQ ID NO: 2988428 - protein, 37 aa, Entamoeba invadens
AILLALINKHFQVKLLIPIKRSVLTLQLFKIEELTEG

SEQ ID NO: 2988429 - protein, 20 aa, Entamoeba invadens
AILLAPIFRELQCVVNVILL

SEQ ID NO: 2988430 - protein, 19 aa, Entamoeba invadens
AILNAFNLFIVNCPNQLSN

SEQ ID NO: 2988431 - protein, 30 aa, Entamoeba invadens
AILNTYNPVWDSRFLLHHLATGDITIELFD

SEQ ID NO: 2988432 - protein, 18 aa, Entamoeba invadens
AILPIEPKSPRGINAWYV

SEQ ID NO: 2988433 - protein, 29 aa, Entamoeba invadens
AILSTKYEYIPFFVKNGFKGVARSMPTSA

SEQ ID NO: 2988434 - protein, 30 aa, Entamoeba invadens
AILTQIPQLPLNFLPFAPTPLKAPTQQKFI

SEQ ID NO: 2988435 - protein, 23 aa, Entamoeba invadens
AILVNEYLPFKDEMTRQLVLEID

SEQ ID NO: 2988436 - protein, 18 aa, Entamoeba invadens
AILWIHINSRPPQITQDL

SEQ ID NO: 2988437 - protein, 30 aa, Entamoeba invadens
AINAVTTLLFLRFILTPFTSTPVILKETQK

SEQ ID NO: 2988438 - protein, 35 aa, Entamoeba invadens
AINERKYVKLYVQFFIYIRSLMQRDPQKVAFSSDM

SEQ ID NO: 2988439 - protein, 29 aa, Entamoeba invadens
AINERRYVQLYVKFFVKVRNAMLVVDTKK

SEQ ID NO: 2988440 - protein, 18 aa, Entamoeba invadens
AINKMDAMKWSETKFKNV

SEQ ID NO: 2988441 - protein, 23 aa, Entamoeba invadens
AINSSLSFVSFGANIKRFTGVAN

SEQ ID NO: 2988442 - protein, 27 aa, Entamoeba invadens
AIPDSHRPFLLPIIKSKPVRTASGIVA

SEQ ID NO: 2988443 - protein, 25 aa, Entamoeba invadens
AIPDVRFEYLCDQFKPLSKVAAALQ

SEQ ID NO: 2988444 - protein, 19 aa, Entamoeba invadens
AIPLKIIFIGESGVGKTAV

SEQ ID NO: 2988445 - protein, 32 aa, Entamoeba invadens
AIPMYAAFSKHPPPILFFVTRNNQLVSVTFDT

SEQ ID NO: 2988446 - protein, 24 aa, Entamoeba invadens
AIPNAYLSMWYYELQTYPREFAVI

SEQ ID NO: 2988447 - protein, 25 aa, Entamoeba invadens
AIPSAFVPVQCLPSFFSVENNVSNT

SEQ ID NO: 2988448 - protein, 18 aa, Entamoeba invadens
AIPVLFSISLLSESYRTF

SEQ ID NO: 2988449 - protein, 27 aa, Entamoeba invadens
AIQREVLPLLYLFIANSNAPAVLHYIL

SEQ ID NO: 2988450 - protein, 24 aa, Entamoeba invadens
AIQTYFDSTLYFHYYFMQHNCCSS

SEQ ID NO: 2988451 - protein, 21 aa, Entamoeba invadens
AIQVISNSSWRYNTIKSAITN

SEQ ID NO: 2988452 - protein, 25 aa, Entamoeba invadens
AIRECLLDLLKRLLVYDPSSRLTPG

SEQ ID NO: 2988453 - protein, 23 aa, Entamoeba invadens
AIRKLIKDRLVIRKPHIIHSRSR

SEQ ID NO: 2988454 - protein, 25 aa, Entamoeba invadens
AIRNRQRVLFFLKQNYKEIKDTPEK

SEQ ID NO: 2988455 - protein, 19 aa, Entamoeba invadens
AIRQFLHDVEWGDLDYLVF

SEQ ID NO: 2988456 - protein, 25 aa, Entamoeba invadens
AISDPQIIALQRSLATRPKISPIKK

SEQ ID NO: 2988457 - protein, 26 aa, Entamoeba invadens
AISFQTPFFNFIMKTAERFYVTNNFF

SEQ ID NO: 2988458 - protein, 17 aa, Entamoeba invadens
AISLCEEILLLNPENPE

SEQ ID NO: 2988459 - protein, 26 aa, Entamoeba invadens
AISTAMLIYHFLWEEGRITFKKSKQS

SEQ ID NO: 2988460 - protein, 28 aa, Entamoeba invadens
AITGDAKHFIFTLLNSKFEKKRFDLKNG

SEQ ID NO: 2988461 - protein, 17 aa, Entamoeba invadens
AITMYECFKWKDPYPKS

SEQ ID NO: 2988462 - protein, 23 aa, Entamoeba invadens
AITMYEIFIWGEAFPREMFRYPW

SEQ ID NO: 2988463 - protein, 23 aa, Entamoeba invadens
AITTFLSPCLLTKFVLPNLVNVA

SEQ ID NO: 2988464 - protein, 25 aa, Entamoeba invadens
AITVIPDFTFPLLENLTIASNKITH

SEQ ID NO: 2988465 - protein, 28 aa, Entamoeba invadens
AIVCYKILTMLFQCDGILHTAIPVNNQD

SEQ ID NO: 2988466 - protein, 18 aa, Entamoeba invadens
AIVEGNNLPLFFGKVSHP

SEQ ID NO: 2988467 - protein, 26 aa, Entamoeba invadens
AIVFDFEKKFIITPTILEGNYEDFAK

SEQ ID NO: 2988468 - protein, 20 aa, Entamoeba invadens
AIVGASLLALGQKYHPECFV

SEQ ID NO: 2988469 - protein, 22 aa, Entamoeba invadens
AIVILRKYYADRKVEWALLEEK

SEQ ID NO: 2988470 - protein, 35 aa, Entamoeba invadens
AIVKNCGGFTFIYQWLLLLFKREFDSKTVFRIWDS

SEQ ID NO: 2988471 - protein, 33 aa, Entamoeba invadens
AIVLCAPYKLCYYNFFLEFYYNLGTSAENKEPV

SEQ ID NO: 2988472 - protein, 24 aa, Entamoeba invadens
AIVNPIHIPPLLTQENHLKDDEYL

SEQ ID NO: 2988473 - protein, 47 aa, Entamoeba invadens
AIVPINEFYQWDVTLPSPVPQKLAYVGFFEMLPQIISGIYNALDGGN

SEQ ID NO: 2988474 - protein, 18 aa, Entamoeba invadens
AIVRLLIRVSYTVQKEDT

SEQ ID NO: 2988475 - protein, 27 aa, Entamoeba invadens
AIVVNKMCKLYRNINTIVAPPLNGDCS

SEQ ID NO: 2988476 - protein, 19 aa, Entamoeba invadens
AIYAGIILANPVLLEPIYS

SEQ ID NO: 2988477 - protein, 29 aa, Entamoeba invadens
AIYLGRASIKPIMYEGFLAGGIAAGGQLT

SEQ ID NO: 2988478 - protein, 21 aa, Entamoeba invadens
AIYLKSLEKLIVPPTVKVLKL

SEQ ID NO: 2988479 - protein, 19 aa, Entamoeba invadens
AIYRLQFNKNVEFIESFLA

SEQ ID NO: 2988480 - protein, 19 aa, Entamoeba invadens
AIYSGRRWDWRGNVIKYNY

SEQ ID NO: 2988481 - protein, 18 aa, Entamoeba invadens
AKAKKQAKQYARKVEEAE

SEQ ID NO: 2988482 - protein, 24 aa, Entamoeba invadens
AKAKKQVKQYARKVEEAERKLAEF

SEQ ID NO: 2988483 - protein, 18 aa, Entamoeba invadens
AKAQAYFRRFSAKNTMNS

SEQ ID NO: 2988484 - protein, 29 aa, Entamoeba invadens
AKATDYIDWSLYYLGLKDQKPPLKGETPE

SEQ ID NO: 2988485 - protein, 29 aa, Entamoeba invadens
AKAVDALKYLLLMKLMQKKPGEIDVVLGT

SEQ ID NO: 2988486 - protein, 18 aa, Entamoeba invadens
AKCFYQCSSLGFVNLPNV

SEQ ID NO: 2988487 - protein, 25 aa, Entamoeba invadens
AKDFRTVVWCLDPARRKLFKKLCDQ

SEQ ID NO: 2988488 - protein, 26 aa, Entamoeba invadens
AKDSRDFCFLLSTRAGGLGINLTSAD

SEQ ID NO: 2988489 - protein, 34 aa, Entamoeba invadens
AKDVNYIIPKPLYFSVTPLFWNIARNSTFVCTDA

SEQ ID NO: 2988490 - protein, 28 aa, Entamoeba invadens
AKEDRNYHIFYQCWLNKTSPNEIMVDGM

SEQ ID NO: 2988491 - protein, 28 aa, Entamoeba invadens
AKEDRNYHIFYQLLAGATPQQRSEWRLE

SEQ ID NO: 2988492 - protein, 23 aa, Entamoeba invadens
AKEGLFCCELWDTAGQEKFRSVT

SEQ ID NO: 2988493 - protein, 25 aa, Entamoeba invadens
AKEKSVLLGPLGFVGGIFAGVAGVV

SEQ ID NO: 2988494 - protein, 19 aa, Entamoeba invadens
AKELLAHPFIGWATTSYFY

SEQ ID NO: 2988495 - protein, 23 aa, Entamoeba invadens
AKEYSPMAFAIIRRFFGVSDREM

SEQ ID NO: 2988496 - protein, 24 aa, Entamoeba invadens
AKFEEATVLLCTLSAAVPQHSMSI

SEQ ID NO: 2988497 - protein, 24 aa, Entamoeba invadens
AKFHFNPIPLTRKTMKYFPNIETL

SEQ ID NO: 2988498 - protein, 22 aa, Entamoeba invadens
AKFHYNPISLTPKTRRFFPNLN

SEQ ID NO: 2988499 - protein, 25 aa, Entamoeba invadens
AKFRSEYIVHFYGAVFIPNKICVVT

SEQ ID NO: 2988500 - protein, 27 aa, Entamoeba invadens
AKFSRAYPPPPPPPPGGAVPPPPGASA

SEQ ID NO: 2988501 - protein, 29 aa, Entamoeba invadens
AKGGMCGIVYPYTWISNDVTVLVFTQSWD

SEQ ID NO: 2988502 - protein, 18 aa, Entamoeba invadens
AKGLRHPYLTVSSKTTAV

SEQ ID NO: 2988503 - protein, 25 aa, Entamoeba invadens
AKGPFSRMLVLDDRFLAILVHFYTE

SEQ ID NO: 2988504 - protein, 39 aa, Entamoeba invadens
AKGQLKYFVPFLSIYRGFIINLILYLPNEDFAFGEKELF

SEQ ID NO: 2988505 - protein, 23 aa, Entamoeba invadens
AKGRFPIISWVGPNMQCLARSSQ

SEQ ID NO: 2988506 - protein, 25 aa, Entamoeba invadens
AKGYHVPPFMELLESPIQQYGRIGV

SEQ ID NO: 2988507 - protein, 20 aa, Entamoeba invadens
AKGYYLTYNSCLKCSVGCLD

SEQ ID NO: 2988508 - protein, 26 aa, Entamoeba invadens
AKHLTPGFIFAGIIPVYDTYSNILLT

SEQ ID NO: 2988509 - protein, 24 aa, Entamoeba invadens
AKHNFKIRTLPVTARALDSLIRIS

SEQ ID NO: 2988510 - protein, 22 aa, Entamoeba invadens
AKIAMALFEKNGVFFQMLSTAS

SEQ ID NO: 2988511 - protein, 25 aa, Entamoeba invadens
AKKFESLLQCRLLQKIYIVVATLDD

SEQ ID NO: 2988512 - protein, 24 aa, Entamoeba invadens
AKKGEFTLSFQFCKYIATHHLIID

SEQ ID NO: 2988513 - protein, 26 aa, Entamoeba invadens
AKKLLEEYPFFINYKNKGGETPLHLA

SEQ ID NO: 2988514 - protein, 17 aa, Entamoeba invadens
AKKLYAFSMYHDFVDDS

SEQ ID NO: 2988515 - protein, 24 aa, Entamoeba invadens
AKKMPLPETYALTHSFKLSSKHVI

SEQ ID NO: 2988516 - protein, 34 aa, Entamoeba invadens
AKKNAFILATNVSITILLVDQIVMQKPAGGPKMP

SEQ ID NO: 2988517 - protein, 32 aa, Entamoeba invadens
AKKNDCWAIGIILYQVFTGKLPFTPTDTSDED

SEQ ID NO: 2988518 - protein, 24 aa, Entamoeba invadens
AKKNNRAYLLQRLNQRLAQYYYEN

SEQ ID NO: 2988519 - protein, 18 aa, Entamoeba invadens
AKKPTFASNVYALALIFW

SEQ ID NO: 2988520 - protein, 25 aa, Entamoeba invadens
AKKRKDIMHFLQSILAQDGFEVIIE

SEQ ID NO: 2988521 - protein, 27 aa, Entamoeba invadens
AKKSKWWGVNVLLPLLKVFGLDDEVRE

SEQ ID NO: 2988522 - protein, 25 aa, Entamoeba invadens
AKKYPLYMQMLTKETVNMKFIPDIQ

SEQ ID NO: 2988523 - protein, 17 aa, Entamoeba invadens
AKLADAGATGAFIAKLK

SEQ ID NO: 2988524 - protein, 33 aa, Entamoeba invadens
AKLDLRDYLIMPVQRLPRYNLLLTDLVKNTEET

SEQ ID NO: 2988525 - protein, 24 aa, Entamoeba invadens
AKLDNEDDLPLRRAKITLEAAQKR

SEQ ID NO: 2988526 - protein, 18 aa, Entamoeba invadens
AKLFMMSELYHSHYPNME

SEQ ID NO: 2988527 - protein, 26 aa, Entamoeba invadens
AKLGLTFNIFFLCELKDDSKVPIKYF

SEQ ID NO: 2988528 - protein, 23 aa, Entamoeba invadens
AKLLNLKLVLISVDMKTGVITEL

SEQ ID NO: 2988529 - protein, 29 aa, Entamoeba invadens
AKLQGFWYTVLFHSRFFDFYATSPKDVKI

SEQ ID NO: 2988530 - protein, 25 aa, Entamoeba invadens
AKLRKRIELIKKRRAALLKRKEHER

SEQ ID NO: 2988531 - protein, 21 aa, Entamoeba invadens
AKMIVMMKLLDKHIKNKGKVL

SEQ ID NO: 2988532 - protein, 30 aa, Entamoeba invadens
AKMNSLQRRFPLIRLGLLHFYTDKGTLCYS

SEQ ID NO: 2988533 - protein, 22 aa, Entamoeba invadens
AKNAIFVGKKMNVGLFSVGNDD

SEQ ID NO: 2988534 - protein, 40 aa, Entamoeba invadens
AKNLVVFLVLFIFQDFFPDLYERFLHWFNTTKNDWKKDML

SEQ ID NO: 2988535 - protein, 34 aa, Entamoeba invadens
AKNNRALYTRVLTRTMFALGFKDFDALNDIAFVD

SEQ ID NO: 2988536 - protein, 24 aa, Entamoeba invadens
AKNQLVSLPPTMSRLKSLKQLILY

SEQ ID NO: 2988537 - protein, 24 aa, Entamoeba invadens
AKNTRIWFNGILHVAVMEEYEYDL

SEQ ID NO: 2988538 - protein, 24 aa, Entamoeba invadens
AKNWRLIKYLVINEPKLTKVIKKI

SEQ ID NO: 2988539 - protein, 22 aa, Entamoeba invadens
AKPMLEAFQKGTAACYPLGGYG

SEQ ID NO: 2988540 - protein, 28 aa, Entamoeba invadens
AKQRFERSLDLYYYLRNELIEDMRNIIE

SEQ ID NO: 2988541 - protein, 20 aa, Entamoeba invadens
AKREAAEKALFEMKIKNVDL

SEQ ID NO: 2988542 - protein, 24 aa, Entamoeba invadens
AKRLDPFVDYFPLGTSKDFFCNIK

SEQ ID NO: 2988543 - protein, 35 aa, Entamoeba invadens
AKRMIAIHLKTENMMFLYLMRWAKYVGKNGESAMK

SEQ ID NO: 2988544 - protein, 32 aa, Entamoeba invadens
AKRPEMMGELLPYCLFVIKDKLQFPSIKQHEK

SEQ ID NO: 2988545 - protein, 25 aa, Entamoeba invadens
AKSEKRLVRVERGHLIVLNSKGKAS

SEQ ID NO: 2988546 - protein, 25 aa, Entamoeba invadens
AKSGFGLEELFTDLANNIAELPTEE

SEQ ID NO: 2988547 - protein, 18 aa, Entamoeba invadens
AKSIWENIQRNKEGKWSE

SEQ ID NO: 2988548 - protein, 29 aa, Entamoeba invadens
AKSNYNFERPFLWIARKLTGNPNLQFVTD

SEQ ID NO: 2988549 - protein, 39 aa, Entamoeba invadens
AKSYEELLVKLLDGWLCIFSSELFLAKRFVFTQFDDSDE

SEQ ID NO: 2988550 - protein, 27 aa, Entamoeba invadens
AKTAGLCLSIFSRLLTNYLQRVGHTCS

SEQ ID NO: 2988551 - protein, 33 aa, Entamoeba invadens
AKTFEELIILVYPLFFDLYRNPSLSILYKQKLY

SEQ ID NO: 2988552 - protein, 19 aa, Entamoeba invadens
AKTFWSSRLLKTSQDFAVF

SEQ ID NO: 2988553 - protein, 27 aa, Entamoeba invadens
AKTHSKLIAPRHIVHRGREIEPVSSDA

SEQ ID NO: 2988554 - protein, 26 aa, Entamoeba invadens
AKTIDKWAFRNYTFESLIIPNHIQSI

SEQ ID NO: 2988555 - protein, 22 aa, Entamoeba invadens
AKTIVYGCIYGIGPYSLADELK

SEQ ID NO: 2988556 - protein, 34 aa, Entamoeba invadens
AKTKYGVYLLPSNTFYCFIPFAFDSNVSMECIYA

SEQ ID NO: 2988557 - protein, 23 aa, Entamoeba invadens
AKTLFQIQQNITILLGLIEKSFG

SEQ ID NO: 2988558 - protein, 17 aa, Entamoeba invadens
AKTLVRCLLQTGSYPDS

SEQ ID NO: 2988559 - protein, 23 aa, Entamoeba invadens
AKTNAYLVSYLRDQMPTFGKEKK

SEQ ID NO: 2988560 - protein, 20 aa, Entamoeba invadens
AKTQLIKGKYKKDIAEITVR

SEQ ID NO: 2988561 - protein, 29 aa, Entamoeba invadens
AKTRLHTYFPGLTLFISYLEGLIDEFERV

SEQ ID NO: 2988562 - protein, 26 aa, Entamoeba invadens
AKTSFNIDLVFSKFLDLYFQNTTHEC

SEQ ID NO: 2988563 - protein, 25 aa, Entamoeba invadens
AKVADLVVCLYIDKDYYFNTIDDPL

SEQ ID NO: 2988564 - protein, 23 aa, Entamoeba invadens
AKVAEVFKALEGKNVWEVIEEGK

SEQ ID NO: 2988565 - protein, 32 aa, Entamoeba invadens
AKVELPSTNPIRLGLVLNFSVFYYEIMNDPEK

SEQ ID NO: 2988566 - protein, 18 aa, Entamoeba invadens
AKVFIKSKPGRYGIKVWM

SEQ ID NO: 2988567 - protein, 20 aa, Entamoeba invadens
AKVFLTQFVLEFQGKFDEVL

SEQ ID NO: 2988568 - protein, 23 aa, Entamoeba invadens
AKVLLRWNACLFHKNQHGFTPLG

SEQ ID NO: 2988569 - protein, 30 aa, Entamoeba invadens
AKVQCTLIKGLKQSLKFIENDNALYAFIAE

SEQ ID NO: 2988570 - protein, 22 aa, Entamoeba invadens
AKVSFSYLIFTNGFPEISRSVE

SEQ ID NO: 2988571 - protein, 30 aa, Entamoeba invadens
AKVVERIFLKMRILNFNEFLLKIGDIEKAV

SEQ ID NO: 2988572 - protein, 29 aa, Entamoeba invadens
AKVVTLLQSYALLLTNIKIVLTNKTSNKS

SEQ ID NO: 2988573 - protein, 29 aa, Entamoeba invadens
AKWECPKQVILTLLFRLADTNNSGKLNKK

SEQ ID NO: 2988574 - protein, 18 aa, Entamoeba invadens
AKYAALVFVGPVWCWDLC

SEQ ID NO: 2988575 - protein, 22 aa, Entamoeba invadens
AKYLVDQLILSKFSPLYRGNSY

SEQ ID NO: 2988576 - protein, 22 aa, Entamoeba invadens
AKYNPISYDIPRYVVDTPISSC

SEQ ID NO: 2988577 - protein, 29 aa, Entamoeba invadens
AKYSALIFVGPVWCWDLCAPLKNACKEVL

SEQ ID NO: 2988578 - protein, 23 aa, Entamoeba invadens
AKYTCPICLQKYCSVPCFKTHKE

SEQ ID NO: 2988579 - protein, 24 aa, Entamoeba invadens
ALAALPEILAAKPIEMEKLPDIFG

SEQ ID NO: 2988580 - protein, 18 aa, Entamoeba invadens
ALALINKFTTVVPHGIFD

SEQ ID NO: 2988581 - protein, 18 aa, Entamoeba invadens
ALANDSFPNAKRLVLLLP

SEQ ID NO: 2988582 - protein, 25 aa, Entamoeba invadens
ALANTGLTVLKFTKNIWTSSSYTDI

SEQ ID NO: 2988583 - protein, 32 aa, Entamoeba invadens
ALAPVAIEYCWFFLDIIIKSLTLYLDKMSIFD

SEQ ID NO: 2988584 - protein, 24 aa, Entamoeba invadens
ALARPASYICRYFGQTLAAASNTD

SEQ ID NO: 2988585 - protein, 20 aa, Entamoeba invadens
ALCLITKLQKMLIGFSICFD

SEQ ID NO: 2988586 - protein, 18 aa, Entamoeba invadens
ALCVLRRVLESNTVSVGG

SEQ ID NO: 2988587 - protein, 25 aa, Entamoeba invadens
ALDESFFYKGILYMTRRISQEISLQ

SEQ ID NO: 2988588 - protein, 19 aa, Entamoeba invadens
ALDLILERKLQIANKYVDC

SEQ ID NO: 2988589 - protein, 17 aa, Entamoeba invadens
ALDLLTEAIAKAGYTGK

SEQ ID NO: 2988590 - protein, 34 aa, Entamoeba invadens
ALDMGIVLNVLHINPFHFNPFRVGLETKRISEDV

SEQ ID NO: 2988591 - protein, 18 aa, Entamoeba invadens
ALDTVILSLVEEKEVLSA

SEQ ID NO: 2988592 - protein, 20 aa, Entamoeba invadens
ALDYIKKVMQCKYVSWSNSM

SEQ ID NO: 2988593 - protein, 25 aa, Entamoeba invadens
ALEFNYRPPFYVITPATLSLEQNFL

SEQ ID NO: 2988594 - protein, 19 aa, Entamoeba invadens
ALEHPFITGVNYLSGVDFQ

SEQ ID NO: 2988595 - protein, 19 aa, Entamoeba invadens
ALEILGLSSLLDLLKRGDV

SEQ ID NO: 2988596 - protein, 19 aa, Entamoeba invadens
ALEKLIFNGKAGEGYLQCL

SEQ ID NO: 2988597 - protein, 36 aa, Entamoeba invadens
ALEKLWPTAKPLPGAFRILKYLKSHNIPIALATSTT

SEQ ID NO: 2988598 - protein, 25 aa, Entamoeba invadens
ALELGIFGQLKFGIQSSFDTLLNNY

SEQ ID NO: 2988599 - protein, 31 aa, Entamoeba invadens
ALENFPRSGLLQFFLFPNRTLGLFNDDGEFD

SEQ ID NO: 2988600 - protein, 23 aa, Entamoeba invadens
ALENLKVNFLFESIAKGVVKSTI

SEQ ID NO: 2988601 - protein, 19 aa, Entamoeba invadens
ALEQIAQTFYPLSKGRPIS

SEQ ID NO: 2988602 - protein, 27 aa, Entamoeba invadens
ALEQKKPVYVFLQKLPSKEFSLSDYVD

SEQ ID NO: 2988603 - protein, 24 aa, Entamoeba invadens
ALETIHRYVVILDKYFGSVSEIDI

SEQ ID NO: 2988604 - protein, 17 aa, Entamoeba invadens
ALETTQFFYHTKLDWVE

SEQ ID NO: 2988605 - protein, 21 aa, Entamoeba invadens
ALFFKKLMNQIKTKIPTIVRP

SEQ ID NO: 2988606 - protein, 17 aa, Entamoeba invadens
ALFGNIYSHLKLMFGSN

SEQ ID NO: 2988607 - protein, 18 aa, Entamoeba invadens
ALFLFHQCVVCPNKSLTT

SEQ ID NO: 2988608 - protein, 17 aa, Entamoeba invadens
ALFQLEGLYLEGYIMSS

SEQ ID NO: 2988609 - protein, 30 aa, Entamoeba invadens
ALFQPRLIGSSSDSIPLLALKAINQVKESD

SEQ ID NO: 2988610 - protein, 17 aa, Entamoeba invadens
ALFQQAIDLENIGAVDK

SEQ ID NO: 2988611 - protein, 19 aa, Entamoeba invadens
ALFSRHKILEDKEIKRNNW

SEQ ID NO: 2988612 - protein, 20 aa, Entamoeba invadens
ALFVDTPDKFAIKSLLVLEF

SEQ ID NO: 2988613 - protein, 18 aa, Entamoeba invadens
ALGDGEMRLYQYICNSFL

SEQ ID NO: 2988614 - protein, 29 aa, Entamoeba invadens
ALGGMMKIFNYLLLNYTTLVYVLDNEKHQ

SEQ ID NO: 2988615 - protein, 18 aa, Entamoeba invadens
ALGQLFTMSIFMVNDIDV

SEQ ID NO: 2988616 - protein, 25 aa, Entamoeba invadens
ALHESGKFEWRWDPLGYIFHESEIG

SEQ ID NO: 2988617 - protein, 21 aa, Entamoeba invadens
ALHHRVLTPLRMSFNSCKQFF

SEQ ID NO: 2988618 - protein, 27 aa, Entamoeba invadens
ALHLGHLIPFIFTQYLQEAFNAELVVQ

SEQ ID NO: 2988619 - protein, 18 aa, Entamoeba invadens
ALHLLLDVLGEVGYFFEV

SEQ ID NO: 2988620 - protein, 20 aa, Entamoeba invadens
ALHQLVHCLRLVGFDYVFDI

SEQ ID NO: 2988621 - protein, 24 aa, Entamoeba invadens
ALHSLTLPTYLLTLGECLFDGCVS

SEQ ID NO: 2988622 - protein, 25 aa, Entamoeba invadens
ALIDGKPVNMFWSLKDFKQRTETQT

SEQ ID NO: 2988623 - protein, 17 aa, Entamoeba invadens
ALIELLTGRVFCGTESC

SEQ ID NO: 2988624 - protein, 26 aa, Entamoeba invadens
ALIIMNYHIFPLVMIWLEFGNEKCIE

SEQ ID NO: 2988625 - protein, 18 aa, Entamoeba invadens
ALILEEFPTLDDLHPFYG

SEQ ID NO: 2988626 - protein, 17 aa, Entamoeba invadens
ALILRFAIPSRIMTKED

SEQ ID NO: 2988627 - protein, 19 aa, Entamoeba invadens
ALISQFLNRVIDPNTQPTI

SEQ ID NO: 2988628 - protein, 26 aa, Entamoeba invadens
ALKAMHALGRLIGTIHKNGFIHGDLT

SEQ ID NO: 2988629 - protein, 19 aa, Entamoeba invadens
ALKCDGVFYVIDDVTKRSL

SEQ ID NO: 2988630 - protein, 27 aa, Entamoeba invadens
ALKDTIAPFLLRRLKKDVLPTLPNKTE

SEQ ID NO: 2988631 - protein, 27 aa, Entamoeba invadens
ALKEESRYSLSYWDSPFREKLCDEILK

SEQ ID NO: 2988632 - protein, 23 aa, Entamoeba invadens
ALKERYMYLFNDGVVIYGENFGK

SEQ ID NO: 2988633 - protein, 18 aa, Entamoeba invadens
ALKFELHHLSTLADFLLR

SEQ ID NO: 2988634 - protein, 19 aa, Entamoeba invadens
ALKFLETIIRLLDEDLSQI

SEQ ID NO: 2988635 - protein, 29 aa, Entamoeba invadens
ALKHFNILNYLALKCFLLSGFKSKRNANK

SEQ ID NO: 2988636 - protein, 26 aa, Entamoeba invadens
ALKHGPFALIEKDLPVVLIILDDENA

SEQ ID NO: 2988637 - protein, 25 aa, Entamoeba invadens
ALKILLRICSMFPRVKECVVGDETF

SEQ ID NO: 2988638 - protein, 23 aa, Entamoeba invadens
ALKNNLRSPTIWHLYGIVAREQK

SEQ ID NO: 2988639 - protein, 17 aa, Entamoeba invadens
ALKNYPNLKFLITGHSL

SEQ ID NO: 2988640 - protein, 21 aa, Entamoeba invadens
ALKQAALFNALYFEVSALTGE

SEQ ID NO: 2988641 - protein, 25 aa, Entamoeba invadens
ALKRFLTKIPCRGILGTYACFYHTE

SEQ ID NO: 2988642 - protein, 25 aa, Entamoeba invadens
ALKRKMLQILSSFLKMEHYSDYISG

SEQ ID NO: 2988643 - protein, 23 aa, Entamoeba invadens
ALKRLYQRYLPLQIAFEASEKEQ

SEQ ID NO: 2988644 - protein, 20 aa, Entamoeba invadens
ALKTLLTYVLKCTSLPKYQT

SEQ ID NO: 2988645 - protein, 19 aa, Entamoeba invadens
ALKYLLYEKRLVHRDIKSR

SEQ ID NO: 2988646 - protein, 18 aa, Entamoeba invadens
ALLAKKYKARYVKAIDTR

SEQ ID NO: 2988647 - protein, 19 aa, Entamoeba invadens
ALLCYIASGNVPKIMDMWV

SEQ ID NO: 2988648 - protein, 18 aa, Entamoeba invadens
ALLEAKRIEIAPTQLTQS

SEQ ID NO: 2988649 - protein, 25 aa, Entamoeba invadens
ALLHSRFHRVFFIYKNDIDGAFTKY

SEQ ID NO: 2988650 - protein, 24 aa, Entamoeba invadens
ALLIKTNWAKWMDEVWVTVVSPKI

SEQ ID NO: 2988651 - protein, 30 aa, Entamoeba invadens
ALLKSKMTTLPLLLLNLKTITDIIFVHLEQ

SEQ ID NO: 2988652 - protein, 22 aa, Entamoeba invadens
ALLLNRIFNINRIYQEWKPPQR

SEQ ID NO: 2988653 - protein, 17 aa, Entamoeba invadens
ALLLRGVGVHHAGLLPF

SEQ ID NO: 2988654 - protein, 20 aa, Entamoeba invadens
ALLNKYCSFSFKQPAKKSTV

SEQ ID NO: 2988655 - protein, 17 aa, Entamoeba invadens
ALLQLSSLGMEASCIHE

SEQ ID NO: 2988656 - protein, 23 aa, Entamoeba invadens
ALLRQRKMTPISLYDESILTEEE

SEQ ID NO: 2988657 - protein, 18 aa, Entamoeba invadens
ALLRQYCDQKFIFDTTST

SEQ ID NO: 2988658 - protein, 30 aa, Entamoeba invadens
ALLYGSEILKVFKRFGFRYTSVKQHYWLPV

SEQ ID NO: 2988659 - protein, 22 aa, Entamoeba invadens
ALMAEMLARRVLPNYKVKESRL

SEQ ID NO: 2988660 - protein, 21 aa, Entamoeba invadens
ALMAFRRRTFVGLSTSYSALQ

SEQ ID NO: 2988661 - protein, 18 aa, Entamoeba invadens
ALMIAHAAAHLKPKEIGK

SEQ ID NO: 2988662 - protein, 19 aa, Entamoeba invadens
ALMLLRKNVIYPTELLEVY

SEQ ID NO: 2988663 - protein, 27 aa, Entamoeba invadens
ALMNFEDFFIYNRYKFGVLYAGIGQTK

SEQ ID NO: 2988664 - protein, 24 aa, Entamoeba invadens
ALNALDYFLLHYSDNSDKVRYNDL

SEQ ID NO: 2988665 - protein, 22 aa, Entamoeba invadens
ALNFGSYNYLGFGGLHPIVTPQ

SEQ ID NO: 2988666 - protein, 27 aa, Entamoeba invadens
ALNGEEYWIVKNSWGTSWGDKGYVLMA

SEQ ID NO: 2988667 - protein, 29 aa, Entamoeba invadens
ALNKRSTIGRIFFWLIKSELHIPETQRRF

SEQ ID NO: 2988668 - protein, 22 aa, Entamoeba invadens
ALNLIKALYLTYKFDDTSAQID

SEQ ID NO: 2988669 - protein, 26 aa, Entamoeba invadens
ALNQFYRVAYLSLVSLFFSSSNCMAD

SEQ ID NO: 2988670 - protein, 18 aa, Entamoeba invadens
ALNRVAIWAIGEYGDLLA

SEQ ID NO: 2988671 - protein, 25 aa, Entamoeba invadens
ALNSLANYIFDFYKKIDYSTQLEFI

SEQ ID NO: 2988672 - protein, 30 aa, Entamoeba invadens
ALPDENKNILWLLIRFLRKVTDNTELTQMT

SEQ ID NO: 2988673 - protein, 17 aa, Entamoeba invadens
ALPKLYSMRYEERTKFL

SEQ ID NO: 2988674 - protein, 25 aa, Entamoeba invadens
ALPLPYGVFAMLYTLLPLDYKNHLF

SEQ ID NO: 2988675 - protein, 17 aa, Entamoeba invadens
ALPPKTLPVLSRCVSQF

SEQ ID NO: 2988676 - protein, 26 aa, Entamoeba invadens
ALPPQYKIIPKILFPSYEQSFIIKED

SEQ ID NO: 2988677 - protein, 18 aa, Entamoeba invadens
ALQIIRINPQYKVARRGV

SEQ ID NO: 2988678 - protein, 17 aa, Entamoeba invadens
ALQKGFVLNVLDPNPFA

SEQ ID NO: 2988679 - protein, 18 aa, Entamoeba invadens
ALQKKAQQLELLVRCVFK

SEQ ID NO: 2988680 - protein, 19 aa, Entamoeba invadens
ALQLVPPKLLVKMKNEAKF

SEQ ID NO: 2988681 - protein, 20 aa, Entamoeba invadens
ALQLVYEHLLKEGLVDSAAS

SEQ ID NO: 2988682 - protein, 31 aa, Entamoeba invadens
ALQSIRNFAFYYCINFTQIVLPISLVDIGSS

SEQ ID NO: 2988683 - protein, 31 aa, Entamoeba invadens
ALQSIRNFVFYYCINFTQIVLPISLVDIGSS

SEQ ID NO: 2988684 - protein, 21 aa, Entamoeba invadens
ALRCDFLMITAMRDSVVVALE

SEQ ID NO: 2988685 - protein, 30 aa, Entamoeba invadens
ALRDKYFDNAVYFLSLFPKKRVSFSIKSFV

SEQ ID NO: 2988686 - protein, 24 aa, Entamoeba invadens
ALRDPSLWRCIDATHYRTGNKYKV

SEQ ID NO: 2988687 - protein, 27 aa, Entamoeba invadens
ALRVCDVKKILFYMRSVFKSLQNISME

SEQ ID NO: 2988688 - protein, 22 aa, Entamoeba invadens
ALRVPTYPTVIKYPMDLGTIKR

SEQ ID NO: 2988689 - protein, 17 aa, Entamoeba invadens
ALSHPFIIGIPIEGYVP

SEQ ID NO: 2988690 - protein, 36 aa, Entamoeba invadens
ALSLLGFYTLPQTFRDVSIFPIVFFGGKVQATKLRA

SEQ ID NO: 2988691 - protein, 17 aa, Entamoeba invadens
ALSLLPLVHVFSNGFEG

SEQ ID NO: 2988692 - protein, 22 aa, Entamoeba invadens
ALSNWGLLDPSDRFLQLFLVSV

SEQ ID NO: 2988693 - protein, 17 aa, Entamoeba invadens
ALSRNRSDEFSGLKPEY

SEQ ID NO: 2988694 - protein, 25 aa, Entamoeba invadens
ALSTEPIFFPFSAIALHSTAIQREV

SEQ ID NO: 2988695 - protein, 31 aa, Entamoeba invadens
ALSTTTTLLFLRFLLTPFSAVPNVLIETQKL

SEQ ID NO: 2988696 - protein, 18 aa, Entamoeba invadens
ALSVHWKNRKCVASSLHL

SEQ ID NO: 2988697 - protein, 17 aa, Entamoeba invadens
ALTCLTKFTLNGGSVSV

SEQ ID NO: 2988698 - protein, 21 aa, Entamoeba invadens
ALTEWAFAPSCVFIKALIPEV

SEQ ID NO: 2988699 - protein, 17 aa, Entamoeba invadens
ALTLIRLSSEEQKGVVI

SEQ ID NO: 2988700 - protein, 25 aa, Entamoeba invadens
ALTQKPLDLVPPLAPPQTKQPLGFL

SEQ ID NO: 2988701 - protein, 24 aa, Entamoeba invadens
ALTTFRLFNDVAVPVILLSENSQF

SEQ ID NO: 2988702 - protein, 18 aa, Entamoeba invadens
ALTTLGDVYLWGANTYGE

SEQ ID NO: 2988703 - protein, 19 aa, Entamoeba invadens
ALTYSSFRYVFKNVAFTCK

SEQ ID NO: 2988704 - protein, 25 aa, Entamoeba invadens
ALVALSLNNTLFLRPEIREMISACF

SEQ ID NO: 2988705 - protein, 20 aa, Entamoeba invadens
ALVDKKNTYDLLTKFKKQYG

SEQ ID NO: 2988706 - protein, 17 aa, Entamoeba invadens
ALVFTTKNTVIFLKNQR

SEQ ID NO: 2988707 - protein, 27 aa, Entamoeba invadens
ALVHYGLFEPFCRTIQVLPNRTHPTVL

SEQ ID NO: 2988708 - protein, 23 aa, Entamoeba invadens
ALVIHPAVWPLIHAITITGLRRT

SEQ ID NO: 2988709 - protein, 22 aa, Entamoeba invadens
ALVILCRMVFSLIAQISVKNKV

SEQ ID NO: 2988710 - protein, 17 aa, Entamoeba invadens
ALVILTISFLKCEQQID

SEQ ID NO: 2988711 - protein, 19 aa, Entamoeba invadens
ALVKYGLALFSRKILNEKM

SEQ ID NO: 2988712 - protein, 19 aa, Entamoeba invadens
ALVLNYLCKAAMSRLHLTD

SEQ ID NO: 2988713 - protein, 17 aa, Entamoeba invadens
ALVNYKGILPGKRVVIQ

SEQ ID NO: 2988714 - protein, 28 aa, Entamoeba invadens
ALVVFDLNNFLTFQKASYWLDEIRSEGY

SEQ ID NO: 2988715 - protein, 19 aa, Entamoeba invadens
ALVVHKVLVPPNVMGTVKW

SEQ ID NO: 2988716 - protein, 20 aa, Entamoeba invadens
ALVVRDYLSVRTFDLRKTES

SEQ ID NO: 2988717 - protein, 18 aa, Entamoeba invadens
ALVVYKDPLAFVKQSELP

SEQ ID NO: 2988718 - protein, 17 aa, Entamoeba invadens
ALVWLEEVLKTWEGTIL

SEQ ID NO: 2988719 - protein, 20 aa, Entamoeba invadens
ALVYQFCLNKYYANIDLLDN

SEQ ID NO: 2988720 - protein, 17 aa, Entamoeba invadens
ALYDSRLTPHKKICEEL

SEQ ID NO: 2988721 - protein, 18 aa, Entamoeba invadens
ALYLLRWISLMMAEELPT

SEQ ID NO: 2988722 - protein, 25 aa, Entamoeba invadens
ALYQTNFLVCTPGRLLYHLENTPKF

SEQ ID NO: 2988723 - protein, 25 aa, Entamoeba invadens
ALYSSIFNFIINAFPKIETLQCYDY

SEQ ID NO: 2988724 - protein, 21 aa, Entamoeba invadens
ALYTLYTLYNTQHNIPLLSIN

SEQ ID NO: 2988725 - protein, 18 aa, Entamoeba invadens
ALYVIDSLIRYLADDTAT

SEQ ID NO: 2988726 - protein, 20 aa, Entamoeba invadens
AMAFMVFNFFKIRIEKSFTE

SEQ ID NO: 2988727 - protein, 22 aa, Entamoeba invadens
AMAFVVYNFFKIRIEKSFTEKC

SEQ ID NO: 2988728 - protein, 20 aa, Entamoeba invadens
AMAIFAKFGPPDLFITFTAN

SEQ ID NO: 2988729 - protein, 26 aa, Entamoeba invadens
AMAKITRLIFKTFSDLVNPKPNADAV

SEQ ID NO: 2988730 - protein, 19 aa, Entamoeba invadens
AMCIFAELSFVPGKMIQAE

SEQ ID NO: 2988731 - protein, 26 aa, Entamoeba invadens
AMCNLPLLEHLTFIDSPGILSGEKQR

SEQ ID NO: 2988732 - protein, 24 aa, Entamoeba invadens
AMDCPEFFAVCIFRILDKNFEAKV

SEQ ID NO: 2988733 - protein, 26 aa, Entamoeba invadens
AMDVLYGRVYPLKLGYIGVLNRSQED

SEQ ID NO: 2988734 - protein, 26 aa, Entamoeba invadens
AMEASLPFLHFFDGFRTSHEIQKIHQ

SEQ ID NO: 2988735 - protein, 31 aa, Entamoeba invadens
AMFEKDFIERATVLILYKLLFVNFEQSEVVY

SEQ ID NO: 2988736 - protein, 20 aa, Entamoeba invadens
AMFGGKLEIILNGSAPLTSE

SEQ ID NO: 2988737 - protein, 20 aa, Entamoeba invadens
AMFVSQLESTGWKRGKGLGK

SEQ ID NO: 2988738 - protein, 24 aa, Entamoeba invadens
AMGLRRIKYWDNVFIDFVSQCFYY

SEQ ID NO: 2988739 - protein, 28 aa, Entamoeba invadens
AMGSAKSIIVFWALKVIVTLLNPKVEED

SEQ ID NO: 2988740 - protein, 26 aa, Entamoeba invadens
AMHNLYIFSKINFLCDMDLSRISNHI

SEQ ID NO: 2988741 - protein, 18 aa, Entamoeba invadens
AMILAPPTIDRSHAVMVS

SEQ ID NO: 2988742 - protein, 17 aa, Entamoeba invadens
AMILRFAIPSRKMTKED

SEQ ID NO: 2988743 - protein, 31 aa, Entamoeba invadens
AMIVQSKIFVQNTLPFFAKKLEIPSELTSNI

SEQ ID NO: 2988744 - protein, 20 aa, Entamoeba invadens
AMIVSMYFKTVEDFINIEFV

SEQ ID NO: 2988745 - protein, 21 aa, Entamoeba invadens
AMKILLARYYGGRMIQPSYSH

SEQ ID NO: 2988746 - protein, 27 aa, Entamoeba invadens
AMKRHNEREDRLKAIQSAREKARKDME

SEQ ID NO: 2988747 - protein, 20 aa, Entamoeba invadens
AMKVATPPSIPFLGSTMGDL

SEQ ID NO: 2988748 - protein, 21 aa, Entamoeba invadens
AMKYLAQFGFGEDLVNKIIAA

SEQ ID NO: 2988749 - protein, 17 aa, Entamoeba invadens
AMLKYMKEKQIPLTQYE

SEQ ID NO: 2988750 - protein, 18 aa, Entamoeba invadens
AMLPYFCEVYGNPNSLHT

SEQ ID NO: 2988751 - protein, 21 aa, Entamoeba invadens
AMLQKTLLICETLCNDWLNLE

SEQ ID NO: 2988752 - protein, 26 aa, Entamoeba invadens
AMLREFYTKDLIFQKLIETRFMSISR

SEQ ID NO: 2988753 - protein, 29 aa, Entamoeba invadens
AMLSKGQVYPFRYLLQSFPRNQHIAQLIS

SEQ ID NO: 2988754 - protein, 17 aa, Entamoeba invadens
AMMCSGIVCYDNLPENI

SEQ ID NO: 2988755 - protein, 23 aa, Entamoeba invadens
AMMDYIEIITYIQETRNFIDHPV

SEQ ID NO: 2988756 - protein, 27 aa, Entamoeba invadens
AMMVSNFLSFQLSFTYVLTVEKSPYIK

SEQ ID NO: 2988757 - protein, 17 aa, Entamoeba invadens
AMNIFYIDKTKMTLESL

SEQ ID NO: 2988758 - protein, 19 aa, Entamoeba invadens
AMNNCYLFEMTKSRLTCLM

SEQ ID NO: 2988759 - protein, 28 aa, Entamoeba invadens
AMNSSLIKRYLIPRYTPNLVRNKSPHNN

SEQ ID NO: 2988760 - protein, 25 aa, Entamoeba invadens
AMPVIQALFRVLSPFEWHGVLIPIL

SEQ ID NO: 2988761 - protein, 29 aa, Entamoeba invadens
AMQRQGIVPIFLYPTLGLESLDYIVKLLN

SEQ ID NO: 2988762 - protein, 23 aa, Entamoeba invadens
AMQRQGIVPVPLYPTLGKDSLNY

SEQ ID NO: 2988763 - protein, 20 aa, Entamoeba invadens
AMRCGNFTTLYRGECYLTHN

SEQ ID NO: 2988764 - protein, 27 aa, Entamoeba invadens
AMRLFDHPNLLSLFDYIESSESFAARL

SEQ ID NO: 2988765 - protein, 24 aa, Entamoeba invadens
AMSKLISIILLMFNVPKKKSLTLL

SEQ ID NO: 2988766 - protein, 19 aa, Entamoeba invadens
AMSKLISIILLMSNVPKKV

SEQ ID NO: 2988767 - protein, 18 aa, Entamoeba invadens
AMSLFAVKTVSLLRFRLE

SEQ ID NO: 2988768 - protein, 25 aa, Entamoeba invadens
AMTDSRVILLEYLISFKSGEVFLGN

SEQ ID NO: 2988769 - protein, 26 aa, Entamoeba invadens
AMTGKLIEMFQFLLSIDFVDDAFNLL

SEQ ID NO: 2988770 - protein, 24 aa, Entamoeba invadens
AMTMYEIFIWGEAFPREMFRYPWE

SEQ ID NO: 2988771 - protein, 22 aa, Entamoeba invadens
AMTMYEVLQWDFVFKKDDERFL

SEQ ID NO: 2988772 - protein, 18 aa, Entamoeba invadens
AMWSPKFERVFQLGSLSG

SEQ ID NO: 2988773 - protein, 36 aa, Entamoeba invadens
AMYFNPMVPDFLGERYRELWLDYFVLLCGQNNDSSL

SEQ ID NO: 2988774 - protein, 18 aa, Entamoeba invadens
AMYGYYYGKLLIVNSRYQ

SEQ ID NO: 2988775 - protein, 21 aa, Entamoeba invadens
AMYKKTFCGYALEKAFDQFQT

SEQ ID NO: 2988776 - protein, 25 aa, Entamoeba invadens
ANAGISFTQLIFAQSGNLNKTEMKE

SEQ ID NO: 2988777 - protein, 23 aa, Entamoeba invadens
ANALKVFILLLLGKKELAANVVR

SEQ ID NO: 2988778 - protein, 25 aa, Entamoeba invadens
ANCAQLLMEKAIVLPVFEDVKIKEE

SEQ ID NO: 2988779 - protein, 24 aa, Entamoeba invadens
ANCKSLKEFVFPGNFFMIGKRCFQ

SEQ ID NO: 2988780 - protein, 26 aa, Entamoeba invadens
ANCKSLKEFVFPGNFFMIGKRCFQNC

SEQ ID NO: 2988781 - protein, 22 aa, Entamoeba invadens
ANCRGLMGVTLPTTLEFLVNEC

SEQ ID NO: 2988782 - protein, 19 aa, Entamoeba invadens
ANCYSLKEILLPKSLQEVE

SEQ ID NO: 2988783 - protein, 17 aa, Entamoeba invadens
ANDIIPNSLYFLRNQMD

SEQ ID NO: 2988784 - protein, 27 aa, Entamoeba invadens
ANDITTFPLLPQIIKFKLEGPDNLALY

SEQ ID NO: 2988785 - protein, 26 aa, Entamoeba invadens
ANDSQMMLYNFTSGVLRELSSKWSDI

SEQ ID NO: 2988786 - protein, 23 aa, Entamoeba invadens
ANDYFVQILSNVAETNFYNSHII

SEQ ID NO: 2988787 - protein, 29 aa, Entamoeba invadens
ANEDELQILVIQQYTLLDDMVLSTHYKAN

SEQ ID NO: 2988788 - protein, 33 aa, Entamoeba invadens
ANEHQAHSMGYFFPVLPFQDPNTSTFKLSPQFT

SEQ ID NO: 2988789 - protein, 29 aa, Entamoeba invadens
ANEIDIMRFKYLIRLFGKFYNDKNCLRKM

SEQ ID NO: 2988790 - protein, 25 aa, Entamoeba invadens
ANENKLFTFKIITHQLKDLEPVEIF

SEQ ID NO: 2988791 - protein, 29 aa, Entamoeba invadens
ANESGFIQFLPLIIFYITSQERGQYKNSL

SEQ ID NO: 2988792 - protein, 31 aa, Entamoeba invadens
ANESSDPLPPRLFRKYLAYAKANVHPILNDE

SEQ ID NO: 2988793 - protein, 26 aa, Entamoeba invadens
ANFPTEGLLQFFIGTGNYYGTEHSKL

SEQ ID NO: 2988794 - protein, 26 aa, Entamoeba invadens
ANFSKYINFSIANGFITCDILIEKDG

SEQ ID NO: 2988795 - protein, 17 aa, Entamoeba invadens
ANGNGKVQLEEFMKWLL

SEQ ID NO: 2988796 - protein, 28 aa, Entamoeba invadens
ANGNKFCEFIKFQLNFPNPGCFPENIVD

SEQ ID NO: 2988797 - protein, 23 aa, Entamoeba invadens
ANGSFLSVYKILEGALEVYKTYM

SEQ ID NO: 2988798 - protein, 31 aa, Entamoeba invadens
ANGSVDDFCLYLYLTYFVINGNNQENDEQLE

SEQ ID NO: 2988799 - protein, 21 aa, Entamoeba invadens
ANHDFSLYPTFSIVDPCHTMS

SEQ ID NO: 2988800 - protein, 23 aa, Entamoeba invadens
ANHKFFHVFDRWDCTQSSVSPLT

SEQ ID NO: 2988801 - protein, 18 aa, Entamoeba invadens
ANHLESFNSYVILPVQRI

SEQ ID NO: 2988802 - protein, 19 aa, Entamoeba invadens
ANICFIFFDDQNNVFGAFS

SEQ ID NO: 2988803 - protein, 18 aa, Entamoeba invadens
ANIFIHDMHVKIGDFGLA

SEQ ID NO: 2988804 - protein, 23 aa, Entamoeba invadens
ANILLDLPVFCEDTTEPYFRAPA

SEQ ID NO: 2988805 - protein, 22 aa, Entamoeba invadens
ANIPHCAFFRCYKLSEISVPNS

SEQ ID NO: 2988806 - protein, 28 aa, Entamoeba invadens
ANIPNKKMLVLLPVPMKLEKDEYYVVYK

SEQ ID NO: 2988807 - protein, 23 aa, Entamoeba invadens
ANITKCIYDLSEAIKRMRALDER

SEQ ID NO: 2988808 - protein, 24 aa, Entamoeba invadens
ANKAVFQDFYIFSVPLQKGKDCCK

SEQ ID NO: 2988809 - protein, 27 aa, Entamoeba invadens
ANKGLFFTRPFNTLRLKFYCTELTSPS

SEQ ID NO: 2988810 - protein, 22 aa, Entamoeba invadens
ANKKLNCECRQLYTINKELEIK

SEQ ID NO: 2988811 - protein, 25 aa, Entamoeba invadens
ANKKPQYFIIPLGTGNDLSICTGWG

SEQ ID NO: 2988812 - protein, 27 aa, Entamoeba invadens
ANKNDFVITVVLYKNGISVNNGGLQSY

SEQ ID NO: 2988813 - protein, 17 aa, Entamoeba invadens
ANKNFVRGYKKSGLKML

SEQ ID NO: 2988814 - protein, 26 aa, Entamoeba invadens
ANKRKVSYFPRDLYDFAFEVIDTDDS

SEQ ID NO: 2988815 - protein, 31 aa, Entamoeba invadens
ANLHSFAISLCYFIIPYFSANHNFRKLADTH

SEQ ID NO: 2988816 - protein, 18 aa, Entamoeba invadens
ANLILTEGKLGMPGAIAH

SEQ ID NO: 2988817 - protein, 27 aa, Entamoeba invadens
ANLKALFEIIEKKFLWDKVRVEGGAYD

SEQ ID NO: 2988818 - protein, 21 aa, Entamoeba invadens
ANLLDTVFTLFVKLSDLDVKQ

SEQ ID NO: 2988819 - protein, 20 aa, Entamoeba invadens
ANLLMTPRGFTLRPKIEVND

SEQ ID NO: 2988820 - protein, 19 aa, Entamoeba invadens
ANLNNLIKGSKDLADKMKG

SEQ ID NO: 2988821 - protein, 19 aa, Entamoeba invadens
ANLPLFDFQNFLVSGYVNL

SEQ ID NO: 2988822 - protein, 27 aa, Entamoeba invadens
ANLSTIEAIYYFYRDYYLATIGNYTGQ

SEQ ID NO: 2988823 - protein, 19 aa, Entamoeba invadens
ANLVLLLSAFFEGVQQTVM

SEQ ID NO: 2988824 - protein, 17 aa, Entamoeba invadens
ANLYLVGMLYAATSPDA

SEQ ID NO: 2988825 - protein, 28 aa, Entamoeba invadens
ANMEEALQWFQYTYLYVCLKRSEGGVGY

SEQ ID NO: 2988826 - protein, 27 aa, Entamoeba invadens
ANNCRAYSFTVKRFIRVTPSVEGSHFI

SEQ ID NO: 2988827 - protein, 19 aa, Entamoeba invadens
ANNINLLLPSGQFGSRLQG

SEQ ID NO: 2988828 - protein, 25 aa, Entamoeba invadens
ANNIVNLVYLIYHFGHQKVTGSSLI

SEQ ID NO: 2988829 - protein, 22 aa, Entamoeba invadens
ANNKKMFISCFSAFWIEHNGDV

SEQ ID NO: 2988830 - protein, 23 aa, Entamoeba invadens
ANNKNVLVFFKVDATTATEYAAE

SEQ ID NO: 2988831 - protein, 22 aa, Entamoeba invadens
ANNKSHEIFLYSKANPTIKINK

SEQ ID NO: 2988832 - protein, 22 aa, Entamoeba invadens
ANNKWVADYILYENEIPLQDAM

SEQ ID NO: 2988833 - protein, 18 aa, Entamoeba invadens
ANNPTLQKLLIQTSIKAA

SEQ ID NO: 2988834 - protein, 22 aa, Entamoeba invadens
ANNRLVLSSKENPTSKNDEEPA

SEQ ID NO: 2988835 - protein, 34 aa, Entamoeba invadens
ANPLLPKLEDLINLPFIQLLQLKQCFSDILKHFP

SEQ ID NO: 2988836 - protein, 25 aa, Entamoeba invadens
ANPLQLFKEYLIPVSKYQVSFSHGR

SEQ ID NO: 2988837 - protein, 18 aa, Entamoeba invadens
ANPPVTPAFEFLEGSSLS

SEQ ID NO: 2988838 - protein, 20 aa, Entamoeba invadens
ANQFGIQRLISLRIKEGDTS

SEQ ID NO: 2988839 - protein, 24 aa, Entamoeba invadens
ANQMVLHYLLHTLNIIASNNYINM

SEQ ID NO: 2988840 - protein, 19 aa, Entamoeba invadens
ANQRFRHWFTKDELYALFD

SEQ ID NO: 2988841 - protein, 18 aa, Entamoeba invadens
ANQYFPDPQLPAVFDDDI

SEQ ID NO: 2988842 - protein, 20 aa, Entamoeba invadens
ANRGLIWENASDYKEKIIKN

SEQ ID NO: 2988843 - protein, 27 aa, Entamoeba invadens
ANRVEKIYTQRIILFVGSPINMKEEET

SEQ ID NO: 2988844 - protein, 20 aa, Entamoeba invadens
ANRWTDAIFNVQSYAKSKAV

SEQ ID NO: 2988845 - protein, 30 aa, Entamoeba invadens
ANSAPLNNVIYTAQPFIPKKRHVVGLASPS

SEQ ID NO: 2988846 - protein, 26 aa, Entamoeba invadens
ANSFIHPYDFFPFDRRFEEQRKEDGM

SEQ ID NO: 2988847 - protein, 29 aa, Entamoeba invadens
ANSFKNELILFYMFYVMVGEEAQFKAAKT

SEQ ID NO: 2988848 - protein, 22 aa, Entamoeba invadens
ANSKVLFFTPTDDIKEVNCAII

SEQ ID NO: 2988849 - protein, 23 aa, Entamoeba invadens
ANSKWLYHISKILKGTVIAINRM

SEQ ID NO: 2988850 - protein, 21 aa, Entamoeba invadens
ANSLRREGLIKKIANQWIRRE

SEQ ID NO: 2988851 - protein, 24 aa, Entamoeba invadens
ANSPFILHLEEMQSIIDCLELLEY

SEQ ID NO: 2988852 - protein, 30 aa, Entamoeba invadens; identical to SEQ ID NO: 2519189

SEQ ID NO: 2988853 - protein, 31 aa, Entamoeba invadens
ANSYKELLEYLLSFPQMKPLINVKNLSGSTP

SEQ ID NO: 2988854 - protein, 25 aa, Entamoeba invadens
ANTKYACFLIAYFKIEDKMIKKIQD

SEQ ID NO: 2988855 - protein, 19 aa, Entamoeba invadens
ANTLYECGGKFKIYIADWF

SEQ ID NO: 2988856 - protein, 24 aa, Entamoeba invadens
ANTMDAMIYALRQNALVALEARSV

SEQ ID NO: 2988857 - protein, 25 aa, Entamoeba invadens
ANTMDVLIYILRQNALVALKAREEG

SEQ ID NO: 2988858 - protein, 27 aa, Entamoeba invadens
ANTMPIQNVRPFPDVLPQQTQPTQQYG

SEQ ID NO: 2988859 - protein, 27 aa, Entamoeba invadens
ANVLIGNLFCMLGPVFKIYSEYTMSYN

SEQ ID NO: 2988860 - protein, 20 aa, Entamoeba invadens
ANWKGARWVPTEKTTLITIS

SEQ ID NO: 2988861 - protein, 25 aa, Entamoeba invadens
ANWTSSMILIFADFKNRVAMFQKMI

SEQ ID NO: 2988862 - protein, 18 aa, Entamoeba invadens
ANYCAVGLFVKDKAFFGN

SEQ ID NO: 2988863 - protein, 17 aa, Entamoeba invadens
ANYFFQVADLFSLQNRR

SEQ ID NO: 2988864 - protein, 25 aa, Entamoeba invadens
ANYFKGEMFYIHKDFIFFNHQIDEE

SEQ ID NO: 2988865 - protein, 22 aa, Entamoeba invadens
ANYSNWGFPKPLYVDGTEVCDN

SEQ ID NO: 2988866 - protein, 22 aa, Entamoeba invadens
ANYYSLLAALDLLITKKAVLPE

SEQ ID NO: 2988867 - protein, 33 aa, Entamoeba invadens
APASYIIETPQRKLIRVSLYGVDQMLKFNPANK

SEQ ID NO: 2988868 - protein, 26 aa, Entamoeba invadens
APCVLQINILKLTSVKYVKHPMFQVK

SEQ ID NO: 2988869 - protein, 18 aa, Entamoeba invadens
APDSHLVIPYTADCKAPT

SEQ ID NO: 2988870 - protein, 24 aa, Entamoeba invadens
APEEANAFFVLQHASLEGSESTQL

SEQ ID NO: 2988871 - protein, 18 aa, Entamoeba invadens
APEILFKMPSYTSAVDMW

SEQ ID NO: 2988872 - protein, 20 aa, Entamoeba invadens
APEILLGALKYDGSIDIWST

SEQ ID NO: 2988873 - protein, 18 aa, Entamoeba invadens
APEIMLRTPYSSKSDLYS

SEQ ID NO: 2988874 - protein, 21 aa, Entamoeba invadens
APELLFEYTYYDYGIDVWGAG

SEQ ID NO: 2988875 - protein, 26 aa, Entamoeba invadens
APENALLYVILSPVGPYFKGGFKAIK

SEQ ID NO: 2988876 - protein, 31 aa, Entamoeba invadens
APFDIVTTFIKWLCNSTKLKEYYTFCNSNNI

SEQ ID NO: 2988877 - protein, 22 aa, Entamoeba invadens
APFIQLSQYVPIFTKLKTEFTK

SEQ ID NO: 2988878 - protein, 19 aa, Entamoeba invadens
APFPKMFGLSNIQKEIYPY

SEQ ID NO: 2988879 - protein, 27 aa, Entamoeba invadens
APGKYDYPFVFQLPQGLPSSQFFTGRN

SEQ ID NO: 2988880 - protein, 21 aa, Entamoeba invadens
APHKIKLLNLLQTLFETAHHR

SEQ ID NO: 2988881 - protein, 37 aa, Entamoeba invadens
APHLIFDNLTTPLGKRFEMILKNLFPVPKPDTKRIMT

SEQ ID NO: 2988882 - protein, 19 aa, Entamoeba invadens
APHLPYLSTPFLSKMLSEH

SEQ ID NO: 2988883 - protein, 21 aa, Entamoeba invadens
APHVYAIAEGALTQMRDLSAQ

SEQ ID NO: 2988884 - protein, 19 aa, Entamoeba invadens
APILGDFLKELYKLYADYV

SEQ ID NO: 2988885 - protein, 27 aa, Entamoeba invadens
APITMGYYIYYVNVVPVYFVPQQQDIQ

SEQ ID NO: 2988886 - protein, 19 aa, Entamoeba invadens
APKLPKSVIKPTNGSSGFS

SEQ ID NO: 2988887 - protein, 30 aa, Entamoeba invadens
APLELFKEWKSGMPLPMVFVSSFNSVIRLH

SEQ ID NO: 2988888 - protein, 19 aa, Entamoeba invadens
APLEPLTPLYSLLNPSETG

SEQ ID NO: 2988889 - protein, 24 aa, Entamoeba invadens
APLGEECVVLILLIKSAGAESISL

SEQ ID NO: 2988890 - protein, 35 aa, Entamoeba invadens
APLGSEFFYNLYLFPYLVFIGFTRCQLPVSGISPQ

SEQ ID NO: 2988891 - protein, 19 aa, Entamoeba invadens
APLKEKPLTAPKAPTALPT

SEQ ID NO: 2988892 - protein, 18 aa, Entamoeba invadens
APLKLLWSSLKAIGLVCE

SEQ ID NO: 2988893 - protein, 19 aa, Entamoeba invadens
APLKPIHRFNFSEAITEQT

SEQ ID NO: 2988894 - protein, 29 aa, Entamoeba invadens
APLLFDCSSAYFPILYPPRGDEELRLKLT

SEQ ID NO: 2988895 - protein, 32 aa, Entamoeba invadens
APLLTQLSVIGSPLMNFDLPKLQKFAVDNTTV

SEQ ID NO: 2988896 - protein, 21 aa, Entamoeba invadens
APLPPQIQTTPIAAPPPPPTS

SEQ ID NO: 2988897 - protein, 18 aa, Entamoeba invadens
APLPTVTRGRPIHIGYMS

SEQ ID NO: 2988898 - protein, 19 aa, Entamoeba invadens
APLRGASVCVQRLLPKDNM

SEQ ID NO: 2988899 - protein, 29 aa, Entamoeba invadens
APLTMEIYNYFRVNLPNTLILQGYGSTET

SEQ ID NO: 2988900 - protein, 17 aa, Entamoeba invadens
APMGLPFFSNQIVMNPS

SEQ ID NO: 2988901 - protein, 29 aa, Entamoeba invadens
APMYRDMTQCLLFPSPYFQITPSQVNEKI

SEQ ID NO: 2988902 - protein, 18 aa, Entamoeba invadens
APNAFLSMVLFVAQLCAI

SEQ ID NO: 2988903 - protein, 19 aa, Entamoeba invadens
APNFVPRFITPGHYINSYL

SEQ ID NO: 2988904 - protein, 29 aa, Entamoeba invadens
APNTFEWVYKYFFELLKKSSEFKDNTVAH

SEQ ID NO: 2988905 - protein, 18 aa, Entamoeba invadens
APPAAKPIYKVKNGKIQI

SEQ ID NO: 2988906 - protein, 22 aa, Entamoeba invadens
APPERIMSTWIGGSILMSLSTN

SEQ ID NO: 2988907 - protein, 17 aa, Entamoeba invadens
APPEYIYPGLKYQRPVS

SEQ ID NO: 2988908 - protein, 31 aa, Entamoeba invadens
APPGGLMPPGMLPPPGLAPPGGMMPPPGMAP

SEQ ID NO: 2988909 - protein, 28 aa, Entamoeba invadens
APPPGLAPPGMLPPPAPPGGLAPPGMLP

SEQ ID NO: 2988910 - protein, 36 aa, Entamoeba invadens
APPPLAPPGGLAPPPGLAPPGGLAPPPGLAPPGGLE

SEQ ID NO: 2988911 - protein, 28 aa, Entamoeba invadens
APQKEVNLYFRCEGLNLLTFTSEAQVTV

SEQ ID NO: 2988912 - protein, 17 aa, Entamoeba invadens
APQLPKAYGFHVCVTKW

SEQ ID NO: 2988913 - protein, 22 aa, Entamoeba invadens
APRQLLQMVKFIEFEANSKRQE

SEQ ID NO: 2988914 - protein, 17 aa, Entamoeba invadens
APRTIGFLGLGDADVQT

SEQ ID NO: 2988915 - protein, 25 aa, Entamoeba invadens
APSELLGLFYRFSGTLAKYAKKLEG

SEQ ID NO: 2988916 - protein, 18 aa, Entamoeba invadens
APSLLFIDEIDSIVQKRD

SEQ ID NO: 2988917 - protein, 20 aa, Entamoeba invadens
APSVTFSTLPEINSAVFEAM

SEQ ID NO: 2988918 - protein, 25 aa, Entamoeba invadens
APTEVVFFVNYFVRNYTLLPLAVND

SEQ ID NO: 2988919 - protein, 17 aa, Entamoeba invadens
APTFKTPYGITVHDILK

SEQ ID NO: 2988920 - protein, 18 aa, Entamoeba invadens
APTFKTPYGITVHDILKG

SEQ ID NO: 2988921 - protein, 19 aa, Entamoeba invadens
APTLITQNFMYKHFICIMM

SEQ ID NO: 2988922 - protein, 26 aa, Entamoeba invadens
APTLQELRVMSWLGFIGGAKGVFYYS

SEQ ID NO: 2988923 - protein, 26 aa, Entamoeba invadens
APTLQKLKVISWLGFIKGAKGVFYYA

SEQ ID NO: 2988924 - protein, 17 aa, Entamoeba invadens
APTLRNNMALLAIDPHG

SEQ ID NO: 2988925 - protein, 24 aa, Entamoeba invadens
APTQRICRYELLLSTILKDVQKES

SEQ ID NO: 2988926 - protein, 24 aa, Entamoeba invadens
APTTLITEFFLKCKEKSFVISPRV

SEQ ID NO: 2988927 - protein, 27 aa, Entamoeba invadens
APTVAPPAMFTPPTPFVGFDNKTPASN

SEQ ID NO: 2988928 - protein, 19 aa, Entamoeba invadens
APVDIIMMSPKLGLPTKTL

SEQ ID NO: 2988929 - protein, 19 aa, Entamoeba invadens
APVDLFGIVKEQIDIAKTS

SEQ ID NO: 2988930 - protein, 21 aa, Entamoeba invadens
APVIYNLFRECGCETNFVLGS

SEQ ID NO: 2988931 - protein, 19 aa, Entamoeba invadens
APVPPFITTDFYVHSPEFG

SEQ ID NO: 2988932 - protein, 17 aa, Entamoeba invadens
APVWPSSLLQNLLTITK

SEQ ID NO: 2988933 - protein, 19 aa, Entamoeba invadens
AQAIGSLGLLPPPLNFSFS

SEQ ID NO: 2988934 - protein, 18 aa, Entamoeba invadens
AQAIKFLGLRPQVPVVGN

SEQ ID NO: 2988935 - protein, 26 aa, Entamoeba invadens
AQAMSPLKAPPLISAEKKLPPSDQKG

SEQ ID NO: 2988936 - protein, 27 aa, Entamoeba invadens
AQAVLQTTSLLIRQEKYFSRKCKVCAN

SEQ ID NO: 2988937 - protein, 19 aa, Entamoeba invadens
AQCPLTAVHPYRPSSSSTQ

SEQ ID NO: 2988938 - protein, 24 aa, Entamoeba invadens
AQCQYYLGFYDANPANLNPLTPVN

SEQ ID NO: 2988939 - protein, 24 aa, Entamoeba invadens
AQDARNFIFRLVNPKDPTDNPRRW

SEQ ID NO: 2988940 - protein, 38 aa, Entamoeba invadens
AQDEIRSVRVPPFRFKYFKNNWPAIYEPIVKQMKLNIR

SEQ ID NO: 2988941 - protein, 17 aa, Entamoeba invadens
AQDILTEISSNLKYFII

SEQ ID NO: 2988942 - protein, 26 aa, Entamoeba invadens
AQDKLEQLQAKYKKLRKQFEALRDAD

SEQ ID NO: 2988943 - protein, 25 aa, Entamoeba invadens
AQDKRYIVDIFLLYGNIAVDTSESR

SEQ ID NO: 2988944 - protein, 25 aa, Entamoeba invadens
AQDYYQLLVKALGTLLKFIPDNEAQ

SEQ ID NO: 2988945 - protein, 24 aa, Entamoeba invadens
AQEAHRKYLFLEDEKLELERNLQL

SEQ ID NO: 2988946 - protein, 30 aa, Entamoeba invadens
AQEECKLYKKPWYSYFVRVVDEDLNVSVRQ

SEQ ID NO: 2988947 - protein, 19 aa, Entamoeba invadens
AQEHLWKYISTADAEWCMD

SEQ ID NO: 2988948 - protein, 25 aa, Entamoeba invadens
AQFGDYFYMNLVIQFDSLSAFYLES

SEQ ID NO: 2988949 - protein, 29 aa, Entamoeba invadens
AQFMELLGFFQNRYLKYAPNAPKYFKSNL

SEQ ID NO: 2988950 - protein, 26 aa, Entamoeba invadens
AQFSNGKWRSEWTVTLNGSKASIEGR

SEQ ID NO: 2988951 - protein, 24 aa, Entamoeba invadens
AQHFSLLTKLKTPPLLVLENGDSL

SEQ ID NO: 2988952 - protein, 25 aa, Entamoeba invadens
AQHSGGMLGGWKFSNFKDGVFSEVF

SEQ ID NO: 2988953 - protein, 18 aa, Entamoeba invadens
AQHSNLDQYWLQTVDWME

SEQ ID NO: 2988954 - protein, 22 aa, Entamoeba invadens
AQIALRVQLISKMKAYCNGFLP

SEQ ID NO: 2988955 - protein, 24 aa, Entamoeba invadens
AQIMQLVFCILKKDTNRELITLME

SEQ ID NO: 2988956 - protein, 26 aa, Entamoeba invadens
AQITNKLPDYYYVIKEYYNRSDCKFS

SEQ ID NO: 2988957 - protein, 17 aa, Entamoeba invadens
AQKLYNETVNFLDSAII

SEQ ID NO: 2988958 - protein, 23 aa, Entamoeba invadens
AQKPFQCLVLVTGHAYFALYNDI

SEQ ID NO: 2988959 - protein, 18 aa, Entamoeba invadens
AQKQFVLTFSNAEDSSKA

SEQ ID NO: 2988960 - protein, 22 aa, Entamoeba invadens
AQKYGIIPVPLYATLGEQAIDY

SEQ ID NO: 2988961 - protein, 22 aa, Entamoeba invadens
AQLAVLVFQTLFGKYQQLIRNA

SEQ ID NO: 2988962 - protein, 17 aa, Entamoeba invadens
AQLFLTMFTHSSEGNQA

SEQ ID NO: 2988963 - protein, 24 aa, Entamoeba invadens
AQLIAVIKEFFTKMGLPDVKFKPA

SEQ ID NO: 2988964 - protein, 19 aa, Entamoeba invadens
AQLLSLKLQKRVTVSCNVT

SEQ ID NO: 2988965 - protein, 30 aa, Entamoeba invadens
AQLRSLGENFFFVEPLLSGEFLKFNSNNGD

SEQ ID NO: 2988966 - protein, 21 aa, Entamoeba invadens
AQLTSVFQCPTAVLYTVELNP

SEQ ID NO: 2988967 - protein, 22 aa, Entamoeba invadens
AQLTSVFQCPTAVLYTVELNPM

SEQ ID NO: 2988968 - protein, 19 aa, Entamoeba invadens
AQMELIRKALSLYMQNPTK

SEQ ID NO: 2988969 - protein, 23 aa, Entamoeba invadens
AQMIGILFESFDKLLFGCLEGNT

SEQ ID NO: 2988970 - protein, 36 aa, Entamoeba invadens
AQNIFEGDLKLILGLLWVLILKYQIAANKMDASTQA

SEQ ID NO: 2988971 - protein, 24 aa, Entamoeba invadens
AQNLPDYYIVITEPMDLGTITKKL

SEQ ID NO: 2988972 - protein, 32 aa, Entamoeba invadens
AQNLRIKYPFPLRRAPLLNKLAYMAVINKLLS

SEQ ID NO: 2988973 - protein, 29 aa, Entamoeba invadens
AQNMLFDEAWFPYAHFHPFYASYHSMNKD

SEQ ID NO: 2988974 - protein, 22 aa, Entamoeba invadens
AQNTLRQKLFAPPIYEKRGDEY

SEQ ID NO: 2988975 - protein, 26 aa, Entamoeba invadens
AQNVLLHSYYIICIEKNYILPEQFLD

SEQ ID NO: 2988976 - protein, 30 aa, Entamoeba invadens
AQPGQNPPLFLYFATILEGGSLNALEGFTL

SEQ ID NO: 2988977 - protein, 25 aa, Entamoeba invadens
AQPKGVLLYGPPGTGKTLLARAVAH

SEQ ID NO: 2988978 - protein, 17 aa, Entamoeba invadens
AQPKPFRAVPCQPKPLK

SEQ ID NO: 2988979 - protein, 24 aa, Entamoeba invadens
AQPLPSILRRQIVFNKASDVYMSP

SEQ ID NO: 2988980 - protein, 18 aa, Entamoeba invadens
AQPSTKLFKTILELVPTE

SEQ ID NO: 2988981 - protein, 25 aa, Entamoeba invadens
AQQAPLVYRLLIQYFIDNSEFEGIF

SEQ ID NO: 2988982 - protein, 26 aa, Entamoeba invadens
AQQGLYLPLNLLMSIFKQIAVVQHYL

SEQ ID NO: 2988983 - protein, 25 aa, Entamoeba invadens
AQQRKIKKQQLLKRAGKPIVENKGK

SEQ ID NO: 2988984 - protein, 26 aa, Entamoeba invadens
AQRDPKKWWKFAFTATRDYLRQKEED

SEQ ID NO: 2988985 - protein, 30 aa, Entamoeba invadens
AQREFAIRELMRPSVLFNPQPLFKEESTNN

SEQ ID NO: 2988986 - protein, 26 aa, Entamoeba invadens
AQRIEYFENIFYKGKLVMSVFDIAEK

SEQ ID NO: 2988987 - protein, 18 aa, Entamoeba invadens
AQRKVSHTLLPTSKQHLF

SEQ ID NO: 2988988 - protein, 24 aa, Entamoeba invadens
AQRVSKLYCALLNAATKTGNLLIF

SEQ ID NO: 2988989 - protein, 24 aa, Entamoeba invadens
AQSEKLVRYIFQLAMYDNSFDIRD

SEQ ID NO: 2988990 - protein, 22 aa, Entamoeba invadens
AQSKIILNIPFKKTDELFVYHH

SEQ ID NO: 2988991 - protein, 24 aa, Entamoeba invadens
AQSLATVILQRLPRYRMLLDAIGK

SEQ ID NO: 2988992 - protein, 18 aa, Entamoeba invadens
AQSTFYKDKYNESDFVLM

SEQ ID NO: 2988993 - protein, 34 aa, Entamoeba invadens
AQSVFKDMMLFTSTFTLLRSYCEVSLKASKSVEN

SEQ ID NO: 2988994 - protein, 25 aa, Entamoeba invadens
AQTAFIELRDLYLTPLVEKSNAFDP

SEQ ID NO: 2988995 - protein, 23 aa, Entamoeba invadens
AQTAMQLIYTGASVIQMCSSIQK

SEQ ID NO: 2988996 - protein, 18 aa, Entamoeba invadens
AQTPLSQLGPKDGFIYLI

SEQ ID NO: 2988997 - protein, 20 aa, Entamoeba invadens
AQTVFSIMIGLQQGILRGGL

SEQ ID NO: 2988998 - protein, 19 aa, Entamoeba invadens
AQVCTPFVLFSTASQTEES

SEQ ID NO: 2988999 - protein, 23 aa, Entamoeba invadens
AQVDHVLSLLNPIFKELTIEEIL

SEQ ID NO: 2989000 - protein, 31 aa, Entamoeba invadens
AQVDWWTFGILMYEILYGRTPFFNRNRDTVF

SEQ ID NO: 2989001 - protein, 20 aa, Entamoeba invadens
AQVKFIFVGEINDSLKTAIN

SEQ ID NO: 2989002 - protein, 21 aa, Entamoeba invadens
AQVSSLKVQISAPASVAQEEE

SEQ ID NO: 2989003 - protein, 24 aa, Entamoeba invadens
AQVSSLKVQVSPPASVAQKEKNNM

SEQ ID NO: 2989004 - protein, 29 aa, Entamoeba invadens
AQWGNIFGNYLWFVNAMSTNLEIARIFGE

SEQ ID NO: 2989005 - protein, 27 aa, Entamoeba invadens
AQYGGKYFALDARVIRLPRHGASCPIG

SEQ ID NO: 2989006 - protein, 19 aa, Entamoeba invadens
AQYGYYYNLGYAKAQDYIN

SEQ ID NO: 2989007 - protein, 29 aa, Entamoeba invadens
AQYLTHHNITYLFNLMRKYRVAIREKKAK

SEQ ID NO: 2989008 - protein, 25 aa, Entamoeba invadens
AQYQLYLGFYDGNPASLDPLAPEEM

SEQ ID NO: 2989009 - protein, 18 aa, Entamoeba invadens
ARAFEHCYSLSVITIPDS

SEQ ID NO: 2989010 - protein, 28 aa, Entamoeba invadens
ARALDNFDFLKVHKKLFKLPKIDISNIN

SEQ ID NO: 2989011 - protein, 19 aa, Entamoeba invadens
ARALIRNPKILLLDEATSA

SEQ ID NO: 2989012 - protein, 28 aa, Entamoeba invadens
ARCGKLLTVRDFLRDSMYCKECKLDISL

SEQ ID NO: 2989013 - protein, 22 aa, Entamoeba invadens
ARCLKLQHFSLKFLLEKYVGVE

SEQ ID NO: 2989014 - protein, 19 aa, Entamoeba invadens
ARCLQLRYEYNLYKVLMEN

SEQ ID NO: 2989015 - protein, 18 aa, Entamoeba invadens
ARCNECYPPYTLSSNGKS

SEQ ID NO: 2989016 - protein, 19 aa, Entamoeba invadens
ARDKVLIWNINPGNNVLSD

SEQ ID NO: 2989017 - protein, 26 aa, Entamoeba invadens
ARDRLSQILIYLFSGNVKDASELLDD

SEQ ID NO: 2989018 - protein, 22 aa, Entamoeba invadens
AREFLKKPIEIICGGRSHVSDT

SEQ ID NO: 2989019 - protein, 22 aa, Entamoeba invadens
AREFMMKTRRRKGLTDDADIEK

SEQ ID NO: 2989020 - protein, 25 aa, Entamoeba invadens
AREKLPRVIILSPTRELATQILEEV

SEQ ID NO: 2989021 - protein, 24 aa, Entamoeba invadens
AREKLYKLNLLPDTNYISYSFPVP

SEQ ID NO: 2989022 - protein, 26 aa, Entamoeba invadens
ARFSLSCSPSFFIKYLRAFDKEVRRF

SEQ ID NO: 2989023 - protein, 21 aa, Entamoeba invadens
ARFVVEPILRLSNGLTEFEFE

SEQ ID NO: 2989024 - protein, 23 aa, Entamoeba invadens
ARGFMNNPAMRPMLNMVAQSMGI

SEQ ID NO: 2989025 - protein, 25 aa, Entamoeba invadens
ARGGLRSYPIIDIIKRIKKSINEGV

SEQ ID NO: 2989026 - protein, 29 aa, Entamoeba invadens
ARIAISMMRMRFNLFWKPAQDLLAACIAR

SEQ ID NO: 2989027 - protein, 19 aa, Entamoeba invadens
ARIFAVMKGMCDGGVYVPH

SEQ ID NO: 2989028 - protein, 20 aa, Entamoeba invadens
ARIRELEMYGVEKNELLRQR

SEQ ID NO: 2989029 - protein, 17 aa, Entamoeba invadens
ARKLNVIVADRIFDLVT

SEQ ID NO: 2989030 - protein, 20 aa, Entamoeba invadens
ARKTITMPFLKIEKLSKGNT

SEQ ID NO: 2989031 - protein, 24 aa, Entamoeba invadens
ARKVAPVWYPIYHTSLNFKNFNRI

SEQ ID NO: 2989032 - protein, 31 aa, Entamoeba invadens
ARKVPYGNGCLVCKVGYYKKGADCVLCDVKC

SEQ ID NO: 2989033 - protein, 26 aa, Entamoeba invadens
ARLCTAMFPSILARKLNEVDLPLTKI

SEQ ID NO: 2989034 - protein, 18 aa, Entamoeba invadens
ARLFVLHLKIEEGFTEVT

SEQ ID NO: 2989035 - protein, 23 aa, Entamoeba invadens
ARLLERPKKIAGLLAAARGVTER

SEQ ID NO: 2989036 - protein, 21 aa, Entamoeba invadens
ARLLLNFPPNLQSGAVPLQIL

SEQ ID NO: 2989037 - protein, 26 aa, Entamoeba invadens
ARLPFSFKYYIAYLNKVIAIVGTTSE

SEQ ID NO: 2989038 - protein, 22 aa, Entamoeba invadens
ARMRGRLFGFFNRFFEKESESK

SEQ ID NO: 2989039 - protein, 25 aa, Entamoeba invadens
ARNGNLLCLITILKAFPTVDEASII

SEQ ID NO: 2989040 - protein, 20 aa, Entamoeba invadens
ARNRRFIKPTLLPHSPPGNR

SEQ ID NO: 2989041 - protein, 32 aa, Entamoeba invadens
ARNWHGMMTLTHMALLYFSPSSTIHVDKLKIT

SEQ ID NO: 2989042 - protein, 18 aa, Entamoeba invadens
ARPATLPMTASMNGMTYS

SEQ ID NO: 2989043 - protein, 17 aa, Entamoeba invadens
ARQLWDVRWNNRKGCTI

SEQ ID NO: 2989044 - protein, 29 aa, Entamoeba invadens
ARQMTMMEFDLFRKIKPAELYAWNKKEKE

SEQ ID NO: 2989045 - protein, 23 aa, Entamoeba invadens
ARREIEAFLIENPQLRKKKSFVE

SEQ ID NO: 2989046 - protein, 27 aa, Entamoeba invadens
ARSVLYSVIQLYLRSGFYGRCFDYHIE

SEQ ID NO: 2989047 - protein, 25 aa, Entamoeba invadens
ARTFEPAPPRRLLIRVFGEGNATWA

SEQ ID NO: 2989048 - protein, 22 aa, Entamoeba invadens
ARTFLQQILQTLIVLYKSNIIH

SEQ ID NO: 2989049 - protein, 25 aa, Entamoeba invadens
ARTPLRPPPSPPLTKPPQPPQTQNN

SEQ ID NO: 2989050 - protein, 27 aa, Entamoeba invadens
ARTQKEYHELFWGCIKKYIENNSETDK

SEQ ID NO: 2989051 - protein, 23 aa, Entamoeba invadens
ARVFLARAYCLLGLNKEADKVLQ

SEQ ID NO: 2989052 - protein, 23 aa, Entamoeba invadens
ARVPLNTFGYIQSKWMGEKYCEK

SEQ ID NO: 2989053 - protein, 17 aa, Entamoeba invadens
ARWESWKFCFGLSNSPV

SEQ ID NO: 2989054 - protein, 23 aa, Entamoeba invadens
ARYLVDLAIARKSPDNVTVLVAF

SEQ ID NO: 2989055 - protein, 23 aa, Entamoeba invadens
ARYPRGYHLYKHLLWVVDHSKWL

SEQ ID NO: 2989056 - protein, 25 aa, Entamoeba invadens
ASAIFRVHFPFYDPTTNDRTWGQTK

SEQ ID NO: 2989057 - protein, 17 aa, Entamoeba invadens
ASALCLSLNISTDPLVC

SEQ ID NO: 2989058 - protein, 30 aa, Entamoeba invadens
ASCALLDSFYRLYFSWRPTAQKYPPESFSQ

SEQ ID NO: 2989059 - protein, 20 aa, Entamoeba invadens
ASCLVICTIIAESLKAEKSP

SEQ ID NO: 2989060 - protein, 25 aa, Entamoeba invadens
ASCTPPYKLVSYSCYYNGCTVPNCE

SEQ ID NO: 2989061 - protein, 26 aa, Entamoeba invadens
ASDDGTLYMWMPTASQKPLHRLVGHS

SEQ ID NO: 2989062 - protein, 17 aa, Entamoeba invadens
ASDFFMESLKKTFGLSY

SEQ ID NO: 2989063 - protein, 23 aa, Entamoeba invadens
ASDFSRKCLTCRGGKYPKDGVNC

SEQ ID NO: 2989064 - protein, 23 aa, Entamoeba invadens
ASDFSRKCVTCRGGKYPKDGANC

SEQ ID NO: 2989065 - protein, 23 aa, Entamoeba invadens
ASDGFWNFINYEETVQIIRKVSL

SEQ ID NO: 2989066 - protein, 27 aa, Entamoeba invadens
ASDKKAIKLCIEISFAGLSRNSLNRAK

SEQ ID NO: 2989067 - protein, 23 aa, Entamoeba invadens
ASDKKIILGLKKLVKNVCMYSLN

SEQ ID NO: 2989068 - protein, 25 aa, Entamoeba invadens
ASDLLTLVPFILSQSFDKLPPLIQI

SEQ ID NO: 2989069 - protein, 24 aa, Entamoeba invadens
ASDVFAFAIIILECLTWKNAYNEK

SEQ ID NO: 2989070 - protein, 25 aa, Entamoeba invadens
ASDVFAFAIIILECLTWKNAYNEKQ

SEQ ID NO: 2989071 - protein, 24 aa, Entamoeba invadens
ASDYTRKCIVCQSGYFTNEDADFK

SEQ ID NO: 2989072 - protein, 18 aa, Entamoeba invadens
ASEAYLVGLFEDTNLCAI

SEQ ID NO: 2989073 - protein, 29 aa, Entamoeba invadens
ASECQNHLIIKLPPLLTTNGTSLPYRPHA

SEQ ID NO: 2989074 - protein, 18 aa, Entamoeba invadens
ASEKNYPRRRTMEDAHFI

SEQ ID NO: 2989075 - protein, 32 aa, Entamoeba invadens
ASEKRFLVCRAFPFILEFCYGFPCVIPYVENS

SEQ ID NO: 2989076 - protein, 18 aa, Entamoeba invadens
ASELPFVTPSRKTCLNAT

SEQ ID NO: 2989077 - protein, 27 aa, Entamoeba invadens
ASENYLYRTLMIFLEYAWSHGQTEFKR

SEQ ID NO: 2989078 - protein, 18 aa, Entamoeba invadens
ASESYLVSLFQDSQQIAA

SEQ ID NO: 2989079 - protein, 29 aa, Entamoeba invadens
ASEYIEDILPPFFKALVKYLNQGKYSWHS

SEQ ID NO: 2989080 - protein, 18 aa, Entamoeba invadens
ASFIYQPFCPIQSTLNLS

SEQ ID NO: 2989081 - protein, 17 aa, Entamoeba invadens
ASFLLRCDTLKEYTGNY

SEQ ID NO: 2989082 - protein, 18 aa, Entamoeba invadens
ASFLLRRSLKNRRRIGHN

SEQ ID NO: 2989083 - protein, 19 aa, Entamoeba invadens
ASFSGYVQAIKPTLQVSKS

SEQ ID NO: 2989084 - protein, 31 aa, Entamoeba invadens
ASFVLFKGDIVMRDILGFTVLNRTRKELTTQ

SEQ ID NO: 2989085 - protein, 25 aa, Entamoeba invadens
ASHDREMYFVRFNEYSFQFGHCGSV

SEQ ID NO: 2989086 - protein, 23 aa, Entamoeba invadens
ASHFVNLPNFQFSSGPPAKSHIP

SEQ ID NO: 2989087 - protein, 26 aa, Entamoeba invadens
ASHIEYVWRFITKKLGQSPNRVILYG

SEQ ID NO: 2989088 - protein, 25 aa, Entamoeba invadens
ASHKNVMFMVLTSDNFVFGNTHESS

SEQ ID NO: 2989089 - protein, 25 aa, Entamoeba invadens
ASHYEMIRFDLLTSLKFLNISNRQV

SEQ ID NO: 2989090 - protein, 24 aa, Entamoeba invadens
ASIIKSLLSGFFFNTAQLTKEGVY

SEQ ID NO: 2989091 - protein, 23 aa, Entamoeba invadens
ASIKFPALGFEIPSTAQASSLNT

SEQ ID NO: 2989092 - protein, 23 aa, Entamoeba invadens
ASKAAIALALFGGEPKLLKEKGN

SEQ ID NO: 2989093 - protein, 23 aa, Entamoeba invadens
ASKFSDLLIQNVDMKKSIDGLQS

SEQ ID NO: 2989094 - protein, 22 aa, Entamoeba invadens
ASKHQHIILLPISTPNIDQVVK

SEQ ID NO: 2989095 - protein, 23 aa, Entamoeba invadens
ASKKLDLSVLLNNTKWSCACDLL

SEQ ID NO: 2989096 - protein, 27 aa, Entamoeba invadens
ASKLKSTFTPYVPTPEKKKPKKSVEKS

SEQ ID NO: 2989097 - protein, 53 aa, Entamoeba invadens
ASKNNALQTPLEPPQGLLPPPPGMAPPIVESTSPIPQVACGGLSLAEMIAAKQ

SEQ ID NO: 2989098 - protein, 24 aa, Entamoeba invadens
ASKQTFEQWWKGKEAERKITMKRI

SEQ ID NO: 2989099 - protein, 18 aa, Entamoeba invadens
ASKVLVWIADAPPHGFGC

SEQ ID NO: 2989100 - protein, 17 aa, Entamoeba invadens
ASLFGNFDPTQKPLRKS

SEQ ID NO: 2989101 - protein, 17 aa, Entamoeba invadens
ASLKLIRAILLATNGKA

SEQ ID NO: 2989102 - protein, 17 aa, Entamoeba invadens
ASLNLVPGAVLLVTIQN

SEQ ID NO: 2989103 - protein, 24 aa, Entamoeba invadens
ASLRSPLMFSMPKQAEWGLVGNHD

SEQ ID NO: 2989104 - protein, 18 aa, Entamoeba invadens
ASMELQILRKETTGYPPN

SEQ ID NO: 2989105 - protein, 27 aa, Entamoeba invadens
ASNDKMLMVWDIRKPEVPFKTIQNHTA

SEQ ID NO: 2989106 - protein, 24 aa, Entamoeba invadens
ASNHYLWVVWDRALELCLLQINNH

SEQ ID NO: 2989107 - protein, 24 aa, Entamoeba invadens
ASNKFGGVFFDTITDRSGWISSPS

SEQ ID NO: 2989108 - protein, 25 aa, Entamoeba invadens
ASNKPFYTFLGTFLSPQTHDEKTFE

SEQ ID NO: 2989109 - protein, 18 aa, Entamoeba invadens
ASNPLFIRCKKVELLRCD

SEQ ID NO: 2989110 - protein, 25 aa, Entamoeba invadens
ASNQFNWATLYMRPDTAITAVAEQL

SEQ ID NO: 2989111 - protein, 25 aa, Entamoeba invadens
ASNRIDQFLYLEKLAKGWYPEKEII

SEQ ID NO: 2989112 - protein, 17 aa, Entamoeba invadens
ASPPFPPTSYNVKFTFI

SEQ ID NO: 2989113 - protein, 39 aa, Entamoeba invadens
ASPVVPALLTLPFALVIKVCKFLNKIDIFALSRTCKYFK

SEQ ID NO: 2989114 - protein, 34 aa, Entamoeba invadens
ASQKFTPIRPDCYPLWIYKSGNALFCVQYFCHVS

SEQ ID NO: 2989115 - protein, 25 aa, Entamoeba invadens
ASQMTSKFIVSFYTNSKTALVHFPG

SEQ ID NO: 2989116 - protein, 20 aa, Entamoeba invadens
ASQYLFKNILRFNEKYFDVY

SEQ ID NO: 2989117 - protein, 17 aa, Entamoeba invadens
ASRFYTTLVDILSKHKS

SEQ ID NO: 2989118 - protein, 20 aa, Entamoeba invadens
ASRLHLVYDSSQQFFDSKGF

SEQ ID NO: 2989119 - protein, 27 aa, Entamoeba invadens
ASRNDGFISYWRLFRNGRWKPVKEVKS

SEQ ID NO: 2989120 - protein, 22 aa, Entamoeba invadens
ASRNEYLPILLQSSIQDFLADV

SEQ ID NO: 2989121 - protein, 18 aa, Entamoeba invadens
ASRVIFNRPYIGIDFLDV

SEQ ID NO: 2989122 - protein, 18 aa, Entamoeba invadens
ASSFPSLLIMKCFKSLET

SEQ ID NO: 2989123 - protein, 23 aa, Entamoeba invadens
ASSGTIHIFVISNSNLDKEANDQ

SEQ ID NO: 2989124 - protein, 28 aa, Entamoeba invadens
ASSHISNFVSILYFTLRALRLATSMTFL

SEQ ID NO: 2989125 - protein, 33 aa, Entamoeba invadens
ASSSRKVPIGGFGMPCMLIAEELNKRKSGRQTM

SEQ ID NO: 2989126 - protein, 25 aa, Entamoeba invadens
ASSVCITCENGCKKCFIKDNLTKEQ

SEQ ID NO: 2989127 - protein, 31 aa, Entamoeba invadens
ASTCMETLLFLRFFLPPLASTPSVLKNIQTL

SEQ ID NO: 2989128 - protein, 19 aa, Entamoeba invadens
ASTLFSWLVDLRYLNLCGC

SEQ ID NO: 2989129 - protein, 24 aa, Entamoeba invadens
ASTRREYHIGEFEAKLREYKVRVS

SEQ ID NO: 2989130 - protein, 25 aa, Entamoeba invadens
ASTTKQYIFEFKNSLEFQKKKAAIE

SEQ ID NO: 2989131 - protein, 25 aa, Entamoeba invadens
ASTTKTDFLLVLGTSLQVAPCNIIP

SEQ ID NO: 2989132 - protein, 24 aa, Entamoeba invadens
ASVKQVRLLLQEPTIVIGTPGRIF

SEQ ID NO: 2989133 - protein, 28 aa, Entamoeba invadens
ASVLKQIYMMIPFWKENYTLLRSIFSLF

SEQ ID NO: 2989134 - protein, 20 aa, Entamoeba invadens
ASVTLAGLLNALKLVHKRLE

SEQ ID NO: 2989135 - protein, 20 aa, Entamoeba invadens
ASVTLPSFSQRELFPSLPDE

SEQ ID NO: 2989136 - protein, 20 aa, Entamoeba invadens
ASVYEDLLAVPVIRGKKSKG

SEQ ID NO: 2989137 - protein, 17 aa, Entamoeba invadens
ASYDPAVFSVPQKPMKK

SEQ ID NO: 2989138 - protein, 24 aa, Entamoeba invadens
ASYNHLTTFPPLSSLQNLKVLLLA

SEQ ID NO: 2989139 - protein, 36 aa, Entamoeba invadens
ASYVARCFFLKVGKTFIKRYFTKFFTNFFNEKLDLE

SEQ ID NO: 2989140 - protein, 37 aa, Entamoeba invadens
ASYVDFKNYLLPLFPLKYLKTGSLLRGYIADVANLGT

SEQ ID NO: 2989141 - protein, 28 aa, Entamoeba invadens
ATALFLTLPPDQFNPYILPSFDLASKDK

SEQ ID NO: 2989142 - protein, 18 aa, Entamoeba invadens
ATALPKQYSYIPQKCFPE

SEQ ID NO: 2989143 - protein, 19 aa, Entamoeba invadens
ATCFLICFSLINLDHFHSV

SEQ ID NO: 2989144 - protein, 17 aa, Entamoeba invadens
ATCICLVLCSCPEQDVL

SEQ ID NO: 2989145 - protein, 18 aa, Entamoeba invadens
ATCPIDNGYYLRGMDCKN

SEQ ID NO: 2989146 - protein, 31 aa, Entamoeba invadens
ATCVLKGILSWLIHNVWITKKLNTVNLLTTR

SEQ ID NO: 2989147 - protein, 23 aa, Entamoeba invadens
ATDDWLVAALKQFSALSSQLVAA

SEQ ID NO: 2989148 - protein, 30 aa, Entamoeba invadens
ATDIYSFGITLWEIFYRAQPFREYLASFKD

SEQ ID NO: 2989149 - protein, 28 aa, Entamoeba invadens
ATDQWEKFYMMLHGAALCLFLSEEEAAE

SEQ ID NO: 2989150 - protein, 24 aa, Entamoeba invadens
ATDSVLKHILLIQKRIRGFCVRKL

SEQ ID NO: 2989151 - protein, 17 aa, Entamoeba invadens
ATEAAITILRIDDMIKL

SEQ ID NO: 2989152 - protein, 31 aa, Entamoeba invadens
ATEDIPTIFHMAWLAFLFYKSLKEGCAKEDE

SEQ ID NO: 2989153 - protein, 26 aa, Entamoeba invadens
ATEISMYLFRDVSMKGISYLTNPGAK

SEQ ID NO: 2989154 - protein, 25 aa, Entamoeba invadens
ATEKAKFFMYSFKNSMNALTLISSF

SEQ ID NO: 2989155 - protein, 27 aa, Entamoeba invadens
ATEKDGQYIYWIGNAIYLIGKIGEKKS

SEQ ID NO: 2989156 - protein, 21 aa, Entamoeba invadens
ATELPMLFEKMCLNNLVMKNI

SEQ ID NO: 2989157 - protein, 24 aa, Entamoeba invadens
ATENDLKKAYRKLALKWHPDRNPN

SEQ ID NO: 2989158 - protein, 26 aa, Entamoeba invadens
ATEPTFTKFWFDIFGKNTSGRTDLVK

SEQ ID NO: 2989159 - protein, 27 aa, Entamoeba invadens
ATESTKGYGFLTFKTLSDAENIVNRLN

SEQ ID NO: 2989160 - protein, 23 aa, Entamoeba invadens
ATETLIVLPLGSHNFFEICHAFA

SEQ ID NO: 2989161 - protein, 18 aa, Entamoeba invadens
ATFERGILSFQLLDKFIV

SEQ ID NO: 2989162 - protein, 17 aa, Entamoeba invadens
ATFNTLFNRMKNHKLQF

SEQ ID NO: 2989163 - protein, 31 aa, Entamoeba invadens
ATGHFPEMTPGKDWLFFPNSGAYTISMASNF

SEQ ID NO: 2989164 - protein, 21 aa, Entamoeba invadens
ATGIPFVKWWGMQDDWNLMVM

SEQ ID NO: 2989165 - protein, 24 aa, Entamoeba invadens
ATGKSVFLWLCDLEDQKLGGPGTQ

SEQ ID NO: 2989166 - protein, 28 aa, Entamoeba invadens
ATGPIKVMFIKFLANCFVTTPPEIFMHV

SEQ ID NO: 2989167 - protein, 22 aa, Entamoeba invadens
ATGQIPWRSLDITYKKNQLFLD

SEQ ID NO: 2989168 - protein, 18 aa, Entamoeba invadens
ATHVLWKPSVTRPREMYN

SEQ ID NO: 2989169 - protein, 17 aa, Entamoeba invadens
ATIFFYSVNKKESFQLL

SEQ ID NO: 2989170 - protein, 19 aa, Entamoeba invadens
ATIIYFKYSNEVMKTTWVI

SEQ ID NO: 2989171 - protein, 33 aa, Entamoeba invadens
ATIKKTIPINPTKIKLIGKQMWVLQHDGTVNVY

SEQ ID NO: 2989172 - protein, 21 aa, Entamoeba invadens
ATILPQLFGVLLQTLKVYECE

SEQ ID NO: 2989173 - protein, 24 aa, Entamoeba invadens
ATISSWDLTLKHLVDWKVFDRVRK

SEQ ID NO: 2989174 - protein, 23 aa, Entamoeba invadens
ATISYILKASFLNSSLRTFVQGS

SEQ ID NO: 2989175 - protein, 28 aa, Entamoeba invadens
ATKFLLLMIDVDITATLTFVECLIEATL

SEQ ID NO: 2989176 - protein, 24 aa, Entamoeba invadens
ATKKFYKVIIWYSVNYLTYFQNTD

SEQ ID NO: 2989177 - protein, 21 aa, Entamoeba invadens
ATKLQNPFYSKRRPFTIKSEV

SEQ ID NO: 2989178 - protein, 26 aa, Entamoeba invadens
ATKLRSYLKVIPPLYNVLTMPQTYTP

SEQ ID NO: 2989179 - protein, 27 aa, Entamoeba invadens
ATKNAFPMCPFAQLECAISAVFRSWMG

SEQ ID NO: 2989180 - protein, 23 aa, Entamoeba invadens
ATKNFLFEPIAELKELVYSKVNA

SEQ ID NO: 2989181 - protein, 27 aa, Entamoeba invadens
ATLADGYLYILIREFGYSVKLKQTKHA

SEQ ID NO: 2989182 - protein, 20 aa, Entamoeba invadens
ATLAVFVFEPVPMAAMEYLS

SEQ ID NO: 2989183 - protein, 17 aa, Entamoeba invadens
ATLFAYGQTGSGKTFTV

SEQ ID NO: 2989184 - protein, 18 aa, Entamoeba invadens
ATLLLTNGYFSAEIIALM

SEQ ID NO: 2989185 - protein, 20 aa, Entamoeba invadens
ATLSKAVFKIKFACAVIDES

SEQ ID NO: 2989186 - protein, 30 aa, Entamoeba invadens
ATLVEVVKMICWPWKYLIQSKMFSVGNIVA

SEQ ID NO: 2989187 - protein, 34 aa, Entamoeba invadens
ATNENTLFWLLKLVMDFLQPFYFCGNDVIMKALK

SEQ ID NO: 2989188 - protein, 17 aa, Entamoeba invadens
ATNFSRRCIICNTGFYP

SEQ ID NO: 2989189 - protein, 30 aa, Entamoeba invadens
ATNGNIYVLNFINKLLLDITQRNGFKNVKI

SEQ ID NO: 2989190 - protein, 33 aa, Entamoeba invadens
ATNKGYGSLWCGLLKFMFSFNECLDIVGLKGKK

SEQ ID NO: 2989191 - protein, 34 aa, Entamoeba invadens
ATNKGYGSLWCGLLKFMFSFNECLDIVGLKGKKV

SEQ ID NO: 2989192 - protein, 24 aa, Entamoeba invadens
ATNSTLIPILLGKGDVVFSDELNH

SEQ ID NO: 2989193 - protein, 17 aa, Entamoeba invadens
ATPGRLLHFMERKIVCL

SEQ ID NO: 2989194 - protein, 29 aa, Entamoeba invadens
ATPQQAQQALYKKLLYWEPKDANGSVLDE

SEQ ID NO: 2989195 - protein, 18 aa, Entamoeba invadens
ATQKTLPKTFQRISQIES

SEQ ID NO: 2989196 - protein, 18 aa, Entamoeba invadens
ATQNHILFVIQDVSLDSN

SEQ ID NO: 2989197 - protein, 31 aa, Entamoeba invadens
ATQSILVALLNIKFKIVLKSPLKKAKVTQQL

SEQ ID NO: 2989198 - protein, 24 aa, Entamoeba invadens
ATRSHYFTLPHIPSTQPVIHSLHL

SEQ ID NO: 2989199 - protein, 25 aa, Entamoeba invadens
ATRSKVFELFNPKKSFTLKIIDSPG

SEQ ID NO: 2989200 - protein, 26 aa, Entamoeba invadens
ATSDNFVLFGRPNPWDGPVFITRKEE

SEQ ID NO: 2989201 - protein, 22 aa, Entamoeba invadens
ATSHLEILLASINKITSLVTDQ

SEQ ID NO: 2989202 - protein, 19 aa, Entamoeba invadens
ATSIWFVSNICNSNLFDVA

SEQ ID NO: 2989203 - protein, 26 aa, Entamoeba invadens
ATSKKHRILCVGGTRGDLLFWNVDYQ

SEQ ID NO: 2989204 - protein, 17 aa, Entamoeba invadens
ATSLIFLFSAEPYSYFH

SEQ ID NO: 2989205 - protein, 22 aa, Entamoeba invadens
ATSLPCISSFYQMFNDSSLLEQ

SEQ ID NO: 2989206 - protein, 18 aa, Entamoeba invadens
ATTFLPIDGNNMKIVIWD

SEQ ID NO: 2989207 - protein, 31 aa, Entamoeba invadens
ATTKDEFKLYLPIIVPVLLNELSRLKYSNKD

SEQ ID NO: 2989208 - protein, 18 aa, Entamoeba invadens
ATTLPKFSNKRVMELGCG

SEQ ID NO: 2989209 - protein, 24 aa, Entamoeba invadens
ATTQNILLQPELSLRFVHIPTDVN

SEQ ID NO: 2989210 - protein, 23 aa, Entamoeba invadens
ATVALNWSLCVGVSMCGGAHAVG

SEQ ID NO: 2989211 - protein, 22 aa, Entamoeba invadens
ATVELFCFKINRNLVNEMKYAM

SEQ ID NO: 2989212 - protein, 25 aa, Entamoeba invadens
ATVGYLKILQQCNPDYFTDAFCDLW

SEQ ID NO: 2989213 - protein, 38 aa, Entamoeba invadens
ATVKPLECIIFENVPLFKALLWEFKIKSENLVFPDQVN

SEQ ID NO: 2989214 - protein, 26 aa, Entamoeba invadens
ATVLSRFDMIFMIRDVPNKENDSRIV

SEQ ID NO: 2989215 - protein, 29 aa, Entamoeba invadens
ATVVFQRKLKFAAEGVAWIGLNKYIAISE

SEQ ID NO: 2989216 - protein, 19 aa, Entamoeba invadens
ATVYKKIKALPNEGLCQKC

SEQ ID NO: 2989217 - protein, 17 aa, Entamoeba invadens
ATYRLAVLILTSMKQID

SEQ ID NO: 2989218 - protein, 20 aa, Entamoeba invadens
ATYTLVVYLMNNVISKCPIQ

SEQ ID NO: 2989219 - protein, 33 aa, Entamoeba invadens
AVAANPRLQFQWWFPLVLTLTGNDYRELQAWFK

SEQ ID NO: 2989220 - protein, 31 aa, Entamoeba invadens
AVAANTFHFLLLSMPPKNLKVLAFYMNFFYN

SEQ ID NO: 2989221 - protein, 17 aa, Entamoeba invadens
AVALLSSIDYKVVDEVS

SEQ ID NO: 2989222 - protein, 23 aa, Entamoeba invadens
AVCEAPVIPFLGSTLGDLVFTKE

SEQ ID NO: 2989223 - protein, 25 aa, Entamoeba invadens
AVCQDLITRILFPKNTTQFDCKFEC

SEQ ID NO: 2989224 - protein, 21 aa, Entamoeba invadens
AVCYKENLIFLIITDTCTFGV

SEQ ID NO: 2989225 - protein, 21 aa, Entamoeba invadens
AVDILLGVVENYIAAGAFSQA

SEQ ID NO: 2989226 - protein, 17 aa, Entamoeba invadens
AVDKFFKKNGFIGMLRG

SEQ ID NO: 2989227 - protein, 33 aa, Entamoeba invadens
AVDLKGFFVPYVPKCFQIVIPLIGYKASFKVRN

SEQ ID NO: 2989228 - protein, 18 aa, Entamoeba invadens
AVDLLQKMFVYNPAKRIT

SEQ ID NO: 2989229 - protein, 22 aa, Entamoeba invadens
AVEFEIFVTPLCTCSISETIAI

SEQ ID NO: 2989230 - protein, 19 aa, Entamoeba invadens
AVEFWNKNFLKNGRYVFSV

SEQ ID NO: 2989231 - protein, 31 aa, Entamoeba invadens
AVEKSGWKIPLPLYRFIPFLEDMGYYQTPQV

SEQ ID NO: 2989232 - protein, 17 aa, Entamoeba invadens
AVENLIMRQSKKAAQCV

SEQ ID NO: 2989233 - protein, 29 aa, Entamoeba invadens
AVESFARALRQLPMIIADNAGYDSADLVA

SEQ ID NO: 2989234 - protein, 23 aa, Entamoeba invadens
AVESLTPLYTILRIIYEEAKSKL

SEQ ID NO: 2989235 - protein, 17 aa, Entamoeba invadens
AVEVLNSYFLILNIEIV

SEQ ID NO: 2989236 - protein, 26 aa, Entamoeba invadens
AVFGALGSFPIFRLKYSWEGISSEDK

SEQ ID NO: 2989237 - protein, 21 aa, Entamoeba invadens
AVFGRQIGMLNMLLGMGISPN

SEQ ID NO: 2989238 - protein, 17 aa, Entamoeba invadens
AVFIACSLANHSCCENV

SEQ ID NO: 2989239 - protein, 27 aa, Entamoeba invadens
AVFKKNSKWSLIKPVPQLGDDLTTDAE

SEQ ID NO: 2989240 - protein, 18 aa, Entamoeba invadens
AVFTKRLESYKRKTKRME

SEQ ID NO: 2989241 - protein, 24 aa, Entamoeba invadens
AVFTNGVFLLIPPNVEARSLHGIF

SEQ ID NO: 2989242 - protein, 25 aa, Entamoeba invadens
AVFVPGAPLFLLGIEYKTTPLKKQA

SEQ ID NO: 2989243 - protein, 26 aa, Entamoeba invadens
AVGATLPYLGMYLTDLLFTEDMSSSA

SEQ ID NO: 2989244 - protein, 24 aa, Entamoeba invadens
AVGEEQVMVLGEKIGELQMEKAGY

SEQ ID NO: 2989245 - protein, 27 aa, Entamoeba invadens
AVGKSCLLLQFQDKRFQPIHDLTIGVE

SEQ ID NO: 2989246 - protein, 27 aa, Entamoeba invadens
AVGKTCLLTRYRTNTFPTDYVPTVFDN

SEQ ID NO: 2989247 - protein, 24 aa, Entamoeba invadens
AVGLKGFLAVIKFSYEEIGGTLVS

SEQ ID NO: 2989248 - protein, 22 aa, Entamoeba invadens
AVGLPVYADVYRLAKELGGVTI

SEQ ID NO: 2989249 - protein, 17 aa, Entamoeba invadens
AVGMFLTTITTPEKFFL

SEQ ID NO: 2989250 - protein, 20 aa, Entamoeba invadens
AVHFSFLQFALECSEYKCIG

SEQ ID NO: 2989251 - protein, 19 aa, Entamoeba invadens
AVHLTPLQPIGPSGSAYSL

SEQ ID NO: 2989252 - protein, 24 aa, Entamoeba invadens
AVIETIKLFLFIAEKFIKDEKYTQ

SEQ ID NO: 2989253 - protein, 19 aa, Entamoeba invadens
AVILTICHHPNIVSILGFG

SEQ ID NO: 2989254 - protein, 22 aa, Entamoeba invadens
AVINTIICIFIRQLDGSATFRK

SEQ ID NO: 2989255 - protein, 20 aa, Entamoeba invadens
AVINVVFKDTKESGSLILKN

SEQ ID NO: 2989256 - protein, 20 aa, Entamoeba invadens
AVIPTEKYFAGPRPTFGRCV

SEQ ID NO: 2989257 - protein, 18 aa, Entamoeba invadens
AVIQIAIVFIRQILQKYY

SEQ ID NO: 2989258 - protein, 22 aa, Entamoeba invadens
AVISLLVHFSYDSTCSITGYSF

SEQ ID NO: 2989259 - protein, 37 aa, Entamoeba invadens
AVITAIYKSGLFFRFHNSNLRAFCHCSQIETGTFFTF

SEQ ID NO: 2989260 - protein, 19 aa, Entamoeba invadens
AVKAKKQAKQYARKVEEAE

SEQ ID NO: 2989261 - protein, 21 aa, Entamoeba invadens
AVKAKKQAKQYTRKVEEAERK

SEQ ID NO: 2989262 - protein, 24 aa, Entamoeba invadens
AVKEKFFTLFKNIPKVHILQNAFE

SEQ ID NO: 2989263 - protein, 33 aa, Entamoeba invadens
AVKETRGYLIDKQFPFLFTKKDPQFGVFCKKNT

SEQ ID NO: 2989264 - protein, 29 aa, Entamoeba invadens
AVKFLTYTYYFRRLLKNPNYYGYDGKIQI

SEQ ID NO: 2989265 - protein, 23 aa, Entamoeba invadens
AVKFYSNLLNYIDTPVLSLHGQL

SEQ ID NO: 2989266 - protein, 33 aa, Entamoeba invadens
AVKIAFDRNCFLLLRVMWMFVKFSFTKPDNVDD

SEQ ID NO: 2989267 - protein, 19 aa, Entamoeba invadens
AVKIIGLGYFRVPIFRECL

SEQ ID NO: 2989268 - protein, 28 aa, Entamoeba invadens
AVKKSSWRFPIPLFRSIQYLIENDAQHM

SEQ ID NO: 2989269 - protein, 19 aa, Entamoeba invadens
AVKLGPQYFLFHASVCAAL

SEQ ID NO: 2989270 - protein, 24 aa, Entamoeba invadens
AVKNRYFGHIKRLGISELELVEEA

SEQ ID NO: 2989271 - protein, 28 aa, Entamoeba invadens
AVKTWKKRWFVLKENRLWYFASKTATSA

SEQ ID NO: 2989272 - protein, 18 aa, Entamoeba invadens
AVLCLMIGGSRKGLPDGT

SEQ ID NO: 2989273 - protein, 25 aa, Entamoeba invadens
AVLHVRIIERIIFVFNYTDICVFEL

SEQ ID NO: 2989274 - protein, 18 aa, Entamoeba invadens
AVLIVSNGTLHVRKSGEA

SEQ ID NO: 2989275 - protein, 27 aa, Entamoeba invadens
AVLKKEFYRIIVWFNVDFETVDRNKSR

SEQ ID NO: 2989276 - protein, 21 aa, Entamoeba invadens
AVLKLFPHSLHITQPLDVSVF

SEQ ID NO: 2989277 - protein, 27 aa, Entamoeba invadens
AVLKRKFFCVIVWFNVDFETVDRNKSR

SEQ ID NO: 2989278 - protein, 20 aa, Entamoeba invadens
AVLLAIINTFTPCTLLSPAK

SEQ ID NO: 2989279 - protein, 28 aa, Entamoeba invadens
AVLSPTKLIIYIPDRDVRMSVLLANCRL

SEQ ID NO: 2989280 - protein, 26 aa, Entamoeba invadens
AVLYANAFMHYGTTNIMFLKDNNEWI

SEQ ID NO: 2989281 - protein, 19 aa, Entamoeba invadens
AVMAYRLAHILYTTGDREY

SEQ ID NO: 2989282 - protein, 18 aa, Entamoeba invadens
AVNCGFIMMSWIMMEEMK

SEQ ID NO: 2989283 - protein, 20 aa, Entamoeba invadens
AVNHFASMAPMLDVLGDEKY

SEQ ID NO: 2989284 - protein, 27 aa, Entamoeba invadens
AVNIEKYIKMLLLNKVICENCVVTINT

SEQ ID NO: 2989285 - protein, 28 aa, Entamoeba invadens
AVNKKRLDLVLLLLKYGANINIKNVSGN

SEQ ID NO: 2989286 - protein, 18 aa, Entamoeba invadens
AVNPNDPLYGFAQSYLRL

SEQ ID NO: 2989287 - protein, 22 aa, Entamoeba invadens
AVNRPLELFPVLSCLLDTIHSV

SEQ ID NO: 2989288 - protein, 22 aa, Entamoeba invadens
AVNTWTGLRYAIGTSIESIKLY

SEQ ID NO: 2989289 - protein, 20 aa, Entamoeba invadens
AVNYALLDVGFYTTTLTFVS

SEQ ID NO: 2989290 - protein, 26 aa, Entamoeba invadens
AVPALPDNIIDLPLAKKLASMNFLCS

SEQ ID NO: 2989291 - protein, 19 aa, Entamoeba invadens
AVPFDFALRMSQKGIFFTN

SEQ ID NO: 2989292 - protein, 18 aa, Entamoeba invadens
AVPFLLKCCNDCANALLY

SEQ ID NO: 2989293 - protein, 19 aa, Entamoeba invadens
AVPPLNEDKLVKLPKGLIT

SEQ ID NO: 2989294 - protein, 18 aa, Entamoeba invadens
AVPRRNPPPPPRPQFAPV

SEQ ID NO: 2989295 - protein, 25 aa, Entamoeba invadens
AVPSAFVPVQCLPSFFSVENNVSNT

SEQ ID NO: 2989296 - protein, 25 aa, Entamoeba invadens
AVPYPINLLMNNLGLNWKFAVNTEE

SEQ ID NO: 2989297 - protein, 21 aa, Entamoeba invadens
AVQHCLLYPGLPCFGYITEKR

SEQ ID NO: 2989298 - protein, 20 aa, Entamoeba invadens
AVQLIELFDRINKHSGLNIY

SEQ ID NO: 2989299 - protein, 28 aa, Entamoeba invadens
AVQNSYFNKVLFFTPRFKNIQIYGEEEN

SEQ ID NO: 2989300 - protein, 23 aa, Entamoeba invadens
AVQNVIWPSIASVPNFCYYNCRN

SEQ ID NO: 2989301 - protein, 23 aa, Entamoeba invadens
AVQQAVFICLLSQSFEVTIERPP

SEQ ID NO: 2989302 - protein, 30 aa, Entamoeba invadens
AVQQITTLPQIPLLMKISCSSLSNLKKWGD

SEQ ID NO: 2989303 - protein, 26 aa, Entamoeba invadens
AVQSGRIKIVEWLFKQKKELLEEKND

SEQ ID NO: 2989304 - protein, 34 aa, Entamoeba invadens
AVRAAYELLPLEKKRILFLKRWLVQLQGEDDGTL

SEQ ID NO: 2989305 - protein, 20 aa, Entamoeba invadens
AVRICFFKFISEMLGNYRDY

SEQ ID NO: 2989306 - protein, 24 aa, Entamoeba invadens
AVRNKSIRMLLVTRLLEKGANVNA

SEQ ID NO: 2989307 - protein, 20 aa, Entamoeba invadens
AVRVLLQYNAKTNLKFYGKT

SEQ ID NO: 2989308 - protein, 19 aa, Entamoeba invadens
AVSFLKLTNYLTLKHVIFH

SEQ ID NO: 2989309 - protein, 23 aa, Entamoeba invadens
AVSKKFLNAPLRYAKPSHFDKVK

SEQ ID NO: 2989310 - protein, 25 aa, Entamoeba invadens
AVSQFLLSNYAFFDEVIEFSRNVNA

SEQ ID NO: 2989311 - protein, 25 aa, Entamoeba invadens
AVSQFLLSNYAFFDEVTEFSRNVNA

SEQ ID NO: 2989312 - protein, 18 aa, Entamoeba invadens
AVTFGRQIPKCEIDIFDK

SEQ ID NO: 2989313 - protein, 22 aa, Entamoeba invadens
AVTNAIIRVNKIGHFIIETEDK

SEQ ID NO: 2989314 - protein, 26 aa, Entamoeba invadens
AVTSLKVNPWFALTQDIEKFYDLFHP

SEQ ID NO: 2989315 - protein, 21 aa, Entamoeba invadens
AVTTNNLLIRNCRLGIIVLKK

SEQ ID NO: 2989316 - protein, 21 aa, Entamoeba invadens
AVTVALYRKMSSYLSSRSTAG

SEQ ID NO: 2989317 - protein, 26 aa, Entamoeba invadens
AVVKGVSFLILLFKQARLSVMRYNTE

SEQ ID NO: 2989318 - protein, 32 aa, Entamoeba invadens
AVVKPFRLNAKNLLLTWPQTPLPKENAMKQLR

SEQ ID NO: 2989319 - protein, 20 aa, Entamoeba invadens
AVVLELFHQIKGKPNFVVYQ

SEQ ID NO: 2989320 - protein, 27 aa, Entamoeba invadens
AVVLFPCQRVLLVIYSKRIVKPGIPLR

SEQ ID NO: 2989321 - protein, 25 aa, Entamoeba invadens
AVVQLVFFVFAYFEGQKSVKEIPEV

SEQ ID NO: 2989322 - protein, 39 aa, Entamoeba invadens
AVVSRWLVSFLSTDLPLYTFVELLQLLLVRGASVLVSNS

SEQ ID NO: 2989323 - protein, 18 aa, Entamoeba invadens
AVVWLALQCNKPILQLTS

SEQ ID NO: 2989324 - protein, 22 aa, Entamoeba invadens
AVWNHPQLQARERWREVATPAG

SEQ ID NO: 2989325 - protein, 31 aa, Entamoeba invadens
AVYNDIVIPYTLFSELPYPVTNPITIRFVKE

SEQ ID NO: 2989326 - protein, 26 aa, Entamoeba invadens
AWEDENTIYFLPFTSLKNTLSDVSYD

SEQ ID NO: 2989327 - protein, 20 aa, Entamoeba invadens
AWGYGIRYQYGMFKQKIVDG

SEQ ID NO: 2989328 - protein, 24 aa, Entamoeba invadens
AWVENMKMYYFVNLIASDVPDDYC

SEQ ID NO: 2989329 - protein, 18 aa, Entamoeba invadens
AYCSSLCEINLPPTVEKL

SEQ ID NO: 2989330 - protein, 26 aa, Entamoeba invadens
AYDQYMKMSNWKLAVFSAETASELYV

SEQ ID NO: 2989331 - protein, 21 aa, Entamoeba invadens
AYFLMNSPNKFIVKRVIIFYY

SEQ ID NO: 2989332 - protein, 18 aa, Entamoeba invadens
AYGFDMMHLVYTTALNKY

SEQ ID NO: 2989333 - protein, 31 aa, Entamoeba invadens
AYGLSIDIRHLLLLSDLMTFKGVILGITRYG

SEQ ID NO: 2989334 - protein, 19 aa, Entamoeba invadens
AYGSLFGVIKREEKIELKV

SEQ ID NO: 2989335 - protein, 21 aa, Entamoeba invadens
AYHALSLLRVLLSDAPHLFQN

SEQ ID NO: 2989336 - protein, 28 aa, Entamoeba invadens
AYHRVVYLFHCPFCLKFVVLRNQIGMGT

SEQ ID NO: 2989337 - protein, 23 aa, Entamoeba invadens
AYKPFGDLIAAYSLGVRLTLVDS

SEQ ID NO: 2989338 - protein, 27 aa, Entamoeba invadens
AYKYRSDSKLLLLHYPQRSLCQCTLME

SEQ ID NO: 2989339 - protein, 25 aa, Entamoeba invadens
AYMAHIKGYFKHMIEHLTATNPERV

SEQ ID NO: 2989340 - protein, 18 aa, Entamoeba invadens
AYNFLCDLPHNAVCYFHN

SEQ ID NO: 2989341 - protein, 24 aa, Entamoeba invadens
AYNKYQILNLTYPIKNSVITNAKY

SEQ ID NO: 2989342 - protein, 31 aa, Entamoeba invadens
AYPELRPVLIVVPNILKLQWRMQLCDVLDVS

SEQ ID NO: 2989343 - protein, 22 aa, Entamoeba invadens
AYPTHNFHFFIAAAIVMVQHEN

SEQ ID NO: 2989344 - protein, 19 aa, Entamoeba invadens
AYRGVNGVIFVFDVSNKKS

SEQ ID NO: 2989345 - protein, 34 aa, Entamoeba invadens
AYRMFRKDNKVFGWLFIRVLSLSDHFPYNYYHVI

SEQ ID NO: 2989346 - protein, 22 aa, Entamoeba invadens
AYRVIYQTKWSSSGIFRLLPSL

SEQ ID NO: 2989347 - protein, 26 aa, Entamoeba invadens
AYSPELIVHPFFKQDYNLEDCIKWAD

SEQ ID NO: 2989348 - protein, 19 aa, Entamoeba invadens
AYSVDIFRFPWTIAEFVTA

SEQ ID NO: 2989349 - protein, 24 aa, Entamoeba invadens
AYSVKPFQKFGWWTEPDMVYNTGN

SEQ ID NO: 2989350 - protein, 25 aa, Entamoeba invadens
AYVAYALSDVSFIYPITPSSTMAEN

SEQ ID NO: 2989351 - protein, 36 aa, Entamoeba invadens
AYVGLYFHQISELPYFVILLPYFGYLNVAKADDLEA

SEQ ID NO: 2989352 - protein, 17 aa, Entamoeba invadens
AYVHTLVTKRRSVLEPA

SEQ ID NO: 2989353 - protein, 43 aa, Entamoeba invadens
AYVICHTFICSCLYRGIYPFTVVQFDYFFLMLDDIVCERMPNY

SEQ ID NO: 2989354 - protein, 18 aa, Entamoeba invadens
AYVPNSYFTRLKTVFAFA

SEQ ID NO: 2989355 - protein, 26 aa, Entamoeba invadens
AYVSRLYFNRLLFAERLTIVKNNLLE

SEQ ID NO: 2989356 - protein, 20 aa, Entamoeba invadens
AYVVFRNHATPLKIHQTRTF

SEQ ID NO: 2989357 - protein, 18 aa, Entamoeba invadens
AYYQISIPQFTSFETSLK

SEQ ID NO: 2989358 - protein, 25 aa, Entamoeba invadens
CAAGELFFLFDSKVLSILIGQNVLY

SEQ ID NO: 2989359 - protein, 36 aa, Entamoeba invadens
CAAMFLPFVVQFLEKFDDFVSWKYVAAKTKVAEKKV

SEQ ID NO: 2989360 - protein, 25 aa, Entamoeba invadens
CAAMFLPFVVQFLEKFDNFADWKFV

SEQ ID NO: 2989361 - protein, 18 aa, Entamoeba invadens
CADLLINTFSLPESSHLQ

SEQ ID NO: 2989362 - protein, 25 aa, Entamoeba invadens
CAEFPKLDVLLPTSLLSLTVGTPQF

SEQ ID NO: 2989363 - protein, 22 aa, Entamoeba invadens
CAELVLGIPLFPGSSEFNQLFK

SEQ ID NO: 2989364 - protein, 17 aa, Entamoeba invadens
CAFHSYFIMLKENKKNE

SEQ ID NO: 2989365 - protein, 38 aa, Entamoeba invadens
CAGAILLSEVCETKFLPEFFKFLREAFELVKEAKTGEL

SEQ ID NO: 2989366 - protein, 18 aa, Entamoeba invadens
CAGGNFYRALRKTPHKFL

SEQ ID NO: 2989367 - protein, 22 aa, Entamoeba invadens
CAGVENMFPYMLSKANEGVLPF

SEQ ID NO: 2989368 - protein, 25 aa, Entamoeba invadens
CAIDMWSFGCIIAEMMIGIPIFPGE

SEQ ID NO: 2989369 - protein, 18 aa, Entamoeba invadens
CAIRPDDIFARILCKNLI

SEQ ID NO: 2989370 - protein, 17 aa, Entamoeba invadens
CAKFEVLYDSERPIPIT

SEQ ID NO: 2989371 - protein, 25 aa, Entamoeba invadens
CAKSKIFIGLFQSFRVLLSGDIEVA

SEQ ID NO: 2989372 - protein, 24 aa, Entamoeba invadens
CAKSLSLIVDLLKNAKRTDDKLLS

SEQ ID NO: 2989373 - protein, 24 aa, Entamoeba invadens
CALSYAIFVSLIAKGTNVLDVVRC

SEQ ID NO: 2989374 - protein, 25 aa, Entamoeba invadens
CANRSMFCYSCKMLTPIELEKHTKK

SEQ ID NO: 2989375 - protein, 27 aa, Entamoeba invadens
CAQFGCTICKSGFYLNNGRCFPCSEGC

SEQ ID NO: 2989376 - protein, 20 aa, Entamoeba invadens
CAQKMRSVCKEEFIVINTEW

SEQ ID NO: 2989377 - protein, 26 aa, Entamoeba invadens
CASEIRLFLTINYTIKTNTTIPLVTK

SEQ ID NO: 2989378 - protein, 17 aa, Entamoeba invadens
CASLKIVLPNTPILLKD

SEQ ID NO: 2989379 - protein, 32 aa, Entamoeba invadens
CASLTLIDIPETLKRFGNMVFYGCCCLKTIHL

SEQ ID NO: 2989380 - protein, 21 aa, Entamoeba invadens
CASNVLFMLELVKKKVVYSSI

SEQ ID NO: 2989381 - protein, 23 aa, Entamoeba invadens
CASPPQLPPPRKSTLVKPQQTSQ

SEQ ID NO: 2989382 - protein, 20 aa, Entamoeba invadens
CAVHSMVFSPNSLSLISVGG

SEQ ID NO: 2989383 - protein, 20 aa, Entamoeba invadens
CAVLALDEPTINLDADHCSN

SEQ ID NO: 2989384 - protein, 26 aa, Entamoeba invadens
CAVVARTLSLLWHKPIVGVNHCVAHI

SEQ ID NO: 2989385 - protein, 26 aa, Entamoeba invadens
CAYDTVCMLPIVDYVRRAALQMRTLQ

SEQ ID NO: 2989386 - protein, 31 aa, Entamoeba invadens
CCCGTGFRIPAFPKLLPCMHLICRDCLFSIV

SEQ ID NO: 2989387 - protein, 20 aa, Entamoeba invadens
CCDCTFPLFCFPVCYQCKKV

SEQ ID NO: 2989388 - protein, 17 aa, Entamoeba invadens
CCDINGLIQYLHEKICI

SEQ ID NO: 2989389 - protein, 25 aa, Entamoeba invadens
CCELLFLQELSLPERLIKIGKSAFE

SEQ ID NO: 2989390 - protein, 23 aa, Entamoeba invadens
CCFDDFLVYDKLLQNISNFTKNY

SEQ ID NO: 2989391 - protein, 18 aa, Entamoeba invadens
CCFENVIKWTSFTKSEII

SEQ ID NO: 2989392 - protein, 17 aa, Entamoeba invadens
CCFLKNVVILSSVTSIP

SEQ ID NO: 2989393 - protein, 24 aa, Entamoeba invadens
CCFNCLSLRILIPSTLKSIGVNSF

SEQ ID NO: 2989394 - protein, 28 aa, Entamoeba invadens
CCHFHFCQSLYRRVLTMGLSRRFVEGDT

SEQ ID NO: 2989395 - protein, 29 aa, Entamoeba invadens
CCHFHFCQSLYRRVLTMGLSRRFVEGDTF

SEQ ID NO: 2989396 - protein, 19 aa, Entamoeba invadens
CCKCLPLSEITLPNTVRFL

SEQ ID NO: 2989397 - protein, 17 aa, Entamoeba invadens
CCLHKIPEPIRLADLDS

SEQ ID NO: 2989398 - protein, 23 aa, Entamoeba invadens
CCLIERFFGRLKTVFAFARTKFV

SEQ ID NO: 2989399 - protein, 26 aa, Entamoeba invadens
CCNLKIVKLPRFLVEIGDYCFFNCVA

SEQ ID NO: 2989400 - protein, 24 aa, Entamoeba invadens
CCPESYIILIASLIANMICIPLQH

SEQ ID NO: 2989401 - protein, 24 aa, Entamoeba invadens
CCPGWMEYLEKKYPELIPHVSTAR

SEQ ID NO: 2989402 - protein, 18 aa, Entamoeba invadens
CCSALRYFELPKNIKHLG

SEQ ID NO: 2989403 - protein, 22 aa, Entamoeba invadens
CCSLFETLCTMTQMLESTITAN

SEQ ID NO: 2989404 - protein, 18 aa, Entamoeba invadens
CCTSIPSPLVRFIHAAHL

SEQ ID NO: 2989405 - protein, 27 aa, Entamoeba invadens
CDADLRSLTCLTKFYLYGGTVSVKLPT

SEQ ID NO: 2989406 - protein, 22 aa, Entamoeba invadens
CDAFEATYPILFISLDSSDNKG

SEQ ID NO: 2989407 - protein, 46 aa, Entamoeba invadens
CDDDFTFFKQFFYDSPKASYVLFPKSGIILVYQKTLRYQFVMMFQS

SEQ ID NO: 2989408 - protein, 18 aa, Entamoeba invadens
CDDYLRAMLLSNKVNRTT

SEQ ID NO: 2989409 - protein, 18 aa, Entamoeba invadens
CDEILHLVCKTWRGIQVE

SEQ ID NO: 2989410 - protein, 26 aa, Entamoeba invadens
CDEKCVLPFLYFHSNHFFILQDVRYF

SEQ ID NO: 2989411 - protein, 36 aa, Entamoeba invadens
CDESTLPYYTIQLPYLFPGVQLTYIVKLPTSEVLES

SEQ ID NO: 2989412 - protein, 22 aa, Entamoeba invadens
CDFAFYRCLSLSKIDIPKSVTR

SEQ ID NO: 2989413 - protein, 22 aa, Entamoeba invadens
CDFFKQYFSMPSQEKLELSDDA

SEQ ID NO: 2989414 - protein, 18 aa, Entamoeba invadens
CDFTLLKILATCGIDLKL

SEQ ID NO: 2989415 - protein, 17 aa, Entamoeba invadens
CDGATFTPKRITVLQLA

SEQ ID NO: 2989416 - protein, 20 aa, Entamoeba invadens
CDGFVLMHSITSFGSFEAVK

SEQ ID NO: 2989417 - protein, 30 aa, Entamoeba invadens
CDGKCSVVFALFWKGGLFGVFNRELLHSEK

SEQ ID NO: 2989418 - protein, 18 aa, Entamoeba invadens
CDGKVLFFWVDNGEEIGR

SEQ ID NO: 2989419 - protein, 18 aa, Entamoeba invadens
CDGVFVFDKLVNSTIEHL

SEQ ID NO: 2989420 - protein, 26 aa, Entamoeba invadens
CDGYYFGIDRYLFNGNIFYLHRMIVV

SEQ ID NO: 2989421 - protein, 20 aa, Entamoeba invadens
CDHHKVTLPLFLNEAKASDK

SEQ ID NO: 2989422 - protein, 24 aa, Entamoeba invadens
CDHKAFIFVLENNGAFDPMKVMLK

SEQ ID NO: 2989423 - protein, 27 aa, Entamoeba invadens
CDIKGKFIRLFTQKGIIKLNIQKVLTE

SEQ ID NO: 2989424 - protein, 34 aa, Entamoeba invadens
CDIWSLGVITYVLLSGYLPFFGETQDELFQKILS

SEQ ID NO: 2989425 - protein, 17 aa, Entamoeba invadens
CDKFFCTLKLSHYLAAF

SEQ ID NO: 2989426 - protein, 18 aa, Entamoeba invadens
CDLLALNGLKFEDVENYK

SEQ ID NO: 2989427 - protein, 17 aa, Entamoeba invadens
CDLLIQRGRLLLNERFG

SEQ ID NO: 2989428 - protein, 17 aa, Entamoeba invadens
CDMLYAEQLEEVRAPLI

SEQ ID NO: 2989429 - protein, 17 aa, Entamoeba invadens
CDNFFCSLRLAHYLAQC

SEQ ID NO: 2989430 - protein, 17 aa, Entamoeba invadens
CDNFFCSLRLAHYLAQY

SEQ ID NO: 2989431 - protein, 18 aa, Entamoeba invadens
CDNFFCTLKLSHYLAAFG

SEQ ID NO: 2989432 - protein, 28 aa, Entamoeba invadens
CDNMTLNLRFSLTFLRMLLGKRTEVEDL

SEQ ID NO: 2989433 - protein, 27 aa, Entamoeba invadens
CDNPKFLMTVIHPTPMFIVLTANVDKD

SEQ ID NO: 2989434 - protein, 17 aa, Entamoeba invadens
CDPLIIRSIKFQDKLVL

SEQ ID NO: 2989435 - protein, 29 aa, Entamoeba invadens
CDQVYGYCTSCKLGYVLKLDKQSLICESC

SEQ ID NO: 2989436 - protein, 26 aa, Entamoeba invadens
CDRAGIVVLRVPSTFDLKRICRVTGS

SEQ ID NO: 2989437 - protein, 17 aa, Entamoeba invadens
CDRKEYIGWNIPDPLCL

SEQ ID NO: 2989438 - protein, 25 aa, Entamoeba invadens
CDRVLFRIHNLYQLSLHVYERVDVL

SEQ ID NO: 2989439 - protein, 24 aa, Entamoeba invadens
CDSSTCLRCKMPFTLNGENCFDCS

SEQ ID NO: 2989440 - protein, 24 aa, Entamoeba invadens
CDSTKGCLKCNLGYFLNSSSCFLC

SEQ ID NO: 2989441 - protein, 23 aa, Entamoeba invadens
CDSTTEFCSRCLLNYTITSPISK

SEQ ID NO: 2989442 - protein, 18 aa, Entamoeba invadens
CDTFLILRKNFHGLINLF

SEQ ID NO: 2989443 - protein, 29 aa, Entamoeba invadens
CDTLSPQMRQLFEKFFKLPKDKKVDQEIK

SEQ ID NO: 2989444 - protein, 29 aa, Entamoeba invadens
CDTPLLQCRSYILDVLKSELKTLANYVAS

SEQ ID NO: 2989445 - protein, 19 aa, Entamoeba invadens
CDVGHWFTNVFYKTIEEQR

SEQ ID NO: 2989446 - protein, 25 aa, Entamoeba invadens
CDVTVHYFFPFIECPFEVSLEDVYN

SEQ ID NO: 2989447 - protein, 23 aa, Entamoeba invadens
CDWSVFQICKWLNLLVEHKRYVT

SEQ ID NO: 2989448 - protein, 24 aa, Entamoeba invadens
CDYCKSLRGVGIKKALKLVTSAVD

SEQ ID NO: 2989449 - protein, 21 aa, Entamoeba invadens
CDYTFKVLIIGESGVGKTAVL

SEQ ID NO: 2989450 - protein, 29 aa, Entamoeba invadens
CDYWSVGCILFEMVCGFPPFLSDDAVQTC

SEQ ID NO: 2989451 - protein, 23 aa, Entamoeba invadens
CDYYAFVQYNLHLQLKEASEYAT

SEQ ID NO: 2989452 - protein, 23 aa, Entamoeba invadens
CEAMPFLTQFFPLEDFDSVFTTA

SEQ ID NO: 2989453 - protein, 18 aa, Entamoeba invadens
CECVLKKARICMSLLLRG

SEQ ID NO: 2989454 - protein, 25 aa, Entamoeba invadens
CEDKEAFLFMLNKHGKHEPRMFEVD

SEQ ID NO: 2989455 - protein, 25 aa, Entamoeba invadens
CEDLGRLRLLVTKKLKSLVTENKAK

SEQ ID NO: 2989456 - protein, 24 aa, Entamoeba invadens
CEDLLNEIISLYKGAKIGVVIGPV

SEQ ID NO: 2989457 - protein, 23 aa, Entamoeba invadens
CEDYTNYVIPIDNIEIQEVRKRD

SEQ ID NO: 2989458 - protein, 18 aa, Entamoeba invadens
CEEAINNLFFLLENNQSV

SEQ ID NO: 2989459 - protein, 26 aa, Entamoeba invadens
CEERKAFLNLIWKYKHGNIIDILGVY

SEQ ID NO: 2989460 - protein, 23 aa, Entamoeba invadens
CEFEIFIKLLCLCKIDEHFVVIY

SEQ ID NO: 2989461 - protein, 18 aa, Entamoeba invadens
CEFLDDIKGTQIGLQITF

SEQ ID NO: 2989462 - protein, 19 aa, Entamoeba invadens
CEFSLFLTPLCNSNMESSF

SEQ ID NO: 2989463 - protein, 17 aa, Entamoeba invadens
CEFVHLNIWYEVSYSRS

SEQ ID NO: 2989464 - protein, 29 aa, Entamoeba invadens
CEGICGMKFLKQLLLTNNYISKLPTFKDC

SEQ ID NO: 2989465 - protein, 23 aa, Entamoeba invadens
CEGRLDDNFLLASEYLSLAEELS

SEQ ID NO: 2989466 - protein, 20 aa, Entamoeba invadens
CEGVQLLGLMKSNITFTVQL

SEQ ID NO: 2989467 - protein, 20 aa, Entamoeba invadens
CEIKICLFHLNQAVYRMLGK

SEQ ID NO: 2989468 - protein, 26 aa, Entamoeba invadens
CEINPALIMGILGSIIPFPDHNQSPR

SEQ ID NO: 2989469 - protein, 21 aa, Entamoeba invadens
CEKCFIGIPNCQVCSTKKVGI

SEQ ID NO: 2989470 - protein, 23 aa, Entamoeba invadens
CEKCQAGYFSIGGLVSCVKCGDK

SEQ ID NO: 2989471 - protein, 28 aa, Entamoeba invadens
CEKGEQDIFLTFYKTTLVLKANQKHRIN

SEQ ID NO: 2989472 - protein, 22 aa, Entamoeba invadens
CEKLEEIVIPKSLSELGKKCFF

SEQ ID NO: 2989473 - protein, 33 aa, Entamoeba invadens
CEKLEKIIFNYNIYLYDHLLFSGCVSLKEIEID

SEQ ID NO: 2989474 - protein, 25 aa, Entamoeba invadens
CEKLEMFIFGEHLKFVGNSAFIKCQ

SEQ ID NO: 2989475 - protein, 24 aa, Entamoeba invadens
CEKLQNLYLMKCVKLRMGCLVCTL

SEQ ID NO: 2989476 - protein, 23 aa, Entamoeba invadens
CEKLRVVAFGPSLKQFGKRVFAG

SEQ ID NO: 2989477 - protein, 23 aa, Entamoeba invadens
CEKPYDQILLRGFAADRDVVIVA

SEQ ID NO: 2989478 - protein, 33 aa, Entamoeba invadens
CEKRNVMIIVITYNKYVFGSFTSLPIPTSQKQD

SEQ ID NO: 2989479 - protein, 24 aa, Entamoeba invadens
CELCDPIFSSLISISGECKSIENE

SEQ ID NO: 2989480 - protein, 23 aa, Entamoeba invadens
CELDLIYYFHKVYQVIDEVFLAG

SEQ ID NO: 2989481 - protein, 18 aa, Entamoeba invadens
CELLVSVSLPDCVTLFGD

SEQ ID NO: 2989482 - protein, 19 aa, Entamoeba invadens
CEMMLDPYFRTLDGFVVLV

SEQ ID NO: 2989483 - protein, 36 aa, Entamoeba invadens
CENELLVYRLTRIKCLLFPWAVRPQNNIFFTSVIQK

SEQ ID NO: 2989484 - protein, 19 aa, Entamoeba invadens
CENGFALKDNLCYKCGQNC

SEQ ID NO: 2989485 - protein, 17 aa, Entamoeba invadens
CENGIFDSTKRKCQKCQ

SEQ ID NO: 2989486 - protein, 31 aa, Entamoeba invadens
CENKSFLKKKFFRIIVWFNVDFETVDRNKSR

SEQ ID NO: 2989487 - protein, 18 aa, Entamoeba invadens
CENLIAVTFGRQIPKCEI

SEQ ID NO: 2989488 - protein, 25 aa, Entamoeba invadens
CEQKGVFLLLDAIWTIVKETEGKCQ

SEQ ID NO: 2989489 - protein, 20 aa, Entamoeba invadens
CEQTTAILLAPIFRELQCVV

SEQ ID NO: 2989490 - protein, 23 aa, Entamoeba invadens
CESEFFKQWLTSILSTRLISIKR

SEQ ID NO: 2989491 - protein, 25 aa, Entamoeba invadens
CESKKLLENPYVPKGWPLYHKKNEV

SEQ ID NO: 2989492 - protein, 26 aa, Entamoeba invadens
CESMKTCGYINYYGLQRFGSNGTTHL

SEQ ID NO: 2989493 - protein, 32 aa, Entamoeba invadens
CESNINTILAMKVFSSVFYGVRGKIDTLRRNL

SEQ ID NO: 2989494 - protein, 23 aa, Entamoeba invadens
CETLKLLCKEGVVHFLFEEYINH

SEQ ID NO: 2989495 - protein, 30 aa, Entamoeba invadens
CETPIFSVMQQWLWGIHSSKFMNGYKKDYD

SEQ ID NO: 2989496 - protein, 19 aa, Entamoeba invadens
CEVGLKYVFSLLKYAEVDN

SEQ ID NO: 2989497 - protein, 23 aa, Entamoeba invadens
CEVKSCINLYFDEVFFNANKEKG

SEQ ID NO: 2989498 - protein, 24 aa, Entamoeba invadens
CEVSMLMEGFFKSSSWSLKCEVCI

SEQ ID NO: 2989499 - protein, 21 aa, Entamoeba invadens
CEYEIMFHVSTLLPEQPNDLQ

SEQ ID NO: 2989500 - protein, 23 aa, Entamoeba invadens
CEYMTFLLECHCKYTIKIYDEFV

SEQ ID NO: 2989501 - protein, 17 aa, Entamoeba invadens
CEYSKAISCNPFNHIYY

SEQ ID NO: 2989502 - protein, 21 aa, Entamoeba invadens
CEYVIPKRFERGYVPIKTISK

SEQ ID NO: 2989503 - protein, 33 aa, Entamoeba invadens
CEYVTRLLQISPIRKYILSFLLNEQIEAKSQYN

SEQ ID NO: 2989504 - protein, 18 aa, Entamoeba invadens
CFAGCEKLMKVSLAVGLY

SEQ ID NO: 2989505 - protein, 28 aa, Entamoeba invadens
CFAKAFTTFQFYVFRTIDFTKMIQQASL

SEQ ID NO: 2989506 - protein, 25 aa, Entamoeba invadens
CFDFAKLKEFIAKYNLKLLVDSFNA

SEQ ID NO: 2989507 - protein, 29 aa, Entamoeba invadens
CFDFKNYYMIYTTALWNGIVLSSTTANPF

SEQ ID NO: 2989508 - protein, 17 aa, Entamoeba invadens
CFDIIIKEFLKNDLDVL

SEQ ID NO: 2989509 - protein, 32 aa, Entamoeba invadens
CFDTKKVYKALFFPLVFDLMNLDELKTIFKDR

SEQ ID NO: 2989510 - protein, 22 aa, Entamoeba invadens
CFDVWAAFFDLPICGSLCISDE

SEQ ID NO: 2989511 - protein, 25 aa, Entamoeba invadens
CFECGIKILYEFFLIFVNAETKVDS

SEQ ID NO: 2989512 - protein, 25 aa, Entamoeba invadens
CFEFISKLTYLEALYLEKCMKISGE

SEQ ID NO: 2989513 - protein, 17 aa, Entamoeba invadens
CFEFQSFVLDCYDLQLT

SEQ ID NO: 2989514 - protein, 17 aa, Entamoeba invadens
CFFKYRFGRICEKEKNV

SEQ ID NO: 2989515 - protein, 18 aa, Entamoeba invadens
CFFNCRRLSGVTIPTSVI

SEQ ID NO: 2989516 - protein, 29 aa, Entamoeba invadens
CFGCASLLENYYAFLVYSIDEKKKKVVIY

SEQ ID NO: 2989517 - protein, 19 aa, Entamoeba invadens
CFGFPKYVIDEVVDLFVGL

SEQ ID NO: 2989518 - protein, 24 aa, Entamoeba invadens
CFGIFPEEFAICSGPVFVPPDAFF

SEQ ID NO: 2989519 - protein, 20 aa, Entamoeba invadens
CFGWCFAYDNDDFTYPWKIA

SEQ ID NO: 2989520 - protein, 20 aa, Entamoeba invadens
CFGWCLSLCEFDIPKNIDKL

SEQ ID NO: 2989521 - protein, 25 aa, Entamoeba invadens
CFHDCRLLSKIILPINIKSLGQYCF

SEQ ID NO: 2989522 - protein, 17 aa, Entamoeba invadens
CFICGSLTHKTLTCPQH

SEQ ID NO: 2989523 - protein, 31 aa, Entamoeba invadens
CFIHDFIDIILTIIYGMEFRFPYVKCSSFDH

SEQ ID NO: 2989524 - protein, 17 aa, Entamoeba invadens
CFIIPLGTGNSLSRCTG

SEQ ID NO: 2989525 - protein, 23 aa, Entamoeba invadens
CFINVLIFFSQKMSIKEEKEELK

SEQ ID NO: 2989526 - protein, 20 aa, Entamoeba invadens
CFKCKDYYTGLIDGNGYKCV

SEQ ID NO: 2989527 - protein, 27 aa, Entamoeba invadens
CFKKPSRLFEIMLVYGLKNIKENCFDG

SEQ ID NO: 2989528 - protein, 18 aa, Entamoeba invadens
CFKLCISLSVINIPDGVN

SEQ ID NO: 2989529 - protein, 26 aa, Entamoeba invadens
CFKNCTSLTFVYIPQKVLSIEENAFK

SEQ ID NO: 2989530 - protein, 24 aa, Entamoeba invadens
CFKNSLSFAFYRFPRSVSNIGDQC

SEQ ID NO: 2989531 - protein, 17 aa, Entamoeba invadens
CFLCGKTGHISLVCPEK

SEQ ID NO: 2989532 - protein, 19 aa, Entamoeba invadens
CFLHNHILSRITLSSNLHE

SEQ ID NO: 2989533 - protein, 50 aa, Entamoeba invadens
CFMNCESLEYVILPKTIMTIPYKCFSMCVRLQFLYIPKGITTIGENAFER

SEQ ID NO: 2989534 - protein, 22 aa, Entamoeba invadens
CFMNCFGLVHIVIPQSVERING

SEQ ID NO: 2989535 - protein, 18 aa, Entamoeba invadens
CFNAKFNLINVNPPELVN

SEQ ID NO: 2989536 - protein, 19 aa, Entamoeba invadens
CFNCGMPGHILAKCPVPRK

SEQ ID NO: 2989537 - protein, 19 aa, Entamoeba invadens
CFNEWDALFLMKRTINEYL

SEQ ID NO: 2989538 - protein, 17 aa, Entamoeba invadens
CFNLIIARMKNVSKRKA

SEQ ID NO: 2989539 - protein, 22 aa, Entamoeba invadens
CFNLIIARMKSVSKRKAKMVKN

SEQ ID NO: 2989540 - protein, 32 aa, Entamoeba invadens
CFNLKTIPKIQFLKRGVFWCCNSLVKFERFGD

SEQ ID NO: 2989541 - protein, 23 aa, Entamoeba invadens
CFNMIPEQLALVEFDFLTKLNPH

SEQ ID NO: 2989542 - protein, 17 aa, Entamoeba invadens
CFNWLSETLSKMINDCA

SEQ ID NO: 2989543 - protein, 20 aa, Entamoeba invadens
CFPRRHFENFIKICNVFNVQ

SEQ ID NO: 2989544 - protein, 25 aa, Entamoeba invadens
CFRACSLLNDIQFPSSLLSVGDNAF

SEQ ID NO: 2989545 - protein, 17 aa, Entamoeba invadens
CFRCGYPLRGYKVLYPT

SEQ ID NO: 2989546 - protein, 17 aa, Entamoeba invadens
CFRLQKDRVYYVRLDVA

SEQ ID NO: 2989547 - protein, 20 aa, Entamoeba invadens
CFRNCFLQEVVLSDSLVSVG

SEQ ID NO: 2989548 - protein, 19 aa, Entamoeba invadens
CFSECYVLEQINIPKNVKE

SEQ ID NO: 2989549 - protein, 31 aa, Entamoeba invadens
CFSELVRVFIQCVIIPYLNSKRALLRKFGSS

SEQ ID NO: 2989550 - protein, 25 aa, Entamoeba invadens
CFSKCYFLERVILSKNIIHIGSYCF

SEQ ID NO: 2989551 - protein, 25 aa, Entamoeba invadens
CFSKLKVIMSTHLSSPKLFFPDDID

SEQ ID NO: 2989552 - protein, 18 aa, Entamoeba invadens
CFSKYLKIAQIFDSLSVE

SEQ ID NO: 2989553 - protein, 25 aa, Entamoeba invadens
CFSQLFLDLFGTYFAYYEKDNGVCN

SEQ ID NO: 2989554 - protein, 17 aa, Entamoeba invadens
CFTLLQIQDIPGIDFML

SEQ ID NO: 2989555 - protein, 32 aa, Entamoeba invadens
CFTNNLAFRNWYAKFIGESFVMTLTPQDVTLF

SEQ ID NO: 2989556 - protein, 23 aa, Entamoeba invadens
CFVCATKLERVVLPLSITGTPSF

SEQ ID NO: 2989557 - protein, 18 aa, Entamoeba invadens
CFVELLYTNYNIVDTKDG

SEQ ID NO: 2989558 - protein, 25 aa, Entamoeba invadens
CFVHNIVHIYQLPEFTFVGSLTNVV

SEQ ID NO: 2989559 - protein, 18 aa, Entamoeba invadens
CFVKSTLPPLIKTVPFDL

SEQ ID NO: 2989560 - protein, 19 aa, Entamoeba invadens
CFVKSTLPPLIKTVPFDLL

SEQ ID NO: 2989561 - protein, 24 aa, Entamoeba invadens
CFVKSTLPPLIKTVSFDLLGDYSC

SEQ ID NO: 2989562 - protein, 18 aa, Entamoeba invadens
CFVLAYRLVTTPDKLLEL

SEQ ID NO: 2989563 - protein, 23 aa, Entamoeba invadens
CFVNIWHLFCFYKTNTSNNSKSN

SEQ ID NO: 2989564 - protein, 17 aa, Entamoeba invadens
CFVPRLCNAAVQKNIFS

SEQ ID NO: 2989565 - protein, 19 aa, Entamoeba invadens
CFVRNDAGFFIFSLENHKS

SEQ ID NO: 2989566 - protein, 20 aa, Entamoeba invadens
CFYECKSLSIVSIPFGVTII

SEQ ID NO: 2989567 - protein, 20 aa, Entamoeba invadens
CFYFVMDYCAGGNFYRALRK

SEQ ID NO: 2989568 - protein, 20 aa, Entamoeba invadens
CFYGCRALHNVTLPNALTKI

SEQ ID NO: 2989569 - protein, 18 aa, Entamoeba invadens
CFYKCIKLTSISIPQGVE

SEQ ID NO: 2989570 - protein, 44 aa, Entamoeba invadens
CGAANPTWASAPYGIFLCINCAGLHRGLGVHLTFVRSCDMDEWK

SEQ ID NO: 2989571 - protein, 33 aa, Entamoeba invadens
CGAKNLVKVSLPLNFKRLPFKAFYNVTSLAEIE

SEQ ID NO: 2989572 - protein, 32 aa, Entamoeba invadens
CGAKNLVKVSLPLNFKRLPFKAFYNVTSLTEI

SEQ ID NO: 2989573 - protein, 31 aa, Entamoeba invadens
CGALLSLQTLRRVVLYIPLSALDHFLSLNCV

SEQ ID NO: 2989574 - protein, 24 aa, Entamoeba invadens
CGANDLLEYLYSKQFAPWEVGKDG

SEQ ID NO: 2989575 - protein, 17 aa, Entamoeba invadens
CGAPALLQFCECNRMKN

SEQ ID NO: 2989576 - protein, 18 aa, Entamoeba invadens
CGCELYTNYWNYYITAID

SEQ ID NO: 2989577 - protein, 23 aa, Entamoeba invadens
CGCVSLHSILLPTDLKLLKKGCF

SEQ ID NO: 2989578 - protein, 26 aa, Entamoeba invadens
CGDAVTWFWCRTIQEGYYYGYDMSVH

SEQ ID NO: 2989579 - protein, 22 aa, Entamoeba invadens
CGDIHGQFYDLLRLFEIGGQLP

SEQ ID NO: 2989580 - protein, 25 aa, Entamoeba invadens
CGDKDFVQFGLWDTPGVEATESFVQ

SEQ ID NO: 2989581 - protein, 24 aa, Entamoeba invadens
CGDPYVGKTCFFQRFSAGEFNANT

SEQ ID NO: 2989582 - protein, 27 aa, Entamoeba invadens
CGDTNIFDLLFRLGDPKFYCSDCLKEN

SEQ ID NO: 2989583 - protein, 19 aa, Entamoeba invadens
CGDVIQFTARKNFSFWEFI

SEQ ID NO: 2989584 - protein, 18 aa, Entamoeba invadens
CGEMPVINLEFYSSYLLI

SEQ ID NO: 2989585 - protein, 29 aa, Entamoeba invadens
CGENYCPGHLLVLHLPTLSHLEAYIEKKF

SEQ ID NO: 2989586 - protein, 17 aa, Entamoeba invadens
CGFACEFEIFLTPYCTM

SEQ ID NO: 2989587 - protein, 27 aa, Entamoeba invadens
CGFHSLIDYLISLSDVFVIVYAINYRE

SEQ ID NO: 2989588 - protein, 18 aa, Entamoeba invadens
CGFLKILRCNPLACRNLS

SEQ ID NO: 2989589 - protein, 18 aa, Entamoeba invadens
CGFMYMDVLKIIGTPDIS

SEQ ID NO: 2989590 - protein, 23 aa, Entamoeba invadens
CGFSSVVIAKQLGWIDSEVMKNY

SEQ ID NO: 2989591 - protein, 20 aa, Entamoeba invadens
CGGLSLAEMIAAKQGNLKAV

SEQ ID NO: 2989592 - protein, 20 aa, Entamoeba invadens
CGGRALMSWSFMPPQTFVSN

SEQ ID NO: 2989593 - protein, 33 aa, Entamoeba invadens
CGHLLNFEFQVLPSIISLMRDIPEFDSLFVFSC

SEQ ID NO: 2989594 - protein, 29 aa, Entamoeba invadens
CGIHFSSFFKYFIFLCQPLNKDLTAVVQS

SEQ ID NO: 2989595 - protein, 25 aa, Entamoeba invadens
CGIISFMVTPKYILSPSVFNLCYLK

SEQ ID NO: 2989596 - protein, 20 aa, Entamoeba invadens
CGILKLVVIYQKLDYFLEVK

SEQ ID NO: 2989597 - protein, 17 aa, Entamoeba invadens
CGILLDATYFTTHVDKI

SEQ ID NO: 2989598 - protein, 18 aa, Entamoeba invadens
CGITLHQGCINLAPRKCT

SEQ ID NO: 2989599 - protein, 34 aa, Entamoeba invadens
CGKGIESLKSALQLFLRQLPTDSTFDIISFGSQF

SEQ ID NO: 2989600 - protein, 25 aa, Entamoeba invadens
CGKKDNEMLLKLMKDPYANYVIQTL

SEQ ID NO: 2989601 - protein, 19 aa, Entamoeba invadens
CGKRVYFNERLTFAGRDYH

SEQ ID NO: 2989602 - protein, 26 aa, Entamoeba invadens
CGKTKIFFRLVFLLKLKKLERTESLN

SEQ ID NO: 2989603 - protein, 31 aa, Entamoeba invadens
CGKTTFVKGMFSFLSLMGRTPLIVNLDPANE

SEQ ID NO: 2989604 - protein, 28 aa, Entamoeba invadens
CGLPTPHIPSFAPCPPPPGCCPRTIPLG

SEQ ID NO: 2989605 - protein, 18 aa, Entamoeba invadens
CGMGIIFGTGTNGCYIEK

SEQ ID NO: 2989606 - protein, 18 aa, Entamoeba invadens
CGMGLIFGTGTNGCYIEK

SEQ ID NO: 2989607 - protein, 18 aa, Entamoeba invadens
CGMIILDHFQIQGIFVLT

SEQ ID NO: 2989608 - protein, 17 aa, Entamoeba invadens
CGMTKMFGFVLGNARYK

SEQ ID NO: 2989609 - protein, 20 aa, Entamoeba invadens
CGNAIYRITVKIDCWSSLVL

SEQ ID NO: 2989610 - protein, 25 aa, Entamoeba invadens
CGNISISFREPPPTFIVSVKDPFEW

SEQ ID NO: 2989611 - protein, 30 aa, Entamoeba invadens
CGNLFEQFYNLRILFLPDSVVGIDPTVLDC

SEQ ID NO: 2989612 - protein, 33 aa, Entamoeba invadens
CGNTIPEWVLQFLLSFFIPGLLDFFGGNEYNVK

SEQ ID NO: 2989613 - protein, 20 aa, Entamoeba invadens
CGPCQLMGPIFEDLAKKHTN

SEQ ID NO: 2989614 - protein, 27 aa, Entamoeba invadens
CGQNEFLKLHNFLYNPTEFPITKFNIL

SEQ ID NO: 2989615 - protein, 24 aa, Entamoeba invadens
CGQQQFQRLWKTYYSNVICFAFVI

SEQ ID NO: 2989616 - protein, 29 aa, Entamoeba invadens
CGQRYMSDAFLRLLIQKAAVDVKTQTFVL

SEQ ID NO: 2989617 - protein, 18 aa, Entamoeba invadens
CGQYKKTSGMYYYSTFRS

SEQ ID NO: 2989618 - protein, 18 aa, Entamoeba invadens
CGREEIRPRYLCGIMFLH

SEQ ID NO: 2989619 - protein, 22 aa, Entamoeba invadens
CGRIHRYFTNKPQVCAPKILGD

SEQ ID NO: 2989620 - protein, 24 aa, Entamoeba invadens
CGSEAEYIWKTCGLVAELDVENGV

SEQ ID NO: 2989621 - protein, 28 aa, Entamoeba invadens
CGSFNPIHELHLLIFEIAKNYFTLNGRN

SEQ ID NO: 2989622 - protein, 25 aa, Entamoeba invadens
CGSIKLQMVVFIKAKPNDKIELIVE

SEQ ID NO: 2989623 - protein, 17 aa, Entamoeba invadens
CGSQNFVPKHFIVVQMK

SEQ ID NO: 2989624 - protein, 20 aa, Entamoeba invadens
CGSYFYAAPELFLEESYDGC

SEQ ID NO: 2989625 - protein, 17 aa, Entamoeba invadens
CGTFELVNYINPTPGGL

SEQ ID NO: 2989626 - protein, 26 aa, Entamoeba invadens
CGTLSIFDFIGLGGYGLIGWAVKPRI

SEQ ID NO: 2989627 - protein, 18 aa, Entamoeba invadens
CGTPLRCILEGKKYIRDI

SEQ ID NO: 2989628 - protein, 17 aa, Entamoeba invadens
CGTVKYIPIMESDRVLT

SEQ ID NO: 2989629 - protein, 25 aa, Entamoeba invadens
CGVDFSLLEAYFNYTRTRTQLKNKY

SEQ ID NO: 2989630 - protein, 23 aa, Entamoeba invadens
CGVFHYFEVLVPQIVSILSKIDK

SEQ ID NO: 2989631 - protein, 26 aa, Entamoeba invadens
CGVIDRALKMLSLSSVSLAIIHLLEN

SEQ ID NO: 2989632 - protein, 26 aa, Entamoeba invadens
CGVKVILQLLILKRIVEKFPHFLDNV

SEQ ID NO: 2989633 - protein, 23 aa, Entamoeba invadens
CGVLSIVVTPNICVSLNAFECSN

SEQ ID NO: 2989634 - protein, 21 aa, Entamoeba invadens
CGVMVYMMLTSQFPFDMKMQS

SEQ ID NO: 2989635 - protein, 20 aa, Entamoeba invadens
CGYIYIIHIPENVVTFGAGC

SEQ ID NO: 2989636 - protein, 20 aa, Entamoeba invadens
CGYLFLGDYVDRGDFGCEVL

SEQ ID NO: 2989637 - protein, 17 aa, Entamoeba invadens
CGYNAIHLTPLQPIGPS

SEQ ID NO: 2989638 - protein, 30 aa, Entamoeba invadens
CGYYLVDAIRRWTGWMTPIVLFDSDNDCIT

SEQ ID NO: 2989639 - protein, 24 aa, Entamoeba invadens
CHCDNLVSVILPPTITKLSYKCFA

SEQ ID NO: 2989640 - protein, 30 aa, Entamoeba invadens
CHCVKIIYIYTIFFNVLNFLKIFVKQDESN

SEQ ID NO: 2989641 - protein, 27 aa, Entamoeba invadens
CHDFVVRLIQELVVRFANPLRKSTCFE

SEQ ID NO: 2989642 - protein, 23 aa, Entamoeba invadens
CHECTLLYGCSECINYLTNNETS

SEQ ID NO: 2989643 - protein, 17 aa, Entamoeba invadens
CHELPTNSVYFIAVTDT

SEQ ID NO: 2989644 - protein, 21 aa, Entamoeba invadens
CHETDGLVTCECGRHFCNGKV

SEQ ID NO: 2989645 - protein, 24 aa, Entamoeba invadens
CHFTQLWESLQQKCLFLRKSDVKD

SEQ ID NO: 2989646 - protein, 19 aa, Entamoeba invadens
CHFVNLWDGRYQKCILMRK

SEQ ID NO: 2989647 - protein, 33 aa, Entamoeba invadens
CHHSRSLGYYIVPLLLILPFSKTSTEVHLTGVT

SEQ ID NO: 2989648 - protein, 19 aa, Entamoeba invadens
CHKHLVVDLCSQVNFIVGE

SEQ ID NO: 2989649 - protein, 23 aa, Entamoeba invadens
CHKKLIQLLTQQLPSDLLSDVMY

SEQ ID NO: 2989650 - protein, 20 aa, Entamoeba invadens
CHNPAPSFSLFTCHNEKRNS

SEQ ID NO: 2989651 - protein, 19 aa, Entamoeba invadens
CHPYLLFCKEHRDELSAKY

SEQ ID NO: 2989652 - protein, 24 aa, Entamoeba invadens
CHRALSVSNYKLLKDTNEIYCTIH

SEQ ID NO: 2989653 - protein, 28 aa, Entamoeba invadens
CHRSFDGTFFKLERFRKIVILKKELSCD

SEQ ID NO: 2989654 - protein, 35 aa, Entamoeba invadens
CHRSVDGTFFKLERFRKIVILKRGLSCDNLVEIED

SEQ ID NO: 2989655 - protein, 25 aa, Entamoeba invadens
CHTAFTMLRINPFYSLKTLNEEMKM

SEQ ID NO: 2989656 - protein, 32 aa, Entamoeba invadens
CHVVYTDYRPTPLCHYLFPINGNGIHLVVDKE

SEQ ID NO: 2989657 - protein, 18 aa, Entamoeba invadens
CIACNQYYPKCISCSQDV

SEQ ID NO: 2989658 - protein, 18 aa, Entamoeba invadens
CIADFFLSRGISVIELTA

SEQ ID NO: 2989659 - protein, 17 aa, Entamoeba invadens
CIALKRVLLSKNVTEIC

SEQ ID NO: 2989660 - protein, 22 aa, Entamoeba invadens
CIAPVTLAGLLNALRLVHKRLE

SEQ ID NO: 2989661 - protein, 24 aa, Entamoeba invadens
CIAQGYFVWSCKVVESFKGINPML

SEQ ID NO: 2989662 - protein, 26 aa, Entamoeba invadens
CICPEMNNFFFPEHLGVPLSQRKFVS

SEQ ID NO: 2989663 - protein, 24 aa, Entamoeba invadens
CICPGGIGFDINCGVRLLRTNLKE

SEQ ID NO: 2989664 - protein, 18 aa, Entamoeba invadens
CIDGYILIDGQCQTCQYY

SEQ ID NO: 2989665 - protein, 28 aa, Entamoeba invadens
CIDLLAPLFTFVGYQLDLPRNIKAKIVF

SEQ ID NO: 2989666 - protein, 25 aa, Entamoeba invadens
CIDPAMLRPGRLDRLISVELPNENA

SEQ ID NO: 2989667 - protein, 17 aa, Entamoeba invadens
CIDTFFPVEETISKFET

SEQ ID NO: 2989668 - protein, 17 aa, Entamoeba invadens
CIECIPSDFWQKPGDLS

SEQ ID NO: 2989669 - protein, 17 aa, Entamoeba invadens
CIELLGLIHLSFSKQRN

SEQ ID NO: 2989670 - protein, 23 aa, Entamoeba invadens
CIELPSCLTVLKKKCFSGCKELQ

SEQ ID NO: 2989671 - protein, 24 aa, Entamoeba invadens
CIEMDKFLLSSMQSVLFQNPEFLG

SEQ ID NO: 2989672 - protein, 24 aa, Entamoeba invadens
CIENGCFYCAFYLKEINIPDTGTK

SEQ ID NO: 2989673 - protein, 25 aa, Entamoeba invadens
CIENGCFYCAFYLKEINIPDTVTKI

SEQ ID NO: 2989674 - protein, 27 aa, Entamoeba invadens
CIENSKWYQFIYAIFIGSVQIVEKVKR

SEQ ID NO: 2989675 - protein, 27 aa, Entamoeba invadens
CIEYSRYQTIFSLYKSIGKRTVDAFQI

SEQ ID NO: 2989676 - protein, 17 aa, Entamoeba invadens
CIFGMRLESLNRLPRPI

SEQ ID NO: 2989677 - protein, 17 aa, Entamoeba invadens
CIFICFSINDWNQFERT

SEQ ID NO: 2989678 - protein, 19 aa, Entamoeba invadens
CIFRHSGLKGIYLSGNHST

SEQ ID NO: 2989679 - protein, 24 aa, Entamoeba invadens
CIFSLKREGIVKRKKFEILSDCAN

SEQ ID NO: 2989680 - protein, 19 aa, Entamoeba invadens
CIGASFPFPTTGAAKAVGK

SEQ ID NO: 2989681 - protein, 22 aa, Entamoeba invadens
CIGCTCTIVYVWEEDGEMYVQS

SEQ ID NO: 2989682 - protein, 25 aa, Entamoeba invadens
CIGDTLKMLLPHVAPYLNFTTDYQI

SEQ ID NO: 2989683 - protein, 18 aa, Entamoeba invadens
CIHKYILKVYDIFEDGDS

SEQ ID NO: 2989684 - protein, 24 aa, Entamoeba invadens
CIHYVTIMLLKIIGTKYNIEGLNA

SEQ ID NO: 2989685 - protein, 17 aa, Entamoeba invadens
CIIGDSGVGKTCISSRL

SEQ ID NO: 2989686 - protein, 18 aa, Entamoeba invadens
CIKGGLRGDMFKCDQRAI

SEQ ID NO: 2989687 - protein, 25 aa, Entamoeba invadens
CIKYGVRSMPTFVLFKGGDVVKKFT

SEQ ID NO: 2989688 - protein, 23 aa, Entamoeba invadens
CILGCSNVFLTSHRAVLEMDFMH

SEQ ID NO: 2989689 - protein, 18 aa, Entamoeba invadens
CILLRRDGSCAIFNTTKN

SEQ ID NO: 2989690 - protein, 19 aa, Entamoeba invadens
CILQCKHIHFINSYGPLKT

SEQ ID NO: 2989691 - protein, 19 aa, Entamoeba invadens
CIMCASALVECGITKIIYG

SEQ ID NO: 2989692 - protein, 24 aa, Entamoeba invadens
CINFDFEVDVLYFNGKWVVSRSVT

SEQ ID NO: 2989693 - protein, 18 aa, Entamoeba invadens
CINGYYPNSEGECNKCDT

SEQ ID NO: 2989694 - protein, 23 aa, Entamoeba invadens
CINLEDLILPNGLVLIGENLKQI

SEQ ID NO: 2989695 - protein, 24 aa, Entamoeba invadens
CINLKEIKLPKMLKFIPDSCFSGC

SEQ ID NO: 2989696 - protein, 21 aa, Entamoeba invadens
CIPHCTFMKCYNLKEMVLPET

SEQ ID NO: 2989697 - protein, 19 aa, Entamoeba invadens
CIPNEKGDYVLLFTDGFHD

SEQ ID NO: 2989698 - protein, 17 aa, Entamoeba invadens
CIQRNIDKLLLLEGEVF

SEQ ID NO: 2989699 - protein, 18 aa, Entamoeba invadens
CIQSWMKDKIFSETPMPT

SEQ ID NO: 2989700 - protein, 23 aa, Entamoeba invadens
CIRHWKKWRIIQNGLSTIASKGL

SEQ ID NO: 2989701 - protein, 18 aa, Entamoeba invadens
CISNDKLINKCEKVAIVT

SEQ ID NO: 2989702 - protein, 32 aa, Entamoeba invadens
CITCYSPFQINTQTSLFRWILSVKQQMCVGNQ

SEQ ID NO: 2989703 - protein, 19 aa, Entamoeba invadens
CITPIIRKAFTNGEPMNID

SEQ ID NO: 2989704 - protein, 27 aa, Entamoeba invadens
CIVPLKDPDHPCELSYTAKLITMVEGM

SEQ ID NO: 2989705 - protein, 23 aa, Entamoeba invadens
CKAPLDKYFMKEKKLMCKECACP

SEQ ID NO: 2989706 - protein, 25 aa, Entamoeba invadens
CKDCRRNFVSLGDKVKIVGGNYKGR

SEQ ID NO: 2989707 - protein, 24 aa, Entamoeba invadens
CKDNFDWGLYTPSAFSPTDKQLYE

SEQ ID NO: 2989708 - protein, 19 aa, Entamoeba invadens
CKDTVKMVLMGNNLIELGV

SEQ ID NO: 2989709 - protein, 30 aa, Entamoeba invadens
CKEEGFEIPIPLFYQIRKEKIALPTVGIFS

SEQ ID NO: 2989710 - protein, 25 aa, Entamoeba invadens
CKEKTVFDIYLKVLHLVVEENYAAD

SEQ ID NO: 2989711 - protein, 24 aa, Entamoeba invadens
CKEMLLAVICKVGYYYISKDCKQC

SEQ ID NO: 2989712 - protein, 28 aa, Entamoeba invadens
CKEQRTKIVLTFLCLKELRSKDFYELDD

SEQ ID NO: 2989713 - protein, 25 aa, Entamoeba invadens
CKESNIFVIRYRREELKFYCKECIP

SEQ ID NO: 2989714 - protein, 27 aa, Entamoeba invadens
CKEVLSMFFYNPLPIKSTKIFDNMTYQ

SEQ ID NO: 2989715 - protein, 24 aa, Entamoeba invadens
CKFGIDYLMDLLYDQIETQYGLIT

SEQ ID NO: 2989716 - protein, 22 aa, Entamoeba invadens
CKFVFEIAVKFTKHVIPMIIKV

SEQ ID NO: 2989717 - protein, 20 aa, Entamoeba invadens
CKHDIKPIPPFITTDEYCGS

SEQ ID NO: 2989718 - protein, 19 aa, Entamoeba invadens
CKIAILMIRTNPNYRPQLH

SEQ ID NO: 2989719 - protein, 24 aa, Entamoeba invadens
CKIANAVCNHFWRAEGRDLHGVVY

SEQ ID NO: 2989720 - protein, 25 aa, Entamoeba invadens
CKICQKVFGVIRESFWRNTRSKLNA

SEQ ID NO: 2989721 - protein, 33 aa, Entamoeba invadens
CKIGPFQLGMPLYRILKMLAKPSATTLADVHIS

SEQ ID NO: 2989722 - protein, 28 aa, Entamoeba invadens
CKINSPEKIYPNANVKFVEGDKFTVEFI

SEQ ID NO: 2989723 - protein, 33 aa, Entamoeba invadens
CKIPQIESYLYDILTLFITTKLPPVTLEDFYIY

SEQ ID NO: 2989724 - protein, 22 aa, Entamoeba invadens
CKIVAWCYQIGKGSLFVKIGEI

SEQ ID NO: 2989725 - protein, 24 aa, Entamoeba invadens
CKKFKEIPLMFHFNPIQWNPKMVN

SEQ ID NO: 2989726 - protein, 25 aa, Entamoeba invadens
CKKFKEIPLMFHFNPIQWNPKMVNY

SEQ ID NO: 2989727 - protein, 18 aa, Entamoeba invadens
CKKGFYNTGKMCEKCNKS

SEQ ID NO: 2989728 - protein, 17 aa, Entamoeba invadens
CKKLKRIVGKMRGVQII

SEQ ID NO: 2989729 - protein, 23 aa, Entamoeba invadens
CKKPMCVPVCPAHINIPQFISHL

SEQ ID NO: 2989730 - protein, 31 aa, Entamoeba invadens
CKKTNKLRYFYLFNDLMIYGIGNQRIIVSEW

SEQ ID NO: 2989731 - protein, 21 aa, Entamoeba invadens
CKKYALLLDRFRTNPIRITRK

SEQ ID NO: 2989732 - protein, 30 aa, Entamoeba invadens
CKKYKDTLLKFHFNPIPLTTKTRRYFQNLE

SEQ ID NO: 2989733 - protein, 22 aa, Entamoeba invadens
CKKYKFLLDRFRINPIRISPKY

SEQ ID NO: 2989734 - protein, 41 aa, Entamoeba invadens
CKKYSNLITRFYYNPIPLTTETRLYFPKLETLHLYSDLDEK

SEQ ID NO: 2989735 - protein, 26 aa, Entamoeba invadens
CKKYVNLLELFRYNPIPVTSTKLFPN

SEQ ID NO: 2989736 - protein, 17 aa, Entamoeba invadens
CKLEDVVPVLPPKPRRL

SEQ ID NO: 2989737 - protein, 22 aa, Entamoeba invadens
CKLFVACMFFTQIVLSKVKIIN

SEQ ID NO: 2989738 - protein, 23 aa, Entamoeba invadens
CKLRNLEVPHYIPLPVANEEYDI

SEQ ID NO: 2989739 - protein, 34 aa, Entamoeba invadens
CKLVKTMERYGVDKYYWPSSWREDFRKEVLNTVT

SEQ ID NO: 2989740 - protein, 18 aa, Entamoeba invadens
CKMDPWYTIAFRNVPDEM

SEQ ID NO: 2989741 - protein, 19 aa, Entamoeba invadens
CKNFTLADGTFWPIPITMS

SEQ ID NO: 2989742 - protein, 24 aa, Entamoeba invadens
CKNKAFGVKYLLKTNKKHPTKVMV

SEQ ID NO: 2989743 - protein, 25 aa, Entamoeba invadens
CKNLSWIKLPSRLFEISYLAFSGCQ

SEQ ID NO: 2989744 - protein, 19 aa, Entamoeba invadens
CKPGYFPKNLGCSQCSEIA

SEQ ID NO: 2989745 - protein, 26 aa, Entamoeba invadens
CKPSIPPFCPFIDTGVYKYGERLRHF

SEQ ID NO: 2989746 - protein, 18 aa, Entamoeba invadens
CKQFAKLVLDLQAVHTTL

SEQ ID NO: 2989747 - protein, 20 aa, Entamoeba invadens
CKQFVYTKKDFLLTNGVIPD

SEQ ID NO: 2989748 - protein, 17 aa, Entamoeba invadens
CKRCFIKDNLTKEQLCV

SEQ ID NO: 2989749 - protein, 23 aa, Entamoeba invadens
CKRYRNLSYRFDSNPISINSPVC

SEQ ID NO: 2989750 - protein, 19 aa, Entamoeba invadens
CKTCPVPFFPGTKGMLESS

SEQ ID NO: 2989751 - protein, 24 aa, Entamoeba invadens
CKTRDGINPLLLEKEMVVFGNPLI

SEQ ID NO: 2989752 - protein, 28 aa, Entamoeba invadens
CKTREVSFHRITEVCLLMLMDVSQFTSM

SEQ ID NO: 2989753 - protein, 21 aa, Entamoeba invadens
CKVCAIGFYPDETSGKCVACS

SEQ ID NO: 2989754 - protein, 18 aa, Entamoeba invadens
CKYIPCIYVVNKIDQMNK

SEQ ID NO: 2989755 - protein, 27 aa, Entamoeba invadens
CLATYTKTRFNSCYLSFSKLLKREKSV

SEQ ID NO: 2989756 - protein, 28 aa, Entamoeba invadens
CLATYTKTRFNSCYLSFSKLLKREKSVK

SEQ ID NO: 2989757 - protein, 17 aa, Entamoeba invadens
CLDKMYPFIKETLPNDV

SEQ ID NO: 2989758 - protein, 18 aa, Entamoeba invadens
CLDLMKKLLTFNPDKRIT

SEQ ID NO: 2989759 - protein, 19 aa, Entamoeba invadens
CLDLVWTLFKKVSEQQMTA

SEQ ID NO: 2989760 - protein, 25 aa, Entamoeba invadens
CLDSKFYPVCQQAVLVSLLNKKYAI

SEQ ID NO: 2989761 - protein, 21 aa, Entamoeba invadens
CLDVPLLLKWTDEYEPLPTDP

SEQ ID NO: 2989762 - protein, 25 aa, Entamoeba invadens
CLEATEMLRFFPKMSLKTLQNKNEI

SEQ ID NO: 2989763 - protein, 24 aa, Entamoeba invadens
CLEEMIKNLKILKSFSFQNQNFFT

SEQ ID NO: 2989764 - protein, 24 aa, Entamoeba invadens
CLELAFNYSNFLRIFFNILAKAQD

SEQ ID NO: 2989765 - protein, 20 aa, Entamoeba invadens
CLELLFQKKQRNLEVGISMF

SEQ ID NO: 2989766 - protein, 19 aa, Entamoeba invadens
CLELLLNTLDFKDKPLDLS

SEQ ID NO: 2989767 - protein, 26 aa, Entamoeba invadens
CLETECLTCKTGFYLNNEKLCSPCSD

SEQ ID NO: 2989768 - protein, 21 aa, Entamoeba invadens
CLETGYLFAIKITFRREKILI

SEQ ID NO: 2989769 - protein, 20 aa, Entamoeba invadens
CLETIQFPTTVLSIGCVCFD

SEQ ID NO: 2989770 - protein, 24 aa, Entamoeba invadens
CLFDALTNWAFSPSGIFVKSLTPE

SEQ ID NO: 2989771 - protein, 17 aa, Entamoeba invadens
CLFHQRQAIRKFINNAG

SEQ ID NO: 2989772 - protein, 17 aa, Entamoeba invadens
CLFSKKEKFELVKENRR

SEQ ID NO: 2989773 - protein, 20 aa, Entamoeba invadens
CLGGLYINPFIDVSVQSFSM

SEQ ID NO: 2989774 - protein, 20 aa, Entamoeba invadens
CLGRKVLTVNQVFEILGEFC

SEQ ID NO: 2989775 - protein, 18 aa, Entamoeba invadens
CLGSFYKTRHRLFVEPFQ

SEQ ID NO: 2989776 - protein, 19 aa, Entamoeba invadens
CLIGYTYRDHTCTQCPDNC

SEQ ID NO: 2989777 - protein, 30 aa, Entamoeba invadens
CLIRHCGQELIPFWDALRDCLDSDGVLLYI

SEQ ID NO: 2989778 - protein, 25 aa, Entamoeba invadens
CLISFYCWEVFFRKLVMRADTCLQQ

SEQ ID NO: 2989779 - protein, 31 aa, Entamoeba invadens
CLIVLIGNGPFKNALFNCWVGKESLRLCVCY

SEQ ID NO: 2989780 - protein, 24 aa, Entamoeba invadens
CLKAKTCVLFKMDLKGKQKLYENS

SEQ ID NO: 2989781 - protein, 19 aa, Entamoeba invadens
CLKDIDFYFEKYLAICEAV

SEQ ID NO: 2989782 - protein, 23 aa, Entamoeba invadens
CLKIPERWFTSKKVLLLQNGEKV

SEQ ID NO: 2989783 - protein, 26 aa, Entamoeba invadens
CLKKEFYQIIVWFTVDFDTFNTNKSL

SEQ ID NO: 2989784 - protein, 26 aa, Entamoeba invadens
CLKKEFYQIIVWFTVDFDTFNTNKSS

SEQ ID NO: 2989785 - protein, 28 aa, Entamoeba invadens
CLKNVYLFFHFIFNFLCNFDQLIQNVKD

SEQ ID NO: 2989786 - protein, 19 aa, Entamoeba invadens
CLLDDLLSTYIQLCVGDMS

SEQ ID NO: 2989787 - protein, 17 aa, Entamoeba invadens
CLLFYSNLEDGSCHLCK

SEQ ID NO: 2989788 - protein, 17 aa, Entamoeba invadens
CLLISFTSNVFPNEYIP

SEQ ID NO: 2989789 - protein, 18 aa, Entamoeba invadens
CLLISYSIKKFPEDYIPT

SEQ ID NO: 2989790 - protein, 17 aa, Entamoeba invadens
CLLISYTTNAFPNEYIP

SEQ ID NO: 2989791 - protein, 17 aa, Entamoeba invadens
CLLLGESGVGKTACVQR

SEQ ID NO: 2989792 - protein, 18 aa, Entamoeba invadens
CLMIPLLNLERCWAYAND

SEQ ID NO: 2989793 - protein, 29 aa, Entamoeba invadens
CLMSSLSLLINPYYPMYPHYSKCVEARDE

SEQ ID NO: 2989794 - protein, 23 aa, Entamoeba invadens
CLNCFIGDIWFLTSNSKIELFHH

SEQ ID NO: 2989795 - protein, 19 aa, Entamoeba invadens
CLNEFESVQLWSQLLIFNC

SEQ ID NO: 2989796 - protein, 23 aa, Entamoeba invadens
CLNMTQFTFSDIKSLPLLCFESC

SEQ ID NO: 2989797 - protein, 22 aa, Entamoeba invadens
CLNQIFVHLTINNLANLAQVSK

SEQ ID NO: 2989798 - protein, 17 aa, Entamoeba invadens
CLNRHLFFTEYPNPLPK

SEQ ID NO: 2989799 - protein, 34 aa, Entamoeba invadens
CLNSCVQWCFIKNFLVIFQFFPTLVNISIFKYPN

SEQ ID NO: 2989800 - protein, 21 aa, Entamoeba invadens
CLNVLPESVFFELTLNRLKMK

SEQ ID NO: 2989801 - protein, 31 aa, Entamoeba invadens
CLPKLLESKIVLFLFKVLFRCDSVYSSSKKQ

SEQ ID NO: 2989802 - protein, 25 aa, Entamoeba invadens
CLPNYVFAYICDSCALFDINCLTCD

SEQ ID NO: 2989803 - protein, 25 aa, Entamoeba invadens
CLQSCQITPIFVFDGAELPSKKMTE

SEQ ID NO: 2989804 - protein, 26 aa, Entamoeba invadens
CLRCGDGYYIFNSLCVKCEYPCTHCS

SEQ ID NO: 2989805 - protein, 17 aa, Entamoeba invadens
CLRVFNNEVKYVFKLLD

SEQ ID NO: 2989806 - protein, 25 aa, Entamoeba invadens
CLSADYNYFFSLFDQICFEVNQNIY

SEQ ID NO: 2989807 - protein, 18 aa, Entamoeba invadens
CLSCRSDVSYLVKGYCVS

SEQ ID NO: 2989808 - protein, 30 aa, Entamoeba invadens
CLSHYKIIQKLMRKAILDKQLVLSTETLEL

SEQ ID NO: 2989809 - protein, 29 aa, Entamoeba invadens
CLSKLDHLVLPSIFFKFVILLINRREIQP

SEQ ID NO: 2989810 - protein, 19 aa, Entamoeba invadens
CLSNCPTFRHLSIPFSVTS

SEQ ID NO: 2989811 - protein, 27 aa, Entamoeba invadens
CLSQGDSILLLRSFKWNLNKMNDVYYD

SEQ ID NO: 2989812 - protein, 18 aa, Entamoeba invadens
CLSRLDLSANFLTDFSYS

SEQ ID NO: 2989813 - protein, 18 aa, Entamoeba invadens
CLTCKDPFIQKSGGCEIC

SEQ ID NO: 2989814 - protein, 17 aa, Entamoeba invadens
CLTCVNKYRPASNGTCI

SEQ ID NO: 2989815 - protein, 24 aa, Entamoeba invadens
CLTKLDRMNLIQGLFHGLMVFKDK

SEQ ID NO: 2989816 - protein, 30 aa, Entamoeba invadens
CLTRIFNKGFLIYYYREHLLGNLALDEKHF

SEQ ID NO: 2989817 - protein, 17 aa, Entamoeba invadens
CLTTISGLPERYDMELI

SEQ ID NO: 2989818 - protein, 19 aa, Entamoeba invadens
CLVDPYFGRLKTVYAFARE

SEQ ID NO: 2989819 - protein, 18 aa, Entamoeba invadens
CLVSLCEILLTTNGKYMK

SEQ ID NO: 2989820 - protein, 19 aa, Entamoeba invadens
CLVTEFALYGSLQDLMKHK

SEQ ID NO: 2989821 - protein, 25 aa, Entamoeba invadens
CLVVSIYHDGTNPVFYFFRDGMKQE

SEQ ID NO: 2989822 - protein, 20 aa, Entamoeba invadens
CLWEQRYTILKSKPQALARL

SEQ ID NO: 2989823 - protein, 25 aa, Entamoeba invadens
CLYFEELDLLINGDTLFRGSMGRTD

SEQ ID NO: 2989824 - protein, 24 aa, Entamoeba invadens
CMDKAAVLAFYLILIDRTSEEYVN

SEQ ID NO: 2989825 - protein, 37 aa, Entamoeba invadens
CMGKFVIVVCDNFFCSLRLVHYLAQYGSTLLGTVRKN

SEQ ID NO: 2989826 - protein, 25 aa, Entamoeba invadens
CMGNLRLAHYLAQYGSTLLGTVRKN

SEQ ID NO: 2989827 - protein, 23 aa, Entamoeba invadens
CMKQEMVCPIKRAYGKFLNKFEK

SEQ ID NO: 2989828 - protein, 19 aa, Entamoeba invadens
CMLHPPIQKWTFTYNQLIH

SEQ ID NO: 2989829 - protein, 19 aa, Entamoeba invadens
CMNRFKLLVTYLRDSYGCK

SEQ ID NO: 2989830 - protein, 25 aa, Entamoeba invadens
CMVFGVMQLYRKRGLYYLNYIPTET

SEQ ID NO: 2989831 - protein, 25 aa, Entamoeba invadens
CNCDSIYNFTLYQNVTKLQIDCIGN

SEQ ID NO: 2989832 - protein, 23 aa, Entamoeba invadens
CNCFKNCHKLRNINIPYSVQMLE

SEQ ID NO: 2989833 - protein, 28 aa, Entamoeba invadens
CNDIQNLPDLLFINLTRLQSLESATNQI

SEQ ID NO: 2989834 - protein, 26 aa, Entamoeba invadens
CNDLMTFGIDILKFQKVHSIDEGAFF

SEQ ID NO: 2989835 - protein, 18 aa, Entamoeba invadens
CNDNEYPAWETTPKPHVK

SEQ ID NO: 2989836 - protein, 28 aa, Entamoeba invadens
CNDYIEDYYLVPINDVYMIFVRSELSKG

SEQ ID NO: 2989837 - protein, 25 aa, Entamoeba invadens
CNEETFVNFFITPDAYIMEFCPKYI

SEQ ID NO: 2989838 - protein, 27 aa, Entamoeba invadens
CNEETYKRFMYFICKDFISHRKSYVFC

SEQ ID NO: 2989839 - protein, 19 aa, Entamoeba invadens
CNEGYILNNTDCVKCDEKC

SEQ ID NO: 2989840 - protein, 29 aa, Entamoeba invadens
CNERPEVLQPLLNPIQADNPQLAQMIQAN

SEQ ID NO: 2989841 - protein, 21 aa, Entamoeba invadens
CNFDDGPLRYSEAIISIFCAE

SEQ ID NO: 2989842 - protein, 20 aa, Entamoeba invadens
CNFVAPFEFMKNNLMLNVVE

SEQ ID NO: 2989843 - protein, 24 aa, Entamoeba invadens
CNGCIDNYIPYLVNNRSCQACSSF

SEQ ID NO: 2989844 - protein, 25 aa, Entamoeba invadens
CNGKIDALWLWVNGTDPTWITKLKK

SEQ ID NO: 2989845 - protein, 17 aa, Entamoeba invadens
CNGKLDNKYALEKTLTT

SEQ ID NO: 2989846 - protein, 25 aa, Entamoeba invadens
CNGRIDALWLWVNGTDPTWISKYKK

SEQ ID NO: 2989847 - protein, 26 aa, Entamoeba invadens
CNGTITYRLFLNYLKTKKYSEALNLV

SEQ ID NO: 2989848 - protein, 18 aa, Entamoeba invadens
CNGYSIKLLLFDLKTTKS

SEQ ID NO: 2989849 - protein, 29 aa, Entamoeba invadens
CNIKAIYTINMEGVFFLKLEQDKMVFANE

SEQ ID NO: 2989850 - protein, 21 aa, Entamoeba invadens
CNIPFKCKYLSPILKNYNVCP

SEQ ID NO: 2989851 - protein, 20 aa, Entamoeba invadens
CNITNIKTLKFVKVMQRKVC

SEQ ID NO: 2989852 - protein, 24 aa, Entamoeba invadens
CNKHKLFYVYDQIGSFLFEMFTSF

SEQ ID NO: 2989853 - protein, 18 aa, Entamoeba invadens
CNKNYYFENEKCSLSKEG

SEQ ID NO: 2989854 - protein, 21 aa, Entamoeba invadens
CNKSHLLVDNIQLHVEKFKGC

SEQ ID NO: 2989855 - protein, 18 aa, Entamoeba invadens
CNKYYFEVQLRHINNPNP

SEQ ID NO: 2989856 - protein, 24 aa, Entamoeba invadens
CNLLGKFELSGIPPAPRGVPQVEV

SEQ ID NO: 2989857 - protein, 20 aa, Entamoeba invadens
CNLLIDLALFYGEQDEITFQ

SEQ ID NO: 2989858 - protein, 19 aa, Entamoeba invadens
CNLLTHSPLTNVLQLLPRQ

SEQ ID NO: 2989859 - protein, 27 aa, Entamoeba invadens
CNNEEVRLLRQKIFRIKRGEGDDLIIL

SEQ ID NO: 2989860 - protein, 22 aa, Entamoeba invadens
CNNIKIFVPQFMKLELEDVLSI

SEQ ID NO: 2989861 - protein, 18 aa, Entamoeba invadens
CNNLREIVLPKSLSFISK

SEQ ID NO: 2989862 - protein, 17 aa, Entamoeba invadens
CNNLSNIIIPSSVTFIG

SEQ ID NO: 2989863 - protein, 30 aa, Entamoeba invadens
CNNTEQIVLLIGLWVVAYIEEKNKTRALVD

SEQ ID NO: 2989864 - protein, 19 aa, Entamoeba invadens
CNPLLKIPYEFFEESTSLY

SEQ ID NO: 2989865 - protein, 26 aa, Entamoeba invadens
CNQLQKLPFSLFSLEKLVNLVISRND

SEQ ID NO: 2989866 - protein, 22 aa, Entamoeba invadens
CNQMCFPPPPFGRFGGWERRRR

SEQ ID NO: 2989867 - protein, 18 aa, Entamoeba invadens
CNQYVRILKQGHSKFRDV

SEQ ID NO: 2989868 - protein, 25 aa, Entamoeba invadens
CNSEITESIPWFFEHFDSEHFTIWF

SEQ ID NO: 2989869 - protein, 17 aa, Entamoeba invadens
CNSGYYIVNGKCRQCDY

SEQ ID NO: 2989870 - protein, 19 aa, Entamoeba invadens
CNSKELLLYVLDQFVKVEN

SEQ ID NO: 2989871 - protein, 18 aa, Entamoeba invadens
CNSNYFLANGVCQQTTRC

SEQ ID NO: 2989872 - protein, 22 aa, Entamoeba invadens
CNTDDFVYKMLRLSVLNHIGFG

SEQ ID NO: 2989873 - protein, 23 aa, Entamoeba invadens
CNVHLIDAPILFSKFDESKMMLY

SEQ ID NO: 2989874 - protein, 18 aa, Entamoeba invadens
CNVNCKLFVACMFFTQIV

SEQ ID NO: 2989875 - protein, 25 aa, Entamoeba invadens
CNYNLFVYMISFIKEVLKKNGELVS

SEQ ID NO: 2989876 - protein, 28 aa, Entamoeba invadens
CNYVLCRTLDTLFKLLILDTFSSVDSDS

SEQ ID NO: 2989877 - protein, 23 aa, Entamoeba invadens
CPALSFKQIFDIIAKFEPPVNIV

SEQ ID NO: 2989878 - protein, 17 aa, Entamoeba invadens
CPASFLLRCDTLKEYTG

SEQ ID NO: 2989879 - protein, 21 aa, Entamoeba invadens
CPASFLLRCDTLNEYTGNYGE

SEQ ID NO: 2989880 - protein, 29 aa, Entamoeba invadens
CPDLEDGTILMRFVEQITTNFYPKPHVVK

SEQ ID NO: 2989881 - protein, 22 aa, Entamoeba invadens
CPEFICLVCELFARLSSVRSQT

SEQ ID NO: 2989882 - protein, 30 aa, Entamoeba invadens
CPIYTYESLVALWTLLSNKEKFIHLLQENR

SEQ ID NO: 2989883 - protein, 21 aa, Entamoeba invadens
CPKCWPLLVSASNLLNFVLVT

SEQ ID NO: 2989884 - protein, 29 aa, Entamoeba invadens
CPKGDPLEHLIWLHAWKYSIEGKTWVANV

SEQ ID NO: 2989885 - protein, 17 aa, Entamoeba invadens
CPLCKKPSELHSGISVC

SEQ ID NO: 2989886 - protein, 22 aa, Entamoeba invadens
CPMKIKMCDFGFATKTLKKMVH

SEQ ID NO: 2989887 - protein, 28 aa, Entamoeba invadens
CPPKYLDILMEYIFFLCSFDGSSLVQNQ

SEQ ID NO: 2989888 - protein, 32 aa, Entamoeba invadens
CPQVNAMFWERYIVFYVNSTLWNSVFLTRLQK

SEQ ID NO: 2989889 - protein, 24 aa, Entamoeba invadens
CPRNIYLIIVIIDKIFKIESEEKK

SEQ ID NO: 2989890 - protein, 27 aa, Entamoeba invadens
CPSRIFTMLCFFLEALTRPDKPARNVL

SEQ ID NO: 2989891 - protein, 24 aa, Entamoeba invadens
CPTVRSLLVVLIYHVFVMGHQTSK

SEQ ID NO: 2989892 - protein, 24 aa, Entamoeba invadens
CPTVRSLLVVLIYRVIAMGHQPSK

SEQ ID NO: 2989893 - protein, 18 aa, Entamoeba invadens
CPYSLPSTMVMPCLKCSR

SEQ ID NO: 2989894 - protein, 17 aa, Entamoeba invadens
CPYTAIIKKTIPCMAAC

SEQ ID NO: 2989895 - protein, 31 aa, Entamoeba invadens
CPYYCSRRNFFKSPFIVCTYNYLVDPKVENV

SEQ ID NO: 2989896 - protein, 18 aa, Entamoeba invadens
CQASVSIKVYLIGEFLRG

SEQ ID NO: 2989897 - protein, 26 aa, Entamoeba invadens
CQCCVMDLEFNIPYYVRDAALAQVNA

SEQ ID NO: 2989898 - protein, 26 aa, Entamoeba invadens
CQCFKWGDVYLNKHFKFPWQIAEFVS

SEQ ID NO: 2989899 - protein, 23 aa, Entamoeba invadens
CQKAEFFKIGRLLWGVGVDNYKA

SEQ ID NO: 2989900 - protein, 25 aa, Entamoeba invadens
CQKRTFFMTPFPKVKTTRLVIMILQ

SEQ ID NO: 2989901 - protein, 24 aa, Entamoeba invadens
CQKYGGFYLGAIGGAAALLAEKNI

SEQ ID NO: 2989902 - protein, 30 aa, Entamoeba invadens
CQLSFETFNFSHFCLISQPVLSFLSTGKST

SEQ ID NO: 2989903 - protein, 19 aa, Entamoeba invadens
CQMVKDMQLNKLFIDCSEA

SEQ ID NO: 2989904 - protein, 21 aa, Entamoeba invadens
CQNEILNLDLYLSKQPFDGTA

SEQ ID NO: 2989905 - protein, 28 aa, Entamoeba invadens
CQRKAKINGLFRTLQLFNVTTTEFHNQF

SEQ ID NO: 2989906 - protein, 21 aa, Entamoeba invadens
CQSIYSGYRTQFWNANYNSGY

SEQ ID NO: 2989907 - protein, 29 aa, Entamoeba invadens
CQSKELYFIPDVATLRKFTLVFPIAQITK

SEQ ID NO: 2989908 - protein, 28 aa, Entamoeba invadens
CQTTKEFNILFWRYLTQVQPFSSRDVVP

SEQ ID NO: 2989909 - protein, 29 aa, Entamoeba invadens
CRAAASFKKLPLYKYLNELTNHKEMSMPV

SEQ ID NO: 2989910 - protein, 25 aa, Entamoeba invadens
CRAHQLIQEGFKWMLDNKIVTVWSA

SEQ ID NO: 2989911 - protein, 24 aa, Entamoeba invadens
CRDKPPFYGYVKRSMNRAPGPNDF

SEQ ID NO: 2989912 - protein, 32 aa, Entamoeba invadens
CREAFNRAPFPKIPVLHLWLADLARISELPTF

SEQ ID NO: 2989913 - protein, 18 aa, Entamoeba invadens
CREKGILPWLCPDAKTQV

SEQ ID NO: 2989914 - protein, 20 aa, Entamoeba invadens
CRELENLSLFKTLSLQQIEV

SEQ ID NO: 2989915 - protein, 29 aa, Entamoeba invadens
CRERYFNSLMFKSQKRPWLSYEDTIIIQT

SEQ ID NO: 2989916 - protein, 18 aa, Entamoeba invadens
CRFFLGYIDDTDLHNNLH

SEQ ID NO: 2989917 - protein, 23 aa, Entamoeba invadens
CRIIMKQMFSALGYLHSHNIVHR

SEQ ID NO: 2989918 - protein, 28 aa, Entamoeba invadens
CRINTIVPLIPRYSNPSIFKFLKCPINS

SEQ ID NO: 2989919 - protein, 17 aa, Entamoeba invadens
CRLFELRNRPPISVAAA

SEQ ID NO: 2989920 - protein, 20 aa, Entamoeba invadens
CRLIAKCTCGVSKVVNCTHN

SEQ ID NO: 2989921 - protein, 26 aa, Entamoeba invadens
CRLNVVLTCPAYFNDLQRDLTMRAAQ

SEQ ID NO: 2989922 - protein, 20 aa, Entamoeba invadens
CRLVAKCTCGVSKVVNCTHN

SEQ ID NO: 2989923 - protein, 18 aa, Entamoeba invadens
CRNFGNFIMFVFAASEGA

SEQ ID NO: 2989924 - protein, 25 aa, Entamoeba invadens
CRNMTYKRLLCMHEHINNLGSNNFE

SEQ ID NO: 2989925 - protein, 20 aa, Entamoeba invadens
CRNPYKILLSTDNITPVSLV

SEQ ID NO: 2989926 - protein, 17 aa, Entamoeba invadens
CRTYLTDKTLFQVFDHK

SEQ ID NO: 2989927 - protein, 17 aa, Entamoeba invadens
CSALPESALPKIPETTK

SEQ ID NO: 2989928 - protein, 18 aa, Entamoeba invadens
CSCARVTLRLIKETIRMN

SEQ ID NO: 2989929 - protein, 31 aa, Entamoeba invadens
CSCHTLASLFKLFLRELPNPVIPSKFYDNFV

SEQ ID NO: 2989930 - protein, 31 aa, Entamoeba invadens
CSCNTIAGLFKLFLRELPTPIIPTNCYDFFV

SEQ ID NO: 2989931 - protein, 23 aa, Entamoeba invadens
CSCPLLRKVTLPTTINTLKTQCF

SEQ ID NO: 2989932 - protein, 23 aa, Entamoeba invadens
CSDEFLLTTLPPKKINQKLEEIV

SEQ ID NO: 2989933 - protein, 19 aa, Entamoeba invadens
CSDVFSPRRLTPRKTHVVH

SEQ ID NO: 2989934 - protein, 24 aa, Entamoeba invadens
CSDYLFKILLIGDSGVGKSCLLLR

SEQ ID NO: 2989935 - protein, 23 aa, Entamoeba invadens
CSEFDPYCSKCALDFTRKCELCS

SEQ ID NO: 2989936 - protein, 23 aa, Entamoeba invadens
CSEKWKEWLVVDPKPDNTWDYQS

SEQ ID NO: 2989937 - protein, 23 aa, Entamoeba invadens
CSEMALGVNWLHSAIGLVHRDLK

SEQ ID NO: 2989938 - protein, 24 aa, Entamoeba invadens
CSERSIYPIPTTAFARDILIDSSY

SEQ ID NO: 2989939 - protein, 30 aa, Entamoeba invadens
CSFVYNGVANPLFWNWKNASFKSKGVPVFM

SEQ ID NO: 2989940 - protein, 20 aa, Entamoeba invadens
CSGKHRGLGVHLSFVRSIDM

SEQ ID NO: 2989941 - protein, 18 aa, Entamoeba invadens
CSIDFPYDKPLSPPANNS

SEQ ID NO: 2989942 - protein, 17 aa, Entamoeba invadens
CSIKVGFQRHIAVVMPS

SEQ ID NO: 2989943 - protein, 26 aa, Entamoeba invadens
CSIYKAKVLLVFPQKNRYLVRLAKST

SEQ ID NO: 2989944 - protein, 22 aa, Entamoeba invadens
CSKLEIIGLPQNLMKIGENCFA

SEQ ID NO: 2989945 - protein, 17 aa, Entamoeba invadens
CSKLHLVLRLRGGGISQ

SEQ ID NO: 2989946 - protein, 25 aa, Entamoeba invadens
CSKYRMPLPPLNLLERGCSACFDRL

SEQ ID NO: 2989947 - protein, 32 aa, Entamoeba invadens
CSLETRKCFKCLDGFYLLSGQCALCNKTTQKC

SEQ ID NO: 2989948 - protein, 23 aa, Entamoeba invadens
CSLLEKVLCIPSLRDVTIYFSQT

SEQ ID NO: 2989949 - protein, 21 aa, Entamoeba invadens
CSLRKTPLLEIIQIEPARSES

SEQ ID NO: 2989950 - protein, 18 aa, Entamoeba invadens
CSNDCPTGYFADNQKCLK

SEQ ID NO: 2989951 - protein, 24 aa, Entamoeba invadens
CSNGGFPVITAFTATGKALEVTVW

SEQ ID NO: 2989952 - protein, 25 aa, Entamoeba invadens
CSNLENIVFPNYLNSFTPNPLAEQN

SEQ ID NO: 2989953 - protein, 18 aa, Entamoeba invadens
CSPPISGIVNRMYYHGLL

SEQ ID NO: 2989954 - protein, 18 aa, Entamoeba invadens
CSPRKSIHLIQKIDILNS

SEQ ID NO: 2989955 - protein, 20 aa, Entamoeba invadens
CSQLFKTVFIVFGNHDFYNF

SEQ ID NO: 2989956 - protein, 22 aa, Entamoeba invadens
CSQNCYLFCYPHLKEKKDEQTP

SEQ ID NO: 2989957 - protein, 22 aa, Entamoeba invadens
CSQNDLILICKSLGLMKGDNHM

SEQ ID NO: 2989958 - protein, 28 aa, Entamoeba invadens
CSQTRKFCGLFFAFLPNNIYEIDAVANY

SEQ ID NO: 2989959 - protein, 17 aa, Entamoeba invadens
CSRDKSVWLWKSYTGSD

SEQ ID NO: 2989960 - protein, 24 aa, Entamoeba invadens
CSRNFGLGTLIPWDKRYLIESLSD

SEQ ID NO: 2989961 - protein, 22 aa, Entamoeba invadens
CSRNIPTWRQCLVERSWRSSNS

SEQ ID NO: 2989962 - protein, 18 aa, Entamoeba invadens
CSSDNKKCLKCEDGFVLV

SEQ ID NO: 2989963 - protein, 17 aa, Entamoeba invadens
CSSKLFGFYKEMVTFTK

SEQ ID NO: 2989964 - protein, 21 aa, Entamoeba invadens
CSSLISITIPSSVTSIGDCCF

SEQ ID NO: 2989965 - protein, 27 aa, Entamoeba invadens
CSSLQTIYIPLFVLKLNSTFCNCSALR

SEQ ID NO: 2989966 - protein, 21 aa, Entamoeba invadens
CSSLSIVFIPSSVKSIGAFCF

SEQ ID NO: 2989967 - protein, 18 aa, Entamoeba invadens
CSSVLLRTLIMLENKPMG

SEQ ID NO: 2989968 - protein, 31 aa, Entamoeba invadens
CSTAQPFIQILYIIVLKRPDLFTTKTAQKLT

SEQ ID NO: 2989969 - protein, 19 aa, Entamoeba invadens
CSTCNTFLRCLTCNSTNYK

SEQ ID NO: 2989970 - protein, 17 aa, Entamoeba invadens
CSTFTVPDLLPNEAFEV

SEQ ID NO: 2989971 - protein, 23 aa, Entamoeba invadens
CSTPQRLQSIIQYSLCDIPSSQT

SEQ ID NO: 2989972 - protein, 23 aa, Entamoeba invadens
CSTYLIGLPYFQIASVLDITVTV

SEQ ID NO: 2989973 - protein, 26 aa, Entamoeba invadens
CSVEAFDIFVAFLKMYRTMNHTELLQ

SEQ ID NO: 2989974 - protein, 25 aa, Entamoeba invadens
CSVNNIKWIRFLERLSPRENDSSEY

SEQ ID NO: 2989975 - protein, 25 aa, Entamoeba invadens
CSVVIQLLFHHHATMGLTGQVQFSI

SEQ ID NO: 2989976 - protein, 29 aa, Entamoeba invadens
CSYVRDAFHVLLLYRMTLGRCTKLDNLHE

SEQ ID NO: 2989977 - protein, 23 aa, Entamoeba invadens
CTAGVVVIFGRFLICGNVGDTEI

SEQ ID NO: 2989978 - protein, 23 aa, Entamoeba invadens
CTDLFQFFMMTVFKHLNGEGYNM

SEQ ID NO: 2989979 - protein, 27 aa, Entamoeba invadens
CTDLKPDFILFSSLLHLHDPEGASSAL

SEQ ID NO: 2989980 - protein, 29 aa, Entamoeba invadens
CTDLSLIEKRQLMKFLNDIYLDKDTPIEQ

SEQ ID NO: 2989981 - protein, 24 aa, Entamoeba invadens
CTDNIYCCLCAGKAKLQEDKKNVT

SEQ ID NO: 2989982 - protein, 23 aa, Entamoeba invadens
CTELTIYRNFARFGAIESANCLF

SEQ ID NO: 2989983 - protein, 17 aa, Entamoeba invadens
CTEQLFIPENYGKEING

SEQ ID NO: 2989984 - protein, 22 aa, Entamoeba invadens
CTGALYPLPDIIYTSLGCIDID

SEQ ID NO: 2989985 - protein, 17 aa, Entamoeba invadens
CTGFEIYVTHEPCLFCG

SEQ ID NO: 2989986 - protein, 25 aa, Entamoeba invadens
CTGLDPIPGTILITSARLIFRVQRQ

SEQ ID NO: 2989987 - protein, 19 aa, Entamoeba invadens
CTGVILQVRITNKAARHLY

SEQ ID NO: 2989988 - protein, 24 aa, Entamoeba invadens
CTHNKLYVLPPGMSALKSIDTLDF

SEQ ID NO: 2989989 - protein, 26 aa, Entamoeba invadens
CTIEIRGKCPIIGKKNMKYIIPNNVT

SEQ ID NO: 2989990 - protein, 17 aa, Entamoeba invadens
CTIPLKGKGTAVCWNEK

SEQ ID NO: 2989991 - protein, 17 aa, Entamoeba invadens
CTIRHRKVPYKVYRPKI

SEQ ID NO: 2989992 - protein, 17 aa, Entamoeba invadens
CTKLLCLLNGKAWNEEV

SEQ ID NO: 2989993 - protein, 28 aa, Entamoeba invadens
CTKSIFEGILITLKYFYTSEAFTELVIK

SEQ ID NO: 2989994 - protein, 18 aa, Entamoeba invadens
CTLILSSLPSDVCYNDII

SEQ ID NO: 2989995 - protein, 23 aa, Entamoeba invadens
CTLISLEKQPELFRYWHEHDQTK

SEQ ID NO: 2989996 - protein, 21 aa, Entamoeba invadens
CTLSLVCKKFRHVMGQLTSNP

SEQ ID NO: 2989997 - protein, 17 aa, Entamoeba invadens
CTMLSFIEIPTSVKSME

SEQ ID NO: 2989998 - protein, 18 aa, Entamoeba invadens
CTMQLPLMVSRAAFNLPY

SEQ ID NO: 2989999 - protein, 17 aa, Entamoeba invadens
CTNLHINFPTTLKCFDK

SEQ ID NO: 2990000 - protein, 22 aa, Entamoeba invadens
CTPHAIRVCGYTGKQLVLNDEK

SEQ ID NO: 2990001 - protein, 27 aa, Entamoeba invadens
CTPPNKPAMTPPLPFSSPENKPFGSKS

SEQ ID NO: 2990002 - protein, 19 aa, Entamoeba invadens
CTQLKHLNFPESVNFIGER

SEQ ID NO: 2990003 - protein, 24 aa, Entamoeba invadens
CTQYLTKTLLVKTGFTKLQTFISS

SEQ ID NO: 2990004 - protein, 39 aa, Entamoeba invadens
CTRGKMTHNLLYPWKIYVYDALTEVYVWVGPKSSQTLRK

SEQ ID NO: 2990005 - protein, 26 aa, Entamoeba invadens
CTRLKKINLPPLVTKLPIKGFLNCDS

SEQ ID NO: 2990006 - protein, 24 aa, Entamoeba invadens
CTSCAEGYYLYQVSSISSCIACPI

SEQ ID NO: 2990007 - protein, 24 aa, Entamoeba invadens
CTSLKTIKLPSLLTSLKKSTFFDC

SEQ ID NO: 2990008 - protein, 18 aa, Entamoeba invadens
CTSLTKLVVPFEYMKRVY

SEQ ID NO: 2990009 - protein, 24 aa, Entamoeba invadens
CTSPDLFRDFIWGHRLFATTQEVL

SEQ ID NO: 2990010 - protein, 29 aa, Entamoeba invadens
CTSRWNERILYDLLDIAALNDYKVYHHYH

SEQ ID NO: 2990011 - protein, 19 aa, Entamoeba invadens
CTSSFLVKTIFLKITKIVS

SEQ ID NO: 2990012 - protein, 22 aa, Entamoeba invadens
CTSYIKVEIGFFARPTQVSIEA

SEQ ID NO: 2990013 - protein, 31 aa, Entamoeba invadens
CTTEFPFAIDIWSIGCVFYTLLTGVILFEAN

SEQ ID NO: 2990014 - protein, 24 aa, Entamoeba invadens
CTTTAPRMPLLFVWENDMDALSNA

SEQ ID NO: 2990015 - protein, 23 aa, Entamoeba invadens
CTVCKKGMYPSTTSPFTCVGCDS

SEQ ID NO: 2990016 - protein, 29 aa, Entamoeba invadens
CTVDYLFNSAYFPPFNQPSVKVFHTSTLF

SEQ ID NO: 2990017 - protein, 23 aa, Entamoeba invadens
CTVKLHDLTTIFKLKKGELIKKS

SEQ ID NO: 2990018 - protein, 17 aa, Entamoeba invadens
CTYGSLHNIIIPPDYIE

SEQ ID NO: 2990019 - protein, 43 aa, Entamoeba invadens
CVADRKFHVKILPHKFCWRVKNDLYICVKDITVFTHLNGKNYA

SEQ ID NO: 2990020 - protein, 30 aa, Entamoeba invadens
CVADVWSLGVLFYALLFGTMPFPGDTELEI

SEQ ID NO: 2990021 - protein, 30 aa, Entamoeba invadens
CVALSEVGEVVLTFLHLMDQLQIDLDNCIV

SEQ ID NO: 2990022 - protein, 25 aa, Entamoeba invadens
CVCKKYQHLLDRFRYNPISVVSTRL

SEQ ID NO: 2990023 - protein, 28 aa, Entamoeba invadens
CVDAKKRILKILFLETISSFLMNKVMIR

SEQ ID NO: 2990024 - protein, 23 aa, Entamoeba invadens
CVDGKLCLTCKIEYFKLSGMENK

SEQ ID NO: 2990025 - protein, 18 aa, Entamoeba invadens
CVDGYYPDDGKCKSCLTI

SEQ ID NO: 2990026 - protein, 18 aa, Entamoeba invadens
CVDGYYPDEGKCKSCLTI

SEQ ID NO: 2990027 - protein, 17 aa, Entamoeba invadens
CVDLDFGCFLCVKCMKD

SEQ ID NO: 2990028 - protein, 17 aa, Entamoeba invadens
CVDLTDTSLLTFARAIS

SEQ ID NO: 2990029 - protein, 18 aa, Entamoeba invadens
CVDPFLKKFETLKFDFKL

SEQ ID NO: 2990030 - protein, 30 aa, Entamoeba invadens
CVESVETLYFVYKLFDSKSPLFEFLQILVD

SEQ ID NO: 2990031 - protein, 27 aa, Entamoeba invadens
CVFEKGKIALLLLYVISKNKDYGDPKV

SEQ ID NO: 2990032 - protein, 18 aa, Entamoeba invadens
CVFGVYRGKRYIVDYINK

SEQ ID NO: 2990033 - protein, 18 aa, Entamoeba invadens
CVGGVPYFPKGMEYPMAD

SEQ ID NO: 2990034 - protein, 18 aa, Entamoeba invadens
CVGVFFTHGHFDHVVGST

SEQ ID NO: 2990035 - protein, 23 aa, Entamoeba invadens
CVHQSVQFLVRMMELLTTGFMKS

SEQ ID NO: 2990036 - protein, 26 aa, Entamoeba invadens
CVHYKNIVVMLLIEKNALQGNIVRCS

SEQ ID NO: 2990037 - protein, 25 aa, Entamoeba invadens
CVHYRSEYFIFVLNKLVNTPTEIQK

SEQ ID NO: 2990038 - protein, 18 aa, Entamoeba invadens
CVICSSGSYVHQEYCRPC

SEQ ID NO: 2990039 - protein, 25 aa, Entamoeba invadens
CVIERLWDILTPTGVAYIVLVQDNN

SEQ ID NO: 2990040 - protein, 19 aa, Entamoeba invadens
CVIKKVLFPPSVKALQFNN

SEQ ID NO: 2990041 - protein, 17 aa, Entamoeba invadens
CVIMYCVLFLNKVVYNY

SEQ ID NO: 2990042 - protein, 22 aa, Entamoeba invadens
CVIPELFGTIPLFAANSAKKIT

SEQ ID NO: 2990043 - protein, 18 aa, Entamoeba invadens
CVIRYLSFMDTNTVEYIV

SEQ ID NO: 2990044 - protein, 18 aa, Entamoeba invadens
CVIVPMLYDIDTGVASVL

SEQ ID NO: 2990045 - protein, 17 aa, Entamoeba invadens
CVKLSLKYNVLSKYTTF

SEQ ID NO: 2990046 - protein, 26 aa, Entamoeba invadens
CVKNDVIPVPPFIMKEKYIFESALHD

SEQ ID NO: 2990047 - protein, 22 aa, Entamoeba invadens
CVKSDIFVYGYTGRLVEISEKQ

SEQ ID NO: 2990048 - protein, 23 aa, Entamoeba invadens
CVLCLIEYYLKDLQCLKCYEILT

SEQ ID NO: 2990049 - protein, 34 aa, Entamoeba invadens
CVLGLLTLFYPFYWPGIFIPYVPDILFEFFETPV

SEQ ID NO: 2990050 - protein, 17 aa, Entamoeba invadens
CVLIQNLSTGKYLGVAK

SEQ ID NO: 2990051 - protein, 17 aa, Entamoeba invadens
CVLISILNKFHTFVVQR

SEQ ID NO: 2990052 - protein, 17 aa, Entamoeba invadens
CVLLRFDSGDMLAIDTL

SEQ ID NO: 2990053 - protein, 28 aa, Entamoeba invadens
CVLNKHSLFIILFDKKGNIFGAYLRKSV

SEQ ID NO: 2990054 - protein, 28 aa, Entamoeba invadens
CVLTKEFFCIIVWFAVDFKTVNTNKSRN

SEQ ID NO: 2990055 - protein, 17 aa, Entamoeba invadens
CVLVKKSKYWKVHNAEV

SEQ ID NO: 2990056 - protein, 18 aa, Entamoeba invadens
CVMCNTGYYPNEIGVCVQ

SEQ ID NO: 2990057 - protein, 24 aa, Entamoeba invadens
CVMKETKLDDNLEIKRIADEIKNK

SEQ ID NO: 2990058 - protein, 30 aa, Entamoeba invadens
CVMKTQNWKLMPTSGLFKLGITTFYGQTKN

SEQ ID NO: 2990059 - protein, 18 aa, Entamoeba invadens
CVMMVFSLLISRDAKLKQ

SEQ ID NO: 2990060 - protein, 18 aa, Entamoeba invadens
CVMVFHKNGVFGYYQEDA

SEQ ID NO: 2990061 - protein, 19 aa, Entamoeba invadens
CVNHIGYHAFMNCVSLPNF

SEQ ID NO: 2990062 - protein, 17 aa, Entamoeba invadens
CVNIASFLCKVHYSYLV

SEQ ID NO: 2990063 - protein, 23 aa, Entamoeba invadens
CVNKFTYSKVEKWLLGYKSLQVD

SEQ ID NO: 2990064 - protein, 18 aa, Entamoeba invadens
CVNVYIKKEILELGFDVV

SEQ ID NO: 2990065 - protein, 25 aa, Entamoeba invadens
CVPEDISLLAFLISKSVKQNIKMLY

SEQ ID NO: 2990066 - protein, 17 aa, Entamoeba invadens
CVPIYEGFSLPHAILRI

SEQ ID NO: 2990067 - protein, 25 aa, Entamoeba invadens
CVPNIPLPIMFCKSVVMNGIANATV

SEQ ID NO: 2990068 - protein, 19 aa, Entamoeba invadens
CVPVYEGVVLREGIRPIKV

SEQ ID NO: 2990069 - protein, 18 aa, Entamoeba invadens
CVQLGWDMMYAVFAAIVD

SEQ ID NO: 2990070 - protein, 26 aa, Entamoeba invadens
CVQRYKDILNFVPKAYYIVKVNVNDL

SEQ ID NO: 2990071 - protein, 17 aa, Entamoeba invadens
CVRSLAFGCFQSCKNLS

SEQ ID NO: 2990072 - protein, 18 aa, Entamoeba invadens
CVSFYAFEFSNLNHIEFV

SEQ ID NO: 2990073 - protein, 30 aa, Entamoeba invadens
CVSHEPPFGILDYGLRWRQLIHGGVFHAGS

SEQ ID NO: 2990074 - protein, 21 aa, Entamoeba invadens
CVSHFMTPAPFFNIMNDDKFD

SEQ ID NO: 2990075 - protein, 18 aa, Entamoeba invadens
CVSLKELLLPNLLVEVCE

SEQ ID NO: 2990076 - protein, 21 aa, Entamoeba invadens
CVSLQSINLFADLLLCPQEVE

SEQ ID NO: 2990077 - protein, 19 aa, Entamoeba invadens
CVSNLIGVQILSMSKRIMN

SEQ ID NO: 2990078 - protein, 30 aa, Entamoeba invadens
CVSVYQTRYHYMPQISIFPDNKFAIKYIDK

SEQ ID NO: 2990079 - protein, 19 aa, Entamoeba invadens
CVTCQFQPFQLPSTQKPYV

SEQ ID NO: 2990080 - protein, 19 aa, Entamoeba invadens
CVTCRTSGMYPSDSTYKCV

SEQ ID NO: 2990081 - protein, 18 aa, Entamoeba invadens
CVTCSQTEKYQCISCVDR

SEQ ID NO: 2990082 - protein, 26 aa, Entamoeba invadens
CVTLEHFGLPPKFYRKCQLSPTPSYE

SEQ ID NO: 2990083 - protein, 21 aa, Entamoeba invadens
CVTRTEFIGGLELLKKGKVSD

SEQ ID NO: 2990084 - protein, 17 aa, Entamoeba invadens
CVVIPELLIGSVFPRVE

SEQ ID NO: 2990085 - protein, 33 aa, Entamoeba invadens
CVVKDYLRALPEPLIPFDLYQDFIAIPTRKDGK

SEQ ID NO: 2990086 - protein, 25 aa, Entamoeba invadens
CVVKMNFAFLAALMKWKREKDEEER

SEQ ID NO: 2990087 - protein, 18 aa, Entamoeba invadens
CVVPLLRLEFHKTVLNLL

SEQ ID NO: 2990088 - protein, 18 aa, Entamoeba invadens
CVWPSNHQMMVFGVKRFI

SEQ ID NO: 2990089 - protein, 19 aa, Entamoeba invadens
CVYALPPSIRGTWWFPLLS

SEQ ID NO: 2990090 - protein, 17 aa, Entamoeba invadens
CVYLARKVKKSGIDIQN

SEQ ID NO: 2990091 - protein, 26 aa, Entamoeba invadens
CVYQLFANYHKLPVLDFNYVTIVSNL

SEQ ID NO: 2990092 - protein, 17 aa, Entamoeba invadens
CWDIKNQNLKLLLHFED

SEQ ID NO: 2990093 - protein, 18 aa, Entamoeba invadens
CWDLRHTIANIGWRVPTH

SEQ ID NO: 2990094 - protein, 19 aa, Entamoeba invadens
CWGCLYSESKACSDIYLFD

SEQ ID NO: 2990095 - protein, 31 aa, Entamoeba invadens
CWKALIPRVDILFNFYDFSNQLKEIFTQIIQ

SEQ ID NO: 2990096 - protein, 25 aa, Entamoeba invadens
CWKCLLQFFVLCPAPHKCPVCNAII

SEQ ID NO: 2990097 - protein, 17 aa, Entamoeba invadens
CWKFRTTVEQYIIKMAT

SEQ ID NO: 2990098 - protein, 20 aa, Entamoeba invadens
CWVGKESLRLCVCYEQLLSF

SEQ ID NO: 2990099 - protein, 19 aa, Entamoeba invadens
CYCFSNCELLVSVSLPDCV

SEQ ID NO: 2990100 - protein, 25 aa, Entamoeba invadens
CYCGVFHYFEVLVPQIIVILSKIDK

SEQ ID NO: 2990101 - protein, 19 aa, Entamoeba invadens
CYCVPPRLVVWRMEKVNRE

SEQ ID NO: 2990102 - protein, 19 aa, Entamoeba invadens
CYDGLYLNNEFECDYCSSN

SEQ ID NO: 2990103 - protein, 20 aa, Entamoeba invadens
CYDIGLPSHKSLFQIQSERL

SEQ ID NO: 2990104 - protein, 19 aa, Entamoeba invadens
CYEIGRHLICLISSKERLL

SEQ ID NO: 2990105 - protein, 30 aa, Entamoeba invadens
CYGLEKLEDGLFFTFDFGGGTLDTTVMKKA

SEQ ID NO: 2990106 - protein, 43 aa, Entamoeba invadens
CYGVFSRFGALYKYGFITKCVGLYRVWFYLRSDFNRCRREMKS

SEQ ID NO: 2990107 - protein, 18 aa, Entamoeba invadens
CYHRLNVLCLINKRARAG

SEQ ID NO: 2990108 - protein, 17 aa, Entamoeba invadens
CYICKRRFGLFWTKYHC

SEQ ID NO: 2990109 - protein, 27 aa, Entamoeba invadens
CYIEFRAPYIHLIPQNIFLGRNPTSPF

SEQ ID NO: 2990110 - protein, 29 aa, Entamoeba invadens
CYILDTETEMFLWLGNNGELRCEEHVRYS

SEQ ID NO: 2990111 - protein, 18 aa, Entamoeba invadens
CYILFRTEEKDDLSNGYK

SEQ ID NO: 2990112 - protein, 17 aa, Entamoeba invadens
CYINCQPQYWTGGNQED

SEQ ID NO: 2990113 - protein, 19 aa, Entamoeba invadens
CYLIVQTFKMMGNIVVRFS

SEQ ID NO: 2990114 - protein, 26 aa, Entamoeba invadens
CYLQAVCLALFNFFGDFSLIQPKKRT

SEQ ID NO: 2990115 - protein, 23 aa, Entamoeba invadens
CYLRSFENFIKIPSYLIKFSSIE

SEQ ID NO: 2990116 - protein, 17 aa, Entamoeba invadens
CYLTIPSIVQVISEQCF

SEQ ID NO: 2990117 - protein, 36 aa, Entamoeba invadens
CYNIITEIYIIFDFLRHILIYKAITKRNANANAIIF

SEQ ID NO: 2990118 - protein, 44 aa, Entamoeba invadens
CYNITYCLTCDPQYYLTSTFIYKPLGDLFTKCELTLPTGVGCAI

SEQ ID NO: 2990119 - protein, 22 aa, Entamoeba invadens
CYQENSFDRYNEWVVKYAKGQI

SEQ ID NO: 2990120 - protein, 19 aa, Entamoeba invadens
CYQESILVYLINNFCSITI

SEQ ID NO: 2990121 - protein, 28 aa, Entamoeba invadens
CYRDVNGVVFVFDVSNRASFEGISFWIA

SEQ ID NO: 2990122 - protein, 32 aa, Entamoeba invadens
CYSHTFGHFVLLRTPIFYYEIEVLPNASSHVI

SEQ ID NO: 2990123 - protein, 26 aa, Entamoeba invadens
CYSTLKCEVILPKKYYNTVFTRSGNW

SEQ ID NO: 2990124 - protein, 30 aa, Entamoeba invadens
CYTFFKKYKNLCEIVFPTTIKKFESLIFDE

SEQ ID NO: 2990125 - protein, 30 aa, Entamoeba invadens
CYTYHNFDTVLCIMLLFGTSAIHRLKRTFE

SEQ ID NO: 2990126 - protein, 17 aa, Entamoeba invadens
CYVLNKFIKFLTENDMK

SEQ ID NO: 2990127 - protein, 24 aa, Entamoeba invadens
DAAAFLKMYPKGEAYLHPLGGKEE

SEQ ID NO: 2990128 - protein, 24 aa, Entamoeba invadens
DAAKDWMKLFANDKVRVLIVSDTK

SEQ ID NO: 2990129 - protein, 18 aa, Entamoeba invadens
DAANILKPMLSRGELRCI

SEQ ID NO: 2990130 - protein, 24 aa, Entamoeba invadens
DAANILRPILSRGELWCIEATIQK

SEQ ID NO: 2990131 - protein, 19 aa, Entamoeba invadens
DAAQQAFLIGMAASFGYQI

SEQ ID NO: 2990132 - protein, 21 aa, Entamoeba invadens
DACAHYLYEGLMILQNRGYDS

SEQ ID NO: 2990133 - protein, 22 aa, Entamoeba invadens
DACEKLYKQVLPLLAVEKDTSA

SEQ ID NO: 2990134 - protein, 17 aa, Entamoeba invadens
DACFSECYALEQINIPK

SEQ ID NO: 2990135 - protein, 23 aa, Entamoeba invadens
DADDQLISLCKNIGTNMKNGIET

SEQ ID NO: 2990136 - protein, 17 aa, Entamoeba invadens
DADGLCYFNTTFQGRPT

SEQ ID NO: 2990137 - protein, 39 aa, Entamoeba invadens
DADIKKHPWFEGIDWDKLLAKQLPPPWKPQIQSADDTSH

SEQ ID NO: 2990138 - protein, 17 aa, Entamoeba invadens
DADPFGIPPPDGSAKKV

SEQ ID NO: 2990139 - protein, 25 aa, Entamoeba invadens
DADRYLRKNSLLVKSFYGVAENIRC

SEQ ID NO: 2990140 - protein, 23 aa, Entamoeba invadens
DADYKIVLTTPNHKGRLFDTFDS

SEQ ID NO: 2990141 - protein, 22 aa, Entamoeba invadens
DADYMFTSFHWHSIQFEAMAIY

SEQ ID NO: 2990142 - protein, 26 aa, Entamoeba invadens
DAECFAFLNRMLESQLAPIVVFATNR

SEQ ID NO: 2990143 - protein, 20 aa, Entamoeba invadens
DAEEFISRLVLPLTRLLPNE

SEQ ID NO: 2990144 - protein, 31 aa, Entamoeba invadens
DAEELLKVFEDLYNRVFVLRNVETSITTLEE

SEQ ID NO: 2990145 - protein, 23 aa, Entamoeba invadens
DAEKCFLLNVLSEVLCKGNSTDV

SEQ ID NO: 2990146 - protein, 25 aa, Entamoeba invadens
DAESALIWFEMSPFSALSVSNVTSV

SEQ ID NO: 2990147 - protein, 23 aa, Entamoeba invadens
DAETFVDTVLSKNYKYVRPIVTP

SEQ ID NO: 2990148 - protein, 31 aa, Entamoeba invadens
DAETVKLIMAFFEIFVLRKVTVMKQRGMDGL

SEQ ID NO: 2990149 - protein, 24 aa, Entamoeba invadens
DAFADLLWSDPIPRSYLSDDWKDK

SEQ ID NO: 2990150 - protein, 21 aa, Entamoeba invadens
DAFANFFRKTMYDIIELNKTH

SEQ ID NO: 2990151 - protein, 22 aa, Entamoeba invadens
DAFDIFNMMFGGGSGRKGKSSF

SEQ ID NO: 2990152 - protein, 18 aa, Entamoeba invadens
DAFLKSEPKSKIMNLTWG

SEQ ID NO: 2990153 - protein, 23 aa, Entamoeba invadens
DAFNGFLYAMERNNTLLALDISD

SEQ ID NO: 2990154 - protein, 26 aa, Entamoeba invadens
DAFPTAFHIAGLWKIDRLVAEMKLCY

SEQ ID NO: 2990155 - protein, 25 aa, Entamoeba invadens
DAFQQSFLLGMLVKCGYNVYVNKLY

SEQ ID NO: 2990156 - protein, 23 aa, Entamoeba invadens
DAFSYIDGFLKKGSITNTIPLEE

SEQ ID NO: 2990157 - protein, 29 aa, Entamoeba invadens
DAFTTSCGVTLFTPFKPMLAKPKKSVEEV

SEQ ID NO: 2990158 - protein, 18 aa, Entamoeba invadens
DAFVFSFITPRGSSIPLR

SEQ ID NO: 2990159 - protein, 20 aa, Entamoeba invadens
DAGNIILMKARHPLAETLSS

SEQ ID NO: 2990160 - protein, 22 aa, Entamoeba invadens
DAHDFAMKFVPDNMFLPVIAEI

SEQ ID NO: 2990161 - protein, 26 aa, Entamoeba invadens
DAHHRLFHLCDASIYVFKKGESGSAC

SEQ ID NO: 2990162 - protein, 17 aa, Entamoeba invadens
DAHKLQEIAIFLSSLCI

SEQ ID NO: 2990163 - protein, 28 aa, Entamoeba invadens
DAIDMKMRVKIMLNALRGISYLHDNEIL

SEQ ID NO: 2990164 - protein, 36 aa, Entamoeba invadens
DAIENNHVLTLNKEYFFLRKPLERRLYELARKHCGS

SEQ ID NO: 2990165 - protein, 18 aa, Entamoeba invadens
DAIFSYGNDLEFVDYLFL

SEQ ID NO: 2990166 - protein, 19 aa, Entamoeba invadens
DAIIMRFGLHLIRLASFKE

SEQ ID NO: 2990167 - protein, 25 aa, Entamoeba invadens
DAIIQYACRMFLNKNYEGSLDGFRI

SEQ ID NO: 2990168 - protein, 26 aa, Entamoeba invadens
DAILRRFSRRILVDLPTKEDRENILK

SEQ ID NO: 2990169 - protein, 24 aa, Entamoeba invadens
DAINRWAKVLPSVHPMYAVKCNPE

SEQ ID NO: 2990170 - protein, 26 aa, Entamoeba invadens
DAIPPTKRWGALIPIGFITPEADCPV

SEQ ID NO: 2990171 - protein, 39 aa, Entamoeba invadens
DAIQMLRINPPLFFFRLPFIFNFFPNLSTLRGNLIEFQN

SEQ ID NO: 2990172 - protein, 22 aa, Entamoeba invadens
DAISHFVPYRLADGRYICDILL

SEQ ID NO: 2990173 - protein, 23 aa, Entamoeba invadens
DAIVVFNDLMKPISLKKKLAEEI

SEQ ID NO: 2990174 - protein, 18 aa, Entamoeba invadens
DAKKYFLSVTPKEKAKQV

SEQ ID NO: 2990175 - protein, 24 aa, Entamoeba invadens
DAKLNEWILRLPDFCFQKCYSLST

SEQ ID NO: 2990176 - protein, 26 aa, Entamoeba invadens
DAKRREFMHLIEDILFVEGYDITYTS

SEQ ID NO: 2990177 - protein, 22 aa, Entamoeba invadens
DAKSVFTTVFLLLDIHDKGKIG

SEQ ID NO: 2990178 - protein, 35 aa, Entamoeba invadens
DAKTAFKRIVYSRYKGVPLYLEWAPERLFNEEAKS

SEQ ID NO: 2990179 - protein, 26 aa, Entamoeba invadens
DAKTLAKWIIRKIENLGLNTYRIVNC

SEQ ID NO: 2990180 - protein, 17 aa, Entamoeba invadens
DAKVCILSCPFEPPKTK

SEQ ID NO: 2990181 - protein, 24 aa, Entamoeba invadens
DAKYNLEMFLYRDSLMKGDHYILN

SEQ ID NO: 2990182 - protein, 33 aa, Entamoeba invadens
DALDEMRSQIQSKALILVFRKTMHEAHRDDPPQ

SEQ ID NO: 2990183 - protein, 18 aa, Entamoeba invadens
DALDVIEIFKIASLTGIG

SEQ ID NO: 2990184 - protein, 23 aa, Entamoeba invadens
DALEKLIQTWAALCSKINASVQT

SEQ ID NO: 2990185 - protein, 22 aa, Entamoeba invadens
DALGLLDALQLKINQLEKSSNM

SEQ ID NO: 2990186 - protein, 26 aa, Entamoeba invadens
DALGTQIPFLLKKFPMEDNLSTHTNP

SEQ ID NO: 2990187 - protein, 19 aa, Entamoeba invadens
DALKNIEFFIRFVESNEED

SEQ ID NO: 2990188 - protein, 27 aa, Entamoeba invadens
DALKRYIKLFLFDGVKYRVAALPYFVS

SEQ ID NO: 2990189 - protein, 18 aa, Entamoeba invadens
DALLVHKAGRDKIFTFEK

SEQ ID NO: 2990190 - protein, 18 aa, Entamoeba invadens
DALQNVLINFLRIRSEIK

SEQ ID NO: 2990191 - protein, 33 aa, Entamoeba invadens
DALSEYAMKLKLYIPFVLLKDKILFECSSEINT

SEQ ID NO: 2990192 - protein, 25 aa, Entamoeba invadens
DALSTQIPFLLKKFPMEDELSTHTN

SEQ ID NO: 2990193 - protein, 20 aa, Entamoeba invadens
DALVLIRRGVVERITRFNDP

SEQ ID NO: 2990194 - protein, 20 aa, Entamoeba invadens
DALYVILEFCTADLRAFLKE

SEQ ID NO: 2990195 - protein, 23 aa, Entamoeba invadens
DAMFVFCCCFCNVDIQINPLIVE

SEQ ID NO: 2990196 - protein, 23 aa, Entamoeba invadens
DAMFVLCCCFCNVDIQINPLIAE

SEQ ID NO: 2990197 - protein, 18 aa, Entamoeba invadens
DAMILRFAIPSRKMTKED

SEQ ID NO: 2990198 - protein, 20 aa, Entamoeba invadens
DAMILRFAIPSRKMTKKDLF

SEQ ID NO: 2990199 - protein, 17 aa, Entamoeba invadens
DAMKWSETKFKNVVNFA

SEQ ID NO: 2990200 - protein, 26 aa, Entamoeba invadens
DAMLSARSCIALKLSINVLMITNQID

SEQ ID NO: 2990201 - protein, 29 aa, Entamoeba invadens
DAMSIFSHFGLPDLFITFTANPKWQEIVE

SEQ ID NO: 2990202 - protein, 25 aa, Entamoeba invadens
DANCLLCDTTWKLINEGILCETVDI

SEQ ID NO: 2990203 - protein, 26 aa, Entamoeba invadens
DANDYTKYKLILSPLEGYYEGGKWSF

SEQ ID NO: 2990204 - protein, 18 aa, Entamoeba invadens
DANFRKNMTLQQAKQFVI

SEQ ID NO: 2990205 - protein, 26 aa, Entamoeba invadens
DANGIIFRLPLFPNPLVKTLVEMILI

SEQ ID NO: 2990206 - protein, 23 aa, Entamoeba invadens
DANGKIFMWDWKKGKVLKCYTKA

SEQ ID NO: 2990207 - protein, 32 aa, Entamoeba invadens
DANGYLNGELYFIGIIDILMDYTTRKKLETVM

SEQ ID NO: 2990208 - protein, 27 aa, Entamoeba invadens
DANIVNRKLFYHCDMLSNIVFTDPPTD

SEQ ID NO: 2990209 - protein, 26 aa, Entamoeba invadens
DANKSFLGFSFWKKKEDKKSLARSVS

SEQ ID NO: 2990210 - protein, 22 aa, Entamoeba invadens
DANLIQPWRYFLKESKLSVNGK

SEQ ID NO: 2990211 - protein, 23 aa, Entamoeba invadens
DANRQLLYHGSRLTNFVGILSTG

SEQ ID NO: 2990212 - protein, 24 aa, Entamoeba invadens
DANRRVLLDFLKKIFVMDPEQRMT

SEQ ID NO: 2990213 - protein, 23 aa, Entamoeba invadens
DANYFKYPINFNKIEVLKLVSVS

SEQ ID NO: 2990214 - protein, 24 aa, Entamoeba invadens
DAPALLQVYLSQWNFDECIKIHDQ

SEQ ID NO: 2990215 - protein, 21 aa, Entamoeba invadens
DAPMPFIIGCQRKIYPLLQED

SEQ ID NO: 2990216 - protein, 25 aa, Entamoeba invadens
DAPNLYETIIRILVSLFSIPETCGL

SEQ ID NO: 2990217 - protein, 27 aa, Entamoeba invadens
DAPQIFRLSFMGKEPIFCVYTQSQNTF

SEQ ID NO: 2990218 - protein, 23 aa, Entamoeba invadens
DAQALFFKMIYLSLELNSPKDVD

SEQ ID NO: 2990219 - protein, 23 aa, Entamoeba invadens
DAQIYNFIAGWLAETFELDSEAR

SEQ ID NO: 2990220 - protein, 24 aa, Entamoeba invadens
DAQIYNFIAGWLAETFELGSEARK

SEQ ID NO: 2990221 - protein, 37 aa, Entamoeba invadens
DAQNIFEGDLKLILGLLWVLILKYQIAANKMDASTQA

SEQ ID NO: 2990222 - protein, 28 aa, Entamoeba invadens
DAQNRILSAHLLIIGYDALMSEILKNVV

SEQ ID NO: 2990223 - protein, 22 aa, Entamoeba invadens
DAQYTRLVGWKSLTRTELVQLL

SEQ ID NO: 2990224 - protein, 17 aa, Entamoeba invadens
DARAYVAAVKWLNTHYS

SEQ ID NO: 2990225 - protein, 24 aa, Entamoeba invadens
DARDEILLRKEWLRELIRNEEEED

SEQ ID NO: 2990226 - protein, 23 aa, Entamoeba invadens
DARTYMLLYAKFESLLGLGYQVI

SEQ ID NO: 2990227 - protein, 29 aa, Entamoeba invadens
DASDFFAVGVLKLLKLLFVKVKTTPEEME

SEQ ID NO: 2990228 - protein, 27 aa, Entamoeba invadens
DASEWKPLTIPPLPLLRALFLKKCNTF

SEQ ID NO: 2990229 - protein, 17 aa, Entamoeba invadens
DASFISLIAMFVRPEDL

SEQ ID NO: 2990230 - protein, 18 aa, Entamoeba invadens
DASLLIPFVTVFNTIKQQ

SEQ ID NO: 2990231 - protein, 25 aa, Entamoeba invadens
DASSKIKVLYMYGDYAKYTENAVEN

SEQ ID NO: 2990232 - protein, 25 aa, Entamoeba invadens
DASVVLLRYFNPIGAHKSGLIGESP

SEQ ID NO: 2990233 - protein, 23 aa, Entamoeba invadens
DATEFYVLLLDHLHEAAIGKGKN

SEQ ID NO: 2990234 - protein, 22 aa, Entamoeba invadens
DATEITGILRKEEYRKVRVYAL

SEQ ID NO: 2990235 - protein, 21 aa, Entamoeba invadens
DATKFIDLALDWTATADPFDM

SEQ ID NO: 2990236 - protein, 23 aa, Entamoeba invadens
DATKINIKPFKLSLSASTIKRRI

SEQ ID NO: 2990237 - protein, 21 aa, Entamoeba invadens
DATPIFYFNPLSQHNMHPQLL

SEQ ID NO: 2990238 - protein, 23 aa, Entamoeba invadens
DATSVLYLFVKTNHEILKNTECM

SEQ ID NO: 2990239 - protein, 18 aa, Entamoeba invadens
DATTCTGALYPLPDIIYT

SEQ ID NO: 2990240 - protein, 27 aa, Entamoeba invadens
DATTFETNFLLFVQGNFLILKEEVTKC

SEQ ID NO: 2990241 - protein, 25 aa, Entamoeba invadens
DAVGYDTVPLYLPDNFKQMCFDENV

SEQ ID NO: 2990242 - protein, 18 aa, Entamoeba invadens
DAVKIPVYPKLTPNVQNI

SEQ ID NO: 2990243 - protein, 21 aa, Entamoeba invadens
DAVLAQLLNKVVPGTLPNYET

SEQ ID NO: 2990244 - protein, 27 aa, Entamoeba invadens
DAVRTAPPNSYIFIEPGRYEESEPIVI

SEQ ID NO: 2990245 - protein, 30 aa, Entamoeba invadens
DAVSATQVLGLLWQLMDYELRKTIGGIDCE

SEQ ID NO: 2990246 - protein, 19 aa, Entamoeba invadens
DAVWKVMYDLHFNPATFQI

SEQ ID NO: 2990247 - protein, 17 aa, Entamoeba invadens
DAYKLDPEMGTRGSLKK

SEQ ID NO: 2990248 - protein, 20 aa, Entamoeba invadens
DAYPITTFKFPWKIAEFVSS

SEQ ID NO: 2990249 - protein, 22 aa, Entamoeba invadens
DAYTLKIVRLLSYKQAEDPSEL

SEQ ID NO: 2990250 - protein, 44 aa, Entamoeba invadens
DAYTQSELCIAALKFAVNFLRKGGWFISKVFRSQDYYSILYVFE

SEQ ID NO: 2990251 - protein, 18 aa, Entamoeba invadens
DCAACNEGYILNNTDCVK

SEQ ID NO: 2990252 - protein, 20 aa, Entamoeba invadens
DCAFLHHIHVTNFATGCIYE

SEQ ID NO: 2990253 - protein, 20 aa, Entamoeba invadens
DCALVPQRKLPKAEPEPQHP

SEQ ID NO: 2990254 - protein, 22 aa, Entamoeba invadens
DCAVMKLLPPDLSKVAAETLCN

SEQ ID NO: 2990255 - protein, 33 aa, Entamoeba invadens
DCCEQAHISIFRKGVLLFDLGLTTITLSVVAKT

SEQ ID NO: 2990256 - protein, 18 aa, Entamoeba invadens
DCDFINFKVKYVEGETWE

SEQ ID NO: 2990257 - protein, 17 aa, Entamoeba invadens
DCDNYLCFTCEDKYGLS

SEQ ID NO: 2990258 - protein, 20 aa, Entamoeba invadens
DCDTLYTRCALFEASPKITR

SEQ ID NO: 2990259 - protein, 23 aa, Entamoeba invadens
DCEIALICFNSTNNKIFVYSSGD

SEQ ID NO: 2990260 - protein, 23 aa, Entamoeba invadens
DCELFNGLLPFDITNLKTIEKDV

SEQ ID NO: 2990261 - protein, 23 aa, Entamoeba invadens
DCELFNGLLPFNITNLKTIEKDV

SEQ ID NO: 2990262 - protein, 23 aa, Entamoeba invadens
DCELFNGLLPFNITNLKTIEKNV

SEQ ID NO: 2990263 - protein, 27 aa, Entamoeba invadens
DCELPSITYFIVWYKILYSQITTKSEY

SEQ ID NO: 2990264 - protein, 27 aa, Entamoeba invadens
DCFFGCSNLMEIKLPKTIFSLPTDCFR

SEQ ID NO: 2990265 - protein, 17 aa, Entamoeba invadens
DCFKRCYSLTEVRLNEG

SEQ ID NO: 2990266 - protein, 18 aa, Entamoeba invadens
DCFTHVIPLLQYTIHYNY

SEQ ID NO: 2990267 - protein, 20 aa, Entamoeba invadens
DCFYEILFTYGLLCEEGPSE

SEQ ID NO: 2990268 - protein, 26 aa, Entamoeba invadens
DCGEIYSIRIKYFNKSPTDVAYVCFT

SEQ ID NO: 2990269 - protein, 18 aa, Entamoeba invadens
DCGFLKQIEIPSSVLVIQ

SEQ ID NO: 2990270 - protein, 24 aa, Entamoeba invadens
DCHMLKNISLPLQLQEIPFECFLN

SEQ ID NO: 2990271 - protein, 24 aa, Entamoeba invadens
DCHSLSRLSLPKALSYIGSCCFKG

SEQ ID NO: 2990272 - protein, 25 aa, Entamoeba invadens
DCICHQRYEFDPAYWGNKSPEVKDL

SEQ ID NO: 2990273 - protein, 20 aa, Entamoeba invadens
DCIELKTILKKVVSSVIVLT

SEQ ID NO: 2990274 - protein, 20 aa, Entamoeba invadens
DCIGLTYLSLAKNQLVSLPP

SEQ ID NO: 2990275 - protein, 18 aa, Entamoeba invadens
DCISLEKVILPDGLESIK

SEQ ID NO: 2990276 - protein, 18 aa, Entamoeba invadens
DCKSLSKILIGKSVERLD

SEQ ID NO: 2990277 - protein, 24 aa, Entamoeba invadens
DCLKHELDLLFKYYPKVGVAVNKE

SEQ ID NO: 2990278 - protein, 20 aa, Entamoeba invadens
DCLSKVYDYIFKTQCKGDSH

SEQ ID NO: 2990279 - protein, 23 aa, Entamoeba invadens
DCLTPILEALLFLVDTPLSQDIE

SEQ ID NO: 2990280 - protein, 17 aa, Entamoeba invadens
DCMKQLWDHTFCYELRT

SEQ ID NO: 2990281 - protein, 18 aa, Entamoeba invadens
DCNKLDTFIFKQCRNTIF

SEQ ID NO: 2990282 - protein, 18 aa, Entamoeba invadens
DCNLAPLTTPSLPETSKS

SEQ ID NO: 2990283 - protein, 24 aa, Entamoeba invadens
DCNNLREIVLPKSLSFISKSAFYN

SEQ ID NO: 2990284 - protein, 29 aa, Entamoeba invadens
DCNSCVKFLREFKLFPGIKTLVINSSYFR

SEQ ID NO: 2990285 - protein, 33 aa, Entamoeba invadens
DCPISQKCTMKWRKGLFPWNRGKEFVTGAVTEG

SEQ ID NO: 2990286 - protein, 23 aa, Entamoeba invadens
DCQLYFCYGVLKTLKIENLKCCT

SEQ ID NO: 2990287 - protein, 24 aa, Entamoeba invadens
DCRELIPEWLGFIKGVVDSEDLPL

SEQ ID NO: 2990288 - protein, 35 aa, Entamoeba invadens
DCRGPLFLVQTREKEMWMIVLNQLGFGTYRISIDE

SEQ ID NO: 2990289 - protein, 26 aa, Entamoeba invadens
DCRLSTPFKSILLNDSFVLFNSCMGE

SEQ ID NO: 2990290 - protein, 17 aa, Entamoeba invadens
DCRRLKEVVLPPNLNQV

SEQ ID NO: 2990291 - protein, 18 aa, Entamoeba invadens
DCRYWSSKMFATYLIYNK

SEQ ID NO: 2990292 - protein, 18 aa, Entamoeba invadens
DCSKLEIVLFKTTKLVTI

SEQ ID NO: 2990293 - protein, 23 aa, Entamoeba invadens
DCSYWERELTRRCRLFELRNRPP

SEQ ID NO: 2990294 - protein, 18 aa, Entamoeba invadens
DCTGAHLYGLMANGYTSE

SEQ ID NO: 2990295 - protein, 23 aa, Entamoeba invadens
DCVCFCLFSCRLTYEGVPNVNRI

SEQ ID NO: 2990296 - protein, 28 aa, Entamoeba invadens
DCVSFIFDVLSRWLLSYGKNLFSVHLID

SEQ ID NO: 2990297 - protein, 22 aa, Entamoeba invadens
DDACILFTTYSMLSFSGTRQYD

SEQ ID NO: 2990298 - protein, 24 aa, Entamoeba invadens
DDADSFIFSLINPTKTAMKVIPKY

SEQ ID NO: 2990299 - protein, 24 aa, Entamoeba invadens
DDAKLVLTILFKKAVNERKYTSLY

SEQ ID NO: 2990300 - protein, 17 aa, Entamoeba invadens
DDALHCKLLPNGHFEIG

SEQ ID NO: 2990301 - protein, 23 aa, Entamoeba invadens
DDAMLQILFLAPYSPLLKSYVRT

SEQ ID NO: 2990302 - protein, 30 aa, Entamoeba invadens
DDARLFQILARGCAQLSFYAKAVAANSSVV

SEQ ID NO: 2990303 - protein, 30 aa, Entamoeba invadens
DDARNAFVTLLFLRYLYTPFMKNVQILKLL

SEQ ID NO: 2990304 - protein, 20 aa, Entamoeba invadens
DDCFFMCFNLDNVIIPSSVT

SEQ ID NO: 2990305 - protein, 27 aa, Entamoeba invadens
DDDAMNYWKYWLESLPSKHSNPPLYPD

SEQ ID NO: 2990306 - protein, 22 aa, Entamoeba invadens
DDDCHFLFTLRNPWHTKPKLFK

SEQ ID NO: 2990307 - protein, 24 aa, Entamoeba invadens
DDDFSFCLCGAFIHKIVSLLQTKT

SEQ ID NO: 2990308 - protein, 29 aa, Entamoeba invadens
DDDGEFILTAFPELLPEWITPQNELHHVY

SEQ ID NO: 2990309 - protein, 27 aa, Entamoeba invadens
DDDGELCFADFYKLLTILNHMPDKSET

SEQ ID NO: 2990310 - protein, 26 aa, Entamoeba invadens
DDDGFPVQLKIPLALSLSLVLNIKNY

SEQ ID NO: 2990311 - protein, 24 aa, Entamoeba invadens
DDDIFLFVKNLLEDYRKMIFCGNE

SEQ ID NO: 2990312 - protein, 22 aa, Entamoeba invadens
DDDIKPKKAAPKKIDLSDSDDD

SEQ ID NO: 2990313 - protein, 24 aa, Entamoeba invadens
DDDKFVALLFFVDFITSRVKVLSD

SEQ ID NO: 2990314 - protein, 17 aa, Entamoeba invadens
DDDKKCFVALTTKFSTL

SEQ ID NO: 2990315 - protein, 17 aa, Entamoeba invadens
DDDLLDKKPAAKTAAKK

SEQ ID NO: 2990316 - protein, 19 aa, Entamoeba invadens
DDDLLDKKPTKKAVAKKDS

SEQ ID NO: 2990317 - protein, 22 aa, Entamoeba invadens
DDDQFIFTLRNSSGTPPTIFRP

SEQ ID NO: 2990318 - protein, 17 aa, Entamoeba invadens
DDDYSFENLKFRMLQKL

SEQ ID NO: 2990319 - protein, 21 aa, Entamoeba invadens
DDEAKHLLSCGPSRVGHGVFL

SEQ ID NO: 2990320 - protein, 23 aa, Entamoeba invadens
DDEALVLDYMIKQNKPFNAKTIF

SEQ ID NO: 2990321 - protein, 24 aa, Entamoeba invadens
DDECYLSLIFIECYGIHLGYIKHL

SEQ ID NO: 2990322 - protein, 24 aa, Entamoeba invadens
DDEFKRIEKKLVFNEGSDLKKREK

SEQ ID NO: 2990323 - protein, 25 aa, Entamoeba invadens
DDEGIKIILGLWKFTDPIAVAMVTQ

SEQ ID NO: 2990324 - protein, 23 aa, Entamoeba invadens
DDEHEPIIGNKIIEKVEAIWNSY

SEQ ID NO: 2990325 - protein, 24 aa, Entamoeba invadens
DDEICYFIEVLSCDPNFSFFESEK

SEQ ID NO: 2990326 - protein, 37 aa, Entamoeba invadens
DDEIKYFLGEIGSGLWYLHFIKKLIHRDLKPANLLLQ

SEQ ID NO: 2990327 - protein, 22 aa, Entamoeba invadens
DDELPPILPLNEMPLRSRSRSL

SEQ ID NO: 2990328 - protein, 18 aa, Entamoeba invadens
DDEMVCLSASDNRWILVI

SEQ ID NO: 2990329 - protein, 24 aa, Entamoeba invadens
DDENHFIFCLRREDGVPFTEPKRW

SEQ ID NO: 2990330 - protein, 17 aa, Entamoeba invadens
DDENHFVFTLKNEFNIP

SEQ ID NO: 2990331 - protein, 24 aa, Entamoeba invadens
DDERNKFLLEQLEQRRIQKENSSV

SEQ ID NO: 2990332 - protein, 23 aa, Entamoeba invadens
DDEVPLCQTCLVMQLKMKEVICE

SEQ ID NO: 2990333 - protein, 28 aa, Entamoeba invadens
DDFDFSTIDAWLLLSVPGKFHGDMASEV

SEQ ID NO: 2990334 - protein, 23 aa, Entamoeba invadens
DDFDLFRVVIFKDFLNDFKSECR

SEQ ID NO: 2990335 - protein, 24 aa, Entamoeba invadens
DDFESVCMLLDALVLEQNPTLIFH

SEQ ID NO: 2990336 - protein, 24 aa, Entamoeba invadens
DDFITFLLDFLQKTVTRITYFDRQ

SEQ ID NO: 2990337 - protein, 26 aa, Entamoeba invadens
DDFKACQLIEFVLRPGPRDKKRGFIS

SEQ ID NO: 2990338 - protein, 19 aa, Entamoeba invadens
DDFKPLLANALRKTTQEIV

SEQ ID NO: 2990339 - protein, 18 aa, Entamoeba invadens
DDFVLIRKMLENPTSSIV

SEQ ID NO: 2990340 - protein, 17 aa, Entamoeba invadens
DDFYVFTETFPTIFEIP

SEQ ID NO: 2990341 - protein, 29 aa, Entamoeba invadens
DDGDGYEMCAVWKLIEMGYREDIAEEAVS

SEQ ID NO: 2990342 - protein, 24 aa, Entamoeba invadens
DDGKEILNFRNTTLDLIIEKERQR

SEQ ID NO: 2990343 - protein, 24 aa, Entamoeba invadens
DDGKIYIGALPNIAQILYEISDLL

SEQ ID NO: 2990344 - protein, 23 aa, Entamoeba invadens
DDGLPPVPFYSDDLVNISPTSPI

SEQ ID NO: 2990345 - protein, 23 aa, Entamoeba invadens
DDGTLFTKRFLKDVIVANKLFEE

SEQ ID NO: 2990346 - protein, 25 aa, Entamoeba invadens
DDGTYEVKYTPLVPGIHKVEVQVND

SEQ ID NO: 2990347 - protein, 26 aa, Entamoeba invadens
DDGVERKILRFCGAKELRSLKEKTEK

SEQ ID NO: 2990348 - protein, 19 aa, Entamoeba invadens
DDHLIPVYGFGDISTTNKS

SEQ ID NO: 2990349 - protein, 23 aa, Entamoeba invadens
DDHNILIDNFPFDAVFAITGDMK

SEQ ID NO: 2990350 - protein, 20 aa, Entamoeba invadens
DDIADLLKYGAYGLLKDEDE

SEQ ID NO: 2990351 - protein, 17 aa, Entamoeba invadens
DDIDWLVKNTTIYPKMD

SEQ ID NO: 2990352 - protein, 20 aa, Entamoeba invadens
DDIINLLSRNIKVTLYVEHN

SEQ ID NO: 2990353 - protein, 23 aa, Entamoeba invadens
DDISMRGDFFVFIGKGKYAAEKN

SEQ ID NO: 2990354 - protein, 32 aa, Entamoeba invadens
DDKDYLDLFVTSWKFFFTPKELCKLCVEEALL

SEQ ID NO: 2990355 - protein, 25 aa, Entamoeba invadens
DDKFSPVFVELQSGFIFISEPNSKP

SEQ ID NO: 2990356 - protein, 23 aa, Entamoeba invadens
DDKGFLKRLQKAMPIFVMETTAE

SEQ ID NO: 2990357 - protein, 17 aa, Entamoeba invadens
DDKGYLFNVYRINPSGG

SEQ ID NO: 2990358 - protein, 23 aa, Entamoeba invadens
DDKIALRMWAIDSKGLPVGGETE

SEQ ID NO: 2990359 - protein, 23 aa, Entamoeba invadens
DDKILVNFRYPLSYREASEQKKK

SEQ ID NO: 2990360 - protein, 32 aa, Entamoeba invadens
DDKISEALFTLPNLEVLFKVLSFDATIQQNGP

SEQ ID NO: 2990361 - protein, 24 aa, Entamoeba invadens
DDKKYFTWKKSQFPDPAKLIDDLK

SEQ ID NO: 2990362 - protein, 26 aa, Entamoeba invadens
DDKLDTFTVQLGIKYTKKNGGVYYRI

SEQ ID NO: 2990363 - protein, 23 aa, Entamoeba invadens
DDKLFSRMVVHDFQLCFALDKQY

SEQ ID NO: 2990364 - protein, 18 aa, Entamoeba invadens
DDKLISALVARLTRKEIY

SEQ ID NO: 2990365 - protein, 22 aa, Entamoeba invadens
DDKLKEIVLLEPLIEEDKIVQK

SEQ ID NO: 2990366 - protein, 18 aa, Entamoeba invadens
DDKLLPSQLVGGILFLRV

SEQ ID NO: 2990367 - protein, 28 aa, Entamoeba invadens
DDKNPTYWVLTQTSLLIYPFMSKELEEK

SEQ ID NO: 2990368 - protein, 25 aa, Entamoeba invadens
DDKPVNTDFVLIKQDILEVDCCVVK

SEQ ID NO: 2990369 - protein, 18 aa, Entamoeba invadens
DDKRFRVARYPNYEYTDT

SEQ ID NO: 2990370 - protein, 29 aa, Entamoeba invadens
DDKSKIEEQLNLVKIERDKTSGELSNEKE

SEQ ID NO: 2990371 - protein, 29 aa, Entamoeba invadens
DDKTHFTEYCVLCYILALSKAEDLNNRIK

SEQ ID NO: 2990372 - protein, 23 aa, Entamoeba invadens
DDKTIRLWKYNETRMWELCCLRG

SEQ ID NO: 2990373 - protein, 24 aa, Entamoeba invadens
DDLESFAYSILYLAKGSLPWQGLK

SEQ ID NO: 2990374 - protein, 30 aa, Entamoeba invadens
DDLESLAYMFIYFLQGKLPWQGFSRQNNTE

SEQ ID NO: 2990375 - protein, 19 aa, Entamoeba invadens
DDLEVYYRKLLFGLGVAFA

SEQ ID NO: 2990376 - protein, 21 aa, Entamoeba invadens
DDLFDLLVFLPQRGGAFEIPA

SEQ ID NO: 2990377 - protein, 31 aa, Entamoeba invadens
DDLIHTDFFDLAKIPSFLPQKCLTSDVSCYT

SEQ ID NO: 2990378 - protein, 30 aa, Entamoeba invadens
DDLIIEPMQRLFRYPMFIQSLLKTFDEKIE

SEQ ID NO: 2990379 - protein, 17 aa, Entamoeba invadens
DDLIVQGFVFRSVKRLV

SEQ ID NO: 2990380 - protein, 24 aa, Entamoeba invadens
DDLKTLFYHFTSKVPEFDASEDIP

SEQ ID NO: 2990381 - protein, 19 aa, Entamoeba invadens
DDLLSGKPAAKKPASKKID

SEQ ID NO: 2990382 - protein, 33 aa, Entamoeba invadens
DDLMKKLRMTTPHFIRCILPNTQKRRHYFIDST

SEQ ID NO: 2990383 - protein, 25 aa, Entamoeba invadens
DDLPSQFPELQALYVELQCKVKKTK

SEQ ID NO: 2990384 - protein, 25 aa, Entamoeba invadens
DDLQKLHPTFLIAVPRVLQKIYDKF

SEQ ID NO: 2990385 - protein, 25 aa, Entamoeba invadens
DDLRKFMSINNWMDAIQSELIALFT

SEQ ID NO: 2990386 - protein, 19 aa, Entamoeba invadens
DDLVKLLVGPTKGHGGAIL

SEQ ID NO: 2990387 - protein, 19 aa, Entamoeba invadens
DDLVLALKQANKYTLRLKL

SEQ ID NO: 2990388 - protein, 30 aa, Entamoeba invadens
DDLVVNKSVFITNGVRHPASSRVLMKNECQ

SEQ ID NO: 2990389 - protein, 33 aa, Entamoeba invadens
DDMAESFLFYANWIEPIRYISRRVVKLEKALEV

SEQ ID NO: 2990390 - protein, 28 aa, Entamoeba invadens
DDMESLAYLFVYLLKGSLPWQDLPSTAD

SEQ ID NO: 2990391 - protein, 25 aa, Entamoeba invadens
DDMIDAFRGFKIRYLITTDVIARGI

SEQ ID NO: 2990392 - protein, 26 aa, Entamoeba invadens
DDMKPMYFKLTNFLAKVLKLTCDNEK

SEQ ID NO: 2990393 - protein, 33 aa, Entamoeba invadens
DDMLIMLKRYLDYIIDIVRPRKLVYMAVDGVAP

SEQ ID NO: 2990394 - protein, 25 aa, Entamoeba invadens
DDNCLFNLISIRPPLEILSVSNCPK

SEQ ID NO: 2990395 - protein, 21 aa, Entamoeba invadens
DDNDEFQEKPLKSRLRKRPSK

SEQ ID NO: 2990396 - protein, 32 aa, Entamoeba invadens
DDNSPLLLPSMALLPKPPLLRNKNLDFSKLPE

SEQ ID NO: 2990397 - protein, 17 aa, Entamoeba invadens
DDNTCALGYFLHKAPWP

SEQ ID NO: 2990398 - protein, 26 aa, Entamoeba invadens
DDNTLVLYLSYFVTKETRFGSQDMKV

SEQ ID NO: 2990399 - protein, 24 aa, Entamoeba invadens
DDNTPVPLILPKTKSTDVVPSFEI

SEQ ID NO: 2990400 - protein, 26 aa, Entamoeba invadens
DDNVLGLLLITFYHVSESWFYTEITE

SEQ ID NO: 2990401 - protein, 23 aa, Entamoeba invadens
DDPKLYFTNFQQIGKGGFGEVFV

SEQ ID NO: 2990402 - protein, 23 aa, Entamoeba invadens
DDPLFINFLNQRLLYDRKKAMLR

SEQ ID NO: 2990403 - protein, 24 aa, Entamoeba invadens
DDPLKLIQFKNLQKAKIRLLKDQK

SEQ ID NO: 2990404 - protein, 23 aa, Entamoeba invadens
DDPMTLIDLLTSVLMNMSKAFVF

SEQ ID NO: 2990405 - protein, 26 aa, Entamoeba invadens
DDPRSQMIVIKITPTFTLLNSTPYDM

SEQ ID NO: 2990406 - protein, 22 aa, Entamoeba invadens
DDPTLIGYKQPQWSLLSRIHKL

SEQ ID NO: 2990407 - protein, 17 aa, Entamoeba invadens
DDQILKLLSPGPNSPAP

SEQ ID NO: 2990408 - protein, 21 aa, Entamoeba invadens
DDQIQFAYYRTISGDAESHRV

SEQ ID NO: 2990409 - protein, 27 aa, Entamoeba invadens
DDQKILFLHDFFELMRDLHAKNIVHRD

SEQ ID NO: 2990410 - protein, 36 aa, Entamoeba invadens
DDQLYRKYFTLSSVLDGLFLTIKKLYGVSLVYNEKV

SEQ ID NO: 2990411 - protein, 23 aa, Entamoeba invadens
DDQNNVFYIYSVNWMKMLTMNKR

SEQ ID NO: 2990412 - protein, 32 aa, Entamoeba invadens
DDQRFEALILCFLRFVEVFKIYAFFINNHQKS

SEQ ID NO: 2990413 - protein, 27 aa, Entamoeba invadens
DDQVQCILQVYSVLHIFLEQTNPNRKA

SEQ ID NO: 2990414 - protein, 23 aa, Entamoeba invadens
DDQVSFVLLAIRLELQGIPDQVR

SEQ ID NO: 2990415 - protein, 19 aa, Entamoeba invadens
DDQYYYQPQQRMAYAPMRY

SEQ ID NO: 2990416 - protein, 22 aa, Entamoeba invadens
DDRLIMLRLREIGEPIKLFSES

SEQ ID NO: 2990417 - protein, 26 aa, Entamoeba invadens
DDRRPQLVPVLYKLEFVSLIIQNIYT

SEQ ID NO: 2990418 - protein, 29 aa, Entamoeba invadens
DDRTIRVWNWMSRQCVLLLPGHEHYVMSA

SEQ ID NO: 2990419 - protein, 18 aa, Entamoeba invadens
DDSDLLCAILMKKIEEEG

SEQ ID NO: 2990420 - protein, 26 aa, Entamoeba invadens
DDSFVDSLLIWIKNSGTRRGVDIIGV

SEQ ID NO: 2990421 - protein, 40 aa, Entamoeba invadens
DDSGLTAMDILTLSDKELNQIIGFRKLATYSDWRPNNTER

SEQ ID NO: 2990422 - protein, 23 aa, Entamoeba invadens
DDSKSFIFISKINGKNTFEKYPI

SEQ ID NO: 2990423 - protein, 25 aa, Entamoeba invadens
DDSLPRILVFSSHLQQLIAFKADHI

SEQ ID NO: 2990424 - protein, 23 aa, Entamoeba invadens
DDSLSSYAIFYCIDSGIGESRFV

SEQ ID NO: 2990425 - protein, 18 aa, Entamoeba invadens
DDSLTLYKRYGLYNLVEM

SEQ ID NO: 2990426 - protein, 26 aa, Entamoeba invadens
DDSPYQGGLFFLDVHFPVDYPFKAPR

SEQ ID NO: 2990427 - protein, 19 aa, Entamoeba invadens
DDSQLFSYIVDPKARMPPS

SEQ ID NO: 2990428 - protein, 24 aa, Entamoeba invadens
DDSTNWYEVFGRHPKLPNGDDLKI

SEQ ID NO: 2990429 - protein, 25 aa, Entamoeba invadens
DDSVTIKFAFINYIGDKSPRLQKAG

SEQ ID NO: 2990430 - protein, 23 aa, Entamoeba invadens
DDTEIVWTNLKTLSIRNAGIRSI

SEQ ID NO: 2990431 - protein, 20 aa, Entamoeba invadens
DDTFIIDRPLNPTDFKLVSL

SEQ ID NO: 2990432 - protein, 26 aa, Entamoeba invadens
DDTKVLTVPLIRPLTINCLNEEKKPI

SEQ ID NO: 2990433 - protein, 21 aa, Entamoeba invadens
DDTLKLPLRIKKLGDRAFYQN

SEQ ID NO: 2990434 - protein, 27 aa, Entamoeba invadens
DDTLSLLLQSAYYFKRYPITRDFRTIE

SEQ ID NO: 2990435 - protein, 23 aa, Entamoeba invadens
DDTNFVLKLLTYLLDHPECSVDE

SEQ ID NO: 2990436 - protein, 22 aa, Entamoeba invadens
DDTQFLEYKNNLNYMSTSDDTE

SEQ ID NO: 2990437 - protein, 32 aa, Entamoeba invadens
DDTTRKFLKFSWVIFLLIVKSINTYQITLRQT

SEQ ID NO: 2990438 - protein, 25 aa, Entamoeba invadens
DDTTSLYQYLLAQLVGLQKQNTETQ

SEQ ID NO: 2990439 - protein, 25 aa, Entamoeba invadens
DDVDMSMEYLLSSRYTFFIGVEDGK

SEQ ID NO: 2990440 - protein, 24 aa, Entamoeba invadens
DDVFAILTRLEFVYEQLKLICRSA

SEQ ID NO: 2990441 - protein, 29 aa, Entamoeba invadens
DDVIFIRNIHIILQQYFLLKITENDAHVT

SEQ ID NO: 2990442 - protein, 23 aa, Entamoeba invadens
DDVKRFEGVYKGLKDSTSATEDT

SEQ ID NO: 2990443 - protein, 27 aa, Entamoeba invadens
DDVKRMLHFTDLYAKLLNIEPEKYIKK

SEQ ID NO: 2990444 - protein, 24 aa, Entamoeba invadens
DDVNLIFGGIELIRRLHISIVRKL

SEQ ID NO: 2990445 - protein, 28 aa, Entamoeba invadens
DDVTNQISMFFAFAAPMVLCLSETATES

SEQ ID NO: 2990446 - protein, 26 aa, Entamoeba invadens
DDVVTLTKMYITYFKDRAALENVYGK

SEQ ID NO: 2990447 - protein, 23 aa, Entamoeba invadens
DDWNLMVMELLGPSLEDLFTYCE

SEQ ID NO: 2990448 - protein, 21 aa, Entamoeba invadens
DDYFNVKLLKTGELGTKYFTM

SEQ ID NO: 2990449 - protein, 24 aa, Entamoeba invadens
DDYLDLFRQINRGVLILYVASTNV

SEQ ID NO: 2990450 - protein, 29 aa, Entamoeba invadens
DDYRGVTTGWVWYNNPAPRPKIEIGANGM

SEQ ID NO: 2990451 - protein, 27 aa, Entamoeba invadens
DDYTSADYIVLPYTAKFTENMSKIVDY

SEQ ID NO: 2990452 - protein, 24 aa, Entamoeba invadens
DEAAQKELFLLEKELKDVPLDKAV

SEQ ID NO: 2990453 - protein, 23 aa, Entamoeba invadens
DEADRMFDLGFGPQIKHIIDGIR

SEQ ID NO: 2990454 - protein, 31 aa, Entamoeba invadens
DEATQTIEPLILIPLLRFTPKVLVCVGDPMQ

SEQ ID NO: 2990455 - protein, 21 aa, Entamoeba invadens
DECFSDCINLRIVELPNSLVS

SEQ ID NO: 2990456 - protein, 24 aa, Entamoeba invadens
DECSAIYLHAFKDGFIIVSVSNNT

SEQ ID NO: 2990457 - protein, 21 aa, Entamoeba invadens
DECYNLTFLSLSCPSPPPLNK

SEQ ID NO: 2990458 - protein, 27 aa, Entamoeba invadens
DEDFITILKFNVDYFRRLHVDFYHKKE

SEQ ID NO: 2990459 - protein, 24 aa, Entamoeba invadens
DEDFLEEIILPYPSVFDGLATEKM

SEQ ID NO: 2990460 - protein, 24 aa, Entamoeba invadens
DEDGYFYWVYKNYVVFKTLNKQKF

SEQ ID NO: 2990461 - protein, 30 aa, Entamoeba invadens
DEDIKVLETDKLKLFEKPIEKLNDLPLEKP

SEQ ID NO: 2990462 - protein, 20 aa, Entamoeba invadens
DEDMILIGKTVQRVPIYETD

SEQ ID NO: 2990463 - protein, 28 aa, Entamoeba invadens
DEDPQKWYRPVLQYNPHLFLMGVNQPGD

SEQ ID NO: 2990464 - protein, 28 aa, Entamoeba invadens
DEDQLIPNLFRYILPWETEFKDSQRVWM

SEQ ID NO: 2990465 - protein, 25 aa, Entamoeba invadens
DEDSNYLLRVFDDPTFDGIPVDKTK

SEQ ID NO: 2990466 - protein, 30 aa, Entamoeba invadens
DEDVIKLNRLHREPFLKLTKRYKELREKLH

SEQ ID NO: 2990467 - protein, 24 aa, Entamoeba invadens
DEDVYSKFLIHRVKQRLTKVYQYL

SEQ ID NO: 2990468 - protein, 26 aa, Entamoeba invadens
DEEEKKLWTLYNKNIAQFFQLLTSNW

SEQ ID NO: 2990469 - protein, 19 aa, Entamoeba invadens
DEEFIKLFKMTRPEFEALP

SEQ ID NO: 2990470 - protein, 31 aa, Entamoeba invadens
DEEIKAYQKRLWGLRFIQIVNNVRGSTTHLI

SEQ ID NO: 2990471 - protein, 25 aa, Entamoeba invadens
DEEIMNVPILFYLNKIDLPNALAKQ

SEQ ID NO: 2990472 - protein, 17 aa, Entamoeba invadens
DEEIVSYLFINAGDDKQ

SEQ ID NO: 2990473 - protein, 24 aa, Entamoeba invadens
DEEKFVYFFELTSISTVFLLQKDV

SEQ ID NO: 2990474 - protein, 24 aa, Entamoeba invadens
DEEKKKQFLALKKQFQVLCEAVES

SEQ ID NO: 2990475 - protein, 26 aa, Entamoeba invadens
DEEKTYKQLWYYVSTFTNMSMDEVLE

SEQ ID NO: 2990476 - protein, 24 aa, Entamoeba invadens
DEELINVPILFYLNKTDLPNALTK

SEQ ID NO: 2990477 - protein, 34 aa, Entamoeba invadens
DEENGFLVVKIPAFPFQKIPFTLAITGTSQLSTS

SEQ ID NO: 2990478 - protein, 24 aa, Entamoeba invadens
DEERQLRYQVFLKEFAGLQKKKYD

SEQ ID NO: 2990479 - protein, 27 aa, Entamoeba invadens
DEESHRVKFVLICWAGEGIKKPKLRAV

SEQ ID NO: 2990480 - protein, 28 aa, Entamoeba invadens
DEEYIYVAMEYITAGSLFARIMKKPLSE

SEQ ID NO: 2990481 - protein, 20 aa, Entamoeba invadens
DEEYPLLVSKSRAVYSAYTG

SEQ ID NO: 2990482 - protein, 17 aa, Entamoeba invadens
DEFEYLGTVFLVSYLYT

SEQ ID NO: 2990483 - protein, 21 aa, Entamoeba invadens
DEFFGYIANKLKSFVYTHKLE

SEQ ID NO: 2990484 - protein, 21 aa, Entamoeba invadens
DEFGISKYFEFLRVPIRNLKN

SEQ ID NO: 2990485 - protein, 22 aa, Entamoeba invadens
DEFGSLFKRKYFTDKSVSVGKG

SEQ ID NO: 2990486 - protein, 17 aa, Entamoeba invadens
DEFIPGWERNQYTQMKV

SEQ ID NO: 2990487 - protein, 25 aa, Entamoeba invadens
DEFKHTIFGILFASNYKLATKILND

SEQ ID NO: 2990488 - protein, 26 aa, Entamoeba invadens
DEFKTLNIEIFPYANFYGVLNKELHN

SEQ ID NO: 2990489 - protein, 25 aa, Entamoeba invadens
DEFLGILGEKVALKGFKKFKGGLDV

SEQ ID NO: 2990490 - protein, 31 aa, Entamoeba invadens
DEFNEHSITLFNNLLRRIHPIMKTSNTTFSR

SEQ ID NO: 2990491 - protein, 25 aa, Entamoeba invadens
DEFSRRAFLQSISKTKLPPLFCRYK

SEQ ID NO: 2990492 - protein, 33 aa, Entamoeba invadens
DEFVPGFFQYYVHYPIELSRYKKLNKKIKVICP

SEQ ID NO: 2990493 - protein, 22 aa, Entamoeba invadens
DEFYEKYYYFPPVEKTVDIVDM

SEQ ID NO: 2990494 - protein, 24 aa, Entamoeba invadens
DEFYKSFVKGKLRNLFPFFEEHFE

SEQ ID NO: 2990495 - protein, 25 aa, Entamoeba invadens
DEGDSRSVFWWESQQRSHHMSSLFN

SEQ ID NO: 2990496 - protein, 23 aa, Entamoeba invadens
DEGLQQYVLYYTGLINNEASSIK

SEQ ID NO: 2990497 - protein, 22 aa, Entamoeba invadens
DEGYFVKQLLINGGMQNLFYCF

SEQ ID NO: 2990498 - protein, 23 aa, Entamoeba invadens
DEHFNLKIAFYKNSHLFLQKLEN

SEQ ID NO: 2990499 - protein, 23 aa, Entamoeba invadens
DEHLITPQPTLPLDLSTLDFETS

SEQ ID NO: 2990500 - protein, 37 aa, Entamoeba invadens
DEHPPFPPSVSPYLRQFLLACFDRDINLRKTAKELKS

SEQ ID NO: 2990501 - protein, 25 aa, Entamoeba invadens
DEHRNNILFFTLNGEIYGRCAIDFK

SEQ ID NO: 2990502 - protein, 23 aa, Entamoeba invadens
DEIADLFLTIPQISRTRVTEYFL

SEQ ID NO: 2990503 - protein, 26 aa, Entamoeba invadens
DEIDDLDLFPYYNSIREEIEFNLLFT

SEQ ID NO: 2990504 - protein, 28 aa, Entamoeba invadens
DEIDMKLRIKFLLDALKGIQYLHENGIL

SEQ ID NO: 2990505 - protein, 34 aa, Entamoeba invadens
DEIGLEIIYQYIKVDSLPLLRERVLKLSDRVLHI

SEQ ID NO: 2990506 - protein, 23 aa, Entamoeba invadens
DEIHEFLKPYQPISVDIPRYAED

SEQ ID NO: 2990507 - protein, 20 aa, Entamoeba invadens
DEIIGKVKPYLKQCGFTDCY

SEQ ID NO: 2990508 - protein, 24 aa, Entamoeba invadens
DEIKEKVKNLAYDKDLLSSEKKKL

SEQ ID NO: 2990509 - protein, 18 aa, Entamoeba invadens
DEIKSLLLMLEEARGWYS

SEQ ID NO: 2990510 - protein, 20 aa, Entamoeba invadens
DEINIKHRVKMMLDGANGIS

SEQ ID NO: 2990511 - protein, 24 aa, Entamoeba invadens
DEINRIILAAIDLKIEKDKFLYHK

SEQ ID NO: 2990512 - protein, 26 aa, Entamoeba invadens
DEINRRGYKLYLKLRDLFKNTERNIP

SEQ ID NO: 2990513 - protein, 25 aa, Entamoeba invadens
DEIPTQRIMSKGEKKARKALEKVGL

SEQ ID NO: 2990514 - protein, 24 aa, Entamoeba invadens
DEIQSYFYYHYFTPAFVGMEENKR

SEQ ID NO: 2990515 - protein, 24 aa, Entamoeba invadens
DEIRQIMICLSTSLKYIHSIGYCH

SEQ ID NO: 2990516 - protein, 40 aa, Entamoeba invadens
DEIRTLYLTPEDVSAIILLKIKQIVLSKYPGKNIKAIVGV

SEQ ID NO: 2990517 - protein, 18 aa, Entamoeba invadens
DEISLGFKGLEGTLSFTF

SEQ ID NO: 2990518 - protein, 36 aa, Entamoeba invadens
DEISNLIKLWFRELPKPILNVLSSDQIFYSAEAAES

SEQ ID NO: 2990519 - protein, 27 aa, Entamoeba invadens
DEISNRYVYLLTKYVPLIKESIRGVVR

SEQ ID NO: 2990520 - protein, 30 aa, Entamoeba invadens
DEIVDAILSHFFFLKPIATPQKFFMKFINF

SEQ ID NO: 2990521 - protein, 24 aa, Entamoeba invadens
DEIYEKFIIITEKFMSFSKKINES

SEQ ID NO: 2990522 - protein, 19 aa, Entamoeba invadens
DEKAKIKPWTRLATSQAKA

SEQ ID NO: 2990523 - protein, 23 aa, Entamoeba invadens
DEKFYLEILHFIEALVEAISTLF

SEQ ID NO: 2990524 - protein, 17 aa, Entamoeba invadens
DEKGNLCFYYLTVAFPE

SEQ ID NO: 2990525 - protein, 18 aa, Entamoeba invadens
DEKHNAAFILGMQAILIS

SEQ ID NO: 2990526 - protein, 18 aa, Entamoeba invadens
DEKHNAAFILGMQAILIT

SEQ ID NO: 2990527 - protein, 22 aa, Entamoeba invadens
DEKIIPWFEANLEEFLTEMRQH

SEQ ID NO: 2990528 - protein, 33 aa, Entamoeba invadens
DEKIKHYLNCTLPYYHLPNPFKKLGIPQTVDLA

SEQ ID NO: 2990529 - protein, 25 aa, Entamoeba invadens
DEKIKLKMILDAAKGILYLHENGIL

SEQ ID NO: 2990530 - protein, 22 aa, Entamoeba invadens
DEKKFDPFSMFKGWKEKLEAHP

SEQ ID NO: 2990531 - protein, 17 aa, Entamoeba invadens
DEKKFGFLIQPVNDNPY

SEQ ID NO: 2990532 - protein, 27 aa, Entamoeba invadens
DEKKSWVTLLNFALYQEKVYQFVDDES

SEQ ID NO: 2990533 - protein, 25 aa, Entamoeba invadens
DEKLLFMAFEWMKQSVALSAGNLDI

SEQ ID NO: 2990534 - protein, 25 aa, Entamoeba invadens
DEKLMKFTLVHLTDGGKKKKEEIVG

SEQ ID NO: 2990535 - protein, 26 aa, Entamoeba invadens
DEKLRRYFEVLYIPDEAVLGAPVGAI

SEQ ID NO: 2990536 - protein, 19 aa, Entamoeba invadens
DEKMLLSLFTVIVKSNMKL

SEQ ID NO: 2990537 - protein, 20 aa, Entamoeba invadens
DEKQCTLLVKGLSLDTPEDA

SEQ ID NO: 2990538 - protein, 28 aa, Entamoeba invadens
DEKRDWNRLLKNVSYINMKPLTKWTAFM

SEQ ID NO: 2990539 - protein, 26 aa, Entamoeba invadens
DEKSSLMEFFLQSVRKILTIGNIHSV

SEQ ID NO: 2990540 - protein, 28 aa, Entamoeba invadens
DEKTHFTEYCVLCYILALSKSEDIYHNF

SEQ ID NO: 2990541 - protein, 26 aa, Entamoeba invadens
DEKYRVRSVFGMYLVASSDGGVRLKR

SEQ ID NO: 2990542 - protein, 28 aa, Entamoeba invadens
DEKYVTAYIILYIDIRYVKYIIKKVVDV

SEQ ID NO: 2990543 - protein, 29 aa, Entamoeba invadens
DELDQFKGLIPVLIEYFNNAKKGDISAKQ

SEQ ID NO: 2990544 - protein, 20 aa, Entamoeba invadens
DELFKTMKKVSLPKLPKFKD

SEQ ID NO: 2990545 - protein, 18 aa, Entamoeba invadens
DELFSHFDFFKSVEWQNT

SEQ ID NO: 2990546 - protein, 24 aa, Entamoeba invadens
DELGLLFLTSLILAARYQDIEIGN

SEQ ID NO: 2990547 - protein, 17 aa, Entamoeba invadens
DELHKENKLGEGGFGIV

SEQ ID NO: 2990548 - protein, 22 aa, Entamoeba invadens
DELIGFIALHTFTVCVLVKEVK

SEQ ID NO: 2990549 - protein, 17 aa, Entamoeba invadens
DELIGVPLLVFANKHDL

SEQ ID NO: 2990550 - protein, 17 aa, Entamoeba invadens
DELKGAPLLIFANKHDL

SEQ ID NO: 2990551 - protein, 26 aa, Entamoeba invadens
DELKHYLCFIFWTSSQSWHLSFVMTF

SEQ ID NO: 2990552 - protein, 24 aa, Entamoeba invadens
DELKPETFTWNPYTYQLNVERKQV

SEQ ID NO: 2990553 - protein, 22 aa, Entamoeba invadens
DELLDYLRAHCAHCPTGSFFPS

SEQ ID NO: 2990554 - protein, 24 aa, Entamoeba invadens
DELMDSYGPMILLITDISGLNDNQ

SEQ ID NO: 2990555 - protein, 23 aa, Entamoeba invadens
DELNKKQLVFSPLSFFRTKYSVT

SEQ ID NO: 2990556 - protein, 22 aa, Entamoeba invadens
DELPVKIVLIGALGAGKTSLIK

SEQ ID NO: 2990557 - protein, 25 aa, Entamoeba invadens
DELRSFIIIFLKQCTAYGLKFEINK

SEQ ID NO: 2990558 - protein, 27 aa, Entamoeba invadens
DELSQIFIIIQPAILDLTIDLFGNYVV

SEQ ID NO: 2990559 - protein, 19 aa, Entamoeba invadens
DELTQPLAFWVFDIKGVED

SEQ ID NO: 2990560 - protein, 17 aa, Entamoeba invadens
DELTRYLNTPAIKNFKE

SEQ ID NO: 2990561 - protein, 17 aa, Entamoeba invadens
DELYYLKNHKFFHNLTL

SEQ ID NO: 2990562 - protein, 22 aa, Entamoeba invadens
DELYYLLEPFIDIVTMRNEAPT

SEQ ID NO: 2990563 - protein, 28 aa, Entamoeba invadens
DEMKSRSLQWFFKSVYEGKIYDADEGGS

SEQ ID NO: 2990564 - protein, 18 aa, Entamoeba invadens
DEMNIHRILEFYQSQQTI

SEQ ID NO: 2990565 - protein, 24 aa, Entamoeba invadens
DEMTFRPIKYPFNPIEFEKEIIFE

SEQ ID NO: 2990566 - protein, 25 aa, Entamoeba invadens
DEMVDIFKLLLLVTNYKSLLEEKKF

SEQ ID NO: 2990567 - protein, 26 aa, Entamoeba invadens
DENARKTFLKYLAGQRLKDNFLCYTV

SEQ ID NO: 2990568 - protein, 22 aa, Entamoeba invadens
DENCALPKLTSLRVLLSNDIIF

SEQ ID NO: 2990569 - protein, 23 aa, Entamoeba invadens
DENDAFYKKKTIAKITAPSDVLH

SEQ ID NO: 2990570 - protein, 24 aa, Entamoeba invadens
DENDFNIAFIIYSVLSRSSTTCAA

SEQ ID NO: 2990571 - protein, 25 aa, Entamoeba invadens
DENDYYFFNIDVLKIIYDNLDVVVA

SEQ ID NO: 2990572 - protein, 21 aa, Entamoeba invadens
DENFKLCYLKIGPNGNCYSWV

SEQ ID NO: 2990573 - protein, 18 aa, Entamoeba invadens
DENFLEKNLSEFVQPEKK

SEQ ID NO: 2990574 - protein, 26 aa, Entamoeba invadens
DENKVEALVTFFKTPTRPNGDETVEF

SEQ ID NO: 2990575 - protein, 26 aa, Entamoeba invadens
DENNPRIYPQWFSQKLKKVRLYSEEI

SEQ ID NO: 2990576 - protein, 24 aa, Entamoeba invadens
DENSPRFMLLKKICPHITFSFVIN

SEQ ID NO: 2990577 - protein, 25 aa, Entamoeba invadens
DENYYLKDFLCVLTLFDSECISKGK

SEQ ID NO: 2990578 - protein, 22 aa, Entamoeba invadens
DEPFNKKLLRDISDRNKLFGTL

SEQ ID NO: 2990579 - protein, 30 aa, Entamoeba invadens
DEPFSDIHFFKRIIYYPTSYMYYHLTKDTN

SEQ ID NO: 2990580 - protein, 21 aa, Entamoeba invadens
DEPFTFIKNYGNRFICVIFGN

SEQ ID NO: 2990581 - protein, 17 aa, Entamoeba invadens
DEPLKVLNKLGILKLFS

SEQ ID NO: 2990582 - protein, 23 aa, Entamoeba invadens
DEQHIKYIIQYIQLIVDNLNNYN

SEQ ID NO: 2990583 - protein, 30 aa, Entamoeba invadens
DEQIQPLRSYLILPIQRVPRYSLLLSDFLK

SEQ ID NO: 2990584 - protein, 26 aa, Entamoeba invadens
DEQKAQFKMMYMLMKLKKSQNEENEE

SEQ ID NO: 2990585 - protein, 24 aa, Entamoeba invadens
DEQKMYFDLFGLSSGVLFNTKSDK

SEQ ID NO: 2990586 - protein, 24 aa, Entamoeba invadens
DEQKNFFPMVNLKDVDYFNNKIST

SEQ ID NO: 2990587 - protein, 20 aa, Entamoeba invadens
DEQKRDLKLSIQVLEKNLMQ

SEQ ID NO: 2990588 - protein, 24 aa, Entamoeba invadens
DEQMKLWLEERRKRFPRRKPTQNN

SEQ ID NO: 2990589 - protein, 29 aa, Entamoeba invadens
DEQTEFAYLKYILLFSRNPILPNAVLNVF

SEQ ID NO: 2990590 - protein, 33 aa, Entamoeba invadens
DERENVPSVLLFRLKFPQLKFEMTHSRFRNVYG

SEQ ID NO: 2990591 - protein, 24 aa, Entamoeba invadens
DERFRSVMPVYFRGATSAIIVYDV

SEQ ID NO: 2990592 - protein, 24 aa, Entamoeba invadens
DERIDALWLWVNGTDPTWISKYKK

SEQ ID NO: 2990593 - protein, 21 aa, Entamoeba invadens
DERIKLINLAKTLFLSVNELK

SEQ ID NO: 2990594 - protein, 32 aa, Entamoeba invadens
DERKSLFISIALAIKLVLISKTSNELNITELY

SEQ ID NO: 2990595 - protein, 17 aa, Entamoeba invadens
DERSVVLLLEVIFNFQR

SEQ ID NO: 2990596 - protein, 20 aa, Entamoeba invadens
DESCEDKWYGSAPYMSPEAV

SEQ ID NO: 2990597 - protein, 25 aa, Entamoeba invadens
DESCFFLTTWVVVPLQKISKLCCNP

SEQ ID NO: 2990598 - protein, 31 aa, Entamoeba invadens
DESDFEFKCTVSFPRFAPETPQLKRKEIEAT

SEQ ID NO: 2990599 - protein, 17 aa, Entamoeba invadens
DESFIGMMLSKLSVKSP

SEQ ID NO: 2990600 - protein, 22 aa, Entamoeba invadens
DESIIVYQTLNTLPQILITKVV

SEQ ID NO: 2990601 - protein, 21 aa, Entamoeba invadens
DESILECLYLDKFSDKPLETI

SEQ ID NO: 2990602 - protein, 18 aa, Entamoeba invadens
DESLFVLLTKQGNVYVYE

SEQ ID NO: 2990603 - protein, 17 aa, Entamoeba invadens
DESLLDCSQASVSTLLA

SEQ ID NO: 2990604 - protein, 25 aa, Entamoeba invadens
DESPLLPFMGIISRDLVFASEYNAS

SEQ ID NO: 2990605 - protein, 28 aa, Entamoeba invadens
DESRTYMKLQFLGILEGLLSLGDFNSAY

SEQ ID NO: 2990606 - protein, 33 aa, Entamoeba invadens
DESYKVYELRLLQTLKLEYLIDGSIELSQIGKE

SEQ ID NO: 2990607 - protein, 25 aa, Entamoeba invadens
DESYSLFRVIPNTAISVRRSATLIS

SEQ ID NO: 2990608 - protein, 18 aa, Entamoeba invadens
DESYWVCQRLQLEILMNV

SEQ ID NO: 2990609 - protein, 26 aa, Entamoeba invadens
DETCALIPLPILPKQNPCYALCKEKT

SEQ ID NO: 2990610 - protein, 17 aa, Entamoeba invadens
DETFGNLFFVKTAFDED

SEQ ID NO: 2990611 - protein, 17 aa, Entamoeba invadens
DETFGNLLFVKTAFDED

SEQ ID NO: 2990612 - protein, 21 aa, Entamoeba invadens
DETFLICRDLQVLAYENTQLA

SEQ ID NO: 2990613 - protein, 23 aa, Entamoeba invadens
DETIKIFGLVRAEQKLTLTGHIG

SEQ ID NO: 2990614 - protein, 25 aa, Entamoeba invadens
DETKKHLAALPLDKFQIALDMHVGR

SEQ ID NO: 2990615 - protein, 21 aa, Entamoeba invadens
DETLKTFRLASNPLFPVTSLD

SEQ ID NO: 2990616 - protein, 23 aa, Entamoeba invadens
DETLLLSALTTLLADFCEYSPEY

SEQ ID NO: 2990617 - protein, 20 aa, Entamoeba invadens
DETLLSRIFSIVGHVVSCKI

SEQ ID NO: 2990618 - protein, 28 aa, Entamoeba invadens
DETLSTLINVFYLLDYSGRTKEMKEIVV

SEQ ID NO: 2990619 - protein, 23 aa, Entamoeba invadens
DETLYLLMEYLGGGDMMTLLIRE

SEQ ID NO: 2990620 - protein, 21 aa, Entamoeba invadens
DETYINWLSYAKKLDFSQFSK

SEQ ID NO: 2990621 - protein, 19 aa, Entamoeba invadens
DETYMLLGRSFSRGVPETQ

SEQ ID NO: 2990622 - protein, 20 aa, Entamoeba invadens
DEVDLLVNALKFSTKHFNDS

SEQ ID NO: 2990623 - protein, 18 aa, Entamoeba invadens
DEVFFTCNGKLVYKKKFE

SEQ ID NO: 2990624 - protein, 23 aa, Entamoeba invadens
DEVFKMIAQWIVLIKTKAQSASE

SEQ ID NO: 2990625 - protein, 28 aa, Entamoeba invadens
DEVIELHRLLERWPLLEPTPALELLDFR

SEQ ID NO: 2990626 - protein, 18 aa, Entamoeba invadens
DEVIRYFPSIVDLIFIQL

SEQ ID NO: 2990627 - protein, 19 aa, Entamoeba invadens
DEVLALDADWKKKGFELDQ

SEQ ID NO: 2990628 - protein, 25 aa, Entamoeba invadens
DEVLKIVYINVYPLVHFSSKKVPVS

SEQ ID NO: 2990629 - protein, 20 aa, Entamoeba invadens
DEVTAFFKKVGCEQAVEQVM

SEQ ID NO: 2990630 - protein, 19 aa, Entamoeba invadens
DEVVLALRGILDERRKDIA

SEQ ID NO: 2990631 - protein, 27 aa, Entamoeba invadens
DEVVLDLSFTPRLYKRSGVRFKQNEIS

SEQ ID NO: 2990632 - protein, 26 aa, Entamoeba invadens
DEVVMKLRIKFLLDGAKGIQYLHENG

SEQ ID NO: 2990633 - protein, 21 aa, Entamoeba invadens
DEVWIMRRSVGSSLFDDIFKM

SEQ ID NO: 2990634 - protein, 24 aa, Entamoeba invadens
DEWNLMVMELLGPSLEDLFTYCGR

SEQ ID NO: 2990635 - protein, 19 aa, Entamoeba invadens
DEWWRSVVAVTHSIVSYCI

SEQ ID NO: 2990636 - protein, 25 aa, Entamoeba invadens
DEYIDSIIGYIVTFLPELKNLFNGE

SEQ ID NO: 2990637 - protein, 27 aa, Entamoeba invadens
DEYRHLFCYIVSFIKKLKILGEEPDTL

SEQ ID NO: 2990638 - protein, 37 aa, Entamoeba invadens
DEYRYVVMNNLFPNTQFPLQFKFDLKGSLYGRKADEN

SEQ ID NO: 2990639 - protein, 39 aa, Entamoeba invadens
DEYYEDVYYGDGYWGDDGFYYVYDYETKRYYQGEPPEDD

SEQ ID NO: 2990640 - protein, 23 aa, Entamoeba invadens
DEYYWPNSHILLYGGKDVYAYTI

SEQ ID NO: 2990641 - protein, 33 aa, Entamoeba invadens
DFAEKEAEFYWPKLLILLEILKMFEKTGDKCLV

SEQ ID NO: 2990642 - protein, 20 aa, Entamoeba invadens
DFAKWVLEKYPNAYFGFAGV

SEQ ID NO: 2990643 - protein, 25 aa, Entamoeba invadens
DFANAVFVQVLLLRGNTQISELAID

SEQ ID NO: 2990644 - protein, 19 aa, Entamoeba invadens
DFANLAAMLLPLTSDETDA

SEQ ID NO: 2990645 - protein, 25 aa, Entamoeba invadens
DFATRCLYWFNFGYSEVGDIGALGV

SEQ ID NO: 2990646 - protein, 18 aa, Entamoeba invadens
DFAVICYMATIEASLPFL

SEQ ID NO: 2990647 - protein, 29 aa, Entamoeba invadens
DFAVQFLCDVMVLRYILLQTHKVAFSELK

SEQ ID NO: 2990648 - protein, 18 aa, Entamoeba invadens
DFAYYRCCELIISNFIQT

SEQ ID NO: 2990649 - protein, 18 aa, Entamoeba invadens
DFCFAYCRRLGQVVIGEG

SEQ ID NO: 2990650 - protein, 18 aa, Entamoeba invadens
DFCSRVVDFITAVSDILK

SEQ ID NO: 2990651 - protein, 25 aa, Entamoeba invadens
DFCYEQAILIFLVNQFGAVTLEKPG

SEQ ID NO: 2990652 - protein, 19 aa, Entamoeba invadens
DFDEGFLTQPKLVEENKTE

SEQ ID NO: 2990653 - protein, 27 aa, Entamoeba invadens
DFDGLTTQLFTYLIQWMDEVLKDVVDK

SEQ ID NO: 2990654 - protein, 17 aa, Entamoeba invadens
DFDLVMIEILKQKIEEI

SEQ ID NO: 2990655 - protein, 18 aa, Entamoeba invadens
DFDTNYKSPLFAIFGSGC

SEQ ID NO: 2990656 - protein, 22 aa, Entamoeba invadens
DFDVRIAKYTAFVKKMIGVDVN

SEQ ID NO: 2990657 - protein, 34 aa, Entamoeba invadens
DFDVVRTNWFWKHQPRTIRLSSKKFYRLNAGIFR

SEQ ID NO: 2990658 - protein, 23 aa, Entamoeba invadens
DFEAREYIPPKTSTRYFFGICPT

SEQ ID NO: 2990659 - protein, 23 aa, Entamoeba invadens
DFEAYQMAILLALINSRARILLE

SEQ ID NO: 2990660 - protein, 27 aa, Entamoeba invadens
DFEDAVYYFYLMMSGIFSQLLSTRKLA

SEQ ID NO: 2990661 - protein, 24 aa, Entamoeba invadens
DFEDLGMEAVWKIKVENLRAFILV

SEQ ID NO: 2990662 - protein, 33 aa, Entamoeba invadens
DFEETRFQPLAKKYLELLKIFDDKNRGKKFMTL

SEQ ID NO: 2990663 - protein, 22 aa, Entamoeba invadens
DFEIFRTFKNVFFFGEKISLEK

SEQ ID NO: 2990664 - protein, 29 aa, Entamoeba invadens
DFEIINRSKYFLITANKYIWYTDHDYNVL

SEQ ID NO: 2990665 - protein, 25 aa, Entamoeba invadens
DFEKDVLYLFGIINDFVMQKIKSGA

SEQ ID NO: 2990666 - protein, 26 aa, Entamoeba invadens
DFEKKKIFFFFLENQPNEVYDAGKIT

SEQ ID NO: 2990667 - protein, 30 aa, Entamoeba invadens
DFEMEELRALIFYLMDRPYVMVSSDVKSVI

SEQ ID NO: 2990668 - protein, 31 aa, Entamoeba invadens
DFEMEELRALIFYLMDRPYVMVSSDVKSVIP

SEQ ID NO: 2990669 - protein, 19 aa, Entamoeba invadens
DFENMKKSPLFAPKINRKR

SEQ ID NO: 2990670 - protein, 26 aa, Entamoeba invadens
DFETKYRVVFVKNLPKVLIEQDYKKY

SEQ ID NO: 2990671 - protein, 27 aa, Entamoeba invadens
DFEWDIHQVIIPPRQTDPVSLVLSAPV

SEQ ID NO: 2990672 - protein, 18 aa, Entamoeba invadens
DFFKAKTPIIERKDEKKP

SEQ ID NO: 2990673 - protein, 19 aa, Entamoeba invadens
DFFKQCWQFKYIQPIPIES

SEQ ID NO: 2990674 - protein, 18 aa, Entamoeba invadens
DFFQLPPVSKNQNIKFVF

SEQ ID NO: 2990675 - protein, 19 aa, Entamoeba invadens
DFFRRSAFSGLTKKGDKSG

SEQ ID NO: 2990676 - protein, 21 aa, Entamoeba invadens
DFFSYVLVCKKFRDTLMKYHT

SEQ ID NO: 2990677 - protein, 18 aa, Entamoeba invadens
DFFVAHNNGFFVVQNGSL

SEQ ID NO: 2990678 - protein, 32 aa, Entamoeba invadens
DFFYESSPYHRAILSLLFDPIVHYSPLNVIPF

SEQ ID NO: 2990679 - protein, 19 aa, Entamoeba invadens
DFFYEYLLERYDGFESLFE

SEQ ID NO: 2990680 - protein, 24 aa, Entamoeba invadens
DFGDEINDIRLEAAKVQAINLEEF

SEQ ID NO: 2990681 - protein, 31 aa, Entamoeba invadens
DFGESAFMYMVRLNTFPFPKKVTAFGNLCFA

SEQ ID NO: 2990682 - protein, 29 aa, Entamoeba invadens
DFGKTKFYKKDVFLPPPVSKELIENLVML

SEQ ID NO: 2990683 - protein, 17 aa, Entamoeba invadens
DFGNIFNQPPKEQTPPM

SEQ ID NO: 2990684 - protein, 27 aa, Entamoeba invadens
DFGVDKIVCVIRLLFDVFDTKQSGFIS

SEQ ID NO: 2990685 - protein, 24 aa, Entamoeba invadens
DFHTTLQPLYLKKKKLSNIIGVDM

SEQ ID NO: 2990686 - protein, 35 aa, Entamoeba invadens
DFHTWKKRWFVMKEQYIWYFPKNTGSAQPKGIIEL

SEQ ID NO: 2990687 - protein, 19 aa, Entamoeba invadens
DFHVLPPSLFSLSGLNELD

SEQ ID NO: 2990688 - protein, 19 aa, Entamoeba invadens
DFILRKLINGERMSLFSPT

SEQ ID NO: 2990689 - protein, 17 aa, Entamoeba invadens
DFILRKMINAERSAMLT

SEQ ID NO: 2990690 - protein, 35 aa, Entamoeba invadens
DFINAVLVCKKFIHLLERYRYNPIPVTSKRLFPYM

SEQ ID NO: 2990691 - protein, 25 aa, Entamoeba invadens
DFINIIFVCKKYRNIIENFHYNPIP

SEQ ID NO: 2990692 - protein, 27 aa, Entamoeba invadens
DFINSILMCKKFSFILDRFRYNPIQVD

SEQ ID NO: 2990693 - protein, 33 aa, Entamoeba invadens
DFINSVLINKKYRLLLDRFRYNPISVSDIKIFP

SEQ ID NO: 2990694 - protein, 20 aa, Entamoeba invadens
DFINTVIMRLPKDQQKRLFK

SEQ ID NO: 2990695 - protein, 24 aa, Entamoeba invadens
DFINVTFVCKKYYINKGREILLKK

SEQ ID NO: 2990696 - protein, 20 aa, Entamoeba invadens
DFITISFVSKKYRNITNYFH

SEQ ID NO: 2990697 - protein, 24 aa, Entamoeba invadens
DFKAQLSYLIALKRKETNDPLCVL

SEQ ID NO: 2990698 - protein, 20 aa, Entamoeba invadens
DFKERGGYKEKAPNKEHYDT

SEQ ID NO: 2990699 - protein, 23 aa, Entamoeba invadens
DFKFTPNIFLQLLNEKKLLEQRK

SEQ ID NO: 2990700 - protein, 25 aa, Entamoeba invadens
DFKFYYRDRSLKGGIVFCDCTSPET

SEQ ID NO: 2990701 - protein, 31 aa, Entamoeba invadens
DFKKLDLVIDYASVQSLFPGTLRDGVEVKFN

SEQ ID NO: 2990702 - protein, 19 aa, Entamoeba invadens
DFKKLIRRLTPIKVRSEKS

SEQ ID NO: 2990703 - protein, 18 aa, Entamoeba invadens
DFKLANYEKALYSAFLKT

SEQ ID NO: 2990704 - protein, 22 aa, Entamoeba invadens
DFKMNFFRVNIWYEVSYELVQN

SEQ ID NO: 2990705 - protein, 23 aa, Entamoeba invadens
DFKVAGQLELLFLNDLRELKRVE

SEQ ID NO: 2990706 - protein, 17 aa, Entamoeba invadens
DFKWNNDGVIFLTTFEN

SEQ ID NO: 2990707 - protein, 19 aa, Entamoeba invadens
DFLAPSKFDPNLLDPKFVF

SEQ ID NO: 2990708 - protein, 18 aa, Entamoeba invadens
DFLEILFSDLLFGDTERT

SEQ ID NO: 2990709 - protein, 18 aa, Entamoeba invadens
DFLMLFEVGFEEFKGWKA

SEQ ID NO: 2990710 - protein, 32 aa, Entamoeba invadens
DFLQEFSIGEITLLEDVPLITIITPSYSESKK

SEQ ID NO: 2990711 - protein, 26 aa, Entamoeba invadens
DFLRVIFSYQYFFEMNIPISMKSDNI

SEQ ID NO: 2990712 - protein, 25 aa, Entamoeba invadens
DFLTGFPLFGMNGFWKLINKDDPWM

SEQ ID NO: 2990713 - protein, 18 aa, Entamoeba invadens
DFLTSVKMYFLSMPEMQK

SEQ ID NO: 2990714 - protein, 22 aa, Entamoeba invadens
DFLWFSSALPNLLDVIKKCSMS

SEQ ID NO: 2990715 - protein, 23 aa, Entamoeba invadens
DFLYDEFFIRPVNNAPIYVEQEV

SEQ ID NO: 2990716 - protein, 24 aa, Entamoeba invadens
DFMDPPVETALYSAMHHLFSIGAL

SEQ ID NO: 2990717 - protein, 19 aa, Entamoeba invadens
DFMVCELVQFLPHLATLLW

SEQ ID NO: 2990718 - protein, 17 aa, Entamoeba invadens
DFMYVPFRCFDGCVNLE

SEQ ID NO: 2990719 - protein, 17 aa, Entamoeba invadens
DFNAYTYDMRYMKTPYR

SEQ ID NO: 2990720 - protein, 35 aa, Entamoeba invadens
DFNLFALPEKILHKILTFLPLEDLVVLLAVSKRMH

SEQ ID NO: 2990721 - protein, 30 aa, Entamoeba invadens
DFNNEIIKLIKLFMVRTFIFTCSQIALESV

SEQ ID NO: 2990722 - protein, 42 aa, Entamoeba invadens
DFNNFDFNFIDFYKMSLILFQQSFYLNFSYFTKDKAALFKKS

SEQ ID NO: 2990723 - protein, 34 aa, Entamoeba invadens
DFNNYPTTLYLTCQSLVLLPIFSSLPKNHIFINF

SEQ ID NO: 2990724 - protein, 37 aa, Entamoeba invadens
DFNVLHEFLNFYVILMKFVCFKLYNTAGLVYPPRIDY

SEQ ID NO: 2990725 - protein, 20 aa, Entamoeba invadens
DFQEIAFNAPVGKYTQPFKT

SEQ ID NO: 2990726 - protein, 21 aa, Entamoeba invadens
DFQFKLVGVLIHLGSLDSGHY

SEQ ID NO: 2990727 - protein, 17 aa, Entamoeba invadens
DFQHLFTTAITLLKEYK

SEQ ID NO: 2990728 - protein, 17 aa, Entamoeba invadens
DFQICIEPSFLNSKTLK

SEQ ID NO: 2990729 - protein, 19 aa, Entamoeba invadens
DFQIPKHGYLIEWARQGVL

SEQ ID NO: 2990730 - protein, 25 aa, Entamoeba invadens
DFQMRDFMLCLISDCYKCYLNSPIS

SEQ ID NO: 2990731 - protein, 19 aa, Entamoeba invadens
DFQNFKWLESIKVVCYSTL

SEQ ID NO: 2990732 - protein, 30 aa, Entamoeba invadens
DFQPDLVAAVFKKFLRELPEHLFDAEVTKL

SEQ ID NO: 2990733 - protein, 25 aa, Entamoeba invadens
DFRATLNPFPRWGNYQNFGQMMATV

SEQ ID NO: 2990734 - protein, 17 aa, Entamoeba invadens
DFRFLELGDYQKGFTHL

SEQ ID NO: 2990735 - protein, 22 aa, Entamoeba invadens
DFRIKLMRPRDLGYDEIDVNFF

SEQ ID NO: 2990736 - protein, 37 aa, Entamoeba invadens
DFSEIIVKGFYFYNLPFLTVIRLFQKYANASILFPHR

SEQ ID NO: 2990737 - protein, 23 aa, Entamoeba invadens
DFSEPFTIIQLPIQIMFSTNNCK

SEQ ID NO: 2990738 - protein, 36 aa, Entamoeba invadens
DFSINIFDVKLLPDILPKITSFYFGGSNIFPINFRP

SEQ ID NO: 2990739 - protein, 21 aa, Entamoeba invadens
DFSKIVLIEKTPVDLKLCDFA

SEQ ID NO: 2990740 - protein, 23 aa, Entamoeba invadens
DFSNFDNLKVLRILLKKSVATEI

SEQ ID NO: 2990741 - protein, 32 aa, Entamoeba invadens
DFTEVVRWFAERADMIILVFDAHKLDISDEFK

SEQ ID NO: 2990742 - protein, 25 aa, Entamoeba invadens
DFTFLHTFHMYAVSQKYLHIYDDST

SEQ ID NO: 2990743 - protein, 17 aa, Entamoeba invadens
DFTIDKNVFIKKSIFVC

SEQ ID NO: 2990744 - protein, 24 aa, Entamoeba invadens
DFTIKIRRLYKKGHKTHQLFVIES

SEQ ID NO: 2990745 - protein, 25 aa, Entamoeba invadens
DFTKDQIVIMKLLSYSITSFGTKKH

SEQ ID NO: 2990746 - protein, 29 aa, Entamoeba invadens
DFTKLQVFYVPMLGIAPKWCSFLENLTEE

SEQ ID NO: 2990747 - protein, 17 aa, Entamoeba invadens
DFTLLKNTPQNLKVWTT

SEQ ID NO: 2990748 - protein, 19 aa, Entamoeba invadens
DFTNDLFVYFRSGEMRKYT

SEQ ID NO: 2990749 - protein, 20 aa, Entamoeba invadens
DFTNLFIGNLTFNTTEKELE

SEQ ID NO: 2990750 - protein, 24 aa, Entamoeba invadens
DFTPQCILCSRGFYPTTSGTCDSC

SEQ ID NO: 2990751 - protein, 29 aa, Entamoeba invadens
DFTRKCVSCKPYYYIKTSGNYKCQSCSST

SEQ ID NO: 2990752 - protein, 21 aa, Entamoeba invadens
DFTVLVIDLVSYKVYYRQTIS

SEQ ID NO: 2990753 - protein, 25 aa, Entamoeba invadens
DFTVSYLVYKFIKDKLQLLELKLDK

SEQ ID NO: 2990754 - protein, 21 aa, Entamoeba invadens
DFVAPSEVILRPFWIEDKSTD

SEQ ID NO: 2990755 - protein, 20 aa, Entamoeba invadens
DFVDTTILLVKPQTKMTANH

SEQ ID NO: 2990756 - protein, 20 aa, Entamoeba invadens
DFVGLPMYLEEIEDFVFTNC

SEQ ID NO: 2990757 - protein, 25 aa, Entamoeba invadens
DFVKAKRTWINPNNGFWCQLYHFAK

SEQ ID NO: 2990758 - protein, 23 aa, Entamoeba invadens
DFVKIKFCFRIILQKYFNEEKNL

SEQ ID NO: 2990759 - protein, 28 aa, Entamoeba invadens
DFVPPKITHADLLLFDLKRCFPTEQWLD

SEQ ID NO: 2990760 - protein, 21 aa, Entamoeba invadens
DFVQITKIDKGAFGKIFVARR

SEQ ID NO: 2990761 - protein, 28 aa, Entamoeba invadens
DFVVDEELFLFTFKKGPFSYCKKWVPNR

SEQ ID NO: 2990762 - protein, 24 aa, Entamoeba invadens
DFVVFWLKEMKKFQKMFVRIVDRK

SEQ ID NO: 2990763 - protein, 28 aa, Entamoeba invadens
DFVVYVKTRAKYIVLTETMFVILKDEAV

SEQ ID NO: 2990764 - protein, 18 aa, Entamoeba invadens
DFWAVNHCSVLNCTFRHG

SEQ ID NO: 2990765 - protein, 17 aa, Entamoeba invadens
DFWGFREHPSLEGHKEM

SEQ ID NO: 2990766 - protein, 21 aa, Entamoeba invadens
DFWKVVIFDQFNCDLLSLQLR

SEQ ID NO: 2990767 - protein, 20 aa, Entamoeba invadens
DFYFQDFDIPSIQKVVILLH

SEQ ID NO: 2990768 - protein, 18 aa, Entamoeba invadens
DFYVMRTNWYGRHQIRIF

SEQ ID NO: 2990769 - protein, 25 aa, Entamoeba invadens
DGACGLQFFLNCFKNLQIKRKTRAS

SEQ ID NO: 2990770 - protein, 23 aa, Entamoeba invadens
DGADRICFVCHKPFHNKCYSETK

SEQ ID NO: 2990771 - protein, 17 aa, Entamoeba invadens
DGAIPFEKELDAFCSSF

SEQ ID NO: 2990772 - protein, 23 aa, Entamoeba invadens
DGAKCIPCQIGTYSNLPGSASCT

SEQ ID NO: 2990773 - protein, 26 aa, Entamoeba invadens
DGASRILYPLFARLPSEPLTRRHYTQ

SEQ ID NO: 2990774 - protein, 19 aa, Entamoeba invadens
DGAYVLIRNGWLSGKLLAK

SEQ ID NO: 2990775 - protein, 20 aa, Entamoeba invadens
DGCFWNCNTLIYINIPQKVT

SEQ ID NO: 2990776 - protein, 19 aa, Entamoeba invadens
DGCIRIFMKNTGEPLILKA

SEQ ID NO: 2990777 - protein, 34 aa, Entamoeba invadens
DGCTFKAWKYWPYSLHCHRLMWYANTVGKGGELM

SEQ ID NO: 2990778 - protein, 25 aa, Entamoeba invadens
DGCTKMRVPLPPLMTLERACPGCVD

SEQ ID NO: 2990779 - protein, 23 aa, Entamoeba invadens
DGDDIILLCSFYKQTDVNKNFKV

SEQ ID NO: 2990780 - protein, 20 aa, Entamoeba invadens
DGDERLNVRWAFDDPNPIAK

SEQ ID NO: 2990781 - protein, 24 aa, Entamoeba invadens
DGDILVMLYTYRREKDKNYIEYQR

SEQ ID NO: 2990782 - protein, 33 aa, Entamoeba invadens
DGDKFTPKRIYPYIFYIIITDCLFNISRQLNIS

SEQ ID NO: 2990783 - protein, 18 aa, Entamoeba invadens
DGDLKENKFTLIFKNKDN

SEQ ID NO: 2990784 - protein, 30 aa, Entamoeba invadens
DGDSYRSPFSNTYFPPFPEGNKPSAELRNL

SEQ ID NO: 2990785 - protein, 21 aa, Entamoeba invadens
DGDYVWAHDPYYHGVQSQKVS

SEQ ID NO: 2990786 - protein, 23 aa, Entamoeba invadens
DGEFELMNYRLTSNVRQLIWVES

SEQ ID NO: 2990787 - protein, 29 aa, Entamoeba invadens
DGEFLSTGWIPFLRCLFEIERLRQIASGW

SEQ ID NO: 2990788 - protein, 25 aa, Entamoeba invadens
DGELNFINGSLSFKGKFDGSVESIQ

SEQ ID NO: 2990789 - protein, 31 aa, Entamoeba invadens
DGEQKYILGMVWMMILKYKINNVPKSDESSG

SEQ ID NO: 2990790 - protein, 29 aa, Entamoeba invadens
DGESFKFNLLQFRLSFEFTKDFRIKSISQ

SEQ ID NO: 2990791 - protein, 24 aa, Entamoeba invadens
DGESFNFNLLQLRPSFEFTKDFRI

SEQ ID NO: 2990792 - protein, 26 aa, Entamoeba invadens
DGESMCEWIFNALAFDINKEVLFPIA

SEQ ID NO: 2990793 - protein, 25 aa, Entamoeba invadens
DGESMCEWIFNALAFDINKEVLFPL

SEQ ID NO: 2990794 - protein, 23 aa, Entamoeba invadens
DGESMCEWIFNSLAFDTNKEVLF

SEQ ID NO: 2990795 - protein, 21 aa, Entamoeba invadens
DGEVLFPKTWTYPVSAHARDL

SEQ ID NO: 2990796 - protein, 26 aa, Entamoeba invadens
DGEYRMHLALFAAFYPSYFTTESADD

SEQ ID NO: 2990797 - protein, 19 aa, Entamoeba invadens
DGFAVKEEWLYDCISEMKL

SEQ ID NO: 2990798 - protein, 20 aa, Entamoeba invadens
DGFFLGFSQEGLIPPSSKYG

SEQ ID NO: 2990799 - protein, 25 aa, Entamoeba invadens
DGFGGKLRFIFNGGAPITPALFEWL

SEQ ID NO: 2990800 - protein, 17 aa, Entamoeba invadens
DGFIFSTIDIPYANKYT

SEQ ID NO: 2990801 - protein, 19 aa, Entamoeba invadens
DGFKYACDFMVYKKNPKEC

SEQ ID NO: 2990802 - protein, 19 aa, Entamoeba invadens
DGFLIVYSITDRKSFDEID

SEQ ID NO: 2990803 - protein, 19 aa, Entamoeba invadens
DGFNIDFLLKLRDVKDNTN

SEQ ID NO: 2990804 - protein, 19 aa, Entamoeba invadens
DGFRIAVDFARREEARDKT

SEQ ID NO: 2990805 - protein, 36 aa, Entamoeba invadens
DGFTLLKTRMELYKTIFPIIKLENTILYFRAWEMID

SEQ ID NO: 2990806 - protein, 23 aa, Entamoeba invadens
DGFVDFCLRHDFEYGYSSLSDSE

SEQ ID NO: 2990807 - protein, 19 aa, Entamoeba invadens
DGFVKFGVIIPTPTVYAVA

SEQ ID NO: 2990808 - protein, 22 aa, Entamoeba invadens
DGHKLLKIRNPWGKCEWTGKWS

SEQ ID NO: 2990809 - protein, 20 aa, Entamoeba invadens
DGIFDQMNVYVKTPPQRQVV

SEQ ID NO: 2990810 - protein, 24 aa, Entamoeba invadens
DGIHGGLAHCFLFKKIDDCYCLQK

SEQ ID NO: 2990811 - protein, 29 aa, Entamoeba invadens
DGIHLLMDLLTECGYFFVTKLTEGKSGTV

SEQ ID NO: 2990812 - protein, 22 aa, Entamoeba invadens
DGILRLCGSQEKMKWMKERLQF

SEQ ID NO: 2990813 - protein, 19 aa, Entamoeba invadens
DGILTFHFECRGVQYGFIV

SEQ ID NO: 2990814 - protein, 20 aa, Entamoeba invadens
DGILTFHFECRGVQYGFIVP

SEQ ID NO: 2990815 - protein, 19 aa, Entamoeba invadens
DGIRNFLNLQILSCRSNHI

SEQ ID NO: 2990816 - protein, 26 aa, Entamoeba invadens
DGIVKLWDIRTLERPLYTLTKHKDAI

SEQ ID NO: 2990817 - protein, 27 aa, Entamoeba invadens
DGIVKYRNYWTINLASNQHSLIAKIRE

SEQ ID NO: 2990818 - protein, 17 aa, Entamoeba invadens
DGKCGLQFFFKNKTRKG

SEQ ID NO: 2990819 - protein, 30 aa, Entamoeba invadens
DGKDTFTCEGPIRWYCCGPTVYDDSHLGHA

SEQ ID NO: 2990820 - protein, 32 aa, Entamoeba invadens
DGKENQLMDIRYLQLLGVMKQLLETKRGFRVL

SEQ ID NO: 2990821 - protein, 17 aa, Entamoeba invadens
DGKEPFVFTNYFHGWRI

SEQ ID NO: 2990822 - protein, 30 aa, Entamoeba invadens
DGKIGIDKIPVFRIQAVTLSGVKCTKGGDE

SEQ ID NO: 2990823 - protein, 21 aa, Entamoeba invadens
DGKIYVHHLIKEMYPGLKNMT

SEQ ID NO: 2990824 - protein, 27 aa, Entamoeba invadens
DGKLAQFQIFLITHDQDFVKKMKDFGN

SEQ ID NO: 2990825 - protein, 25 aa, Entamoeba invadens
DGKLKLLEVLPYVKQAFQPQYVPYK

SEQ ID NO: 2990826 - protein, 27 aa, Entamoeba invadens
DGKLPCVFFIFSRKLVMDYAKRLAKST

SEQ ID NO: 2990827 - protein, 29 aa, Entamoeba invadens
DGKLPLEYALHLKLPLMVKLILDIDNFED

SEQ ID NO: 2990828 - protein, 17 aa, Entamoeba invadens
DGKLYQLQLWDTAGQEK

SEQ ID NO: 2990829 - protein, 36 aa, Entamoeba invadens
DGKPRVYTVEFRFGKIKIFFKVGVLAEIEEIRENRV

SEQ ID NO: 2990830 - protein, 18 aa, Entamoeba invadens
DGKRQNEFGIGGRNAKVG

SEQ ID NO: 2990831 - protein, 25 aa, Entamoeba invadens
DGKSFIYTVYWNFGGYCPAFSHGGT

SEQ ID NO: 2990832 - protein, 24 aa, Entamoeba invadens
DGKSIIWAILKQQAGWVGTGSLDF

SEQ ID NO: 2990833 - protein, 40 aa, Entamoeba invadens
DGKSVFVFDVKIPTSFFSHVYPVALCDLRQLHRSEELPLV

SEQ ID NO: 2990834 - protein, 27 aa, Entamoeba invadens
DGKTERAMIPLNPPITLLNKRTIKSPE

SEQ ID NO: 2990835 - protein, 17 aa, Entamoeba invadens
DGKTMKMNLIYNKKKLT

SEQ ID NO: 2990836 - protein, 21 aa, Entamoeba invadens
DGKVILRFKGINIPGGKGLGK

SEQ ID NO: 2990837 - protein, 42 aa, Entamoeba invadens
DGLFRKTSLLPATTWPWYKLISAIKLFTFPPGVNRFNRKRFS

SEQ ID NO: 2990838 - protein, 43 aa, Entamoeba invadens
DGLFRKTSLLPATTWPWYKLISAIKLFTFPPGVNRFNRKRFSE

SEQ ID NO: 2990839 - protein, 24 aa, Entamoeba invadens
DGLHLVLVINKIDRLVFEKSFSID

SEQ ID NO: 2990840 - protein, 27 aa, Entamoeba invadens
DGLIKYKPTRKFLSLVKERFPEDTEFI

SEQ ID NO: 2990841 - protein, 32 aa, Entamoeba invadens
DGLKLYPTLVIRGTRLYEMWRKGLYHSYTSEE

SEQ ID NO: 2990842 - protein, 20 aa, Entamoeba invadens
DGLKPRFDYYAKPKIEGGMV

SEQ ID NO: 2990843 - protein, 21 aa, Entamoeba invadens
DGLVNIFSLKWRDAVFTFSVS

SEQ ID NO: 2990844 - protein, 26 aa, Entamoeba invadens
DGMEWLATHNYARPDDFLYCEENGKI

SEQ ID NO: 2990845 - protein, 20 aa, Entamoeba invadens
DGMILTNMLFDGLLNKMEVY

SEQ ID NO: 2990846 - protein, 21 aa, Entamoeba invadens
DGMLDLIDSGKLRMASATAFS

SEQ ID NO: 2990847 - protein, 29 aa, Entamoeba invadens
DGMLIRINKAVITKMFPGVPLVCASNSVT

SEQ ID NO: 2990848 - protein, 32 aa, Entamoeba invadens
DGNDLEFCEFNLDLRFLPDDLELPYEATDYCD

SEQ ID NO: 2990849 - protein, 22 aa, Entamoeba invadens
DGNKFGGFLYNEITGPDVWIQD

SEQ ID NO: 2990850 - protein, 17 aa, Entamoeba invadens
DGNLFGAVVFKSITSEN

SEQ ID NO: 2990851 - protein, 23 aa, Entamoeba invadens
DGNLIRKIGTIGGGVFDIVRNTE

SEQ ID NO: 2990852 - protein, 17 aa, Entamoeba invadens
DGNRLYAILFTQIEMIG

SEQ ID NO: 2990853 - protein, 27 aa, Entamoeba invadens
DGNTALHRFPFLPRFNNGLKFGSVPIT

SEQ ID NO: 2990854 - protein, 21 aa, Entamoeba invadens
DGPFAIFLDVIEKNTQKPVTT

SEQ ID NO: 2990855 - protein, 18 aa, Entamoeba invadens
DGQLKGYAFIEYATKQEA

SEQ ID NO: 2990856 - protein, 17 aa, Entamoeba invadens
DGQLRIVELEDISENLV

SEQ ID NO: 2990857 - protein, 25 aa, Entamoeba invadens
DGQNPFVFFLRFHDEPTVKECIHAF

SEQ ID NO: 2990858 - protein, 24 aa, Entamoeba invadens
DGQRTLFRVLRAWSMQDKEVGYVQ

SEQ ID NO: 2990859 - protein, 20 aa, Entamoeba invadens
DGQVRKWRRELHAFDEMKSA

SEQ ID NO: 2990860 - protein, 17 aa, Entamoeba invadens
DGRDYEFKYGKFKLKRI

SEQ ID NO: 2990861 - protein, 17 aa, Entamoeba invadens
DGRFFHIDFGHFLGNFK

SEQ ID NO: 2990862 - protein, 27 aa, Entamoeba invadens
DGRIRGVEMILIDDWVGYAVGFSSGKL

SEQ ID NO: 2990863 - protein, 24 aa, Entamoeba invadens
DGRRWSILPRHVHILQKIDLRMDI

SEQ ID NO: 2990864 - protein, 23 aa, Entamoeba invadens
DGRVSYYESYFVRRCGIKCSNIS

SEQ ID NO: 2990865 - protein, 26 aa, Entamoeba invadens
DGRVTYPLVLIYYSPTGINPRESMIY

SEQ ID NO: 2990866 - protein, 25 aa, Entamoeba invadens
DGSFIGMSFPHLYMLQYPDVVLDSD

SEQ ID NO: 2990867 - protein, 24 aa, Entamoeba invadens
DGSKFLFQMHFLKEEFAWKISALK

SEQ ID NO: 2990868 - protein, 32 aa, Entamoeba invadens
DGSKNLFGIFYGFWLKKTMGFIIDGEIGNFFG

SEQ ID NO: 2990869 - protein, 23 aa, Entamoeba invadens
DGSLILEIPGDKLRFETGGKGVD

SEQ ID NO: 2990870 - protein, 25 aa, Entamoeba invadens
DGSLNFLSILALKYGLEEQDKFGVK

SEQ ID NO: 2990871 - protein, 22 aa, Entamoeba invadens
DGSLRFLKHGNVLNHYGAIPQT

SEQ ID NO: 2990872 - protein, 23 aa, Entamoeba invadens
DGSNGMLCVCNIKKFGHVFNVKL

SEQ ID NO: 2990873 - protein, 21 aa, Entamoeba invadens
DGSVCIICHNGNLFDKCESCK

SEQ ID NO: 2990874 - protein, 23 aa, Entamoeba invadens
DGSVFVWNLLDGKFAKRIYPDVN

SEQ ID NO: 2990875 - protein, 24 aa, Entamoeba invadens
DGSVKIVLYIRFPDSDVARCDSIE

SEQ ID NO: 2990876 - protein, 30 aa, Entamoeba invadens
DGTFKIITTPFILLNTLINVLEKNTIRVDC

SEQ ID NO: 2990877 - protein, 23 aa, Entamoeba invadens
DGTFKIVTTPYTLLNTLYTTLEK

SEQ ID NO: 2990878 - protein, 21 aa, Entamoeba invadens
DGTFRLSSFGGKNKLFIDDKF

SEQ ID NO: 2990879 - protein, 18 aa, Entamoeba invadens
DGTIFNLEKLEIIGKQNL

SEQ ID NO: 2990880 - protein, 18 aa, Entamoeba invadens
DGTMINSVVVILITILCV

SEQ ID NO: 2990881 - protein, 29 aa, Entamoeba invadens
DGTPPYMDLPPMKALFKITTSGIPPLQGN

SEQ ID NO: 2990882 - protein, 26 aa, Entamoeba invadens
DGTQPIYYEFIEETTNLRDLSEYKMV

SEQ ID NO: 2990883 - protein, 18 aa, Entamoeba invadens
DGTWFYYGNNRIDRVESV

SEQ ID NO: 2990884 - protein, 29 aa, Entamoeba invadens
DGVFAVWDGTKFFCLFIKINSSQMDYLKM

SEQ ID NO: 2990885 - protein, 24 aa, Entamoeba invadens
DGVILKRYYYVFTDKFDTEKIFKI

SEQ ID NO: 2990886 - protein, 20 aa, Entamoeba invadens
DGVILSRYLEIESCKKIEGI

SEQ ID NO: 2990887 - protein, 24 aa, Entamoeba invadens
DGVIRIVQITPNKLLGCVGKHEFP

SEQ ID NO: 2990888 - protein, 20 aa, Entamoeba invadens
DGVLPLMFALQRADVESCKT

SEQ ID NO: 2990889 - protein, 24 aa, Entamoeba invadens
DGVPNPILIVKPYKRRTSANEESP

SEQ ID NO: 2990890 - protein, 28 aa, Entamoeba invadens
DGVTSKTMKIIMIGESSVGKTCCMNRYT

SEQ ID NO: 2990891 - protein, 19 aa, Entamoeba invadens
DGVVKFWSYKDRIAYLDGE

SEQ ID NO: 2990892 - protein, 17 aa, Entamoeba invadens
DGWWRCDLCGDRYKRNE

SEQ ID NO: 2990893 - protein, 20 aa, Entamoeba invadens
DGWYTITLIVDGDLSQLISM

SEQ ID NO: 2990894 - protein, 23 aa, Entamoeba invadens
DGYEKIMYTFIVILRGEFELTSE

SEQ ID NO: 2990895 - protein, 23 aa, Entamoeba invadens
DGYEKMMYTFIVILRGEFELTSE

SEQ ID NO: 2990896 - protein, 18 aa, Entamoeba invadens
DGYILYYCKAGDGLVDLS

SEQ ID NO: 2990897 - protein, 19 aa, Entamoeba invadens
DGYVIVYSITSMASFLEAN

SEQ ID NO: 2990898 - protein, 17 aa, Entamoeba invadens
DGYVIVYSITSTTSFFE

SEQ ID NO: 2990899 - protein, 19 aa, Entamoeba invadens
DGYVIVYSITSTTSFLEAN

SEQ ID NO: 2990900 - protein, 20 aa, Entamoeba invadens
DGYVIVYSITSTTSFLEANN

SEQ ID NO: 2990901 - protein, 20 aa, Entamoeba invadens
DGYVIVYSITSTTSFLEANS

SEQ ID NO: 2990902 - protein, 27 aa, Entamoeba invadens
DHAKKFVEFLQTLVPLRYQQSKKLVSQ

SEQ ID NO: 2990903 - protein, 19 aa, Entamoeba invadens
DHCGFDKVFFPNNLKEFGE

SEQ ID NO: 2990904 - protein, 24 aa, Entamoeba invadens
DHCKDWLDLFYGSISSGFTPPILL

SEQ ID NO: 2990905 - protein, 25 aa, Entamoeba invadens
DHCKNFKIRILKPNTLISIKNCSKF

SEQ ID NO: 2990906 - protein, 25 aa, Entamoeba invadens
DHCTHAHLLLNERVTLFGIEIFGGC

SEQ ID NO: 2990907 - protein, 30 aa, Entamoeba invadens
DHDNNFVLERYIVALNYMFKRASDITNTKT

SEQ ID NO: 2990908 - protein, 29 aa, Entamoeba invadens
DHDQATYFQFLPIFKKQTIKHTKNKQDTK

SEQ ID NO: 2990909 - protein, 25 aa, Entamoeba invadens
DHDYEHCFILRFLEKTPKAILVITS

SEQ ID NO: 2990910 - protein, 21 aa, Entamoeba invadens
DHFEYIGYKKWIELTRKINNN

SEQ ID NO: 2990911 - protein, 24 aa, Entamoeba invadens
DHFKGKLPLNYKNFKTIILDVNFG

SEQ ID NO: 2990912 - protein, 27 aa, Entamoeba invadens
DHFLSNLVLHPFVINRGIFQCDTSDGS

SEQ ID NO: 2990913 - protein, 17 aa, Entamoeba invadens
DHFPLKLNEIMNLQNCD

SEQ ID NO: 2990914 - protein, 42 aa, Entamoeba invadens
DHGCDSMNSTWLHKVYWKVLIRCWITEQLLFASQNPLGEGSG

SEQ ID NO: 2990915 - protein, 27 aa, Entamoeba invadens
DHGCGKTCLLTLYSSSEFPTDYIPTCH

SEQ ID NO: 2990916 - protein, 29 aa, Entamoeba invadens
DHGYTVVPTLHFPLLTPDWGADEELMLLE

SEQ ID NO: 2990917 - protein, 24 aa, Entamoeba invadens
DHHHGRLVLVIDQLPGLPPLVSNG

SEQ ID NO: 2990918 - protein, 24 aa, Entamoeba invadens
DHHIGFYGIDINGVLIGAIAYIPS

SEQ ID NO: 2990919 - protein, 20 aa, Entamoeba invadens
DHIFKYIIIGEVSVGKSCLL

SEQ ID NO: 2990920 - protein, 23 aa, Entamoeba invadens
DHIPHSYVRVLLKCLVNLGGMDI

SEQ ID NO: 2990921 - protein, 20 aa, Entamoeba invadens
DHIPTFFWQVGRSLLEHPCE

SEQ ID NO: 2990922 - protein, 28 aa, Entamoeba invadens
DHKTQRIFPNMETIYLYFPLNEEEEGSD

SEQ ID NO: 2990923 - protein, 22 aa, Entamoeba invadens
DHLCNIFIVKPFKKTTKEKIKV

SEQ ID NO: 2990924 - protein, 23 aa, Entamoeba invadens
DHLSNTRCFLFKNLKCLVIDEAD

SEQ ID NO: 2990925 - protein, 17 aa, Entamoeba invadens
DHLTAFLRLPKDPTFEV

SEQ ID NO: 2990926 - protein, 18 aa, Entamoeba invadens
DHMTFCTSSLQALMRVVR

SEQ ID NO: 2990927 - protein, 33 aa, Entamoeba invadens
DHNKFYDSFVQWQFWRLKNLGKILFGKRYTIYS

SEQ ID NO: 2990928 - protein, 31 aa, Entamoeba invadens
DHPDLFKGLLNELFYVVFVSVLRHPNTTQSM

SEQ ID NO: 2990929 - protein, 22 aa, Entamoeba invadens
DHPSIIKLYDVFETRMYVYIVM

SEQ ID NO: 2990930 - protein, 27 aa, Entamoeba invadens
DHPTVFDFLSLLWQAAGYPPYAQDRRN

SEQ ID NO: 2990931 - protein, 24 aa, Entamoeba invadens
DHPYIYKLLCTINYLLRVKKNFQF

SEQ ID NO: 2990932 - protein, 19 aa, Entamoeba invadens
DHQNFLKEITLPNTLTSLG

SEQ ID NO: 2990933 - protein, 21 aa, Entamoeba invadens
DHRKNYFLKTPDFRRKIFVDC

SEQ ID NO: 2990934 - protein, 17 aa, Entamoeba invadens
DHRMKFFYMNNTCFLRQ

SEQ ID NO: 2990935 - protein, 19 aa, Entamoeba invadens
DHRVEAISLFSILRVRVSS

SEQ ID NO: 2990936 - protein, 18 aa, Entamoeba invadens
DHSALIRTFIPSASPVIR

SEQ ID NO: 2990937 - protein, 19 aa, Entamoeba invadens
DHVFYTYYASNSVGYPLVL

SEQ ID NO: 2990938 - protein, 22 aa, Entamoeba invadens
DHVYKMIVDTFNYLPLAADVQG

SEQ ID NO: 2990939 - protein, 19 aa, Entamoeba invadens
DHYKLALAQLSVAKKLVDG

SEQ ID NO: 2990940 - protein, 20 aa, Entamoeba invadens
DIAAALVYGKKFITPNWFSH

SEQ ID NO: 2990941 - protein, 27 aa, Entamoeba invadens
DIAAKPIQPPVLLQDQLPKKVETSPKR

SEQ ID NO: 2990942 - protein, 19 aa, Entamoeba invadens
DIADLEKQVKMLQNTISGV

SEQ ID NO: 2990943 - protein, 23 aa, Entamoeba invadens
DIAEIFGIVIELLTKISNNFKIK

SEQ ID NO: 2990944 - protein, 21 aa, Entamoeba invadens
DIAEIIVRAKTFEKKVQMAEQ

SEQ ID NO: 2990945 - protein, 18 aa, Entamoeba invadens
DIANMSFIRGKSGWIVVD

SEQ ID NO: 2990946 - protein, 22 aa, Entamoeba invadens
DIAQFLFPKVTTLSLRKDKIDF

SEQ ID NO: 2990947 - protein, 29 aa, Entamoeba invadens
DIAQHYLQKAGITALRRARKNDNLRLARA

SEQ ID NO: 2990948 - protein, 18 aa, Entamoeba invadens
DIASLTLIRGKTGWIAVD

SEQ ID NO: 2990949 - protein, 38 aa, Entamoeba invadens
DIATPFMRPQLVDWLFKTCDFLKFHKKLVFQALTLADS

SEQ ID NO: 2990950 - protein, 21 aa, Entamoeba invadens
DIAVPFWMANLINKSGCFCSN

SEQ ID NO: 2990951 - protein, 25 aa, Entamoeba invadens
DIAYMILHPILCDLKSRLKTVSFYN

SEQ ID NO: 2990952 - protein, 29 aa, Entamoeba invadens
DIAYNYAYVAWVYFDRIINTSALGKKESE

SEQ ID NO: 2990953 - protein, 25 aa, Entamoeba invadens
DICLEKGYFFNSRLARKSKKTKRLD

SEQ ID NO: 2990954 - protein, 17 aa, Entamoeba invadens
DIDFFSSTPPKKTEEEK

SEQ ID NO: 2990955 - protein, 25 aa, Entamoeba invadens
DIDGKTFHFAIWDTAGDEKYDSLTR

SEQ ID NO: 2990956 - protein, 23 aa, Entamoeba invadens
DIDGLVLVRGKLVWSITVCVNII

SEQ ID NO: 2990957 - protein, 17 aa, Entamoeba invadens
DIDHFLSNLVLHPFVIN

SEQ ID NO: 2990958 - protein, 24 aa, Entamoeba invadens
DIDKLVRWLIQRQMPVEGGFNGRI

SEQ ID NO: 2990959 - protein, 19 aa, Entamoeba invadens
DIDLFKIVFGGKLSQFVIR

SEQ ID NO: 2990960 - protein, 26 aa, Entamoeba invadens
DIDNIRGILFKLFQAGFINGQEVPRS

SEQ ID NO: 2990961 - protein, 17 aa, Entamoeba invadens
DIDNSRFFLTHKSPSTI

SEQ ID NO: 2990962 - protein, 31 aa, Entamoeba invadens
DIDTPFLLSHRQFFIDLLPTLISNFPTTRFI

SEQ ID NO: 2990963 - protein, 24 aa, Entamoeba invadens
DIEDAWEIYFKIYKRIHKSINSVS

SEQ ID NO: 2990964 - protein, 32 aa, Entamoeba invadens
DIEDIPVFKKAFYKIIVWFNVNFETVDQNKSR

SEQ ID NO: 2990965 - protein, 23 aa, Entamoeba invadens
DIEKLVFHFLQGGVVSRPTLFLL

SEQ ID NO: 2990966 - protein, 26 aa, Entamoeba invadens
DIEKYDFLVLVLLVLFCKTTMTEKMK

SEQ ID NO: 2990967 - protein, 23 aa, Entamoeba invadens
DIENQLIQLNPMLEAFGNAKTVK

SEQ ID NO: 2990968 - protein, 23 aa, Entamoeba invadens
DIENYYKPFFSVRPLVDTSPTYS

SEQ ID NO: 2990969 - protein, 28 aa, Entamoeba invadens
DIEQFKKLFFKTVAVSYAFYLQMKAFGY

SEQ ID NO: 2990970 - protein, 28 aa, Entamoeba invadens
DIERKQFEYIIKFIFSFIAKDKQHEQLM

SEQ ID NO: 2990971 - protein, 25 aa, Entamoeba invadens
DIERRKMRVLLHLLVLGKLNSEEKT

SEQ ID NO: 2990972 - protein, 21 aa, Entamoeba invadens
DIETRWFSKLGMLCSVRDNVE

SEQ ID NO: 2990973 - protein, 23 aa, Entamoeba invadens
DIFEFHAAVFYFVKKMGLENHFS

SEQ ID NO: 2990974 - protein, 19 aa, Entamoeba invadens
DIFGGYCSEFPIVDDVAKG

SEQ ID NO: 2990975 - protein, 26 aa, Entamoeba invadens
DIFGRQLINMGFIKVVDKLLDSTSQT

SEQ ID NO: 2990976 - protein, 17 aa, Entamoeba invadens
DIFNCNGCKVKIVTAPQ

SEQ ID NO: 2990977 - protein, 18 aa, Entamoeba invadens
DIFNHVFFDFQIAHIFQY

SEQ ID NO: 2990978 - protein, 25 aa, Entamoeba invadens
DIFNNNFFNEITKKSLNKWDKKLLF

SEQ ID NO: 2990979 - protein, 18 aa, Entamoeba invadens
DIFPFFTDFYQQVDDLKK

SEQ ID NO: 2990980 - protein, 34 aa, Entamoeba invadens
DIFPNQVPGWPALIYPFVRQLLNLKLVKNQKSEN

SEQ ID NO: 2990981 - protein, 25 aa, Entamoeba invadens
DIFTALSFMVKYLHKEFTKDLNTFF

SEQ ID NO: 2990982 - protein, 26 aa, Entamoeba invadens
DIFTIETFSFQFVLTTTDFVPPKITH

SEQ ID NO: 2990983 - protein, 22 aa, Entamoeba invadens
DIGFDSFLMSEIQTLAIPTSVT

SEQ ID NO: 2990984 - protein, 25 aa, Entamoeba invadens
DIHGQFYDLLKLFSIGGDLPEKSYI

SEQ ID NO: 2990985 - protein, 25 aa, Entamoeba invadens
DIHGQFYDMLNFMDLLGSPAENRFV

SEQ ID NO: 2990986 - protein, 26 aa, Entamoeba invadens
DIHHPAILGMVGIILSSSTILLDGDT

SEQ ID NO: 2990987 - protein, 29 aa, Entamoeba invadens
DIHLQVTFSTFFILLIVDQTNVQSLAYVQ

SEQ ID NO: 2990988 - protein, 28 aa, Entamoeba invadens
DIIAVLDLFARYRYLKEITSLVLDTLNG

SEQ ID NO: 2990989 - protein, 17 aa, Entamoeba invadens
DIIAVVMRVVNSPTFVG

SEQ ID NO: 2990990 - protein, 19 aa, Entamoeba invadens
DIIEMGNAILPIFERKGIT

SEQ ID NO: 2990991 - protein, 21 aa, Entamoeba invadens
DIIISQIACEGANADLEKLKE

SEQ ID NO: 2990992 - protein, 25 aa, Entamoeba invadens
DIIKHLHMNLPQNLAIEATPHYCFV

SEQ ID NO: 2990993 - protein, 19 aa, Entamoeba invadens
DIIKKLASSFPSLLIMKCF

SEQ ID NO: 2990994 - protein, 38 aa, Entamoeba invadens
DIIKNTLLDKLSAKKSVYLKLIIELEFQNIDLKSAETD

SEQ ID NO: 2990995 - protein, 18 aa, Entamoeba invadens
DIILDPLYKTKNITYLPF

SEQ ID NO: 2990996 - protein, 30 aa, Entamoeba invadens
DIILLPPNGKTLVALPFIPVKQVIFNEDDE

SEQ ID NO: 2990997 - protein, 17 aa, Entamoeba invadens
DIIPLLLTRIEKKTTFS

SEQ ID NO: 2990998 - protein, 19 aa, Entamoeba invadens
DIIQFSHYVHKLLALCIGC

SEQ ID NO: 2990999 - protein, 17 aa, Entamoeba invadens
DIISKRVILLPKDQRTY

SEQ ID NO: 2991000 - protein, 27 aa, Entamoeba invadens
DIITDLFVDHIVLLLIEMGISEKKEHI

SEQ ID NO: 2991001 - protein, 29 aa, Entamoeba invadens
DIITIHCPLNAKTKYLFGTSAFLKMKKDV

SEQ ID NO: 2991002 - protein, 18 aa, Entamoeba invadens
DIIYFNYIEEEIVEMIIH

SEQ ID NO: 2991003 - protein, 36 aa, Entamoeba invadens
DIIYKLMELFITFKFSPTFLYFMSRALVELHSRTPM

SEQ ID NO: 2991004 - protein, 17 aa, Entamoeba invadens
DIKASLPGIKLSNTFHW

SEQ ID NO: 2991005 - protein, 30 aa, Entamoeba invadens
DIKDKTFGDLWVEFLLRESGSLDSGTSHQV

SEQ ID NO: 2991006 - protein, 43 aa, Entamoeba invadens
DIKEAYRKLSLTSFLITPIQRLPRYKLFLIDLVKCTPACHPDH

SEQ ID NO: 2991007 - protein, 28 aa, Entamoeba invadens
DIKESEGILLFFDLSIGPSFVSLDEYFE

SEQ ID NO: 2991008 - protein, 32 aa, Entamoeba invadens
DIKKTDFKIHPSILPKIYPSTSIVFKSSDPSI

SEQ ID NO: 2991009 - protein, 24 aa, Entamoeba invadens
DIKKTLLEFVQFKNKFVSFSNDDY

SEQ ID NO: 2991010 - protein, 34 aa, Entamoeba invadens
DIKMLGVAELKVLLKWREFVLRKIKIAQNDAEQK

SEQ ID NO: 2991011 - protein, 24 aa, Entamoeba invadens
DIKPDNILVFRLVLNNKANAKLTD

SEQ ID NO: 2991012 - protein, 18 aa, Entamoeba invadens
DIKPDNILVFSLDLNDKA

SEQ ID NO: 2991013 - protein, 25 aa, Entamoeba invadens
DIKPDNLLVFSLYLNDKVNAKLTEF

SEQ ID NO: 2991014 - protein, 17 aa, Entamoeba invadens
DIKPDNVLLFSLNPNDV

SEQ ID NO: 2991015 - protein, 29 aa, Entamoeba invadens
DIKPIEMALGSLFLYALDLQLVDEEFLKQ

SEQ ID NO: 2991016 - protein, 22 aa, Entamoeba invadens
DIKQIIFTPPSVLIRLDNDCIL

SEQ ID NO: 2991017 - protein, 22 aa, Entamoeba invadens
DIKRIRQVISKKGKLKGHAAKL

SEQ ID NO: 2991018 - protein, 24 aa, Entamoeba invadens
DIKTEDIELPIASNTSLEDAMLSQ

SEQ ID NO: 2991019 - protein, 24 aa, Entamoeba invadens
DIKTFGYIWDSRLCWQDDRLVELE

SEQ ID NO: 2991020 - protein, 25 aa, Entamoeba invadens
DIKTKGFCFSLFLSFVMEQANVQQQ

SEQ ID NO: 2991021 - protein, 17 aa, Entamoeba invadens
DIKTLPLHKLRKPIGMV

SEQ ID NO: 2991022 - protein, 19 aa, Entamoeba invadens
DIKTVNWNVKVPHIIALTL

SEQ ID NO: 2991023 - protein, 17 aa, Entamoeba invadens
DILAPAVTQRRVFELAL

SEQ ID NO: 2991024 - protein, 25 aa, Entamoeba invadens
DILDDLTFFARKYLYQVTYDKVATL

SEQ ID NO: 2991025 - protein, 36 aa, Entamoeba invadens
DILDPALMRPGRLDQLLFIPLPDRDSRLSILKAKLR

SEQ ID NO: 2991026 - protein, 27 aa, Entamoeba invadens
DILEVNKKFYLALRRLRDTHQLYTTIG

SEQ ID NO: 2991027 - protein, 27 aa, Entamoeba invadens
DILKAFLDTAVPILLKYFKLVFEDNVA

SEQ ID NO: 2991028 - protein, 20 aa, Entamoeba invadens
DILKCFILHSFISFSSNLFI

SEQ ID NO: 2991029 - protein, 17 aa, Entamoeba invadens
DILKIHSKKMNLVRGID

SEQ ID NO: 2991030 - protein, 18 aa, Entamoeba invadens
DILKRTLRLTNLIGVQIL

SEQ ID NO: 2991031 - protein, 19 aa, Entamoeba invadens
DILLLSTFNSQFNEFPSCG

SEQ ID NO: 2991032 - protein, 19 aa, Entamoeba invadens
DILLPKSLCLFGHQCFVFC

SEQ ID NO: 2991033 - protein, 27 aa, Entamoeba invadens
DILNTLDFLIIRPTTLDFLRRFSRAFE

SEQ ID NO: 2991034 - protein, 21 aa, Entamoeba invadens
DILPFMMINKRYQQIVLKLAV

SEQ ID NO: 2991035 - protein, 24 aa, Entamoeba invadens
DILQSLFTLFALNKFPITHEILEK

SEQ ID NO: 2991036 - protein, 20 aa, Entamoeba invadens
DILQTAGLVNFIGRDDKHTI

SEQ ID NO: 2991037 - protein, 25 aa, Entamoeba invadens
DILRKQICILPQEATLFSGSLKYNL

SEQ ID NO: 2991038 - protein, 18 aa, Entamoeba invadens
DILTAIKNASGTRPCLYV

SEQ ID NO: 2991039 - protein, 34 aa, Entamoeba invadens
DILTEISSNLKYFIISASPLLQKSLKMAQNTVFK

SEQ ID NO: 2991040 - protein, 26 aa, Entamoeba invadens
DILTKDYIWMTVLKNDTPYDEYKCVQ

SEQ ID NO: 2991041 - protein, 21 aa, Entamoeba invadens
DILTLQMIRLMNGIWKNNGLD

SEQ ID NO: 2991042 - protein, 20 aa, Entamoeba invadens
DILVKLLPSGELKKGFKKVL

SEQ ID NO: 2991043 - protein, 18 aa, Entamoeba invadens
DILYYFDAEKLHLKGYIP

SEQ ID NO: 2991044 - protein, 29 aa, Entamoeba invadens
DIMDHAIIPLPKIKFFATELLLAINAIHH

SEQ ID NO: 2991045 - protein, 18 aa, Entamoeba invadens
DIMESLWAEFVSDYLTFV

SEQ ID NO: 2991046 - protein, 19 aa, Entamoeba invadens
DIMKKLKPLTLPDNNKEVL

SEQ ID NO: 2991047 - protein, 20 aa, Entamoeba invadens
DIMKNITYFISLREKYLEEN

SEQ ID NO: 2991048 - protein, 17 aa, Entamoeba invadens
DIMTNEFLKNAVKLIFL

SEQ ID NO: 2991049 - protein, 21 aa, Entamoeba invadens
DINFDCFSLTLPSGLQLVNVV

SEQ ID NO: 2991050 - protein, 21 aa, Entamoeba invadens
DINFNLCFKDYYLAANSSKNP

SEQ ID NO: 2991051 - protein, 19 aa, Entamoeba invadens
DINFSYIKTLKNLSFIEVK

SEQ ID NO: 2991052 - protein, 23 aa, Entamoeba invadens
DINGMIPSFFINTASKSSTLEWY

SEQ ID NO: 2991053 - protein, 28 aa, Entamoeba invadens
DINKDYPAVVGLLFELLDRLEKMQQVYF

SEQ ID NO: 2991054 - protein, 17 aa, Entamoeba invadens
DINLSCNPLLKIPYEFF

SEQ ID NO: 2991055 - protein, 24 aa, Entamoeba invadens
DINQVYQLVDPVSWYALDKAVWDN

SEQ ID NO: 2991056 - protein, 23 aa, Entamoeba invadens
DINRLYLPSFQQSLPEDLIDAFG

SEQ ID NO: 2991057 - protein, 26 aa, Entamoeba invadens
DINSYVIAIPRIYGRWKSMGLVNNFA

SEQ ID NO: 2991058 - protein, 27 aa, Entamoeba invadens
DINVENVFCALLKAVLKKKQSFQRAKN

SEQ ID NO: 2991059 - protein, 29 aa, Entamoeba invadens
DINVFIKNHWALLSNLPLFKTNHYRKALL

SEQ ID NO: 2991060 - protein, 17 aa, Entamoeba invadens
DINVLISIYTIARNYMI

SEQ ID NO: 2991061 - protein, 21 aa, Entamoeba invadens
DINVVFLIGRGSKTLHCFEVT

SEQ ID NO: 2991062 - protein, 25 aa, Entamoeba invadens
DIPEDVIITFLLKMNVKLAKSDEKV

SEQ ID NO: 2991063 - protein, 21 aa, Entamoeba invadens
DIPEVYVVPKGLFKIGKGAFT

SEQ ID NO: 2991064 - protein, 38 aa, Entamoeba invadens
DIPFSLSFIRSVAKQLLLFLSFLHSKGIIHCDIKPENI

SEQ ID NO: 2991065 - protein, 25 aa, Entamoeba invadens
DIPIDRLIDPFFIPEKKRKTNRKKV

SEQ ID NO: 2991066 - protein, 29 aa, Entamoeba invadens
DIPKPFITTTPYIITTPKPISKLNIPPLD

SEQ ID NO: 2991067 - protein, 17 aa, Entamoeba invadens
DIPKWSEIVCDVNKMSL

SEQ ID NO: 2991068 - protein, 19 aa, Entamoeba invadens
DIPLDVPPYEPELIQQPQQ

SEQ ID NO: 2991069 - protein, 25 aa, Entamoeba invadens
DIPNCTLFTILRDVASALSFIHSQQ

SEQ ID NO: 2991070 - protein, 23 aa, Entamoeba invadens
DIPNFIQELPKFCFSKCFSLRHL

SEQ ID NO: 2991071 - protein, 18 aa, Entamoeba invadens
DIPPSVFYGCYNLRSVRL

SEQ ID NO: 2991072 - protein, 28 aa, Entamoeba invadens
DIQLEQRMRLIYDLLISFDISPELVKRS

SEQ ID NO: 2991073 - protein, 24 aa, Entamoeba invadens
DIQLQLRFQILKIYQEFVPTDKED

SEQ ID NO: 2991074 - protein, 27 aa, Entamoeba invadens
DIQPRFALFAAHYRYVFLSYDQSLETD

SEQ ID NO: 2991075 - protein, 19 aa, Entamoeba invadens
DIQPVFPAMFPSLSPHPLS

SEQ ID NO: 2991076 - protein, 25 aa, Entamoeba invadens
DIQSLMQAILFGLKGVCAYISHAYL

SEQ ID NO: 2991077 - protein, 22 aa, Entamoeba invadens
DIRDIVKFLRTFKRLNQLVEYI

SEQ ID NO: 2991078 - protein, 32 aa, Entamoeba invadens
DIRERNDFIVYWLKELIKYKKIGVLLINEEYE

SEQ ID NO: 2991079 - protein, 17 aa, Entamoeba invadens
DIRFVKYIIKNQYDVLR

SEQ ID NO: 2991080 - protein, 22 aa, Entamoeba invadens
DIRGFKVRHLSFPSSLQSLTIS

SEQ ID NO: 2991081 - protein, 21 aa, Entamoeba invadens
DIRKMLFERVEFIRNAIFDED

SEQ ID NO: 2991082 - protein, 21 aa, Entamoeba invadens
DIRNIPLISKKYKNILRLFTF

SEQ ID NO: 2991083 - protein, 19 aa, Entamoeba invadens
DIRQILNELSLSKPYCVQR

SEQ ID NO: 2991084 - protein, 24 aa, Entamoeba invadens
DIRVILNSFIKRPNYWISSDETVI

SEQ ID NO: 2991085 - protein, 19 aa, Entamoeba invadens
DISIFSEQIQTLGTAILNE

SEQ ID NO: 2991086 - protein, 18 aa, Entamoeba invadens
DISKLLVQYLKHGDRRVV

SEQ ID NO: 2991087 - protein, 33 aa, Entamoeba invadens
DISKVHPRKLPTEFMYLFDLYQNNEISREDLLN

SEQ ID NO: 2991088 - protein, 24 aa, Entamoeba invadens
DISVKKLPYGMKKWTPEQTIEVNN

SEQ ID NO: 2991089 - protein, 19 aa, Entamoeba invadens
DISVLLALLLNDPANDEIL

SEQ ID NO: 2991090 - protein, 22 aa, Entamoeba invadens
DITAMYLMILKEMKVKPHNIFI

SEQ ID NO: 2991091 - protein, 28 aa, Entamoeba invadens
DITDMRVVWVCWIFKMKDFRIERNNYFD

SEQ ID NO: 2991092 - protein, 25 aa, Entamoeba invadens
DITEKPPVFTFKTNLFGKPPSKDEE

SEQ ID NO: 2991093 - protein, 21 aa, Entamoeba invadens
DITHPLVMTLFTAPNYCDVYD

SEQ ID NO: 2991094 - protein, 35 aa, Entamoeba invadens
DITKLDRRLLFLFLTQLPLADLVAFMATCKRFYLI

SEQ ID NO: 2991095 - protein, 26 aa, Entamoeba invadens
DITLQSPLVFWKWANEHILAIVTATA

SEQ ID NO: 2991096 - protein, 31 aa, Entamoeba invadens
DITLRMLRESLRFVLTNYSYLSASGVLGSTL

SEQ ID NO: 2991097 - protein, 33 aa, Entamoeba invadens
DITRTGIQFGAFKKFILTGKKRGLMMTRDIRKF

SEQ ID NO: 2991098 - protein, 29 aa, Entamoeba invadens
DITSAFFIYFENLLGTLPWSGLDESNTIK

SEQ ID NO: 2991099 - protein, 17 aa, Entamoeba invadens
DITSDFCFFERYVKGNP

SEQ ID NO: 2991100 - protein, 25 aa, Entamoeba invadens
DITTEDACFFLLISNINNAQKSMRE

SEQ ID NO: 2991101 - protein, 26 aa, Entamoeba invadens
DITTSIIIFCQLIRAVKYLHSKCICH

SEQ ID NO: 2991102 - protein, 23 aa, Entamoeba invadens
DITTSIWVQKKIYWNAKDTEFVR

SEQ ID NO: 2991103 - protein, 20 aa, Entamoeba invadens
DITWNNFVLGILEKIPVSQE

SEQ ID NO: 2991104 - protein, 20 aa, Entamoeba invadens
DIVEPITLSLIYDFDFKSSR

SEQ ID NO: 2991105 - protein, 18 aa, Entamoeba invadens
DIVFGRPSKRTTTTLQFL

SEQ ID NO: 2991106 - protein, 21 aa, Entamoeba invadens
DIVFKLLLEERYIFLASSIEQ

SEQ ID NO: 2991107 - protein, 20 aa, Entamoeba invadens
DIVGLLIVAFLEPRQYDGVF

SEQ ID NO: 2991108 - protein, 26 aa, Entamoeba invadens
DIVKEACPTLFSEKILFTPQDSMSEE

SEQ ID NO: 2991109 - protein, 26 aa, Entamoeba invadens
DIVKKIIVQVLNALLYLHQHKTVHRD

SEQ ID NO: 2991110 - protein, 18 aa, Entamoeba invadens
DIVLDRITFIVNSKMFFS

SEQ ID NO: 2991111 - protein, 19 aa, Entamoeba invadens
DIVMGTRSTWPVLQAMNWK

SEQ ID NO: 2991112 - protein, 23 aa, Entamoeba invadens
DIVRIKPFSLLTQKEVVLYAHYM

SEQ ID NO: 2991113 - protein, 23 aa, Entamoeba invadens
DIVRWVKLLIKSWRNYDQSGVAN

SEQ ID NO: 2991114 - protein, 25 aa, Entamoeba invadens
DIVSSGAYVLFYIRRDDEEYSSSLR

SEQ ID NO: 2991115 - protein, 28 aa, Entamoeba invadens
DIVTLLCDVLVIPPEIIKSLPTRLRVLI

SEQ ID NO: 2991116 - protein, 19 aa, Entamoeba invadens
DIVVFERLSRNLTLKNFDM

SEQ ID NO: 2991117 - protein, 20 aa, Entamoeba invadens
DIVVVVLGGLIRLVPSFETF

SEQ ID NO: 2991118 - protein, 19 aa, Entamoeba invadens
DIVWFLECTKKFYDKEKPK

SEQ ID NO: 2991119 - protein, 17 aa, Entamoeba invadens
DIWALGCTVLELITGNP

SEQ ID NO: 2991120 - protein, 28 aa, Entamoeba invadens
DIWSIGILIYVLFSNKFPMPPNKVFEFL

SEQ ID NO: 2991121 - protein, 26 aa, Entamoeba invadens
DIWSYGVTLWEIFSDAATPYSSVGNQ

SEQ ID NO: 2991122 - protein, 23 aa, Entamoeba invadens
DIYDPMCSSLSKYFALIRNSGVK

SEQ ID NO: 2991123 - protein, 17 aa, Entamoeba invadens
DIYFPKKVLLHVDSMYT

SEQ ID NO: 2991124 - protein, 20 aa, Entamoeba invadens
DIYIHPLVQSCTWDTLAVQV

SEQ ID NO: 2991125 - protein, 30 aa, Entamoeba invadens
DIYRPNMLHNFSLYLDGKWYSLTAHKDIYD

SEQ ID NO: 2991126 - protein, 23 aa, Entamoeba invadens
DIYSFGMTMYFTFTKIDPYDESI

SEQ ID NO: 2991127 - protein, 26 aa, Entamoeba invadens
DIYSLGITMWELFYEGYPFGERPEID

SEQ ID NO: 2991128 - protein, 20 aa, Entamoeba invadens
DIYSLPHFADYFTEKDRHFD

SEQ ID NO: 2991129 - protein, 17 aa, Entamoeba invadens
DIYVEIIDPSEIEFVKP

SEQ ID NO: 2991130 - protein, 28 aa, Entamoeba invadens
DKAKKLGIKYFEVSAKSGFGLEELFTDL

SEQ ID NO: 2991131 - protein, 19 aa, Entamoeba invadens
DKAKWEKDRKRVFTHILFD

SEQ ID NO: 2991132 - protein, 24 aa, Entamoeba invadens
DKATDFRQAMQWLLHEAERTTARQ

SEQ ID NO: 2991133 - protein, 20 aa, Entamoeba invadens
DKCFYLCANLKEIDLEHIRV

SEQ ID NO: 2991134 - protein, 17 aa, Entamoeba invadens
DKCYMICYNGALIMKGS

SEQ ID NO: 2991135 - protein, 22 aa, Entamoeba invadens
DKDEFIIMNKSIELPDCPATSD

SEQ ID NO: 2991136 - protein, 20 aa, Entamoeba invadens
DKDFFGFYQRDTFDPQMNIK

SEQ ID NO: 2991137 - protein, 27 aa, Entamoeba invadens
DKDKAFINLIIPLIRRVTKSNDQKFDG

SEQ ID NO: 2991138 - protein, 23 aa, Entamoeba invadens
DKDLLKYMKKRNDYYYLCSRAFN

SEQ ID NO: 2991139 - protein, 23 aa, Entamoeba invadens
DKDLYPHLWEEARRQAEAEVSTI

SEQ ID NO: 2991140 - protein, 25 aa, Entamoeba invadens
DKDPEYMLLVNVPKMLLAVTNQISA

SEQ ID NO: 2991141 - protein, 22 aa, Entamoeba invadens
DKDPYTMQFIQKVLYGRHNVVV

SEQ ID NO: 2991142 - protein, 21 aa, Entamoeba invadens
DKDRFKFPWKIAEFVISGKRL

SEQ ID NO: 2991143 - protein, 26 aa, Entamoeba invadens
DKDRKILMYSLYFTMDMKFGNRIGRI

SEQ ID NO: 2991144 - protein, 29 aa, Entamoeba invadens
DKDRLINRLEYLNRLWAAGIYAETIQKLN

SEQ ID NO: 2991145 - protein, 29 aa, Entamoeba invadens
DKDTTEVKIVLPKGFKTPRQQAKFASRSP

SEQ ID NO: 2991146 - protein, 29 aa, Entamoeba invadens
DKDVKILTFLQHKFPRIDADTLLPVTTHL

SEQ ID NO: 2991147 - protein, 23 aa, Entamoeba invadens
DKEAKRCVLCMRPYVAFLNDCKD

SEQ ID NO: 2991148 - protein, 35 aa, Entamoeba invadens
DKEATMVCIRWMMGAMFLIKACKPLIEKNTADNKE

SEQ ID NO: 2991149 - protein, 24 aa, Entamoeba invadens
DKEFKSIIYIFSCPDGSHGTKSAP

SEQ ID NO: 2991150 - protein, 26 aa, Entamoeba invadens
DKEGETPLHKAAWKDKLQTISKLISL

SEQ ID NO: 2991151 - protein, 24 aa, Entamoeba invadens
DKEGLGRVLSFPPNKQDFFCETMS

SEQ ID NO: 2991152 - protein, 33 aa, Entamoeba invadens
DKEKDLRQFAVKGVLQLFNAISEHQLKLRIQKQ

SEQ ID NO: 2991153 - protein, 24 aa, Entamoeba invadens
DKELIDIYRSAYNYILEDFYNKFG

SEQ ID NO: 2991154 - protein, 20 aa, Entamoeba invadens
DKELKIFGLGSFFETRNGIL

SEQ ID NO: 2991155 - protein, 24 aa, Entamoeba invadens
DKELQPIFQRLVELGYLTVVGSQV

SEQ ID NO: 2991156 - protein, 25 aa, Entamoeba invadens
DKELYGYFKMLQIGYSFMSKWVVVL

SEQ ID NO: 2991157 - protein, 26 aa, Entamoeba invadens
DKENVIMNVLITTLKKMIYATNAKTI

SEQ ID NO: 2991158 - protein, 28 aa, Entamoeba invadens
DKERDIIPDFLLLRNFPTDFRGKMYTNL

SEQ ID NO: 2991159 - protein, 24 aa, Entamoeba invadens
DKETIRVAFVGDSPAFVVRNNTLK

SEQ ID NO: 2991160 - protein, 28 aa, Entamoeba invadens
DKFATVVFVPLRMMRKIRPIQAKLVDAL

SEQ ID NO: 2991161 - protein, 17 aa, Entamoeba invadens
DKFFFKCGSLRSVILPS

SEQ ID NO: 2991162 - protein, 17 aa, Entamoeba invadens
DKFFLSVFTKIRMFSTV

SEQ ID NO: 2991163 - protein, 18 aa, Entamoeba invadens
DKFGGRLQIIISAGAPLP

SEQ ID NO: 2991164 - protein, 25 aa, Entamoeba invadens
DKFHYNPIPLTLKTISYFPNLETLH

SEQ ID NO: 2991165 - protein, 20 aa, Entamoeba invadens
DKFHYNPIPLTNITIKYFPQ

SEQ ID NO: 2991166 - protein, 23 aa, Entamoeba invadens
DKFKKLWDTYSFYLAKDVETIKR

SEQ ID NO: 2991167 - protein, 21 aa, Entamoeba invadens
DKFLKFPKKILVFDTFDEKSI

SEQ ID NO: 2991168 - protein, 29 aa, Entamoeba invadens
DKFLPGYYQYYVHYPIPLYKSIEINKRRR

SEQ ID NO: 2991169 - protein, 18 aa, Entamoeba invadens
DKFPIVQHFLFGKILPFE

SEQ ID NO: 2991170 - protein, 19 aa, Entamoeba invadens
DKFPLTNFHLLPCVSKEFE

SEQ ID NO: 2991171 - protein, 22 aa, Entamoeba invadens
DKFQIALDMHVGRIPSSSLVQI

SEQ ID NO: 2991172 - protein, 23 aa, Entamoeba invadens
DKFRCDFIVHFYGAVFIKSKMCM

SEQ ID NO: 2991173 - protein, 25 aa, Entamoeba invadens
DKFRCDYIIHFYGAVFIPSKVCMVT

SEQ ID NO: 2991174 - protein, 22 aa, Entamoeba invadens
DKFRCDYIVHFYGAGFMTNKIC

SEQ ID NO: 2991175 - protein, 22 aa, Entamoeba invadens
DKFRCDYIVHFYGAVFIINKMS

SEQ ID NO: 2991176 - protein, 25 aa, Entamoeba invadens
DKFRCDYIVHFYGAVFIPNKMCMVT

SEQ ID NO: 2991177 - protein, 25 aa, Entamoeba invadens
DKFRCDYIVHFYGAVFVPHKMCMVT

SEQ ID NO: 2991178 - protein, 25 aa, Entamoeba invadens
DKFRCEYIIHFYGAVFIPNKMCMVT

SEQ ID NO: 2991179 - protein, 25 aa, Entamoeba invadens
DKFRNEYIIHFYGAVFIPNKVCMVT

SEQ ID NO: 2991180 - protein, 25 aa, Entamoeba invadens
DKFRNEYIIHFYGAVFITNHICMVS

SEQ ID NO: 2991181 - protein, 25 aa, Entamoeba invadens
DKFRSDYIVHFYGAVFILNKICMVT

SEQ ID NO: 2991182 - protein, 27 aa, Entamoeba invadens
DKFRSDYIVHFYGAVFIPNKICMVTEF

SEQ ID NO: 2991183 - protein, 24 aa, Entamoeba invadens
DKFRSEFIVHFYGAVFVPNKVCMI

SEQ ID NO: 2991184 - protein, 26 aa, Entamoeba invadens
DKFRSEYIVHFFGAVLIPNKICMVTE

SEQ ID NO: 2991185 - protein, 26 aa, Entamoeba invadens
DKFRSEYIVHFYGAVFDINKTCMVTE

SEQ ID NO: 2991186 - protein, 28 aa, Entamoeba invadens
DKFRSEYIVHFYGAVFIPNKVCLVTEFA

SEQ ID NO: 2991187 - protein, 30 aa, Entamoeba invadens
DKFRSEYIVHFYGAVFIPNKVCLVTEFAQF

SEQ ID NO: 2991188 - protein, 25 aa, Entamoeba invadens
DKFRSEYIVHFYGAVFIPNKVCTVT

SEQ ID NO: 2991189 - protein, 31 aa, Entamoeba invadens
DKFRSEYIVHFYGAVFIPTKLCMVTEFAQYG

SEQ ID NO: 2991190 - protein, 25 aa, Entamoeba invadens
DKFRSEYIVHLYDAVFTPNKVCRSL

SEQ ID NO: 2991191 - protein, 26 aa, Entamoeba invadens
DKFRSEYLVHFFGAVFVPNKICMVTE

SEQ ID NO: 2991192 - protein, 25 aa, Entamoeba invadens
DKFRSKIIVHFYGAVFIPSKNCMVT

SEQ ID NO: 2991193 - protein, 17 aa, Entamoeba invadens
DKFRYNPIPITSQHIFP

SEQ ID NO: 2991194 - protein, 19 aa, Entamoeba invadens
DKFTFEKVITWFQDVMEHN

SEQ ID NO: 2991195 - protein, 21 aa, Entamoeba invadens
DKFTVEILSKEVFKYILKDEE

SEQ ID NO: 2991196 - protein, 29 aa, Entamoeba invadens
DKFVPGFYQYYIHYPLELTEYKKLNKKMK

SEQ ID NO: 2991197 - protein, 21 aa, Entamoeba invadens
DKGLEKAIRFAPQDAEFVQII

SEQ ID NO: 2991198 - protein, 23 aa, Entamoeba invadens
DKGSPIPFKRFDFEKPTMKISSS

SEQ ID NO: 2991199 - protein, 25 aa, Entamoeba invadens
DKHKAILIRIIPNLSFEIIEVMKVF

SEQ ID NO: 2991200 - protein, 25 aa, Entamoeba invadens
DKHSHLLICSLLTKCIPPPELIQRL

SEQ ID NO: 2991201 - protein, 19 aa, Entamoeba invadens
DKHVIPCEIAINSIDREVE

SEQ ID NO: 2991202 - protein, 34 aa, Entamoeba invadens
DKIEIAFEGRLLLCEKIVFPLTKTIRTYVDHAEN

SEQ ID NO: 2991203 - protein, 27 aa, Entamoeba invadens
DKIEKKQALFMFKYAENKIIGSFHEKV

SEQ ID NO: 2991204 - protein, 24 aa, Entamoeba invadens
DKIFDVMLLKMYTGDTLKIIQELC

SEQ ID NO: 2991205 - protein, 21 aa, Entamoeba invadens
DKIFTFCRRIFVNLGQKTDQY

SEQ ID NO: 2991206 - protein, 19 aa, Entamoeba invadens
DKINPFWWTHQRHDGKLWN

SEQ ID NO: 2991207 - protein, 27 aa, Entamoeba invadens
DKITIKNPLFIVALPRSGSTFTHAVLS

SEQ ID NO: 2991208 - protein, 22 aa, Entamoeba invadens
DKITTQLLFGKTTTFFDEIKIE

SEQ ID NO: 2991209 - protein, 22 aa, Entamoeba invadens
DKIVMRIVELLLSKGADRLVKN

SEQ ID NO: 2991210 - protein, 21 aa, Entamoeba invadens
DKIVSLKMTLLKLSEIDLTNF

SEQ ID NO: 2991211 - protein, 22 aa, Entamoeba invadens
DKIYQLSTVWFATISSNSISGR

SEQ ID NO: 2991212 - protein, 22 aa, Entamoeba invadens
DKKAEVLFVEKFKIVQKSIVPI

SEQ ID NO: 2991213 - protein, 17 aa, Entamoeba invadens
DKKALVTTPKGFLSVDE

SEQ ID NO: 2991214 - protein, 28 aa, Entamoeba invadens
DKKDILKVFKGLLLYHYLTQIEGRDFSI

SEQ ID NO: 2991215 - protein, 20 aa, Entamoeba invadens
DKKELVRWINSQLMDNKTMT

SEQ ID NO: 2991216 - protein, 25 aa, Entamoeba invadens
DKKERRLSFFQKMKGKKDKKKEDDT

SEQ ID NO: 2991217 - protein, 30 aa, Entamoeba invadens
DKKETFTQVPIPRMINFEKITAATKPKNLD

SEQ ID NO: 2991218 - protein, 17 aa, Entamoeba invadens
DKKFCFDIYSRWAGKIK

SEQ ID NO: 2991219 - protein, 30 aa, Entamoeba invadens
DKKFLEYDIEWFPSQWKVNFAKRLPNTNVT

SEQ ID NO: 2991220 - protein, 17 aa, Entamoeba invadens
DKKHFVFTLRNSFNIQP

SEQ ID NO: 2991221 - protein, 17 aa, Entamoeba invadens
DKKIFFVELCAEKFSFV

SEQ ID NO: 2991222 - protein, 29 aa, Entamoeba invadens
DKKIGIHKNIIRYFLLIHGDEKLFEEYCF

SEQ ID NO: 2991223 - protein, 28 aa, Entamoeba invadens
DKKIKELLMPAFTPLLNESLFKPCLKQI

SEQ ID NO: 2991224 - protein, 17 aa, Entamoeba invadens
DKKIWRKKTVNVRKDLK

SEQ ID NO: 2991225 - protein, 24 aa, Entamoeba invadens
DKKKFIESIVWFNVDFETVDINKN

SEQ ID NO: 2991226 - protein, 23 aa, Entamoeba invadens
DKKKPIFVSLLDELEKEMTGEDQ

SEQ ID NO: 2991227 - protein, 21 aa, Entamoeba invadens
DKKPMVGVHVIVKFAGKKEEK

SEQ ID NO: 2991228 - protein, 25 aa, Entamoeba invadens
DKKQKAVLRKKPSKEELHPPKFEMD

SEQ ID NO: 2991229 - protein, 22 aa, Entamoeba invadens
DKKRYEFEGFGIRLNKRPPKIK

SEQ ID NO: 2991230 - protein, 18 aa, Entamoeba invadens
DKKRYGETIPFNLPVHHL

SEQ ID NO: 2991231 - protein, 24 aa, Entamoeba invadens
DKKTIKYFPNIETLNLWSKTDERF

SEQ ID NO: 2991232 - protein, 17 aa, Entamoeba invadens
DKKVLVTTPKGFLSVDE

SEQ ID NO: 2991233 - protein, 23 aa, Entamoeba invadens
DKKYAEYINKILCPFQVAGTDSE

SEQ ID NO: 2991234 - protein, 25 aa, Entamoeba invadens
DKKYVHQGFGTLLMDFVFYVCREAH

SEQ ID NO: 2991235 - protein, 22 aa, Entamoeba invadens
DKLAREEAERLEKERLAKEKAE

SEQ ID NO: 2991236 - protein, 24 aa, Entamoeba invadens
DKLDCDEFVILISAIEQCMRGKVI

SEQ ID NO: 2991237 - protein, 29 aa, Entamoeba invadens
DKLFQTNTSLQFELVKLKSILEEKEKDLN

SEQ ID NO: 2991238 - protein, 22 aa, Entamoeba invadens
DKLFYVSILGMIDFSCSFEGAQ

SEQ ID NO: 2991239 - protein, 24 aa, Entamoeba invadens
DKLHYNPLPITFVTSRLFPNIETQ

SEQ ID NO: 2991240 - protein, 24 aa, Entamoeba invadens
DKLKNVFLIIQNDVKLHLLAATEK

SEQ ID NO: 2991241 - protein, 18 aa, Entamoeba invadens
DKLKPWDISFYINIIKEQ

SEQ ID NO: 2991242 - protein, 28 aa, Entamoeba invadens
DKLLPKHIYRFVGILIYMGAHHDTKNPI

SEQ ID NO: 2991243 - protein, 19 aa, Entamoeba invadens
DKLLTFHDRILFAKSGVLG

SEQ ID NO: 2991244 - protein, 17 aa, Entamoeba invadens
DKLMATQKTLPKTFQRI

SEQ ID NO: 2991245 - protein, 17 aa, Entamoeba invadens
DKLRPVSYSNASVFLLC

SEQ ID NO: 2991246 - protein, 22 aa, Entamoeba invadens
DKLYMILEFVNGGELFHHLKEE

SEQ ID NO: 2991247 - protein, 45 aa, Entamoeba invadens
DKMCESALIITLGFKPVGIKNIGKYAFIIGFEKCVMFDSDGKMLF

SEQ ID NO: 2991248 - protein, 18 aa, Entamoeba invadens
DKMKAEIIELNKSFFESS

SEQ ID NO: 2991249 - protein, 24 aa, Entamoeba invadens
DKNESFLLKLVRNTKLDVYIVSYL

SEQ ID NO: 2991250 - protein, 23 aa, Entamoeba invadens
DKNHKFFHLFDRWDNSCSNVSPL

SEQ ID NO: 2991251 - protein, 32 aa, Entamoeba invadens
DKNIRTYLALYNGIINRFVMINAKELKIIHQW

SEQ ID NO: 2991252 - protein, 24 aa, Entamoeba invadens
DKNITPTVYLKPSAFNYMEKKFFE

SEQ ID NO: 2991253 - protein, 22 aa, Entamoeba invadens
DKNKTLLFIGNVPETFTHEKFS

SEQ ID NO: 2991254 - protein, 22 aa, Entamoeba invadens
DKNLSVIVYYIKETLRTLRVID

SEQ ID NO: 2991255 - protein, 26 aa, Entamoeba invadens
DKNRGKKFMTLLESLPSKKVVEDSKK

SEQ ID NO: 2991256 - protein, 24 aa, Entamoeba invadens
DKNSKLIWPLDPRNDTDWDGLEAI

SEQ ID NO: 2991257 - protein, 21 aa, Entamoeba invadens
DKNTLLNALSYLPNIISCIPS

SEQ ID NO: 2991258 - protein, 27 aa, Entamoeba invadens
DKNVNFYTILFTWKQKKIWKTTPKRFS

SEQ ID NO: 2991259 - protein, 25 aa, Entamoeba invadens
DKNVPPLIVLERRVMRIFTKRKNVE

SEQ ID NO: 2991260 - protein, 17 aa, Entamoeba invadens
DKPLYFQIGAHPAFNYK

SEQ ID NO: 2991261 - protein, 18 aa, Entamoeba invadens
DKPQLPPLLSLPKNTRKL

SEQ ID NO: 2991262 - protein, 29 aa, Entamoeba invadens
DKQEELIYLLCNYLEKNCCVIASGFLRDE

SEQ ID NO: 2991263 - protein, 20 aa, Entamoeba invadens
DKQIVMFSATFPQSVEQSAR

SEQ ID NO: 2991264 - protein, 26 aa, Entamoeba invadens
DKQKQFVALQFVWEMIRKYEDMFEGK

SEQ ID NO: 2991265 - protein, 23 aa, Entamoeba invadens
DKQKRIMMYINANSKVEGLIREN

SEQ ID NO: 2991266 - protein, 23 aa, Entamoeba invadens
DKQLRMWTLEEQNKRVTFIVKMM

SEQ ID NO: 2991267 - protein, 30 aa, Entamoeba invadens
DKQQVLGNKWKLISTFLPGRAPNSVKNRYF

SEQ ID NO: 2991268 - protein, 23 aa, Entamoeba invadens
DKQRYARMFSALGSLSQVEEEQK

SEQ ID NO: 2991269 - protein, 24 aa, Entamoeba invadens
DKRAPFIIQSIRTLGLHSGDFIPR

SEQ ID NO: 2991270 - protein, 25 aa, Entamoeba invadens
DKREYLVYTYYLLIDYDYTCQEEDK

SEQ ID NO: 2991271 - protein, 19 aa, Entamoeba invadens
DKRFLSWAQKNTRKCPKCS

SEQ ID NO: 2991272 - protein, 24 aa, Entamoeba invadens
DKRHRLFYISGAIGIMKRGFEGDC

SEQ ID NO: 2991273 - protein, 22 aa, Entamoeba invadens
DKSCYCAMWNPLTSQMISGYGK

SEQ ID NO: 2991274 - protein, 23 aa, Entamoeba invadens
DKSFAISFLRRVKSERLQKVIRI

SEQ ID NO: 2991275 - protein, 23 aa, Entamoeba invadens
DKSIKIRLPFPTPEISYYEDTDT

SEQ ID NO: 2991276 - protein, 25 aa, Entamoeba invadens
DKSKPFHDKFDLLKIAKVAATKEGL

SEQ ID NO: 2991277 - protein, 19 aa, Entamoeba invadens
DKSLFTVYFNLIDDDNNGK

SEQ ID NO: 2991278 - protein, 23 aa, Entamoeba invadens
DKSLVDLRLLIQKGNDFLNEELV

SEQ ID NO: 2991279 - protein, 24 aa, Entamoeba invadens
DKSMLRKSLLNTRYVIPLPPTSVS

SEQ ID NO: 2991280 - protein, 25 aa, Entamoeba invadens
DKSNVRLVLALKKPVILLYDSSASE

SEQ ID NO: 2991281 - protein, 23 aa, Entamoeba invadens
DKSPFDTFFKCGLNVSLSSDDPL

SEQ ID NO: 2991282 - protein, 25 aa, Entamoeba invadens
DKSQICIKCKDGCKRCFIKNDVTKE

SEQ ID NO: 2991283 - protein, 25 aa, Entamoeba invadens
DKSQVCITCEDGCKRCFIKNDVTKT

SEQ ID NO: 2991284 - protein, 25 aa, Entamoeba invadens
DKSRGYILETLLSKVMYVGGHIQVI

SEQ ID NO: 2991285 - protein, 21 aa, Entamoeba invadens
DKSRLLFQHLKTQRLFSEHSH

SEQ ID NO: 2991286 - protein, 22 aa, Entamoeba invadens
DKSTFIFLGDYVDRGSFSCEII

SEQ ID NO: 2991287 - protein, 18 aa, Entamoeba invadens
DKTAGMISLIVALYGRWL

SEQ ID NO: 2991288 - protein, 27 aa, Entamoeba invadens
DKTAKSELFFKPPKHFFELSLNITNPQ

SEQ ID NO: 2991289 - protein, 22 aa, Entamoeba invadens
DKTAMLWKVDPLTSMGVYTCDG

SEQ ID NO: 2991290 - protein, 30 aa, Entamoeba invadens
DKTDELLAYLDKLLPLGNLLLINQSYIEYL

SEQ ID NO: 2991291 - protein, 26 aa, Entamoeba invadens
DKTGASQHLKLKKLHEKHMNEDIQLR

SEQ ID NO: 2991292 - protein, 25 aa, Entamoeba invadens
DKTKERLWNIFGSTFSYICEILFSN

SEQ ID NO: 2991293 - protein, 20 aa, Entamoeba invadens
DKTLFIRGDYYRELTFTEME

SEQ ID NO: 2991294 - protein, 22 aa, Entamoeba invadens
DKTNVLFRLQSNSNMNLSFDVL

SEQ ID NO: 2991295 - protein, 31 aa, Entamoeba invadens
DKTPSRVCSSLFIKAILGCNGLVVVVSVEDS

SEQ ID NO: 2991296 - protein, 25 aa, Entamoeba invadens
DKTVDHIIVFITKQLRDTTTTYRVY

SEQ ID NO: 2991297 - protein, 26 aa, Entamoeba invadens
DKTVIRPMNFIKKYSFAIHAACDFNT

SEQ ID NO: 2991298 - protein, 23 aa, Entamoeba invadens
DKTVKLWDVVSGKIKSSFGGVLQ

SEQ ID NO: 2991299 - protein, 24 aa, Entamoeba invadens
DKVKDYCVPYISPLLKEIRSITQK

SEQ ID NO: 2991300 - protein, 18 aa, Entamoeba invadens
DKVKGLFHRFSKPKIGVG

SEQ ID NO: 2991301 - protein, 30 aa, Entamoeba invadens
DKVLHRVSLFLLFVWIKINPPFQNEIGEIF

SEQ ID NO: 2991302 - protein, 20 aa, Entamoeba invadens
DKVMQPPQPIPLVQQIQQPV

SEQ ID NO: 2991303 - protein, 20 aa, Entamoeba invadens
DKVNCSFFYKVGACRHGDAC

SEQ ID NO: 2991304 - protein, 20 aa, Entamoeba invadens
DKWCVRIAINYVDRIYAQVL

SEQ ID NO: 2991305 - protein, 21 aa, Entamoeba invadens
DKWDMSIICKYIKERCFVNEE

SEQ ID NO: 2991306 - protein, 22 aa, Entamoeba invadens
DKWIPELRTYCPSALIYSVGLK

SEQ ID NO: 2991307 - protein, 17 aa, Entamoeba invadens
DKWYGSAPYMSPEAVLK

SEQ ID NO: 2991308 - protein, 30 aa, Entamoeba invadens
DKYAQYQEIWLRGYWLIFAHDQIVRGKVDN

SEQ ID NO: 2991309 - protein, 22 aa, Entamoeba invadens
DKYCEVLLNFLLPKVENEYDAP

SEQ ID NO: 2991310 - protein, 24 aa, Entamoeba invadens
DKYDTLLSIYFKNTLLYNTVDIEN

SEQ ID NO: 2991311 - protein, 23 aa, Entamoeba invadens
DKYKGMAHALFMDMRDLDKKVDV

SEQ ID NO: 2991312 - protein, 23 aa, Entamoeba invadens
DKYKQIFFAFAECLNDLTKPSCF

SEQ ID NO: 2991313 - protein, 23 aa, Entamoeba invadens
DKYPFLQEGWRWEQKGCLDATSE

SEQ ID NO: 2991314 - protein, 21 aa, Entamoeba invadens
DLAALPLFKKVEVNDLFLSGS

SEQ ID NO: 2991315 - protein, 32 aa, Entamoeba invadens
DLAHIVNLLARYFDVSLKYPLIPNAMYSMISV

SEQ ID NO: 2991316 - protein, 19 aa, Entamoeba invadens
DLALKIDLFAQCCASIQWI

SEQ ID NO: 2991317 - protein, 25 aa, Entamoeba invadens
DLCDSWMIRFTSIDSYELAVMLLRN

SEQ ID NO: 2991318 - protein, 27 aa, Entamoeba invadens
DLCDYDGVVTWYKKAVVLIHPDKNQFR

SEQ ID NO: 2991319 - protein, 20 aa, Entamoeba invadens
DLCLGTWQGIYLNEHRDNGG

SEQ ID NO: 2991320 - protein, 25 aa, Entamoeba invadens
DLDALLYRPQSLPESLRITLTPAIK

SEQ ID NO: 2991321 - protein, 22 aa, Entamoeba invadens
DLDFGCFLCVKCMKDHKLFGRD

SEQ ID NO: 2991322 - protein, 22 aa, Entamoeba invadens
DLDGIISKIPYLQDLGVTIVWL

SEQ ID NO: 2991323 - protein, 18 aa, Entamoeba invadens
DLDKIITAIIQLTKTDGL

SEQ ID NO: 2991324 - protein, 19 aa, Entamoeba invadens
DLDLSKFPALYDLDISVAK

SEQ ID NO: 2991325 - protein, 23 aa, Entamoeba invadens
DLDMFTRYMIKYPKKVRDPYGCD

SEQ ID NO: 2991326 - protein, 24 aa, Entamoeba invadens
DLDSPVIPVMLYHVGKLKDVSRGC

SEQ ID NO: 2991327 - protein, 21 aa, Entamoeba invadens
DLDVILFIAETFEKLMTHSTE

SEQ ID NO: 2991328 - protein, 31 aa, Entamoeba invadens
DLDYHGTLSPWLQIKLFRLLAGVQLDEQQKK

SEQ ID NO: 2991329 - protein, 28 aa, Entamoeba invadens
DLEDIKTLYFSLLTIIRNCPKDELRQWV

SEQ ID NO: 2991330 - protein, 17 aa, Entamoeba invadens
DLEFISFAFFRIIMTSD

SEQ ID NO: 2991331 - protein, 20 aa, Entamoeba invadens
DLEGYFPGFNEYRELVSCSN

SEQ ID NO: 2991332 - protein, 21 aa, Entamoeba invadens
DLEKILCTWRKQIKGLNEKYV

SEQ ID NO: 2991333 - protein, 25 aa, Entamoeba invadens
DLEKIRVLGKYFIEVFKACGLKEDA

SEQ ID NO: 2991334 - protein, 26 aa, Entamoeba invadens
DLENIQRLIELGASKKLATEAYVVCN

SEQ ID NO: 2991335 - protein, 39 aa, Entamoeba invadens
DLENVRTAFILLKLFFLFLPTPILPPEFLKKLSKMYKAN

SEQ ID NO: 2991336 - protein, 22 aa, Entamoeba invadens
DLETFPFINRKCTSALDVIQKN

SEQ ID NO: 2991337 - protein, 24 aa, Entamoeba invadens
DLETYQLAIFMVALNQFADISIER

SEQ ID NO: 2991338 - protein, 31 aa, Entamoeba invadens
DLFARDVGCIKNFFWKKFGFSIEEAPRLDQI

SEQ ID NO: 2991339 - protein, 18 aa, Entamoeba invadens
DLFFHLHINPYKSSKIDP

SEQ ID NO: 2991340 - protein, 19 aa, Entamoeba invadens
DLFLMEGGYLYLRRSYFDA

SEQ ID NO: 2991341 - protein, 43 aa, Entamoeba invadens
DLFNALSDGVLLYHLVLKFYPEYPINFQPKYVQTSLFYKDENL

SEQ ID NO: 2991342 - protein, 20 aa, Entamoeba invadens
DLFNLSCAAAMRPLRDYLKS

SEQ ID NO: 2991343 - protein, 26 aa, Entamoeba invadens
DLFNSNELFYIGNNSFHFVSVSIDEK

SEQ ID NO: 2991344 - protein, 18 aa, Entamoeba invadens
DLFWSNISEKVFAEQFGY

SEQ ID NO: 2991345 - protein, 18 aa, Entamoeba invadens
DLGFYKKPYLKKFNHKHE

SEQ ID NO: 2991346 - protein, 19 aa, Entamoeba invadens
DLGITSGSFKFKKTKTKHE

SEQ ID NO: 2991347 - protein, 25 aa, Entamoeba invadens
DLGNRLHALIDQFLLDAVTAQNQKV

SEQ ID NO: 2991348 - protein, 34 aa, Entamoeba invadens
DLGSLLITPIQRLPRYRLLLKDLLKHLSDKDLDF

SEQ ID NO: 2991349 - protein, 24 aa, Entamoeba invadens
DLGVLELYVDILFFVSDKANKSKP

SEQ ID NO: 2991350 - protein, 19 aa, Entamoeba invadens
DLHFTNTLFMNCLTKWINL

SEQ ID NO: 2991351 - protein, 17 aa, Entamoeba invadens
DLHLGIVLYMMQQDSES

SEQ ID NO: 2991352 - protein, 29 aa, Entamoeba invadens
DLIECDEWARDAFYFGMRDTIVSEDIETA

SEQ ID NO: 2991353 - protein, 20 aa, Entamoeba invadens
DLIETVQLDFLNYSTGDDSC

SEQ ID NO: 2991354 - protein, 17 aa, Entamoeba invadens
DLIFLNEKVVLYGVGNF

SEQ ID NO: 2991355 - protein, 21 aa, Entamoeba invadens
DLIICHAAMLYIYINPSQDHT

SEQ ID NO: 2991356 - protein, 18 aa, Entamoeba invadens
DLITYVDDIIAVISAKKT

SEQ ID NO: 2991357 - protein, 19 aa, Entamoeba invadens
DLIVMISYIGKMELYYDLI

SEQ ID NO: 2991358 - protein, 24 aa, Entamoeba invadens
DLIYQKPILEFFLVNGKVGFMKFF

SEQ ID NO: 2991359 - protein, 34 aa, Entamoeba invadens
DLKDDTGLILYPKKEKSMVFTCHGAFWVMSDGKV

SEQ ID NO: 2991360 - protein, 23 aa, Entamoeba invadens
DLKEIFAKVPFNTTDPLVTYKET

SEQ ID NO: 2991361 - protein, 25 aa, Entamoeba invadens
DLKISESLGFILEKFTPVNENEIEV

SEQ ID NO: 2991362 - protein, 36 aa, Entamoeba invadens
DLKITLIFEDPLDANAWFVALAYTISLSPSLNESKS

SEQ ID NO: 2991363 - protein, 23 aa, Entamoeba invadens
DLKKRIENFLQPKSPSLSTSSES

SEQ ID NO: 2991364 - protein, 17 aa, Entamoeba invadens
DLKLCQPTFMVAVPRVL

SEQ ID NO: 2991365 - protein, 25 aa, Entamoeba invadens
DLKNKVLLHEFDFNDTFILQKSEFI

SEQ ID NO: 2991366 - protein, 21 aa, Entamoeba invadens
DLKPDNILLARQNSDWVKITD

SEQ ID NO: 2991367 - protein, 25 aa, Entamoeba invadens
DLKTESLIFTLRFAEAYLKSGNKDL

SEQ ID NO: 2991368 - protein, 26 aa, Entamoeba invadens
DLKTQQMLLNEELGYVLAKVSLEQKT

SEQ ID NO: 2991369 - protein, 17 aa, Entamoeba invadens
DLLAVPVIRGKKSKGET

SEQ ID NO: 2991370 - protein, 20 aa, Entamoeba invadens
DLLCAILMKKIEEEGIVVMF

SEQ ID NO: 2991371 - protein, 29 aa, Entamoeba invadens
DLLDKVCDKFYWYSLSEYTYQQELMLCEG

SEQ ID NO: 2991372 - protein, 30 aa, Entamoeba invadens
DLLDQALLRPGRFDRILYVGLPDNSTRKQI

SEQ ID NO: 2991373 - protein, 24 aa, Entamoeba invadens
DLLEKVRYLYAITNYIKQIDYHSA

SEQ ID NO: 2991374 - protein, 18 aa, Entamoeba invadens
DLLFLTHGHGDHLFGIFS

SEQ ID NO: 2991375 - protein, 20 aa, Entamoeba invadens
DLLGSKAFCDLLALNGLKFE

SEQ ID NO: 2991376 - protein, 31 aa, Entamoeba invadens
DLLHDLKDGLVLAKFLRNLSCKNIPTIIRKP

SEQ ID NO: 2991377 - protein, 18 aa, Entamoeba invadens
DLLIATLVNNINKLLVCY

SEQ ID NO: 2991378 - protein, 23 aa, Entamoeba invadens
DLLIELMKYVKVPCLLINGVMND

SEQ ID NO: 2991379 - protein, 18 aa, Entamoeba invadens
DLLILDEPTNHLDLNAVI

SEQ ID NO: 2991380 - protein, 27 aa, Entamoeba invadens
DLLKPFNQFFQTNYIRNIYKAKDVIQR

SEQ ID NO: 2991381 - protein, 20 aa, Entamoeba invadens
DLLLIVQQKINEPTDRKFAA

SEQ ID NO: 2991382 - protein, 17 aa, Entamoeba invadens
DLLLRIGCFLDLCKNKE

SEQ ID NO: 2991383 - protein, 20 aa, Entamoeba invadens
DLLMKKNASLGLTLVKRFAF

SEQ ID NO: 2991384 - protein, 17 aa, Entamoeba invadens
DLLMNIKAKIVFGAALP

SEQ ID NO: 2991385 - protein, 21 aa, Entamoeba invadens
DLLNLHLRYFTPTEIKRIHGF

SEQ ID NO: 2991386 - protein, 23 aa, Entamoeba invadens
DLLNLIFVNKKFQKAALSLSTNP

SEQ ID NO: 2991387 - protein, 21 aa, Entamoeba invadens
DLLRNIAAYCPFLSNIELRMC

SEQ ID NO: 2991388 - protein, 17 aa, Entamoeba invadens
DLLSIAFEKWDQMTVTE

SEQ ID NO: 2991389 - protein, 20 aa, Entamoeba invadens
DLLSNLDDIDISSSALEKME

SEQ ID NO: 2991390 - protein, 27 aa, Entamoeba invadens
DLLSNQPIMLAFYTHLLHVLIESNFFD

SEQ ID NO: 2991391 - protein, 29 aa, Entamoeba invadens
DLLTVSIIPFKFMARLYDLSVQYRKVNKD

SEQ ID NO: 2991392 - protein, 17 aa, Entamoeba invadens
DLLVEIAARMAEDRFRL

SEQ ID NO: 2991393 - protein, 36 aa, Entamoeba invadens
DLLVVLQFFREFNPPLLPFIQKILFHWFKHEEKVKN

SEQ ID NO: 2991394 - protein, 37 aa, Entamoeba invadens
DLMKFQEGLYLLSSLTRLYLMLLKEAEKSRSIPLNHF

SEQ ID NO: 2991395 - protein, 19 aa, Entamoeba invadens
DLMKLFCEKYKKQAKSEHW

SEQ ID NO: 2991396 - protein, 20 aa, Entamoeba invadens
DLMQNMLLGNPEKRFSAAQC

SEQ ID NO: 2991397 - protein, 29 aa, Entamoeba invadens
DLNDIKSLYVVFFFIIKNLREETIQQWLV

SEQ ID NO: 2991398 - protein, 24 aa, Entamoeba invadens
DLNGYYYVRLYYNGMPVVVAVTTK

SEQ ID NO: 2991399 - protein, 18 aa, Entamoeba invadens
DLNIYWPLTNQHLNNFKY

SEQ ID NO: 2991400 - protein, 25 aa, Entamoeba invadens
DLNKLTMFVYDFYVTKLTLTSITEQ

SEQ ID NO: 2991401 - protein, 25 aa, Entamoeba invadens
DLNKTTIFIYFHSLDEHFVSAIESI

SEQ ID NO: 2991402 - protein, 17 aa, Entamoeba invadens
DLNLQEIIIRYTRSENL

SEQ ID NO: 2991403 - protein, 21 aa, Entamoeba invadens
DLNLVLIETIGLMRVDERRTE

SEQ ID NO: 2991404 - protein, 26 aa, Entamoeba invadens
DLNPNDRFFYNKAIKYALIAGDITKA

SEQ ID NO: 2991405 - protein, 28 aa, Entamoeba invadens
DLNRAALTFNWLVDYAEQNGFIVHKRST

SEQ ID NO: 2991406 - protein, 17 aa, Entamoeba invadens
DLNRREKTIKCAELKIE

SEQ ID NO: 2991407 - protein, 20 aa, Entamoeba invadens
DLNSFLIMPVQRVPRYRLLL

SEQ ID NO: 2991408 - protein, 21 aa, Entamoeba invadens
DLNSFLVMPVQRVPRYRMLLE

SEQ ID NO: 2991409 - protein, 21 aa, Entamoeba invadens
DLNTLITFLNESLPSSLRNTI

SEQ ID NO: 2991410 - protein, 25 aa, Entamoeba invadens
DLNTPLHLFCAFFPNPNCAEAFHLF

SEQ ID NO: 2991411 - protein, 19 aa, Entamoeba invadens
DLNVACIPNLRTLYYETQL

SEQ ID NO: 2991412 - protein, 21 aa, Entamoeba invadens
DLPELKLLFLNNNKLAFVDSM

SEQ ID NO: 2991413 - protein, 24 aa, Entamoeba invadens
DLPFAEIKPPENVLFVCKLNQCTR

SEQ ID NO: 2991414 - protein, 24 aa, Entamoeba invadens
DLPGGPFYSTPFVLQARDKKDSQK

SEQ ID NO: 2991415 - protein, 22 aa, Entamoeba invadens
DLPKLNVLLLENVKLNTIKAIP

SEQ ID NO: 2991416 - protein, 20 aa, Entamoeba invadens
DLPKTVGLLDFRKVKMIGRG

SEQ ID NO: 2991417 - protein, 22 aa, Entamoeba invadens
DLPKVLFFSYFDINEISLGTTT

SEQ ID NO: 2991418 - protein, 20 aa, Entamoeba invadens
DLPNLLTLVGERWCYSLQSV

SEQ ID NO: 2991419 - protein, 25 aa, Entamoeba invadens
DLPNSDVFFTGFKPIVSFSNDGTSI

SEQ ID NO: 2991420 - protein, 33 aa, Entamoeba invadens
DLPSKPEFPVTLPPPIIIPPQKRNLFQLGGGVG

SEQ ID NO: 2991421 - protein, 21 aa, Entamoeba invadens
DLPSPLFLCSNIVSLNISCCR

SEQ ID NO: 2991422 - protein, 23 aa, Entamoeba invadens
DLPTFIVQIILDDGVVTVPVTSI

SEQ ID NO: 2991423 - protein, 19 aa, Entamoeba invadens
DLPTLFSLIRESASKTICS

SEQ ID NO: 2991424 - protein, 20 aa, Entamoeba invadens
DLQDVPLMKSLNPNLQQGET

SEQ ID NO: 2991425 - protein, 22 aa, Entamoeba invadens
DLQKYFYLKKSPSQIKDKINNT

SEQ ID NO: 2991426 - protein, 30 aa, Entamoeba invadens
DLQQRLADPQLLMKMRFYMLEMDIPRLDEY

SEQ ID NO: 2991427 - protein, 21 aa, Entamoeba invadens
DLQSREPFYIVSGRTLVITHC

SEQ ID NO: 2991428 - protein, 27 aa, Entamoeba invadens
DLQTKTYFIPFVSPPMQPPLNDSTLFK

SEQ ID NO: 2991429 - protein, 17 aa, Entamoeba invadens
DLRALALDLRRKRDKLR

SEQ ID NO: 2991430 - protein, 19 aa, Entamoeba invadens
DLRCVTCSPSFARKCVNCV

SEQ ID NO: 2991431 - protein, 28 aa, Entamoeba invadens
DLRDKNNVLTLLLAKDLYVALKQQLKEF

SEQ ID NO: 2991432 - protein, 25 aa, Entamoeba invadens
DLRDPKFVWGAKYIEYVNVRKTKVG

SEQ ID NO: 2991433 - protein, 23 aa, Entamoeba invadens
DLRELFQLMTYPGPARFSPGDIL

SEQ ID NO: 2991434 - protein, 20 aa, Entamoeba invadens
DLRIAGLKYGIFRMSMRHTE

SEQ ID NO: 2991435 - protein, 24 aa, Entamoeba invadens
DLRIPNAKTFVWTFPCQLSKAQRL

SEQ ID NO: 2991436 - protein, 26 aa, Entamoeba invadens
DLRNRDHEKFITPLSAHSLNNSQPTS

SEQ ID NO: 2991437 - protein, 21 aa, Entamoeba invadens
DLRRIVAGHYSLLKNAIHLAN

SEQ ID NO: 2991438 - protein, 31 aa, Entamoeba invadens
DLRSKPIELKKFLSFAFTYNLEKSKQLDKET

SEQ ID NO: 2991439 - protein, 38 aa, Entamoeba invadens
DLRVGEIIHIIFLEERFTYILPDTISLTNTSPLLLIEY

SEQ ID NO: 2991440 - protein, 39 aa, Entamoeba invadens
DLSCSRQIVFNPLVINFLRSLLMYVQEAKGGALPEHPTQ

SEQ ID NO: 2991441 - protein, 19 aa, Entamoeba invadens
DLSCVLHFEKGCEGMTTDI

SEQ ID NO: 2991442 - protein, 25 aa, Entamoeba invadens
DLSIKFYELLDLLGDRIELKGFTGY

SEQ ID NO: 2991443 - protein, 17 aa, Entamoeba invadens
DLSKDYCFIYNLTNNNG

SEQ ID NO: 2991444 - protein, 19 aa, Entamoeba invadens
DLSLKFDLFHQCCVGVQWL

SEQ ID NO: 2991445 - protein, 24 aa, Entamoeba invadens
DLSLQDVIHFWLSRSMKMVVEVKA

SEQ ID NO: 2991446 - protein, 19 aa, Entamoeba invadens
DLSPKKPAAKKDSLDLSDS

SEQ ID NO: 2991447 - protein, 23 aa, Entamoeba invadens
DLSQLISMNKIYVGQKLRVCGME

SEQ ID NO: 2991448 - protein, 29 aa, Entamoeba invadens
DLSSVDGIVLVKFLEKHFYCGQLLCLYGC

SEQ ID NO: 2991449 - protein, 27 aa, Entamoeba invadens
DLSTFIMPNIVYSVGILCFHHFYKLNK

SEQ ID NO: 2991450 - protein, 25 aa, Entamoeba invadens
DLSVPSLQKELDALKLRLSEKEELF

SEQ ID NO: 2991451 - protein, 17 aa, Entamoeba invadens
DLSWLENSKTVVEMSDE

SEQ ID NO: 2991452 - protein, 36 aa, Entamoeba invadens
DLSYGYLMHLIILECTRLGLKTVWLGGTFTTSVFTA

SEQ ID NO: 2991453 - protein, 21 aa, Entamoeba invadens
DLTDYLMKILTERCYAFITTA

SEQ ID NO: 2991454 - protein, 25 aa, Entamoeba invadens
DLTEQIFQFILIHNIEADFFSSYVS

SEQ ID NO: 2991455 - protein, 33 aa, Entamoeba invadens
DLTKAWRKVSVFLFRNILLLTKPGSEIILSTIY

SEQ ID NO: 2991456 - protein, 26 aa, Entamoeba invadens
DLTMCMSCVDGYFLSDYTCKSNDALN

SEQ ID NO: 2991457 - protein, 20 aa, Entamoeba invadens
DLTNDIVFYSRRIRVYQLGE

SEQ ID NO: 2991458 - protein, 18 aa, Entamoeba invadens
DLTTHFVNVTEKSQTCLM

SEQ ID NO: 2991459 - protein, 18 aa, Entamoeba invadens
DLTVIDWLRLQDYRIRPQ

SEQ ID NO: 2991460 - protein, 25 aa, Entamoeba invadens
DLTVLACFILVVESLLPLTPFQVVQ

SEQ ID NO: 2991461 - protein, 18 aa, Entamoeba invadens
DLVASPPLGIKEYRLKAD

SEQ ID NO: 2991462 - protein, 32 aa, Entamoeba invadens
DLVCLECLMKQRFLKRNFWCKICKKEFKDLLI

SEQ ID NO: 2991463 - protein, 23 aa, Entamoeba invadens
DLVGAYDFWPIDALSSALSVVTF

SEQ ID NO: 2991464 - protein, 24 aa, Entamoeba invadens
DLVHFFYQLLTHIGVFKDTLHSSE

SEQ ID NO: 2991465 - protein, 28 aa, Entamoeba invadens
DLVILSLGAGYPAAPYIPLENVFDAGVV

SEQ ID NO: 2991466 - protein, 17 aa, Entamoeba invadens
DLVMIEILKQKIEEIAQ

SEQ ID NO: 2991467 - protein, 22 aa, Entamoeba invadens
DLVVNKQIFIKQGVRHPDFHGE

SEQ ID NO: 2991468 - protein, 24 aa, Entamoeba invadens
DLVYKIMLDTWNITPNKRPGFMEI

SEQ ID NO: 2991469 - protein, 19 aa, Entamoeba invadens
DLWSLGVLTFELLTGYTPF

SEQ ID NO: 2991470 - protein, 30 aa, Entamoeba invadens
DLYDYDACSLYLSAIHRLKLATGKPIVIPQ

SEQ ID NO: 2991471 - protein, 22 aa, Entamoeba invadens
DLYIGGDFRRSFSIVEAVHDAE

SEQ ID NO: 2991472 - protein, 20 aa, Entamoeba invadens
DLYKQFGWPLAKEHGSLHDA

SEQ ID NO: 2991473 - protein, 18 aa, Entamoeba invadens
DLYLLLGSADFLGNPVGL

SEQ ID NO: 2991474 - protein, 19 aa, Entamoeba invadens
DLYLVIHQIPNTEPEDPIW

SEQ ID NO: 2991475 - protein, 23 aa, Entamoeba invadens
DLYSLGIILYHLCTKAWPFGCQK

SEQ ID NO: 2991476 - protein, 28 aa, Entamoeba invadens
DLYSLGVILYRMATLEFPFTDDYVLFQN

SEQ ID NO: 2991477 - protein, 21 aa, Entamoeba invadens
DLYYIWDVLFAHDNLLELLNH

SEQ ID NO: 2991478 - protein, 17 aa, Entamoeba invadens
DLYYPPIIKDLLDVNNN

SEQ ID NO: 2991479 - protein, 18 aa, Entamoeba invadens
DMALQHLSKFFSGDSTLL

SEQ ID NO: 2991480 - protein, 17 aa, Entamoeba invadens
DMELFPEDIKMIAKAKK

SEQ ID NO: 2991481 - protein, 29 aa, Entamoeba invadens
DMETYALLKVLLELIYHKTVYNSPTEMGV

SEQ ID NO: 2991482 - protein, 27 aa, Entamoeba invadens
DMFEFHLYVYEKLSICAYLDLMDNNMK

SEQ ID NO: 2991483 - protein, 26 aa, Entamoeba invadens
DMFEQHYQLMLSKRLLYKGYDLDSER

SEQ ID NO: 2991484 - protein, 18 aa, Entamoeba invadens
DMFLPMNYNDFHGEGVEW

SEQ ID NO: 2991485 - protein, 19 aa, Entamoeba invadens
DMFVIPLIKDKVNIQMVSY

SEQ ID NO: 2991486 - protein, 18 aa, Entamoeba invadens
DMFWAGVATFECEKFGLR

SEQ ID NO: 2991487 - protein, 18 aa, Entamoeba invadens
DMGQLPYDLLDQLKSTGN

SEQ ID NO: 2991488 - protein, 21 aa, Entamoeba invadens
DMGYEILVVSQFTLYAILNGT

SEQ ID NO: 2991489 - protein, 18 aa, Entamoeba invadens
DMHLYGPAMLACFPLQDI

SEQ ID NO: 2991490 - protein, 19 aa, Entamoeba invadens
DMIAKTVVPVVPAAGAKAP

SEQ ID NO: 2991491 - protein, 20 aa, Entamoeba invadens
DMILRIKMMLDASRGILYLH

SEQ ID NO: 2991492 - protein, 17 aa, Entamoeba invadens
DMIRRRSAILSKADSIS

SEQ ID NO: 2991493 - protein, 19 aa, Entamoeba invadens
DMKFQKVCDWQTQGDLDPF

SEQ ID NO: 2991494 - protein, 52 aa, Entamoeba invadens
DMKKQLKTLWRLRIMDHRLRHLKHKRRWLWTTKRRLRRLQRTNLIEEKNMED

SEQ ID NO: 2991495 - protein, 23 aa, Entamoeba invadens
DMKLKSIAFCGISTGIYGFPAKE

SEQ ID NO: 2991496 - protein, 24 aa, Entamoeba invadens
DMKLRLKMMLDASRGILYLHENGI

SEQ ID NO: 2991497 - protein, 17 aa, Entamoeba invadens
DMKMYCSPLQLSFIHKK

SEQ ID NO: 2991498 - protein, 17 aa, Entamoeba invadens
DMKNFYMKLLMPESQDL

SEQ ID NO: 2991499 - protein, 23 aa, Entamoeba invadens
DMKPKLPFRVIRFSLLHVFSSDL

SEQ ID NO: 2991500 - protein, 18 aa, Entamoeba invadens
DMKYIITGYFPSSALVDI

SEQ ID NO: 2991501 - protein, 28 aa, Entamoeba invadens
DMLAKQLTMSLNPPPLPPKSYQKDKKER

SEQ ID NO: 2991502 - protein, 17 aa, Entamoeba invadens
DMLCKWSNKQTLHVLFK

SEQ ID NO: 2991503 - protein, 28 aa, Entamoeba invadens
DMLEDQLSVYLWRFERDGEFDVWRCFYE

SEQ ID NO: 2991504 - protein, 24 aa, Entamoeba invadens
DMLHAGHYELFRKAKELGTYLVVG

SEQ ID NO: 2991505 - protein, 18 aa, Entamoeba invadens
DMLLLKRFGVKCVHISFV

SEQ ID NO: 2991506 - protein, 26 aa, Entamoeba invadens
DMLSDKFLSFKITFSSAYVPDKEYED

SEQ ID NO: 2991507 - protein, 26 aa, Entamoeba invadens
DMMQTTHFGIPQSIGLCECNNTEQIV

SEQ ID NO: 2991508 - protein, 19 aa, Entamoeba invadens
DMNCSIHGINFFIHDKRHL

SEQ ID NO: 2991509 - protein, 18 aa, Entamoeba invadens
DMNCSVKLRPKKMRGATS

SEQ ID NO: 2991510 - protein, 23 aa, Entamoeba invadens
DMNDIFAQFFPGMAGMGGFEQRS

SEQ ID NO: 2991511 - protein, 35 aa, Entamoeba invadens
DMPNLQQFYAPFNKLAFLPNGLFKSKKLRFVNVAF

SEQ ID NO: 2991512 - protein, 21 aa, Entamoeba invadens
DMQSVWLKYKSNTICLLDLIE

SEQ ID NO: 2991513 - protein, 19 aa, Entamoeba invadens
DMSDLFYQPILCVVGNQRD

SEQ ID NO: 2991514 - protein, 26 aa, Entamoeba invadens
DMSELLEFLNYFYKFSEDKGDTFVQT

SEQ ID NO: 2991515 - protein, 22 aa, Entamoeba invadens
DMSKILEVLLAYEKTNTYISQL

SEQ ID NO: 2991516 - protein, 36 aa, Entamoeba invadens
DMSLTYNELIIKFKCISFKKLLFKFSTTAVKSIAVI

SEQ ID NO: 2991517 - protein, 24 aa, Entamoeba invadens
DMSQAPLFQFPSIGESKIYTDFLA

SEQ ID NO: 2991518 - protein, 26 aa, Entamoeba invadens
DMSQQLFHLFSLINTKSPLSATCKYS

SEQ ID NO: 2991519 - protein, 33 aa, Entamoeba invadens
DMSSYLIMPVQRLPRYVLLLNELKKHTWEGHPD

SEQ ID NO: 2991520 - protein, 26 aa, Entamoeba invadens
DMSVQKTFLIRILTKVFLEDGQQKDV

SEQ ID NO: 2991521 - protein, 23 aa, Entamoeba invadens
DMTAYFATLYPVYFKILEASVNN

SEQ ID NO: 2991522 - protein, 23 aa, Entamoeba invadens
DMTFPINLKQLVIYSFCEFQKTN

SEQ ID NO: 2991523 - protein, 17 aa, Entamoeba invadens
DMTLIRETDLKQPKFGA

SEQ ID NO: 2991524 - protein, 23 aa, Entamoeba invadens
DMTSMISFFKTTLTTTFSVMKAV

SEQ ID NO: 2991525 - protein, 25 aa, Entamoeba invadens
DMTVKDMVFGLINLGLKIKDEMVVT

SEQ ID NO: 2991526 - protein, 18 aa, Entamoeba invadens
DMVLPMLCRGTKFTVLAS

SEQ ID NO: 2991527 - protein, 17 aa, Entamoeba invadens
DMWSFGCIAAELILGIP

SEQ ID NO: 2991528 - protein, 28 aa, Entamoeba invadens
DMWSIGVITYVLFGYPPFSGDTLGEILS

SEQ ID NO: 2991529 - protein, 22 aa, Entamoeba invadens
DMYGFYVQLNCREVKYFPFDFH

SEQ ID NO: 2991530 - protein, 19 aa, Entamoeba invadens
DMYLILLNTLNVCQVTSLE

SEQ ID NO: 2991531 - protein, 29 aa, Entamoeba invadens
DMYMRNGNKWTLMNKLLPGRTARAIRNRQ

SEQ ID NO: 2991532 - protein, 29 aa, Entamoeba invadens
DMYYLQNMIKQYFQFYYDDDTIVRELMKK

SEQ ID NO: 2991533 - protein, 18 aa, Entamoeba invadens
DNAFQYLVIAAEPYNTIA

SEQ ID NO: 2991534 - protein, 21 aa, Entamoeba invadens
DNAFYLEKYFIEAENCFITPV

SEQ ID NO: 2991535 - protein, 33 aa, Entamoeba invadens
DNARLQEIIYKVKPTYYLFLLDKEFEHQDDVHD

SEQ ID NO: 2991536 - protein, 23 aa, Entamoeba invadens
DNCEFWFEANKLEILSLNSSKNI

SEQ ID NO: 2991537 - protein, 19 aa, Entamoeba invadens
DNCFRLRKLVFEGEFPQAK

SEQ ID NO: 2991538 - protein, 24 aa, Entamoeba invadens
DNCGIRFVTAYYKADGCIGDQYLE

SEQ ID NO: 2991539 - protein, 24 aa, Entamoeba invadens
DNCVRLQMVSLPISLKKVALTKCD

SEQ ID NO: 2991540 - protein, 26 aa, Entamoeba invadens
DNCVSLGILNIPKTLLSIGDFCFQMC

SEQ ID NO: 2991541 - protein, 26 aa, Entamoeba invadens
DNDAFIFFGVVCESYFLLNTQIPDLK

SEQ ID NO: 2991542 - protein, 24 aa, Entamoeba invadens
DNDEKSVFLFLNEFFRETYVMSHT

SEQ ID NO: 2991543 - protein, 22 aa, Entamoeba invadens
DNDELFEHLYQQQLDYQQNAQP

SEQ ID NO: 2991544 - protein, 31 aa, Entamoeba invadens
DNDFLIKLMNETLFSYLLLKSSDSDIFHSSL

SEQ ID NO: 2991545 - protein, 23 aa, Entamoeba invadens
DNDFPKFVLPKNAVEIPPKTFCN

SEQ ID NO: 2991546 - protein, 26 aa, Entamoeba invadens
DNDIKELVMAYNSLSSKLDTFANTIH

SEQ ID NO: 2991547 - protein, 17 aa, Entamoeba invadens
DNDKQDLTAKAARFKKN

SEQ ID NO: 2991548 - protein, 40 aa, Entamoeba invadens
DNDPSQVPYPLNKYLLFSLLKLHLPPNRMLIQKIQNLDTT

SEQ ID NO: 2991549 - protein, 21 aa, Entamoeba invadens
DNDRHIILTKLKGNIVRLSMG

SEQ ID NO: 2991550 - protein, 22 aa, Entamoeba invadens
DNDVLFEHLYQQQLEYQQNAQP

SEQ ID NO: 2991551 - protein, 25 aa, Entamoeba invadens
DNDVMLDVLPVYLGFCVNSNKFDCF

SEQ ID NO: 2991552 - protein, 23 aa, Entamoeba invadens
DNEDIYMNPIPQIPPEIKSRICV

SEQ ID NO: 2991553 - protein, 26 aa, Entamoeba invadens
DNEHMKFLICICFLNATSSKRLPVSK

SEQ ID NO: 2991554 - protein, 34 aa, Entamoeba invadens
DNENETIVLLRRRRLVILKSIEQLAKSLKSVRND

SEQ ID NO: 2991555 - protein, 33 aa, Entamoeba invadens
DNENETIVLLRRRRLVILKSVEQLAKSLKSVRN

SEQ ID NO: 2991556 - protein, 33 aa, Entamoeba invadens
DNESIFLCSSLTFFIFPLSLRRICDKSFAECRS

SEQ ID NO: 2991557 - protein, 25 aa, Entamoeba invadens
DNEVLNCLILVDYVITKQPSFRPQI

SEQ ID NO: 2991558 - protein, 28 aa, Entamoeba invadens
DNEWIKHSLKGFKLLQAAVVNGFVGLTT

SEQ ID NO: 2991559 - protein, 23 aa, Entamoeba invadens
DNFDEIFTILIRITNPKTRLIQT

SEQ ID NO: 2991560 - protein, 25 aa, Entamoeba invadens
DNFESKAYFLGYMTNHFLSVYTGKR

SEQ ID NO: 2991561 - protein, 17 aa, Entamoeba invadens
DNFFCTLMLSHYLASCG

SEQ ID NO: 2991562 - protein, 20 aa, Entamoeba invadens
DNFISFKKLPKIGVTTLLKK

SEQ ID NO: 2991563 - protein, 28 aa, Entamoeba invadens
DNFKDNFQIILQLTLALSGLPIDNSETV

SEQ ID NO: 2991564 - protein, 19 aa, Entamoeba invadens
DNFSIQNWTKFLQIFNLML

SEQ ID NO: 2991565 - protein, 20 aa, Entamoeba invadens
DNFSLGQRQLLCLARALLNG

SEQ ID NO: 2991566 - protein, 27 aa, Entamoeba invadens
DNFSVVPPLRAILGWFGTEAVDAMIVG

SEQ ID NO: 2991567 - protein, 17 aa, Entamoeba invadens
DNFVLSKRIVFLRTFNC

SEQ ID NO: 2991568 - protein, 27 aa, Entamoeba invadens
DNFVTCEKGYYIKIIPNKATICTKCSE

SEQ ID NO: 2991569 - protein, 18 aa, Entamoeba invadens
DNGFDILFTIGGDGTLKG

SEQ ID NO: 2991570 - protein, 23 aa, Entamoeba invadens
DNGISFFKKLVSKPPIVKKKTDE

SEQ ID NO: 2991571 - protein, 21 aa, Entamoeba invadens
DNGKYFNRMFFVDKSGIVGKY

SEQ ID NO: 2991572 - protein, 23 aa, Entamoeba invadens
DNGTLQYMILANNKLKTSPDLSM

SEQ ID NO: 2991573 - protein, 27 aa, Entamoeba invadens
DNGVREAYFFLFNDVLIETKIDKMKGQ

SEQ ID NO: 2991574 - protein, 26 aa, Entamoeba invadens
DNIFELRNYIIRTQPYKIYNTFGNNF

SEQ ID NO: 2991575 - protein, 29 aa, Entamoeba invadens
DNIFIKYDQLFIYKYLQNVHLTLDKSDDT

SEQ ID NO: 2991576 - protein, 20 aa, Entamoeba invadens
DNIFKLLEKALPKEFRVVED

SEQ ID NO: 2991577 - protein, 20 aa, Entamoeba invadens
DNIKDVLSFILPLIGKEEPS

SEQ ID NO: 2991578 - protein, 28 aa, Entamoeba invadens
DNIKTLMVRWFYIIHNDINLNQFVRTKE

SEQ ID NO: 2991579 - protein, 24 aa, Entamoeba invadens
DNIPSSFCPRCGAYLILSIQGDIT

SEQ ID NO: 2991580 - protein, 23 aa, Entamoeba invadens
DNIRDKLAYYWREDGDKLKKFQF

SEQ ID NO: 2991581 - protein, 25 aa, Entamoeba invadens
DNISLAKVLLLFTNRIKMNIKSLKK

SEQ ID NO: 2991582 - protein, 19 aa, Entamoeba invadens
DNITYIRFPSFITDFLNGT

SEQ ID NO: 2991583 - protein, 18 aa, Entamoeba invadens
DNKFFILKVVHQKLRREN

SEQ ID NO: 2991584 - protein, 22 aa, Entamoeba invadens
DNKFQVLFASKDEYPTAMGFVD

SEQ ID NO: 2991585 - protein, 27 aa, Entamoeba invadens
DNKFTTFPSVLLTLSTLAKLYISSNHF

SEQ ID NO: 2991586 - protein, 22 aa, Entamoeba invadens
DNKKCLKCEDGFVLVNDECVSL

SEQ ID NO: 2991587 - protein, 23 aa, Entamoeba invadens
DNKLRFDLLKKTIGIFIKLSNST

SEQ ID NO: 2991588 - protein, 20 aa, Entamoeba invadens
DNKMFFKKVLLDRNVIPVQI

SEQ ID NO: 2991589 - protein, 19 aa, Entamoeba invadens
DNKNYHCWSHRVWVCNKFN

SEQ ID NO: 2991590 - protein, 23 aa, Entamoeba invadens
DNKSLVRNALWFSPLTMNEMENY

SEQ ID NO: 2991591 - protein, 17 aa, Entamoeba invadens
DNKYSIWFYGETAGVST

SEQ ID NO: 2991592 - protein, 26 aa, Entamoeba invadens
DNLARVVIIVGIPYPNLGDLNVKMKK

SEQ ID NO: 2991593 - protein, 20 aa, Entamoeba invadens
DNLCIVVAPTFFWKKGEMQR

SEQ ID NO: 2991594 - protein, 22 aa, Entamoeba invadens
DNLEFIGNYAFNYWTNLKTANL

SEQ ID NO: 2991595 - protein, 18 aa, Entamoeba invadens
DNLIFESINRFEKKYFRL

SEQ ID NO: 2991596 - protein, 21 aa, Entamoeba invadens
DNLIMTVFSAFWMNSEGIVQI

SEQ ID NO: 2991597 - protein, 24 aa, Entamoeba invadens
DNLPTTCFYTFFNSQNLVNCVDWC

SEQ ID NO: 2991598 - protein, 18 aa, Entamoeba invadens
DNLYEIGNFCFCGCINLA

SEQ ID NO: 2991599 - protein, 19 aa, Entamoeba invadens
DNLYHLILENNYKGFPISV

SEQ ID NO: 2991600 - protein, 24 aa, Entamoeba invadens
DNLYTPYFDVFYKNKTAKCPFHWM

SEQ ID NO: 2991601 - protein, 26 aa, Entamoeba invadens
DNMKKFHFNPIPITKLTIKHFPNIET

SEQ ID NO: 2991602 - protein, 24 aa, Entamoeba invadens
DNMKKFHFNPIPLTNKTFKHFPNI

SEQ ID NO: 2991603 - protein, 24 aa, Entamoeba invadens
DNMNTIINFFTGYTLYEVSKIYTR

SEQ ID NO: 2991604 - protein, 24 aa, Entamoeba invadens
DNNDVFPVLPDPFLVYSSAQEHVR

SEQ ID NO: 2991605 - protein, 33 aa, Entamoeba invadens
DNNGKCYKYEDGYFYWVYKNYVVFKTLNKQKFE

SEQ ID NO: 2991606 - protein, 27 aa, Entamoeba invadens
DNNIKFIEAFLVTYRQYLKPTELFEKL

SEQ ID NO: 2991607 - protein, 23 aa, Entamoeba invadens
DNNMYLLVNGICVSLKLANPDFE

SEQ ID NO: 2991608 - protein, 18 aa, Entamoeba invadens
DNNRIIGFVPPDGEFELM

SEQ ID NO: 2991609 - protein, 30 aa, Entamoeba invadens
DNNSQQVFLTQYPTRLAWRPFDLSQVDEVR

SEQ ID NO: 2991610 - protein, 22 aa, Entamoeba invadens
DNPADYELVMTFAIEKLPELVI

SEQ ID NO: 2991611 - protein, 30 aa, Entamoeba invadens
DNPDLRDRGLFYWRLLAHDPDLAKEMVCSE

SEQ ID NO: 2991612 - protein, 42 aa, Entamoeba invadens
DNPKDELFIRFRKAIDYYDLYRSFSLYFFKDKTLDKFNKKKE

SEQ ID NO: 2991613 - protein, 33 aa, Entamoeba invadens
DNPPAQPKFYLTGAFLFSLMYAGSNIKEIAKLL

SEQ ID NO: 2991614 - protein, 34 aa, Entamoeba invadens
DNPTAQPKFYLTGAFYFALLYSGSNFKEISRLLA

SEQ ID NO: 2991615 - protein, 26 aa, Entamoeba invadens
DNQCLKFVLKYVKLFDQSIFEKSIGY

SEQ ID NO: 2991616 - protein, 33 aa, Entamoeba invadens
DNQLSLIVFTTKLWVSFFRYFMAKLAETYKQDQ

SEQ ID NO: 2991617 - protein, 17 aa, Entamoeba invadens
DNQMYLHLKYDGIHLVL

SEQ ID NO: 2991618 - protein, 24 aa, Entamoeba invadens
DNQNYKLYRNLLIEAKGATVPFVA

SEQ ID NO: 2991619 - protein, 21 aa, Entamoeba invadens
DNQRESWWLAYIMDQIEEEKS

SEQ ID NO: 2991620 - protein, 25 aa, Entamoeba invadens
DNQSKHLLNLPWYKKEPKQENDFKK

SEQ ID NO: 2991621 - protein, 18 aa, Entamoeba invadens
DNRNLFVYLCSFAQKMVE

SEQ ID NO: 2991622 - protein, 17 aa, Entamoeba invadens
DNRTKILLSYRGSAWFV

SEQ ID NO: 2991623 - protein, 19 aa, Entamoeba invadens
DNRVFKHLNFVANSVPTKN

SEQ ID NO: 2991624 - protein, 22 aa, Entamoeba invadens
DNSAIVCAVGRRFRLGDWHADP

SEQ ID NO: 2991625 - protein, 25 aa, Entamoeba invadens
DNSFPPFLEYFLTQITSHPTEIFED

SEQ ID NO: 2991626 - protein, 24 aa, Entamoeba invadens
DNSHIFRFITLLNSNEILPKFVQS

SEQ ID NO: 2991627 - protein, 20 aa, Entamoeba invadens
DNSKFMCCYSLGISNLYTVN

SEQ ID NO: 2991628 - protein, 18 aa, Entamoeba invadens
DNSLIDRDLIPEIITEVG

SEQ ID NO: 2991629 - protein, 24 aa, Entamoeba invadens
DNTCYPIAFLLLPNDTEETFVRAL

SEQ ID NO: 2991630 - protein, 24 aa, Entamoeba invadens
DNTCYPVVFILLPNETEETFTRAF

SEQ ID NO: 2991631 - protein, 25 aa, Entamoeba invadens
DNTCYPVVFILLPNETEETFTRAFS

SEQ ID NO: 2991632 - protein, 27 aa, Entamoeba invadens
DNTKCYTDFRIFLQKMTNERLDFEKRM

SEQ ID NO: 2991633 - protein, 31 aa, Entamoeba invadens
DNTKLPLNFLLFNEPLDFLSISPFNFAHELT

SEQ ID NO: 2991634 - protein, 24 aa, Entamoeba invadens
DNTNPLWYYTIIVQKLFDKEDVRD

SEQ ID NO: 2991635 - protein, 24 aa, Entamoeba invadens
DNTRALYDVLWIAKEILVKHPNPL

SEQ ID NO: 2991636 - protein, 25 aa, Entamoeba invadens
DNTSKFHFNPIPLRLADIKHFERIE

SEQ ID NO: 2991637 - protein, 21 aa, Entamoeba invadens
DNTTYICRVSAFSSIIEEGCT

SEQ ID NO: 2991638 - protein, 17 aa, Entamoeba invadens
DNTVLYDRLLQKGYKEN

SEQ ID NO: 2991639 - protein, 29 aa, Entamoeba invadens
DNVALFVDILNRYICLFKYGQTDLKKYIV

SEQ ID NO: 2991640 - protein, 22 aa, Entamoeba invadens
DNVFVWDIWMEGPTQTPYEGGV

SEQ ID NO: 2991641 - protein, 25 aa, Entamoeba invadens
DNVIDFIHLFSVKPKFCRNGDQVTL

SEQ ID NO: 2991642 - protein, 19 aa, Entamoeba invadens
DNVIFVMDGAIGQAAFAQA

SEQ ID NO: 2991643 - protein, 24 aa, Entamoeba invadens
DNVIGVVVVYLLKLNARDIEKMIV

SEQ ID NO: 2991644 - protein, 19 aa, Entamoeba invadens
DNVKWYPFPDHHNPTLIVL

SEQ ID NO: 2991645 - protein, 35 aa, Entamoeba invadens
DNVLEKYLPTCFLLRQYLLLIQKPSDFSKMAVMSL

SEQ ID NO: 2991646 - protein, 17 aa, Entamoeba invadens
DNVPYRDAFKYCRRWLE

SEQ ID NO: 2991647 - protein, 27 aa, Entamoeba invadens
DNVRFITHVQLFTLWTKVFTHKVENVN

SEQ ID NO: 2991648 - protein, 29 aa, Entamoeba invadens
DNVRLLEKFFHAYATWDWARNPVMLGVSD

SEQ ID NO: 2991649 - protein, 24 aa, Entamoeba invadens
DNVRPILPHIFLEEYKGKKAFEQM

SEQ ID NO: 2991650 - protein, 23 aa, Entamoeba invadens
DNVRRLHGLLDFPIVSQKEFDEN

SEQ ID NO: 2991651 - protein, 25 aa, Entamoeba invadens
DNVSKYALFVFLKRVIMCDVDKRFA

SEQ ID NO: 2991652 - protein, 21 aa, Entamoeba invadens
DNVVWMLLGCKCDDQIKVDEE

SEQ ID NO: 2991653 - protein, 29 aa, Entamoeba invadens
DNVWKAVLITYFLWIKQNSDFSLCEVIIG

SEQ ID NO: 2991654 - protein, 25 aa, Entamoeba invadens
DNYKTIQTTRFLLIGNHPSLSFVSE

SEQ ID NO: 2991655 - protein, 18 aa, Entamoeba invadens
DNYLLQYTTGKLFHIDFG

SEQ ID NO: 2991656 - protein, 17 aa, Entamoeba invadens
DNYQLVNSFLNHQRQYC

SEQ ID NO: 2991657 - protein, 18 aa, Entamoeba invadens
DNYRKIVFQFPTSNKEVF

SEQ ID NO: 2991658 - protein, 23 aa, Entamoeba invadens
DNYRKVVLYFPTTNKDAFNASWL

SEQ ID NO: 2991659 - protein, 21 aa, Entamoeba invadens
DNYTVAIIIANFFFCVNNTTK

SEQ ID NO: 2991660 - protein, 38 aa, Entamoeba invadens
DNYVCNRLNHVFANHAQLLMHIVINARLHLTEIKKCLA

SEQ ID NO: 2991661 - protein, 21 aa, Entamoeba invadens
DPAEFTIHPIKSNGEPCDPAE

SEQ ID NO: 2991662 - protein, 27 aa, Entamoeba invadens
DPASPFPKLYLSPVAYLLPFVDAEIEM

SEQ ID NO: 2991663 - protein, 26 aa, Entamoeba invadens
DPAYKYIYNVFVTRLPKEITHDTFLE

SEQ ID NO: 2991664 - protein, 19 aa, Entamoeba invadens
DPDFLWEVPKTLEMPEDVR

SEQ ID NO: 2991665 - protein, 24 aa, Entamoeba invadens
DPDNPNSLMLIKKKKKMYSRKEEK

SEQ ID NO: 2991666 - protein, 17 aa, Entamoeba invadens
DPEFREVFVNTISLFFS

SEQ ID NO: 2991667 - protein, 31 aa, Entamoeba invadens
DPELTTFVPVLIPEFLPLYETERLLQELMTL

SEQ ID NO: 2991668 - protein, 23 aa, Entamoeba invadens
DPENPIVFFDISVGDKVIGRVKM

SEQ ID NO: 2991669 - protein, 37 aa, Entamoeba invadens
DPEPKPGQPKFFPVSKEPFPDVFFKDISDDSENLLDT

SEQ ID NO: 2991670 - protein, 19 aa, Entamoeba invadens
DPEWPIARNAQGVEGSVPM

SEQ ID NO: 2991671 - protein, 20 aa, Entamoeba invadens
DPFAFIVNKQTDWNTPYKPR

SEQ ID NO: 2991672 - protein, 21 aa, Entamoeba invadens
DPFTFPQRYNLRKKLLLLLSK

SEQ ID NO: 2991673 - protein, 24 aa, Entamoeba invadens
DPFVKIITELLITFGKVVPCTSLM

SEQ ID NO: 2991674 - protein, 17 aa, Entamoeba invadens
DPFYYRRSKTLYSLRTQ

SEQ ID NO: 2991675 - protein, 17 aa, Entamoeba invadens
DPGDILFFLTGQEEIDN

SEQ ID NO: 2991676 - protein, 22 aa, Entamoeba invadens
DPGTIVCILLHSNQKIPNCSLY

SEQ ID NO: 2991677 - protein, 18 aa, Entamoeba invadens
DPGVVYPGKYWKCDKCFT

SEQ ID NO: 2991678 - protein, 18 aa, Entamoeba invadens
DPHSKLRSKVWQILLGYL

SEQ ID NO: 2991679 - protein, 26 aa, Entamoeba invadens
DPHTKVFLLLSAYFGDNTLPIVDFVL

SEQ ID NO: 2991680 - protein, 18 aa, Entamoeba invadens
DPIFDDLFHYHFSYQINF

SEQ ID NO: 2991681 - protein, 25 aa, Entamoeba invadens
DPIKKLMFVITYHSLIRNCYKQIEE

SEQ ID NO: 2991682 - protein, 24 aa, Entamoeba invadens
DPIKKNWVIEWAKSSQIKEGDLDK

SEQ ID NO: 2991683 - protein, 21 aa, Entamoeba invadens
DPITCKYCQSILSYLDTVKDG

SEQ ID NO: 2991684 - protein, 18 aa, Entamoeba invadens
DPITKLTPLYLSVPNIPR

SEQ ID NO: 2991685 - protein, 17 aa, Entamoeba invadens
DPKAVFASEWYKLRLQT

SEQ ID NO: 2991686 - protein, 17 aa, Entamoeba invadens
DPKFLKLGIPFFMWEIG

SEQ ID NO: 2991687 - protein, 25 aa, Entamoeba invadens
DPKIDSLPLYDFSLAVPSFGVSVLV

SEQ ID NO: 2991688 - protein, 22 aa, Entamoeba invadens
DPKKLVMFDTKGSLHLEREDIK

SEQ ID NO: 2991689 - protein, 23 aa, Entamoeba invadens
DPKNFYNYKLTISPTEKLYKGAS

SEQ ID NO: 2991690 - protein, 26 aa, Entamoeba invadens
DPKRKPLYLVEQPIRAIIFGFNTEEI

SEQ ID NO: 2991691 - protein, 17 aa, Entamoeba invadens
DPKRWAMDYVNAGASLV

SEQ ID NO: 2991692 - protein, 24 aa, Entamoeba invadens
DPKTKPTVFLPNEITRLIPHVEHN

SEQ ID NO: 2991693 - protein, 19 aa, Entamoeba invadens
DPLELYKKLYDGESFKFNL

SEQ ID NO: 2991694 - protein, 20 aa, Entamoeba invadens
DPLFAISSLLGTLFKYYHKL

SEQ ID NO: 2991695 - protein, 17 aa, Entamoeba invadens
DPLFVTMEYFESGSLYD

SEQ ID NO: 2991696 - protein, 25 aa, Entamoeba invadens
DPLPMTAPHLLMLPTANVLSQTSAE

SEQ ID NO: 2991697 - protein, 23 aa, Entamoeba invadens
DPLSICLRALRRALYTGTYQYEA

SEQ ID NO: 2991698 - protein, 24 aa, Entamoeba invadens
DPLSLRNFLVVRVDGLKNLTSVES

SEQ ID NO: 2991699 - protein, 23 aa, Entamoeba invadens
DPLTLFFGDSYGFVYGWNAQQQG

SEQ ID NO: 2991700 - protein, 18 aa, Entamoeba invadens
DPMAEYIKVVICKKCFAC

SEQ ID NO: 2991701 - protein, 22 aa, Entamoeba invadens
DPMSILHCHPLYLSDPFKEYTE

SEQ ID NO: 2991702 - protein, 25 aa, Entamoeba invadens
DPMTRRIINTIDLLALERIDITEKE

SEQ ID NO: 2991703 - protein, 27 aa, Entamoeba invadens
DPNEYAWMSYIKYLIRLKEVEKARKLF

SEQ ID NO: 2991704 - protein, 17 aa, Entamoeba invadens
DPNIDSTYFLIKNLYEG

SEQ ID NO: 2991705 - protein, 23 aa, Entamoeba invadens
DPNILTTLCYLLNNVHIVEIRES

SEQ ID NO: 2991706 - protein, 18 aa, Entamoeba invadens
DPNQVRGYKKIGLCLYDD

SEQ ID NO: 2991707 - protein, 17 aa, Entamoeba invadens
DPNSFIFKITQKSMKKF

SEQ ID NO: 2991708 - protein, 32 aa, Entamoeba invadens
DPNTYFFTAMMEGNWWKGIFGNFYNFLRTVWN

SEQ ID NO: 2991709 - protein, 32 aa, Entamoeba invadens
DPNVRLFSSFRGFNFFGLKEGITSPNSIFVCD

SEQ ID NO: 2991710 - protein, 21 aa, Entamoeba invadens
DPPLLVDRKMKRYAYKVLKRE

SEQ ID NO: 2991711 - protein, 22 aa, Entamoeba invadens
DPPQFPITINTFNYVLLCRLNC

SEQ ID NO: 2991712 - protein, 28 aa, Entamoeba invadens
DPQKLANLPKSLPFVLKIDSFKKGVFEF

SEQ ID NO: 2991713 - protein, 27 aa, Entamoeba invadens
DPQKYADMAGDLCSCGLQISEDMKSQA

SEQ ID NO: 2991714 - protein, 23 aa, Entamoeba invadens
DPQSRKIMLPSVANTSVPQRGQI

SEQ ID NO: 2991715 - protein, 25 aa, Entamoeba invadens
DPQTFSTLFVFSFSSNLDIGEKRLP

SEQ ID NO: 2991716 - protein, 19 aa, Entamoeba invadens
DPREYPPRRDDYQLPYTPQ

SEQ ID NO: 2991717 - protein, 20 aa, Entamoeba invadens
DPRILLEQIAICRDAVFDTE

SEQ ID NO: 2991718 - protein, 19 aa, Entamoeba invadens
DPRRVVISEFAVLFKDRDP

SEQ ID NO: 2991719 - protein, 21 aa, Entamoeba invadens
DPRRVVISEFAVLFKTRDPVI

SEQ ID NO: 2991720 - protein, 19 aa, Entamoeba invadens
DPRTELFKYVDKEDLKAVD

SEQ ID NO: 2991721 - protein, 19 aa, Entamoeba invadens
DPSDRFLQLFLVSVSKELT

SEQ ID NO: 2991722 - protein, 24 aa, Entamoeba invadens
DPSFFRQYLRIPSSLLPPELSEDS

SEQ ID NO: 2991723 - protein, 26 aa, Entamoeba invadens
DPSFYNVYQCFKLAPPLHAHNSTLSQ

SEQ ID NO: 2991724 - protein, 23 aa, Entamoeba invadens
DPSKVNLVLLKKEIAKTPMDTMD

SEQ ID NO: 2991725 - protein, 34 aa, Entamoeba invadens
DPSLVSRFDLWLSKYYPFGEAILKELFLSMNNDI

SEQ ID NO: 2991726 - protein, 27 aa, Entamoeba invadens
DPSTFFFVLLAIVYLRQHDFGDSMESF

SEQ ID NO: 2991727 - protein, 24 aa, Entamoeba invadens
DPTELFMVHVFLFNSNTPPSGPQF

SEQ ID NO: 2991728 - protein, 24 aa, Entamoeba invadens
DPTLPLEYLNPILQTYTSTASYPI

SEQ ID NO: 2991729 - protein, 38 aa, Entamoeba invadens
DPTQILDIPQILLKKSNLLFIVVDTSGSIFGGFLGVKI

SEQ ID NO: 2991730 - protein, 26 aa, Entamoeba invadens
DPTSLLIPKLTLAQMTPFEKQYWNIK

SEQ ID NO: 2991731 - protein, 23 aa, Entamoeba invadens
DPYLGVLCPCDVNSFSVVLYSWH

SEQ ID NO: 2991732 - protein, 31 aa, Entamoeba invadens
DPYVLESISMAVFYVQAFRVENLREKFKVIV

SEQ ID NO: 2991733 - protein, 17 aa, Entamoeba invadens
DQAFEWCFNFKEIVLKE

SEQ ID NO: 2991734 - protein, 23 aa, Entamoeba invadens
DQALQHPFITKKPFVVDYVLPPS

SEQ ID NO: 2991735 - protein, 22 aa, Entamoeba invadens
DQARMMTKFITEKTLEMNKTLN

SEQ ID NO: 2991736 - protein, 27 aa, Entamoeba invadens
DQCDHDLLIGILKYGFGGGVLMEEDEQ

SEQ ID NO: 2991737 - protein, 18 aa, Entamoeba invadens
DQCSSLEVVYFPLSITKL

SEQ ID NO: 2991738 - protein, 24 aa, Entamoeba invadens
DQCTTFGEGAFKNCLELILCADEI

SEQ ID NO: 2991739 - protein, 22 aa, Entamoeba invadens
DQDFPLTMEPKIDKLTFGSNYA

SEQ ID NO: 2991740 - protein, 33 aa, Entamoeba invadens
DQEIFCVFMRLVKGKRVYSMPLLLQEYKGSTDA

SEQ ID NO: 2991741 - protein, 22 aa, Entamoeba invadens
DQEKIQALYQSYKEKKDAIEKA

SEQ ID NO: 2991742 - protein, 19 aa, Entamoeba invadens
DQELAILRILHHPHIINYY

SEQ ID NO: 2991743 - protein, 25 aa, Entamoeba invadens
DQEMSIFSLLITVKKYFNIETGIRV

SEQ ID NO: 2991744 - protein, 24 aa, Entamoeba invadens
DQETEDLLRLMKKSLSDLTKVEKI

SEQ ID NO: 2991745 - protein, 20 aa, Entamoeba invadens
DQFCEGIMRTLVHSGPLTVK

SEQ ID NO: 2991746 - protein, 20 aa, Entamoeba invadens
DQFIVFLIDIVIPLVQKKNP

SEQ ID NO: 2991747 - protein, 21 aa, Entamoeba invadens
DQFNKVCEIGYWLTKEETGKG

SEQ ID NO: 2991748 - protein, 25 aa, Entamoeba invadens
DQFSSCFWVLNKIVELNVFVREECF

SEQ ID NO: 2991749 - protein, 26 aa, Entamoeba invadens
DQFTKGVITPYYRPPEVYFEAPIYGP

SEQ ID NO: 2991750 - protein, 23 aa, Entamoeba invadens
DQHRSRWMNLDWKCADWTDDTDQ

SEQ ID NO: 2991751 - protein, 24 aa, Entamoeba invadens
DQIDPITVLPFTLNEPQLLSTVKT

SEQ ID NO: 2991752 - protein, 23 aa, Entamoeba invadens
DQIFANIDYLNDAMIAPLAELGN

SEQ ID NO: 2991753 - protein, 18 aa, Entamoeba invadens
DQIKKFGFGVPSLYLNDM

SEQ ID NO: 2991754 - protein, 29 aa, Entamoeba invadens
DQIQKWNEFLFNEFLPLNQLPQSINISVK

SEQ ID NO: 2991755 - protein, 17 aa, Entamoeba invadens
DQISWIDGSKFLFQMHF

SEQ ID NO: 2991756 - protein, 20 aa, Entamoeba invadens
DQIWQIPMILSYENKVVKYI

SEQ ID NO: 2991757 - protein, 26 aa, Entamoeba invadens
DQKAVVLSFRNLLSEIIKLKNLQGNV

SEQ ID NO: 2991758 - protein, 24 aa, Entamoeba invadens
DQKEKIMFFSDILKIIPLNDSNSL

SEQ ID NO: 2991759 - protein, 32 aa, Entamoeba invadens
DQKESIIENLIPLKIFLVELVAVIVTKMGEVK

SEQ ID NO: 2991760 - protein, 29 aa, Entamoeba invadens
DQKFSYELFNILPLSFFHEYLRGQNILYV

SEQ ID NO: 2991761 - protein, 17 aa, Entamoeba invadens
DQKIFCLYSDENPSWIF

SEQ ID NO: 2991762 - protein, 25 aa, Entamoeba invadens
DQKILDMFLELFLNPTVQSSVFRHY

SEQ ID NO: 2991763 - protein, 38 aa, Entamoeba invadens
DQKIPNLFAYYYYYTISYSKAFFLLSKSLTKTLQKFRC

SEQ ID NO: 2991764 - protein, 25 aa, Entamoeba invadens
DQKLALVKFGPFIEKLYVRGSVEKE

SEQ ID NO: 2991765 - protein, 22 aa, Entamoeba invadens
DQKLFNEFFLKYKKIRHWLGDA

SEQ ID NO: 2991766 - protein, 20 aa, Entamoeba invadens
DQKMFILRIARESGGNEIRK

SEQ ID NO: 2991767 - protein, 23 aa, Entamoeba invadens
DQLDINKLWEDYFMSTIFEVKEI

SEQ ID NO: 2991768 - protein, 33 aa, Entamoeba invadens
DQLIEIFKEFKPLFVTKLKFPGQFDIAFPVEVD

SEQ ID NO: 2991769 - protein, 29 aa, Entamoeba invadens
DQLMRVVRYRLHKHGIRTGFKAVYSLESP

SEQ ID NO: 2991770 - protein, 17 aa, Entamoeba invadens
DQLQQDFDYLKKNADTD

SEQ ID NO: 2991771 - protein, 26 aa, Entamoeba invadens
DQLTILIHMMSKDPTRLMAYLAKIKL

SEQ ID NO: 2991772 - protein, 17 aa, Entamoeba invadens
DQLYRPTIGVDFAVKMT

SEQ ID NO: 2991773 - protein, 23 aa, Entamoeba invadens
DQMKDIYHCILSGGKLPSFFLEK

SEQ ID NO: 2991774 - protein, 21 aa, Entamoeba invadens
DQMLNIGFKEDLNKILEAIHG

SEQ ID NO: 2991775 - protein, 20 aa, Entamoeba invadens
DQMLNLLYSSYSNFSNLQIQ

SEQ ID NO: 2991776 - protein, 19 aa, Entamoeba invadens
DQMRYVLNETLKGLVYLHS

SEQ ID NO: 2991777 - protein, 22 aa, Entamoeba invadens
DQNCVTCATDFTRKCVSCKPYY

SEQ ID NO: 2991778 - protein, 23 aa, Entamoeba invadens
DQNGFVFSLVSKTKLTTPTKFLS

SEQ ID NO: 2991779 - protein, 21 aa, Entamoeba invadens
DQNILALYRAVSSGVSRFLLA

SEQ ID NO: 2991780 - protein, 27 aa, Entamoeba invadens
DQNIRQFADLYFAPTQRICRYELLLST

SEQ ID NO: 2991781 - protein, 30 aa, Entamoeba invadens
DQNKDGLLFYLIFPVQHPARYNLLLRELLK

SEQ ID NO: 2991782 - protein, 26 aa, Entamoeba invadens
DQNKTFLEYFVPLCLKIVEHKTSKMN

SEQ ID NO: 2991783 - protein, 21 aa, Entamoeba invadens
DQNPDEFLRSIHISHTNLKAI

SEQ ID NO: 2991784 - protein, 24 aa, Entamoeba invadens
DQNSPFFTLKDMKKVVFTPHIGWT

SEQ ID NO: 2991785 - protein, 26 aa, Entamoeba invadens
DQNTCVIVPSLVFYIEIKLSGTTKYN

SEQ ID NO: 2991786 - protein, 24 aa, Entamoeba invadens
DQNTKTLISFLEKTKRPSQRMTTT

SEQ ID NO: 2991787 - protein, 17 aa, Entamoeba invadens
DQNTPLKKLISSSFRQV

SEQ ID NO: 2991788 - protein, 27 aa, Entamoeba invadens
DQPFKQYIQLVVTLILKRLIMKENTSD

SEQ ID NO: 2991789 - protein, 18 aa, Entamoeba invadens
DQPIYDEFALFQKQNNFT

SEQ ID NO: 2991790 - protein, 24 aa, Entamoeba invadens
DQPQQLKRILFVSPFNVVKETKKA

SEQ ID NO: 2991791 - protein, 22 aa, Entamoeba invadens
DQPTRQLNLLPPSKYSQTPQKQ

SEQ ID NO: 2991792 - protein, 18 aa, Entamoeba invadens
DQQHCPVPLRTTLTTSIK

SEQ ID NO: 2991793 - protein, 18 aa, Entamoeba invadens
DQQKSYFEQLDDFKLEED

SEQ ID NO: 2991794 - protein, 22 aa, Entamoeba invadens
DQQQIMILLQSFTIEPYYSMDL

SEQ ID NO: 2991795 - protein, 23 aa, Entamoeba invadens
DQRLQGILPNPLFPVMFVHCKGD

SEQ ID NO: 2991796 - protein, 17 aa, Entamoeba invadens
DQRYSLDVSKLEKLGWK

SEQ ID NO: 2991797 - protein, 21 aa, Entamoeba invadens
DQSFNVYSAMLSFEVLCTSEE

SEQ ID NO: 2991798 - protein, 28 aa, Entamoeba invadens
DQTDSIFNYFDYGFNKPSYSNYKKKCQI

SEQ ID NO: 2991799 - protein, 21 aa, Entamoeba invadens
DQTFQIFSLENKLLKEQTKKL

SEQ ID NO: 2991800 - protein, 24 aa, Entamoeba invadens
DQTKKWLDLFKNYGGYKDTTKNIF

SEQ ID NO: 2991801 - protein, 22 aa, Entamoeba invadens
DQTKLPPVLDLFGGLCLKCMDA

SEQ ID NO: 2991802 - protein, 28 aa, Entamoeba invadens
DQTLLHYEPLINIPILKFTYEQFEKAYP

SEQ ID NO: 2991803 - protein, 26 aa, Entamoeba invadens
DQTNWKALLRRGTAYYYLDKMGKAKE

SEQ ID NO: 2991804 - protein, 32 aa, Entamoeba invadens
DQTPRITVVVPTTTIYVYQSVSFDVFLEPGHT

SEQ ID NO: 2991805 - protein, 22 aa, Entamoeba invadens
DQTTFTLTLRCSGNFISSFVDR

SEQ ID NO: 2991806 - protein, 28 aa, Entamoeba invadens
DQVDANQFFFIVKFWGSFFTNLSLNDFT

SEQ ID NO: 2991807 - protein, 37 aa, Entamoeba invadens
DQVFHRLMFHSIFTKCKRVLNPLYIQNGYTTDSAIYS

SEQ ID NO: 2991808 - protein, 20 aa, Entamoeba invadens
DQVGFLFTHTEYMTPHSIAK

SEQ ID NO: 2991809 - protein, 18 aa, Entamoeba invadens
DQVKHSMHKFQEKNMLNA

SEQ ID NO: 2991810 - protein, 23 aa, Entamoeba invadens
DQVPPLWDAIFAYGNHLELANGI

SEQ ID NO: 2991811 - protein, 20 aa, Entamoeba invadens
DQVTLPGIYVALIQHLSQFE

SEQ ID NO: 2991812 - protein, 27 aa, Entamoeba invadens
DQVYMNYIPLIFSISVPLLLQSNDVLL

SEQ ID NO: 2991813 - protein, 21 aa, Entamoeba invadens
DQYFQMPDFIGQQPPTHSDNK

SEQ ID NO: 2991814 - protein, 41 aa, Entamoeba invadens
DQYKKRAFIFKLENFEKMHYWLNAIKWQQCFIEECIDNIVI

SEQ ID NO: 2991815 - protein, 19 aa, Entamoeba invadens
DQYQRIYAWFMGVDRDRSG

SEQ ID NO: 2991816 - protein, 20 aa, Entamoeba invadens
DQYQRIYMWFMGVDRDRSGT

SEQ ID NO: 2991817 - protein, 23 aa, Entamoeba invadens
DQYSSPFRLCYFDPILDFEKEIE

SEQ ID NO: 2991818 - protein, 17 aa, Entamoeba invadens
DRAIEIYPEFRIPAELA

SEQ ID NO: 2991819 - protein, 28 aa, Entamoeba invadens
DRAPALIAAYFVLKNKINFLQVSEIFKQ

SEQ ID NO: 2991820 - protein, 23 aa, Entamoeba invadens
DRAVYVLDCPYSQRLFKWFTKRN

SEQ ID NO: 2991821 - protein, 18 aa, Entamoeba invadens
DRCFDPITPLLTEWTYQA

SEQ ID NO: 2991822 - protein, 24 aa, Entamoeba invadens
DRDAIVFDFGMKRIDAITLGRGTS

SEQ ID NO: 2991823 - protein, 25 aa, Entamoeba invadens
DRDELPYYLLWLEETATAVSLKSRI

SEQ ID NO: 2991824 - protein, 25 aa, Entamoeba invadens
DRDTLPIEYLKKKFDLSLKFDLFHQ

SEQ ID NO: 2991825 - protein, 21 aa, Entamoeba invadens
DREFYFGSYGSFALFREENSF

SEQ ID NO: 2991826 - protein, 22 aa, Entamoeba invadens
DREIEFLYKEYSKVLPDPCPFE

SEQ ID NO: 2991827 - protein, 22 aa, Entamoeba invadens
DREMYFVQFDEYSFRIGHNQAV

SEQ ID NO: 2991828 - protein, 24 aa, Entamoeba invadens
DRENIWKAYLQIEAKYRTNSEFQT

SEQ ID NO: 2991829 - protein, 25 aa, Entamoeba invadens
DRETALYWGLVLIQKMFAYEQMMGK

SEQ ID NO: 2991830 - protein, 25 aa, Entamoeba invadens
DRFDKLIELIYFSPVRPIYVNDIIT

SEQ ID NO: 2991831 - protein, 17 aa, Entamoeba invadens
DRFFIPEDSKVSDFVKV

SEQ ID NO: 2991832 - protein, 20 aa, Entamoeba invadens
DRFIYTPTILQEKPVKKYLD

SEQ ID NO: 2991833 - protein, 17 aa, Entamoeba invadens
DRFMNPEMNKFVFLLCT

SEQ ID NO: 2991834 - protein, 22 aa, Entamoeba invadens
DRFNKFIRRHFQVAAQQVMQQP

SEQ ID NO: 2991835 - protein, 19 aa, Entamoeba invadens
DRFNKLIQHHQLVNGAGEM

SEQ ID NO: 2991836 - protein, 29 aa, Entamoeba invadens
DRFTQYSLLLFKLIERIKTHAIELSRKLF

SEQ ID NO: 2991837 - protein, 33 aa, Entamoeba invadens
DRGDFSCEVLFFLMAHKINYPNQFYFLRGNHES

SEQ ID NO: 2991838 - protein, 28 aa, Entamoeba invadens
DRGEIYFINWNKKYTTWIDPRPFPNRKV

SEQ ID NO: 2991839 - protein, 32 aa, Entamoeba invadens
DRGIYSIEVISFLLLLKVKYPERIHLLRGNHE

SEQ ID NO: 2991840 - protein, 26 aa, Entamoeba invadens
DRGQFSCETLLTLLCLKVNSPTDVYL

SEQ ID NO: 2991841 - protein, 24 aa, Entamoeba invadens
DRGSPFEFYHNFQYFLKTEKDVKV

SEQ ID NO: 2991842 - protein, 25 aa, Entamoeba invadens
DRHIPFVDLFAYDYPLTYTEYLDKQ

SEQ ID NO: 2991843 - protein, 18 aa, Entamoeba invadens
DRHVYLYYVSYDEFKEKN

SEQ ID NO: 2991844 - protein, 19 aa, Entamoeba invadens
DRIALNIVYQALKDGRLKE

SEQ ID NO: 2991845 - protein, 28 aa, Entamoeba invadens
DRIKPIEGIVLLFEYDKRALTYFQSEFC

SEQ ID NO: 2991846 - protein, 26 aa, Entamoeba invadens
DRISLIRLVLTYGQQKPLRSPYAHVE

SEQ ID NO: 2991847 - protein, 22 aa, Entamoeba invadens
DRKCIVMPLISTLNNETLPSPK

SEQ ID NO: 2991848 - protein, 26 aa, Entamoeba invadens
DRKDNVFTTQWFPPKIRKLCVYPQQV

SEQ ID NO: 2991849 - protein, 24 aa, Entamoeba invadens
DRKIRTWDLNTFPISGRVLIGPNS

SEQ ID NO: 2991850 - protein, 25 aa, Entamoeba invadens
DRKKDDLIFAFMLDKIANILESIGY

SEQ ID NO: 2991851 - protein, 29 aa, Entamoeba invadens
DRKLPQITEIFPLLLRGIGIHHSGLLPIV

SEQ ID NO: 2991852 - protein, 28 aa, Entamoeba invadens
DRKMDIEWLIHFFDVLKRNALTKFNTFI

SEQ ID NO: 2991853 - protein, 20 aa, Entamoeba invadens
DRKRLVVGSIKTLFENKKKS

SEQ ID NO: 2991854 - protein, 20 aa, Entamoeba invadens
DRKVIPTEQEIPPAASKHQL

SEQ ID NO: 2991855 - protein, 22 aa, Entamoeba invadens
DRLDEIIKRKINITTSLNTIVI

SEQ ID NO: 2991856 - protein, 20 aa, Entamoeba invadens
DRLFNSLEDLWKLLSGPTVK

SEQ ID NO: 2991857 - protein, 20 aa, Entamoeba invadens
DRLIALIRSLLKVEINARKF

SEQ ID NO: 2991858 - protein, 24 aa, Entamoeba invadens
DRLIGLIRSLLKIEINARKFIDVG

SEQ ID NO: 2991859 - protein, 24 aa, Entamoeba invadens
DRLKEAVLFSYRFPAKAEDVRSML

SEQ ID NO: 2991860 - protein, 33 aa, Entamoeba invadens
DRLLKIRYVVELDKFKFFEIDKPKAVQIFSNVK

SEQ ID NO: 2991861 - protein, 17 aa, Entamoeba invadens
DRLRDLLDDFPPLIFQS

SEQ ID NO: 2991862 - protein, 32 aa, Entamoeba invadens
DRLRHLSYPGCNCFLMCFSLISQGSLDNIEGK

SEQ ID NO: 2991863 - protein, 17 aa, Entamoeba invadens
DRMKKFRGHKILIQESE

SEQ ID NO: 2991864 - protein, 24 aa, Entamoeba invadens
DRNEMMSVFLPLLLIEDEAGQESV

SEQ ID NO: 2991865 - protein, 25 aa, Entamoeba invadens
DRNQFPILVFELLTFLFNCVETDPD

SEQ ID NO: 2991866 - protein, 33 aa, Entamoeba invadens
DRNRIAVYCLKDTYLPIRLIKKLMSLVNGVEMC

SEQ ID NO: 2991867 - protein, 17 aa, Entamoeba invadens
DRPPFTMSPDLLNPPEV

SEQ ID NO: 2991868 - protein, 22 aa, Entamoeba invadens
DRPWFNAKYFRSQKYRKIVQES

SEQ ID NO: 2991869 - protein, 18 aa, Entamoeba invadens
DRPYPPYDPKFVDEFPLL

SEQ ID NO: 2991870 - protein, 29 aa, Entamoeba invadens
DRQITSIGIFLWKFWSVYDKAVEEGILDL

SEQ ID NO: 2991871 - protein, 21 aa, Entamoeba invadens
DRQKFYELVYLCKQFDTKANK

SEQ ID NO: 2991872 - protein, 25 aa, Entamoeba invadens
DRQNTIEYFLRNSEDYYKCLEHLKQ

SEQ ID NO: 2991873 - protein, 17 aa, Entamoeba invadens
DRRPICELSKWLESITM

SEQ ID NO: 2991874 - protein, 25 aa, Entamoeba invadens
DRRQKRLIFQVLTQKMNLSKEIDLE

SEQ ID NO: 2991875 - protein, 28 aa, Entamoeba invadens
DRSDPNVVPFIFKNVKTPLMFINCDGSE

SEQ ID NO: 2991876 - protein, 26 aa, Entamoeba invadens
DRSENKLYIYLPPNSTDVWITQSTDP

SEQ ID NO: 2991877 - protein, 22 aa, Entamoeba invadens
DRSGWISSPSAFIFSLVKDGVS

SEQ ID NO: 2991878 - protein, 24 aa, Entamoeba invadens
DRTIRIWNYLSLKCIAIMTGHDHF

SEQ ID NO: 2991879 - protein, 19 aa, Entamoeba invadens
DRTIVLNNYFSVGIDAGIA

SEQ ID NO: 2991880 - protein, 22 aa, Entamoeba invadens
DRTKLDCTIPLILDANELYNVI

SEQ ID NO: 2991881 - protein, 17 aa, Entamoeba invadens
DRTLLINEQSFSALYIF

SEQ ID NO: 2991882 - protein, 25 aa, Entamoeba invadens
DRVPRQIGWGLLPKGSVLYDSDIYG

SEQ ID NO: 2991883 - protein, 18 aa, Entamoeba invadens
DRVRHKYFTILSSKYIKE

SEQ ID NO: 2991884 - protein, 18 aa, Entamoeba invadens
DRVRSVEPDVFIMVVGNK

SEQ ID NO: 2991885 - protein, 26 aa, Entamoeba invadens
DRVSGDVFYLRRNGFHYKVRIVENMV

SEQ ID NO: 2991886 - protein, 24 aa, Entamoeba invadens
DRWAYVWDLRLRKPVSKIYLKRMP

SEQ ID NO: 2991887 - protein, 24 aa, Entamoeba invadens
DRYDVAITTACGMLDHIVVEKTED

SEQ ID NO: 2991888 - protein, 19 aa, Entamoeba invadens
DRYGLIIIDSATALYRTDY

SEQ ID NO: 2991889 - protein, 21 aa, Entamoeba invadens
DRYLKKNFTLVRSMYDISNNI

SEQ ID NO: 2991890 - protein, 22 aa, Entamoeba invadens
DRYNPPWSTKYPSLSRLPKTNE

SEQ ID NO: 2991891 - protein, 22 aa, Entamoeba invadens
DRYNPPWSTKYPSLSRLPRTNE

SEQ ID NO: 2991892 - protein, 26 aa, Entamoeba invadens
DRYQLPLYLTQIIIPNGVSQINSHCF

SEQ ID NO: 2991893 - protein, 27 aa, Entamoeba invadens
DSAFRLEEMLLNAVLFNDIRQLEMVNK

SEQ ID NO: 2991894 - protein, 28 aa, Entamoeba invadens
DSAGKNYLPPVFAIEPVEIDLDTFTCEC

SEQ ID NO: 2991895 - protein, 31 aa, Entamoeba invadens
DSAQQSFLIAILIRNGFYIKIKRLYKRGKTT

SEQ ID NO: 2991896 - protein, 25 aa, Entamoeba invadens
DSAVAFFKGFFKKDFQTISSFFPDI

SEQ ID NO: 2991897 - protein, 26 aa, Entamoeba invadens
DSAVDWWSFGILTYEMMVGIPPFYSE

SEQ ID NO: 2991898 - protein, 21 aa, Entamoeba invadens
DSCFSYCYSLSSVTIPFGVKS

SEQ ID NO: 2991899 - protein, 30 aa, Entamoeba invadens
DSCGMYVVYCYYSTYLLSCNASVLIKAYLS

SEQ ID NO: 2991900 - protein, 25 aa, Entamoeba invadens
DSDDDDLLDKKPAAKAPAKKDSLDL

SEQ ID NO: 2991901 - protein, 24 aa, Entamoeba invadens
DSDDDDLLDKKPAAKAPAKKVDLS

SEQ ID NO: 2991902 - protein, 25 aa, Entamoeba invadens
DSDDDDLLDKKPAAKAPSKKLDLSD

SEQ ID NO: 2991903 - protein, 24 aa, Entamoeba invadens
DSDFLTPIMPTTFKAKSPLVLKNA

SEQ ID NO: 2991904 - protein, 28 aa, Entamoeba invadens
DSDICVCTVIRLLDFLGRKVLSTDNCRL

SEQ ID NO: 2991905 - protein, 24 aa, Entamoeba invadens
DSDIKQFWCSAHRLALRGEGLEKE

SEQ ID NO: 2991906 - protein, 32 aa, Entamoeba invadens
DSDKLKGVVLPILTSVSRKGRLRYIKKVEAIA

SEQ ID NO: 2991907 - protein, 34 aa, Entamoeba invadens
DSDVYKWAVKLDKMFDGFWKLAFDDKKVVVEKKM

SEQ ID NO: 2991908 - protein, 28 aa, Entamoeba invadens
DSEENLMGIKLLYQLLIQPDERARTVFV

SEQ ID NO: 2991909 - protein, 32 aa, Entamoeba invadens
DSEESFYPEEIFAIIIRGLLNKFMEYTSCKLE

SEQ ID NO: 2991910 - protein, 24 aa, Entamoeba invadens
DSERRFMEQYIAANPPTSTNGISQ

SEQ ID NO: 2991911 - protein, 26 aa, Entamoeba invadens
DSEVTALKMWKVNDFLGIVTAGKDKK

SEQ ID NO: 2991912 - protein, 21 aa, Entamoeba invadens
DSEWKQKNGFNQLCKHERSRS

SEQ ID NO: 2991913 - protein, 20 aa, Entamoeba invadens
DSFKLLSTFKNIKLLHLYCR

SEQ ID NO: 2991914 - protein, 18 aa, Entamoeba invadens
DSFLEALDSYYNNRNFAL

SEQ ID NO: 2991915 - protein, 32 aa, Entamoeba invadens
DSFNSYVILPIQRIPRYKLLLEELIKTMPDNH

SEQ ID NO: 2991916 - protein, 26 aa, Entamoeba invadens
DSFNVIVPFVVKLLRKIDTVRTASGK

SEQ ID NO: 2991917 - protein, 30 aa, Entamoeba invadens
DSFRKLQNGGIFWVRAPQDKGDKLVISEFN

SEQ ID NO: 2991918 - protein, 30 aa, Entamoeba invadens
DSFSKIRVILDKFIFNLVNQTYYKPSNSVS

SEQ ID NO: 2991919 - protein, 17 aa, Entamoeba invadens
DSFTHALKYDRYLRVGY

SEQ ID NO: 2991920 - protein, 17 aa, Entamoeba invadens
DSFVEICEHKHGCCVVQ

SEQ ID NO: 2991921 - protein, 18 aa, Entamoeba invadens
DSFVKYTDTWCVSKSVIS

SEQ ID NO: 2991922 - protein, 23 aa, Entamoeba invadens
DSFVVTCVGAFWVLSDGTATVHP

SEQ ID NO: 2991923 - protein, 17 aa, Entamoeba invadens
DSGCGWPAFTKPIHPLS

SEQ ID NO: 2991924 - protein, 30 aa, Entamoeba invadens
DSGDGTYFATPYFLLVKAFNNCVIKQHYKE

SEQ ID NO: 2991925 - protein, 31 aa, Entamoeba invadens
DSGDNIYHVGWLDDYRLIIVTRKRYIYMYTT

SEQ ID NO: 2991926 - protein, 20 aa, Entamoeba invadens
DSGKIWRMRACCVIYVNFAN

SEQ ID NO: 2991927 - protein, 24 aa, Entamoeba invadens
DSGRKPFPNVFYLNDFVGTFVEVK

SEQ ID NO: 2991928 - protein, 35 aa, Entamoeba invadens
DSGSTALPFLKVMNILIFVFATNSIDSYNFLEGSP

SEQ ID NO: 2991929 - protein, 25 aa, Entamoeba invadens
DSGVGKSCLLLRFADDTYTDTHIAT

SEQ ID NO: 2991930 - protein, 25 aa, Entamoeba invadens
DSGVGKSCLLLRFADDVFSKTYITT

SEQ ID NO: 2991931 - protein, 37 aa, Entamoeba invadens
DSGVYNKFIELFRTLPLCVYLSLPLGNFFLCHGGLSP

SEQ ID NO: 2991932 - protein, 23 aa, Entamoeba invadens
DSHKYWQMWALVNLEVVGLYEIQ

SEQ ID NO: 2991933 - protein, 24 aa, Entamoeba invadens
DSHYKGITAEFWKTFQSKAYKKDQ

SEQ ID NO: 2991934 - protein, 17 aa, Entamoeba invadens
DSHYLFSSYIFEQLSST

SEQ ID NO: 2991935 - protein, 22 aa, Entamoeba invadens
DSIAKYFSKFGKVVQVKLSKSS

SEQ ID NO: 2991936 - protein, 23 aa, Entamoeba invadens
DSIALFGIPFTITRMKIVEAPNS

SEQ ID NO: 2991937 - protein, 20 aa, Entamoeba invadens
DSIAQFLKLSSDLNLDCVKQ

SEQ ID NO: 2991938 - protein, 40 aa, Entamoeba invadens
DSIAWNVLPRSLFYKLFRQDLLIASLYRNFFLAQRVMQSL

SEQ ID NO: 2991939 - protein, 18 aa, Entamoeba invadens
DSIFILSSPLTLLNKYTR

SEQ ID NO: 2991940 - protein, 17 aa, Entamoeba invadens
DSIFTLIDKFRLHSNMI

SEQ ID NO: 2991941 - protein, 28 aa, Entamoeba invadens
DSIHFLEDLLYIIGIDCFCQIGDKVGNT

SEQ ID NO: 2991942 - protein, 22 aa, Entamoeba invadens
DSIKKLLVCSPIIYTNTAIENS

SEQ ID NO: 2991943 - protein, 33 aa, Entamoeba invadens
DSILRVVDLCKTGLRLHKSFMKIEFSRLQNVME

SEQ ID NO: 2991944 - protein, 41 aa, Entamoeba invadens
DSIMETSFTLVKWRSLVPTAPPYGLFLERCNFDVYNNDIQN

SEQ ID NO: 2991945 - protein, 19 aa, Entamoeba invadens
DSINDFINLVFVSKKFKDT

SEQ ID NO: 2991946 - protein, 20 aa, Entamoeba invadens
DSINHFFSIFNRAYACNELN

SEQ ID NO: 2991947 - protein, 22 aa, Entamoeba invadens
DSITLFANFINKGGRPFMPGEA

SEQ ID NO: 2991948 - protein, 28 aa, Entamoeba invadens
DSITSYVDLLFVLFLNWNRGAEDWELLR

SEQ ID NO: 2991949 - protein, 25 aa, Entamoeba invadens
DSKFTPGNFLCELLDMFDLAIHTNE

SEQ ID NO: 2991950 - protein, 23 aa, Entamoeba invadens
DSKINVFPQCQKCGALLTTKSLC

SEQ ID NO: 2991951 - protein, 29 aa, Entamoeba invadens
DSKIVGHLNDLLKFFFFVEQEDVQEEIKS

SEQ ID NO: 2991952 - protein, 25 aa, Entamoeba invadens
DSKIYHIQLAAYLPSTGFGISVKID

SEQ ID NO: 2991953 - protein, 26 aa, Entamoeba invadens
DSKKQKRLFYIPPVSQTDQSVYTPFK

SEQ ID NO: 2991954 - protein, 22 aa, Entamoeba invadens
DSKMTGSWCRIEKFPRGTNALR

SEQ ID NO: 2991955 - protein, 17 aa, Entamoeba invadens
DSKTMFLFSFKNDGKTP

SEQ ID NO: 2991956 - protein, 24 aa, Entamoeba invadens
DSKTRYSLKCLFNIIKDALGVKNV

SEQ ID NO: 2991957 - protein, 24 aa, Entamoeba invadens
DSKVYAMCFLGKSLVLAMEDKIII

SEQ ID NO: 2991958 - protein, 22 aa, Entamoeba invadens
DSKYFYIHSCLSYLAMKKKYSF

SEQ ID NO: 2991959 - protein, 17 aa, Entamoeba invadens
DSLGRKFIPDRLKIIIQ

SEQ ID NO: 2991960 - protein, 25 aa, Entamoeba invadens
DSLKGDLFDLMLDLFGNYVVQKFIE

SEQ ID NO: 2991961 - protein, 30 aa, Entamoeba invadens
DSLKIVPEELFKGYFDFVVFGHEHMCQVAT

SEQ ID NO: 2991962 - protein, 22 aa, Entamoeba invadens
DSLKVIPLAWKPETPNLFTTQF

SEQ ID NO: 2991963 - protein, 19 aa, Entamoeba invadens
DSLLYIGHVKQRSIPLESL

SEQ ID NO: 2991964 - protein, 26 aa, Entamoeba invadens
DSLNHPAYVPHYHFLCPNNPKVRSDL

SEQ ID NO: 2991965 - protein, 20 aa, Entamoeba invadens
DSLPDYLPEGILKKLTKKVN

SEQ ID NO: 2991966 - protein, 18 aa, Entamoeba invadens
DSLPLLKLRATKSSVPIY

SEQ ID NO: 2991967 - protein, 25 aa, Entamoeba invadens
DSLRELISRLMTIDPTKRITIPEIR

SEQ ID NO: 2991968 - protein, 26 aa, Entamoeba invadens
DSLRKNMIYSETFGVWIEISDTENSD

SEQ ID NO: 2991969 - protein, 19 aa, Entamoeba invadens
DSLVNYFPPRGEQFCFGKI

SEQ ID NO: 2991970 - protein, 21 aa, Entamoeba invadens
DSMEGFFFCHSICGGTGSGLG

SEQ ID NO: 2991971 - protein, 23 aa, Entamoeba invadens
DSMERIWHHTLYNELRVEPSEHS

SEQ ID NO: 2991972 - protein, 21 aa, Entamoeba invadens
DSMKIIERYWIDVELEKVRRL

SEQ ID NO: 2991973 - protein, 23 aa, Entamoeba invadens
DSMSKLISIILLMSNVPQKVVNT

SEQ ID NO: 2991974 - protein, 24 aa, Entamoeba invadens
DSNAHPILLVFQSSAIFTQQLTRF

SEQ ID NO: 2991975 - protein, 26 aa, Entamoeba invadens
DSNDLLLFFTDILRNFFVLGSNETTE

SEQ ID NO: 2991976 - protein, 37 aa, Entamoeba invadens
DSNFSKAFLRIFVFSLPPDNRLILFKLTDLVQNGKID

SEQ ID NO: 2991977 - protein, 24 aa, Entamoeba invadens
DSNGCLMPFIHGRPPYYPQSIITQ

SEQ ID NO: 2991978 - protein, 20 aa, Entamoeba invadens
DSNIFNLKCNVLKEIFCHVC

SEQ ID NO: 2991979 - protein, 23 aa, Entamoeba invadens
DSNLDFIKKLQISKYLFGPHLFS

SEQ ID NO: 2991980 - protein, 28 aa, Entamoeba invadens
DSNLKSLFELSLLFPTKTIQQITSRVKW

SEQ ID NO: 2991981 - protein, 21 aa, Entamoeba invadens
DSNPYNYNYPPQPPPPQQNIQ

SEQ ID NO: 2991982 - protein, 27 aa, Entamoeba invadens
DSNRMVISVFSAFWMDKEGMISFNPCV

SEQ ID NO: 2991983 - protein, 23 aa, Entamoeba invadens
DSNSACAIIKTLEGYQFDVGESD

SEQ ID NO: 2991984 - protein, 23 aa, Entamoeba invadens
DSNSHYAQFLSTSKFSILLNRDL

SEQ ID NO: 2991985 - protein, 22 aa, Entamoeba invadens
DSNVLVIFITGAISYSEMRIAY

SEQ ID NO: 2991986 - protein, 24 aa, Entamoeba invadens
DSPATILFETTTRKLMRVSVYAVN

SEQ ID NO: 2991987 - protein, 24 aa, Entamoeba invadens
DSPAYVSWDFKFIEWRDTDYLPGI

SEQ ID NO: 2991988 - protein, 25 aa, Entamoeba invadens
DSPNCKFCFRILNLSNSEVDLTFQC

SEQ ID NO: 2991989 - protein, 22 aa, Entamoeba invadens
DSPPFDVKRLLQAKIKFSGISV

SEQ ID NO: 2991990 - protein, 20 aa, Entamoeba invadens
DSPRWIGFGDHYMSTPYLKF

SEQ ID NO: 2991991 - protein, 20 aa, Entamoeba invadens
DSQFFKVVLSALVSSNLKNG

SEQ ID NO: 2991992 - protein, 23 aa, Entamoeba invadens
DSQLKLFIYLVQHFDEFDIQPVF

SEQ ID NO: 2991993 - protein, 30 aa, Entamoeba invadens; identical to SEQ ID NO: 2931130

SEQ ID NO: 2991994 - protein, 24 aa, Entamoeba invadens
DSQRSLDLFLTQLELLTDQGESLI

SEQ ID NO: 2991995 - protein, 23 aa, Entamoeba invadens
DSQYFYIYSCLSYLAMKKKYSFI

SEQ ID NO: 2991996 - protein, 17 aa, Entamoeba invadens
DSQYYWISYSHTNIHEE

SEQ ID NO: 2991997 - protein, 20 aa, Entamoeba invadens
DSRCKDMFTYICMDGKCVVK

SEQ ID NO: 2991998 - protein, 26 aa, Entamoeba invadens
DSREYQWRVFSAWDLTTNAMAAMKMK

SEQ ID NO: 2991999 - protein, 25 aa, Entamoeba invadens
DSRGCFVVFTMEGTLYIWKGSLSQQ

SEQ ID NO: 2992000 - protein, 27 aa, Entamoeba invadens
DSRKKREWQLTALPWTTRPSQVMRKKF

SEQ ID NO: 2992001 - protein, 18 aa, Entamoeba invadens
DSRLFFEVSQSYLEFLFS

SEQ ID NO: 2992002 - protein, 17 aa, Entamoeba invadens
DSRMLKLPVISLENGVE

SEQ ID NO: 2992003 - protein, 20 aa, Entamoeba invadens
DSRTNTLNYLFKPKNSIIEE

SEQ ID NO: 2992004 - protein, 23 aa, Entamoeba invadens
DSSLRSLSPFPKVTLHSPPDSDF

SEQ ID NO: 2992005 - protein, 25 aa, Entamoeba invadens
DSSSLALIHYILVRGLSDPKQKTRA

SEQ ID NO: 2992006 - protein, 25 aa, Entamoeba invadens
DSTFRFYEIIMVDPMLKEIRDDPTI

SEQ ID NO: 2992007 - protein, 20 aa, Entamoeba invadens
DSTKLLASLAARNEVLKNSK

SEQ ID NO: 2992008 - protein, 23 aa, Entamoeba invadens
DSTNLKIISIDFSKLAMPKVIER

SEQ ID NO: 2992009 - protein, 27 aa, Entamoeba invadens
DSTNYKNYLWKLLKALFDDYTDFADTL

SEQ ID NO: 2992010 - protein, 29 aa, Entamoeba invadens
DSVNHLLAFPPVFTIFLSITIDQGFRNKR

SEQ ID NO: 2992011 - protein, 28 aa, Entamoeba invadens
DSVPDMGLEFLTRYLTDLIGDVVVFSEH

SEQ ID NO: 2992012 - protein, 30 aa, Entamoeba invadens
DSVSLGYVRFYMTTLPYFTTQKTVLQFIKD

SEQ ID NO: 2992013 - protein, 23 aa, Entamoeba invadens
DSVTGFLLAGIGSVDRLSTQLFH

SEQ ID NO: 2992014 - protein, 26 aa, Entamoeba invadens
DSWEKNLVLRFLWDLLSISTEIPKLD

SEQ ID NO: 2992015 - protein, 23 aa, Entamoeba invadens
DSWTMRSAKIHNFLKKAMGDKKE

SEQ ID NO: 2992016 - protein, 18 aa, Entamoeba invadens
DSWYSYYIRAVDKDLKIH

SEQ ID NO: 2992017 - protein, 23 aa, Entamoeba invadens
DSYAFQNCYFLKSVTLCEGLCVI

SEQ ID NO: 2992018 - protein, 26 aa, Entamoeba invadens
DSYGKRILVPLGFYNMMLRTKQPNYN

SEQ ID NO: 2992019 - protein, 18 aa, Entamoeba invadens
DSYHLNIPLRFKVENIIQ

SEQ ID NO: 2992020 - protein, 19 aa, Entamoeba invadens
DSYKNLCMNGQLFFSQKIE

SEQ ID NO: 2992021 - protein, 31 aa, Entamoeba invadens
DSYKYNKEVLLIYFFKMIQTVSQADLCILTL

SEQ ID NO: 2992022 - protein, 18 aa, Entamoeba invadens
DSYQIVHNKLPIVRTAFT

SEQ ID NO: 2992023 - protein, 35 aa, Entamoeba invadens
DSYQYFIDCSFQTQFRVWCYPFDSGPVIEVCLDKG

SEQ ID NO: 2992024 - protein, 24 aa, Entamoeba invadens
DTAFLIRETLRALQYIHEFGFIHR

SEQ ID NO: 2992025 - protein, 30 aa, Entamoeba invadens
DTAHCFMRALYQKALFLDKSKIKAVVAQKE

SEQ ID NO: 2992026 - protein, 22 aa, Entamoeba invadens
DTAKFVVHALKSNGAPYTLEKV

SEQ ID NO: 2992027 - protein, 25 aa, Entamoeba invadens
DTAKFYTAELVLALLHLHSLGVVYR

SEQ ID NO: 2992028 - protein, 23 aa, Entamoeba invadens
DTAKKWFADILAENWTETSKGDV

SEQ ID NO: 2992029 - protein, 24 aa, Entamoeba invadens
DTAKYFAYRPIFEGGKLIDNMEHP

SEQ ID NO: 2992030 - protein, 25 aa, Entamoeba invadens
DTALRRFGRFDREIDLGIPDEEGRL

SEQ ID NO: 2992031 - protein, 24 aa, Entamoeba invadens
DTAVDLLHQFYPQPNTRIDQFVNY

SEQ ID NO: 2992032 - protein, 17 aa, Entamoeba invadens
DTAVFLNSFLPNSLQEL

SEQ ID NO: 2992033 - protein, 21 aa, Entamoeba invadens
DTCFKFCTSLKMVNLPDKIKS

SEQ ID NO: 2992034 - protein, 26 aa, Entamoeba invadens
DTCGPFFQVKLLKLLRVMNPTNTNYQ

SEQ ID NO: 2992035 - protein, 25 aa, Entamoeba invadens
DTCHKYYKEILPYALNNFKAISAPT

SEQ ID NO: 2992036 - protein, 21 aa, Entamoeba invadens
DTCQYLESIKFDFAKEKEAKK

SEQ ID NO: 2992037 - protein, 23 aa, Entamoeba invadens
DTDIKLFKINKKVPTLKIGTKDF

SEQ ID NO: 2992038 - protein, 30 aa, Entamoeba invadens
DTDPDFNWKYLFLLYDSYTQMSNFFNKTLT

SEQ ID NO: 2992039 - protein, 26 aa, Entamoeba invadens
DTDPRHLLEFYRRYIPKQTGTSKLNS

SEQ ID NO: 2992040 - protein, 39 aa, Entamoeba invadens
DTEASVFRFFLLNNTFNKAFIPLLKTLTSKSLINTSKES

SEQ ID NO: 2992041 - protein, 23 aa, Entamoeba invadens
DTEFCLMLIRKFVSKTTVRLIIM

SEQ ID NO: 2992042 - protein, 19 aa, Entamoeba invadens
DTEGIIPTALYTVNRGFMY

SEQ ID NO: 2992043 - protein, 28 aa, Entamoeba invadens
DTEGNIRFCGLKLLGFMMTKHPKAVIES

SEQ ID NO: 2992044 - protein, 23 aa, Entamoeba invadens
DTEKKLDQQVCLGEMSSVDSFKK

SEQ ID NO: 2992045 - protein, 17 aa, Entamoeba invadens
DTEKMRIYLNVTNDFNE

SEQ ID NO: 2992046 - protein, 26 aa, Entamoeba invadens
DTEKSLINFFKIRGIGNLIKEIMVKQ

SEQ ID NO: 2992047 - protein, 17 aa, Entamoeba invadens
DTERHIFYALSTTSLDV

SEQ ID NO: 2992048 - protein, 20 aa, Entamoeba invadens
DTERKNFLGQKHTKTPSQTS

SEQ ID NO: 2992049 - protein, 23 aa, Entamoeba invadens
DTETMIFTLLRQTVATYSTHTIL

SEQ ID NO: 2992050 - protein, 26 aa, Entamoeba invadens
DTETPKVIDLAFCKLYGVANTNKFVL

SEQ ID NO: 2992051 - protein, 20 aa, Entamoeba invadens
DTFAKRIKQLIRPDSYEILS

SEQ ID NO: 2992052 - protein, 27 aa, Entamoeba invadens
DTFDPQDSFLFIGPTKHSYISTVYQKI

SEQ ID NO: 2992053 - protein, 18 aa, Entamoeba invadens
DTFFGIVEEMSHLFAVFL

SEQ ID NO: 2992054 - protein, 31 aa, Entamoeba invadens
DTFLRQRTAIKLLKKYLPSTGDIKIIVKGNM

SEQ ID NO: 2992055 - protein, 20 aa, Entamoeba invadens
DTFLSLFGRGRFDPSFVAER

SEQ ID NO: 2992056 - protein, 26 aa, Entamoeba invadens
DTFNMWNIPISFWNFHKSITLNEKEI

SEQ ID NO: 2992057 - protein, 24 aa, Entamoeba invadens
DTFPKLEFGPFKKAVLKELIKYTV

SEQ ID NO: 2992058 - protein, 17 aa, Entamoeba invadens
DTFRFNNYPFIILSIAT

SEQ ID NO: 2992059 - protein, 21 aa, Entamoeba invadens
DTFRIFGTMNPGGDFGKRELS

SEQ ID NO: 2992060 - protein, 23 aa, Entamoeba invadens
DTFTHEYFLKQGESAILLTDLYS

SEQ ID NO: 2992061 - protein, 21 aa, Entamoeba invadens
DTFTKLDYWVTSIKDNSDVKA

SEQ ID NO: 2992062 - protein, 25 aa, Entamoeba invadens
DTFVCLGCTIGYYIRTGKCVACLTN

SEQ ID NO: 2992063 - protein, 24 aa, Entamoeba invadens
DTHGMLLSCFSAFWVGTNGNVNFN

SEQ ID NO: 2992064 - protein, 24 aa, Entamoeba invadens
DTHKRQFLFRLRKSIMTKQVSLPP

SEQ ID NO: 2992065 - protein, 23 aa, Entamoeba invadens
DTHMLFLGDYVDRGYFGCENILL

SEQ ID NO: 2992066 - protein, 24 aa, Entamoeba invadens
DTHNLLREIIDWEAAPAYSASPMS

SEQ ID NO: 2992067 - protein, 23 aa, Entamoeba invadens
DTHYLLYICDLMRNECLEQNVLY

SEQ ID NO: 2992068 - protein, 20 aa, Entamoeba invadens
DTIFSTKKFANEDELQILVI

SEQ ID NO: 2992069 - protein, 17 aa, Entamoeba invadens
DTIGTKYTFSPLLGATE

SEQ ID NO: 2992070 - protein, 19 aa, Entamoeba invadens
DTIKLSELILYIRDHNGFK

SEQ ID NO: 2992071 - protein, 25 aa, Entamoeba invadens
DTISPYFLPAFDFIDKFVSTERNVL

SEQ ID NO: 2992072 - protein, 17 aa, Entamoeba invadens
DTIVRYHRMLGDTTLWV

SEQ ID NO: 2992073 - protein, 24 aa, Entamoeba invadens
DTKIHNYCPLPPTWNLLGFCGSHT

SEQ ID NO: 2992074 - protein, 23 aa, Entamoeba invadens
DTKIIMSNLVIAFSSLIESSTTR

SEQ ID NO: 2992075 - protein, 28 aa, Entamoeba invadens
DTKKCGKYTFFLNPSFFDQKISLTQQDF

SEQ ID NO: 2992076 - protein, 25 aa, Entamoeba invadens
DTKKDLIIIQAKIQNMRLMLRLGTS

SEQ ID NO: 2992077 - protein, 26 aa, Entamoeba invadens
DTKQKHLFYMNKALTFLIQNKHIDIH

SEQ ID NO: 2992078 - protein, 24 aa, Entamoeba invadens
DTKRMIEFMLGPFTRDEGFKKRVE

SEQ ID NO: 2992079 - protein, 22 aa, Entamoeba invadens
DTKSFFVIGKMLWNVNEECEQK

SEQ ID NO: 2992080 - protein, 22 aa, Entamoeba invadens
DTKSTILGTIGYAAPEILTGHY

SEQ ID NO: 2992081 - protein, 25 aa, Entamoeba invadens
DTKTLTDFAKFVGKIYKIDENAIVA

SEQ ID NO: 2992082 - protein, 19 aa, Entamoeba invadens
DTLCYFIDLPKIPGRFDPK

SEQ ID NO: 2992083 - protein, 26 aa, Entamoeba invadens
DTLIIEQKMDFIPNLKLNNFIGKCPD

SEQ ID NO: 2992084 - protein, 26 aa, Entamoeba invadens
DTLKAFHAMLPFGETSKLLADVLSVL

SEQ ID NO: 2992085 - protein, 24 aa, Entamoeba invadens
DTLKERLYYDIFNFITKQTMTAAE

SEQ ID NO: 2992086 - protein, 22 aa, Entamoeba invadens
DTLKILRLDVYYNYLQATTNGH

SEQ ID NO: 2992087 - protein, 26 aa, Entamoeba invadens
DTLKIRLIRLTQITNNLLLFSNKKIA

SEQ ID NO: 2992088 - protein, 28 aa, Entamoeba invadens
DTLKKTGWIGLYDMLQMDNSKYLKYIYI

SEQ ID NO: 2992089 - protein, 37 aa, Entamoeba invadens
DTLKNSISKIFLRFCPFFAIYQHFLINHDNAFSILTK

SEQ ID NO: 2992090 - protein, 18 aa, Entamoeba invadens
DTLLKKIEQLADGTFEFA

SEQ ID NO: 2992091 - protein, 19 aa, Entamoeba invadens
DTLLLLKPKEKKAALRGVT

SEQ ID NO: 2992092 - protein, 17 aa, Entamoeba invadens
DTLPPTNELLYSYYIGL

SEQ ID NO: 2992093 - protein, 24 aa, Entamoeba invadens
DTLQKKLVPAINDSNQFIKDSKDE

SEQ ID NO: 2992094 - protein, 18 aa, Entamoeba invadens
DTLRFIITCSFDQKLRVI

SEQ ID NO: 2992095 - protein, 19 aa, Entamoeba invadens
DTLTGLFKSGSIGSSDSNT

SEQ ID NO: 2992096 - protein, 20 aa, Entamoeba invadens
DTLWCLGDVLRKSSAKSYSS

SEQ ID NO: 2992097 - protein, 20 aa, Entamoeba invadens
DTLWGALRLANSVALIVETT

SEQ ID NO: 2992098 - protein, 17 aa, Entamoeba invadens
DTLYINSIMSPICTLSD

SEQ ID NO: 2992099 - protein, 28 aa, Entamoeba invadens
DTMEQLWHRVFYNELKIKPKEHPLLYIE

SEQ ID NO: 2992100 - protein, 18 aa, Entamoeba invadens
DTMERYLYSILSEVLRDW

SEQ ID NO: 2992101 - protein, 33 aa, Entamoeba invadens
DTMETDRLFFFWHKMFLLICDASCIATGENLEK

SEQ ID NO: 2992102 - protein, 21 aa, Entamoeba invadens
DTMRNLLYIPQVDFNIVEFEK

SEQ ID NO: 2992103 - protein, 25 aa, Entamoeba invadens
DTMSKLISIILLMSNVPKKQCDYYT

SEQ ID NO: 2992104 - protein, 24 aa, Entamoeba invadens
DTMSKLISIILLMSNVPKKVVNTA

SEQ ID NO: 2992105 - protein, 24 aa, Entamoeba invadens
DTMVLPSITLKAGTIKWFVQLQKG

SEQ ID NO: 2992106 - protein, 29 aa, Entamoeba invadens
DTNATTCISCYFGFILNVQTSHCDSSEDI

SEQ ID NO: 2992107 - protein, 25 aa, Entamoeba invadens
DTNKNEPFMSWGCLTTPATSSTETK

SEQ ID NO: 2992108 - protein, 25 aa, Entamoeba invadens
DTNLSTLCLFKLVTKFLPTANINPN

SEQ ID NO: 2992109 - protein, 27 aa, Entamoeba invadens
DTNNDTILIVPQPERFITPPHTQTPSQ

SEQ ID NO: 2992110 - protein, 17 aa, Entamoeba invadens
DTNPEIIELIKNKYNIT

SEQ ID NO: 2992111 - protein, 41 aa, Entamoeba invadens
DTNRYRICITFSTQCMIILFYTLPSCYPSEGSPLFMAKTKR

SEQ ID NO: 2992112 - protein, 25 aa, Entamoeba invadens
DTNVFNLFFETDTPIFYCIKCLKKK

SEQ ID NO: 2992113 - protein, 31 aa, Entamoeba invadens
DTPAIAVLTKVLPPLFHLIRDPMSNDICLQL

SEQ ID NO: 2992114 - protein, 22 aa, Entamoeba invadens
DTPGVDIQFKYLDKNLFVINNF

SEQ ID NO: 2992115 - protein, 17 aa, Entamoeba invadens
DTPMYGVSWIFKSTSAL

SEQ ID NO: 2992116 - protein, 31 aa, Entamoeba invadens
DTPSSPLPHLLLSPLAFFLKSDKMTKEDLKM

SEQ ID NO: 2992117 - protein, 25 aa, Entamoeba invadens
DTPTHPIIPHFPTSWLDKIIGADGY

SEQ ID NO: 2992118 - protein, 26 aa, Entamoeba invadens
DTPVVKWLWEILHEYPIDLKKKFLFF

SEQ ID NO: 2992119 - protein, 25 aa, Entamoeba invadens
DTQQFQQPFQFSFHYAPEIPDDSFI

SEQ ID NO: 2992120 - protein, 23 aa, Entamoeba invadens
DTQRRVIHLPVHSTSLPSPFLTT

SEQ ID NO: 2992121 - protein, 23 aa, Entamoeba invadens
DTQTFGFYQRDLVPIASKTTQLT

SEQ ID NO: 2992122 - protein, 23 aa, Entamoeba invadens
DTRCFRFCLSLDNITIPKTVTSL

SEQ ID NO: 2992123 - protein, 24 aa, Entamoeba invadens
DTRHLFQDLFVMTIDSDKARLLDD

SEQ ID NO: 2992124 - protein, 25 aa, Entamoeba invadens
DTRKQFLELLKSYRYPTESVLSNCK

SEQ ID NO: 2992125 - protein, 25 aa, Entamoeba invadens
DTSEFLPIDFTYTKHLKLFSVCRFS

SEQ ID NO: 2992126 - protein, 18 aa, Entamoeba invadens
DTSFIFSQLSSEAFTKCM

SEQ ID NO: 2992127 - protein, 28 aa, Entamoeba invadens
DTSFKSIMIYIYWYPQVKNSLAQKLCTL

SEQ ID NO: 2992128 - protein, 21 aa, Entamoeba invadens
DTSILSYFYKNDMDFSVELTP

SEQ ID NO: 2992129 - protein, 30 aa, Entamoeba invadens
DTSLFKAPYEIMFYMPIHGLSRENPASPFT

SEQ ID NO: 2992130 - protein, 21 aa, Entamoeba invadens
DTSLPEVFYTPKIDPSSTIPK

SEQ ID NO: 2992131 - protein, 32 aa, Entamoeba invadens
DTSLTKLLLKFPNDFFSILKLTLIDSKSVLLS

SEQ ID NO: 2992132 - protein, 26 aa, Entamoeba invadens
DTSPERGFFFQIPEYSKKVFVYFRDG

SEQ ID NO: 2992133 - protein, 22 aa, Entamoeba invadens
DTSPYIRKAAALAIPKIYNLDE

SEQ ID NO: 2992134 - protein, 17 aa, Entamoeba invadens
DTSSLFAMLFKENPTDK

SEQ ID NO: 2992135 - protein, 25 aa, Entamoeba invadens
DTSSPIPIPVNVPLPYGKDVDQAMD

SEQ ID NO: 2992136 - protein, 22 aa, Entamoeba invadens
DTTFGFLIYRFAMEKHMMINFV

SEQ ID NO: 2992137 - protein, 20 aa, Entamoeba invadens
DTTIFFLKGKCKLISYFNEK

SEQ ID NO: 2992138 - protein, 32 aa, Entamoeba invadens
DTTIFRPDILHYTLLTLLDSPLNKAGLLQIYI

SEQ ID NO: 2992139 - protein, 26 aa, Entamoeba invadens
DTTKLNKFISFLTQNVTLVVTKPICH

SEQ ID NO: 2992140 - protein, 27 aa, Entamoeba invadens
DTTKVVLKLLTLFPFENLDVSERTFLS

SEQ ID NO: 2992141 - protein, 25 aa, Entamoeba invadens
DTTNHFFYQIVPTTKVLVISSKKIP

SEQ ID NO: 2992142 - protein, 20 aa, Entamoeba invadens
DTTPFTLPKIYPMDVHKNDP

SEQ ID NO: 2992143 - protein, 24 aa, Entamoeba invadens
DTTPSFIMNILKQAWEKDKVQKEV

SEQ ID NO: 2992144 - protein, 25 aa, Entamoeba invadens
DTTVDPALFLRFEKSTDIDKSLERS

SEQ ID NO: 2992145 - protein, 20 aa, Entamoeba invadens
DTTVVRILKILLAKSTGVTV

SEQ ID NO: 2992146 - protein, 21 aa, Entamoeba invadens
DTTVYFTWRDSYPYNPNSVQA

SEQ ID NO: 2992147 - protein, 21 aa, Entamoeba invadens
DTTVYFTWRDTYPYNPNSVQA

SEQ ID NO: 2992148 - protein, 20 aa, Entamoeba invadens
DTVFRTYFRILKTNLDSPMI

SEQ ID NO: 2992149 - protein, 26 aa, Entamoeba invadens
DTVGKGYVRGLKFFGMKFTPKEGGCS

SEQ ID NO: 2992150 - protein, 20 aa, Entamoeba invadens
DTVILIMKKIYEVFSTNTEV

SEQ ID NO: 2992151 - protein, 25 aa, Entamoeba invadens
DTVKIIIIMATMLNSHYKTCDFITG

SEQ ID NO: 2992152 - protein, 18 aa, Entamoeba invadens
DTVLHSTYLPMYEQFQLK

SEQ ID NO: 2992153 - protein, 26 aa, Entamoeba invadens
DTVQYLPAFDAFGLDIYPINESVVFN

SEQ ID NO: 2992154 - protein, 20 aa, Entamoeba invadens
DTVSPLLIRSRSAALFSGNF

SEQ ID NO: 2992155 - protein, 27 aa, Entamoeba invadens
DTYAFSLVIYQIFTQRLIFTNCTTTEE

SEQ ID NO: 2992156 - protein, 28 aa, Entamoeba invadens
DTYFGVIGRIRYFIRTTLTRTSFSKTVK

SEQ ID NO: 2992157 - protein, 25 aa, Entamoeba invadens
DTYGYTILHYLALTNGLEEWAIKYK

SEQ ID NO: 2992158 - protein, 23 aa, Entamoeba invadens
DTYHFNPIRLNKHTFPFFSHIET

SEQ ID NO: 2992159 - protein, 24 aa, Entamoeba invadens
DVAFEVVGPCPFYSATPGCLSVFI

SEQ ID NO: 2992160 - protein, 22 aa, Entamoeba invadens
DVAGVLRMKNNYVFAICDGCGW

SEQ ID NO: 2992161 - protein, 25 aa, Entamoeba invadens
DVANKMSMFFAFSSPMMKVLTEAVN

SEQ ID NO: 2992162 - protein, 22 aa, Entamoeba invadens
DVAPPIQFLQKLFKKKPSFPKI

SEQ ID NO: 2992163 - protein, 23 aa, Entamoeba invadens
DVAQCVFVKKVKYWKIHSVEVSN

SEQ ID NO: 2992164 - protein, 29 aa, Entamoeba invadens
DVCARGISILPKTPALWLEAIELERKDSE

SEQ ID NO: 2992165 - protein, 29 aa, Entamoeba invadens
DVCEHQNFDFFNFNEIFLKRKSEREVDED

SEQ ID NO: 2992166 - protein, 30 aa, Entamoeba invadens
DVCLRLCETYLLFLLFGRAMNENTNLSCLI

SEQ ID NO: 2992167 - protein, 25 aa, Entamoeba invadens
DVCLSYGFFEPFFHLCEIVYKTKPD

SEQ ID NO: 2992168 - protein, 30 aa, Entamoeba invadens
DVCNCFSAYRLMIEYNMQFPKLVDISDQLK

SEQ ID NO: 2992169 - protein, 27 aa, Entamoeba invadens
DVCPHLTDDLLINILKDVLKKQNDQEV

SEQ ID NO: 2992170 - protein, 24 aa, Entamoeba invadens
DVCYIGFHAFLNCSLIRNVKINPN

SEQ ID NO: 2992171 - protein, 25 aa, Entamoeba invadens
DVCYSFLHESPWERLRLLREKIPNV

SEQ ID NO: 2992172 - protein, 28 aa, Entamoeba invadens
DVDERALMLYLTLFNRNDKMEQSERMKE

SEQ ID NO: 2992173 - protein, 24 aa, Entamoeba invadens
DVDFNQLLPEKFLTKMSKTEFRCY

SEQ ID NO: 2992174 - protein, 25 aa, Entamoeba invadens
DVDFRIFLDIFFEGVRSPCYLIYTT

SEQ ID NO: 2992175 - protein, 22 aa, Entamoeba invadens
DVDIKFRVKILLDASHGIKYLH

SEQ ID NO: 2992176 - protein, 20 aa, Entamoeba invadens
DVDIPKDYNKRVFPVVVCHL

SEQ ID NO: 2992177 - protein, 33 aa, Entamoeba invadens
DVDKFISLTILQHLFLYGYPFAVKLVVTMMEES

SEQ ID NO: 2992178 - protein, 23 aa, Entamoeba invadens
DVDLSKMTFVQRQRYLAQKRDKE

SEQ ID NO: 2992179 - protein, 21 aa, Entamoeba invadens
DVDMFQSCFSSLLSGLQVLYT

SEQ ID NO: 2992180 - protein, 23 aa, Entamoeba invadens
DVDPIKYHTIFPKGAKVVKYSNT

SEQ ID NO: 2992181 - protein, 24 aa, Entamoeba invadens
DVDPKRLFALRALQEKVKGAEYKM

SEQ ID NO: 2992182 - protein, 20 aa, Entamoeba invadens
DVDQKIVVGLWSCDVLILSL

SEQ ID NO: 2992183 - protein, 27 aa, Entamoeba invadens
DVDRLPVFFPILFNNKDDWKVFYRIGE

SEQ ID NO: 2992184 - protein, 21 aa, Entamoeba invadens
DVDYFFAFLNDTYSVAFRKQM

SEQ ID NO: 2992185 - protein, 26 aa, Entamoeba invadens
DVDYIEIIPTLITQYWKTSFNEKINL

SEQ ID NO: 2992186 - protein, 22 aa, Entamoeba invadens
DVEEIFVFRRSLARVRLISNSL

SEQ ID NO: 2992187 - protein, 27 aa, Entamoeba invadens
DVEEMAQALFIYWKSKELLRTNEYQYD

SEQ ID NO: 2992188 - protein, 25 aa, Entamoeba invadens
DVEKDYVFPTIKYSRKISFLNYQMY

SEQ ID NO: 2992189 - protein, 24 aa, Entamoeba invadens
DVEKKYIYILLDLCNMETLKEVSS

SEQ ID NO: 2992190 - protein, 17 aa, Entamoeba invadens
DVELRKNSERKEELGVI

SEQ ID NO: 2992191 - protein, 24 aa, Entamoeba invadens
DVEPLVTQLKVFLEKHDMNCSVKL

SEQ ID NO: 2992192 - protein, 24 aa, Entamoeba invadens
DVEPMFLQNFQNSVLHFIDFEFAN

SEQ ID NO: 2992193 - protein, 25 aa, Entamoeba invadens
DVEPTFLQNFQTSILHFIDFEFANS

SEQ ID NO: 2992194 - protein, 27 aa, Entamoeba invadens
DVESDFPFYKQFFYKNLKVHHYLSKEE

SEQ ID NO: 2992195 - protein, 25 aa, Entamoeba invadens
DVESDFPYYKTFFYENPNTRHYLSK

SEQ ID NO: 2992196 - protein, 30 aa, Entamoeba invadens
DVESRLRYILLVDALNFCFWPTANFEYDNL

SEQ ID NO: 2992197 - protein, 33 aa, Entamoeba invadens
DVETYTSVIDLLLILCLIICSMNNKKMCCDCES

SEQ ID NO: 2992198 - protein, 17 aa, Entamoeba invadens
DVFCWDIKNQNLKLLLH

SEQ ID NO: 2992199 - protein, 25 aa, Entamoeba invadens
DVFEKRILKYILTPMINSIRILHEK

SEQ ID NO: 2992200 - protein, 31 aa, Entamoeba invadens
DVFFELQQLQKIFFPDFFLPHKNISQSHISL

SEQ ID NO: 2992201 - protein, 26 aa, Entamoeba invadens
DVFFPTLVYVIIKGNIPYFASNIGFI

SEQ ID NO: 2992202 - protein, 19 aa, Entamoeba invadens
DVFGKFKENMWKFSQFTNL

SEQ ID NO: 2992203 - protein, 30 aa, Entamoeba invadens
DVFKCSRLAYCFDYFLASKPFKDLTGEKGS

SEQ ID NO: 2992204 - protein, 19 aa, Entamoeba invadens
DVFKGERGPLDYYWMVINL

SEQ ID NO: 2992205 - protein, 20 aa, Entamoeba invadens
DVFKKKVVIPFFQWKEIPND

SEQ ID NO: 2992206 - protein, 23 aa, Entamoeba invadens
DVFKLIHRIINIKQIQPIALADF

SEQ ID NO: 2992207 - protein, 17 aa, Entamoeba invadens
DVFLLNKNIFERFGKYI

SEQ ID NO: 2992208 - protein, 26 aa, Entamoeba invadens
DVFMSFFSFYIQIVYFTVKEKKDFRE

SEQ ID NO: 2992209 - protein, 18 aa, Entamoeba invadens
DVFMYAWRIKDMTEETKF

SEQ ID NO: 2992210 - protein, 19 aa, Entamoeba invadens
DVFPDEYIPTCFIDFGKIV

SEQ ID NO: 2992211 - protein, 17 aa, Entamoeba invadens
DVFQLIIKVMAVFKTEL

SEQ ID NO: 2992212 - protein, 17 aa, Entamoeba invadens
DVFVKWAEQHGINMVIS

SEQ ID NO: 2992213 - protein, 32 aa, Entamoeba invadens
DVFYQNCLITQIFPKSLLLAILSQAHTLLLNR

SEQ ID NO: 2992214 - protein, 31 aa, Entamoeba invadens
DVGCEVLSNGLYIKCYSKYFLNKEYPPKCES

SEQ ID NO: 2992215 - protein, 26 aa, Entamoeba invadens
DVGKTSLLLRYITQAYQEGVRSTIGV

SEQ ID NO: 2992216 - protein, 20 aa, Entamoeba invadens
DVGMFNFLAPVIPTSTGVFA

SEQ ID NO: 2992217 - protein, 27 aa, Entamoeba invadens
DVGVDKKHFLFISKKSGVFFTTLIKQK

SEQ ID NO: 2992218 - protein, 23 aa, Entamoeba invadens
DVHALMQIPSLPLGIRTLNRSMY

SEQ ID NO: 2992219 - protein, 21 aa, Entamoeba invadens
DVHFPFLPNLFQTLIQMYDLA

SEQ ID NO: 2992220 - protein, 21 aa, Entamoeba invadens
DVHLYINFLVRNAETHVKCLF

SEQ ID NO: 2992221 - protein, 23 aa, Entamoeba invadens
DVHQFLIGQFLRKKIFKNWGNDD

SEQ ID NO: 2992222 - protein, 17 aa, Entamoeba invadens
DVICEVKRLIGCQYSDP

SEQ ID NO: 2992223 - protein, 28 aa, Entamoeba invadens
DVIFFINRGLNILSLYQKVVLKNNVMLD

SEQ ID NO: 2992224 - protein, 21 aa, Entamoeba invadens
DVIFYTYQARLALILFTIINE

SEQ ID NO: 2992225 - protein, 33 aa, Entamoeba invadens
DVIISQRALREIYLENFRIAIEAKPFAAMTAYN

SEQ ID NO: 2992226 - protein, 25 aa, Entamoeba invadens
DVIKLLGFDLLIKKVVPISQDTLRT

SEQ ID NO: 2992227 - protein, 24 aa, Entamoeba invadens
DVIKPLNIQPLLTHKVKTLSGGEA

SEQ ID NO: 2992228 - protein, 20 aa, Entamoeba invadens
DVIKYKYLSFIRKPILEQNF

SEQ ID NO: 2992229 - protein, 20 aa, Entamoeba invadens
DVIMKSFISHFPQFIPYNLE

SEQ ID NO: 2992230 - protein, 24 aa, Entamoeba invadens
DVIQKCWCTIPTERIEIGEVVTLV

SEQ ID NO: 2992231 - protein, 19 aa, Entamoeba invadens
DVIVLYGRVGWKVMKPVIL

SEQ ID NO: 2992232 - protein, 22 aa, Entamoeba invadens
DVKEVFVMIGNYSNFVCGNIEN

SEQ ID NO: 2992233 - protein, 27 aa, Entamoeba invadens
DVKGVYWKTVSCGFIFVTYYDIRASRS

SEQ ID NO: 2992234 - protein, 21 aa, Entamoeba invadens
DVKILGFDPKYSHPKFMVFEV

SEQ ID NO: 2992235 - protein, 25 aa, Entamoeba invadens
DVKIPNTLLIIESKAFARCIRLKPI

SEQ ID NO: 2992236 - protein, 40 aa, Entamoeba invadens
DVKKIKSGLLILEMFWRNEMYILKFAPFCRFLSSLREIDL

SEQ ID NO: 2992237 - protein, 17 aa, Entamoeba invadens
DVKLILKKLFDSSAFIY

SEQ ID NO: 2992238 - protein, 25 aa, Entamoeba invadens
DVKNCPLFVFDIYLHGYTTKTVKEK

SEQ ID NO: 2992239 - protein, 22 aa, Entamoeba invadens
DVKNIMQFQGMGSPYLVVDFLD

SEQ ID NO: 2992240 - protein, 23 aa, Entamoeba invadens
DVKQECGFLIGFTAREGKGNTKN

SEQ ID NO: 2992241 - protein, 28 aa, Entamoeba invadens
DVKQGVHNLLIQYLLQGPKEIFNNLSEV

SEQ ID NO: 2992242 - protein, 23 aa, Entamoeba invadens
DVKRAIAFIKKKYVPVKKTAVIE

SEQ ID NO: 2992243 - protein, 23 aa, Entamoeba invadens
DVKSQIWYVFMSNAFEWNSDAEV

SEQ ID NO: 2992244 - protein, 24 aa, Entamoeba invadens
DVKTRVDALLTPNIEMDPFSTLLD

SEQ ID NO: 2992245 - protein, 22 aa, Entamoeba invadens
DVKYKAVFVWVDAALVLLDKRA

SEQ ID NO: 2992246 - protein, 24 aa, Entamoeba invadens
DVLANNIVLLPQTLTKLGISNAIN

SEQ ID NO: 2992247 - protein, 25 aa, Entamoeba invadens
DVLDRYHYNPISSLRLFKNVETQYL

SEQ ID NO: 2992248 - protein, 21 aa, Entamoeba invadens
DVLFGFRGQNMFGAKYKLVCT

SEQ ID NO: 2992249 - protein, 25 aa, Entamoeba invadens
DVLGFLYFVVIEKMDNWFYGKVKTC

SEQ ID NO: 2992250 - protein, 21 aa, Entamoeba invadens
DVLGLFLLKEASILLTTKSSI

SEQ ID NO: 2992251 - protein, 27 aa, Entamoeba invadens
DVLIKKLDWNFLIGNSKRRPKKMLEFF

SEQ ID NO: 2992252 - protein, 19 aa, Entamoeba invadens
DVLIYVVDVTLPTAFDSIE

SEQ ID NO: 2992253 - protein, 28 aa, Entamoeba invadens
DVLKYYQRLVFLYKSRKFRKGVNKSFYC

SEQ ID NO: 2992254 - protein, 20 aa, Entamoeba invadens
DVLLIRRGCLLLSDTFNVLN

SEQ ID NO: 2992255 - protein, 20 aa, Entamoeba invadens
DVLLKMYATVFYQLEKYIAT

SEQ ID NO: 2992256 - protein, 17 aa, Entamoeba invadens
DVLLKRCVRSPATVGYW

SEQ ID NO: 2992257 - protein, 27 aa, Entamoeba invadens
DVLMGRVYPLKLGYIGVVNRSQQDINN

SEQ ID NO: 2992258 - protein, 25 aa, Entamoeba invadens
DVLRIDFFRILKSKLITKYFGTVPR

SEQ ID NO: 2992259 - protein, 25 aa, Entamoeba invadens
DVLSAIFAFWYKDVAQQIMLMQYDL

SEQ ID NO: 2992260 - protein, 22 aa, Entamoeba invadens
DVLSMFHFNPITVYDFQLFPHM

SEQ ID NO: 2992261 - protein, 26 aa, Entamoeba invadens
DVLTPEMFLKLFRQDIAVASLFRHFI

SEQ ID NO: 2992262 - protein, 26 aa, Entamoeba invadens
DVLTRIFPILMMFRRELTYPAMTMTS

SEQ ID NO: 2992263 - protein, 34 aa, Entamoeba invadens
DVLVDGPYIEAKRNLELLFRGSDNQRILRLKDGK

SEQ ID NO: 2992264 - protein, 23 aa, Entamoeba invadens
DVLVGFLRRKILSKLKKGLYYSF

SEQ ID NO: 2992265 - protein, 19 aa, Entamoeba invadens
DVLVLFDDQLSTKGVMLCK

SEQ ID NO: 2992266 - protein, 19 aa, Entamoeba invadens
DVMDGHFVPNLTLGAPIVK

SEQ ID NO: 2992267 - protein, 25 aa, Entamoeba invadens
DVMEGIFTFIFDEIPKRFPDELKVI

SEQ ID NO: 2992268 - protein, 24 aa, Entamoeba invadens
DVMEKLVRSILIKINVEDLEEDLV

SEQ ID NO: 2992269 - protein, 21 aa, Entamoeba invadens
DVMLSKIHDFLFVVIRDLQGE

SEQ ID NO: 2992270 - protein, 21 aa, Entamoeba invadens
DVMNFANLALDLQLDEQLNAA

SEQ ID NO: 2992271 - protein, 33 aa, Entamoeba invadens
DVMPQSRLWFPDMPSEFLLPADLPVKPVEEDNI

SEQ ID NO: 2992272 - protein, 17 aa, Entamoeba invadens
DVMTTLLNQMASKFSDL

SEQ ID NO: 2992273 - protein, 19 aa, Entamoeba invadens
DVMVLVYITETLHSVFPIE

SEQ ID NO: 2992274 - protein, 27 aa, Entamoeba invadens
DVNKQWENPLLNLKVQKFLVAESVLAF

SEQ ID NO: 2992275 - protein, 20 aa, Entamoeba invadens
DVNNNILPAFLSEEIECYSF

SEQ ID NO: 2992276 - protein, 25 aa, Entamoeba invadens
DVNVKPYCFVPYKNSILYHSGVHVK

SEQ ID NO: 2992277 - protein, 23 aa, Entamoeba invadens
DVPEQLFRKKSVLNWFDQEGKEQ

SEQ ID NO: 2992278 - protein, 22 aa, Entamoeba invadens
DVPFQYLRFFLNDDQLLDKIKT

SEQ ID NO: 2992279 - protein, 21 aa, Entamoeba invadens
DVPITLLFEEATTRGFQVLSY

SEQ ID NO: 2992280 - protein, 19 aa, Entamoeba invadens
DVPKGIFFSMPVVCCGGEY

SEQ ID NO: 2992281 - protein, 31 aa, Entamoeba invadens
DVPNCLFFIDKYSQVPWILAPVLKTSKRMFS

SEQ ID NO: 2992282 - protein, 24 aa, Entamoeba invadens
DVPNCLFFIDKYSQVPWIVSPIVK

SEQ ID NO: 2992283 - protein, 24 aa, Entamoeba invadens
DVPSGVLFCAKYAFKHCSALQQMC

SEQ ID NO: 2992284 - protein, 17 aa, Entamoeba invadens
DVQLLYNSIVTLFECAK

SEQ ID NO: 2992285 - protein, 28 aa, Entamoeba invadens
DVQMRESLLMVVPPNQKVEFFKSQQIDK

SEQ ID NO: 2992286 - protein, 23 aa, Entamoeba invadens
DVQPFTLLYFHDCNEDLGMISSS

SEQ ID NO: 2992287 - protein, 20 aa, Entamoeba invadens
DVQQTFRLVLPTKSEKEKGR

SEQ ID NO: 2992288 - protein, 17 aa, Entamoeba invadens
DVQQWDVFLSKIRSVSP

SEQ ID NO: 2992289 - protein, 22 aa, Entamoeba invadens
DVQSIKYTDFLDFFYDFDNEVN

SEQ ID NO: 2992290 - protein, 32 aa, Entamoeba invadens
DVQTKIREAMKFILKYYNIEGVIIDGFTDEQI

SEQ ID NO: 2992291 - protein, 28 aa, Entamoeba invadens
DVQTVFNLARWIYIHGIEVEGLFRVNGD

SEQ ID NO: 2992292 - protein, 19 aa, Entamoeba invadens
DVQYLKGEYYPNVLTISKT

SEQ ID NO: 2992293 - protein, 23 aa, Entamoeba invadens
DVRAAIHLLIRLGYKDVVSVLKE

SEQ ID NO: 2992294 - protein, 17 aa, Entamoeba invadens
DVRAIFLKQGELETANK

SEQ ID NO: 2992295 - protein, 24 aa, Entamoeba invadens
DVRITPPINLIKLDDMRGAEEFFL

SEQ ID NO: 2992296 - protein, 26 aa, Entamoeba invadens
DVRPNELLYMYFPVVQRRSDAFNLFT

SEQ ID NO: 2992297 - protein, 26 aa, Entamoeba invadens
DVSCDLLYDMPDLKAVPYVAQKPITF

SEQ ID NO: 2992298 - protein, 22 aa, Entamoeba invadens
DVSCLIRFESYDKLFPKLDTAK

SEQ ID NO: 2992299 - protein, 23 aa, Entamoeba invadens
DVSCNPLVEFPVCLSRCVSLKTL

SEQ ID NO: 2992300 - protein, 23 aa, Entamoeba invadens
DVSCPWCYVGRRRLINAITQLST

SEQ ID NO: 2992301 - protein, 19 aa, Entamoeba invadens
DVSFNFIKALPVDIENLKN

SEQ ID NO: 2992302 - protein, 25 aa, Entamoeba invadens
DVSGNQPLYYALQSKCEPLVNFLLN

SEQ ID NO: 2992303 - protein, 31 aa, Entamoeba invadens
DVSGVLLNEPLFVISPKKVYIHKIYVAYKER

SEQ ID NO: 2992304 - protein, 32 aa, Entamoeba invadens
DVSGVLLNEPLFVISPKKVYIHKIYVAYKERK

SEQ ID NO: 2992305 - protein, 26 aa, Entamoeba invadens
DVSHDEVFALMKWPKLERNVGKGYFN

SEQ ID NO: 2992306 - protein, 25 aa, Entamoeba invadens
DVSLFVRLSRLCFASFLSTLKCEML

SEQ ID NO: 2992307 - protein, 18 aa, Entamoeba invadens
DVSLLAFCYKNKMMHDNT

SEQ ID NO: 2992308 - protein, 31 aa, Entamoeba invadens
DVSPAFIQFFPQVLAFLFFQIPEFREDLLEL

SEQ ID NO: 2992309 - protein, 38 aa, Entamoeba invadens
DVSPLSFGALFYFLEKTMSIVLKLLYFKSDVVYKWLKR

SEQ ID NO: 2992310 - protein, 25 aa, Entamoeba invadens
DVSQRFNIALIIQNILKVPKTESTR

SEQ ID NO: 2992311 - protein, 24 aa, Entamoeba invadens
DVSRPNVIILALVGETLPDAHIQH

SEQ ID NO: 2992312 - protein, 38 aa, Entamoeba invadens
DVSSYLIMPVQRLPRYVLLLNELLKRTWETHPDYALLK

SEQ ID NO: 2992313 - protein, 34 aa, Entamoeba invadens
DVSYITAYYYNDAKGMLLMFDLSNLKSLDNLQGW

SEQ ID NO: 2992314 - protein, 33 aa, Entamoeba invadens
DVTALVVIATISPYLRIFHEKDQTLDMMKTIKS

SEQ ID NO: 2992315 - protein, 17 aa, Entamoeba invadens
DVTFACTQAMNGCLLEK

SEQ ID NO: 2992316 - protein, 19 aa, Entamoeba invadens
DVTIPSSLSLLPYNCFEKC

SEQ ID NO: 2992317 - protein, 25 aa, Entamoeba invadens
DVTKDLLNLISMNPIPVSQVVDIFG

SEQ ID NO: 2992318 - protein, 24 aa, Entamoeba invadens
DVTKIILDDLIVLSTQKFSSNVIE

SEQ ID NO: 2992319 - protein, 27 aa, Entamoeba invadens
DVTKLNFYRVIVWCKVTYSFYESRQPT

SEQ ID NO: 2992320 - protein, 17 aa, Entamoeba invadens
DVTKRSLLKRRYEQSIL

SEQ ID NO: 2992321 - protein, 24 aa, Entamoeba invadens
DVTKTFSIAKIMIILFSVDSQESL

SEQ ID NO: 2992322 - protein, 30 aa, Entamoeba invadens
DVTLSDKVIKITGALRSPFTLTVESPSYTG

SEQ ID NO: 2992323 - protein, 24 aa, Entamoeba invadens
DVTPQMIFTVAYLTLDTQGGIPKK

SEQ ID NO: 2992324 - protein, 23 aa, Entamoeba invadens
DVTQDFAYGKKVKRFYTSAKTGM

SEQ ID NO: 2992325 - protein, 23 aa, Entamoeba invadens
DVTSKIMWFVNKKSKVTYNVMTT

SEQ ID NO: 2992326 - protein, 26 aa, Entamoeba invadens
DVTVPLALMKKPIIIQAKGIRLQAKE

SEQ ID NO: 2992327 - protein, 22 aa, Entamoeba invadens
DVTVWRGGILTVIGLYNTQKIV

SEQ ID NO: 2992328 - protein, 19 aa, Entamoeba invadens
DVTYFFAPYVPIQSMLQPN

SEQ ID NO: 2992329 - protein, 31 aa, Entamoeba invadens
DVTYMNSDIPFFCLFPLFITQNSFILRQDDS

SEQ ID NO: 2992330 - protein, 21 aa, Entamoeba invadens
DVVAGVLKKFLLQMPNRIFGY

SEQ ID NO: 2992331 - protein, 25 aa, Entamoeba invadens
DVVEMLFQMFWSLEKAQNKFNFCHH

SEQ ID NO: 2992332 - protein, 25 aa, Entamoeba invadens
DVVKFFTEPLPIYPKSKLFCTESDL

SEQ ID NO: 2992333 - protein, 18 aa, Entamoeba invadens
DVVKVSQPKLPKQKTPTA

SEQ ID NO: 2992334 - protein, 20 aa, Entamoeba invadens
DVVLFSIDPNWIDSKGILII

SEQ ID NO: 2992335 - protein, 20 aa, Entamoeba invadens
DVVLQLIAFTKSAILDKVNV

SEQ ID NO: 2992336 - protein, 24 aa, Entamoeba invadens
DVVLYYLENWNYEKGIYIIPDEVT

SEQ ID NO: 2992337 - protein, 25 aa, Entamoeba invadens
DVVNNFKILSLYITSDPNKKIFSKE

SEQ ID NO: 2992338 - protein, 28 aa, Entamoeba invadens
DVVSDVLFFLMILFDLISQKKAIKLVKE

SEQ ID NO: 2992339 - protein, 24 aa, Entamoeba invadens
DVVVPWTHLYSKPIILRLGEVFVE

SEQ ID NO: 2992340 - protein, 26 aa, Entamoeba invadens
DVVVYFYHKRFLISDVFLGCVEFDLT

SEQ ID NO: 2992341 - protein, 19 aa, Entamoeba invadens
DVWLNINTFAIVYEPSIIS

SEQ ID NO: 2992342 - protein, 19 aa, Entamoeba invadens
DVWRIVVLDPRGSIPGWVV

SEQ ID NO: 2992343 - protein, 27 aa, Entamoeba invadens
DVWSAGVILFVMVCGYPPFSDGDDGGN

SEQ ID NO: 2992344 - protein, 24 aa, Entamoeba invadens
DVWSLGCCLYWMATGHSIYPKDDV

SEQ ID NO: 2992345 - protein, 28 aa, Entamoeba invadens
DVYGYVTAFFILFRKEVCYYYGCPTCKI

SEQ ID NO: 2992346 - protein, 17 aa, Entamoeba invadens
DVYIVSYLSQGTCAWVL

SEQ ID NO: 2992347 - protein, 17 aa, Entamoeba invadens
DVYKGIFSYLKEKGIST

SEQ ID NO: 2992348 - protein, 17 aa, Entamoeba invadens
DVYMIFVRSELSKGVVN

SEQ ID NO: 2992349 - protein, 24 aa, Entamoeba invadens
DVYNPLTKIMFLTNIRNVIEKFAR

SEQ ID NO: 2992350 - protein, 20 aa, Entamoeba invadens
DVYPQTIKFSPNGRFVAIVG

SEQ ID NO: 2992351 - protein, 26 aa, Entamoeba invadens
DVYRILDIELSEHIPILLAGNKSDLE

SEQ ID NO: 2992352 - protein, 25 aa, Entamoeba invadens
DVYTNPYMFYAVKTPLHIIKYSVVP

SEQ ID NO: 2992353 - protein, 17 aa, Entamoeba invadens
DVYVQVFLYIYIESFVN

SEQ ID NO: 2992354 - protein, 33 aa, Entamoeba invadens
DWDVTLCRIFINRLTQTQLLLLKTIVSVIKDFS

SEQ ID NO: 2992355 - protein, 21 aa, Entamoeba invadens
DWFGMDYTSSFFKIFSEFVRD

SEQ ID NO: 2992356 - protein, 18 aa, Entamoeba invadens
DWFQIIIAQFTAAGITNP

SEQ ID NO: 2992357 - protein, 18 aa, Entamoeba invadens
DWGNFWNCPNVEKIAIFS

SEQ ID NO: 2992358 - protein, 20 aa, Entamoeba invadens
DWILLHQKIEILLLGEEAPY

SEQ ID NO: 2992359 - protein, 25 aa, Entamoeba invadens
DWKTLPKLKRIKLCLKRSKELKIPK

SEQ ID NO: 2992360 - protein, 19 aa, Entamoeba invadens
DWLSAIRMYSAALGHLEAM

SEQ ID NO: 2992361 - protein, 23 aa, Entamoeba invadens
DWLTERITLAYLEYFTFVATEES

SEQ ID NO: 2992362 - protein, 25 aa, Entamoeba invadens
DWMSTLPVLMKVYGTYKYPLACAVS

SEQ ID NO: 2992363 - protein, 21 aa, Entamoeba invadens
DWNGTFFFKNGNSLGISVHCP

SEQ ID NO: 2992364 - protein, 20 aa, Entamoeba invadens
DWTEIFFKCLDLSVFKRPED

SEQ ID NO: 2992365 - protein, 31 aa, Entamoeba invadens
DYAAEYSIASLPTFVFFQNQNVVKKATGSSE

SEQ ID NO: 2992366 - protein, 27 aa, Entamoeba invadens
DYAGNIILWDYFVNVPLITFTNTHNSP

SEQ ID NO: 2992367 - protein, 21 aa, Entamoeba invadens
DYAGQFPLPRLTVGAFCKCLQ

SEQ ID NO: 2992368 - protein, 17 aa, Entamoeba invadens
DYAYHFIPKFSKKVGEF

SEQ ID NO: 2992369 - protein, 27 aa, Entamoeba invadens
DYCEKVYVDVLLKSPAFKAGDYKKALI

SEQ ID NO: 2992370 - protein, 20 aa, Entamoeba invadens
DYCFDNCISLSYLEVPYLTS

SEQ ID NO: 2992371 - protein, 36 aa, Entamoeba invadens
DYCFFQCIGLSDYTWRLLKPAPLPHPPPGNKDYLNV

SEQ ID NO: 2992372 - protein, 33 aa, Entamoeba invadens
DYCVKNDIIDGMLIAKWKKPGFGHLCCLKCLRP

SEQ ID NO: 2992373 - protein, 18 aa, Entamoeba invadens
DYDFSKMNTLTYFDVSFN

SEQ ID NO: 2992374 - protein, 23 aa, Entamoeba invadens
DYDITRSLPLYLSIYVFGESNNE

SEQ ID NO: 2992375 - protein, 21 aa, Entamoeba invadens
DYDNFHNIFFKPSRLILIQWY

SEQ ID NO: 2992376 - protein, 26 aa, Entamoeba invadens
DYDRLRPLSYPMTDVFLICFSVISKV

SEQ ID NO: 2992377 - protein, 29 aa, Entamoeba invadens
DYDSLFPLLEVILSWTYPSFAKKVGYKYI

SEQ ID NO: 2992378 - protein, 19 aa, Entamoeba invadens
DYDTQLEMPLLSSESIFTM

SEQ ID NO: 2992379 - protein, 28 aa, Entamoeba invadens
DYEGTLLMILRSKILLKKIIEQKMYQER

SEQ ID NO: 2992380 - protein, 22 aa, Entamoeba invadens
DYENLFFLYPTEICLGKERKKS

SEQ ID NO: 2992381 - protein, 34 aa, Entamoeba invadens
DYEQLRPLSYPNTDLFLLCFSVISRTSFNNITAK

SEQ ID NO: 2992382 - protein, 35 aa, Entamoeba invadens
DYEQLRPLSYPNTDLFLLCFSVISRTSYKNVVSKW

SEQ ID NO: 2992383 - protein, 22 aa, Entamoeba invadens
DYERLVDYLISNKYKELHLVAR

SEQ ID NO: 2992384 - protein, 20 aa, Entamoeba invadens
DYESGQFYGLCSKCGDGYGL

SEQ ID NO: 2992385 - protein, 17 aa, Entamoeba invadens
DYETLEKMIFEFVNSSQ

SEQ ID NO: 2992386 - protein, 19 aa, Entamoeba invadens
DYEVYTPFNLPPKNTYLRL

SEQ ID NO: 2992387 - protein, 27 aa, Entamoeba invadens
DYFALGCMMFEFVVGYPPFNAPTPDAI

SEQ ID NO: 2992388 - protein, 22 aa, Entamoeba invadens
DYFAYVCDPLYKDFTTFFKKFP

SEQ ID NO: 2992389 - protein, 26 aa, Entamoeba invadens
DYFETFAANILLYTHLCVLYINGINS

SEQ ID NO: 2992390 - protein, 34 aa, Entamoeba invadens
DYFGGIIFENNVKKYFKVWHDELRVFDESGKTET

SEQ ID NO: 2992391 - protein, 27 aa, Entamoeba invadens
DYFGVLNMFKSFFKKKFFQVVVWFTVD

SEQ ID NO: 2992392 - protein, 20 aa, Entamoeba invadens
DYFVQLFAILSKISQKRNNS

SEQ ID NO: 2992393 - protein, 19 aa, Entamoeba invadens
DYGLFDLIRQRSAGIFEIF

SEQ ID NO: 2992394 - protein, 20 aa, Entamoeba invadens
DYIKEFLFKIGLVVTDGYGT

SEQ ID NO: 2992395 - protein, 17 aa, Entamoeba invadens
DYINMVFVCKKFEEIPA

SEQ ID NO: 2992396 - protein, 23 aa, Entamoeba invadens
DYIRFGFIIPKHIHRMGDACFYS

SEQ ID NO: 2992397 - protein, 26 aa, Entamoeba invadens
DYKEKKLYIYLPTTVSKVWISQSTSL

SEQ ID NO: 2992398 - protein, 25 aa, Entamoeba invadens
DYKFDYLVSPLMKPADFDAKPMVLF

SEQ ID NO: 2992399 - protein, 26 aa, Entamoeba invadens
DYKNHLFKIYAFIPTNLQLKQQKYLA

SEQ ID NO: 2992400 - protein, 17 aa, Entamoeba invadens
DYKYIPIKEDGNDFFYA

SEQ ID NO: 2992401 - protein, 20 aa, Entamoeba invadens
DYKYLMDCRYWSSKMFATYL

SEQ ID NO: 2992402 - protein, 18 aa, Entamoeba invadens
DYLMNLVMKIQAANLHQI

SEQ ID NO: 2992403 - protein, 21 aa, Entamoeba invadens
DYLRQLPEPLIPYNVYDEFIA

SEQ ID NO: 2992404 - protein, 23 aa, Entamoeba invadens
DYLSEVNYLWYLQEWTSKEVMEI

SEQ ID NO: 2992405 - protein, 24 aa, Entamoeba invadens
DYMAKFFCNVPMTICPFVVDTFTS

SEQ ID NO: 2992406 - protein, 22 aa, Entamoeba invadens
DYNAAFLIYSALAYSFDEFADD

SEQ ID NO: 2992407 - protein, 22 aa, Entamoeba invadens
DYNFVGMHFLTFLSLSNCVMLS

SEQ ID NO: 2992408 - protein, 21 aa, Entamoeba invadens
DYNKGFVLPIAIKQGTYVAVS

SEQ ID NO: 2992409 - protein, 24 aa, Entamoeba invadens
DYNKRVFPVVVCHLSQIGNDVNLP

SEQ ID NO: 2992410 - protein, 24 aa, Entamoeba invadens
DYNNVIEIIACKQQYTYDVKIKKM

SEQ ID NO: 2992411 - protein, 26 aa, Entamoeba invadens
DYNSFIALFTIFQSTLERLYVARKGD

SEQ ID NO: 2992412 - protein, 17 aa, Entamoeba invadens
DYPLISVFHANGSFFCS

SEQ ID NO: 2992413 - protein, 19 aa, Entamoeba invadens
DYPRLRPLSYPNTTCFVLC

SEQ ID NO: 2992414 - protein, 34 aa, Entamoeba invadens
DYSEFKRLTLLLTKLPRKRLRDVSSRLEYYKAVE

SEQ ID NO: 2992415 - protein, 20 aa, Entamoeba invadens
DYSFVRPLSIDFLRRFDRAA

SEQ ID NO: 2992416 - protein, 25 aa, Entamoeba invadens
DYSKHPLTEYVFIVIKMDLDNMNEN

SEQ ID NO: 2992417 - protein, 19 aa, Entamoeba invadens
DYSLPLTPHEVRLQQMTRS

SEQ ID NO: 2992418 - protein, 28 aa, Entamoeba invadens
DYSLYFLAFEIENLIRILFVLEKIKATE

SEQ ID NO: 2992419 - protein, 25 aa, Entamoeba invadens
DYSNLYFPSLILVDYLNVVNADDWE

SEQ ID NO: 2992420 - protein, 21 aa, Entamoeba invadens
DYTCKKLTWTPNHIWKGAVTL

SEQ ID NO: 2992421 - protein, 25 aa, Entamoeba invadens
DYTEKKLYIYLPTTVDKVWISQSTS

SEQ ID NO: 2992422 - protein, 34 aa, Entamoeba invadens
DYTNKLAFALRFYSPTIVLIPKFINHTLEAITPA

SEQ ID NO: 2992423 - protein, 25 aa, Entamoeba invadens
DYTPKLTETLLPPKDDERLTVIFDL

SEQ ID NO: 2992424 - protein, 18 aa, Entamoeba invadens
DYTVFFDSIIFSSLSQKE

SEQ ID NO: 2992425 - protein, 23 aa, Entamoeba invadens
DYVDNPLLLRSGIKDPKLAECLM

SEQ ID NO: 2992426 - protein, 29 aa, Entamoeba invadens
DYVDQSFEYLILLLHIIGSVWDSSNDLSF

SEQ ID NO: 2992427 - protein, 37 aa, Entamoeba invadens
DYVDRGHYGLECLLLLAALKLRFPTKVSLLRGNHECS

SEQ ID NO: 2992428 - protein, 31 aa, Entamoeba invadens
DYVFVKVDDTLYPHLLRFGQGLLARNGILGC

SEQ ID NO: 2992429 - protein, 18 aa, Entamoeba invadens
DYVIHQSSLLLFKTIASD

SEQ ID NO: 2992430 - protein, 20 aa, Entamoeba invadens
DYVIYFPVKDISRELQTIFP

SEQ ID NO: 2992431 - protein, 40 aa, Entamoeba invadens
DYVKTYDRNTLVAAYKLLNMSYQILLEMQTTGPKSVAELK

SEQ ID NO: 2992432 - protein, 18 aa, Entamoeba invadens
DYVLNNNLLFRAVTDRDF

SEQ ID NO: 2992433 - protein, 25 aa, Entamoeba invadens
DYVYNAPLNFFPSSDFLAARFMIGW

SEQ ID NO: 2992434 - protein, 23 aa, Entamoeba invadens
DYYDDYFGVLKLLRDRRYISEIL

SEQ ID NO: 2992435 - protein, 20 aa, Entamoeba invadens
DYYNPFPFVDVRSSDFQISS

SEQ ID NO: 2992436 - protein, 17 aa, Entamoeba invadens
DYYTPFIRDNSLTFQTK

SEQ ID NO: 2992437 - protein, 21 aa, Entamoeba invadens
EAAALYAIAARAGKKALCICS

SEQ ID NO: 2992438 - protein, 23 aa, Entamoeba invadens
EAADEIFRLVQNLFARIYDFDGV

SEQ ID NO: 2992439 - protein, 38 aa, Entamoeba invadens
EAAIRGIQKEGLMWGAARLEPVVHTIKMLVIMMNVDDE

SEQ ID NO: 2992440 - protein, 21 aa, Entamoeba invadens
EAAITILRIDDMIKLNPEPQP

SEQ ID NO: 2992441 - protein, 33 aa, Entamoeba invadens
EAAKVQAINLEEFISVLKGGVDLFSDVEMELLG

SEQ ID NO: 2992442 - protein, 27 aa, Entamoeba invadens
EAALAALEHHLGLLGLQAHGLVAGHGL

SEQ ID NO: 2992443 - protein, 17 aa, Entamoeba invadens
EAALCETHMIFFISRFV

SEQ ID NO: 2992444 - protein, 25 aa, Entamoeba invadens
EACEFEILLVPNYTTKIDSKMVVIA

SEQ ID NO: 2992445 - protein, 24 aa, Entamoeba invadens
EACEFEVFLTPFCTMNLCDEIMII

SEQ ID NO: 2992446 - protein, 24 aa, Entamoeba invadens
EACKDYRFRRMKPVEFDNTTISVS

SEQ ID NO: 2992447 - protein, 24 aa, Entamoeba invadens
EACNIFYGTIIKSLSHYPYGLRYL

SEQ ID NO: 2992448 - protein, 23 aa, Entamoeba invadens
EACSGLQGFFYYNSVGGGTGSGF

SEQ ID NO: 2992449 - protein, 24 aa, Entamoeba invadens
EACTKLTQLTLPNTLKALPSCFLK

SEQ ID NO: 2992450 - protein, 23 aa, Entamoeba invadens
EADEEVYRRSLNAPPLAPSATPS

SEQ ID NO: 2992451 - protein, 23 aa, Entamoeba invadens
EADFERLDFSKCNKLLFLKTKNY

SEQ ID NO: 2992452 - protein, 27 aa, Entamoeba invadens
EADGTRFLYRLCEDVYIVVITTLSSNV

SEQ ID NO: 2992453 - protein, 25 aa, Entamoeba invadens
EADIFAKIIQLYAFNNVILTSAKRC

SEQ ID NO: 2992454 - protein, 23 aa, Entamoeba invadens
EADIFEYSLWIVKEPKFACQFKL

SEQ ID NO: 2992455 - protein, 17 aa, Entamoeba invadens
EADKRFLSWAQKNTRKC

SEQ ID NO: 2992456 - protein, 26 aa, Entamoeba invadens
EADLKLFRTFWFTCVVVKYVKEGEHP

SEQ ID NO: 2992457 - protein, 31 aa, Entamoeba invadens
EADTQLFPSQFYLLSLFGFISDQLLVRTIDA

SEQ ID NO: 2992458 - protein, 35 aa, Entamoeba invadens
EAEASTQAMLKFIYHRLFVFIVEQVNRVMRKDGDT

SEQ ID NO: 2992459 - protein, 17 aa, Entamoeba invadens
EAEDIAAALVYGKKFIT

SEQ ID NO: 2992460 - protein, 40 aa, Entamoeba invadens
EAEHVTFVYLNLFIQQIYSWLLDLLHICSVRVFPSNTPSY

SEQ ID NO: 2992461 - protein, 26 aa, Entamoeba invadens
EAEIWEKYRLFMNVLGREEFEKYVRT

SEQ ID NO: 2992462 - protein, 25 aa, Entamoeba invadens
EAEKYVKALFTLASKLSPCVIFVDE

SEQ ID NO: 2992463 - protein, 27 aa, Entamoeba invadens
EAEQQAVLMWILLQGDVTSFTVQCPRK

SEQ ID NO: 2992464 - protein, 20 aa, Entamoeba invadens
EAEQSRRATPIIFKSKPESN

SEQ ID NO: 2992465 - protein, 28 aa, Entamoeba invadens
EAERKRRLEKILLYFLSIEETFDDDVKE

SEQ ID NO: 2992466 - protein, 34 aa, Entamoeba invadens
EAETFGCMFMLIDQMRMWFLPSFDNQKNGIKDSM

SEQ ID NO: 2992467 - protein, 29 aa, Entamoeba invadens
EAETKTPAPFKIITRNRIGQPLKKGGQKF

SEQ ID NO: 2992468 - protein, 40 aa, Entamoeba invadens
EAEYLKTIKFIPQRPFRTPRELQIWIWKEIFQETKRFNVD

SEQ ID NO: 2992469 - protein, 24 aa, Entamoeba invadens
EAFDYVITCFFIDTAHNIIEYFRV

SEQ ID NO: 2992470 - protein, 19 aa, Entamoeba invadens
EAFIVYRRTVLEMPASSDE

SEQ ID NO: 2992471 - protein, 18 aa, Entamoeba invadens
EAFQMVPRVLAENSGLDA

SEQ ID NO: 2992472 - protein, 27 aa, Entamoeba invadens
EAFSKCYYLTQLVFSKNLKEIKKFAFS

SEQ ID NO: 2992473 - protein, 17 aa, Entamoeba invadens
EAFSKSEFKYPWKIADF

SEQ ID NO: 2992474 - protein, 20 aa, Entamoeba invadens
EAFSRNYYMYLTAALDEINT

SEQ ID NO: 2992475 - protein, 27 aa, Entamoeba invadens
EAFVKTYLATFLLLQPVDFAEVLVHLF

SEQ ID NO: 2992476 - protein, 19 aa, Entamoeba invadens
EAFWDETLTLSVHPTLHCS

SEQ ID NO: 2992477 - protein, 17 aa, Entamoeba invadens
EAFWKFMNLISKEEEVK

SEQ ID NO: 2992478 - protein, 26 aa, Entamoeba invadens
EAGKFFRTRELLLRDGFAFISKQEII

SEQ ID NO: 2992479 - protein, 25 aa, Entamoeba invadens
EAGKLLPELILAINSLLQDLNHPNE

SEQ ID NO: 2992480 - protein, 24 aa, Entamoeba invadens
EAGKRYPVITLPEKRKSNGSLRAL

SEQ ID NO: 2992481 - protein, 21 aa, Entamoeba invadens
EAHHLLMDLVGLDGILFDSYY

SEQ ID NO: 2992482 - protein, 21 aa, Entamoeba invadens
EAIAWNVLPPDVFMKLFRQDI

SEQ ID NO: 2992483 - protein, 24 aa, Entamoeba invadens
EAIEKLRVFKIPLPPPTECPASAC

SEQ ID NO: 2992484 - protein, 24 aa, Entamoeba invadens
EAIELLDFRYPDPQIRAFALRCID

SEQ ID NO: 2992485 - protein, 17 aa, Entamoeba invadens
EAIFLNMNFEKLELGIV

SEQ ID NO: 2992486 - protein, 24 aa, Entamoeba invadens
EAIHWVDVFYKENTDHFLYIVNML

SEQ ID NO: 2992487 - protein, 25 aa, Entamoeba invadens
EAIIKKIFKFFPRLEVLQVDPETAK

SEQ ID NO: 2992488 - protein, 18 aa, Entamoeba invadens
EAILYDEIRNKDGYLLVY

SEQ ID NO: 2992489 - protein, 28 aa, Entamoeba invadens
EAIPYLSEAMGIPLINYQFQSNSSICIE

SEQ ID NO: 2992490 - protein, 19 aa, Entamoeba invadens
EAIRLVKTAILQAATDPLT

SEQ ID NO: 2992491 - protein, 17 aa, Entamoeba invadens
EAIYDELGIIREPGKIF

SEQ ID NO: 2992492 - protein, 22 aa, Entamoeba invadens
EAKALPWYNKLIGGMDYQCVKT

SEQ ID NO: 2992493 - protein, 23 aa, Entamoeba invadens
EAKELLTEVGINKYALEHDDLVT

SEQ ID NO: 2992494 - protein, 25 aa, Entamoeba invadens
EAKERLGIVSYGRKIKETLRKESQA

SEQ ID NO: 2992495 - protein, 27 aa, Entamoeba invadens
EAKKFHLEYTLRILPHLQNTGGFYTAV

SEQ ID NO: 2992496 - protein, 28 aa, Entamoeba invadens
EAKKFHLEYTLRILPHLQNTGGFYTAVF

SEQ ID NO: 2992497 - protein, 31 aa, Entamoeba invadens
EAKLAKNDIVFLKGWIPVKINKFYNPMTDLT

SEQ ID NO: 2992498 - protein, 17 aa, Entamoeba invadens
EAKLMHLMLKQSVPTMT

SEQ ID NO: 2992499 - protein, 30 aa, Entamoeba invadens
EAKMGSLAYTPLFISILKLENDVILRNYSY

SEQ ID NO: 2992500 - protein, 20 aa, Entamoeba invadens
EAKMMFGERFHRVDPVLPGQ

SEQ ID NO: 2992501 - protein, 32 aa, Entamoeba invadens
EAKNKRKLRLRSRSIHPLIDTVDEVSYTTWKR

SEQ ID NO: 2992502 - protein, 24 aa, Entamoeba invadens
EAKSLINWFKVRGIGNLIKEIMVK

SEQ ID NO: 2992503 - protein, 23 aa, Entamoeba invadens
EAKSPFGFSFGNFQSKLDSRLNG

SEQ ID NO: 2992504 - protein, 25 aa, Entamoeba invadens
EAKVMSVLRFEVAKARCAICEMVPS

SEQ ID NO: 2992505 - protein, 17 aa, Entamoeba invadens
EALFKPGCALKVREGKL

SEQ ID NO: 2992506 - protein, 25 aa, Entamoeba invadens
EALGNFIVVLLRVYSRKIAMECMDI

SEQ ID NO: 2992507 - protein, 22 aa, Entamoeba invadens
EALLTLERPRTRMREKRNCEKI

SEQ ID NO: 2992508 - protein, 22 aa, Entamoeba invadens
EALNCELCHIDFTFFVRRHHCR

SEQ ID NO: 2992509 - protein, 18 aa, Entamoeba invadens
EALQLFSKTIYDSSIIPP

SEQ ID NO: 2992510 - protein, 25 aa, Entamoeba invadens
EALQPTQYVFIPQESHLVPMYYDYF

SEQ ID NO: 2992511 - protein, 19 aa, Entamoeba invadens
EALWREAICLYAAIKSPIT

SEQ ID NO: 2992512 - protein, 17 aa, Entamoeba invadens
EAMMDYSPEASLLAIKR

SEQ ID NO: 2992513 - protein, 22 aa, Entamoeba invadens
EAMTYFGFTTFVLMFRDWFDKD

SEQ ID NO: 2992514 - protein, 23 aa, Entamoeba invadens
EANFVWIHREPIEQLKSFIVLMV

SEQ ID NO: 2992515 - protein, 20 aa, Entamoeba invadens
EANIPIIPVPIRKTQDNEPD

SEQ ID NO: 2992516 - protein, 25 aa, Entamoeba invadens
EANKKQLALLLFETLHLNCVANIAD

SEQ ID NO: 2992517 - protein, 18 aa, Entamoeba invadens
EANLCFAEFIRDASLLWR

SEQ ID NO: 2992518 - protein, 44 aa, Entamoeba invadens
EANLKSIFEIAMLFPNKSLQQLTMRLNWLPLKSKIGWEEYCRQN

SEQ ID NO: 2992519 - protein, 25 aa, Entamoeba invadens
EANNIFRLINNLEIYNTILLNTKLE

SEQ ID NO: 2992520 - protein, 17 aa, Entamoeba invadens
EANYFDNVYPSVIAVFG

SEQ ID NO: 2992521 - protein, 26 aa, Entamoeba invadens
EAPANMMCYFPKLHALAAADNMLQFL

SEQ ID NO: 2992522 - protein, 22 aa, Entamoeba invadens
EAPANMMQYFPHLHALSSADNI

SEQ ID NO: 2992523 - protein, 29 aa, Entamoeba invadens
EAPEKLKEGYFFLFNDVLIETVVLKHKGN

SEQ ID NO: 2992524 - protein, 18 aa, Entamoeba invadens
EAPFLIPKEIFRTVDHIV

SEQ ID NO: 2992525 - protein, 25 aa, Entamoeba invadens
EAPLIIKTFELFIQNRTRIFTDIED

SEQ ID NO: 2992526 - protein, 26 aa, Entamoeba invadens
EAQEEGRLALYKLSQNKMVSYKENST

SEQ ID NO: 2992527 - protein, 23 aa, Entamoeba invadens
EAQIKQLRYENCQLHHIVYSLIK

SEQ ID NO: 2992528 - protein, 28 aa, Entamoeba invadens
EAQISNSLLFFLKMVGFSFEEKKTKKAK

SEQ ID NO: 2992529 - protein, 17 aa, Entamoeba invadens
EAQMHLKRLLACHNNLS

SEQ ID NO: 2992530 - protein, 26 aa, Entamoeba invadens
EAQRMKYEAIHLSKKTLEDAKKAKKE

SEQ ID NO: 2992531 - protein, 30 aa, Entamoeba invadens
EARNAVSTLFFLRFLLTPFTAHSEILKILQ

SEQ ID NO: 2992532 - protein, 26 aa, Entamoeba invadens
EARQKRFLDFLRKYNTKEFRFDFKKM

SEQ ID NO: 2992533 - protein, 28 aa, Entamoeba invadens
EARTNNGLIYLIKSFGYDFVIRQTKKAK

SEQ ID NO: 2992534 - protein, 26 aa, Entamoeba invadens
EASKKIQLILYSNVSAMYLHLKQYDS

SEQ ID NO: 2992535 - protein, 18 aa, Entamoeba invadens
EASKSLFPNSYLDQFVAA

SEQ ID NO: 2992536 - protein, 17 aa, Entamoeba invadens
EASLLKRIVDALKSTID

SEQ ID NO: 2992537 - protein, 18 aa, Entamoeba invadens
EASPSQQLFPPIPQQQQE

SEQ ID NO: 2992538 - protein, 26 aa, Entamoeba invadens
EASQQAFLIALLNINGYGIRVKRPER

SEQ ID NO: 2992539 - protein, 25 aa, Entamoeba invadens
EASSPLKPILFTQKNKKRPTSTVEP

SEQ ID NO: 2992540 - protein, 24 aa, Entamoeba invadens
EASSRLVDIFKTKSSPSLLIVKDI

SEQ ID NO: 2992541 - protein, 17 aa, Entamoeba invadens
EASTILELLPSLNAGEL

SEQ ID NO: 2992542 - protein, 20 aa, Entamoeba invadens
EATKLVFSRIAFKIKDGLVI

SEQ ID NO: 2992543 - protein, 24 aa, Entamoeba invadens
EATKSLMVYVQINGFTVLDLLHNV

SEQ ID NO: 2992544 - protein, 24 aa, Entamoeba invadens
EATKTHFVGKVYDLSLLHLPKCVK

SEQ ID NO: 2992545 - protein, 17 aa, Entamoeba invadens
EATLFSGSLKYNLDPRY

SEQ ID NO: 2992546 - protein, 23 aa, Entamoeba invadens
EATPHYCFVALLVLANKKKVKLI

SEQ ID NO: 2992547 - protein, 33 aa, Entamoeba invadens
EAVCLLKYLIDLFNSFQLAYNFEFILSSKRFVD

SEQ ID NO: 2992548 - protein, 26 aa, Entamoeba invadens
EAVELARKLFPKKLDQFNPAFVIVDE

SEQ ID NO: 2992549 - protein, 27 aa, Entamoeba invadens
EAVKFIRDYAMKYFLLKNENGAVTQLK

SEQ ID NO: 2992550 - protein, 18 aa, Entamoeba invadens
EAVKKVLVCYPKINSICC

SEQ ID NO: 2992551 - protein, 23 aa, Entamoeba invadens
EAVLKSMKLTPKSDVWSLGISVI

SEQ ID NO: 2992552 - protein, 23 aa, Entamoeba invadens
EAVLPYRTLAGTLVYDTVPLRVS

SEQ ID NO: 2992553 - protein, 21 aa, Entamoeba invadens
EAVMMWTNMKAGLYGLTVTDF

SEQ ID NO: 2992554 - protein, 40 aa, Entamoeba invadens
EAVPKIHINFCFKIFRVLPNALYLNKTKPILCPPDNIKRP

SEQ ID NO: 2992555 - protein, 28 aa, Entamoeba invadens
EAVQQAVLIALLNYLGYSIEIKHPERLA

SEQ ID NO: 2992556 - protein, 25 aa, Entamoeba invadens
EAVTILLRYFNIPHISLIQPPYPTV

SEQ ID NO: 2992557 - protein, 27 aa, Entamoeba invadens
EAVVKKILKYFPKLQTLQIDPKTANTL

SEQ ID NO: 2992558 - protein, 23 aa, Entamoeba invadens
EAWPIRNSLYDTPLSELLIGLSK

SEQ ID NO: 2992559 - protein, 27 aa, Entamoeba invadens
EAYAREQFKYPWAIAEFVISGKRLQFN

SEQ ID NO: 2992560 - protein, 26 aa, Entamoeba invadens
EAYKHYFDCIFGPYKSFVLKGIEMME

SEQ ID NO: 2992561 - protein, 23 aa, Entamoeba invadens
EAYNMSFYTFQTTPVSVLELLKD

SEQ ID NO: 2992562 - protein, 20 aa, Entamoeba invadens
EAYPKEDFKYPWKIAEFVMS

SEQ ID NO: 2992563 - protein, 25 aa, Entamoeba invadens
EAYPKTEFKYPWKIADFVNGGNRLQ

SEQ ID NO: 2992564 - protein, 25 aa, Entamoeba invadens
EAYQNDIFKFPWKIAEFVIEGKRLE

SEQ ID NO: 2992565 - protein, 24 aa, Entamoeba invadens
EAYSVDIFRFPWTIAEFVTAGKRL

SEQ ID NO: 2992566 - protein, 22 aa, Entamoeba invadens
EAYVEKLNWMYDAPMGVDSGVI

SEQ ID NO: 2992567 - protein, 18 aa, Entamoeba invadens
ECCTAFLSFALSMGSSLF

SEQ ID NO: 2992568 - protein, 27 aa, Entamoeba invadens
ECDVWAIGIILYIILSGTHPFSMDNEN

SEQ ID NO: 2992569 - protein, 30 aa, Entamoeba invadens
ECDYFEIRCAPPLMTLKPGYACEFEIFIKP

SEQ ID NO: 2992570 - protein, 21 aa, Entamoeba invadens
ECEEFLERIFTSATNLLRSTK

SEQ ID NO: 2992571 - protein, 27 aa, Entamoeba invadens
ECEERRIKIVIFRNDVIAKLIEREKHK

SEQ ID NO: 2992572 - protein, 18 aa, Entamoeba invadens
ECEIPLLKFNQIRGFDKM

SEQ ID NO: 2992573 - protein, 18 aa, Entamoeba invadens
ECENAIKPGLHWYEIHDL

SEQ ID NO: 2992574 - protein, 26 aa, Entamoeba invadens
ECEQRIPGFPIVLHGSSSVPQEWVKV

SEQ ID NO: 2992575 - protein, 23 aa, Entamoeba invadens
ECESFGQWKMVFDDWKRMEAQNV

SEQ ID NO: 2992576 - protein, 18 aa, Entamoeba invadens
ECEYTILDILQDDKNRNF

SEQ ID NO: 2992577 - protein, 25 aa, Entamoeba invadens
ECFNGCMMLSFISLKGQKRIPNGLC

SEQ ID NO: 2992578 - protein, 24 aa, Entamoeba invadens
ECFQSLFINPLINLEIETFALFKE

SEQ ID NO: 2992579 - protein, 18 aa, Entamoeba invadens
ECFSALKTQLLPKETRVL

SEQ ID NO: 2992580 - protein, 17 aa, Entamoeba invadens
ECFSWKMAYQKDDVRFK

SEQ ID NO: 2992581 - protein, 27 aa, Entamoeba invadens
ECFVCNVCKAPFPRGQFYNLDGKPVCA

SEQ ID NO: 2992582 - protein, 27 aa, Entamoeba invadens
ECGNEFILSPKGHKLLFMFGGCKGNDI

SEQ ID NO: 2992583 - protein, 17 aa, Entamoeba invadens
ECGSLSSVIIPPSVISI

SEQ ID NO: 2992584 - protein, 28 aa, Entamoeba invadens
ECHMKKLLMFYMWNSNNIKFLNKNVALQ

SEQ ID NO: 2992585 - protein, 19 aa, Entamoeba invadens
ECIIQNALLLIKKYIEMNV

SEQ ID NO: 2992586 - protein, 17 aa, Entamoeba invadens
ECIWKYGDAIYNQFLLL

SEQ ID NO: 2992587 - protein, 17 aa, Entamoeba invadens
ECKLNVLSSQHEDHFFR

SEQ ID NO: 2992588 - protein, 17 aa, Entamoeba invadens
ECKLTVLSSQHEDSLFK

SEQ ID NO: 2992589 - protein, 18 aa, Entamoeba invadens
ECKPSSARLLRLSHDQFF

SEQ ID NO: 2992590 - protein, 42 aa, Entamoeba invadens
ECKTKYSLTLYFTFCDLFDTFPLAALVTRKIGKFFLCHGGIS

SEQ ID NO: 2992591 - protein, 24 aa, Entamoeba invadens
ECLKCPTDFYLRNKTCKPFDNKNL

SEQ ID NO: 2992592 - protein, 29 aa, Entamoeba invadens
ECLKTPFPGLINYFLYTAKNMHFQHLCLE

SEQ ID NO: 2992593 - protein, 17 aa, Entamoeba invadens
ECNEQFWEFMNGLGERI

SEQ ID NO: 2992594 - protein, 26 aa, Entamoeba invadens
ECNNLKWIEVPKTLKLRKGSFPKTTA

SEQ ID NO: 2992595 - protein, 23 aa, Entamoeba invadens
ECNNTSLDILKRNKEKFQFSKQQ

SEQ ID NO: 2992596 - protein, 25 aa, Entamoeba invadens
ECPCWYLEDFIYLQKLIIENAEDLS

SEQ ID NO: 2992597 - protein, 18 aa, Entamoeba invadens
ECPKLSSLILPNTPILFM

SEQ ID NO: 2992598 - protein, 17 aa, Entamoeba invadens
ECPLIGDIIVKFSPSLE

SEQ ID NO: 2992599 - protein, 17 aa, Entamoeba invadens
ECPTSYQWSVEGLLISI

SEQ ID NO: 2992600 - protein, 17 aa, Entamoeba invadens
ECQNLTCIAIPSSVTFI

SEQ ID NO: 2992601 - protein, 18 aa, Entamoeba invadens
ECRKGVIYLTFFDSFHSG

SEQ ID NO: 2992602 - protein, 26 aa, Entamoeba invadens
ECRKKLIQYKLWRKEGYQSLEEGRGG

SEQ ID NO: 2992603 - protein, 27 aa, Entamoeba invadens
ECSAKFNVGINFLFEKLKKIANDKMAV

SEQ ID NO: 2992604 - protein, 17 aa, Entamoeba invadens
ECSALTQKNLKLLFDQA

SEQ ID NO: 2992605 - protein, 26 aa, Entamoeba invadens
ECSIPPDIYTAVFFGWQNSLNMTVMG

SEQ ID NO: 2992606 - protein, 17 aa, Entamoeba invadens
ECSKWKMPMPPNNDMER

SEQ ID NO: 2992607 - protein, 22 aa, Entamoeba invadens
ECSLQMNSYDYGIEKCPFGMER

SEQ ID NO: 2992608 - protein, 26 aa, Entamoeba invadens
ECSPAFFKFMALIGNKTELLGYSNYR

SEQ ID NO: 2992609 - protein, 27 aa, Entamoeba invadens
ECSPNFYYKFIKLFKKSNKNLTDFPRS

SEQ ID NO: 2992610 - protein, 18 aa, Entamoeba invadens
ECSRLSCVTIPSSVIFIG

SEQ ID NO: 2992611 - protein, 25 aa, Entamoeba invadens
ECSSLRRIVLPKRANRIGFLCFGYC

SEQ ID NO: 2992612 - protein, 35 aa, Entamoeba invadens
ECSTIDGLFELLFRVVKRIWKLDIYGEYFGDDEHI

SEQ ID NO: 2992613 - protein, 17 aa, Entamoeba invadens
ECSVFAPYPGLGDGYLF

SEQ ID NO: 2992614 - protein, 33 aa, Entamoeba invadens
ECTIECFLCRCRNPFVLGYIVLRNNPGTKTVIC

SEQ ID NO: 2992615 - protein, 23 aa, Entamoeba invadens
ECTKCMDMFINNAGQCAKIAKCL

SEQ ID NO: 2992616 - protein, 17 aa, Entamoeba invadens
ECTRLGLKTVWLGGTFT

SEQ ID NO: 2992617 - protein, 26 aa, Entamoeba invadens
ECVFEWQLLPQFIYATNLDIELNIEF

SEQ ID NO: 2992618 - protein, 19 aa, Entamoeba invadens
ECVKTLRIIFRFTAIVSVN

SEQ ID NO: 2992619 - protein, 25 aa, Entamoeba invadens
ECVMLQLPNLFIVKDLPLPKEFNTK

SEQ ID NO: 2992620 - protein, 17 aa, Entamoeba invadens
ECVNLKTLLLPSSVKEL

SEQ ID NO: 2992621 - protein, 19 aa, Entamoeba invadens
ECYILWTNVQPVYEKGEYV

SEQ ID NO: 2992622 - protein, 17 aa, Entamoeba invadens
ECYKCRNGYILNNNNCY

SEQ ID NO: 2992623 - protein, 19 aa, Entamoeba invadens
ECYKLILDVAAWINEKKLY

SEQ ID NO: 2992624 - protein, 24 aa, Entamoeba invadens
ECYKVHFVCRVGVVYLTHFDSFHT

SEQ ID NO: 2992625 - protein, 26 aa, Entamoeba invadens
ECYKVWRSTLTLEILINKECYPKAKS

SEQ ID NO: 2992626 - protein, 17 aa, Entamoeba invadens
ECYLHGCGLKKDLFKAL

SEQ ID NO: 2992627 - protein, 25 aa, Entamoeba invadens
ECYLRPLELMLSQGIIPVLHGDVVT

SEQ ID NO: 2992628 - protein, 30 aa, Entamoeba invadens
EDAKIPFNEKLFLTRSKVSDILYITCQESE

SEQ ID NO: 2992629 - protein, 37 aa, Entamoeba invadens
EDALFILRTHLLSLPKNLLDVVFFKTLYCCFSPELPD

SEQ ID NO: 2992630 - protein, 21 aa, Entamoeba invadens
EDALMLMKNKPADLIKPVVRI

SEQ ID NO: 2992631 - protein, 22 aa, Entamoeba invadens
EDALSYLSLVNILVHRKDMHCV

SEQ ID NO: 2992632 - protein, 24 aa, Entamoeba invadens
EDAQKFHRKRKEKIVRCDFINDKN

SEQ ID NO: 2992633 - protein, 24 aa, Entamoeba invadens
EDARTLFFELSLTKMRGFCITNDE

SEQ ID NO: 2992634 - protein, 30 aa, Entamoeba invadens
EDAVKDFFKDFTFMSFYRDVEKKGTLQGNT

SEQ ID NO: 2992635 - protein, 18 aa, Entamoeba invadens
EDCENKFLPKYVELKILP

SEQ ID NO: 2992636 - protein, 20 aa, Entamoeba invadens
EDCIDLHGLQIDGAVMMMKE

SEQ ID NO: 2992637 - protein, 22 aa, Entamoeba invadens
EDCIFWVNTLTPKEPPIDKIES

SEQ ID NO: 2992638 - protein, 18 aa, Entamoeba invadens
EDCINYASLDSYLYNYKI

SEQ ID NO: 2992639 - protein, 26 aa, Entamoeba invadens
EDCNLSGLRRGKKGLIGDNYFDMKKG

SEQ ID NO: 2992640 - protein, 19 aa, Entamoeba invadens
EDDDFFAFSLKNPHNTQPL

SEQ ID NO: 2992641 - protein, 23 aa, Entamoeba invadens
EDDELFEHLYQQQLEYQQNAQPR

SEQ ID NO: 2992642 - protein, 25 aa, Entamoeba invadens
EDDHNWTLDTLKYIGGLDITFSTKE

SEQ ID NO: 2992643 - protein, 26 aa, Entamoeba invadens
EDDIADSRRRLPNATKIEDYEPQIKA

SEQ ID NO: 2992644 - protein, 32 aa, Entamoeba invadens
EDDRRVLFNSLALAIKIVMPKQIVLDNTMLYE

SEQ ID NO: 2992645 - protein, 22 aa, Entamoeba invadens
EDDTFLFQMHFNMDLQICFDTM

SEQ ID NO: 2992646 - protein, 26 aa, Entamoeba invadens
EDDVKEFLSDFKIKKITQIVRTEGEL

SEQ ID NO: 2992647 - protein, 23 aa, Entamoeba invadens
EDDVKKYLKGYKVKSVKRGIAKK

SEQ ID NO: 2992648 - protein, 25 aa, Entamoeba invadens
EDDYFLSRMIEYVPAVNFGIECHVN

SEQ ID NO: 2992649 - protein, 32 aa, Entamoeba invadens
EDEAYAPYFTTIAEYLGINTLFVPSHVAVSMF

SEQ ID NO: 2992650 - protein, 29 aa, Entamoeba invadens
EDEEKVMMKVLFFNSPPVYPDLVKISSEF

SEQ ID NO: 2992651 - protein, 22 aa, Entamoeba invadens
EDEFEFYILKSKMYELLGMRDC

SEQ ID NO: 2992652 - protein, 23 aa, Entamoeba invadens
EDEGEYWREGFSSLLKVASGKAL

SEQ ID NO: 2992653 - protein, 21 aa, Entamoeba invadens
EDEHFFGVTKFVYHCPVCYSY

SEQ ID NO: 2992654 - protein, 23 aa, Entamoeba invadens
EDEKLLKAIDLYGPNNWELVSQF

SEQ ID NO: 2992655 - protein, 27 aa, Entamoeba invadens
EDEKRRQLFALYYKQWENIVLRQKDEL

SEQ ID NO: 2992656 - protein, 21 aa, Entamoeba invadens
EDELIIAMKRIEESEKEKKEK

SEQ ID NO: 2992657 - protein, 22 aa, Entamoeba invadens
EDEMMHLLAKKLLEEYPFFINY

SEQ ID NO: 2992658 - protein, 28 aa, Entamoeba invadens
EDENFVAILYFVDYIITKIKVVSDWLQK

SEQ ID NO: 2992659 - protein, 21 aa, Entamoeba invadens
EDENIFLLISKKKVNELKDRT

SEQ ID NO: 2992660 - protein, 24 aa, Entamoeba invadens
EDEQRELQRQFDNLKMEKNNLNEE

SEQ ID NO: 2992661 - protein, 23 aa, Entamoeba invadens
EDETELEFFFSKSAEDKKSQSST

SEQ ID NO: 2992662 - protein, 18 aa, Entamoeba invadens
EDETELIWKLRYTVKKTK

SEQ ID NO: 2992663 - protein, 24 aa, Entamoeba invadens
EDEWGVISVVCKNFILGCLKMNCE

SEQ ID NO: 2992664 - protein, 22 aa, Entamoeba invadens
EDEYDQLINLVYKHEDETNNLN

SEQ ID NO: 2992665 - protein, 20 aa, Entamoeba invadens
EDFIKIITHKTLRTVTFSAA

SEQ ID NO: 2992666 - protein, 17 aa, Entamoeba invadens
EDFLYYSYNLQNIAFDC

SEQ ID NO: 2992667 - protein, 20 aa, Entamoeba invadens
EDFMKIITHKTLRTVTFSAA

SEQ ID NO: 2992668 - protein, 38 aa, Entamoeba invadens
EDFQTNILDFLYAQLTRYLPMKWLPNAPIATIDSVIDK

SEQ ID NO: 2992669 - protein, 25 aa, Entamoeba invadens
EDFSSFRTFGFITGSKYWIFGVTGK

SEQ ID NO: 2992670 - protein, 17 aa, Entamoeba invadens
EDFTFHKCFSLQNIVFP

SEQ ID NO: 2992671 - protein, 36 aa, Entamoeba invadens
EDGEEDGWVFCKIGTRFGFVPKKYIERIDFTKNIGK

SEQ ID NO: 2992672 - protein, 24 aa, Entamoeba invadens
EDGKRKIDLGLKVKPKLKNQDTVV

SEQ ID NO: 2992673 - protein, 17 aa, Entamoeba invadens
EDGVILKQLTKICKTKV

SEQ ID NO: 2992674 - protein, 17 aa, Entamoeba invadens
EDGYSMHYITTKSLAAG

SEQ ID NO: 2992675 - protein, 24 aa, Entamoeba invadens
EDHDALLICLFMNVRHAKSRHRCE

SEQ ID NO: 2992676 - protein, 39 aa, Entamoeba invadens
EDHFVFVQQSLTLWWNIMRQMPFLWIMTDRDFLSGEEYK

SEQ ID NO: 2992677 - protein, 24 aa, Entamoeba invadens
EDHKMTLDCLKVHQFPIVNISQMC

SEQ ID NO: 2992678 - protein, 22 aa, Entamoeba invadens
EDICLYKSPIPTMKIVVEPLNP

SEQ ID NO: 2992679 - protein, 20 aa, Entamoeba invadens
EDIFNLFKEFNTFLITCFNQ

SEQ ID NO: 2992680 - protein, 18 aa, Entamoeba invadens
EDIFSLVAGYMEIITMKA

SEQ ID NO: 2992681 - protein, 38 aa, Entamoeba invadens
EDILDLIPSIIQCGDLYFNKWLALISTLGSMSEVTPIS

SEQ ID NO: 2992682 - protein, 20 aa, Entamoeba invadens
EDILNIIKSQLRFARSVYEG

SEQ ID NO: 2992683 - protein, 21 aa, Entamoeba invadens
EDILPPISLDPIKKSPVRGGL

SEQ ID NO: 2992684 - protein, 23 aa, Entamoeba invadens
EDIPLRYRAAYGGPLDKFDQKEK

SEQ ID NO: 2992685 - protein, 29 aa, Entamoeba invadens
EDIPVFKKAFYKIIVWFNVDFETVDQNKS

SEQ ID NO: 2992686 - protein, 17 aa, Entamoeba invadens
EDIQLRSNLEGQILEIE

SEQ ID NO: 2992687 - protein, 24 aa, Entamoeba invadens
EDIRETFRRAAVVQDIMLGNAMGK

SEQ ID NO: 2992688 - protein, 24 aa, Entamoeba invadens
EDISLIMELYKEFLLKNGYVTDAG

SEQ ID NO: 2992689 - protein, 19 aa, Entamoeba invadens
EDIVRCVVKLLQTPELSAL

SEQ ID NO: 2992690 - protein, 18 aa, Entamoeba invadens
EDIYPYLRNLTIPSSSLV

SEQ ID NO: 2992691 - protein, 24 aa, Entamoeba invadens
EDIYTIFEFLMKDLGDFYQSKDAK

SEQ ID NO: 2992692 - protein, 39 aa, Entamoeba invadens
EDKAYTKIVFELCPFCHIPKEYCEFGPNAKKCKKAQAET

SEQ ID NO: 2992693 - protein, 26 aa, Entamoeba invadens
EDKDSIFYYYQKLLKLRKENSIMVYG

SEQ ID NO: 2992694 - protein, 18 aa, Entamoeba invadens
EDKEFQIKALKKSSIFPI

SEQ ID NO: 2992695 - protein, 27 aa, Entamoeba invadens
EDKGDHPPITPLTYPQFALGDGEMRLY

SEQ ID NO: 2992696 - protein, 25 aa, Entamoeba invadens
EDKGKDVFFFSDPTKKVLGGGAELD

SEQ ID NO: 2992697 - protein, 17 aa, Entamoeba invadens
EDKIYLRKSVRSELDSI

SEQ ID NO: 2992698 - protein, 24 aa, Entamoeba invadens
EDKKCFLFCLRENGNVRTRKYNIK

SEQ ID NO: 2992699 - protein, 27 aa, Entamoeba invadens
EDKKRVMLELLLDNKIFRLAFDSDATR

SEQ ID NO: 2992700 - protein, 30 aa, Entamoeba invadens
EDKKYQLFSLLINKGYFVKDGFKYACDFMV

SEQ ID NO: 2992701 - protein, 34 aa, Entamoeba invadens
EDKLEHLKFDVGLLLRLVLCLTSALSYDGDRRLR

SEQ ID NO: 2992702 - protein, 26 aa, Entamoeba invadens
EDKLLRYKNLLAFERSMFALEKEHPW

SEQ ID NO: 2992703 - protein, 24 aa, Entamoeba invadens
EDKMVYFPMIDSTFMFFENRTMLV

SEQ ID NO: 2992704 - protein, 18 aa, Entamoeba invadens
EDKNALVLYALLDLLEEL

SEQ ID NO: 2992705 - protein, 26 aa, Entamoeba invadens
EDKNQTLQFDLMKEKEISKQLQNDNE

SEQ ID NO: 2992706 - protein, 25 aa, Entamoeba invadens
EDKNRKLAVLFKKIEDGLNDSDMLK

SEQ ID NO: 2992707 - protein, 18 aa, Entamoeba invadens
EDKRLVFNILANDQIFSA

SEQ ID NO: 2992708 - protein, 27 aa, Entamoeba invadens
EDKSDRSLYTLLFHLIDDDNSGTLEIN

SEQ ID NO: 2992709 - protein, 22 aa, Entamoeba invadens
EDKSPLFIKLKSMYGVMEHSLM

SEQ ID NO: 2992710 - protein, 21 aa, Entamoeba invadens
EDLAKTPLFTMKKLPEDEKQK

SEQ ID NO: 2992711 - protein, 24 aa, Entamoeba invadens
EDLDPLRVLNIFKSLVREDIEAMD

SEQ ID NO: 2992712 - protein, 17 aa, Entamoeba invadens
EDLFILFKEQLSIPQRT

SEQ ID NO: 2992713 - protein, 19 aa, Entamoeba invadens
EDLFKLCFELTEYPSKKGI

SEQ ID NO: 2992714 - protein, 37 aa, Entamoeba invadens
EDLGFTFTIVPRTPVPMIRMFNPRINTTDLLKERKEV

SEQ ID NO: 2992715 - protein, 25 aa, Entamoeba invadens
EDLGRIFIKMQPYLKVYNMYVANNA

SEQ ID NO: 2992716 - protein, 25 aa, Entamoeba invadens
EDLHDFVRPPIPCIKEELKKAQNLT

SEQ ID NO: 2992717 - protein, 19 aa, Entamoeba invadens
EDLIDSIVLHDLVLNQSAQ

SEQ ID NO: 2992718 - protein, 17 aa, Entamoeba invadens
EDLIKVSKRFITIAETH

SEQ ID NO: 2992719 - protein, 20 aa, Entamoeba invadens
EDLILPNGLVLIGEKSFFDC

SEQ ID NO: 2992720 - protein, 27 aa, Entamoeba invadens
EDLKMDSLLLISKLTNFIALLEDDSYL

SEQ ID NO: 2992721 - protein, 23 aa, Entamoeba invadens
EDLLKSLLFANPSPLLNAYCDGL

SEQ ID NO: 2992722 - protein, 31 aa, Entamoeba invadens
EDLNRGCGYIIDTFNEVFVYYGTSAGCVERA

SEQ ID NO: 2992723 - protein, 20 aa, Entamoeba invadens
EDLSFDELILPKVHFENIQH

SEQ ID NO: 2992724 - protein, 18 aa, Entamoeba invadens
EDLSPYKYAGYGLLIPCL

SEQ ID NO: 2992725 - protein, 20 aa, Entamoeba invadens
EDLTPEDLFILFKEQLSIPQ

SEQ ID NO: 2992726 - protein, 29 aa, Entamoeba invadens
EDLVMLLNSKITPFLPLNFLKLNENNSKM

SEQ ID NO: 2992727 - protein, 24 aa, Entamoeba invadens
EDLYTNYFIQEALTFHANISKLIV

SEQ ID NO: 2992728 - protein, 18 aa, Entamoeba invadens
EDMCTIAYRVATFGGKKG

SEQ ID NO: 2992729 - protein, 24 aa, Entamoeba invadens
EDMLFRIRVVVSDKGKPVGEVISN

SEQ ID NO: 2992730 - protein, 25 aa, Entamoeba invadens
EDMNANLFGVYLETKVFRSNRYVCD

SEQ ID NO: 2992731 - protein, 33 aa, Entamoeba invadens
EDMPYYPQFMDFDSIFWMSIHFHPNIFNSVYFN

SEQ ID NO: 2992732 - protein, 19 aa, Entamoeba invadens
EDMTEAIILNDEEEAHLLI

SEQ ID NO: 2992733 - protein, 24 aa, Entamoeba invadens
EDMTKVWHHSFYSELRNIPNDSNV

SEQ ID NO: 2992734 - protein, 28 aa, Entamoeba invadens
EDNDYLELIKTFPMLYISVFGGISNMCD

SEQ ID NO: 2992735 - protein, 33 aa, Entamoeba invadens
EDNGDITILKKKFFRIIVWFSVDFGTVDRNKSR

SEQ ID NO: 2992736 - protein, 26 aa, Entamoeba invadens
EDNGQMAAWYIWNSIGMYSMTPGTGE

SEQ ID NO: 2992737 - protein, 29 aa, Entamoeba invadens
EDNLTAIDLIPIFFALKSNMWFTDVSVED

SEQ ID NO: 2992738 - protein, 23 aa, Entamoeba invadens
EDNPTIPFMNVRGKILEKVIEFM

SEQ ID NO: 2992739 - protein, 24 aa, Entamoeba invadens
EDPTNVLNLKDLLSINIVGMEYTY

SEQ ID NO: 2992740 - protein, 25 aa, Entamoeba invadens
EDQAWETWPPHVITFFKKMSSEWDA

SEQ ID NO: 2992741 - protein, 20 aa, Entamoeba invadens
EDQKMLFIPIFSQSVREFFT

SEQ ID NO: 2992742 - protein, 24 aa, Entamoeba invadens
EDQSSFIFSPFFKEKSYGIQLSCT

SEQ ID NO: 2992743 - protein, 24 aa, Entamoeba invadens
EDRADRLYMYLKENKRFVSSSGME

SEQ ID NO: 2992744 - protein, 18 aa, Entamoeba invadens
EDRDPYFAYICYKKKNLD

SEQ ID NO: 2992745 - protein, 29 aa, Entamoeba invadens
EDRKIEPKYYVPIIPMVLVNGAEGIGTGW

SEQ ID NO: 2992746 - protein, 28 aa, Entamoeba invadens
EDRNPDLTYIWMTLAPNGPSLKFFVESS

SEQ ID NO: 2992747 - protein, 37 aa, Entamoeba invadens
EDRQLYNIAPVQGMLFGIQLQPLPPPTRLLEDQDRIY

SEQ ID NO: 2992748 - protein, 18 aa, Entamoeba invadens
EDRRINFQGYLRTLEKLE

SEQ ID NO: 2992749 - protein, 26 aa, Entamoeba invadens
EDRTSSMKLMLFLNGVGAHDKSLISV

SEQ ID NO: 2992750 - protein, 17 aa, Entamoeba invadens
EDRVYVKKYYNNEKYNI

SEQ ID NO: 2992751 - protein, 17 aa, Entamoeba invadens
EDRYKCIQTLFKLSLGL

SEQ ID NO: 2992752 - protein, 30 aa, Entamoeba invadens
EDSDLIVHGCKRVWFGFNLSEETVKEFTIE

SEQ ID NO: 2992753 - protein, 17 aa, Entamoeba invadens
EDSFIDRKRDCDLTDSL

SEQ ID NO: 2992754 - protein, 22 aa, Entamoeba invadens
EDSFIHRADINFIPPLKENDNL

SEQ ID NO: 2992755 - protein, 19 aa, Entamoeba invadens
EDSFTLEGVAFKKCFSYAG

SEQ ID NO: 2992756 - protein, 20 aa, Entamoeba invadens
  misc_feature (20)..(20): Xaa can be any naturally occurring amino acid
EDSKLYAYTSLDLVIPYIRX

SEQ ID NO: 2992757 - protein, 31 aa, Entamoeba invadens
EDSNKPFPETALPALLVYKGDVMVKSLFGKE

SEQ ID NO: 2992758 - protein, 24 aa, Entamoeba invadens
EDSRRGMRLGLEEITFLMNDKLDE

SEQ ID NO: 2992759 - protein, 26 aa, Entamoeba invadens
EDSTSIPIVLPRFLSAVNPFKEFTRK

SEQ ID NO: 2992760 - protein, 18 aa, Entamoeba invadens
EDTAPINAIPPKVEEFES

SEQ ID NO: 2992761 - protein, 24 aa, Entamoeba invadens
EDTCRIILPLLFSASYSGITLLDT

SEQ ID NO: 2992762 - protein, 23 aa, Entamoeba invadens
EDTFLHYKPFIKEISLRNNTMAY

SEQ ID NO: 2992763 - protein, 29 aa, Entamoeba invadens
EDTIDLHGLQIEGAILMMKEQIEQRKSQG

SEQ ID NO: 2992764 - protein, 18 aa, Entamoeba invadens
EDTIRTITTKLKETCDTN

SEQ ID NO: 2992765 - protein, 17 aa, Entamoeba invadens
EDTLKVLLPLMNDVHTT

SEQ ID NO: 2992766 - protein, 24 aa, Entamoeba invadens
EDTMTITYRIHFLDVLYSEEDEKK

SEQ ID NO: 2992767 - protein, 18 aa, Entamoeba invadens
EDTPLIPTVQILEIKKEQ

SEQ ID NO: 2992768 - protein, 43 aa, Entamoeba invadens
EDTTRLLFYVEMVYSFFDLKFTDLPVFIQEKIKLYNTLITLKA

SEQ ID NO: 2992769 - protein, 28 aa, Entamoeba invadens
EDTYKNLKFFLDVVSQRKLTLTSKIEEI

SEQ ID NO: 2992770 - protein, 29 aa, Entamoeba invadens
EDVEEMAQALYIYWKSRDIARSGECDYEE

SEQ ID NO: 2992771 - protein, 19 aa, Entamoeba invadens
EDVFGPIFQYFITTIIEKN

SEQ ID NO: 2992772 - protein, 21 aa, Entamoeba invadens
EDVFKACIEALWNISIDPTAC

SEQ ID NO: 2992773 - protein, 25 aa, Entamoeba invadens
EDVHYNFDGSKFVFKHNWHLVELDR

SEQ ID NO: 2992774 - protein, 21 aa, Entamoeba invadens
EDVIITKKYFPYLENDGRVFY

SEQ ID NO: 2992775 - protein, 26 aa, Entamoeba invadens
EDVKSSLFVTKLFKILGFQKEEREHI

SEQ ID NO: 2992776 - protein, 18 aa, Entamoeba invadens
EDVKYYLDYLDSEDNRFG

SEQ ID NO: 2992777 - protein, 26 aa, Entamoeba invadens
EDVLKFSIIIDLYVLSGVYPTTKTSH

SEQ ID NO: 2992778 - protein, 24 aa, Entamoeba invadens
EDVQPILFKESRATLPLFSVSGRN

SEQ ID NO: 2992779 - protein, 22 aa, Entamoeba invadens
EDVQQLILNPQLIKMYEEQINT

SEQ ID NO: 2992780 - protein, 19 aa, Entamoeba invadens
EDVRKWLDGKGLKVERVAL

SEQ ID NO: 2992781 - protein, 24 aa, Entamoeba invadens
EDVSKFYNQKYRIGQCLFGVLAGD

SEQ ID NO: 2992782 - protein, 25 aa, Entamoeba invadens
EDVTLYSDYLYAPLIFSRCTSLKTV

SEQ ID NO: 2992783 - protein, 21 aa, Entamoeba invadens
EDVVGFLNFFIDATKINIKPF

SEQ ID NO: 2992784 - protein, 20 aa, Entamoeba invadens
EDVVICDFSWVVLSQVDAVA

SEQ ID NO: 2992785 - protein, 17 aa, Entamoeba invadens
EDYADFPEIQKEILDAS

SEQ ID NO: 2992786 - protein, 35 aa, Entamoeba invadens
EDYDKLRPLSYPQTDVFLICFSVVSPPSFDNVSSK

SEQ ID NO: 2992787 - protein, 36 aa, Entamoeba invadens
EDYDRLRPLSYPQTDVFLICFSVVLPPSFDNVSSKW

SEQ ID NO: 2992788 - protein, 36 aa, Entamoeba invadens
EDYDRLRPLSYPSTDVFLLCFSVIAPASYDNAQVKW

SEQ ID NO: 2992789 - protein, 17 aa, Entamoeba invadens
EDYIYVKTVFGDKLKEG

SEQ ID NO: 2992790 - protein, 23 aa, Entamoeba invadens
EDYLKLHQILPKFEKLLSRVNDS

SEQ ID NO: 2992791 - protein, 18 aa, Entamoeba invadens
EDYNNFILPDFLSDEIQS

SEQ ID NO: 2992792 - protein, 24 aa, Entamoeba invadens
EDYTWNFPSAIVGGLYIPPLVMEI

SEQ ID NO: 2992793 - protein, 19 aa, Entamoeba invadens
EEAFFMEMLGQCFVMSSSI

SEQ ID NO: 2992794 - protein, 25 aa, Entamoeba invadens
EEAHTLILLFSLLPTEDLMVYEETF

SEQ ID NO: 2992795 - protein, 22 aa, Entamoeba invadens
EEAILVLQDLLRTNPRGNLQII

SEQ ID NO: 2992796 - protein, 30 aa, Entamoeba invadens
EEAMHLTKFGSKIIILHRRDSFRASKAMQE

SEQ ID NO: 2992797 - protein, 25 aa, Entamoeba invadens
EEANYFDYYIPYMCYINTKDGKPYI

SEQ ID NO: 2992798 - protein, 18 aa, Entamoeba invadens
EEAPWGLLTILDLVTKCF

SEQ ID NO: 2992799 - protein, 27 aa, Entamoeba invadens
EEASLANSYLFLLLSECDGKAVIKYTK

SEQ ID NO: 2992800 - protein, 29 aa, Entamoeba invadens
EEAYEKYSQELFKYIFGDTDVSTLNLPKI

SEQ ID NO: 2992801 - protein, 18 aa, Entamoeba invadens
EECKALMEIVIPESVTKL

SEQ ID NO: 2992802 - protein, 25 aa, Entamoeba invadens
EECKDIIFLLSQFIGTSGKIESIGL

SEQ ID NO: 2992803 - protein, 30 aa, Entamoeba invadens
EECMRLAFLIGYLNVKGVGFMLARRAKRAE

SEQ ID NO: 2992804 - protein, 25 aa, Entamoeba invadens
EECQRMAFLIGLLNANGVGFSIARR

SEQ ID NO: 2992805 - protein, 18 aa, Entamoeba invadens
EECRQVMEYLYKRLNEDG

SEQ ID NO: 2992806 - protein, 18 aa, Entamoeba invadens
EECWKGVFAMLYIGGIDE

SEQ ID NO: 2992807 - protein, 23 aa, Entamoeba invadens
EEDDSHYLLLKNKRITLGTQYLS

SEQ ID NO: 2992808 - protein, 26 aa, Entamoeba invadens
EEDDVMLYYLNFLQGVFYGSLEMRGF

SEQ ID NO: 2992809 - protein, 20 aa, Entamoeba invadens
EEDILISGGLFPTSDHPSAL

SEQ ID NO: 2992810 - protein, 33 aa, Entamoeba invadens
EEDKKVVFNGLALAIKIVLPKEVLKIDNTMLYE

SEQ ID NO: 2992811 - protein, 33 aa, Entamoeba invadens
EEDKTQFTALTGLKVYECLYDYPKYASSIVSHK

SEQ ID NO: 2992812 - protein, 20 aa, Entamoeba invadens
EEDLIDDLDFLPSNPFVPTE

SEQ ID NO: 2992813 - protein, 29 aa, Entamoeba invadens
EEDLIFDSMFFIPINRRMNAVLKELWMKL

SEQ ID NO: 2992814 - protein, 18 aa, Entamoeba invadens
EEDLIVEGIYKEMPQFDK

SEQ ID NO: 2992815 - protein, 24 aa, Entamoeba invadens
EEDLVEWIYTNFTSSLVCFYGTPK

SEQ ID NO: 2992816 - protein, 26 aa, Entamoeba invadens
EEDRLRPLSYSESDVILLCFSVNSRT

SEQ ID NO: 2992817 - protein, 23 aa, Entamoeba invadens
EEDRMMNIAKILKLPQTHKILNV

SEQ ID NO: 2992818 - protein, 28 aa, Entamoeba invadens
EEDVLVLKKIEVLGKKWIEISKCLPGKT

SEQ ID NO: 2992819 - protein, 25 aa, Entamoeba invadens
EEDVQKLFLVMQGLLEHCKEGLAIH

SEQ ID NO: 2992820 - protein, 27 aa, Entamoeba invadens
EEEEESLWFRLYGNPEALKGLSQELQP

SEQ ID NO: 2992821 - protein, 29 aa, Entamoeba invadens
EEEEKVAYLFTFPFSTLKNFDWKSYQNEL

SEQ ID NO: 2992822 - protein, 26 aa, Entamoeba invadens
EEEEPYYKTLLSIDLTNLTVADRISL

SEQ ID NO: 2992823 - protein, 27 aa, Entamoeba invadens
EEEEREFFTVYFRVAILESLDNYNYQQ

SEQ ID NO: 2992824 - protein, 26 aa, Entamoeba invadens
EEEGKPNYWVVRPVLRKHQKCFGLFD

SEQ ID NO: 2992825 - protein, 24 aa, Entamoeba invadens
EEEGQYWREGFSALIKLAQGKAPE

SEQ ID NO: 2992826 - protein, 23 aa, Entamoeba invadens
EEEHIFWQLRDYTEQYKVLEQRL

SEQ ID NO: 2992827 - protein, 26 aa, Entamoeba invadens
EEEICFKAMLGFSWVYSLCLPRLEQY

SEQ ID NO: 2992828 - protein, 20 aa, Entamoeba invadens
EEEIPFRLPEDRPELEEKVG

SEQ ID NO: 2992829 - protein, 19 aa, Entamoeba invadens
EEEIPKLMFSSCLVDLKLQ

SEQ ID NO: 2992830 - protein, 25 aa, Entamoeba invadens
EEELFFQEMIGFSWTYSLSLPRLEQ

SEQ ID NO: 2992831 - protein, 23 aa, Entamoeba invadens
EEEMMLWSCWFHNAGVEIRLPTP

SEQ ID NO: 2992832 - protein, 24 aa, Entamoeba invadens
EEEMPLGLAIQFLAPRKRDIVCDI

SEQ ID NO: 2992833 - protein, 27 aa, Entamoeba invadens
EEEMTFLLFRDEDMLIFGNRNLFEFFI

SEQ ID NO: 2992834 - protein, 20 aa, Entamoeba invadens
EEENFFAKSNKRKTKYEESD

SEQ ID NO: 2992835 - protein, 24 aa, Entamoeba invadens
EEENPFAKSNKRKTKFEESDELSE

SEQ ID NO: 2992836 - protein, 26 aa, Entamoeba invadens
EEENTEMVILMKKYLNYVLGESNEIV

SEQ ID NO: 2992837 - protein, 22 aa, Entamoeba invadens
EEEREMDVLDFLRDFSKHSSEY

SEQ ID NO: 2992838 - protein, 21 aa, Entamoeba invadens
EEERLRQIELQKIREKEQLAR

SEQ ID NO: 2992839 - protein, 27 aa, Entamoeba invadens
EEERRKLFVPFFGKVEMDVTCFVFMEV

SEQ ID NO: 2992840 - protein, 23 aa, Entamoeba invadens
EEETDQPILWNPGKDPRVSRPSK

SEQ ID NO: 2992841 - protein, 23 aa, Entamoeba invadens
EEETLICIIKTFNMLLMTKNPAF

SEQ ID NO: 2992842 - protein, 25 aa, Entamoeba invadens
EEEYSYVQPPPLPTKPKRFNKEEKQ

SEQ ID NO: 2992843 - protein, 24 aa, Entamoeba invadens
EEFDKYGIVIKTQFRKEGSLQQLN

SEQ ID NO: 2992844 - protein, 34 aa, Entamoeba invadens
EEFDSLRPLSYPGTDIFLLCYAVNSSASLANLKD

SEQ ID NO: 2992845 - protein, 26 aa, Entamoeba invadens
EEFEKKFEGVFPEQWEVKTSFILEFV

SEQ ID NO: 2992846 - protein, 18 aa, Entamoeba invadens
EEFFVKKFDVLLNGFLNC

SEQ ID NO: 2992847 - protein, 24 aa, Entamoeba invadens
EEFKDSFFPPDPSVVYFHNSSPQS

SEQ ID NO: 2992848 - protein, 28 aa, Entamoeba invadens
EEFLKSISCKMLVIGLGLLHLCCGDAST

SEQ ID NO: 2992849 - protein, 19 aa, Entamoeba invadens
EEFLVLDAKIVLDKNMIGK

SEQ ID NO: 2992850 - protein, 26 aa, Entamoeba invadens
EEFMKMDWFKDIDFDKLLKKEISPPW

SEQ ID NO: 2992851 - protein, 18 aa, Entamoeba invadens
EEFNAFLAVTIIQGQFKD

SEQ ID NO: 2992852 - protein, 17 aa, Entamoeba invadens
EEFNRVWNAKLKTIKLK

SEQ ID NO: 2992853 - protein, 17 aa, Entamoeba invadens
EEFRKYFTLSSVLEGLF

SEQ ID NO: 2992854 - protein, 26 aa, Entamoeba invadens
EEFSKAFERMLLFGFKKNEKIPYLEV

SEQ ID NO: 2992855 - protein, 30 aa, Entamoeba invadens
EEFSNIFQCIQIPVLLVFATQDQYVPYSSE

SEQ ID NO: 2992856 - protein, 27 aa, Entamoeba invadens
EEFYTLTVLGLLFKILQDNNLVLGHVQ

SEQ ID NO: 2992857 - protein, 23 aa, Entamoeba invadens
EEFYVCSLQTCFDFFYQELISEE

SEQ ID NO: 2992858 - protein, 41 aa, Entamoeba invadens
EEGEKDVKILLATLSEQIPQHSLEIPIYGEDAKLYCEGKGT

SEQ ID NO: 2992859 - protein, 27 aa, Entamoeba invadens
EEGFYLEKNAIYLFPYSSVAEFVNSDY

SEQ ID NO: 2992860 - protein, 24 aa, Entamoeba invadens
EEGLCDLPFRRISGGSNIFGKTGG

SEQ ID NO: 2992861 - protein, 33 aa, Entamoeba invadens
EEGYDISISYLSKIMKRLGLAKGNTLKSGLLSQ

SEQ ID NO: 2992862 - protein, 23 aa, Entamoeba invadens
EEGYVWVVMEFMDSGCLTEILTE

SEQ ID NO: 2992863 - protein, 24 aa, Entamoeba invadens
EEHALFVEGLNLYHRDWKRIEQHI

SEQ ID NO: 2992864 - protein, 19 aa, Entamoeba invadens
EEHKFWRYEPVIGTGVVVP

SEQ ID NO: 2992865 - protein, 36 aa, Entamoeba invadens
EEHLLFEVLQIKTLKKVYLIFTTMTLQFINEFNFSE

SEQ ID NO: 2992866 - protein, 29 aa, Entamoeba invadens
EEHPKYIALYIDLLLRRVGPGKEALDVVL

SEQ ID NO: 2992867 - protein, 24 aa, Entamoeba invadens
EEHQYLFQLLNVLTKKLLETNIPP

SEQ ID NO: 2992868 - protein, 30 aa, Entamoeba invadens
EEIEDVLNGLIFLTPFYLSHLLLVNNTLIM

SEQ ID NO: 2992869 - protein, 33 aa, Entamoeba invadens
EEIEKKYGEPLLLFYNGIIVSDKPSFAAAVNDC

SEQ ID NO: 2992870 - protein, 29 aa, Entamoeba invadens
EEIFPRGLYILVIPFYQDYLTINYGDKCY

SEQ ID NO: 2992871 - protein, 34 aa, Entamoeba invadens
EEIFVKRKIGTLTNNLVYIVLSLVLSGYDKVHEE

SEQ ID NO: 2992872 - protein, 17 aa, Entamoeba invadens
EEIILDSRLTHLPLMCF

SEQ ID NO: 2992873 - protein, 22 aa, Entamoeba invadens
EEIILPPHLMLIGENAFYNCKK

SEQ ID NO: 2992874 - protein, 31 aa, Entamoeba invadens
EEILLKYDVSCVPTFILFKDNVEVKRLNGTN

SEQ ID NO: 2992875 - protein, 19 aa, Entamoeba invadens
EEILRRHFAEWGELEYIRV

SEQ ID NO: 2992876 - protein, 20 aa, Entamoeba invadens
EEILRRIGFNLPFNNEFCER

SEQ ID NO: 2992877 - protein, 19 aa, Entamoeba invadens
EEILSLLNRLVFNGSAECS

SEQ ID NO: 2992878 - protein, 24 aa, Entamoeba invadens
EEINRISLYLMVALVSRLDLDKNL

SEQ ID NO: 2992879 - protein, 24 aa, Entamoeba invadens
EEIPKTQFLLPDITKNYLNLKTPH

SEQ ID NO: 2992880 - protein, 24 aa, Entamoeba invadens
EEIPVGMFSLPLWAVNAYSKKAHP

SEQ ID NO: 2992881 - protein, 21 aa, Entamoeba invadens
EEIRPRYLCGIMFLHEQGIVH

SEQ ID NO: 2992882 - protein, 32 aa, Entamoeba invadens
EEIRREIPLLQHQDFILFNPLDNLVETITSLC

SEQ ID NO: 2992883 - protein, 28 aa, Entamoeba invadens
EEISDWIVTIILLMFSAENRVKAAIRFI

SEQ ID NO: 2992884 - protein, 25 aa, Entamoeba invadens
EEIVMTCGCAGACNVFLRTVLEIGD

SEQ ID NO: 2992885 - protein, 17 aa, Entamoeba invadens
EEIVRYLNDACPLPMTP

SEQ ID NO: 2992886 - protein, 24 aa, Entamoeba invadens
EEKAFWGCKNVKELIFNETCILKN

SEQ ID NO: 2992887 - protein, 31 aa, Entamoeba invadens
EEKDPKIAVAKLITLLYKPSRGTDYSLLCGK

SEQ ID NO: 2992888 - protein, 30 aa, Entamoeba invadens
EEKEDWCMGFLFSDLFLLAKPSVPKEYTKE

SEQ ID NO: 2992889 - protein, 18 aa, Entamoeba invadens
EEKGYFVQVIWQDNKKQK

SEQ ID NO: 2992890 - protein, 24 aa, Entamoeba invadens
EEKIELKVLIRMLLNAARGLEYLH

SEQ ID NO: 2992891 - protein, 26 aa, Entamoeba invadens
EEKIHLMSLMRYFVKSCLFTQELVST

SEQ ID NO: 2992892 - protein, 29 aa, Entamoeba invadens
EEKKDDKMLLPPLPPITPIKRMADEKEVK

SEQ ID NO: 2992893 - protein, 23 aa, Entamoeba invadens
EEKKDIPQAFNFSNVFQTGEKKE

SEQ ID NO: 2992894 - protein, 41 aa, Entamoeba invadens
EEKKVVQRLLLVPVGFYQKILRLLRCLLREGPFKENQLLMD

SEQ ID NO: 2992895 - protein, 17 aa, Entamoeba invadens
EEKLEGEFIIRIYSQEK

SEQ ID NO: 2992896 - protein, 18 aa, Entamoeba invadens
EEKLEILDAEIKRKESEL

SEQ ID NO: 2992897 - protein, 20 aa, Entamoeba invadens
EEKLKLLEVEKEKIVNELDT

SEQ ID NO: 2992898 - protein, 17 aa, Entamoeba invadens
EEKLNIIGLLRDTEVKI

SEQ ID NO: 2992899 - protein, 25 aa, Entamoeba invadens
EEKMKNIIKLLPSDTPQDIIEQIEK

SEQ ID NO: 2992900 - protein, 32 aa, Entamoeba invadens
EEKMLEVFINKFALFCDCIVQFVPNFEKFQST

SEQ ID NO: 2992901 - protein, 23 aa, Entamoeba invadens
EEKNAFICDPLELICPLEITDKE

SEQ ID NO: 2992902 - protein, 20 aa, Entamoeba invadens
EEKRRILETLAKQNNKNKQP

SEQ ID NO: 2992903 - protein, 26 aa, Entamoeba invadens
EEKSIKIPVFTNFNAQLPLAELSDEE

SEQ ID NO: 2992904 - protein, 48 aa, Entamoeba invadens
EEKSILEFKFESRFRWLYRPMRKMSPYHLVLFKALRNYFMTNACPNPV

SEQ ID NO: 2992905 - protein, 22 aa, Entamoeba invadens
EEKSLIEHYKFGVIYAKPGQHD

SEQ ID NO: 2992906 - protein, 17 aa, Entamoeba invadens
EEKVPLFAGSFQCYFDV

SEQ ID NO: 2992907 - protein, 32 aa, Entamoeba invadens
EEKWKWKDMFKDFDLIQTLWKMTCEIMKEKYP

SEQ ID NO: 2992908 - protein, 21 aa, Entamoeba invadens
EEKYGCNILFDNLALNGDQTL

SEQ ID NO: 2992909 - protein, 23 aa, Entamoeba invadens
EELAYIIQLTFTSDFVFDVLSLT

SEQ ID NO: 2992910 - protein, 22 aa, Entamoeba invadens
EELAYPLLDALLKQRTEVLLEK

SEQ ID NO: 2992911 - protein, 28 aa, Entamoeba invadens
EELEPYISIFFRVFTPLITTTDSSLSAE

SEQ ID NO: 2992912 - protein, 25 aa, Entamoeba invadens
EELGVLQILYYEQCRFYCKTSDCII

SEQ ID NO: 2992913 - protein, 28 aa, Entamoeba invadens
EELHEKYDILFTLFKALERRYNTEIFND

SEQ ID NO: 2992914 - protein, 21 aa, Entamoeba invadens
EELIIKYRKIEMEKMRQKVSF

SEQ ID NO: 2992915 - protein, 21 aa, Entamoeba invadens
EELIKENNTLKSTIDADDTKL

SEQ ID NO: 2992916 - protein, 39 aa, Entamoeba invadens
EELKLDTLILNNNKLYQCYLYCTPYLKNLFVDCNDFESL

SEQ ID NO: 2992917 - protein, 17 aa, Entamoeba invadens
EELKLRTLFLKIKIIQW

SEQ ID NO: 2992918 - protein, 24 aa, Entamoeba invadens
EELKLVIIDEIHLLHDTRGPVIEA

SEQ ID NO: 2992919 - protein, 25 aa, Entamoeba invadens
EELKQKWPDFIYTSGVPKVISALLV

SEQ ID NO: 2992920 - protein, 19 aa, Entamoeba invadens
EELLDLYDLKLTNVNIRHF

SEQ ID NO: 2992921 - protein, 17 aa, Entamoeba invadens
EELLVKLQNLEKLKNLE

SEQ ID NO: 2992922 - protein, 20 aa, Entamoeba invadens
EELMKMKGFYHALASQQFGT

SEQ ID NO: 2992923 - protein, 19 aa, Entamoeba invadens
EELMRMKGFYHVLATQQCE

SEQ ID NO: 2992924 - protein, 17 aa, Entamoeba invadens
EELNIHLTIYNTNKLKD

SEQ ID NO: 2992925 - protein, 17 aa, Entamoeba invadens
EELRKILTALRPQDFEP

SEQ ID NO: 2992926 - protein, 22 aa, Entamoeba invadens
EELTKIIKKYYPNRLDFSCDTE

SEQ ID NO: 2992927 - protein, 22 aa, Entamoeba invadens
EELTKNLYIKKLISLLTQTELK

SEQ ID NO: 2992928 - protein, 21 aa, Entamoeba invadens
EELVIQWKITSDEFLFELIRC

SEQ ID NO: 2992929 - protein, 32 aa, Entamoeba invadens
EELYIKDGPALNQYLLRIALMNASVSTGGANP

SEQ ID NO: 2992930 - protein, 23 aa, Entamoeba invadens
EELYTFEDGTFLVYDRIDYKEID

SEQ ID NO: 2992931 - protein, 25 aa, Entamoeba invadens
EEMADLIKIWPGIGPIQVIGLLDVR

SEQ ID NO: 2992932 - protein, 27 aa, Entamoeba invadens
EEMAYPLNVMFVNLFNTSAFAQCKSAN

SEQ ID NO: 2992933 - protein, 19 aa, Entamoeba invadens
EEMCYPKPLIDDHKWMHTK

SEQ ID NO: 2992934 - protein, 20 aa, Entamoeba invadens
EEMIDRWLCFIQQTTQKEWE

SEQ ID NO: 2992935 - protein, 19 aa, Entamoeba invadens
EEMIGVLLMFPSFKLENAN

SEQ ID NO: 2992936 - protein, 17 aa, Entamoeba invadens
EEMLLRFKNETFGEDWI

SEQ ID NO: 2992937 - protein, 25 aa, Entamoeba invadens
EENAFSWCDFLTKVVFSQKLKNIKN

SEQ ID NO: 2992938 - protein, 23 aa, Entamoeba invadens
EENDPMLLLKTVYYCLNAECSVQ

SEQ ID NO: 2992939 - protein, 24 aa, Entamoeba invadens
EENKKAWGMLRLKKRRDLMKEIYD

SEQ ID NO: 2992940 - protein, 17 aa, Entamoeba invadens
EENKKIVEQLKLTTNEK

SEQ ID NO: 2992941 - protein, 29 aa, Entamoeba invadens
EENKKLPMKVRVSESFIACNALSEESAPS

SEQ ID NO: 2992942 - protein, 20 aa, Entamoeba invadens
EENKSYFMTLAKDVCWHVRY

SEQ ID NO: 2992943 - protein, 23 aa, Entamoeba invadens
EENLLHEKLKGDKKWKRGRRGKG

SEQ ID NO: 2992944 - protein, 20 aa, Entamoeba invadens
EENPKILNFPLHTESGLLYD

SEQ ID NO: 2992945 - protein, 25 aa, Entamoeba invadens
EENQMKEFFVFPPNTNYVGMSFNFL

SEQ ID NO: 2992946 - protein, 24 aa, Entamoeba invadens
EENSKLLVKITELEKEKVDFEESN

SEQ ID NO: 2992947 - protein, 28 aa, Entamoeba invadens
EENVARNYVLFKSLEIVYNNLKTMKKKV

SEQ ID NO: 2992948 - protein, 18 aa, Entamoeba invadens
EEPIFFQRPHYKRLLESF

SEQ ID NO: 2992949 - protein, 22 aa, Entamoeba invadens
EEPKVIEMTDFVLYKVPEAKPN

SEQ ID NO: 2992950 - protein, 17 aa, Entamoeba invadens
EEPLPTHKWDQPLFQMK

SEQ ID NO: 2992951 - protein, 22 aa, Entamoeba invadens
EEPPKVGSPEKRGFGSNTGAPK

SEQ ID NO: 2992952 - protein, 26 aa, Entamoeba invadens
EEPVPFSSWETLIPQMILSMRNERPL

SEQ ID NO: 2992953 - protein, 24 aa, Entamoeba invadens
EEQAKLLNLLIEKVDKRYVQHKKN

SEQ ID NO: 2992954 - protein, 20 aa, Entamoeba invadens
EEQEIIVGIGRQVTELRAKL

SEQ ID NO: 2992955 - protein, 27 aa, Entamoeba invadens
EEQFVKYFETFGPLRKNPDNKFQVLFA

SEQ ID NO: 2992956 - protein, 25 aa, Entamoeba invadens
EEQIDLIYERIYIKAVKICSFKMEG

SEQ ID NO: 2992957 - protein, 34 aa, Entamoeba invadens
EEQKIKIKHLGEGKYFISYTLPAVKGDYNVNCKL

SEQ ID NO: 2992958 - protein, 18 aa, Entamoeba invadens
EEQKPKIVRPRGASLFGN

SEQ ID NO: 2992959 - protein, 26 aa, Entamoeba invadens
EEQNKIRAILKRAFNGQDYDLTFSKT

SEQ ID NO: 2992960 - protein, 23 aa, Entamoeba invadens
EEQSAVNMLMIVKDMVYVGIVNQ

SEQ ID NO: 2992961 - protein, 23 aa, Entamoeba invadens
EEQSLLMSLSVLSAISVLKDNRD

SEQ ID NO: 2992962 - protein, 26 aa, Entamoeba invadens
EEQVRNWKFAMTIPDFEKKSTIEELA

SEQ ID NO: 2992963 - protein, 35 aa, Entamoeba invadens
EERDTIARPIMSSLLLCYTLYLDTVNDKWLQIRDV

SEQ ID NO: 2992964 - protein, 25 aa, Entamoeba invadens
EERDVLPYLLIQPRKVIKKYSVFLY

SEQ ID NO: 2992965 - protein, 23 aa, Entamoeba invadens
EEREYVMNVFRKGEKRVLITTDI

SEQ ID NO: 2992966 - protein, 24 aa, Entamoeba invadens
EERFLCPEVLFQPQLFVSGDSMVQ

SEQ ID NO: 2992967 - protein, 19 aa, Entamoeba invadens
EERGVFQCIVMLMPDLFNI

SEQ ID NO: 2992968 - protein, 24 aa, Entamoeba invadens
EERGVFQTIIFWQKDLFTTFADMA

SEQ ID NO: 2992969 - protein, 17 aa, Entamoeba invadens
EERIRVRILEKKNKTQS

SEQ ID NO: 2992970 - protein, 24 aa, Entamoeba invadens
EERKKDVRMWFTNPSGIAKNPLRD

SEQ ID NO: 2992971 - protein, 17 aa, Entamoeba invadens
EERKLIFDFLSKIFVFE

SEQ ID NO: 2992972 - protein, 24 aa, Entamoeba invadens
EERKYSFLFIKRMSKLKELIISDD

SEQ ID NO: 2992973 - protein, 25 aa, Entamoeba invadens
EERLGDILFLTSRWGALVLLDEGDA

SEQ ID NO: 2992974 - protein, 26 aa, Entamoeba invadens
EERLGDILFLTSRWGALVLLDEGDAL

SEQ ID NO: 2992975 - protein, 20 aa, Entamoeba invadens
EERLVVPDMLLVRNVPINIH

SEQ ID NO: 2992976 - protein, 25 aa, Entamoeba invadens
EERMRRMLFNFPSPLLKTYCEVFVK

SEQ ID NO: 2992977 - protein, 23 aa, Entamoeba invadens
EERNLHWLVMENTDIYCNVFSGS

SEQ ID NO: 2992978 - protein, 26 aa, Entamoeba invadens
EERQKFARMYLLNTDTIYGDISVKKL

SEQ ID NO: 2992979 - protein, 23 aa, Entamoeba invadens
EERRRALLSIKNKLPKDLRSEFV

SEQ ID NO: 2992980 - protein, 32 aa, Entamoeba invadens
EERSPTTSPITTPLKLIPLKEEPKSELDSQSC

SEQ ID NO: 2992981 - protein, 17 aa, Entamoeba invadens
EERYSFVKKFTTLETPQ

SEQ ID NO: 2992982 - protein, 29 aa, Entamoeba invadens
EESDETLLLILDRGFDPYTPFLPNIGVYG

SEQ ID NO: 2992983 - protein, 33 aa, Entamoeba invadens
EESFLLPQFVHAMFDRLFIDAPKTEGIFRVSAS

SEQ ID NO: 2992984 - protein, 24 aa, Entamoeba invadens
EESGLIFELFEFMDYPYNERTTPA

SEQ ID NO: 2992985 - protein, 22 aa, Entamoeba invadens
EESLIRFSGFPHGGACTVVLRG

SEQ ID NO: 2992986 - protein, 21 aa, Entamoeba invadens
EESLRLFTLVREATLKSKKLF

SEQ ID NO: 2992987 - protein, 28 aa, Entamoeba invadens
EESPVRFFSLLLYYHIVTSLRSLTPDLT

SEQ ID NO: 2992988 - protein, 30 aa, Entamoeba invadens
EESRLLVQNGYWNLFRYDPSKKGTGVNPLT

SEQ ID NO: 2992989 - protein, 29 aa, Entamoeba invadens
EESRLLVQNGYWNLFRYDPSKKGVGVNPL

SEQ ID NO: 2992990 - protein, 17 aa, Entamoeba invadens
EESSKLLNFIRLLSNAK

SEQ ID NO: 2992991 - protein, 24 aa, Entamoeba invadens
EESSNVFFLIYNITSDSINGIDFL

SEQ ID NO: 2992992 - protein, 20 aa, Entamoeba invadens
EESYDKIKFKFPWKIAEFVI

SEQ ID NO: 2992993 - protein, 22 aa, Entamoeba invadens
EETALFIDFIELTAKFAFEALK

SEQ ID NO: 2992994 - protein, 21 aa, Entamoeba invadens
EETCQILIANGFFSLDVIQLM

SEQ ID NO: 2992995 - protein, 26 aa, Entamoeba invadens
EETEFDANLFFDLNHDEEKLEENRQQ

SEQ ID NO: 2992996 - protein, 18 aa, Entamoeba invadens
EETFKKLNVVVNKEKRKS

SEQ ID NO: 2992997 - protein, 30 aa, Entamoeba invadens
EETIDVLSRILALVPPWVRIHRIQRDIPIP

SEQ ID NO: 2992998 - protein, 23 aa, Entamoeba invadens
EETINLLKKLCLVKINGGLGTTM

SEQ ID NO: 2992999 - protein, 25 aa, Entamoeba invadens
EETKAVFSLFTFPLGMMMRTNPVGD

SEQ ID NO: 2993000 - protein, 27 aa, Entamoeba invadens
EETKKWNCLLMKLQRRDKRPNLVREEN

SEQ ID NO: 2993001 - protein, 24 aa, Entamoeba invadens
EETKNYGLKFFKQTGSAVERCYIC

SEQ ID NO: 2993002 - protein, 17 aa, Entamoeba invadens
EETLPMSLTELRKTWTE

SEQ ID NO: 2993003 - protein, 21 aa, Entamoeba invadens
EETPLYLPQNFKQSFLDENIY

SEQ ID NO: 2993004 - protein, 21 aa, Entamoeba invadens
EETRHFVMVLFHAALTKKQDP

SEQ ID NO: 2993005 - protein, 17 aa, Entamoeba invadens
EETRQEIEELLKKVDFA

SEQ ID NO: 2993006 - protein, 26 aa, Entamoeba invadens
EETRRRFYFLVAAVLMGVDNHADVLR

SEQ ID NO: 2993007 - protein, 24 aa, Entamoeba invadens
EETRRVVLSKIFSGTAALLEKKAG

SEQ ID NO: 2993008 - protein, 26 aa, Entamoeba invadens
EETSHLPIVAIFLKDFVVLNELKTIV

SEQ ID NO: 2993009 - protein, 23 aa, Entamoeba invadens
EETSYLIELRKTLTDQLRKAEAE

SEQ ID NO: 2993010 - protein, 33 aa, Entamoeba invadens
EETVQIIVIQLLNLIHYLSLNSIVFTHLRVSNI

SEQ ID NO: 2993011 - protein, 25 aa, Entamoeba invadens
EETVRVLPLIDYRTLRNEYFCFTQR

SEQ ID NO: 2993012 - protein, 17 aa, Entamoeba invadens
EETWKIAEILSLKFDEG

SEQ ID NO: 2993013 - protein, 25 aa, Entamoeba invadens
EEVAPHVYAIAEGALTQMRDLSAQF

SEQ ID NO: 2993014 - protein, 26 aa, Entamoeba invadens
EEVDWDYFLKDPFVGALTAAPDILLG

SEQ ID NO: 2993015 - protein, 26 aa, Entamoeba invadens
EEVEFPVLYNHALISSLPLTVSGIIN

SEQ ID NO: 2993016 - protein, 24 aa, Entamoeba invadens
EEVFKLLNSPAVYPNWKAGNALKN

SEQ ID NO: 2993017 - protein, 24 aa, Entamoeba invadens
EEVFVKFFRKPYAPKGDTVREIPK

SEQ ID NO: 2993018 - protein, 25 aa, Entamoeba invadens
EEVIRIVILRYGFGITPFVSEFMNI

SEQ ID NO: 2993019 - protein, 21 aa, Entamoeba invadens
EEVKPLIVPLTKELPPDTRVI

SEQ ID NO: 2993020 - protein, 58 aa, Entamoeba invadens
EEVLRGEFKPTITLLFYIMYRYRLNDVPVRIIDFSRWFRFVLKITNPLFDLKSEFGDG

SEQ ID NO: 2993021 - protein, 24 aa, Entamoeba invadens
EEVMRQMLLLPQQISVLNASCAEM

SEQ ID NO: 2993022 - protein, 25 aa, Entamoeba invadens
EEVNPIICFYGGEPLLRPDIIYEVM

SEQ ID NO: 2993023 - protein, 21 aa, Entamoeba invadens
EEVNVFSPFYPYITHDDSSIN

SEQ ID NO: 2993024 - protein, 24 aa, Entamoeba invadens
EEVTKNMWAIKSFSLYEEERVFGV

SEQ ID NO: 2993025 - protein, 19 aa, Entamoeba invadens
EEVTRQKVSFESQNKELQT

SEQ ID NO: 2993026 - protein, 24 aa, Entamoeba invadens
EEVTWNFVMLIQQNIELQNYAVRR

SEQ ID NO: 2993027 - protein, 19 aa, Entamoeba invadens
EEVVFLNDLTYIPNFTFSN

SEQ ID NO: 2993028 - protein, 30 aa, Entamoeba invadens
EEVYEIFRVFFYKIFHNYFDFFIRNSDQKI

SEQ ID NO: 2993029 - protein, 19 aa, Entamoeba invadens
EEYALLMKRICASNTNFTM

SEQ ID NO: 2993030 - protein, 25 aa, Entamoeba invadens
EEYDDLRLVFGEFGDLFLKETAEGK

SEQ ID NO: 2993031 - protein, 37 aa, Entamoeba invadens
EEYESFRPLSYPSTDIFLLCFNVIQPSSLTNIIEKWY

SEQ ID NO: 2993032 - protein, 36 aa, Entamoeba invadens
EEYESIRPLSYPSTDIFLLCFSVVQPVSLTNVAEKW

SEQ ID NO: 2993033 - protein, 18 aa, Entamoeba invadens
EEYFDKVISTFSVMPSPT

SEQ ID NO: 2993034 - protein, 24 aa, Entamoeba invadens
EEYFRFEWELRLVFNNELTQFSEV

SEQ ID NO: 2993035 - protein, 25 aa, Entamoeba invadens
EEYGKVLYFISRFDTNIQHYCEIAD

SEQ ID NO: 2993036 - protein, 17 aa, Entamoeba invadens
EEYLREGIEWTRQNFGN

SEQ ID NO: 2993037 - protein, 31 aa, Entamoeba invadens
EEYLSEFKTNQIIQPRLRKAKNCGSGMIVTK

SEQ ID NO: 2993038 - protein, 30 aa, Entamoeba invadens
EEYMSLSKFLFHMITLYTSSLVLRNESTKK

SEQ ID NO: 2993039 - protein, 34 aa, Entamoeba invadens
EEYNSLRPLSYPQTDIFLLCFSVVYHASYVNVRD

SEQ ID NO: 2993040 - protein, 26 aa, Entamoeba invadens
EEYPAVILVVFRKYLYLCRKLQQVYR

SEQ ID NO: 2993041 - protein, 21 aa, Entamoeba invadens
EEYPPITYLNILRYEEFLLDP

SEQ ID NO: 2993042 - protein, 22 aa, Entamoeba invadens
EEYPTVFSTVFYPFNSHTSEHN

SEQ ID NO: 2993043 - protein, 27 aa, Entamoeba invadens
EEYTQLRPLSYPGTDLFIVCYSTIQSI

SEQ ID NO: 2993044 - protein, 38 aa, Entamoeba invadens
EEYTSLRPLSYPQTDIFVLCFSVIYKSSYTNVRDKWCK

SEQ ID NO: 2993045 - protein, 29 aa, Entamoeba invadens
EEYYPPQQYVPIQQYQRQPMRRQRPVYQQ

SEQ ID NO: 2993046 - protein, 30 aa, Entamoeba invadens
EFAQQIYAFDFYLLRKMTISDFLHTTMNTQ

SEQ ID NO: 2993047 - protein, 25 aa, Entamoeba invadens
EFCDGYFTVPSLPKVLPCFHVICRD

SEQ ID NO: 2993048 - protein, 35 aa, Entamoeba invadens
EFCPLRELIALKKIYGFYLYIDEAHSIGALGATGR

SEQ ID NO: 2993049 - protein, 19 aa, Entamoeba invadens
EFCSKCELNYFLYDENMPQ

SEQ ID NO: 2993050 - protein, 23 aa, Entamoeba invadens
EFCSKFTTFILMESVAINTEMFS

SEQ ID NO: 2993051 - protein, 26 aa, Entamoeba invadens
EFDAESFVRRLLGMGDLKGINKLAKD

SEQ ID NO: 2993052 - protein, 18 aa, Entamoeba invadens
EFDFIEFPSKLFENFCFE

SEQ ID NO: 2993053 - protein, 18 aa, Entamoeba invadens
EFDIIHYAGDVTYDGIDW

SEQ ID NO: 2993054 - protein, 17 aa, Entamoeba invadens
EFDPSIQLETSVKPKLV

SEQ ID NO: 2993055 - protein, 25 aa, Entamoeba invadens
EFDQLQQNFDYLKKNADTDAADKEK

SEQ ID NO: 2993056 - protein, 26 aa, Entamoeba invadens
EFDRIRPLSYKDTDVFILCFAVDNDR

SEQ ID NO: 2993057 - protein, 21 aa, Entamoeba invadens
EFDVIPKIVFKCPLVKLYLDS

SEQ ID NO: 2993058 - protein, 33 aa, Entamoeba invadens
EFDVWPLEVFCESLLLLLSALSKPVGYFGYTEN

SEQ ID NO: 2993059 - protein, 28 aa, Entamoeba invadens
EFEEWTLYEGIIWMIHSTVSSLELCTRS

SEQ ID NO: 2993060 - protein, 25 aa, Entamoeba invadens
EFEGMMYRLQLWDTAGQERFRTIVT

SEQ ID NO: 2993061 - protein, 17 aa, Entamoeba invadens
EFEIFITPLCSCQINDK

SEQ ID NO: 2993062 - protein, 17 aa, Entamoeba invadens
EFEIFITPLCSCYINDK

SEQ ID NO: 2993063 - protein, 20 aa, Entamoeba invadens
EFEIFLTPYCTMQLIDEIII

SEQ ID NO: 2993064 - protein, 19 aa, Entamoeba invadens
EFEIFVTPLCTCSISETIA

SEQ ID NO: 2993065 - protein, 21 aa, Entamoeba invadens
EFELLREFPFTFGNCVFKPIN

SEQ ID NO: 2993066 - protein, 18 aa, Entamoeba invadens
EFELPDGTILRLGIVRFE

SEQ ID NO: 2993067 - protein, 17 aa, Entamoeba invadens
EFELPNITNPLFGGAVS

SEQ ID NO: 2993068 - protein, 34 aa, Entamoeba invadens
EFEMLMKSIADINYPTGFYLYQNKEKISFTEIQV

SEQ ID NO: 2993069 - protein, 26 aa, Entamoeba invadens
EFEPEKILFLLVESFLKTLDGNKPQR

SEQ ID NO: 2993070 - protein, 27 aa, Entamoeba invadens
EFEPQTKLLFVMINDGKYKSKAYLDCT

SEQ ID NO: 2993071 - protein, 22 aa, Entamoeba invadens
EFETILEKILYLSNDFVYVLEN

SEQ ID NO: 2993072 - protein, 19 aa, Entamoeba invadens
EFEYSVPIVILDKKNITFS

SEQ ID NO: 2993073 - protein, 17 aa, Entamoeba invadens
EFFDLRDAAKAEAALNH

SEQ ID NO: 2993074 - protein, 17 aa, Entamoeba invadens
EFFERYRWIMHDVVLIT

SEQ ID NO: 2993075 - protein, 22 aa, Entamoeba invadens
EFFMSELRIPENLFLESRTCSL

SEQ ID NO: 2993076 - protein, 20 aa, Entamoeba invadens
EFFVTHLIRRHPHSKGFISL

SEQ ID NO: 2993077 - protein, 20 aa, Entamoeba invadens
EFGDLWRRLTSAEATKDIIL

SEQ ID NO: 2993078 - protein, 20 aa, Entamoeba invadens
EFGFKCIFILVRGSVTQANK

SEQ ID NO: 2993079 - protein, 24 aa, Entamoeba invadens
EFGGKPMRILKAEGFKMKCFICGQ

SEQ ID NO: 2993080 - protein, 18 aa, Entamoeba invadens
EFGKIKLVVLDKDGHQDP

SEQ ID NO: 2993081 - protein, 17 aa, Entamoeba invadens
EFGVYRYKWENWNVYDE

SEQ ID NO: 2993082 - protein, 17 aa, Entamoeba invadens
EFGYVWDPQLCWQDERF

SEQ ID NO: 2993083 - protein, 18 aa, Entamoeba invadens
EFHIYQQLFMLFEKAMTQ

SEQ ID NO: 2993084 - protein, 24 aa, Entamoeba invadens
EFHNLKLVYRRYVGLYFICGVDES

SEQ ID NO: 2993085 - protein, 17 aa, Entamoeba invadens
EFHYHMTFAIWDNFIVR

SEQ ID NO: 2993086 - protein, 19 aa, Entamoeba invadens
EFIAFKQSLFAKKDEFLLS

SEQ ID NO: 2993087 - protein, 27 aa, Entamoeba invadens
EFIAKAYYQSFGLPLIITRGNNVYGPH

SEQ ID NO: 2993088 - protein, 24 aa, Entamoeba invadens
EFIAQFCNFFFERGRFMVVMDLMD

SEQ ID NO: 2993089 - protein, 26 aa, Entamoeba invadens
EFIDFKFKYRRGLPMKLKGINAKIES

SEQ ID NO: 2993090 - protein, 25 aa, Entamoeba invadens
EFIEEGFFIHGLWPQFNSKTSLKCC

SEQ ID NO: 2993091 - protein, 17 aa, Entamoeba invadens
EFIENICKEARMNCITP

SEQ ID NO: 2993092 - protein, 22 aa, Entamoeba invadens
EFIIEERIIGEPILSVEFIGKT

SEQ ID NO: 2993093 - protein, 21 aa, Entamoeba invadens
EFINMMQAQGFPKLIGCLTHM

SEQ ID NO: 2993094 - protein, 27 aa, Entamoeba invadens
EFINSCPRDWLLCQTHFVENAEKLDCC

SEQ ID NO: 2993095 - protein, 17 aa, Entamoeba invadens
EFIPCKECPYKKSIGSV

SEQ ID NO: 2993096 - protein, 18 aa, Entamoeba invadens
EFISLLNLPINQSLVISK

SEQ ID NO: 2993097 - protein, 20 aa, Entamoeba invadens
EFKDISRSPLVSCFQQNREY

SEQ ID NO: 2993098 - protein, 35 aa, Entamoeba invadens
EFKDVFINTITLYFPTHTILQRLFKKKGKKLNKNS

SEQ ID NO: 2993099 - protein, 25 aa, Entamoeba invadens
EFKELIPQIVMLFKNVIRSNGQEDF

SEQ ID NO: 2993100 - protein, 26 aa, Entamoeba invadens
EFKERKWVDVYWLKAKIFGGVCSLEA

SEQ ID NO: 2993101 - protein, 30 aa, Entamoeba invadens
EFKESTKDWLLPYCIYRTLIKSVDTPLPPT

SEQ ID NO: 2993102 - protein, 26 aa, Entamoeba invadens
EFKGEKKNRLCPEKYLYMFETHIEQG

SEQ ID NO: 2993103 - protein, 24 aa, Entamoeba invadens
EFKKELLSFILYHSISMKFSTMSV

SEQ ID NO: 2993104 - protein, 18 aa, Entamoeba invadens
EFKKTMALQLEKLKTHFV

SEQ ID NO: 2993105 - protein, 28 aa, Entamoeba invadens
EFKLSHKWRYILFKLNDKMTEIVVDKTA

SEQ ID NO: 2993106 - protein, 17 aa, Entamoeba invadens
EFKNMLLRKILNGERTC

SEQ ID NO: 2993107 - protein, 19 aa, Entamoeba invadens
EFKNRFEPILIVTQKLVAE

SEQ ID NO: 2993108 - protein, 25 aa, Entamoeba invadens
EFKRNLVLRLWDAFFAFPDERLFMF

SEQ ID NO: 2993109 - protein, 18 aa, Entamoeba invadens
EFKYPWKIADFVNNGNRL

SEQ ID NO: 2993110 - protein, 24 aa, Entamoeba invadens
EFLANFVVDLFGPKAAVDFMEANE

SEQ ID NO: 2993111 - protein, 17 aa, Entamoeba invadens
EFLDARRSVPKWSKIEK

SEQ ID NO: 2993112 - protein, 25 aa, Entamoeba invadens
EFLDSDYVVFVFSLSDEMTFRHAQE

SEQ ID NO: 2993113 - protein, 20 aa, Entamoeba invadens
EFLENLFVKSLIDYETYVKQ

SEQ ID NO: 2993114 - protein, 26 aa, Entamoeba invadens
EFLGDIDLLLRLYQTQFDFYSQCNDL

SEQ ID NO: 2993115 - protein, 23 aa, Entamoeba invadens
EFLGYLLGIVESEGLRIIDDNTK

SEQ ID NO: 2993116 - protein, 28 aa, Entamoeba invadens
EFLKVRKYIHLFLLKKMGKVQDLNLKAR

SEQ ID NO: 2993117 - protein, 19 aa, Entamoeba invadens
EFLLNCGVLTKVVRLFTMS

SEQ ID NO: 2993118 - protein, 20 aa, Entamoeba invadens
EFLQPIIPLKLLYTKNEHAL

SEQ ID NO: 2993119 - protein, 26 aa, Entamoeba invadens
EFLQTTFAPCMQKFNKEFPAYRKLEL

SEQ ID NO: 2993120 - protein, 18 aa, Entamoeba invadens
EFLSHLLPMWSDDLLYKD

SEQ ID NO: 2993121 - protein, 24 aa, Entamoeba invadens
EFLSKLVMFLKERFDVLKKSKSFE

SEQ ID NO: 2993122 - protein, 21 aa, Entamoeba invadens
EFLSVFTITFLEENTPFTFEV

SEQ ID NO: 2993123 - protein, 18 aa, Entamoeba invadens
EFLVSLLSAMLPSLNEII

SEQ ID NO: 2993124 - protein, 17 aa, Entamoeba invadens
EFMMDASPLLALLEVPN

SEQ ID NO: 2993125 - protein, 23 aa, Entamoeba invadens
EFMNCMVTYLKNYGRILMKSKTV

SEQ ID NO: 2993126 - protein, 20 aa, Entamoeba invadens
EFMNLGMFTFFVLNTSTQKD

SEQ ID NO: 2993127 - protein, 31 aa, Entamoeba invadens
EFNFKLFKSLQRVKLIFWATTSKSSMESMVE

SEQ ID NO: 2993128 - protein, 17 aa, Entamoeba invadens
EFNGMKIWCFNAGHILG

SEQ ID NO: 2993129 - protein, 19 aa, Entamoeba invadens
EFNKSYTLFKPITDSYITK

SEQ ID NO: 2993130 - protein, 40 aa, Entamoeba invadens
EFNKVHITLGNTYLKFVRINQIVIVLSGLTPYELIEYQTA

SEQ ID NO: 2993131 - protein, 19 aa, Entamoeba invadens
EFNLLELRPSFEFDKQFNI

SEQ ID NO: 2993132 - protein, 18 aa, Entamoeba invadens
EFNSLLADLRTKLKESQD

SEQ ID NO: 2993133 - protein, 19 aa, Entamoeba invadens
EFPIIPPRVETPKLIEEEV

SEQ ID NO: 2993134 - protein, 22 aa, Entamoeba invadens
EFPVELVEILKKCKLPSNAKVT

SEQ ID NO: 2993135 - protein, 28 aa, Entamoeba invadens
EFQAELDFFSFYVPLIKIANFKKINTNE

SEQ ID NO: 2993136 - protein, 17 aa, Entamoeba invadens
EFQFQFDLPLQASGVFQ

SEQ ID NO: 2993137 - protein, 26 aa, Entamoeba invadens
EFQITSLPTFVFFQDQKVVKKAPGIP

SEQ ID NO: 2993138 - protein, 36 aa, Entamoeba invadens
EFRCGITKALLYKFHPFFKYLYPTIVTGLQNLIHML

SEQ ID NO: 2993139 - protein, 17 aa, Entamoeba invadens
EFRCQFSFLKFGDETYS

SEQ ID NO: 2993140 - protein, 21 aa, Entamoeba invadens
EFREKYFDVLSRYIDFIKDKK

SEQ ID NO: 2993141 - protein, 19 aa, Entamoeba invadens
EFREVFVNTISLFFSPDNV

SEQ ID NO: 2993142 - protein, 19 aa, Entamoeba invadens
EFRIFDYNTIGSDDFLGNC

SEQ ID NO: 2993143 - protein, 24 aa, Entamoeba invadens
EFRLGMVEFYKFGPLNSKAQAIVE

SEQ ID NO: 2993144 - protein, 18 aa, Entamoeba invadens
EFRMFSTQSKEMLWKCEL

SEQ ID NO: 2993145 - protein, 27 aa, Entamoeba invadens
EFRQTNWVNLIQFLETLRFDEYCAERS

SEQ ID NO: 2993146 - protein, 19 aa, Entamoeba invadens
EFRVIPPKFPADIEAIFVK

SEQ ID NO: 2993147 - protein, 24 aa, Entamoeba invadens
EFSAKLFRFKSAIESQERQLELLF

SEQ ID NO: 2993148 - protein, 26 aa, Entamoeba invadens
EFSGGWRMRISIAKAIYMKPDLLLLD

SEQ ID NO: 2993149 - protein, 25 aa, Entamoeba invadens
EFSIKVILRLWDSFLAFENGLGFST

SEQ ID NO: 2993150 - protein, 26 aa, Entamoeba invadens
EFSKQMKFLLQRLNTLTTLQLSDNPL

SEQ ID NO: 2993151 - protein, 18 aa, Entamoeba invadens
EFSLFLNPLCTSTIDSTF

SEQ ID NO: 2993152 - protein, 29 aa, Entamoeba invadens
EFSQLYGESFLYYTLSNLVLHNFTINKIK

SEQ ID NO: 2993153 - protein, 21 aa, Entamoeba invadens
EFSYAVRPEQVFDVFRAVKSH

SEQ ID NO: 2993154 - protein, 19 aa, Entamoeba invadens
EFTGFFYITVTFENYRTEK

SEQ ID NO: 2993155 - protein, 23 aa, Entamoeba invadens
EFTNLEFLSQRFSLEEVKQFLKW

SEQ ID NO: 2993156 - protein, 18 aa, Entamoeba invadens
EFTPLLKIGDQVSGGDII

SEQ ID NO: 2993157 - protein, 27 aa, Entamoeba invadens
EFTTFELVPPLQKLVLREATRLLNLLM

SEQ ID NO: 2993158 - protein, 20 aa, Entamoeba invadens
EFTVLNNFWTKQHVFIKEWS

SEQ ID NO: 2993159 - protein, 19 aa, Entamoeba invadens
EFTYALHQLTLKRVFVVLK

SEQ ID NO: 2993160 - protein, 27 aa, Entamoeba invadens
EFVDDKNAFLFSLRSNGRLGSPMKFDM

SEQ ID NO: 2993161 - protein, 25 aa, Entamoeba invadens
EFVHLHSLFKATPLRHRPYDVVIVD

SEQ ID NO: 2993162 - protein, 23 aa, Entamoeba invadens
EFVHPSFQRIQYLCGFTGENVSI

SEQ ID NO: 2993163 - protein, 18 aa, Entamoeba invadens
EFVKIWQKVDVEDALGLL

SEQ ID NO: 2993164 - protein, 27 aa, Entamoeba invadens
EFVKYTPMITQNPLPCFFQISELFAMD

SEQ ID NO: 2993165 - protein, 24 aa, Entamoeba invadens
EFVLPSEIEECVLWGCLSLTSVTL

SEQ ID NO: 2993166 - protein, 23 aa, Entamoeba invadens
EFVQLFYDNIPRSSPTNITGSVN

SEQ ID NO: 2993167 - protein, 24 aa, Entamoeba invadens
EFWRQSGCTPPRQPFQRIEAEMRQ

SEQ ID NO: 2993168 - protein, 19 aa, Entamoeba invadens
EFYEIIVWFEVDYGTVVKN

SEQ ID NO: 2993169 - protein, 20 aa, Entamoeba invadens
EFYHQFILSKSNDSTWYIIS

SEQ ID NO: 2993170 - protein, 20 aa, Entamoeba invadens
EFYNLVGLMLLVFDNTKDST

SEQ ID NO: 2993171 - protein, 21 aa, Entamoeba invadens
EFYQVFMRRCAIYKDSMNCLN

SEQ ID NO: 2993172 - protein, 29 aa, Entamoeba invadens
EGADLLIEKKFIKEFPQDLLDESINTAIN

SEQ ID NO: 2993173 - protein, 24 aa, Entamoeba invadens
EGADPTLLKTLNGTFDKMVVERQG

SEQ ID NO: 2993174 - protein, 26 aa, Entamoeba invadens
EGAGQGTIWFMQREVTEKKKFMPVRK

SEQ ID NO: 2993175 - protein, 25 aa, Entamoeba invadens
EGALPLVHQLIISPSLHKVVPEYFW

SEQ ID NO: 2993176 - protein, 22 aa, Entamoeba invadens
EGAVFVIWFKRVQVRNGEMYKD

SEQ ID NO: 2993177 - protein, 24 aa, Entamoeba invadens
EGCIDWLCNKGFIPKLITTLMGTQ

SEQ ID NO: 2993178 - protein, 27 aa, Entamoeba invadens
EGCLSLTSIILPKALRTIGYKAFYNCS

SEQ ID NO: 2993179 - protein, 26 aa, Entamoeba invadens
EGCLVPFKVILIVTIKHINEVSGVVS

SEQ ID NO: 2993180 - protein, 26 aa, Entamoeba invadens
EGCNYFYVKTLLQFYSSRGKLTDLLI

SEQ ID NO: 2993181 - protein, 18 aa, Entamoeba invadens
EGCSWGFLCDNIQNWRSK

SEQ ID NO: 2993182 - protein, 18 aa, Entamoeba invadens
EGCVLCDTGYLLVQQNGV

SEQ ID NO: 2993183 - protein, 19 aa, Entamoeba invadens
EGCWLYRNQVFIGMEYCSL

SEQ ID NO: 2993184 - protein, 24 aa, Entamoeba invadens
EGDAKSWVEWILRSLNHVKLSVQQ

SEQ ID NO: 2993185 - protein, 32 aa, Entamoeba invadens
EGDCKYYEDVILLILIIEKLTNHMDIHFMQRV

SEQ ID NO: 2993186 - protein, 31 aa, Entamoeba invadens
EGDDDGMILAVRWAFYIREKSGSISPSFTSV

SEQ ID NO: 2993187 - protein, 23 aa, Entamoeba invadens
EGDEIIIPPDFPKSVPIGSQITP

SEQ ID NO: 2993188 - protein, 22 aa, Entamoeba invadens
EGDIIKLLDFLEKNELWDIFLD

SEQ ID NO: 2993189 - protein, 17 aa, Entamoeba invadens
EGDIYIHPLVQSCTWDT

SEQ ID NO: 2993190 - protein, 27 aa, Entamoeba invadens
EGDKIQKFGFNLFYKCFSLKEIAIPPL

SEQ ID NO: 2993191 - protein, 28 aa, Entamoeba invadens
EGDKSIYLHDFYLMPELKGKGLGSILMG

SEQ ID NO: 2993192 - protein, 25 aa, Entamoeba invadens
EGDRHKGFCLLTYKNPKSCVLAVDN

SEQ ID NO: 2993193 - protein, 18 aa, Entamoeba invadens
EGDTNHFAFVFSTSKVGA

SEQ ID NO: 2993194 - protein, 21 aa, Entamoeba invadens
EGDWWMGELNGVQGYFPSNYV

SEQ ID NO: 2993195 - protein, 18 aa, Entamoeba invadens
EGDYLIAVYINDKQMNQV

SEQ ID NO: 2993196 - protein, 29 aa, Entamoeba invadens
EGEDYCGVKVFRFYFKCTNCKNVFTIKTD

SEQ ID NO: 2993197 - protein, 24 aa, Entamoeba invadens
EGEEMKFGIPVLFIGTHADIAQKE

SEQ ID NO: 2993198 - protein, 22 aa, Entamoeba invadens
EGEFLYGSLYISVSNKRCECQG

SEQ ID NO: 2993199 - protein, 31 aa, Entamoeba invadens
EGELKNIFWEFGDVKNVIFVKNKKGKRVNYC

SEQ ID NO: 2993200 - protein, 39 aa, Entamoeba invadens
EGELKSYLNLHLVPFSIPTFIFPLQEFPRTSFGKLYAPK

SEQ ID NO: 2993201 - protein, 30 aa, Entamoeba invadens
EGERPKLLFELFTPLFQYKDLAVTLAGVRS

SEQ ID NO: 2993202 - protein, 19 aa, Entamoeba invadens
EGFIPQEYVEMARTSNIAI

SEQ ID NO: 2993203 - protein, 20 aa, Entamoeba invadens
EGFKIFFLHKVVNACRTVIK

SEQ ID NO: 2993204 - protein, 24 aa, Entamoeba invadens
EGFKLHYFMQNIDLPPCITVFSAP

SEQ ID NO: 2993205 - protein, 27 aa, Entamoeba invadens
EGFKNRMYFVYPNGTYLYYDKKHLYTM

SEQ ID NO: 2993206 - protein, 26 aa, Entamoeba invadens
EGFKQRLPRFVQMLMILSRRPNKNTE

SEQ ID NO: 2993207 - protein, 25 aa, Entamoeba invadens
EGFPEPMMELLRKYVLGGIVHPLPS

SEQ ID NO: 2993208 - protein, 17 aa, Entamoeba invadens
EGFQIDDKKMKVKVRAP

SEQ ID NO: 2993209 - protein, 17 aa, Entamoeba invadens
EGFTMKRCGLRTSVAGN

SEQ ID NO: 2993210 - protein, 22 aa, Entamoeba invadens
EGFTVFSDYLKACGVKVRPTKT

SEQ ID NO: 2993211 - protein, 18 aa, Entamoeba invadens
EGFVPRSFVKIQKFVKPY

SEQ ID NO: 2993212 - protein, 24 aa, Entamoeba invadens
EGGIYLFTIFYKEGKLFRSLFSQD

SEQ ID NO: 2993213 - protein, 37 aa, Entamoeba invadens
EGGLEKSMFERLLLNKVPYVLLNTQYLMHPAISKFSN

SEQ ID NO: 2993214 - protein, 35 aa, Entamoeba invadens
EGGNDWNLLFKKRHCFCGYYIFVEFSVRGSLESLE

SEQ ID NO: 2993215 - protein, 20 aa, Entamoeba invadens
EGHENVLLGMLLSKVMRNGR

SEQ ID NO: 2993216 - protein, 21 aa, Entamoeba invadens
EGHLCIVFELLSLNLYDVLNQ

SEQ ID NO: 2993217 - protein, 22 aa, Entamoeba invadens
EGHLCIVFELLSLNLYDVLNQN

SEQ ID NO: 2993218 - protein, 20 aa, Entamoeba invadens
EGHTLIATKLNLITRAEENH

SEQ ID NO: 2993219 - protein, 22 aa, Entamoeba invadens
EGHVPYRNSKLTELLQPCLGDE

SEQ ID NO: 2993220 - protein, 21 aa, Entamoeba invadens
EGIFRVSPVFEWLKRVKEQLD

SEQ ID NO: 2993221 - protein, 27 aa, Entamoeba invadens
EGIGTVFTKLSYFLKMYSNYINRTDEI

SEQ ID NO: 2993222 - protein, 20 aa, Entamoeba invadens
EGIHYLEDMLLFKGFKMEND

SEQ ID NO: 2993223 - protein, 18 aa, Entamoeba invadens
EGILLRFSELVATELRNE

SEQ ID NO: 2993224 - protein, 22 aa, Entamoeba invadens
EGIPLYHTIPVDLTTKMTECIM

SEQ ID NO: 2993225 - protein, 22 aa, Entamoeba invadens
EGIQEILKCRYDYVVDAIDSVS

SEQ ID NO: 2993226 - protein, 20 aa, Entamoeba invadens
EGITWRDPYPKENFKFAWCI

SEQ ID NO: 2993227 - protein, 21 aa, Entamoeba invadens
EGKALLMKYLGGIDAVPVCMD

SEQ ID NO: 2993228 - protein, 22 aa, Entamoeba invadens
EGKDTMALSFYKKAIDITPKMA

SEQ ID NO: 2993229 - protein, 17 aa, Entamoeba invadens
EGKDVFMYAWRIKDMTE

SEQ ID NO: 2993230 - protein, 22 aa, Entamoeba invadens
EGKIPPVVSLLTTVSRYAVVDW

SEQ ID NO: 2993231 - protein, 29 aa, Entamoeba invadens
EGKKDIAELILLIVKFRVPRNNISLYDIH

SEQ ID NO: 2993232 - protein, 24 aa, Entamoeba invadens
EGKKRDIVLVDVTPLTLGIETMGG

SEQ ID NO: 2993233 - protein, 24 aa, Entamoeba invadens
EGKKYTLNFLVDFSMKDPLNVQKN

SEQ ID NO: 2993234 - protein, 25 aa, Entamoeba invadens
EGKMLFLVETLLTDSFIKWNSNNGD

SEQ ID NO: 2993235 - protein, 24 aa, Entamoeba invadens
EGKMLKAMGKFWHPECFVCSMCGG

SEQ ID NO: 2993236 - protein, 20 aa, Entamoeba invadens
EGKRNWLRQQNLDEIFDEAE

SEQ ID NO: 2993237 - protein, 30 aa, Entamoeba invadens
EGKRRKPVVGCFFELLVLKTQGVIDLEQQT

SEQ ID NO: 2993238 - protein, 26 aa, Entamoeba invadens
EGKRTNELYYTQFLGKFFNGMVKAFE

SEQ ID NO: 2993239 - protein, 23 aa, Entamoeba invadens
EGKSLMEAFWLFTEQIQLPEAVS

SEQ ID NO: 2993240 - protein, 23 aa, Entamoeba invadens
EGKTYFVKWVGLQYGECSWESEG

SEQ ID NO: 2993241 - protein, 28 aa, Entamoeba invadens
EGKVITKIMNWMLKCLICHEEIFDLSKK

SEQ ID NO: 2993242 - protein, 24 aa, Entamoeba invadens
EGKVKNFMWQKINDKQLKGSVFEK

SEQ ID NO: 2993243 - protein, 20 aa, Entamoeba invadens
EGKWLAELGEVFFQQINLKK

SEQ ID NO: 2993244 - protein, 17 aa, Entamoeba invadens
EGKYFISYTLPSVKGDY

SEQ ID NO: 2993245 - protein, 29 aa, Entamoeba invadens
EGLEKEPEIFLVKVFIKWFCKKSRLNDYN

SEQ ID NO: 2993246 - protein, 29 aa, Entamoeba invadens
EGLERLMKILKLVGFKVAILSGGFTYFGN

SEQ ID NO: 2993247 - protein, 19 aa, Entamoeba invadens
EGLGRVLSFPPHKDDFFCE

SEQ ID NO: 2993248 - protein, 25 aa, Entamoeba invadens
EGLIDLVYRYPNCINILIIRIEQFI

SEQ ID NO: 2993249 - protein, 22 aa, Entamoeba invadens
EGLKQYVPCLPYVCERKRDGEE

SEQ ID NO: 2993250 - protein, 25 aa, Entamoeba invadens
EGLKSVTFPPFISSVGLFAFEECYS

SEQ ID NO: 2993251 - protein, 18 aa, Entamoeba invadens
EGLTFPEISQRLSRFEYF

SEQ ID NO: 2993252 - protein, 21 aa, Entamoeba invadens
EGLVLNAMIYLLAQEGFSVNV

SEQ ID NO: 2993253 - protein, 31 aa, Entamoeba invadens
EGLVYKVRLPLFTQYLYVQNNTLRSLAAETI

SEQ ID NO: 2993254 - protein, 18 aa, Entamoeba invadens
EGLYLENLANFLEREFSH

SEQ ID NO: 2993255 - protein, 26 aa, Entamoeba invadens
EGNEKIPLVTFIMHYTQADMFGDYLK

SEQ ID NO: 2993256 - protein, 17 aa, Entamoeba invadens
EGNMWYQIKNKETTETI

SEQ ID NO: 2993257 - protein, 26 aa, Entamoeba invadens
EGNNLTPKLFWSLTKKLKNMMIVVET

SEQ ID NO: 2993258 - protein, 22 aa, Entamoeba invadens
EGNVFRFFDIEKRSLIKIEGST

SEQ ID NO: 2993259 - protein, 17 aa, Entamoeba invadens
EGQDLMVEWHLQKGKEK

SEQ ID NO: 2993260 - protein, 17 aa, Entamoeba invadens
EGQLYEALLNLHTECKL

SEQ ID NO: 2993261 - protein, 24 aa, Entamoeba invadens
EGQNLLKTLAIPRLTRVGCSKETL

SEQ ID NO: 2993262 - protein, 17 aa, Entamoeba invadens
EGQNLYEWLSVNGFDFL

SEQ ID NO: 2993263 - protein, 24 aa, Entamoeba invadens
EGQYFIMFDVLLKYISVFENMAKK

SEQ ID NO: 2993264 - protein, 23 aa, Entamoeba invadens
EGQYGIPKGIFFSMPVICYGGEY

SEQ ID NO: 2993265 - protein, 17 aa, Entamoeba invadens
EGREYVVMLLSEFKYKE

SEQ ID NO: 2993266 - protein, 20 aa, Entamoeba invadens
EGRINCLEKNEAQFVFYAHC

SEQ ID NO: 2993267 - protein, 24 aa, Entamoeba invadens
EGRKKKSFGIFRKSRKDDFDLSSS

SEQ ID NO: 2993268 - protein, 20 aa, Entamoeba invadens
EGRKLGRLPTFIVVANKIDC

SEQ ID NO: 2993269 - protein, 20 aa, Entamoeba invadens
EGRLYQVEYALKSVKCENLT

SEQ ID NO: 2993270 - protein, 21 aa, Entamoeba invadens
EGRQGWTLSFIPVSERVENVT

SEQ ID NO: 2993271 - protein, 34 aa, Entamoeba invadens
EGRVFYQLPLVIESMLIYLYNKGCTTHGLFRETS

SEQ ID NO: 2993272 - protein, 24 aa, Entamoeba invadens
EGRYITTPYLDLVSPFCVHTVLGK

SEQ ID NO: 2993273 - protein, 17 aa, Entamoeba invadens
EGSDIVLKIIFSNQIFT

SEQ ID NO: 2993274 - protein, 25 aa, Entamoeba invadens
EGSFAVVYLGLFRGNAVAVKKMKDI

SEQ ID NO: 2993275 - protein, 19 aa, Entamoeba invadens
EGSFGIVYKGSFRGNCVAI

SEQ ID NO: 2993276 - protein, 19 aa, Entamoeba invadens
EGSFGIVYKGSFRGNIVAI

SEQ ID NO: 2993277 - protein, 20 aa, Entamoeba invadens
EGSFGIVYKGSFRGNIVAIK

SEQ ID NO: 2993278 - protein, 20 aa, Entamoeba invadens
EGSFGIVYLGSYRGNTVAIK

SEQ ID NO: 2993279 - protein, 20 aa, Entamoeba invadens
EGSFGIVYLGTFRGNVVCIK

SEQ ID NO: 2993280 - protein, 34 aa, Entamoeba invadens
EGTAFSSFTDCEGFIACLMKLYNDTEIDSLLCKL

SEQ ID NO: 2993281 - protein, 30 aa, Entamoeba invadens
EGTKLSFFSWNCWNGHIPALFVNKATKTMM

SEQ ID NO: 2993282 - protein, 29 aa, Entamoeba invadens
EGTKLSFFSWNSWNGWIPNWVVNKCSKYM

SEQ ID NO: 2993283 - protein, 25 aa, Entamoeba invadens
EGTKRMSEIAGYIRDMAFILGSEDN

SEQ ID NO: 2993284 - protein, 17 aa, Entamoeba invadens
EGTLLTDCYLKYLQVIG

SEQ ID NO: 2993285 - protein, 29 aa, Entamoeba invadens
EGTLNYEKILKHAFYWFVPDDEEKMSLSR

SEQ ID NO: 2993286 - protein, 22 aa, Entamoeba invadens
EGTYHYRMAFLPPEDQVQKVAD

SEQ ID NO: 2993287 - protein, 17 aa, Entamoeba invadens
EGVDVFGRRVTDYIISQ

SEQ ID NO: 2993288 - protein, 18 aa, Entamoeba invadens
EGVDWIIFPCTGAYSISL

SEQ ID NO: 2993289 - protein, 28 aa, Entamoeba invadens
EGVEHELCYGCLPLEFLKKEEYLNLMMT

SEQ ID NO: 2993290 - protein, 28 aa, Entamoeba invadens
EGVFNLFRPNLNLERLLRTSTRLGLPTF

SEQ ID NO: 2993291 - protein, 37 aa, Entamoeba invadens
EGVLTHPWLCGHSVYTNPYFQPLLIEMKSGISALEED

SEQ ID NO: 2993292 - protein, 19 aa, Entamoeba invadens
EGVNWLTYAFSKNVNVILA

SEQ ID NO: 2993293 - protein, 26 aa, Entamoeba invadens
EGVPPYIDDPPLRALFKISTKGIPPV

SEQ ID NO: 2993294 - protein, 28 aa, Entamoeba invadens
EGVQQGVLIALLNSIGFSFEFRRPERYA

SEQ ID NO: 2993295 - protein, 20 aa, Entamoeba invadens
EGVQYWEEYTYKKMVTFRKE

SEQ ID NO: 2993296 - protein, 26 aa, Entamoeba invadens
EGVTLDLLCKVLTSLLIPIQSKEFEQ

SEQ ID NO: 2993297 - protein, 19 aa, Entamoeba invadens
EGVYNRRFDVPHKPEDAIL

SEQ ID NO: 2993298 - protein, 24 aa, Entamoeba invadens
EGWEKLINGIFYSAFQKLKVIVFP

SEQ ID NO: 2993299 - protein, 17 aa, Entamoeba invadens
EGWYVIVLRPDGSLAAL

SEQ ID NO: 2993300 - protein, 20 aa, Entamoeba invadens
EGYCGALYAAMQIAGPEKEE

SEQ ID NO: 2993301 - protein, 24 aa, Entamoeba invadens
EGYHYVYYEDDPVYGWTVYNVVLS

SEQ ID NO: 2993302 - protein, 26 aa, Entamoeba invadens
EGYNMLLPVVLVLLKSVKPSSNKTTY

SEQ ID NO: 2993303 - protein, 25 aa, Entamoeba invadens
EGYPPYMEDPPLRALFQISTKGVPP

SEQ ID NO: 2993304 - protein, 37 aa, Entamoeba invadens
EGYVIKRWVLRYVIVKHNFLIYFVSEKEFSKLTLPTV

SEQ ID NO: 2993305 - protein, 24 aa, Entamoeba invadens
EHAKILSLVQIIFSDKPYAFIRSA

SEQ ID NO: 2993306 - protein, 21 aa, Entamoeba invadens
EHDHRELLSRFKINFAKELEM

SEQ ID NO: 2993307 - protein, 32 aa, Entamoeba invadens
EHDITLLQFVCKKFMTLYKTLMANPVLSAKKS

SEQ ID NO: 2993308 - protein, 24 aa, Entamoeba invadens
EHDYITAASYFYEAFENYHSLNIR

SEQ ID NO: 2993309 - protein, 26 aa, Entamoeba invadens
EHEMLLRYKKLLPQVDDILYSGKANS

SEQ ID NO: 2993310 - protein, 19 aa, Entamoeba invadens
EHEQNFLQQFYAKYAPKKS

SEQ ID NO: 2993311 - protein, 25 aa, Entamoeba invadens
EHEVCYIFVLGYGRVAFNCGGLGEL

SEQ ID NO: 2993312 - protein, 18 aa, Entamoeba invadens
EHEYEYVYILRYSTPYPH

SEQ ID NO: 2993313 - protein, 18 aa, Entamoeba invadens
EHFIIDVGSCIIKAGFES

SEQ ID NO: 2993314 - protein, 18 aa, Entamoeba invadens
EHFIVLFNKLTTVFNNLF

SEQ ID NO: 2993315 - protein, 22 aa, Entamoeba invadens
EHFNLLFSKFLNYSKKVSDVFL

SEQ ID NO: 2993316 - protein, 27 aa, Entamoeba invadens
EHGAVCFCHWFQPLTSKSAKKFDCFLN

SEQ ID NO: 2993317 - protein, 17 aa, Entamoeba invadens
EHGEGFKIFFLHKVVNA

SEQ ID NO: 2993318 - protein, 25 aa, Entamoeba invadens
EHGNKWTLFSQHFIGRTPNSLKNRF

SEQ ID NO: 2993319 - protein, 23 aa, Entamoeba invadens
EHHKTIVRLLQPGIIKDVFETIE

SEQ ID NO: 2993320 - protein, 26 aa, Entamoeba invadens
EHIEGGLTFFQLFRGLMKYSRVVPKV

SEQ ID NO: 2993321 - protein, 24 aa, Entamoeba invadens
EHKEEVVPPVESPKAEPVEEKNEE

SEQ ID NO: 2993322 - protein, 40 aa, Entamoeba invadens
EHKERGIVALTPRNHLFDGWSFLTKIQIVKKLAEGCGGTI

SEQ ID NO: 2993323 - protein, 22 aa, Entamoeba invadens
EHKNFFGIFDGYSGVQAAFETK

SEQ ID NO: 2993324 - protein, 35 aa, Entamoeba invadens
EHKSELEIVIPTYKSLMSKKQALKPYVLCKECKQL

SEQ ID NO: 2993325 - protein, 17 aa, Entamoeba invadens
EHKVNMSAPWEMRYSLP

SEQ ID NO: 2993326 - protein, 25 aa, Entamoeba invadens
EHKVNMSAPWEMRYSLPCCEKYKQM

SEQ ID NO: 2993327 - protein, 26 aa, Entamoeba invadens
EHKVNSFIPWYLLNTSDKTPEDMLPL

SEQ ID NO: 2993328 - protein, 24 aa, Entamoeba invadens
EHKYRPLSVILPTKSGRIDLSGLR

SEQ ID NO: 2993329 - protein, 26 aa, Entamoeba invadens
EHLAGKWPFWLSPRQIMVATVSEKFN

SEQ ID NO: 2993330 - protein, 22 aa, Entamoeba invadens
EHLESFVIPPRPTYLVKSEEES

SEQ ID NO: 2993331 - protein, 21 aa, Entamoeba invadens
EHLFLETYYQTSGCTSKVIEH

SEQ ID NO: 2993332 - protein, 17 aa, Entamoeba invadens
EHLLRVLQLPKFKDMKI

SEQ ID NO: 2993333 - protein, 24 aa, Entamoeba invadens
EHMKRQWDELNQKLLQEANAAPKN

SEQ ID NO: 2993334 - protein, 18 aa, Entamoeba invadens
EHMLTFASFIYSSSISIK

SEQ ID NO: 2993335 - protein, 20 aa, Entamoeba invadens
EHMNLIGNLVFGVCVSLKEV

SEQ ID NO: 2993336 - protein, 29 aa, Entamoeba invadens
EHMPEKDPFFLYILLRCNSIPTSKAIECA

SEQ ID NO: 2993337 - protein, 30 aa, Entamoeba invadens
EHNTNNIPLPIKALIDYLKIHAANVEGIFR

SEQ ID NO: 2993338 - protein, 17 aa, Entamoeba invadens
EHPFLKKHFDNFVETPI

SEQ ID NO: 2993339 - protein, 19 aa, Entamoeba invadens
EHPLLPIGLFDVFGKSKVK

SEQ ID NO: 2993340 - protein, 20 aa, Entamoeba invadens
EHPLLYIESILNTIKDREKM

SEQ ID NO: 2993341 - protein, 26 aa, Entamoeba invadens
EHPVMNPMMIWYLYKVNSKNESEAID

SEQ ID NO: 2993342 - protein, 24 aa, Entamoeba invadens
EHQIKRLVLIYLESIQKTENGQLK

SEQ ID NO: 2993343 - protein, 17 aa, Entamoeba invadens
EHRAEIKEKFPDMKVTE

SEQ ID NO: 2993344 - protein, 35 aa, Entamoeba invadens
EHRKDSFTLLDDKTLIFIFSFLSLEAIIAVKHTCK

SEQ ID NO: 2993345 - protein, 44 aa, Entamoeba invadens
EHRKLQTFAINMLYQKFPESVAKTIFPFVDVIEKFIAKPSEEEM

SEQ ID NO: 2993346 - protein, 20 aa, Entamoeba invadens
EHSIDLIKFPYTSAQNDQYW

SEQ ID NO: 2993347 - protein, 17 aa, Entamoeba invadens
EHTIMYPEFAKVAKEEG

SEQ ID NO: 2993348 - protein, 31 aa, Entamoeba invadens
EHTPDMFSWFPFFFPIQPPIDLKRGDVVEFL

SEQ ID NO: 2993349 - protein, 19 aa, Entamoeba invadens
EHTVIVDFFATWCGPCQLM

SEQ ID NO: 2993350 - protein, 23 aa, Entamoeba invadens
EHVEPIIHRLPNQVTSDLTLPKN

SEQ ID NO: 2993351 - protein, 26 aa, Entamoeba invadens
EHVGKRVILLVRIKQASGEIGPLEVS

SEQ ID NO: 2993352 - protein, 33 aa, Entamoeba invadens
EHVKYLALKNTNLSWRSSYIKNEFLFCHLEELT

SEQ ID NO: 2993353 - protein, 18 aa, Entamoeba invadens
EHVNKMASVYLTAVIEYL

SEQ ID NO: 2993354 - protein, 27 aa, Entamoeba invadens
EHVTSLYYFLSVFSKWGLRASECEEML

SEQ ID NO: 2993355 - protein, 20 aa, Entamoeba invadens
EHVWLTTESKYPFNYKDYNF

SEQ ID NO: 2993356 - protein, 27 aa, Entamoeba invadens
EHYKFNSIMFHSFIQLKKYNEAAQVGK

SEQ ID NO: 2993357 - protein, 25 aa, Entamoeba invadens
EHYKQWILLFKIVASNPQLIQTNKT

SEQ ID NO: 2993358 - protein, 34 aa, Entamoeba invadens
EHYKYDIFMFGIKMMIMLFTWTSSKTDFQEFNEY

SEQ ID NO: 2993359 - protein, 18 aa, Entamoeba invadens
EIAAYFKKNLPAEELKFT

SEQ ID NO: 2993360 - protein, 31 aa, Entamoeba invadens
EIACREDLLFGMYLEALFLDKKPPQTYKEMI

SEQ ID NO: 2993361 - protein, 23 aa, Entamoeba invadens
EIADSILRLPLTPSTHIQTPNTF

SEQ ID NO: 2993362 - protein, 22 aa, Entamoeba invadens
EIADWLFSELNLLISNFPFERI

SEQ ID NO: 2993363 - protein, 26 aa, Entamoeba invadens
EIAEKFPRNLQLIELLISLAKENNTD

SEQ ID NO: 2993364 - protein, 18 aa, Entamoeba invadens
EIAEKILTFVTRFGEENG

SEQ ID NO: 2993365 - protein, 24 aa, Entamoeba invadens
EIAIDPHYSFLEKIQLIPTIVKDT

SEQ ID NO: 2993366 - protein, 24 aa, Entamoeba invadens
EIAKMKIPYFNGKSLKIEKIGVLD

SEQ ID NO: 2993367 - protein, 19 aa, Entamoeba invadens
EIALKLIPHAQFTFKKVWV

SEQ ID NO: 2993368 - protein, 17 aa, Entamoeba invadens
EIALLKQNEKIEKEKVK

SEQ ID NO: 2993369 - protein, 17 aa, Entamoeba invadens
EIALQRPDFYSLDKYMI

SEQ ID NO: 2993370 - protein, 20 aa, Entamoeba invadens
EIALVKYYRSKIDSMTYEYS

SEQ ID NO: 2993371 - protein, 26 aa, Entamoeba invadens
EIAMWRSIFVLYAITIFGIRNCTADK

SEQ ID NO: 2993372 - protein, 25 aa, Entamoeba invadens
EIAQEIYIRWKTRKLIRERNYDDDR

SEQ ID NO: 2993373 - protein, 25 aa, Entamoeba invadens
EIAQEIYVRWKTRKLVKERSYDLER

SEQ ID NO: 2993374 - protein, 23 aa, Entamoeba invadens
EIAQMPFICRKFHSALVSQNGNL

SEQ ID NO: 2993375 - protein, 30 aa, Entamoeba invadens
EIARFEEMLKLQNVLPTAILNNLKLKKEQL

SEQ ID NO: 2993376 - protein, 25 aa, Entamoeba invadens
EIARKYFIHFFASGVSDIQELTSLV

SEQ ID NO: 2993377 - protein, 23 aa, Entamoeba invadens
EIASLLMKNPLRILTKREKVTLD

SEQ ID NO: 2993378 - protein, 34 aa, Entamoeba invadens
EIASTQLLMKLPFNHLFDFLGVCMEPISVENVCA

SEQ ID NO: 2993379 - protein, 17 aa, Entamoeba invadens
EIATIMAKIMGIDLFTL

SEQ ID NO: 2993380 - protein, 25 aa, Entamoeba invadens
EIAVKLLSFVLLKSNVPFLHSNLQY

SEQ ID NO: 2993381 - protein, 17 aa, Entamoeba invadens
EIAYQRKSFITEDIYTL

SEQ ID NO: 2993382 - protein, 25 aa, Entamoeba invadens
EICDFEFYRCLSLSKIDIPKSVTRI

SEQ ID NO: 2993383 - protein, 25 aa, Entamoeba invadens
EICEIFISITQLYVIKQLYVEEFPS

SEQ ID NO: 2993384 - protein, 25 aa, Entamoeba invadens
EICEKLEKYIYWLEEDGYDETKGAY

SEQ ID NO: 2993385 - protein, 18 aa, Entamoeba invadens
EICPKICGLQRNVVQCCK

SEQ ID NO: 2993386 - protein, 22 aa, Entamoeba invadens
EICRTLFDIPMVIIINKADLLS

SEQ ID NO: 2993387 - protein, 24 aa, Entamoeba invadens
EICSFHPPLHLTNSSLRILVHSLI

SEQ ID NO: 2993388 - protein, 20 aa, Entamoeba invadens
EICTLLFKKLSTYNYNTFYY

SEQ ID NO: 2993389 - protein, 19 aa, Entamoeba invadens
EICYDCQATYFLNGNSQCQ

SEQ ID NO: 2993390 - protein, 53 aa, Entamoeba invadens
EICYDKIYQFISPSYLEYSAWLAVIPLGMKCNEIFGIPLSIGVKKSGWRFPLP

SEQ ID NO: 2993391 - protein, 24 aa, Entamoeba invadens
EIDDMLFCPLLRLCTDFSAVSRQF

SEQ ID NO: 2993392 - protein, 22 aa, Entamoeba invadens
EIDEKMILKMILEAAKGILYLH

SEQ ID NO: 2993393 - protein, 21 aa, Entamoeba invadens
EIDEYALGTPFLLIGTKADLR

SEQ ID NO: 2993394 - protein, 18 aa, Entamoeba invadens
EIDIIFDFARAYVVLDEV

SEQ ID NO: 2993395 - protein, 18 aa, Entamoeba invadens
EIDKWKVYKSRIPVVGAL

SEQ ID NO: 2993396 - protein, 21 aa, Entamoeba invadens
EIDKYNEVLLFPGLPASIQNE

SEQ ID NO: 2993397 - protein, 19 aa, Entamoeba invadens
EIDLRVGFAFTRLSTSLLT

SEQ ID NO: 2993398 - protein, 20 aa, Entamoeba invadens
EIDSQWSFPLSGLSKNRFDD

SEQ ID NO: 2993399 - protein, 20 aa, Entamoeba invadens
EIEALWVFTGHELPKEFTDC

SEQ ID NO: 2993400 - protein, 23 aa, Entamoeba invadens
EIEDFKVPTGKISKKVIEKVNEE

SEQ ID NO: 2993401 - protein, 23 aa, Entamoeba invadens
EIEDIWKIIITQYARIHEKRKLV

SEQ ID NO: 2993402 - protein, 24 aa, Entamoeba invadens
EIEEIVYLFIKNLSELNQPLFESI

SEQ ID NO: 2993403 - protein, 27 aa, Entamoeba invadens
EIEELSHAVYIYWRAKEMVKTKEYEVD

SEQ ID NO: 2993404 - protein, 18 aa, Entamoeba invadens
EIEFDIMEQFLTGGRVFL

SEQ ID NO: 2993405 - protein, 30 aa, Entamoeba invadens
EIEGDKIMNLFLFSFRFWDDEKVVLEWCEE

SEQ ID NO: 2993406 - protein, 17 aa, Entamoeba invadens
EIEIGRDVKLGFGCFKG

SEQ ID NO: 2993407 - protein, 17 aa, Entamoeba invadens
EIEINKLYHALGYSDEY

SEQ ID NO: 2993408 - protein, 29 aa, Entamoeba invadens
EIEKNEIVIPLLVKYLKSQKRLTLFHAEL

SEQ ID NO: 2993409 - protein, 26 aa, Entamoeba invadens
EIEKQKIILISKMPRPLELHHKKQKK

SEQ ID NO: 2993410 - protein, 18 aa, Entamoeba invadens
EIELFKYSQLISAKQSFD

SEQ ID NO: 2993411 - protein, 26 aa, Entamoeba invadens
EIELFNDKILLFDKTRKTFLQKVIQI

SEQ ID NO: 2993412 - protein, 18 aa, Entamoeba invadens
EIELIASGRLEKTTYLLS

SEQ ID NO: 2993413 - protein, 32 aa, Entamoeba invadens
EIELIRNLSRDYLLIVRKSIKDLVPKAVIHFL

SEQ ID NO: 2993414 - protein, 28 aa, Entamoeba invadens
EIELKKRMSLSFIPEDLLVSFEIPVKVE

SEQ ID NO: 2993415 - protein, 17 aa, Entamoeba invadens
EIELVGHIFPISKNTTN

SEQ ID NO: 2993416 - protein, 25 aa, Entamoeba invadens
EIEMKLRIKLMLDSISGIIYLHTNG

SEQ ID NO: 2993417 - protein, 17 aa, Entamoeba invadens
EIENFLPKCCFTCCSML

SEQ ID NO: 2993418 - protein, 23 aa, Entamoeba invadens
EIERKIGFLMRANTYYESLDEDL

SEQ ID NO: 2993419 - protein, 19 aa, Entamoeba invadens
EIERKWIIAIFMEKENEIG

SEQ ID NO: 2993420 - protein, 20 aa, Entamoeba invadens
EIETLIYPKEADVSQIPFID

SEQ ID NO: 2993421 - protein, 24 aa, Entamoeba invadens
EIETPLCFTIFSAPMYSKSNRGAS

SEQ ID NO: 2993422 - protein, 19 aa, Entamoeba invadens
EIETVEQLLPALKKGMRPI

SEQ ID NO: 2993423 - protein, 19 aa, Entamoeba invadens
EIEVFLFSSFKHFAMCLTD

SEQ ID NO: 2993424 - protein, 18 aa, Entamoeba invadens
EIEWLMATSWNKGNRSRY

SEQ ID NO: 2993425 - protein, 32 aa, Entamoeba invadens
EIFADSVSSLVLMLVALQEKNKPPKPEMQASI

SEQ ID NO: 2993426 - protein, 17 aa, Entamoeba invadens
EIFAYHAGLKKYVEVGN

SEQ ID NO: 2993427 - protein, 25 aa, Entamoeba invadens
EIFEKPFIVKWFNENNPWELLIFPD

SEQ ID NO: 2993428 - protein, 20 aa, Entamoeba invadens
EIFETLPADFRKLLQTMSEF

SEQ ID NO: 2993429 - protein, 20 aa, Entamoeba invadens
EIFKFFTHIVGILQYVDGPI

SEQ ID NO: 2993430 - protein, 25 aa, Entamoeba invadens
EIFKQLIEFYKMRADFPQEQMYVIG

SEQ ID NO: 2993431 - protein, 18 aa, Entamoeba invadens
EIFMLEVLLPLCMRHCSS

SEQ ID NO: 2993432 - protein, 17 aa, Entamoeba invadens
EIFMNALRRGSIFQDET

SEQ ID NO: 2993433 - protein, 19 aa, Entamoeba invadens
EIFNFYKPMFGDCDKSCMC

SEQ ID NO: 2993434 - protein, 24 aa, Entamoeba invadens
EIFNRGMIDLPDNVRFITHVQLFT

SEQ ID NO: 2993435 - protein, 18 aa, Entamoeba invadens
EIFSFLLQSNRKGFKDPI

SEQ ID NO: 2993436 - protein, 17 aa, Entamoeba invadens
EIFSPMMVYILSAIDRF

SEQ ID NO: 2993437 - protein, 17 aa, Entamoeba invadens
EIFSSPVDTRRFPSYIL

SEQ ID NO: 2993438 - protein, 17 aa, Entamoeba invadens
EIFTQISTGLQTEYQNA

SEQ ID NO: 2993439 - protein, 18 aa, Entamoeba invadens
EIFVKRRKGTSSDYEVTF

SEQ ID NO: 2993440 - protein, 24 aa, Entamoeba invadens
EIFVKTFVAILDYLAEQSAIYDEN

SEQ ID NO: 2993441 - protein, 30 aa, Entamoeba invadens
EIGANCFLGCKSLCKLKIPQNVEKLMNSTF

SEQ ID NO: 2993442 - protein, 23 aa, Entamoeba invadens
EIGDFAFYNCLNLKKSCITNKRC

SEQ ID NO: 2993443 - protein, 25 aa, Entamoeba invadens
EIGGSSFFFLISSLPSNRSAFGLFL

SEQ ID NO: 2993444 - protein, 28 aa, Entamoeba invadens
EIGGTKNLIYITLYNLPDGTTTEQVRDF

SEQ ID NO: 2993445 - protein, 33 aa, Entamoeba invadens
EIGGYFIIHGVEKYLRMILYAKPNHPIAVARPS

SEQ ID NO: 2993446 - protein, 25 aa, Entamoeba invadens
EIGIEAIRHPVLSRYLLYHCECNSS

SEQ ID NO: 2993447 - protein, 33 aa, Entamoeba invadens
EIGKLIHRIEYVAPKYFFIRSRSENFVFELDMN

SEQ ID NO: 2993448 - protein, 25 aa, Entamoeba invadens
EIGMKYVFKLAPILFDESLFITVDN

SEQ ID NO: 2993449 - protein, 17 aa, Entamoeba invadens
EIGRGTYGIVFLGAIKQ

SEQ ID NO: 2993450 - protein, 20 aa, Entamoeba invadens
EIGRLFLMTPIENRRLLLAL

SEQ ID NO: 2993451 - protein, 20 aa, Entamoeba invadens
EIGRVLMLSQKILLSTEARL

SEQ ID NO: 2993452 - protein, 26 aa, Entamoeba invadens
EIGRVTMTMFYFGAYKLLFPEKPLKD

SEQ ID NO: 2993453 - protein, 19 aa, Entamoeba invadens
EIGTFPPYLNKNGLYKHDK

SEQ ID NO: 2993454 - protein, 30 aa, Entamoeba invadens
EIGTKAFFDSKYLTSLYIPKSVTKIGKNFV

SEQ ID NO: 2993455 - protein, 20 aa, Entamoeba invadens
EIGVLKKVFHPNIVLFMGAC

SEQ ID NO: 2993456 - protein, 27 aa, Entamoeba invadens
EIHDDNLLPFPFLLDGTKPTFLDIPPV

SEQ ID NO: 2993457 - protein, 25 aa, Entamoeba invadens
EIHDMSFVFLQIFAGKTVYVDTKDH

SEQ ID NO: 2993458 - protein, 17 aa, Entamoeba invadens
EIHFFAADMFKALEYLI

SEQ ID NO: 2993459 - protein, 32 aa, Entamoeba invadens
EIHPSSVLYGKSPRWILFYELVMTTKEYVRQV

SEQ ID NO: 2993460 - protein, 18 aa, Entamoeba invadens
EIIAMITSSFYKGDCHLR

SEQ ID NO: 2993461 - protein, 18 aa, Entamoeba invadens
EIIELIKNKYNITSDHIG

SEQ ID NO: 2993462 - protein, 27 aa, Entamoeba invadens
EIIFEQFLKFKDVAILLQDSFANYVIQ

SEQ ID NO: 2993463 - protein, 20 aa, Entamoeba invadens
EIIINEILALKMIDVEKRVV

SEQ ID NO: 2993464 - protein, 26 aa, Entamoeba invadens
EIIIPRLVKEKLGVSFLYEYKGDPCY

SEQ ID NO: 2993465 - protein, 25 aa, Entamoeba invadens
EIIKMGFLEKLLKYNKLFFDSKEVK

SEQ ID NO: 2993466 - protein, 26 aa, Entamoeba invadens
EIIKNDLKMYLLKLQHTDLNEADIPS

SEQ ID NO: 2993467 - protein, 25 aa, Entamoeba invadens
EIIKTTLFAIEWFVSANFGDSITSY

SEQ ID NO: 2993468 - protein, 23 aa, Entamoeba invadens
EIIKYFELDTIKNRVWSFVLINK

SEQ ID NO: 2993469 - protein, 23 aa, Entamoeba invadens
EIILDGYYRTLEGFIVLVEKDWK

SEQ ID NO: 2993470 - protein, 26 aa, Entamoeba invadens
EIILDGYYRTLNGFIVLIEKDWKSFG

SEQ ID NO: 2993471 - protein, 19 aa, Entamoeba invadens
EIILKNLFLCSHTLIRIQE

SEQ ID NO: 2993472 - protein, 17 aa, Entamoeba invadens
EIILNGSAPLTSELYDW

SEQ ID NO: 2993473 - protein, 27 aa, Entamoeba invadens
EIILPENLKTIEKFAFKNCYSLENLTF

SEQ ID NO: 2993474 - protein, 22 aa, Entamoeba invadens
EIILSTIYIPDCYKLLMFQDPS

SEQ ID NO: 2993475 - protein, 19 aa, Entamoeba invadens
EIINQPLPTSFRLTKNEFF

SEQ ID NO: 2993476 - protein, 23 aa, Entamoeba invadens
EIINTEIPQLLFMKGGNFSINIH

SEQ ID NO: 2993477 - protein, 25 aa, Entamoeba invadens
EIIQIFTHLFMEDQNPDEFLRSIHI

SEQ ID NO: 2993478 - protein, 29 aa, Entamoeba invadens
EIISNKDLFALMYWKNLFSKLTGAKIQNI

SEQ ID NO: 2993479 - protein, 18 aa, Entamoeba invadens
EIITKRIFQLFLSEDYKN

SEQ ID NO: 2993480 - protein, 25 aa, Entamoeba invadens
EIIVCNYVLFEFLLTDKKVEVWCRK

SEQ ID NO: 2993481 - protein, 28 aa, Entamoeba invadens
EIIVEDLKRVFQLIFDRVPESFTHHLDH

SEQ ID NO: 2993482 - protein, 19 aa, Entamoeba invadens
EIIVFTDHFCFSACSLFAK

SEQ ID NO: 2993483 - protein, 28 aa, Entamoeba invadens
EIIYKEQFGLDLPFRWVTFDQYQQKEYR

SEQ ID NO: 2993484 - protein, 18 aa, Entamoeba invadens
EIKDPLRMTFADVQIYFN

SEQ ID NO: 2993485 - protein, 18 aa, Entamoeba invadens
EIKDVDSLALFFKLADSN

SEQ ID NO: 2993486 - protein, 39 aa, Entamoeba invadens
EIKELLISQVVEPLKLYLDQWGVLYKRIAVLKNRKMDMD

SEQ ID NO: 2993487 - protein, 25 aa, Entamoeba invadens
EIKIDFYRIVVWFSVDYTTVDVNKN

SEQ ID NO: 2993488 - protein, 25 aa, Entamoeba invadens
EIKINFYRIVVWFNVDYTTVDINSN

SEQ ID NO: 2993489 - protein, 20 aa, Entamoeba invadens
EIKKAILLMLVGATEKIRLR

SEQ ID NO: 2993490 - protein, 27 aa, Entamoeba invadens
EIKKTDEPLIPPSMILEIKTQVEETTS

SEQ ID NO: 2993491 - protein, 18 aa, Entamoeba invadens
EIKKWNAVALWSWDLQVD

SEQ ID NO: 2993492 - protein, 17 aa, Entamoeba invadens
EIKLFYKDILKKTKKWT

SEQ ID NO: 2993493 - protein, 18 aa, Entamoeba invadens
EIKLKKKDGANWDNLTKG

SEQ ID NO: 2993494 - protein, 17 aa, Entamoeba invadens
EIKLPDLLEFIPDSCFA

SEQ ID NO: 2993495 - protein, 30 aa, Entamoeba invadens
EIKLPSIEALIFINLPIYGGGIVFYDEVTK

SEQ ID NO: 2993496 - protein, 17 aa, Entamoeba invadens
EIKMLKILCQWFCRKRK

SEQ ID NO: 2993497 - protein, 26 aa, Entamoeba invadens
EIKMVKVFAQWFCRKNRLVDYCDKCS

SEQ ID NO: 2993498 - protein, 21 aa, Entamoeba invadens
EIKQLYFNDLISKIGVFNGNN

SEQ ID NO: 2993499 - protein, 27 aa, Entamoeba invadens
EIKQSFYKTVVWFRVHYEDTLDPAYAT

SEQ ID NO: 2993500 - protein, 28 aa, Entamoeba invadens
EIKQSFYSLLKVLFFGDKRSYTFVLDIN

SEQ ID NO: 2993501 - protein, 19 aa, Entamoeba invadens
EIKSILNIIGKSTLKKVYI

SEQ ID NO: 2993502 - protein, 17 aa, Entamoeba invadens
EIKSLLLMLEEARGWYS

SEQ ID NO: 2993503 - protein, 20 aa, Entamoeba invadens
EIKVVLWDVVVFDPHDPKSF

SEQ ID NO: 2993504 - protein, 18 aa, Entamoeba invadens
EILDAEIKRKESELVERL

SEQ ID NO: 2993505 - protein, 20 aa, Entamoeba invadens
EILDVLRNLGQLYTYLVISV

SEQ ID NO: 2993506 - protein, 19 aa, Entamoeba invadens
EILFRIMKITKSQTTSLLT

SEQ ID NO: 2993507 - protein, 23 aa, Entamoeba invadens
EILHFLAEIASGLWYLHFCKHII

SEQ ID NO: 2993508 - protein, 23 aa, Entamoeba invadens
EILKELIIHAHKYKLPTVFFNGV

SEQ ID NO: 2993509 - protein, 26 aa, Entamoeba invadens
EILKRSNEFLDYLTAAETKFRQFEKS

SEQ ID NO: 2993510 - protein, 22 aa, Entamoeba invadens
EILKYVVQFLQYDPNRFDDDEE

SEQ ID NO: 2993511 - protein, 17 aa, Entamoeba invadens
EILLESYPVEYKGLSFG

SEQ ID NO: 2993512 - protein, 22 aa, Entamoeba invadens
EILMDGFTIEKVPVPSNFITEI

SEQ ID NO: 2993513 - protein, 19 aa, Entamoeba invadens
EILMLKTPNYIETEWWSKF

SEQ ID NO: 2993514 - protein, 33 aa, Entamoeba invadens
EILPILNLKSLLYYETCAWMWRRGFTMTFKENN

SEQ ID NO: 2993515 - protein, 17 aa, Entamoeba invadens
EILRINPNLAEFVNFYY

SEQ ID NO: 2993516 - protein, 18 aa, Entamoeba invadens
EILSMPPFDNNGIRRPFT

SEQ ID NO: 2993517 - protein, 30 aa, Entamoeba invadens
EILSPLRLKIMNFIRIWMKNAWKDFEAKDE

SEQ ID NO: 2993518 - protein, 18 aa, Entamoeba invadens
EILVVDSEALRTLTEAAV

SEQ ID NO: 2993519 - protein, 18 aa, Entamoeba invadens
EIMGRVMALCKKGIMIAK

SEQ ID NO: 2993520 - protein, 25 aa, Entamoeba invadens
EIMKELLLKAYQLGVNLKFSPVTKE

SEQ ID NO: 2993521 - protein, 24 aa, Entamoeba invadens
EIMLSEFYDLPLTRKGRIEDFNVF

SEQ ID NO: 2993522 - protein, 17 aa, Entamoeba invadens
EIMRILGLCSICFAFKD

SEQ ID NO: 2993523 - protein, 20 aa, Entamoeba invadens
EINDICWELPHIAIATNEGA

SEQ ID NO: 2993524 - protein, 25 aa, Entamoeba invadens
EINDTYFKFKLILADFPIGQESKDL

SEQ ID NO: 2993525 - protein, 25 aa, Entamoeba invadens
EINDTYFKFKLTLADLPIGQESVEK

SEQ ID NO: 2993526 - protein, 20 aa, Entamoeba invadens
EINEGIFLTFDFGGGTLDTT

SEQ ID NO: 2993527 - protein, 18 aa, Entamoeba invadens
EINELSMKVLLDLDSYLG

SEQ ID NO: 2993528 - protein, 17 aa, Entamoeba invadens
EINKTIMEWVRSGADIS

SEQ ID NO: 2993529 - protein, 18 aa, Entamoeba invadens
EINKTMCLVILIGEIYVK

SEQ ID NO: 2993530 - protein, 18 aa, Entamoeba invadens
EINLCPVLLIQDVTYMYI

SEQ ID NO: 2993531 - protein, 25 aa, Entamoeba invadens
EINNKAFYHCFKLKSLELPICVSYI

SEQ ID NO: 2993532 - protein, 33 aa, Entamoeba invadens
EINNQRIPFGFYKRTLPHYWKEDYGFVTRGFCE

SEQ ID NO: 2993533 - protein, 23 aa, Entamoeba invadens
EINNVVLVCKKFKNIMKMFHYNP

SEQ ID NO: 2993534 - protein, 24 aa, Entamoeba invadens
EINPDNMFMFYDSFEKDDSLPRIL

SEQ ID NO: 2993535 - protein, 21 aa, Entamoeba invadens
EINRISLYLMVALVARLDLDQ

SEQ ID NO: 2993536 - protein, 17 aa, Entamoeba invadens
EINRYADTSLIRGVVAF

SEQ ID NO: 2993537 - protein, 29 aa, Entamoeba invadens
EINTLCPQMFLFTMLLHVLLMCVGRERSE

SEQ ID NO: 2993538 - protein, 22 aa, Entamoeba invadens
EINVQPGWKDGTKLRFENYGDV

SEQ ID NO: 2993539 - protein, 19 aa, Entamoeba invadens
EIPASFDCSNIIKFDARCF

SEQ ID NO: 2993540 - protein, 24 aa, Entamoeba invadens
EIPDAPILDYVLEAPITKTDSEKT

SEQ ID NO: 2993541 - protein, 26 aa, Entamoeba invadens
EIPDGIGEILLLYRCSIKTVKWEDYC

SEQ ID NO: 2993542 - protein, 25 aa, Entamoeba invadens
EIPDKCFFICTKLKEIDLEHIRVFG

SEQ ID NO: 2993543 - protein, 31 aa, Entamoeba invadens
EIPEPNGFIFKYLMFFLTKVVEKSDINKMVA

SEQ ID NO: 2993544 - protein, 26 aa, Entamoeba invadens
EIPFVTSVLGQFGYITDIVPSRRGLR

SEQ ID NO: 2993545 - protein, 25 aa, Entamoeba invadens
EIPHKVYCRYTPGDIFPFFTDFYQQ

SEQ ID NO: 2993546 - protein, 17 aa, Entamoeba invadens
EIPIIGIKNFRSTCFAN

SEQ ID NO: 2993547 - protein, 18 aa, Entamoeba invadens
EIPLLQSIPMLQTNPEIA

SEQ ID NO: 2993548 - protein, 26 aa, Entamoeba invadens
EIPMEESYMRLLPSKGIEKGSPDDVE

SEQ ID NO: 2993549 - protein, 22 aa, Entamoeba invadens
EIPNCISFIGKDAFLSCSGLTS

SEQ ID NO: 2993550 - protein, 24 aa, Entamoeba invadens
EIPNMFHYNPFPITKHQLTMFPHI

SEQ ID NO: 2993551 - protein, 26 aa, Entamoeba invadens
EIPRPSYHCLPFSDWVLSQAKSLHLE

SEQ ID NO: 2993552 - protein, 19 aa, Entamoeba invadens
EIPSFYNLQKWVSERNKQV

SEQ ID NO: 2993553 - protein, 27 aa, Entamoeba invadens
EIPSKPFFAVIVWYPCDYSYIKTYEST

SEQ ID NO: 2993554 - protein, 21 aa, Entamoeba invadens
EIPSMFHYNPIPLKNKKKFFP

SEQ ID NO: 2993555 - protein, 22 aa, Entamoeba invadens
EIPYLINVLLHFNFETARLFEQ

SEQ ID NO: 2993556 - protein, 18 aa, Entamoeba invadens
EIQELAIAVFIKKLEDKL

SEQ ID NO: 2993557 - protein, 25 aa, Entamoeba invadens
EIQETLKLVIWYTVDYQSSLKLNKL

SEQ ID NO: 2993558 - protein, 23 aa, Entamoeba invadens
EIQGIEDGLLKIAIDAPPVDGKA

SEQ ID NO: 2993559 - protein, 38 aa, Entamoeba invadens
EIQHDLRSLLIMPIQRIPRYVLLLKELKKNTTQEHPDY

SEQ ID NO: 2993560 - protein, 34 aa, Entamoeba invadens
EIQKIRVVSLLKNSWFFYELIVKSLTMDVEANGQ

SEQ ID NO: 2993561 - protein, 17 aa, Entamoeba invadens
EIQKWTEAEYKLFNENI

SEQ ID NO: 2993562 - protein, 24 aa, Entamoeba invadens
EIQLTLSVLLPTLNISLFRKAAVE

SEQ ID NO: 2993563 - protein, 23 aa, Entamoeba invadens
EIQMPNMQIAPPSPLPVEKISID

SEQ ID NO: 2993564 - protein, 24 aa, Entamoeba invadens
EIQRRFLCNVIDWKIQMDIDISKQ

SEQ ID NO: 2993565 - protein, 22 aa, Entamoeba invadens
EIQRTMLELLNQLDGFCKTDDV

SEQ ID NO: 2993566 - protein, 23 aa, Entamoeba invadens
EIQRTMLELLNQLDGFDTRGEVK

SEQ ID NO: 2993567 - protein, 22 aa, Entamoeba invadens
EIQSYFYYHYFTPAFVGMEENK

SEQ ID NO: 2993568 - protein, 17 aa, Entamoeba invadens
EIRCRLITLTSKENQIY

SEQ ID NO: 2993569 - protein, 24 aa, Entamoeba invadens
EIRHDYIQWLFPTFGQSMFNSSSF

SEQ ID NO: 2993570 - protein, 25 aa, Entamoeba invadens
EIRKKPDLLIWAVYNVVRSVDYLHS

SEQ ID NO: 2993571 - protein, 22 aa, Entamoeba invadens
EIRKKQIFPACYTLLSKRDEQW

SEQ ID NO: 2993572 - protein, 21 aa, Entamoeba invadens
EIRLSILRTLFHCLSVENASG

SEQ ID NO: 2993573 - protein, 26 aa, Entamoeba invadens
EIRNKDGYLLVYPINSKEKFKEVVVF

SEQ ID NO: 2993574 - protein, 21 aa, Entamoeba invadens
EIRPIVYQILEGLAFCHHHEI

SEQ ID NO: 2993575 - protein, 20 aa, Entamoeba invadens
EIRQFLGRFGLKGDTPKQRI

SEQ ID NO: 2993576 - protein, 23 aa, Entamoeba invadens
EIRRKLCCGFVFKDTDRAMEMIK

SEQ ID NO: 2993577 - protein, 28 aa, Entamoeba invadens
EIRTIITDVLKALLFLHDNKIVHRDVKM

SEQ ID NO: 2993578 - protein, 25 aa, Entamoeba invadens
EISCDLSRMIFYRKELQKLKLPSNV

SEQ ID NO: 2993579 - protein, 25 aa, Entamoeba invadens
EISEIPLHWDLPSLTSVDLSQNNLC

SEQ ID NO: 2993580 - protein, 23 aa, Entamoeba invadens
EISEMVDSFFRDGFLRKRVETKS

SEQ ID NO: 2993581 - protein, 19 aa, Entamoeba invadens
EISLILSSPLQFAKSYIEE

SEQ ID NO: 2993582 - protein, 33 aa, Entamoeba invadens
EISLRLLAEQLYVTDLYLIKKVSIGDFLSESAL

SEQ ID NO: 2993583 - protein, 20 aa, Entamoeba invadens
EISMYLFRDSNMKGDHYFLD

SEQ ID NO: 2993584 - protein, 28 aa, Entamoeba invadens
EISNLIKLWFRELPKPILNVLSSDQIFY

SEQ ID NO: 2993585 - protein, 23 aa, Entamoeba invadens
EISQKRFSFLCSIFGKYYKKKEN

SEQ ID NO: 2993586 - protein, 22 aa, Entamoeba invadens
EISRQLIHFCKAPIGIDLIKFK

SEQ ID NO: 2993587 - protein, 23 aa, Entamoeba invadens
EISRQLIHFCKAPIGIDLIKFKG

SEQ ID NO: 2993588 - protein, 29 aa, Entamoeba invadens
EITAKSDLIILPLYSALQKEKQKKVFLKA

SEQ ID NO: 2993589 - protein, 21 aa, Entamoeba invadens
EITCIPKYCFHNCYGLEKINM

SEQ ID NO: 2993590 - protein, 26 aa, Entamoeba invadens
EITDFGKKLVKFPLSPRQAAAVCEGY

SEQ ID NO: 2993591 - protein, 24 aa, Entamoeba invadens
EITHLMMEYPFLKGYGMSAIKAYT

SEQ ID NO: 2993592 - protein, 29 aa, Entamoeba invadens
EITKHQKLMLIFMCVIRRVYLRFDTEEEC

SEQ ID NO: 2993593 - protein, 23 aa, Entamoeba invadens
EITKNYIMMFVHGLITVANNTAF

SEQ ID NO: 2993594 - protein, 25 aa, Entamoeba invadens
EITPEILAHYLVFQNSPIPNISERT

SEQ ID NO: 2993595 - protein, 27 aa, Entamoeba invadens
EITPKIYRFRHFVIKLTIDPSFGIQYT

SEQ ID NO: 2993596 - protein, 35 aa, Entamoeba invadens
EITPRLLELVQLVIYLPIFDLIMSKLTVDPPQNWM

SEQ ID NO: 2993597 - protein, 27 aa, Entamoeba invadens
EITRINYYITLYLKVRLSKVLQMARMG

SEQ ID NO: 2993598 - protein, 17 aa, Entamoeba invadens
EIVAYFTKSTFGTFVRE

SEQ ID NO: 2993599 - protein, 26 aa, Entamoeba invadens
EIVCSPSMKLLWDNYKFTTDNPIVQW

SEQ ID NO: 2993600 - protein, 28 aa, Entamoeba invadens
EIVEVAIIKKYLYKLTTDNVRTLWERFC

SEQ ID NO: 2993601 - protein, 26 aa, Entamoeba invadens
EIVGNILLFLMNTFQKFEPTCVGRVA

SEQ ID NO: 2993602 - protein, 26 aa, Entamoeba invadens
EIVKNRYHMLLVQMLKASQKCDKTVR

SEQ ID NO: 2993603 - protein, 18 aa, Entamoeba invadens
EIVKVLKYYFPKCGNFDD

SEQ ID NO: 2993604 - protein, 19 aa, Entamoeba invadens
EIVLGLPYSCAIDMWSVGC

SEQ ID NO: 2993605 - protein, 17 aa, Entamoeba invadens
EIVLPKSLSFISKSAFY

SEQ ID NO: 2993606 - protein, 18 aa, Entamoeba invadens
EIVLPPHLTHIGNSAFYN

SEQ ID NO: 2993607 - protein, 18 aa, Entamoeba invadens
EIVLRMFISPELITTHFS

SEQ ID NO: 2993608 - protein, 17 aa, Entamoeba invadens
EIVMFNPKAILPKYIIQ

SEQ ID NO: 2993609 - protein, 25 aa, Entamoeba invadens
EIVNYLGEYILLKDVIEPKVDDEIT

SEQ ID NO: 2993610 - protein, 18 aa, Entamoeba invadens
EIVPYHNLSIDPAASCFH

SEQ ID NO: 2993611 - protein, 29 aa, Entamoeba invadens
EIVRYTHDQIFIITVVFKSKDITSIMTEQ

SEQ ID NO: 2993612 - protein, 25 aa, Entamoeba invadens
EIVTTYQLLPALLSGVRPILPVTLI

SEQ ID NO: 2993613 - protein, 32 aa, Entamoeba invadens
EIVVFADLYQTRRFLDIIPKLKEPSKSEKIRR

SEQ ID NO: 2993614 - protein, 20 aa, Entamoeba invadens
EIVVLKSALNTLLDKVLLLE

SEQ ID NO: 2993615 - protein, 17 aa, Entamoeba invadens
EIVWIDDVLPFKVFADR

SEQ ID NO: 2993616 - protein, 20 aa, Entamoeba invadens
EIVYKYLLSQDGWKTYMLNT

SEQ ID NO: 2993617 - protein, 18 aa, Entamoeba invadens
EIWVNKNTWLIKNDSFHD

SEQ ID NO: 2993618 - protein, 18 aa, Entamoeba invadens
EIWVNKNTWLIKSNSFHD

SEQ ID NO: 2993619 - protein, 23 aa, Entamoeba invadens
EIYCVILRYELNGDFYSVPLILK

SEQ ID NO: 2993620 - protein, 30 aa, Entamoeba invadens
EIYEYKNIKGWKLLPLETQLIMTLRIDFDK

SEQ ID NO: 2993621 - protein, 17 aa, Entamoeba invadens
EIYGGIAGLYDMGPLGC

SEQ ID NO: 2993622 - protein, 27 aa, Entamoeba invadens
EIYGMTKLIREYPVITISVFGIPEAQK

SEQ ID NO: 2993623 - protein, 20 aa, Entamoeba invadens
EIYLKNKIILSTDKIYGLGI

SEQ ID NO: 2993624 - protein, 23 aa, Entamoeba invadens
EIYSVRVKYYEKVPTSIAFVCFT

SEQ ID NO: 2993625 - protein, 39 aa, Entamoeba invadens
EIYTFWRVTIISTFHISRRLVLMIFVSCMNVTFAEKCKI

SEQ ID NO: 2993626 - protein, 18 aa, Entamoeba invadens
EKAAILRKKLPEMNQKVA

SEQ ID NO: 2993627 - protein, 23 aa, Entamoeba invadens
EKAERKLAKFERKESIFNTHIGK

SEQ ID NO: 2993628 - protein, 23 aa, Entamoeba invadens
EKAETFVVFQDKMCLLDVNKSCC

SEQ ID NO: 2993629 - protein, 17 aa, Entamoeba invadens
EKAFLPLDTFVLCYSAI

SEQ ID NO: 2993630 - protein, 17 aa, Entamoeba invadens
EKAKLVVWSGRQHMKAV

SEQ ID NO: 2993631 - protein, 19 aa, Entamoeba invadens
EKAKNMKKWSVEDASKIEN

SEQ ID NO: 2993632 - protein, 18 aa, Entamoeba invadens
EKALFEMKIKNVDLEALV

SEQ ID NO: 2993633 - protein, 24 aa, Entamoeba invadens
EKALQQGLLVFLLNSDCSVYFKRP

SEQ ID NO: 2993634 - protein, 28 aa, Entamoeba invadens
EKAQLFVKFGKYIVESLYVYAMTDKYSA

SEQ ID NO: 2993635 - protein, 19 aa, Entamoeba invadens
EKAVQWYIEAEKLGFTDFF

SEQ ID NO: 2993636 - protein, 18 aa, Entamoeba invadens
EKAVYVLDCPYSERLFKW

SEQ ID NO: 2993637 - protein, 24 aa, Entamoeba invadens
EKCDQIFPRVPKINKVPLIKTTHL

SEQ ID NO: 2993638 - protein, 27 aa, Entamoeba invadens
EKCEEICEFAFYKCFSLSKIDIPKSVT

SEQ ID NO: 2993639 - protein, 25 aa, Entamoeba invadens
EKCFYGCTLLYKIELPDSLTSIGNN

SEQ ID NO: 2993640 - protein, 22 aa, Entamoeba invadens
EKCIKLMNGRWFDQRQLTCEYY

SEQ ID NO: 2993641 - protein, 25 aa, Entamoeba invadens
EKCKSIKKLLLPKCLNTCFDFSLLT

SEQ ID NO: 2993642 - protein, 19 aa, Entamoeba invadens
EKCLLTGKRTKPVSKSHKP

SEQ ID NO: 2993643 - protein, 35 aa, Entamoeba invadens
EKCNTSVRTVIPIIKNFRKALNRKASRRTTICATN

SEQ ID NO: 2993644 - protein, 25 aa, Entamoeba invadens
EKCQQLYMFVPAYAKHTYLAYVANN

SEQ ID NO: 2993645 - protein, 23 aa, Entamoeba invadens
EKCQQYINPSYSPSPSPLSSDVS

SEQ ID NO: 2993646 - protein, 26 aa, Entamoeba invadens
EKCVSLQRIVIPPKIKTIPKNCFKNC

SEQ ID NO: 2993647 - protein, 24 aa, Entamoeba invadens
EKCYSLKNVIFPKSLHTIGEKCFY

SEQ ID NO: 2993648 - protein, 32 aa, Entamoeba invadens
EKDDLSNGYKWLLLSYIPDKSKVRMKMLYSST

SEQ ID NO: 2993649 - protein, 26 aa, Entamoeba invadens
EKDFSYVYVRAIYKDVNFSFCLHHHK

SEQ ID NO: 2993650 - protein, 23 aa, Entamoeba invadens
EKDFYAVFGAVFKKNSKWSLIKP

SEQ ID NO: 2993651 - protein, 18 aa, Entamoeba invadens
EKDHPYVIKCCGGFFASP

SEQ ID NO: 2993652 - protein, 27 aa, Entamoeba invadens
EKDIITPDDLIIDPKIILQQAERMERE

SEQ ID NO: 2993653 - protein, 20 aa, Entamoeba invadens
EKDIYIEKVILFQQRDCCSK

SEQ ID NO: 2993654 - protein, 20 aa, Entamoeba invadens
EKDKFLYHKTIKKAKEFLDS

SEQ ID NO: 2993655 - protein, 24 aa, Entamoeba invadens
EKDKIKIVLKEKEENLKGTLQQLE

SEQ ID NO: 2993656 - protein, 26 aa, Entamoeba invadens
EKDKLVIHVVPLPSGVFNVFASKNSP

SEQ ID NO: 2993657 - protein, 26 aa, Entamoeba invadens
EKDKQIEFGNKERIELQSSIENIKTE

SEQ ID NO: 2993658 - protein, 25 aa, Entamoeba invadens
EKDLNAFYGLVDFYVKILTAKKEAV

SEQ ID NO: 2993659 - protein, 24 aa, Entamoeba invadens
EKDLQECFYYFDTNGDNMLTAEQL

SEQ ID NO: 2993660 - protein, 18 aa, Entamoeba invadens
EKDLYFQLHPDASGIKFK

SEQ ID NO: 2993661 - protein, 24 aa, Entamoeba invadens
EKDMKKIDYFVKKIKAMIEEIKKK

SEQ ID NO: 2993662 - protein, 24 aa, Entamoeba invadens
EKDNQNIFFIDENEKMDLKNQKLE

SEQ ID NO: 2993663 - protein, 23 aa, Entamoeba invadens
EKDPDFYQFMLKNDPKLFSIEKE

SEQ ID NO: 2993664 - protein, 24 aa, Entamoeba invadens
EKDQIWYLDHQYLETLYRMTQRVT

SEQ ID NO: 2993665 - protein, 22 aa, Entamoeba invadens
EKDRKRVFTHILFDLIDTDHSG

SEQ ID NO: 2993666 - protein, 25 aa, Entamoeba invadens
EKDRRNVMVYLYDKHKITYDVFMGA

SEQ ID NO: 2993667 - protein, 23 aa, Entamoeba invadens
EKDSPDRLLPFKTPQDLVNTRQS

SEQ ID NO: 2993668 - protein, 20 aa, Entamoeba invadens
EKDSRFYRQWEICKTTNPDK

SEQ ID NO: 2993669 - protein, 23 aa, Entamoeba invadens
EKDTLFAYMEFNAKNDLALHQCL

SEQ ID NO: 2993670 - protein, 23 aa, Entamoeba invadens
EKDTTVFTVTFEEYFMGCVKQVA

SEQ ID NO: 2993671 - protein, 22 aa, Entamoeba invadens
EKDVFIMEIKFIDAKTLAVITP

SEQ ID NO: 2993672 - protein, 19 aa, Entamoeba invadens
EKDVLKRAYILLKTDDGDV

SEQ ID NO: 2993673 - protein, 22 aa, Entamoeba invadens
EKDVLRRFKALILLHTLSQLEE

SEQ ID NO: 2993674 - protein, 25 aa, Entamoeba invadens
EKDYGNRLLTLSKAPLRGASVCVQR

SEQ ID NO: 2993675 - protein, 25 aa, Entamoeba invadens
EKEAPLLCKMGNVRGFKLFKRLERL

SEQ ID NO: 2993676 - protein, 20 aa, Entamoeba invadens
EKEDTLLLQIQHLSEKLDTQ

SEQ ID NO: 2993677 - protein, 26 aa, Entamoeba invadens
EKEEALLQNANTEDTFIPLDSDEESE

SEQ ID NO: 2993678 - protein, 39 aa, Entamoeba invadens
EKEEITRLEIPMAMFHFGGTFTHIIGEKPVEMTIEAGTA

SEQ ID NO: 2993679 - protein, 22 aa, Entamoeba invadens
EKEEKFWFLKNNMIFDCVMVAM

SEQ ID NO: 2993680 - protein, 26 aa, Entamoeba invadens
EKEEMLYTLIVRNLPTVYKSVDLLRL

SEQ ID NO: 2993681 - protein, 33 aa, Entamoeba invadens
EKEEVKGLFWIWGDLWRRVYSALLDYDDQKYLT

SEQ ID NO: 2993682 - protein, 17 aa, Entamoeba invadens
EKEFVGSQRFFVFSLER

SEQ ID NO: 2993683 - protein, 22 aa, Entamoeba invadens
EKEHIRFLVCIQYLNATKCGGL

SEQ ID NO: 2993684 - protein, 29 aa, Entamoeba invadens
EKEIGGKKIKFVVLPNYKGKKCFKCGKYG

SEQ ID NO: 2993685 - protein, 18 aa, Entamoeba invadens
EKEIQLNEKLEKMKNEKK

SEQ ID NO: 2993686 - protein, 17 aa, Entamoeba invadens
EKEITPFAFDFTNKIFY

SEQ ID NO: 2993687 - protein, 18 aa, Entamoeba invadens
EKEIVVEPPLEKRKKRST

SEQ ID NO: 2993688 - protein, 34 aa, Entamoeba invadens
EKEKKCDVWPRLVHLYHYFGEKYTTFLDVQDRGE

SEQ ID NO: 2993689 - protein, 34 aa, Entamoeba invadens
EKEKLLYIETSDLLVRLINILSGYINAVATAHRI

SEQ ID NO: 2993690 - protein, 19 aa, Entamoeba invadens
EKEKLRLLLPMRCDEFENQ

SEQ ID NO: 2993691 - protein, 23 aa, Entamoeba invadens
EKEKLSFEIFYDKVYTFVCPSQS

SEQ ID NO: 2993692 - protein, 20 aa, Entamoeba invadens
EKELEDIFNCNGCKVKIVTA

SEQ ID NO: 2993693 - protein, 28 aa, Entamoeba invadens
EKELHDMYGFYIGLNAPQVKYFAFDFHK

SEQ ID NO: 2993694 - protein, 29 aa, Entamoeba invadens
EKELNILLEKVMIRRLKIDVLKELGKKER

SEQ ID NO: 2993695 - protein, 19 aa, Entamoeba invadens
EKELTRRISIVSSDKEKMY

SEQ ID NO: 2993696 - protein, 26 aa, Entamoeba invadens
EKELTTIEFLLFKASFLLKTVSRNDT

SEQ ID NO: 2993697 - protein, 23 aa, Entamoeba invadens
EKEMITYADAFPKLFEVLNIIRV

SEQ ID NO: 2993698 - protein, 22 aa, Entamoeba invadens
EKEMSVMDFLRQMSKEKPISPS

SEQ ID NO: 2993699 - protein, 20 aa, Entamoeba invadens
EKEMVVFGNPLIAPQVFSLI

SEQ ID NO: 2993700 - protein, 17 aa, Entamoeba invadens
EKENLKCKIGVQNPFDV

SEQ ID NO: 2993701 - protein, 21 aa, Entamoeba invadens
EKEQLARYRQLQSQKYHQTST

SEQ ID NO: 2993702 - protein, 30 aa, Entamoeba invadens
EKERELETTIKQFDAIKKRMDEVNDQKTLL

SEQ ID NO: 2993703 - protein, 18 aa, Entamoeba invadens
EKERMFHFLIDDFAYNRE

SEQ ID NO: 2993704 - protein, 27 aa, Entamoeba invadens
EKERNRIVLLFQNLTPKSFLRTLKNFV

SEQ ID NO: 2993705 - protein, 23 aa, Entamoeba invadens
EKETDFVMVWKMMNKYINDLTSS

SEQ ID NO: 2993706 - protein, 23 aa, Entamoeba invadens
EKEYEAFYLKKGKSKKLVWLNHL

SEQ ID NO: 2993707 - protein, 38 aa, Entamoeba invadens
EKEYRKVLVTTPWYFDCHIRISYHYWDLGRYDLASHEL

SEQ ID NO: 2993708 - protein, 21 aa, Entamoeba invadens
EKFAKRGGIPKQKKIKKVEVK

SEQ ID NO: 2993709 - protein, 22 aa, Entamoeba invadens
EKFCAQLFPKITRLTFYSFEDP

SEQ ID NO: 2993710 - protein, 24 aa, Entamoeba invadens
EKFDLLKDVLKLSYKTRNAQGINL

SEQ ID NO: 2993711 - protein, 18 aa, Entamoeba invadens
EKFDRRRRGYLDRAQFRT

SEQ ID NO: 2993712 - protein, 22 aa, Entamoeba invadens
EKFHFNPILLDFKTLRYFPNIE

SEQ ID NO: 2993713 - protein, 26 aa, Entamoeba invadens
EKFHFNPIPLIFKTLGYFSNIETLHL

SEQ ID NO: 2993714 - protein, 27 aa, Entamoeba invadens
EKFHFNPIPLNFKTLGFFPNIETLHLW

SEQ ID NO: 2993715 - protein, 27 aa, Entamoeba invadens
EKFHFNPIPLNFKTLGYFPKIETLHLW

SEQ ID NO: 2993716 - protein, 26 aa, Entamoeba invadens
EKFHFNPIPLNFKTLGYFPNIETLHL

SEQ ID NO: 2993717 - protein, 35 aa, Entamoeba invadens
EKFHFNPIPLNFKTLGYFPNIETLYLWDVKDENFG

SEQ ID NO: 2993718 - protein, 28 aa, Entamoeba invadens
EKFHFNPIPLNFKTLGYLPNIETLHLWD

SEQ ID NO: 2993719 - protein, 20 aa, Entamoeba invadens
EKFHFNPIPLNSKTFVYFPN

SEQ ID NO: 2993720 - protein, 21 aa, Entamoeba invadens
EKFHFNPIPLNSKTLGYFSNI

SEQ ID NO: 2993721 - protein, 21 aa, Entamoeba invadens
EKFHFNPIPLNYKTIKYFTNI

SEQ ID NO: 2993722 - protein, 19 aa, Entamoeba invadens
EKFHFNPIPLNYKTIRYFP

SEQ ID NO: 2993723 - protein, 20 aa, Entamoeba invadens
EKFHFNPIPLNYKTIRYFPN

SEQ ID NO: 2993724 - protein, 19 aa, Entamoeba invadens
EKFHFNPIPLSQKTRKYFP

SEQ ID NO: 2993725 - protein, 24 aa, Entamoeba invadens
EKFHFNPIPLTFKIQKYFPNIETL

SEQ ID NO: 2993726 - protein, 24 aa, Entamoeba invadens
EKFHFNPIPLTVKTVGYFPNIETL

SEQ ID NO: 2993727 - protein, 27 aa, Entamoeba invadens
EKFHYNPIPLTFKTLKYFPNIETLHLW

SEQ ID NO: 2993728 - protein, 26 aa, Entamoeba invadens
EKFKGRLFISAFTFCMEMLNSKKYQK

SEQ ID NO: 2993729 - protein, 26 aa, Entamoeba invadens
EKFKKSRVFFSKPLASQWYEKEDLTR

SEQ ID NO: 2993730 - protein, 26 aa, Entamoeba invadens
EKFKKYLFDTVSVSYAFYLQMKAFGY

SEQ ID NO: 2993731 - protein, 18 aa, Entamoeba invadens
EKFKTMRDYKTASEELMR

SEQ ID NO: 2993732 - protein, 23 aa, Entamoeba invadens
EKFMTIVFERIALPITLDNKDQT

SEQ ID NO: 2993733 - protein, 20 aa, Entamoeba invadens
EKFPNFFNEIDLITGVSASS

SEQ ID NO: 2993734 - protein, 25 aa, Entamoeba invadens
EKFSFALNFCSLPKGLQPSSCKKEE

SEQ ID NO: 2993735 - protein, 22 aa, Entamoeba invadens
EKFVQMYRNLGKKVVLMSPIAA

SEQ ID NO: 2993736 - protein, 22 aa, Entamoeba invadens
EKGAVGFWYLFQERMEEEFLYI

SEQ ID NO: 2993737 - protein, 26 aa, Entamoeba invadens
EKGDAYKLKLCFCPFCQVGIKALGLD

SEQ ID NO: 2993738 - protein, 18 aa, Entamoeba invadens
EKGDLLLIVQQKINEPTD

SEQ ID NO: 2993739 - protein, 26 aa, Entamoeba invadens
EKGIHLIVRDILGKWGWTLKEMRERE

SEQ ID NO: 2993740 - protein, 17 aa, Entamoeba invadens
EKGIIELKRMYSDGLLS

SEQ ID NO: 2993741 - protein, 27 aa, Entamoeba invadens
EKGKDIKLPLLPPLRPKTPKPTEEQAL

SEQ ID NO: 2993742 - protein, 23 aa, Entamoeba invadens
EKGKSIVDPLQAQDFQKLVKDNV

SEQ ID NO: 2993743 - protein, 23 aa, Entamoeba invadens
EKGKVFDVWKQMKTLNVLYAAEG

SEQ ID NO: 2993744 - protein, 26 aa, Entamoeba invadens
EKGLPPKGIPFLILGQEENPADTKLM

SEQ ID NO: 2993745 - protein, 29 aa, Entamoeba invadens
EKGREKFDRYLIRPNLNKFAFKIDKKDSN

SEQ ID NO: 2993746 - protein, 29 aa, Entamoeba invadens
EKGVDLWKIIFFIAVKYIEINGKPKDFAF

SEQ ID NO: 2993747 - protein, 18 aa, Entamoeba invadens
EKHDPVLSVYSPGNNLAA

SEQ ID NO: 2993748 - protein, 39 aa, Entamoeba invadens
EKHFYCGQLLCLYGCYHKNRIFSLLKKGEVSKDKLPAVG

SEQ ID NO: 2993749 - protein, 29 aa, Entamoeba invadens
EKHISEFVVWMYNHLLVGYSNEFPLTGEF

SEQ ID NO: 2993750 - protein, 21 aa, Entamoeba invadens
EKHIVWLPCNMKIESFSSLNV

SEQ ID NO: 2993751 - protein, 21 aa, Entamoeba invadens
EKHVIVMIVAAKIDLAAKREV

SEQ ID NO: 2993752 - protein, 18 aa, Entamoeba invadens
EKIARMFCLMSNGTISPV

SEQ ID NO: 2993753 - protein, 27 aa, Entamoeba invadens
EKIDAIYLLELFFGKENPQVIRFIQFL

SEQ ID NO: 2993754 - protein, 26 aa, Entamoeba invadens
EKIFPIDNVYIRKVKILKSGKIDSLK

SEQ ID NO: 2993755 - protein, 24 aa, Entamoeba invadens
EKIFRIYLCFMMSEAGNVESIFDV

SEQ ID NO: 2993756 - protein, 28 aa, Entamoeba invadens
EKIGEILFNGWLRLFDTKIVFENVIESF

SEQ ID NO: 2993757 - protein, 25 aa, Entamoeba invadens
EKIHPQIIIEGWRVALKAAQERLGS

SEQ ID NO: 2993758 - protein, 24 aa, Entamoeba invadens
EKIKEFLGLIPKEKLSVAATFLKQ

SEQ ID NO: 2993759 - protein, 19 aa, Entamoeba invadens
EKIMCGWRKQLKGLDEKYV

SEQ ID NO: 2993760 - protein, 28 aa, Entamoeba invadens
EKINTFKTFFFNTLVVSYEFYLQMKAFG

SEQ ID NO: 2993761 - protein, 30 aa, Entamoeba invadens
EKIRKLEEKWKFRKIPLPTDDRLIMLRLRE

SEQ ID NO: 2993762 - protein, 28 aa, Entamoeba invadens
EKIRLNPSTVLFFNGLTNPTYGTMNTLS

SEQ ID NO: 2993763 - protein, 25 aa, Entamoeba invadens
EKITVQILRAVLSTIFNLLLDEEML

SEQ ID NO: 2993764 - protein, 21 aa, Entamoeba invadens
EKIVIFAYHVDVITGLTQFLI

SEQ ID NO: 2993765 - protein, 24 aa, Entamoeba invadens
EKIVYYYSDTFDTTYNRCVMVKGG

SEQ ID NO: 2993766 - protein, 18 aa, Entamoeba invadens
EKIYLANVVLYLNDIDSA

SEQ ID NO: 2993767 - protein, 56 aa, Entamoeba invadens
EKKARKALEKVGLVEVLNVIEFSMKRADAKFVIHSPAVFKLPGSEQYVVYGEPRNE

SEQ ID NO: 2993768 - protein, 23 aa, Entamoeba invadens
EKKDILNFIEKVQIEKWSSCKLD

SEQ ID NO: 2993769 - protein, 31 aa, Entamoeba invadens
EKKDKNVSFLLATPQSKFLFEAEDRSVWVTK

SEQ ID NO: 2993770 - protein, 24 aa, Entamoeba invadens
EKKDQLILLDYRFTKTETPPSKKS

SEQ ID NO: 2993771 - protein, 22 aa, Entamoeba invadens
EKKEAWFYVSEYGEIVLKNAFI

SEQ ID NO: 2993772 - protein, 24 aa, Entamoeba invadens
EKKEKIFVQDKWWEKQQKDEPKEP

SEQ ID NO: 2993773 - protein, 35 aa, Entamoeba invadens
EKKEKVKQCYLCKETGHTFKDCKFKDDAEKVNVPL

SEQ ID NO: 2993774 - protein, 25 aa, Entamoeba invadens
EKKFIRLLCVLYRLMDIDQEYFILA

SEQ ID NO: 2993775 - protein, 21 aa, Entamoeba invadens
EKKIKIENRMAKIVDEKQNFE

SEQ ID NO: 2993776 - protein, 18 aa, Entamoeba invadens
EKKINKYTLFINQEEITT

SEQ ID NO: 2993777 - protein, 30 aa, Entamoeba invadens
EKKKLDPFLPIFLELFFDVSFVVFNDKTKS

SEQ ID NO: 2993778 - protein, 24 aa, Entamoeba invadens
EKKKLQYEYDQFNNLVFGHEDETN

SEQ ID NO: 2993779 - protein, 22 aa, Entamoeba invadens
EKKLAYDNTFIGAIKSLDAANI

SEQ ID NO: 2993780 - protein, 19 aa, Entamoeba invadens
EKKLGEGLFGIVYKVTYRG

SEQ ID NO: 2993781 - protein, 28 aa, Entamoeba invadens
EKKLTELNEQLDLERITAQQAKTQKKKY

SEQ ID NO: 2993782 - protein, 22 aa, Entamoeba invadens
EKKLTFDGFWGKDQLSKDQINY

SEQ ID NO: 2993783 - protein, 19 aa, Entamoeba invadens
EKKMVGPFLKDLGTKEFET

SEQ ID NO: 2993784 - protein, 24 aa, Entamoeba invadens
EKKMVPPPMRYIKKGSGTVVGNDD

SEQ ID NO: 2993785 - protein, 17 aa, Entamoeba invadens
EKKNNVIMIITETIRKL

SEQ ID NO: 2993786 - protein, 24 aa, Entamoeba invadens
EKKPGMVDLFDDYLDLFRQINRGV

SEQ ID NO: 2993787 - protein, 24 aa, Entamoeba invadens
EKKPRKNFTVSQKVIPVSKRKNKP

SEQ ID NO: 2993788 - protein, 24 aa, Entamoeba invadens
EKKQKLIKWPIHVDPFFSNKNVMC

SEQ ID NO: 2993789 - protein, 27 aa, Entamoeba invadens
EKKRRKYYKLAISESPFLLTSGGTQPA

SEQ ID NO: 2993790 - protein, 25 aa, Entamoeba invadens
EKKRVHIVWFVLNSVSGRLQPFEEE

SEQ ID NO: 2993791 - protein, 30 aa, Entamoeba invadens
EKKTKIGVRGGFPHGFNPADIKLKNTGGLR

SEQ ID NO: 2993792 - protein, 24 aa, Entamoeba invadens
EKKVFYQIVVWFGVGVDVVNRTIS

SEQ ID NO: 2993793 - protein, 19 aa, Entamoeba invadens
EKKVLLEKNEKLFKKCDLL

SEQ ID NO: 2993794 - protein, 31 aa, Entamoeba invadens
EKLDDLCYRLNKFIVTLFPEYKDVFSGAELE

SEQ ID NO: 2993795 - protein, 19 aa, Entamoeba invadens
EKLDQWSSLIIPSAICEDS

SEQ ID NO: 2993796 - protein, 29 aa, Entamoeba invadens
EKLELKEFIYMFYFIQLDGDFEKKKEIYI

SEQ ID NO: 2993797 - protein, 28 aa, Entamoeba invadens
EKLFEKSDILLFLAKRYYFNQQYEEALM

SEQ ID NO: 2993798 - protein, 22 aa, Entamoeba invadens
EKLFERCMGVVKKTLKESNISA

SEQ ID NO: 2993799 - protein, 18 aa, Entamoeba invadens
EKLFFEKLGEKRTLKTIK

SEQ ID NO: 2993800 - protein, 27 aa, Entamoeba invadens
EKLFKRDEVFKEWLLCKAINGERSSIE

SEQ ID NO: 2993801 - protein, 22 aa, Entamoeba invadens
EKLIRLCCAVLRRAKANIPDIL

SEQ ID NO: 2993802 - protein, 29 aa, Entamoeba invadens
EKLISKELPSFIFFRWDHTHEDKEFKSII

SEQ ID NO: 2993803 - protein, 17 aa, Entamoeba invadens
EKLLMYDEVREILRNIR

SEQ ID NO: 2993804 - protein, 25 aa, Entamoeba invadens
EKLPMDQLKMRMEDGELKLGHIEIA

SEQ ID NO: 2993805 - protein, 31 aa, Entamoeba invadens
EKLPSNIDLFLKKLRIFFPNIIDLKEVTSRL

SEQ ID NO: 2993806 - protein, 22 aa, Entamoeba invadens
EKLQKRLFDLSLSTRQTVVIIN

SEQ ID NO: 2993807 - protein, 19 aa, Entamoeba invadens
EKLQLFTPPPNCGLVFAKG

SEQ ID NO: 2993808 - protein, 26 aa, Entamoeba invadens
EKLQRDCKILLMMQKLVGMEITNTLN

SEQ ID NO: 2993809 - protein, 25 aa, Entamoeba invadens
EKLRDKLDDVLLKNGEPISDVSKGK

SEQ ID NO: 2993810 - protein, 23 aa, Entamoeba invadens
EKLRNWLIGLVLPGLFTSDDINA

SEQ ID NO: 2993811 - protein, 17 aa, Entamoeba invadens
EKLRTWLLDSKVSKFIQ

SEQ ID NO: 2993812 - protein, 29 aa, Entamoeba invadens
EKLSGKPLHQFLRRGFYYSEIDFEEVITA

SEQ ID NO: 2993813 - protein, 20 aa, Entamoeba invadens
EKLSSLFKWTRKSEYDILYD

SEQ ID NO: 2993814 - protein, 29 aa, Entamoeba invadens
EKLVDQLMVHCVRFVSIKIIELLVQNDTV

SEQ ID NO: 2993815 - protein, 21 aa, Entamoeba invadens
EKLVLLFTQAVFNKKISNKNK

SEQ ID NO: 2993816 - protein, 26 aa, Entamoeba invadens
EKLVNIPGPILYFDISQKDVLVQNKK

SEQ ID NO: 2993817 - protein, 20 aa, Entamoeba invadens
EKLYMVMDYIQGGELFHKLE

SEQ ID NO: 2993818 - protein, 19 aa, Entamoeba invadens
EKMDDVELTRLFCQNKSVT

SEQ ID NO: 2993819 - protein, 27 aa, Entamoeba invadens
EKMDFNCLKYILLPNNVSVIKNCCFRE

SEQ ID NO: 2993820 - protein, 25 aa, Entamoeba invadens
EKMDIKVSFDIPKFKYLCDGSTNLN

SEQ ID NO: 2993821 - protein, 21 aa, Entamoeba invadens
EKMDMLLYFQQTQAQRSVVRD

SEQ ID NO: 2993822 - protein, 27 aa, Entamoeba invadens
EKMEKQNFFIYLINDPELGSEEEKERK

SEQ ID NO: 2993823 - protein, 25 aa, Entamoeba invadens
EKMNRDHLKAIKTPSPRRVRVRSRS

SEQ ID NO: 2993824 - protein, 23 aa, Entamoeba invadens
EKMNYIKELLKPENKYSAEYIAQ

SEQ ID NO: 2993825 - protein, 23 aa, Entamoeba invadens
EKMPENIEFLKTGKIRDWSCCTK

SEQ ID NO: 2993826 - protein, 23 aa, Entamoeba invadens
EKMQGDTIFPYLGKTASAMTIKG

SEQ ID NO: 2993827 - protein, 28 aa, Entamoeba invadens
EKMRQKVSFLEIIPIYKQMNAELESLIQ

SEQ ID NO: 2993828 - protein, 24 aa, Entamoeba invadens
EKMSQIFLHFNDVFYINSVLLDNM

SEQ ID NO: 2993829 - protein, 24 aa, Entamoeba invadens
EKMSYNYRVLLINTNYSIVNYLLC

SEQ ID NO: 2993830 - protein, 20 aa, Entamoeba invadens
EKMYRMPVYSLVQHLKRKVE

SEQ ID NO: 2993831 - protein, 20 aa, Entamoeba invadens
EKNCCVIASGFLRDEETTEK

SEQ ID NO: 2993832 - protein, 29 aa, Entamoeba invadens
EKNCFRNYKLVTMLKMPISLKIVNSCCFC

SEQ ID NO: 2993833 - protein, 26 aa, Entamoeba invadens
EKNDFFITRLILDGFARCLKNKEILR

SEQ ID NO: 2993834 - protein, 26 aa, Entamoeba invadens
EKNESVFFLKWHVLQPDYAINLVNKE

SEQ ID NO: 2993835 - protein, 27 aa, Entamoeba invadens
EKNESVYFFKWHILQPDYATNLVEMEK

SEQ ID NO: 2993836 - protein, 31 aa, Entamoeba invadens
EKNESVYFLKWHILLPDYAINLVQMEKTPGG

SEQ ID NO: 2993837 - protein, 28 aa, Entamoeba invadens
EKNFVFTMFSAFWLKSDGKLAFHAMWKD

SEQ ID NO: 2993838 - protein, 24 aa, Entamoeba invadens
EKNGYLFVRLISKDIRVVTFRTSL

SEQ ID NO: 2993839 - protein, 30 aa, Entamoeba invadens
EKNKKIFVHNFLFDIALELGFTFDSKLSRK

SEQ ID NO: 2993840 - protein, 32 aa, Entamoeba invadens
EKNKRVFVHNLLFDLALEHGFFFNSKLSRKST

SEQ ID NO: 2993841 - protein, 24 aa, Entamoeba invadens
EKNLHTFLFIPGKINQKFVKEIRR

SEQ ID NO: 2993842 - protein, 24 aa, Entamoeba invadens
EKNMNTIVDFLKGEKIKVTTSVEE

SEQ ID NO: 2993843 - protein, 24 aa, Entamoeba invadens
EKNNALLEWVKKIASNYGLEVTGF

SEQ ID NO: 2993844 - protein, 26 aa, Entamoeba invadens
EKNPDIIVATPGRLTFILESANISLQ

SEQ ID NO: 2993845 - protein, 18 aa, Entamoeba invadens
EKNQEYFPTIKYSEFMSD

SEQ ID NO: 2993846 - protein, 25 aa, Entamoeba invadens
EKNRKVFVQNLLIDITRELDFEISS

SEQ ID NO: 2993847 - protein, 19 aa, Entamoeba invadens
EKNSLIFDLGGGTFDVSLL

SEQ ID NO: 2993848 - protein, 23 aa, Entamoeba invadens
EKNTIMITGASGFVGRFVLRSVC

SEQ ID NO: 2993849 - protein, 27 aa, Entamoeba invadens
EKNTKIVMLQLLSASRYLHSMNIVHRD

SEQ ID NO: 2993850 - protein, 20 aa, Entamoeba invadens
EKNTKMSLLLSARVAEDERA

SEQ ID NO: 2993851 - protein, 33 aa, Entamoeba invadens
EKNWKKVFVILKHTFLFVFKSAEDPTLIDVFLF

SEQ ID NO: 2993852 - protein, 23 aa, Entamoeba invadens
EKPKEVFTCHSCKIKKAIAFQVP

SEQ ID NO: 2993853 - protein, 23 aa, Entamoeba invadens
EKPLQIERVVIPSVSELRNESDV

SEQ ID NO: 2993854 - protein, 22 aa, Entamoeba invadens
EKPPSMLKFAEEYKFLVEKQEM

SEQ ID NO: 2993855 - protein, 33 aa, Entamoeba invadens
EKPQIRAKPMHHFTYQRLKEITLFTCENGIYLL

SEQ ID NO: 2993856 - protein, 28 aa, Entamoeba invadens
EKPRFLLRRVLMGLFMRPHMLNFLTPEE

SEQ ID NO: 2993857 - protein, 24 aa, Entamoeba invadens
EKQCTTCFLSYGVFSGRCHKCSEE

SEQ ID NO: 2993858 - protein, 24 aa, Entamoeba invadens
EKQDFAFLAGAERSSKRFEIGEGD

SEQ ID NO: 2993859 - protein, 25 aa, Entamoeba invadens
EKQEFSETLVFVGNLAFAATDDDLK

SEQ ID NO: 2993860 - protein, 24 aa, Entamoeba invadens
EKQGPKIPPFIKPNRKDVTVDNTD

SEQ ID NO: 2993861 - protein, 23 aa, Entamoeba invadens
EKQMNEFFVFPTNTNYVGMSFNF

SEQ ID NO: 2993862 - protein, 24 aa, Entamoeba invadens
EKQMQIETINTKLAELHTKLESEK

SEQ ID NO: 2993863 - protein, 31 aa, Entamoeba invadens
EKQNVSYYIYLYYFYSNIVSLNILRTMKGLN

SEQ ID NO: 2993864 - protein, 17 aa, Entamoeba invadens
EKQQFFNKAWSNEKLAP

SEQ ID NO: 2993865 - protein, 22 aa, Entamoeba invadens
EKQQNEVLYYDQSTPFSGNIDM

SEQ ID NO: 2993866 - protein, 26 aa, Entamoeba invadens
EKQRDTFCLLMIKAEVLQGLLTGTTG

SEQ ID NO: 2993867 - protein, 23 aa, Entamoeba invadens
EKQTVLYCNSTLWQILEAEGRQA

SEQ ID NO: 2993868 - protein, 29 aa, Entamoeba invadens
EKQVKLVNAMDLALNWIMGGSTKYTRNDG

SEQ ID NO: 2993869 - protein, 23 aa, Entamoeba invadens
EKRANVWFMSPPCQPYNNSIMSK

SEQ ID NO: 2993870 - protein, 20 aa, Entamoeba invadens
EKRCRRLYSLKSSTTHDEFT

SEQ ID NO: 2993871 - protein, 25 aa, Entamoeba invadens
EKRFEAEFKPMVTVVEPEIEQPGYY

SEQ ID NO: 2993872 - protein, 26 aa, Entamoeba invadens
EKRGERFIMAFGVGAPQKMFLTRKSK

SEQ ID NO: 2993873 - protein, 33 aa, Entamoeba invadens
EKRGFDLIKTVWVKKQYVGQSVIIPINIDILSE

SEQ ID NO: 2993874 - protein, 31 aa, Entamoeba invadens
EKRKKKQWKFLQKYYHIGSFFLDGSDWDVTK

SEQ ID NO: 2993875 - protein, 28 aa, Entamoeba invadens
EKRKQHAFLSANYKKYFPKPATIYISQN

SEQ ID NO: 2993876 - protein, 28 aa, Entamoeba invadens
EKRKTKYKYLLRQTSTKTIQLFEQYLKK

SEQ ID NO: 2993877 - protein, 17 aa, Entamoeba invadens
EKRLREQLLGKKRIKWE

SEQ ID NO: 2993878 - protein, 26 aa, Entamoeba invadens
EKRQEIMHYLEDVLFLYHFDTKLEID

SEQ ID NO: 2993879 - protein, 18 aa, Entamoeba invadens
EKRVIQQDKWWEKKSEKK

SEQ ID NO: 2993880 - protein, 27 aa, Entamoeba invadens
EKRVRFITKGILSPHFKMLKLPHHPFV

SEQ ID NO: 2993881 - protein, 23 aa, Entamoeba invadens
EKRVTGAGFKRPNGGFGDFVIRK

SEQ ID NO: 2993882 - protein, 21 aa, Entamoeba invadens
EKRVYVRVRYLLTSDSVCFHG

SEQ ID NO: 2993883 - protein, 29 aa, Entamoeba invadens
EKRWVPYPRHFFLPYYLTSPYCYEGSQRG

SEQ ID NO: 2993884 - protein, 32 aa, Entamoeba invadens
EKRYSQFYFLDNYLHLKLPKKVMPTLPPKEIL

SEQ ID NO: 2993885 - protein, 29 aa, Entamoeba invadens
EKSAWTRYIEFWVLYARFEEKHNNIERAQ

SEQ ID NO: 2993886 - protein, 29 aa, Entamoeba invadens
EKSDTFLQVNPWRIFSGSCPPKRLENTST

SEQ ID NO: 2993887 - protein, 26 aa, Entamoeba invadens
EKSDVYSLGIIIWEMTYRTVYQKYMR

SEQ ID NO: 2993888 - protein, 24 aa, Entamoeba invadens
EKSEIANLISLFGDVKKRNVGGKI

SEQ ID NO: 2993889 - protein, 19 aa, Entamoeba invadens
EKSFGVFLEFLLKTIKENA

SEQ ID NO: 2993890 - protein, 31 aa, Entamoeba invadens
EKSGVINFNFVMKDLYAFYSGMANPLIYKSF

SEQ ID NO: 2993891 - protein, 34 aa, Entamoeba invadens
EKSIPRMCVLMNNLLLIAKVKMFKGLKVDDGYIT

SEQ ID NO: 2993892 - protein, 18 aa, Entamoeba invadens
EKSKILMRFFKTGKGEYG

SEQ ID NO: 2993893 - protein, 23 aa, Entamoeba invadens
EKSKQFKLLVKECLRELTIDMNS

SEQ ID NO: 2993894 - protein, 27 aa, Entamoeba invadens
EKSKVTRIYLPFCFTSYSYELKNEPVL

SEQ ID NO: 2993895 - protein, 27 aa, Entamoeba invadens
EKSLLKFPFVIPVNYKMKFLHQEAKQE

SEQ ID NO: 2993896 - protein, 29 aa, Entamoeba invadens
EKSLPPKKERILRVGLSGLQKQYYRWIIT

SEQ ID NO: 2993897 - protein, 18 aa, Entamoeba invadens
EKSPIASYFYKKLSEKGL

SEQ ID NO: 2993898 - protein, 23 aa, Entamoeba invadens
EKSPLLLKYIASEALYSLPEMNI

SEQ ID NO: 2993899 - protein, 27 aa, Entamoeba invadens
EKSPLTYFLPLIFDIPQNYPTNLPLVK

SEQ ID NO: 2993900 - protein, 18 aa, Entamoeba invadens
EKSPVDIDFFSSTPPKKT

SEQ ID NO: 2993901 - protein, 25 aa, Entamoeba invadens
EKSQLGLSRLSLMGARPSIMRSMVK

SEQ ID NO: 2993902 - protein, 23 aa, Entamoeba invadens
EKSRPCLPGDLLMKSGEDAVNEM

SEQ ID NO: 2993903 - protein, 37 aa, Entamoeba invadens
EKSSILYKAPISLKKYKLIKKYLRFDDGAYLREIARI

SEQ ID NO: 2993904 - protein, 27 aa, Entamoeba invadens
EKSTVKPIFGTLLFTSARIIFLKQNDK

SEQ ID NO: 2993905 - protein, 23 aa, Entamoeba invadens
EKSVHVVLIGLPKTGKTALASQF

SEQ ID NO: 2993906 - protein, 25 aa, Entamoeba invadens
EKSVNRYTLHFPGKRLKTVSVSNTS

SEQ ID NO: 2993907 - protein, 25 aa, Entamoeba invadens
EKSYPLLQEILPNTLELSKDQYGNY

SEQ ID NO: 2993908 - protein, 26 aa, Entamoeba invadens
EKTAKFLFLASTDDLNLHKLETSYKA

SEQ ID NO: 2993909 - protein, 39 aa, Entamoeba invadens
EKTAQLMFERFKTPLLYFSMQPILSLFAAEKIDGLVVDS

SEQ ID NO: 2993910 - protein, 29 aa, Entamoeba invadens
EKTDRQRFFCVIFWYPVSYSTTRKYTNEN

SEQ ID NO: 2993911 - protein, 24 aa, Entamoeba invadens
EKTETYFPALQLISIAKKFVDFSH

SEQ ID NO: 2993912 - protein, 33 aa, Entamoeba invadens
EKTGYGFYVTKDPGFFLFCLAGKSVLKPKKYTK

SEQ ID NO: 2993913 - protein, 33 aa, Entamoeba invadens
EKTHAFAIAVEWYRVLKVLCWSSIQNSINEEIT

SEQ ID NO: 2993914 - protein, 24 aa, Entamoeba invadens
EKTLIFLNCHLIYIATQPALLLET

SEQ ID NO: 2993915 - protein, 19 aa, Entamoeba invadens
EKTLPIFSTGKWGSGAYKG

SEQ ID NO: 2993916 - protein, 25 aa, Entamoeba invadens
EKTLSVFIFAYFNKDGKVYLDNLRD

SEQ ID NO: 2993917 - protein, 23 aa, Entamoeba invadens
EKTNFYPDYFLINSMMMYNIYKN

SEQ ID NO: 2993918 - protein, 23 aa, Entamoeba invadens
EKTNSFGLFLKLSCNTSVVPNQP

SEQ ID NO: 2993919 - protein, 25 aa, Entamoeba invadens
EKTQLTLLDFINRATLEKLSFKKTK

SEQ ID NO: 2993920 - protein, 30 aa, Entamoeba invadens
EKTVVFTMFYLLYAVGHLEHFCKDEPFLVV

SEQ ID NO: 2993921 - protein, 21 aa, Entamoeba invadens
EKTYGGHSVFAFLYGNKMEMA

SEQ ID NO: 2993922 - protein, 29 aa, Entamoeba invadens
EKVDHPVFEGELLIPKKSQTKQTKLGDYV

SEQ ID NO: 2993923 - protein, 21 aa, Entamoeba invadens
EKVDLAVIAIPAKFVPSVCVE

SEQ ID NO: 2993924 - protein, 25 aa, Entamoeba invadens
EKVEAIWNSYVVPSMPVNTATTQPE

SEQ ID NO: 2993925 - protein, 25 aa, Entamoeba invadens
EKVEFPTFIPEIKPIRPIQNQKDFV

SEQ ID NO: 2993926 - protein, 26 aa, Entamoeba invadens
EKVERKLSFTFAKKEKKDKTESRKSL

SEQ ID NO: 2993927 - protein, 25 aa, Entamoeba invadens
EKVERKVILNPKFTGKISKKKVSPV

SEQ ID NO: 2993928 - protein, 28 aa, Entamoeba invadens
EKVGFNRVLLYLFSRYFEKLLEKEQNEF

SEQ ID NO: 2993929 - protein, 26 aa, Entamoeba invadens
EKVGILKLFLECSCTPFFLHLDNIDF

SEQ ID NO: 2993930 - protein, 22 aa, Entamoeba invadens
EKVILPKSLSSVFYNRGYYGTV

SEQ ID NO: 2993931 - protein, 18 aa, Entamoeba invadens
EKVIVILRNRYGKAVYSF

SEQ ID NO: 2993932 - protein, 29 aa, Entamoeba invadens
EKVKEKGVLPRVVYLDDFMSELCVYVDVK

SEQ ID NO: 2993933 - protein, 27 aa, Entamoeba invadens
EKVKTPLYVNVLTLGVWPFSNETVPSE

SEQ ID NO: 2993934 - protein, 20 aa, Entamoeba invadens
EKVKYILCDPSCSGSGILER

SEQ ID NO: 2993935 - protein, 21 aa, Entamoeba invadens
EKVLESLVRGIPIVSEKYLEA

SEQ ID NO: 2993936 - protein, 20 aa, Entamoeba invadens
EKVLLSADFIKKIGKSWNDV

SEQ ID NO: 2993937 - protein, 30 aa, Entamoeba invadens
EKVMEPPKKWMYFFLFNDRLVETIPELYEG

SEQ ID NO: 2993938 - protein, 18 aa, Entamoeba invadens
EKVNVPLEAHEDAKNGEI

SEQ ID NO: 2993939 - protein, 23 aa, Entamoeba invadens
EKVPIGAFGYIQSKWMGEKVVEK

SEQ ID NO: 2993940 - protein, 27 aa, Entamoeba invadens
EKVREIDPYFYIIRPSDLVSERLNKRS

SEQ ID NO: 2993941 - protein, 18 aa, Entamoeba invadens
EKVSLLTIPEKCQYFQSV

SEQ ID NO: 2993942 - protein, 25 aa, Entamoeba invadens
EKYAQEIVKFMQKPGNTKPVVTATE

SEQ ID NO: 2993943 - protein, 28 aa, Entamoeba invadens
EKYHSLVRLYFKDIKGVLLVFQIDRQES

SEQ ID NO: 2993944 - protein, 24 aa, Entamoeba invadens
EKYIGIDLGFLRYLVEFIKHETVS

SEQ ID NO: 2993945 - protein, 23 aa, Entamoeba invadens
EKYIHPPSIPLLKGNWHVTIQGD

SEQ ID NO: 2993946 - protein, 17 aa, Entamoeba invadens
EKYKMPCDIYSLAISFF

SEQ ID NO: 2993947 - protein, 18 aa, Entamoeba invadens
EKYLYMFETHIEQGPILE

SEQ ID NO: 2993948 - protein, 17 aa, Entamoeba invadens
EKYNIKTACVKNAFCVG

SEQ ID NO: 2993949 - protein, 28 aa, Entamoeba invadens
EKYNLGEMFMPLLYPLLSSADMDVVSEA

SEQ ID NO: 2993950 - protein, 25 aa, Entamoeba invadens
EKYQERMCCLLIAIIFEITDIEKVK

SEQ ID NO: 2993951 - protein, 24 aa, Entamoeba invadens
EKYRSMVGMYYRGASGAIIVYDIT

SEQ ID NO: 2993952 - protein, 25 aa, Entamoeba invadens
EKYSKWTIRMLLGYNKIVAMGIDVD

SEQ ID NO: 2993953 - protein, 26 aa, Entamoeba invadens
EKYTRTLLYYFSSRGKLVDLLNRIIS

SEQ ID NO: 2993954 - protein, 20 aa, Entamoeba invadens
ELAFKHLTSYFYREFYRIIV

SEQ ID NO: 2993955 - protein, 18 aa, Entamoeba invadens
ELAKESTLYLGLFTPIMN

SEQ ID NO: 2993956 - protein, 28 aa, Entamoeba invadens
ELAKPYNLPTMFMIPYSMNEIQQLVQAP

SEQ ID NO: 2993957 - protein, 25 aa, Entamoeba invadens
ELAQFQEQLLTRKNLLLQQENIMET

SEQ ID NO: 2993958 - protein, 18 aa, Entamoeba invadens
ELASLLMDSAYYAHYNIL

SEQ ID NO: 2993959 - protein, 40 aa, Entamoeba invadens
ELASVCGGYIFMPLNPLYTKPQLERLLPRVKPSIVVTMMR

SEQ ID NO: 2993960 - protein, 25 aa, Entamoeba invadens
ELATLPLDDVFLKIELLSGVRNDMP

SEQ ID NO: 2993961 - protein, 25 aa, Entamoeba invadens
ELAYNDIFLILHDGTMHRFIDFDDF

SEQ ID NO: 2993962 - protein, 19 aa, Entamoeba invadens
ELCEDIPIVLYGNKCDLEL

SEQ ID NO: 2993963 - protein, 28 aa, Entamoeba invadens
ELCGMRLCKLAVMLVALGGVPHLDEVTK

SEQ ID NO: 2993964 - protein, 20 aa, Entamoeba invadens
ELCIALANHLDWYTTLYATD

SEQ ID NO: 2993965 - protein, 23 aa, Entamoeba invadens
ELCKEILKFRPLKKYVTVIPSSL

SEQ ID NO: 2993966 - protein, 24 aa, Entamoeba invadens
ELCTKIVIMLSLVFSTPKLVFLFQ

SEQ ID NO: 2993967 - protein, 20 aa, Entamoeba invadens
ELCVQCVLISILNKFHTFVV

SEQ ID NO: 2993968 - protein, 21 aa, Entamoeba invadens
ELCVRLGIVKYFECTAFDNNN

SEQ ID NO: 2993969 - protein, 17 aa, Entamoeba invadens
ELCWKFRTTVEQYIIKM

SEQ ID NO: 2993970 - protein, 25 aa, Entamoeba invadens
ELDAKAIASMELLKKLFPKSQNNYE

SEQ ID NO: 2993971 - protein, 23 aa, Entamoeba invadens
ELDDFYRYEVIPGFIKRLNELLS

SEQ ID NO: 2993972 - protein, 17 aa, Entamoeba invadens
ELDELLKAKWPKDMKIN

SEQ ID NO: 2993973 - protein, 27 aa, Entamoeba invadens
ELDGKSFKGWVISVKYDKTDDKNKTLL

SEQ ID NO: 2993974 - protein, 33 aa, Entamoeba invadens
ELDIIPMVLETIDDCVWAIMAIKEVGGKLQKTT

SEQ ID NO: 2993975 - protein, 18 aa, Entamoeba invadens
ELDKALAFFLRRNEYIKV

SEQ ID NO: 2993976 - protein, 26 aa, Entamoeba invadens
ELDKDLFINFMRLLKPRNIEKSRFYH

SEQ ID NO: 2993977 - protein, 34 aa, Entamoeba invadens
ELDKDLMFLISSVSPLFYSMNPAVVVEATLLYFH

SEQ ID NO: 2993978 - protein, 29 aa, Entamoeba invadens
ELDKIIIKNPLFIVALPRSGSTFTHAVLS

SEQ ID NO: 2993979 - protein, 25 aa, Entamoeba invadens
ELDQLQQNFDYFKKNADTDAADKKK

SEQ ID NO: 2993980 - protein, 25 aa, Entamoeba invadens
ELDQLQQNFDYLKKNADTDAADKKK

SEQ ID NO: 2993981 - protein, 25 aa, Entamoeba invadens
ELDQLQQNFDYLKKNADTDTVDKKK

SEQ ID NO: 2993982 - protein, 19 aa, Entamoeba invadens
ELDQLQQNFDYLKNNADTD

SEQ ID NO: 2993983 - protein, 17 aa, Entamoeba invadens
ELDQLQQNIDYLKKYAD

SEQ ID NO: 2993984 - protein, 23 aa, Entamoeba invadens
ELDQNGTLIIPFIEELINNNAEI

SEQ ID NO: 2993985 - protein, 21 aa, Entamoeba invadens
ELDRKFKLHYLLNSQKSKTLT

SEQ ID NO: 2993986 - protein, 20 aa, Entamoeba invadens
ELDVLFHEKVKTPLYVNVLT

SEQ ID NO: 2993987 - protein, 17 aa, Entamoeba invadens
ELEAFEQAAKTYKQSKN

SEQ ID NO: 2993988 - protein, 30 aa, Entamoeba invadens
ELEAKLMLGDRFFRLNPKLPHYVDLDDCKD

SEQ ID NO: 2993989 - protein, 23 aa, Entamoeba invadens
ELEALYNVVRLRSQVSQKSELRR

SEQ ID NO: 2993990 - protein, 24 aa, Entamoeba invadens
ELECVLLALLSLKYSFTISKPQKK

SEQ ID NO: 2993991 - protein, 25 aa, Entamoeba invadens
ELEDIKMLILLILNTRGNITEYKTE

SEQ ID NO: 2993992 - protein, 24 aa, Entamoeba invadens
ELEDKKLMLEQMNQLILESKVQDA

SEQ ID NO: 2993993 - protein, 21 aa, Entamoeba invadens
ELEFVMCNLIFKGIMKSQLYH

SEQ ID NO: 2993994 - protein, 29 aa, Entamoeba invadens
ELEGQLIQRPWFFQALEELEYFETSIPEQ

SEQ ID NO: 2993995 - protein, 19 aa, Entamoeba invadens
ELELPKTVIRISNNMFAHC

SEQ ID NO: 2993996 - protein, 40 aa, Entamoeba invadens
ELENTPLNVLLIQPIQRIMRYPMLIKEVLKFTPQSHPDYF

SEQ ID NO: 2993997 - protein, 31 aa, Entamoeba invadens
ELESLQTVVLLAHLLYEVSKTWVFEKSVDQE

SEQ ID NO: 2993998 - protein, 26 aa, Entamoeba invadens
ELFDALKYRIVPMLLTVVVVPSIFIQ

SEQ ID NO: 2993999 - protein, 23 aa, Entamoeba invadens
ELFDTYQRTILKLIRTELLSPIE

SEQ ID NO: 2994000 - protein, 17 aa, Entamoeba invadens
ELFESFLTLVQHNQFFA

SEQ ID NO: 2994001 - protein, 23 aa, Entamoeba invadens
ELFGKVRNFYKRDQTIDLTELIQ

SEQ ID NO: 2994002 - protein, 26 aa, Entamoeba invadens
ELFGRVFQVFLRNQKWYKFVSNLGDA

SEQ ID NO: 2994003 - protein, 26 aa, Entamoeba invadens
ELFKDLKAFVTKFLEYAFTALDAEDL

SEQ ID NO: 2994004 - protein, 23 aa, Entamoeba invadens
ELFKEWKSGMPLAMVFVSSFNSV

SEQ ID NO: 2994005 - protein, 18 aa, Entamoeba invadens
ELFLRLDTSEKNPYPFIL

SEQ ID NO: 2994006 - protein, 24 aa, Entamoeba invadens
ELFLTFIEMFPKKCKPVKDVLIPM

SEQ ID NO: 2994007 - protein, 17 aa, Entamoeba invadens
ELFNKNNFFIKMGPDKV

SEQ ID NO: 2994008 - protein, 17 aa, Entamoeba invadens
ELFPSLPDEVALSPCPK

SEQ ID NO: 2994009 - protein, 33 aa, Entamoeba invadens
ELFQKMINVFQQQWYFPLVPREVALSFLEGQID

SEQ ID NO: 2994010 - protein, 21 aa, Entamoeba invadens
ELFSKFFMNYLKIDTNEQLRE

SEQ ID NO: 2994011 - protein, 25 aa, Entamoeba invadens
ELFVNQKQIVIKKLESLIACKEKIQ

SEQ ID NO: 2994012 - protein, 18 aa, Entamoeba invadens
ELGFFNKETQKRGNLVMV

SEQ ID NO: 2994013 - protein, 28 aa, Entamoeba invadens
ELGFGVDYWSLGILLFAMCFGDAPFYDT

SEQ ID NO: 2994014 - protein, 23 aa, Entamoeba invadens
ELGKKCFFHCEKLKEINLENVVK

SEQ ID NO: 2994015 - protein, 17 aa, Entamoeba invadens
ELGLPHYWRQLAQKAIE

SEQ ID NO: 2994016 - protein, 29 aa, Entamoeba invadens
ELGTKRRVFVIPYLMYSTMERAVKPGEVV

SEQ ID NO: 2994017 - protein, 30 aa, Entamoeba invadens
ELGYDTITYMLKTFTRDLPGMLLSSSVSQD

SEQ ID NO: 2994018 - protein, 30 aa, Entamoeba invadens
ELHEGILKKEWFASLLLYTDSLEIESGKLT

SEQ ID NO: 2994019 - protein, 35 aa, Entamoeba invadens
ELHFELYMALRKTIYKPRAFFKGIIFPLCTEKNVT

SEQ ID NO: 2994020 - protein, 22 aa, Entamoeba invadens
ELHHHSALASFLLRRSLKNRRR

SEQ ID NO: 2994021 - protein, 23 aa, Entamoeba invadens
ELHKLFVQFPCDLTIELKNEEKR

SEQ ID NO: 2994022 - protein, 22 aa, Entamoeba invadens
ELHLTEYLTFGTVMVWSCFTAA

SEQ ID NO: 2994023 - protein, 21 aa, Entamoeba invadens
ELHRLIADWPLLDPQTAIEML

SEQ ID NO: 2994024 - protein, 24 aa, Entamoeba invadens
ELHTLPPHLFTLPELEILHLEGNP

SEQ ID NO: 2994025 - protein, 23 aa, Entamoeba invadens
ELHVKFIDLLTATKFLLLMIDVD

SEQ ID NO: 2994026 - protein, 34 aa, Entamoeba invadens
ELIAYILSRCLDVIRVYIIILQTSRNTQLISSTL

SEQ ID NO: 2994027 - protein, 21 aa, Entamoeba invadens
ELIDSTPIFSVPIMSFEKTVF

SEQ ID NO: 2994028 - protein, 24 aa, Entamoeba invadens
ELIEQLMIEFILELTYKIRLDEPT

SEQ ID NO: 2994029 - protein, 21 aa, Entamoeba invadens
ELIEYNRKIALRDKIDEIKRK

SEQ ID NO: 2994030 - protein, 19 aa, Entamoeba invadens
ELIFLVPHSSHMTQILDVG

SEQ ID NO: 2994031 - protein, 17 aa, Entamoeba invadens
ELIINDTLFLDKLVTFL

SEQ ID NO: 2994032 - protein, 20 aa, Entamoeba invadens
ELIKVVLNKIPNPTSYIIRV

SEQ ID NO: 2994033 - protein, 18 aa, Entamoeba invadens
ELILSKYHYKAFCFLKSL

SEQ ID NO: 2994034 - protein, 28 aa, Entamoeba invadens
ELINTLPREWKICKPDFIRLLKTMECCI

SEQ ID NO: 2994035 - protein, 17 aa, Entamoeba invadens
ELIPQSCLDSIKDKLLI

SEQ ID NO: 2994036 - protein, 20 aa, Entamoeba invadens
ELIPYAHSFGLTKPVKTNLA

SEQ ID NO: 2994037 - protein, 35 aa, Entamoeba invadens
ELIQFKQLMYLTSTISWIMLLYNNNNTISQHAKDI

SEQ ID NO: 2994038 - protein, 20 aa, Entamoeba invadens
ELIQLFIKNFVNAKTPAMDK

SEQ ID NO: 2994039 - protein, 22 aa, Entamoeba invadens
ELIRLISNFCRFKPHISFEGFD

SEQ ID NO: 2994040 - protein, 44 aa, Entamoeba invadens
ELIRLVVGAVQYPELYKKFGIYTPAGILLYGPPGCGKTFCAKAL

SEQ ID NO: 2994041 - protein, 26 aa, Entamoeba invadens
ELISKTMRLFLFFTNPEMVSQEVVRC

SEQ ID NO: 2994042 - protein, 25 aa, Entamoeba invadens
ELITPLLNTLPFFRTLIIEASASNI

SEQ ID NO: 2994043 - protein, 19 aa, Entamoeba invadens
ELITQLRYMFPKKSSFIDE

SEQ ID NO: 2994044 - protein, 27 aa, Entamoeba invadens
ELIVDRSMDILLIKLLGVSTQLGQQAI

SEQ ID NO: 2994045 - protein, 19 aa, Entamoeba invadens
ELIVPNIPFCFENISPRSI

SEQ ID NO: 2994046 - protein, 23 aa, Entamoeba invadens
ELKAFLLNGPGYFRYMKTHHESL

SEQ ID NO: 2994047 - protein, 28 aa, Entamoeba invadens
ELKAKLNKMFLTKRELLWKKRCIRFRKV

SEQ ID NO: 2994048 - protein, 17 aa, Entamoeba invadens
ELKALEQAAKTYKQSKN

SEQ ID NO: 2994049 - protein, 21 aa, Entamoeba invadens
ELKDLPKSFAFFKTMIDSLVE

SEQ ID NO: 2994050 - protein, 17 aa, Entamoeba invadens
ELKEKFIQILQVLSKEE

SEQ ID NO: 2994051 - protein, 25 aa, Entamoeba invadens
ELKEKKIPFIIRRRLPNGSYEDWKI

SEQ ID NO: 2994052 - protein, 24 aa, Entamoeba invadens
ELKELVNELKACLSLPLVQNNSTK

SEQ ID NO: 2994053 - protein, 28 aa, Entamoeba invadens
ELKEMEKGIWATAAQLSAKAKSAGICPV

SEQ ID NO: 2994054 - protein, 24 aa, Entamoeba invadens
ELKEMVWKYVYFYCKNKQMNEAYK

SEQ ID NO: 2994055 - protein, 17 aa, Entamoeba invadens
ELKFVEYFKVNLIDILN

SEQ ID NO: 2994056 - protein, 23 aa, Entamoeba invadens
ELKKWEIKYYKGLGTSKDSDAKV

SEQ ID NO: 2994057 - protein, 17 aa, Entamoeba invadens
ELKLDGVKVDDLQTLLL

SEQ ID NO: 2994058 - protein, 22 aa, Entamoeba invadens
ELKLLSGIVKLIIYYNDISSDD

SEQ ID NO: 2994059 - protein, 26 aa, Entamoeba invadens
ELKNDFPHRVYPLSYSFTLPCTAPFT

SEQ ID NO: 2994060 - protein, 22 aa, Entamoeba invadens
ELKNLSHIILSEAFCTFFASRE

SEQ ID NO: 2994061 - protein, 24 aa, Entamoeba invadens
ELKNPDISVALNLSLRQLDPTVCE

SEQ ID NO: 2994062 - protein, 25 aa, Entamoeba invadens
ELKNPDISVALNLSLRQLDPTVCES

SEQ ID NO: 2994063 - protein, 22 aa, Entamoeba invadens
ELKQILTFTHLSLNVPVCVSPI

SEQ ID NO: 2994064 - protein, 20 aa, Entamoeba invadens
ELKREYLLLESATEFEEVGI

SEQ ID NO: 2994065 - protein, 22 aa, Entamoeba invadens
ELKRHNFYCSAGANFPAIVGKE

SEQ ID NO: 2994066 - protein, 23 aa, Entamoeba invadens
ELKSYFPVPSLNEMWYVFKGSNA

SEQ ID NO: 2994067 - protein, 47 aa, Entamoeba invadens
ELKTDYLRDFLVKYISRMDLFKFPTFTILHLTLNLLKNDFPIKNLLQ

SEQ ID NO: 2994068 - protein, 25 aa, Entamoeba invadens
ELKTKLDLFPLKTVGFFTFEDVLNI

SEQ ID NO: 2994069 - protein, 23 aa, Entamoeba invadens
ELKVNQRLFPKLETWCIYNIQRK

SEQ ID NO: 2994070 - protein, 26 aa, Entamoeba invadens
ELKVQPNFILMNLPATAVNFLDVIPE

SEQ ID NO: 2994071 - protein, 17 aa, Entamoeba invadens
ELLDLYDLEITNVNIRH

SEQ ID NO: 2994072 - protein, 19 aa, Entamoeba invadens
ELLDNVLKLFREEIVREIT

SEQ ID NO: 2994073 - protein, 18 aa, Entamoeba invadens
ELLEEYGKVLYFISRFDT

SEQ ID NO: 2994074 - protein, 26 aa, Entamoeba invadens
ELLEEYRIQLILNHILFAGIDGQFSK

SEQ ID NO: 2994075 - protein, 20 aa, Entamoeba invadens
ELLELLRICLNFGNILNAKS

SEQ ID NO: 2994076 - protein, 23 aa, Entamoeba invadens
ELLEVRRWILVDSILRASNRHTE

SEQ ID NO: 2994077 - protein, 19 aa, Entamoeba invadens
ELLFPRGCETKNAIDFLVS

SEQ ID NO: 2994078 - protein, 20 aa, Entamoeba invadens
ELLKLHVYLTQLHTQYSELS

SEQ ID NO: 2994079 - protein, 27 aa, Entamoeba invadens
ELLKYTGYFMYYRFVGQYITATETGQS

SEQ ID NO: 2994080 - protein, 18 aa, Entamoeba invadens
ELLMADFLHKEASIVVPM

SEQ ID NO: 2994081 - protein, 21 aa, Entamoeba invadens
ELLMEVIRMAMPCPEHQIKRL

SEQ ID NO: 2994082 - protein, 19 aa, Entamoeba invadens
ELLNEWIVVLESAAQFTNR

SEQ ID NO: 2994083 - protein, 23 aa, Entamoeba invadens
ELLPKFVVILTKCFDRFKEDEEA

SEQ ID NO: 2994084 - protein, 26 aa, Entamoeba invadens
ELLQYTGYFMYYRFVGHYITSNETGQ

SEQ ID NO: 2994085 - protein, 17 aa, Entamoeba invadens
ELLRTFLQYDCCRTPFI

SEQ ID NO: 2994086 - protein, 25 aa, Entamoeba invadens
ELLSDFRTKKIPVASWNNFVRKMYD

SEQ ID NO: 2994087 - protein, 19 aa, Entamoeba invadens
ELLTKYYAMSKLRLDIYEK

SEQ ID NO: 2994088 - protein, 17 aa, Entamoeba invadens
ELLTMWFGESEGNVREV

SEQ ID NO: 2994089 - protein, 17 aa, Entamoeba invadens
ELLVSPRPIQQNNVFFD

SEQ ID NO: 2994090 - protein, 18 aa, Entamoeba invadens
ELMEQIITLEETARRLRK

SEQ ID NO: 2994091 - protein, 17 aa, Entamoeba invadens
ELMKQICEKDGKSYTEE

SEQ ID NO: 2994092 - protein, 29 aa, Entamoeba invadens
ELMNNSNMLLWIQQTPFLGKIIHCAVALN

SEQ ID NO: 2994093 - protein, 37 aa, Entamoeba invadens
ELMPDPRRIDPFPREPPLPQLDRHPLQPTLQGPMPGN

SEQ ID NO: 2994094 - protein, 23 aa, Entamoeba invadens
ELMRMDKFRIFGASTLFVYDADA

SEQ ID NO: 2994095 - protein, 26 aa, Entamoeba invadens
ELMTQAEGLLRMGLHPTIIVDGYRAG

SEQ ID NO: 2994096 - protein, 17 aa, Entamoeba invadens
ELMYFTTTMTSVEKNSF

SEQ ID NO: 2994097 - protein, 24 aa, Entamoeba invadens
ELNALREEIILLKITHENEKTSFK

SEQ ID NO: 2994098 - protein, 18 aa, Entamoeba invadens
ELNCPSRFASKTMQLFVI

SEQ ID NO: 2994099 - protein, 25 aa, Entamoeba invadens
ELNDLLKDVTIINGGVFPNVPTAVN

SEQ ID NO: 2994100 - protein, 25 aa, Entamoeba invadens
ELNDLLLSHMTFTLPPLPYEKNALS

SEQ ID NO: 2994101 - protein, 33 aa, Entamoeba invadens
ELNGLLVHRAIYFTALLLQFHASNLLKPSTSLS

SEQ ID NO: 2994102 - protein, 19 aa, Entamoeba invadens
ELNGNFYSVPLILKEYEEK

SEQ ID NO: 2994103 - protein, 20 aa, Entamoeba invadens
ELNIKLIDFGLAKNFRDEGL

SEQ ID NO: 2994104 - protein, 26 aa, Entamoeba invadens
ELNKHAEFLTKLPPFSNALLDKKVTE

SEQ ID NO: 2994105 - protein, 27 aa, Entamoeba invadens
ELNNEINKLQLKLNDLEKTSTLEKEQL

SEQ ID NO: 2994106 - protein, 26 aa, Entamoeba invadens
ELNNEMIVCSYIIPLILCVGQSAYNE

SEQ ID NO: 2994107 - protein, 17 aa, Entamoeba invadens
ELNNFFYEKVKLGKKYV

SEQ ID NO: 2994108 - protein, 22 aa, Entamoeba invadens
ELNQTWFEKLGRWQKALDIYEK

SEQ ID NO: 2994109 - protein, 21 aa, Entamoeba invadens
ELNQTWFEKLGRWQQALNIYE

SEQ ID NO: 2994110 - protein, 32 aa, Entamoeba invadens
ELNRFQKYILERNFYVNRIGILFGEFAKNNNV

SEQ ID NO: 2994111 - protein, 23 aa, Entamoeba invadens
ELNRTSMRLSLTKKRSYLSFVAT

SEQ ID NO: 2994112 - protein, 26 aa, Entamoeba invadens
ELNSWILDCLYGVFVPVFGFFNGDDD

SEQ ID NO: 2994113 - protein, 18 aa, Entamoeba invadens
ELNTIYPPTKDILDLFSH

SEQ ID NO: 2994114 - protein, 24 aa, Entamoeba invadens
ELNVFQIRRFILSTYNITLSIEQI

SEQ ID NO: 2994115 - protein, 20 aa, Entamoeba invadens
ELNYFKYHIMESDGFVVQYS

SEQ ID NO: 2994116 - protein, 19 aa, Entamoeba invadens
ELNYYVEFPLETTKIEVPS

SEQ ID NO: 2994117 - protein, 19 aa, Entamoeba invadens
ELPFITFDDLLAHLEDLVC

SEQ ID NO: 2994118 - protein, 24 aa, Entamoeba invadens
ELPKIEGLALINLPTYGGGNKFWP

SEQ ID NO: 2994119 - protein, 35 aa, Entamoeba invadens
ELPLHIILSWYEQKAVCILLTVIYLGLKNVRIGPS

SEQ ID NO: 2994120 - protein, 31 aa, Entamoeba invadens
ELPPTHPIRLGLALNFSVFYYEILNDADKAC

SEQ ID NO: 2994121 - protein, 32 aa, Entamoeba invadens
ELPPTHPIRLGLALNFSVFYYEIMNEADKACQ

SEQ ID NO: 2994122 - protein, 18 aa, Entamoeba invadens
ELPSWMGKYSMKVPGRIW

SEQ ID NO: 2994123 - protein, 24 aa, Entamoeba invadens
ELPTDLLRVLRIVNLSLVEANQYS

SEQ ID NO: 2994124 - protein, 23 aa, Entamoeba invadens
ELQELFPYVDADTIKSVLIDCNY

SEQ ID NO: 2994125 - protein, 18 aa, Entamoeba invadens
ELQFITKTGEHINQCFIC

SEQ ID NO: 2994126 - protein, 23 aa, Entamoeba invadens
ELQKFHSELKPYILRRMKKEVEK

SEQ ID NO: 2994127 - protein, 30 aa, Entamoeba invadens
ELQKIDSRKNIPLPKNRTPRTTNTTLTEVA

SEQ ID NO: 2994128 - protein, 19 aa, Entamoeba invadens
ELQKIREKEQLARYRQLQS

SEQ ID NO: 2994129 - protein, 24 aa, Entamoeba invadens
ELQKSCFIFCTSLKKIILPTQLSK

SEQ ID NO: 2994130 - protein, 25 aa, Entamoeba invadens
ELQNIQHFVVLYPVDYSFVKSYSKD

SEQ ID NO: 2994131 - protein, 21 aa, Entamoeba invadens
ELQPMKPWYRGWTGELKENKE

SEQ ID NO: 2994132 - protein, 17 aa, Entamoeba invadens
ELQRKLKRQKALQNRLI

SEQ ID NO: 2994133 - protein, 20 aa, Entamoeba invadens
ELQSVKKFIKFYGIPKDTTT

SEQ ID NO: 2994134 - protein, 19 aa, Entamoeba invadens
ELQTRLYTEKEITQKLDDE

SEQ ID NO: 2994135 - protein, 22 aa, Entamoeba invadens
ELRDILVLFYKRKDVNPFDIIQ

SEQ ID NO: 2994136 - protein, 20 aa, Entamoeba invadens
ELREFCPKILNLLGTTERSV

SEQ ID NO: 2994137 - protein, 17 aa, Entamoeba invadens
ELRFAYFKNEDFAVSVG

SEQ ID NO: 2994138 - protein, 24 aa, Entamoeba invadens
ELRGCIGCFSPEKPVYELIQEYAV

SEQ ID NO: 2994139 - protein, 20 aa, Entamoeba invadens
ELRGYLLDLGIVDELNNLKK

SEQ ID NO: 2994140 - protein, 23 aa, Entamoeba invadens
ELRIIDKFAKIFMFFIKKMCKHN

SEQ ID NO: 2994141 - protein, 24 aa, Entamoeba invadens
ELRKLNEQIIEKRKFINECRIKMQ

SEQ ID NO: 2994142 - protein, 24 aa, Entamoeba invadens
ELRKPQIALKVLRPLLSVPLPSMA

SEQ ID NO: 2994143 - protein, 31 aa, Entamoeba invadens
ELRKYPIDVLKCLPVFKIKRVPYGEIVWENV

SEQ ID NO: 2994144 - protein, 27 aa, Entamoeba invadens
ELRLENIFRLSVLKLPPQVETLFLRTI

SEQ ID NO: 2994145 - protein, 22 aa, Entamoeba invadens
ELRLKQQFFFTSASLQDIVRRF

SEQ ID NO: 2994146 - protein, 27 aa, Entamoeba invadens
ELRNENYQFFLAPTKLLQVGVALSPKM

SEQ ID NO: 2994147 - protein, 25 aa, Entamoeba invadens
ELRPGKGFNLQPHPFVQNALSQRDA

SEQ ID NO: 2994148 - protein, 22 aa, Entamoeba invadens
ELRQPLLHILDNFSINGPNGTH

SEQ ID NO: 2994149 - protein, 21 aa, Entamoeba invadens
ELRRYGPFKGKVPRIICGTKA

SEQ ID NO: 2994150 - protein, 17 aa, Entamoeba invadens
ELRYLNNEVLLPVNPKA

SEQ ID NO: 2994151 - protein, 30 aa, Entamoeba invadens
ELSAPKYGKYYLYFTNFIDTTQLTLLSHSD

SEQ ID NO: 2994152 - protein, 28 aa, Entamoeba invadens
ELSASGHFLLVSIFEVTANGVTSDAMPV

SEQ ID NO: 2994153 - protein, 17 aa, Entamoeba invadens
ELSDRALLLTGVIIQMN

SEQ ID NO: 2994154 - protein, 20 aa, Entamoeba invadens
ELSDSILFIGMKNMRMVIVH

SEQ ID NO: 2994155 - protein, 25 aa, Entamoeba invadens
ELSEFEKMELSYVSKVSPVDNNVSS

SEQ ID NO: 2994156 - protein, 25 aa, Entamoeba invadens
ELSEIRKMFIGQFGTTLVAECIEEN

SEQ ID NO: 2994157 - protein, 30 aa, Entamoeba invadens
ELSESEIIIRPYPLVIRQKHPIIDVDEINE

SEQ ID NO: 2994158 - protein, 32 aa, Entamoeba invadens
ELSESQFYFCKSLRKISLPKNLLFIDKNVFAE

SEQ ID NO: 2994159 - protein, 27 aa, Entamoeba invadens
ELSGYHIMIVSKYFKTIKDFINLELLC

SEQ ID NO: 2994160 - protein, 31 aa, Entamoeba invadens
ELSKEYFEIRVVLQRLLLKAKVLTKDICKDL

SEQ ID NO: 2994161 - protein, 23 aa, Entamoeba invadens
ELSLFIETIKKPLPTSFRLTRSS

SEQ ID NO: 2994162 - protein, 21 aa, Entamoeba invadens
ELSMKVLLDLDSYLGLNDENK

SEQ ID NO: 2994163 - protein, 24 aa, Entamoeba invadens
ELSNMLSLKILRIGYNKLSGNIDV

SEQ ID NO: 2994164 - protein, 23 aa, Entamoeba invadens
ELSPELRKRLILFDCEDPNTCSD

SEQ ID NO: 2994165 - protein, 25 aa, Entamoeba invadens
ELSPSFLVNIPYNSFTAPLHVIGTS

SEQ ID NO: 2994166 - protein, 21 aa, Entamoeba invadens
ELSTLVYLLDFYETKITDKQH

SEQ ID NO: 2994167 - protein, 17 aa, Entamoeba invadens
ELSVDISVLRMAKILKA

SEQ ID NO: 2994168 - protein, 27 aa, Entamoeba invadens
ELSVFDLYQKFLINFLKIESHPEIREA

SEQ ID NO: 2994169 - protein, 22 aa, Entamoeba invadens
ELSVKIILIGELGVGKTSMVHK

SEQ ID NO: 2994170 - protein, 40 aa, Entamoeba invadens
ELTDDQMFAVAFTIALQKEGTLLILQKDIKHANKDEQVFD

SEQ ID NO: 2994171 - protein, 27 aa, Entamoeba invadens
ELTEHNFLKFVGIGGVLPLLANDLSQP

SEQ ID NO: 2994172 - protein, 23 aa, Entamoeba invadens
ELTIWSVTGLSLPKIDSLRKLSL

SEQ ID NO: 2994173 - protein, 23 aa, Entamoeba invadens
ELTKLKLKAPLRTKSKKSISKFD

SEQ ID NO: 2994174 - protein, 22 aa, Entamoeba invadens
ELTLTYLALYNIEPYQGGINVC

SEQ ID NO: 2994175 - protein, 23 aa, Entamoeba invadens
ELTMAHHWPVRKPRPTADKITST

SEQ ID NO: 2994176 - protein, 20 aa, Entamoeba invadens
ELTMIMLDFIKRGMKHLGVL

SEQ ID NO: 2994177 - protein, 26 aa, Entamoeba invadens
ELTNMKVMNLLKMSSITESYLFGCTD

SEQ ID NO: 2994178 - protein, 25 aa, Entamoeba invadens
ELTNMNFIFTTFKTIIADYSTIANS

SEQ ID NO: 2994179 - protein, 25 aa, Entamoeba invadens
ELTRLTKLFILRRTSKVNQKYLPPK

SEQ ID NO: 2994180 - protein, 48 aa, Entamoeba invadens
ELTRRQVAGLLALSLLGFYTLPQTFRDVSIFPIVFFGGKVQATKLRAY

SEQ ID NO: 2994181 - protein, 34 aa, Entamoeba invadens
ELTSFLITPIQRIPRYKLLLNDLLKHTPQNHIDY

SEQ ID NO: 2994182 - protein, 25 aa, Entamoeba invadens
ELTSQQVWLYIYESQFFLEKKEFSY

SEQ ID NO: 2994183 - protein, 25 aa, Entamoeba invadens
ELTVKYHMVFLRHVTFIYPTNVKKM

SEQ ID NO: 2994184 - protein, 18 aa, Entamoeba invadens
ELTVLHFLNKFYDNSPHS

SEQ ID NO: 2994185 - protein, 24 aa, Entamoeba invadens
ELVAKAFIGNPKMFDSRTLNTSDL

SEQ ID NO: 2994186 - protein, 25 aa, Entamoeba invadens
ELVAQKLYVQHKLNASLKRKIAMKD

SEQ ID NO: 2994187 - protein, 19 aa, Entamoeba invadens
ELVFPESTVHFGVNAFYGC

SEQ ID NO: 2994188 - protein, 18 aa, Entamoeba invadens
ELVGFVWGLLANFEERCS

SEQ ID NO: 2994189 - protein, 24 aa, Entamoeba invadens
ELVKDREFIRLTGTLKKYSHTLQA

SEQ ID NO: 2994190 - protein, 24 aa, Entamoeba invadens
ELVKQVMKTWLPAGQSLLEMIVMH

SEQ ID NO: 2994191 - protein, 24 aa, Entamoeba invadens
ELVLQSIRLLVKKRSFVPFTTKKV

SEQ ID NO: 2994192 - protein, 17 aa, Entamoeba invadens
ELVLWDTAGQEKYNCLF

SEQ ID NO: 2994193 - protein, 26 aa, Entamoeba invadens
ELVRQLNWTIIIAPKQRKTSKKTNTL

SEQ ID NO: 2994194 - protein, 24 aa, Entamoeba invadens
ELVSPFREFIRSGLLMKVCRKFNK

SEQ ID NO: 2994195 - protein, 18 aa, Entamoeba invadens
ELVTFMKRPLDSVISIAV

SEQ ID NO: 2994196 - protein, 19 aa, Entamoeba invadens
ELWDSCLLIFPTIETDINF

SEQ ID NO: 2994197 - protein, 26 aa, Entamoeba invadens
ELWEKRGLVVPRRTSVALSINKSGNA

SEQ ID NO: 2994198 - protein, 17 aa, Entamoeba invadens
ELWRKSMSGVKSKKLVI

SEQ ID NO: 2994199 - protein, 19 aa, Entamoeba invadens
ELWSTRFDLSPFPNPNREY

SEQ ID NO: 2994200 - protein, 21 aa, Entamoeba invadens
ELYHNLMQMLDQIELYHKGRQ

SEQ ID NO: 2994201 - protein, 24 aa, Entamoeba invadens
ELYKELYTTYRTKGVNFPPLTQPD

SEQ ID NO: 2994202 - protein, 18 aa, Entamoeba invadens
ELYKLMNKYYTIDGVIEG

SEQ ID NO: 2994203 - protein, 17 aa, Entamoeba invadens
ELYKLPTIPENLALISS

SEQ ID NO: 2994204 - protein, 19 aa, Entamoeba invadens
ELYKNVMDFLASEKKKRKA

SEQ ID NO: 2994205 - protein, 33 aa, Entamoeba invadens
ELYKTDFVFDEQKFANLIYSMTKEMATGKKEDE

SEQ ID NO: 2994206 - protein, 19 aa, Entamoeba invadens
ELYNVIIFFMHNLAHIEEN

SEQ ID NO: 2994207 - protein, 34 aa, Entamoeba invadens
EMAKKFIGKPAPFTPFTAFLTENWKKQKYFKKKR

SEQ ID NO: 2994208 - protein, 28 aa, Entamoeba invadens
EMANCELHMVFYLISVLKIEIDVSEIKD

SEQ ID NO: 2994209 - protein, 26 aa, Entamoeba invadens
EMAPNIMQILQLLITKLPITDEEVDT

SEQ ID NO: 2994210 - protein, 17 aa, Entamoeba invadens
EMCFEHFVPPQVKGRAF

SEQ ID NO: 2994211 - protein, 36 aa, Entamoeba invadens
EMCSFPEHLCVVPIQKQLHWSALNNPTWKRVERIEY

SEQ ID NO: 2994212 - protein, 34 aa, Entamoeba invadens
EMCYLILLNDMYRSVILLLFQPQKKSVIPLGKDG

SEQ ID NO: 2994213 - protein, 34 aa, Entamoeba invadens
EMDFDERILKRKDEVFRKACVLKRIEESARPQLE

SEQ ID NO: 2994214 - protein, 25 aa, Entamoeba invadens
EMDKNYITYFYPITGKDTYTFDKEL

SEQ ID NO: 2994215 - protein, 25 aa, Entamoeba invadens
EMDKNYITYFYPVTGKDTYTFDKEL

SEQ ID NO: 2994216 - protein, 36 aa, Entamoeba invadens
EMDMELLKQLIATPFYYRYNPFIQKFNVLRSDKFES

SEQ ID NO: 2994217 - protein, 39 aa, Entamoeba invadens
EMDMRGRCSMGQKALASLIIRIALAKTFCTKCAVLALDE

SEQ ID NO: 2994218 - protein, 24 aa, Entamoeba invadens
EMDSILHMVGIMPVFAVLEREEFS

SEQ ID NO: 2994219 - protein, 25 aa, Entamoeba invadens
EMDYCRKMIGLTDALNARSTLGLLK

SEQ ID NO: 2994220 - protein, 17 aa, Entamoeba invadens
EMDYTKYNKDDVSLSTS

SEQ ID NO: 2994221 - protein, 25 aa, Entamoeba invadens
EMECRLVMQQLLQGLQYLHHNHVIH

SEQ ID NO: 2994222 - protein, 25 aa, Entamoeba invadens
EMEDDMFWELLDLLADLDKTKELPE

SEQ ID NO: 2994223 - protein, 19 aa, Entamoeba invadens
EMEEKMKNMKLTESELTEK

SEQ ID NO: 2994224 - protein, 29 aa, Entamoeba invadens
EMEKELYFKGLVFYIFGHNKDLLMEHIIS

SEQ ID NO: 2994225 - protein, 19 aa, Entamoeba invadens
EMEKERIKRSFDVDMSELL

SEQ ID NO: 2994226 - protein, 35 aa, Entamoeba invadens
EMEKLKYLIHLFDYSFYKNLLLSFPTLSRTIEGMV

SEQ ID NO: 2994227 - protein, 28 aa, Entamoeba invadens
EMENCSWFDFVFPFHSLLELTMNGCENI

SEQ ID NO: 2994228 - protein, 18 aa, Entamoeba invadens
EMEPITIVVIQLLAFHYS

SEQ ID NO: 2994229 - protein, 18 aa, Entamoeba invadens
EMESFNFFTNDCGLIGTT

SEQ ID NO: 2994230 - protein, 26 aa, Entamoeba invadens
EMESSKKMMINVENILLFGVQTNSKE

SEQ ID NO: 2994231 - protein, 24 aa, Entamoeba invadens
EMEYEPTPLYFLCERDNVYRAVRT

SEQ ID NO: 2994232 - protein, 19 aa, Entamoeba invadens
EMFCGCYLLKEFNFPPHLT

SEQ ID NO: 2994233 - protein, 20 aa, Entamoeba invadens
EMFETYFTLLQSFCVMSIVS

SEQ ID NO: 2994234 - protein, 21 aa, Entamoeba invadens
EMFFTAIVVISYYSAPHSKAM

SEQ ID NO: 2994235 - protein, 26 aa, Entamoeba invadens
EMFHYNPISILFKTQKYFPNVETLHL

SEQ ID NO: 2994236 - protein, 19 aa, Entamoeba invadens
EMFIGLLQDVQRNKTKQRN

SEQ ID NO: 2994237 - protein, 25 aa, Entamoeba invadens
EMFKAKSKVLVLTAKKVLYTLDIKN

SEQ ID NO: 2994238 - protein, 23 aa, Entamoeba invadens
EMFKQIPYFEFLGNGWMKKDKET

SEQ ID NO: 2994239 - protein, 18 aa, Entamoeba invadens
EMFSVDNKFFILKVVHQK

SEQ ID NO: 2994240 - protein, 28 aa, Entamoeba invadens
EMFSVDNKLFILKVVHKRFRREGDDVVC

SEQ ID NO: 2994241 - protein, 39 aa, Entamoeba invadens
EMFVLANIRDFHLALRPETLGELALFAMSLVPPKQSAKS

SEQ ID NO: 2994242 - protein, 17 aa, Entamoeba invadens
EMFYGNKTLNELPRNVF

SEQ ID NO: 2994243 - protein, 41 aa, Entamoeba invadens
EMGALEKALILYRYTYIDLFAKLKMMFVAKLEGDMKSQDIL

SEQ ID NO: 2994244 - protein, 31 aa, Entamoeba invadens
EMGHTAIVRLIFERYLFVPISNSTRHITAFY

SEQ ID NO: 2994245 - protein, 26 aa, Entamoeba invadens
EMGRLGVQAFLVLCNAQNILTGKTDD

SEQ ID NO: 2994246 - protein, 18 aa, Entamoeba invadens
EMHLYSAHDVTLFMVLKF

SEQ ID NO: 2994247 - protein, 28 aa, Entamoeba invadens
EMIDKLPTEGFWLNYVIKAYGDSMEKEA

SEQ ID NO: 2994248 - protein, 21 aa, Entamoeba invadens
EMIGLFFGIIAKFLDRDNPRF

SEQ ID NO: 2994249 - protein, 19 aa, Entamoeba invadens
EMIVVCAITLLFNLITNNQ

SEQ ID NO: 2994250 - protein, 40 aa, Entamoeba invadens
EMKEWRKLYKIDITILRALYDLGFIYPTEIQKFAIPKALT

SEQ ID NO: 2994251 - protein, 22 aa, Entamoeba invadens
EMKIGAFRKKRLARQHTRRQSF

SEQ ID NO: 2994252 - protein, 23 aa, Entamoeba invadens
EMKKEIPIFVKYMKENVSQVEID

SEQ ID NO: 2994253 - protein, 19 aa, Entamoeba invadens
EMKKSVLSIPFAEGGGCNI

SEQ ID NO: 2994254 - protein, 18 aa, Entamoeba invadens
EMKNTKLLQLNEELVKEL

SEQ ID NO: 2994255 - protein, 41 aa, Entamoeba invadens
EMKNVWYRWLENIHDWCISRQLWWGHRIPAYLVNVKDTPEV

SEQ ID NO: 2994256 - protein, 23 aa, Entamoeba invadens
EMKQTPFFIQCFNFKHIQPEETT

SEQ ID NO: 2994257 - protein, 30 aa, Entamoeba invadens
EMKRIKGFELLNLFIYKKAKLMSTDSLLVL

SEQ ID NO: 2994258 - protein, 26 aa, Entamoeba invadens
EMKRNKLFSFFVQPVDTAAIKDYLSI

SEQ ID NO: 2994259 - protein, 17 aa, Entamoeba invadens
EMKTFLDQMASKFSDLL

SEQ ID NO: 2994260 - protein, 28 aa, Entamoeba invadens
EMLAHRLGLIPIYADPRKFQFAPNRAFL

SEQ ID NO: 2994261 - protein, 17 aa, Entamoeba invadens
EMLFVRNAVVQAALYVM

SEQ ID NO: 2994262 - protein, 25 aa, Entamoeba invadens
EMLGHVLVPLLNAIEIRSVEWNQLV

SEQ ID NO: 2994263 - protein, 22 aa, Entamoeba invadens
EMLRQSFICGSFPFNSNEMYTV

SEQ ID NO: 2994264 - protein, 19 aa, Entamoeba invadens
EMMCYFNKKIFECVLLLFS

SEQ ID NO: 2994265 - protein, 27 aa, Entamoeba invadens
EMMEKYKLVFKKLPKIIAEFVEELTEL

SEQ ID NO: 2994266 - protein, 27 aa, Entamoeba invadens
EMMLILSFLKSDLALTARFFALIEKRV

SEQ ID NO: 2994267 - protein, 26 aa, Entamoeba invadens
EMMYCFGPIMTRFFLDEAIPYEKRYE

SEQ ID NO: 2994268 - protein, 19 aa, Entamoeba invadens
EMMYYYCNFLACKDYILTL

SEQ ID NO: 2994269 - protein, 24 aa, Entamoeba invadens
EMNSIIQMTFAVLSPQSVGIISKV

SEQ ID NO: 2994270 - protein, 30 aa, Entamoeba invadens
EMNVKSIHPMLVLVGKYSLPYIMLHHTGVL

SEQ ID NO: 2994271 - protein, 20 aa, Entamoeba invadens
EMPDLVRPNMFVGVPVKMTA

SEQ ID NO: 2994272 - protein, 36 aa, Entamoeba invadens
EMPILVRMAINLVNSFYSTFLRIINKFLSTYEDLDC

SEQ ID NO: 2994273 - protein, 20 aa, Entamoeba invadens
EMPKLKNFPTTGILQIFINP

SEQ ID NO: 2994274 - protein, 17 aa, Entamoeba invadens
EMPLLSSESIFTMQAVD

SEQ ID NO: 2994275 - protein, 19 aa, Entamoeba invadens
EMPLYVNQIGYHAFKDCTA

SEQ ID NO: 2994276 - protein, 17 aa, Entamoeba invadens
EMPQLKGLVLNNNKITR

SEQ ID NO: 2994277 - protein, 19 aa, Entamoeba invadens
EMPRLKVLFMKKCFLHGDC

SEQ ID NO: 2994278 - protein, 26 aa, Entamoeba invadens
EMQAFVSWKFVRIERLVLSWLDIMST

SEQ ID NO: 2994279 - protein, 19 aa, Entamoeba invadens
EMQLFFKYDDIENAKKCAH

SEQ ID NO: 2994280 - protein, 21 aa, Entamoeba invadens
EMQLQIWDVCGRQRNCMMSGK

SEQ ID NO: 2994281 - protein, 17 aa, Entamoeba invadens
EMQRKYTPYNNRPKSAV

SEQ ID NO: 2994282 - protein, 26 aa, Entamoeba invadens
EMRESYLEDGFLLEKKFGTSQKRFLE

SEQ ID NO: 2994283 - protein, 24 aa, Entamoeba invadens
EMRHAFLDFIQRALQWDPEVRMRP

SEQ ID NO: 2994284 - protein, 23 aa, Entamoeba invadens
EMRKYKLFAVNDFQTFPALKNDH

SEQ ID NO: 2994285 - protein, 30 aa, Entamoeba invadens
EMRLYQYICNSFLASLYKDAVFQKASVSIE

SEQ ID NO: 2994286 - protein, 44 aa, Entamoeba invadens
EMRNHMRKVGVTSFKKISMINFLIFYFKQDFAEVVHAPQGGNQE

SEQ ID NO: 2994287 - protein, 19 aa, Entamoeba invadens
EMRNLFLTTNNVEKGKYYG

SEQ ID NO: 2994288 - protein, 17 aa, Entamoeba invadens
EMRSSIASIIFSMGFKC

SEQ ID NO: 2994289 - protein, 25 aa, Entamoeba invadens
EMRVGNILIICPLTLISHWVSEAHR

SEQ ID NO: 2994290 - protein, 24 aa, Entamoeba invadens
EMSEFMQLFVSRISPFKKSHGLLS

SEQ ID NO: 2994291 - protein, 25 aa, Entamoeba invadens
EMSELFTPFLFKVQEKRLAKYREIV

SEQ ID NO: 2994292 - protein, 19 aa, Entamoeba invadens
EMSFTQKSYTAPCGCFISG

SEQ ID NO: 2994293 - protein, 22 aa, Entamoeba invadens
EMSLLWSLFDQEMKHRFLSVVE

SEQ ID NO: 2994294 - protein, 24 aa, Entamoeba invadens
EMSMIAMFPSDLLNRGSGPAVNYT

SEQ ID NO: 2994295 - protein, 25 aa, Entamoeba invadens
EMSQKYYIGFLNEMSRLLFVKKSVV

SEQ ID NO: 2994296 - protein, 24 aa, Entamoeba invadens
EMSSRLIYKLYINTFFNIIKLYNH

SEQ ID NO: 2994297 - protein, 24 aa, Entamoeba invadens
EMSVKFLGRIPLDPVIARSCDVGS

SEQ ID NO: 2994298 - protein, 20 aa, Entamoeba invadens
EMTFLLFRDEDMLIFGNRNL

SEQ ID NO: 2994299 - protein, 22 aa, Entamoeba invadens
EMTFLLFRDEDMLIFGNRNLFE

SEQ ID NO: 2994300 - protein, 18 aa, Entamoeba invadens
EMTKLPMFYHYKNKVCMI

SEQ ID NO: 2994301 - protein, 25 aa, Entamoeba invadens
EMTLKEMLFTTPSPLLDAYATLMNG

SEQ ID NO: 2994302 - protein, 25 aa, Entamoeba invadens
EMTNYMKKFYNFCFGENFEAKSEEN

SEQ ID NO: 2994303 - protein, 19 aa, Entamoeba invadens
EMTQLRYLSVLFSQNEVID

SEQ ID NO: 2994304 - protein, 30 aa, Entamoeba invadens
EMTQQICVGIIDFLRTFTWDKQIESFVKKI

SEQ ID NO: 2994305 - protein, 19 aa, Entamoeba invadens
EMTRLKEVLAESRTANEEH

SEQ ID NO: 2994306 - protein, 32 aa, Entamoeba invadens
EMTTKLTQILLWFSSLYLSPDVLLVPPLELDI

SEQ ID NO: 2994307 - protein, 17 aa, Entamoeba invadens
EMVLDRFRYNPIPVKST

SEQ ID NO: 2994308 - protein, 24 aa, Entamoeba invadens
EMVNLLLHCNVHHYLQFRAIHGSY

SEQ ID NO: 2994309 - protein, 23 aa, Entamoeba invadens
EMVTLMKKYFNFCYNGNYTFTDK

SEQ ID NO: 2994310 - protein, 25 aa, Entamoeba invadens
EMVTLMKKYFNFCYNGNYTFTDKNI

SEQ ID NO: 2994311 - protein, 19 aa, Entamoeba invadens
EMWRAIMIKYDQIYVGNED

SEQ ID NO: 2994312 - protein, 26 aa, Entamoeba invadens
EMYGYLMMLYSNNSCFKIWEFYERFF

SEQ ID NO: 2994313 - protein, 27 aa, Entamoeba invadens
EMYNTPISYTPLFGRGTFGGDFVGHMP

SEQ ID NO: 2994314 - protein, 23 aa, Entamoeba invadens
ENAAFILCLILSSCLKNVPYTNF

SEQ ID NO: 2994315 - protein, 20 aa, Entamoeba invadens
ENACDIFYIIYCLRKGLPVT

SEQ ID NO: 2994316 - protein, 27 aa, Entamoeba invadens
ENAERYLKLFKEVMYKMLPAIDSKDLD

SEQ ID NO: 2994317 - protein, 18 aa, Entamoeba invadens
ENAIKELNFPAGSKFIAE

SEQ ID NO: 2994318 - protein, 30 aa, Entamoeba invadens
ENAKILTHMILYIWLYYNNNVESEWDELYK

SEQ ID NO: 2994319 - protein, 22 aa, Entamoeba invadens
ENALPGMAIRTGANPLVYDCNL

SEQ ID NO: 2994320 - protein, 25 aa, Entamoeba invadens
ENALQKFTLKILEKIRFAPSASNKQ

SEQ ID NO: 2994321 - protein, 23 aa, Entamoeba invadens
ENAPLFINTIRLLVRSSMIDRVI

SEQ ID NO: 2994322 - protein, 26 aa, Entamoeba invadens
ENAPTNLFKSQFFFQVAKALKTGGTF

SEQ ID NO: 2994323 - protein, 24 aa, Entamoeba invadens
ENAVYALRMFLGATSSRSLQLGDT

SEQ ID NO: 2994324 - protein, 19 aa, Entamoeba invadens
ENCAFLRNVKIPSSVSLVD

SEQ ID NO: 2994325 - protein, 18 aa, Entamoeba invadens
ENCDKLEIVQFLGDFRNL

SEQ ID NO: 2994326 - protein, 17 aa, Entamoeba invadens
ENCFGLSQISLPKTVKV

SEQ ID NO: 2994327 - protein, 23 aa, Entamoeba invadens
ENCKTLKEITLNEGLLSIGNYCF

SEQ ID NO: 2994328 - protein, 18 aa, Entamoeba invadens
ENCRADFYKWISCAKFEV

SEQ ID NO: 2994329 - protein, 17 aa, Entamoeba invadens
ENCRFFEFGLKQSIFAY

SEQ ID NO: 2994330 - protein, 25 aa, Entamoeba invadens
ENCRSLKILFLQRKSLNEDHKKNKN

SEQ ID NO: 2994331 - protein, 27 aa, Entamoeba invadens
ENCSSLKNIILPYSVLSIGFGCFQNCC

SEQ ID NO: 2994332 - protein, 21 aa, Entamoeba invadens
ENCTLLRIKIPTTITIFEESK

SEQ ID NO: 2994333 - protein, 22 aa, Entamoeba invadens
ENDCIKYVLSKIMKLSYEQQIN

SEQ ID NO: 2994334 - protein, 22 aa, Entamoeba invadens
ENDDVIYGTKFFAFCVSLKEVP

SEQ ID NO: 2994335 - protein, 27 aa, Entamoeba invadens
ENDDYELVMITYPPTFDIKKLSTLQYN

SEQ ID NO: 2994336 - protein, 18 aa, Entamoeba invadens
ENDENLLLFIYKLKEHNN

SEQ ID NO: 2994337 - protein, 28 aa, Entamoeba invadens
ENDENYLERLLLIPVDEERLRMVKIVSY

SEQ ID NO: 2994338 - protein, 31 aa, Entamoeba invadens
ENDEYLLTDIAPYQMYLYKRRSGRVERMMRR

SEQ ID NO: 2994339 - protein, 17 aa, Entamoeba invadens
ENDFRGYVYSVAKALLL

SEQ ID NO: 2994340 - protein, 26 aa, Entamoeba invadens
ENDGDWHFLAITTLRDILQKQNLDYS

SEQ ID NO: 2994341 - protein, 23 aa, Entamoeba invadens
ENDLQAFDFVQKKKGVAVAMGNA

SEQ ID NO: 2994342 - protein, 23 aa, Entamoeba invadens
ENDNFYRVISWCPIELGTVPHNF

SEQ ID NO: 2994343 - protein, 26 aa, Entamoeba invadens
ENDPKEIITFDSLWDILNKKYTYEEL

SEQ ID NO: 2994344 - protein, 29 aa, Entamoeba invadens
ENDTTRIRNALLFYYRTGKTLSSQLLEDK

SEQ ID NO: 2994345 - protein, 23 aa, Entamoeba invadens
ENDYLRIFSLRQAIQTCKEKFHD

SEQ ID NO: 2994346 - protein, 30 aa, Entamoeba invadens
ENEAVPVSEWPMWINSKIENTPFRAMRDVN

SEQ ID NO: 2994347 - protein, 25 aa, Entamoeba invadens
ENECRILLVANKRDLQWKVTRQEVQ

SEQ ID NO: 2994348 - protein, 25 aa, Entamoeba invadens
ENEELIKCALPQDIWFHVDSESSAH

SEQ ID NO: 2994349 - protein, 19 aa, Entamoeba invadens
ENEKCLICNDIFLLNNENV

SEQ ID NO: 2994350 - protein, 24 aa, Entamoeba invadens
ENEKGIFKMMRFISNSFALEIVDG

SEQ ID NO: 2994351 - protein, 27 aa, Entamoeba invadens
ENEKYPFSRIVMFLLECFRSNMEKPTV

SEQ ID NO: 2994352 - protein, 31 aa, Entamoeba invadens
ENELWDILKKCYVNWITNKTVALIWKDTMIS

SEQ ID NO: 2994353 - protein, 26 aa, Entamoeba invadens
ENEMPSHLMYILRRIYNAVYLKRGEK

SEQ ID NO: 2994354 - protein, 18 aa, Entamoeba invadens
ENEQIVQAYPILGGIQVT

SEQ ID NO: 2994355 - protein, 25 aa, Entamoeba invadens
ENESVFTFLYNRLLRIYQALVNLFG

SEQ ID NO: 2994356 - protein, 25 aa, Entamoeba invadens
ENETIISLNGTITELTEKEKKSQDK

SEQ ID NO: 2994357 - protein, 23 aa, Entamoeba invadens
ENEVPKPLFGFNQEQPQNSSDVS

SEQ ID NO: 2994358 - protein, 25 aa, Entamoeba invadens
ENEWKKNFIVLNNQQLEDSRNKEKR

SEQ ID NO: 2994359 - protein, 24 aa, Entamoeba invadens
ENEYDLYDYLFNNNPILVGSNFEM

SEQ ID NO: 2994360 - protein, 23 aa, Entamoeba invadens
ENEYKIIQLINLRLDTVKANLKA

SEQ ID NO: 2994361 - protein, 18 aa, Entamoeba invadens
ENEYKVFSGITESSHIIP

SEQ ID NO: 2994362 - protein, 18 aa, Entamoeba invadens
ENFAIFSVFIMDVLVFLD

SEQ ID NO: 2994363 - protein, 23 aa, Entamoeba invadens
ENFFKRIGMKTRLSEWGYGKEHF

SEQ ID NO: 2994364 - protein, 32 aa, Entamoeba invadens
ENFFQLYDRTPLYLLVPPHIPMFRTIVTNYMN

SEQ ID NO: 2994365 - protein, 22 aa, Entamoeba invadens
ENFNYYVPYIQNNALIFQTKNL

SEQ ID NO: 2994366 - protein, 32 aa, Entamoeba invadens
ENFRVVTDSFLGNVLTLWKKDSTLQTLKNDTK

SEQ ID NO: 2994367 - protein, 23 aa, Entamoeba invadens
ENFTTALKRVLKSVLPKIQTAKL

SEQ ID NO: 2994368 - protein, 26 aa, Entamoeba invadens
ENFVAILYFVDYIITKIKVVSDWLQK

SEQ ID NO: 2994369 - protein, 19 aa, Entamoeba invadens
ENFYQVVIHFKVSFQIYLT

SEQ ID NO: 2994370 - protein, 27 aa, Entamoeba invadens
ENGALDFPEFLKLMTALDAMPDNSDKT

SEQ ID NO: 2994371 - protein, 28 aa, Entamoeba invadens
ENGFLCSLILRHPLPVLVAVYNSHQFQV

SEQ ID NO: 2994372 - protein, 30 aa, Entamoeba invadens
ENGFVFSCIGAFWIMQDWKLYIQQNVGGSF

SEQ ID NO: 2994373 - protein, 23 aa, Entamoeba invadens
ENGIPFLFGILSSAGTYEMSFVQ

SEQ ID NO: 2994374 - protein, 27 aa, Entamoeba invadens
ENGLSAFVIIWYNLCKYYHVLNRTVNN

SEQ ID NO: 2994375 - protein, 18 aa, Entamoeba invadens
ENGQFTVFKALCACVTIT

SEQ ID NO: 2994376 - protein, 26 aa, Entamoeba invadens
ENHDKIEVLLWKVKADKEIQLRNEYL

SEQ ID NO: 2994377 - protein, 25 aa, Entamoeba invadens
ENHEGEILVFGLVSNKIDSLEEQIK

SEQ ID NO: 2994378 - protein, 34 aa, Entamoeba invadens
ENHEVIIGCGFYPTTLKMFYTINGELVYSQHVEF

SEQ ID NO: 2994379 - protein, 19 aa, Entamoeba invadens
ENHFEMVYFISDVLSLLDP

SEQ ID NO: 2994380 - protein, 23 aa, Entamoeba invadens
ENHFNMMLSCKFYCNQDVRILKE

SEQ ID NO: 2994381 - protein, 25 aa, Entamoeba invadens
ENHFNMMLYCKFYCNQDVRILKEGH

SEQ ID NO: 2994382 - protein, 24 aa, Entamoeba invadens
ENHFNMMLYCKLYCNQDVRILKEG

SEQ ID NO: 2994383 - protein, 27 aa, Entamoeba invadens
ENHTTFTLTRLLKKLQKTFKKLQFYVE

SEQ ID NO: 2994384 - protein, 27 aa, Entamoeba invadens
ENHTTFTYTRLLKKLQKTFKKLQFYVE

SEQ ID NO: 2994385 - protein, 18 aa, Entamoeba invadens
ENIDILRSLLRTEQQISC

SEQ ID NO: 2994386 - protein, 22 aa, Entamoeba invadens
ENIGLMIIKMTQPFFVENKEFI

SEQ ID NO: 2994387 - protein, 23 aa, Entamoeba invadens
ENIKTVFLEKICGVPNVCVIITD

SEQ ID NO: 2994388 - protein, 20 aa, Entamoeba invadens
ENIKVIQMLVKVPVVTNREF

SEQ ID NO: 2994389 - protein, 17 aa, Entamoeba invadens
ENILFAEVLARDVIRVN

SEQ ID NO: 2994390 - protein, 22 aa, Entamoeba invadens
ENILLAAHQLGYGGVWLGVYPE

SEQ ID NO: 2994391 - protein, 19 aa, Entamoeba invadens
ENILSFAGAFVISGNCKAN

SEQ ID NO: 2994392 - protein, 29 aa, Entamoeba invadens
ENIMGQMMLIRLFSLFVRDILVQKMSKGM

SEQ ID NO: 2994393 - protein, 34 aa, Entamoeba invadens
ENIQIIQFAFRWFNCFLLREFSFKQGLRLWDTYL

SEQ ID NO: 2994394 - protein, 26 aa, Entamoeba invadens
ENITRQIVYSIIKRPTLSSSLTCEEV

SEQ ID NO: 2994395 - protein, 24 aa, Entamoeba invadens
ENIVKKVINFIFKKTHTKTPDPDY

SEQ ID NO: 2994396 - protein, 28 aa, Entamoeba invadens
ENKDNWKQKLIAWHLYKVYANFSAETVD

SEQ ID NO: 2994397 - protein, 25 aa, Entamoeba invadens
ENKEDVIFAFNFFKGIGMIELAKVL

SEQ ID NO: 2994398 - protein, 26 aa, Entamoeba invadens
ENKEKAIKFLGKLFKDAKFGDQFADE

SEQ ID NO: 2994399 - protein, 24 aa, Entamoeba invadens
ENKERVLRIQTTWLPYGNAPEINC

SEQ ID NO: 2994400 - protein, 30 aa, Entamoeba invadens
ENKFLPKYVELKILPANPFEILDRPGVGEV

SEQ ID NO: 2994401 - protein, 19 aa, Entamoeba invadens
ENKFSFDEIILLLGAESAT

SEQ ID NO: 2994402 - protein, 25 aa, Entamoeba invadens
ENKIRAVLDQRMHLRFLLEEVNTRL

SEQ ID NO: 2994403 - protein, 33 aa, Entamoeba invadens
ENKKLVIDCSGYLYRMTLWEVPILAIVSELYQK

SEQ ID NO: 2994404 - protein, 25 aa, Entamoeba invadens
ENKKNLVFLIQDTTGFVFGGFVGKE

SEQ ID NO: 2994405 - protein, 18 aa, Entamoeba invadens
ENKKSFNLSVKVPKDIIG

SEQ ID NO: 2994406 - protein, 24 aa, Entamoeba invadens
ENKLDPIVFLKKCVTILSSKQNII

SEQ ID NO: 2994407 - protein, 25 aa, Entamoeba invadens
ENKLDPIVFLKNQNIILFDLDMNTA

SEQ ID NO: 2994408 - protein, 17 aa, Entamoeba invadens
ENKLGEGGFGIVYKGTL

SEQ ID NO: 2994409 - protein, 23 aa, Entamoeba invadens
ENKPEHIFIENVPLFKESLVFKD

SEQ ID NO: 2994410 - protein, 17 aa, Entamoeba invadens
ENKRFREELSKNSYRKK

SEQ ID NO: 2994411 - protein, 17 aa, Entamoeba invadens
ENKRNIGTFVFDKLPKT

SEQ ID NO: 2994412 - protein, 25 aa, Entamoeba invadens
ENKTNFREFLEQKARLRWNNMVNKR

SEQ ID NO: 2994413 - protein, 29 aa, Entamoeba invadens
ENKTNKIPIFLPFLTSLREFFQNYMEKQN

SEQ ID NO: 2994414 - protein, 17 aa, Entamoeba invadens
ENKVNATLFPQPQVKHQ

SEQ ID NO: 2994415 - protein, 22 aa, Entamoeba invadens
ENKYFTHVLVFSHGLVTSLLFD

SEQ ID NO: 2994416 - protein, 21 aa, Entamoeba invadens
ENLFLLEVVCLLQYTKSTEVM

SEQ ID NO: 2994417 - protein, 21 aa, Entamoeba invadens
ENLKELILPTTLKVIGKHIFS

SEQ ID NO: 2994418 - protein, 21 aa, Entamoeba invadens
ENLKLFKWMCQGRYAEGEATL

SEQ ID NO: 2994419 - protein, 30 aa, Entamoeba invadens
ENLKNGIIASYLPLLQEWTKKKKYNVIFNS

SEQ ID NO: 2994420 - protein, 27 aa, Entamoeba invadens
ENLLNRNLLNRLLLLSFKTPSTLSTNS

SEQ ID NO: 2994421 - protein, 25 aa, Entamoeba invadens
ENLQDNHWIVEWAKSTQIRDSDLDK

SEQ ID NO: 2994422 - protein, 25 aa, Entamoeba invadens
ENLREHIVNLHKWAPYMKNTEGFGN

SEQ ID NO: 2994423 - protein, 29 aa, Entamoeba invadens
ENLRVEIYEFKIPQILKICNQLISNHYDS

SEQ ID NO: 2994424 - protein, 27 aa, Entamoeba invadens
ENLVKIIDYFSFPYSIFGEEAGGTFQY

SEQ ID NO: 2994425 - protein, 20 aa, Entamoeba invadens
ENLVTGHYLTIDPPAPKQKV

SEQ ID NO: 2994426 - protein, 17 aa, Entamoeba invadens
ENLVYFHPAMDKVFNIP

SEQ ID NO: 2994427 - protein, 25 aa, Entamoeba invadens
ENMDKYIITYPIDVKYVLNPTLLKT

SEQ ID NO: 2994428 - protein, 28 aa, Entamoeba invadens
ENMENVFKMFFVLKKKFPEFEDKVILNT

SEQ ID NO: 2994429 - protein, 17 aa, Entamoeba invadens
ENMFLFGNSFGNYLPSQ

SEQ ID NO: 2994430 - protein, 24 aa, Entamoeba invadens
ENMHKFIVIGFKDQTYVLKKVADT

SEQ ID NO: 2994431 - protein, 22 aa, Entamoeba invadens
ENMVNFINKMKDLEELVSYLKM

SEQ ID NO: 2994432 - protein, 27 aa, Entamoeba invadens
ENMWKFSQFTNLMNLTLFASQINLSKL

SEQ ID NO: 2994433 - protein, 24 aa, Entamoeba invadens
ENNEKILFPFINVEELRVMSTRFV

SEQ ID NO: 2994434 - protein, 25 aa, Entamoeba invadens
ENNEVRFYSLELIKILLKNPQENAR

SEQ ID NO: 2994435 - protein, 24 aa, Entamoeba invadens
ENNFYQIMMFNFSQYFGEKNFDEY

SEQ ID NO: 2994436 - protein, 18 aa, Entamoeba invadens
ENNHYIPTLLLGVASRLK

SEQ ID NO: 2994437 - protein, 26 aa, Entamoeba invadens
ENNIKGLFRKGLALNGLKKYEEALGV

SEQ ID NO: 2994438 - protein, 25 aa, Entamoeba invadens
ENNIKLLGNIFTKPTFIPPEVTSPN

SEQ ID NO: 2994439 - protein, 25 aa, Entamoeba invadens
ENNIYNNIFYHCTYGYHGDARGPYR

SEQ ID NO: 2994440 - protein, 25 aa, Entamoeba invadens
ENNKCTICYPGYNLREDGTCTVCEA

SEQ ID NO: 2994441 - protein, 27 aa, Entamoeba invadens
ENNKVVESFLFWLKQRKHKSFSPERRS

SEQ ID NO: 2994442 - protein, 20 aa, Entamoeba invadens
ENNLKIFSYLKNQNTLRSSQ

SEQ ID NO: 2994443 - protein, 22 aa, Entamoeba invadens
ENNLLLKSILQLEEEKFRLRKN

SEQ ID NO: 2994444 - protein, 17 aa, Entamoeba invadens
ENNPMEILMDGFTIEKV

SEQ ID NO: 2994445 - protein, 21 aa, Entamoeba invadens
ENNPVACAWPYLFGENGIGID

SEQ ID NO: 2994446 - protein, 25 aa, Entamoeba invadens
ENNQLQMRLVCLSLPLGDSKSLRDW

SEQ ID NO: 2994447 - protein, 25 aa, Entamoeba invadens
ENNRLKTLGIRKRLPRACKGAPMPR

SEQ ID NO: 2994448 - protein, 32 aa, Entamoeba invadens
ENNVDMYFLHNYNYFPMAYPPFSAEDHLRSAV

SEQ ID NO: 2994449 - protein, 27 aa, Entamoeba invadens
ENNVHLFDLRVGGLFMKTPLFTTIAED

SEQ ID NO: 2994450 - protein, 17 aa, Entamoeba invadens
ENNVNEVLFWTVPGPEE

SEQ ID NO: 2994451 - protein, 27 aa, Entamoeba invadens
ENPKRVKAPVWYPIYHTSLNFKNFNRI

SEQ ID NO: 2994452 - protein, 23 aa, Entamoeba invadens
ENPMESAPFVKLRKVEKQKPVET

SEQ ID NO: 2994453 - protein, 18 aa, Entamoeba invadens
ENPMLIAIREFCFKPKKL

SEQ ID NO: 2994454 - protein, 25 aa, Entamoeba invadens
ENPTKRKALAKPVSKAGTMTGSSSL

SEQ ID NO: 2994455 - protein, 25 aa, Entamoeba invadens
ENQCRICETGFFIGAMSTCHPCTDY

SEQ ID NO: 2994456 - protein, 33 aa, Entamoeba invadens
ENQEKVAYFFFNKAYIMLLKDTDGYWNVQMEVD

SEQ ID NO: 2994457 - protein, 21 aa, Entamoeba invadens
ENQFRMSMAKNLPIVTLKLPQ

SEQ ID NO: 2994458 - protein, 39 aa, Entamoeba invadens
ENQLDLRSYLIMPVQRLPRYRLLLTDLIKHTDDAFPDKP

SEQ ID NO: 2994459 - protein, 28 aa, Entamoeba invadens
ENQLFISKIPIFLQNTPNLAAIFGDFGR

SEQ ID NO: 2994460 - protein, 27 aa, Entamoeba invadens
ENQNYWEKEIWYSITSPLLLQSQLMGR

SEQ ID NO: 2994461 - protein, 26 aa, Entamoeba invadens
ENQSKALPEFDWILGNTTHLEEKTQN

SEQ ID NO: 2994462 - protein, 25 aa, Entamoeba invadens
ENQVLPPNYFLHVVSQFNAGYDYLY

SEQ ID NO: 2994463 - protein, 21 aa, Entamoeba invadens
ENRFNAVFFVGKKLTPSNEKI

SEQ ID NO: 2994464 - protein, 20 aa, Entamoeba invadens
ENRHLWFQALQKPKASRRRI

SEQ ID NO: 2994465 - protein, 25 aa, Entamoeba invadens
ENRIWPGLIDIVSRNLLMFSSYDDM

SEQ ID NO: 2994466 - protein, 34 aa, Entamoeba invadens
ENRMNVQIPWGLEKALKYLFDKGLDKEGLFRLSS

SEQ ID NO: 2994467 - protein, 27 aa, Entamoeba invadens
ENRQMLHKILFLYAMKHPEINYTQGFN

SEQ ID NO: 2994468 - protein, 28 aa, Entamoeba invadens
ENRTHQIPPLITLKIQKVGFTVSELCSK

SEQ ID NO: 2994469 - protein, 26 aa, Entamoeba invadens
ENSAPLKELHFAGKKAFIVVVSQNEI

SEQ ID NO: 2994470 - protein, 21 aa, Entamoeba invadens
ENSELLMSYYDTQVELYKTKI

SEQ ID NO: 2994471 - protein, 24 aa, Entamoeba invadens
ENSFLLKYIVNVVTVPWYHGNDSS

SEQ ID NO: 2994472 - protein, 34 aa, Entamoeba invadens
ENSGEKTPVLATKRRTPRLQRAESSMSLSLDMTT

SEQ ID NO: 2994473 - protein, 34 aa, Entamoeba invadens
ENSGFIFWEMCRTYDFYLLRLMMRHSTSTVPEFW

SEQ ID NO: 2994474 - protein, 17 aa, Entamoeba invadens
ENSIFDFKEICNKKWCV

SEQ ID NO: 2994475 - protein, 18 aa, Entamoeba invadens
ENSIPYTLPLEAIVAIEE

SEQ ID NO: 2994476 - protein, 25 aa, Entamoeba invadens
ENSIRQYEEFLRQITLRSDYNTEVE

SEQ ID NO: 2994477 - protein, 34 aa, Entamoeba invadens
ENSKDRLLSYLRLEKIGFVFQTFNLITSMNAIEN

SEQ ID NO: 2994478 - protein, 24 aa, Entamoeba invadens
ENSQRFVLVKWRGMSYLHVDTLPE

SEQ ID NO: 2994479 - protein, 33 aa, Entamoeba invadens
ENSSNDIHFTFLWVKDMFTFLDLKPYSAKDDME

SEQ ID NO: 2994480 - protein, 31 aa, Entamoeba invadens
ENSTGLSHELLEKDYRGILGLPPKKIHMNYR

SEQ ID NO: 2994481 - protein, 22 aa, Entamoeba invadens
ENSTRLRHISFPQTVWNIPQSM

SEQ ID NO: 2994482 - protein, 30 aa, Entamoeba invadens
ENSVGICYEITPIIYALKNKKITGKHCVVP

SEQ ID NO: 2994483 - protein, 27 aa, Entamoeba invadens
ENTDHFLYIVNMLTPDFVLEVTESILA

SEQ ID NO: 2994484 - protein, 17 aa, Entamoeba invadens
ENTDITPPPIPPSPRSG

SEQ ID NO: 2994485 - protein, 24 aa, Entamoeba invadens
ENTDLFLVFIELDQKFNQDKNKTI

SEQ ID NO: 2994486 - protein, 19 aa, Entamoeba invadens
ENTFLLDDRAYMGDFGSGV

SEQ ID NO: 2994487 - protein, 28 aa, Entamoeba invadens
ENTFPLLSINIIYQLLRNFKVDEMDNVP

SEQ ID NO: 2994488 - protein, 25 aa, Entamoeba invadens
ENTGFIALSFLKLIPEKFAIPERHK

SEQ ID NO: 2994489 - protein, 23 aa, Entamoeba invadens
ENTIKLFPVMQYQTLYKNGEDRL

SEQ ID NO: 2994490 - protein, 23 aa, Entamoeba invadens
ENTILYFRAWEMIDNKNTGFFDP

SEQ ID NO: 2994491 - protein, 22 aa, Entamoeba invadens
ENTIRYLWEFGNLRIDAEEWVY

SEQ ID NO: 2994492 - protein, 40 aa, Entamoeba invadens
ENTKIAFIKAVTFFACVRLSELVLPLSLFSIQDNAFQYCS

SEQ ID NO: 2994493 - protein, 24 aa, Entamoeba invadens
ENTKRVIQYIATIAGRSSATMGDI

SEQ ID NO: 2994494 - protein, 22 aa, Entamoeba invadens
ENTLKTKWFPPKVRKIRLFTNE

SEQ ID NO: 2994495 - protein, 26 aa, Entamoeba invadens
ENTLTNLFCLRVMTGSIILNDIISTL

SEQ ID NO: 2994496 - protein, 30 aa, Entamoeba invadens
ENTPEFPRRFYLFVLKFFSKIFKTDFVVVY

SEQ ID NO: 2994497 - protein, 24 aa, Entamoeba invadens
ENTPRLESIPILRSTSPKPDNKIV

SEQ ID NO: 2994498 - protein, 18 aa, Entamoeba invadens
ENTPRVLKELSYSEYYYL

SEQ ID NO: 2994499 - protein, 24 aa, Entamoeba invadens
ENTRRIIVSSLLIDGKMKQIIGDK

SEQ ID NO: 2994500 - protein, 26 aa, Entamoeba invadens
ENTSTSMRWSLFPLENELLQKDCWES

SEQ ID NO: 2994501 - protein, 17 aa, Entamoeba invadens
ENTTFVVIINKQAVQKT

SEQ ID NO: 2994502 - protein, 24 aa, Entamoeba invadens
ENTTLKATILELQTSEKYSKEENS

SEQ ID NO: 2994503 - protein, 29 aa, Entamoeba invadens
ENTTLKGYRKWFSSGIDTASLLLIGVSKD

SEQ ID NO: 2994504 - protein, 26 aa, Entamoeba invadens
ENTTPTPFILKLFELVNNPESQHLMR

SEQ ID NO: 2994505 - protein, 27 aa, Entamoeba invadens
ENTVFFMEYFMRHALFNKDVNIIVLAQ

SEQ ID NO: 2994506 - protein, 18 aa, Entamoeba invadens
ENTVFGGNLIIDCDFGDK

SEQ ID NO: 2994507 - protein, 26 aa, Entamoeba invadens
ENTVKCFSYLALRPVWEIYTVVKQYF

SEQ ID NO: 2994508 - protein, 28 aa, Entamoeba invadens
ENVCVMVSRWFGGILLGPDRFKHIVNTA

SEQ ID NO: 2994509 - protein, 30 aa, Entamoeba invadens
ENVDIQNLILILTNILRKGVQNSPLWTHAN

SEQ ID NO: 2994510 - protein, 30 aa, Entamoeba invadens
ENVDWWGLGILIYEMLFTKSPFLADSMEEL

SEQ ID NO: 2994511 - protein, 31 aa, Entamoeba invadens
ENVEPSKLPESWKILLREAGVKKRDLQNPDT

SEQ ID NO: 2994512 - protein, 37 aa, Entamoeba invadens
ENVETWIEECKKYEEKRVIVLAGNKIDLGEGRVVTKE

SEQ ID NO: 2994513 - protein, 17 aa, Entamoeba invadens
ENVFIFTNIVKSNKITV

SEQ ID NO: 2994514 - protein, 17 aa, Entamoeba invadens
ENVFRDVIYPKAKEILS

SEQ ID NO: 2994515 - protein, 22 aa, Entamoeba invadens
ENVFVQHKPLLDSLLEPFVTQQ

SEQ ID NO: 2994516 - protein, 27 aa, Entamoeba invadens
ENVISLFVQLLLFKGTIAKVKNIESGV

SEQ ID NO: 2994517 - protein, 22 aa, Entamoeba invadens
ENVKVDFLQFHPIKTLESVTLQ

SEQ ID NO: 2994518 - protein, 30 aa, Entamoeba invadens
ENVLLSLVRYQFMKSFVLISFQYIDHFMSQ

SEQ ID NO: 2994519 - protein, 37 aa, Entamoeba invadens
ENVNNLLFTVFDLQLTLKLLLYELIDWMRDHPSYTIP

SEQ ID NO: 2994520 - protein, 24 aa, Entamoeba invadens
ENVPNTSIFIKPKNFKFVFQMCGK

SEQ ID NO: 2994521 - protein, 25 aa, Entamoeba invadens
ENVRYIGFHAFLNCVLLSNIVINKD

SEQ ID NO: 2994522 - protein, 24 aa, Entamoeba invadens
ENVTFIPPFYCDYGKYIEIGDYTT

SEQ ID NO: 2994523 - protein, 22 aa, Entamoeba invadens
ENVTFLPPFHCDYGKYITVGSS

SEQ ID NO: 2994524 - protein, 17 aa, Entamoeba invadens
ENVVFRNCKFNKSLFYN

SEQ ID NO: 2994525 - protein, 24 aa, Entamoeba invadens
ENVVWVNYCFWICMDNVVFLWHHF

SEQ ID NO: 2994526 - protein, 26 aa, Entamoeba invadens
ENVYKSPSWFWGISSIWFSLQDVDFS

SEQ ID NO: 2994527 - protein, 25 aa, Entamoeba invadens
ENVYNKKCHLQYPKKLKTPFHQIEA

SEQ ID NO: 2994528 - protein, 20 aa, Entamoeba invadens
ENWLKWIVSVGEEFEFDFKK

SEQ ID NO: 2994529 - protein, 20 aa, Entamoeba invadens
ENWMLDKRIVVLPVVHNRMH

SEQ ID NO: 2994530 - protein, 31 aa, Entamoeba invadens
ENYENFQILTKLFISPLRTLALAHLEIKTLD

SEQ ID NO: 2994531 - protein, 26 aa, Entamoeba invadens
ENYKNFPILLKRVSSFIQGALSTLVG

SEQ ID NO: 2994532 - protein, 26 aa, Entamoeba invadens
ENYKSQIKALEALNKMVWDDKTDDEK

SEQ ID NO: 2994533 - protein, 23 aa, Entamoeba invadens
ENYLEMLLPLVKLGLYTSEEVRK

SEQ ID NO: 2994534 - protein, 45 aa, Entamoeba invadens
ENYNTDFVFTFSTLLMYFYMKSIRTVLRRTVLLVASYTQKNADLY

SEQ ID NO: 2994535 - protein, 20 aa, Entamoeba invadens
ENYNVPIVVPDTPTSFNLGE

SEQ ID NO: 2994536 - protein, 28 aa, Entamoeba invadens
ENYQLKYYYYHNMSWPTLTFLAENAEGK

SEQ ID NO: 2994537 - protein, 34 aa, Entamoeba invadens
ENYVADDKVDDFCLFFYLSFCVMKETKLDDNLEI

SEQ ID NO: 2994538 - protein, 24 aa, Entamoeba invadens
ENYVANFVTSLRTFFKYTNEENLG

SEQ ID NO: 2994539 - protein, 26 aa, Entamoeba invadens
ENYVHLPVKCFQYFKALKTVNVWSHK

SEQ ID NO: 2994540 - protein, 23 aa, Entamoeba invadens
ENYVVIKEVFKMLLEIHKNAKVT

SEQ ID NO: 2994541 - protein, 19 aa, Entamoeba invadens
ENYYFKKVIIKDTNLRRCY

SEQ ID NO: 2994542 - protein, 17 aa, Entamoeba invadens
EPAITFPPTYRIAKGTK

SEQ ID NO: 2994543 - protein, 17 aa, Entamoeba invadens
EPAIVKKSHMSRSLLES

SEQ ID NO: 2994544 - protein, 32 aa, Entamoeba invadens
EPAKARTMLLETYLYIRDLYNEYGTDTTKMFR

SEQ ID NO: 2994545 - protein, 23 aa, Entamoeba invadens
EPARFYLAEILLALEYLHLNGII

SEQ ID NO: 2994546 - protein, 23 aa, Entamoeba invadens
EPDCEFLPVMKAFLLASQSDLDS

SEQ ID NO: 2994547 - protein, 23 aa, Entamoeba invadens
EPDFSTFRDGLLLRQLYEKVNDL

SEQ ID NO: 2994548 - protein, 17 aa, Entamoeba invadens
EPDLTRQVLLKRLKEKS

SEQ ID NO: 2994549 - protein, 24 aa, Entamoeba invadens
EPDNYLMRPIQRPPRYKLLMDAVV

SEQ ID NO: 2994550 - protein, 18 aa, Entamoeba invadens
EPDRWYYGGGLYMGKKMP

SEQ ID NO: 2994551 - protein, 17 aa, Entamoeba invadens
EPDVFIMVVGNKVDKPT

SEQ ID NO: 2994552 - protein, 28 aa, Entamoeba invadens
EPEDKKIYNFLLRVALKQKRYTDAVRLM

SEQ ID NO: 2994553 - protein, 26 aa, Entamoeba invadens
EPEEEEYLYKYALLSLRKKKSLDRQL

SEQ ID NO: 2994554 - protein, 25 aa, Entamoeba invadens
EPEIKMLKILCRWFCRKRRLSDYNQ

SEQ ID NO: 2994555 - protein, 22 aa, Entamoeba invadens
EPEMISIDCSQLVLVEYKLEEK

SEQ ID NO: 2994556 - protein, 21 aa, Entamoeba invadens
EPFDRIITYLITTLKTFPERG

SEQ ID NO: 2994557 - protein, 24 aa, Entamoeba invadens
EPFKKPIEILYTQNTFRPIDQSKC

SEQ ID NO: 2994558 - protein, 22 aa, Entamoeba invadens
EPFRTAVDPIYYDVLDYFTIVK

SEQ ID NO: 2994559 - protein, 21 aa, Entamoeba invadens
EPFYLRNVVLNLPTLLDISNF

SEQ ID NO: 2994560 - protein, 25 aa, Entamoeba invadens
EPGAFSMCRTLRRVFLPFQTQYHST

SEQ ID NO: 2994561 - protein, 26 aa, Entamoeba invadens
EPGAFSMCRTLRRVFLPFQTRYHSTA

SEQ ID NO: 2994562 - protein, 26 aa, Entamoeba invadens
EPGKCQIEVSFFKGLEMRSTFQTNRQ

SEQ ID NO: 2994563 - protein, 23 aa, Entamoeba invadens
EPGKQYIGLILFSAVLEGGCSLE

SEQ ID NO: 2994564 - protein, 27 aa, Entamoeba invadens
EPHLKLLEKATPIPLPPNLKCNVLQLH

SEQ ID NO: 2994565 - protein, 23 aa, Entamoeba invadens
EPIEILLHIPILCEDKNVPYVFV

SEQ ID NO: 2994566 - protein, 19 aa, Entamoeba invadens
EPINFDLNVLPPIKKDFSD

SEQ ID NO: 2994567 - protein, 29 aa, Entamoeba invadens
EPIRHDLAFRRILFILSLVNGGVSYVQGM

SEQ ID NO: 2994568 - protein, 17 aa, Entamoeba invadens
EPIYEGFTMKRCGLRTS

SEQ ID NO: 2994569 - protein, 17 aa, Entamoeba invadens
EPIYPRQDRFERKNLLR

SEQ ID NO: 2994570 - protein, 28 aa, Entamoeba invadens
EPKKDFLKKFLFEPFPLESYFENVIADQ

SEQ ID NO: 2994571 - protein, 18 aa, Entamoeba invadens
EPKKLLKTVEKKKQLLSG

SEQ ID NO: 2994572 - protein, 18 aa, Entamoeba invadens
EPKRITIKKIRRKDEASE

SEQ ID NO: 2994573 - protein, 26 aa, Entamoeba invadens
EPKSKIMNLTWGFSLKKIIKKEDRES

SEQ ID NO: 2994574 - protein, 36 aa, Entamoeba invadens
EPKSSIYSFRFPLTRNYIFCHVLFVQIPHTDKRKSI

SEQ ID NO: 2994575 - protein, 22 aa, Entamoeba invadens
EPKYICDTVLYTIDYRVMGNIP

SEQ ID NO: 2994576 - protein, 18 aa, Entamoeba invadens
EPLFFQYVANLFSDDDFV

SEQ ID NO: 2994577 - protein, 27 aa, Entamoeba invadens
EPLKRAFVQFCFEPIQKLFVSIMDGKK

SEQ ID NO: 2994578 - protein, 24 aa, Entamoeba invadens
EPLTERVLSLWSLSILCKNKVFKV

SEQ ID NO: 2994579 - protein, 22 aa, Entamoeba invadens
EPLTIRGQVWKLLSGIYTLDDT

SEQ ID NO: 2994580 - protein, 21 aa, Entamoeba invadens
EPLVVAYFHRTVLKMMKTKDR

SEQ ID NO: 2994581 - protein, 25 aa, Entamoeba invadens
EPMDDAELIMFLPQLVQALKFELHH

SEQ ID NO: 2994582 - protein, 24 aa, Entamoeba invadens
EPNHALKRKLLERQPLRRQRLGLK

SEQ ID NO: 2994583 - protein, 22 aa, Entamoeba invadens
EPNLDNVFYPQIDYTQPFNSFY

SEQ ID NO: 2994584 - protein, 24 aa, Entamoeba invadens
EPNLVFLKAFGRTQSRLVCRCSRE

SEQ ID NO: 2994585 - protein, 24 aa, Entamoeba invadens
EPNTILMVLAPLNERTQCCLDYPF

SEQ ID NO: 2994586 - protein, 25 aa, Entamoeba invadens
EPNWKPVITVLTTISILIVEKRGDN

SEQ ID NO: 2994587 - protein, 32 aa, Entamoeba invadens
EPPGGLMPPGMLPPPGLAPPGGMMPPPGLAPP

SEQ ID NO: 2994588 - protein, 21 aa, Entamoeba invadens
EPQFKRYYQMYEEIKKEMQEN

SEQ ID NO: 2994589 - protein, 28 aa, Entamoeba invadens
EPQQKMQLLYWMDLLSDYTNLKYEDFAH

SEQ ID NO: 2994590 - protein, 26 aa, Entamoeba invadens
EPSALYTYMNPLLRTIPVNDPNYNMA

SEQ ID NO: 2994591 - protein, 20 aa, Entamoeba invadens
EPSFLLIDPLMIARQMTMME

SEQ ID NO: 2994592 - protein, 23 aa, Entamoeba invadens
EPSLITTPLKRNVKIHTYTDNQF

SEQ ID NO: 2994593 - protein, 26 aa, Entamoeba invadens
EPSPQTMFTLYYSKLVYILLNENMKD

SEQ ID NO: 2994594 - protein, 22 aa, Entamoeba invadens
EPSVLDMFFKKWGTMSVNNQNG

SEQ ID NO: 2994595 - protein, 20 aa, Entamoeba invadens
EPTPALLNITQNFLLKCPDL

SEQ ID NO: 2994596 - protein, 33 aa, Entamoeba invadens
EPTTFRPKEIAALFFKTLMNQIKMEVPDLVRPN

SEQ ID NO: 2994597 - protein, 21 aa, Entamoeba invadens
EPTTLVLPQSLSKFIHFSIPK

SEQ ID NO: 2994598 - protein, 19 aa, Entamoeba invadens
EPVFLMNVVLYIQQTDIVT

SEQ ID NO: 2994599 - protein, 30 aa, Entamoeba invadens
EPVKKIIANALDLMKSYFTGLKNIFDIVAA

SEQ ID NO: 2994600 - protein, 24 aa, Entamoeba invadens
EPVQLAANVLPRFFKHSNFSSFVR

SEQ ID NO: 2994601 - protein, 19 aa, Entamoeba invadens
EPVTLTLEFFDAALRYLAT

SEQ ID NO: 2994602 - protein, 31 aa, Entamoeba invadens
EPVTMPLNTKLATLHRLIFDTSLKENVIKQF

SEQ ID NO: 2994603 - protein, 26 aa, Entamoeba invadens
EPYIHAEDIKPLRLFFSLADTDSNGS

SEQ ID NO: 2994604 - protein, 31 aa, Entamoeba invadens
EPYLSGLKYNAMPPFKRFHDLEQLSGGEKTI

SEQ ID NO: 2994605 - protein, 25 aa, Entamoeba invadens
EPYNKLEFKFPWKIAEFVISGKRLP

SEQ ID NO: 2994606 - protein, 20 aa, Entamoeba invadens
EQAHYILHKRVHDVSMISSA

SEQ ID NO: 2994607 - protein, 18 aa, Entamoeba invadens
EQALKFIVADGIKLVNID

SEQ ID NO: 2994608 - protein, 28 aa, Entamoeba invadens
EQAYNADLLLTLQYYIPLVQKELKSDGV

SEQ ID NO: 2994609 - protein, 20 aa, Entamoeba invadens
EQCECCELYYPIAYKKLHRR

SEQ ID NO: 2994610 - protein, 33 aa, Entamoeba invadens
EQCIRLKNKLKALLFYESAFTVSLLYSSKSGFV

SEQ ID NO: 2994611 - protein, 30 aa, Entamoeba invadens
EQDDDWVYIVRRWFALKDNLCYKCGENCTT

SEQ ID NO: 2994612 - protein, 25 aa, Entamoeba invadens
EQDKFDWAINFVKFLKEMVVYIKQY

SEQ ID NO: 2994613 - protein, 25 aa, Entamoeba invadens
EQDLNLILYRIFVGGTRLISVDING

SEQ ID NO: 2994614 - protein, 24 aa, Entamoeba invadens
EQDLNLVLFRIFVGGTRLTNFDIH

SEQ ID NO: 2994615 - protein, 24 aa, Entamoeba invadens
EQDLYLMEQAVVSFIRLMKTHPVD

SEQ ID NO: 2994616 - protein, 25 aa, Entamoeba invadens
EQEFPFYRQYFYQKKSVRHFLDKEN

SEQ ID NO: 2994617 - protein, 23 aa, Entamoeba invadens
EQEIAYIIFVGNKTDLPPKVTVE

SEQ ID NO: 2994618 - protein, 20 aa, Entamoeba invadens
EQEIINGYKLLEKISPETKN

SEQ ID NO: 2994619 - protein, 21 aa, Entamoeba invadens
EQELAMRTKYGWVFDEFCEDC

SEQ ID NO: 2994620 - protein, 17 aa, Entamoeba invadens
EQELPYCQVGVRTDIPI

SEQ ID NO: 2994621 - protein, 21 aa, Entamoeba invadens
EQELYLGMLLDPTTEVVYLTP

SEQ ID NO: 2994622 - protein, 23 aa, Entamoeba invadens
EQENDLITNMQILGYLNETDNNE

SEQ ID NO: 2994623 - protein, 23 aa, Entamoeba invadens
EQERLIKENLLKSFYSPPGSESK

SEQ ID NO: 2994624 - protein, 26 aa, Entamoeba invadens
EQESLHVFPFHPVDFIVTTKRRISEC

SEQ ID NO: 2994625 - protein, 17 aa, Entamoeba invadens
EQEVTEFLLLFGIECQR

SEQ ID NO: 2994626 - protein, 21 aa, Entamoeba invadens
EQFENSFVPSQLTRVILGCLK

SEQ ID NO: 2994627 - protein, 19 aa, Entamoeba invadens
EQFGFYNEDLIPIVKNETL

SEQ ID NO: 2994628 - protein, 26 aa, Entamoeba invadens
EQFIDSAPPCFLLSALYVIDSLIRYL

SEQ ID NO: 2994629 - protein, 22 aa, Entamoeba invadens
EQFKKLFFKTVAVSYEFYLQMK

SEQ ID NO: 2994630 - protein, 36 aa, Entamoeba invadens
EQFKKYFFDTVVVSYTFYLQMKAFGYMFHNVNYKIS

SEQ ID NO: 2994631 - protein, 29 aa, Entamoeba invadens
EQFKNAMKISWKCKAKYPILAALANKCVD

SEQ ID NO: 2994632 - protein, 26 aa, Entamoeba invadens
EQFVKEIIAAMRKIRDPQFEKYELNK

SEQ ID NO: 2994633 - protein, 17 aa, Entamoeba invadens
EQFWAGIYPTSKSIPNS

SEQ ID NO: 2994634 - protein, 25 aa, Entamoeba invadens
EQGFTLTLLNIEHGFFGSPIPVLTR

SEQ ID NO: 2994635 - protein, 28 aa, Entamoeba invadens
EQGKRDKYFSMLLPFVLFMLDDSDKINE

SEQ ID NO: 2994636 - protein, 24 aa, Entamoeba invadens
EQGTPFGMLALPAAPGMMPMQQPQ

SEQ ID NO: 2994637 - protein, 31 aa, Entamoeba invadens
EQGVILKVAALPVPIPVLRGNASYVASNPNI

SEQ ID NO: 2994638 - protein, 20 aa, Entamoeba invadens
EQIEFYFSTLNFSSDAFLQT

SEQ ID NO: 2994639 - protein, 25 aa, Entamoeba invadens
EQIHLLIDLAWLNGFFCNSTFTSGS

SEQ ID NO: 2994640 - protein, 27 aa, Entamoeba invadens
EQIKKLPYFWYYVVVNSSWAERLLSNN

SEQ ID NO: 2994641 - protein, 24 aa, Entamoeba invadens
EQIKLPKGLQYLGPLCFEKCNNLK

SEQ ID NO: 2994642 - protein, 18 aa, Entamoeba invadens
EQILKDWTCANSMELIYD

SEQ ID NO: 2994643 - protein, 20 aa, Entamoeba invadens
EQIPPKLKKIFELQQVFPDC

SEQ ID NO: 2994644 - protein, 25 aa, Entamoeba invadens
EQIPQNLRPEKIAWYSTAYQINAKK

SEQ ID NO: 2994645 - protein, 29 aa, Entamoeba invadens
EQISEGISHLIFWARASGVKVANACWVVV

SEQ ID NO: 2994646 - protein, 25 aa, Entamoeba invadens
EQITKILMERLLVSKPLQVGVVVTV

SEQ ID NO: 2994647 - protein, 17 aa, Entamoeba invadens
EQIVLTEDYLINMSLMM

SEQ ID NO: 2994648 - protein, 24 aa, Entamoeba invadens
EQIWGNFYTLYFKPTSFCTYTKKC

SEQ ID NO: 2994649 - protein, 24 aa, Entamoeba invadens
EQKARERLEDFPELNFVEENLYEE

SEQ ID NO: 2994650 - protein, 24 aa, Entamoeba invadens
EQKDGWIEILKKNVGDKLVVKNSG

SEQ ID NO: 2994651 - protein, 18 aa, Entamoeba invadens
EQKEIPVFKATTFKNEPT

SEQ ID NO: 2994652 - protein, 22 aa, Entamoeba invadens
EQKFLIRTNPPVVTLKRGFACE

SEQ ID NO: 2994653 - protein, 24 aa, Entamoeba invadens
EQKGLLQLVLFSATAVKFKGAYDN

SEQ ID NO: 2994654 - protein, 25 aa, Entamoeba invadens
EQKKEFFRVVFWYNVSYSITQKFKT

SEQ ID NO: 2994655 - protein, 17 aa, Entamoeba invadens
EQKRFEEELQKNSFRKA

SEQ ID NO: 2994656 - protein, 27 aa, Entamoeba invadens
EQKSHLKEILPFFVYLAGNKIIQKDIF

SEQ ID NO: 2994657 - protein, 25 aa, Entamoeba invadens
EQKTNYQYILLFNDILICGKGDEKH

SEQ ID NO: 2994658 - protein, 25 aa, Entamoeba invadens
EQLCLKYCIFITLFVDNTATLEKTI

SEQ ID NO: 2994659 - protein, 22 aa, Entamoeba invadens
EQLEIYLHAWKYEIDGEKFETD

SEQ ID NO: 2994660 - protein, 31 aa, Entamoeba invadens
EQLHKVFKEVPQRFLFARYKNITSADDILPF

SEQ ID NO: 2994661 - protein, 25 aa, Entamoeba invadens
EQLHNLHSLFYTKLSKRIAEVGENN

SEQ ID NO: 2994662 - protein, 33 aa, Entamoeba invadens
EQLKKEIEIIKKDNYSWSIYLNENKKVIEKQKE

SEQ ID NO: 2994663 - protein, 21 aa, Entamoeba invadens
EQLKNVRELMKNKLKKVLYDH

SEQ ID NO: 2994664 - protein, 20 aa, Entamoeba invadens
EQLLIHISFTQTVNLRTLLF

SEQ ID NO: 2994665 - protein, 25 aa, Entamoeba invadens
EQLMKYIVVAFFKPTYVTVEAVVKY

SEQ ID NO: 2994666 - protein, 17 aa, Entamoeba invadens
EQLMNFIHKLAEMYKKA

SEQ ID NO: 2994667 - protein, 20 aa, Entamoeba invadens
EQLNEIRYTISSLTFENKEF

SEQ ID NO: 2994668 - protein, 17 aa, Entamoeba invadens
EQLNLIRVYTKVPGEFP

SEQ ID NO: 2994669 - protein, 18 aa, Entamoeba invadens
EQLNMIYRNVLYEVQFSF

SEQ ID NO: 2994670 - protein, 31 aa, Entamoeba invadens
EQLPIPLGHVRLFTYQLCRGLCYLHSMNICH

SEQ ID NO: 2994671 - protein, 18 aa, Entamoeba invadens
EQLRVVLSALRVEQNFWK

SEQ ID NO: 2994672 - protein, 19 aa, Entamoeba invadens
EQLSHIVWHVFCRVKNLRS

SEQ ID NO: 2994673 - protein, 34 aa, Entamoeba invadens
EQLVDWSITPFVKKVVLFLIEKCKGYGVTQEMVI

SEQ ID NO: 2994674 - protein, 21 aa, Entamoeba invadens
EQMYNFLKCIYISPNTKIAVM

SEQ ID NO: 2994675 - protein, 25 aa, Entamoeba invadens
EQNALKKLVLLYETEIKKLAIIELK

SEQ ID NO: 2994676 - protein, 25 aa, Entamoeba invadens
EQNFKFDSFVADIVLLAVGSNDFWD

SEQ ID NO: 2994677 - protein, 17 aa, Entamoeba invadens
EQNFNFGLENGERKKLE

SEQ ID NO: 2994678 - protein, 27 aa, Entamoeba invadens
EQNKFIFDGILGDSFVEICEHKHGCCV

SEQ ID NO: 2994679 - protein, 21 aa, Entamoeba invadens
EQNTFLASKPYLYVTNKKIVA

SEQ ID NO: 2994680 - protein, 20 aa, Entamoeba invadens
EQNVFLKCFMLTNVNVVEND

SEQ ID NO: 2994681 - protein, 29 aa, Entamoeba invadens
EQNVSPIPHLLLSPLSLILPVVNKQFNTE

SEQ ID NO: 2994682 - protein, 18 aa, Entamoeba invadens
EQPLFFKKKEDDVVQLVE

SEQ ID NO: 2994683 - protein, 23 aa, Entamoeba invadens
EQPLLPFMGTISRDLVLASEYNA

SEQ ID NO: 2994684 - protein, 23 aa, Entamoeba invadens
EQPLLPVGLYDTVGQETVKCFCP

SEQ ID NO: 2994685 - protein, 26 aa, Entamoeba invadens
EQQHFLIDILRELGYFCSGYICQGKL

SEQ ID NO: 2994686 - protein, 28 aa, Entamoeba invadens
EQQKHIGMNLFFGCVNLKEVVLSDVVES

SEQ ID NO: 2994687 - protein, 17 aa, Entamoeba invadens
EQQLYHLPIQIISICQT

SEQ ID NO: 2994688 - protein, 21 aa, Entamoeba invadens
EQQPKRHFSPNTLLELASEDN

SEQ ID NO: 2994689 - protein, 25 aa, Entamoeba invadens
EQQYYGAFYFVTVLQTIGVEKWSLL

SEQ ID NO: 2994690 - protein, 24 aa, Entamoeba invadens
EQRGLVCYLVWLFNEESKKFGGKP

SEQ ID NO: 2994691 - protein, 20 aa, Entamoeba invadens
EQRLLGVINLFTGFIYDDST

SEQ ID NO: 2994692 - protein, 31 aa, Entamoeba invadens
EQRNALYASIFLFILKAFPKIETLQCVDYML

SEQ ID NO: 2994693 - protein, 21 aa, Entamoeba invadens
EQRNEIVIATGRPLKTALWFT

SEQ ID NO: 2994694 - protein, 22 aa, Entamoeba invadens
EQRNIVGNITKLGAGAFVEEFV

SEQ ID NO: 2994695 - protein, 26 aa, Entamoeba invadens
EQRSKRGILFLSEAMRWIVDETCFKS

SEQ ID NO: 2994696 - protein, 34 aa, Entamoeba invadens
EQSITTLLGTKYPLKRIKLFADKHHCFITFYTRT

SEQ ID NO: 2994697 - protein, 17 aa, Entamoeba invadens
EQSKLYEKYIQATNLFS

SEQ ID NO: 2994698 - protein, 22 aa, Entamoeba invadens
EQTILLIPKVNYVLPNGYTIIL

SEQ ID NO: 2994699 - protein, 22 aa, Entamoeba invadens
EQTLDLFRKAAAVQIVMLGGEF

SEQ ID NO: 2994700 - protein, 25 aa, Entamoeba invadens
EQTLVLFNDMILFLSKDYATTLVNT

SEQ ID NO: 2994701 - protein, 25 aa, Entamoeba invadens
EQTVYVNSLIALYSHLTGNVLEVDS

SEQ ID NO: 2994702 - protein, 25 aa, Entamoeba invadens
EQVGTPLVFTLFSAPNYSKGNLGAG

SEQ ID NO: 2994703 - protein, 28 aa, Entamoeba invadens
EQVHYSIVLPTLRALYKFLQHVDAEEFI

SEQ ID NO: 2994704 - protein, 24 aa, Entamoeba invadens
EQVKKWPVNPLDLIIKKIQENADI

SEQ ID NO: 2994705 - protein, 25 aa, Entamoeba invadens
EQVRNWKFAMTIPDFEKKSTIEELA

SEQ ID NO: 2994706 - protein, 36 aa, Entamoeba invadens
EQVRSFLQEFSIGEITVLENVPLITITTPSYADSKK

SEQ ID NO: 2994707 - protein, 32 aa, Entamoeba invadens
EQWHNALQYLKLDPPFKFLNPAFEGIFLSINE

SEQ ID NO: 2994708 - protein, 26 aa, Entamoeba invadens
EQWTETLLMSKPILIDLESLPTKSHV

SEQ ID NO: 2994709 - protein, 23 aa, Entamoeba invadens
EQYIKYIGVIDFRMTDYVLVGGI

SEQ ID NO: 2994710 - protein, 27 aa, Entamoeba invadens
EQYKITIPTLTFSGPTTFVPLIEHATQ

SEQ ID NO: 2994711 - protein, 27 aa, Entamoeba invadens
EQYNEVFHIFSKYLNDLLSRVVYIEKV

SEQ ID NO: 2994712 - protein, 18 aa, Entamoeba invadens
ERAKDVIVLYGRVGWKVM

SEQ ID NO: 2994713 - protein, 23 aa, Entamoeba invadens
ERALKIHLWVVDWDENGFVNNMN

SEQ ID NO: 2994714 - protein, 28 aa, Entamoeba invadens
ERARFIPLRITQAERKLLRLLEATLHVS

SEQ ID NO: 2994715 - protein, 23 aa, Entamoeba invadens
ERARQLRAEKLAKITGRSDSLGK

SEQ ID NO: 2994716 - protein, 28 aa, Entamoeba invadens
ERATYLLPMVYNLWYKYVKLEETVGNYG

SEQ ID NO: 2994717 - protein, 27 aa, Entamoeba invadens
ERCRALAWLVFMKILPKQISTRWGVLL

SEQ ID NO: 2994718 - protein, 27 aa, Entamoeba invadens
ERCSSLSKIILFDGLANIPHCAFFRCY

SEQ ID NO: 2994719 - protein, 34 aa, Entamoeba invadens
ERCTNFLDVRYPLPEIFNLPKGWGMGCDRGELYF

SEQ ID NO: 2994720 - protein, 26 aa, Entamoeba invadens
ERDETTWRVFQLRKDFFPSAKLQMED

SEQ ID NO: 2994721 - protein, 18 aa, Entamoeba invadens
ERDFAIRLINVPPTVDEV

SEQ ID NO: 2994722 - protein, 19 aa, Entamoeba invadens
ERDPECLLLTFDIIKTVSA

SEQ ID NO: 2994723 - protein, 24 aa, Entamoeba invadens
ERDYLTLYNTFREKDIVWFLECTK

SEQ ID NO: 2994724 - protein, 27 aa, Entamoeba invadens
ERECCLKMSVIYLIIKNSTFGNDLLMK

SEQ ID NO: 2994725 - protein, 23 aa, Entamoeba invadens
EREDLYGQFGFQSASSKPRKFKY

SEQ ID NO: 2994726 - protein, 22 aa, Entamoeba invadens
EREIFTLIETLLGWVNGTKMDI

SEQ ID NO: 2994727 - protein, 26 aa, Entamoeba invadens
EREPTAAFFAYKQLKYSKEDLSHGTM

SEQ ID NO: 2994728 - protein, 30 aa, Entamoeba invadens
ERERNDFVVYWMRDIYKFKSIGVRLVEEEY

SEQ ID NO: 2994729 - protein, 26 aa, Entamoeba invadens
ERFLLTTELSMPCGMKRVKVVKSDKN

SEQ ID NO: 2994730 - protein, 19 aa, Entamoeba invadens
ERFRTISASYYRGSHGIII

SEQ ID NO: 2994731 - protein, 19 aa, Entamoeba invadens
ERFRTITSSYYRGAQGIIV

SEQ ID NO: 2994732 - protein, 19 aa, Entamoeba invadens
ERFYKKELLQQIINPFDIH

SEQ ID NO: 2994733 - protein, 25 aa, Entamoeba invadens
ERGITSLFPIQISTYAPIYEGLDVV

SEQ ID NO: 2994734 - protein, 26 aa, Entamoeba invadens
ERGPLDYYWMVINLRKNIDIWTLLKE

SEQ ID NO: 2994735 - protein, 24 aa, Entamoeba invadens
ERGSFITMMAVLMMGACGLTNNQI

SEQ ID NO: 2994736 - protein, 23 aa, Entamoeba invadens
ERGVTLFWKYFDTTSRLVLVDLS

SEQ ID NO: 2994737 - protein, 17 aa, Entamoeba invadens
ERGYYFNSNQCNTCVDH

SEQ ID NO: 2994738 - protein, 37 aa, Entamoeba invadens
ERICGKKNILFLIITNEGYSFGAFISGLIPSPKPHPE

SEQ ID NO: 2994739 - protein, 31 aa, Entamoeba invadens
ERIEQFYKVQWEYNFPLRLLNKDTKEEELAW

SEQ ID NO: 2994740 - protein, 19 aa, Entamoeba invadens
ERIFLFHNESFDDPDPWEV

SEQ ID NO: 2994741 - protein, 22 aa, Entamoeba invadens
ERIKGLRLFNRNIQVFSNNYLM

SEQ ID NO: 2994742 - protein, 18 aa, Entamoeba invadens
ERIKKRAEADLEERKKEF

SEQ ID NO: 2994743 - protein, 18 aa, Entamoeba invadens
ERIKVWEKLGAELPYVRD

SEQ ID NO: 2994744 - protein, 25 aa, Entamoeba invadens
ERIPETLHFLIDILTELGTNVFLKM

SEQ ID NO: 2994745 - protein, 22 aa, Entamoeba invadens
ERIRQLYYYLISKLDSFVNSEY

SEQ ID NO: 2994746 - protein, 18 aa, Entamoeba invadens
ERISKYRDVFISGTEFPY

SEQ ID NO: 2994747 - protein, 28 aa, Entamoeba invadens
ERKALLNTLKLCGQFVLLISSGDFLFGA

SEQ ID NO: 2994748 - protein, 25 aa, Entamoeba invadens
ERKGWDNWQFLLAGFVSLKGVFEME

SEQ ID NO: 2994749 - protein, 18 aa, Entamoeba invadens
ERKKYFESFFVIVSDPTS

SEQ ID NO: 2994750 - protein, 22 aa, Entamoeba invadens
ERKLDIFQIFSTHITQIVKTQN

SEQ ID NO: 2994751 - protein, 42 aa, Entamoeba invadens
ERKRDAFRLGSETWEWLFWMGFRDIFIWKKGSEYENFCEQQS

SEQ ID NO: 2994752 - protein, 25 aa, Entamoeba invadens
ERKVWPYWQHLMSGIGSLKDVFEND

SEQ ID NO: 2994753 - protein, 25 aa, Entamoeba invadens
ERKYTSLYVRFYKELQLLTMTTRES

SEQ ID NO: 2994754 - protein, 19 aa, Entamoeba invadens
ERLDAIFYNGNFVMGATKI

SEQ ID NO: 2994755 - protein, 24 aa, Entamoeba invadens
ERLESWYFVLTLNEKIEDFPDQLK

SEQ ID NO: 2994756 - protein, 17 aa, Entamoeba invadens
ERLKVLGIVIQICQVML

SEQ ID NO: 2994757 - protein, 32 aa, Entamoeba invadens
ERLPFSRVMWCSLVFYPIDWREDKLFECLSAR

SEQ ID NO: 2994758 - protein, 22 aa, Entamoeba invadens
ERLRRIEKIRWDIGTTIPLSVS

SEQ ID NO: 2994759 - protein, 28 aa, Entamoeba invadens
ERLVCFYNYIFYVLLHPEIQTEVVTFSR

SEQ ID NO: 2994760 - protein, 22 aa, Entamoeba invadens
ERMATLSEKAFLPLDTFVLCYS

SEQ ID NO: 2994761 - protein, 23 aa, Entamoeba invadens
ERMKFIVTQLLEQRRKGFPDFPA

SEQ ID NO: 2994762 - protein, 23 aa, Entamoeba invadens
ERNELLMRVGYKEHVAIGKIGEL

SEQ ID NO: 2994763 - protein, 20 aa, Entamoeba invadens
ERNLPPIPPQTKPPMHPKPN

SEQ ID NO: 2994764 - protein, 25 aa, Entamoeba invadens
ERNQAILKILKEKKLILSTLVPLYE

SEQ ID NO: 2994765 - protein, 20 aa, Entamoeba invadens
ERNQILPSDSLFYGLTSGST

SEQ ID NO: 2994766 - protein, 20 aa, Entamoeba invadens
ERNRNLLLEVAFGPSKQNDK

SEQ ID NO: 2994767 - protein, 25 aa, Entamoeba invadens
ERPAYHTLMKLKLPQYPIKTTATKR

SEQ ID NO: 2994768 - protein, 25 aa, Entamoeba invadens
ERPLSHVFCLWNSNSMYRTLLLNEL

SEQ ID NO: 2994769 - protein, 29 aa, Entamoeba invadens
ERQFNSLKRFWFVQNRPMMFVATAGKESF

SEQ ID NO: 2994770 - protein, 19 aa, Entamoeba invadens
ERQHEVKIGRITEKCDKVK

SEQ ID NO: 2994771 - protein, 28 aa, Entamoeba invadens
ERQNVAMMLTLPFITQNRFLAILNTLEN

SEQ ID NO: 2994772 - protein, 45 aa, Entamoeba invadens
ERREMCMQFIKLLDAPQKVILGEYLYLMTFIAANQRINRMGSLNL

SEQ ID NO: 2994773 - protein, 20 aa, Entamoeba invadens
ERRKKFMEDRKAEIAAKKEM

SEQ ID NO: 2994774 - protein, 17 aa, Entamoeba invadens
ERRKTFVKTILPYLLHE

SEQ ID NO: 2994775 - protein, 23 aa, Entamoeba invadens
ERRRQCLFAVLSLATELLRKKNF

SEQ ID NO: 2994776 - protein, 29 aa, Entamoeba invadens
ERSDVYSLGVLILYLLSVATTHNTTEKLS

SEQ ID NO: 2994777 - protein, 26 aa, Entamoeba invadens
ERSIKMNAIFLEKNMSVLPPSFVFEV

SEQ ID NO: 2994778 - protein, 23 aa, Entamoeba invadens
ERSLVHLVPLTYVPYCLKAIQKD

SEQ ID NO: 2994779 - protein, 18 aa, Entamoeba invadens
ERSPLIELQLLETPFVEI

SEQ ID NO: 2994780 - protein, 17 aa, Entamoeba invadens
ERTCAISALIINPSNLL

SEQ ID NO: 2994781 - protein, 27 aa, Entamoeba invadens
ERTKNAQFSIISLRPEMFELADRLIGI

SEQ ID NO: 2994782 - protein, 21 aa, Entamoeba invadens
ERTLGIMLDVPFKVLMERKHI

SEQ ID NO: 2994783 - protein, 29 aa, Entamoeba invadens
ERTRSNQILLLHLFNFTLKNREIIAKDTK

SEQ ID NO: 2994784 - protein, 27 aa, Entamoeba invadens
ERVALLRIKETQQCSGFGFVTFENKED

SEQ ID NO: 2994785 - protein, 25 aa, Entamoeba invadens
ERVDTDLLAFYLVKGYSSYFQNRRY

SEQ ID NO: 2994786 - protein, 22 aa, Entamoeba invadens
ERVLGSYLRALELRFCNWTTVK

SEQ ID NO: 2994787 - protein, 30 aa, Entamoeba invadens
ERVLNYDFERNWTLSFFGNLLAIGADQGTL

SEQ ID NO: 2994788 - protein, 28 aa, Entamoeba invadens
ERVLSVSKYLIYIPEKDARMAVLLANCR

SEQ ID NO: 2994789 - protein, 18 aa, Entamoeba invadens
ERVMEILKSVYIVPIDIN

SEQ ID NO: 2994790 - protein, 27 aa, Entamoeba invadens
ERVNQIIRIEFLNLYLGFSRFSGKETS

SEQ ID NO: 2994791 - protein, 19 aa, Entamoeba invadens
ERVSLLRTIFNRIVLENAN

SEQ ID NO: 2994792 - protein, 17 aa, Entamoeba invadens
ERVVNLLPKARKEIPEI

SEQ ID NO: 2994793 - protein, 24 aa, Entamoeba invadens
ERWDGIFLAIYLTRRKELMRVSVV

SEQ ID NO: 2994794 - protein, 23 aa, Entamoeba invadens
ERWRAVFEKAFYEDIKVLRESED

SEQ ID NO: 2994795 - protein, 23 aa, Entamoeba invadens
ERYCGSLLFVVHFGKIVMSSSLN

SEQ ID NO: 2994796 - protein, 21 aa, Entamoeba invadens
ERYFNYLFDCGPKSPWTPEED

SEQ ID NO: 2994797 - protein, 25 aa, Entamoeba invadens
ERYHSLIPSYIRDSSVAVIVYDIND

SEQ ID NO: 2994798 - protein, 20 aa, Entamoeba invadens
ERYIDCSTLAPVAKAPVKCE

SEQ ID NO: 2994799 - protein, 18 aa, Entamoeba invadens
ERYKAVVPTITLSGPTSF

SEQ ID NO: 2994800 - protein, 24 aa, Entamoeba invadens
ERYLKIFQELPQIVKGFIRDLVEF

SEQ ID NO: 2994801 - protein, 42 aa, Entamoeba invadens
ERYLLESRMAYLDIFPKCRGYQLPSLFNYQPTMDRAYETTKT

SEQ ID NO: 2994802 - protein, 24 aa, Entamoeba invadens
ERYLRKNSLLVKSFYDVAENIRCF

SEQ ID NO: 2994803 - protein, 17 aa, Entamoeba invadens
ERYMFERASMKLGLDQA

SEQ ID NO: 2994804 - protein, 24 aa, Entamoeba invadens
ERYRSLIPSYIRDSAAAVVVYDVN

SEQ ID NO: 2994805 - protein, 30 aa, Entamoeba invadens
ERYRSLSAIYYRNATVALLVFDITRQETFN

SEQ ID NO: 2994806 - protein, 31 aa, Entamoeba invadens
ERYRSLSSIYYRNATVALLVYDITRAETFSA

SEQ ID NO: 2994807 - protein, 27 aa, Entamoeba invadens
ERYSVPLNMALLFHKKYNIFSGKYVVP

SEQ ID NO: 2994808 - protein, 27 aa, Entamoeba invadens
ESAAFVIKIFQVLRIYPLCQGVVDGLK

SEQ ID NO: 2994809 - protein, 22 aa, Entamoeba invadens
ESADIYIIQLIANSNFVDLDGL

SEQ ID NO: 2994810 - protein, 18 aa, Entamoeba invadens
ESADVKEVLKEVLNMEEI

SEQ ID NO: 2994811 - protein, 18 aa, Entamoeba invadens
ESAFRVMFPLDEFVQTML

SEQ ID NO: 2994812 - protein, 24 aa, Entamoeba invadens
ESAILLTDLYSIYNRARGDVVSPR

SEQ ID NO: 2994813 - protein, 25 aa, Entamoeba invadens
ESAKQLAIMQKLIEEKEKEMRVIES

SEQ ID NO: 2994814 - protein, 20 aa, Entamoeba invadens
ESALMTLQKEHDKMYSISKD

SEQ ID NO: 2994815 - protein, 18 aa, Entamoeba invadens
ESALRVLVQRVYTLYTNV

SEQ ID NO: 2994816 - protein, 25 aa, Entamoeba invadens
ESAPPLPKKSAPPHPSKRAAPPLPK

SEQ ID NO: 2994817 - protein, 18 aa, Entamoeba invadens
ESAQWFVSHFRPDTFRFN

SEQ ID NO: 2994818 - protein, 25 aa, Entamoeba invadens
ESAVLTEDLFFSISFHNLRSFDKVS

SEQ ID NO: 2994819 - protein, 21 aa, Entamoeba invadens
ESAVWRNIYLTGALELEEDKS

SEQ ID NO: 2994820 - protein, 26 aa, Entamoeba invadens
ESAVYLQSLFIKKLTFDEKEGQNEEV

SEQ ID NO: 2994821 - protein, 31 aa, Entamoeba invadens
ESCKEICDFAFYRCLSLIKIGIPKSVTKIGV

SEQ ID NO: 2994822 - protein, 30 aa, Entamoeba invadens
ESCLNLTMCLSCVDGYFLSDYTCKSNDALN

SEQ ID NO: 2994823 - protein, 24 aa, Entamoeba invadens
ESCLSLKEIVLPKSLQYTGNRAFE

SEQ ID NO: 2994824 - protein, 25 aa, Entamoeba invadens
ESCLSLKEIVLPKSLQYTGNRAFEK

SEQ ID NO: 2994825 - protein, 18 aa, Entamoeba invadens
ESDDIAFEVPSKQPKHTE

SEQ ID NO: 2994826 - protein, 27 aa, Entamoeba invadens
ESDETTWRVFQLRKDFFPAAKLQMEDD

SEQ ID NO: 2994827 - protein, 21 aa, Entamoeba invadens
ESDGFVLIYSIDNYFTFCGLK

SEQ ID NO: 2994828 - protein, 25 aa, Entamoeba invadens
ESDKVLAVALKLYNLILDKQFDGIE

SEQ ID NO: 2994829 - protein, 26 aa, Entamoeba invadens
ESDLPRTCDFLSSEILKYLQDNCNIA

SEQ ID NO: 2994830 - protein, 29 aa, Entamoeba invadens
ESDRFALIRVILDKFIFNLVNQKYYTLSN

SEQ ID NO: 2994831 - protein, 26 aa, Entamoeba invadens
ESDSYALTCLTLSTLYQALLCVSFED

SEQ ID NO: 2994832 - protein, 24 aa, Entamoeba invadens
ESDYFFDGILCVPQTLPNETIKQT

SEQ ID NO: 2994833 - protein, 26 aa, Entamoeba invadens
ESEDDMPIMLLYTRMNEKMKKGIQQT

SEQ ID NO: 2994834 - protein, 26 aa, Entamoeba invadens
ESEDRIPIMFTVFSSAGYNGNNKAGA

SEQ ID NO: 2994835 - protein, 27 aa, Entamoeba invadens
ESEIYKYLDFLAVDGVFMYLNNKIIRV

SEQ ID NO: 2994836 - protein, 25 aa, Entamoeba invadens
ESEKYKFAYILIEGYNGSIPKDDKI

SEQ ID NO: 2994837 - protein, 28 aa, Entamoeba invadens
ESENNRVFFFRRAFVFFSSEGKGISVQY

SEQ ID NO: 2994838 - protein, 17 aa, Entamoeba invadens
ESESSLFVPKIDRVLLD

SEQ ID NO: 2994839 - protein, 30 aa, Entamoeba invadens
ESEYIQHRLIQYVLVLYLNITDIDAQIAFV

SEQ ID NO: 2994840 - protein, 22 aa, Entamoeba invadens
ESFAKLITFRKGDQVFKGHYAS

SEQ ID NO: 2994841 - protein, 17 aa, Entamoeba invadens
ESFFFQIKDVYIDELVF

SEQ ID NO: 2994842 - protein, 25 aa, Entamoeba invadens
ESFKKDFGGLLWRPQPKNLIKDDLE

SEQ ID NO: 2994843 - protein, 23 aa, Entamoeba invadens
ESFMKYLGLLKNHIEEFLKDLSD

SEQ ID NO: 2994844 - protein, 26 aa, Entamoeba invadens
ESFQGALNVFKYFSRLNDASVMCLVG

SEQ ID NO: 2994845 - protein, 19 aa, Entamoeba invadens
ESFVLPPTSTYLVKMAEES

SEQ ID NO: 2994846 - protein, 31 aa, Entamoeba invadens
ESFWRNTRSKLNAYFLQPMIGEVKEELSRQI

SEQ ID NO: 2994847 - protein, 18 aa, Entamoeba invadens
ESGDMELFPEDIKMIAKA

SEQ ID NO: 2994848 - protein, 25 aa, Entamoeba invadens
ESGEGWFFNVWQPSDILSGKKNIYE

SEQ ID NO: 2994849 - protein, 25 aa, Entamoeba invadens
ESGKKFVIVIPPPNVTGKLHIGHAL

SEQ ID NO: 2994850 - protein, 28 aa, Entamoeba invadens
ESGLGLPYPHWLLTFGRDYFASNLTQRA

SEQ ID NO: 2994851 - protein, 18 aa, Entamoeba invadens
ESGLVAVGGIFFLRLINP

SEQ ID NO: 2994852 - protein, 24 aa, Entamoeba invadens
ESGRLVLNPIDYPDLPFFNPSTTV

SEQ ID NO: 2994853 - protein, 24 aa, Entamoeba invadens
ESGTGLSYVYPLGDGVFSENKFKE

SEQ ID NO: 2994854 - protein, 26 aa, Entamoeba invadens
ESGVLSVVFFYCTQIQFINVIGITQN

SEQ ID NO: 2994855 - protein, 32 aa, Entamoeba invadens
ESGVTSFKIFMVYDFFVNDGQFYTILKKTKEC

SEQ ID NO: 2994856 - protein, 21 aa, Entamoeba invadens
ESHDFYPQTPLSQSVQSQRLV

SEQ ID NO: 2994857 - protein, 23 aa, Entamoeba invadens
ESHDIVFWMGDLNYRLDEEDSVI

SEQ ID NO: 2994858 - protein, 34 aa, Entamoeba invadens
ESHLPPKTVHWFKNFDSYEYSFFISLKEENKSLA

SEQ ID NO: 2994859 - protein, 21 aa, Entamoeba invadens
ESHSVSRLIGAPPGYVGHDEG

SEQ ID NO: 2994860 - protein, 26 aa, Entamoeba invadens
ESIGYKFELIKLISFVVVVDAREGGP

SEQ ID NO: 2994861 - protein, 25 aa, Entamoeba invadens
ESIITVFQFLPLQSVVAMMRTSKRM

SEQ ID NO: 2994862 - protein, 30 aa, Entamoeba invadens
ESIKLKEQIPPNNFLKLLQVQVIQQYKESL

SEQ ID NO: 2994863 - protein, 37 aa, Entamoeba invadens
ESINRFEKKYFRLGYYQLCGVVLYVFFHERMENHIEE

SEQ ID NO: 2994864 - protein, 25 aa, Entamoeba invadens
ESIQQGVLLALLNTFCDFSLELPTK

SEQ ID NO: 2994865 - protein, 30 aa, Entamoeba invadens
ESIRYNFAINYAFGFWDNQLFKDESGYLYF

SEQ ID NO: 2994866 - protein, 25 aa, Entamoeba invadens
ESISFLNIYCKVEITTLNIPNRLKE

SEQ ID NO: 2994867 - protein, 19 aa, Entamoeba invadens
ESISIIMSDTLEAKKAAIR

SEQ ID NO: 2994868 - protein, 25 aa, Entamoeba invadens
ESKDYLAIALLIAVNYLRDEEVRKS

SEQ ID NO: 2994869 - protein, 25 aa, Entamoeba invadens
ESKELYEFFMPFAKAMLEKVVTLHM

SEQ ID NO: 2994870 - protein, 48 aa, Entamoeba invadens
ESKEQQKFFEWMKYAFHATNFFELYLECRPQNVFIVCKTIEEGIDVEE

SEQ ID NO: 2994871 - protein, 32 aa, Entamoeba invadens
ESKILKIEKYNIPFLFPVPYREDRNYSVTFFT

SEQ ID NO: 2994872 - protein, 24 aa, Entamoeba invadens
ESKKDRLTLLRKKSIFVENETQEH

SEQ ID NO: 2994873 - protein, 21 aa, Entamoeba invadens
ESKLKYMNRLVKLAGPEHLIP

SEQ ID NO: 2994874 - protein, 19 aa, Entamoeba invadens
ESKLLEESPRRKVLHGPKK

SEQ ID NO: 2994875 - protein, 28 aa, Entamoeba invadens
ESKMFSPKFLKAFFIYCQAKDVISAKKI

SEQ ID NO: 2994876 - protein, 24 aa, Entamoeba invadens
ESKNDFKFVIGDLPVICDGFEKGV

SEQ ID NO: 2994877 - protein, 22 aa, Entamoeba invadens
ESKPLFTHIQTQIVYTPYDIIV

SEQ ID NO: 2994878 - protein, 23 aa, Entamoeba invadens
ESKQNGCIAKYGKKFLIGYQEGK

SEQ ID NO: 2994879 - protein, 24 aa, Entamoeba invadens
ESKRFQLVIEDRVGEITKFQNEVI

SEQ ID NO: 2994880 - protein, 25 aa, Entamoeba invadens
ESKRVKFVFVSWAGEGIKKPKLRAA

SEQ ID NO: 2994881 - protein, 25 aa, Entamoeba invadens
ESKRWEIVHLLMDIGHRFGWDVETT

SEQ ID NO: 2994882 - protein, 34 aa, Entamoeba invadens
ESKSVCKPKLKLVFLTPERIQLDSFLEALDSYYN

SEQ ID NO: 2994883 - protein, 21 aa, Entamoeba invadens
ESKVLIEWIGNEVPSRLEILV

SEQ ID NO: 2994884 - protein, 17 aa, Entamoeba invadens
ESKYKLDGYLRDVCLQS

SEQ ID NO: 2994885 - protein, 18 aa, Entamoeba invadens
ESLADFVTLGKVCPYYRH

SEQ ID NO: 2994886 - protein, 19 aa, Entamoeba invadens
ESLADFVTLGKVCPYYRHV

SEQ ID NO: 2994887 - protein, 24 aa, Entamoeba invadens
ESLAVMFTSFKYLRFLNTDSCVAF

SEQ ID NO: 2994888 - protein, 22 aa, Entamoeba invadens
ESLDLKVFYPQKTLIKKGTTEM

SEQ ID NO: 2994889 - protein, 27 aa, Entamoeba invadens
ESLDYIVKLLNLKYLFCGTPAKTGVEI

SEQ ID NO: 2994890 - protein, 24 aa, Entamoeba invadens
ESLEAELLTLRQVVSSSDTKAIEL

SEQ ID NO: 2994891 - protein, 17 aa, Entamoeba invadens
ESLELPTTIPILEEQPD

SEQ ID NO: 2994892 - protein, 38 aa, Entamoeba invadens
ESLENLNLNYLEFSKTLRLLKNLFIPFDRVSKKIKNNL

SEQ ID NO: 2994893 - protein, 23 aa, Entamoeba invadens
ESLHLLMDILEEFGFYFSNTLSS

SEQ ID NO: 2994894 - protein, 38 aa, Entamoeba invadens
ESLIEHLKMILKLDTKLKFVEFLNEALVGNSVLMTVTQ

SEQ ID NO: 2994895 - protein, 22 aa, Entamoeba invadens
ESLIKFIEEPLPLESRLIEQEN

SEQ ID NO: 2994896 - protein, 26 aa, Entamoeba invadens
ESLKGGLAPLMTLFSPIKQCEFLTPT

SEQ ID NO: 2994897 - protein, 17 aa, Entamoeba invadens
ESLLTKIQECHAPRLVY

SEQ ID NO: 2994898 - protein, 23 aa, Entamoeba invadens
ESLNVVFGIHRLSPDKKVPVETD

SEQ ID NO: 2994899 - protein, 32 aa, Entamoeba invadens
ESLRKLRLDYLDLYLIHWPVSLRVGATWPLKR

SEQ ID NO: 2994900 - protein, 24 aa, Entamoeba invadens
ESLRQILLYCGQVKSLSKVEKPSQ

SEQ ID NO: 2994901 - protein, 21 aa, Entamoeba invadens
ESLVPPAYIKPKAIKREKEVH

SEQ ID NO: 2994902 - protein, 25 aa, Entamoeba invadens
ESMDDIFVRMYLISKLIQSNFIVEI

SEQ ID NO: 2994903 - protein, 26 aa, Entamoeba invadens
ESMINTFYAILLRFNVPIQKFHYEIP

SEQ ID NO: 2994904 - protein, 33 aa, Entamoeba invadens; identical to SEQ ID NO: 2934705

SEQ ID NO: 2994905 - protein, 24 aa, Entamoeba invadens
ESNFIMYGNTCQISILLKFNKQDK

SEQ ID NO: 2994906 - protein, 25 aa, Entamoeba invadens
ESNFTRGCTKCKSGMYPQQNGRCGD

SEQ ID NO: 2994907 - protein, 20 aa, Entamoeba invadens
ESNRLYDYPFTISLKENGNT

SEQ ID NO: 2994908 - protein, 24 aa, Entamoeba invadens
ESNSSMITLKFIEPVQSGTTGDVQ

SEQ ID NO: 2994909 - protein, 34 aa, Entamoeba invadens
ESNVNDRILLKLPIAYLFDVFAVSLDPTPVEGID

SEQ ID NO: 2994910 - protein, 24 aa, Entamoeba invadens
ESNYYPKQGLCVPCDYGCTTCSSA

SEQ ID NO: 2994911 - protein, 24 aa, Entamoeba invadens
ESPAFLEIFKLYLPALHVSDCQQN

SEQ ID NO: 2994912 - protein, 22 aa, Entamoeba invadens
ESPDFKLMAMLKCLIDELQQPE

SEQ ID NO: 2994913 - protein, 26 aa, Entamoeba invadens
ESPFKSIVPPQLRNALNKYKSESSKI

SEQ ID NO: 2994914 - protein, 23 aa, Entamoeba invadens
ESPLLVVKYVKLESVQTALLFDK

SEQ ID NO: 2994915 - protein, 30 aa, Entamoeba invadens
ESPNGFKFEMFIFDAFRLAKKMGALEVRRE

SEQ ID NO: 2994916 - protein, 18 aa, Entamoeba invadens
ESQARNRYLIYSRAAKKE

SEQ ID NO: 2994917 - protein, 23 aa, Entamoeba invadens
ESQERLRFIKVIQSLAPTTKHGV

SEQ ID NO: 2994918 - protein, 20 aa, Entamoeba invadens
ESQILFMDYSAMSNLENLDV

SEQ ID NO: 2994919 - protein, 29 aa, Entamoeba invadens
ESQILSVYYPRIVPILQILLRSVEDKIVS

SEQ ID NO: 2994920 - protein, 21 aa, Entamoeba invadens
ESQPNYMNFDFYKVEPKKKES

SEQ ID NO: 2994921 - protein, 25 aa, Entamoeba invadens
ESQTLYLSPLDFLFGIKATARSVNK

SEQ ID NO: 2994922 - protein, 24 aa, Entamoeba invadens
ESQTLYLSPLDFLFGVKATARSVN

SEQ ID NO: 2994923 - protein, 17 aa, Entamoeba invadens
ESRADFIHITFVSKKFQ

SEQ ID NO: 2994924 - protein, 18 aa, Entamoeba invadens
ESRSVIVTVLSRATKSPS

SEQ ID NO: 2994925 - protein, 25 aa, Entamoeba invadens
ESRTVFLSAIALSYKVTHSQSYNIS

SEQ ID NO: 2994926 - protein, 22 aa, Entamoeba invadens
ESRVLVWKLVLGYYTPQMTYTQ

SEQ ID NO: 2994927 - protein, 24 aa, Entamoeba invadens
ESSCLFDRLLAIQQELLKNDKTAP

SEQ ID NO: 2994928 - protein, 27 aa, Entamoeba invadens
ESSELFIEAFQKLITTHKFKIVVFTGS

SEQ ID NO: 2994929 - protein, 17 aa, Entamoeba invadens
ESSFKLFKFGDGDVEVG

SEQ ID NO: 2994930 - protein, 21 aa, Entamoeba invadens
ESSHPFIQNLLQNILTYSSGM

SEQ ID NO: 2994931 - protein, 29 aa, Entamoeba invadens
ESSKSFLFKIENEKVIFFDIKAGYEKYDF

SEQ ID NO: 2994932 - protein, 33 aa, Entamoeba invadens
ESSKSFLFKIENEKVIFFDIKKGYEKYDFKMNN

SEQ ID NO: 2994933 - protein, 43 aa, Entamoeba invadens
ESSMSLSLDMTTAKETNPLFVKHATLPLNIGKSIKSEGIIRIN

SEQ ID NO: 2994934 - protein, 24 aa, Entamoeba invadens
ESSNEEMICLIQQKYSISDDVISV

SEQ ID NO: 2994935 - protein, 22 aa, Entamoeba invadens
ESSNLIISIDFTGSNQSSGKRT

SEQ ID NO: 2994936 - protein, 26 aa, Entamoeba invadens
ESSQIPLVFAKKCKLLYLGVKNVLCG

SEQ ID NO: 2994937 - protein, 22 aa, Entamoeba invadens
ESSSHFLFTYKNTLKGLSQDEM

SEQ ID NO: 2994938 - protein, 17 aa, Entamoeba invadens
ESSSHLAYYGESSMYAT

SEQ ID NO: 2994939 - protein, 26 aa, Entamoeba invadens
ESSTPLQFFPKRCLVNLLYASQHSSL

SEQ ID NO: 2994940 - protein, 25 aa, Entamoeba invadens
ESSVIWFYKHFTPETIDFGYYEFTS

SEQ ID NO: 2994941 - protein, 24 aa, Entamoeba invadens
ESTATQPFAGFFKGFDSLTDGKEG

SEQ ID NO: 2994942 - protein, 27 aa, Entamoeba invadens
ESTEDNLWFPIYVSGWKPKSVSYDLRR

SEQ ID NO: 2994943 - protein, 24 aa, Entamoeba invadens
ESTEIFFALTKLFTSQDLTLRRLC

SEQ ID NO: 2994944 - protein, 26 aa, Entamoeba invadens
ESTKADLFQFFKMTSLDKEKVKFVPV

SEQ ID NO: 2994945 - protein, 17 aa, Entamoeba invadens
ESTQKYWRDVLLTLIGE

SEQ ID NO: 2994946 - protein, 25 aa, Entamoeba invadens
ESVAKWLLDKLLLLGIPLNKLHCIT

SEQ ID NO: 2994947 - protein, 22 aa, Entamoeba invadens
ESVALKLAVMYLICAEFIPEKK

SEQ ID NO: 2994948 - protein, 26 aa, Entamoeba invadens
ESVEIKAPQLLFLSGGKFSVDVHGTV

SEQ ID NO: 2994949 - protein, 27 aa, Entamoeba invadens
ESVHKNIVVYLRFGANYNKFVSGKMPI

SEQ ID NO: 2994950 - protein, 25 aa, Entamoeba invadens
ESVIQLLMTLTKSPKNRIAAIQLLE

SEQ ID NO: 2994951 - protein, 26 aa, Entamoeba invadens
ESVKLPKGFKKLPYKAFYGAKDLTEI

SEQ ID NO: 2994952 - protein, 25 aa, Entamoeba invadens
ESVLKCWLKSKFYNPNYDKSPYFVA

SEQ ID NO: 2994953 - protein, 24 aa, Entamoeba invadens
ESVNFIGERAFYLCVSLESINIPS

SEQ ID NO: 2994954 - protein, 17 aa, Entamoeba invadens
ESVNKHLKVFRAHFNSL

SEQ ID NO: 2994955 - protein, 31 aa, Entamoeba invadens
ESVPRTLLNTQYRMHPFLSTFSNKVFYSSRL

SEQ ID NO: 2994956 - protein, 27 aa, Entamoeba invadens
ESVSKWVGLFDIFVSKWKTVEILLAKY

SEQ ID NO: 2994957 - protein, 27 aa, Entamoeba invadens
ESVTCHSYFLLQFPDLLMNEENIKNVI

SEQ ID NO: 2994958 - protein, 26 aa, Entamoeba invadens
ESVVGKRRDIFKNKYIKIGKLENYQY

SEQ ID NO: 2994959 - protein, 17 aa, Entamoeba invadens
ESWIASFGTRKDKDETN

SEQ ID NO: 2994960 - protein, 19 aa, Entamoeba invadens
ESWSTYIYGDFFKHGFDGS

SEQ ID NO: 2994961 - protein, 20 aa, Entamoeba invadens
ESYDRKIFGIAIPECVNSLG

SEQ ID NO: 2994962 - protein, 25 aa, Entamoeba invadens
ESYGFSYYCLKWEPESYYKVSKHKS

SEQ ID NO: 2994963 - protein, 22 aa, Entamoeba invadens
ESYIPFHMNLSPYKPKKYSYWM

SEQ ID NO: 2994964 - protein, 24 aa, Entamoeba invadens
ESYKFLHLMYGLSERLFFGDEVPK

SEQ ID NO: 2994965 - protein, 22 aa, Entamoeba invadens
ESYLLLRNELTKDLKKLEKATD

SEQ ID NO: 2994966 - protein, 27 aa, Entamoeba invadens
ESYNEESLQVVWFWSVLEEMNQLLRNK

SEQ ID NO: 2994967 - protein, 24 aa, Entamoeba invadens
ESYQQALLLALLNTNFGFSIEHPG

SEQ ID NO: 2994968 - protein, 24 aa, Entamoeba invadens
ESYSQIILYINNQPFKNKIALIKS

SEQ ID NO: 2994969 - protein, 29 aa, Entamoeba invadens
ETADFIMTDFYEKLLSLGYDSKTALRIIR

SEQ ID NO: 2994970 - protein, 25 aa, Entamoeba invadens
ETADQNLFVFRLKSQKGKVEKYDLL

SEQ ID NO: 2994971 - protein, 26 aa, Entamoeba invadens
ETAEVTRLFYKAAIMENTVLGDEESI

SEQ ID NO: 2994972 - protein, 22 aa, Entamoeba invadens
ETAFFEIISQIKKTNGRIAQFK

SEQ ID NO: 2994973 - protein, 21 aa, Entamoeba invadens
ETAILVAGMPRKVGMERKELI

SEQ ID NO: 2994974 - protein, 24 aa, Entamoeba invadens
ETAKKWWVFAKESILAEVRKKRYK

SEQ ID NO: 2994975 - protein, 19 aa, Entamoeba invadens
ETAKWWKKNFSIVDSKKNE

SEQ ID NO: 2994976 - protein, 19 aa, Entamoeba invadens
ETALDLTTKMLTRSTSPSK

SEQ ID NO: 2994977 - protein, 22 aa, Entamoeba invadens
ETALLDFYMSTRPSYIIYVTAA

SEQ ID NO: 2994978 - protein, 25 aa, Entamoeba invadens
ETANKMSMFFAYSSPMMKVLTDAVN

SEQ ID NO: 2994979 - protein, 27 aa, Entamoeba invadens
ETARPLYAAALWYLDQWDDFGRVVVEM

SEQ ID NO: 2994980 - protein, 25 aa, Entamoeba invadens
ETARPLYAAALWYLDRWDDFGKIVV

SEQ ID NO: 2994981 - protein, 29 aa, Entamoeba invadens
ETASRRYKKWLPLVLTVLDVEKKTFVVVG

SEQ ID NO: 2994982 - protein, 30 aa, Entamoeba invadens
ETCDVCKGGYYLNRGLCELCSTRNCKLSDD

SEQ ID NO: 2994983 - protein, 22 aa, Entamoeba invadens
ETCEIFCELLYDTADMRPVPFV

SEQ ID NO: 2994984 - protein, 25 aa, Entamoeba invadens
ETCQRFFDDIRKLLRDRLQSTLPIP

SEQ ID NO: 2994985 - protein, 23 aa, Entamoeba invadens
ETCRFIQMIVVAFEKGLTGSNKR

SEQ ID NO: 2994986 - protein, 24 aa, Entamoeba invadens
ETCTKCLPNYLDKNLICQPCSEVY

SEQ ID NO: 2994987 - protein, 24 aa, Entamoeba invadens
ETCTYYNYFSRGFDFVFGKNDNLV

SEQ ID NO: 2994988 - protein, 21 aa, Entamoeba invadens
ETDHYLYYLLEAISNVLTCDP

SEQ ID NO: 2994989 - protein, 19 aa, Entamoeba invadens
ETDIAMRVMKLWITNKDRP

SEQ ID NO: 2994990 - protein, 24 aa, Entamoeba invadens
ETDKGFNGFLILRSMYITTKKKHL

SEQ ID NO: 2994991 - protein, 17 aa, Entamoeba invadens
ETDLTLTKRVVAIGSKP

SEQ ID NO: 2994992 - protein, 23 aa, Entamoeba invadens
ETDVFILCFSLVSQTTLDNIITF

SEQ ID NO: 2994993 - protein, 24 aa, Entamoeba invadens
ETDWDGFFSVIQNIYQNELNGCDP

SEQ ID NO: 2994994 - protein, 30 aa, Entamoeba invadens
ETEDLCITAAPYIDFLKLGFGTSVFTGGLR

SEQ ID NO: 2994995 - protein, 18 aa, Entamoeba invadens
ETEDVRAIFLKQGELETA

SEQ ID NO: 2994996 - protein, 26 aa, Entamoeba invadens
ETEFNLKYYYLAKCHMKLGQFPLALR

SEQ ID NO: 2994997 - protein, 23 aa, Entamoeba invadens
ETEGEFWKGCKASIIPDVTDAIQ

SEQ ID NO: 2994998 - protein, 30 aa, Entamoeba invadens
ETEHTLKFVPLTYVPFSQALIDVSVMEKSQ

SEQ ID NO: 2994999 - protein, 18 aa, Entamoeba invadens
ETEILRNQLLKDINLILT

SEQ ID NO: 2995000 - protein, 23 aa, Entamoeba invadens
ETEKFDALLKLMKKRQMRVKDVY

SEQ ID NO: 2995001 - protein, 18 aa, Entamoeba invadens
ETEKFKGIDFSVLTIDSL

SEQ ID NO: 2995002 - protein, 32 aa, Entamoeba invadens
ETELLNVISYRFYKVLFLRDLDYDQVPPLWDA

SEQ ID NO: 2995003 - protein, 17 aa, Entamoeba invadens
ETELNQTWFEKLGRWQQ

SEQ ID NO: 2995004 - protein, 18 aa, Entamoeba invadens
ETERALLSILQMQEKQLK

SEQ ID NO: 2995005 - protein, 24 aa, Entamoeba invadens
ETETHFFIVMEYVPGVSLEKVFES

SEQ ID NO: 2995006 - protein, 25 aa, Entamoeba invadens
ETFDIDPFLSLLNLSKSRIDNQFLA

SEQ ID NO: 2995007 - protein, 20 aa, Entamoeba invadens
ETFDLLIPKITSGVLDLYGE

SEQ ID NO: 2995008 - protein, 24 aa, Entamoeba invadens
ETFGAFIKIIPKLLEIFPDDEQYM

SEQ ID NO: 2995009 - protein, 31 aa, Entamoeba invadens
ETFHDVTKALLYLVLIFQLTIFTDQQADYQI

SEQ ID NO: 2995010 - protein, 20 aa, Entamoeba invadens
ETFHIVSVPPDIAFESIFFQ

SEQ ID NO: 2995011 - protein, 23 aa, Entamoeba invadens
ETFKDHLNWLLTQKNLYEQNSIM

SEQ ID NO: 2995012 - protein, 23 aa, Entamoeba invadens
ETFKNSEILTPFKTQPKFDEMKK

SEQ ID NO: 2995013 - protein, 33 aa, Entamoeba invadens
ETFKREMKVLEDKLLQWTKQSDTLILELDSAND

SEQ ID NO: 2995014 - protein, 25 aa, Entamoeba invadens
ETFQFIQRKFITSEDPTLLKHCMIV

SEQ ID NO: 2995015 - protein, 23 aa, Entamoeba invadens
ETFSPLISKLPKLEVKFYKYDQP

SEQ ID NO: 2995016 - protein, 30 aa, Entamoeba invadens
ETFYRVNNAFYLRPYLFEKKGKTWDDFCKD

SEQ ID NO: 2995017 - protein, 20 aa, Entamoeba invadens
ETGMRYFTGCVDKTIKMYVP

SEQ ID NO: 2995018 - protein, 25 aa, Entamoeba invadens
ETGNTVLFKPYLPQEVLLKGISEKK

SEQ ID NO: 2995019 - protein, 26 aa, Entamoeba invadens
ETGQEYFIARNTWGTWWGENGGFGKI

SEQ ID NO: 2995020 - protein, 42 aa, Entamoeba invadens
ETGQFMLPSLLGIMTLFINNFSTLFPRFADPTLAFANGSKSI

SEQ ID NO: 2995021 - protein, 17 aa, Entamoeba invadens
ETHFINVFFTRKDVKPY

SEQ ID NO: 2995022 - protein, 32 aa, Entamoeba invadens
ETHHMLTDLLFEYGYLFETYFTSGKNNTPKME

SEQ ID NO: 2995023 - protein, 26 aa, Entamoeba invadens
ETHHRRAMIKEDGKWRRRSIVSAESS

SEQ ID NO: 2995024 - protein, 22 aa, Entamoeba invadens
ETHNLIFLGDYVDRGTFSCEVM

SEQ ID NO: 2995025 - protein, 25 aa, Entamoeba invadens
ETHNPTVFLELLKTAVRLNVDVNKK

SEQ ID NO: 2995026 - protein, 23 aa, Entamoeba invadens
ETHPIVYPLLVDATILDGNLVYS

SEQ ID NO: 2995027 - protein, 25 aa, Entamoeba invadens
ETHPKIMEEFLYKKSTIISKQGGYN

SEQ ID NO: 2995028 - protein, 30 aa, Entamoeba invadens
ETHPSEEVVVPLLGILFNFSQTDSMEEEVH

SEQ ID NO: 2995029 - protein, 64 aa, Entamoeba invadens
ETIAPPPELAPPGGLAPPPGLEPPGMLPPPGLEPPGGMLPPPGLAPPGLEPPGGLMPPGMLPPP

SEQ ID NO: 2995030 - protein, 19 aa, Entamoeba invadens
ETIFQKELLLFPNIEILRC

SEQ ID NO: 2995031 - protein, 30 aa, Entamoeba invadens
ETIGNHLYAIRYFIPMLEIYPELQGEAKLR

SEQ ID NO: 2995032 - protein, 29 aa, Entamoeba invadens
ETIKTLLETESFKLGPFLDESLKMKEESF

SEQ ID NO: 2995033 - protein, 25 aa, Entamoeba invadens
ETIKTNLLIMWDLLAESNKVTKSVF

SEQ ID NO: 2995034 - protein, 30 aa, Entamoeba invadens
ETILKNYKFPVTFLIRGFVLLVNESKGLKL

SEQ ID NO: 2995035 - protein, 18 aa, Entamoeba invadens
ETINDVIKFLMINKKLRS

SEQ ID NO: 2995036 - protein, 26 aa, Entamoeba invadens
ETIQQWLVSDFLPSLLNSLLMHIRRA

SEQ ID NO: 2995037 - protein, 18 aa, Entamoeba invadens
ETISKIIELIKGVLGRVH

SEQ ID NO: 2995038 - protein, 23 aa, Entamoeba invadens
ETISQLHIHLVRPIVFEKDDDTN

SEQ ID NO: 2995039 - protein, 21 aa, Entamoeba invadens
ETIVPLIKTYNPNGRTIVFCD

SEQ ID NO: 2995040 - protein, 18 aa, Entamoeba invadens
ETKAQISALIWKKKEEKG

SEQ ID NO: 2995041 - protein, 24 aa, Entamoeba invadens
ETKEWYDYQQSYLICTLIKEGHEV

SEQ ID NO: 2995042 - protein, 34 aa, Entamoeba invadens
ETKHFTTITLPVIFDLAILSLKYIQSPIPQLKMT

SEQ ID NO: 2995043 - protein, 23 aa, Entamoeba invadens
ETKIEIFNFIKTVGKLVLDFKEN

SEQ ID NO: 2995044 - protein, 25 aa, Entamoeba invadens
ETKIFIHNRLFKWKLRELTAKQMEK

SEQ ID NO: 2995045 - protein, 23 aa, Entamoeba invadens
ETKIGILLQTYIGRLQLPGYVLS

SEQ ID NO: 2995046 - protein, 24 aa, Entamoeba invadens
ETKIQKLLFTPQRFIDTKYVLPSG

SEQ ID NO: 2995047 - protein, 23 aa, Entamoeba invadens
ETKKLENVLKPKLTQPTRAGCYA

SEQ ID NO: 2995048 - protein, 17 aa, Entamoeba invadens
ETKKPRVYKKRAKKYPV

SEQ ID NO: 2995049 - protein, 17 aa, Entamoeba invadens
ETKKRKMGYGGSGFKFD

SEQ ID NO: 2995050 - protein, 19 aa, Entamoeba invadens
ETKKYFVRPKMIKGIDNLE

SEQ ID NO: 2995051 - protein, 17 aa, Entamoeba invadens
ETKLLLTPYEKNIEFWR

SEQ ID NO: 2995052 - protein, 27 aa, Entamoeba invadens
ETKMRRGYFFLFNDVLIRSRITKYDGR

SEQ ID NO: 2995053 - protein, 34 aa, Entamoeba invadens
ETKPRYLMGVGYPVEMILCVLFGVDMFDCVYPTR

SEQ ID NO: 2995054 - protein, 18 aa, Entamoeba invadens
ETKRSFLLYSVINTNGVG

SEQ ID NO: 2995055 - protein, 27 aa, Entamoeba invadens
ETKTKEMISLLKWLIQRHIEQQKRGKS

SEQ ID NO: 2995056 - protein, 22 aa, Entamoeba invadens
ETKTLLPQFKFLCQVKEDDIKA

SEQ ID NO: 2995057 - protein, 21 aa, Entamoeba invadens
ETKVCYLPIVNNRVGNFPIVL

SEQ ID NO: 2995058 - protein, 18 aa, Entamoeba invadens
ETLALNLPPQIPKTKYRY

SEQ ID NO: 2995059 - protein, 29 aa, Entamoeba invadens
ETLDGGLGFYLLPLDYFNARRSKLEDDLH

SEQ ID NO: 2995060 - protein, 23 aa, Entamoeba invadens
ETLEVICTILKWFIHKEDTDYST

SEQ ID NO: 2995061 - protein, 29 aa, Entamoeba invadens
ETLEWLQHPTLKFTLPQILITLDVAFREK

SEQ ID NO: 2995062 - protein, 21 aa, Entamoeba invadens
ETLFEFLERDYLKNFKTAMAE

SEQ ID NO: 2995063 - protein, 17 aa, Entamoeba invadens
ETLFHECGHLIHTLLAE

SEQ ID NO: 2995064 - protein, 28 aa, Entamoeba invadens
ETLFSSLITLLKYQNPTIFKRSLDIIAS

SEQ ID NO: 2995065 - protein, 24 aa, Entamoeba invadens
ETLFTNWQNTQPLKRLKMFKMCNV

SEQ ID NO: 2995066 - protein, 24 aa, Entamoeba invadens
ETLIPQLLKMFIERQRPAVASLLT

SEQ ID NO: 2995067 - protein, 33 aa, Entamoeba invadens
ETLKGFVHLKTQKPFQFTGLLLSFSGVVDINNS

SEQ ID NO: 2995068 - protein, 25 aa, Entamoeba invadens
ETLKNTNFFPPFDKFQNIFSEWTTE

SEQ ID NO: 2995069 - protein, 19 aa, Entamoeba invadens
ETLKVIPAKELLYCVPDRV

SEQ ID NO: 2995070 - protein, 17 aa, Entamoeba invadens
ETLKWGEVYDKEFFKFP

SEQ ID NO: 2995071 - protein, 21 aa, Entamoeba invadens
ETLLEGFVFLSNTFESTQSEI

SEQ ID NO: 2995072 - protein, 20 aa, Entamoeba invadens
ETLNFIAHYCKKCGYPFIQL

SEQ ID NO: 2995073 - protein, 26 aa, Entamoeba invadens
ETLPEHLHKLVWPTVSAYSITQKCWG

SEQ ID NO: 2995074 - protein, 23 aa, Entamoeba invadens
ETLRQEVIKLFDLAKAAIDEPIT

SEQ ID NO: 2995075 - protein, 23 aa, Entamoeba invadens
ETLSKLLQKKNCGILLLGEHGSG

SEQ ID NO: 2995076 - protein, 21 aa, Entamoeba invadens
ETLVFTLRPPVYTPTYIELHH

SEQ ID NO: 2995077 - protein, 25 aa, Entamoeba invadens
ETLVNVFHFILTRRAQQKSAIIVVV

SEQ ID NO: 2995078 - protein, 26 aa, Entamoeba invadens
ETLYDSLNLLIYRFYVLHFSSQNALN

SEQ ID NO: 2995079 - protein, 18 aa, Entamoeba invadens
ETLYKTMQLLVKYFKRPL

SEQ ID NO: 2995080 - protein, 23 aa, Entamoeba invadens
ETMKDVFNFMFINKSSLTAVQTM

SEQ ID NO: 2995081 - protein, 21 aa, Entamoeba invadens
ETMLSFLFQFINSCTKELMNV

SEQ ID NO: 2995082 - protein, 24 aa, Entamoeba invadens
ETMRTPLHYLCRNPKLDDKTISLL

SEQ ID NO: 2995083 - protein, 25 aa, Entamoeba invadens
ETNDYFKWMFRSSDKSGKMYYEENK

SEQ ID NO: 2995084 - protein, 24 aa, Entamoeba invadens
ETNEDVAKVEEPKVEEHKEEVVPP

SEQ ID NO: 2995085 - protein, 29 aa, Entamoeba invadens
ETNFDAFLFVVSLWLLSAPPSPSTAIFLV

SEQ ID NO: 2995086 - protein, 27 aa, Entamoeba invadens
ETNGKFLDFFAIFQTLNNIPFPEHSDF

SEQ ID NO: 2995087 - protein, 27 aa, Entamoeba invadens
ETNHQIPDLLLPLLDQEDFLTATIHVI

SEQ ID NO: 2995088 - protein, 20 aa, Entamoeba invadens
ETNIGLFFDLEDEPNLPDDI

SEQ ID NO: 2995089 - protein, 22 aa, Entamoeba invadens
ETNILTLTLLSSNSLLLEQIQN

SEQ ID NO: 2995090 - protein, 18 aa, Entamoeba invadens
ETNKIKQLTSARRIEFLQ

SEQ ID NO: 2995091 - protein, 26 aa, Entamoeba invadens
ETNKIVESLYLLIDILHECATTFSSS

SEQ ID NO: 2995092 - protein, 31 aa, Entamoeba invadens
ETNNRQKAAQLLLIIKEKHPEYLDAFSSYTE

SEQ ID NO: 2995093 - protein, 24 aa, Entamoeba invadens
ETNVTVILFNDIILFLTADFGASL

SEQ ID NO: 2995094 - protein, 24 aa, Entamoeba invadens
ETPAIDSLFLVVLDFMSTVGIKDA

SEQ ID NO: 2995095 - protein, 25 aa, Entamoeba invadens
ETPIIRRLFERIVAMKLSTKSMKTF

SEQ ID NO: 2995096 - protein, 25 aa, Entamoeba invadens
ETPLINRSVFIPKSRRDVIEDVPYV

SEQ ID NO: 2995097 - protein, 30 aa, Entamoeba invadens
ETPTKGKLVFLMMLLKTPKGVEVLLDILKD

SEQ ID NO: 2995098 - protein, 23 aa, Entamoeba invadens
ETQDFLTVSFLLTAKDFVVTEEE

SEQ ID NO: 2995099 - protein, 28 aa, Entamoeba invadens
ETQDRYDVLLFNLKEFGLIDTSINYNEK

SEQ ID NO: 2995100 - protein, 27 aa, Entamoeba invadens
ETQGLRTSYFLYYSDKDVLKRFQTPYY

SEQ ID NO: 2995101 - protein, 23 aa, Entamoeba invadens
ETQGRISMFIASPSPMMNHLINI

SEQ ID NO: 2995102 - protein, 22 aa, Entamoeba invadens
ETQKLCEFISNTTTKYLGDLKI

SEQ ID NO: 2995103 - protein, 24 aa, Entamoeba invadens
ETQLRLISSIFHFKPREAVVSLKR

SEQ ID NO: 2995104 - protein, 23 aa, Entamoeba invadens
ETQRRFISMYLSAYYKKPAEELI

SEQ ID NO: 2995105 - protein, 27 aa, Entamoeba invadens
ETQRSTYLVLLYKMLLRRNGNQLASEL

SEQ ID NO: 2995106 - protein, 19 aa, Entamoeba invadens
ETQVMYLDEIAKMNMEYNF

SEQ ID NO: 2995107 - protein, 23 aa, Entamoeba invadens
ETRGIPLIIIFSKVDLPYNMTET

SEQ ID NO: 2995108 - protein, 24 aa, Entamoeba invadens
ETRQSLLHFLHGLLQIDPETRWTA

SEQ ID NO: 2995109 - protein, 24 aa, Entamoeba invadens
ETRRKFKQFLNLRQKMIEQEDIPI

SEQ ID NO: 2995110 - protein, 24 aa, Entamoeba invadens
ETRWYRAPEILLGSQRYSFGIDLW

SEQ ID NO: 2995111 - protein, 17 aa, Entamoeba invadens
ETSAYRLRNGLPRPSQS

SEQ ID NO: 2995112 - protein, 24 aa, Entamoeba invadens
ETSGVILFFPRGDIPLGTNLDFSN

SEQ ID NO: 2995113 - protein, 23 aa, Entamoeba invadens
ETSLYPHSRPLIFKGSVFGHTMM

SEQ ID NO: 2995114 - protein, 24 aa, Entamoeba invadens
ETSQMLRINPFKISFKTVCQNPTL

SEQ ID NO: 2995115 - protein, 18 aa, Entamoeba invadens
ETSSTIKFCFSSRNIQCI

SEQ ID NO: 2995116 - protein, 44 aa, Entamoeba invadens
ETSVFTRQMYLQLYFQSFLMLRKSLVNEFLLKDLKKKGVDMVYL

SEQ ID NO: 2995117 - protein, 17 aa, Entamoeba invadens
ETSYQAEFKSRCLKSRT

SEQ ID NO: 2995118 - protein, 32 aa, Entamoeba invadens
ETTEIVLFDLLRINTKMYLECKLPELNIGKWV

SEQ ID NO: 2995119 - protein, 25 aa, Entamoeba invadens
ETTLDDLPAYILMEISYPQSTSCSN

SEQ ID NO: 2995120 - protein, 25 aa, Entamoeba invadens
ETTLTEIIQLKIKFLRAALKGDKKL

SEQ ID NO: 2995121 - protein, 29 aa, Entamoeba invadens
ETTLVNALVFLIVKLGFNVKIKKTKKTVH

SEQ ID NO: 2995122 - protein, 24 aa, Entamoeba invadens
ETTNPIDFLGIRQLLERQKKGIFD

SEQ ID NO: 2995123 - protein, 28 aa, Entamoeba invadens
ETTPTVGAEFYKFKYTFKDKEVSISLFD

SEQ ID NO: 2995124 - protein, 26 aa, Entamoeba invadens
ETTPYEIFSLFFTKELKDFVILQSNN

SEQ ID NO: 2995125 - protein, 26 aa, Entamoeba invadens
ETVERQLICIYLANLFNKLNASPNKL

SEQ ID NO: 2995126 - protein, 27 aa, Entamoeba invadens
ETVHISSLALLKMLKHGRAGVPVEVMG

SEQ ID NO: 2995127 - protein, 19 aa, Entamoeba invadens
ETVLRCLPKLPFEITDEYL

SEQ ID NO: 2995128 - protein, 24 aa, Entamoeba invadens
ETVNCFYFDFFDLQIFSSVKNIRC

SEQ ID NO: 2995129 - protein, 26 aa, Entamoeba invadens
ETVNPSLWRQSQLIRIDGLFELIPNK

SEQ ID NO: 2995130 - protein, 26 aa, Entamoeba invadens
ETVRKIFKRLFRVYAHMFYNHMEHME

SEQ ID NO: 2995131 - protein, 24 aa, Entamoeba invadens
ETVRSLFVLNIVEPIIKGTPLVNS

SEQ ID NO: 2995132 - protein, 19 aa, Entamoeba invadens
ETVRYLFQSLKKSGSLVVY

SEQ ID NO: 2995133 - protein, 18 aa, Entamoeba invadens
ETVYLMNVIPYFNSLSDV

SEQ ID NO: 2995134 - protein, 23 aa, Entamoeba invadens
ETVYPLHRTIALVKELQPGVKKV

SEQ ID NO: 2995135 - protein, 18 aa, Entamoeba invadens
ETWRQLYLSVYGISTKFI

SEQ ID NO: 2995136 - protein, 25 aa, Entamoeba invadens
ETYAPLCVLSFPSSNPKLINENALK

SEQ ID NO: 2995137 - protein, 25 aa, Entamoeba invadens
ETYASLLCQFGWKSFVPPSEKIQRQ

SEQ ID NO: 2995138 - protein, 36 aa, Entamoeba invadens
ETYDEYILNVKFKTAIFFKAIASIGLYLAGRSEEDI

SEQ ID NO: 2995139 - protein, 20 aa, Entamoeba invadens
ETYFNVMKLISVPTDADPNF

SEQ ID NO: 2995140 - protein, 30 aa, Entamoeba invadens
ETYGNEGYPLIRPLCYLNTTCFVLCFSLVD

SEQ ID NO: 2995141 - protein, 29 aa, Entamoeba invadens
ETYHPMFRGTLFRWMENLRYLNLSACIQF

SEQ ID NO: 2995142 - protein, 32 aa, Entamoeba invadens
ETYIKIIVMEYTDILVKLLPSGELKKASKRCY

SEQ ID NO: 2995143 - protein, 26 aa, Entamoeba invadens
ETYNDIFKFLWRVKCLRISINKVFKR

SEQ ID NO: 2995144 - protein, 20 aa, Entamoeba invadens
EVACLYLDMFPEKSNYILNL

SEQ ID NO: 2995145 - protein, 26 aa, Entamoeba invadens
EVAEEIKLLRFLENDYIVRYIASTQS

SEQ ID NO: 2995146 - protein, 24 aa, Entamoeba invadens
EVAFDYITFLQKKIGDFFFGYKDQ

SEQ ID NO: 2995147 - protein, 34 aa, Entamoeba invadens
EVAFENMNVSDLFIKLNILLNNELNKLSPNNDSI

SEQ ID NO: 2995148 - protein, 20 aa, Entamoeba invadens
EVAFQFILDNLDLSVVPEEP

SEQ ID NO: 2995149 - protein, 20 aa, Entamoeba invadens
EVAILVAGMPRKVGMERKEL

SEQ ID NO: 2995150 - protein, 33 aa, Entamoeba invadens
EVAMLAKFVSPYVIRFYGASFIPNRICMVTELA

SEQ ID NO: 2995151 - protein, 24 aa, Entamoeba invadens
EVANEAIKFLKEQGLLSVSIESEN

SEQ ID NO: 2995152 - protein, 25 aa, Entamoeba invadens
  misc_feature (25)..(25): Xaa can be any naturally occurring amino acid
EVASEILKYLKTAALKRLGFGCDPX

SEQ ID NO: 2995153 - protein, 25 aa, Entamoeba invadens
EVASELFQMWELQPFYLDEDKPLHQ

SEQ ID NO: 2995154 - protein, 26 aa, Entamoeba invadens
EVATPAGSIQALLPPATLSDAEAAMG

SEQ ID NO: 2995155 - protein, 19 aa, Entamoeba invadens
EVCVQSHLAIFRPDVQLFM

SEQ ID NO: 2995156 - protein, 24 aa, Entamoeba invadens
EVDDDIEFKFVYKTRPDNYKDFEK

SEQ ID NO: 2995157 - protein, 20 aa, Entamoeba invadens
EVDDLFQLMIEKIGMKEGEK

SEQ ID NO: 2995158 - protein, 22 aa, Entamoeba invadens
EVDEYCFHSFGWDEDGLAAYCR

SEQ ID NO: 2995159 - protein, 19 aa, Entamoeba invadens
EVDFLPQFKTEIPSLLAQI

SEQ ID NO: 2995160 - protein, 21 aa, Entamoeba invadens
EVDGVLELLLEAIKLEDINKN

SEQ ID NO: 2995161 - protein, 26 aa, Entamoeba invadens
EVDHKTINYLPLVKGLYVEVPDVTRL

SEQ ID NO: 2995162 - protein, 19 aa, Entamoeba invadens
EVDIKMRLKFMNDSARGIL

SEQ ID NO: 2995163 - protein, 25 aa, Entamoeba invadens
EVDIYALGVIFWEMLYEMKPFNEFY

SEQ ID NO: 2995164 - protein, 23 aa, Entamoeba invadens
EVDKALVVLFKDDYKVSSYSYYN

SEQ ID NO: 2995165 - protein, 24 aa, Entamoeba invadens
EVDKKRLMTFVKLAKEGKLEKSPI

SEQ ID NO: 2995166 - protein, 17 aa, Entamoeba invadens
EVDKLLSKLTFPRRFKL

SEQ ID NO: 2995167 - protein, 26 aa, Entamoeba invadens
EVDKNYLKVFAFYEKMKRDSVKICKE

SEQ ID NO: 2995168 - protein, 26 aa, Entamoeba invadens
EVDLKRFQFLILQFGNFYEDKKAFEK

SEQ ID NO: 2995169 - protein, 19 aa, Entamoeba invadens
EVDLVFLQCLLQTVIQSFD

SEQ ID NO: 2995170 - protein, 25 aa, Entamoeba invadens
EVDMKLRMKFLLDAAKGIQYLHENG

SEQ ID NO: 2995171 - protein, 32 aa, Entamoeba invadens
EVDRFLVTIQMETLPWVVPRQVIQAETDVIPA

SEQ ID NO: 2995172 - protein, 33 aa, Entamoeba invadens
EVDRFLVTIQMETLPWVVPRQVIQAETDVIPAQ

SEQ ID NO: 2995173 - protein, 18 aa, Entamoeba invadens
EVEDLGVPILLVGLKNDL

SEQ ID NO: 2995174 - protein, 25 aa, Entamoeba invadens
EVEDLYKVVVPIDGFISVEDLIKNM

SEQ ID NO: 2995175 - protein, 24 aa, Entamoeba invadens
EVEFCFFRRKTAALNIFKEALKKY

SEQ ID NO: 2995176 - protein, 26 aa, Entamoeba invadens
EVEKFLIEFKPVCVTFVQPLLDQKRC

SEQ ID NO: 2995177 - protein, 36 aa, Entamoeba invadens
EVELKILDLILMEGWEILFTVFSAILHFSKPAILEM

SEQ ID NO: 2995178 - protein, 29 aa, Entamoeba invadens
EVELYAHQFFQHPFKTLCDSRRFSHYYIV

SEQ ID NO: 2995179 - protein, 24 aa, Entamoeba invadens
EVERRVFLFLNTQEKYETLKKTNN

SEQ ID NO: 2995180 - protein, 24 aa, Entamoeba invadens
EVETLKFYFTFVIARHLEQRAFSP

SEQ ID NO: 2995181 - protein, 28 aa, Entamoeba invadens
EVFCTTQIIVVLKLRYTNPMSIDVTSMG

SEQ ID NO: 2995182 - protein, 21 aa, Entamoeba invadens
EVFEALTTLILQNKTLMDNLP

SEQ ID NO: 2995183 - protein, 23 aa, Entamoeba invadens
EVFENYRHFLPVLGKDDLEKYIK

SEQ ID NO: 2995184 - protein, 17 aa, Entamoeba invadens
EVFEYLGTVYLVSYLYT

SEQ ID NO: 2995185 - protein, 27 aa, Entamoeba invadens
EVFGKIKMYFKVMIIKVKNLDTLSERN

SEQ ID NO: 2995186 - protein, 19 aa, Entamoeba invadens
EVFGMLMQCLVDFCAIPNI

SEQ ID NO: 2995187 - protein, 28 aa, Entamoeba invadens
EVFGWCEAYQHTKFKFPWKIAEFVIKGN

SEQ ID NO: 2995188 - protein, 18 aa, Entamoeba invadens
EVFKIVAGMLHMGNVCYV

SEQ ID NO: 2995189 - protein, 18 aa, Entamoeba invadens
EVFKMWRSNLLDVSEEFK

SEQ ID NO: 2995190 - protein, 21 aa, Entamoeba invadens
EVFMDECEYWIPSILSSIVSE

SEQ ID NO: 2995191 - protein, 22 aa, Entamoeba invadens
EVFSRIYKVMLPGDYIAYRMSG

SEQ ID NO: 2995192 - protein, 36 aa, Entamoeba invadens
EVFVENYFAPIEEMLIALLGYPIDLIRERALVLLNC

SEQ ID NO: 2995193 - protein, 18 aa, Entamoeba invadens
EVFVLTDRKKALIVVSMI

SEQ ID NO: 2995194 - protein, 23 aa, Entamoeba invadens
EVFYKCGFVSFTFPKASISLENH

SEQ ID NO: 2995195 - protein, 25 aa, Entamoeba invadens
EVGKIFLNFSPYFAVYQNFLINHEN

SEQ ID NO: 2995196 - protein, 20 aa, Entamoeba invadens
EVGMINWNMFSIFNVPDEQM

SEQ ID NO: 2995197 - protein, 24 aa, Entamoeba invadens
EVGSLFYFLLRTQNGYEPLQIIDL

SEQ ID NO: 2995198 - protein, 31 aa, Entamoeba invadens
EVGSLPLVFPIPVRRDLHYFVAYQVGDVKGK

SEQ ID NO: 2995199 - protein, 29 aa, Entamoeba invadens
EVGVVNEDIFYFAKQLLQKFRKTIFDSHE

SEQ ID NO: 2995200 - protein, 19 aa, Entamoeba invadens
EVHHKLESVDFGNGVVMTY

SEQ ID NO: 2995201 - protein, 31 aa, Entamoeba invadens
EVHHWAVKLEGLFLKLWTTAFGATKPTAVDP

SEQ ID NO: 2995202 - protein, 24 aa, Entamoeba invadens
EVHWAPFWDSLSSLFRKCCMHPNE

SEQ ID NO: 2995203 - protein, 21 aa, Entamoeba invadens
EVHWFVESIPFILVATKTDLK

SEQ ID NO: 2995204 - protein, 20 aa, Entamoeba invadens
EVICLDRFFDALFTREFFKE

SEQ ID NO: 2995205 - protein, 32 aa, Entamoeba invadens
EVIDLAMYLPSKENFIAIYQKLLIKRIVEGTS

SEQ ID NO: 2995206 - protein, 18 aa, Entamoeba invadens
EVIFVKHLYDKVVASSKD

SEQ ID NO: 2995207 - protein, 24 aa, Entamoeba invadens
EVIHLLEDILFEDGFLVFYDNENR

SEQ ID NO: 2995208 - protein, 24 aa, Entamoeba invadens
EVIHLLVDILREKGYFFGTRMTVG

SEQ ID NO: 2995209 - protein, 17 aa, Entamoeba invadens
EVIIKYVKAFATTQLKE

SEQ ID NO: 2995210 - protein, 25 aa, Entamoeba invadens
EVIKPVTIYIKSGYYPLINNSIEIT

SEQ ID NO: 2995211 - protein, 19 aa, Entamoeba invadens
EVIKRDNQIAYLENEVAAL

SEQ ID NO: 2995212 - protein, 26 aa, Entamoeba invadens
EVIQFEHTILWYDVDYQTALSNMSSQ

SEQ ID NO: 2995213 - protein, 29 aa, Entamoeba invadens
EVIQYRDTPTFRRSVIGFFVKVVSGKDEY

SEQ ID NO: 2995214 - protein, 17 aa, Entamoeba invadens
EVIRLLISFARDMGFDI

SEQ ID NO: 2995215 - protein, 24 aa, Entamoeba invadens
EVIRNFVYVYPLPSSFEEAKYGPK

SEQ ID NO: 2995216 - protein, 29 aa, Entamoeba invadens
EVISCENQWWYGRKGNSFGYFPGEYCQVI

SEQ ID NO: 2995217 - protein, 18 aa, Entamoeba invadens
EVISLFHSVFEFDGIDSI

SEQ ID NO: 2995218 - protein, 18 aa, Entamoeba invadens
EVIVCNKMFYDQAVVTAV

SEQ ID NO: 2995219 - protein, 27 aa, Entamoeba invadens
EVIVQLYYLRHNLLATLGLSIGFSSFR

SEQ ID NO: 2995220 - protein, 30 aa, Entamoeba invadens
EVIVTQQMLDALRPSKYPTKSAKRVRMIVR

SEQ ID NO: 2995221 - protein, 29 aa, Entamoeba invadens
EVKAFYENWKYFCSKLEFYDKLPNNIADA

SEQ ID NO: 2995222 - protein, 22 aa, Entamoeba invadens
EVKDIYLLFDVIKHFIQSELNN

SEQ ID NO: 2995223 - protein, 25 aa, Entamoeba invadens
EVKEKPRKQLTRKPLHKTKKAKIAE

SEQ ID NO: 2995224 - protein, 28 aa, Entamoeba invadens
EVKESKIPIILFIDEIHTVLGAGATGEG

SEQ ID NO: 2995225 - protein, 22 aa, Entamoeba invadens
EVKICLIGCERSGKTTILNIWK

SEQ ID NO: 2995226 - protein, 17 aa, Entamoeba invadens
EVKPFVKSGLNLVTKLI

SEQ ID NO: 2995227 - protein, 24 aa, Entamoeba invadens
EVKQFLKWVDNFPSLQYVCFTIGE

SEQ ID NO: 2995228 - protein, 30 aa, Entamoeba invadens
EVKRLKYRNGRFLPFLMAGNPINFGRPFKL

SEQ ID NO: 2995229 - protein, 19 aa, Entamoeba invadens
EVKRWCSLFDDWRVYEFPQ

SEQ ID NO: 2995230 - protein, 23 aa, Entamoeba invadens
EVKSRTVVYLKRGKLYLKHNSLT

SEQ ID NO: 2995231 - protein, 17 aa, Entamoeba invadens
EVKYFDRKAYLAQSPQL

SEQ ID NO: 2995232 - protein, 22 aa, Entamoeba invadens
EVKYLLKVFPGCNEMTLLGTDI

SEQ ID NO: 2995233 - protein, 26 aa, Entamoeba invadens
EVLAVHLQCFMLYELDPSRLLEMADK

SEQ ID NO: 2995234 - protein, 20 aa, Entamoeba invadens
EVLCLLYALKVKYPDCVYIV

SEQ ID NO: 2995235 - protein, 25 aa, Entamoeba invadens
EVLCLVYALKLRYPKQYFLIRGNHE

SEQ ID NO: 2995236 - protein, 17 aa, Entamoeba invadens
EVLEIASLLMKNPLRIL

SEQ ID NO: 2995237 - protein, 27 aa, Entamoeba invadens
EVLEIQQIYFFQSITWFSVMSVSHART

SEQ ID NO: 2995238 - protein, 21 aa, Entamoeba invadens
EVLFYLLAHKICYPTKVYMLR

SEQ ID NO: 2995239 - protein, 24 aa, Entamoeba invadens
EVLGNLFSFPLRVISKADGKKKNL

SEQ ID NO: 2995240 - protein, 24 aa, Entamoeba invadens
EVLHEVLCGILLKAIHLRVKKGVE

SEQ ID NO: 2995241 - protein, 27 aa, Entamoeba invadens
EVLKDTEVLLQKLQIMNVRSQKLAKLT

SEQ ID NO: 2995242 - protein, 29 aa, Entamoeba invadens
EVLKGFLLYIQQFNPFMKVVLDFGKYNKA

SEQ ID NO: 2995243 - protein, 28 aa, Entamoeba invadens
EVLKTVYMNVYPLVTFPSKKVPVSGLSV

SEQ ID NO: 2995244 - protein, 22 aa, Entamoeba invadens
EVLLGISKMRFSLQVSPQQLAS

SEQ ID NO: 2995245 - protein, 17 aa, Entamoeba invadens
EVLLTRRKKSSTFTEKL

SEQ ID NO: 2995246 - protein, 17 aa, Entamoeba invadens
EVLLYYFNYVTFSSDKS

SEQ ID NO: 2995247 - protein, 27 aa, Entamoeba invadens
EVLNNWGIQVFLPFFDESKFIELVRNS

SEQ ID NO: 2995248 - protein, 25 aa, Entamoeba invadens
EVLSRVSWVGVFPLYGDKKNNYITY

SEQ ID NO: 2995249 - protein, 24 aa, Entamoeba invadens
EVLYKQWETILPQTIELFNQMIDL

SEQ ID NO: 2995250 - protein, 17 aa, Entamoeba invadens
EVLYYSPLNKEKCITVV

SEQ ID NO: 2995251 - protein, 17 aa, Entamoeba invadens
EVMCANYPLFKSEKPIL

SEQ ID NO: 2995252 - protein, 31 aa, Entamoeba invadens
EVMILKIQIRRSYYELFSLIKTMEFVGDLDK

SEQ ID NO: 2995253 - protein, 24 aa, Entamoeba invadens
EVMQNLLNIHLIQKKAIGGLVNGD

SEQ ID NO: 2995254 - protein, 19 aa, Entamoeba invadens
EVMSYLNKLEKCYTKYAKV

SEQ ID NO: 2995255 - protein, 25 aa, Entamoeba invadens
EVMYTMPCYYITDQPFRYYERVKSM

SEQ ID NO: 2995256 - protein, 25 aa, Entamoeba invadens
EVNDDWLLDFANNKALSYGTLFSDE

SEQ ID NO: 2995257 - protein, 23 aa, Entamoeba invadens
EVNEAIISIYKSTDSKELIPKQH

SEQ ID NO: 2995258 - protein, 25 aa, Entamoeba invadens
EVNHSYWYAYFEASTQGYHNPYCVC

SEQ ID NO: 2995259 - protein, 17 aa, Entamoeba invadens
EVNILASSAFEKCTTLK

SEQ ID NO: 2995260 - protein, 25 aa, Entamoeba invadens
EVNILKTPINLSRGFGFIDVKTEED

SEQ ID NO: 2995261 - protein, 20 aa, Entamoeba invadens
EVNLTPKRTILLLGATGFVG

SEQ ID NO: 2995262 - protein, 35 aa, Entamoeba invadens
EVNMLDKFRYKYIVYFYGAVLYQTRRVWSPNLQYG

SEQ ID NO: 2995263 - protein, 42 aa, Entamoeba invadens
EVNNLDIFAYLILPIQRVPRYELFIKGFLKYLPRSHVEFEKL

SEQ ID NO: 2995264 - protein, 25 aa, Entamoeba invadens
EVNNWKAPKLGKKSILRKGEYAYEP

SEQ ID NO: 2995265 - protein, 30 aa, Entamoeba invadens
EVNPNGMIKRKWYDDVIFKNQGKKDDVKKK

SEQ ID NO: 2995266 - protein, 26 aa, Entamoeba invadens
EVNQNTLWYLLYLCNEIAQNASENQM

SEQ ID NO: 2995267 - protein, 23 aa, Entamoeba invadens
EVNQVFAKYSPLSVEIPRYNEDT

SEQ ID NO: 2995268 - protein, 19 aa, Entamoeba invadens
EVPDKEQFWAGIYPTSKSI

SEQ ID NO: 2995269 - protein, 25 aa, Entamoeba invadens
EVPPTNTYVALGKAFVLSDCDYLKK

SEQ ID NO: 2995270 - protein, 27 aa, Entamoeba invadens
EVPRTVVVILERYLVSGLSAGQRIRVE

SEQ ID NO: 2995271 - protein, 35 aa, Entamoeba invadens
EVPSRLEILVKVLTRFILLFRNFPVQESLDVYEEI

SEQ ID NO: 2995272 - protein, 17 aa, Entamoeba invadens
EVPTIVFSAFPRTTNKI

SEQ ID NO: 2995273 - protein, 26 aa, Entamoeba invadens
EVPVGVPRIPIIQVWIEDTKSVELSS

SEQ ID NO: 2995274 - protein, 19 aa, Entamoeba invadens
EVQAILREAICKHIIVMVV

SEQ ID NO: 2995275 - protein, 22 aa, Entamoeba invadens
EVQCDIWIVELPQLKMKEGPTE

SEQ ID NO: 2995276 - protein, 27 aa, Entamoeba invadens
EVQERACFFLAILRQFETLREQHIDII

SEQ ID NO: 2995277 - protein, 17 aa, Entamoeba invadens
EVQKWLPSISVGLMGGT

SEQ ID NO: 2995278 - protein, 21 aa, Entamoeba invadens
EVQRANILVEEYKSRYNRAVE

SEQ ID NO: 2995279 - protein, 27 aa, Entamoeba invadens
EVQSGLISWMRELSESDCRLRQALREE

SEQ ID NO: 2995280 - protein, 24 aa, Entamoeba invadens
EVQVDDFRLSFIQSTDLLVGSSML

SEQ ID NO: 2995281 - protein, 23 aa, Entamoeba invadens
EVQYLQILKHPNIVRFYSAEKTE

SEQ ID NO: 2995282 - protein, 23 aa, Entamoeba invadens
EVRAWMATHLKSASILILTGPPG

SEQ ID NO: 2995283 - protein, 22 aa, Entamoeba invadens
EVRCECFIFNDMIAWMDSFVPI

SEQ ID NO: 2995284 - protein, 24 aa, Entamoeba invadens
EVREKWVSALRNLTIWVESIPRTV

SEQ ID NO: 2995285 - protein, 19 aa, Entamoeba invadens
EVREWYRVYKVAEGKKLNK

SEQ ID NO: 2995286 - protein, 17 aa, Entamoeba invadens
EVRKIHSVISKIVPRHL

SEQ ID NO: 2995287 - protein, 22 aa, Entamoeba invadens
EVRNLQMFRIGFEKSTNTFVDI

SEQ ID NO: 2995288 - protein, 22 aa, Entamoeba invadens
EVRRDVWRIVLFPAIDMGDLKK

SEQ ID NO: 2995289 - protein, 18 aa, Entamoeba invadens
EVRYFKKNSKLGTTYIPF

SEQ ID NO: 2995290 - protein, 22 aa, Entamoeba invadens
EVSDTFVFVKNLPYSVDDAQLA

SEQ ID NO: 2995291 - protein, 25 aa, Entamoeba invadens
EVSFNNEFLFTNLFIEDSKITLEQL

SEQ ID NO: 2995292 - protein, 35 aa, Entamoeba invadens
EVSKEWKMCILFNDILIIARPFVFGKKTTRERENL

SEQ ID NO: 2995293 - protein, 23 aa, Entamoeba invadens
EVSKFREIELLSHQTQFIVVTTP

SEQ ID NO: 2995294 - protein, 25 aa, Entamoeba invadens
EVSKSEMLYIKQATYLFSSLTRLAV

SEQ ID NO: 2995295 - protein, 30 aa, Entamoeba invadens
EVSLDRLIYLMKIFGEFFYKKDYLMSFYKI

SEQ ID NO: 2995296 - protein, 22 aa, Entamoeba invadens
EVSLQCVFGDQKALWDAYESNE

SEQ ID NO: 2995297 - protein, 19 aa, Entamoeba invadens
EVSMPQIVFLKNLFKINER

SEQ ID NO: 2995298 - protein, 17 aa, Entamoeba invadens
EVSPFKFINGVSTIVQT

SEQ ID NO: 2995299 - protein, 34 aa, Entamoeba invadens
EVSPHGIPMDLLDRLLIIPTKPYDSTQLYKIISV

SEQ ID NO: 2995300 - protein, 18 aa, Entamoeba invadens
EVSPYLYLELHTLDDLVD

SEQ ID NO: 2995301 - protein, 31 aa, Entamoeba invadens
EVSSLLLSLRWKLFLKCLPTDGTQWTTEIRK

SEQ ID NO: 2995302 - protein, 28 aa, Entamoeba invadens
EVSTTKGCLRCFSGYYLADRMCVKCEYP

SEQ ID NO: 2995303 - protein, 22 aa, Entamoeba invadens
EVSVLMILNAYYEQERPVVILK

SEQ ID NO: 2995304 - protein, 19 aa, Entamoeba invadens
EVSYTCLGSFYKTRHRLFV

SEQ ID NO: 2995305 - protein, 22 aa, Entamoeba invadens
EVTDKMVIKFFLDFFSVECPFS

SEQ ID NO: 2995306 - protein, 19 aa, Entamoeba invadens
EVTFYMQKPENVKAEEYFA

SEQ ID NO: 2995307 - protein, 18 aa, Entamoeba invadens
EVTMYYYRDNMCKNSTDT

SEQ ID NO: 2995308 - protein, 25 aa, Entamoeba invadens
EVTQIKPICALALLDGGETDWKVIG

SEQ ID NO: 2995309 - protein, 24 aa, Entamoeba invadens
EVTQPLMNLIISFLAMTVTRNEVR

SEQ ID NO: 2995310 - protein, 18 aa, Entamoeba invadens
EVTVYPYQLHKTHVELDF

SEQ ID NO: 2995311 - protein, 20 aa, Entamoeba invadens
EVVCHVWVPTISYSPLEEWK

SEQ ID NO: 2995312 - protein, 26 aa, Entamoeba invadens
EVVDIISLEYFTFLKTSTTVLNSRNA

SEQ ID NO: 2995313 - protein, 19 aa, Entamoeba invadens
EVVEFFIKSYQLIMKENFE

SEQ ID NO: 2995314 - protein, 24 aa, Entamoeba invadens
EVVFKHCMSLYWNDLLKANGNKVV

SEQ ID NO: 2995315 - protein, 20 aa, Entamoeba invadens
EVVIKIRIKMMLDAAKGICY

SEQ ID NO: 2995316 - protein, 22 aa, Entamoeba invadens
EVVKIKLYLCCTCYDVYNVMKA

SEQ ID NO: 2995317 - protein, 24 aa, Entamoeba invadens
EVVKPHPQFMLFATQNPPNTYGGR

SEQ ID NO: 2995318 - protein, 18 aa, Entamoeba invadens
EVVKRLPGIPIDKVYDLQ

SEQ ID NO: 2995319 - protein, 18 aa, Entamoeba invadens
EVVKSYVYTYIKSYNKKT

SEQ ID NO: 2995320 - protein, 17 aa, Entamoeba invadens
EVVLPTTIKKIEKFIFV

SEQ ID NO: 2995321 - protein, 27 aa, Entamoeba invadens
EVVLREFYRIIVWFNVDFETINRNKSR

SEQ ID NO: 2995322 - protein, 22 aa, Entamoeba invadens
EVVQAWTYKPGFPVVSLELKDG

SEQ ID NO: 2995323 - protein, 24 aa, Entamoeba invadens
EVVQYLIDLFNRKGIKDNEIGIIS

SEQ ID NO: 2995324 - protein, 25 aa, Entamoeba invadens
EVVRPLRKWSDVTFLPEIQATLSKL

SEQ ID NO: 2995325 - protein, 25 aa, Entamoeba invadens
EVVVHGITFIILALTSLNGEAIFDD

SEQ ID NO: 2995326 - protein, 27 aa, Entamoeba invadens
EVVVKNMRVILPLVIESGYALHKCDDI

SEQ ID NO: 2995327 - protein, 26 aa, Entamoeba invadens
EVWIAPLFFEFPGYEQVMFKERFCDF

SEQ ID NO: 2995328 - protein, 29 aa, Entamoeba invadens
EVWKGVVPFLKLLPMKIRIIQLVKSIHQL

SEQ ID NO: 2995329 - protein, 17 aa, Entamoeba invadens
EVWLGKKINMINTCAFY

SEQ ID NO: 2995330 - protein, 17 aa, Entamoeba invadens
EVWRHKYPVRGVGFFDT

SEQ ID NO: 2995331 - protein, 19 aa, Entamoeba invadens
EVYDDLVEFLKQSGLKLEE

SEQ ID NO: 2995332 - protein, 18 aa, Entamoeba invadens
EVYEFWEGYGMSITPKVV

SEQ ID NO: 2995333 - protein, 17 aa, Entamoeba invadens
EVYGMVLSFVLIENGRE

SEQ ID NO: 2995334 - protein, 17 aa, Entamoeba invadens
EVYKTYMISYSLSIQRV

SEQ ID NO: 2995335 - protein, 30 aa, Entamoeba invadens
EVYLRGLKYLPPTYIEFLKGLKFDPKEVTM

SEQ ID NO: 2995336 - protein, 22 aa, Entamoeba invadens
EVYLVCKDFLAPSKFDPNLLDP

SEQ ID NO: 2995337 - protein, 23 aa, Entamoeba invadens
EVYPFFMNTMLPENWIIGYNRNE

SEQ ID NO: 2995338 - protein, 17 aa, Entamoeba invadens
EVYPKSEFKFAWDIVNF

SEQ ID NO: 2995339 - protein, 17 aa, Entamoeba invadens
EVYPTNFPHQNTQKGKD

SEQ ID NO: 2995340 - protein, 18 aa, Entamoeba invadens
EVYPYTSFNEKMGSLLEG

SEQ ID NO: 2995341 - protein, 28 aa, Entamoeba invadens
EVYSGISLRVIFPAFGGDAKTIQQLSGG

SEQ ID NO: 2995342 - protein, 18 aa, Entamoeba invadens
EVYSRFKKLQNIRFIGGI

SEQ ID NO: 2995343 - protein, 27 aa, Entamoeba invadens
EVYSTFTFKLFQKGIFYRQFTMSEENT

SEQ ID NO: 2995344 - protein, 19 aa, Entamoeba invadens
EVYVDYLEFIPDIDKNTLT

SEQ ID NO: 2995345 - protein, 28 aa, Entamoeba invadens
EWADLTTMYIMLKYRKWQLKERRTVSLH

SEQ ID NO: 2995346 - protein, 23 aa, Entamoeba invadens
EWDKPFHILPNKMEFEGAGEVTA

SEQ ID NO: 2995347 - protein, 21 aa, Entamoeba invadens
EWEAKMKAWDFEKAGDLLKDQ

SEQ ID NO: 2995348 - protein, 27 aa, Entamoeba invadens
EWEKYSQFLFTEQIFKLVFSVIVEPSC

SEQ ID NO: 2995349 - protein, 25 aa, Entamoeba invadens
EWEQLIIDRNDLLQTLLCGAEAQES

SEQ ID NO: 2995350 - protein, 18 aa, Entamoeba invadens
EWFNYFNSLPRVKEVANR

SEQ ID NO: 2995351 - protein, 29 aa, Entamoeba invadens
EWINKYVLKINEIILRNIIATRDEWIKKD

SEQ ID NO: 2995352 - protein, 19 aa, Entamoeba invadens
EWKILFYETSAKNKTNITE

SEQ ID NO: 2995353 - protein, 17 aa, Entamoeba invadens
EWKKRKRITKEAAEAVL

SEQ ID NO: 2995354 - protein, 24 aa, Entamoeba invadens
EWKRLACEVVNIPTGSFFSKTRNG

SEQ ID NO: 2995355 - protein, 17 aa, Entamoeba invadens
EWLTLQNPVPQTGNDSF

SEQ ID NO: 2995356 - protein, 19 aa, Entamoeba invadens
EWNDNVMIPQLVSLKSHNP

SEQ ID NO: 2995357 - protein, 21 aa, Entamoeba invadens
EWSTLFSPINSLQMEMCERVF

SEQ ID NO: 2995358 - protein, 22 aa, Entamoeba invadens
EWTAIIPMMYKDEFMTLQHLLL

SEQ ID NO: 2995359 - protein, 20 aa, Entamoeba invadens
EYADYLTPFIRDNSLTFQTK

SEQ ID NO: 2995360 - protein, 28 aa, Entamoeba invadens
EYAEKLLQSCLPLQKPLLDQVVEQLHKA

SEQ ID NO: 2995361 - protein, 40 aa, Entamoeba invadens
EYAFGTYSFSFMFTLPPSFPPSLIVPNKPFKSTYSLHPIV

SEQ ID NO: 2995362 - protein, 26 aa, Entamoeba invadens
EYAFRIREFLGEQICVVPVAFPGRRS

SEQ ID NO: 2995363 - protein, 24 aa, Entamoeba invadens
EYAFRIREFLGEQVCVVFVAFPER

SEQ ID NO: 2995364 - protein, 25 aa, Entamoeba invadens
EYAFRIREFLGEQVCVVPVAFPGRR

SEQ ID NO: 2995365 - protein, 29 aa, Entamoeba invadens
EYAKYDSVWMRRYWFIFSQDQAVKGKIDK

SEQ ID NO: 2995366 - protein, 26 aa, Entamoeba invadens
EYANCFTFICRSLGYYARLVLDTTDH

SEQ ID NO: 2995367 - protein, 23 aa, Entamoeba invadens
EYCPNTLVEILQKGYPNPLPESA

SEQ ID NO: 2995368 - protein, 33 aa, Entamoeba invadens
EYCSRFVIYQRSVPLLNFLIEILEEKYPLEVYL

SEQ ID NO: 2995369 - protein, 17 aa, Entamoeba invadens
EYCTQYMITANKLNDLV

SEQ ID NO: 2995370 - protein, 30 aa, Entamoeba invadens
EYDDWMSTLPILMKVYGTYKYPLACAVSKS

SEQ ID NO: 2995371 - protein, 25 aa, Entamoeba invadens
EYDEILLCTLLRKLVKTELCSTHNF

SEQ ID NO: 2995372 - protein, 26 aa, Entamoeba invadens
EYDEKFTFMFQIVDGVGAWNAKDGKL

SEQ ID NO: 2995373 - protein, 17 aa, Entamoeba invadens
EYDFLMTSVLGLSGDEL

SEQ ID NO: 2995374 - protein, 31 aa, Entamoeba invadens
EYDFRQYAAKIIIWICDAPPHGFNIQYDGFP

SEQ ID NO: 2995375 - protein, 27 aa, Entamoeba invadens
EYDKLRPMSYPNTNILIICFSIDSRSS

SEQ ID NO: 2995376 - protein, 19 aa, Entamoeba invadens
EYDLYKKYHFLRMMSENFT

SEQ ID NO: 2995377 - protein, 35 aa, Entamoeba invadens
EYDMKIMQMLAYLLAPLHISLIREALFDPKPNTIR

SEQ ID NO: 2995378 - protein, 25 aa, Entamoeba invadens
EYDQLRPLSYSSASIFLICFSVTSS

SEQ ID NO: 2995379 - protein, 26 aa, Entamoeba invadens
EYDRLRPLSYPGTSVFLLCFSVISPA

SEQ ID NO: 2995380 - protein, 30 aa, Entamoeba invadens
EYDRLRPMSYPDTNILIICFAIDSRSSFSN

SEQ ID NO: 2995381 - protein, 26 aa, Entamoeba invadens
EYDRQRMEKELALAKACMKKGDKTGA

SEQ ID NO: 2995382 - protein, 22 aa, Entamoeba invadens
EYDVLLSLDFFNKSTSDNKMRY

SEQ ID NO: 2995383 - protein, 23 aa, Entamoeba invadens
EYDVLYPEPFIDVYPTKQILSIQ

SEQ ID NO: 2995384 - protein, 23 aa, Entamoeba invadens
EYERGIFTMCYAVGNIDLGEGIT

SEQ ID NO: 2995385 - protein, 22 aa, Entamoeba invadens
EYFFPLCILLMSYTDGRNFAWS

SEQ ID NO: 2995386 - protein, 19 aa, Entamoeba invadens
EYFIEVIVQLYYLRHNLLA

SEQ ID NO: 2995387 - protein, 25 aa, Entamoeba invadens
EYFNYKKWFFQTIGVMMRKFDSTKQ

SEQ ID NO: 2995388 - protein, 17 aa, Entamoeba invadens
EYFPNITTLNLWNKDEE

SEQ ID NO: 2995389 - protein, 25 aa, Entamoeba invadens
EYFRTNDPLVILEKMCLFDVSNKCS

SEQ ID NO: 2995390 - protein, 33 aa, Entamoeba invadens
EYIALREQYYLKGDGFVLVYSIENKASFLAIGN

SEQ ID NO: 2995391 - protein, 17 aa, Entamoeba invadens
EYIASYKSNFIAALCGG

SEQ ID NO: 2995392 - protein, 32 aa, Entamoeba invadens
EYIEFLQRVTPSKALLPYFRRSLEEFNFTVDD

SEQ ID NO: 2995393 - protein, 23 aa, Entamoeba invadens
EYIKMDLYKLVHSPSLPSEYAKR

SEQ ID NO: 2995394 - protein, 21 aa, Entamoeba invadens
EYIKRVFHFFVNTLKRMQQEN

SEQ ID NO: 2995395 - protein, 25 aa, Entamoeba invadens
EYISFLHSSFLQCVKPYDISTLLRD

SEQ ID NO: 2995396 - protein, 27 aa, Entamoeba invadens
EYITDENAFVFLLRDNGKEKMKKFCIK

SEQ ID NO: 2995397 - protein, 23 aa, Entamoeba invadens
EYIYQQIVPLLDSLMIDPFGNYL

SEQ ID NO: 2995398 - protein, 18 aa, Entamoeba invadens
EYKDFFTWDRSIVANFVG

SEQ ID NO: 2995399 - protein, 23 aa, Entamoeba invadens
EYKDLWKRQVSEVYWQEIVRKMN

SEQ ID NO: 2995400 - protein, 24 aa, Entamoeba invadens
EYKELQKIGIPDFRKKEDLDETLD

SEQ ID NO: 2995401 - protein, 23 aa, Entamoeba invadens
EYKKLLVLRHAKFTLKQNKKIGK

SEQ ID NO: 2995402 - protein, 25 aa, Entamoeba invadens
EYKLKACVCEKLQWTSKIRASHFGP

SEQ ID NO: 2995403 - protein, 24 aa, Entamoeba invadens
EYKQLVDHPKWTKVILQIGDNKIR

SEQ ID NO: 2995404 - protein, 26 aa, Entamoeba invadens
EYKVSLISIEPLLEVAPQIAQKIQKK

SEQ ID NO: 2995405 - protein, 24 aa, Entamoeba invadens
EYLDGFTISGLPKLKKGKVKFRVT

SEQ ID NO: 2995406 - protein, 21 aa, Entamoeba invadens
EYLFGVVVTKPVQIYGDCVAD

SEQ ID NO: 2995407 - protein, 17 aa, Entamoeba invadens
EYLFWEAETYNTFDGEK

SEQ ID NO: 2995408 - protein, 25 aa, Entamoeba invadens
EYLGTVFLVSYLYTEGTVIADLVLQ

SEQ ID NO: 2995409 - protein, 26 aa, Entamoeba invadens
EYLGTVYLVSYLYTEKTVIPDLVLQC

SEQ ID NO: 2995410 - protein, 18 aa, Entamoeba invadens
EYLKTGLPLKQVCEKIAD

SEQ ID NO: 2995411 - protein, 32 aa, Entamoeba invadens
EYLKVQTPLFFLDYFTIFTSLYQVGSTYLPNT

SEQ ID NO: 2995412 - protein, 18 aa, Entamoeba invadens
EYLLLHEFMKRRSEFVIP

SEQ ID NO: 2995413 - protein, 19 aa, Entamoeba invadens
EYLPPTLKGHYLELTLRKL

SEQ ID NO: 2995414 - protein, 27 aa, Entamoeba invadens
EYLRELPNPLIPFNFYNDFVVIGRLGG

SEQ ID NO: 2995415 - protein, 39 aa, Entamoeba invadens
EYLRGFSLFALKQWFESKKLVLIMYALHVLDYILDSRNH

SEQ ID NO: 2995416 - protein, 24 aa, Entamoeba invadens
EYLTEFALQYKLPYYIKGDQQRHY

SEQ ID NO: 2995417 - protein, 18 aa, Entamoeba invadens
EYLYFHCSSYQKGVGNIR

SEQ ID NO: 2995418 - protein, 27 aa, Entamoeba invadens
EYMLLANVWVAKKIYDAFPQCALLRRH

SEQ ID NO: 2995419 - protein, 20 aa, Entamoeba invadens
EYMQNLGFGFQIIDNLKVTV

SEQ ID NO: 2995420 - protein, 28 aa, Entamoeba invadens
EYMQQGQYPMQYWPYMYMQGNQGKQKAT

SEQ ID NO: 2995421 - protein, 24 aa, Entamoeba invadens
EYNEEEVWRYIKGLKFPSGKEMVY

SEQ ID NO: 2995422 - protein, 24 aa, Entamoeba invadens
EYNILIELLMILHGFIETYYKSSP

SEQ ID NO: 2995423 - protein, 25 aa, Entamoeba invadens
EYNITRGYMWIGLNQMYLVKRLRKY

SEQ ID NO: 2995424 - protein, 24 aa, Entamoeba invadens
EYNKIFDFSYGFIETLKLSNLKNC

SEQ ID NO: 2995425 - protein, 23 aa, Entamoeba invadens
EYNPTSCRLPLDASHQSKGFGFL

SEQ ID NO: 2995426 - protein, 25 aa, Entamoeba invadens
EYNQMYFKDYSTKFVILVIDRSSQE

SEQ ID NO: 2995427 - protein, 24 aa, Entamoeba invadens
EYNYPNLLEVFKAASLPLAQNYLQ

SEQ ID NO: 2995428 - protein, 18 aa, Entamoeba invadens
EYPISTLCGLLKSFLMEM

SEQ ID NO: 2995429 - protein, 28 aa, Entamoeba invadens
EYQKGHCLSCQRGFALNLSNPPVCTECG

SEQ ID NO: 2995430 - protein, 18 aa, Entamoeba invadens
EYQKLRLIVGEYITVMSP

SEQ ID NO: 2995431 - protein, 20 aa, Entamoeba invadens
EYQLYYEKLSAVYDSIKDCT

SEQ ID NO: 2995432 - protein, 27 aa, Entamoeba invadens
EYQVTSLPAFVFFQDQKVAKKAPGSPD

SEQ ID NO: 2995433 - protein, 29 aa, Entamoeba invadens
EYREISFTPVFHLILRLLNPTTNEVACVE

SEQ ID NO: 2995434 - protein, 25 aa, Entamoeba invadens
EYRLNSCSFYFEPKMLTKDFINMVI

SEQ ID NO: 2995435 - protein, 17 aa, Entamoeba invadens
EYRLTSTVILYLETNTE

SEQ ID NO: 2995436 - protein, 17 aa, Entamoeba invadens
EYRMAVVNFPERKFKLI

SEQ ID NO: 2995437 - protein, 29 aa, Entamoeba invadens
EYRRRPKDLVLLAWYYAPNLVVGYYNRFT

SEQ ID NO: 2995438 - protein, 17 aa, Entamoeba invadens
EYRWAATVLNHLVFADV

SEQ ID NO: 2995439 - protein, 19 aa, Entamoeba invadens
EYRYVVMNNLFPNTQFPLQ

SEQ ID NO: 2995440 - protein, 26 aa, Entamoeba invadens
EYSDGDFVYIDFLDLFLKDFETTEVV

SEQ ID NO: 2995441 - protein, 29 aa, Entamoeba invadens
EYSDRAPLYDWVVDIFGMRKPIIEVFSRM

SEQ ID NO: 2995442 - protein, 27 aa, Entamoeba invadens
EYSGGWRMRIALATALYLQPDLLILDE

SEQ ID NO: 2995443 - protein, 22 aa, Entamoeba invadens
EYSIRDVVFYMFERDSTRFLMC

SEQ ID NO: 2995444 - protein, 26 aa, Entamoeba invadens
EYSITSLPTFVFFQNQKVVKKAPGSS

SEQ ID NO: 2995445 - protein, 17 aa, Entamoeba invadens
EYSLTPSVAIIDPMFCV

SEQ ID NO: 2995446 - protein, 18 aa, Entamoeba invadens
EYSNFKKLFVNCLVENFE

SEQ ID NO: 2995447 - protein, 19 aa, Entamoeba invadens
EYSPRTLMSILSPRKSRSK

SEQ ID NO: 2995448 - protein, 21 aa, Entamoeba invadens
EYSPYIWTAAFDGSISQWYYD

SEQ ID NO: 2995449 - protein, 25 aa, Entamoeba invadens
EYSRPVYTPIFKNKGGAISPPQLDR

SEQ ID NO: 2995450 - protein, 27 aa, Entamoeba invadens
EYSRSHFYPHLFTLILRHVHSLPTTLQ

SEQ ID NO: 2995451 - protein, 18 aa, Entamoeba invadens
EYSYCLPILAITFGNGHP

SEQ ID NO: 2995452 - protein, 47 aa, Entamoeba invadens
EYTDPMRFLFLLELAHWYYMDNWIKRLPYLPMIVDFKVFVVTFVKEV

SEQ ID NO: 2995453 - protein, 25 aa, Entamoeba invadens
EYTKIQCISFVKPDITPLHAFSSGE

SEQ ID NO: 2995454 - protein, 22 aa, Entamoeba invadens
EYTPFLRTYSFGYPKTIVTSYQ

SEQ ID NO: 2995455 - protein, 18 aa, Entamoeba invadens
EYVIVPYERRLQTLIHYL

SEQ ID NO: 2995456 - protein, 19 aa, Entamoeba invadens
EYVKVFILQYLRPMKKVDS

SEQ ID NO: 2995457 - protein, 19 aa, Entamoeba invadens
EYVKYFYPLEVHGAIADID

SEQ ID NO: 2995458 - protein, 17 aa, Entamoeba invadens
EYVLLFQCNTRAELDVI

SEQ ID NO: 2995459 - protein, 22 aa, Entamoeba invadens
EYVPGLLKQLTVGYLDLIARCK

SEQ ID NO: 2995460 - protein, 23 aa, Entamoeba invadens
EYVSHFCKFITRLAMLKDDAVKT

SEQ ID NO: 2995461 - protein, 18 aa, Entamoeba invadens
EYVTMMEYGLSFVIACNS

SEQ ID NO: 2995462 - protein, 32 aa, Entamoeba invadens
EYVTTSLLRMLSSFVLKLNTFFVDSKKTRDLQ

SEQ ID NO: 2995463 - protein, 22 aa, Entamoeba invadens
EYVVHFYGAVFARKKCLRLKFC

SEQ ID NO: 2995464 - protein, 20 aa, Entamoeba invadens
EYVVHFYGAVFARKKCLRVK

SEQ ID NO: 2995465 - protein, 28 aa, Entamoeba invadens
EYVYFRQLLEFFEIYIKAIKCVNKYIDF

SEQ ID NO: 2995466 - protein, 22 aa, Entamoeba invadens
EYVYILRYSTPYPHNIFIVTSQ

SEQ ID NO: 2995467 - protein, 17 aa, Entamoeba invadens
EYWAMRAMGILRKHKLC

SEQ ID NO: 2995468 - protein, 17 aa, Entamoeba invadens
EYYIKYIDTYITMSGDQ

SEQ ID NO: 2995469 - protein, 28 aa, Entamoeba invadens
EYYIKYIDTYIWMKGEQRKIYNKMTSSA

SEQ ID NO: 2995470 - protein, 21 aa, Entamoeba invadens
EYYREFVCGTYTPVPSEEITI

SEQ ID NO: 2995471 - protein, 27 aa, Entamoeba invadens
EYYRNPEILAFIRKLNVRYLAIGEKEL

SEQ ID NO: 2995472 - protein, 17 aa, Entamoeba invadens
EYYVLPDGNALKLGDER

SEQ ID NO: 2995473 - protein, 33 aa, Entamoeba invadens
FAACKKLEQATLPKYLTKLPSRLFEGCSLLTKI

SEQ ID NO: 2995474 - protein, 24 aa, Entamoeba invadens
FAARCLYWYNFGFSEVGDIKPSDV

SEQ ID NO: 2995475 - protein, 25 aa, Entamoeba invadens
FADDVTDCVAYAHLLHNCDKRCTLD

SEQ ID NO: 2995476 - protein, 19 aa, Entamoeba invadens
FADFAISVAVIHHFSSEER

SEQ ID NO: 2995477 - protein, 37 aa, Entamoeba invadens
FADKHHCFITFYTRTTAMEAFRFFATTETAKGVYYKV

SEQ ID NO: 2995478 - protein, 17 aa, Entamoeba invadens
FADLLIELLKRDEDEEK

SEQ ID NO: 2995479 - protein, 24 aa, Entamoeba invadens
FADRSKMPLLYKKLGEAQLDEFKV

SEQ ID NO: 2995480 - protein, 18 aa, Entamoeba invadens
FADYLHLVIPVFADLVSE

SEQ ID NO: 2995481 - protein, 21 aa, Entamoeba invadens
FAEAFQMVPRVLAENSGLDAT

SEQ ID NO: 2995482 - protein, 18 aa, Entamoeba invadens
FAECQSLRVLELPEDLTE

SEQ ID NO: 2995483 - protein, 17 aa, Entamoeba invadens
FAECYSLKNVFLIGATE

SEQ ID NO: 2995484 - protein, 25 aa, Entamoeba invadens
FAEDLHLTYFWGQTKEPLYHQSTSQ

SEQ ID NO: 2995485 - protein, 25 aa, Entamoeba invadens
FAEIASIDFLKFSFNSRSYEQQLKD

SEQ ID NO: 2995486 - protein, 17 aa, Entamoeba invadens
FAELFDYRIVVKRGNMK

SEQ ID NO: 2995487 - protein, 18 aa, Entamoeba invadens
FAELKKKEKYVVRVSFLQ

SEQ ID NO: 2995488 - protein, 25 aa, Entamoeba invadens
FAETLHLLMDLLQEFGYLFEVVSTK

SEQ ID NO: 2995489 - protein, 21 aa, Entamoeba invadens
FAETLILDKIGVFSPLRCDTT

SEQ ID NO: 2995490 - protein, 33 aa, Entamoeba invadens
FAEWGELEYIRVLPVRNIAFVRYRMRGAAEFAK

SEQ ID NO: 2995491 - protein, 20 aa, Entamoeba invadens
FAFAYCEKLFRVVIPQTVKT

SEQ ID NO: 2995492 - protein, 27 aa, Entamoeba invadens
FAFDLRTRLWGEHLGLLEYSFGMIEDP

SEQ ID NO: 2995493 - protein, 31 aa, Entamoeba invadens
FAFEKMKEDKIVLENELNFAKDKAHKIAKEL

SEQ ID NO: 2995494 - protein, 18 aa, Entamoeba invadens
FAFLYSDFGKEKKTLADG

SEQ ID NO: 2995495 - protein, 28 aa, Entamoeba invadens
FAFPSRRFHLFIASTILIMNAKSAKMMT

SEQ ID NO: 2995496 - protein, 21 aa, Entamoeba invadens
FAGALDPLVRLGLPDSDNIFA

SEQ ID NO: 2995497 - protein, 19 aa, Entamoeba invadens
FAGCFDSESVIFKNSFRSS

SEQ ID NO: 2995498 - protein, 26 aa, Entamoeba invadens
FAHAQIPQFVPYIPKVLQFVGSMLQR

SEQ ID NO: 2995499 - protein, 17 aa, Entamoeba invadens
FAHFVNDTFSKFFVKIK

SEQ ID NO: 2995500 - protein, 23 aa, Entamoeba invadens
FAHLVRPPIVLLSDKQLKRSMNS

SEQ ID NO: 2995501 - protein, 19 aa, Entamoeba invadens
FAHQLTLYEFEMFKAIEAK

SEQ ID NO: 2995502 - protein, 20 aa, Entamoeba invadens
FAHTFEYIASYKSNFIAALC

SEQ ID NO: 2995503 - protein, 17 aa, Entamoeba invadens
FAILTNCLAFDPSKRPS

SEQ ID NO: 2995504 - protein, 18 aa, Entamoeba invadens
FAIQLRQKKPNYVPLVVD

SEQ ID NO: 2995505 - protein, 17 aa, Entamoeba invadens
FAITMYECFGWSYAFSK

SEQ ID NO: 2995506 - protein, 20 aa, Entamoeba invadens
FAITSSWDQSLRLWDLEKFE

SEQ ID NO: 2995507 - protein, 18 aa, Entamoeba invadens
FAIYNLKELTLSGVKMKV

SEQ ID NO: 2995508 - protein, 31 aa, Entamoeba invadens
FAKDKFTNTLPPQWRFWESMTQDFCATSKEA

SEQ ID NO: 2995509 - protein, 17 aa, Entamoeba invadens
FAKQEGMKFFETSAKHA

SEQ ID NO: 2995510 - protein, 27 aa, Entamoeba invadens
FAKYISNFFHPLFEATLHTEKYKELSL

SEQ ID NO: 2995511 - protein, 18 aa, Entamoeba invadens
FALEFQFVYNFDQTAHLG

SEQ ID NO: 2995512 - protein, 26 aa, Entamoeba invadens
FALGCMMYEFVVGYPPFNASTPEAIF

SEQ ID NO: 2995513 - protein, 18 aa, Entamoeba invadens
FALKNVLGVNKKIADPEY

SEQ ID NO: 2995514 - protein, 18 aa, Entamoeba invadens
FALLLKKEKQGNIAWTKE

SEQ ID NO: 2995515 - protein, 25 aa, Entamoeba invadens
FALNLKVLVIYLTLTLNGGVVTINS

SEQ ID NO: 2995516 - protein, 21 aa, Entamoeba invadens
FALNLSNPPVCTECGCRECNK

SEQ ID NO: 2995517 - protein, 27 aa, Entamoeba invadens
FAMERQGIIPIPLYGTFGLDALDFIIK

SEQ ID NO: 2995518 - protein, 25 aa, Entamoeba invadens
FAMTMYEIFIWGEAFPREMFRYPWE

SEQ ID NO: 2995519 - protein, 26 aa, Entamoeba invadens
FANNKMKIVLPLPKLIAAKEVKKEEE

SEQ ID NO: 2995520 - protein, 27 aa, Entamoeba invadens
FANNVLLTTIVLPPSLYQLGNFCFSFC

SEQ ID NO: 2995521 - protein, 18 aa, Entamoeba invadens
FANYVIQKALEFVPESRH

SEQ ID NO: 2995522 - protein, 33 aa, Entamoeba invadens
FAPDIPYQPFANPGLFKWKYMTHWTIDYGIKEY

SEQ ID NO: 2995523 - protein, 24 aa, Entamoeba invadens
FAPHLFRCYNKEKVPPFVHFLKIF

SEQ ID NO: 2995524 - protein, 17 aa, Entamoeba invadens
FAPVFTMGKYYTQGDKV

SEQ ID NO: 2995525 - protein, 32 aa, Entamoeba invadens
FAQCSSLKYITIPPLVYSLPSHCFLYCTSLSS

SEQ ID NO: 2995526 - protein, 22 aa, Entamoeba invadens
FAQIDKLDALIQNYLGSIHKDN

SEQ ID NO: 2995527 - protein, 24 aa, Entamoeba invadens
FAQIKGYLFQFLVGINYLHKTGIV

SEQ ID NO: 2995528 - protein, 33 aa, Entamoeba invadens
FAQQKRMKKIKEVLFEEIGFMKAAFSQGKKDEK

SEQ ID NO: 2995529 - protein, 23 aa, Entamoeba invadens
FARKFQVVVFLENEKVIFKTGDL

SEQ ID NO: 2995530 - protein, 19 aa, Entamoeba invadens
FARRLCEMALKSPLESDDV

SEQ ID NO: 2995531 - protein, 33 aa, Entamoeba invadens
FASEKSKWVVPLPLYRFIPYLEEKNFYVTNNLL

SEQ ID NO: 2995532 - protein, 18 aa, Entamoeba invadens
FASFFALFGEDMSVTQQK

SEQ ID NO: 2995533 - protein, 17 aa, Entamoeba invadens
FASLNFAKPKQTETAQQ

SEQ ID NO: 2995534 - protein, 24 aa, Entamoeba invadens
FASRAFMKNLFANVLRCLINLGDF

SEQ ID NO: 2995535 - protein, 19 aa, Entamoeba invadens
FASSMIFYSGKYKAYCIKE

SEQ ID NO: 2995536 - protein, 21 aa, Entamoeba invadens
FASSMIFYSGKYKAYCIKKEV

SEQ ID NO: 2995537 - protein, 17 aa, Entamoeba invadens
FASSSQLKVLLPTKLPK

SEQ ID NO: 2995538 - protein, 33 aa, Entamoeba invadens
FATKLVDSVSLLPLHFHQLLRFISVEVGNKKSK

SEQ ID NO: 2995539 - protein, 25 aa, Entamoeba invadens
FATNSTLIPILLGKGDVVFSDELNH

SEQ ID NO: 2995540 - protein, 20 aa, Entamoeba invadens
FATTKLFAIIQKSPGAVKRA

SEQ ID NO: 2995541 - protein, 26 aa, Entamoeba invadens
FATTTYYYKFFIPELKNTTPQMFKTI

SEQ ID NO: 2995542 - protein, 17 aa, Entamoeba invadens
FAVCLPLMRLEGVKLYD

SEQ ID NO: 2995543 - protein, 17 aa, Entamoeba invadens
FAVICYMATIEASLPFL

SEQ ID NO: 2995544 - protein, 21 aa, Entamoeba invadens
FAVIYNYLIKLCSQIGQRVVF

SEQ ID NO: 2995545 - protein, 37 aa, Entamoeba invadens
FAVKLPLDYRLSKLVFFGLYFGIFTECAKAAALFGTA

SEQ ID NO: 2995546 - protein, 24 aa, Entamoeba invadens
FAVLNGCCITLFSAPFYCGTVTNS

SEQ ID NO: 2995547 - protein, 27 aa, Entamoeba invadens
FAYDSYRRFVSLFGRIALGVEDAVYDK

SEQ ID NO: 2995548 - protein, 18 aa, Entamoeba invadens
FCAFFFPDTVNCNSLAVS

SEQ ID NO: 2995549 - protein, 24 aa, Entamoeba invadens
FCALNMKYIVYNKKEIKVVLWDVV

SEQ ID NO: 2995550 - protein, 26 aa, Entamoeba invadens
FCALTPLQKMIYQRLIDYYNTTRDEA

SEQ ID NO: 2995551 - protein, 27 aa, Entamoeba invadens
FCCFLECYSLVTLKLPQSLLKIKENAF

SEQ ID NO: 2995552 - protein, 30 aa, Entamoeba invadens
FCDATSYTLFTLKFPRKLFVLTNSIITKNN

SEQ ID NO: 2995553 - protein, 18 aa, Entamoeba invadens
FCDFLEAPKKLKSWEFDD

SEQ ID NO: 2995554 - protein, 24 aa, Entamoeba invadens
FCDGFVIIRTPWGNSLSFKLNELT

SEQ ID NO: 2995555 - protein, 28 aa, Entamoeba invadens
FCDLEDMKWTFVTRLLGFRAVGTNYDNI

SEQ ID NO: 2995556 - protein, 19 aa, Entamoeba invadens
FCDLVTKMLAMDPAKRITP

SEQ ID NO: 2995557 - protein, 27 aa, Entamoeba invadens
FCDNTIPNKCLLCAQNYFTKNELCESC

SEQ ID NO: 2995558 - protein, 17 aa, Entamoeba invadens
FCDSIGFLSANFYAKNL

SEQ ID NO: 2995559 - protein, 18 aa, Entamoeba invadens
FCEAFKEVLRRDDSLELR

SEQ ID NO: 2995560 - protein, 30 aa, Entamoeba invadens
FCEAKNIVKIALPLGIKKLPFKAFYNVTSL

SEQ ID NO: 2995561 - protein, 25 aa, Entamoeba invadens
FCEDTTEPYFRAPASFLPIRERREE

SEQ ID NO: 2995562 - protein, 19 aa, Entamoeba invadens
FCEIFSQPFSLHKFSSKIF

SEQ ID NO: 2995563 - protein, 20 aa, Entamoeba invadens
FCEKAGISFGPFIQTLQKKR

SEQ ID NO: 2995564 - protein, 34 aa, Entamoeba invadens
FCELEVEPQLFLLRWVRILFCQVFNTTDLYYIWD

SEQ ID NO: 2995565 - protein, 27 aa, Entamoeba invadens
FCEMGRLYSEFYMSPFIKALVSEDLGR

SEQ ID NO: 2995566 - protein, 17 aa, Entamoeba invadens
FCESVSVALLQLSKEVD

SEQ ID NO: 2995567 - protein, 19 aa, Entamoeba invadens
FCFDLCLSLKTVEIPNCIS

SEQ ID NO: 2995568 - protein, 19 aa, Entamoeba invadens
FCFHTYKDLYESTIGIEIC

SEQ ID NO: 2995569 - protein, 17 aa, Entamoeba invadens
FCFKCREMWHKDFTCEQ

SEQ ID NO: 2995570 - protein, 31 aa, Entamoeba invadens
FCFSYRNFDTLLCILLLFGTSAIHRLKRTFD

SEQ ID NO: 2995571 - protein, 27 aa, Entamoeba invadens
FCGCEKLQIFLFPTQLHKIENNCFSHC

SEQ ID NO: 2995572 - protein, 18 aa, Entamoeba invadens
FCGDDPLKLIQFKNLQKA

SEQ ID NO: 2995573 - protein, 23 aa, Entamoeba invadens
FCGGSLGLLAVRQSELLVVLSNE

SEQ ID NO: 2995574 - protein, 18 aa, Entamoeba invadens
FCGRYVNLGAYLIIKNGD

SEQ ID NO: 2995575 - protein, 18 aa, Entamoeba invadens
FCHEVVALQFLKSTNCFK

SEQ ID NO: 2995576 - protein, 17 aa, Entamoeba invadens
FCHLEELTIWSVTGLSL

SEQ ID NO: 2995577 - protein, 19 aa, Entamoeba invadens
FCHRNKLCLSFARLVAHIK

SEQ ID NO: 2995578 - protein, 34 aa, Entamoeba invadens
FCHWNHYVRMFFCELLLYRSTMSPSWNRVKTNTL

SEQ ID NO: 2995579 - protein, 19 aa, Entamoeba invadens
FCIIIPGKSFRLRAENEND

SEQ ID NO: 2995580 - protein, 17 aa, Entamoeba invadens
FCKVSVLNIQRPIENGK

SEQ ID NO: 2995581 - protein, 22 aa, Entamoeba invadens
FCLQHHCWILKSGEKDHSSYFK

SEQ ID NO: 2995582 - protein, 18 aa, Entamoeba invadens
FCLRLLLLHVKGARSYKE

SEQ ID NO: 2995583 - protein, 19 aa, Entamoeba invadens
FCMLRLSHYLASCRLIGKN

SEQ ID NO: 2995584 - protein, 19 aa, Entamoeba invadens
FCMVFELLSFNLYDLLMKK

SEQ ID NO: 2995585 - protein, 20 aa, Entamoeba invadens
FCNFIHVLEPNHALKRKLLE

SEQ ID NO: 2995586 - protein, 19 aa, Entamoeba invadens
FCNQLDIVMEYIDGVTLKR

SEQ ID NO: 2995587 - protein, 18 aa, Entamoeba invadens
FCNQPPLTYVRQIISMVE

SEQ ID NO: 2995588 - protein, 35 aa, Entamoeba invadens
FCPGTYQFPFNFTLPPTFPPTLIIPGKPYQTTYTL

SEQ ID NO: 2995589 - protein, 25 aa, Entamoeba invadens
FCPKCGYHDLRRISYYVLSDGKIKE

SEQ ID NO: 2995590 - protein, 17 aa, Entamoeba invadens
FCQSRPLTKTLTSELKI

SEQ ID NO: 2995591 - protein, 29 aa, Entamoeba invadens
FCQVHSKYFQYYFFSQPTLMVRMSISETP

SEQ ID NO: 2995592 - protein, 27 aa, Entamoeba invadens
FCRTNVLSVFILPINATKKFSICELCG

SEQ ID NO: 2995593 - protein, 26 aa, Entamoeba invadens
FCSECLEVLLNTQGVHYCPICRSKIS

SEQ ID NO: 2995594 - protein, 24 aa, Entamoeba invadens
FCSLRLAHYLAQYGSTLLGTVRKN

SEQ ID NO: 2995595 - protein, 22 aa, Entamoeba invadens
FCSTCSIGFVYREPKSKECELC

SEQ ID NO: 2995596 - protein, 19 aa, Entamoeba invadens
FCSVTDPLLASKFKATYKA

SEQ ID NO: 2995597 - protein, 27 aa, Entamoeba invadens
FCTENLLRKFVVKGLNKWIQTGKCSFP

SEQ ID NO: 2995598 - protein, 17 aa, Entamoeba invadens
FCTLKLSHYLAAFGCQL

SEQ ID NO: 2995599 - protein, 20 aa, Entamoeba invadens
FCTMCSDGFYLSQESRRCLS

SEQ ID NO: 2995600 - protein, 24 aa, Entamoeba invadens
FCTTNKLKYFPLSSLKHDGFDDCL

SEQ ID NO: 2995601 - protein, 27 aa, Entamoeba invadens
FCVNDVPFDYVEFLFMPVQNQMEALKN

SEQ ID NO: 2995602 - protein, 18 aa, Entamoeba invadens
FCVRAYRMYIIKDDKTPL

SEQ ID NO: 2995603 - protein, 18 aa, Entamoeba invadens
FCYEQAILVLLVNKEYGV

SEQ ID NO: 2995604 - protein, 27 aa, Entamoeba invadens
FDAEKLHLKGYIPLAFGTITRSPEMKK

SEQ ID NO: 2995605 - protein, 18 aa, Entamoeba invadens
FDAPIHLYLLVNKIIQNE

SEQ ID NO: 2995606 - protein, 21 aa, Entamoeba invadens
FDCDMPLSASLLRSKKEMKGE

SEQ ID NO: 2995607 - protein, 20 aa, Entamoeba invadens
FDCLPLCAIIHSDLGNFFCV

SEQ ID NO: 2995608 - protein, 22 aa, Entamoeba invadens
FDCPEIFKKALLKRFNQKFTRK

SEQ ID NO: 2995609 - protein, 28 aa, Entamoeba invadens
FDCVLPFCKLLNIPFAALVQLHEFGNLR

SEQ ID NO: 2995610 - protein, 27 aa, Entamoeba invadens
FDDEDFFSKIFWYQVDYQTYKIFMKAN

SEQ ID NO: 2995611 - protein, 38 aa, Entamoeba invadens
FDDFYQRLVWAHQVFWSRAFLVIYPDPIGDVASLIPFA

SEQ ID NO: 2995612 - protein, 26 aa, Entamoeba invadens
FDDIKDTIFGILKHATVQLKNFGKVI

SEQ ID NO: 2995613 - protein, 25 aa, Entamoeba invadens
FDDISFFERIIWYSISYSHVIQTLD

SEQ ID NO: 2995614 - protein, 28 aa, Entamoeba invadens
FDDKFEFPAFGVNLLIDPQIKEGYKFVG

SEQ ID NO: 2995615 - protein, 17 aa, Entamoeba invadens
FDDLNKIIKLSLDDTIV

SEQ ID NO: 2995616 - protein, 18 aa, Entamoeba invadens
FDDLPYLQKVEIFDAVLK

SEQ ID NO: 2995617 - protein, 27 aa, Entamoeba invadens
FDDLSTTFPYPPYPQQVQMLSAIQKAI

SEQ ID NO: 2995618 - protein, 24 aa, Entamoeba invadens
FDDNHYIFVLLRNGKDTQPKMFTP

SEQ ID NO: 2995619 - protein, 25 aa, Entamoeba invadens
FDDSLSSYAIFYCIDSGIGESRFVS

SEQ ID NO: 2995620 - protein, 19 aa, Entamoeba invadens
FDDYFTPEQSDLVYERSEF

SEQ ID NO: 2995621 - protein, 22 aa, Entamoeba invadens
FDDYQTVRLYYLVSTKPEKTIS

SEQ ID NO: 2995622 - protein, 27 aa, Entamoeba invadens
FDEDEQLWYWSYNGTKLYMYINTPIRF

SEQ ID NO: 2995623 - protein, 27 aa, Entamoeba invadens
FDEDLNTYALLYLLNEITTKFGFKVVT

SEQ ID NO: 2995624 - protein, 20 aa, Entamoeba invadens
FDEFDAFIGMLLFNGVAHDN

SEQ ID NO: 2995625 - protein, 23 aa, Entamoeba invadens
FDEFVDYLKSMLTLINDVIQMYG

SEQ ID NO: 2995626 - protein, 25 aa, Entamoeba invadens
FDEKKKWLPLFSTIEGICVTESCSN

SEQ ID NO: 2995627 - protein, 25 aa, Entamoeba invadens
FDEKKLGWFEGFKIKGEVLDKVRAC

SEQ ID NO: 2995628 - protein, 18 aa, Entamoeba invadens
FDELFGDVYSKESYFLGK

SEQ ID NO: 2995629 - protein, 23 aa, Entamoeba invadens
FDELMIFIQTLTERIPIGVIYDA

SEQ ID NO: 2995630 - protein, 24 aa, Entamoeba invadens
FDESLGFVKPILSDGTEFVDEKVS

SEQ ID NO: 2995631 - protein, 28 aa, Entamoeba invadens
FDEYMDGLIYPIPLHRPVYKEQRLSLIF

SEQ ID NO: 2995632 - protein, 23 aa, Entamoeba invadens
FDEYMEILMKFVSAVFPEFIGVM

SEQ ID NO: 2995633 - protein, 23 aa, Entamoeba invadens
FDEYWDVFTGKKPFSSLPSEMCP

SEQ ID NO: 2995634 - protein, 17 aa, Entamoeba invadens
FDFFSIRLEYESVKNHQ

SEQ ID NO: 2995635 - protein, 18 aa, Entamoeba invadens
FDFISNPMNFELFDPFIQ

SEQ ID NO: 2995636 - protein, 24 aa, Entamoeba invadens
FDFKTLVLVCKKFEDIMAMFHYNP

SEQ ID NO: 2995637 - protein, 20 aa, Entamoeba invadens
FDFLDQKVFFTLNGVLIEEI

SEQ ID NO: 2995638 - protein, 24 aa, Entamoeba invadens
FDFLDSSVLLYMKTMIGLNGENSK

SEQ ID NO: 2995639 - protein, 48 aa, Entamoeba invadens
FDFSRLPFFIFEWHYLWFIHALPFDFALKLFDVILLDGFYALFNIGDT

SEQ ID NO: 2995640 - protein, 19 aa, Entamoeba invadens
FDFTYILPNLVAMGYPATG

SEQ ID NO: 2995641 - protein, 18 aa, Entamoeba invadens
FDFVYLQTRVDDLHNYLW

SEQ ID NO: 2995642 - protein, 27 aa, Entamoeba invadens
FDGCVSLKIVILPDSLISIGAYTFHKC

SEQ ID NO: 2995643 - protein, 20 aa, Entamoeba invadens
FDGFIEPAITFPPTYRIAKG

SEQ ID NO: 2995644 - protein, 26 aa, Entamoeba invadens
FDGFLRICFLRKHKTLKSLFTITSVV

SEQ ID NO: 2995645 - protein, 19 aa, Entamoeba invadens
FDGFTTHPLPCEGVYFVLY

SEQ ID NO: 2995646 - protein, 28 aa, Entamoeba invadens
FDGLGIHPFMLKTLNNFKIITPTKIQQL

SEQ ID NO: 2995647 - protein, 36 aa, Entamoeba invadens
FDGSRLIRVLEQLLKKKAPRYFPKAKTLFQIQQNIT

SEQ ID NO: 2995648 - protein, 28 aa, Entamoeba invadens
FDHALGNAFSLIRLKRIGVHMRIVNYQQ

SEQ ID NO: 2995649 - protein, 18 aa, Entamoeba invadens
FDHFVFYNHICIVTELLG

SEQ ID NO: 2995650 - protein, 21 aa, Entamoeba invadens
FDIFGFLPNVFSQVQSTFPLA

SEQ ID NO: 2995651 - protein, 19 aa, Entamoeba invadens
FDIIIPKIDPLPEGITLGC

SEQ ID NO: 2995652 - protein, 21 aa, Entamoeba invadens
FDILRSLYYLQMDSIRVIHCD

SEQ ID NO: 2995653 - protein, 29 aa, Entamoeba invadens
FDILTGLCKADYPDFLKIYYATILNNIHP

SEQ ID NO: 2995654 - protein, 19 aa, Entamoeba invadens
FDIQLTNTAIERLQFSYPV

SEQ ID NO: 2995655 - protein, 18 aa, Entamoeba invadens
FDIQLTNTSIERLQFSYP

SEQ ID NO: 2995656 - protein, 21 aa, Entamoeba invadens
FDISSFPIGINLMCKDIVKTK

SEQ ID NO: 2995657 - protein, 18 aa, Entamoeba invadens
FDITLFPNIQHITFNILP

SEQ ID NO: 2995658 - protein, 30 aa, Entamoeba invadens
FDITRAVIKFYAFYSFMINSDNFDYAKQQL

SEQ ID NO: 2995659 - protein, 18 aa, Entamoeba invadens
FDKFRAIMEKCVSGILTA

SEQ ID NO: 2995660 - protein, 23 aa, Entamoeba invadens
FDKGYFRLYYAALETNQLGTALI

SEQ ID NO: 2995661 - protein, 29 aa, Entamoeba invadens
FDKKMRERWFYFTEVLPIKTTFITWNVAE

SEQ ID NO: 2995662 - protein, 25 aa, Entamoeba invadens
FDKKRLYNFYGLYNSAYVPGIVKIL

SEQ ID NO: 2995663 - protein, 20 aa, Entamoeba invadens
FDKNCKTCTILFARYCNECN

SEQ ID NO: 2995664 - protein, 17 aa, Entamoeba invadens
FDKTCFHVFALFHGKMI

SEQ ID NO: 2995665 - protein, 35 aa, Entamoeba invadens
FDKVVYFGKSSFGYTSLRILKLNPLAEYSTNVFEH

SEQ ID NO: 2995666 - protein, 30 aa, Entamoeba invadens
FDLFEQFVCSKLRVLYKLNWPVDVIKHNPQ

SEQ ID NO: 2995667 - protein, 18 aa, Entamoeba invadens
FDLFIEFTEKSKIGHVPV

SEQ ID NO: 2995668 - protein, 31 aa, Entamoeba invadens
FDLKQSLADGIIFAQLLNYLQSGVIDISTLE

SEQ ID NO: 2995669 - protein, 27 aa, Entamoeba invadens
FDLKYFVDLPLEKLVIDSSLFTYSKTA

SEQ ID NO: 2995670 - protein, 20 aa, Entamoeba invadens
FDLLFADYNSIKRPLFQLLE

SEQ ID NO: 2995671 - protein, 17 aa, Entamoeba invadens
FDLLMEKPKFVKRLPTQ

SEQ ID NO: 2995672 - protein, 27 aa, Entamoeba invadens
FDLQNNRFLILQGEVERIALMPAKAKT

SEQ ID NO: 2995673 - protein, 21 aa, Entamoeba invadens
FDLQYFPPDVSIQDWFQLSCF

SEQ ID NO: 2995674 - protein, 28 aa, Entamoeba invadens
FDLQYYIHKGVWFLMDFLRDEFKAAQSE

SEQ ID NO: 2995675 - protein, 30 aa, Entamoeba invadens
FDLREQKPVSWKSFFNKKPTTTELKVSDKI

SEQ ID NO: 2995676 - protein, 24 aa, Entamoeba invadens
FDLRGRFERSIVGGFLYPSCVRIN

SEQ ID NO: 2995677 - protein, 17 aa, Entamoeba invadens
FDLSKKFCPKCGYHDLR

SEQ ID NO: 2995678 - protein, 17 aa, Entamoeba invadens
FDLSKYNALYDLNLFFR

SEQ ID NO: 2995679 - protein, 30 aa, Entamoeba invadens
FDMDITHTLPILLDIIFGLYDVKFSATDKL

SEQ ID NO: 2995680 - protein, 28 aa, Entamoeba invadens
FDMKAYCVFYCNQYVRILKQGHSKFRDV

SEQ ID NO: 2995681 - protein, 19 aa, Entamoeba invadens
FDMLGCSLLAGMALNAITS

SEQ ID NO: 2995682 - protein, 17 aa, Entamoeba invadens
FDMMHLVYTTALNKYCK

SEQ ID NO: 2995683 - protein, 21 aa, Entamoeba invadens
FDMNDIFSQFFGGGGFGFGGR

SEQ ID NO: 2995684 - protein, 25 aa, Entamoeba invadens
FDMNPLLLDIFKDLKIKIPVLPFVR

SEQ ID NO: 2995685 - protein, 21 aa, Entamoeba invadens
FDMRLYCKFYCCQDVRILKEG

SEQ ID NO: 2995686 - protein, 21 aa, Entamoeba invadens
FDMVKLLTKTTLPSAPFLFLG

SEQ ID NO: 2995687 - protein, 25 aa, Entamoeba invadens
FDMYEKLFIQYGARVDLWPQEALAH

SEQ ID NO: 2995688 - protein, 26 aa, Entamoeba invadens
FDNCDKLIKLILPSSLSKIGTKVFCP

SEQ ID NO: 2995689 - protein, 24 aa, Entamoeba invadens
FDNFHKLYVFFGITTQISVNVSLD

SEQ ID NO: 2995690 - protein, 25 aa, Entamoeba invadens
FDNIKYFIETIYRILDKELCEDIPI

SEQ ID NO: 2995691 - protein, 26 aa, Entamoeba invadens
FDNKSQEFIILPPIIDTIDSFTIENK

SEQ ID NO: 2995692 - protein, 18 aa, Entamoeba invadens
FDNLYWVGALDTDLRVFD

SEQ ID NO: 2995693 - protein, 24 aa, Entamoeba invadens
FDNNSHLLYAIFSNLIYDPDDTYC

SEQ ID NO: 2995694 - protein, 30 aa, Entamoeba invadens
FDNPIPFTSLQPFLEYLFAVANKTTSHKIL

SEQ ID NO: 2995695 - protein, 24 aa, Entamoeba invadens
FDNVRLFIGYIQMLQYSPVTTSIT

SEQ ID NO: 2995696 - protein, 21 aa, Entamoeba invadens
FDNVVLMPFSVNELHFSVQGD

SEQ ID NO: 2995697 - protein, 31 aa, Entamoeba invadens
FDPDVIFGRKLVFANLPFLMNINLPNTLTKI

SEQ ID NO: 2995698 - protein, 21 aa, Entamoeba invadens
FDPITPLLTEWTYQAMIHEFI

SEQ ID NO: 2995699 - protein, 26 aa, Entamoeba invadens
FDPLGFSDPLLLPTKPKELPPPQVSI

SEQ ID NO: 2995700 - protein, 24 aa, Entamoeba invadens
FDPNKLRYHRIIIMTDADVDGAHI

SEQ ID NO: 2995701 - protein, 17 aa, Entamoeba invadens
FDPVYFINKNIPQFDHR

SEQ ID NO: 2995702 - protein, 18 aa, Entamoeba invadens
FDPYTPFLPNIGVYGQAV

SEQ ID NO: 2995703 - protein, 18 aa, Entamoeba invadens
FDQATFLNIMLDYGQEVD

SEQ ID NO: 2995704 - protein, 24 aa, Entamoeba invadens
FDQCRALTQLILSNKIKVFGARAF

SEQ ID NO: 2995705 - protein, 17 aa, Entamoeba invadens
FDQETSFVAYCMCSGNK

SEQ ID NO: 2995706 - protein, 18 aa, Entamoeba invadens
FDQILWLHNNCCTEVGTM

SEQ ID NO: 2995707 - protein, 20 aa, Entamoeba invadens
FDQNFATVVFPKILRLRLSK

SEQ ID NO: 2995708 - protein, 20 aa, Entamoeba invadens
FDQVVIFVKNAMESTLEMSP

SEQ ID NO: 2995709 - protein, 18 aa, Entamoeba invadens
FDRALRSLPSGQHKILWG

SEQ ID NO: 2995710 - protein, 22 aa, Entamoeba invadens
FDRCTNLTHVALPSSLKYIPPL

SEQ ID NO: 2995711 - protein, 17 aa, Entamoeba invadens
FDRFTLESPYKEVFYKK

SEQ ID NO: 2995712 - protein, 32 aa, Entamoeba invadens
FDRIRNRAYPDTDIFLLCFSIDDTNSYENIEA

SEQ ID NO: 2995713 - protein, 19 aa, Entamoeba invadens
FDRLELENISFTRSDLSNE

SEQ ID NO: 2995714 - protein, 17 aa, Entamoeba invadens
FDRLHCGHYSLLQSGLF

SEQ ID NO: 2995715 - protein, 21 aa, Entamoeba invadens
FDRLLCDVPCTGDGTLRKCID

SEQ ID NO: 2995716 - protein, 24 aa, Entamoeba invadens
FDRPNIYFRVLYKDLYENPQEELL

SEQ ID NO: 2995717 - protein, 26 aa, Entamoeba invadens
FDSFNDYAFFINLYKRLMNDYDDLTN

SEQ ID NO: 2995718 - protein, 25 aa, Entamoeba invadens
FDSIKLFFELLTQNPTRKVTIPFEL

SEQ ID NO: 2995719 - protein, 22 aa, Entamoeba invadens
FDSIYKIFFDVPGLEKMSVVIR

SEQ ID NO: 2995720 - protein, 26 aa, Entamoeba invadens
FDSKNYFFMTPSILYPKETQTHWKRI

SEQ ID NO: 2995721 - protein, 22 aa, Entamoeba invadens
FDSLIHLFNVRCVYDASTICNV

SEQ ID NO: 2995722 - protein, 22 aa, Entamoeba invadens
FDSLPLACKYTTSLGNFFLCHG

SEQ ID NO: 2995723 - protein, 36 aa, Entamoeba invadens
FDSVFQEYFTIQYALSIATVWLFCYEMELNDIPPYK

SEQ ID NO: 2995724 - protein, 18 aa, Entamoeba invadens
FDTDYKSPLFIIVVTDAV

SEQ ID NO: 2995725 - protein, 17 aa, Entamoeba invadens
FDTEIYQTIFYSHRLDL

SEQ ID NO: 2995726 - protein, 18 aa, Entamoeba invadens
FDTIIHLLRKSTLSQTLF

SEQ ID NO: 2995727 - protein, 18 aa, Entamoeba invadens
FDTTKPLISLSHEPPLGV

SEQ ID NO: 2995728 - protein, 18 aa, Entamoeba invadens
FDVFLDSVTRKVAINALM

SEQ ID NO: 2995729 - protein, 24 aa, Entamoeba invadens
FDVKLNTEKLFFNYPKSAKECLIE

SEQ ID NO: 2995730 - protein, 26 aa, Entamoeba invadens
FDVMMTSMYMVYDNKIKIGMNVDVFG

SEQ ID NO: 2995731 - protein, 26 aa, Entamoeba invadens
FDVPYLSLFAPIGSWQLHTCPLPSDS

SEQ ID NO: 2995732 - protein, 17 aa, Entamoeba invadens
FDVPYLSVDFSNAKVFL

SEQ ID NO: 2995733 - protein, 23 aa, Entamoeba invadens
FDVTDLATFEKISYWLGELANEK

SEQ ID NO: 2995734 - protein, 19 aa, Entamoeba invadens
FDYKSFVQIKAYEAYLDCG

SEQ ID NO: 2995735 - protein, 18 aa, Entamoeba invadens
FDYLGLEQALCGSRNFCP

SEQ ID NO: 2995736 - protein, 26 aa, Entamoeba invadens
FDYREFCIDVISFRYKPNWNAKQLSL

SEQ ID NO: 2995737 - protein, 17 aa, Entamoeba invadens
FDYSGMPALKNQFLVIP

SEQ ID NO: 2995738 - protein, 17 aa, Entamoeba invadens
FDYTLWVNKVFKGTVFG

SEQ ID NO: 2995739 - protein, 17 aa, Entamoeba invadens
FEALPGWKKQKQKYELK

SEQ ID NO: 2995740 - protein, 27 aa, Entamoeba invadens
FEAVQQALILSLLNVNGVGFKVRRPER

SEQ ID NO: 2995741 - protein, 25 aa, Entamoeba invadens
FEAYQQAVLLSFLNQYCSITIEKRR

SEQ ID NO: 2995742 - protein, 19 aa, Entamoeba invadens
FECLLKCGVHLDNNLLRYG

SEQ ID NO: 2995743 - protein, 26 aa, Entamoeba invadens
FECLNFRTLQRLRFVNKKIFFLTQHI

SEQ ID NO: 2995744 - protein, 23 aa, Entamoeba invadens
FEDLDVLAPLLLRSIFGGKRIKV

SEQ ID NO: 2995745 - protein, 17 aa, Entamoeba invadens
FEDNFLVHFLVNKNGFE

SEQ ID NO: 2995746 - protein, 26 aa, Entamoeba invadens
FEDSVCGLMKCWSTLRLTVEHQFGGQ

SEQ ID NO: 2995747 - protein, 23 aa, Entamoeba invadens
FEDSYFAECLIFGYSTFTTKESL

SEQ ID NO: 2995748 - protein, 17 aa, Entamoeba invadens
FEDTLGDLVLLPAKDFG

SEQ ID NO: 2995749 - protein, 19 aa, Entamoeba invadens
FEEELLLLKDKISEMFQFM

SEQ ID NO: 2995750 - protein, 18 aa, Entamoeba invadens
FEEFRNYFTFELKTQLPE

SEQ ID NO: 2995751 - protein, 19 aa, Entamoeba invadens
FEEFRNYFTFELKTQLPEN

SEQ ID NO: 2995752 - protein, 21 aa, Entamoeba invadens
FEEICLPPLNILKTNYEKKRY

SEQ ID NO: 2995753 - protein, 21 aa, Entamoeba invadens
FEEIICNIFGPLLEATLNPSE

SEQ ID NO: 2995754 - protein, 24 aa, Entamoeba invadens
FEEIPAMFHFNPISVSFITQKYFP

SEQ ID NO: 2995755 - protein, 25 aa, Entamoeba invadens
FEEIPQMFHFNPISVSFKTQKCFPN

SEQ ID NO: 2995756 - protein, 26 aa, Entamoeba invadens
FEEIYGFAESFFKKYNKYTTKNITFT

SEQ ID NO: 2995757 - protein, 18 aa, Entamoeba invadens
FEEIYQCKYLKFVVKNNA

SEQ ID NO: 2995758 - protein, 18 aa, Entamoeba invadens
FEEKAQLFAWSGRSVGNL

SEQ ID NO: 2995759 - protein, 22 aa, Entamoeba invadens
FEEKKREFLTRFKAEFDSIKNE

SEQ ID NO: 2995760 - protein, 23 aa, Entamoeba invadens
FEEKVEIPTLPSQDVDPIIQEIK

SEQ ID NO: 2995761 - protein, 17 aa, Entamoeba invadens
FEELARVALKERPIRQQ

SEQ ID NO: 2995762 - protein, 19 aa, Entamoeba invadens
FEELRLEFCRLMVKYYSHE

SEQ ID NO: 2995763 - protein, 27 aa, Entamoeba invadens
FEERPPTLLPLYFEKIMYKMYFEKGDM

SEQ ID NO: 2995764 - protein, 30 aa, Entamoeba invadens
FEERVSNLSFLYFLVIDNNNILGAFVKPPL

SEQ ID NO: 2995765 - protein, 27 aa, Entamoeba invadens
FEETIDKFHYNPIPIIKRNIFKNMQTH

SEQ ID NO: 2995766 - protein, 19 aa, Entamoeba invadens
FEETKYKILDLLKVVRIKS

SEQ ID NO: 2995767 - protein, 20 aa, Entamoeba invadens
FEEVCDLCYPPFVLNTDASS

SEQ ID NO: 2995768 - protein, 24 aa, Entamoeba invadens
FEEYKKMNGAYPKKLVVYRGTVNS

SEQ ID NO: 2995769 - protein, 24 aa, Entamoeba invadens
FEFKDFVMFYSNCTAILDATKTVG

SEQ ID NO: 2995770 - protein, 22 aa, Entamoeba invadens
FEFMNFSVFAMCDLLIEDQNVD

SEQ ID NO: 2995771 - protein, 17 aa, Entamoeba invadens
FEFNQDAVFIYDGTFSV

SEQ ID NO: 2995772 - protein, 17 aa, Entamoeba invadens
FEFPLALNWNNENMELS

SEQ ID NO: 2995773 - protein, 21 aa, Entamoeba invadens
FEFPQKLLELGSSAFSRCLHL

SEQ ID NO: 2995774 - protein, 19 aa, Entamoeba invadens
FEFQKSQLIVKQLSLAIVA

SEQ ID NO: 2995775 - protein, 18 aa, Entamoeba invadens
FEFSTKAIWSVLHGRRNV

SEQ ID NO: 2995776 - protein, 22 aa, Entamoeba invadens
FEFTDTLIAFLFSALTENRYEE

SEQ ID NO: 2995777 - protein, 34 aa, Entamoeba invadens
FEGDSYYKFLAHVYKWVLILLAEVNKTVAPGQPQ

SEQ ID NO: 2995778 - protein, 18 aa, Entamoeba invadens
FEGDVVLFSIDPNWIDSK

SEQ ID NO: 2995779 - protein, 26 aa, Entamoeba invadens
FEGFKGFQNVKIYVTFLAPETLNLEF

SEQ ID NO: 2995780 - protein, 18 aa, Entamoeba invadens
FEGILLPMLQAVLTTNGV

SEQ ID NO: 2995781 - protein, 19 aa, Entamoeba invadens
FEGKLFFYLDQEKDAYHEI

SEQ ID NO: 2995782 - protein, 30 aa, Entamoeba invadens
FEGNPPYRELGMLKGLFKVATVGAPGLRFP

SEQ ID NO: 2995783 - protein, 25 aa, Entamoeba invadens
FEGVRPNRKSIVNSALLSEKINEKE

SEQ ID NO: 2995784 - protein, 24 aa, Entamoeba invadens
FEGVRSPCYLIYTTSLQIVSYLAV

SEQ ID NO: 2995785 - protein, 25 aa, Entamoeba invadens
FEHFDSEHFTIWFSKYNTPVEMPQR

SEQ ID NO: 2995786 - protein, 26 aa, Entamoeba invadens
FEHFTKVFLPWYMEIGTKKNTLIMIP

SEQ ID NO: 2995787 - protein, 24 aa, Entamoeba invadens
FEHFYKKRFESRKLQWVLNVSTVC

SEQ ID NO: 2995788 - protein, 33 aa, Entamoeba invadens
FEHPKGMFVIPLKNPISIFGTTAARLLCLQKLA

SEQ ID NO: 2995789 - protein, 25 aa, Entamoeba invadens
FEHPKGMFVIPLKNPISLFGVIAAR

SEQ ID NO: 2995790 - protein, 17 aa, Entamoeba invadens
FEIANGLYLPVTISEPK

SEQ ID NO: 2995791 - protein, 23 aa, Entamoeba invadens
FEICGFPFLVKMSDSRFVTLAIT

SEQ ID NO: 2995792 - protein, 18 aa, Entamoeba invadens
FEIEIPIYIPVNCINEID

SEQ ID NO: 2995793 - protein, 26 aa, Entamoeba invadens
FEIFIKPLCSCYLEEDIMVIALDIET

SEQ ID NO: 2995794 - protein, 17 aa, Entamoeba invadens
FEIFIKPLCTCATKEHV

SEQ ID NO: 2995795 - protein, 29 aa, Entamoeba invadens
FEIHHQSFLAFFLLRRALRNKNIIGHQFF

SEQ ID NO: 2995796 - protein, 26 aa, Entamoeba invadens
FEIVADLKCYAIPEAKIRLTELKNQT

SEQ ID NO: 2995797 - protein, 18 aa, Entamoeba invadens
FEIVKLKTKIVFGNESES

SEQ ID NO: 2995798 - protein, 29 aa, Entamoeba invadens
FEKAHVLYNAGILLFRVASSQASAQSSIP

SEQ ID NO: 2995799 - protein, 23 aa, Entamoeba invadens
FEKANILYNMACSDMALAASFTK

SEQ ID NO: 2995800 - protein, 22 aa, Entamoeba invadens
FEKCNMLSIVIIPTSVKTIGNN

SEQ ID NO: 2995801 - protein, 18 aa, Entamoeba invadens
FEKCYSLFSIVLPETVEL

SEQ ID NO: 2995802 - protein, 17 aa, Entamoeba invadens
FEKFEIQAGTFAQALQT

SEQ ID NO: 2995803 - protein, 27 aa, Entamoeba invadens
FEKHEFTTYVFVITYSPYLSEIPDYDI

SEQ ID NO: 2995804 - protein, 27 aa, Entamoeba invadens
FEKIFRLQNSFLSLFRMNVLCPYKPLE

SEQ ID NO: 2995805 - protein, 19 aa, Entamoeba invadens
FEKIVRYFNYTSSKGLNNC

SEQ ID NO: 2995806 - protein, 27 aa, Entamoeba invadens
FEKKTFVISPKPLIPPKHRPTPSFSEV

SEQ ID NO: 2995807 - protein, 19 aa, Entamoeba invadens
FEKKTLLRVKVRSVYSYLD

SEQ ID NO: 2995808 - protein, 18 aa, Entamoeba invadens
FEKLENFGQYAFSGTGII

SEQ ID NO: 2995809 - protein, 17 aa, Entamoeba invadens
FEKMPITSPFPLSKLHF

SEQ ID NO: 2995810 - protein, 18 aa, Entamoeba invadens
FEKPFDKSFDKMYEKQFE

SEQ ID NO: 2995811 - protein, 29 aa, Entamoeba invadens
FEKQFNCWSYKLYVYQCKCSYFNGRKFIC

SEQ ID NO: 2995812 - protein, 26 aa, Entamoeba invadens
FEKQRSNLMCLLSLILSTFNVKDQKR

SEQ ID NO: 2995813 - protein, 17 aa, Entamoeba invadens
FEKQYLDIEKFVTFLFT

SEQ ID NO: 2995814 - protein, 25 aa, Entamoeba invadens
FEKRNLLEFFTSNRVLFFKGDVDLG

SEQ ID NO: 2995815 - protein, 23 aa, Entamoeba invadens
FEKRVPYTPLIPSVNHIGRRLNI

SEQ ID NO: 2995816 - protein, 34 aa, Entamoeba invadens
FEKTKYSLIDTTLSPIPQLVPPKPVVSKIPGKSV

SEQ ID NO: 2995817 - protein, 24 aa, Entamoeba invadens
FEKTPIIFFVNKKSGNHLGVKILQ

SEQ ID NO: 2995818 - protein, 36 aa, Entamoeba invadens
FEKTVFLDKNFGDGWVWLYKTVFDLNSIKLKGTNEP

SEQ ID NO: 2995819 - protein, 26 aa, Entamoeba invadens
FEKVSQLMLIPKNVLSMMFLVKRFHK

SEQ ID NO: 2995820 - protein, 17 aa, Entamoeba invadens
FEKWMTFDPNEYAWMSY

SEQ ID NO: 2995821 - protein, 18 aa, Entamoeba invadens
FEKWVAFFCSQLKEKKNK

SEQ ID NO: 2995822 - protein, 17 aa, Entamoeba invadens
FELARRLIKPIINITKI

SEQ ID NO: 2995823 - protein, 25 aa, Entamoeba invadens
FELEQLEWKWGICMAIGLSEFIDIR

SEQ ID NO: 2995824 - protein, 18 aa, Entamoeba invadens
FELIPNKVYQFRGYDVAN

SEQ ID NO: 2995825 - protein, 33 aa, Entamoeba invadens
FELKKEIGLLFKYVYLFYLKSPLAMMSYKDAII

SEQ ID NO: 2995826 - protein, 25 aa, Entamoeba invadens
FELMETKMNFAKLVKLLILNCKNKD

SEQ ID NO: 2995827 - protein, 17 aa, Entamoeba invadens
FELNFGDKKFCFDIYSR

SEQ ID NO: 2995828 - protein, 18 aa, Entamoeba invadens
FELYVLKKMQSGPDMDKL

SEQ ID NO: 2995829 - protein, 24 aa, Entamoeba invadens
FEMARTRHKFAFYIGTNRSTRLID

SEQ ID NO: 2995830 - protein, 18 aa, Entamoeba invadens
FEMCYSLQRVTLPKMIKM

SEQ ID NO: 2995831 - protein, 22 aa, Entamoeba invadens
FEMEYPLKLQIDIPGSLIDLTQ

SEQ ID NO: 2995832 - protein, 18 aa, Entamoeba invadens
FEMGLLFVENFDVNRFKI

SEQ ID NO: 2995833 - protein, 32 aa, Entamoeba invadens
FEMKKMTTFIRDWKKRCVILPDMLNVEKVEFD

SEQ ID NO: 2995834 - protein, 19 aa, Entamoeba invadens
FEMPLQIKTLEYCKLASYN

SEQ ID NO: 2995835 - protein, 18 aa, Entamoeba invadens
FEMVFARNFCKINDVAAN

SEQ ID NO: 2995836 - protein, 24 aa, Entamoeba invadens
FEMWKGVIPHNFNKLKAISPFVNF

SEQ ID NO: 2995837 - protein, 31 aa, Entamoeba invadens
FENCEQLSFVYLPLNINLLQKKAFAGCKSLQ

SEQ ID NO: 2995838 - protein, 26 aa, Entamoeba invadens
FENCGFDQVFFMKNLKEFGFGVFSNN

SEQ ID NO: 2995839 - protein, 28 aa, Entamoeba invadens
FENCGKLKRFLMPKSKALAIAEFIQPND

SEQ ID NO: 2995840 - protein, 24 aa, Entamoeba invadens
FENDNFYRVISWCPIELGTVPHNF

SEQ ID NO: 2995841 - protein, 23 aa, Entamoeba invadens
FENFKFVEALHFLGDILLELGFQ

SEQ ID NO: 2995842 - protein, 17 aa, Entamoeba invadens
FENFKKPSTKRKSLSTI

SEQ ID NO: 2995843 - protein, 30 aa, Entamoeba invadens
FENGFYELCLFNAYCRMDWLLCTKRIKDNS

SEQ ID NO: 2995844 - protein, 26 aa, Entamoeba invadens
FENGQLPWYGLTVSSIVIPYYTEKKK

SEQ ID NO: 2995845 - protein, 17 aa, Entamoeba invadens
FENGTWEWSPHRNPLWN

SEQ ID NO: 2995846 - protein, 23 aa, Entamoeba invadens
FENIAKIMGLRYGKKYTDLNELR

SEQ ID NO: 2995847 - protein, 24 aa, Entamoeba invadens
FENIIKALVPPPQSSKRKLYESFN

SEQ ID NO: 2995848 - protein, 23 aa, Entamoeba invadens
FENIYEIMYIFNTPELIKHQTFV

SEQ ID NO: 2995849 - protein, 23 aa, Entamoeba invadens
FENNPSVCAFPFVFGERGLGIEM

SEQ ID NO: 2995850 - protein, 18 aa, Entamoeba invadens
FENNYIKGVFRTANWSVF

SEQ ID NO: 2995851 - protein, 29 aa, Entamoeba invadens
FENNYRRVQPYYYNFKVNAKGRWVGKSIV

SEQ ID NO: 2995852 - protein, 39 aa, Entamoeba invadens
FENPFPVSFALRLFGRFYPIIPLKFIQKEFEWLGIDLNE

SEQ ID NO: 2995853 - protein, 18 aa, Entamoeba invadens
FENRIYKKLGNYVNQVVM

SEQ ID NO: 2995854 - protein, 25 aa, Entamoeba invadens
FENTIKKLIALKEKFPKYAALMKEN

SEQ ID NO: 2995855 - protein, 24 aa, Entamoeba invadens
FENYDYVHLSFDIDGIDPKYIIGT

SEQ ID NO: 2995856 - protein, 32 aa, Entamoeba invadens
FENYSFSEILTFDFNFFKMATLTYKSYLYLST

SEQ ID NO: 2995857 - protein, 17 aa, Entamoeba invadens
FEPKYIKLLINIIQTAL

SEQ ID NO: 2995858 - protein, 25 aa, Entamoeba invadens
FEQDEKKCFPLIFINHKGTESSSEQ

SEQ ID NO: 2995859 - protein, 24 aa, Entamoeba invadens
FEQETMISGILIQLNMQTKFRLDL

SEQ ID NO: 2995860 - protein, 17 aa, Entamoeba invadens
FEQLDINKMKFPKMIFL

SEQ ID NO: 2995861 - protein, 25 aa, Entamoeba invadens
FEQTPYEFGKLLKMVKKIGYENSTG

SEQ ID NO: 2995862 - protein, 17 aa, Entamoeba invadens
FEQWTPPEKEEVKGLFW

SEQ ID NO: 2995863 - protein, 26 aa, Entamoeba invadens
FEQYGFIPKNFKFIKLVFESNKTFQL

SEQ ID NO: 2995864 - protein, 25 aa, Entamoeba invadens
FERCIKEDIALLYTTFSRCSNSREM

SEQ ID NO: 2995865 - protein, 28 aa, Entamoeba invadens
FERDSTRFLMCTLSFHLTNISGMEIVKK

SEQ ID NO: 2995866 - protein, 31 aa, Entamoeba invadens
FERDSTRFLMCTLSFHLTYISGIEIVKEGRG

SEQ ID NO: 2995867 - protein, 30 aa, Entamoeba invadens
FERDSTRFLMCTLSFHLTYISGMEIVKEGR

SEQ ID NO: 2995868 - protein, 20 aa, Entamoeba invadens
FERELKVVRLLYQRAVEGKP

SEQ ID NO: 2995869 - protein, 26 aa, Entamoeba invadens
FERFQKSRYFKTLVERLTPVFKTDKS

SEQ ID NO: 2995870 - protein, 34 aa, Entamoeba invadens
FERSKSLRFAIAVCNFIIPFLANNHEFKLLSEKH

SEQ ID NO: 2995871 - protein, 17 aa, Entamoeba invadens
FERWGIVPGDPLDKEIK

SEQ ID NO: 2995872 - protein, 19 aa, Entamoeba invadens
FERYTSTLLPLFEQIHTEM

SEQ ID NO: 2995873 - protein, 29 aa, Entamoeba invadens
FESFELLENQLFLEDLKAQKKKREIVLRP

SEQ ID NO: 2995874 - protein, 32 aa, Entamoeba invadens
FESFKGKFIVLLFYPLDWTFVCPTEMLGYSKL

SEQ ID NO: 2995875 - protein, 28 aa, Entamoeba invadens
FESFKVPSLYICRPSVLPIYSAGTTTGL

SEQ ID NO: 2995876 - protein, 17 aa, Entamoeba invadens
FESITNLFLQLFSKYGV

SEQ ID NO: 2995877 - protein, 24 aa, Entamoeba invadens
FESNTKIFVLKRIKSDRKPAKKRE

SEQ ID NO: 2995878 - protein, 24 aa, Entamoeba invadens
FESPPTFPRKSLYPLRDVEITQYL

SEQ ID NO: 2995879 - protein, 20 aa, Entamoeba invadens
FESQWGLAFESFLDGLTVQT

SEQ ID NO: 2995880 - protein, 26 aa, Entamoeba invadens
FESYEPLLVNWLRYELRGIRQDEPDF

SEQ ID NO: 2995881 - protein, 29 aa, Entamoeba invadens
FESYTCSALALFLLKRALKSRGDIGQLFY

SEQ ID NO: 2995882 - protein, 25 aa, Entamoeba invadens
FETFPIAGDLPRLLKHMTLFEVQDD

SEQ ID NO: 2995883 - protein, 17 aa, Entamoeba invadens
FETIELKIPLETGGFRA

SEQ ID NO: 2995884 - protein, 21 aa, Entamoeba invadens
FETIKTWPGLLSLTSMNGIEC

SEQ ID NO: 2995885 - protein, 24 aa, Entamoeba invadens
FETIPVGVLTFPKWVITEYTKVSH

SEQ ID NO: 2995886 - protein, 24 aa, Entamoeba invadens
FETKFYQINIWFEVDYTLTQVHKN

SEQ ID NO: 2995887 - protein, 24 aa, Entamoeba invadens
FETSKRIQEMLRMNDLALVSSKGS

SEQ ID NO: 2995888 - protein, 22 aa, Entamoeba invadens
FETSNINMLLLKKYKKDKVTLK

SEQ ID NO: 2995889 - protein, 20 aa, Entamoeba invadens
FETVFKEKFVQLTVLQLGGV

SEQ ID NO: 2995890 - protein, 29 aa, Entamoeba invadens
FETVQIVIAFLIFVIDNYPTLFPDDVDSG

SEQ ID NO: 2995891 - protein, 20 aa, Entamoeba invadens
FEVAFDLGLPPSLYVINRNK

SEQ ID NO: 2995892 - protein, 19 aa, Entamoeba invadens
FEVFLNELINSGDKAKFEK

SEQ ID NO: 2995893 - protein, 24 aa, Entamoeba invadens
FEVGCVVIPSLSYLPSGPLQKFLQ

SEQ ID NO: 2995894 - protein, 19 aa, Entamoeba invadens
FEVGYFKKGNGSCVVLLIG

SEQ ID NO: 2995895 - protein, 17 aa, Entamoeba invadens
FEVIKGKLYQIRGFDIA

SEQ ID NO: 2995896 - protein, 18 aa, Entamoeba invadens
FEVIPHKVYQFRGFDIAN

SEQ ID NO: 2995897 - protein, 31 aa, Entamoeba invadens
FEVKKLYALGVYLSWNYKLTLKKFVNAPQGA

SEQ ID NO: 2995898 - protein, 34 aa, Entamoeba invadens
FEVNIRPIYTHPCKLRFLANLSQTAFVFVDVKNV

SEQ ID NO: 2995899 - protein, 21 aa, Entamoeba invadens
FEVSFTTRKYFFDKIGVVCNN

SEQ ID NO: 2995900 - protein, 20 aa, Entamoeba invadens
FEVSYTFYLQMKNIPIYCEN

SEQ ID NO: 2995901 - protein, 23 aa, Entamoeba invadens
FEWHGVLIPILPVDESFAGFAGC

SEQ ID NO: 2995902 - protein, 17 aa, Entamoeba invadens
FEYALVKHKQLFDDWES

SEQ ID NO: 2995903 - protein, 17 aa, Entamoeba invadens
FEYFNSFGNIKNFNLSE

SEQ ID NO: 2995904 - protein, 18 aa, Entamoeba invadens
FEYIGYKKWIELTRKINN

SEQ ID NO: 2995905 - protein, 26 aa, Entamoeba invadens
FEYKTKWLEMFYLKTMPIEKSFVYKT

SEQ ID NO: 2995906 - protein, 17 aa, Entamoeba invadens
FEYPLDPQTLLSSNEQV

SEQ ID NO: 2995907 - protein, 21 aa, Entamoeba invadens
FEYTPFVAQMFYDYSTVVEGT

SEQ ID NO: 2995908 - protein, 24 aa, Entamoeba invadens
FEYTRKNMISFYLSNNILVKNCTF

SEQ ID NO: 2995909 - protein, 25 aa, Entamoeba invadens
FEYVSALKIIQFPKGILSFESCSFA

SEQ ID NO: 2995910 - protein, 26 aa, Entamoeba invadens
FEYVSALKIIQFPKGILSFESYSFAR

SEQ ID NO: 2995911 - protein, 27 aa, Entamoeba invadens
FEYVSALKIIQFPKGILSFESYSFARC

SEQ ID NO: 2995912 - protein, 19 aa, Entamoeba invadens
FFAALKKLTSLKTLYLYCN

SEQ ID NO: 2995913 - protein, 18 aa, Entamoeba invadens
FFAEFIPPLITKASLDKE

SEQ ID NO: 2995914 - protein, 18 aa, Entamoeba invadens
FFALTKLFTSQDLTLRRL

SEQ ID NO: 2995915 - protein, 32 aa, Entamoeba invadens
FFANYDTYVQYLPFIWKFNYLDHRDVFDFIVE

SEQ ID NO: 2995916 - protein, 19 aa, Entamoeba invadens
FFCEEITNNLLLFSNKKIA

SEQ ID NO: 2995917 - protein, 25 aa, Entamoeba invadens
FFCSLRLAHYLAQCGSTLLGTVRKN

SEQ ID NO: 2995918 - protein, 26 aa, Entamoeba invadens
FFCSLRLAHYLAQCGSTLLGTVRKNR

SEQ ID NO: 2995919 - protein, 19 aa, Entamoeba invadens
FFCTLKLSHYLAAFGCQLL

SEQ ID NO: 2995920 - protein, 21 aa, Entamoeba invadens
FFCTLMLSHYLASCGCQLLGT

SEQ ID NO: 2995921 - protein, 21 aa, Entamoeba invadens
FFDCINLKTIILPESLKQIKD

SEQ ID NO: 2995922 - protein, 19 aa, Entamoeba invadens
FFDDFFVPNLIGVQTLTMS

SEQ ID NO: 2995923 - protein, 31 aa, Entamoeba invadens
FFDEIKIEIPFPLLQSHYLLFDVVELHDGNI

SEQ ID NO: 2995924 - protein, 26 aa, Entamoeba invadens
FFDEMKVELPFPLTNNDRLIFNVMEL

SEQ ID NO: 2995925 - protein, 26 aa, Entamoeba invadens
FFDKHIGYMAFTLLFSNVPESTRMII

SEQ ID NO: 2995926 - protein, 17 aa, Entamoeba invadens
FFDLMRVEDLDMIKTFN

SEQ ID NO: 2995927 - protein, 26 aa, Entamoeba invadens
FFDQKSLEWFLRKFTVDTVDLNYLPI

SEQ ID NO: 2995928 - protein, 18 aa, Entamoeba invadens
FFDVGKGDIKIWRNKEEK

SEQ ID NO: 2995929 - protein, 19 aa, Entamoeba invadens
FFEAFAWKDAFGDVKYFFE

SEQ ID NO: 2995930 - protein, 19 aa, Entamoeba invadens
FFECKSLCQISLSQNCKEI

SEQ ID NO: 2995931 - protein, 18 aa, Entamoeba invadens
FFEDCESLNLVFLNDKTL

SEQ ID NO: 2995932 - protein, 20 aa, Entamoeba invadens
FFEFSHFCFFKIRQSEDVKI

SEQ ID NO: 2995933 - protein, 19 aa, Entamoeba invadens
FFEHPEIVTTYQLLPALLS

SEQ ID NO: 2995934 - protein, 17 aa, Entamoeba invadens
FFEKIDLIAGLSASSLI

SEQ ID NO: 2995935 - protein, 17 aa, Entamoeba invadens
FFEKTFSLQFGKDKVNL

SEQ ID NO: 2995936 - protein, 22 aa, Entamoeba invadens
FFEKYKEKIFFVAKTLQKMEYE

SEQ ID NO: 2995937 - protein, 18 aa, Entamoeba invadens
FFELVPTTPTITPVVSAT

SEQ ID NO: 2995938 - protein, 35 aa, Entamoeba invadens
FFETMRLTFEFIARWLLMLFKREFKRNLVLRLWDA

SEQ ID NO: 2995939 - protein, 20 aa, Entamoeba invadens
FFFDADVMKLYYVDLSFTKS

SEQ ID NO: 2995940 - protein, 17 aa, Entamoeba invadens
FFFLLDQTLDESLEWID

SEQ ID NO: 2995941 - protein, 17 aa, Entamoeba invadens
FFGGFYSSVFPTAPSFK

SEQ ID NO: 2995942 - protein, 17 aa, Entamoeba invadens
FFGNFLENCAHNPSFHP

SEQ ID NO: 2995943 - protein, 25 aa, Entamoeba invadens
FFGPRINSFIYHRLQNSKKVAFEMG

SEQ ID NO: 2995944 - protein, 23 aa, Entamoeba invadens
FFGSQYDMTFLTAITLNNNIQIN

SEQ ID NO: 2995945 - protein, 21 aa, Entamoeba invadens
FFHCTQLGELILPPSVHSLYS

SEQ ID NO: 2995946 - protein, 17 aa, Entamoeba invadens
FFHFIEPHSSSYIQPSL

SEQ ID NO: 2995947 - protein, 17 aa, Entamoeba invadens
FFHIDFGHFLGNFKSKF

SEQ ID NO: 2995948 - protein, 18 aa, Entamoeba invadens
FFHTNEMLFIVNKEVRDH

SEQ ID NO: 2995949 - protein, 20 aa, Entamoeba invadens
FFINSYLCTNLYCDTCSSTG

SEQ ID NO: 2995950 - protein, 23 aa, Entamoeba invadens
FFKAQFSELKWSPKGNLVICKAQ

SEQ ID NO: 2995951 - protein, 20 aa, Entamoeba invadens
FFKCANLCYLTIPSIVQVIS

SEQ ID NO: 2995952 - protein, 19 aa, Entamoeba invadens
FFKCSSLAQIDLPNKLRDI

SEQ ID NO: 2995953 - protein, 17 aa, Entamoeba invadens
FFKFHNISSPFPTLKFL

SEQ ID NO: 2995954 - protein, 27 aa, Entamoeba invadens
FFKKYKNLCEIVFPTTIKKFESLIFDE

SEQ ID NO: 2995955 - protein, 17 aa, Entamoeba invadens
FFKRNLCVCFGRVALVN

SEQ ID NO: 2995956 - protein, 18 aa, Entamoeba invadens
FFKVILPYCKDAEVATHA

SEQ ID NO: 2995957 - protein, 19 aa, Entamoeba invadens
FFKYFIQIGVLEKLKTLIL

SEQ ID NO: 2995958 - protein, 22 aa, Entamoeba invadens
FFLEKYFYTFFCHWNSTVRQFF

SEQ ID NO: 2995959 - protein, 17 aa, Entamoeba invadens
FFLSFNDICFDKIFNEA

SEQ ID NO: 2995960 - protein, 21 aa, Entamoeba invadens
FFMKMLPKLETLEAPFECYNS

SEQ ID NO: 2995961 - protein, 17 aa, Entamoeba invadens
FFNCCFLETISIPSSVT

SEQ ID NO: 2995962 - protein, 25 aa, Entamoeba invadens
FFNCPSLTHFSFPKSLCSVGIQTFC

SEQ ID NO: 2995963 - protein, 19 aa, Entamoeba invadens
FFNCQILSEIVFNEKLTSI

SEQ ID NO: 2995964 - protein, 17 aa, Entamoeba invadens
FFNEITKKSLNKWDKKL

SEQ ID NO: 2995965 - protein, 18 aa, Entamoeba invadens
FFNEITKKSLNKWDKKLL

SEQ ID NO: 2995966 - protein, 17 aa, Entamoeba invadens
FFNEITKKSLNKWNKKL

SEQ ID NO: 2995967 - protein, 17 aa, Entamoeba invadens
FFNFPKCVKECLLELNN

SEQ ID NO: 2995968 - protein, 22 aa, Entamoeba invadens
FFNIIKDSTMTLSMCFALVIAF

SEQ ID NO: 2995969 - protein, 18 aa, Entamoeba invadens
FFNKAWSNEKLAPQAMDL

SEQ ID NO: 2995970 - protein, 24 aa, Entamoeba invadens
FFNNYVLRFKGVPGTILSLESIFL

SEQ ID NO: 2995971 - protein, 38 aa, Entamoeba invadens
FFNPMVPDFLGEQYRKIWLDWYVYYCGKLGSVPNDKIM

SEQ ID NO: 2995972 - protein, 23 aa, Entamoeba invadens
FFNQNLKVIGGFAFYNCTGLTAI

SEQ ID NO: 2995973 - protein, 20 aa, Entamoeba invadens
FFNRLQNFLIFEILDQKNIE

SEQ ID NO: 2995974 - protein, 26 aa, Entamoeba invadens
FFNRQEQFLKQLLFKTNNERFETLFN

SEQ ID NO: 2995975 - protein, 20 aa, Entamoeba invadens
FFNSFLTLNKLYLFSNVSFV

SEQ ID NO: 2995976 - protein, 28 aa, Entamoeba invadens
FFPAMYDDFFFFKYSHLIPLSAKTQNYQ

SEQ ID NO: 2995977 - protein, 19 aa, Entamoeba invadens
FFPERPKLMMTFLGEPVLF

SEQ ID NO: 2995978 - protein, 18 aa, Entamoeba invadens
FFPLKGMDFVAWNDNVQI

SEQ ID NO: 2995979 - protein, 18 aa, Entamoeba invadens
FFPNIETLNVWSLPAQFF

SEQ ID NO: 2995980 - protein, 28 aa, Entamoeba invadens
FFQCTSLTSFIFPLSLRRICDKSFAECR

SEQ ID NO: 2995981 - protein, 30 aa, Entamoeba invadens
FFQKKLSLIRWIESILKVPIDSDLCVSLAG

SEQ ID NO: 2995982 - protein, 17 aa, Entamoeba invadens
FFQSIQGMDLNDAKLGL

SEQ ID NO: 2995983 - protein, 18 aa, Entamoeba invadens
FFQTFFLEKYFYTFFCHW

SEQ ID NO: 2995984 - protein, 18 aa, Entamoeba invadens
FFQTLIQFVSNSASFPLI

SEQ ID NO: 2995985 - protein, 20 aa, Entamoeba invadens
FFQVNIWFEVTFTDYLNVGA

SEQ ID NO: 2995986 - protein, 17 aa, Entamoeba invadens
FFQWFTLMNEKYGEFKI

SEQ ID NO: 2995987 - protein, 27 aa, Entamoeba invadens
FFRCSKLPSVMFSRNLKFLGGEGFCEC

SEQ ID NO: 2995988 - protein, 29 aa, Entamoeba invadens
FFRCSNLKRVTLPPTLRTICDSAFCGCVS

SEQ ID NO: 2995989 - protein, 32 aa, Entamoeba invadens
FFRFEHFVLVELYLQLGPPLKVFIPITVVTSQ

SEQ ID NO: 2995990 - protein, 17 aa, Entamoeba invadens
FFRILTLENYGDPIFFR

SEQ ID NO: 2995991 - protein, 19 aa, Entamoeba invadens
FFRVTRIINSLRAFGFERY

SEQ ID NO: 2995992 - protein, 27 aa, Entamoeba invadens
FFSKYKNLCEIVFPTTIKKFESLILDE

SEQ ID NO: 2995993 - protein, 18 aa, Entamoeba invadens
FFSYLAKSKKKTAFHGHI

SEQ ID NO: 2995994 - protein, 27 aa, Entamoeba invadens
FFTEMRIELPFPLKKTHHLLFSIFDVS

SEQ ID NO: 2995995 - protein, 17 aa, Entamoeba invadens
FFTLQFVTKFEPSEYFF

SEQ ID NO: 2995996 - protein, 27 aa, Entamoeba invadens
FFTNEVSVVWFFKNFTPETFDSPLINL

SEQ ID NO: 2995997 - protein, 22 aa, Entamoeba invadens
FFVDKKKYWKGNVTLFPVVFSS

SEQ ID NO: 2995998 - protein, 18 aa, Entamoeba invadens
FFVELEAKLMLGDRFFRL

SEQ ID NO: 2995999 - protein, 17 aa, Entamoeba invadens
FFVETLGIHCRVTVIQS

SEQ ID NO: 2996000 - protein, 17 aa, Entamoeba invadens
FFVFSLRNNTGDQPRRF

SEQ ID NO: 2996001 - protein, 18 aa, Entamoeba invadens
FFVFSLVNPHHTTAIKIT

SEQ ID NO: 2996002 - protein, 25 aa, Entamoeba invadens
FFVSPKLEYLLPERGFLKKMMDKHV

SEQ ID NO: 2996003 - protein, 20 aa, Entamoeba invadens
FFYKKDYLMSFYKIMQADWK

SEQ ID NO: 2996004 - protein, 17 aa, Entamoeba invadens
FFYLDQEKDAYHEITKN

SEQ ID NO: 2996005 - protein, 17 aa, Entamoeba invadens
FFYLVRAVKCFCGKTPD

SEQ ID NO: 2996006 - protein, 19 aa, Entamoeba invadens
FFYNESLLEIILPSTMKSI

SEQ ID NO: 2996007 - protein, 29 aa, Entamoeba invadens
FGAKRPVSWILICRVIIYSLMELHKGTIY

SEQ ID NO: 2996008 - protein, 36 aa, Entamoeba invadens
FGCALPDPEMWFTTATIPFFDILRLAIFMSVQVKKD

SEQ ID NO: 2996009 - protein, 17 aa, Entamoeba invadens
FGCCAFYPRVCGVGSGD

SEQ ID NO: 2996010 - protein, 22 aa, Entamoeba invadens
FGCSQMCFPPPPPFGRFGGWER

SEQ ID NO: 2996011 - protein, 17 aa, Entamoeba invadens
FGDALPKPPAAGPSFLD

SEQ ID NO: 2996012 - protein, 22 aa, Entamoeba invadens
FGDIPVVLCANKSDLKFERKVD

SEQ ID NO: 2996013 - protein, 25 aa, Entamoeba invadens
FGDSFLAMYKGLNKVPFVFRYDTQN

SEQ ID NO: 2996014 - protein, 23 aa, Entamoeba invadens
FGDYCFCRCCSLCSVTIPSSVNS

SEQ ID NO: 2996015 - protein, 26 aa, Entamoeba invadens
FGDYLEVVWRLPLTLFCRMLDGNTTN

SEQ ID NO: 2996016 - protein, 27 aa, Entamoeba invadens
FGEALTLILRSPIALKRLDLGNIGLTE

SEQ ID NO: 2996017 - protein, 29 aa, Entamoeba invadens
FGEDQTLLLGLLEDKPYFVDKELTQIGWS

SEQ ID NO: 2996018 - protein, 21 aa, Entamoeba invadens
FGEDTAVFIELPFAKEETGDL

SEQ ID NO: 2996019 - protein, 27 aa, Entamoeba invadens
FGEDVGIIASFLLRYEIFEPYHAFFIP

SEQ ID NO: 2996020 - protein, 26 aa, Entamoeba invadens
FGEFEFAHFLVQNLVAIVFYNTNKSN

SEQ ID NO: 2996021 - protein, 26 aa, Entamoeba invadens
FGEFEFFHYLVQNLVALVYYNTDKRN

SEQ ID NO: 2996022 - protein, 26 aa, Entamoeba invadens
FGEFEFLHYLVQNLVALVYYNTDKRY

SEQ ID NO: 2996023 - protein, 28 aa, Entamoeba invadens
FGEHTLPPIYWRYAFEEHVWSDPIPLNI

SEQ ID NO: 2996024 - protein, 20 aa, Entamoeba invadens
FGEIGVMRRLKKVEFLGSTL

SEQ ID NO: 2996025 - protein, 28 aa, Entamoeba invadens
FGESSDDFLFQITPFISVSKDFNDCRVS

SEQ ID NO: 2996026 - protein, 27 aa, Entamoeba invadens
FGEWERYHFLVQNLVALVFYNTDKKNN

SEQ ID NO: 2996027 - protein, 19 aa, Entamoeba invadens
FGFCGMLSKVVLPQTIKSL

SEQ ID NO: 2996028 - protein, 18 aa, Entamoeba invadens
FGFGLSYTEFEYSVPIVI

SEQ ID NO: 2996029 - protein, 18 aa, Entamoeba invadens
FGFGVPSLYLNDMVIQCV

SEQ ID NO: 2996030 - protein, 24 aa, Entamoeba invadens
FGFGVSKFLTFLQAIGGYDDGEKE

SEQ ID NO: 2996031 - protein, 23 aa, Entamoeba invadens
FGFKCIFILVRQTVQKSHKVDYF

SEQ ID NO: 2996032 - protein, 21 aa, Entamoeba invadens
FGFLVYKYYAITGNPVHFHFP

SEQ ID NO: 2996033 - protein, 23 aa, Entamoeba invadens
FGFNFVALDFAMNSSFKGLCEII

SEQ ID NO: 2996034 - protein, 17 aa, Entamoeba invadens
FGFYQKDMIPLVKSNEP

SEQ ID NO: 2996035 - protein, 23 aa, Entamoeba invadens
FGGGHAIGVFKKGSLSRSYCNPS

SEQ ID NO: 2996036 - protein, 26 aa, Entamoeba invadens
FGGHDWHLLGNAKITKFWSIQRDAFK

SEQ ID NO: 2996037 - protein, 27 aa, Entamoeba invadens
FGGKHSFITLRELFKWADRHASSYEEL

SEQ ID NO: 2996038 - protein, 27 aa, Entamoeba invadens
FGGKLKDIWWMLLVTSQMTDLNFMNVG

SEQ ID NO: 2996039 - protein, 28 aa, Entamoeba invadens
FGGKLSQFVIRFVLDRIRLGRENLLYLV

SEQ ID NO: 2996040 - protein, 23 aa, Entamoeba invadens
FGGLYYRGVGVVTPIFSLRTRES

SEQ ID NO: 2996041 - protein, 24 aa, Entamoeba invadens
FGGNLLNIKIIKDPFGKWMNGEIM

SEQ ID NO: 2996042 - protein, 18 aa, Entamoeba invadens
FGHWKTFFDLANKEENGF

SEQ ID NO: 2996043 - protein, 25 aa, Entamoeba invadens
FGIQLEPMTPYFRFEELFNGFVEDE

SEQ ID NO: 2996044 - protein, 28 aa, Entamoeba invadens
FGKDDFSMNLLLVYIYEKRINIDVMHKE

SEQ ID NO: 2996045 - protein, 22 aa, Entamoeba invadens
FGKDVLSLKYISPAIYDVMDKY

SEQ ID NO: 2996046 - protein, 18 aa, Entamoeba invadens
FGKFIEIQFQANKVIGCK

SEQ ID NO: 2996047 - protein, 17 aa, Entamoeba invadens
FGKGVMEYLKINNMLFN

SEQ ID NO: 2996048 - protein, 24 aa, Entamoeba invadens
FGKIKMYFKVMIIKVKNLDTLSER

SEQ ID NO: 2996049 - protein, 22 aa, Entamoeba invadens
FGKILSGLHLAKVGGLSDFKQA

SEQ ID NO: 2996050 - protein, 36 aa, Entamoeba invadens
FGKKFDRDAYGFKGNPFVFPLQNENQNLPFSTMFSS

SEQ ID NO: 2996051 - protein, 24 aa, Entamoeba invadens
FGKRILREKFILKPLMDVEKILKR

SEQ ID NO: 2996052 - protein, 19 aa, Entamoeba invadens
FGLCAIVFAFHKIPDFDYI

SEQ ID NO: 2996053 - protein, 27 aa, Entamoeba invadens
FGLCENQIHFFPQGMLPVTDFNGKTLY

SEQ ID NO: 2996054 - protein, 19 aa, Entamoeba invadens
FGLCWNIKTLSFPNLLLNI

SEQ ID NO: 2996055 - protein, 21 aa, Entamoeba invadens
FGLDNWAAVASNLPFRDHFDC

SEQ ID NO: 2996056 - protein, 21 aa, Entamoeba invadens
FGLEKALKYLYTSGIDSEGLF

SEQ ID NO: 2996057 - protein, 18 aa, Entamoeba invadens
FGLFLPKSPNCFDTLSFA

SEQ ID NO: 2996058 - protein, 28 aa, Entamoeba invadens
FGLRCFMYNNLLIAITLSCNLREIPDIC

SEQ ID NO: 2996059 - protein, 19 aa, Entamoeba invadens
FGLRILGVSGIFKFYDVNK

SEQ ID NO: 2996060 - protein, 18 aa, Entamoeba invadens
FGMCKKNFPKIYGQKEMK

SEQ ID NO: 2996061 - protein, 17 aa, Entamoeba invadens
FGMEHVMKFFEVSTLLP

SEQ ID NO: 2996062 - protein, 17 aa, Entamoeba invadens
FGMFYGNCKDRVLIPYD

SEQ ID NO: 2996063 - protein, 34 aa, Entamoeba invadens
FGMKEWAEELGATCFTHWFQPLSSSTARKYDSFL

SEQ ID NO: 2996064 - protein, 18 aa, Entamoeba invadens
FGMNQYFKSIPLKQNILV

SEQ ID NO: 2996065 - protein, 22 aa, Entamoeba invadens
FGMTSQLLCQCGLEYFADEVPS

SEQ ID NO: 2996066 - protein, 21 aa, Entamoeba invadens
FGNAKLVYEGLLSSGCQYMPN

SEQ ID NO: 2996067 - protein, 20 aa, Entamoeba invadens
FGNGFAIFSFRFEDVGYDDS

SEQ ID NO: 2996068 - protein, 23 aa, Entamoeba invadens
FGNHYFYKCYNLNKIVIPAGVET

SEQ ID NO: 2996069 - protein, 17 aa, Entamoeba invadens
FGNIGMPTLNFGTLNIG

SEQ ID NO: 2996070 - protein, 18 aa, Entamoeba invadens
FGNIYSHLKLMFGSNVSS

SEQ ID NO: 2996071 - protein, 24 aa, Entamoeba invadens
FGNNCFYYCSYLESITLPPHIKKL

SEQ ID NO: 2996072 - protein, 27 aa, Entamoeba invadens
FGNNKLLFLEKVATIPLKIIISLKKDM

SEQ ID NO: 2996073 - protein, 23 aa, Entamoeba invadens
FGNSFHLCREILKMMKLVVDAFC

SEQ ID NO: 2996074 - protein, 41 aa, Entamoeba invadens
FGPHPLEVFAMIAAMKILCSKNFVLLSPQYPLNNLPNEMKP

SEQ ID NO: 2996075 - protein, 29 aa, Entamoeba invadens
FGPNGALVYCLEYFLDNLEWFDEKLGDYD

SEQ ID NO: 2996076 - protein, 20 aa, Entamoeba invadens
FGPNKIPCVGFSVGLERIMI

SEQ ID NO: 2996077 - protein, 31 aa, Entamoeba invadens
FGQKLPVPVNYLKQALFPLVVVTSSVMNISK

SEQ ID NO: 2996078 - protein, 21 aa, Entamoeba invadens
FGQTRPMFFQNQHTQLFLNGF

SEQ ID NO: 2996079 - protein, 23 aa, Entamoeba invadens
FGRDRVLFHYNGHGVPLPTLNHE

SEQ ID NO: 2996080 - protein, 24 aa, Entamoeba invadens
FGRGSLMNLLRQFASLMVDGDRQI

SEQ ID NO: 2996081 - protein, 17 aa, Entamoeba invadens
FGRLAVARVKLGKLNEA

SEQ ID NO: 2996082 - protein, 17 aa, Entamoeba invadens
FGRLKTVYAFAREKYNK

SEQ ID NO: 2996083 - protein, 25 aa, Entamoeba invadens
FGRNDPDFLWEVPKILELGDDVREK

SEQ ID NO: 2996084 - protein, 20 aa, Entamoeba invadens
FGRSEWVVIFSLIYEIFSVK

SEQ ID NO: 2996085 - protein, 24 aa, Entamoeba invadens
FGSFHGILPEKQGAWVREDKDQFI

SEQ ID NO: 2996086 - protein, 35 aa, Entamoeba invadens
FGSKHLPLLAMLFTPTPVLPLYNKAQTKLRGILFA

SEQ ID NO: 2996087 - protein, 26 aa, Entamoeba invadens
FGTEGNLWYLLNRLFAKLNALEHSEL

SEQ ID NO: 2996088 - protein, 24 aa, Entamoeba invadens
FGTHLCFANLPFLNEIRLPTTLTK

SEQ ID NO: 2996089 - protein, 22 aa, Entamoeba invadens
FGTNCFFSCDLLRDNPSIPKEA

SEQ ID NO: 2996090 - protein, 26 aa, Entamoeba invadens
FGVAALKKFWRKMRQWKTYGRMVLEN

SEQ ID NO: 2996091 - protein, 21 aa, Entamoeba invadens
FGVFVLFNKLDTIKLRYTVGD

SEQ ID NO: 2996092 - protein, 17 aa, Entamoeba invadens
FGVFYHQVKSRKEMFGS

SEQ ID NO: 2996093 - protein, 18 aa, Entamoeba invadens
FGVGYGYHIRSEGKSYIG

SEQ ID NO: 2996094 - protein, 24 aa, Entamoeba invadens
FGVKVLFYYSRLLNMRSMLEEAES

SEQ ID NO: 2996095 - protein, 17 aa, Entamoeba invadens
FGVLPNINTLTSSIEYA

SEQ ID NO: 2996096 - protein, 17 aa, Entamoeba invadens
FGVTMFEVVGWSEAYQK

SEQ ID NO: 2996097 - protein, 18 aa, Entamoeba invadens
FGWCDRLLLRTIKVDHGC

SEQ ID NO: 2996098 - protein, 24 aa, Entamoeba invadens
FGWCKGLKRVKLPFALKSSGMNIF

SEQ ID NO: 2996099 - protein, 27 aa, Entamoeba invadens
FGWDAEPLFFPIRVLRKVQSKVEPVES

SEQ ID NO: 2996100 - protein, 25 aa, Entamoeba invadens
FGWGNIYPKETFPFPWKIAEFVIKG

SEQ ID NO: 2996101 - protein, 23 aa, Entamoeba invadens
FGYCSKLCLITIPTSVTSINAKC

SEQ ID NO: 2996102 - protein, 33 aa, Entamoeba invadens
FGYDQNWWFEAYLKTLTFLLLQNDTDTFMKILK

SEQ ID NO: 2996103 - protein, 19 aa, Entamoeba invadens
FGYELWVDQYIKARQPTEL

SEQ ID NO: 2996104 - protein, 20 aa, Entamoeba invadens
FGYNHSFKRIPNLSKLNIFV

SEQ ID NO: 2996105 - protein, 25 aa, Entamoeba invadens
FGYTFKLIRLIFDDLVDIHKYESKQ

SEQ ID NO: 2996106 - protein, 47 aa, Entamoeba invadens
FGYVEMIIVRLMIALKTQLYPFLDTYFPILLSRCKLSLPPTSTHGGL

SEQ ID NO: 2996107 - protein, 25 aa, Entamoeba invadens
FGYVMTMDLFGISLSTFRSLQPDKK

SEQ ID NO: 2996108 - protein, 25 aa, Entamoeba invadens
FHADRVHYVLNEFIQAGLILNIDTD

SEQ ID NO: 2996109 - protein, 17 aa, Entamoeba invadens
FHAVFRMRLIEMRHLVF

SEQ ID NO: 2996110 - protein, 19 aa, Entamoeba invadens
FHCASLTCVTLPSALTRIK

SEQ ID NO: 2996111 - protein, 18 aa, Entamoeba invadens
FHDNSLWIVMEICGAGSV

SEQ ID NO: 2996112 - protein, 21 aa, Entamoeba invadens
FHECGHLIHTLLAEAKYPQFT

SEQ ID NO: 2996113 - protein, 30 aa, Entamoeba invadens
FHEYSSHDITLYMFLALLGYETDKWIPLAS

SEQ ID NO: 2996114 - protein, 24 aa, Entamoeba invadens
FHFECRGVQYGFIVPELCIFAEDK

SEQ ID NO: 2996115 - protein, 17 aa, Entamoeba invadens
FHFNPILLDFKTLRYFP

SEQ ID NO: 2996116 - protein, 17 aa, Entamoeba invadens
FHFNPIPLTIKTLKYFT

SEQ ID NO: 2996117 - protein, 17 aa, Entamoeba invadens
FHFNPISITLNTQRYFP

SEQ ID NO: 2996118 - protein, 17 aa, Entamoeba invadens
FHFPYTHSPKEKNYDDR

SEQ ID NO: 2996119 - protein, 24 aa, Entamoeba invadens
FHFQIVMKYFLYEQDYINSMLTCK

SEQ ID NO: 2996120 - protein, 25 aa, Entamoeba invadens
FHFQIVMKYFLYEQNFINSMLTCKK

SEQ ID NO: 2996121 - protein, 18 aa, Entamoeba invadens
FHGKKSVKFYIDTTKLIL

SEQ ID NO: 2996122 - protein, 35 aa, Entamoeba invadens
FHGPKGVGCLFIRAGRPIIPLLHGGEQMGGLRSGT

SEQ ID NO: 2996123 - protein, 18 aa, Entamoeba invadens
FHHFVSLRIDTTLDELPF

SEQ ID NO: 2996124 - protein, 17 aa, Entamoeba invadens
FHIELHATSLDDLKEEE

SEQ ID NO: 2996125 - protein, 19 aa, Entamoeba invadens
FHKCFSLQNIVFPSSLHSI

SEQ ID NO: 2996126 - protein, 18 aa, Entamoeba invadens
FHKGFLQAGGTIEKTPLV

SEQ ID NO: 2996127 - protein, 32 aa, Entamoeba invadens
FHLESAPGLLILYLVSLHQPLLPRDHTKHFVS

SEQ ID NO: 2996128 - protein, 26 aa, Entamoeba invadens
FHLKYFEACLVEFTWAGVYSPSYSVN

SEQ ID NO: 2996129 - protein, 21 aa, Entamoeba invadens
FHLPFNYFSLENDFLAKPIME

SEQ ID NO: 2996130 - protein, 17 aa, Entamoeba invadens
FHLYVCVAILKKYSAKL

SEQ ID NO: 2996131 - protein, 19 aa, Entamoeba invadens
FHMMIVAKYFVSITDFLFL

SEQ ID NO: 2996132 - protein, 18 aa, Entamoeba invadens
FHMMIVSKYFLTYKDFYR

SEQ ID NO: 2996133 - protein, 22 aa, Entamoeba invadens
FHNEHPLMYPDFVIGDRDKNAD

SEQ ID NO: 2996134 - protein, 17 aa, Entamoeba invadens
FHNSMTLSFRKLLDKRT

SEQ ID NO: 2996135 - protein, 30 aa, Entamoeba invadens
FHNVDNKPFCKNCFVLKFAKLCATCGKPIT

SEQ ID NO: 2996136 - protein, 24 aa, Entamoeba invadens
FHNVTSSYFRGTHGCVIVYDVNKV

SEQ ID NO: 2996137 - protein, 20 aa, Entamoeba invadens
FHNYSLLYDTPVVLLSKHEN

SEQ ID NO: 2996138 - protein, 40 aa, Entamoeba invadens
FHPDTLNCNFLPISFDYLLKPIYIRNYILEGTPEMIEKIT

SEQ ID NO: 2996139 - protein, 19 aa, Entamoeba invadens
FHPDYLMDNIPPTPVSTLR

SEQ ID NO: 2996140 - protein, 28 aa, Entamoeba invadens
FHPKEPWVLAALHTGSIYILNYQTKSIV

SEQ ID NO: 2996141 - protein, 25 aa, Entamoeba invadens
FHPQVMMKTVTILGDLYDPSGVLTG

SEQ ID NO: 2996142 - protein, 20 aa, Entamoeba invadens
FHQFVQIQPTDFLIICGDIT

SEQ ID NO: 2996143 - protein, 25 aa, Entamoeba invadens
FHRDDTYLPLFYNKSKVNNLFMRKV

SEQ ID NO: 2996144 - protein, 18 aa, Entamoeba invadens
FHTNPFPLSTKTLKYFPS

SEQ ID NO: 2996145 - protein, 25 aa, Entamoeba invadens
FHTRQKLQFSPPLIKGKPKLVEVIY

SEQ ID NO: 2996146 - protein, 22 aa, Entamoeba invadens
FHVETIRLKGFIGRMKLSETVK

SEQ ID NO: 2996147 - protein, 25 aa, Entamoeba invadens
FHVNMVIFKKLYPYNYYNADRIQNN

SEQ ID NO: 2996148 - protein, 17 aa, Entamoeba invadens
FHYDFSIAGPDRNTLRV

SEQ ID NO: 2996149 - protein, 18 aa, Entamoeba invadens
FHYNPIPLTFNTLHYFTH

SEQ ID NO: 2996150 - protein, 18 aa, Entamoeba invadens
FHYNPIPLTLKTIEFFES

SEQ ID NO: 2996151 - protein, 17 aa, Entamoeba invadens
FIAFRNYITKHINEIDR

SEQ ID NO: 2996152 - protein, 29 aa, Entamoeba invadens
FIARAFYQSFGLPLIITRGNNVFGPHQFP

SEQ ID NO: 2996153 - protein, 25 aa, Entamoeba invadens
FIASQFPLNFPDLEKIYLRDITVPK

SEQ ID NO: 2996154 - protein, 17 aa, Entamoeba invadens
FIDALCMMAGCKHKIHF

SEQ ID NO: 2996155 - protein, 18 aa, Entamoeba invadens
FIDFLRTKMGSLREVKNV

SEQ ID NO: 2996156 - protein, 22 aa, Entamoeba invadens
FIDKTVLIPFQNLTAFLEKENV

SEQ ID NO: 2996157 - protein, 19 aa, Entamoeba invadens
FIDLKMKILDEFTQSTKRL

SEQ ID NO: 2996158 - protein, 21 aa, Entamoeba invadens
FIDMLFAMEQLGVDVFSFGEY

SEQ ID NO: 2996159 - protein, 22 aa, Entamoeba invadens
FIDSPICCVLVLSILKQNASVA

SEQ ID NO: 2996160 - protein, 18 aa, Entamoeba invadens
FIDTSVIPTFRSEDLPTF

SEQ ID NO: 2996161 - protein, 18 aa, Entamoeba invadens
FIDYFKQPDEKKLFILEE

SEQ ID NO: 2996162 - protein, 18 aa, Entamoeba invadens
FIDYFKQPDNKKLFILEE

SEQ ID NO: 2996163 - protein, 20 aa, Entamoeba invadens
FIDYFKQPYDKKLFILEECV

SEQ ID NO: 2996164 - protein, 17 aa, Entamoeba invadens
FIEALVGFQFNVVESTI

SEQ ID NO: 2996165 - protein, 17 aa, Entamoeba invadens
FIECKTGYKLNTTTNKC

SEQ ID NO: 2996166 - protein, 19 aa, Entamoeba invadens
FIECLNGSYFKYIVMEYVE

SEQ ID NO: 2996167 - protein, 25 aa, Entamoeba invadens
FIECQNLKEIVFPPGLKKIPNKVCM

SEQ ID NO: 2996168 - protein, 19 aa, Entamoeba invadens
FIEESYLCAYANYTENHFV

SEQ ID NO: 2996169 - protein, 17 aa, Entamoeba invadens
FIEFFRAIDTNMGGTID

SEQ ID NO: 2996170 - protein, 34 aa, Entamoeba invadens
FIEGSIFEIPFGNIPILFISQTLRFEGCMWGFIN

SEQ ID NO: 2996171 - protein, 20 aa, Entamoeba invadens
FIEKMLCVFNRMISDFAKET

SEQ ID NO: 2996172 - protein, 18 aa, Entamoeba invadens
FIELIPGTETKDVSENKK

SEQ ID NO: 2996173 - protein, 18 aa, Entamoeba invadens
FIENDNALYAFIAEDLDE

SEQ ID NO: 2996174 - protein, 17 aa, Entamoeba invadens
FIENLYNSNLTKTMLFT

SEQ ID NO: 2996175 - protein, 19 aa, Entamoeba invadens
FIENMPQTEFKWIYNILDG

SEQ ID NO: 2996176 - protein, 19 aa, Entamoeba invadens
FIEPDLHVLARLFEIINGI

SEQ ID NO: 2996177 - protein, 19 aa, Entamoeba invadens
FIEQFFFPNVHQFTTDYIQ

SEQ ID NO: 2996178 - protein, 24 aa, Entamoeba invadens
FIERKKMLLSKFKFKITINNTLSN

SEQ ID NO: 2996179 - protein, 26 aa, Entamoeba invadens
FIESITDTLLLLLTTALRVENGASAV

SEQ ID NO: 2996180 - protein, 19 aa, Entamoeba invadens
FIETFKDYFEIMKTVWGTE

SEQ ID NO: 2996181 - protein, 23 aa, Entamoeba invadens
FIETFKDYFEVMKTVWGMEGNDK

SEQ ID NO: 2996182 - protein, 21 aa, Entamoeba invadens
FIEVAIQPVFLQYASELNTKN

SEQ ID NO: 2996183 - protein, 17 aa, Entamoeba invadens
FIFCKNLTNVKLPDNLQ

SEQ ID NO: 2996184 - protein, 20 aa, Entamoeba invadens
FIFDYLRGAKLDLPFEVMSG

SEQ ID NO: 2996185 - protein, 17 aa, Entamoeba invadens
FIFKITQKSMKKFNLKN

SEQ ID NO: 2996186 - protein, 18 aa, Entamoeba invadens
FIFRNLKYVVRKLMDIKL

SEQ ID NO: 2996187 - protein, 17 aa, Entamoeba invadens
FIGAFRFIANNFELMTD

SEQ ID NO: 2996188 - protein, 30 aa, Entamoeba invadens
FIGDAIISFLLKYKYADLALLFVRDTHAKF

SEQ ID NO: 2996189 - protein, 23 aa, Entamoeba invadens
FIGGRGMLPLKKGDRIYLLAKSG

SEQ ID NO: 2996190 - protein, 30 aa, Entamoeba invadens
FIGHLNLRGFFPSHFIVKIIRQLLDDYVDQ

SEQ ID NO: 2996191 - protein, 34 aa, Entamoeba invadens
FIGPNIPNPYIIWVYCFVLFPKQISEEPLFTQYG

SEQ ID NO: 2996192 - protein, 18 aa, Entamoeba invadens
FIGVFDGHLGTSAAEFCC

SEQ ID NO: 2996193 - protein, 26 aa, Entamoeba invadens
FIGVSSLLIIALLKNEILQLNGEHTE

SEQ ID NO: 2996194 - protein, 20 aa, Entamoeba invadens
FIHDMHVKIGDFGLAAQLDS

SEQ ID NO: 2996195 - protein, 17 aa, Entamoeba invadens
FIHEIFFQINNISGLRD

SEQ ID NO: 2996196 - protein, 21 aa, Entamoeba invadens
FIHLEFVCQLYKETMSKFHYN

SEQ ID NO: 2996197 - protein, 20 aa, Entamoeba invadens
FIHNRILRKITLSPNLHEIP

SEQ ID NO: 2996198 - protein, 18 aa, Entamoeba invadens
FIICDIAPIFGCQITACL

SEQ ID NO: 2996199 - protein, 17 aa, Entamoeba invadens
FIIGKKGEDLYIIDQHA

SEQ ID NO: 2996200 - protein, 18 aa, Entamoeba invadens
FIIKPHLYDELEASFYIE

SEQ ID NO: 2996201 - protein, 18 aa, Entamoeba invadens
FIITNFAAIFPNFGGNFT

SEQ ID NO: 2996202 - protein, 19 aa, Entamoeba invadens
FIITTLSIVLVKFKRQVDI

SEQ ID NO: 2996203 - protein, 17 aa, Entamoeba invadens
FIKAMTEKDLLTITLSQ

SEQ ID NO: 2996204 - protein, 25 aa, Entamoeba invadens
FIKDTTPIMVTFKLTLKSLNNADNE

SEQ ID NO: 2996205 - protein, 18 aa, Entamoeba invadens
FIKFTSKYQRKIIASHYM

SEQ ID NO: 2996206 - protein, 34 aa, Entamoeba invadens
FIKIIKKLKITPISGGFLFMYDVSAIVDTVRRLS

SEQ ID NO: 2996207 - protein, 23 aa, Entamoeba invadens
FIKKSIFVCNTLTKITFCGKKCI

SEQ ID NO: 2996208 - protein, 19 aa, Entamoeba invadens
FIKNRFIAQRNVLMYHFIH

SEQ ID NO: 2996209 - protein, 25 aa, Entamoeba invadens
FIKQAVIPFFKSRRGLLKTYGKDVE

SEQ ID NO: 2996210 - protein, 24 aa, Entamoeba invadens
FIKQRNLSLFKLYDDKHLSENNFN

SEQ ID NO: 2996211 - protein, 23 aa, Entamoeba invadens
FIKQTSRPVLWIDTIRDLDFDIV

SEQ ID NO: 2996212 - protein, 26 aa, Entamoeba invadens
FILEKYSIHLLVKLSDAMILRFAIPS

SEQ ID NO: 2996213 - protein, 17 aa, Entamoeba invadens
FILFCTNVCNIISPIRS

SEQ ID NO: 2996214 - protein, 25 aa, Entamoeba invadens
FILKKYSIHLLVKLGDALILRFAIP

SEQ ID NO: 2996215 - protein, 17 aa, Entamoeba invadens
FILLRGNHEERLVTSMY

SEQ ID NO: 2996216 - protein, 17 aa, Entamoeba invadens
FILPDFLSDEIQSNVYV

SEQ ID NO: 2996217 - protein, 18 aa, Entamoeba invadens
FIMATYLADKVIVYDGEP

SEQ ID NO: 2996218 - protein, 19 aa, Entamoeba invadens
FIMCSQLKSITFPSSLTYL

SEQ ID NO: 2996219 - protein, 20 aa, Entamoeba invadens
FIMVITNTKVFMLTPDFALL

SEQ ID NO: 2996220 - protein, 17 aa, Entamoeba invadens
FINFDHFTITSSSLFPS

SEQ ID NO: 2996221 - protein, 18 aa, Entamoeba invadens
FINIPAKVFAQQITLIEF

SEQ ID NO: 2996222 - protein, 17 aa, Entamoeba invadens
FINITRKVADFAVAMED

SEQ ID NO: 2996223 - protein, 19 aa, Entamoeba invadens
FINLVIKEKAAFIPTEAFV

SEQ ID NO: 2996224 - protein, 25 aa, Entamoeba invadens
FINSCPRDWLLCQTHFVENAEKLDC

SEQ ID NO: 2996225 - protein, 17 aa, Entamoeba invadens
FINSEFFFEWVEKILVP

SEQ ID NO: 2996226 - protein, 18 aa, Entamoeba invadens
FINVFDLTQVLFSTMQRL

SEQ ID NO: 2996227 - protein, 25 aa, Entamoeba invadens
FIPEKKDLLTKLKGIRMLENFPVYQ

SEQ ID NO: 2996228 - protein, 19 aa, Entamoeba invadens
FIPNYYEKLYEPSSANLKP

SEQ ID NO: 2996229 - protein, 18 aa, Entamoeba invadens
FIQVPKQVGEKRTIQVVV

SEQ ID NO: 2996230 - protein, 32 aa, Entamoeba invadens
FIRGVQMDFLVLPILQLLCYKFPKDMSEEEEL

SEQ ID NO: 2996231 - protein, 17 aa, Entamoeba invadens
FIRKILVETLAKYPDQV

SEQ ID NO: 2996232 - protein, 19 aa, Entamoeba invadens
FIRTIGYNWFIPLASSTYN

SEQ ID NO: 2996233 - protein, 18 aa, Entamoeba invadens
FIRTKFRCGMWERVEPNP

SEQ ID NO: 2996234 - protein, 19 aa, Entamoeba invadens
FISDIQWKPQVYGDDCIFA

SEQ ID NO: 2996235 - protein, 30 aa, Entamoeba invadens
FISGFKLVFNSRLLTIFSPRELQLLVSGSD

SEQ ID NO: 2996236 - protein, 24 aa, Entamoeba invadens
FISHFPQFIPYNLEKSRKYFTNVY

SEQ ID NO: 2996237 - protein, 18 aa, Entamoeba invadens
FISKKFSVGAAIDKTQNI

SEQ ID NO: 2996238 - protein, 17 aa, Entamoeba invadens
FISLLCELVIDSPTPFP

SEQ ID NO: 2996239 - protein, 18 aa, Entamoeba invadens
FISMNNLQTKFPLKETFE

SEQ ID NO: 2996240 - protein, 18 aa, Entamoeba invadens
FISNFFVTNLSFDGFIFS

SEQ ID NO: 2996241 - protein, 23 aa, Entamoeba invadens
FISTFECLPLAATITRGIGEFFC

SEQ ID NO: 2996242 - protein, 19 aa, Entamoeba invadens
FISTTFDAPPLSMSDIKEI

SEQ ID NO: 2996243 - protein, 27 aa, Entamoeba invadens
FITGEASLFLIKYFADGKHQFMENTFN

SEQ ID NO: 2996244 - protein, 19 aa, Entamoeba invadens
FITGSKYWIFGVTGKNDRN

SEQ ID NO: 2996245 - protein, 18 aa, Entamoeba invadens
FITLVGTLPIKYLENNYN

SEQ ID NO: 2996246 - protein, 25 aa, Entamoeba invadens
FITNTKALHFALTRGLFFEITEYSL

SEQ ID NO: 2996247 - protein, 19 aa, Entamoeba invadens
FITQQPFTRNWTPKPRKVK

SEQ ID NO: 2996248 - protein, 17 aa, Entamoeba invadens
FIVAVIIERIVIQNNIT

SEQ ID NO: 2996249 - protein, 41 aa, Entamoeba invadens
FIVDDVTERKTLFNCLALSITVLAKKKLTTGTIERLFRDAE

SEQ ID NO: 2996250 - protein, 18 aa, Entamoeba invadens
FIVEKVMEPPKKWMYFFL

SEQ ID NO: 2996251 - protein, 19 aa, Entamoeba invadens
FIVNNKKRKARPLDQNWCR

SEQ ID NO: 2996252 - protein, 18 aa, Entamoeba invadens
FIWDIKYGEPAKKIKMLK

SEQ ID NO: 2996253 - protein, 25 aa, Entamoeba invadens
FIYCGFITIKMPFDEFIKFAVKIER

SEQ ID NO: 2996254 - protein, 25 aa, Entamoeba invadens
FIYENISVRFYPQSPPKSPKRIHSP

SEQ ID NO: 2996255 - protein, 19 aa, Entamoeba invadens
FIYNLVNNKYFTPSTTLSV

SEQ ID NO: 2996256 - protein, 22 aa, Entamoeba invadens
FKAIFSMCDGCSLFHKKDGKLS

SEQ ID NO: 2996257 - protein, 18 aa, Entamoeba invadens
FKALLLYHHLSKNGVTSI

SEQ ID NO: 2996258 - protein, 23 aa, Entamoeba invadens
FKARVMLLTEALTGFDHQLSVLA

SEQ ID NO: 2996259 - protein, 18 aa, Entamoeba invadens
FKCAHIQEIAIPDSVTFL

SEQ ID NO: 2996260 - protein, 19 aa, Entamoeba invadens
FKCEEECFLDVNILQFIAL

SEQ ID NO: 2996261 - protein, 24 aa, Entamoeba invadens
FKCEKLSNIVIPLNIKLIGEYCFF

SEQ ID NO: 2996262 - protein, 17 aa, Entamoeba invadens
FKCISLTSIGIPPSIKS

SEQ ID NO: 2996263 - protein, 25 aa, Entamoeba invadens
FKCTKFECLECQTGFYLNDNKLCSL

SEQ ID NO: 2996264 - protein, 24 aa, Entamoeba invadens
FKDDNIEELLFKISGFIEIKRGYC

SEQ ID NO: 2996265 - protein, 18 aa, Entamoeba invadens
FKDIDFDKLLKKEVPPPW

SEQ ID NO: 2996266 - protein, 21 aa, Entamoeba invadens
FKDIKRDLLGSKAFCDLLALN

SEQ ID NO: 2996267 - protein, 29 aa, Entamoeba invadens
FKDKLFNTIPHFLLTYSQLNLSITSILFP

SEQ ID NO: 2996268 - protein, 17 aa, Entamoeba invadens
FKDLSWINLLKNTKTLI

SEQ ID NO: 2996269 - protein, 18 aa, Entamoeba invadens
FKDNLKAVILFPEYYKNP

SEQ ID NO: 2996270 - protein, 27 aa, Entamoeba invadens
FKDNLMVFLGYSCLLHQCCWRVLKEST

SEQ ID NO: 2996271 - protein, 19 aa, Entamoeba invadens
FKDPIKWNTKRNVKCGICI

SEQ ID NO: 2996272 - protein, 24 aa, Entamoeba invadens
FKDSLALITAPLSAFPKMFGLSNI

SEQ ID NO: 2996273 - protein, 25 aa, Entamoeba invadens
FKDSYTLISTSFAPFPKMFGLSNIQ

SEQ ID NO: 2996274 - protein, 18 aa, Entamoeba invadens
FKDYSYFTITRALSSVTS

SEQ ID NO: 2996275 - protein, 25 aa, Entamoeba invadens
FKECSKLSCIVIPSSVTFIGKNCFD

SEQ ID NO: 2996276 - protein, 26 aa, Entamoeba invadens
FKEDTPLGLVFLKTDSEKHAEHLIKK

SEQ ID NO: 2996277 - protein, 18 aa, Entamoeba invadens
FKEEKTLIFLNCHLIYIA

SEQ ID NO: 2996278 - protein, 31 aa, Entamoeba invadens
FKEGQPMVYRLIWLNFPERKLRLVRHRKTKE

SEQ ID NO: 2996279 - protein, 30 aa, Entamoeba invadens
FKEGYEYLRLLFGPVKIPFPPGTYVENFLN

SEQ ID NO: 2996280 - protein, 19 aa, Entamoeba invadens
FKEIKVTYPVDALDKIIAS

SEQ ID NO: 2996281 - protein, 31 aa, Entamoeba invadens
FKEKDARAEELWSLVSLFASLEQENGKEGCG

SEQ ID NO: 2996282 - protein, 27 aa, Entamoeba invadens
FKELFGFIQDPLTLHRIYIRAKYQAKQ

SEQ ID NO: 2996283 - protein, 23 aa, Entamoeba invadens
FKELLEEQIPIKLKPFDIACIKF

SEQ ID NO: 2996284 - protein, 29 aa, Entamoeba invadens
FKEPAKRLMFLVFDRTHTLLPKCEEFANY

SEQ ID NO: 2996285 - protein, 34 aa, Entamoeba invadens
FKEQRKALYTSIFLFLLKAFPKIETLQCVDFMLG

SEQ ID NO: 2996286 - protein, 17 aa, Entamoeba invadens
FKESDVLVWLSILPLQY

SEQ ID NO: 2996287 - protein, 26 aa, Entamoeba invadens
FKESGEGWFFGCWQPRDILSGKNDIY

SEQ ID NO: 2996288 - protein, 17 aa, Entamoeba invadens
FKFFGASVLLVYDADQK

SEQ ID NO: 2996289 - protein, 17 aa, Entamoeba invadens
FKFGKTKIFFKDKEIEA

SEQ ID NO: 2996290 - protein, 31 aa, Entamoeba invadens
FKFGTDLLQSGWRVAPYYPIIEGSVVEKQKK

SEQ ID NO: 2996291 - protein, 17 aa, Entamoeba invadens
FKFPWKIAEFVIKGNHL

SEQ ID NO: 2996292 - protein, 18 aa, Entamoeba invadens
FKFPWKIAEFVTARKRLE

SEQ ID NO: 2996293 - protein, 23 aa, Entamoeba invadens
FKGCGLLKIIPLPITVESYGAST

SEQ ID NO: 2996294 - protein, 24 aa, Entamoeba invadens
FKGCISLHKIGCLQLLHFSTSSLC

SEQ ID NO: 2996295 - protein, 18 aa, Entamoeba invadens
FKGCKFCDNTIPNKCLLC

SEQ ID NO: 2996296 - protein, 33 aa, Entamoeba invadens
FKGCVQDITWLPGGLMFMACSIDGFVGFFKLTE

SEQ ID NO: 2996297 - protein, 28 aa, Entamoeba invadens
FKGEHLHCVLPLWLKNKLPSNVKVDYVG

SEQ ID NO: 2996298 - protein, 28 aa, Entamoeba invadens
FKGEMPEIPKIYFLAQTFKELVDVLKTR

SEQ ID NO: 2996299 - protein, 17 aa, Entamoeba invadens
FKGISHLPGDDGLKFHT

SEQ ID NO: 2996300 - protein, 18 aa, Entamoeba invadens
FKGKFPPNCKNITAIFAC

SEQ ID NO: 2996301 - protein, 26 aa, Entamoeba invadens
FKGKIWAKVFIKSKPQRYGIKFCFLF

SEQ ID NO: 2996302 - protein, 26 aa, Entamoeba invadens
FKGKIWAKVFIKSKPQRYGIKFWKEE

SEQ ID NO: 2996303 - protein, 27 aa, Entamoeba invadens
FKGKIWAKVFIKSKPQRYGIKFWMCCD

SEQ ID NO: 2996304 - protein, 37 aa, Entamoeba invadens
FKGKIWAKVFIKSKPQRYGIKFWMCCDCGSGMVINLQ

SEQ ID NO: 2996305 - protein, 27 aa, Entamoeba invadens
FKGKIWAKVFIKSKPQRYGIKFWMCRV

SEQ ID NO: 2996306 - protein, 26 aa, Entamoeba invadens
FKGKIWAKVFIKSKPQRYGIKFWVFL

SEQ ID NO: 2996307 - protein, 26 aa, Entamoeba invadens
FKGKIWAKVFIKSKPQRYSIKFWMCC

SEQ ID NO: 2996308 - protein, 30 aa, Entamoeba invadens
FKGNMEKFYYNPIPLNYITAKYFPNIETLH

SEQ ID NO: 2996309 - protein, 24 aa, Entamoeba invadens
FKHCPFTYITLPDSLLTLGHNTFS

SEQ ID NO: 2996310 - protein, 22 aa, Entamoeba invadens
FKHEKLVFEALFKPGCALKVRE

SEQ ID NO: 2996311 - protein, 31 aa, Entamoeba invadens
FKHVKFWELMQWVIQSKLPLIGSPYVDIDDA

SEQ ID NO: 2996312 - protein, 17 aa, Entamoeba invadens
FKIFIAPNSFIETKFRG

SEQ ID NO: 2996313 - protein, 19 aa, Entamoeba invadens
FKILIIGEPSVGKTAIMER

SEQ ID NO: 2996314 - protein, 18 aa, Entamoeba invadens
FKINLLKFNTQVVINSCI

SEQ ID NO: 2996315 - protein, 17 aa, Entamoeba invadens
FKIRATRGILLHGPPGN

SEQ ID NO: 2996316 - protein, 19 aa, Entamoeba invadens
FKIVLKAVGKYTLGAEALK

SEQ ID NO: 2996317 - protein, 18 aa, Entamoeba invadens
FKIWRFSDSATMTVSFEK

SEQ ID NO: 2996318 - protein, 26 aa, Entamoeba invadens
FKKEDVLRIWDFLISYIEDKMYLFLM

SEQ ID NO: 2996319 - protein, 21 aa, Entamoeba invadens
FKKEEIGLEQFWQGGLYGNCT

SEQ ID NO: 2996320 - protein, 24 aa, Entamoeba invadens
FKKFHYNPFPLTNKTRPFFTNLQT

SEQ ID NO: 2996321 - protein, 18 aa, Entamoeba invadens
FKKLFVNCLVENFEYVFP

SEQ ID NO: 2996322 - protein, 20 aa, Entamoeba invadens
FKKLNVVVNKEKRKSRQFSP

SEQ ID NO: 2996323 - protein, 29 aa, Entamoeba invadens
FKKMVEAYGSDWWFPFYSKEEAVSQLEGR

SEQ ID NO: 2996324 - protein, 24 aa, Entamoeba invadens
FKKNNSIFLKQLTQRRVRTYKCIN

SEQ ID NO: 2996325 - protein, 18 aa, Entamoeba invadens
FKLDARYLQFRDLVGVVD

SEQ ID NO: 2996326 - protein, 19 aa, Entamoeba invadens
FKLFIDFRCNSHFPQFISA

SEQ ID NO: 2996327 - protein, 22 aa, Entamoeba invadens
FKLFVSLCCDTFLILRKNFHGL

SEQ ID NO: 2996328 - protein, 20 aa, Entamoeba invadens
FKLLLIGDSGVGKSCLLLRF

SEQ ID NO: 2996329 - protein, 22 aa, Entamoeba invadens
FKLPHDVVIISFLYKRLNSVYL

SEQ ID NO: 2996330 - protein, 31 aa, Entamoeba invadens
FKLQTPYRTFVATPPILVFQLLRFKQTEKGS

SEQ ID NO: 2996331 - protein, 22 aa, Entamoeba invadens
FKMDFDFRDFLLQKIINAERTA

SEQ ID NO: 2996332 - protein, 17 aa, Entamoeba invadens
FKMFDEVEAKYLVEFLK

SEQ ID NO: 2996333 - protein, 22 aa, Entamoeba invadens
FKMLHDIFGDLIIPADITPKNV

SEQ ID NO: 2996334 - protein, 23 aa, Entamoeba invadens
FKMNWLNIEMVKLSAYLVSNKTT

SEQ ID NO: 2996335 - protein, 19 aa, Entamoeba invadens
FKMPTRPFKRMTYADAIKF

SEQ ID NO: 2996336 - protein, 18 aa, Entamoeba invadens
FKMSCSNITFIPIGDDVI

SEQ ID NO: 2996337 - protein, 20 aa, Entamoeba invadens
FKNCFKIKELVFNRSCVIER

SEQ ID NO: 2996338 - protein, 26 aa, Entamoeba invadens
FKNCFNLRNVILPERLLSLGNRCFEG

SEQ ID NO: 2996339 - protein, 26 aa, Entamoeba invadens
FKNCFRLQRVVLPKFLKKLGKEVFEN

SEQ ID NO: 2996340 - protein, 20 aa, Entamoeba invadens
FKNCGKLKKFVGKIKKVPVG

SEQ ID NO: 2996341 - protein, 19 aa, Entamoeba invadens
FKNCGKLKKFVGKIKKVSV

SEQ ID NO: 2996342 - protein, 27 aa, Entamoeba invadens
FKNCSKLEQLYFPKSLTFIKKNAFIHC

SEQ ID NO: 2996343 - protein, 30 aa, Entamoeba invadens
FKNCTCFLNDLYLPYGLTKIGYGAFENFTT

SEQ ID NO: 2996344 - protein, 23 aa, Entamoeba invadens
FKNDVHFYFMPHGIGHLIGVDTH

SEQ ID NO: 2996345 - protein, 36 aa, Entamoeba invadens
FKNGITKLMLTEIPYFRTILLAHFSCPYCHYSNTEV

SEQ ID NO: 2996346 - protein, 18 aa, Entamoeba invadens
FKNIKTLLLVTYSSPQTT

SEQ ID NO: 2996347 - protein, 25 aa, Entamoeba invadens
FKNKKFLLTDFGSVVPESAFYNRKR

SEQ ID NO: 2996348 - protein, 27 aa, Entamoeba invadens
FKNMGLATLPRFFYINTMKGITRKLIL

SEQ ID NO: 2996349 - protein, 21 aa, Entamoeba invadens
FKNNFIYSNYMWNAAIVNSSE

SEQ ID NO: 2996350 - protein, 26 aa, Entamoeba invadens
FKNNKYLREIVLPTTIKIFGDSIFDK

SEQ ID NO: 2996351 - protein, 24 aa, Entamoeba invadens
FKNRPKRVPRRTAGYVRNGNRRFN

SEQ ID NO: 2996352 - protein, 25 aa, Entamoeba invadens
FKNSITNVLLKIDKKEFLCSPLVVQ

SEQ ID NO: 2996353 - protein, 20 aa, Entamoeba invadens
FKNSIYIFKKVFCSKITTSL

SEQ ID NO: 2996354 - protein, 25 aa, Entamoeba invadens
FKNSVLYFKDLCEYLKTINVDQNET

SEQ ID NO: 2996355 - protein, 25 aa, Entamoeba invadens
FKNWKLGRCVVIKAPLLKIPNECFT

SEQ ID NO: 2996356 - protein, 27 aa, Entamoeba invadens
FKPENTMELRLYPHIKYVLGLECVKLD

SEQ ID NO: 2996357 - protein, 30 aa, Entamoeba invadens
FKPFSKFVDLTWVFEMLKTRQFIAPDTFSS

SEQ ID NO: 2996358 - protein, 22 aa, Entamoeba invadens
FKQLKTILGVYGIKYLLVCQER

SEQ ID NO: 2996359 - protein, 31 aa, Entamoeba invadens
FKQLNEVLSAKYIYQVLIGLEYIHGQGIVHR

SEQ ID NO: 2996360 - protein, 40 aa, Entamoeba invadens
FKQRRLPIDQFLIQPIQRLPRYVLLLKELIKATPELVVDE

SEQ ID NO: 2996361 - protein, 25 aa, Entamoeba invadens
FKQYPSCHTWINSKSEIPLFTALLK

SEQ ID NO: 2996362 - protein, 28 aa, Entamoeba invadens
FKRCYHLKYVILYGVKYLEKESFSYCKE

SEQ ID NO: 2996363 - protein, 17 aa, Entamoeba invadens
FKRKYVFCVDCDFYQKN

SEQ ID NO: 2996364 - protein, 26 aa, Entamoeba invadens
FKRLRRLQELLYETQLKNLALLTVAQ

SEQ ID NO: 2996365 - protein, 22 aa, Entamoeba invadens
FKRNVDMFWDKTGQLIMEIVPK

SEQ ID NO: 2996366 - protein, 24 aa, Entamoeba invadens
FKRVKLPFLSKKLILSEDQVELLV

SEQ ID NO: 2996367 - protein, 30 aa, Entamoeba invadens
FKSDIFHYLLEFLVFPFEVGVDKFSVEAIL

SEQ ID NO: 2996368 - protein, 25 aa, Entamoeba invadens
FKSEKLILGIHYYLYKNTTNYWTIS

SEQ ID NO: 2996369 - protein, 26 aa, Entamoeba invadens
FKSEKPILGIHYYLYKNTTNYWTISS

SEQ ID NO: 2996370 - protein, 17 aa, Entamoeba invadens
FKSEPTPLLPWQMVEYN

SEQ ID NO: 2996371 - protein, 20 aa, Entamoeba invadens
FKSKPRFLPLQLAQVLTHVG

SEQ ID NO: 2996372 - protein, 24 aa, Entamoeba invadens
FKSLKVLKTLVLYIDYYGSYTNDT

SEQ ID NO: 2996373 - protein, 19 aa, Entamoeba invadens
FKSLQTLFITRLDKENYLE

SEQ ID NO: 2996374 - protein, 27 aa, Entamoeba invadens
FKSQNRLRELFYWAYKQEFLPNTRNQS

SEQ ID NO: 2996375 - protein, 26 aa, Entamoeba invadens
FKSSLTLSWVFLKRGVELTKRIPLIF

SEQ ID NO: 2996376 - protein, 30 aa, Entamoeba invadens
FKTANFINKLHSYLLKIGTRVPICYQDQMY

SEQ ID NO: 2996377 - protein, 20 aa, Entamoeba invadens
FKTDPKPFWKMAEELHKIKA

SEQ ID NO: 2996378 - protein, 21 aa, Entamoeba invadens
FKTHLNIIYKQFPIYEDVFCN

SEQ ID NO: 2996379 - protein, 23 aa, Entamoeba invadens
FKTIEFCDKYAFSKHLEAIFVHK

SEQ ID NO: 2996380 - protein, 26 aa, Entamoeba invadens
FKTLVETYKGWWRLETKQKGGLCFLY

SEQ ID NO: 2996381 - protein, 20 aa, Entamoeba invadens
FKTSIFWKLCCVYDHIVVHT

SEQ ID NO: 2996382 - protein, 20 aa, Entamoeba invadens
FKTTHFDRIIARDIKEHMCY

SEQ ID NO: 2996383 - protein, 21 aa, Entamoeba invadens
FKTVSFLFETLKNGGIEWVEK

SEQ ID NO: 2996384 - protein, 22 aa, Entamoeba invadens
FKTYLVTHLTMGYANAFPLNAE

SEQ ID NO: 2996385 - protein, 24 aa, Entamoeba invadens
FKVFLSSCFMFDPKMRPKCEDLLK

SEQ ID NO: 2996386 - protein, 26 aa, Entamoeba invadens
FKVHGRFMELLMWAIDIDFLTTDTLT

SEQ ID NO: 2996387 - protein, 21 aa, Entamoeba invadens
FKVMHLAHFPVMSDALLTGNG

SEQ ID NO: 2996388 - protein, 22 aa, Entamoeba invadens
FKVPHHVTLLEDFVFQENLHLE

SEQ ID NO: 2996389 - protein, 25 aa, Entamoeba invadens
FKVYNSTMWAILVTGFNILVKDNYA

SEQ ID NO: 2996390 - protein, 17 aa, Entamoeba invadens
FKYFPNIETLHLWDIDD

SEQ ID NO: 2996391 - protein, 19 aa, Entamoeba invadens
FKYFPNIETLHLWNVKDEN

SEQ ID NO: 2996392 - protein, 20 aa, Entamoeba invadens
FKYIFERKNTMWKNQKLTLT

SEQ ID NO: 2996393 - protein, 17 aa, Entamoeba invadens
FKYIPNAFVKIQPLRIK

SEQ ID NO: 2996394 - protein, 31 aa, Entamoeba invadens
FKYKYNYVMDIRTWSPLMFARYLVHNGVAHR

SEQ ID NO: 2996395 - protein, 19 aa, Entamoeba invadens
FKYNDYLKTVYFPSSLVDF

SEQ ID NO: 2996396 - protein, 17 aa, Entamoeba invadens
FLAGFAKSRRYYTNTRG

SEQ ID NO: 2996397 - protein, 20 aa, Entamoeba invadens
FLAHKNMILRRLTVLILSDV

SEQ ID NO: 2996398 - protein, 18 aa, Entamoeba invadens
FLAINTRDTRYDGVTLSR

SEQ ID NO: 2996399 - protein, 17 aa, Entamoeba invadens
FLCDFLCSVSGVGSSLN

SEQ ID NO: 2996400 - protein, 19 aa, Entamoeba invadens
FLCIAEHICALLLPSFSKT

SEQ ID NO: 2996401 - protein, 18 aa, Entamoeba invadens
FLCKVHYSYLVGSKDQKI

SEQ ID NO: 2996402 - protein, 18 aa, Entamoeba invadens
FLDKVSFKNLVLVNFKDL

SEQ ID NO: 2996403 - protein, 17 aa, Entamoeba invadens
FLDLTKPKQQPPQLGQI

SEQ ID NO: 2996404 - protein, 24 aa, Entamoeba invadens
FLEANNFREQLYRVLDKDLNEHVP

SEQ ID NO: 2996405 - protein, 19 aa, Entamoeba invadens
FLEEVILGPYLKLDIYEFA

SEQ ID NO: 2996406 - protein, 17 aa, Entamoeba invadens
FLEFLLKTIKENACSQN

SEQ ID NO: 2996407 - protein, 17 aa, Entamoeba invadens
FLEIENYFSLRYDNRIF

SEQ ID NO: 2996408 - protein, 19 aa, Entamoeba invadens
FLEIYNTQNFYFCDTFWHL

SEQ ID NO: 2996409 - protein, 28 aa, Entamoeba invadens
FLEKHHLFISIFIPKNSNFDWIISQAVN

SEQ ID NO: 2996410 - protein, 18 aa, Entamoeba invadens
FLEKKSNLMVWGNTVGYI

SEQ ID NO: 2996411 - protein, 25 aa, Entamoeba invadens
FLEKNELWDIFLDVSLHLEMYEKAY

SEQ ID NO: 2996412 - protein, 19 aa, Entamoeba invadens
FLELLKADEGLMRRNVMSN

SEQ ID NO: 2996413 - protein, 17 aa, Entamoeba invadens
FLENLLQNKYKESLAPT

SEQ ID NO: 2996414 - protein, 17 aa, Entamoeba invadens
FLFEIYDWDRFKTDDFL

SEQ ID NO: 2996415 - protein, 17 aa, Entamoeba invadens
FLFELVEFSFKKNQYFC

SEQ ID NO: 2996416 - protein, 22 aa, Entamoeba invadens
FLFKILIIGESGVGKTAIMQRL

SEQ ID NO: 2996417 - protein, 17 aa, Entamoeba invadens
FLFLEKLLPALRSGVED

SEQ ID NO: 2996418 - protein, 18 aa, Entamoeba invadens
FLFRSPKCMACEDKSFTL

SEQ ID NO: 2996419 - protein, 21 aa, Entamoeba invadens
FLFSLSHIYSTRLFPKTQNSI

SEQ ID NO: 2996420 - protein, 21 aa, Entamoeba invadens
FLFVVQKRIILSLKDFSMSFR

SEQ ID NO: 2996421 - protein, 24 aa, Entamoeba invadens
FLGFRHFYLFCRKFELLSKDDISP

SEQ ID NO: 2996422 - protein, 24 aa, Entamoeba invadens
FLGINEFKDFVWRGKFRGCDVVVD

SEQ ID NO: 2996423 - protein, 25 aa, Entamoeba invadens
FLGKVLVWDPFLRMRPSQAINHPFI

SEQ ID NO: 2996424 - protein, 20 aa, Entamoeba invadens
FLGVTKVLLSTPIYFNMLYE

SEQ ID NO: 2996425 - protein, 31 aa, Entamoeba invadens
FLGYGECLLPFFQGVFLGQLPKILASSPIIG

SEQ ID NO: 2996426 - protein, 18 aa, Entamoeba invadens
FLHCLDILNGTKKSEWVV

SEQ ID NO: 2996427 - protein, 20 aa, Entamoeba invadens
FLHCTSLVKIGLPNNLTTLG

SEQ ID NO: 2996428 - protein, 23 aa, Entamoeba invadens
FLHDVEWGDLDYLVFDTPPGTSD

SEQ ID NO: 2996429 - protein, 29 aa, Entamoeba invadens
FLHEEFSLAMYFSYFKSFIKSAPKKRIMR

SEQ ID NO: 2996430 - protein, 20 aa, Entamoeba invadens
FLHEKMPIFYDKFSKIRLQS

SEQ ID NO: 2996431 - protein, 18 aa, Entamoeba invadens
FLHFEFFTEKIGTEELII

SEQ ID NO: 2996432 - protein, 18 aa, Entamoeba invadens
FLHGLWPQNDAHKNLVCC

SEQ ID NO: 2996433 - protein, 17 aa, Entamoeba invadens
FLHLTGVSPLVPKYSLA

SEQ ID NO: 2996434 - protein, 26 aa, Entamoeba invadens
FLHVSKFLEFLESTKINFFIIGKEYT

SEQ ID NO: 2996435 - protein, 18 aa, Entamoeba invadens
FLIEFDGFELKRYIKGKT

SEQ ID NO: 2996436 - protein, 18 aa, Entamoeba invadens
FLIHRALNKRSTIGRIFF

SEQ ID NO: 2996437 - protein, 24 aa, Entamoeba invadens
FLINEMPLLYKRCLLTDALIRVEE

SEQ ID NO: 2996438 - protein, 18 aa, Entamoeba invadens
FLISFIENRFDEAYVPTV

SEQ ID NO: 2996439 - protein, 23 aa, Entamoeba invadens
FLITNGECICRSGFYLNEVNGCS

SEQ ID NO: 2996440 - protein, 18 aa, Entamoeba invadens
FLIYLPLNDWCSEINIDF

SEQ ID NO: 2996441 - protein, 27 aa, Entamoeba invadens
FLKAHSRFTDFIFTLETILDPEIKRDK

SEQ ID NO: 2996442 - protein, 19 aa, Entamoeba invadens
FLKEITLPNTLTSLGKKCF

SEQ ID NO: 2996443 - protein, 26 aa, Entamoeba invadens
FLKEQFKQFVFFTVKTQYETNVQLVL

SEQ ID NO: 2996444 - protein, 19 aa, Entamoeba invadens
FLKGEIFFKSSITLKALKD

SEQ ID NO: 2996445 - protein, 19 aa, Entamoeba invadens
FLKINLWNYNHADSCYNLV

SEQ ID NO: 2996446 - protein, 25 aa, Entamoeba invadens
FLKSCPAKKLTLNTLFALMSQEEKI

SEQ ID NO: 2996447 - protein, 24 aa, Entamoeba invadens
FLKSCPVKKLTLNSVFALMSQEKK

SEQ ID NO: 2996448 - protein, 26 aa, Entamoeba invadens
FLKSCPVKKLTLNTLFALMTQEEKNQ

SEQ ID NO: 2996449 - protein, 21 aa, Entamoeba invadens
FLKSFIDTYPFKCFIDFSITE

SEQ ID NO: 2996450 - protein, 22 aa, Entamoeba invadens
FLKSFLEQFPSFEAWKKETIKK

SEQ ID NO: 2996451 - protein, 18 aa, Entamoeba invadens
FLKTIGIAAILSLGKKPF

SEQ ID NO: 2996452 - protein, 19 aa, Entamoeba invadens
FLKWLARAPKRWILRNEIQ

SEQ ID NO: 2996453 - protein, 23 aa, Entamoeba invadens
FLKYKKIRHWLGDADIFKYKFIF

SEQ ID NO: 2996454 - protein, 29 aa, Entamoeba invadens
FLLCTSLTSFIFPLSLRRICDKSFVECRS

SEQ ID NO: 2996455 - protein, 17 aa, Entamoeba invadens
FLLEMMSYYGICFSLSY

SEQ ID NO: 2996456 - protein, 27 aa, Entamoeba invadens
FLLENKVTHILSVAPLKPVFPELFKYK

SEQ ID NO: 2996457 - protein, 25 aa, Entamoeba invadens
FLLENSMSYIRFIKCVEKFGMESIE

SEQ ID NO: 2996458 - protein, 17 aa, Entamoeba invadens
FLLFNKTNENIFAEVGR

SEQ ID NO: 2996459 - protein, 20 aa, Entamoeba invadens
FLLSLKQISSIFVCEYFFKR

SEQ ID NO: 2996460 - protein, 25 aa, Entamoeba invadens
FLLSVRTCLLPVFRKVKSKISEDLR

SEQ ID NO: 2996461 - protein, 17 aa, Entamoeba invadens
FLLYSVINTNGVGKMEE

SEQ ID NO: 2996462 - protein, 17 aa, Entamoeba invadens
FLMEKVKLPSTLQIASN

SEQ ID NO: 2996463 - protein, 20 aa, Entamoeba invadens
FLMGKIGVGKSTFALRFCHQ

SEQ ID NO: 2996464 - protein, 17 aa, Entamoeba invadens
FLMLKKQCERKALKEST

SEQ ID NO: 2996465 - protein, 21 aa, Entamoeba invadens
FLMNVTLYLKTADTLFNFILI

SEQ ID NO: 2996466 - protein, 20 aa, Entamoeba invadens
FLMNVVLYIDTFNSLLTFST

SEQ ID NO: 2996467 - protein, 18 aa, Entamoeba invadens
FLMQMHYSFQTGDKLYFI

SEQ ID NO: 2996468 - protein, 28 aa, Entamoeba invadens
FLNAKTLKYKYLPLLNYCFESRRETLVR

SEQ ID NO: 2996469 - protein, 26 aa, Entamoeba invadens
FLNCVNLQRIYLPKSVPKLSPIAFLN

SEQ ID NO: 2996470 - protein, 19 aa, Entamoeba invadens
FLNERLFEIVIKELKERYE

SEQ ID NO: 2996471 - protein, 17 aa, Entamoeba invadens
FLNIINNQRIFVYYICE

SEQ ID NO: 2996472 - protein, 19 aa, Entamoeba invadens
FLNIPFPVERWTDSVMKTM

SEQ ID NO: 2996473 - protein, 21 aa, Entamoeba invadens
FLNIVTVMWDWPKESIQRLNS

SEQ ID NO: 2996474 - protein, 18 aa, Entamoeba invadens
FLNKKQAFWKYNNTIDYA

SEQ ID NO: 2996475 - protein, 22 aa, Entamoeba invadens
FLNPKEFSRFLRKSGLDTKKES

SEQ ID NO: 2996476 - protein, 18 aa, Entamoeba invadens
FLNQTIPVSPTFEKKLEK

SEQ ID NO: 2996477 - protein, 24 aa, Entamoeba invadens
FLNRFADLLKFRSVPTTLSTAQMC

SEQ ID NO: 2996478 - protein, 29 aa, Entamoeba invadens
FLNVLSSYQYFYELNIPLLIKSDTIQSVG

SEQ ID NO: 2996479 - protein, 17 aa, Entamoeba invadens
FLPIGMYYSSITEDEME

SEQ ID NO: 2996480 - protein, 18 aa, Entamoeba invadens
FLPKCCFTCCSMLENIKF

SEQ ID NO: 2996481 - protein, 27 aa, Entamoeba invadens
FLPKKEMYYCLCLMDYLVENCPEFRKQ

SEQ ID NO: 2996482 - protein, 29 aa, Entamoeba invadens
FLPRGCGMVTKRPLILQLVNLPPTETTEW

SEQ ID NO: 2996483 - protein, 17 aa, Entamoeba invadens
FLQAFYTAFSDTLRQAV

SEQ ID NO: 2996484 - protein, 18 aa, Entamoeba invadens
FLQAIFEIGRRYKIMNPD

SEQ ID NO: 2996485 - protein, 23 aa, Entamoeba invadens
FLQDVEFALFPSLFTALSTIENE

SEQ ID NO: 2996486 - protein, 17 aa, Entamoeba invadens
FLQFFEADGLLLKSVEE

SEQ ID NO: 2996487 - protein, 17 aa, Entamoeba invadens
FLQIPRSLNAFLQTHKN

SEQ ID NO: 2996488 - protein, 19 aa, Entamoeba invadens
FLQKDAFLQQNSELKRFVL

SEQ ID NO: 2996489 - protein, 17 aa, Entamoeba invadens
FLQKFDKAGFLWGKFFI

SEQ ID NO: 2996490 - protein, 24 aa, Entamoeba invadens
FLQKKMMLVRWIESMVGVGIDPDL

SEQ ID NO: 2996491 - protein, 19 aa, Entamoeba invadens
FLQQFYAKYAPKKSFVIGA

SEQ ID NO: 2996492 - protein, 24 aa, Entamoeba invadens
FLQSGMLNALLPYYRLTQAVQVGD

SEQ ID NO: 2996493 - protein, 17 aa, Entamoeba invadens
FLQTLLNIFGFVPSEKG

SEQ ID NO: 2996494 - protein, 20 aa, Entamoeba invadens
FLRAEEFLDKVKLYEGGIEA

SEQ ID NO: 2996495 - protein, 39 aa, Entamoeba invadens
FLRKLDVMDFLVKPLQRLTKYPLLLKEAKKYLVAPNEIT

SEQ ID NO: 2996496 - protein, 17 aa, Entamoeba invadens
FLRKWIVHNTTQLVYNI

SEQ ID NO: 2996497 - protein, 21 aa, Entamoeba invadens
FLSCYSLKEITLPKGLQTVGD

SEQ ID NO: 2996498 - protein, 18 aa, Entamoeba invadens
FLSDWRFKKVLNETLKNI

SEQ ID NO: 2996499 - protein, 17 aa, Entamoeba invadens
FLSFLHFTKKPKESKEE

SEQ ID NO: 2996500 - protein, 17 aa, Entamoeba invadens
FLSIISLYIKGTTNFLV

SEQ ID NO: 2996501 - protein, 24 aa, Entamoeba invadens
FLSKHKHMIFLKSNCLNEPSKRNA

SEQ ID NO: 2996502 - protein, 25 aa, Entamoeba invadens
FLSKYRQYYVHYPTPLHKCIKLNQG

SEQ ID NO: 2996503 - protein, 22 aa, Entamoeba invadens
FLSLFDKLKHLCVGCYLPMLDQ

SEQ ID NO: 2996504 - protein, 19 aa, Entamoeba invadens
FLSPLQTLPSLQVSLISNG

SEQ ID NO: 2996505 - protein, 19 aa, Entamoeba invadens
FLSSQMINSIFPLNNMVFD

SEQ ID NO: 2996506 - protein, 18 aa, Entamoeba invadens
FLSTIIHKTPLANFRNKR

SEQ ID NO: 2996507 - protein, 33 aa, Entamoeba invadens
FLTDRPLEEYIVPPRLFPFVEYGKTMSLDQKDF

SEQ ID NO: 2996508 - protein, 17 aa, Entamoeba invadens
FLTGGRVFLFQLITSVM

SEQ ID NO: 2996509 - protein, 18 aa, Entamoeba invadens
FLTMYHYNPIPLTTTTRA

SEQ ID NO: 2996510 - protein, 18 aa, Entamoeba invadens
FLTNFTIPSTVTSIDDYC

SEQ ID NO: 2996511 - protein, 30 aa, Entamoeba invadens
FLTPQVITSFFPNIIYGLYSTNKKIVTCAI

SEQ ID NO: 2996512 - protein, 19 aa, Entamoeba invadens
FLTTITTPEKFFLKLMERL

SEQ ID NO: 2996513 - protein, 18 aa, Entamoeba invadens
FLVDISHKYGLHPDLFDL

SEQ ID NO: 2996514 - protein, 26 aa, Entamoeba invadens
FLVDLVGFLLVERKFLFVSNSIQTVS

SEQ ID NO: 2996515 - protein, 19 aa, Entamoeba invadens
FLVGALIAFGYEVSINRLY

SEQ ID NO: 2996516 - protein, 18 aa, Entamoeba invadens
FLVKTIFLKITKIVSTQN

SEQ ID NO: 2996517 - protein, 17 aa, Entamoeba invadens
FLVLSHLHIFRYAFEIL

SEQ ID NO: 2996518 - protein, 18 aa, Entamoeba invadens
FLVNLEKKGFFANCSETQ

SEQ ID NO: 2996519 - protein, 22 aa, Entamoeba invadens
FLVNMHYTFQTPTHLVFVLDYC

SEQ ID NO: 2996520 - protein, 29 aa, Entamoeba invadens
FLVSQTDPFLFVKMIDFGWSRSIAEEMES

SEQ ID NO: 2996521 - protein, 25 aa, Entamoeba invadens
FLVTNYQYIVVVKKPVRNQLFPVII

SEQ ID NO: 2996522 - protein, 18 aa, Entamoeba invadens
FLYGNEGLPFITFEESRK

SEQ ID NO: 2996523 - protein, 17 aa, Entamoeba invadens
FLYHCLTPLFNEILEKK

SEQ ID NO: 2996524 - protein, 18 aa, Entamoeba invadens
FLYQEKLGEILTSGLDHI

SEQ ID NO: 2996525 - protein, 19 aa, Entamoeba invadens
FMATFKEKWIVKLKEMMVY

SEQ ID NO: 2996526 - protein, 36 aa, Entamoeba invadens
FMCGKGIESLKSALQLFLRQLPTDSTFDIISFGSQF

SEQ ID NO: 2996527 - protein, 17 aa, Entamoeba invadens
FMDQKCFVFKLKEKGRE

SEQ ID NO: 2996528 - protein, 25 aa, Entamoeba invadens
FMEPSKTMMLFYKLMKMEDMTYDEM

SEQ ID NO: 2996529 - protein, 31 aa, Entamoeba invadens
FMEQQKSFHVLIMSLYTHLQHCRSAPQTLVD

SEQ ID NO: 2996530 - protein, 28 aa, Entamoeba invadens
FMEQSRILTPFRDRFNFTLSIIGACLHD

SEQ ID NO: 2996531 - protein, 20 aa, Entamoeba invadens
FMFNHWCFFCQTFVESGEQK

SEQ ID NO: 2996532 - protein, 19 aa, Entamoeba invadens
FMGCERLFEIKIPSSVSFL

SEQ ID NO: 2996533 - protein, 17 aa, Entamoeba invadens
FMIHCMCNRLTAVFPAL

SEQ ID NO: 2996534 - protein, 25 aa, Entamoeba invadens
FMKCYNLKEMVFPTTLKTIGKFAFK

SEQ ID NO: 2996535 - protein, 24 aa, Entamoeba invadens
FMKCYNLREIILPKTLKTIGKFAF

SEQ ID NO: 2996536 - protein, 24 aa, Entamoeba invadens
FMKEALVFVGKPIEALLTVSVSLG

SEQ ID NO: 2996537 - protein, 26 aa, Entamoeba invadens
FMKGDRFVFLLCTRAGGIGINLSEAD

SEQ ID NO: 2996538 - protein, 18 aa, Entamoeba invadens
FMKIITHKTLRTVTFSTA

SEQ ID NO: 2996539 - protein, 17 aa, Entamoeba invadens
FMKIVVAKVLSVFPSQR

SEQ ID NO: 2996540 - protein, 18 aa, Entamoeba invadens
FMLKEVKREFLCCGPMYV

SEQ ID NO: 2996541 - protein, 20 aa, Entamoeba invadens
FMLTKRNTFFNREQFCQIVS

SEQ ID NO: 2996542 - protein, 20 aa, Entamoeba invadens
FMMNVVLYINSFKALRAFVT

SEQ ID NO: 2996543 - protein, 17 aa, Entamoeba invadens
FMMSELYHSHYPNMEVK

SEQ ID NO: 2996544 - protein, 36 aa, Entamoeba invadens
FMNCFNLKTIPKIQFLKRGIFWCCNSLVKFESFGDV

SEQ ID NO: 2996545 - protein, 18 aa, Entamoeba invadens
FMNYLKIDTNEQLREQSF

SEQ ID NO: 2996546 - protein, 25 aa, Entamoeba invadens
FMQGKIPTLKISLIQIFRAHLWQKI

SEQ ID NO: 2996547 - protein, 18 aa, Entamoeba invadens
FMQPSLPSTFFQPQTQQP

SEQ ID NO: 2996548 - protein, 26 aa, Entamoeba invadens
FMRCGSLKRFVIPRTVQYMSNAIFFD

SEQ ID NO: 2996549 - protein, 32 aa, Entamoeba invadens
FMRQEIDAEKLYKIFNKWISAGIFSSKKLEEA

SEQ ID NO: 2996550 - protein, 19 aa, Entamoeba invadens
FMSCNNIFFKSKSKFLKTI

SEQ ID NO: 2996551 - protein, 24 aa, Entamoeba invadens
FMSLNLMTYPYVPPFHYSTLKEKE

SEQ ID NO: 2996552 - protein, 20 aa, Entamoeba invadens
FMTKITCSKVPSAFLFRLYN

SEQ ID NO: 2996553 - protein, 18 aa, Entamoeba invadens
FMTSFIPNRLLFVCGRSV

SEQ ID NO: 2996554 - protein, 18 aa, Entamoeba invadens
FMVMVCRMESYLTSSGVL

SEQ ID NO: 2996555 - protein, 27 aa, Entamoeba invadens
FNAENNYYDLLYKWKIPNIEMPLKLFS

SEQ ID NO: 2996556 - protein, 23 aa, Entamoeba invadens
FNAHFDRLMNLFYASVCGLCGNK

SEQ ID NO: 2996557 - protein, 17 aa, Entamoeba invadens
FNAINSVKGFLIAILCG

SEQ ID NO: 2996558 - protein, 17 aa, Entamoeba invadens
FNAKTIFENLKKAVKMA

SEQ ID NO: 2996559 - protein, 27 aa, Entamoeba invadens
FNASSMSIKPLLREPSRDLLKDQKNAR

SEQ ID NO: 2996560 - protein, 24 aa, Entamoeba invadens
FNAVMSFLSYLLKAPVVPKGTPVV

SEQ ID NO: 2996561 - protein, 25 aa, Entamoeba invadens
FNAVMSFLSYLLKAPVVPKGTPVVN

SEQ ID NO: 2996562 - protein, 26 aa, Entamoeba invadens
FNAVRRFYIFICLQPHVQGLIQALEV

SEQ ID NO: 2996563 - protein, 20 aa, Entamoeba invadens
FNCPYFCLVSQPVLSLMSTG

SEQ ID NO: 2996564 - protein, 25 aa, Entamoeba invadens
FNCRSLKMLIIPKSVQVIKKRCFDF

SEQ ID NO: 2996565 - protein, 25 aa, Entamoeba invadens
FNCRSVKQLSLPESLLFIGKGCFES

SEQ ID NO: 2996566 - protein, 34 aa, Entamoeba invadens
FNDALKALAFATALDKFFIFQSKFPPARKEFYTF

SEQ ID NO: 2996567 - protein, 23 aa, Entamoeba invadens
FNDCQQLEFPKLPSLLTELGSFA

SEQ ID NO: 2996568 - protein, 21 aa, Entamoeba invadens
FNDGKVFLALAHYISNKSFDY

SEQ ID NO: 2996569 - protein, 26 aa, Entamoeba invadens
FNDKDKIFIFTLNSPTKPLRKFQEIS

SEQ ID NO: 2996570 - protein, 20 aa, Entamoeba invadens
FNDLLVLLREQLPPGKQLDL

SEQ ID NO: 2996571 - protein, 25 aa, Entamoeba invadens
FNDNTTIFFYGDYYSYYGKDLSKLD

SEQ ID NO: 2996572 - protein, 25 aa, Entamoeba invadens
FNDPSLDEFIFLLSSKAGGCGLNLI

SEQ ID NO: 2996573 - protein, 26 aa, Entamoeba invadens
FNDVSEFLMLLWDALEKQLDSNDYKQ

SEQ ID NO: 2996574 - protein, 26 aa, Entamoeba invadens
FNEIEKHIFFKDIHWSTLFDENREDI

SEQ ID NO: 2996575 - protein, 20 aa, Entamoeba invadens
FNEIMEFVDTLKGLLEKEDF

SEQ ID NO: 2996576 - protein, 26 aa, Entamoeba invadens
FNEIPPVIIKIPHLLRLHICCNPIYD

SEQ ID NO: 2996577 - protein, 23 aa, Entamoeba invadens
FNEKQYHFTFYDSCGESMLDTRT

SEQ ID NO: 2996578 - protein, 17 aa, Entamoeba invadens
FNELTFKTNLRASLIIG

SEQ ID NO: 2996579 - protein, 24 aa, Entamoeba invadens
FNESAFAFCVPYAFAIGINGVSTI

SEQ ID NO: 2996580 - protein, 20 aa, Entamoeba invadens
FNETWNLDLPLKDLQKRKHK

SEQ ID NO: 2996581 - protein, 25 aa, Entamoeba invadens
FNFISSFFVNLFLNTTVLEERIALA

SEQ ID NO: 2996582 - protein, 17 aa, Entamoeba invadens
FNFKQLLLNANNSQINA

SEQ ID NO: 2996583 - protein, 22 aa, Entamoeba invadens
FNFPITFQKQYFRVESPLQWLE

SEQ ID NO: 2996584 - protein, 24 aa, Entamoeba invadens
FNFQIVSKYFYFEEDFINAVLVCK

SEQ ID NO: 2996585 - protein, 26 aa, Entamoeba invadens
FNGEWNEPFHILPNKMEFEGAGEVTA

SEQ ID NO: 2996586 - protein, 30 aa, Entamoeba invadens
FNGQTYYDGFVYKSFPVSSLQFNNIVPTDE

SEQ ID NO: 2996587 - protein, 20 aa, Entamoeba invadens
FNGYCYLEELVIPKSVTKIG

SEQ ID NO: 2996588 - protein, 22 aa, Entamoeba invadens
FNHLLKVVGDILLYILDNPNHV

SEQ ID NO: 2996589 - protein, 18 aa, Entamoeba invadens
FNISRVLHIFKTQIDTFL

SEQ ID NO: 2996590 - protein, 21 aa, Entamoeba invadens
FNIWTLLLNLEETLEKIEQSN

SEQ ID NO: 2996591 - protein, 25 aa, Entamoeba invadens
FNKALLMGMYQFFVVPDKINISQIR

SEQ ID NO: 2996592 - protein, 25 aa, Entamoeba invadens
FNKCANLIKIVLPTSLKALPNYCFR

SEQ ID NO: 2996593 - protein, 27 aa, Entamoeba invadens
FNKEQKILIGKMRVVPFSHNSLDYEEV

SEQ ID NO: 2996594 - protein, 25 aa, Entamoeba invadens
FNKIKLFFKVMFLSVSHMDTFNMWN

SEQ ID NO: 2996595 - protein, 25 aa, Entamoeba invadens
FNKITLFIRKYFYLHSNEYIFQSVD

SEQ ID NO: 2996596 - protein, 26 aa, Entamoeba invadens
FNKKTSWVRYFLHTGHLHINGLKMSK

SEQ ID NO: 2996597 - protein, 24 aa, Entamoeba invadens
FNKLNNIFFISKKNTYFKHFDKVT

SEQ ID NO: 2996598 - protein, 23 aa, Entamoeba invadens
FNKYAIYKRLVGKPVSLLRERDD

SEQ ID NO: 2996599 - protein, 26 aa, Entamoeba invadens
FNKYKNLCEVVFPPTIKIFEQSIFYN

SEQ ID NO: 2996600 - protein, 26 aa, Entamoeba invadens
FNLDELVPLVFKRKSGLKSLELGGRD

SEQ ID NO: 2996601 - protein, 20 aa, Entamoeba invadens
FNLDIYCWANNSLTLQVPPF

SEQ ID NO: 2996602 - protein, 32 aa, Entamoeba invadens
FNLEMAQMQFQYGMQLCFVSEKFYFTDNVDTS

SEQ ID NO: 2996603 - protein, 24 aa, Entamoeba invadens
FNLITPLTHPEPCDYHYLVKTSKM

SEQ ID NO: 2996604 - protein, 30 aa, Entamoeba invadens
FNLKTIPKIQFLKRGVFWCCNSLVKFERFG

SEQ ID NO: 2996605 - protein, 17 aa, Entamoeba invadens
FNLLELKHSFEFSKTFD

SEQ ID NO: 2996606 - protein, 19 aa, Entamoeba invadens
FNLLQDERGYWMTTHLGCV

SEQ ID NO: 2996607 - protein, 26 aa, Entamoeba invadens
FNLQSRLVVRLTLFNITKQTICNLFC

SEQ ID NO: 2996608 - protein, 18 aa, Entamoeba invadens
FNLYKRAESSRIKKQITI

SEQ ID NO: 2996609 - protein, 27 aa, Entamoeba invadens
FNMRMNNIFAFILTHTKTIFPSAKRCF

SEQ ID NO: 2996610 - protein, 25 aa, Entamoeba invadens
FNNEVKYVFKLLDLGVIKTEVPTTL

SEQ ID NO: 2996611 - protein, 24 aa, Entamoeba invadens
FNNKEFCATLVRLPCVVETHKSYD

SEQ ID NO: 2996612 - protein, 22 aa, Entamoeba invadens
FNNLCKLLPAKWECPKQVILTL

SEQ ID NO: 2996613 - protein, 28 aa, Entamoeba invadens
FNNPNDRLLLLYLFCRYNNLKMIRDMCI

SEQ ID NO: 2996614 - protein, 21 aa, Entamoeba invadens
FNPADIKLKNTGGLRRKSFSQ

SEQ ID NO: 2996615 - protein, 25 aa, Entamoeba invadens
FNPCVKQMFLMNKKAFNPFFGMSLN

SEQ ID NO: 2996616 - protein, 19 aa, Entamoeba invadens
FNPIPINNTIIKLRKLRLS

SEQ ID NO: 2996617 - protein, 19 aa, Entamoeba invadens
FNPLEWWKEHSCDYPLISR

SEQ ID NO: 2996618 - protein, 36 aa, Entamoeba invadens
FNPQYFKPETALLWFSLLPIPTYPDDILQSLFTLFA

SEQ ID NO: 2996619 - protein, 19 aa, Entamoeba invadens
FNPRFKYGRLMTDEDFKEE

SEQ ID NO: 2996620 - protein, 28 aa, Entamoeba invadens
FNPTQVYNVFWGYKKPFEYIKDYGNDFI

SEQ ID NO: 2996621 - protein, 18 aa, Entamoeba invadens
FNQCISLSIVVFNKNLRF

SEQ ID NO: 2996622 - protein, 21 aa, Entamoeba invadens
FNQELLIFGKFLEFKKNKKTE

SEQ ID NO: 2996623 - protein, 21 aa, Entamoeba invadens
FNQNMVYITASLISCYLPEYE

SEQ ID NO: 2996624 - protein, 25 aa, Entamoeba invadens
FNQTDCFLLCFAMNDRKSFEDIKTK

SEQ ID NO: 2996625 - protein, 22 aa, Entamoeba invadens
FNQTICSICKPSYYPEISCNEC

SEQ ID NO: 2996626 - protein, 33 aa, Entamoeba invadens
FNRIESVYFNPDNIPFLSYLSLNNNKLSDINSL

SEQ ID NO: 2996627 - protein, 24 aa, Entamoeba invadens
FNSAKVLYVFLFDNNTPITIKKNC

SEQ ID NO: 2996628 - protein, 26 aa, Entamoeba invadens
FNSFCVVVMTIYYLQQRGLLPDIQSE

SEQ ID NO: 2996629 - protein, 36 aa, Entamoeba invadens
FNSLVKMTKPWYLRFEYWKLILPLTRSIGEMVNSMI

SEQ ID NO: 2996630 - protein, 19 aa, Entamoeba invadens
FNSNKFLVKVTLKGISNVP

SEQ ID NO: 2996631 - protein, 20 aa, Entamoeba invadens
FNSRTFIMQTQPYKIYQMFN

SEQ ID NO: 2996632 - protein, 18 aa, Entamoeba invadens
FNSSYILYTVVKNAYETY

SEQ ID NO: 2996633 - protein, 23 aa, Entamoeba invadens
FNTFLDILTIKPEIPIGVLLIDE

SEQ ID NO: 2996634 - protein, 17 aa, Entamoeba invadens
FNTLFNRMKNHKLQFVG

SEQ ID NO: 2996635 - protein, 35 aa, Entamoeba invadens
FNTPDAICCVKGFQFKFFMSYIDLDLTKKDLKDLK

SEQ ID NO: 2996636 - protein, 24 aa, Entamoeba invadens
FNTSPNYILFSKLAHFARGNLVTR

SEQ ID NO: 2996637 - protein, 25 aa, Entamoeba invadens
FNTTKLIVHIKLFASSPLNPLVILQ

SEQ ID NO: 2996638 - protein, 27 aa, Entamoeba invadens
FNTVRMYLHYLMFESDLSPYQYKESGF

SEQ ID NO: 2996639 - protein, 21 aa, Entamoeba invadens
FNVHDLLPYDFSPADLPEINF

SEQ ID NO: 2996640 - protein, 19 aa, Entamoeba invadens
FNVKKDFVVTLTGMKLDKN

SEQ ID NO: 2996641 - protein, 17 aa, Entamoeba invadens
FNVMRKSAMRLFSICDF

SEQ ID NO: 2996642 - protein, 18 aa, Entamoeba invadens
FNVNIKYLTGDPSPALNP

SEQ ID NO: 2996643 - protein, 26 aa, Entamoeba invadens
FNVNITPHFLISLFSLSKMVRDVKPK

SEQ ID NO: 2996644 - protein, 18 aa, Entamoeba invadens
FNVSITQELYLPFLQILK

SEQ ID NO: 2996645 - protein, 30 aa, Entamoeba invadens
FNVVMDDILSRFIVKLYPQNLSLSIKETLG

SEQ ID NO: 2996646 - protein, 24 aa, Entamoeba invadens
FNVYTTYYFKEAISFFSNKKLLKV

SEQ ID NO: 2996647 - protein, 17 aa, Entamoeba invadens
FNYIIQEQMEITRDLLA

SEQ ID NO: 2996648 - protein, 20 aa, Entamoeba invadens
FNYIKLKPKISRLDLYGEFP

SEQ ID NO: 2996649 - protein, 18 aa, Entamoeba invadens
FNYLLVGERLVFSSNDAA

SEQ ID NO: 2996650 - protein, 19 aa, Entamoeba invadens
FNYMKGMYFVKQGFSSSEV

SEQ ID NO: 2996651 - protein, 21 aa, Entamoeba invadens
FNYNFPVVQPIYNYLKNVICQ

SEQ ID NO: 2996652 - protein, 17 aa, Entamoeba invadens
FNYNPIPLTKKTIAYFP

SEQ ID NO: 2996653 - protein, 22 aa, Entamoeba invadens
FNYNPIPLTKKTIAYFPNIETL

SEQ ID NO: 2996654 - protein, 17 aa, Entamoeba invadens
FNYPTYLEKITSFMDTS

SEQ ID NO: 2996655 - protein, 28 aa, Entamoeba invadens
FPAFLTVVDLLKYYYIRISAIAKKESRS

SEQ ID NO: 2996656 - protein, 18 aa, Entamoeba invadens
FPALVAFIHEDPITDVFF

SEQ ID NO: 2996657 - protein, 18 aa, Entamoeba invadens
FPAMFPSLSPHPLSVDYV

SEQ ID NO: 2996658 - protein, 21 aa, Entamoeba invadens
FPATYLFNFSETAKFNSLQLK

SEQ ID NO: 2996659 - protein, 17 aa, Entamoeba invadens
FPAVEPFSTYLKGIENM

SEQ ID NO: 2996660 - protein, 29 aa, Entamoeba invadens
FPEGPVQLFCDGLLLFLSGLHDSVLHCDG

SEQ ID NO: 2996661 - protein, 18 aa, Entamoeba invadens
FPEIYNYNAFLVMKNTVV

SEQ ID NO: 2996662 - protein, 21 aa, Entamoeba invadens
FPEMMMIERSLLRNLDKGFIE

SEQ ID NO: 2996663 - protein, 27 aa, Entamoeba invadens
FPEMQPGVDWLIFPSTGAYSITLATNF

SEQ ID NO: 2996664 - protein, 20 aa, Entamoeba invadens
FPEYYSYTFFQIPEFRLELL

SEQ ID NO: 2996665 - protein, 19 aa, Entamoeba invadens
FPFTIVDYPGTNSCGIQIT

SEQ ID NO: 2996666 - protein, 21 aa, Entamoeba invadens
FPGFELFKMDIFRLVSIKLKE

SEQ ID NO: 2996667 - protein, 27 aa, Entamoeba invadens
FPGVAAHLPIALMPIALQMLQKELNGL

SEQ ID NO: 2996668 - protein, 18 aa, Entamoeba invadens
FPHGGACTVVLRGSSKQL

SEQ ID NO: 2996669 - protein, 19 aa, Entamoeba invadens
FPHITVFGDTHLYSRFGFV

SEQ ID NO: 2996670 - protein, 18 aa, Entamoeba invadens
FPHLFVPTLPDSVLSTRF

SEQ ID NO: 2996671 - protein, 19 aa, Entamoeba invadens
FPHNKYVIGFHYFQQHDTW

SEQ ID NO: 2996672 - protein, 18 aa, Entamoeba invadens
FPHPLKSFVFHTKFPPNT

SEQ ID NO: 2996673 - protein, 33 aa, Entamoeba invadens
FPIESNTICNLLWTLVTLKYPDDKLLPSQLVGG

SEQ ID NO: 2996674 - protein, 18 aa, Entamoeba invadens
FPILVKYLQDNENLLRGM

SEQ ID NO: 2996675 - protein, 18 aa, Entamoeba invadens
FPIVPMRKSDAVDVTFAC

SEQ ID NO: 2996676 - protein, 17 aa, Entamoeba invadens
FPIVVSKLIDMYNRKSG

SEQ ID NO: 2996677 - protein, 23 aa, Entamoeba invadens
FPKDRVLFHYNGHGVPLPTLNHE

SEQ ID NO: 2996678 - protein, 26 aa, Entamoeba invadens
FPKEMPMQLIYLVGSMLQINPNARPT

SEQ ID NO: 2996679 - protein, 26 aa, Entamoeba invadens
FPKLFEVLNIIRVVKSPLLKEISDME

SEQ ID NO: 2996680 - protein, 21 aa, Entamoeba invadens
FPKLKQLVPTPFYSTLNDFVD

SEQ ID NO: 2996681 - protein, 22 aa, Entamoeba invadens
FPKMFGLRNLQKELYPYNYYTQ

SEQ ID NO: 2996682 - protein, 22 aa, Entamoeba invadens
FPLLLEYCRLCCKWGNGWNGQQ

SEQ ID NO: 2996683 - protein, 25 aa, Entamoeba invadens
FPLPQAYLCYYKYNKDQKYLVLAAE

SEQ ID NO: 2996684 - protein, 28 aa, Entamoeba invadens
FPNELAEYDFLYEKYKQLGIKFPEMSPV

SEQ ID NO: 2996685 - protein, 20 aa, Entamoeba invadens
FPNGCPCNIEFFDVIRRCQK

SEQ ID NO: 2996686 - protein, 24 aa, Entamoeba invadens
FPNIQNIVLWFKVSCKTMKESPPN

SEQ ID NO: 2996687 - protein, 18 aa, Entamoeba invadens
FPNKVCIEFIKAPNFGME

SEQ ID NO: 2996688 - protein, 29 aa, Entamoeba invadens
FPNSSFLHLEWLCNFKGLYGYVLITHTNA

SEQ ID NO: 2996689 - protein, 17 aa, Entamoeba invadens
FPPFLKDRWYPHNETTK

SEQ ID NO: 2996690 - protein, 18 aa, Entamoeba invadens
FPPKIRKLCVYPQQVIKM

SEQ ID NO: 2996691 - protein, 18 aa, Entamoeba invadens
FPPLLDHPEIFPKDLIDH

SEQ ID NO: 2996692 - protein, 20 aa, Entamoeba invadens
FPQKNRYLVRLAKSTWKNNE

SEQ ID NO: 2996693 - protein, 32 aa, Entamoeba invadens
FPQTAAAPFTAFPTFSPYVPQSVSFPTQAPPQ

SEQ ID NO: 2996694 - protein, 19 aa, Entamoeba invadens
FPQYIMSDCKFIASNVLYS

SEQ ID NO: 2996695 - protein, 17 aa, Entamoeba invadens
FPREMFRYPWEVVNFIT

SEQ ID NO: 2996696 - protein, 17 aa, Entamoeba invadens
FPRMFKLEVCQLYDKLC

SEQ ID NO: 2996697 - protein, 27 aa, Entamoeba invadens
FPRNLKQYFMLFDALANIGYKACYMLA

SEQ ID NO: 2996698 - protein, 17 aa, Entamoeba invadens
FPRQGFNPVIPYTSLIK

SEQ ID NO: 2996699 - protein, 19 aa, Entamoeba invadens
FPRTSFGKVYLPKLREMVG

SEQ ID NO: 2996700 - protein, 18 aa, Entamoeba invadens
FPSALILAPTRELGQQIH

SEQ ID NO: 2996701 - protein, 17 aa, Entamoeba invadens
FPSHIKSVGYYSCFSCA

SEQ ID NO: 2996702 - protein, 18 aa, Entamoeba invadens
FPSKFLCQKYRKTFKMNF

SEQ ID NO: 2996703 - protein, 35 aa, Entamoeba invadens
FPSKILHFTFYNYCPKYFLVGRPITSMALVLYWPG

SEQ ID NO: 2996704 - protein, 24 aa, Entamoeba invadens
FPSKKLLVELFTNLSDQKPVGIEK

SEQ ID NO: 2996705 - protein, 20 aa, Entamoeba invadens
FPSLPDEVALSPCPKLKDLP

SEQ ID NO: 2996706 - protein, 33 aa, Entamoeba invadens
FPSRVLRLKMTRKILFIVFQTEVKIYKFATNEI

SEQ ID NO: 2996707 - protein, 24 aa, Entamoeba invadens
FPSSKGIISYLKYQNARPTIVYQK

SEQ ID NO: 2996708 - protein, 17 aa, Entamoeba invadens
FPSYLRPSHKTKEAEEK

SEQ ID NO: 2996709 - protein, 25 aa, Entamoeba invadens
FPTAPNVVVCVLFPKIIKVNTRLNP

SEQ ID NO: 2996710 - protein, 28 aa, Entamoeba invadens
FPTFQKSLIVFQKWKKNLPTKRKLFKLF

SEQ ID NO: 2996711 - protein, 17 aa, Entamoeba invadens
FPTHTFLQVFPLEKNSE

SEQ ID NO: 2996712 - protein, 23 aa, Entamoeba invadens
FPTKKMFYFITVAILKEYTDLII

SEQ ID NO: 2996713 - protein, 21 aa, Entamoeba invadens
FPTKWPTMVTLILQTFANGTP

SEQ ID NO: 2996714 - protein, 18 aa, Entamoeba invadens
FPTSLKYLDILGKRPDVC

SEQ ID NO: 2996715 - protein, 18 aa, Entamoeba invadens
FPVDLVWELTKAMQAYCL

SEQ ID NO: 2996716 - protein, 17 aa, Entamoeba invadens
FPVFGPRSTNSAPFNMS

SEQ ID NO: 2996717 - protein, 22 aa, Entamoeba invadens
FPVNPFPDYLIAHVLKGILSGL

SEQ ID NO: 2996718 - protein, 20 aa, Entamoeba invadens
FPYPRVGAIEFRPLSRNDYT

SEQ ID NO: 2996719 - protein, 18 aa, Entamoeba invadens
FQALHQANFFFHFFAFVR

SEQ ID NO: 2996720 - protein, 28 aa, Entamoeba invadens
FQCDGLEHCFWLAFFFKYATVGEGEEVK

SEQ ID NO: 2996721 - protein, 39 aa, Entamoeba invadens
FQCIETQVFYTPFDYSLPGLNLHVYLYRVSYSEYKKKSS

SEQ ID NO: 2996722 - protein, 20 aa, Entamoeba invadens
FQCTSLTSFIFPLSLRRICD

SEQ ID NO: 2996723 - protein, 28 aa, Entamoeba invadens
FQDADSLIYVFLNNTNLHFINQKTTFYN

SEQ ID NO: 2996724 - protein, 23 aa, Entamoeba invadens
FQDAVVFRFIAFRNYITKHINEI

SEQ ID NO: 2996725 - protein, 19 aa, Entamoeba invadens
FQDDIFPDTRRKVPTYTPE

SEQ ID NO: 2996726 - protein, 27 aa, Entamoeba invadens
FQDEFSLVIRYAWISANLGKLAKKLLT

SEQ ID NO: 2996727 - protein, 17 aa, Entamoeba invadens
FQDGRIVISDEFNKLYD

SEQ ID NO: 2996728 - protein, 22 aa, Entamoeba invadens
FQDIFNYYLKSEKPLPQFVIWF

SEQ ID NO: 2996729 - protein, 18 aa, Entamoeba invadens
FQECGIISFMVTPKYILS

SEQ ID NO: 2996730 - protein, 28 aa, Entamoeba invadens
FQEGDIFHLVQYYYSFIPATEDPDDTHF

SEQ ID NO: 2996731 - protein, 17 aa, Entamoeba invadens
FQELRVYALLSPYSIKQ

SEQ ID NO: 2996732 - protein, 46 aa, Entamoeba invadens
FQEMRNHMRKVGVTSFKKISMINFLIFYFGYDWKEVVNAPQGGNTE

SEQ ID NO: 2996733 - protein, 18 aa, Entamoeba invadens
FQENIDFILISKKNQKMI

SEQ ID NO: 2996734 - protein, 27 aa, Entamoeba invadens
FQERMEEEFLYILKKFLIKMDCKKDEE

SEQ ID NO: 2996735 - protein, 20 aa, Entamoeba invadens
FQFNDKLLIFLADSLYDAKF

SEQ ID NO: 2996736 - protein, 17 aa, Entamoeba invadens
FQFSFHYAPEIPNDSFI

SEQ ID NO: 2996737 - protein, 23 aa, Entamoeba invadens
FQIDNMALDTPYPVLLCKHKEEK

SEQ ID NO: 2996738 - protein, 18 aa, Entamoeba invadens
FQIVFQSFKINDIFYSLY

SEQ ID NO: 2996739 - protein, 27 aa, Entamoeba invadens
FQIYGIYQLRMLLNYLVVKGGVELYRF

SEQ ID NO: 2996740 - protein, 18 aa, Entamoeba invadens
FQIYVYSMWEIYMSAFFP

SEQ ID NO: 2996741 - protein, 21 aa, Entamoeba invadens
FQKDLVPLQKAITERKTKFEN

SEQ ID NO: 2996742 - protein, 30 aa, Entamoeba invadens
FQKRRHGLIKKAMELSILCDCQVSLMVFKD

SEQ ID NO: 2996743 - protein, 18 aa, Entamoeba invadens
FQLDYETNARRDCCFINF

SEQ ID NO: 2996744 - protein, 17 aa, Entamoeba invadens
FQLERLDAIFYNGNFVM

SEQ ID NO: 2996745 - protein, 19 aa, Entamoeba invadens
FQLKLVKLPSTLSEIQKFC

SEQ ID NO: 2996746 - protein, 19 aa, Entamoeba invadens
FQLKPQDLFNVFFGTPEEV

SEQ ID NO: 2996747 - protein, 17 aa, Entamoeba invadens
FQLMIEKIGMKEGEKQI

SEQ ID NO: 2996748 - protein, 24 aa, Entamoeba invadens
FQLMMTELIEHDTSFFNCPKELKC

SEQ ID NO: 2996749 - protein, 17 aa, Entamoeba invadens
FQLYDAPIVLPELDINI

SEQ ID NO: 2996750 - protein, 27 aa, Entamoeba invadens
FQMLSTKIKATLPLLRKIVLGRDAGQT

SEQ ID NO: 2996751 - protein, 17 aa, Entamoeba invadens
FQMYLGWYDNNPAHLNE

SEQ ID NO: 2996752 - protein, 25 aa, Entamoeba invadens
FQNDFSDFDFFVASTQFFKTKTYPK

SEQ ID NO: 2996753 - protein, 37 aa, Entamoeba invadens
FQNIEPLLESFLFPGKFLYDNILLPKTSFDQLNEELC

SEQ ID NO: 2996754 - protein, 25 aa, Entamoeba invadens
FQNLELMYIKFSFNISIMCTFNITK

SEQ ID NO: 2996755 - protein, 17 aa, Entamoeba invadens
FQNPHCIGFLLETILKS

SEQ ID NO: 2996756 - protein, 27 aa, Entamoeba invadens
FQPQYVPYKFYMYLKENVSLDELSEEL

SEQ ID NO: 2996757 - protein, 25 aa, Entamoeba invadens
FQQAICLMLFHFFGEFTILKPVKQS

SEQ ID NO: 2996758 - protein, 28 aa, Entamoeba invadens
FQQIEFNIIRIYYWTGCKSSVFSNEIEK

SEQ ID NO: 2996759 - protein, 27 aa, Entamoeba invadens
FQQIEYKIIRGYYWTGNKFFKKQGNLV

SEQ ID NO: 2996760 - protein, 25 aa, Entamoeba invadens
FQQLQSIFTVFLTIAPTAKAIPKNG

SEQ ID NO: 2996761 - protein, 32 aa, Entamoeba invadens
FQQMVPAIFVDPISGLYYYYSCQPNLFVEGQN

SEQ ID NO: 2996762 - protein, 23 aa, Entamoeba invadens
FQRFQLGLIVSPIYYIENSPMNH

SEQ ID NO: 2996763 - protein, 18 aa, Entamoeba invadens
FQRKAPYIVPMHMVQAIL

SEQ ID NO: 2996764 - protein, 29 aa, Entamoeba invadens
FQRNKNYLNFIILIKIKYTYNNRDKLFGV

SEQ ID NO: 2996765 - protein, 17 aa, Entamoeba invadens
FQSLKLFATHTYRIDLF

SEQ ID NO: 2996766 - protein, 26 aa, Entamoeba invadens
FQTDPSGMFLEFYAKATGAGTEAAQS

SEQ ID NO: 2996767 - protein, 17 aa, Entamoeba invadens
FQTIILNDEMMLCDCPG

SEQ ID NO: 2996768 - protein, 17 aa, Entamoeba invadens
FQTIYDSLKLPEVGSAS

SEQ ID NO: 2996769 - protein, 22 aa, Entamoeba invadens
FQTLQQCLCICLLSEMADITIK

SEQ ID NO: 2996770 - protein, 19 aa, Entamoeba invadens
FQTNCTLILSSLPSDVCYN

SEQ ID NO: 2996771 - protein, 19 aa, Entamoeba invadens
FQTPFSPIKKARSPSPLIG

SEQ ID NO: 2996772 - protein, 20 aa, Entamoeba invadens
FQTQIEDVFLQKAKYVGLMA

SEQ ID NO: 2996773 - protein, 42 aa, Entamoeba invadens
FQTQLMINTAWLSPQLRDVLKRAGFKPSYLSNPVWVETLMDT

SEQ ID NO: 2996774 - protein, 23 aa, Entamoeba invadens
FQTTLLKRQVPVLKDLKVISYGA

SEQ ID NO: 2996775 - protein, 35 aa, Entamoeba invadens
FQTTQPFKLPDTFYKTLLPYYKVSRILLVKENSQY

SEQ ID NO: 2996776 - protein, 22 aa, Entamoeba invadens
FQTWKLKRVITGNKGWISSISF

SEQ ID NO: 2996777 - protein, 20 aa, Entamoeba invadens
FQVVVVSDMFRLFNIVFAEE

SEQ ID NO: 2996778 - protein, 25 aa, Entamoeba invadens
FQYDTTLIIITIPQQITLLRENSFF

SEQ ID NO: 2996779 - protein, 21 aa, Entamoeba invadens
FQYLSKTFPRFTPERLKQIIL

SEQ ID NO: 2996780 - protein, 17 aa, Entamoeba invadens
FQYLVIAAEPYNTIAFK

SEQ ID NO: 2996781 - protein, 17 aa, Entamoeba invadens
FQYNKMPHFFDEEPNLF

SEQ ID NO: 2996782 - protein, 30 aa, Entamoeba invadens
FRANNRLQDLFIWAFQKEFLQNGKPNDITE

SEQ ID NO: 2996783 - protein, 21 aa, Entamoeba invadens
FRCDYIVHFYGAVFFPNKICM

SEQ ID NO: 2996784 - protein, 21 aa, Entamoeba invadens
FRCDYLVHFYGAVFIPNKVCM

SEQ ID NO: 2996785 - protein, 18 aa, Entamoeba invadens
FRCEYIVHFYGAVFITTK

SEQ ID NO: 2996786 - protein, 23 aa, Entamoeba invadens
FRCEYLVHFYGAVFIPNKVCMVT

SEQ ID NO: 2996787 - protein, 25 aa, Entamoeba invadens
FRDAKLFYERAFKHSIPGILSVIQQ

SEQ ID NO: 2996788 - protein, 18 aa, Entamoeba invadens
FRDGLRCVIPNYKVLQTD

SEQ ID NO: 2996789 - protein, 17 aa, Entamoeba invadens
FRDISFMSPCNCIALHP

SEQ ID NO: 2996790 - protein, 18 aa, Entamoeba invadens
FRDKRNYLVTLQSVLIGL

SEQ ID NO: 2996791 - protein, 18 aa, Entamoeba invadens
FRDNAILDLTESLIFYCG

SEQ ID NO: 2996792 - protein, 24 aa, Entamoeba invadens
FRDQWDSLLLKREKLRQIDDSNQI

SEQ ID NO: 2996793 - protein, 20 aa, Entamoeba invadens
FREALHKGFYELILSRDSYV

SEQ ID NO: 2996794 - protein, 18 aa, Entamoeba invadens
FREELSKNSYRKKEMTFR

SEQ ID NO: 2996795 - protein, 24 aa, Entamoeba invadens
FREISFQFDFFGVKKMVKAVPNTN

SEQ ID NO: 2996796 - protein, 26 aa, Entamoeba invadens
FRELVNYIMALLHGLARNKELFTKKP

SEQ ID NO: 2996797 - protein, 18 aa, Entamoeba invadens
FRENPIPIYPDTTHLFPN

SEQ ID NO: 2996798 - protein, 19 aa, Entamoeba invadens
FREVGFTLALTELFANFNE

SEQ ID NO: 2996799 - protein, 27 aa, Entamoeba invadens
FRFNLDKFHFNPIRLTKKTLKYFSHIE

SEQ ID NO: 2996800 - protein, 27 aa, Entamoeba invadens
FRGCHHVKIMVMLYEGGLRFVLSTGNL

SEQ ID NO: 2996801 - protein, 26 aa, Entamoeba invadens
FRGCKSLKNIIFPPTVRLGEKCFSGC

SEQ ID NO: 2996802 - protein, 26 aa, Entamoeba invadens
FRGCNSLVLLILPQKLVELQNCCFQN

SEQ ID NO: 2996803 - protein, 21 aa, Entamoeba invadens
FRGDTLPERKIPDLPAEHTKA

SEQ ID NO: 2996804 - protein, 19 aa, Entamoeba invadens
FRGLWRSYYPNCRCVSFVI

SEQ ID NO: 2996805 - protein, 25 aa, Entamoeba invadens
FRGNTSFIRIYSLYLRTFCAEFISS

SEQ ID NO: 2996806 - protein, 25 aa, Entamoeba invadens
FRGSTSPLADVFSLGICLFEMTTKM

SEQ ID NO: 2996807 - protein, 20 aa, Entamoeba invadens
FRHCVGFSEIAFPCTLIKLD

SEQ ID NO: 2996808 - protein, 24 aa, Entamoeba invadens
FRHKYKPLLFDTFGDYLVYACDNG

SEQ ID NO: 2996809 - protein, 18 aa, Entamoeba invadens
FRHNFFTIIPCAVSYCTN

SEQ ID NO: 2996810 - protein, 29 aa, Entamoeba invadens
FRHSYAMHMLYAGIPLKVLQSLMGHKSIS

SEQ ID NO: 2996811 - protein, 19 aa, Entamoeba invadens
FRHVYNWLSEARRFCNKEN

SEQ ID NO: 2996812 - protein, 29 aa, Entamoeba invadens
FRIDAKNLFLTYPQCDIYKVIALKQVKGA

SEQ ID NO: 2996813 - protein, 24 aa, Entamoeba invadens
FRIELTNYFKYIEVFENLHFGQIE

SEQ ID NO: 2996814 - protein, 27 aa, Entamoeba invadens
FRIELTNYFKYIEVFENLYFDEIAFKE

SEQ ID NO: 2996815 - protein, 25 aa, Entamoeba invadens
FRIKSTYKIIMYITEVPCGDCCISK

SEQ ID NO: 2996816 - protein, 27 aa, Entamoeba invadens
FRIRYKKIWSFIQENFTVFPKQTGDSV

SEQ ID NO: 2996817 - protein, 18 aa, Entamoeba invadens
FRKAQLEMIYLQKETALS

SEQ ID NO: 2996818 - protein, 25 aa, Entamoeba invadens
FRKCKNLQNLLLPSSLTIINDFAFS

SEQ ID NO: 2996819 - protein, 21 aa, Entamoeba invadens
FRKKHIFNIKEKSPFEPISEI

SEQ ID NO: 2996820 - protein, 27 aa, Entamoeba invadens
FRKQMVDLDLIEWFECIANFKRYKKVQ

SEQ ID NO: 2996821 - protein, 18 aa, Entamoeba invadens
FRKRYLDMIVNPDSVKNF

SEQ ID NO: 2996822 - protein, 28 aa, Entamoeba invadens
FRKVDLTLLNRLLRLVMDPLLADYITAK

SEQ ID NO: 2996823 - protein, 26 aa, Entamoeba invadens
FRKVKLYEMLLWANGEKDRCVNIIAL

SEQ ID NO: 2996824 - protein, 18 aa, Entamoeba invadens
FRKYFTLSSVLEGLFKVI

SEQ ID NO: 2996825 - protein, 20 aa, Entamoeba invadens
FRLACYKFPGRQKLLVSNKW

SEQ ID NO: 2996826 - protein, 25 aa, Entamoeba invadens
FRLEPQNLVFFKKSLKVAYQIILHE

SEQ ID NO: 2996827 - protein, 18 aa, Entamoeba invadens
FRLIIEQMPTRCYIKDVG

SEQ ID NO: 2996828 - protein, 25 aa, Entamoeba invadens
FRMMANKINALPLSFATLTGIRHLD

SEQ ID NO: 2996829 - protein, 19 aa, Entamoeba invadens
FRNAYVATIGADWSKKEFK

SEQ ID NO: 2996830 - protein, 26 aa, Entamoeba invadens
FRNCKALKEITLPKTLKFVDEQNVFV

SEQ ID NO: 2996831 - protein, 25 aa, Entamoeba invadens
FRNCKSLKEITLPESLKSVNEKKAF

SEQ ID NO: 2996832 - protein, 30 aa, Entamoeba invadens
FRNCTSLRRFLIPQGLLYMDSLVFYNCSSL

SEQ ID NO: 2996833 - protein, 32 aa, Entamoeba invadens
FRNCTSLRRFVIPQGLLYIDSLVFCNCSSLEE

SEQ ID NO: 2996834 - protein, 36 aa, Entamoeba invadens
FRNCTSLRRFVIPQGLLYMDSLVFYNCYNLEELNFP

SEQ ID NO: 2996835 - protein, 19 aa, Entamoeba invadens
FRNSVNASFPPILISVLKT

SEQ ID NO: 2996836 - protein, 17 aa, Entamoeba invadens
FRNVFECYYCVFRGLFD

SEQ ID NO: 2996837 - protein, 23 aa, Entamoeba invadens
FRNVMKLCFKIHMYKDANLMDAK

SEQ ID NO: 2996838 - protein, 29 aa, Entamoeba invadens
FRPESSQTLLFTRMYQNPKIRIDESEGLE

SEQ ID NO: 2996839 - protein, 18 aa, Entamoeba invadens
FRPRDLPMDLPREVPREL

SEQ ID NO: 2996840 - protein, 29 aa, Entamoeba invadens
FRPSYLELSYLKQTFPQIPVIALTATATE

SEQ ID NO: 2996841 - protein, 17 aa, Entamoeba invadens
FRQDIAVASLFRHFILA

SEQ ID NO: 2996842 - protein, 20 aa, Entamoeba invadens
FRQFHKYLNLPLENYTVIHR

SEQ ID NO: 2996843 - protein, 26 aa, Entamoeba invadens
FRQYNEYQIMFHVAPLLPNQEDDPQK

SEQ ID NO: 2996844 - protein, 33 aa, Entamoeba invadens
FRREPITLSSFLFQFLLTFKSVLCVPIHVVSNE

SEQ ID NO: 2996845 - protein, 18 aa, Entamoeba invadens
FRRIFEEPILISRQADCT

SEQ ID NO: 2996846 - protein, 46 aa, Entamoeba invadens
FRRMQEERWLLEGNMPYLDIFPKCRGYQLPSLFDTQRGDSGKTLPS

SEQ ID NO: 2996847 - protein, 24 aa, Entamoeba invadens
FRRPEYIRAITRMADFKETVAANM

SEQ ID NO: 2996848 - protein, 28 aa, Entamoeba invadens
FRSAFYDFLNNILIWEQEKRITPQQAIN

SEQ ID NO: 2996849 - protein, 23 aa, Entamoeba invadens
FRSAKILEFFNLKNSNFSVETTV

SEQ ID NO: 2996850 - protein, 24 aa, Entamoeba invadens
FRSEYIVHFYGAVFVPSKTCMVTE

SEQ ID NO: 2996851 - protein, 37 aa, Entamoeba invadens
FRSFVPVLKVVLPLKKLRRLTLPQFAPWRQTTQERIE

SEQ ID NO: 2996852 - protein, 35 aa, Entamoeba invadens
FRSGIDSYYRGCNGALFVYDITMPSSFKAVEEWVN

SEQ ID NO: 2996853 - protein, 32 aa, Entamoeba invadens
FRSMLNMYYRNISSCMIVYDITSRLSFEKVEE

SEQ ID NO: 2996854 - protein, 18 aa, Entamoeba invadens
FRSMTAGYYRGCHGIIVM

SEQ ID NO: 2996855 - protein, 29 aa, Entamoeba invadens
FRSQDYYSILYVFEKFFKTVTATKPPASR

SEQ ID NO: 2996856 - protein, 28 aa, Entamoeba invadens
FRSRFQRYLLHLYSSPYLFYVVELYSVH

SEQ ID NO: 2996857 - protein, 31 aa, Entamoeba invadens
FRSVPLIDSIHFLPLILTSFLDSNIVMNRVV

SEQ ID NO: 2996858 - protein, 24 aa, Entamoeba invadens
FRTALYLYEKVNYWKLLQESALKV

SEQ ID NO: 2996859 - protein, 27 aa, Entamoeba invadens
FRTIDPNFFIFFLKTPSGLPVPAKFQR

SEQ ID NO: 2996860 - protein, 20 aa, Entamoeba invadens
FRTMCLTSFSGEYFFSLPFP

SEQ ID NO: 2996861 - protein, 20 aa, Entamoeba invadens
FRTNFPLFTPREVQLYMKHL

SEQ ID NO: 2996862 - protein, 27 aa, Entamoeba invadens
FRTQACELSFVKLLQQIGKMKKRYDQA

SEQ ID NO: 2996863 - protein, 17 aa, Entamoeba invadens
FRVFGMENGWFRERFSR

SEQ ID NO: 2996864 - protein, 20 aa, Entamoeba invadens
FRVMFPLDEFVQTMLSLKRV

SEQ ID NO: 2996865 - protein, 20 aa, Entamoeba invadens
FRVPSCISFLDYKKRQVKIG

SEQ ID NO: 2996866 - protein, 19 aa, Entamoeba invadens
FRVQHEPVLGLRIINTVSK

SEQ ID NO: 2996867 - protein, 23 aa, Entamoeba invadens
FRVVRDMVLPMLCRGNKFTVVCD

SEQ ID NO: 2996868 - protein, 19 aa, Entamoeba invadens
FRVYTQPTIVLIPISIPDS

SEQ ID NO: 2996869 - protein, 19 aa, Entamoeba invadens
FRYAAPNNLFFPKSNAKEQ

SEQ ID NO: 2996870 - protein, 18 aa, Entamoeba invadens
FRYMSKSDFRVLTAIEMG

SEQ ID NO: 2996871 - protein, 22 aa, Entamoeba invadens
FSAEFYMLQFDTNPEIIELIKN

SEQ ID NO: 2996872 - protein, 26 aa, Entamoeba invadens
FSAFIKSLVLQPIVLSISLNLQPNQL

SEQ ID NO: 2996873 - protein, 17 aa, Entamoeba invadens
FSAFNYQYTIDNFFDFC

SEQ ID NO: 2996874 - protein, 19 aa, Entamoeba invadens
FSAKHFLEQLPASATKISV

SEQ ID NO: 2996875 - protein, 19 aa, Entamoeba invadens
FSALTCLTKFTLKGGKCSV

SEQ ID NO: 2996876 - protein, 26 aa, Entamoeba invadens
FSCKKAYCLSLKRSFELYGVLLELKD

SEQ ID NO: 2996877 - protein, 30 aa, Entamoeba invadens
FSCKLDKLKTLFVFKGYQITFKKIDNLKRL

SEQ ID NO: 2996878 - protein, 18 aa, Entamoeba invadens
FSCKYLKSVLLSSSLKHL

SEQ ID NO: 2996879 - protein, 22 aa, Entamoeba invadens
FSCVLDRFRYNPIPVTTTKLFH

SEQ ID NO: 2996880 - protein, 23 aa, Entamoeba invadens
FSCVLDRFRYNPIPVTTTKLFPY

SEQ ID NO: 2996881 - protein, 28 aa, Entamoeba invadens
FSCYISRIKKFFPNIKTLLLPSYQCLVP

SEQ ID NO: 2996882 - protein, 34 aa, Entamoeba invadens
FSDALCKKLLQKGIPTWINRMAWYGNKYQEYFGT

SEQ ID NO: 2996883 - protein, 28 aa, Entamoeba invadens
FSDELFDTISLLSLTRNQYDRCLTTLFE

SEQ ID NO: 2996884 - protein, 29 aa, Entamoeba invadens
FSDEQLKFFFLYLITRLEPISNTNFSIIY

SEQ ID NO: 2996885 - protein, 23 aa, Entamoeba invadens
FSDEVLLPIGLYDKYVKEEQKTK

SEQ ID NO: 2996886 - protein, 21 aa, Entamoeba invadens
FSDGEVFLALAHFISNKSFDF

SEQ ID NO: 2996887 - protein, 25 aa, Entamoeba invadens
FSDKYVLLSDNFGRLILFDTENRFI

SEQ ID NO: 2996888 - protein, 19 aa, Entamoeba invadens
FSDLFEKLDLEYLLHEENV

SEQ ID NO: 2996889 - protein, 19 aa, Entamoeba invadens
FSDLLIQNVDMKKSIDGLQ

SEQ ID NO: 2996890 - protein, 18 aa, Entamoeba invadens
FSDMLWSDPLMYETYDEK

SEQ ID NO: 2996891 - protein, 26 aa, Entamoeba invadens
FSDQTPFFLISYLMATVPLSFEDANT

SEQ ID NO: 2996892 - protein, 28 aa, Entamoeba invadens
FSDQWNNTHILFFAIMRNRITSSFVDLF

SEQ ID NO: 2996893 - protein, 26 aa, Entamoeba invadens
FSDSSTLRFVPFPPNVHRLGNFSFAR

SEQ ID NO: 2996894 - protein, 18 aa, Entamoeba invadens
FSDVFWRKVDERIKKGKK

SEQ ID NO: 2996895 - protein, 21 aa, Entamoeba invadens
FSDYVALVLVAKKYEDILLKH

SEQ ID NO: 2996896 - protein, 21 aa, Entamoeba invadens
FSECKLHRLSLRQYKTMKAAK

SEQ ID NO: 2996897 - protein, 23 aa, Entamoeba invadens
FSEFLAIHVDPKILENIKGTIKI

SEQ ID NO: 2996898 - protein, 20 aa, Entamoeba invadens
FSEKDAHPIEYPYSECTQVG

SEQ ID NO: 2996899 - protein, 17 aa, Entamoeba invadens
FSELLPLLENPLNVDIL

SEQ ID NO: 2996900 - protein, 20 aa, Entamoeba invadens
FSEMYLKTKLAMCKILYAQC

SEQ ID NO: 2996901 - protein, 19 aa, Entamoeba invadens
FSEPLPHKIVINPSPELEK

SEQ ID NO: 2996902 - protein, 25 aa, Entamoeba invadens
FSEPTRLTALTKLIICETNTGAFLP

SEQ ID NO: 2996903 - protein, 19 aa, Entamoeba invadens
FSERPITEELIINSMPKIL

SEQ ID NO: 2996904 - protein, 26 aa, Entamoeba invadens
FSESELRRLFRRFKKLDTKSKEASTD

SEQ ID NO: 2996905 - protein, 19 aa, Entamoeba invadens
FSESVFQPIFTTIKDPRQI

SEQ ID NO: 2996906 - protein, 27 aa, Entamoeba invadens
FSETNMLPFNLLIELNAFEPLFNRAIN

SEQ ID NO: 2996907 - protein, 24 aa, Entamoeba invadens
FSETYMMGMYKIFLEIVQAFKTLH

SEQ ID NO: 2996908 - protein, 31 aa, Entamoeba invadens
FSEYFDNAPVFLVPGRRFPVTIEYLKEPEPD

SEQ ID NO: 2996909 - protein, 25 aa, Entamoeba invadens
FSEYISRFFKPIFEATLHPEQHKEL

SEQ ID NO: 2996910 - protein, 38 aa, Entamoeba invadens
FSFAITMLECLLWDNAYPKSIYLYPWTVADDVASGKRP

SEQ ID NO: 2996911 - protein, 24 aa, Entamoeba invadens
FSFCEKLMCVSIKGAIKTIGTKCF

SEQ ID NO: 2996912 - protein, 20 aa, Entamoeba invadens
FSFCVSLTQINLPLGLKEIG

SEQ ID NO: 2996913 - protein, 19 aa, Entamoeba invadens
FSFDGVFPMTTDQQTFYTT

SEQ ID NO: 2996914 - protein, 24 aa, Entamoeba invadens
FSFDLTHNFVFPTTITKIKNHNMW

SEQ ID NO: 2996915 - protein, 25 aa, Entamoeba invadens
FSFDLTHNFVFPTTITKIRNHNIWY

SEQ ID NO: 2996916 - protein, 20 aa, Entamoeba invadens
FSFENLGLTGLISCLERIRL

SEQ ID NO: 2996917 - protein, 17 aa, Entamoeba invadens
FSFFKSYFNGKTRSIFY

SEQ ID NO: 2996918 - protein, 19 aa, Entamoeba invadens
FSFFVSSKQFVVTDLQGVF

SEQ ID NO: 2996919 - protein, 25 aa, Entamoeba invadens
FSFGITMVQILTWDLSVNANGSRKL

SEQ ID NO: 2996920 - protein, 19 aa, Entamoeba invadens
FSFGITMYEVFGWCEAYQN

SEQ ID NO: 2996921 - protein, 19 aa, Entamoeba invadens
FSFGVTMYEVFGWTNAYPL

SEQ ID NO: 2996922 - protein, 17 aa, Entamoeba invadens
FSFIQKALPKELQVVKD

SEQ ID NO: 2996923 - protein, 26 aa, Entamoeba invadens
FSFIQNEFLDFKRAVKKKFFVKRGTK

SEQ ID NO: 2996924 - protein, 17 aa, Entamoeba invadens
FSFITPRGSSIPLRHRI

SEQ ID NO: 2996925 - protein, 29 aa, Entamoeba invadens
FSFYGCNCISFYLVPKVLKGLKEKLFNYL

SEQ ID NO: 2996926 - protein, 17 aa, Entamoeba invadens
FSGCFYLNGFKFPNVKC

SEQ ID NO: 2996927 - protein, 24 aa, Entamoeba invadens
FSGCLTLLSIVLPPKIRTIEDNSF

SEQ ID NO: 2996928 - protein, 21 aa, Entamoeba invadens
FSGCQWLRVINFPESVRNIGV

SEQ ID NO: 2996929 - protein, 27 aa, Entamoeba invadens
FSGEKVFMAFLKSFSRIETTKKKIFVF

SEQ ID NO: 2996930 - protein, 26 aa, Entamoeba invadens
FSGGLKIVELLYKTNLLLLVGGGSNP

SEQ ID NO: 2996931 - protein, 17 aa, Entamoeba invadens
FSGKPELLSTEGLFRIG

SEQ ID NO: 2996932 - protein, 23 aa, Entamoeba invadens
FSGLPLFSVFDRDAYVKWDMPDF

SEQ ID NO: 2996933 - protein, 34 aa, Entamoeba invadens
FSGQFELFGRDTSFYRTFLLRNYSYMTTEREVGS

SEQ ID NO: 2996934 - protein, 19 aa, Entamoeba invadens
FSHFDFFKSVEWQNTELYV

SEQ ID NO: 2996935 - protein, 19 aa, Entamoeba invadens
FSHILYLHQLDPPKLLSIY

SEQ ID NO: 2996936 - protein, 17 aa, Entamoeba invadens
FSIFFKTQMKSAPQHLQ

SEQ ID NO: 2996937 - protein, 17 aa, Entamoeba invadens
FSILFSMRLTRESVLDT

SEQ ID NO: 2996938 - protein, 22 aa, Entamoeba invadens
FSINLLEIPSFVTSLNTSSFAC

SEQ ID NO: 2996939 - protein, 20 aa, Entamoeba invadens
FSIPLVPFYSSSIIRTSINP

SEQ ID NO: 2996940 - protein, 27 aa, Entamoeba invadens
FSIRTIRKFLFHLLHALQTLSQANVVH

SEQ ID NO: 2996941 - protein, 25 aa, Entamoeba invadens
FSITLIEIFFKELFLSQENFKLYSP

SEQ ID NO: 2996942 - protein, 29 aa, Entamoeba invadens
FSITNSYRPIFNVPLSDVFFQAYLEKNQS

SEQ ID NO: 2996943 - protein, 25 aa, Entamoeba invadens
FSKEFFRLEIPRLLLNPLSSAQETD

SEQ ID NO: 2996944 - protein, 28 aa, Entamoeba invadens
FSKIYGKKNLYFFVGTQKGPVYGGYCSK

SEQ ID NO: 2996945 - protein, 19 aa, Entamoeba invadens
FSKLTQGAKGVLLFGPPGT

SEQ ID NO: 2996946 - protein, 26 aa, Entamoeba invadens
FSKNDILPKSVTFSFLFDFVEHMEMF

SEQ ID NO: 2996947 - protein, 29 aa, Entamoeba invadens
FSKNMILMDEFFRKPLLSLAEQKVVAASD

SEQ ID NO: 2996948 - protein, 25 aa, Entamoeba invadens
FSKPLWKFHIFTNVAGKWKFVAQIS

SEQ ID NO: 2996949 - protein, 19 aa, Entamoeba invadens
FSKQDRPCFKCGWPGHISK

SEQ ID NO: 2996950 - protein, 32 aa, Entamoeba invadens
FSLDQVLDRSLPPFFIGRCCVNLVTALQYLSS

SEQ ID NO: 2996951 - protein, 18 aa, Entamoeba invadens
FSLKWRDAVFTFSVSSIA

SEQ ID NO: 2996952 - protein, 19 aa, Entamoeba invadens
FSLMDILTQNILTPYLAQL

SEQ ID NO: 2996953 - protein, 20 aa, Entamoeba invadens
FSLPTFMEVIVNILSELVVA

SEQ ID NO: 2996954 - protein, 23 aa, Entamoeba invadens
FSLQSRFVLTNKEKLLPVMQSCN

SEQ ID NO: 2996955 - protein, 21 aa, Entamoeba invadens
FSLSITMYETFGWKLAYMKTD

SEQ ID NO: 2996956 - protein, 17 aa, Entamoeba invadens
FSLTTFSPSGKLVQIEY

SEQ ID NO: 2996957 - protein, 17 aa, Entamoeba invadens
FSMCNKLKELVFNETCV

SEQ ID NO: 2996958 - protein, 18 aa, Entamoeba invadens
FSMLQERCYILEKLQAQV

SEQ ID NO: 2996959 - protein, 24 aa, Entamoeba invadens
FSMMQPIQIQPIQPMKPVAVRQEQ

SEQ ID NO: 2996960 - protein, 26 aa, Entamoeba invadens
FSNCTSLQFVTLPSYLQCIENGCFYC

SEQ ID NO: 2996961 - protein, 34 aa, Entamoeba invadens
FSNEKELLLDDMQLYDLGILQKDKVFQTLKCFSS

SEQ ID NO: 2996962 - protein, 20 aa, Entamoeba invadens
FSNLKVCGSAIFLKLCEISV

SEQ ID NO: 2996963 - protein, 22 aa, Entamoeba invadens
FSNLPQMFHFNPIPLTSSTQKL

SEQ ID NO: 2996964 - protein, 25 aa, Entamoeba invadens
FSNSYIRVFYKGVDFSFCLQQHCWI

SEQ ID NO: 2996965 - protein, 18 aa, Entamoeba invadens
FSNTFPVFPIRNDVIVEL

SEQ ID NO: 2996966 - protein, 18 aa, Entamoeba invadens
FSPEGRLYQVEYALKSVK

SEQ ID NO: 2996967 - protein, 18 aa, Entamoeba invadens
FSPVLNWTDTNYIGVERE

SEQ ID NO: 2996968 - protein, 20 aa, Entamoeba invadens
FSPVPLANFPWHSEKEIGDE

SEQ ID NO: 2996969 - protein, 25 aa, Entamoeba invadens
FSPVRPIYVNDIITILNCFTLRRVT

SEQ ID NO: 2996970 - protein, 19 aa, Entamoeba invadens
FSQCRYLTQIVLNETLKCI

SEQ ID NO: 2996971 - protein, 25 aa, Entamoeba invadens
FSQCTSLFDIYIPDSIIAFGDLCFF

SEQ ID NO: 2996972 - protein, 43 aa, Entamoeba invadens
FSQFKLFEEHLSYLTPSLLLDFFNAFTSFFTLGSSFFQENVFI

SEQ ID NO: 2996973 - protein, 22 aa, Entamoeba invadens
FSQFKLFMVAYERSMGTTTLSL

SEQ ID NO: 2996974 - protein, 22 aa, Entamoeba invadens
FSQLLKAIINLKPIFVDPGEDE

SEQ ID NO: 2996975 - protein, 17 aa, Entamoeba invadens
FSQMNVYIFPKFVVSVV

SEQ ID NO: 2996976 - protein, 17 aa, Entamoeba invadens
FSQRELFPSLPDEVALS

SEQ ID NO: 2996977 - protein, 28 aa, Entamoeba invadens
FSREDFLNFKALILPVLMKNTLLCEFKE

SEQ ID NO: 2996978 - protein, 26 aa, Entamoeba invadens
FSRFAILSAKLFIMLESLNGDIVLIL

SEQ ID NO: 2996979 - protein, 20 aa, Entamoeba invadens
FSRGLGHNTLICKLERRYLG

SEQ ID NO: 2996980 - protein, 18 aa, Entamoeba invadens
FSRIAFKIKDGLVINIVK

SEQ ID NO: 2996981 - protein, 18 aa, Entamoeba invadens
FSRISRRAELSLSGFDIQ

SEQ ID NO: 2996982 - protein, 20 aa, Entamoeba invadens
FSRKCVTCDSGYYPSNGICV

SEQ ID NO: 2996983 - protein, 27 aa, Entamoeba invadens
FSRKKDTFLVLVFYCRDFSVVCPKELV

SEQ ID NO: 2996984 - protein, 33 aa, Entamoeba invadens
FSRLTKFLFSNATSPPLVILLPRTLVECEIAVD

SEQ ID NO: 2996985 - protein, 22 aa, Entamoeba invadens
FSRMNDSAIIYLVASFTDVGKR

SEQ ID NO: 2996986 - protein, 24 aa, Entamoeba invadens
FSRNAIDFLLSRKIDRFIKYRRGT

SEQ ID NO: 2996987 - protein, 17 aa, Entamoeba invadens
FSRNCADTIVRKCLGRV

SEQ ID NO: 2996988 - protein, 17 aa, Entamoeba invadens
FSRVMKCFDNRLCISLA

SEQ ID NO: 2996989 - protein, 24 aa, Entamoeba invadens
FSSDLLYQPFRPTVCSKYNLKMFS

SEQ ID NO: 2996990 - protein, 18 aa, Entamoeba invadens
FSSFPEPLANISRKLRHV

SEQ ID NO: 2996991 - protein, 22 aa, Entamoeba invadens
FSSFRTFGFITGSKYWIFGVTG

SEQ ID NO: 2996992 - protein, 18 aa, Entamoeba invadens
FSSKKKPLLLILQNLDPA

SEQ ID NO: 2996993 - protein, 24 aa, Entamoeba invadens
FSSKSKMVALPLYSALPQNEQQKV

SEQ ID NO: 2996994 - protein, 26 aa, Entamoeba invadens
FSSNCTLILLSLPYDVKNSDIIYTFQ

SEQ ID NO: 2996995 - protein, 38 aa, Entamoeba invadens
FSSQISCFYIMYEDPIFLRTEKIEILLLLVEESTVKDL

SEQ ID NO: 2996996 - protein, 17 aa, Entamoeba invadens
FSSSKTLTDSLIISISI

SEQ ID NO: 2996997 - protein, 23 aa, Entamoeba invadens
FSSTMFPVIPPKYNFVSPKLYSH

SEQ ID NO: 2996998 - protein, 29 aa, Entamoeba invadens
FSSVDLAFWKFLEYVFVLLRNEVIEVFVK

SEQ ID NO: 2996999 - protein, 35 aa, Entamoeba invadens
FSTEDVMKMFYGIKPLTYLLPQLLCVATNILNLWR

SEQ ID NO: 2997000 - protein, 33 aa, Entamoeba invadens
FSTEILIYLCACKINYPKRFMLLRGNHESRIMA

SEQ ID NO: 2997001 - protein, 26 aa, Entamoeba invadens
FSTEVILYLFALKICYPDNIKMLRGN

SEQ ID NO: 2997002 - protein, 17 aa, Entamoeba invadens
FSTGKWGSGAYKGDMRL

SEQ ID NO: 2997003 - protein, 22 aa, Entamoeba invadens
FSTHLPLKEDIYPYLRNLTIPS

SEQ ID NO: 2997004 - protein, 37 aa, Entamoeba invadens
FSTLFKQKCILSYGPCQFPVLFSCYKDFTNDATSTVL

SEQ ID NO: 2997005 - protein, 21 aa, Entamoeba invadens
FSTLIDILKLKNGILESSYLD

SEQ ID NO: 2997006 - protein, 17 aa, Entamoeba invadens
FSTLKPIERLTSTLILL

SEQ ID NO: 2997007 - protein, 41 aa, Entamoeba invadens
FSTNIKNLLGLTDFLARPARLPFLSLLLDLPPDVNDGTQQF

SEQ ID NO: 2997008 - protein, 26 aa, Entamoeba invadens
FSTNIKNLLGLTDYLARPARLPFLSL

SEQ ID NO: 2997009 - protein, 25 aa, Entamoeba invadens
FSTPKLVFLFQGDALIDVYCFLFGL

SEQ ID NO: 2997010 - protein, 17 aa, Entamoeba invadens
FSTQEQLCRALNAFLKF

SEQ ID NO: 2997011 - protein, 36 aa, Entamoeba invadens
FSTRFFCLHWFITKCHSFMIIIFDTISNPIVTIFTN

SEQ ID NO: 2997012 - protein, 18 aa, Entamoeba invadens
FSTRPNEQGHCISVGVLA

SEQ ID NO: 2997013 - protein, 17 aa, Entamoeba invadens
FSTWATKYVVIKENVLV

SEQ ID NO: 2997014 - protein, 29 aa, Entamoeba invadens
FSVAFPKFREAYIKSILPALVAKLEEFKL

SEQ ID NO: 2997015 - protein, 25 aa, Entamoeba invadens
FSVDFDTICSLPIDKPSRDLLCVGN

SEQ ID NO: 2997016 - protein, 18 aa, Entamoeba invadens
FSVFIMDVLVFLDQLDSI

SEQ ID NO: 2997017 - protein, 30 aa, Entamoeba invadens
FSVKQTIPEPLFFLELRISPYHYEEDLIHQ

SEQ ID NO: 2997018 - protein, 17 aa, Entamoeba invadens
FSVMELHDTFLHPKVEC

SEQ ID NO: 2997019 - protein, 18 aa, Entamoeba invadens
FSVQLRTFYCSYDEPIYI

SEQ ID NO: 2997020 - protein, 18 aa, Entamoeba invadens
FSVQSFEMFVWTDKMVDK

SEQ ID NO: 2997021 - protein, 21 aa, Entamoeba invadens
FSVRDLQLLYCDCPEMKSIRR

SEQ ID NO: 2997022 - protein, 26 aa, Entamoeba invadens
FSWLVDLRYLNLCGCTRITPAFLSTL

SEQ ID NO: 2997023 - protein, 25 aa, Entamoeba invadens
FSYDIFKSLILFHYLCRNGSPQIFN

SEQ ID NO: 2997024 - protein, 18 aa, Entamoeba invadens
FSYFKKWTGLSRGKLVFD

SEQ ID NO: 2997025 - protein, 30 aa, Entamoeba invadens
FTACCFGFLSLLHPLSWQGVFLPLVPQNHV

SEQ ID NO: 2997026 - protein, 28 aa, Entamoeba invadens
FTADTCYYEPFWVALFQVKNLKAVISEV

SEQ ID NO: 2997027 - protein, 18 aa, Entamoeba invadens
FTAKNLFELLNKMKEFNI

SEQ ID NO: 2997028 - protein, 28 aa, Entamoeba invadens
FTAPKDFISIILVSKKYEFLLDRFRENP

SEQ ID NO: 2997029 - protein, 24 aa, Entamoeba invadens
FTASKEYLPLKKKPPHPPIYEFLQ

SEQ ID NO: 2997030 - protein, 29 aa, Entamoeba invadens
FTCENGIYLLVTQLKKDALTPYIAMIKEY

SEQ ID NO: 2997031 - protein, 26 aa, Entamoeba invadens
FTCEPLGDLFTKCELTLPTGGGCAIC

SEQ ID NO: 2997032 - protein, 26 aa, Entamoeba invadens
FTCIHPYFNIPNLQVFMLMKGLVSKK

SEQ ID NO: 2997033 - protein, 21 aa, Entamoeba invadens
FTCLFDIKRSLDNMKKLIIDQ

SEQ ID NO: 2997034 - protein, 18 aa, Entamoeba invadens
FTDDAFADLLWSDPIPRS

SEQ ID NO: 2997035 - protein, 30 aa, Entamoeba invadens
FTDGNIFKLVVWFKVNYLSTLAFEKYNVVF

SEQ ID NO: 2997036 - protein, 21 aa, Entamoeba invadens
FTDHFCFSACSLFAKHFQEKK

SEQ ID NO: 2997037 - protein, 20 aa, Entamoeba invadens
FTDLAFSPMGDMLLATSNDG

SEQ ID NO: 2997038 - protein, 18 aa, Entamoeba invadens
FTDLIYFLQNLPTQDWTD

SEQ ID NO: 2997039 - protein, 27 aa, Entamoeba invadens
FTDNKLLFYVMDFYKALKSVEKKFPFL

SEQ ID NO: 2997040 - protein, 27 aa, Entamoeba invadens
FTECLHALTDLLFLSGYLFNVKQSTGK

SEQ ID NO: 2997041 - protein, 23 aa, Entamoeba invadens
FTEFLCYQIMFHVSTLLPDVKSD

SEQ ID NO: 2997042 - protein, 20 aa, Entamoeba invadens
FTEFPRPILRLEGLKHLDLS

SEQ ID NO: 2997043 - protein, 23 aa, Entamoeba invadens
FTEIVPGFLYLSSSLPVADKDFL

SEQ ID NO: 2997044 - protein, 42 aa, Entamoeba invadens
FTEKTFANLFVKYKKFVYKTRAFLFKNGVCKGFGFVDVIDKE

SEQ ID NO: 2997045 - protein, 24 aa, Entamoeba invadens
FTEVLYGMFTGCYNLAEIVGLESV

SEQ ID NO: 2997046 - protein, 26 aa, Entamoeba invadens
FTEVTMIPDLFFLISKALEEKKTEKA

SEQ ID NO: 2997047 - protein, 25 aa, Entamoeba invadens
FTFEFYQKMLLYAFMDRFDIFQLVE

SEQ ID NO: 2997048 - protein, 17 aa, Entamoeba invadens
FTFMENFLEYPSCTQIA

SEQ ID NO: 2997049 - protein, 19 aa, Entamoeba invadens
FTGLKNIFDIVAAQCSELS

SEQ ID NO: 2997050 - protein, 27 aa, Entamoeba invadens
FTGTSVLYLNLLLDFFVIGNGEVKKRI

SEQ ID NO: 2997051 - protein, 18 aa, Entamoeba invadens
FTGVGDTFTYTLFAWIKQ

SEQ ID NO: 2997052 - protein, 19 aa, Entamoeba invadens
FTHGKPWLRVNPNYKEINV

SEQ ID NO: 2997053 - protein, 25 aa, Entamoeba invadens
FTHMSPALIRLWPDDIQNDEIWGVV

SEQ ID NO: 2997054 - protein, 38 aa, Entamoeba invadens
FTIEVIIYFHRLFLFPPYVLCQLLPPVKYIQEIPPRVV

SEQ ID NO: 2997055 - protein, 19 aa, Entamoeba invadens
FTILLEKSIPCGSLMCAVI

SEQ ID NO: 2997056 - protein, 33 aa, Entamoeba invadens
FTKFIQLSGLIERPFLRQYYIDSIRAMSGNLIC

SEQ ID NO: 2997057 - protein, 22 aa, Entamoeba invadens
FTKFQDWYCANIEKVEEIANRL

SEQ ID NO: 2997058 - protein, 20 aa, Entamoeba invadens
FTKFVLPKNAVEIPPKTFCN

SEQ ID NO: 2997059 - protein, 19 aa, Entamoeba invadens
FTKILLKKDILFIVCASEV

SEQ ID NO: 2997060 - protein, 24 aa, Entamoeba invadens
FTKKDFEIFKYRKTVIIKMCGLSG

SEQ ID NO: 2997061 - protein, 26 aa, Entamoeba invadens
FTKKYVKRWVAMSGPFLGAAKTIAAA

SEQ ID NO: 2997062 - protein, 21 aa, Entamoeba invadens
FTKLEPLFCGVVDKVTMNISL

SEQ ID NO: 2997063 - protein, 19 aa, Entamoeba invadens
FTKMGLPDVKFKPAYNPYT

SEQ ID NO: 2997064 - protein, 27 aa, Entamoeba invadens
FTKMVDVFRAAWWFSALTKDEALSVLD

SEQ ID NO: 2997065 - protein, 40 aa, Entamoeba invadens
FTKSTLLEISRFPKFLIPKYFAAFIKKLFASLVPSTFESR

SEQ ID NO: 2997066 - protein, 25 aa, Entamoeba invadens
FTKTGIFVPIFSSYVSLFCGSYRNN

SEQ ID NO: 2997067 - protein, 25 aa, Entamoeba invadens
FTKVNEPHQFGRWMSFSLEKEGELE

SEQ ID NO: 2997068 - protein, 19 aa, Entamoeba invadens
FTLKKTQVLGVLTPSNFVI

SEQ ID NO: 2997069 - protein, 26 aa, Entamoeba invadens
FTLNTHLLKCIDTIRGVFTSLGVNVV

SEQ ID NO: 2997070 - protein, 18 aa, Entamoeba invadens
FTLPKVAVSADLPHLHTK

SEQ ID NO: 2997071 - protein, 19 aa, Entamoeba invadens
FTLQPMTPPVLAWEEAQRR

SEQ ID NO: 2997072 - protein, 32 aa, Entamoeba invadens
FTLQQTFCICLLSPFCKITLKKPSRRSSVTEQ

SEQ ID NO: 2997073 - protein, 26 aa, Entamoeba invadens
FTLSNIKLLLLSWYSTNHMSFSKVEK

SEQ ID NO: 2997074 - protein, 20 aa, Entamoeba invadens
FTMFTATAFKKQVELNLVME

SEQ ID NO: 2997075 - protein, 31 aa, Entamoeba invadens
FTNAKMIKCKLLQKTIFPITLKRLTLEDCEI

SEQ ID NO: 2997076 - protein, 19 aa, Entamoeba invadens
FTNFTTLIEFIFVSKNCRD

SEQ ID NO: 2997077 - protein, 37 aa, Entamoeba invadens
FTNIFLKFKVEKLMRIVLMIIHNILQVDWYIRLLVQH

SEQ ID NO: 2997078 - protein, 23 aa, Entamoeba invadens
FTNLKVFLIIKQDESFTLNQRFE

SEQ ID NO: 2997079 - protein, 19 aa, Entamoeba invadens
FTNPTPIQAVGWPIVLGGT

SEQ ID NO: 2997080 - protein, 23 aa, Entamoeba invadens
FTPDSFFYLRNVTNGFILPETIC

SEQ ID NO: 2997081 - protein, 17 aa, Entamoeba invadens
FTPFIPVAPQCVPLKIY

SEQ ID NO: 2997082 - protein, 29 aa, Entamoeba invadens
FTPHEVLNRYLCVLIDFLSGLELSNEQSY

SEQ ID NO: 2997083 - protein, 20 aa, Entamoeba invadens
FTPNMFPGFLEFLKEFRRRG

SEQ ID NO: 2997084 - protein, 18 aa, Entamoeba invadens
FTQKFLGMLESKKLPVSF

SEQ ID NO: 2997085 - protein, 18 aa, Entamoeba invadens
FTQLELGLVHSWASIRVE

SEQ ID NO: 2997086 - protein, 29 aa, Entamoeba invadens
FTQNLLIDICMEFGYFFESCLSRKSKKTL

SEQ ID NO: 2997087 - protein, 20 aa, Entamoeba invadens
FTQPLVLMREALALRKSYST

SEQ ID NO: 2997088 - protein, 27 aa, Entamoeba invadens
FTRKDDLVVSPLFKMSPLPPNVVHPTD

SEQ ID NO: 2997089 - protein, 26 aa, Entamoeba invadens
FTRNGSFLCAVPYNRKTIIPTFCMEG

SEQ ID NO: 2997090 - protein, 31 aa, Entamoeba invadens
FTRNTRFCLICNYISRILPPISSRCIKFRFN

SEQ ID NO: 2997091 - protein, 23 aa, Entamoeba invadens
FTSDFVFDVLSLTPPKYTQDIYL

SEQ ID NO: 2997092 - protein, 34 aa, Entamoeba invadens
FTSFSHTEIVLYAAFYVMNYSTHSLFFATPGTMS

SEQ ID NO: 2997093 - protein, 32 aa, Entamoeba invadens
FTSGLTGLYFRTVAWRIWLGVYPKEITPEWVS

SEQ ID NO: 2997094 - protein, 29 aa, Entamoeba invadens
FTSPFAPPMGSFLLPSPKAFPMRMASKGD

SEQ ID NO: 2997095 - protein, 22 aa, Entamoeba invadens
FTSPKVYPSVLLINSKKAIPQV

SEQ ID NO: 2997096 - protein, 25 aa, Entamoeba invadens
FTSQDTVFLCRHGFRIDYNDLTWVP

SEQ ID NO: 2997097 - protein, 26 aa, Entamoeba invadens
FTSQDTVFLCRHGFRIDYNDLTWVPK

SEQ ID NO: 2997098 - protein, 30 aa, Entamoeba invadens
FTSSMPNFPYVAPYFFMSPISHNLSVESQT

SEQ ID NO: 2997099 - protein, 24 aa, Entamoeba invadens
FTSSTYIMVIFSNKALTFANVALN

SEQ ID NO: 2997100 - protein, 17 aa, Entamoeba invadens
FTTAFTTAPLSCFSSWN

SEQ ID NO: 2997101 - protein, 20 aa, Entamoeba invadens
FTTDENCFIFVLKENGIKRR

SEQ ID NO: 2997102 - protein, 26 aa, Entamoeba invadens
FTTMDQPLLFTPRKVIKTMEFPTTVI

SEQ ID NO: 2997103 - protein, 26 aa, Entamoeba invadens
FTTQHVVPVIYRGITPNPLYVSCEEC

SEQ ID NO: 2997104 - protein, 29 aa, Entamoeba invadens
FTTQLKATFVVLFNLFDKGPKGGLNIVEF

SEQ ID NO: 2997105 - protein, 17 aa, Entamoeba invadens
FTTWANLPFNTNNTFSM

SEQ ID NO: 2997106 - protein, 30 aa, Entamoeba invadens
FTTYKNFINIRLQIYFKVFHDWVSKNAIDK

SEQ ID NO: 2997107 - protein, 18 aa, Entamoeba invadens
FTVKDYFNVLYGISQKKF

SEQ ID NO: 2997108 - protein, 25 aa, Entamoeba invadens
FTVKKCELLFAMLYARFVIKMEDLK

SEQ ID NO: 2997109 - protein, 17 aa, Entamoeba invadens
FTVLASCGCQLLGTMRI

SEQ ID NO: 2997110 - protein, 28 aa, Entamoeba invadens
FTVLNSSRNCLLPFVDGYKYIPTDSKRI

SEQ ID NO: 2997111 - protein, 25 aa, Entamoeba invadens
FTVNLAHFEILLNQNIRRIDEAAFF

SEQ ID NO: 2997112 - protein, 18 aa, Entamoeba invadens
FTVYFNLIDDDNNGKIGI

SEQ ID NO: 2997113 - protein, 34 aa, Entamoeba invadens
FTYKTQKIFFTRNGKFLGLMNFVSGLVLPAVCVE

SEQ ID NO: 2997114 - protein, 27 aa, Entamoeba invadens
FTYMPQWMMDYLKFNPGDRAIAIKTWV

SEQ ID NO: 2997115 - protein, 25 aa, Entamoeba invadens
FTYSGIKYKIIPFYQKILKNKNKKI

SEQ ID NO: 2997116 - protein, 17 aa, Entamoeba invadens
FTYSMLPLEVRLGVTLY

SEQ ID NO: 2997117 - protein, 19 aa, Entamoeba invadens
FVAFIRQQDLRDGKLNISN

SEQ ID NO: 2997118 - protein, 18 aa, Entamoeba invadens
FVAILKRVVNFFRERLHE

SEQ ID NO: 2997119 - protein, 18 aa, Entamoeba invadens
FVALGRKLLQINHKGEVA

SEQ ID NO: 2997120 - protein, 20 aa, Entamoeba invadens
FVCDNYLFYRFSIDGGDFTK

SEQ ID NO: 2997121 - protein, 20 aa, Entamoeba invadens
FVCEFEVFITPHCTLNFNDN

SEQ ID NO: 2997122 - protein, 18 aa, Entamoeba invadens
FVDAILQKGVLPLMLEEI

SEQ ID NO: 2997123 - protein, 20 aa, Entamoeba invadens
FVDEKYTFPDPPQNFLCCDG

SEQ ID NO: 2997124 - protein, 18 aa, Entamoeba invadens
FVDGKWRFYDDIQSAERF

SEQ ID NO: 2997125 - protein, 18 aa, Entamoeba invadens
FVDGYAVFIACSLANHSC

SEQ ID NO: 2997126 - protein, 26 aa, Entamoeba invadens
FVDIPDSLSLLTKLKTLIINKSFVSC

SEQ ID NO: 2997127 - protein, 27 aa, Entamoeba invadens
FVDKTRFIQMCCAIVDYLKEAEKFKEE

SEQ ID NO: 2997128 - protein, 24 aa, Entamoeba invadens
FVDLKEKYLSKCKYPSFFETKRVI

SEQ ID NO: 2997129 - protein, 25 aa, Entamoeba invadens
FVDQSIGWIISVFSRLALTADEQGK

SEQ ID NO: 2997130 - protein, 28 aa, Entamoeba invadens
FVDSDGLFIVPEKCQVVFTLAEEKTFCN

SEQ ID NO: 2997131 - protein, 28 aa, Entamoeba invadens
FVEDHWDILYRLPILQKQNWKKALLDAF

SEQ ID NO: 2997132 - protein, 27 aa, Entamoeba invadens
FVEDKDFFVFSFKSKSLLKPTKYVKKC

SEQ ID NO: 2997133 - protein, 23 aa, Entamoeba invadens
FVEFAHYFKVYKMIVGNSEAVLA

SEQ ID NO: 2997134 - protein, 26 aa, Entamoeba invadens
FVEIFQSFVVEPFPLRKEKRKTILTP

SEQ ID NO: 2997135 - protein, 21 aa, Entamoeba invadens
FVEINPFPQTLTKIKLMNVNS

SEQ ID NO: 2997136 - protein, 21 aa, Entamoeba invadens
FVEKLFRDRFAFIVVTESTTN

SEQ ID NO: 2997137 - protein, 19 aa, Entamoeba invadens
FVEKNFFKRVIYYPVDCSK

SEQ ID NO: 2997138 - protein, 25 aa, Entamoeba invadens
FVELEVKRILSKYPKFKASVMNSRL

SEQ ID NO: 2997139 - protein, 18 aa, Entamoeba invadens
FVELLGVVSFFKAKTHIK

SEQ ID NO: 2997140 - protein, 22 aa, Entamoeba invadens
FVELLINMIKPTDPNAFYNEFL

SEQ ID NO: 2997141 - protein, 25 aa, Entamoeba invadens
FVENKRVFHLLKIKTILMNMCALEC

SEQ ID NO: 2997142 - protein, 25 aa, Entamoeba invadens
FVEPYLHGYFIKYIDNNGWINEDEF

SEQ ID NO: 2997143 - protein, 22 aa, Entamoeba invadens
FVETPLYTYIQSRHYRSPEVIL

SEQ ID NO: 2997144 - protein, 28 aa, Entamoeba invadens
FVEVYKKVLFLVPFKKITDKNIVAIKAI

SEQ ID NO: 2997145 - protein, 17 aa, Entamoeba invadens
FVEYPVQLYINVEKKNQ

SEQ ID NO: 2997146 - protein, 18 aa, Entamoeba invadens
FVEYTFLNQGYGYEVYKE

SEQ ID NO: 2997147 - protein, 19 aa, Entamoeba invadens
FVFGMKKMMGVDTFADNEF

SEQ ID NO: 2997148 - protein, 17 aa, Entamoeba invadens
FVFNKKVVTLWSAPNYG

SEQ ID NO: 2997149 - protein, 19 aa, Entamoeba invadens
FVFQNSWGLSTRSIGVTVM

SEQ ID NO: 2997150 - protein, 17 aa, Entamoeba invadens
FVFTLKNEFNIPPTRFF

SEQ ID NO: 2997151 - protein, 19 aa, Entamoeba invadens
FVFTNYFHGWRIAAKQVVS

SEQ ID NO: 2997152 - protein, 18 aa, Entamoeba invadens
FVFVLERNGEKDEKKFDI

SEQ ID NO: 2997153 - protein, 19 aa, Entamoeba invadens
FVGAYRACHEKLRKYLIDL

SEQ ID NO: 2997154 - protein, 29 aa, Entamoeba invadens
FVGESCFQGCIALTKLVIPASVKQIEMNA

SEQ ID NO: 2997155 - protein, 19 aa, Entamoeba invadens
FVGFYHKKFERTVLRFLHK

SEQ ID NO: 2997156 - protein, 30 aa, Entamoeba invadens
FVGGNRVVLFFLSYKYYITNKPYLGVIIEK

SEQ ID NO: 2997157 - protein, 17 aa, Entamoeba invadens
FVGLIPIDKKQFEKRGQ

SEQ ID NO: 2997158 - protein, 21 aa, Entamoeba invadens
FVGNTLLPVSTYLVTPILHFT

SEQ ID NO: 2997159 - protein, 26 aa, Entamoeba invadens
FVGRQKLIWRLTRGLYIIKMDLCIDD

SEQ ID NO: 2997160 - protein, 19 aa, Entamoeba invadens
FVGTGRLFRVIINENSKDL

SEQ ID NO: 2997161 - protein, 20 aa, Entamoeba invadens
FVHNTTFPELFSPTSTLNVS

SEQ ID NO: 2997162 - protein, 19 aa, Entamoeba invadens
FVIMVVRKNTVAPPPQPAP

SEQ ID NO: 2997163 - protein, 25 aa, Entamoeba invadens
FVIPNKLLCINPRAFYNCSNLKELN

SEQ ID NO: 2997164 - protein, 24 aa, Entamoeba invadens
FVIQNTLCAIIQRYTDIFTSSIEK

SEQ ID NO: 2997165 - protein, 17 aa, Entamoeba invadens
FVISALPLWVEFMTDQK

SEQ ID NO: 2997166 - protein, 27 aa, Entamoeba invadens
FVISNDVLFVRYIRNGLHFLTFTEKNY

SEQ ID NO: 2997167 - protein, 27 aa, Entamoeba invadens
FVKDIRDLFVSLTLLIIKIYNHIEMPN

SEQ ID NO: 2997168 - protein, 25 aa, Entamoeba invadens
FVKDKNYFIFFIETPFIEDQHQLPI

SEQ ID NO: 2997169 - protein, 17 aa, Entamoeba invadens
FVKELVKDFGDEINDIR

SEQ ID NO: 2997170 - protein, 33 aa, Entamoeba invadens
FVKFTSYLTYYTTYMNIYFPLKDFYENANNTEL

SEQ ID NO: 2997171 - protein, 20 aa, Entamoeba invadens
FVKIQGDLYEYFDLRKTIVP

SEQ ID NO: 2997172 - protein, 17 aa, Entamoeba invadens
FVKKNVLQGGYPLDMRY

SEQ ID NO: 2997173 - protein, 17 aa, Entamoeba invadens
FVKKNVVLIPFCPYNFQ

SEQ ID NO: 2997174 - protein, 17 aa, Entamoeba invadens
FVKKYGFEPVREEFLLF

SEQ ID NO: 2997175 - protein, 17 aa, Entamoeba invadens
FVKLRKVEKQKPVETPQ

SEQ ID NO: 2997176 - protein, 29 aa, Entamoeba invadens
FVKQLNLRKLIGFPFTMKSLGAPEWFIQM

SEQ ID NO: 2997177 - protein, 38 aa, Entamoeba invadens
FVKQTLVLWNIILENMYQLWILAELDLFDPEHPYEMQN

SEQ ID NO: 2997178 - protein, 18 aa, Entamoeba invadens
FVKSGLNLVTKLIEKKQA

SEQ ID NO: 2997179 - protein, 35 aa, Entamoeba invadens
FVKSSLEFVWDKIQKFLYKVLVLRIFETEENATKN

SEQ ID NO: 2997180 - protein, 17 aa, Entamoeba invadens
FVKSTLPPLIKTVPFDL

SEQ ID NO: 2997181 - protein, 29 aa, Entamoeba invadens
FVLDASKGILYFMRMGYYTEISNQTIFWY

SEQ ID NO: 2997182 - protein, 21 aa, Entamoeba invadens
FVLFILNFINPPEKVDCKVSN

SEQ ID NO: 2997183 - protein, 17 aa, Entamoeba invadens
FVLFPKQTITVKSVPPV

SEQ ID NO: 2997184 - protein, 18 aa, Entamoeba invadens
FVLGMMRRIKDTSVESRP

SEQ ID NO: 2997185 - protein, 19 aa, Entamoeba invadens
FVLHRQQHEFLFGFGGGCD

SEQ ID NO: 2997186 - protein, 27 aa, Entamoeba invadens
FVLRAREFAKDKPIILLKSGRSSEGAA

SEQ ID NO: 2997187 - protein, 17 aa, Entamoeba invadens
FVLTKSCELIQHSLNFN

SEQ ID NO: 2997188 - protein, 21 aa, Entamoeba invadens
FVMGESVVTLLLPKKEFFIGE

SEQ ID NO: 2997189 - protein, 18 aa, Entamoeba invadens
FVMKIGKKLSLSIPMKRI

SEQ ID NO: 2997190 - protein, 19 aa, Entamoeba invadens
FVNCLVENFEYVFPKAENV

SEQ ID NO: 2997191 - protein, 17 aa, Entamoeba invadens
FVNCVLRYKHREYFFVK

SEQ ID NO: 2997192 - protein, 19 aa, Entamoeba invadens
FVNCYSLETLTLPKSVTKL

SEQ ID NO: 2997193 - protein, 23 aa, Entamoeba invadens
FVNDFPFILLKDCSTKYTIPFGI

SEQ ID NO: 2997194 - protein, 28 aa, Entamoeba invadens
FVNDPFLRNTGILFEFFDVFLKDIQKKI

SEQ ID NO: 2997195 - protein, 26 aa, Entamoeba invadens
FVNDRSFHMFQFYSNGIHVLRGWKRV

SEQ ID NO: 2997196 - protein, 17 aa, Entamoeba invadens
FVNLLRYAKTYDIDTEQ

SEQ ID NO: 2997197 - protein, 17 aa, Entamoeba invadens
FVNPFIQFTFHNKEYKT

SEQ ID NO: 2997198 - protein, 27 aa, Entamoeba invadens
FVNQSMTLWWNVMRHINEMWLNCDADF

SEQ ID NO: 2997199 - protein, 30 aa, Entamoeba invadens
FVNSIQQAFFVKIFLDRFSIPSVVLNSDFP

SEQ ID NO: 2997200 - protein, 26 aa, Entamoeba invadens
FVNYKKPMEVMLIMYDKMLIVCEFVD

SEQ ID NO: 2997201 - protein, 17 aa, Entamoeba invadens
FVPDTLGALREQPPHTL

SEQ ID NO: 2997202 - protein, 18 aa, Entamoeba invadens
FVPIDTLLGFVKVKELTT

SEQ ID NO: 2997203 - protein, 23 aa, Entamoeba invadens
FVPKAIMHFLVNQTCKDLQNELI

SEQ ID NO: 2997204 - protein, 18 aa, Entamoeba invadens
FVPKHFIVVQMKDLSEVQ

SEQ ID NO: 2997205 - protein, 22 aa, Entamoeba invadens
FVPLHYEVFIKPYPSQRKFIGK

SEQ ID NO: 2997206 - protein, 26 aa, Entamoeba invadens
FVPNLPYEPFENKKMFKWVYNRIVMV

SEQ ID NO: 2997207 - protein, 17 aa, Entamoeba invadens
FVPPLDLNKLNIISSEV

SEQ ID NO: 2997208 - protein, 17 aa, Entamoeba invadens
FVPSEIPCGCVCVVHGI

SEQ ID NO: 2997209 - protein, 27 aa, Entamoeba invadens
FVPSHVAVSMFYFNFKLNHPTKQNVAF

SEQ ID NO: 2997210 - protein, 21 aa, Entamoeba invadens
FVPVPDLPFTYETLNPLRNRA

SEQ ID NO: 2997211 - protein, 36 aa, Entamoeba invadens
FVQKKLVDGWYDPRFPTIQGLLRRGLTLEAMKEFCL

SEQ ID NO: 2997212 - protein, 17 aa, Entamoeba invadens
FVQKYSTVFFQRSPIEV

SEQ ID NO: 2997213 - protein, 24 aa, Entamoeba invadens
FVQNSLFCKCLMLCFSITEEKTIK

SEQ ID NO: 2997214 - protein, 17 aa, Entamoeba invadens
FVQPIGATTPKGTIVKH

SEQ ID NO: 2997215 - protein, 23 aa, Entamoeba invadens
FVQRNIALNYYRNGLKSTTSSVA

SEQ ID NO: 2997216 - protein, 18 aa, Entamoeba invadens
FVQSIGAEGLFKIADGFK

SEQ ID NO: 2997217 - protein, 18 aa, Entamoeba invadens
FVQVRGNIPLIWKTNEED

SEQ ID NO: 2997218 - protein, 19 aa, Entamoeba invadens
FVQYVPLVIGTNSVSVLNL

SEQ ID NO: 2997219 - protein, 22 aa, Entamoeba invadens
FVREYTTFMKTLKCPSIMAGEV

SEQ ID NO: 2997220 - protein, 17 aa, Entamoeba invadens
FVRFGWETSKRIVEKKY

SEQ ID NO: 2997221 - protein, 23 aa, Entamoeba invadens
FVRGLSLAVLLEIVSMRIYDAIL

SEQ ID NO: 2997222 - protein, 20 aa, Entamoeba invadens
FVRIKMFELVPTIISLLKRG

SEQ ID NO: 2997223 - protein, 30 aa, Entamoeba invadens
FVRIKQEMWFFKNIFLVFGLQLGNNKTLII

SEQ ID NO: 2997224 - protein, 28 aa, Entamoeba invadens
FVRIVDDIAFLLLMLENDVLPAVFMATV

SEQ ID NO: 2997225 - protein, 18 aa, Entamoeba invadens
FVRQLNIYGFHKVDHPQG

SEQ ID NO: 2997226 - protein, 23 aa, Entamoeba invadens
FVSEYKATIGADFLTRELDVNGD

SEQ ID NO: 2997227 - protein, 18 aa, Entamoeba invadens
FVSFANPTEFLSALRELN

SEQ ID NO: 2997228 - protein, 24 aa, Entamoeba invadens
FVSGFYQYYVHYPLNLTKLKMLNE

SEQ ID NO: 2997229 - protein, 19 aa, Entamoeba invadens
FVSGLFYGKIQGSITCLSC

SEQ ID NO: 2997230 - protein, 25 aa, Entamoeba invadens
FVSHFNSIFIIVRPIEDKGEPSYEV

SEQ ID NO: 2997231 - protein, 34 aa, Entamoeba invadens
FVSKWKTVEILLAKYIEFFYLTNTSTLHSVDFVH

SEQ ID NO: 2997232 - protein, 18 aa, Entamoeba invadens
FVSLFQHADMIYYKTEDV

SEQ ID NO: 2997233 - protein, 23 aa, Entamoeba invadens
FVTIATDLYLYLKNSLSRVDYQQ

SEQ ID NO: 2997234 - protein, 22 aa, Entamoeba invadens
FVTNLSFDGFIFSTIDIPYANK

SEQ ID NO: 2997235 - protein, 22 aa, Entamoeba invadens
FVTQFNHVFIIVTPTIVKGSPF

SEQ ID NO: 2997236 - protein, 19 aa, Entamoeba invadens
FVTVRRPMPGDNSCLFHCL

SEQ ID NO: 2997237 - protein, 17 aa, Entamoeba invadens
FVVEEFDLFGSWVASIQ

SEQ ID NO: 2997238 - protein, 19 aa, Entamoeba invadens
FVVEFWVEELKSEEILTLY

SEQ ID NO: 2997239 - protein, 17 aa, Entamoeba invadens
FVVGRNRKQCRERYFNS

SEQ ID NO: 2997240 - protein, 24 aa, Entamoeba invadens
FVVKGHVLIIWRKNPPLSDAPGTN

SEQ ID NO: 2997241 - protein, 29 aa, Entamoeba invadens
FVVLKSEHFFLRFSPNLIKPTFDSVLNFF

SEQ ID NO: 2997242 - protein, 25 aa, Entamoeba invadens
FVVNDNTFIFSLTRNGKFEQKKYQV

SEQ ID NO: 2997243 - protein, 28 aa, Entamoeba invadens
FVVNLTQPARDLLAKNPKKFLQLGKEKM

SEQ ID NO: 2997244 - protein, 23 aa, Entamoeba invadens
FVVPQNILAIKYFCFNRCGNLTS

SEQ ID NO: 2997245 - protein, 20 aa, Entamoeba invadens
FVVRFYCAVFARNKVFMVTE

SEQ ID NO: 2997246 - protein, 21 aa, Entamoeba invadens
FVVRNSWLEAEYWPEKKQWIF

SEQ ID NO: 2997247 - protein, 29 aa, Entamoeba invadens
FVVSHFHEFPKVYLALAKEKLLENMKGKI

SEQ ID NO: 2997248 - protein, 17 aa, Entamoeba invadens
FVVTLTGMKLDKNNKYQ

SEQ ID NO: 2997249 - protein, 19 aa, Entamoeba invadens
FVWGAQFGVGYWGWNDIAY

SEQ ID NO: 2997250 - protein, 20 aa, Entamoeba invadens
FVYENPPICPIPTSYVESGY

SEQ ID NO: 2997251 - protein, 17 aa, Entamoeba invadens
FVYLCSFAQKMVELGEE

SEQ ID NO: 2997252 - protein, 27 aa, Entamoeba invadens
FVYMKELLTTFPNGKFLWIHRNPRDSF

SEQ ID NO: 2997253 - protein, 18 aa, Entamoeba invadens
FWAGIYPTSKSIPNSSPV

SEQ ID NO: 2997254 - protein, 17 aa, Entamoeba invadens
FWDALRDILDASGILYS

SEQ ID NO: 2997255 - protein, 19 aa, Entamoeba invadens
FWNFDSLYQPQQHPARDAQ

SEQ ID NO: 2997256 - protein, 20 aa, Entamoeba invadens
FWRQIKEKWMDDLGQLKWVV

SEQ ID NO: 2997257 - protein, 28 aa, Entamoeba invadens
FWTGDFKFTPPQHLVWSYVVRDVNNHTD

SEQ ID NO: 2997258 - protein, 17 aa, Entamoeba invadens
FYALDRAAHFFKLSVPP

SEQ ID NO: 2997259 - protein, 25 aa, Entamoeba invadens
FYALNDFGEILWSLKKQVKCVEISP

SEQ ID NO: 2997260 - protein, 30 aa, Entamoeba invadens
FYCEEKPLHKLPHPLQILEQRRPGKDVRKE

SEQ ID NO: 2997261 - protein, 20 aa, Entamoeba invadens
FYCIDCAKLIKSSTLFEMSR

SEQ ID NO: 2997262 - protein, 18 aa, Entamoeba invadens
FYCQKIAEWITKKGRQIL

SEQ ID NO: 2997263 - protein, 18 aa, Entamoeba invadens
FYDAFSIKYVKNLGTKNL

SEQ ID NO: 2997264 - protein, 25 aa, Entamoeba invadens
FYDEKYLFLWREDIFSQFQVLSPFS

SEQ ID NO: 2997265 - protein, 19 aa, Entamoeba invadens
FYDFGYFEHLEEINVTCLA

SEQ ID NO: 2997266 - protein, 20 aa, Entamoeba invadens
FYDLLTIFDITKNDSCGYLF

SEQ ID NO: 2997267 - protein, 26 aa, Entamoeba invadens
FYDMKEFKKLPLRKLYVAGNPVCNPS

SEQ ID NO: 2997268 - protein, 26 aa, Entamoeba invadens
FYDNALAVQALTSELIVLAGTIAKVK

SEQ ID NO: 2997269 - protein, 21 aa, Entamoeba invadens
FYDNTIPNKCLLCAQNYLTKN

SEQ ID NO: 2997270 - protein, 20 aa, Entamoeba invadens
FYDYFPVLCEILKSTTKKRY

SEQ ID NO: 2997271 - protein, 32 aa, Entamoeba invadens; identical to SEQ ID NO: 2938437

SEQ ID NO: 2997272 - protein, 19 aa, Entamoeba invadens
FYECEKLVRVVLPQSIKEI

SEQ ID NO: 2997273 - protein, 18 aa, Entamoeba invadens
FYECINLNKLLIPQNTEK

SEQ ID NO: 2997274 - protein, 20 aa, Entamoeba invadens
FYEITVWFNVDYTTVVLNKN

SEQ ID NO: 2997275 - protein, 19 aa, Entamoeba invadens
FYEMNILDKSFQWAKEVQY

SEQ ID NO: 2997276 - protein, 40 aa, Entamoeba invadens
FYESTERIKWESPLLFINVFHSFQTLFNTSDLYFSCNEKL

SEQ ID NO: 2997277 - protein, 17 aa, Entamoeba invadens
FYETYFYHKKSVKHYID

SEQ ID NO: 2997278 - protein, 21 aa, Entamoeba invadens
FYFEKYLAICEAVTVYYGKRE

SEQ ID NO: 2997279 - protein, 23 aa, Entamoeba invadens
FYGCISLKHISLPKTLFEIGQKC

SEQ ID NO: 2997280 - protein, 17 aa, Entamoeba invadens
FYGCKYLESVVVPDSVR

SEQ ID NO: 2997281 - protein, 18 aa, Entamoeba invadens
FYGCKYLESVVVPDSVRR

SEQ ID NO: 2997282 - protein, 24 aa, Entamoeba invadens
FYGCSNLMLFRIPINIAQICDSCF

SEQ ID NO: 2997283 - protein, 23 aa, Entamoeba invadens
FYGCSNLQHIVLPDNLLELNNYA

SEQ ID NO: 2997284 - protein, 21 aa, Entamoeba invadens
FYGVRGKIDTLRRNLDNKESN

SEQ ID NO: 2997285 - protein, 26 aa, Entamoeba invadens
FYHCGSLSSFRFFGAIESLGNMCFCG

SEQ ID NO: 2997286 - protein, 17 aa, Entamoeba invadens
FYHSSYNYFLSNPPKHV

SEQ ID NO: 2997287 - protein, 18 aa, Entamoeba invadens
FYIDCNIFNTFSFKQCNN

SEQ ID NO: 2997288 - protein, 19 aa, Entamoeba invadens
FYIRAMEKYPRYSQRESFD

SEQ ID NO: 2997289 - protein, 20 aa, Entamoeba invadens
FYKAFKHYIKSTPKTPIQQI

SEQ ID NO: 2997290 - protein, 21 aa, Entamoeba invadens
FYKEVFLFREASSQTGVVIVS

SEQ ID NO: 2997291 - protein, 20 aa, Entamoeba invadens
FYLAEVLLALEYLHLNGIIY

SEQ ID NO: 2997292 - protein, 31 aa, Entamoeba invadens
FYLKKMSCFGFLLFPLPKIDINLFKAISLEE

SEQ ID NO: 2997293 - protein, 19 aa, Entamoeba invadens
FYLSPLDFLFGVKATARSV

SEQ ID NO: 2997294 - protein, 18 aa, Entamoeba invadens
FYMTSEDFLRLGKLVLDK

SEQ ID NO: 2997295 - protein, 18 aa, Entamoeba invadens
FYNCGFERLIIPSSIYVI

SEQ ID NO: 2997296 - protein, 19 aa, Entamoeba invadens
FYNCKKLKEIKLPDLLEFI

SEQ ID NO: 2997297 - protein, 19 aa, Entamoeba invadens
FYNCLNLKEVILPKNIVEI

SEQ ID NO: 2997298 - protein, 26 aa, Entamoeba invadens
FYNGKILVALLDLFFEQNTEFYKYMM

SEQ ID NO: 2997299 - protein, 17 aa, Entamoeba invadens
FYNILTFSNKKIAKKHK

SEQ ID NO: 2997300 - protein, 36 aa, Entamoeba invadens
FYNKNFAYKFVAIPNTYMFDILYFSDKDKRVTQQKY

SEQ ID NO: 2997301 - protein, 17 aa, Entamoeba invadens
FYNKRESIYFKRHNPRT

SEQ ID NO: 2997302 - protein, 18 aa, Entamoeba invadens
FYNLIVHCKFDQPFVLEN

SEQ ID NO: 2997303 - protein, 19 aa, Entamoeba invadens
FYNPPFSNSLFLRGVSEGA

SEQ ID NO: 2997304 - protein, 19 aa, Entamoeba invadens
FYPFNFIHFRVLNTNPFID

SEQ ID NO: 2997305 - protein, 32 aa, Entamoeba invadens
FYPKENCTFMLTSYWPSYVLDRLSLSSKPTFK

SEQ ID NO: 2997306 - protein, 27 aa, Entamoeba invadens
FYQCDALQKVILPTTLERLCDFTFSEC

SEQ ID NO: 2997307 - protein, 18 aa, Entamoeba invadens
FYQGVYIGVLNKFYDLRI

SEQ ID NO: 2997308 - protein, 28 aa, Entamoeba invadens
FYQRSTELLLRKLPFQHLVREIAQQSKT

SEQ ID NO: 2997309 - protein, 18 aa, Entamoeba invadens
FYQVIVHYAISYQKTTLP

SEQ ID NO: 2997310 - protein, 26 aa, Entamoeba invadens
FYQVKSFYQIILQIVIPKIPQIAETT

SEQ ID NO: 2997311 - protein, 32 aa, Entamoeba invadens
FYRCSSLSSYTWRLLKPAPLPHPLPGNRDYLN

SEQ ID NO: 2997312 - protein, 37 aa, Entamoeba invadens
FYRGIFSQKGMMWLDQIYLVLFPFSHTTKSIIRQIII

SEQ ID NO: 2997313 - protein, 17 aa, Entamoeba invadens
FYRGSDAVLYFYSAINH

SEQ ID NO: 2997314 - protein, 24 aa, Entamoeba invadens
FYRTIEGFQVLIDKEWIAFGHKFK

SEQ ID NO: 2997315 - protein, 26 aa, Entamoeba invadens
FYRVQIKYLIEYYLRKYGDYVDECKD

SEQ ID NO: 2997316 - protein, 24 aa, Entamoeba invadens
FYSAKFSGMTALLRPDRSYISKVK

SEQ ID NO: 2997317 - protein, 40 aa, Entamoeba invadens
FYSCFSLTRIILPQNIKELPMLSFFSCLNLKEINLPNGIT

SEQ ID NO: 2997318 - protein, 17 aa, Entamoeba invadens
FYSNLSLQQIKLPLALC

SEQ ID NO: 2997319 - protein, 36 aa, Entamoeba invadens
FYSRVNLFSPFITNGIWFNQLLPIELNALTMEDKIA

SEQ ID NO: 2997320 - protein, 20 aa, Entamoeba invadens
FYTLLTGVILFEANSEFEVC

SEQ ID NO: 2997321 - protein, 18 aa, Entamoeba invadens
FYVCVKQLLKYAVTQDVI

SEQ ID NO: 2997322 - protein, 20 aa, Entamoeba invadens
FYVMVVQLVIKLIGMSDIEL

SEQ ID NO: 2997323 - protein, 18 aa, Entamoeba invadens
FYVPNLIGVQILSMSKRI

SEQ ID NO: 2997324 - protein, 25 aa, Entamoeba invadens
FYVQREVPEFLFITELIIEEYDYKN

SEQ ID NO: 2997325 - protein, 33 aa, Entamoeba invadens
FYYAHSIFESLYYIFDLFPYEHIPIVLCGNKID

SEQ ID NO: 2997326 - protein, 26 aa, Entamoeba invadens
FYYCSSLERIILPKNLEYIGEAAFGD

SEQ ID NO: 2997327 - protein, 25 aa, Entamoeba invadens
FYYKNFVRGFLIKQLIEKGYTIYVV

SEQ ID NO: 2997328 - protein, 18 aa, Entamoeba invadens
FYYVNIGAYCDATLDLLA

SEQ ID NO: 2997329 - protein, 20 aa, Entamoeba invadens
GAAMLRGMGWKEPQTKEVKD

SEQ ID NO: 2997330 - protein, 24 aa, Entamoeba invadens
GACKKLFGHFIFFVYDKMEEEEKE

SEQ ID NO: 2997331 - protein, 17 aa, Entamoeba invadens
GACLYIICRRERTDHLL

SEQ ID NO: 2997332 - protein, 25 aa, Entamoeba invadens
GACPPLKALLYIMATGSYNGMTIES

SEQ ID NO: 2997333 - protein, 24 aa, Entamoeba invadens
GACVTVVFLTPLKIYTAQCGDCRA

SEQ ID NO: 2997334 - protein, 26 aa, Entamoeba invadens
GADCFYYTPLRQVDLSRIAILDERSF

SEQ ID NO: 2997335 - protein, 31 aa, Entamoeba invadens
GADDFGFGFGFGHFGSFGRFTSFGPTSYMSE

SEQ ID NO: 2997336 - protein, 21 aa, Entamoeba invadens
GADLPFLSGLLLIHFKNFFKL

SEQ ID NO: 2997337 - protein, 23 aa, Entamoeba invadens
GAEDSFLNTSFFRKVIYGKRTDE

SEQ ID NO: 2997338 - protein, 33 aa, Entamoeba invadens
GAFEKSEINFVWLYEAYFIHTSFQTTKEFVDSY

SEQ ID NO: 2997339 - protein, 23 aa, Entamoeba invadens
GAGCGVSLYIAYKQKVSKKKSGA

SEQ ID NO: 2997340 - protein, 24 aa, Entamoeba invadens
GAGKTCLLMRFTRNEFDAEKKSTI

SEQ ID NO: 2997341 - protein, 24 aa, Entamoeba invadens
GAGQGTIWFMQREVTEKKKFMPAS

SEQ ID NO: 2997342 - protein, 30 aa, Entamoeba invadens; identical to SEQ ID NO: 2817813

SEQ ID NO: 2997343 - protein, 26 aa, Entamoeba invadens
GAIASATFWFIGMNDLKNMKVPRVQG

SEQ ID NO: 2997344 - protein, 24 aa, Entamoeba invadens
GAIPKMRGIGLSSRLCELLSHMEK

SEQ ID NO: 2997345 - protein, 19 aa, Entamoeba invadens
GAIWFMQREVTEKKKFMPV

SEQ ID NO: 2997346 - protein, 18 aa, Entamoeba invadens
GAKKGLSFCFIKFSMRED

SEQ ID NO: 2997347 - protein, 22 aa, Entamoeba invadens
GAKKQFYLMGNMKMFAKDYGGE

SEQ ID NO: 2997348 - protein, 18 aa, Entamoeba invadens
GAKVIQIIPTGDTYLHCI

SEQ ID NO: 2997349 - protein, 20 aa, Entamoeba invadens
GALEHNFFYSFLMAKVMCEN

SEQ ID NO: 2997350 - protein, 22 aa, Entamoeba invadens
GALGAIYNYLQPSLTLGCGSYG

SEQ ID NO: 2997351 - protein, 20 aa, Entamoeba invadens
GALMKLDVVLFGEKLDRKIY

SEQ ID NO: 2997352 - protein, 18 aa, Entamoeba invadens
GALPVPMHIRNAPNALLE

SEQ ID NO: 2997353 - protein, 22 aa, Entamoeba invadens
GALRIVHFLVSELGDTRMTNFV

SEQ ID NO: 2997354 - protein, 27 aa, Entamoeba invadens
GAMKHMYILLVSLVTPTGFILSEEIEC

SEQ ID NO: 2997355 - protein, 20 aa, Entamoeba invadens
GAMKVMFPKTLGKVSKRKGN

SEQ ID NO: 2997356 - protein, 19 aa, Entamoeba invadens
GANHILMENPLLDFQQQNW

SEQ ID NO: 2997357 - protein, 24 aa, Entamoeba invadens
GANKRPLDIFTKVKSVLGFVKKSV

SEQ ID NO: 2997358 - protein, 27 aa, Entamoeba invadens
GANVVPKLTLFFRKMVLLKNGAELSDH

SEQ ID NO: 2997359 - protein, 26 aa, Entamoeba invadens
GAPEKRALPFGFQPTTFKPLSQTMKE

SEQ ID NO: 2997360 - protein, 27 aa, Entamoeba invadens
GAPLPLPQIVLDFLKALGPFCKKVVTP

SEQ ID NO: 2997361 - protein, 24 aa, Entamoeba invadens
GAPNLNFCFYIKHISSITNKVTED

SEQ ID NO: 2997362 - protein, 21 aa, Entamoeba invadens
GAPSIYIFDCNCAGRIITWCK

SEQ ID NO: 2997363 - protein, 23 aa, Entamoeba invadens
GAQDFLDFLLSVPESERYRTMEY

SEQ ID NO: 2997364 - protein, 18 aa, Entamoeba invadens
GAQYVFINIGTNDFAWNA

SEQ ID NO: 2997365 - protein, 24 aa, Entamoeba invadens
GARQYANATLLRNLARGAVEYSRE

SEQ ID NO: 2997366 - protein, 23 aa, Entamoeba invadens
GARYTLQLAFFDRIKDLDAYGPR

SEQ ID NO: 2997367 - protein, 26 aa, Entamoeba invadens
GASEALLRAKRFLPMMAEANKGVTVG

SEQ ID NO: 2997368 - protein, 26 aa, Entamoeba invadens
GASKQYFDDFYLTTPDYFMFTNQSNC

SEQ ID NO: 2997369 - protein, 39 aa, Entamoeba invadens
GASQQPAAAPAMNPFGGFNPAAVKLKKAGAAAPSEGTPI

SEQ ID NO: 2997370 - protein, 33 aa, Entamoeba invadens
GATECYNLMNYLFLYPFALLKLSVYKTHTLENI

SEQ ID NO: 2997371 - protein, 29 aa, Entamoeba invadens
GATETPTFARFYLLIVQYVAQMQSHKLFK

SEQ ID NO: 2997372 - protein, 24 aa, Entamoeba invadens
GATGFVGKFILRSLCDIKERVICV

SEQ ID NO: 2997373 - protein, 29 aa, Entamoeba invadens
GATHFRGKIFFWPPYDDSPLVSYNLNGIV

SEQ ID NO: 2997374 - protein, 23 aa, Entamoeba invadens
GATSIFVRLLNCGLDEITVEDNG

SEQ ID NO: 2997375 - protein, 27 aa, Entamoeba invadens
GATSKLKRCFLLIKRSDWTYQTCYGHK

SEQ ID NO: 2997376 - protein, 26 aa, Entamoeba invadens
GATVEYLSGMYILQSSSSWAAVIALA

SEQ ID NO: 2997377 - protein, 25 aa, Entamoeba invadens
GAVDRWCLGVLTYELCVGEPPFQSG

SEQ ID NO: 2997378 - protein, 17 aa, Entamoeba invadens
GAVFARKKCLRLKFCLN

SEQ ID NO: 2997379 - protein, 19 aa, Entamoeba invadens
GAVFSFLNTLQPYFSHLYP

SEQ ID NO: 2997380 - protein, 24 aa, Entamoeba invadens
GAVGKTTFLLSYTAQSFLTEYTPT

SEQ ID NO: 2997381 - protein, 25 aa, Entamoeba invadens
GAVHPTLQLFLKQNVKGQKLGLLDE

SEQ ID NO: 2997382 - protein, 18 aa, Entamoeba invadens
GAVKRATIWCAGEYFDLL

SEQ ID NO: 2997383 - protein, 34 aa, Entamoeba invadens
GAVLEIPQPNLSKVYYFFFAEGCTLRSLPTEYYN

SEQ ID NO: 2997384 - protein, 32 aa, Entamoeba invadens
GAYKMLHTLSLEWSCMSFDFVPDTLGALREQP

SEQ ID NO: 2997385 - protein, 23 aa, Entamoeba invadens
GAYLFTMNVYGTVGIPLKCVLTQ

SEQ ID NO: 2997386 - protein, 17 aa, Entamoeba invadens
GAYPPQGYPPQQYQMQP

SEQ ID NO: 2997387 - protein, 24 aa, Entamoeba invadens
GAYQQLLLVLKETLHLFLINFVPS

SEQ ID NO: 2997388 - protein, 27 aa, Entamoeba invadens
GCAAIAYTLYTRHLKFTPKASNWLSRD

SEQ ID NO: 2997389 - protein, 26 aa, Entamoeba invadens
GCALKQNILQFWRKHFTTYENLFEVE

SEQ ID NO: 2997390 - protein, 32 aa, Entamoeba invadens
GCALLKEIVLYTPQFVPLGKLLTKCSSFSNIG

SEQ ID NO: 2997391 - protein, 20 aa, Entamoeba invadens
GCDFIRAEGFVFGHVADEGY

SEQ ID NO: 2997392 - protein, 40 aa, Entamoeba invadens
GCDGKKLFPTLTLRDFTQLIDKLLIVDPLKRASAQTALGF

SEQ ID NO: 2997393 - protein, 20 aa, Entamoeba invadens
GCDILVATPGRLLHFMERKI

SEQ ID NO: 2997394 - protein, 27 aa, Entamoeba invadens
GCDKSIGMLFYQLATKLLKDKVSFRPQ

SEQ ID NO: 2997395 - protein, 21 aa, Entamoeba invadens
GCDKSIKLWDGFKGTCLHTYR

SEQ ID NO: 2997396 - protein, 18 aa, Entamoeba invadens
GCDNLIYLDLSFNALERS

SEQ ID NO: 2997397 - protein, 28 aa, Entamoeba invadens
GCDRGELYFINWNKKYTTWIDPRTFEQR

SEQ ID NO: 2997398 - protein, 25 aa, Entamoeba invadens
GCENILLLFSMKVTYPDRIHLLRGN

SEQ ID NO: 2997399 - protein, 18 aa, Entamoeba invadens
GCERLNELVGFENLLKIG

SEQ ID NO: 2997400 - protein, 19 aa, Entamoeba invadens
GCESCANYYSTVEIGTKCS

SEQ ID NO: 2997401 - protein, 19 aa, Entamoeba invadens
GCESCANYYSTVEISEKCS

SEQ ID NO: 2997402 - protein, 19 aa, Entamoeba invadens
GCFCIGIVYNYFEKQFNCW

SEQ ID NO: 2997403 - protein, 30 aa, Entamoeba invadens
GCFGTEVIILLFCLKLQFPDRVSLLRGNHE

SEQ ID NO: 2997404 - protein, 31 aa, Entamoeba invadens
GCFGTEVIILLICLKLQFPDRIHLLRGNHEC

SEQ ID NO: 2997405 - protein, 20 aa, Entamoeba invadens
GCFHLKMFIVTNQKVKGYKH

SEQ ID NO: 2997406 - protein, 19 aa, Entamoeba invadens
GCFLKCERLIKLKIPPFIK

SEQ ID NO: 2997407 - protein, 17 aa, Entamoeba invadens
GCFLMEKVKLPSTLQIA

SEQ ID NO: 2997408 - protein, 33 aa, Entamoeba invadens
GCFSHVCYTLFADIIFFLFPSHHLKTVNKQLAT

SEQ ID NO: 2997409 - protein, 22 aa, Entamoeba invadens
GCGAFFNDPLLKFLQQVMVFVV

SEQ ID NO: 2997410 - protein, 25 aa, Entamoeba invadens
GCGDGKIRFYLLDLMQFADDVQCNT

SEQ ID NO: 2997411 - protein, 28 aa, Entamoeba invadens
GCGFSRRPFHQPFYGYCPPPPPMMGQNP

SEQ ID NO: 2997412 - protein, 18 aa, Entamoeba invadens
GCGQALPSILLKLNGATV

SEQ ID NO: 2997413 - protein, 27 aa, Entamoeba invadens
GCGVKWDIDILPLISSYYPAPIKKYNS

SEQ ID NO: 2997414 - protein, 28 aa, Entamoeba invadens
GCGVYITWNYHNIVFFTLNGHFVGRCRA

SEQ ID NO: 2997415 - protein, 17 aa, Entamoeba invadens
GCHDFFYEPAQGLTVSA

SEQ ID NO: 2997416 - protein, 27 aa, Entamoeba invadens
GCIAAEFFLGIPLFAGTSEYNLLFKMI

SEQ ID NO: 2997417 - protein, 23 aa, Entamoeba invadens
GCIAAELILGIPIFPGSSEYNQL

SEQ ID NO: 2997418 - protein, 24 aa, Entamoeba invadens
GCKHKIHFELVKKTAPELADRFWY

SEQ ID NO: 2997419 - protein, 21 aa, Entamoeba invadens
GCKKFLAGTTWFYCEPESKEL

SEQ ID NO: 2997420 - protein, 25 aa, Entamoeba invadens
GCKNMWSFLSILSTTAKQTKQEVLQ

SEQ ID NO: 2997421 - protein, 29 aa, Entamoeba invadens
GCKSDVWALGCLIYKCLMLETPFEESPMK

SEQ ID NO: 2997422 - protein, 17 aa, Entamoeba invadens
GCKTCDLAKFVIHAIKP

SEQ ID NO: 2997423 - protein, 24 aa, Entamoeba invadens
GCKVNEFLQVMYFACKSADEMKSI

SEQ ID NO: 2997424 - protein, 31 aa, Entamoeba invadens
GCLAKFAIVRAIKRIPRLSWLSFQCCKNPRL

SEQ ID NO: 2997425 - protein, 18 aa, Entamoeba invadens
GCLAQTLFNVAYYFKRES

SEQ ID NO: 2997426 - protein, 20 aa, Entamoeba invadens
GCLFLRAKWYEQASSMFYIC

SEQ ID NO: 2997427 - protein, 43 aa, Entamoeba invadens
GCLGQMNIALFLKKHYLDLTIRDLPIFFTYQINSTKFSFQSLS

SEQ ID NO: 2997428 - protein, 26 aa, Entamoeba invadens
GCLIVSIYHDGTNPVFYFFRDGMKHE

SEQ ID NO: 2997429 - protein, 18 aa, Entamoeba invadens
GCLLAPALNIHRHPLGGR

SEQ ID NO: 2997430 - protein, 19 aa, Entamoeba invadens
GCLMCGCEILPPSEYYNCS

SEQ ID NO: 2997431 - protein, 27 aa, Entamoeba invadens
GCMTAELFLGYPLFGATSEYNLLYKMI

SEQ ID NO: 2997432 - protein, 27 aa, Entamoeba invadens
GCMTAELFLGYPLFGATSEYNLLYKMQ

SEQ ID NO: 2997433 - protein, 23 aa, Entamoeba invadens
GCNDLPLNYPVDSKLSIFSIQNG

SEQ ID NO: 2997434 - protein, 24 aa, Entamoeba invadens
GCNHMTCKCGYQFCWLCMQKYTST

SEQ ID NO: 2997435 - protein, 17 aa, Entamoeba invadens
GCNHMTCRCGHQFCWLC

SEQ ID NO: 2997436 - protein, 19 aa, Entamoeba invadens
GCPFRINLNFRTKTNTWNI

SEQ ID NO: 2997437 - protein, 18 aa, Entamoeba invadens
GCQNFFHYDFSIAGPDRN

SEQ ID NO: 2997438 - protein, 17 aa, Entamoeba invadens
GCRIYRAIFSSITKNEI

SEQ ID NO: 2997439 - protein, 18 aa, Entamoeba invadens
GCSLLVGGYDHRGYSLHY

SEQ ID NO: 2997440 - protein, 22 aa, Entamoeba invadens
GCSMKFFLKTDLIEHVKTCHKD

SEQ ID NO: 2997441 - protein, 24 aa, Entamoeba invadens
GCSYYYGFSAVRRFLARNDIVCIV

SEQ ID NO: 2997442 - protein, 20 aa, Entamoeba invadens
GCTLCANKMYYNTTTKLCES

SEQ ID NO: 2997443 - protein, 18 aa, Entamoeba invadens
GCTLCENGFALKDNLCYK

SEQ ID NO: 2997444 - protein, 28 aa, Entamoeba invadens
GCTNLTHVALPFSLKYIPPLTFNRCVSL

SEQ ID NO: 2997445 - protein, 29 aa, Entamoeba invadens
GCTNLTHVALPFSLKYIPPLTFNRCVSLN

SEQ ID NO: 2997446 - protein, 17 aa, Entamoeba invadens
GCTRCINGFYYSYNTKT

SEQ ID NO: 2997447 - protein, 17 aa, Entamoeba invadens
GCTRLNKIDLPTSLLKI

SEQ ID NO: 2997448 - protein, 24 aa, Entamoeba invadens
GCTRLTLHIPGRPLVVVAARDSNV

SEQ ID NO: 2997449 - protein, 24 aa, Entamoeba invadens
GCTTCLDHMYYNTTTRLCDNCVEG

SEQ ID NO: 2997450 - protein, 19 aa, Entamoeba invadens
GCVEELRRLAHTKKIIMSS

SEQ ID NO: 2997451 - protein, 29 aa, Entamoeba invadens
GCVKLLSVNFYAPLTKLLDSLASQNNLFF

SEQ ID NO: 2997452 - protein, 30 aa, Entamoeba invadens
GCVYSACLQLPIKLTLPVVSFAFNVLLNHE

SEQ ID NO: 2997453 - protein, 24 aa, Entamoeba invadens
GCWGDCCYYYYPCQEIVYEQAELS

SEQ ID NO: 2997454 - protein, 26 aa, Entamoeba invadens
GCYHNDFIKDFPLNAVFPSKKSFVVI

SEQ ID NO: 2997455 - protein, 26 aa, Entamoeba invadens
GCYKDDHPRLFYITNCIFVMKRGEEG

SEQ ID NO: 2997456 - protein, 19 aa, Entamoeba invadens
GCYLMRATCQLNDKSKTLV

SEQ ID NO: 2997457 - protein, 18 aa, Entamoeba invadens
GCYSTKLYTYAKGGMRPA

SEQ ID NO: 2997458 - protein, 20 aa, Entamoeba invadens
GCYVMKVVDGILQGSYFSGW

SEQ ID NO: 2997459 - protein, 23 aa, Entamoeba invadens
GCYVPYMFSNRFPQIFYDMLSRD

SEQ ID NO: 2997460 - protein, 23 aa, Entamoeba invadens
GDAETIVEILKLGWDVGVTGLSL

SEQ ID NO: 2997461 - protein, 20 aa, Entamoeba invadens
GDALIDVYCFLFGLVESEKG

SEQ ID NO: 2997462 - protein, 20 aa, Entamoeba invadens
GDAVCPLPTFDKALETPIIN

SEQ ID NO: 2997463 - protein, 29 aa, Entamoeba invadens
GDCSSCFDGYYLSYGNYCNGYCKQCFACS

SEQ ID NO: 2997464 - protein, 28 aa, Entamoeba invadens
GDCSSLVVIFALSPFLRMVHFKEVTCDL

SEQ ID NO: 2997465 - protein, 28 aa, Entamoeba invadens
GDDILYSPLALAFAILTPKRIMFFCGTT

SEQ ID NO: 2997466 - protein, 22 aa, Entamoeba invadens
GDDIYYFIPKKSRLARVVFLPD

SEQ ID NO: 2997467 - protein, 27 aa, Entamoeba invadens
GDDKLETFTVQLGIKYTKKNGGVYYRI

SEQ ID NO: 2997468 - protein, 22 aa, Entamoeba invadens
GDDLFHWVATITGPDDSPYQGG

SEQ ID NO: 2997469 - protein, 24 aa, Entamoeba invadens
GDDRKYPFVIIGNKTDKPAVITSA

SEQ ID NO: 2997470 - protein, 21 aa, Entamoeba invadens
GDEDILRNELKNFIKKQADKG

SEQ ID NO: 2997471 - protein, 26 aa, Entamoeba invadens
GDEEGYLVEYFLPTCIIYSSLCCVIQ

SEQ ID NO: 2997472 - protein, 27 aa, Entamoeba invadens
GDEEYLAKWKLFKKLSLEELKRVYKRL

SEQ ID NO: 2997473 - protein, 26 aa, Entamoeba invadens
GDERFRSVMPVYFRGATSAIIVYDVT

SEQ ID NO: 2997474 - protein, 24 aa, Entamoeba invadens
GDESYLRYCVKPLEKLLTNYKRIV

SEQ ID NO: 2997475 - protein, 20 aa, Entamoeba invadens
GDFLITCQHKLPKEERSDGS

SEQ ID NO: 2997476 - protein, 17 aa, Entamoeba invadens
GDFRFCGCNNLCSVTIP

SEQ ID NO: 2997477 - protein, 17 aa, Entamoeba invadens
GDFRYWNDREHIRFLVC

SEQ ID NO: 2997478 - protein, 20 aa, Entamoeba invadens
GDFVLKFFEADEFKSFTFGQ

SEQ ID NO: 2997479 - protein, 25 aa, Entamoeba invadens
GDGDGRLMNILFSGQFELFGRDTSF

SEQ ID NO: 2997480 - protein, 19 aa, Entamoeba invadens
GDGIFLCCSSLRSVTILNS

SEQ ID NO: 2997481 - protein, 35 aa, Entamoeba invadens
GDGKIMTDKIGSSNFFWAFPSASIVERRTECENLQ

SEQ ID NO: 2997482 - protein, 37 aa, Entamoeba invadens
GDGLNVFNIFFNYPRKFPIYFIVHCALNSYTEKNRPL

SEQ ID NO: 2997483 - protein, 21 aa, Entamoeba invadens
GDGPFDVMIAGTFDLIHPGHI

SEQ ID NO: 2997484 - protein, 18 aa, Entamoeba invadens
GDGSFYICKSLVGVTIPP

SEQ ID NO: 2997485 - protein, 24 aa, Entamoeba invadens
GDGTNMFGMIYSSAFFMSQDFKQM

SEQ ID NO: 2997486 - protein, 23 aa, Entamoeba invadens
GDGVTQFVPIYEGSKIEKGVSCL

SEQ ID NO: 2997487 - protein, 21 aa, Entamoeba invadens
GDGYIIVYSITSTSSFLDANV

SEQ ID NO: 2997488 - protein, 22 aa, Entamoeba invadens
GDGYIIVYSITSTSSFLDANVI

SEQ ID NO: 2997489 - protein, 20 aa, Entamoeba invadens
GDGYVIVYSITSITSFFEAN

SEQ ID NO: 2997490 - protein, 21 aa, Entamoeba invadens
GDGYVIVYSITSTTSFLEANG

SEQ ID NO: 2997491 - protein, 26 aa, Entamoeba invadens
GDHCFLDCHSLIFVSFPKSVTHYGEN

SEQ ID NO: 2997492 - protein, 26 aa, Entamoeba invadens
GDHQSLTSHFLPTETTIPPPPVQHFD

SEQ ID NO: 2997493 - protein, 28 aa, Entamoeba invadens
GDHYFLDKNITITPFYLKNRVEMNKWAL

SEQ ID NO: 2997494 - protein, 24 aa, Entamoeba invadens
GDHYFLDVDIPITPFYLKNRVEMN

SEQ ID NO: 2997495 - protein, 24 aa, Entamoeba invadens
GDHYILNIDIPITPFYLKNREELD

SEQ ID NO: 2997496 - protein, 24 aa, Entamoeba invadens
GDHYILNIDIPITPFYLKNREEMN

SEQ ID NO: 2997497 - protein, 29 aa, Entamoeba invadens
GDIANILSLYLYLPNYISQLFLQNVLPLF

SEQ ID NO: 2997498 - protein, 24 aa, Entamoeba invadens
GDIENQLIQLNPMLEAFGNAKTVK

SEQ ID NO: 2997499 - protein, 22 aa, Entamoeba invadens
GDIGTLFPSGVYTDAFLTPKSS

SEQ ID NO: 2997500 - protein, 40 aa, Entamoeba invadens
GDIKISEELPDLLMRHCTLLAFNGGVFKLCNLSKIKPTKV

SEQ ID NO: 2997501 - protein, 23 aa, Entamoeba invadens
GDIKMFLRDFDVLSAYAVFSLMC

SEQ ID NO: 2997502 - protein, 18 aa, Entamoeba invadens
GDIPLELIKTILVQLIKA

SEQ ID NO: 2997503 - protein, 24 aa, Entamoeba invadens
GDIRSIFSLCPTAIQLAKNEKSQT

SEQ ID NO: 2997504 - protein, 29 aa, Entamoeba invadens
GDISQYINIVYLLYTLFDVDDVRGVLYPV

SEQ ID NO: 2997505 - protein, 27 aa, Entamoeba invadens
GDITRGVIFIWNFLKQFQTEIGTDDAS

SEQ ID NO: 2997506 - protein, 22 aa, Entamoeba invadens
GDIVTVFFVIFCEYYMGKLTVE

SEQ ID NO: 2997507 - protein, 17 aa, Entamoeba invadens
GDKALHPPLSSTPSLYS

SEQ ID NO: 2997508 - protein, 21 aa, Entamoeba invadens
GDKEAFVFTLKENGKKKCGKY

SEQ ID NO: 2997509 - protein, 29 aa, Entamoeba invadens
GDKETVILIHLFLDPPVIIQNKAYSHIQF

SEQ ID NO: 2997510 - protein, 22 aa, Entamoeba invadens
GDKKISVVFIGGGLFHAEAVAY

SEQ ID NO: 2997511 - protein, 26 aa, Entamoeba invadens
GDLCVANLPLFLSKQLSCLLRNPEFT

SEQ ID NO: 2997512 - protein, 31 aa, Entamoeba invadens
GDLDGYITLQEFLKFFLPPQDKNTVPSNKKA

SEQ ID NO: 2997513 - protein, 23 aa, Entamoeba invadens
GDLDNIYMYAFKISKKYEQSCSK

SEQ ID NO: 2997514 - protein, 24 aa, Entamoeba invadens
GDLFRRVKYYYIHAHTLMGEKWNE

SEQ ID NO: 2997515 - protein, 28 aa, Entamoeba invadens
GDLGNFLVTWTSRYISFFAKKEFKFCTP

SEQ ID NO: 2997516 - protein, 24 aa, Entamoeba invadens
GDLHVTFLVYRHLQIFNTLTEYYS

SEQ ID NO: 2997517 - protein, 18 aa, Entamoeba invadens
GDLKAFLRPETAQGIFTM

SEQ ID NO: 2997518 - protein, 23 aa, Entamoeba invadens
GDLNDVIFLSDSVDIYVIIADSS

SEQ ID NO: 2997519 - protein, 28 aa, Entamoeba invadens
GDLPLKNLPRHVLIPAFLIDNGVEPRYC

SEQ ID NO: 2997520 - protein, 18 aa, Entamoeba invadens
GDLSARCSVALPTGGGCA

SEQ ID NO: 2997521 - protein, 24 aa, Entamoeba invadens
GDLSLRLWAVGMLIKAAPDRLEKV

SEQ ID NO: 2997522 - protein, 24 aa, Entamoeba invadens
GDLSMWVLDLVMVEGWQITLSVAS

SEQ ID NO: 2997523 - protein, 17 aa, Entamoeba invadens
GDLSPSTLQYWSQRDRE

SEQ ID NO: 2997524 - protein, 26 aa, Entamoeba invadens
GDMKEYFYPWALKTLDIMVKNLSDPY

SEQ ID NO: 2997525 - protein, 17 aa, Entamoeba invadens
GDMLQFIVEHWYLFQKL

SEQ ID NO: 2997526 - protein, 22 aa, Entamoeba invadens
GDMMSLLIKEDIFPEDMARFYI

SEQ ID NO: 2997527 - protein, 23 aa, Entamoeba invadens
GDMRLKFIIQMCACALNGRDMIY

SEQ ID NO: 2997528 - protein, 26 aa, Entamoeba invadens
GDNCFSTLLLFKRVIKMKLLFLCDTI

SEQ ID NO: 2997529 - protein, 23 aa, Entamoeba invadens
GDNKGIILPPRAAGKQVVIVPLH

SEQ ID NO: 2997530 - protein, 30 aa, Entamoeba invadens
GDNPVSYTVNWLIALLDAKASLMITDESFV

SEQ ID NO: 2997531 - protein, 23 aa, Entamoeba invadens
GDNSLFNVMALKIDLGKVQNQVQ

SEQ ID NO: 2997532 - protein, 18 aa, Entamoeba invadens
GDNYGAIKDTTPNWTCKR

SEQ ID NO: 2997533 - protein, 29 aa, Entamoeba invadens
GDPIFVKYINKQLLFRVNIPDFVTVIPKE

SEQ ID NO: 2997534 - protein, 34 aa, Entamoeba invadens
GDQEIFCVFMRLVKGKRVYSMPLLLQEYKGSTDA

SEQ ID NO: 2997535 - protein, 25 aa, Entamoeba invadens
GDQEIFCVFVLLVQGKRVYSMPLLL

SEQ ID NO: 2997536 - protein, 28 aa, Entamoeba invadens
GDQFAMYEPMLAYHCYEFAFQFGVKTDE

SEQ ID NO: 2997537 - protein, 23 aa, Entamoeba invadens
GDQPRRFYLKRPGKTFCVWPSNH

SEQ ID NO: 2997538 - protein, 25 aa, Entamoeba invadens
GDQVIFCVFVRLVKGKPVYSMPLLL

SEQ ID NO: 2997539 - protein, 23 aa, Entamoeba invadens
GDQYLEQYFYIRGTTDTCSTVSY

SEQ ID NO: 2997540 - protein, 24 aa, Entamoeba invadens
GDRDDSFRKLQNGDFFGLEHHKKI

SEQ ID NO: 2997541 - protein, 27 aa, Entamoeba invadens
GDRENALRVLKLRKIRQRQLTEVTNQR

SEQ ID NO: 2997542 - protein, 22 aa, Entamoeba invadens
GDRKFILFVETEMYLHEFVKRM

SEQ ID NO: 2997543 - protein, 26 aa, Entamoeba invadens
GDRVVLKRFYQPRPLTMLLETVERQL

SEQ ID NO: 2997544 - protein, 18 aa, Entamoeba invadens
GDSTLLSGTSKPLPLLSS

SEQ ID NO: 2997545 - protein, 26 aa, Entamoeba invadens
GDTFTYTLFAWIKQGVPIPNAVNRTI

SEQ ID NO: 2997546 - protein, 19 aa, Entamoeba invadens
GDTIIYMLCGDYKKLENGG

SEQ ID NO: 2997547 - protein, 28 aa, Entamoeba invadens
GDTIQDMMMLLKIKPIPDLKMCDVAQNT

SEQ ID NO: 2997548 - protein, 25 aa, Entamoeba invadens
GDTPHAWPDYVFLKGTSFSSKNKDK

SEQ ID NO: 2997549 - protein, 21 aa, Entamoeba invadens
GDTVPVRIFLNRIKELTPTLS

SEQ ID NO: 2997550 - protein, 26 aa, Entamoeba invadens
GDVEKAILVLKGNPLSGFNVFEEQVP

SEQ ID NO: 2997551 - protein, 24 aa, Entamoeba invadens
GDVEWCLAFLFNTGKASYTSNSLL

SEQ ID NO: 2997552 - protein, 20 aa, Entamoeba invadens
GDVFEKVVLFGHKRLGVAGV

SEQ ID NO: 2997553 - protein, 32 aa, Entamoeba invadens
GDVIVSRMWGGLTVDPYFIFGKESPEVKTYYK

SEQ ID NO: 2997554 - protein, 24 aa, Entamoeba invadens
GDVMAIFLIVIKNTTKNFPKVIES

SEQ ID NO: 2997555 - protein, 21 aa, Entamoeba invadens
GDVQTTLLNGLRIIDLGKSCK

SEQ ID NO: 2997556 - protein, 23 aa, Entamoeba invadens
GDVVFVVKTIPHPLYTRDGDNLH

SEQ ID NO: 2997557 - protein, 19 aa, Entamoeba invadens
GDVYSKESYFLGKKAYCDV

SEQ ID NO: 2997558 - protein, 17 aa, Entamoeba invadens
GDWVLNVDWHYSGRYVA

SEQ ID NO: 2997559 - protein, 25 aa, Entamoeba invadens
GDYGLAHIYCMMAIFATSMAVDSVV

SEQ ID NO: 2997560 - protein, 25 aa, Entamoeba invadens
GDYLFAFGGQKCDIAVYKKGKDGSR

SEQ ID NO: 2997561 - protein, 27 aa, Entamoeba invadens
GDYMHFELRIFPPYPCSKIILENRLSE

SEQ ID NO: 2997562 - protein, 22 aa, Entamoeba invadens
GDYTFSSLIRLLLTIVEAERGL

SEQ ID NO: 2997563 - protein, 17 aa, Entamoeba invadens
GEAISKQIKEKATSIAK

SEQ ID NO: 2997564 - protein, 27 aa, Entamoeba invadens
GECDIVVLIVSDYFRRFKLEREDWSKN

SEQ ID NO: 2997565 - protein, 26 aa, Entamoeba invadens
GEDDSWLIYCYHCFYIRTNGLSKIDN

SEQ ID NO: 2997566 - protein, 17 aa, Entamoeba invadens
GEDFPFLENFPIDSSDL

SEQ ID NO: 2997567 - protein, 23 aa, Entamoeba invadens
GEDGFVRFWDTRKPNFELCHLFG

SEQ ID NO: 2997568 - protein, 25 aa, Entamoeba invadens
GEDKGLCYFDCSQGWFGNYRTLYRH

SEQ ID NO: 2997569 - protein, 20 aa, Entamoeba invadens
GEDNAFKTLVLLVFIIATMF

SEQ ID NO: 2997570 - protein, 33 aa, Entamoeba invadens
GEEDMTQYFFKLRDPLMWGLQRVFLEMTSIFDE

SEQ ID NO: 2997571 - protein, 27 aa, Entamoeba invadens
GEEFCVDVIPFMYGNGKPKLFSVEPLE

SEQ ID NO: 2997572 - protein, 26 aa, Entamoeba invadens
GEEFELAIKIFKTSILIFKDRERYVE

SEQ ID NO: 2997573 - protein, 27 aa, Entamoeba invadens
GEEPHAFMQLFENKYLIHIGDYQNHEE

SEQ ID NO: 2997574 - protein, 23 aa, Entamoeba invadens
GEEPRGFGQLYFIEADQAVKERA

SEQ ID NO: 2997575 - protein, 25 aa, Entamoeba invadens
GEEVQIAFPLNLRKLFLTNAKITNI

SEQ ID NO: 2997576 - protein, 18 aa, Entamoeba invadens
GEEYGCGDVIQFTARKNF

SEQ ID NO: 2997577 - protein, 22 aa, Entamoeba invadens
GEFCFYWCDKLSAITLGTNIVK

SEQ ID NO: 2997578 - protein, 32 aa, Entamoeba invadens
GEFGVELVLMLFSLKISSPKRFIFLRGNHESR

SEQ ID NO: 2997579 - protein, 17 aa, Entamoeba invadens
GEFIIRIYSQEKIEVKE

SEQ ID NO: 2997580 - protein, 23 aa, Entamoeba invadens
GEGIFVRWLGTKDDILYIACDED

SEQ ID NO: 2997581 - protein, 19 aa, Entamoeba invadens
GEGQIVLAYKRAWETKAPA

SEQ ID NO: 2997582 - protein, 29 aa, Entamoeba invadens
GEGYKNVLGMLFSLYRMFCVKNYERNHKG

SEQ ID NO: 2997583 - protein, 27 aa, Entamoeba invadens
GEHQDSMFIACSLLQFGVSIPNSLNYA

SEQ ID NO: 2997584 - protein, 22 aa, Entamoeba invadens
GEIDLFNYVNDNSYRRCLRARC

SEQ ID NO: 2997585 - protein, 19 aa, Entamoeba invadens
GEIIRNSIDWKAMKLPVKF

SEQ ID NO: 2997586 - protein, 28 aa, Entamoeba invadens
GEIIVKNFFYEIVVWFSVDYETVDKNNG

SEQ ID NO: 2997587 - protein, 19 aa, Entamoeba invadens
GEILRVFCGITLYKNKKIE

SEQ ID NO: 2997588 - protein, 19 aa, Entamoeba invadens
GEIMVYIQYGGKCCGCCSA

SEQ ID NO: 2997589 - protein, 28 aa, Entamoeba invadens
GEISTSQFLFLKYLFKVNERFEGEMAKI

SEQ ID NO: 2997590 - protein, 20 aa, Entamoeba invadens
GEISWDDLVKLLVGPTKGHG

SEQ ID NO: 2997591 - protein, 24 aa, Entamoeba invadens
GEITRQIYKPIYPLSFTTEVMTEE

SEQ ID NO: 2997592 - protein, 27 aa, Entamoeba invadens
GEKCFSDFHYLKTIDLPPTITQIESLC

SEQ ID NO: 2997593 - protein, 28 aa, Entamoeba invadens
GEKDEDDIFFFTHFISIAGKKTQKKSYI

SEQ ID NO: 2997594 - protein, 18 aa, Entamoeba invadens
GEKFSVFISPVVSQLIVL

SEQ ID NO: 2997595 - protein, 22 aa, Entamoeba invadens
GEKGWLIIDTLCCMESAAAGLK

SEQ ID NO: 2997596 - protein, 27 aa, Entamoeba invadens
GEKIIQPPWYVCVVCRRQFDTEEMLRL

SEQ ID NO: 2997597 - protein, 24 aa, Entamoeba invadens
GEKNFLLVFEIQGGKTLFITFKIV

SEQ ID NO: 2997598 - protein, 29 aa, Entamoeba invadens
GEKQCVVSLQTFPFKFTKIPIQVSQTIKT

SEQ ID NO: 2997599 - protein, 26 aa, Entamoeba invadens
GEKRRILLVSGFIQVAYIQSIENKLG

SEQ ID NO: 2997600 - protein, 29 aa, Entamoeba invadens
GEKSFSTVCLLLSLWNVVDCPFRAMDEFD

SEQ ID NO: 2997601 - protein, 23 aa, Entamoeba invadens
GEKTLLLKVRCTCVPEGQCVFVG

SEQ ID NO: 2997602 - protein, 22 aa, Entamoeba invadens
GELIYPNTYLFSPNNKVFQFSS

SEQ ID NO: 2997603 - protein, 17 aa, Entamoeba invadens
GELLIKFNPTFKVNLMD

SEQ ID NO: 2997604 - protein, 24 aa, Entamoeba invadens
GELPTKYDYIFIPPVGVTLNDKIA

SEQ ID NO: 2997605 - protein, 22 aa, Entamoeba invadens
GELYGLLQKAGRFEEKRAARYI

SEQ ID NO: 2997606 - protein, 24 aa, Entamoeba invadens
GEMRSVLLKAYSGTFPTLVMKFIE

SEQ ID NO: 2997607 - protein, 23 aa, Entamoeba invadens
GEMTCFFPFFGTCDDKKNLVDWF

SEQ ID NO: 2997608 - protein, 33 aa, Entamoeba invadens
GEMVMMYPTYDYMPFIKDLCNVSIYGKISAVKL

SEQ ID NO: 2997609 - protein, 44 aa, Entamoeba invadens
GENATVLHFIYLPILRLMKQSASPYYLICLTLVLPLPKEKISEN

SEQ ID NO: 2997610 - protein, 27 aa, Entamoeba invadens
GENKKNEIEAILALTNNQLENNEKAQK

SEQ ID NO: 2997611 - protein, 33 aa, Entamoeba invadens
GENNIPMIADLLRYFFHFVKSTCPYIVEYNSNL

SEQ ID NO: 2997612 - protein, 18 aa, Entamoeba invadens
GENPLLFTESFILTQANN

SEQ ID NO: 2997613 - protein, 28 aa, Entamoeba invadens
GEPHRRLIITPLDYPYHSLPRKVGYHTS

SEQ ID NO: 2997614 - protein, 19 aa, Entamoeba invadens
GEPIFDYVLLAFNNGELTA

SEQ ID NO: 2997615 - protein, 26 aa, Entamoeba invadens
GEPKKFEYKDSIFFKFVVDVKKDSKT

SEQ ID NO: 2997616 - protein, 25 aa, Entamoeba invadens
GEPKTTFVIVLTFLKMSLQNETTDE

SEQ ID NO: 2997617 - protein, 20 aa, Entamoeba invadens
GEPMTLPKQPSVPLITPRIL

SEQ ID NO: 2997618 - protein, 44 aa, Entamoeba invadens
GEPSHKPAPPLPHKAAPPPPPAKKAPPPLPKQKVPEQKPQGDFE

SEQ ID NO: 2997619 - protein, 27 aa, Entamoeba invadens
GEPVQMCVYPLWKSSLLPPGITYGMWR

SEQ ID NO: 2997620 - protein, 30 aa, Entamoeba invadens
GEQKQLFRDLFQIVFGFVYDQIVMGDTTVE

SEQ ID NO: 2997621 - protein, 17 aa, Entamoeba invadens
GEQTQIIHGYKSDLKRI

SEQ ID NO: 2997622 - protein, 24 aa, Entamoeba invadens
GEQYINPVLNMLKYTDGEFMLGAT

SEQ ID NO: 2997623 - protein, 26 aa, Entamoeba invadens
GERMCKFLPIYKMVERVYSDSVKRNC

SEQ ID NO: 2997624 - protein, 20 aa, Entamoeba invadens
GERMSLFSPTFRTNYRKTVK

SEQ ID NO: 2997625 - protein, 33 aa, Entamoeba invadens
GERMVCCKIPKLNGFFDLRLMADKTLIAEEKNV

SEQ ID NO: 2997626 - protein, 25 aa, Entamoeba invadens
GERNYHIFYQLLAGASKQYFDDFYL

SEQ ID NO: 2997627 - protein, 24 aa, Entamoeba invadens
GERRDEMSFFLATCPLDLLTFRLE

SEQ ID NO: 2997628 - protein, 18 aa, Entamoeba invadens
GERRKAFEWHFLDLTKPK

SEQ ID NO: 2997629 - protein, 25 aa, Entamoeba invadens
GERSFGVVYKSTFSGKIVAIKGFLE

SEQ ID NO: 2997630 - protein, 26 aa, Entamoeba invadens
GESAAGFLYRVPLLLELVKIVREKNV

SEQ ID NO: 2997631 - protein, 29 aa, Entamoeba invadens
GESCKIAEPMKALLTKPNEIKAEEASNAL

SEQ ID NO: 2997632 - protein, 23 aa, Entamoeba invadens
GESINFVVDLLGELGFRFKAKVS

SEQ ID NO: 2997633 - protein, 25 aa, Entamoeba invadens
GESIYCVEQYWLLHFEARSEFAIRY

SEQ ID NO: 2997634 - protein, 24 aa, Entamoeba invadens
GESSTIMFLKAINQKIIGPSTMRI

SEQ ID NO: 2997635 - protein, 24 aa, Entamoeba invadens
GETDVFYVGPFQKANMLKIKGEIS

SEQ ID NO: 2997636 - protein, 18 aa, Entamoeba invadens
GETIPFNLPVHHLEDDCF

SEQ ID NO: 2997637 - protein, 26 aa, Entamoeba invadens
GETPQTLHLLAFDLLVDSAKPGDRVE

SEQ ID NO: 2997638 - protein, 28 aa, Entamoeba invadens
GETTSHIIGTFYRTIKLMTSGVKPIYVF

SEQ ID NO: 2997639 - protein, 24 aa, Entamoeba invadens
GEVFSKLTYFLKSYCVYVNCIDCV

SEQ ID NO: 2997640 - protein, 36 aa, Entamoeba invadens
GEVGKDWKMCLLFTDVMIVARPFVFGKKSTRDRENL

SEQ ID NO: 2997641 - protein, 26 aa, Entamoeba invadens
GEVHVGMLVDCKVPYVILGHSERRQI

SEQ ID NO: 2997642 - protein, 23 aa, Entamoeba invadens
GEVIYYWCIFQNKGKEAKNGIIQ

SEQ ID NO: 2997643 - protein, 19 aa, Entamoeba invadens
GEVTWWLYGNNILSIEKGD

SEQ ID NO: 2997644 - protein, 27 aa, Entamoeba invadens
GEVWKVRHIYMHFTAAAKIIKSARSSM

SEQ ID NO: 2997645 - protein, 18 aa, Entamoeba invadens
GEVYWTCIYGSKKKTEVF

SEQ ID NO: 2997646 - protein, 18 aa, Entamoeba invadens
GEYCFAYCKSLSALTLGT

SEQ ID NO: 2997647 - protein, 17 aa, Entamoeba invadens
GEYFFSLPFPYCVISTA

SEQ ID NO: 2997648 - protein, 23 aa, Entamoeba invadens
GEYFSAFPEPLYNIPRKSRHLKI

SEQ ID NO: 2997649 - protein, 19 aa, Entamoeba invadens
GEYLNILPLSLYDLAETVS

SEQ ID NO: 2997650 - protein, 42 aa, Entamoeba invadens
GEYLRVQTPMLFLDMFRIFNSHYLLGLNYLPNITPFQEIYNK

SEQ ID NO: 2997651 - protein, 22 aa, Entamoeba invadens
GEYNLLDFVISRPIHYNVWSTR

SEQ ID NO: 2997652 - protein, 36 aa, Entamoeba invadens
GEYQKGHCLSCRLGFAPNLSSPPVCTNCGCRECNKI

SEQ ID NO: 2997653 - protein, 25 aa, Entamoeba invadens
GEYSCEVLITLLCLKMNNPNSVIML

SEQ ID NO: 2997654 - protein, 22 aa, Entamoeba invadens
GEYTAPSLARRTTQMPLKPIVQ

SEQ ID NO: 2997655 - protein, 18 aa, Entamoeba invadens
GEYVSVERWMFKSLKPEE

SEQ ID NO: 2997656 - protein, 20 aa, Entamoeba invadens
GFADYRIPQLLLGWDCLDFL

SEQ ID NO: 2997657 - protein, 20 aa, Entamoeba invadens
GFAGFDTPKLVFPTKVVYLN

SEQ ID NO: 2997658 - protein, 20 aa, Entamoeba invadens
GFARAIGFFRNQEEYYWANQ

SEQ ID NO: 2997659 - protein, 23 aa, Entamoeba invadens
GFCGMGSLEKLILPNAVISIGNF

SEQ ID NO: 2997660 - protein, 17 aa, Entamoeba invadens
GFCGYYVEFDLDNFYYL

SEQ ID NO: 2997661 - protein, 27 aa, Entamoeba invadens
GFDEKLCLYVFWELLRKSDDKTLLQFL

SEQ ID NO: 2997662 - protein, 31 aa, Entamoeba invadens
GFDFERIIDDFIFFCFFVGNDFLPHSPSLEI

SEQ ID NO: 2997663 - protein, 18 aa, Entamoeba invadens
GFDFLDEIQLLYSPISDL

SEQ ID NO: 2997664 - protein, 25 aa, Entamoeba invadens
GFDKFRDIFNFFLKSIGNVYNNKQI

SEQ ID NO: 2997665 - protein, 23 aa, Entamoeba invadens
GFDKKFYISSLFRTVKQSSVDVV

SEQ ID NO: 2997666 - protein, 25 aa, Entamoeba invadens
GFDRRMYGNYIFSIKNQRIVRSSIK

SEQ ID NO: 2997667 - protein, 28 aa, Entamoeba invadens
GFDSIYITPISYFQYLPNNKLYDMCGYV

SEQ ID NO: 2997668 - protein, 17 aa, Entamoeba invadens
GFDVKITLPLVKTGELM

SEQ ID NO: 2997669 - protein, 17 aa, Entamoeba invadens
GFELPVYYVCLTLSDTF

SEQ ID NO: 2997670 - protein, 17 aa, Entamoeba invadens
GFEMYKDTVIPNPNMLV

SEQ ID NO: 2997671 - protein, 27 aa, Entamoeba invadens
GFEPVREEFLLFLSKRVKLQTLPEHIA

SEQ ID NO: 2997672 - protein, 21 aa, Entamoeba invadens
GFEQQPKLFVNPKIICLNIEL

SEQ ID NO: 2997673 - protein, 27 aa, Entamoeba invadens
GFESTFLKNLLKLKTLLKLQTVVLYMK

SEQ ID NO: 2997674 - protein, 24 aa, Entamoeba invadens
GFFDTIIKTVKIVKAFLGCYLIIN

SEQ ID NO: 2997675 - protein, 17 aa, Entamoeba invadens
GFFGSFFSSKDKERKEK

SEQ ID NO: 2997676 - protein, 19 aa, Entamoeba invadens
GFFGSPIPVLTRQGFYSLQ

SEQ ID NO: 2997677 - protein, 19 aa, Entamoeba invadens
GFFKKEFLRVSLEMVFAKY

SEQ ID NO: 2997678 - protein, 25 aa, Entamoeba invadens
GFFPMKNYEFMTWSDNVQIVKYQNF

SEQ ID NO: 2997679 - protein, 25 aa, Entamoeba invadens
GFGDFCSYIFKAAQLKNDFGLVAKL

SEQ ID NO: 2997680 - protein, 17 aa, Entamoeba invadens
GFGGGMLEILFDIIQYV

SEQ ID NO: 2997681 - protein, 26 aa, Entamoeba invadens
GFGGRVLAPIAMFARCGLPTPHIPSF

SEQ ID NO: 2997682 - protein, 21 aa, Entamoeba invadens
GFGHLKGALNIPYAENWKEEV

SEQ ID NO: 2997683 - protein, 23 aa, Entamoeba invadens
GFGKAYIEVLLSKGYNVAATTRT

SEQ ID NO: 2997684 - protein, 21 aa, Entamoeba invadens
GFGLLQNLKILILNDNKFETI

SEQ ID NO: 2997685 - protein, 19 aa, Entamoeba invadens
GFGRIGRLVARVILSRPEF

SEQ ID NO: 2997686 - protein, 19 aa, Entamoeba invadens
GFGYVKYRTIEAALKAVEN

SEQ ID NO: 2997687 - protein, 19 aa, Entamoeba invadens
GFHELVGVMFYALSQDLEQ

SEQ ID NO: 2997688 - protein, 26 aa, Entamoeba invadens
GFHVCVTKWLSLVQLLMGEIPRRKQF

SEQ ID NO: 2997689 - protein, 17 aa, Entamoeba invadens
GFIAFNIGFLLPRDEEI

SEQ ID NO: 2997690 - protein, 19 aa, Entamoeba invadens
GFIELIPGTETKDVSENKK

SEQ ID NO: 2997691 - protein, 20 aa, Entamoeba invadens
GFIFTKGDLHALKDKLAELK

SEQ ID NO: 2997692 - protein, 18 aa, Entamoeba invadens
GFIFVTYYDIRASRSAAK

SEQ ID NO: 2997693 - protein, 20 aa, Entamoeba invadens
GFIGTIQQFLEIGKTWLSLI

SEQ ID NO: 2997694 - protein, 17 aa, Entamoeba invadens
GFIVLRRKVGMILRIIN

SEQ ID NO: 2997695 - protein, 21 aa, Entamoeba invadens
GFKGKLFPINGRKPELFGMKC

SEQ ID NO: 2997696 - protein, 26 aa, Entamoeba invadens
GFKISPILKIFEVKLFRYTQGQCFSS

SEQ ID NO: 2997697 - protein, 33 aa, Entamoeba invadens
GFKVDIWACGVVMYSLLFGKFPFDGEGQELVAN

SEQ ID NO: 2997698 - protein, 24 aa, Entamoeba invadens
GFKYLVIYFGDIFEKCATVWPKLK

SEQ ID NO: 2997699 - protein, 18 aa, Entamoeba invadens
GFLEFLKEFRRRGGIIAV

SEQ ID NO: 2997700 - protein, 27 aa, Entamoeba invadens
GFLGERYFRFDPVLFENLDLDCADAVP

SEQ ID NO: 2997701 - protein, 24 aa, Entamoeba invadens
GFLHKKEMYYTLCLTDYLVKQAKD

SEQ ID NO: 2997702 - protein, 21 aa, Entamoeba invadens
GFLINKKMVFFTRNGSFLCAV

SEQ ID NO: 2997703 - protein, 17 aa, Entamoeba invadens
GFLQVPSVFQCLRSKPD

SEQ ID NO: 2997704 - protein, 19 aa, Entamoeba invadens
GFLVFDMEIIRVIAKEGIC

SEQ ID NO: 2997705 - protein, 20 aa, Entamoeba invadens
GFLVFDMEIIRVIAKEGICS

SEQ ID NO: 2997706 - protein, 24 aa, Entamoeba invadens
GFMSRADWYSVCKNFTLADGTFWP

SEQ ID NO: 2997707 - protein, 18 aa, Entamoeba invadens
GFMTVLIQSVAKGDSQCC

SEQ ID NO: 2997708 - protein, 18 aa, Entamoeba invadens
GFNFIQMGVEYNAALRVL

SEQ ID NO: 2997709 - protein, 19 aa, Entamoeba invadens
GFNTFLWCGSKTSKNAREA

SEQ ID NO: 2997710 - protein, 28 aa, Entamoeba invadens
GFPTNLMPILMRHLSGKLPVLSVFGSDY

SEQ ID NO: 2997711 - protein, 18 aa, Entamoeba invadens
GFPVFGLNGFWKMVEHNN

SEQ ID NO: 2997712 - protein, 22 aa, Entamoeba invadens
GFRKIREIMLTKKLTSIIADEN

SEQ ID NO: 2997713 - protein, 19 aa, Entamoeba invadens
GFSEVRYIKVRGSGVAFIE

SEQ ID NO: 2997714 - protein, 17 aa, Entamoeba invadens
GFSFRLKVFSHISINMK

SEQ ID NO: 2997715 - protein, 21 aa, Entamoeba invadens
GFSPQYGARPMRRYLEKKIVT

SEQ ID NO: 2997716 - protein, 25 aa, Entamoeba invadens
GFTLTLPLMPLTITPEFLLTHMIKK

SEQ ID NO: 2997717 - protein, 24 aa, Entamoeba invadens
GFTRAIYDIFKYLPERRQIVLCSA

SEQ ID NO: 2997718 - protein, 17 aa, Entamoeba invadens
GFTVLNRTRKELTTQIP

SEQ ID NO: 2997719 - protein, 19 aa, Entamoeba invadens
GFTYHLPHCSLTTDAGWGC

SEQ ID NO: 2997720 - protein, 19 aa, Entamoeba invadens
GFVAFKRCYSLTKVVIQNG

SEQ ID NO: 2997721 - protein, 28 aa, Entamoeba invadens
GFVDHKIYKLWQKYVLGPDLENRRKLYK

SEQ ID NO: 2997722 - protein, 25 aa, Entamoeba invadens
GFVDVYVMYLKKKNVLSEWMVVCPG

SEQ ID NO: 2997723 - protein, 19 aa, Entamoeba invadens
GFVGRFVLRSVCEKTERRI

SEQ ID NO: 2997724 - protein, 30 aa, Entamoeba invadens
GFVKIKADLIVVLFIEIFRAIDSDMNGTVC

SEQ ID NO: 2997725 - protein, 21 aa, Entamoeba invadens
GFVKIKGFVTIPPDGLNYLYA

SEQ ID NO: 2997726 - protein, 18 aa, Entamoeba invadens
GFVLNVLDPNPFASPSIF

SEQ ID NO: 2997727 - protein, 31 aa, Entamoeba invadens
GFVNITFVNGFIYFEYIPLIAEPIFEFMSRK

SEQ ID NO: 2997728 - protein, 21 aa, Entamoeba invadens
GFVRTMSIDLLLRIGCFLDLC

SEQ ID NO: 2997729 - protein, 17 aa, Entamoeba invadens
GFVWGLLANFEERCSRN

SEQ ID NO: 2997730 - protein, 20 aa, Entamoeba invadens
GFWENFILGFKNKLVQVENS

SEQ ID NO: 2997731 - protein, 17 aa, Entamoeba invadens
GFYIGSVRNSFISNKMD

SEQ ID NO: 2997732 - protein, 20 aa, Entamoeba invadens
GGAKKFIISAPSADAPMFVV

SEQ ID NO: 2997733 - protein, 17 aa, Entamoeba invadens
GGDGCMSTWSLKKGKVI

SEQ ID NO: 2997734 - protein, 21 aa, Entamoeba invadens
GGDGRFLNLKALDIIVRVAIA

SEQ ID NO: 2997735 - protein, 31 aa, Entamoeba invadens
GGDGRWWAKKRMLQFLRRRWESSPPTIEAID

SEQ ID NO: 2997736 - protein, 30 aa, Entamoeba invadens
GGDLITLLRQVQYALVQPLDRWRVSIHHKD

SEQ ID NO: 2997737 - protein, 23 aa, Entamoeba invadens
GGDTFEYVVLRKTLLPREEPVEV

SEQ ID NO: 2997738 - protein, 28 aa, Entamoeba invadens
GGEERAKEIKECFSEFVEGGKTAFAEPE

SEQ ID NO: 2997739 - protein, 33 aa, Entamoeba invadens
GGEIYELWDAIFAYPKHKLQYFITAIIIEEQRE

SEQ ID NO: 2997740 - protein, 25 aa, Entamoeba invadens
GGEKFAMKILLVLDLSEKKSKNVER

SEQ ID NO: 2997741 - protein, 31 aa, Entamoeba invadens
GGEKSFSTVCLLLSLWNVVDCPFRAMDEFDV

SEQ ID NO: 2997742 - protein, 37 aa, Entamoeba invadens
GGEKTLSSLALIFALHHYRPTPIYVMDEIDAALDFRN

SEQ ID NO: 2997743 - protein, 29 aa, Entamoeba invadens
GGENLAHEYVLLMLLIYTSFKEETKQGFI

SEQ ID NO: 2997744 - protein, 41 aa, Entamoeba invadens
GGEPDLHIVAKLILYDFQRGRLPYFIAPPTPKLNDTVDTDY

SEQ ID NO: 2997745 - protein, 23 aa, Entamoeba invadens
GGERANLSLIRRLKKKQLKEQAL

SEQ ID NO: 2997746 - protein, 33 aa, Entamoeba invadens
GGERSVATMLYLLSLQEQTFCPFRLVDEINQGM

SEQ ID NO: 2997747 - protein, 25 aa, Entamoeba invadens
GGFIFSCDSAFWLSDGKIYIHQCLK

SEQ ID NO: 2997748 - protein, 19 aa, Entamoeba invadens
GGFQFVGIQYHCPPPLNLS

SEQ ID NO: 2997749 - protein, 21 aa, Entamoeba invadens
GGGALNWPVIEQYPILMCSIL

SEQ ID NO: 2997750 - protein, 33 aa, Entamoeba invadens
GGGEIKFLLGLLFQVFMMFHKSDLLAPQNTEKQ

SEQ ID NO: 2997751 - protein, 22 aa, Entamoeba invadens
GGGFGLSWSIVSPGTFCVCENG

SEQ ID NO: 2997752 - protein, 29 aa, Entamoeba invadens
GGGGLLSGIAYVAKTFKPSIRVIGVQAET

SEQ ID NO: 2997753 - protein, 19 aa, Entamoeba invadens
GGGPLSMTFDYASALMSGF

SEQ ID NO: 2997754 - protein, 21 aa, Entamoeba invadens
GGHYFSNCLVDGKWLCFNDRT

SEQ ID NO: 2997755 - protein, 17 aa, Entamoeba invadens
GGHYICYIKGPNSGWFQ

SEQ ID NO: 2997756 - protein, 21 aa, Entamoeba invadens
GGIDLPMWRIADNGIMEWFQL

SEQ ID NO: 2997757 - protein, 31 aa, Entamoeba invadens
GGIKKRITIFMARLTFLIKAVEYSVVPQIIH

SEQ ID NO: 2997758 - protein, 32 aa, Entamoeba invadens
GGIVMACRVQLPLAYAWALSIHKSQGLTLPRA

SEQ ID NO: 2997759 - protein, 24 aa, Entamoeba invadens
GGKFKLKIVLPDEYPQKPPVLTVE

SEQ ID NO: 2997760 - protein, 25 aa, Entamoeba invadens
GGKGRCWVLDPIDGTLGFLRREQYA

SEQ ID NO: 2997761 - protein, 26 aa, Entamoeba invadens
GGKKIGFELIYKLYKNFITQMEVIKR

SEQ ID NO: 2997762 - protein, 27 aa, Entamoeba invadens
GGKLVNAWKVLLDKYWGGYSVLSPREF

SEQ ID NO: 2997763 - protein, 27 aa, Entamoeba invadens
GGKNTTPTLFLLSDLILFGVESPKDIA

SEQ ID NO: 2997764 - protein, 33 aa, Entamoeba invadens
GGKSTYLRMIGMCVIMAQIGMYVPCDSAEVAIC

SEQ ID NO: 2997765 - protein, 26 aa, Entamoeba invadens
GGKTIELRIAFNLKTKLFANVVTITQ

SEQ ID NO: 2997766 - protein, 20 aa, Entamoeba invadens
GGKVNFLFTIREDKVKFFDL

SEQ ID NO: 2997767 - protein, 35 aa, Entamoeba invadens
GGLEKSMFERLLLNKVPYALLTTQYRMHPQIAKFP

SEQ ID NO: 2997768 - protein, 38 aa, Entamoeba invadens
GGLIGYCSTFFVFSDYLRPTVRLAALSGYPAIYVFTHD

SEQ ID NO: 2997769 - protein, 18 aa, Entamoeba invadens
GGLIKDNTLKLLYNDWTF

SEQ ID NO: 2997770 - protein, 24 aa, Entamoeba invadens
GGLQALWVMWKLGSVEMGVITLQK

SEQ ID NO: 2997771 - protein, 32 aa, Entamoeba invadens
GGLRPYGVSFLYAGWDKYFGYQLYMCDPSGNY

SEQ ID NO: 2997772 - protein, 27 aa, Entamoeba invadens
GGLVPKSALPLFKKWDAKIVSSQSSET

SEQ ID NO: 2997773 - protein, 24 aa, Entamoeba invadens
GGLVTLQLFKFFGLAFCREHIEKL

SEQ ID NO: 2997774 - protein, 24 aa, Entamoeba invadens
GGMMPPGMMPPPGGLAPPGMMMPP

SEQ ID NO: 2997775 - protein, 29 aa, Entamoeba invadens
GGNEFLKRRYLLLCYIKTFDIDDFTQIAL

SEQ ID NO: 2997776 - protein, 33 aa, Entamoeba invadens
GGNMEKFHFNPIPLNFKTLGYLPNIETLHLWDV

SEQ ID NO: 2997777 - protein, 30 aa, Entamoeba invadens
GGNMEKFHFNPIPLNYTTLGYFPNIETLHL

SEQ ID NO: 2997778 - protein, 28 aa, Entamoeba invadens
GGNPIELNAFFLNKLKWLEQVLPNNKNS

SEQ ID NO: 2997779 - protein, 40 aa, Entamoeba invadens
GGQKTVVALSLIFAIQRCDPAPFYLFDEIDSNLDNVYRTA

SEQ ID NO: 2997780 - protein, 24 aa, Entamoeba invadens
GGQLRKGQSLLFNQEKRKSNETIE

SEQ ID NO: 2997781 - protein, 26 aa, Entamoeba invadens
GGQSKIRTLWRHYYNEIDAVVFVVDL

SEQ ID NO: 2997782 - protein, 18 aa, Entamoeba invadens
GGRDLELIKVMRLKNNVV

SEQ ID NO: 2997783 - protein, 20 aa, Entamoeba invadens
GGRHSMTFLQPPLLRNRMSP

SEQ ID NO: 2997784 - protein, 22 aa, Entamoeba invadens
GGRLQFFSFFNNGKVKMNIGVL

SEQ ID NO: 2997785 - protein, 26 aa, Entamoeba invadens
GGRNKEYILPLFVVAWRVCSDESGQN

SEQ ID NO: 2997786 - protein, 17 aa, Entamoeba invadens
GGSDGVAYIYSISSRKL

SEQ ID NO: 2997787 - protein, 20 aa, Entamoeba invadens
GGSFFPYRYKEEFSIFGNIL

SEQ ID NO: 2997788 - protein, 29 aa, Entamoeba invadens
GGSGEYNSIVKRLLLLERQSAEERKKPLL

SEQ ID NO: 2997789 - protein, 23 aa, Entamoeba invadens
GGSPIKEVLFGITLQYLNSTEWN

SEQ ID NO: 2997790 - protein, 26 aa, Entamoeba invadens
GGSYSGNLAAWMRQKYPNVVDGAWAS

SEQ ID NO: 2997791 - protein, 22 aa, Entamoeba invadens
GGVCDLSLLQIPKFVKSISLKN

SEQ ID NO: 2997792 - protein, 25 aa, Entamoeba invadens
GGVGFVFSWVSYLSNIFSTFELSKI

SEQ ID NO: 2997793 - protein, 29 aa, Entamoeba invadens
GGVGTLVTPLYLPALFKEMCFDETIIAGD

SEQ ID NO: 2997794 - protein, 17 aa, Entamoeba invadens
GGVHKYRLKGSNKHLAM

SEQ ID NO: 2997795 - protein, 19 aa, Entamoeba invadens
GGVKGVFVDPLKGAKDGGI

SEQ ID NO: 2997796 - protein, 26 aa, Entamoeba invadens
GGVLNNLVYIVLSLVLSGFKQIYDKL

SEQ ID NO: 2997797 - protein, 22 aa, Entamoeba invadens
GGVLPLLANDLSQPIYAKLRDG

SEQ ID NO: 2997798 - protein, 24 aa, Entamoeba invadens
GGVMGFVQFINANKKVLHPTAFHA

SEQ ID NO: 2997799 - protein, 25 aa, Entamoeba invadens
GGYHPLEIFTKLKLSQFFKEVEIAL

SEQ ID NO: 2997800 - protein, 20 aa, Entamoeba invadens
GGYRTWDYISENWRTFGRVR

SEQ ID NO: 2997801 - protein, 24 aa, Entamoeba invadens
GHCRQFINQFAFSKTLKIFIVTIN

SEQ ID NO: 2997802 - protein, 25 aa, Entamoeba invadens
GHDFCSDFYLSSIPSFLQMDSSCDS

SEQ ID NO: 2997803 - protein, 17 aa, Entamoeba invadens
GHEAATFCRDNIKQIYQ

SEQ ID NO: 2997804 - protein, 26 aa, Entamoeba invadens
GHELKYRKMPLPSQYLRIGFESDETT

SEQ ID NO: 2997805 - protein, 27 aa, Entamoeba invadens
GHENIKKGILLLLFGGVHKTTKEGITL

SEQ ID NO: 2997806 - protein, 25 aa, Entamoeba invadens
GHFGSGWCWLVLTNGKLEIVDTHDA

SEQ ID NO: 2997807 - protein, 21 aa, Entamoeba invadens
GHGFLIVYSVTDRNSFESIKN

SEQ ID NO: 2997808 - protein, 17 aa, Entamoeba invadens
GHIFCRECMIHLFSNNE

SEQ ID NO: 2997809 - protein, 18 aa, Entamoeba invadens
GHILAKCPVPRKRRLEFT

SEQ ID NO: 2997810 - protein, 29 aa, Entamoeba invadens
GHIWTGAIDLYFPRLLKWSYTVCCNGKIL

SEQ ID NO: 2997811 - protein, 29 aa, Entamoeba invadens
GHLDDLDSFVILLKKWWADGKSHAELDII

SEQ ID NO: 2997812 - protein, 26 aa, Entamoeba invadens
GHLHYDSLMIYPTYDTAYYHCIVNPA

SEQ ID NO: 2997813 - protein, 22 aa, Entamoeba invadens
GHLLLGICRIYTRKVKYLLQDC

SEQ ID NO: 2997814 - protein, 30 aa, Entamoeba invadens
GHLTIYEFVGIYRFLEICYALFTEIPGSSH

SEQ ID NO: 2997815 - protein, 25 aa, Entamoeba invadens
GHMLHGIFAFQPYFNLTNENVAFDF

SEQ ID NO: 2997816 - protein, 25 aa, Entamoeba invadens
GHQAKILCHTISPNGQFIATGDRSG

SEQ ID NO: 2997817 - protein, 20 aa, Entamoeba invadens
GHQFCWLCMADYNSNHWSTN

SEQ ID NO: 2997818 - protein, 20 aa, Entamoeba invadens
GHQFCWLCMADYTNTHFKSN

SEQ ID NO: 2997819 - protein, 22 aa, Entamoeba invadens
GHSCFMWCNNLSQISLSNKMAF

SEQ ID NO: 2997820 - protein, 18 aa, Entamoeba invadens
GHTGDITCLAFSANGQLY

SEQ ID NO: 2997821 - protein, 18 aa, Entamoeba invadens
GHTGFYGCSNLQHIVLPD

SEQ ID NO: 2997822 - protein, 20 aa, Entamoeba invadens
GHVISQLFKQGQRSSLVKFL

SEQ ID NO: 2997823 - protein, 26 aa, Entamoeba invadens
GHVKLCAYYITYPYKDLNSTDFYYDQ

SEQ ID NO: 2997824 - protein, 31 aa, Entamoeba invadens
GHWEYRGMIIKYNYLHHALGFSYSNSGLNAI

SEQ ID NO: 2997825 - protein, 19 aa, Entamoeba invadens
GHYCGAWSCRPSFSSDGQF

SEQ ID NO: 2997826 - protein, 20 aa, Entamoeba invadens
GHYFCSNCWNERISTLLKTS

SEQ ID NO: 2997827 - protein, 30 aa, Entamoeba invadens
GHYGVEVVTLLFLLKMKYPKHVYLIRGNHE

SEQ ID NO: 2997828 - protein, 18 aa, Entamoeba invadens
GHYISYNKVFGQWFCCDD

SEQ ID NO: 2997829 - protein, 18 aa, Entamoeba invadens
GHYKFPSPYWDNISTEIK

SEQ ID NO: 2997830 - protein, 23 aa, Entamoeba invadens
GIAFVFAFFKIVHLIVHKIGAAF

SEQ ID NO: 2997831 - protein, 18 aa, Entamoeba invadens
GIAIIYVVSLYNPEKRIQ

SEQ ID NO: 2997832 - protein, 31 aa, Entamoeba invadens
GIAKPSRLPFMPLTLNVPPSLIGQRPGTNFQ

SEQ ID NO: 2997833 - protein, 17 aa, Entamoeba invadens
GIALIYIEKSEVMWVID

SEQ ID NO: 2997834 - protein, 28 aa, Entamoeba invadens
GIATGESKFPFVLRIRSAYGMNQFSMVM

SEQ ID NO: 2997835 - protein, 26 aa, Entamoeba invadens
GICDNLLQIWILVNPFIPIKFEDYCS

SEQ ID NO: 2997836 - protein, 19 aa, Entamoeba invadens
GICHNAFGFSKFLRNVTLP

SEQ ID NO: 2997837 - protein, 24 aa, Entamoeba invadens
GIDALRKQIWEQLNLIRVYTKVPG

SEQ ID NO: 2997838 - protein, 29 aa, Entamoeba invadens
GIDFMNTKYFRSFGYPLYEYGITKMLETI

SEQ ID NO: 2997839 - protein, 19 aa, Entamoeba invadens
GIDIDNALLYFVINEWKEY

SEQ ID NO: 2997840 - protein, 24 aa, Entamoeba invadens
GIDLELLKKWTGMRNLRVLYDKSM

SEQ ID NO: 2997841 - protein, 17 aa, Entamoeba invadens
GIDLGTTFSAAFVFDEV

SEQ ID NO: 2997842 - protein, 18 aa, Entamoeba invadens
GIDPIKFIADYAYKYFLL

SEQ ID NO: 2997843 - protein, 23 aa, Entamoeba invadens
GIDPPRGILLHGPPGCGKTLLAE

SEQ ID NO: 2997844 - protein, 32 aa, Entamoeba invadens; identical to SEQ ID NO: 2525233

SEQ ID NO: 2997845 - protein, 18 aa, Entamoeba invadens
GIEALKFVSLKKTTGTAT

SEQ ID NO: 2997846 - protein, 47 aa, Entamoeba invadens
GIEELTVGSDLMYFQIRPNGKKGRYPISKNFFEFNSSLPTQNENSTV

SEQ ID NO: 2997847 - protein, 20 aa, Entamoeba invadens
GIEILVMPSSLTYLGDFAFA

SEQ ID NO: 2997848 - protein, 24 aa, Entamoeba invadens
GIELFKIRYMMIYKYSEDKMVYFP

SEQ ID NO: 2997849 - protein, 36 aa, Entamoeba invadens
GIELQPLGSYLILPIQRLPRYQMLLIQIVNTIKDQV

SEQ ID NO: 2997850 - protein, 20 aa, Entamoeba invadens
GIELYKIFPSFKNVKKLDLS

SEQ ID NO: 2997851 - protein, 18 aa, Entamoeba invadens
GIEPKSTFLLVIDDVTEK

SEQ ID NO: 2997852 - protein, 17 aa, Entamoeba invadens
GIEQMFNELLPLAIEEA

SEQ ID NO: 2997853 - protein, 34 aa, Entamoeba invadens
GIETRHRFSFIDYMMFQYNKTLKDLFEKKAGNAT

SEQ ID NO: 2997854 - protein, 17 aa, Entamoeba invadens
GIFADIDSPLNPSALFE

SEQ ID NO: 2997855 - protein, 21 aa, Entamoeba invadens
GIFAFYACVKLKKVVLSESIT

SEQ ID NO: 2997856 - protein, 27 aa, Entamoeba invadens
GIFENNPITCAFPLIFGERGLGMDVKN

SEQ ID NO: 2997857 - protein, 18 aa, Entamoeba invadens
GIFIDRLEHRRDNETLQC

SEQ ID NO: 2997858 - protein, 20 aa, Entamoeba invadens
GIFKALLPHISHFDEVFRTR

SEQ ID NO: 2997859 - protein, 17 aa, Entamoeba invadens
GIFVLLPTPKKPQGMIL

SEQ ID NO: 2997860 - protein, 19 aa, Entamoeba invadens
GIFVTRFPPEPNGYLHIGH

SEQ ID NO: 2997861 - protein, 20 aa, Entamoeba invadens
GIFVVLMKVFATYNALYPQT

SEQ ID NO: 2997862 - protein, 18 aa, Entamoeba invadens
GIGFICLECSKIVMYHMQ

SEQ ID NO: 2997863 - protein, 23 aa, Entamoeba invadens
GIGNAMYVGFSFAPLASPPADQT

SEQ ID NO: 2997864 - protein, 24 aa, Entamoeba invadens
GIGPLYVKKIFITLSNIFVTLPKQ

SEQ ID NO: 2997865 - protein, 24 aa, Entamoeba invadens
GIGRAPTLIAIALIELGMDNSDAI

SEQ ID NO: 2997866 - protein, 17 aa, Entamoeba invadens
GIHCRVTVIQSFCNYFP

SEQ ID NO: 2997867 - protein, 17 aa, Entamoeba invadens
GIHDVDFWPVGDAGLLV

SEQ ID NO: 2997868 - protein, 24 aa, Entamoeba invadens
GIHSIPQFHNFQAVIGPNGAGKSN

SEQ ID NO: 2997869 - protein, 26 aa, Entamoeba invadens
GIIDNDMLLMQKIKFQTPDEQRILFL

SEQ ID NO: 2997870 - protein, 19 aa, Entamoeba invadens
GIIELKRMYSDGLLSVEAY

SEQ ID NO: 2997871 - protein, 22 aa, Entamoeba invadens
GIIITLWSYPVSVDCKVQLSGM

SEQ ID NO: 2997872 - protein, 20 aa, Entamoeba invadens
GIILIDFKKVDFFDIRNENI

SEQ ID NO: 2997873 - protein, 18 aa, Entamoeba invadens
GIINCVFSIGRVKALLAC

SEQ ID NO: 2997874 - protein, 24 aa, Entamoeba invadens
GIKDELLRSIYSFGFDKPSAIQQR

SEQ ID NO: 2997875 - protein, 20 aa, Entamoeba invadens
GIKFWMCADCETGMTLNLQL

SEQ ID NO: 2997876 - protein, 23 aa, Entamoeba invadens
GIKGLYFGDYGLASPLGYTVFSA

SEQ ID NO: 2997877 - protein, 26 aa, Entamoeba invadens
GIKHTLMQQVLLPKSLFEILEKLAEM

SEQ ID NO: 2997878 - protein, 26 aa, Entamoeba invadens
GIKKFHLQVTLLDKILTPLPLDEKSL

SEQ ID NO: 2997879 - protein, 25 aa, Entamoeba invadens
GIKKSGWYIPNPIYRSVQYLRKNDG

SEQ ID NO: 2997880 - protein, 24 aa, Entamoeba invadens
GIKLDKYIPGFNDGKGFLALCHAY

SEQ ID NO: 2997881 - protein, 29 aa, Entamoeba invadens
GIKQDPRLQFQWWFPLVESISAVEFHQNQ

SEQ ID NO: 2997882 - protein, 20 aa, Entamoeba invadens
GIKQFVFPNIEIYDHAFSGN

SEQ ID NO: 2997883 - protein, 25 aa, Entamoeba invadens
GIKRRISLRDFFPFKREEFPKLYEV

SEQ ID NO: 2997884 - protein, 26 aa, Entamoeba invadens
GILLESVGYLIFPLQFEFGGNDKMKI

SEQ ID NO: 2997885 - protein, 23 aa, Entamoeba invadens
GILNPIKFDLQFGQNRAFIVSVK

SEQ ID NO: 2997886 - protein, 18 aa, Entamoeba invadens
GILPIILTSFNNLSKSFL

SEQ ID NO: 2997887 - protein, 18 aa, Entamoeba invadens
GILVFLTGKREIEDVCTR

SEQ ID NO: 2997888 - protein, 20 aa, Entamoeba invadens
GILYSPKIEFIPFDMDVIIK

SEQ ID NO: 2997889 - protein, 23 aa, Entamoeba invadens
GIMHGCVALEWLYQSIMTKSMLD

SEQ ID NO: 2997890 - protein, 19 aa, Entamoeba invadens
GIMPPVVGGEEWPTRNQEG

SEQ ID NO: 2997891 - protein, 38 aa, Entamoeba invadens
GINAFGMCLSLLEIKIPKLVKIIPKWCFAECIKLSRVN

SEQ ID NO: 2997892 - protein, 20 aa, Entamoeba invadens
GINDDYYHKLFNPIIDRAME

SEQ ID NO: 2997893 - protein, 17 aa, Entamoeba invadens
GINLKICDFGHSSFIVT

SEQ ID NO: 2997894 - protein, 19 aa, Entamoeba invadens
GINVLRIINEPTAATIAYG

SEQ ID NO: 2997895 - protein, 19 aa, Entamoeba invadens
GINVLRIINEPTTAAIAYG

SEQ ID NO: 2997896 - protein, 42 aa, Entamoeba invadens
GINYIRIEKLFEDPLLPYQKMFFMYKFTVYSVSFGQWESTRV

SEQ ID NO: 2997897 - protein, 26 aa, Entamoeba invadens
GIPDGLIVTHFPFGPTAYFGLYNVVS

SEQ ID NO: 2997898 - protein, 17 aa, Entamoeba invadens
GIPNCQVCSTKKVGIPV

SEQ ID NO: 2997899 - protein, 38 aa, Entamoeba invadens
GIPYYPKGSVYPYIDGHPLVLLCQINFSEMPKLVNFPT

SEQ ID NO: 2997900 - protein, 19 aa, Entamoeba invadens
GIQIHVKFFVRNLDRYDDF

SEQ ID NO: 2997901 - protein, 18 aa, Entamoeba invadens
GIQQLPQWSMPLAPMNPQ

SEQ ID NO: 2997902 - protein, 26 aa, Entamoeba invadens
GIRALPVDIWLHVIPQIIARIQSSVP

SEQ ID NO: 2997903 - protein, 23 aa, Entamoeba invadens
GIRKLDLEYGDFPDDGYDYSKHF

SEQ ID NO: 2997904 - protein, 26 aa, Entamoeba invadens
GISASSYFAVLLLIVAGFKDSLLHDD

SEQ ID NO: 2997905 - protein, 25 aa, Entamoeba invadens
GISSFDSLCFLSRLFFGCVDESFIG

SEQ ID NO: 2997906 - protein, 25 aa, Entamoeba invadens
GISYSLPYLLEHCVRILQDLVIAIK

SEQ ID NO: 2997907 - protein, 29 aa, Entamoeba invadens
GITALKVALQLFLRQLPENSTFDVVSFGS

SEQ ID NO: 2997908 - protein, 21 aa, Entamoeba invadens
GITELGWIVLNVFLNAQHATQ

SEQ ID NO: 2997909 - protein, 29 aa, Entamoeba invadens
GITFVAIFIRVCMKFDFYECPLLLSEYFG

SEQ ID NO: 2997910 - protein, 33 aa, Entamoeba invadens
GITMYEVFGWCEAYPFTTFKFPWKIAEFVTAGK

SEQ ID NO: 2997911 - protein, 17 aa, Entamoeba invadens
GIVFDGKFDWTGFKGQK

SEQ ID NO: 2997912 - protein, 18 aa, Entamoeba invadens
GIVFDMNVLMVAPKGSLF

SEQ ID NO: 2997913 - protein, 43 aa, Entamoeba invadens
GIVGCDWDDLSAQELFALLSANLPPTGKLLSVGIYPSQFGIER

SEQ ID NO: 2997914 - protein, 30 aa, Entamoeba invadens
GIVKSWTDMELLWKYVFEEKLHVDTHGASV

SEQ ID NO: 2997915 - protein, 18 aa, Entamoeba invadens
GIVLLGMPKVGKTCVVDA

SEQ ID NO: 2997916 - protein, 23 aa, Entamoeba invadens
GIVLLMKTFLLRDKSVLKVFNQY

SEQ ID NO: 2997917 - protein, 30 aa, Entamoeba invadens
GIVLNILNSNPFMLQPMTPPSLVRANLYEE

SEQ ID NO: 2997918 - protein, 26 aa, Entamoeba invadens
GIVLRVDQIMFLPVQLRECAKNAVRF

SEQ ID NO: 2997919 - protein, 17 aa, Entamoeba invadens
GIVNRMYYHGLLVDGDN

SEQ ID NO: 2997920 - protein, 28 aa, Entamoeba invadens
GIVNYIKTAIRLFKKYDLWKILQESDLK

SEQ ID NO: 2997921 - protein, 33 aa, Entamoeba invadens
GIVQTKEQFKFLVDSLDYLLADIYGKQTKKTGS

SEQ ID NO: 2997922 - protein, 19 aa, Entamoeba invadens
GIWAALCWVSVLAGESEKA

SEQ ID NO: 2997923 - protein, 17 aa, Entamoeba invadens
GIWSWMGYSAEVNSQLS

SEQ ID NO: 2997924 - protein, 28 aa, Entamoeba invadens
GIYALERLRKAIPNFKLLCFEPEVVPAE

SEQ ID NO: 2997925 - protein, 17 aa, Entamoeba invadens
GIYHTNLDVLPLEFSGF

SEQ ID NO: 2997926 - protein, 25 aa, Entamoeba invadens
GIYLTFYSDYALFYSEQRKSNQMLL

SEQ ID NO: 2997927 - protein, 32 aa, Entamoeba invadens
GKAEPLMSSFYLGYNMLLNLMKLEASDPFLGA

SEQ ID NO: 2997928 - protein, 24 aa, Entamoeba invadens
GKAFARFQQCLTKEPFKKMVDEIA

SEQ ID NO: 2997929 - protein, 25 aa, Entamoeba invadens
GKAFFRPLLTPQCSSKLFGFYKEMV

SEQ ID NO: 2997930 - protein, 18 aa, Entamoeba invadens
GKASRAKYFQVGNGDLIV

SEQ ID NO: 2997931 - protein, 23 aa, Entamoeba invadens
GKAVEFEIFVTPLCTCSISETIA

SEQ ID NO: 2997932 - protein, 17 aa, Entamoeba invadens
GKAYIPFGAPEHLKMFN

SEQ ID NO: 2997933 - protein, 20 aa, Entamoeba invadens
GKCAFFFCSNLEEIYVKNKN

SEQ ID NO: 2997934 - protein, 21 aa, Entamoeba invadens
GKCKLYYIAHNDWNGWIPSFI

SEQ ID NO: 2997935 - protein, 25 aa, Entamoeba invadens
GKCLQFFPHPRPVTSVAFHPSEHIM

SEQ ID NO: 2997936 - protein, 22 aa, Entamoeba invadens
GKCYSCEPFGYYFNNRACLSCS

SEQ ID NO: 2997937 - protein, 23 aa, Entamoeba invadens
GKDADFPPYAFVKFTDEKSANLA

SEQ ID NO: 2997938 - protein, 21 aa, Entamoeba invadens
GKDCIIFGIEKKSIAKLQDPR

SEQ ID NO: 2997939 - protein, 26 aa, Entamoeba invadens
GKDELIALYTKYSGFSEVRYIKVRGS

SEQ ID NO: 2997940 - protein, 26 aa, Entamoeba invadens
GKDFIPLIDIMLSSLIELPFLSEVGL

SEQ ID NO: 2997941 - protein, 28 aa, Entamoeba invadens
GKDGIYDHALLVLPEFFKSFLEGDTMEK

SEQ ID NO: 2997942 - protein, 25 aa, Entamoeba invadens
GKDIAEGLLKAGFVFGSKLAEADVA

SEQ ID NO: 2997943 - protein, 19 aa, Entamoeba invadens
GKDPLSKNVPFKIKRRREH

SEQ ID NO: 2997944 - protein, 25 aa, Entamoeba invadens
GKEAIPFLPIQVDYLHLNLQTSNHN

SEQ ID NO: 2997945 - protein, 31 aa, Entamoeba invadens
GKEAQALLKRTLLFVNNIKQSFQYLDSMNEK

SEQ ID NO: 2997946 - protein, 23 aa, Entamoeba invadens
GKECFYFCINLSSVTLPLNVTTI

SEQ ID NO: 2997947 - protein, 26 aa, Entamoeba invadens
GKEDDGFYLMKLLVVLGTAVFKEISK

SEQ ID NO: 2997948 - protein, 23 aa, Entamoeba invadens
GKEDIFYTIRKFTTQMNKTCFTL

SEQ ID NO: 2997949 - protein, 21 aa, Entamoeba invadens
GKEDPLMVLNKSPSQFTPHTR

SEQ ID NO: 2997950 - protein, 18 aa, Entamoeba invadens
GKEGVLVLQLNRVRELSA

SEQ ID NO: 2997951 - protein, 24 aa, Entamoeba invadens
GKEIALVIRGIRTHFPKFLKDIND

SEQ ID NO: 2997952 - protein, 24 aa, Entamoeba invadens
GKEKLGYVFMWDAGSSVGEISGQT

SEQ ID NO: 2997953 - protein, 17 aa, Entamoeba invadens
GKELKACSKAWIAAQKE

SEQ ID NO: 2997954 - protein, 30 aa, Entamoeba invadens
GKEVDGRLLQLRWDRGFRAKVVDRDYKLLL

SEQ ID NO: 2997955 - protein, 21 aa, Entamoeba invadens
GKFHYNLISLNFKTLRYFPKI

SEQ ID NO: 2997956 - protein, 22 aa, Entamoeba invadens
GKGAIFKNLGIFVLGDGCGIGP

SEQ ID NO: 2997957 - protein, 22 aa, Entamoeba invadens
GKGIIATYAAFWYEESYKGDKV

SEQ ID NO: 2997958 - protein, 20 aa, Entamoeba invadens
GKGMPIKRTGKYGNLIVHFK

SEQ ID NO: 2997959 - protein, 24 aa, Entamoeba invadens
GKGMTTLSGMWKLLPDEEKEKYVT

SEQ ID NO: 2997960 - protein, 26 aa, Entamoeba invadens
GKGMYKIRIWRKPNVRLFGPLMDGMV

SEQ ID NO: 2997961 - protein, 24 aa, Entamoeba invadens
GKGQLKYFLPLSSAKGGLYLEKFL

SEQ ID NO: 2997962 - protein, 24 aa, Entamoeba invadens
GKGQLQHILPLIQTKGGLVFNKVL

SEQ ID NO: 2997963 - protein, 24 aa, Entamoeba invadens
GKGYLISNKKLIRFCLNGTPLDED

SEQ ID NO: 2997964 - protein, 21 aa, Entamoeba invadens
GKHVNWGIFSGPECLLVLGET

SEQ ID NO: 2997965 - protein, 26 aa, Entamoeba invadens
GKICLIHAHPFFIIKFIEENKRVKII

SEQ ID NO: 2997966 - protein, 34 aa, Entamoeba invadens
GKIEKNHLLFKQGDIYYCMICEFRGKKTTAYNHS

SEQ ID NO: 2997967 - protein, 31 aa, Entamoeba invadens
GKIFCEKCIFVWWEFQHKCVCPYCRGDFTDF

SEQ ID NO: 2997968 - protein, 26 aa, Entamoeba invadens
GKIFLGYAQSFLAYTNFYINHDKATE

SEQ ID NO: 2997969 - protein, 18 aa, Entamoeba invadens
GKIFPFMFDVTINEISVS

SEQ ID NO: 2997970 - protein, 17 aa, Entamoeba invadens
GKIGWIEKPIPECGPLD

SEQ ID NO: 2997971 - protein, 27 aa, Entamoeba invadens
GKIKELFTPLRTFTKLMFETSFKKSSN

SEQ ID NO: 2997972 - protein, 23 aa, Entamoeba invadens
GKIKRMFFSIKEASRLLLEANGV

SEQ ID NO: 2997973 - protein, 28 aa, Entamoeba invadens
GKILDRFRYNPILIKSTKLFPYMETQYL

SEQ ID NO: 2997974 - protein, 22 aa, Entamoeba invadens
GKILYDFLTPLKDTKALELKVQ

SEQ ID NO: 2997975 - protein, 26 aa, Entamoeba invadens
GKIREDALAYILFNANLRGSVAVLES

SEQ ID NO: 2997976 - protein, 25 aa, Entamoeba invadens
GKIVAFSAYYILPSSILNSYEYKEL

SEQ ID NO: 2997977 - protein, 23 aa, Entamoeba invadens
GKKAIHNSLLFPKKPKDEAYQFL

SEQ ID NO: 2997978 - protein, 22 aa, Entamoeba invadens
GKKALCICSISDCPFRNVAMSA

SEQ ID NO: 2997979 - protein, 36 aa, Entamoeba invadens
GKKCHNLHPKKLLCPLYFMGFCPYGKQCKYSHPSPA

SEQ ID NO: 2997980 - protein, 30 aa, Entamoeba invadens
GKKIEVPEGCMLNLLHFAYEGNEPTSVVLK

SEQ ID NO: 2997981 - protein, 18 aa, Entamoeba invadens
GKKIMIYTEEEEAIMAHE

SEQ ID NO: 2997982 - protein, 24 aa, Entamoeba invadens
GKKKYHQFVPIVRAFFDVMKDKVD

SEQ ID NO: 2997983 - protein, 23 aa, Entamoeba invadens
GKKLLITAVRLRHTAIACYLTVN

SEQ ID NO: 2997984 - protein, 20 aa, Entamoeba invadens
GKKLLMKYLCGIDAVPICID

SEQ ID NO: 2997985 - protein, 24 aa, Entamoeba invadens
GKKLTSIWYLREAVLALAANLNVS

SEQ ID NO: 2997986 - protein, 24 aa, Entamoeba invadens
GKKNCAYILFYQKKEPNYVIKSVT

SEQ ID NO: 2997987 - protein, 23 aa, Entamoeba invadens
GKKNIMFIIKTTEKEVFGSFNSE

SEQ ID NO: 2997988 - protein, 28 aa, Entamoeba invadens
GKKPVTVAAVIILFVCRYNNKYDFSMEK

SEQ ID NO: 2997989 - protein, 24 aa, Entamoeba invadens
GKKSVVLLMRMTNKNCYVVHFGNI

SEQ ID NO: 2997990 - protein, 17 aa, Entamoeba invadens
GKKTLIPLKLTNNEHME

SEQ ID NO: 2997991 - protein, 26 aa, Entamoeba invadens
GKLDNKYALEKTLTTIPKEELKVDPS

SEQ ID NO: 2997992 - protein, 25 aa, Entamoeba invadens
GKLETTLRFNFWDKITFKFEVDEIG

SEQ ID NO: 2997993 - protein, 18 aa, Entamoeba invadens
GKLFYAKLPLLDNGHIIS

SEQ ID NO: 2997994 - protein, 25 aa, Entamoeba invadens
GKLKPELFVPLIQSLHQFYCNTLTR

SEQ ID NO: 2997995 - protein, 20 aa, Entamoeba invadens
GKLLLRKMKELYKTIFSDHR

SEQ ID NO: 2997996 - protein, 20 aa, Entamoeba invadens
GKLLPILRKVLSSDANNFEF

SEQ ID NO: 2997997 - protein, 17 aa, Entamoeba invadens
GKLLPVVDTQFFVSPKL

SEQ ID NO: 2997998 - protein, 20 aa, Entamoeba invadens
GKLQFTFRPSDLFSSTFPVQ

SEQ ID NO: 2997999 - protein, 18 aa, Entamoeba invadens
GKMDQFIVFLIDIVIPLV

SEQ ID NO: 2998000 - protein, 31 aa, Entamoeba invadens
GKMGYGEGYLYPPMFDHVLQQSYLPKEIEGK

SEQ ID NO: 2998001 - protein, 25 aa, Entamoeba invadens
GKMLHILRILLPLENSFVVPKEFLS

SEQ ID NO: 2998002 - protein, 20 aa, Entamoeba invadens
GKMRPFVRAIGEFLVIGNSE

SEQ ID NO: 2998003 - protein, 20 aa, Entamoeba invadens
GKMTLDFHLQMLPKITRDQS

SEQ ID NO: 2998004 - protein, 18 aa, Entamoeba invadens
GKMYFCTLCLLNHPDFDR

SEQ ID NO: 2998005 - protein, 26 aa, Entamoeba invadens
GKNGRQYLCCGLASIYYAQLLKSGER

SEQ ID NO: 2998006 - protein, 29 aa, Entamoeba invadens
GKNKIIELNLLLLDILNMFGYTFSTEMSE

SEQ ID NO: 2998007 - protein, 24 aa, Entamoeba invadens
GKNMNIFGWYNSKKVPESGFIKND

SEQ ID NO: 2998008 - protein, 24 aa, Entamoeba invadens
GKNNDLFLLRISKVSQFKTTNNAG

SEQ ID NO: 2998009 - protein, 26 aa, Entamoeba invadens
GKNRSSFCFAPLLLEIRKAIRQIQGF

SEQ ID NO: 2998010 - protein, 26 aa, Entamoeba invadens
GKNVARIKGFPSILAVDVFKEYTKMK

SEQ ID NO: 2998011 - protein, 21 aa, Entamoeba invadens
GKNVFELFEFIGNLSLRQHEQ

SEQ ID NO: 2998012 - protein, 19 aa, Entamoeba invadens
GKNVRLRYYLRVTVNKKYS

SEQ ID NO: 2998013 - protein, 18 aa, Entamoeba invadens
GKPGEHFIIDVGSCIIKA

SEQ ID NO: 2998014 - protein, 18 aa, Entamoeba invadens
GKPKKLRKKTTQKMIIIG

SEQ ID NO: 2998015 - protein, 30 aa, Entamoeba invadens
GKPNLAFFFHTFDGNLLYYLDPHTTQNAVS

SEQ ID NO: 2998016 - protein, 25 aa, Entamoeba invadens
GKPRDVVSFLPFILQARKLTRQIEA

SEQ ID NO: 2998017 - protein, 34 aa, Entamoeba invadens
GKPRVNTEEFRFGKTKIFFKVGVLAEIEEIRENR

SEQ ID NO: 2998018 - protein, 19 aa, Entamoeba invadens
GKPWSIQPGSSFPLSICEF

SEQ ID NO: 2998019 - protein, 33 aa, Entamoeba invadens
GKQKNYSFYKIVIWFRVFYELTFKKSKVDIEFK

SEQ ID NO: 2998020 - protein, 23 aa, Entamoeba invadens
GKQTPIFLRPANSPEKKPIAFSP

SEQ ID NO: 2998021 - protein, 26 aa, Entamoeba invadens
GKQYQVWYRVSFFGMHGVGITSLIKK

SEQ ID NO: 2998022 - protein, 24 aa, Entamoeba invadens
GKRFKPCFVCGKLGHNTNKCPQKE

SEQ ID NO: 2998023 - protein, 17 aa, Entamoeba invadens
GKRIGLYLSTNETTKFR

SEQ ID NO: 2998024 - protein, 30 aa, Entamoeba invadens
GKRVMELFKENCKLLWALSEMKGFDEMISM

SEQ ID NO: 2998025 - protein, 21 aa, Entamoeba invadens
GKRYCINCYKLVSAMVCEKCK

SEQ ID NO: 2998026 - protein, 24 aa, Entamoeba invadens
GKRYKKCFALIISDAVIFLTNKSI

SEQ ID NO: 2998027 - protein, 23 aa, Entamoeba invadens
GKSAITLQLISSKFVMTYSPTIE

SEQ ID NO: 2998028 - protein, 18 aa, Entamoeba invadens
GKSALISQFLNRVIDPNT

SEQ ID NO: 2998029 - protein, 25 aa, Entamoeba invadens
GKSDSVYCIVYINSIYRPVCAEEQS

SEQ ID NO: 2998030 - protein, 25 aa, Entamoeba invadens
GKSEEIHRKMRCGFILSGGPAAGGH

SEQ ID NO: 2998031 - protein, 21 aa, Entamoeba invadens
GKSFNFMNRKQFCIHCGLCVC

SEQ ID NO: 2998032 - protein, 22 aa, Entamoeba invadens
GKSLVSLPFIPVETIKFQKDDY

SEQ ID NO: 2998033 - protein, 20 aa, Entamoeba invadens
GKSNLLLRFTRNEFDPDKRS

SEQ ID NO: 2998034 - protein, 18 aa, Entamoeba invadens
GKSPLLQDYYPYTHFIMD

SEQ ID NO: 2998035 - protein, 25 aa, Entamoeba invadens
GKSPRNFFGKLKKQIGGTSKEEPPP

SEQ ID NO: 2998036 - protein, 22 aa, Entamoeba invadens
GKSRIKIRFVQGHFVEVYDPVM

SEQ ID NO: 2998037 - protein, 22 aa, Entamoeba invadens
GKSSLCLMFVKGEFNIEYNPTI

SEQ ID NO: 2998038 - protein, 26 aa, Entamoeba invadens
GKSVLFKYLMFPEMKIPFESLVDYQK

SEQ ID NO: 2998039 - protein, 24 aa, Entamoeba invadens
GKSYRIQLGDRRYFRNITFTDTDP

SEQ ID NO: 2998040 - protein, 25 aa, Entamoeba invadens
GKTAAYLVPIIEKLGFHSEDGVRSI

SEQ ID NO: 2998041 - protein, 22 aa, Entamoeba invadens
GKTALIQQYKYGRAITIHNPTV

SEQ ID NO: 2998042 - protein, 29 aa, Entamoeba invadens
GKTDLPSLMLLAVKFVPQFYQLVDDYYKT

SEQ ID NO: 2998043 - protein, 22 aa, Entamoeba invadens
GKTDQFQKPFSDAYLKLQIGEV

SEQ ID NO: 2998044 - protein, 18 aa, Entamoeba invadens
GKTELDLTVIDWLRLQDY

SEQ ID NO: 2998045 - protein, 37 aa, Entamoeba invadens
GKTFSIADYQLYLPYLYILCYYLKIDVPKIKQHTDTA

SEQ ID NO: 2998046 - protein, 25 aa, Entamoeba invadens
GKTHKAVVPNLPPIKREPPPQPELQ

SEQ ID NO: 2998047 - protein, 21 aa, Entamoeba invadens
GKTILTFTPYLKLYSQYCQIF

SEQ ID NO: 2998048 - protein, 28 aa, Entamoeba invadens
GKTISYLLPGIVHLLNKPLAQSREGPTV

SEQ ID NO: 2998049 - protein, 23 aa, Entamoeba invadens
GKTLAYLLPVITKILENHPNIKR

SEQ ID NO: 2998050 - protein, 19 aa, Entamoeba invadens
GKTLFITFKIVLKKTCLCK

SEQ ID NO: 2998051 - protein, 24 aa, Entamoeba invadens
GKTQIDLWKKTQLIREREVVIMQR

SEQ ID NO: 2998052 - protein, 31 aa, Entamoeba invadens
GKTRELKIHLLVTKFYLLEITTIRQAQSFSF

SEQ ID NO: 2998053 - protein, 18 aa, Entamoeba invadens
GKTRITPRHIQLAVRSDL

SEQ ID NO: 2998054 - protein, 33 aa, Entamoeba invadens
GKTSIIQRFVTNKFDPIYKSTIGCDFLAKTVNV

SEQ ID NO: 2998055 - protein, 22 aa, Entamoeba invadens
GKTSLLLRFTENKFFKDITSTI

SEQ ID NO: 2998056 - protein, 20 aa, Entamoeba invadens
GKTSLLLRYTDNTFSDAFIA

SEQ ID NO: 2998057 - protein, 23 aa, Entamoeba invadens
GKTSSLKMLPTYAPIPTGKEVGT

SEQ ID NO: 2998058 - protein, 24 aa, Entamoeba invadens
GKTTILYHLKYYKYVDTIPTMGFN

SEQ ID NO: 2998059 - protein, 18 aa, Entamoeba invadens
GKTTILYRLQCGKVIPSM

SEQ ID NO: 2998060 - protein, 28 aa, Entamoeba invadens
GKTTTITKLALYYKNRGYKPSVVCADTF

SEQ ID NO: 2998061 - protein, 34 aa, Entamoeba invadens
GKTYAGRRLGYRITPAFADHFLRTLFSVPNSVMP

SEQ ID NO: 2998062 - protein, 19 aa, Entamoeba invadens
GKVFKGKALAVCGNLPNPK

SEQ ID NO: 2998063 - protein, 25 aa, Entamoeba invadens
GKVGRKYLLDTYKKFVLDIIHSGVS

SEQ ID NO: 2998064 - protein, 24 aa, Entamoeba invadens
GKVHPIVPIFKKGAFLKNLNDKTI

SEQ ID NO: 2998065 - protein, 17 aa, Entamoeba invadens
GKVIHALLDATSKSRNL

SEQ ID NO: 2998066 - protein, 22 aa, Entamoeba invadens
GKVKLPFKLLNEIQTQVFQSVV

SEQ ID NO: 2998067 - protein, 23 aa, Entamoeba invadens
GKVLFKDVIAFYKTKYKIEEERA

SEQ ID NO: 2998068 - protein, 20 aa, Entamoeba invadens
GKVMDYYFGRYNGPNGYLTK

SEQ ID NO: 2998069 - protein, 29 aa, Entamoeba invadens
GKVMFKPNCFFISFDKKGSIFGGYLKENI

SEQ ID NO: 2998070 - protein, 32 aa, Entamoeba invadens
GKVPEGWFQGFLIPILTGTTFWLELTFRNYPE

SEQ ID NO: 2998071 - protein, 17 aa, Entamoeba invadens
GKVQSYLRFLYEKDTCK

SEQ ID NO: 2998072 - protein, 18 aa, Entamoeba invadens
GKVRVSAEVFRRTLKLLM

SEQ ID NO: 2998073 - protein, 24 aa, Entamoeba invadens
GKVTLHDISFIKDTFREMVLLPSQ

SEQ ID NO: 2998074 - protein, 18 aa, Entamoeba invadens
GKWKPEIDEYALGTPFLL

SEQ ID NO: 2998075 - protein, 24 aa, Entamoeba invadens
GKWVPEEKIVLFKAICLLCSDISS

SEQ ID NO: 2998076 - protein, 22 aa, Entamoeba invadens
GKYAPFVCLEPWFGRCDTEYFD

SEQ ID NO: 2998077 - protein, 24 aa, Entamoeba invadens
GKYDVRVVPFFPSLVSYSPEEQKK

SEQ ID NO: 2998078 - protein, 19 aa, Entamoeba invadens
GKYEKDIAEIIRFICSANT

SEQ ID NO: 2998079 - protein, 17 aa, Entamoeba invadens
GKYEKDIAEITVRAETL

SEQ ID NO: 2998080 - protein, 18 aa, Entamoeba invadens
GKYEKDIAEITVRAVTLE

SEQ ID NO: 2998081 - protein, 24 aa, Entamoeba invadens
GKYGFCIPIFNTQIADCKYSLISQ

SEQ ID NO: 2998082 - protein, 21 aa, Entamoeba invadens
GKYGGSPFVYCQYGYGDVAQG

SEQ ID NO: 2998083 - protein, 22 aa, Entamoeba invadens
GKYLKAFDFPFKVDAFAIGMKE

SEQ ID NO: 2998084 - protein, 28 aa, Entamoeba invadens
GKYLKHNFFQFGFFCLRSKRYILKHMIL

SEQ ID NO: 2998085 - protein, 24 aa, Entamoeba invadens
GKYVIHFTHPPKKIDFSRENVNYS

SEQ ID NO: 2998086 - protein, 27 aa, Entamoeba invadens
GLAEFGGNFMTCDDLEWALSRVGAVET

SEQ ID NO: 2998087 - protein, 28 aa, Entamoeba invadens
GLAFSSFVIQYYGLVLDILLLGPKRAME

SEQ ID NO: 2998088 - protein, 25 aa, Entamoeba invadens
GLAIAHAVVLYTIKHIKPLLIVSTH

SEQ ID NO: 2998089 - protein, 21 aa, Entamoeba invadens
GLAKMPSVCGYIETVLEKEEK

SEQ ID NO: 2998090 - protein, 22 aa, Entamoeba invadens
GLALRIYFQLDYETNARRDCCF

SEQ ID NO: 2998091 - protein, 21 aa, Entamoeba invadens
GLAMLGIGKIGWIEKPIPECG

SEQ ID NO: 2998092 - protein, 27 aa, Entamoeba invadens
GLANPKWKATFVQLLATLPAESKVIYS

SEQ ID NO: 2998093 - protein, 23 aa, Entamoeba invadens
GLAQAMGRIIKFLPKQRRTGVFS

SEQ ID NO: 2998094 - protein, 21 aa, Entamoeba invadens
GLCFLYKINATKKAARLFYIL

SEQ ID NO: 2998095 - protein, 22 aa, Entamoeba invadens
GLCIKCYSKYFLNKEYPPKCES

SEQ ID NO: 2998096 - protein, 20 aa, Entamoeba invadens
GLDELAIIVWKDLNGYAFRV

SEQ ID NO: 2998097 - protein, 28 aa, Entamoeba invadens
GLDEVNMHRVFEKLNAHLTFQEMRNHMR

SEQ ID NO: 2998098 - protein, 26 aa, Entamoeba invadens
GLDFTPDFFCFLKYGTSKQLNMATMK

SEQ ID NO: 2998099 - protein, 17 aa, Entamoeba invadens
GLDIYPINESVVFNVYK

SEQ ID NO: 2998100 - protein, 19 aa, Entamoeba invadens
GLDLVSNMKALCSIFYFET

SEQ ID NO: 2998101 - protein, 27 aa, Entamoeba invadens
GLDTKQSFFVFSNRIPSPTQQCKRSSL

SEQ ID NO: 2998102 - protein, 35 aa, Entamoeba invadens
GLDVEKGHLLFWRQEYFYLRDELIADITKLLSDSE

SEQ ID NO: 2998103 - protein, 20 aa, Entamoeba invadens
GLDWKISVLDIIPTLLAQKS

SEQ ID NO: 2998104 - protein, 17 aa, Entamoeba invadens
GLEAMMDYSPEASLLAI

SEQ ID NO: 2998105 - protein, 35 aa, Entamoeba invadens
GLEKEPEIFLVKVFIKWFCKKSRLNDYNTKCGLNH

SEQ ID NO: 2998106 - protein, 18 aa, Entamoeba invadens
GLERYILKIANRIPQCQL

SEQ ID NO: 2998107 - protein, 17 aa, Entamoeba invadens
GLFDFNKSGQLFAFCHF

SEQ ID NO: 2998108 - protein, 17 aa, Entamoeba invadens
GLFEVIKGKLYQIRGFD

SEQ ID NO: 2998109 - protein, 18 aa, Entamoeba invadens
GLFGLKISSTMWDGSFPK

SEQ ID NO: 2998110 - protein, 29 aa, Entamoeba invadens
GLFISCALTTFVFPPKLMKIGDSCFSNGK

SEQ ID NO: 2998111 - protein, 22 aa, Entamoeba invadens
GLFKNFFAKHQGVKIEKEKKEA

SEQ ID NO: 2998112 - protein, 41 aa, Entamoeba invadens
GLFRKTSLLPATTWPWYKLISAIKLFTFPPGVNRFNRKRFS

SEQ ID NO: 2998113 - protein, 33 aa, Entamoeba invadens
GLFSVLSTTLERPPLYQGKVLYDFVMKNSECLS

SEQ ID NO: 2998114 - protein, 17 aa, Entamoeba invadens
GLFTLVKPTPRGLMLLE

SEQ ID NO: 2998115 - protein, 17 aa, Entamoeba invadens
GLFVLLYETIDQSRPET

SEQ ID NO: 2998116 - protein, 23 aa, Entamoeba invadens
GLGILTFEFLAGYAPLNPAEYWP

SEQ ID NO: 2998117 - protein, 30 aa, Entamoeba invadens
GLGKTLQTIALIWTLYKQCNVKKTVVVCPQ

SEQ ID NO: 2998118 - protein, 27 aa, Entamoeba invadens
GLGLDYFMMQIITLQLNLFSFSKEGGQ

SEQ ID NO: 2998119 - protein, 18 aa, Entamoeba invadens
GLGLPMFSRLLQLGHEPY

SEQ ID NO: 2998120 - protein, 26 aa, Entamoeba invadens
GLGMGAPQPGLGAKPPVLGQPGLGGM

SEQ ID NO: 2998121 - protein, 20 aa, Entamoeba invadens
GLGPKKLDVRMMLPMSVRCN

SEQ ID NO: 2998122 - protein, 47 aa, Entamoeba invadens
GLGQNNYMFINISNIPLILYIINSDLYTQFLTYKSVQGTLLMSDNYL

SEQ ID NO: 2998123 - protein, 31 aa, Entamoeba invadens
GLGTSSRIRWPLLQILKLKYCQLTELEDIFN

SEQ ID NO: 2998124 - protein, 21 aa, Entamoeba invadens
GLGYFRVPIFRECLLLDFETH

SEQ ID NO: 2998125 - protein, 17 aa, Entamoeba invadens
GLHAFVRSLRYLCRTPN

SEQ ID NO: 2998126 - protein, 17 aa, Entamoeba invadens
GLHHLYRCQGCGYALCS

SEQ ID NO: 2998127 - protein, 25 aa, Entamoeba invadens
GLIEGVYILRYLQRENLLLAINEEF

SEQ ID NO: 2998128 - protein, 17 aa, Entamoeba invadens
GLIFFNHGQFDGLENKL

SEQ ID NO: 2998129 - protein, 18 aa, Entamoeba invadens
GLISVLEDLTVSSLSTIV

SEQ ID NO: 2998130 - protein, 22 aa, Entamoeba invadens
GLITKIVLCYPVSYSSSKKEKR

SEQ ID NO: 2998131 - protein, 17 aa, Entamoeba invadens
GLITLRISMSRDAVFSR

SEQ ID NO: 2998132 - protein, 17 aa, Entamoeba invadens
GLIYIYDLDIPRTQIMI

SEQ ID NO: 2998133 - protein, 17 aa, Entamoeba invadens
GLKCAPGVIGFKKSIKS

SEQ ID NO: 2998134 - protein, 29 aa, Entamoeba invadens
GLKEPVVSSFLFKDDFYVSTNTKLFKIGK

SEQ ID NO: 2998135 - protein, 18 aa, Entamoeba invadens
GLKFYRYKSHTLIKHLIT

SEQ ID NO: 2998136 - protein, 26 aa, Entamoeba invadens
GLKIEFFRIIVWFNVDFETVNRNKNR

SEQ ID NO: 2998137 - protein, 41 aa, Entamoeba invadens
GLKKDDLWVVLPQEYPYKLSSRFYVVAALYHSPTSDGLMAV

SEQ ID NO: 2998138 - protein, 40 aa, Entamoeba invadens
GLKKTKFLLFYNFFPQLSRIFQPMVFPHFFLRCKELKKLF

SEQ ID NO: 2998139 - protein, 17 aa, Entamoeba invadens
GLKLFVYQLNTSVINET

SEQ ID NO: 2998140 - protein, 23 aa, Entamoeba invadens
GLKQVLKHLKEKQVKAIFICEDK

SEQ ID NO: 2998141 - protein, 20 aa, Entamoeba invadens
GLKTSLTLLRETYGQLFDCF

SEQ ID NO: 2998142 - protein, 18 aa, Entamoeba invadens
GLLFLQEHAITHGGLNST

SEQ ID NO: 2998143 - protein, 17 aa, Entamoeba invadens
GLLGLGTVRYEATEDDI

SEQ ID NO: 2998144 - protein, 22 aa, Entamoeba invadens
GLLGLVNKWEKYYEPRPLCLKE

SEQ ID NO: 2998145 - protein, 27 aa, Entamoeba invadens
GLLNNYCDITFIKPPKKAVLTHQFVKI

SEQ ID NO: 2998146 - protein, 17 aa, Entamoeba invadens
GLLSFTGLSNRATVIID

SEQ ID NO: 2998147 - protein, 17 aa, Entamoeba invadens
GLLSSICEVTIKQPAKK

SEQ ID NO: 2998148 - protein, 18 aa, Entamoeba invadens
GLLTHDYLIPFQQVVPFI

SEQ ID NO: 2998149 - protein, 24 aa, Entamoeba invadens
GLLVILDLIMNCFNKRFFGGNNEV

SEQ ID NO: 2998150 - protein, 20 aa, Entamoeba invadens
GLMTQLPREEPLVYKVNKTC

SEQ ID NO: 2998151 - protein, 17 aa, Entamoeba invadens
GLMTVNDFTTGKPLAII

SEQ ID NO: 2998152 - protein, 19 aa, Entamoeba invadens
GLNCLLITAFEVGEATFLD

SEQ ID NO: 2998153 - protein, 24 aa, Entamoeba invadens
GLNGYIYKVFNMKTTVSLLHYSEG

SEQ ID NO: 2998154 - protein, 18 aa, Entamoeba invadens
GLNKLYQLVVSMSDLMVQ

SEQ ID NO: 2998155 - protein, 29 aa, Entamoeba invadens
GLNKSLRPLAWRIFLGVLPSEFGEGWEKI

SEQ ID NO: 2998156 - protein, 27 aa, Entamoeba invadens
GLNLIGCSRLILFDPDWNPAKDKQAMA

SEQ ID NO: 2998157 - protein, 18 aa, Entamoeba invadens
GLNLPFSCDANFSKMAKG

SEQ ID NO: 2998158 - protein, 17 aa, Entamoeba invadens
GLNLSHVKHFPLVSIWS

SEQ ID NO: 2998159 - protein, 23 aa, Entamoeba invadens
GLNTLFNTILLPCNSFNPQINTT

SEQ ID NO: 2998160 - protein, 22 aa, Entamoeba invadens
GLNTQILALTSQLESLKKNNES

SEQ ID NO: 2998161 - protein, 22 aa, Entamoeba invadens
GLNVPISSLFIPSTVALCNKDC

SEQ ID NO: 2998162 - protein, 18 aa, Entamoeba invadens
GLPLIPDEHWEPLFAELG

SEQ ID NO: 2998163 - protein, 17 aa, Entamoeba invadens
GLPLQRGITVTSLSTSF

SEQ ID NO: 2998164 - protein, 20 aa, Entamoeba invadens
GLPLSCWIRFLYSHPAMVEK

SEQ ID NO: 2998165 - protein, 22 aa, Entamoeba invadens
GLPNLPIHGIIDWVVEKGGNEF

SEQ ID NO: 2998166 - protein, 17 aa, Entamoeba invadens
GLPPHELLLKVGSIVIL

SEQ ID NO: 2998167 - protein, 24 aa, Entamoeba invadens
GLPTSNLLEIFRTNSYQLLQQPEM

SEQ ID NO: 2998168 - protein, 33 aa, Entamoeba invadens
GLPVLEHGSFYFWMAYCPMIPKSEKLTQIVEKL

SEQ ID NO: 2998169 - protein, 25 aa, Entamoeba invadens
GLQKYHLMVVIPFLSSVEDASRFSQ

SEQ ID NO: 2998170 - protein, 18 aa, Entamoeba invadens
GLQQFGVFCLAKLFSYDS

SEQ ID NO: 2998171 - protein, 19 aa, Entamoeba invadens
GLQRQVTVILLGELVGDTQ

SEQ ID NO: 2998172 - protein, 23 aa, Entamoeba invadens
GLRDRLVLQWLIDQTKVGPLKKT

SEQ ID NO: 2998173 - protein, 29 aa, Entamoeba invadens
GLRVEEGVLKKVYFWHQGLGFSFVHNGEE

SEQ ID NO: 2998174 - protein, 28 aa, Entamoeba invadens
GLRVIEGVLKKVFFWHQGLGFTFVHNGE

SEQ ID NO: 2998175 - protein, 20 aa, Entamoeba invadens
GLRVVLPQVAITRELFDYFA

SEQ ID NO: 2998176 - protein, 29 aa, Entamoeba invadens
GLSELNFPEVYLLEGGFKYFYENVNELCT

SEQ ID NO: 2998177 - protein, 26 aa, Entamoeba invadens
GLSGLQKQYYRWIITKNESALKKAVK

SEQ ID NO: 2998178 - protein, 19 aa, Entamoeba invadens
GLSHHWSSFKIKFSPDKID

SEQ ID NO: 2998179 - protein, 18 aa, Entamoeba invadens
GLSHLFEIGFYLKSARDF

SEQ ID NO: 2998180 - protein, 19 aa, Entamoeba invadens
GLSIYELNFIRLSDALKTW

SEQ ID NO: 2998181 - protein, 17 aa, Entamoeba invadens
GLSKHVLQGILHKGFKV

SEQ ID NO: 2998182 - protein, 24 aa, Entamoeba invadens
GLSNMFSFVFFPENTPTALVPLSK

SEQ ID NO: 2998183 - protein, 20 aa, Entamoeba invadens
GLSRKLGGVKFFFCSAKNGE

SEQ ID NO: 2998184 - protein, 20 aa, Entamoeba invadens
GLSWGYLFGINGLNLDPKRV

SEQ ID NO: 2998185 - protein, 18 aa, Entamoeba invadens
GLTEYMSRLLRTCGYIYR

SEQ ID NO: 2998186 - protein, 29 aa, Entamoeba invadens
GLTGSLFEPYLKPYFNNGYLPVTQGDCIQ

SEQ ID NO: 2998187 - protein, 26 aa, Entamoeba invadens
GLTIYKLMNFLNTSGIFVLLPTPKKP

SEQ ID NO: 2998188 - protein, 18 aa, Entamoeba invadens
GLTTFLGCVILKIKGDAD

SEQ ID NO: 2998189 - protein, 17 aa, Entamoeba invadens
GLTTQQLVISNEAEIVL

SEQ ID NO: 2998190 - protein, 17 aa, Entamoeba invadens
GLTTYILDTFPERLNFQ

SEQ ID NO: 2998191 - protein, 18 aa, Entamoeba invadens
GLTYWSPIEKSFTFISPY

SEQ ID NO: 2998192 - protein, 18 aa, Entamoeba invadens
GLVAFPTETVYGLGADVF

SEQ ID NO: 2998193 - protein, 20 aa, Entamoeba invadens
GLVGYVKIVNIFDSSVMCEG

SEQ ID NO: 2998194 - protein, 20 aa, Entamoeba invadens
GLVKLVCKAKRFGNKCFYDC

SEQ ID NO: 2998195 - protein, 17 aa, Entamoeba invadens
GLVLVPDTLRNPLKTTT

SEQ ID NO: 2998196 - protein, 26 aa, Entamoeba invadens
GLVNNALFLLDKILRTVSLPFTENVV

SEQ ID NO: 2998197 - protein, 20 aa, Entamoeba invadens
GLVPNSVLCVVLTKPPTPKT

SEQ ID NO: 2998198 - protein, 19 aa, Entamoeba invadens
GLVPRCLELLFQKKQRNLE

SEQ ID NO: 2998199 - protein, 27 aa, Entamoeba invadens
GLVQKHIITVYMLLASLFEVNLSNEAD

SEQ ID NO: 2998200 - protein, 35 aa, Entamoeba invadens
GLVTDDRIWFRARMQIVNVMLPDGSQKKMMLDVCQ

SEQ ID NO: 2998201 - protein, 21 aa, Entamoeba invadens
GLVTQIWEWGCSHMMSGLQGW

SEQ ID NO: 2998202 - protein, 20 aa, Entamoeba invadens
GLVYPPRIDYVPGTEFLGEV

SEQ ID NO: 2998203 - protein, 18 aa, Entamoeba invadens
GLYFIDYLDEMKNTNSSV

SEQ ID NO: 2998204 - protein, 18 aa, Entamoeba invadens
GLYGIKFWMSVDSETGMV

SEQ ID NO: 2998205 - protein, 22 aa, Entamoeba invadens
GLYKNFVDITYALRVTEKTLNQ

SEQ ID NO: 2998206 - protein, 20 aa, Entamoeba invadens
GLYTVPPTYIAHQLFEHFVR

SEQ ID NO: 2998207 - protein, 28 aa, Entamoeba invadens
GLYVNSQPFYLFPSNLRGKKVIFKSPSH

SEQ ID NO: 2998208 - protein, 25 aa, Entamoeba invadens
GMACQWNMPLSRFTAMVKFGPLSHT

SEQ ID NO: 2998209 - protein, 24 aa, Entamoeba invadens
GMAIFKKQWFLEKIKKLRITPVIA

SEQ ID NO: 2998210 - protein, 24 aa, Entamoeba invadens
GMCLSCETNYVFTQPISRKCESCQ

SEQ ID NO: 2998211 - protein, 21 aa, Entamoeba invadens
GMDGGWFMITDHTPTIVNLIS

SEQ ID NO: 2998212 - protein, 19 aa, Entamoeba invadens
GMDGLLVWVNAMLEGSGIQ

SEQ ID NO: 2998213 - protein, 17 aa, Entamoeba invadens
GMDVGQVGFFNEKLRKY

SEQ ID NO: 2998214 - protein, 21 aa, Entamoeba invadens
GMEEPFRKLFERGMKICLSTD

SEQ ID NO: 2998215 - protein, 22 aa, Entamoeba invadens
GMEKYQLLHKYAQYAFHCFTDD

SEQ ID NO: 2998216 - protein, 21 aa, Entamoeba invadens
GMENGWFRERFSRTLGGGVGI

SEQ ID NO: 2998217 - protein, 23 aa, Entamoeba invadens
GMERVFLTCTVVHDFIAEGPEEM

SEQ ID NO: 2998218 - protein, 37 aa, Entamoeba invadens
GMETKRMNFFKEMNKNQLFALLKASITLDVESLTEMT

SEQ ID NO: 2998219 - protein, 22 aa, Entamoeba invadens
GMFSMGLLRILPKHIKNIVIGL

SEQ ID NO: 2998220 - protein, 23 aa, Entamoeba invadens
GMGCTAVVALIIDNKIYCGNAGD

SEQ ID NO: 2998221 - protein, 32 aa, Entamoeba invadens
GMGRILKMLLGLYTPSPILPLGAVIFRISNSS

SEQ ID NO: 2998222 - protein, 19 aa, Entamoeba invadens
GMIQKMVDFFWNVGAPENE

SEQ ID NO: 2998223 - protein, 23 aa, Entamoeba invadens
GMIRMIMTCLRSVYQNMDVQLIP

SEQ ID NO: 2998224 - protein, 19 aa, Entamoeba invadens
GMISFQQALPLYLAQKMDS

SEQ ID NO: 2998225 - protein, 18 aa, Entamoeba invadens
GMIVSKYFTRLVDYFVFS

SEQ ID NO: 2998226 - protein, 19 aa, Entamoeba invadens
GMKIWCFNAGHILGAAMFC

SEQ ID NO: 2998227 - protein, 28 aa, Entamoeba invadens
GMKVDIWSLGVVFYLLVTGEYPFGDDTL

SEQ ID NO: 2998228 - protein, 19 aa, Entamoeba invadens
GMMLMDFYRELAMQQLVSA

SEQ ID NO: 2998229 - protein, 24 aa, Entamoeba invadens
GMNDKMILFEFGVGRGTPVHIRFP

SEQ ID NO: 2998230 - protein, 25 aa, Entamoeba invadens
GMNTLKGFELLGNGEKLLSVLRPVS

SEQ ID NO: 2998231 - protein, 17 aa, Entamoeba invadens
GMPFSINGVQFFDYMLF

SEQ ID NO: 2998232 - protein, 24 aa, Entamoeba invadens
GMPGAQKFLLLQKLNINNSIPHNI

SEQ ID NO: 2998233 - protein, 18 aa, Entamoeba invadens
GMPLAMVFVSSFNSVIRL

SEQ ID NO: 2998234 - protein, 28 aa, Entamoeba invadens
GMQWAYCVRTRLFLFKTNETLEHAYDTF

SEQ ID NO: 2998235 - protein, 26 aa, Entamoeba invadens
GMRIREWYGWHFPELSKFVADQLSYC

SEQ ID NO: 2998236 - protein, 17 aa, Entamoeba invadens
GMRIYLSTSLNTPCICE

SEQ ID NO: 2998237 - protein, 29 aa, Entamoeba invadens
GMRNIKRETAILSAKYDNARAEIAALKSE

SEQ ID NO: 2998238 - protein, 20 aa, Entamoeba invadens
GMSADYMLAAQLGATYVRVG

SEQ ID NO: 2998239 - protein, 22 aa, Entamoeba invadens
GMSRVYYSGSLGALIMCDVTKM

SEQ ID NO: 2998240 - protein, 24 aa, Entamoeba invadens
GMTAIPNYFLANCGNLATVINSDN

SEQ ID NO: 2998241 - protein, 31 aa, Entamoeba invadens
GMTAPATIRNELLTGMKIYVGGKTKIQNHTI

SEQ ID NO: 2998242 - protein, 19 aa, Entamoeba invadens
GMTFALHLLELITSNKADI

SEQ ID NO: 2998243 - protein, 18 aa, Entamoeba invadens
GMTGIILASSTILLDGDT

SEQ ID NO: 2998244 - protein, 28 aa, Entamoeba invadens
GMTKSLLYKFQPFYKYLDSVIVTGLQNL

SEQ ID NO: 2998245 - protein, 25 aa, Entamoeba invadens
GMTPEELIISLDKYSKNILPDNVKS

SEQ ID NO: 2998246 - protein, 34 aa, Entamoeba invadens
GMTVKLYEYFNPVFKQPFCFNAFDYSLGEFFSQL

SEQ ID NO: 2998247 - protein, 23 aa, Entamoeba invadens
GMVALFVALLYNKMTSATVLIKE

SEQ ID NO: 2998248 - protein, 22 aa, Entamoeba invadens
GMVKIVIETKFKFSIQIKFKDN

SEQ ID NO: 2998249 - protein, 21 aa, Entamoeba invadens
GMVLYVMLYGKRMTPENYPED

SEQ ID NO: 2998250 - protein, 18 aa, Entamoeba invadens
GMVSGFKDVFKKEKKEMN

SEQ ID NO: 2998251 - protein, 23 aa, Entamoeba invadens
GMVSKLAFFPNDANLILIGTEDN

SEQ ID NO: 2998252 - protein, 50 aa, Entamoeba invadens
GMVVRPLLLVEGALSSIFYSSDYLYIVLSTFLLEIYKNGELLKKVDFSKI

SEQ ID NO: 2998253 - protein, 27 aa, Entamoeba invadens
GMVVSKYFLSMIDFINFTLVNTKFKDN

SEQ ID NO: 2998254 - protein, 25 aa, Entamoeba invadens
GNAFKALQALTFSLLPPGDSVTADV

SEQ ID NO: 2998255 - protein, 21 aa, Entamoeba invadens
GNALLFLLESEVEYIEMLRKA

SEQ ID NO: 2998256 - protein, 17 aa, Entamoeba invadens
GNALRILAKIISTFQVE

SEQ ID NO: 2998257 - protein, 30 aa, Entamoeba invadens
GNATQTLYSFWLYDFCDVFLEASKPTFRGK

SEQ ID NO: 2998258 - protein, 22 aa, Entamoeba invadens
GNAVFIVSMILENLDFLNTNDI

SEQ ID NO: 2998259 - protein, 21 aa, Entamoeba invadens
GNCAFKNCQFLRKVVLDDNVE

SEQ ID NO: 2998260 - protein, 32 aa, Entamoeba invadens
GNCKALKEIILPPKLMYVDEKLAFEGCDNLKK

SEQ ID NO: 2998261 - protein, 25 aa, Entamoeba invadens
GNCKDRVLIPYDLLDRYPSLSVVDE

SEQ ID NO: 2998262 - protein, 21 aa, Entamoeba invadens
GNDFFWVHGVNRRITRCLEFF

SEQ ID NO: 2998263 - protein, 26 aa, Entamoeba invadens
GNDIMRIFCDILYQTVVYKDHRTFTE

SEQ ID NO: 2998264 - protein, 18 aa, Entamoeba invadens
GNDIRAVSFLPINITEKA

SEQ ID NO: 2998265 - protein, 19 aa, Entamoeba invadens
GNDKQKMLTRRLASILKKI

SEQ ID NO: 2998266 - protein, 22 aa, Entamoeba invadens
GNDKQKMLTRRLASNLKKIEQN

SEQ ID NO: 2998267 - protein, 23 aa, Entamoeba invadens
GNDKQKMLTRRLASTLKKIEQNK

SEQ ID NO: 2998268 - protein, 28 aa, Entamoeba invadens
GNDKTVVNYIFWRYVDPLSNVRDEDVKR

SEQ ID NO: 2998269 - protein, 30 aa, Entamoeba invadens
GNDLEFVDYLFLAMVIYIREPILKSLQYST

SEQ ID NO: 2998270 - protein, 17 aa, Entamoeba invadens
GNDLFNALSDGVLLYHL

SEQ ID NO: 2998271 - protein, 20 aa, Entamoeba invadens
GNDNMRFEYVNVNKDDSGLT

SEQ ID NO: 2998272 - protein, 27 aa, Entamoeba invadens
GNDPMKRYTLDLLMKVFLEETSFTKYQ

SEQ ID NO: 2998273 - protein, 24 aa, Entamoeba invadens
GNDREFLLKIQFTTQVDEEKFELN

SEQ ID NO: 2998274 - protein, 17 aa, Entamoeba invadens
GNDVNLPLVFPVEVPRC

SEQ ID NO: 2998275 - protein, 25 aa, Entamoeba invadens
GNEAFRCTEPFFQPSLIGKEMAGLP

SEQ ID NO: 2998276 - protein, 25 aa, Entamoeba invadens
GNEGFLMMIFYYLGCEITLKRTLKE

SEQ ID NO: 2998277 - protein, 17 aa, Entamoeba invadens
GNEILFRRVLVAYSKIA

SEQ ID NO: 2998278 - protein, 25 aa, Entamoeba invadens
GNEISYYMLVVGAFLLNGCSTKEKY

SEQ ID NO: 2998279 - protein, 26 aa, Entamoeba invadens
GNENATRIWLAKWTTAEFPIPESGNE

SEQ ID NO: 2998280 - protein, 29 aa, Entamoeba invadens
GNEPPKYPAFQPMALFPLNMVLSTNRTPI

SEQ ID NO: 2998281 - protein, 27 aa, Entamoeba invadens
GNEPSLQWFFKHFSPDTFDINYYVYDN

SEQ ID NO: 2998282 - protein, 24 aa, Entamoeba invadens
GNFAFEMCIQLKELVFNNNVVFQD

SEQ ID NO: 2998283 - protein, 18 aa, Entamoeba invadens
GNFAFYNCLNLKEVILPK

SEQ ID NO: 2998284 - protein, 18 aa, Entamoeba invadens
GNFAFYNCLNLKEVILPT

SEQ ID NO: 2998285 - protein, 24 aa, Entamoeba invadens
GNFDPLTMVCKGASYYSFMQNDTV

SEQ ID NO: 2998286 - protein, 32 aa, Entamoeba invadens
GNFMNQAFLMSYINYFQQLTSLQPYQKKKSNG

SEQ ID NO: 2998287 - protein, 25 aa, Entamoeba invadens
GNGNGFFGVPPFVASPKPDVKIIPV

SEQ ID NO: 2998288 - protein, 17 aa, Entamoeba invadens
GNHFKFEKSIFGRKFVK

SEQ ID NO: 2998289 - protein, 21 aa, Entamoeba invadens
GNIFTVSYFLSFDFFNIQGDK

SEQ ID NO: 2998290 - protein, 20 aa, Entamoeba invadens
GNIIERKFYGVHCPAHRCNL

SEQ ID NO: 2998291 - protein, 30 aa, Entamoeba invadens
GNIIGNPKWYENPQYLLTLSSKMHVKICLK

SEQ ID NO: 2998292 - protein, 27 aa, Entamoeba invadens
GNIKKQFYTVFPLFQNNAIQVQAGIVS

SEQ ID NO: 2998293 - protein, 22 aa, Entamoeba invadens
GNIPQIWGFQFTFAKELEDTLL

SEQ ID NO: 2998294 - protein, 22 aa, Entamoeba invadens
GNIQKYSIQLLRKLMSAKEGLQ

SEQ ID NO: 2998295 - protein, 25 aa, Entamoeba invadens
GNKAYSFVQIHYLGWPDMGVPKHPE

SEQ ID NO: 2998296 - protein, 19 aa, Entamoeba invadens
GNKEDVIWLLRSLGSDDGA

SEQ ID NO: 2998297 - protein, 18 aa, Entamoeba invadens
GNKFYRAIMSKTRFLQIV

SEQ ID NO: 2998298 - protein, 24 aa, Entamoeba invadens
GNKINSILLERALFLDKSQATLLY

SEQ ID NO: 2998299 - protein, 25 aa, Entamoeba invadens
GNKWTVIQHFLPGRSPNNIKNRWFS

SEQ ID NO: 2998300 - protein, 21 aa, Entamoeba invadens
GNLCFYYLTVAFPEAPVLANP

SEQ ID NO: 2998301 - protein, 33 aa, Entamoeba invadens
GNLDIPQYPAFNPLVIFPLSVILSTNQVRLGLP

SEQ ID NO: 2998302 - protein, 20 aa, Entamoeba invadens
GNLFLTTCQYNKALTLLFDV

SEQ ID NO: 2998303 - protein, 24 aa, Entamoeba invadens
GNLLTTHLPLLKPNLKIENLKIMT

SEQ ID NO: 2998304 - protein, 19 aa, Entamoeba invadens
GNLPVVFLIEDSHYDVHRS

SEQ ID NO: 2998305 - protein, 17 aa, Entamoeba invadens
GNLVFGVCVSLKEVAYS

SEQ ID NO: 2998306 - protein, 24 aa, Entamoeba invadens
GNMEKFHFNPIPLNCNTLGYFPNI

SEQ ID NO: 2998307 - protein, 30 aa, Entamoeba invadens
GNMFYFGDNKFLNLKYRDLVRYDGGISSAG

SEQ ID NO: 2998308 - protein, 33 aa, Entamoeba invadens
GNMKKFHFNPIPLNSKTFRYFPNIETLHLWSKD

SEQ ID NO: 2998309 - protein, 24 aa, Entamoeba invadens
GNMKKFHFNPIPLTCKTINYFPNI

SEQ ID NO: 2998310 - protein, 17 aa, Entamoeba invadens
GNMLVLDPQKRLGFATC

SEQ ID NO: 2998311 - protein, 25 aa, Entamoeba invadens
GNMSRFHFNPIPLTKTTIKYFSRIE

SEQ ID NO: 2998312 - protein, 22 aa, Entamoeba invadens
GNNHLILTYVLRPKDKKILKDT

SEQ ID NO: 2998313 - protein, 20 aa, Entamoeba invadens
GNNHLILTYVLRPKNKGLLV

SEQ ID NO: 2998314 - protein, 24 aa, Entamoeba invadens
GNNIIVVGYFTMKTSRVLPADNHL

SEQ ID NO: 2998315 - protein, 22 aa, Entamoeba invadens
GNNIIVVGYFTMKTSRVLPTDN

SEQ ID NO: 2998316 - protein, 29 aa, Entamoeba invadens
GNNIQLAFSLPITLIRYVQPNPNVAFLNE

SEQ ID NO: 2998317 - protein, 18 aa, Entamoeba invadens
GNNISLHLKIYLANKDTI

SEQ ID NO: 2998318 - protein, 17 aa, Entamoeba invadens
GNNLPPIVTSLGEWCFN

SEQ ID NO: 2998319 - protein, 25 aa, Entamoeba invadens
GNNRKNVILYLYDNSSILGDDLLGF

SEQ ID NO: 2998320 - protein, 33 aa, Entamoeba invadens
GNNSVGMAQIYLLKYNILDCLLNNFYQLQVKEN

SEQ ID NO: 2998321 - protein, 26 aa, Entamoeba invadens
GNPIADFYEMLLYNNTIIHCMCDGCG

SEQ ID NO: 2998322 - protein, 24 aa, Entamoeba invadens
GNPIALEISVLRYGYGYDVFNEGL

SEQ ID NO: 2998323 - protein, 24 aa, Entamoeba invadens
GNPKSILVFVIGGITLGEIATLRN

SEQ ID NO: 2998324 - protein, 24 aa, Entamoeba invadens
GNPSDICLIIPNSIFRITMNTQFL

SEQ ID NO: 2998325 - protein, 26 aa, Entamoeba invadens
GNQKKIIVPFILLKGVNDLETVYMLV

SEQ ID NO: 2998326 - protein, 23 aa, Entamoeba invadens
GNQRFLMTVLDPAVTPGASQKDI

SEQ ID NO: 2998327 - protein, 22 aa, Entamoeba invadens
GNQTYFFVYNLIEELDEEGEYY

SEQ ID NO: 2998328 - protein, 25 aa, Entamoeba invadens
GNQVLRFYRRIIRDFLTRNYSASHT

SEQ ID NO: 2998329 - protein, 19 aa, Entamoeba invadens
GNQWSYIRKHLPGRTANDI

SEQ ID NO: 2998330 - protein, 33 aa, Entamoeba invadens
GNRHKPYSTQLWNIKYIPDLVWTKIFEDTEAKD

SEQ ID NO: 2998331 - protein, 17 aa, Entamoeba invadens
GNRLNAMLTAYKQCFRL

SEQ ID NO: 2998332 - protein, 23 aa, Entamoeba invadens
GNRNILLLYIDVSSGSGIKTSCE

SEQ ID NO: 2998333 - protein, 25 aa, Entamoeba invadens
GNRREFQPPPPLQSPFVICQQPFSQ

SEQ ID NO: 2998334 - protein, 44 aa, Entamoeba invadens
GNSENFVNNFCYIKRIIGLPYERIRYPEFFPFQINSKGTDEPTI

SEQ ID NO: 2998335 - protein, 33 aa, Entamoeba invadens
GNSKGSVFLFTLKSPIMGVYLHKYTPKSIEDGI

SEQ ID NO: 2998336 - protein, 20 aa, Entamoeba invadens
GNSMCKLLFALDKVVCTQPI

SEQ ID NO: 2998337 - protein, 26 aa, Entamoeba invadens
GNSRTQCFEPLFNPQLCSMSCNGLSQ

SEQ ID NO: 2998338 - protein, 23 aa, Entamoeba invadens
GNTFNVIMATCTLFHNSKGYDEK

SEQ ID NO: 2998339 - protein, 24 aa, Entamoeba invadens
GNTIQYYVPVLSIVDRELLEPGVQ

SEQ ID NO: 2998340 - protein, 32 aa, Entamoeba invadens
GNTLEENIYLLSTMLYVLHKDKVEKFEKRGDL

SEQ ID NO: 2998341 - protein, 25 aa, Entamoeba invadens
GNTRLVLMLRQLGYEAIPLNGKMSQ

SEQ ID NO: 2998342 - protein, 22 aa, Entamoeba invadens
GNVCFLTIMKGEFNSIYIGDCQ

SEQ ID NO: 2998343 - protein, 26 aa, Entamoeba invadens
GNVEEAIFLNIYFEKLELGIVVNLEI

SEQ ID NO: 2998344 - protein, 23 aa, Entamoeba invadens
GNVMFTDIIITDPLTQINDECIN

SEQ ID NO: 2998345 - protein, 22 aa, Entamoeba invadens
GNVNVFTYYPKVFDASKEKYFN

SEQ ID NO: 2998346 - protein, 32 aa, Entamoeba invadens
GNVNVPMDLRIPSPFPLFQDFYNTFDFTKMDK

SEQ ID NO: 2998347 - protein, 27 aa, Entamoeba invadens
GNVPKIPIDPILLEKAKQTNTVEINSK

SEQ ID NO: 2998348 - protein, 25 aa, Entamoeba invadens
GNVTDFMFDLFNDDKVYICGEDGKI

SEQ ID NO: 2998349 - protein, 24 aa, Entamoeba invadens
GNVYAYFTSFKTDSTFYYVSCPSC

SEQ ID NO: 2998350 - protein, 23 aa, Entamoeba invadens
GNVYGQYFYLREVRMLSSLKREP

SEQ ID NO: 2998351 - protein, 26 aa, Entamoeba invadens
GNVYPTWFVNKMSRALRLTETPLSCR

SEQ ID NO: 2998352 - protein, 26 aa, Entamoeba invadens
GNYAIRPRTLMKFLALLNTKNCSQDL

SEQ ID NO: 2998353 - protein, 19 aa, Entamoeba invadens
GNYNYLNFDFIFSKVRDGF

SEQ ID NO: 2998354 - protein, 25 aa, Entamoeba invadens
GNYSFAYTALSSFIASKLTSVYLKG

SEQ ID NO: 2998355 - protein, 22 aa, Entamoeba invadens
GNYTFLNCVNLQRIYLPKKREQ

SEQ ID NO: 2998356 - protein, 21 aa, Entamoeba invadens
GNYVIQKLFEFGTKEIRDVFM

SEQ ID NO: 2998357 - protein, 24 aa, Entamoeba invadens
GPACFFGCLHMSDILLPKSLCLFG

SEQ ID NO: 2998358 - protein, 24 aa, Entamoeba invadens
GPAGLAAAYFLRRKGHKVVVYEQK

SEQ ID NO: 2998359 - protein, 17 aa, Entamoeba invadens
GPARWCYSGKRCTKEFS

SEQ ID NO: 2998360 - protein, 18 aa, Entamoeba invadens
GPCKVPLTTPLKDMKMET

SEQ ID NO: 2998361 - protein, 24 aa, Entamoeba invadens
GPCPKSLTLYYTADDFKAWMSDVI

SEQ ID NO: 2998362 - protein, 28 aa, Entamoeba invadens
GPDNAFFCFTFQNPFNTEPLKITKKTTS

SEQ ID NO: 2998363 - protein, 29 aa, Entamoeba invadens
GPEDPPYEYYLYYIYANMTVLNGIRRELK

SEQ ID NO: 2998364 - protein, 29 aa, Entamoeba invadens
GPEICLECRYLPYLIYLEQITEVQNYTIN

SEQ ID NO: 2998365 - protein, 21 aa, Entamoeba invadens
GPIALRLYNALTDIQYGIVKS

SEQ ID NO: 2998366 - protein, 26 aa, Entamoeba invadens
GPIEIESWIDLVDSIIVVWLNGEEHG

SEQ ID NO: 2998367 - protein, 22 aa, Entamoeba invadens
GPIVLLTPCDLIQYIKVYIESG

SEQ ID NO: 2998368 - protein, 27 aa, Entamoeba invadens
GPIVTSIRALLVPVPMKDIRVKTQYNV

SEQ ID NO: 2998369 - protein, 25 aa, Entamoeba invadens
GPKNPLVVRFIEKLFKMVNECRKGK

SEQ ID NO: 2998370 - protein, 20 aa, Entamoeba invadens
GPLASKGTWAATTDIGATEA

SEQ ID NO: 2998371 - protein, 24 aa, Entamoeba invadens
GPLELDIIAFLLRGIVEGVRYIHE

SEQ ID NO: 2998372 - protein, 22 aa, Entamoeba invadens
GPLPATFSLPLSTKRKVQKKRT

SEQ ID NO: 2998373 - protein, 25 aa, Entamoeba invadens
GPMHKRLFIGGIDRSITQQQLKEQF

SEQ ID NO: 2998374 - protein, 19 aa, Entamoeba invadens
GPNVVLFIGLVICNNIPMF

SEQ ID NO: 2998375 - protein, 24 aa, Entamoeba invadens
GPPDLFITFTANPNWREIKENLEK

SEQ ID NO: 2998376 - protein, 17 aa, Entamoeba invadens
GPPPKHSLELLKEIVDV

SEQ ID NO: 2998377 - protein, 35 aa, Entamoeba invadens
GPRFDNTMLHLLLSYIRKPVPPNKRLYIIATTCLA

SEQ ID NO: 2998378 - protein, 21 aa, Entamoeba invadens
GPRSFHPRKLLKFIQDKLVSD

SEQ ID NO: 2998379 - protein, 32 aa, Entamoeba invadens
GPRSVDVVLLVFALKVLYPDRFFLLRGNHESE

SEQ ID NO: 2998380 - protein, 17 aa, Entamoeba invadens
GPRVLLYLEKSPNFQNI

SEQ ID NO: 2998381 - protein, 23 aa, Entamoeba invadens
GPSCAYMLNFAFQNPKYKDSKTE

SEQ ID NO: 2998382 - protein, 24 aa, Entamoeba invadens
GPSKSMFEVGYIALLKTVFKQCTA

SEQ ID NO: 2998383 - protein, 19 aa, Entamoeba invadens
GPSTMRIKCQCQCSGGVVI

SEQ ID NO: 2998384 - protein, 23 aa, Entamoeba invadens
GPTKIGYLFRDALTVKAKKHQKD

SEQ ID NO: 2998385 - protein, 24 aa, Entamoeba invadens
GPTQNIFFDPLKTKVAIVTCGGLC

SEQ ID NO: 2998386 - protein, 29 aa, Entamoeba invadens
GPVDGIIDLFAPLPRFSVGVAQTRGLRQY

SEQ ID NO: 2998387 - protein, 18 aa, Entamoeba invadens
GPVMMEKVINSYLYLMCL

SEQ ID NO: 2998388 - protein, 30 aa, Entamoeba invadens
GPVQNADLEYLVLTNYSFRRDEKTGKLVVL

SEQ ID NO: 2998389 - protein, 19 aa, Entamoeba invadens
GPYIKYFVQSIGAEGLFKI

SEQ ID NO: 2998390 - protein, 17 aa, Entamoeba invadens
GQAYFMQIQIRSADEPM

SEQ ID NO: 2998391 - protein, 23 aa, Entamoeba invadens
GQCDLPFRRISGGSNIFAKSAGV

SEQ ID NO: 2998392 - protein, 23 aa, Entamoeba invadens
GQCLLCSNGFYSNGPQCVKCDTS

SEQ ID NO: 2998393 - protein, 23 aa, Entamoeba invadens
GQCLTCLSGYGLTSSSSCIICNP

SEQ ID NO: 2998394 - protein, 30 aa, Entamoeba invadens
GQDAKPVLRRLLLAYSIYNYNIGYVQGEHD

SEQ ID NO: 2998395 - protein, 25 aa, Entamoeba invadens
GQDYYAAMTRVYFSGAISALVVCDI

SEQ ID NO: 2998396 - protein, 23 aa, Entamoeba invadens
GQEHLLLGRVFNETFFAVETNVP

SEQ ID NO: 2998397 - protein, 28 aa, Entamoeba invadens
GQEIFGILYHIIEKYKFDIPVCGSGGVL

SEQ ID NO: 2998398 - protein, 18 aa, Entamoeba invadens
GQERFPLLPFGEICSRWS

SEQ ID NO: 2998399 - protein, 29 aa, Entamoeba invadens
GQERFRTIVPNYYRGVMGIAMIYDVTSKE

SEQ ID NO: 2998400 - protein, 24 aa, Entamoeba invadens
GQERYRSLIPNYIRGSSVVLIVYD

SEQ ID NO: 2998401 - protein, 22 aa, Entamoeba invadens
GQFEKLGMLFQKNYSGFRAEVK

SEQ ID NO: 2998402 - protein, 31 aa, Entamoeba invadens
GQFEPKEWQHDFLELLPKLSKGEKVDHPVFE

SEQ ID NO: 2998403 - protein, 20 aa, Entamoeba invadens
GQFNKGFIIGKKGEDLYIID

SEQ ID NO: 2998404 - protein, 25 aa, Entamoeba invadens
GQFQTRGIILLKLNSIARGNSIIQP

SEQ ID NO: 2998405 - protein, 22 aa, Entamoeba invadens
GQGNIMFCFETVKGDVFGCFDE

SEQ ID NO: 2998406 - protein, 24 aa, Entamoeba invadens
GQHKILWGVIMKYIVSLDSPKLFN

SEQ ID NO: 2998407 - protein, 39 aa, Entamoeba invadens
GQIEYVVHFSIFKKSGQLLDDLFVSMSYRNSKDGVLNQY

SEQ ID NO: 2998408 - protein, 26 aa, Entamoeba invadens
GQIINRHFLIKKEKQDFAFLAGAERS

SEQ ID NO: 2998409 - protein, 19 aa, Entamoeba invadens
GQIPYDDFLFIMSSVVQFP

SEQ ID NO: 2998410 - protein, 20 aa, Entamoeba invadens
GQISFDCFPTGWDKTFALNH

SEQ ID NO: 2998411 - protein, 21 aa, Entamoeba invadens
GQIWKFCLAYGYRIVTTILPT

SEQ ID NO: 2998412 - protein, 18 aa, Entamoeba invadens
GQIYIMDALATYGPTDPK

SEQ ID NO: 2998413 - protein, 17 aa, Entamoeba invadens
GQKGIILIDFKKVDFFD

SEQ ID NO: 2998414 - protein, 29 aa, Entamoeba invadens
GQKKFQDQAVWMLNAMWPKEQDKRAEELW

SEQ ID NO: 2998415 - protein, 25 aa, Entamoeba invadens
GQKKKLWANFLTKGIIEYVDADEEE

SEQ ID NO: 2998416 - protein, 23 aa, Entamoeba invadens
GQKLKLLRIKFSPNSADFQFLEK

SEQ ID NO: 2998417 - protein, 22 aa, Entamoeba invadens
GQLGFPIYVELVTYSVAMALYQ

SEQ ID NO: 2998418 - protein, 24 aa, Entamoeba invadens
GQLIQILEILAKKKCVVKASRMTV

SEQ ID NO: 2998419 - protein, 17 aa, Entamoeba invadens
GQLPLVIKTDCLCGTEI

SEQ ID NO: 2998420 - protein, 21 aa, Entamoeba invadens
GQMGFFKRTEVNKKIYRIGAG

SEQ ID NO: 2998421 - protein, 26 aa, Entamoeba invadens
GQNFNSILNIKLLQTTITPNKMLCFS

SEQ ID NO: 2998422 - protein, 34 aa, Entamoeba invadens
GQNVPHLLNLMMQLRKVCNHPFLIPGVEEKEVGG

SEQ ID NO: 2998423 - protein, 23 aa, Entamoeba invadens
GQPLILLCQINYSEMPKLANFPT

SEQ ID NO: 2998424 - protein, 17 aa, Entamoeba invadens
GQQDALKGITKPAIRRL

SEQ ID NO: 2998425 - protein, 24 aa, Entamoeba invadens
GQQFDGITSILKISGRFPTKSIQQ

SEQ ID NO: 2998426 - protein, 24 aa, Entamoeba invadens
GQQFNGITSILKISGKFPSKTIQQ

SEQ ID NO: 2998427 - protein, 20 aa, Entamoeba invadens
GQQKSPMHLPQKLITEIEKA

SEQ ID NO: 2998428 - protein, 26 aa, Entamoeba invadens
GQREKIVFYLWTPDGCKIKEKMLFSA

SEQ ID NO: 2998429 - protein, 34 aa, Entamoeba invadens
GQRLKDNFLCYTVLPFYIKIFESELIEARFVVEP

SEQ ID NO: 2998430 - protein, 36 aa, Entamoeba invadens
GQRTFYLLNGYLIVETTSLSWMLVNTTLKLHNLINY

SEQ ID NO: 2998431 - protein, 25 aa, Entamoeba invadens
GQSLQHFDYVFGNDTQIVHILDDDK

SEQ ID NO: 2998432 - protein, 25 aa, Entamoeba invadens
GQSQLEQFILFHGINIMSKWFNQSQ

SEQ ID NO: 2998433 - protein, 22 aa, Entamoeba invadens
GQTFAALIEALLLIGDKECNKD

SEQ ID NO: 2998434 - protein, 24 aa, Entamoeba invadens
GQTKKFLLTILSKNKSVTDKLIQM

SEQ ID NO: 2998435 - protein, 26 aa, Entamoeba invadens
GQTKTLLSCDFKLSRPFRLITSGEDE

SEQ ID NO: 2998436 - protein, 18 aa, Entamoeba invadens
GQVGFFNEKLRKYKKITK

SEQ ID NO: 2998437 - protein, 21 aa, Entamoeba invadens
GQVRDYFVSLFVGDSVTKQNT

SEQ ID NO: 2998438 - protein, 28 aa, Entamoeba invadens
GQWQFGKTKLFIRLPESIFAIEEMLEKM

SEQ ID NO: 2998439 - protein, 25 aa, Entamoeba invadens
GQWRAMFYDFLKKVLDYDPIKRLTP

SEQ ID NO: 2998440 - protein, 17 aa, Entamoeba invadens
GQYTFNSFAEPLTPRGS

SEQ ID NO: 2998441 - protein, 24 aa, Entamoeba invadens
GRAIVPLNYLLQKTQEGKCPIYSE

SEQ ID NO: 2998442 - protein, 27 aa, Entamoeba invadens
GRASTLQMIPTYAPIPTGNETGKFIGI

SEQ ID NO: 2998443 - protein, 23 aa, Entamoeba invadens
GRCELCREGFVFDASNECKESGI

SEQ ID NO: 2998444 - protein, 20 aa, Entamoeba invadens
GRCVVFKAPLLKIPNECFTN

SEQ ID NO: 2998445 - protein, 27 aa, Entamoeba invadens
GRDEEIKRVIRILSRRTKNNPVLIGEP

SEQ ID NO: 2998446 - protein, 18 aa, Entamoeba invadens
GREIISVIEFLSGVKHKQ

SEQ ID NO: 2998447 - protein, 24 aa, Entamoeba invadens
GRENLLYLVDPLIIKIKESQTYTN

SEQ ID NO: 2998448 - protein, 23 aa, Entamoeba invadens
GRERYGFPEALFNPSVIGLTQEG

SEQ ID NO: 2998449 - protein, 18 aa, Entamoeba invadens
GRESIQMYTLIFYKDKEV

SEQ ID NO: 2998450 - protein, 22 aa, Entamoeba invadens
GRETYFVLVNNNCTHFSNIESC

SEQ ID NO: 2998451 - protein, 18 aa, Entamoeba invadens
GRFLAFNDYFRNSLNRQM

SEQ ID NO: 2998452 - protein, 29 aa, Entamoeba invadens
GRGDPFCFVLEAIRFALVPFIDAAKGLPT

SEQ ID NO: 2998453 - protein, 26 aa, Entamoeba invadens
GRHDFKARVFQFYRSEDNELLCNELR

SEQ ID NO: 2998454 - protein, 17 aa, Entamoeba invadens
GRHQLVELLKRIKAEKT

SEQ ID NO: 2998455 - protein, 20 aa, Entamoeba invadens
GRIIRLVLPVEKNSAREKIQ

SEQ ID NO: 2998456 - protein, 17 aa, Entamoeba invadens
GRINGILAISRSFGDIE

SEQ ID NO: 2998457 - protein, 21 aa, Entamoeba invadens
GRKAFYFFGIHHDQLLFLDPH

SEQ ID NO: 2998458 - protein, 23 aa, Entamoeba invadens
GRKILRICPLKLNYDIGCILEQK

SEQ ID NO: 2998459 - protein, 22 aa, Entamoeba invadens
GRKKMYCNHLCTLPCHGTSLCP

SEQ ID NO: 2998460 - protein, 24 aa, Entamoeba invadens
GRLEGMCRFPIFEGEKGRAFELYD

SEQ ID NO: 2998461 - protein, 22 aa, Entamoeba invadens
GRLELIPRDEIPFGIPGCSYAT

SEQ ID NO: 2998462 - protein, 18 aa, Entamoeba invadens
GRLILFDTENRFIVKTLA

SEQ ID NO: 2998463 - protein, 19 aa, Entamoeba invadens
GRMELLYNAFMESVKKTPV

SEQ ID NO: 2998464 - protein, 20 aa, Entamoeba invadens
GRMLLNFNGLLFNNQRTRVS

SEQ ID NO: 2998465 - protein, 25 aa, Entamoeba invadens
GRMNIMYIDILLLHRPDALMDYKEV

SEQ ID NO: 2998466 - protein, 25 aa, Entamoeba invadens
GRNYYIFMLHSHNIFFVVLCAEKFS

SEQ ID NO: 2998467 - protein, 21 aa, Entamoeba invadens
GRQTLMLLSKIYQTFVNQSDE

SEQ ID NO: 2998468 - protein, 23 aa, Entamoeba invadens
GRRTTLIGCIALSGDVLTPGTVV

SEQ ID NO: 2998469 - protein, 22 aa, Entamoeba invadens
GRRWSILPRHVHILQKIDLRMD

SEQ ID NO: 2998470 - protein, 19 aa, Entamoeba invadens
GRSGTFLGTLRFYQQYFNS

SEQ ID NO: 2998471 - protein, 27 aa, Entamoeba invadens
GRSNTVFNNIFFKCKIGFSGNSKGVYR

SEQ ID NO: 2998472 - protein, 30 aa, Entamoeba invadens
GRTGLMCACLLIYFRDCLHAWEAVDFYGNA

SEQ ID NO: 2998473 - protein, 20 aa, Entamoeba invadens
GRTKCIAFLVTVNSIREGIV

SEQ ID NO: 2998474 - protein, 18 aa, Entamoeba invadens
GRTNACVYLARKVKKSGI

SEQ ID NO: 2998475 - protein, 21 aa, Entamoeba invadens
GRVFGAFLKGINGGKVNFLFT

SEQ ID NO: 2998476 - protein, 20 aa, Entamoeba invadens
GRVIQYITPYLAFTTDYNIA

SEQ ID NO: 2998477 - protein, 25 aa, Entamoeba invadens
GRVIYEDWGKRYQDINLRLGINTED

SEQ ID NO: 2998478 - protein, 28 aa, Entamoeba invadens
GRVVNTLYRAWIKLLPTDKTLWDSMCTN

SEQ ID NO: 2998479 - protein, 26 aa, Entamoeba invadens
GRYAHSDILFSYFNTIVQSDNIEVKC

SEQ ID NO: 2998480 - protein, 20 aa, Entamoeba invadens
GSAIRQTLRWFTEPTKDEVK

SEQ ID NO: 2998481 - protein, 17 aa, Entamoeba invadens
GSAKKWPDYQLRPNFLI

SEQ ID NO: 2998482 - protein, 23 aa, Entamoeba invadens
GSALYISLAIDPLWRKRAIENNK

SEQ ID NO: 2998483 - protein, 29 aa, Entamoeba invadens
GSAMDAAKIMWLLYEHPEADFFSMKQKFL

SEQ ID NO: 2998484 - protein, 24 aa, Entamoeba invadens
GSASLELLPYNAMTALIHTFGSML

SEQ ID NO: 2998485 - protein, 23 aa, Entamoeba invadens
GSCFIAKELAKCNGFIVVADVDS

SEQ ID NO: 2998486 - protein, 26 aa, Entamoeba invadens
GSCNTRYGFCTGCLSNYVFISSTSKT

SEQ ID NO: 2998487 - protein, 31 aa, Entamoeba invadens
GSCTCPALFTSRFPFLKKLFFRQVNTSIQAR

SEQ ID NO: 2998488 - protein, 24 aa, Entamoeba invadens
GSCVTCAFGYYYDTTSNDCIYVVE

SEQ ID NO: 2998489 - protein, 27 aa, Entamoeba invadens
GSDITRRLIDLLLVRGYSFNRTADFET

SEQ ID NO: 2998490 - protein, 17 aa, Entamoeba invadens
GSDRYQLPLYLTQIIIP

SEQ ID NO: 2998491 - protein, 28 aa, Entamoeba invadens
GSDRYQLPLYLTQIIIPYGVSQINSHCF

SEQ ID NO: 2998492 - protein, 24 aa, Entamoeba invadens
GSDSFLSLFIRQMTEAATKKAKFG

SEQ ID NO: 2998493 - protein, 29 aa, Entamoeba invadens
GSEGRVLLSFWYIYKKCGNYSMFDIQYIA

SEQ ID NO: 2998494 - protein, 23 aa, Entamoeba invadens
GSEHWLIMRCCTYIVSLLSYLCT

SEQ ID NO: 2998495 - protein, 24 aa, Entamoeba invadens
GSEKKIAVLGPYSKTLSYIASKYE

SEQ ID NO: 2998496 - protein, 25 aa, Entamoeba invadens
GSEKTWVYPFIKDADFVFTTFLTYE

SEQ ID NO: 2998497 - protein, 22 aa, Entamoeba invadens
GSEPIYHVETFFIQVAALFEKN

SEQ ID NO: 2998498 - protein, 24 aa, Entamoeba invadens
GSESNWDLFKLWTGKACAEVLYDS

SEQ ID NO: 2998499 - protein, 26 aa, Entamoeba invadens
GSFCNLPLLEHLTFIDSPGVLSGEKQ

SEQ ID NO: 2998500 - protein, 18 aa, Entamoeba invadens
GSFDLANPPPLPKKPRAL

SEQ ID NO: 2998501 - protein, 18 aa, Entamoeba invadens
GSFITMMAALMMGACGLT

SEQ ID NO: 2998502 - protein, 24 aa, Entamoeba invadens
GSFKFNWMEPFNNTEFLMFGEEVI

SEQ ID NO: 2998503 - protein, 29 aa, Entamoeba invadens
GSFLVKWKRRYCVLAPNVIALFNCAKDLL

SEQ ID NO: 2998504 - protein, 26 aa, Entamoeba invadens
GSFTASGFVFSTLAEPYRPSRSGNAS

SEQ ID NO: 2998505 - protein, 23 aa, Entamoeba invadens
GSFTYSDWWKNQQFYLRIGDSTR

SEQ ID NO: 2998506 - protein, 23 aa, Entamoeba invadens
GSGCAICKSGYYRSGDGCKVCNT

SEQ ID NO: 2998507 - protein, 27 aa, Entamoeba invadens
GSGHELHFFCWIVLFVTIGVIKEEEYP

SEQ ID NO: 2998508 - protein, 21 aa, Entamoeba invadens
GSGKSAILVALALCLGAKANF

SEQ ID NO: 2998509 - protein, 26 aa, Entamoeba invadens
GSGKTAAFLFPIISDILQNPPMPHQM

SEQ ID NO: 2998510 - protein, 23 aa, Entamoeba invadens
GSGKTAAFLLPMLNHLLNTNERK

SEQ ID NO: 2998511 - protein, 25 aa, Entamoeba invadens
GSGKTFLYNVLIDKALTLSKSVKTF

SEQ ID NO: 2998512 - protein, 34 aa, Entamoeba invadens
GSGKTISFTLPLLERMRATNPAREKLPRVIILSP

SEQ ID NO: 2998513 - protein, 24 aa, Entamoeba invadens
GSGKTLSFLIPMFEMIKTAKESYN

SEQ ID NO: 2998514 - protein, 36 aa, Entamoeba invadens
GSGKTLSYLIPLIEYMYRSQWFERGGLCALVMAPTR

SEQ ID NO: 2998515 - protein, 26 aa, Entamoeba invadens
GSGKTMAFLLSALQKIDYTTPQCQVV

SEQ ID NO: 2998516 - protein, 26 aa, Entamoeba invadens
GSGRYTRALLYLQNMFGPGVMKVECS

SEQ ID NO: 2998517 - protein, 25 aa, Entamoeba invadens
GSGSTYIYGFCDANFRKNMTLQQAK

SEQ ID NO: 2998518 - protein, 30 aa, Entamoeba invadens
GSGTRAIAIIIFHRLITPALISPANYNSCL

SEQ ID NO: 2998519 - protein, 24 aa, Entamoeba invadens
GSIENLCVLLKRLGLNEYEINDFV

SEQ ID NO: 2998520 - protein, 26 aa, Entamoeba invadens
GSIGDMLFFFGYRHEGFVLDIAQDLI

SEQ ID NO: 2998521 - protein, 23 aa, Entamoeba invadens
GSIGHTALKCKNAPRFINDILDE

SEQ ID NO: 2998522 - protein, 21 aa, Entamoeba invadens
GSIKKLKRVFSFSKQKGNKED

SEQ ID NO: 2998523 - protein, 18 aa, Entamoeba invadens
GSIKKWPDYQLRPNFLIT

SEQ ID NO: 2998524 - protein, 17 aa, Entamoeba invadens
GSIKLMERMGVSTVLFL

SEQ ID NO: 2998525 - protein, 25 aa, Entamoeba invadens
GSIRRVIVPLFSIGGYDALPIFEKL

SEQ ID NO: 2998526 - protein, 24 aa, Entamoeba invadens
GSKFDNFNFVNFNKVVCGPRVENP

SEQ ID NO: 2998527 - protein, 39 aa, Entamoeba invadens
GSKFGSGCYLVVPYPLMLPIWRRLVWHGGYSIEIEEQSY

SEQ ID NO: 2998528 - protein, 22 aa, Entamoeba invadens
GSKTFFLRATECGNGFVIVIDD

SEQ ID NO: 2998529 - protein, 17 aa, Entamoeba invadens
GSLFLVGKVLEGSVYKS

SEQ ID NO: 2998530 - protein, 23 aa, Entamoeba invadens
GSLFQSLPIGNFPRFKSSNFGKS

SEQ ID NO: 2998531 - protein, 25 aa, Entamoeba invadens
GSLISFISSFFSSPVRMLILGLDSA

SEQ ID NO: 2998532 - protein, 21 aa, Entamoeba invadens
GSLLLVKIHTFMHLNRLILHS

SEQ ID NO: 2998533 - protein, 28 aa, Entamoeba invadens
GSLMSPFDAFLCVRGLKTLPMRMKAHCE

SEQ ID NO: 2998534 - protein, 29 aa, Entamoeba invadens
GSLNGYASLLLPLFLQYVQNNISSEQHIP

SEQ ID NO: 2998535 - protein, 20 aa, Entamoeba invadens
GSLNVNEFVRLMTTIKGIDN

SEQ ID NO: 2998536 - protein, 24 aa, Entamoeba invadens
GSLSFDMLFTIKSTGEFYVQNRMR

SEQ ID NO: 2998537 - protein, 30 aa, Entamoeba invadens
GSLSIIHRDLALRNVLWYEDASGLRGRISD

SEQ ID NO: 2998538 - protein, 19 aa, Entamoeba invadens
GSLTNVVDFVWSNDAFLES

SEQ ID NO: 2998539 - protein, 28 aa, Entamoeba invadens
GSMGFWDVFKFKAIGMLPPIANFASITA

SEQ ID NO: 2998540 - protein, 21 aa, Entamoeba invadens
GSMLMAAAPLTGPTAPVVASL

SEQ ID NO: 2998541 - protein, 26 aa, Entamoeba invadens
GSNDGTIWLWNADSGKLITSLSCGIP

SEQ ID NO: 2998542 - protein, 24 aa, Entamoeba invadens
GSNQAALKIAWIFLHGAEGIPADK

SEQ ID NO: 2998543 - protein, 17 aa, Entamoeba invadens
GSPLFMAKTKRNWLSDG

SEQ ID NO: 2998544 - protein, 26 aa, Entamoeba invadens
GSQEWSFPEIYLLDGGFKCIYEQIPF

SEQ ID NO: 2998545 - protein, 29 aa, Entamoeba invadens
GSQNKDPLANVPPFPKGFADITQTPTKPT

SEQ ID NO: 2998546 - protein, 28 aa, Entamoeba invadens
GSQPNRILMFVSIYYLELFRGERFGFGY

SEQ ID NO: 2998547 - protein, 21 aa, Entamoeba invadens
GSRCRFIHVLPDETNSEQAES

SEQ ID NO: 2998548 - protein, 21 aa, Entamoeba invadens
GSRCVFQLYPESHFDLEMITN

SEQ ID NO: 2998549 - protein, 22 aa, Entamoeba invadens
GSRGVECLFGVLSLFLEHPTRV

SEQ ID NO: 2998550 - protein, 17 aa, Entamoeba invadens
GSRIALTDFRCCMCGMV

SEQ ID NO: 2998551 - protein, 17 aa, Entamoeba invadens
GSRILFCFNMDNEPFAL

SEQ ID NO: 2998552 - protein, 25 aa, Entamoeba invadens
GSSDHKIRFWDLATSKLEMTLNHLT

SEQ ID NO: 2998553 - protein, 37 aa, Entamoeba invadens
GSSLSHEFFYNLYLFPKLFTLKLNKCILPLSTVPAQT

SEQ ID NO: 2998554 - protein, 27 aa, Entamoeba invadens
GSSLTPFDFVMLMGIFRLSQIELNEVM

SEQ ID NO: 2998555 - protein, 27 aa, Entamoeba invadens
GSSTYMLKYFTLIWALMENNNKCDIAV

SEQ ID NO: 2998556 - protein, 29 aa, Entamoeba invadens
GSSVNLPFKLLLKFFGYIVDKLRHAGWQD

SEQ ID NO: 2998557 - protein, 23 aa, Entamoeba invadens
GSSVVYVILLTLMSIFEADEKVK

SEQ ID NO: 2998558 - protein, 23 aa, Entamoeba invadens
GSTALGPALLISTIIAGKEKNGK

SEQ ID NO: 2998559 - protein, 29 aa, Entamoeba invadens
GSTEFFEAMRTITGFIICIEDFEKNRFGV

SEQ ID NO: 2998560 - protein, 30 aa, Entamoeba invadens
GSTFDKGIPAFWFCVLRNSMLFDSAMGSEA

SEQ ID NO: 2998561 - protein, 18 aa, Entamoeba invadens
GSTLFKLTYFNEAAYLTQ

SEQ ID NO: 2998562 - protein, 18 aa, Entamoeba invadens
GSTLFPGLPERIEKDLKV

SEQ ID NO: 2998563 - protein, 20 aa, Entamoeba invadens
GSTLFRLEYLSKTYQQLQTE

SEQ ID NO: 2998564 - protein, 37 aa, Entamoeba invadens
GSTLMVPTTLFTKLARFLRILIRYQSFKRTEGLVEAI

SEQ ID NO: 2998565 - protein, 23 aa, Entamoeba invadens
GSTNTYLLCFDDYGSVFGVFLKN

SEQ ID NO: 2998566 - protein, 23 aa, Entamoeba invadens
GSTPFLLSCAYGRLKMAQSLFME

SEQ ID NO: 2998567 - protein, 26 aa, Entamoeba invadens
GSTSKQLFFVLCDYLFNKYETMEKLR

SEQ ID NO: 2998568 - protein, 25 aa, Entamoeba invadens
GSTTLWSLFNSLFDVLPLSAVIDNS

SEQ ID NO: 2998569 - protein, 19 aa, Entamoeba invadens
GSTVNFSFRGLDKSEDDVK

SEQ ID NO: 2998570 - protein, 28 aa, Entamoeba invadens
GSVDILRFKFLISIFGKFYLNKNQFLKM

SEQ ID NO: 2998571 - protein, 36 aa, Entamoeba invadens
GSVKSWKKRWFVLKPNKLWYFTSKSATTATGYIELN

SEQ ID NO: 2998572 - protein, 27 aa, Entamoeba invadens
GSVLQTILRPINKNALFRLDIRSIGIN

SEQ ID NO: 2998573 - protein, 25 aa, Entamoeba invadens
GSVMRTSIAAIPYFWDIEKVEETTN

SEQ ID NO: 2998574 - protein, 17 aa, Entamoeba invadens
GSVRFFLGRTEVVVGIK

SEQ ID NO: 2998575 - protein, 20 aa, Entamoeba invadens
GSVRIRLVPAPRGSGIVASV

SEQ ID NO: 2998576 - protein, 17 aa, Entamoeba invadens
GSYFFDCRLIVGQKKVS

SEQ ID NO: 2998577 - protein, 26 aa, Entamoeba invadens
GSYHDFRIFGLYEWDQYIREGELFLG

SEQ ID NO: 2998578 - protein, 24 aa, Entamoeba invadens
GSYNTQQYFKIFKIALNNGHVVNI

SEQ ID NO: 2998579 - protein, 25 aa, Entamoeba invadens
GSYRETLAEWVGLKKFSVVYDSKEE

SEQ ID NO: 2998580 - protein, 26 aa, Entamoeba invadens
GTAKTVLYLQLIYKDVLRYGGTEFQF

SEQ ID NO: 2998581 - protein, 35 aa, Entamoeba invadens
GTANVEFKWQIPTIRPKTGLLASLSYNATEIVMDE

SEQ ID NO: 2998582 - protein, 23 aa, Entamoeba invadens
GTDILFGLLKQTCLRRKNFKLIV

SEQ ID NO: 2998583 - protein, 23 aa, Entamoeba invadens
GTDLRKFLQILRPVFRTQANEVV

SEQ ID NO: 2998584 - protein, 27 aa, Entamoeba invadens
GTDNFELKFFVDLFTTIITSQRRPNLD

SEQ ID NO: 2998585 - protein, 17 aa, Entamoeba invadens
GTESSSHLAYYGESSMY

SEQ ID NO: 2998586 - protein, 25 aa, Entamoeba invadens
GTEVKPEWLRLLIPKNQIPVKGAVD

SEQ ID NO: 2998587 - protein, 17 aa, Entamoeba invadens
GTEYIKVAKIKNGVWSQ

SEQ ID NO: 2998588 - protein, 19 aa, Entamoeba invadens
GTFLNGVVYSYIPGRTLCL

SEQ ID NO: 2998589 - protein, 33 aa, Entamoeba invadens
GTFLSLYRVGKLPKIFKLLPSFEEWPQFLKMTN

SEQ ID NO: 2998590 - protein, 22 aa, Entamoeba invadens
GTFTKVFNRTFRKGIGAISVLD

SEQ ID NO: 2998591 - protein, 25 aa, Entamoeba invadens
GTGECKGFAFLKFSSLEDGNRAICE

SEQ ID NO: 2998592 - protein, 19 aa, Entamoeba invadens
GTGISTVLSKFSKFLKCYT

SEQ ID NO: 2998593 - protein, 24 aa, Entamoeba invadens
GTGKTLAYVIPILQNLLTTKSEGN

SEQ ID NO: 2998594 - protein, 25 aa, Entamoeba invadens
GTGLSGMTQPQMGNSLFGNTPSQIG

SEQ ID NO: 2998595 - protein, 25 aa, Entamoeba invadens
GTGNLTMKILPQCKKLIAIEIDPRM

SEQ ID NO: 2998596 - protein, 41 aa, Entamoeba invadens
GTHHGFPCFLLNNEPIFVYGLLDQGYWPDGLYTAPTDEALK

SEQ ID NO: 2998597 - protein, 24 aa, Entamoeba invadens
GTHPHEWMMYYAAAYGYKGANTKA

SEQ ID NO: 2998598 - protein, 24 aa, Entamoeba invadens
GTIEMFKQFLSKEILKEPFAKLKV

SEQ ID NO: 2998599 - protein, 27 aa, Entamoeba invadens
GTIGGLRIIGRLAVGNRKGLLLPHTCN

SEQ ID NO: 2998600 - protein, 21 aa, Entamoeba invadens
GTIGVEFYPYTLEIQGKKCEL

SEQ ID NO: 2998601 - protein, 26 aa, Entamoeba invadens
GTIKGWELPFPTAMSKTISPCCSLEG

SEQ ID NO: 2998602 - protein, 28 aa, Entamoeba invadens
GTINNMQRLYPYSLTLKCSCDLYMHFIN

SEQ ID NO: 2998603 - protein, 20 aa, Entamoeba invadens
GTIQYDEGLKYDFGKTKFYK

SEQ ID NO: 2998604 - protein, 30 aa, Entamoeba invadens
GTIYLTTKNFFFVPKMLLLVSHLTFNYQLY

SEQ ID NO: 2998605 - protein, 25 aa, Entamoeba invadens
GTKEFELNFYPILQQYLYSTHEYLV

SEQ ID NO: 2998606 - protein, 22 aa, Entamoeba invadens
GTKEHYLYAYKNTLKMITDNLL

SEQ ID NO: 2998607 - protein, 25 aa, Entamoeba invadens
GTKEPRFVEYFRDFDIESANLIVEK

SEQ ID NO: 2998608 - protein, 22 aa, Entamoeba invadens
GTKIELVLWDTAGQEKYYCLFP

SEQ ID NO: 2998609 - protein, 30 aa, Entamoeba invadens
GTKQLYEQIRKSGWFRVMFVKYNCVRHILD

SEQ ID NO: 2998610 - protein, 24 aa, Entamoeba invadens
GTKRMSEIAGYIRDMAFILGSEDN

SEQ ID NO: 2998611 - protein, 30 aa, Entamoeba invadens
GTKTTLKMNFFKINIWFEVNYQTVLDNEKN

SEQ ID NO: 2998612 - protein, 20 aa, Entamoeba invadens
GTKYTFSPLLGATECYNLMN

SEQ ID NO: 2998613 - protein, 17 aa, Entamoeba invadens
GTLFYTYASNLLKKSEE

SEQ ID NO: 2998614 - protein, 25 aa, Entamoeba invadens
GTLLDSLWIIIREVCRFVDEKKKKI

SEQ ID NO: 2998615 - protein, 21 aa, Entamoeba invadens
GTLLIHEWAGFATFVPHKEGR

SEQ ID NO: 2998616 - protein, 17 aa, Entamoeba invadens
GTLLMKRDDKFSPVFVE

SEQ ID NO: 2998617 - protein, 20 aa, Entamoeba invadens
GTLMHGYLSVVLKDLDSAIK

SEQ ID NO: 2998618 - protein, 21 aa, Entamoeba invadens
GTLQFYLGNYPTAEATFTYIC

SEQ ID NO: 2998619 - protein, 23 aa, Entamoeba invadens
GTLYPFQRLKRCLLCRSKFVCQK

SEQ ID NO: 2998620 - protein, 30 aa, Entamoeba invadens
GTMALSILRTLLALFSSWTKFNPYNLTLLA

SEQ ID NO: 2998621 - protein, 31 aa, Entamoeba invadens
GTMSCEVVITLLFMKLITPNKVYLLRGNHET

SEQ ID NO: 2998622 - protein, 24 aa, Entamoeba invadens
GTMTKIVFWIPANTDIELPQFVQP

SEQ ID NO: 2998623 - protein, 24 aa, Entamoeba invadens
GTNCFFCCDLLRDNSMIPKEAFNI

SEQ ID NO: 2998624 - protein, 21 aa, Entamoeba invadens
GTNCFFSCDLLRDNPSIPKEA

SEQ ID NO: 2998625 - protein, 26 aa, Entamoeba invadens
GTNESLLLRYAYFSRRYVVTITDENV

SEQ ID NO: 2998626 - protein, 24 aa, Entamoeba invadens
GTNGLYYYPLPLKNTVTGSPKSIK

SEQ ID NO: 2998627 - protein, 26 aa, Entamoeba invadens
GTNIAKLPVLLLYKVKVKVEDRRLTC

SEQ ID NO: 2998628 - protein, 31 aa, Entamoeba invadens
GTNILKPLCWAMKRKCQVILLTDGQISETEE

SEQ ID NO: 2998629 - protein, 25 aa, Entamoeba invadens
GTNIQTMFETLLADAYKLDPEMGTR

SEQ ID NO: 2998630 - protein, 19 aa, Entamoeba invadens
GTNKLPVDLYPIISIDLPK

SEQ ID NO: 2998631 - protein, 33 aa, Entamoeba invadens
GTNPLSVAFPSDEAFPWCFDAATSISPTGRFEK

SEQ ID NO: 2998632 - protein, 23 aa, Entamoeba invadens
GTNSTLIMNFFKINICFGQWKEE

SEQ ID NO: 2998633 - protein, 17 aa, Entamoeba invadens
GTNTLILRLTSTDFDGI

SEQ ID NO: 2998634 - protein, 18 aa, Entamoeba invadens
GTNWIRKQKFAVSRVIAL

SEQ ID NO: 2998635 - protein, 22 aa, Entamoeba invadens
GTPKVILIATGTEVDLAIKAAK

SEQ ID NO: 2998636 - protein, 21 aa, Entamoeba invadens
GTPLSPFLDQELLYNNPYCID

SEQ ID NO: 2998637 - protein, 26 aa, Entamoeba invadens
GTPNPSWASVPYGIFICIQCSGKHRG

SEQ ID NO: 2998638 - protein, 17 aa, Entamoeba invadens
GTPYISPVVMLEKGDEI

SEQ ID NO: 2998639 - protein, 36 aa, Entamoeba invadens
GTQADIWALGCLLYKVLFFVTPFEGSPMKIMRGVFD

SEQ ID NO: 2998640 - protein, 23 aa, Entamoeba invadens
GTQGRLDSFFKVKKAPLEKSSAS

SEQ ID NO: 2998641 - protein, 22 aa, Entamoeba invadens
GTQRMYSLLDRFSKSLEFKTVR

SEQ ID NO: 2998642 - protein, 24 aa, Entamoeba invadens
GTRRPLILQMFNNPDKRTPRCCFA

SEQ ID NO: 2998643 - protein, 25 aa, Entamoeba invadens
GTSESKIFMMSYPLPLSLQNEVTSP

SEQ ID NO: 2998644 - protein, 18 aa, Entamoeba invadens
GTSKLLLHNATMLASSST

SEQ ID NO: 2998645 - protein, 24 aa, Entamoeba invadens
GTSVFLLCFSVISPASLDNISGKW

SEQ ID NO: 2998646 - protein, 28 aa, Entamoeba invadens
GTTALAQLVLSLRKIGFDYVFDADYAAD

SEQ ID NO: 2998647 - protein, 27 aa, Entamoeba invadens
GTTALAQLVLSLRKIGFDYVFDVDYGA

SEQ ID NO: 2998648 - protein, 22 aa, Entamoeba invadens
GTTFMNTWNDILCSLAIDAVTV

SEQ ID NO: 2998649 - protein, 30 aa, Entamoeba invadens
GTTHPVIHKFLEKLLSFQKIINLKYQAYET

SEQ ID NO: 2998650 - protein, 37 aa, Entamoeba invadens
GTTHYPINTAIFKTGLCLPLPLIRSFKYIEAQNFKVE

SEQ ID NO: 2998651 - protein, 20 aa, Entamoeba invadens
GTTQVALYGLTFRTADQLID

SEQ ID NO: 2998652 - protein, 21 aa, Entamoeba invadens
GTTTLLLSLTLTTVSMKQYTV

SEQ ID NO: 2998653 - protein, 18 aa, Entamoeba invadens
GTTVFYNKPILATHIKRT

SEQ ID NO: 2998654 - protein, 18 aa, Entamoeba invadens
GTVFLLKCCSDCANALLY

SEQ ID NO: 2998655 - protein, 20 aa, Entamoeba invadens
GTWEWSPHRNPLWNESRDDQ

SEQ ID NO: 2998656 - protein, 24 aa, Entamoeba invadens
GTYDLSFDPPYEGDYLIAVYINDK

SEQ ID NO: 2998657 - protein, 19 aa, Entamoeba invadens
GTYELVNYINPTPGGLILL

SEQ ID NO: 2998658 - protein, 26 aa, Entamoeba invadens
GTYGYPLRLAILKSGWRYPIPIFRTI

SEQ ID NO: 2998659 - protein, 26 aa, Entamoeba invadens
GTYGYPLRVSVLKSAWRFPTPIFRSI

SEQ ID NO: 2998660 - protein, 24 aa, Entamoeba invadens
GTYKGNRIPSWCDRVLWKIENRHN

SEQ ID NO: 2998661 - protein, 39 aa, Entamoeba invadens
GTYKYPLACAVSKSGWRFPLPIYRAIEYLMNTKGYLTVG

SEQ ID NO: 2998662 - protein, 21 aa, Entamoeba invadens
GTYMRTLCVHLGYLSGTGAHM

SEQ ID NO: 2998663 - protein, 22 aa, Entamoeba invadens
GTYVQFLTLDMFDIGKPLGNGK

SEQ ID NO: 2998664 - protein, 31 aa, Entamoeba invadens
GVAAVHILHYIYKILVEPSGVLLKEKYLKEI

SEQ ID NO: 2998665 - protein, 18 aa, Entamoeba invadens
GVAFLVQNIFGISSKNGL

SEQ ID NO: 2998666 - protein, 21 aa, Entamoeba invadens
GVAHIYFYRNNPLFKNIGQAY

SEQ ID NO: 2998667 - protein, 18 aa, Entamoeba invadens
GVALFSSLISFDVTVERD

SEQ ID NO: 2998668 - protein, 26 aa, Entamoeba invadens
GVAQNLTLYILDQLKQQNPGYFTAYE

SEQ ID NO: 2998669 - protein, 29 aa, Entamoeba invadens
GVAQVLNRITFTSALAYLRKISSPVEGKR

SEQ ID NO: 2998670 - protein, 24 aa, Entamoeba invadens
GVCDLSLLQIPKFVKSISLKNGFT

SEQ ID NO: 2998671 - protein, 24 aa, Entamoeba invadens
GVCDLSLLQIPKYVKSISLKNGFV

SEQ ID NO: 2998672 - protein, 20 aa, Entamoeba invadens
GVCFSNNDVFIPKFTCQADL

SEQ ID NO: 2998673 - protein, 23 aa, Entamoeba invadens
GVDEFIGFLWVSDSPRVVFDKEK

SEQ ID NO: 2998674 - protein, 23 aa, Entamoeba invadens
GVDENLFDFDFEPTPRNPNNVTT

SEQ ID NO: 2998675 - protein, 20 aa, Entamoeba invadens
GVDFNNIRYIPISGLSGENL

SEQ ID NO: 2998676 - protein, 24 aa, Entamoeba invadens
GVDFQNKCFPGLKLDKPLSLQQYY

SEQ ID NO: 2998677 - protein, 27 aa, Entamoeba invadens
GVDHSTWLYLFPYFDNDKFDLTQMDLD

SEQ ID NO: 2998678 - protein, 24 aa, Entamoeba invadens
GVDKKRIVMLKQHPTDPLKVYAQT

SEQ ID NO: 2998679 - protein, 25 aa, Entamoeba invadens
GVDLFSDVEMELLGKKMLETKTDEK

SEQ ID NO: 2998680 - protein, 24 aa, Entamoeba invadens
GVDMLGAPYDWRYFRFDEYSHKEN

SEQ ID NO: 2998681 - protein, 29 aa, Entamoeba invadens
GVDRIEEILIPLGLTRLFFADCKYLKLLD

SEQ ID NO: 2998682 - protein, 24 aa, Entamoeba invadens
GVDRLRFTANFVTPLYPSTSDLTD

SEQ ID NO: 2998683 - protein, 31 aa, Entamoeba invadens
GVDRYISPWKDQFPEWALLPKTSEELMKEEN

SEQ ID NO: 2998684 - protein, 23 aa, Entamoeba invadens
GVDSFVICYPVALNKAVRFKENK

SEQ ID NO: 2998685 - protein, 30 aa, Entamoeba invadens
GVDVFTNCIKLSALTLPNFNGKLTFAISKY

SEQ ID NO: 2998686 - protein, 30 aa, Entamoeba invadens
GVDYWSIGCMLFQFLTGEFPFRGKSDKLTF

SEQ ID NO: 2998687 - protein, 29 aa, Entamoeba invadens
GVEERLWVEKTYFWPQFKEGQKYIECKSD

SEQ ID NO: 2998688 - protein, 26 aa, Entamoeba invadens
GVEFLKFLCDTFIFLNGSFTTQHNTL

SEQ ID NO: 2998689 - protein, 17 aa, Entamoeba invadens
GVEGEAMLWDLNKHGIA

SEQ ID NO: 2998690 - protein, 26 aa, Entamoeba invadens
GVEGILEHTLFKATFFPTWEGLFWEK

SEQ ID NO: 2998691 - protein, 25 aa, Entamoeba invadens
GVELLRILRVLINKSVVILLRDCNF

SEQ ID NO: 2998692 - protein, 24 aa, Entamoeba invadens
GVEYFSLFVRFVFSDGLFEEKRVK

SEQ ID NO: 2998693 - protein, 25 aa, Entamoeba invadens
GVEYFSLFVRFVFSDGSFVEKRVKI

SEQ ID NO: 2998694 - protein, 27 aa, Entamoeba invadens
GVEYMRCRMYWITQQLSIEGVGIVLKT

SEQ ID NO: 2998695 - protein, 29 aa, Entamoeba invadens
GVEYMRCRMYWITQQLSIEGVGIVLKTTQ

SEQ ID NO: 2998696 - protein, 23 aa, Entamoeba invadens
GVEYTFIIPKYSINGVILQIQNQ

SEQ ID NO: 2998697 - protein, 19 aa, Entamoeba invadens
GVFCDLLWSDPLQYEVYDE

SEQ ID NO: 2998698 - protein, 17 aa, Entamoeba invadens
GVFVGAKVEKNGEYITD

SEQ ID NO: 2998699 - protein, 18 aa, Entamoeba invadens
GVFVYENGGGLFASCSMK

SEQ ID NO: 2998700 - protein, 18 aa, Entamoeba invadens
GVFYVIDDVTKRSLLKRR

SEQ ID NO: 2998701 - protein, 22 aa, Entamoeba invadens
GVFYYAYYDLVYIDDKGILLCT

SEQ ID NO: 2998702 - protein, 25 aa, Entamoeba invadens
GVGCSLCKNQFYLNGKARLACNSQC

SEQ ID NO: 2998703 - protein, 39 aa, Entamoeba invadens
GVGFWGPMWRVWVFLLRGIIPILERWLGNLLARQFEGRK

SEQ ID NO: 2998704 - protein, 26 aa, Entamoeba invadens
GVGLQQPVLFRSYSTLSSRLFGHYYD

SEQ ID NO: 2998705 - protein, 18 aa, Entamoeba invadens
GVGRRICPLFVTKGFDRI

SEQ ID NO: 2998706 - protein, 25 aa, Entamoeba invadens
GVGSVKLWRVAFNVFIEDLYIRSKK

SEQ ID NO: 2998707 - protein, 32 aa, Entamoeba invadens
GVGVDWWSLGILIYEMLVGIPPFYDEDVSIMY

SEQ ID NO: 2998708 - protein, 29 aa, Entamoeba invadens
GVHFRETFFRLIVNIRDSLFSDLKLVELE

SEQ ID NO: 2998709 - protein, 25 aa, Entamoeba invadens
GVHGAFGCCLWFEREMKCFCLDKDK

SEQ ID NO: 2998710 - protein, 23 aa, Entamoeba invadens
GVHPITFDVLLQDAFVVITQKSN

SEQ ID NO: 2998711 - protein, 17 aa, Entamoeba invadens
GVIAYQLITGKHPFIKS

SEQ ID NO: 2998712 - protein, 18 aa, Entamoeba invadens
GVIGMWSLNNGTGLYEFL

SEQ ID NO: 2998713 - protein, 19 aa, Entamoeba invadens
GVIIRMCWISSFLGKLGKK

SEQ ID NO: 2998714 - protein, 18 aa, Entamoeba invadens
GVIKPDIVFFGENLPKRF

SEQ ID NO: 2998715 - protein, 17 aa, Entamoeba invadens
GVILASRELYCVYDTIK

SEQ ID NO: 2998716 - protein, 21 aa, Entamoeba invadens
GVILTTKLLKHTLVNYGIKIQ

SEQ ID NO: 2998717 - protein, 22 aa, Entamoeba invadens
GVINLCVLTLPDTLKFIGKHIF

SEQ ID NO: 2998718 - protein, 18 aa, Entamoeba invadens
GVIPLFCNHIGSGVFCNV

SEQ ID NO: 2998719 - protein, 29 aa, Entamoeba invadens
GVIPRLVFELFDVLEKKGLKYVMKVTHIE

SEQ ID NO: 2998720 - protein, 19 aa, Entamoeba invadens
GVKCTKCNFGSYIENGKCV

SEQ ID NO: 2998721 - protein, 23 aa, Entamoeba invadens
GVKDAFVKLFDAINLDDQMGQKE

SEQ ID NO: 2998722 - protein, 39 aa, Entamoeba invadens
GVKEDFQCFVFSLLNPTNTIQRYLPLNFKKVTWTFKDDN

SEQ ID NO: 2998723 - protein, 18 aa, Entamoeba invadens
GVKILQMAEVLFSVPQVC

SEQ ID NO: 2998724 - protein, 21 aa, Entamoeba invadens
GVKILRGTLKMGCPISLPSRN

SEQ ID NO: 2998725 - protein, 26 aa, Entamoeba invadens
GVKISEIPNIVPIPSVPNVPTISLVE

SEQ ID NO: 2998726 - protein, 27 aa, Entamoeba invadens
GVKTPYWEWEDTFLQKVFPTVTSEMTT

SEQ ID NO: 2998727 - protein, 35 aa, Entamoeba invadens
GVKVEYRVWNPYRSKLGCTILKGCKNMKICPGAKV

SEQ ID NO: 2998728 - protein, 18 aa, Entamoeba invadens
GVLERVPCKLTKPVPRSK

SEQ ID NO: 2998729 - protein, 27 aa, Entamoeba invadens
GVLKKEFFRIIVWFDVDFETVDRNKSR

SEQ ID NO: 2998730 - protein, 27 aa, Entamoeba invadens
GVLKKEFFRIIVWFNVDFKTVDRNKNR

SEQ ID NO: 2998731 - protein, 27 aa, Entamoeba invadens
GVLKREFFRIIVWFNVDFETVDRNKSR

SEQ ID NO: 2998732 - protein, 28 aa, Entamoeba invadens
GVLKREFFRIIVWFSVNFEIVNRNKNRN

SEQ ID NO: 2998733 - protein, 17 aa, Entamoeba invadens
GVLLGFIRRGVVDVMNS

SEQ ID NO: 2998734 - protein, 23 aa, Entamoeba invadens
GVLLRKKICALWIKLPPNVHDQI

SEQ ID NO: 2998735 - protein, 18 aa, Entamoeba invadens
GVLLYHERVDIKPTTLLH

SEQ ID NO: 2998736 - protein, 17 aa, Entamoeba invadens
GVLLYILQQHIYEEVKL

SEQ ID NO: 2998737 - protein, 19 aa, Entamoeba invadens
GVLPFFSKELLLFDEAKRA

SEQ ID NO: 2998738 - protein, 24 aa, Entamoeba invadens
GVLPKKTYLPISLKSLTLLNSLKM

SEQ ID NO: 2998739 - protein, 21 aa, Entamoeba invadens
GVLPPPGMPYGGMPNGYGAQQ

SEQ ID NO: 2998740 - protein, 25 aa, Entamoeba invadens
GVMEGKALLMKYLGGIDAVPICIDS

SEQ ID NO: 2998741 - protein, 24 aa, Entamoeba invadens
GVMQNMFEFFMKKAPQILTTMFSN

SEQ ID NO: 2998742 - protein, 25 aa, Entamoeba invadens
GVMRTSIATVFYFWDIEKVEETANT

SEQ ID NO: 2998743 - protein, 28 aa, Entamoeba invadens
GVMVDGKPINMFWALKDFKQRTDTQTNL

SEQ ID NO: 2998744 - protein, 17 aa, Entamoeba invadens
GVNGEIMVYIQYGGKCC

SEQ ID NO: 2998745 - protein, 30 aa, Entamoeba invadens
GVNGIEVFQLLLTLKVKYPKRINLLRGNHE

SEQ ID NO: 2998746 - protein, 25 aa, Entamoeba invadens
GVNKDTYLILEKLPEQYDGRVKSME

SEQ ID NO: 2998747 - protein, 22 aa, Entamoeba invadens
GVPEKGKYPLGLSFEIVNEKTM

SEQ ID NO: 2998748 - protein, 19 aa, Entamoeba invadens
GVPFTEPKRWFHKKEHDGG

SEQ ID NO: 2998749 - protein, 27 aa, Entamoeba invadens
GVPKLSNNLFVGALFFCEMMFSKFRVI

SEQ ID NO: 2998750 - protein, 20 aa, Entamoeba invadens
GVPLKLVRASKKRARKSKKA

SEQ ID NO: 2998751 - protein, 23 aa, Entamoeba invadens
GVPLSCVLSYFQIDQQIDFLKVL

SEQ ID NO: 2998752 - protein, 19 aa, Entamoeba invadens
GVQIIAKNCPFLLSNTKHS

SEQ ID NO: 2998753 - protein, 26 aa, Entamoeba invadens
GVQKITWLFINIHKMYRMYCGCGFDA

SEQ ID NO: 2998754 - protein, 21 aa, Entamoeba invadens
GVQLFCNLFHINTQFVCCCAS

SEQ ID NO: 2998755 - protein, 20 aa, Entamoeba invadens
GVQPFRLKRINWSDITFAVG

SEQ ID NO: 2998756 - protein, 29 aa, Entamoeba invadens
GVRHPALSAVFMKSGYRTLLSLKGFTEQG

SEQ ID NO: 2998757 - protein, 23 aa, Entamoeba invadens
GVRNAMVYLYRNFGVIHRDIKLE

SEQ ID NO: 2998758 - protein, 26 aa, Entamoeba invadens
GVRQTLMFSATFPRPIQKLASDFLDD

SEQ ID NO: 2998759 - protein, 23 aa, Entamoeba invadens
GVRRSQYVIYIDKLTKTKNNGQT

SEQ ID NO: 2998760 - protein, 19 aa, Entamoeba invadens
GVSCRSDIISGIQKVADAV

SEQ ID NO: 2998761 - protein, 29 aa, Entamoeba invadens
GVSIYKGIKVILIGYFKDASVSAGQNSDA

SEQ ID NO: 2998762 - protein, 24 aa, Entamoeba invadens
GVSKRLFYYFGNYQLNGISHVCLM

SEQ ID NO: 2998763 - protein, 17 aa, Entamoeba invadens
GVSLFECAIWKDPYLDK

SEQ ID NO: 2998764 - protein, 17 aa, Entamoeba invadens
GVSLFECVIWKEPYLDK

SEQ ID NO: 2998765 - protein, 31 aa, Entamoeba invadens
GVSLFECVTWKEPYPKIRFKFAWDIVDFVVS

SEQ ID NO: 2998766 - protein, 19 aa, Entamoeba invadens
GVSLLKLVETIVGKVIVFA

SEQ ID NO: 2998767 - protein, 23 aa, Entamoeba invadens
GVSLLLGLLDYVPGRRFCAREAM

SEQ ID NO: 2998768 - protein, 30 aa, Entamoeba invadens
GVSQAVLLQKLKINPFRYGAVIDTIYDNGV

SEQ ID NO: 2998769 - protein, 25 aa, Entamoeba invadens
GVSQLFKTKWFPPKIRKMRIIAQEM

SEQ ID NO: 2998770 - protein, 18 aa, Entamoeba invadens
GVSSKFLNDAYPGVEEDL

SEQ ID NO: 2998771 - protein, 25 aa, Entamoeba invadens
GVSYSCVEGYYLSYGNCIQCYEGCI

SEQ ID NO: 2998772 - protein, 33 aa, Entamoeba invadens
GVTALTIPVNLYFNSLIFLNNLKRISAVGGTVI

SEQ ID NO: 2998773 - protein, 25 aa, Entamoeba invadens
GVTDNPFIVPYLEKFLSFEPTHPPL

SEQ ID NO: 2998774 - protein, 24 aa, Entamoeba invadens
GVTENFMKFLKQFAKIRTKSGFEG

SEQ ID NO: 2998775 - protein, 24 aa, Entamoeba invadens
GVTHMQYWSDLLPNFSGTGVENIC

SEQ ID NO: 2998776 - protein, 23 aa, Entamoeba invadens
GVTPRRWMLQCNPLLSEVVTEYL

SEQ ID NO: 2998777 - protein, 28 aa, Entamoeba invadens
GVTSDFPLLGLMRKWLKALYEVKVESNL

SEQ ID NO: 2998778 - protein, 23 aa, Entamoeba invadens
GVTSLGVYQYLLEGLKAIGLENK

SEQ ID NO: 2998779 - protein, 28 aa, Entamoeba invadens
GVTTPIVRKLLIDIFQIEKTITPSLIIL

SEQ ID NO: 2998780 - protein, 17 aa, Entamoeba invadens
GVTYLVHPIGVSKILIE

SEQ ID NO: 2998781 - protein, 25 aa, Entamoeba invadens
GVVDCVLGMFNYAIKFFGQTVHAGT

SEQ ID NO: 2998782 - protein, 26 aa, Entamoeba invadens
GVVDLLRKVYLPHQLLSFINTTQQLP

SEQ ID NO: 2998783 - protein, 17 aa, Entamoeba invadens
GVVFTKFGPISTSLSGA

SEQ ID NO: 2998784 - protein, 24 aa, Entamoeba invadens
GVVIYTSMRSNIFIPVSGLVDVKD

SEQ ID NO: 2998785 - protein, 21 aa, Entamoeba invadens
GVVLPLTKYSATISALLVFLS

SEQ ID NO: 2998786 - protein, 17 aa, Entamoeba invadens
GVVTKMMKLFGTSIFKE

SEQ ID NO: 2998787 - protein, 30 aa, Entamoeba invadens
GVWGDRCFSKCYSLRWAVLPTIHGEEFFIG

SEQ ID NO: 2998788 - protein, 17 aa, Entamoeba invadens
GVYALYQADGVFVFYSY

SEQ ID NO: 2998789 - protein, 28 aa, Entamoeba invadens
GVYDNERKKYYFGVATFDSAQTANDVYE

SEQ ID NO: 2998790 - protein, 18 aa, Entamoeba invadens
GVYGIKYLLVCQERHEEE

SEQ ID NO: 2998791 - protein, 19 aa, Entamoeba invadens
GVYLVTEACKIPTIKTVYC

SEQ ID NO: 2998792 - protein, 24 aa, Entamoeba invadens
GVYQRLNIYKPWRATNEQLEMFHS

SEQ ID NO: 2998793 - protein, 37 aa, Entamoeba invadens
GVYTTLPVGIFYIKGYNFFGFHVRFRDLARGGLRTVI

SEQ ID NO: 2998794 - protein, 24 aa, Entamoeba invadens
GVYYYRLTGMTMDRLFKNCVSYLS

SEQ ID NO: 2998795 - protein, 19 aa, Entamoeba invadens
GWGVFVQQDGKILQPENRG

SEQ ID NO: 2998796 - protein, 30 aa, Entamoeba invadens
GWKDDDVGTYWSLFPAAAKKYGLHYETVHC

SEQ ID NO: 2998797 - protein, 29 aa, Entamoeba invadens
GWKQYHFNPSIKLARRFLPHVQNMDGFFV

SEQ ID NO: 2998798 - protein, 25 aa, Entamoeba invadens
GWKSWKRRWFALNGNSLMYYKDQLM

SEQ ID NO: 2998799 - protein, 17 aa, Entamoeba invadens
GWKTIAALQLRNPMHRS

SEQ ID NO: 2998800 - protein, 18 aa, Entamoeba invadens
GWLDLEEIKVIINCTREC

SEQ ID NO: 2998801 - protein, 19 aa, Entamoeba invadens
GWLLWICPQVNAMFWERYI

SEQ ID NO: 2998802 - protein, 17 aa, Entamoeba invadens
GWLYFGEQHSNASIKFL

SEQ ID NO: 2998803 - protein, 26 aa, Entamoeba invadens
GWMKKNIIAYDFLLKKMINGERVTMH

SEQ ID NO: 2998804 - protein, 26 aa, Entamoeba invadens
GWSPTTAYSLPQPKNVYSPLLVVTPM

SEQ ID NO: 2998805 - protein, 21 aa, Entamoeba invadens
GWSVEGFLISISEYDMYTTIG

SEQ ID NO: 2998806 - protein, 17 aa, Entamoeba invadens
GWTNIKRLEIPISVTTI

SEQ ID NO: 2998807 - protein, 33 aa, Entamoeba invadens
GWTRSSSAFIFSLIRKGILKPKKFVIRQSRGFD

SEQ ID NO: 2998808 - protein, 37 aa, Entamoeba invadens
GYAVEYLGVVLLPFIERPKLLKYLRPIEDAFVGDDKE

SEQ ID NO: 2998809 - protein, 21 aa, Entamoeba invadens
GYAVFYSWLKLKEQEVRNLMW

SEQ ID NO: 2998810 - protein, 22 aa, Entamoeba invadens
GYCESCLPNYVFTDPPSTSCET

SEQ ID NO: 2998811 - protein, 25 aa, Entamoeba invadens
GYCGVTERTLIISLIKLCGGKITND

SEQ ID NO: 2998812 - protein, 27 aa, Entamoeba invadens
GYCIGCEYNYVLISPTNLKCQTCKEFD

SEQ ID NO: 2998813 - protein, 23 aa, Entamoeba invadens
GYCLSCVTGFVLSASPSQRCITC

SEQ ID NO: 2998814 - protein, 30 aa, Entamoeba invadens
GYCMPEEAFLLPAFPQKPFVFGSEIVITVD

SEQ ID NO: 2998815 - protein, 32 aa, Entamoeba invadens
GYDFERIIDDFIFLCFFIGNDFLPHSPSLEIY

SEQ ID NO: 2998816 - protein, 65 aa, Entamoeba invadens
GYDFQNPRPWWMRRMRGHMFEPFPGHPPVFSPYGPLPMYQPFPMCNPFQYQPMMFPQQFPPFHQQ

SEQ ID NO: 2998817 - protein, 35 aa, Entamoeba invadens
GYDGKKNIFILFINNRYVEFPALKKIFERSYEENI

SEQ ID NO: 2998818 - protein, 23 aa, Entamoeba invadens
GYDSYDGPYDPLVGLYSSQKKEM

SEQ ID NO: 2998819 - protein, 34 aa, Entamoeba invadens
GYDTLYPHFLEFYALWFCRVFNGDLSMWVLDLVM

SEQ ID NO: 2998820 - protein, 27 aa, Entamoeba invadens
GYEDGSVRVWFPKTGVPEKFMVCPQNE

SEQ ID NO: 2998821 - protein, 27 aa, Entamoeba invadens
GYEIPVYYVCLTLIDTFNKFDFTQFRT

SEQ ID NO: 2998822 - protein, 17 aa, Entamoeba invadens
GYFGFQTIFSCKKAYCL

SEQ ID NO: 2998823 - protein, 32 aa, Entamoeba invadens
GYFKEKYMIPMQFWLYYVIDVEKHKLAYIQYT

SEQ ID NO: 2998824 - protein, 22 aa, Entamoeba invadens
GYFPNIETLYLWNKNDENFGNG

SEQ ID NO: 2998825 - protein, 17 aa, Entamoeba invadens
GYFQECFVLAYRLVTTP

SEQ ID NO: 2998826 - protein, 25 aa, Entamoeba invadens
GYGASNLLLERLMYSSDAFKVTVCR

SEQ ID NO: 2998827 - protein, 26 aa, Entamoeba invadens
GYGVRALYFQFGIISNNVICLEVACQ

SEQ ID NO: 2998828 - protein, 20 aa, Entamoeba invadens
GYHTKSLLVNFMNEKDAENF

SEQ ID NO: 2998829 - protein, 18 aa, Entamoeba invadens
GYIHCYEIINKCTTFTVI

SEQ ID NO: 2998830 - protein, 20 aa, Entamoeba invadens
GYIPFIGVVIQDLTFIDEGN

SEQ ID NO: 2998831 - protein, 26 aa, Entamoeba invadens
GYKEGTHFVVIVKKQALKTGATTTDA

SEQ ID NO: 2998832 - protein, 21 aa, Entamoeba invadens
GYKFGMFLNDGLDMLYEYGHL

SEQ ID NO: 2998833 - protein, 24 aa, Entamoeba invadens
GYKLRIEMAFVITNSLYGTGGELV

SEQ ID NO: 2998834 - protein, 25 aa, Entamoeba invadens
GYKSDNPIIITQLGPRQSLYVDCFA

SEQ ID NO: 2998835 - protein, 26 aa, Entamoeba invadens
GYLADKKIIFFTKNGHFLLAVSYDRR

SEQ ID NO: 2998836 - protein, 38 aa, Entamoeba invadens
GYLADKKLIFFTKNGHFLLAVSYYRRRFRPSIVCDGMG

SEQ ID NO: 2998837 - protein, 26 aa, Entamoeba invadens
GYLADKKMIFFTKNGYYLLAVSYERK

SEQ ID NO: 2998838 - protein, 24 aa, Entamoeba invadens
GYLAPNIYYMGFVGLVKLFGLRIL

SEQ ID NO: 2998839 - protein, 19 aa, Entamoeba invadens
GYLECKLNKKWKLRFATIN

SEQ ID NO: 2998840 - protein, 20 aa, Entamoeba invadens
GYLFNVYRINPSGGEDHLFV

SEQ ID NO: 2998841 - protein, 17 aa, Entamoeba invadens
GYLICEEILMKTLSPYS

SEQ ID NO: 2998842 - protein, 18 aa, Entamoeba invadens
GYLKLKNYIKTIRLNGEM

SEQ ID NO: 2998843 - protein, 19 aa, Entamoeba invadens
GYLLLKSERTGKTKRRFFY

SEQ ID NO: 2998844 - protein, 20 aa, Entamoeba invadens
GYLQCLQRLLGTNAGYEMFV

SEQ ID NO: 2998845 - protein, 19 aa, Entamoeba invadens
GYLQMLINVGYMPEFKGTR

SEQ ID NO: 2998846 - protein, 18 aa, Entamoeba invadens
GYLTKIGVDISEATFREM

SEQ ID NO: 2998847 - protein, 18 aa, Entamoeba invadens
GYNEVRFSNFNVHTIRSC

SEQ ID NO: 2998848 - protein, 23 aa, Entamoeba invadens
GYNIIGFFELFVNLLNNGNYVVE

SEQ ID NO: 2998849 - protein, 17 aa, Entamoeba invadens
GYNLRLTQRRDKIAQKA

SEQ ID NO: 2998850 - protein, 21 aa, Entamoeba invadens
GYNRCLAVLALIYCQNNFAEA

SEQ ID NO: 2998851 - protein, 23 aa, Entamoeba invadens
GYNTPQLTTERFMELMKGTSSSK

SEQ ID NO: 2998852 - protein, 19 aa, Entamoeba invadens
GYPPQQYPGYPPQQGYGYP

SEQ ID NO: 2998853 - protein, 17 aa, Entamoeba invadens
GYPSNIIKSFLGLLKDP

SEQ ID NO: 2998854 - protein, 23 aa, Entamoeba invadens
GYQFCWLCMQKYTSTHFLSNTTG

SEQ ID NO: 2998855 - protein, 24 aa, Entamoeba invadens
GYQLDCPRVFPSENYFGASIPKCQ

SEQ ID NO: 2998856 - protein, 25 aa, Entamoeba invadens
GYQLDRPKVFPSLNYFGASVPICKY

SEQ ID NO: 2998857 - protein, 26 aa, Entamoeba invadens
GYQLDRPKVFPSLNYFGASVPICKYT

SEQ ID NO: 2998858 - protein, 31 aa, Entamoeba invadens
GYQQPVCPFVTPPLLPLKPSQPVGVLIKNTQ

SEQ ID NO: 2998859 - protein, 31 aa, Entamoeba invadens
GYSDTLQPPTGFLFSLQRNGVVFPQKFEGKT

SEQ ID NO: 2998860 - protein, 17 aa, Entamoeba invadens
GYSLVVYVPFNSVSKEL

SEQ ID NO: 2998861 - protein, 29 aa, Entamoeba invadens
GYTVLHYAVFMNNTSFLDYILSLCCVDEF

SEQ ID NO: 2998862 - protein, 26 aa, Entamoeba invadens
GYTYEKVIFDFWQKLHLHTICLPVNV

SEQ ID NO: 2998863 - protein, 27 aa, Entamoeba invadens
GYTYEKVIFDFWQSKRLYLFKQIEKCK

SEQ ID NO: 2998864 - protein, 24 aa, Entamoeba invadens
GYTYYAPMVFKEWVRRPKKAKAPC

SEQ ID NO: 2998865 - protein, 20 aa, Entamoeba invadens
GYVLNFLSAALLPTPTRDSE

SEQ ID NO: 2998866 - protein, 18 aa, Entamoeba invadens
GYVRRSDLSRLNRGYIIG

SEQ ID NO: 2998867 - protein, 30 aa, Entamoeba invadens
GYVTKHVLEFFLKSPFALVTHKLLMLTEMK

SEQ ID NO: 2998868 - protein, 21 aa, Entamoeba invadens
GYWCNMDPIAFRRITKKRSCP

SEQ ID NO: 2998869 - protein, 17 aa, Entamoeba invadens
GYWKLRILDNPWAPEVS

SEQ ID NO: 2998870 - protein, 24 aa, Entamoeba invadens
GYYEEDNTWICEKGKYLLSFNKDA

SEQ ID NO: 2998871 - protein, 17 aa, Entamoeba invadens
GYYMDYLNTIKTTVLGL

SEQ ID NO: 2998872 - protein, 21 aa, Entamoeba invadens
GYYQLCGVVQYVFFNTEMEGK

SEQ ID NO: 2998873 - protein, 17 aa, Entamoeba invadens
GYYYNNGFCNKCSVNCE

SEQ ID NO: 2998874 - protein, 24 aa, Entamoeba invadens
HAARREKMILCNLASLFVDGVDVS

SEQ ID NO: 2998875 - protein, 26 aa, Entamoeba invadens
HADDCRMVVWRLSSIRRFFLNKMCKT

SEQ ID NO: 2998876 - protein, 22 aa, Entamoeba invadens
HADVLIKRRSVKSSVTLPFLCI

SEQ ID NO: 2998877 - protein, 25 aa, Entamoeba invadens
HAETLRLFETQTLNKVLTCRCEICI

SEQ ID NO: 2998878 - protein, 17 aa, Entamoeba invadens
HAFHKYADRKIPFLGIN

SEQ ID NO: 2998879 - protein, 24 aa, Entamoeba invadens
HAFLSLQDNSLFGRPMHIAYAKTE

SEQ ID NO: 2998880 - protein, 19 aa, Entamoeba invadens
HAGYRKFLQIESRLVSLVK

SEQ ID NO: 2998881 - protein, 23 aa, Entamoeba invadens
HAIGQVIIFLKSTEGFVNCFNVD

SEQ ID NO: 2998882 - protein, 18 aa, Entamoeba invadens
HAIGVFKKGSLSRSYCNP

SEQ ID NO: 2998883 - protein, 23 aa, Entamoeba invadens
HAKIVLNALVKRKLIVGPEGQSS

SEQ ID NO: 2998884 - protein, 23 aa, Entamoeba invadens
HAKLEMIYLMRVSLELRSISDSQ

SEQ ID NO: 2998885 - protein, 23 aa, Entamoeba invadens
HAKLIHPNVVLPKSIRSGIVVLN

SEQ ID NO: 2998886 - protein, 35 aa, Entamoeba invadens
HAKNQWAREMKEFGLTRIDGIRRDIQDKDAIGKML

SEQ ID NO: 2998887 - protein, 17 aa, Entamoeba invadens
HAKSMFLNFGYAEKTGG

SEQ ID NO: 2998888 - protein, 21 aa, Entamoeba invadens
HAKTQLIKGKYKKDIAEITVR

SEQ ID NO: 2998889 - protein, 17 aa, Entamoeba invadens
HALFDKYSPVSYDNPRY

SEQ ID NO: 2998890 - protein, 23 aa, Entamoeba invadens
HALFVEGLSLYHRDWKRIEQHIK

SEQ ID NO: 2998891 - protein, 17 aa, Entamoeba invadens
HALLDATSKSRNLSMST

SEQ ID NO: 2998892 - protein, 17 aa, Entamoeba invadens
HALLQFDVRSPQNALVG

SEQ ID NO: 2998893 - protein, 27 aa, Entamoeba invadens
HALVLLTTTFLIDPLNKLLNCYYSLFT

SEQ ID NO: 2998894 - protein, 18 aa, Entamoeba invadens
HAMKFVQELYTLHAAEIH

SEQ ID NO: 2998895 - protein, 25 aa, Entamoeba invadens
HAMYQSLKECYLVYTDLLKKYDEIM

SEQ ID NO: 2998896 - protein, 25 aa, Entamoeba invadens
HAPKFLNVFFEFLMLNEDAFIETFH

SEQ ID NO: 2998897 - protein, 17 aa, Entamoeba invadens
HAQFTITAKLLYENIDH

SEQ ID NO: 2998898 - protein, 21 aa, Entamoeba invadens
HARHNGISAGLLFSISLVPFC

SEQ ID NO: 2998899 - protein, 32 aa, Entamoeba invadens
HARTYLSTDIFRRILEDYFGYPVIQCMNVTDV

SEQ ID NO: 2998900 - protein, 34 aa, Entamoeba invadens
HASDFLKCKAEILSIFLFYIQLQFFNTTLCTFEL

SEQ ID NO: 2998901 - protein, 23 aa, Entamoeba invadens
HASKFFLVCPASADIIAKLAAGI

SEQ ID NO: 2998902 - protein, 26 aa, Entamoeba invadens
HATYGYYYMLGYAKATDYIDWSLYYL

SEQ ID NO: 2998903 - protein, 24 aa, Entamoeba invadens
HAVALIFIGLDINGNMMLKISDAK

SEQ ID NO: 2998904 - protein, 25 aa, Entamoeba invadens
HAVATILLMFIRELPEPLITFNMYS

SEQ ID NO: 2998905 - protein, 27 aa, Entamoeba invadens
HAVRKNRYIILPIDFDKAYKKVVRKQT

SEQ ID NO: 2998906 - protein, 24 aa, Entamoeba invadens
HCDVKITLLTALTGGSYTLECIDG

SEQ ID NO: 2998907 - protein, 17 aa, Entamoeba invadens
HCECIPTDIPCKESAIK

SEQ ID NO: 2998908 - protein, 20 aa, Entamoeba invadens
HCELLRCFVKYLKRLRDANE

SEQ ID NO: 2998909 - protein, 18 aa, Entamoeba invadens
HCIGFLLETILKSGAVPD

SEQ ID NO: 2998910 - protein, 17 aa, Entamoeba invadens
HCKWIMEVIGCGLTLPV

SEQ ID NO: 2998911 - protein, 26 aa, Entamoeba invadens
HCNRDKINPIKYFKLIATIQDSSNQQ

SEQ ID NO: 2998912 - protein, 26 aa, Entamoeba invadens
HCNSIFSYLDKIENLSWKCKFCGTEN

SEQ ID NO: 2998913 - protein, 30 aa, Entamoeba invadens
HCPTGSFFPSPGFKIPCKQILHGVGPIGEE

SEQ ID NO: 2998914 - protein, 19 aa, Entamoeba invadens
HCRSAPQTLVDISNAMLKF

SEQ ID NO: 2998915 - protein, 19 aa, Entamoeba invadens
HCSEYINSHFKQVEFLCGF

SEQ ID NO: 2998916 - protein, 19 aa, Entamoeba invadens
HCSFLDNLRYVGDVAVTNV

SEQ ID NO: 2998917 - protein, 25 aa, Entamoeba invadens
HCSSADFLALFLNRFQLAMSIDTTL

SEQ ID NO: 2998918 - protein, 17 aa, Entamoeba invadens
HCTQCINGYYPNSEGEC

SEQ ID NO: 2998919 - protein, 21 aa, Entamoeba invadens
HCVPIYEGFSLPHAILRIDLA

SEQ ID NO: 2998920 - protein, 21 aa, Entamoeba invadens
HCWCLFKTPAGELPWPSIVKR

SEQ ID NO: 2998921 - protein, 23 aa, Entamoeba invadens
HDAKIKIRTLFRNSQREKDKQMS

SEQ ID NO: 2998922 - protein, 17 aa, Entamoeba invadens
HDDNLLKISLLETKLEQ

SEQ ID NO: 2998923 - protein, 25 aa, Entamoeba invadens
HDDRSPLFLSCFSAFWVRKSGDINF

SEQ ID NO: 2998924 - protein, 25 aa, Entamoeba invadens
HDDRTYLAFRWYVAKLIEGVDEFIG

SEQ ID NO: 2998925 - protein, 18 aa, Entamoeba invadens
HDDVRFYDVFDENEKLIG

SEQ ID NO: 2998926 - protein, 25 aa, Entamoeba invadens
HDENPTILYHKMDLLKQQFCYVAED

SEQ ID NO: 2998927 - protein, 25 aa, Entamoeba invadens
HDESQFTFKIFNKMLKQTKSSLGLC

SEQ ID NO: 2998928 - protein, 19 aa, Entamoeba invadens
HDFNRIIPVLKTRTYTDAD

SEQ ID NO: 2998929 - protein, 24 aa, Entamoeba invadens
HDFPTLLQLLSSYTSIPTTLKGLI

SEQ ID NO: 2998930 - protein, 37 aa, Entamoeba invadens
HDFYVEMRTLIVFPTYFYYVKFIGSAFDFPESKPTTP

SEQ ID NO: 2998931 - protein, 23 aa, Entamoeba invadens
HDGKRRIKYFGALKFVTPGEVSK

SEQ ID NO: 2998932 - protein, 25 aa, Entamoeba invadens
HDGLIKDYFQSINEPSMKRINTEKK

SEQ ID NO: 2998933 - protein, 19 aa, Entamoeba invadens
HDGPIWDVQYCPLEYYMIS

SEQ ID NO: 2998934 - protein, 26 aa, Entamoeba invadens
HDIENAWELYFRIYKRIHKSINSVSV

SEQ ID NO: 2998935 - protein, 17 aa, Entamoeba invadens
HDIFRDLMLLVTEVVPA

SEQ ID NO: 2998936 - protein, 19 aa, Entamoeba invadens
HDIKTLTALFVEIVKKYNK

SEQ ID NO: 2998937 - protein, 31 aa, Entamoeba invadens
HDITLNVDTLYFYLCPSFITRTIRIIASNSL

SEQ ID NO: 2998938 - protein, 29 aa, Entamoeba invadens
HDIVDFSPYNPIYIVGETCGKYVIGPVRT

SEQ ID NO: 2998939 - protein, 46 aa, Entamoeba invadens
HDKRFDNIIMIHPLSFYLITPIQRIPRYELLIRDMLRDVGKDFPDL

SEQ ID NO: 2998940 - protein, 21 aa, Entamoeba invadens
HDLIHKACGWMLREIGKKNEK

SEQ ID NO: 2998941 - protein, 18 aa, Entamoeba invadens
HDLLLFDSPEVKVPMVPA

SEQ ID NO: 2998942 - protein, 24 aa, Entamoeba invadens
HDLSHLKIIYISPLKALATEMTNT

SEQ ID NO: 2998943 - protein, 25 aa, Entamoeba invadens
HDLYPLGVCLYRLMTHKIPYGENET

SEQ ID NO: 2998944 - protein, 23 aa, Entamoeba invadens
HDNFDPQFRGIKYKSKDKEVDKK

SEQ ID NO: 2998945 - protein, 30 aa, Entamoeba invadens
HDNNFVIERYIVALDYLFGRASNITNIKTL

SEQ ID NO: 2998946 - protein, 32 aa, Entamoeba invadens
HDNNFVIERYIVALDYLFRRTCNITNIKTLKF

SEQ ID NO: 2998947 - protein, 32 aa, Entamoeba invadens
HDNNFVIERYIVALDYLFRRTCNITNIKTLKS

SEQ ID NO: 2998948 - protein, 25 aa, Entamoeba invadens
HDPKQYISLAPILYETIKNPMNQSN

SEQ ID NO: 2998949 - protein, 22 aa, Entamoeba invadens
HDQLMELIRLRNLINTRQSECA

SEQ ID NO: 2998950 - protein, 24 aa, Entamoeba invadens
HDQMRLAFKIVYDKEYIFVAMNKV

SEQ ID NO: 2998951 - protein, 20 aa, Entamoeba invadens
HDRFFIHRDIKPDNFVMGMK

SEQ ID NO: 2998952 - protein, 17 aa, Entamoeba invadens
HDRLFFHRPAYPQPMSY

SEQ ID NO: 2998953 - protein, 20 aa, Entamoeba invadens
HDRLFIHRDIKPDNFVMGMK

SEQ ID NO: 2998954 - protein, 19 aa, Entamoeba invadens
HDSFHVIIRCKKSDKYTFR

SEQ ID NO: 2998955 - protein, 31 aa, Entamoeba invadens
HDSFSRIRVILDKFIFNLVNQTYYKPSNSVS

SEQ ID NO: 2998956 - protein, 26 aa, Entamoeba invadens
HDTCMKCFSCEKPIRFKAMAIDCKPF

SEQ ID NO: 2998957 - protein, 21 aa, Entamoeba invadens
HDTFLEFFKEYNPTSCRLPLD

SEQ ID NO: 2998958 - protein, 20 aa, Entamoeba invadens
HDTNFFLRKSHLTKMSAALK

SEQ ID NO: 2998959 - protein, 19 aa, Entamoeba invadens
HDTVQIFTILRAISTVPTT

SEQ ID NO: 2998960 - protein, 18 aa, Entamoeba invadens
HEAKKYYLEDILRETRAE

SEQ ID NO: 2998961 - protein, 31 aa, Entamoeba invadens
HEDLLFRVHVKLLMDDTLIDSIYSKPIKSTS

SEQ ID NO: 2998962 - protein, 25 aa, Entamoeba invadens
HEDNPNFMFYSELIELFYCPDDIVN

SEQ ID NO: 2998963 - protein, 21 aa, Entamoeba invadens
HEELRFMIDPHNLPSILFEIY

SEQ ID NO: 2998964 - protein, 32 aa, Entamoeba invadens
HEEVVIDGMRWVKPYYHWFCTEARESWIGKEL

SEQ ID NO: 2998965 - protein, 26 aa, Entamoeba invadens
HEFEGQILNSYFCSLNDQMVNLKKIG

SEQ ID NO: 2998966 - protein, 19 aa, Entamoeba invadens
HEFPKVMGGFDRVLVDAPC

SEQ ID NO: 2998967 - protein, 26 aa, Entamoeba invadens
HEFRPFHIDFLQYLVSKDSAILSIAN

SEQ ID NO: 2998968 - protein, 33 aa, Entamoeba invadens
HEGDILVITEKHSSGWWFATNDKGQSGFVPENY

SEQ ID NO: 2998969 - protein, 25 aa, Entamoeba invadens
HEGKPYCEFHFYRMFGDVCAKCGEP

SEQ ID NO: 2998970 - protein, 26 aa, Entamoeba invadens
HEHASIRVYFPYQVIKTPKYAIKLEL

SEQ ID NO: 2998971 - protein, 25 aa, Entamoeba invadens
HEHASIRVYFPYQVIKTPKYTINLE

SEQ ID NO: 2998972 - protein, 25 aa, Entamoeba invadens
HEIEKGVFALVLRALIESPDGDFCP

SEQ ID NO: 2998973 - protein, 25 aa, Entamoeba invadens
HEIETHILLPYLQGKSARASFQIYV

SEQ ID NO: 2998974 - protein, 26 aa, Entamoeba invadens
HEIFDSPPYLAWFVNVWKMVDEMVNN

SEQ ID NO: 2998975 - protein, 18 aa, Entamoeba invadens
HEIFFQINNISGLRDRHT

SEQ ID NO: 2998976 - protein, 19 aa, Entamoeba invadens
HEIIRMPHGTVRPVCVVVT

SEQ ID NO: 2998977 - protein, 18 aa, Entamoeba invadens
HEIMSQASKIWQQLSSSL

SEQ ID NO: 2998978 - protein, 24 aa, Entamoeba invadens
HEINIHPIYYAFEPIFTLCSRYFN

SEQ ID NO: 2998979 - protein, 23 aa, Entamoeba invadens
HEISIFKHIEKEALCIVYNGDVL

SEQ ID NO: 2998980 - protein, 19 aa, Entamoeba invadens
HEKKYLPLVYVGIDSKVKI

SEQ ID NO: 2998981 - protein, 17 aa, Entamoeba invadens
HEKMDFTYFTKSLSLLT

SEQ ID NO: 2998982 - protein, 28 aa, Entamoeba invadens
HEKYQELVPPILPPPRKTQQNTTILTEE

SEQ ID NO: 2998983 - protein, 21 aa, Entamoeba invadens
HELFDKYKPLSIDVPRFKEDT

SEQ ID NO: 2998984 - protein, 24 aa, Entamoeba invadens
HELKETFRIVFPDRPLLECEDINL

SEQ ID NO: 2998985 - protein, 19 aa, Entamoeba invadens
HELLNFPGPVVFTTNCLMK

SEQ ID NO: 2998986 - protein, 17 aa, Entamoeba invadens
HELVLLENYKKPEELLE

SEQ ID NO: 2998987 - protein, 24 aa, Entamoeba invadens
HEMHRLLARWPLLQPEEAIELLDF

SEQ ID NO: 2998988 - protein, 25 aa, Entamoeba invadens
HEMLLRYKKLLPQVDDILYSGKANS

SEQ ID NO: 2998989 - protein, 25 aa, Entamoeba invadens
HEMNKPPFFIPKELYRIVDRILKKY

SEQ ID NO: 2998990 - protein, 18 aa, Entamoeba invadens
HENGILHRDIKLDNLLVF

SEQ ID NO: 2998991 - protein, 33 aa, Entamoeba invadens
HENSILHRDIKPDNILVFLLDYNERVNAKLTDF

SEQ ID NO: 2998992 - protein, 26 aa, Entamoeba invadens
HENVTLPIYYVPVAISYVNNTPFAIP

SEQ ID NO: 2998993 - protein, 19 aa, Entamoeba invadens
HERANIILYIVQIGLEKFY

SEQ ID NO: 2998994 - protein, 24 aa, Entamoeba invadens
HERNKLELEKIKSKIWITSERGKV

SEQ ID NO: 2998995 - protein, 25 aa, Entamoeba invadens
HERTYISSVLLLKEKLKFLDIMNRV

SEQ ID NO: 2998996 - protein, 23 aa, Entamoeba invadens
HERYSCVVTTFYRGSDCCVLCFD

SEQ ID NO: 2998997 - protein, 24 aa, Entamoeba invadens
HESAFVFMQLVRGIHYLHSHNVIH

SEQ ID NO: 2998998 - protein, 17 aa, Entamoeba invadens
HESLLLIAAKDNKPFGG

SEQ ID NO: 2998999 - protein, 27 aa, Entamoeba invadens
HESLSMTHIFGFEREWVWKYNSTYIWY

SEQ ID NO: 2999000 - protein, 26 aa, Entamoeba invadens
HETCVDILSVVSFWEKHWTCCQCNKL

SEQ ID NO: 2999001 - protein, 34 aa, Entamoeba invadens
HETHQMVYFELGKYYIIMILPKFMKETHVTLSMK

SEQ ID NO: 2999002 - protein, 21 aa, Entamoeba invadens
HEVDLSILPEEQFATTPTVIE

SEQ ID NO: 2999003 - protein, 18 aa, Entamoeba invadens
HEYLRGQNILYVCSSLII

SEQ ID NO: 2999004 - protein, 17 aa, Entamoeba invadens
HFADYFTEKDRHFDFLR

SEQ ID NO: 2999005 - protein, 22 aa, Entamoeba invadens
HFAEPLPTLFDGLVGYFDDSLS

SEQ ID NO: 2999006 - protein, 33 aa, Entamoeba invadens
HFCKDEPFLVVFVKFLTILFMRDDLKLTSLKRK

SEQ ID NO: 2999007 - protein, 17 aa, Entamoeba invadens
HFDELCEVLKYIGKKKY

SEQ ID NO: 2999008 - protein, 17 aa, Entamoeba invadens
HFDIVDLAFDVEATASD

SEQ ID NO: 2999009 - protein, 19 aa, Entamoeba invadens
HFDTFFCRMSLYDMSYNKL

SEQ ID NO: 2999010 - protein, 18 aa, Entamoeba invadens
HFDTVAIGLREMFKRATE

SEQ ID NO: 2999011 - protein, 27 aa, Entamoeba invadens
HFECRGVQYGFIVPELYIFAEDKRNGT

SEQ ID NO: 2999012 - protein, 34 aa, Entamoeba invadens
HFEENNILFFQFAFRWINCFLLRELSPEQGMRLW

SEQ ID NO: 2999013 - protein, 17 aa, Entamoeba invadens
HFEFDIIHYAGDVTYDG

SEQ ID NO: 2999014 - protein, 25 aa, Entamoeba invadens
HFEFIQSDLLLVQLLAQYVGGDFVV

SEQ ID NO: 2999015 - protein, 37 aa, Entamoeba invadens
HFELEEPMYNPLMFDQLILLLRSICLECFTLKASQQT

SEQ ID NO: 2999016 - protein, 26 aa, Entamoeba invadens
HFELMCDLVLKRANLLDTVFTLFVKL

SEQ ID NO: 2999017 - protein, 23 aa, Entamoeba invadens
HFERPFTDWTLMLLKCCFKDKKP

SEQ ID NO: 2999018 - protein, 26 aa, Entamoeba invadens
HFEVLKTIFSLPMKLAEAGLNAVCCY

SEQ ID NO: 2999019 - protein, 20 aa, Entamoeba invadens
HFEYIGYKKWIELTRKINNN

SEQ ID NO: 2999020 - protein, 18 aa, Entamoeba invadens
HFFIQRKNKSNSPVAPSS

SEQ ID NO: 2999021 - protein, 17 aa, Entamoeba invadens
HFFPNLETFNIWSRETE

SEQ ID NO: 2999022 - protein, 17 aa, Entamoeba invadens
HFGFFKKDSKKDMETDS

SEQ ID NO: 2999023 - protein, 18 aa, Entamoeba invadens
HFGQFDMTLIRETDLKQP

SEQ ID NO: 2999024 - protein, 30 aa, Entamoeba invadens
HFGYIQLYAPVYNPVYVKYILKVLKCVCPS

SEQ ID NO: 2999025 - protein, 22 aa, Entamoeba invadens
HFHVDHCAALPYLVLERNYKGK

SEQ ID NO: 2999026 - protein, 21 aa, Entamoeba invadens
HFIDEFYAIFDSRAISVIHQF

SEQ ID NO: 2999027 - protein, 20 aa, Entamoeba invadens
HFINGVGVYYTLIATLQTLK

SEQ ID NO: 2999028 - protein, 18 aa, Entamoeba invadens
HFINQKTTFYNITNSTFI

SEQ ID NO: 2999029 - protein, 20 aa, Entamoeba invadens
HFINVFFTRKDVKPYLIITN

SEQ ID NO: 2999030 - protein, 25 aa, Entamoeba invadens
HFKDTQMFYTALRKYGANMELIAKE

SEQ ID NO: 2999031 - protein, 26 aa, Entamoeba invadens
HFKETRKLFYELALRDSTISTKPTEK

SEQ ID NO: 2999032 - protein, 19 aa, Entamoeba invadens
HFLDLTKPKQQPPQPGQIT

SEQ ID NO: 2999033 - protein, 25 aa, Entamoeba invadens
HFLGDILLELGFQFSVKWSPGKHNT

SEQ ID NO: 2999034 - protein, 17 aa, Entamoeba invadens
HFLGDVLEKVRNCVGFS

SEQ ID NO: 2999035 - protein, 20 aa, Entamoeba invadens
HFLHIDFAHFLGNKLKVAGV

SEQ ID NO: 2999036 - protein, 20 aa, Entamoeba invadens
HFLLGHFHVQLAACKGQAVA

SEQ ID NO: 2999037 - protein, 17 aa, Entamoeba invadens
HFLLINHKCEDVLHSLK

SEQ ID NO: 2999038 - protein, 27 aa, Entamoeba invadens
HFLNENFFCRVIWYEVDFAHYCNTDKK

SEQ ID NO: 2999039 - protein, 17 aa, Entamoeba invadens
HFLTFATVTKEDEMMHL

SEQ ID NO: 2999040 - protein, 20 aa, Entamoeba invadens
HFLVQFPHPLKSFVFHTKFP

SEQ ID NO: 2999041 - protein, 18 aa, Entamoeba invadens
HFLYNLQNKTMTIILDVG

SEQ ID NO: 2999042 - protein, 25 aa, Entamoeba invadens
HFNEVYDALWNPNIPFVIGSAGEGR

SEQ ID NO: 2999043 - protein, 18 aa, Entamoeba invadens
HFNNIFDIIIVIQPIDTE

SEQ ID NO: 2999044 - protein, 17 aa, Entamoeba invadens
HFNPFPLNSKTLEYFPN

SEQ ID NO: 2999045 - protein, 17 aa, Entamoeba invadens
HFNPFSLNSKTLGYFPN

SEQ ID NO: 2999046 - protein, 18 aa, Entamoeba invadens
HFNPIPLNSKTFKYFPNI

SEQ ID NO: 2999047 - protein, 17 aa, Entamoeba invadens
HFNPIPLTNKTFKHFPN

SEQ ID NO: 2999048 - protein, 17 aa, Entamoeba invadens
HFNPIPLTPKTLKYFPR

SEQ ID NO: 2999049 - protein, 22 aa, Entamoeba invadens
HFNRRVLGMDNIPIDMVYPSFD

SEQ ID NO: 2999050 - protein, 24 aa, Entamoeba invadens
HFNVKFKYYLLNKMVTIWYEVDNA

SEQ ID NO: 2999051 - protein, 17 aa, Entamoeba invadens
HFPEMNKLEKLYPQVVR

SEQ ID NO: 2999052 - protein, 29 aa, Entamoeba invadens
HFPKTIYLRFKWFFLVSDILSPTDTVTSD

SEQ ID NO: 2999053 - protein, 19 aa, Entamoeba invadens
HFPLDFDSFIIHRKTPRYQ

SEQ ID NO: 2999054 - protein, 23 aa, Entamoeba invadens
HFQIVMKYFLYEQDFINSMLTCK

SEQ ID NO: 2999055 - protein, 24 aa, Entamoeba invadens
HFQIVMKYFLYKQDYINSMLTCKK

SEQ ID NO: 2999056 - protein, 24 aa, Entamoeba invadens
HFRDSDVFVFVYSVHDVASFNYVK

SEQ ID NO: 2999057 - protein, 17 aa, Entamoeba invadens
HFRIQLGTVIFVQKCFS

SEQ ID NO: 2999058 - protein, 26 aa, Entamoeba invadens
HFRPNTLFCLSKFKPPLSPRPSTLGS

SEQ ID NO: 2999059 - protein, 22 aa, Entamoeba invadens
HFSLIVLCFNGVEGFESLVMTE

SEQ ID NO: 2999060 - protein, 21 aa, Entamoeba invadens
HFSPLFKVEYLFEISLDVVAE

SEQ ID NO: 2999061 - protein, 28 aa, Entamoeba invadens
HFSSFQNFAPLLPLVPKITISTSQSFLF

SEQ ID NO: 2999062 - protein, 18 aa, Entamoeba invadens
HFSSKSHAFFPIPDVLYF

SEQ ID NO: 2999063 - protein, 22 aa, Entamoeba invadens
HFVETILLEAKLLCELVRRKFA

SEQ ID NO: 2999064 - protein, 18 aa, Entamoeba invadens
HFVFTLRNSFNIQPTRFF

SEQ ID NO: 2999065 - protein, 17 aa, Entamoeba invadens
HFVIVMSRLFKTVSKAL

SEQ ID NO: 2999066 - protein, 17 aa, Entamoeba invadens
HFWTIKTGTFRETIRNN

SEQ ID NO: 2999067 - protein, 18 aa, Entamoeba invadens
HFYELQQCYLNSLHLAFS

SEQ ID NO: 2999068 - protein, 22 aa, Entamoeba invadens
HFYPIMFYPIVLETPSSLFSVV

SEQ ID NO: 2999069 - protein, 18 aa, Entamoeba invadens
HFYVDNFLKEDFSFYGCN

SEQ ID NO: 2999070 - protein, 33 aa, Entamoeba invadens
HGAAVDWWSLGILIYEMIVGIPPFYDDDVSIMY

SEQ ID NO: 2999071 - protein, 25 aa, Entamoeba invadens
HGAPPYIDLPPMKAMLQITTKGMPD

SEQ ID NO: 2999072 - protein, 23 aa, Entamoeba invadens
HGCLAFCFMFKKELPCFSPTCKN

SEQ ID NO: 2999073 - protein, 32 aa, Entamoeba invadens
HGDFVIIMNLLLRYIFGLIGFVPTVSFGNYST

SEQ ID NO: 2999074 - protein, 25 aa, Entamoeba invadens
HGDKVIIFCDDLAPASYYSKKLNCV

SEQ ID NO: 2999075 - protein, 17 aa, Entamoeba invadens
HGDPPDFTLLKNTPQNL

SEQ ID NO: 2999076 - protein, 18 aa, Entamoeba invadens
HGDTPFQVTIDQISIITD

SEQ ID NO: 2999077 - protein, 24 aa, Entamoeba invadens
HGEYIIIPMTLFPGDFGSFTIVVH

SEQ ID NO: 2999078 - protein, 25 aa, Entamoeba invadens
HGFDVLLKQMFPVSVFLYNSDNSKT

SEQ ID NO: 2999079 - protein, 19 aa, Entamoeba invadens
HGFLIVYSVTDRNSFESIK

SEQ ID NO: 2999080 - protein, 26 aa, Entamoeba invadens
HGHAKVTYFGYDIFTGKRLDDACPST

SEQ ID NO: 2999081 - protein, 23 aa, Entamoeba invadens
HGIIGYWHLKNADKAPWEKSRFD

SEQ ID NO: 2999082 - protein, 18 aa, Entamoeba invadens
HGINFFIHDKRHLIRASL

SEQ ID NO: 2999083 - protein, 22 aa, Entamoeba invadens
HGKRYICTQCLLLDPTFDVKKL

SEQ ID NO: 2999084 - protein, 23 aa, Entamoeba invadens
HGKRYVFRTGEIACLLKDIASVS

SEQ ID NO: 2999085 - protein, 19 aa, Entamoeba invadens
HGLDRVVILWTATTERYVE

SEQ ID NO: 2999086 - protein, 22 aa, Entamoeba invadens
HGLDRVVILWTATTERYVELKA

SEQ ID NO: 2999087 - protein, 26 aa, Entamoeba invadens
HGNIIFPKDLIEKTKKWIKEFLLNIE

SEQ ID NO: 2999088 - protein, 21 aa, Entamoeba invadens
HGNYFNFLNILNDAQWVNLSH

SEQ ID NO: 2999089 - protein, 18 aa, Entamoeba invadens
HGQFIKIIKKLKITPISG

SEQ ID NO: 2999090 - protein, 26 aa, Entamoeba invadens
HGQYQIYYYRLLFGCEVLCGVDIEHS

SEQ ID NO: 2999091 - protein, 26 aa, Entamoeba invadens
HGTDFPLFNLLKMLEAMRLQIANSVN

SEQ ID NO: 2999092 - protein, 25 aa, Entamoeba invadens
HGTVTVTFQCPFYFVFDTIDTRDVV

SEQ ID NO: 2999093 - protein, 23 aa, Entamoeba invadens
HGVLTCKNLFPIVKKSLKVSNVN

SEQ ID NO: 2999094 - protein, 26 aa, Entamoeba invadens
HGVPDEWRWQVWKYLLRYVPVEKNRT

SEQ ID NO: 2999095 - protein, 26 aa, Entamoeba invadens
HGYVDIALLLLPFCTDVYQLTDVRGY

SEQ ID NO: 2999096 - protein, 22 aa, Entamoeba invadens
HHCPIMDLTLFQKTYLTTCFNV

SEQ ID NO: 2999097 - protein, 17 aa, Entamoeba invadens
HHDNKLALAKWKGRLEF

SEQ ID NO: 2999098 - protein, 36 aa, Entamoeba invadens
HHEILKRLTAPLLPNEFLKLLSLVFFVIKKDTKNSF

SEQ ID NO: 2999099 - protein, 22 aa, Entamoeba invadens
HHERVLICSPSNAAIDGIIMKL

SEQ ID NO: 2999100 - protein, 25 aa, Entamoeba invadens
HHFQTYLIVVSLFIEIFDELVDEND

SEQ ID NO: 2999101 - protein, 26 aa, Entamoeba invadens
HHGSHKYVFFWQPKITGEVNKSCLGQ

SEQ ID NO: 2999102 - protein, 19 aa, Entamoeba invadens
HHHICIVTELLSINLYELM

SEQ ID NO: 2999103 - protein, 29 aa, Entamoeba invadens
HHINIQVYFINFIALKFELVMKLNELRDR

SEQ ID NO: 2999104 - protein, 19 aa, Entamoeba invadens
HHLICLNHFKRYSTNKTPR

SEQ ID NO: 2999105 - protein, 17 aa, Entamoeba invadens
HHLNDIPLLFLADQLSD

SEQ ID NO: 2999106 - protein, 29 aa, Entamoeba invadens
HHNQLDIQMYMRIAPELYLKELVVGGINR

SEQ ID NO: 2999107 - protein, 19 aa, Entamoeba invadens
HHSGIKVEGFWPVVMAKAL

SEQ ID NO: 2999108 - protein, 25 aa, Entamoeba invadens
HHSSELAFFLLRRALRNKNRIGHQF

SEQ ID NO: 2999109 - protein, 18 aa, Entamoeba invadens
HHTKYLTALKYLYIDFES

SEQ ID NO: 2999110 - protein, 26 aa, Entamoeba invadens
HHTLFTLPYVLLPTFVDKPFFAAMSN

SEQ ID NO: 2999111 - protein, 18 aa, Entamoeba invadens
HHTLPLSGRFHKSFENMK

SEQ ID NO: 2999112 - protein, 28 aa, Entamoeba invadens
HHTLTPTLLKTKPSISFAALLKKETQNK

SEQ ID NO: 2999113 - protein, 25 aa, Entamoeba invadens
HHVWPISYVNVLPLDALRPAIVMFV

SEQ ID NO: 2999114 - protein, 18 aa, Entamoeba invadens
HHYGPVLVAIMAFETGYY

SEQ ID NO: 2999115 - protein, 17 aa, Entamoeba invadens
HIAAYAGSVLCCNWLIR

SEQ ID NO: 2999116 - protein, 17 aa, Entamoeba invadens
HIAIIKKNERMTSLLMK

SEQ ID NO: 2999117 - protein, 23 aa, Entamoeba invadens
HIATAMFFECKSLEKIFLIEKCE

SEQ ID NO: 2999118 - protein, 27 aa, Entamoeba invadens
HIAVPSKPLPPRPPMKALPSVPPPREK

SEQ ID NO: 2999119 - protein, 30 aa, Entamoeba invadens
HIAYVENTILRIYDFILKKEIFTHQNVIGV

SEQ ID NO: 2999120 - protein, 18 aa, Entamoeba invadens
HIDDALVLVFADYTLEIV

SEQ ID NO: 2999121 - protein, 17 aa, Entamoeba invadens
HIDDYLVQLLKERSKYT

SEQ ID NO: 2999122 - protein, 21 aa, Entamoeba invadens
HIDFIAMIEILGRVKKPFFSA

SEQ ID NO: 2999123 - protein, 25 aa, Entamoeba invadens
HIDIAFWNHDLLIKTTVWNELWNKQ

SEQ ID NO: 2999124 - protein, 18 aa, Entamoeba invadens
HIDQVSGIKILAPLIRQL

SEQ ID NO: 2999125 - protein, 18 aa, Entamoeba invadens
HIEDLMTLVKDKLQKQIL

SEQ ID NO: 2999126 - protein, 23 aa, Entamoeba invadens
HIEDSLILCQFFAQIEQHYNTQK

SEQ ID NO: 2999127 - protein, 23 aa, Entamoeba invadens
HIENIPMLQITNTTLRPLTFPHT

SEQ ID NO: 2999128 - protein, 21 aa, Entamoeba invadens
HIEVTVRQSLLFFYSDTDEVV

SEQ ID NO: 2999129 - protein, 20 aa, Entamoeba invadens
HIFIPRYLEGQKLTVLPMQK

SEQ ID NO: 2999130 - protein, 19 aa, Entamoeba invadens
HIFSRIFMRNFKDCGKLRK

SEQ ID NO: 2999131 - protein, 18 aa, Entamoeba invadens
HIFYMELVDLFYCPDEMA

SEQ ID NO: 2999132 - protein, 25 aa, Entamoeba invadens
HIGNLDCFVQFAISLGVKVYGINGT

SEQ ID NO: 2999133 - protein, 17 aa, Entamoeba invadens
HIGNPNTIKLLQKGTHV

SEQ ID NO: 2999134 - protein, 18 aa, Entamoeba invadens
HIHFPMKEFLTFFETMNY

SEQ ID NO: 2999135 - protein, 18 aa, Entamoeba invadens
HIIFLTSGYQCDCTQINS

SEQ ID NO: 2999136 - protein, 19 aa, Entamoeba invadens
HIIFWSKSENLKHIRSLID

SEQ ID NO: 2999137 - protein, 19 aa, Entamoeba invadens
HIIPFLKTLSDAQTLSIVS

SEQ ID NO: 2999138 - protein, 19 aa, Entamoeba invadens
HIKELLKPENKYSAEYIAQ

SEQ ID NO: 2999139 - protein, 26 aa, Entamoeba invadens
HILCVLRTMRTILVQYPSLVLENSSS

SEQ ID NO: 2999140 - protein, 32 aa, Entamoeba invadens
HILRETYLFGNPTIYFNFFDVSHGILSRKYFH

SEQ ID NO: 2999141 - protein, 18 aa, Entamoeba invadens
HILTVECKLTVLSSQHED

SEQ ID NO: 2999142 - protein, 20 aa, Entamoeba invadens
HIMIVCKYFNSFNDFVQLMI

SEQ ID NO: 2999143 - protein, 18 aa, Entamoeba invadens
HIMMNTFSNFFEFNEDFL

SEQ ID NO: 2999144 - protein, 34 aa, Entamoeba invadens
HIMQSLRVILSVLPRYKYLDFISTLLSTLNKLGL

SEQ ID NO: 2999145 - protein, 18 aa, Entamoeba invadens
HINGILHRDIKPDNFLVF

SEQ ID NO: 2999146 - protein, 18 aa, Entamoeba invadens
HINIPQFISHLKTQQYNE

SEQ ID NO: 2999147 - protein, 21 aa, Entamoeba invadens
HINQCFICGKYGHKKADCPEK

SEQ ID NO: 2999148 - protein, 26 aa, Entamoeba invadens
HINRKIPVRMLLGCKSDLAKNRQVSL

SEQ ID NO: 2999149 - protein, 29 aa, Entamoeba invadens
HIPDFLKSLPHFMPKITTLSSLATPLQNM

SEQ ID NO: 2999150 - protein, 21 aa, Entamoeba invadens
HIPLTHTYSLVNKLYQAFCFK

SEQ ID NO: 2999151 - protein, 17 aa, Entamoeba invadens
HIQFLPDQKYLSWCTNS

SEQ ID NO: 2999152 - protein, 20 aa, Entamoeba invadens
HIQIVAQHFFFADDFINMIL

SEQ ID NO: 2999153 - protein, 20 aa, Entamoeba invadens
HIQIVTLYGKKLLITAVRLR

SEQ ID NO: 2999154 - protein, 25 aa, Entamoeba invadens
HIRVNSLYIVALARSNNNAAVVFEV

SEQ ID NO: 2999155 - protein, 21 aa, Entamoeba invadens
HISFAYSLNLLVSTPSKQLVQ

SEQ ID NO: 2999156 - protein, 22 aa, Entamoeba invadens
HISFPQNFSFWPGFNTFDFDFA

SEQ ID NO: 2999157 - protein, 20 aa, Entamoeba invadens
HISLIQPPYPTVSTLQLSIF

SEQ ID NO: 2999158 - protein, 17 aa, Entamoeba invadens
HISLPKTLFEIGQKCFY

SEQ ID NO: 2999159 - protein, 26 aa, Entamoeba invadens
HISPPFTKLRLFFTCFDHIAEGLVGF

SEQ ID NO: 2999160 - protein, 29 aa, Entamoeba invadens
HISTDVLIAKLFFFFERSAELCNVDVTNE

SEQ ID NO: 2999161 - protein, 20 aa, Entamoeba invadens
HITKRLIIDKTFVLKPKELD

SEQ ID NO: 2999162 - protein, 17 aa, Entamoeba invadens
HITLVHVYNQWKKHEGD

SEQ ID NO: 2999163 - protein, 23 aa, Entamoeba invadens
HITRNLIVAYSSLTLFCGHDKSH

SEQ ID NO: 2999164 - protein, 18 aa, Entamoeba invadens
HITSNLKKVLLVLSPDDL

SEQ ID NO: 2999165 - protein, 24 aa, Entamoeba invadens
HITVPFPIESLLSGVQRRVSEKEY

SEQ ID NO: 2999166 - protein, 20 aa, Entamoeba invadens
HIVEQYKAPPNPPELTFEQL

SEQ ID NO: 2999167 - protein, 24 aa, Entamoeba invadens
HIVKYEIWHLVNCNTVYGANPEKY

SEQ ID NO: 2999168 - protein, 22 aa, Entamoeba invadens
HIVPRPVQVLSILRLADEILNR

SEQ ID NO: 2999169 - protein, 18 aa, Entamoeba invadens
HIVWHVFCRVKNLRSSMD

SEQ ID NO: 2999170 - protein, 18 aa, Entamoeba invadens
HIWKGAVTLLRPRTLRWS

SEQ ID NO: 2999171 - protein, 37 aa, Entamoeba invadens
HIYGIDDFVFLFKHFPLLLSFSFRLSQIDTIPFTLVD

SEQ ID NO: 2999172 - protein, 20 aa, Entamoeba invadens
HIYRFVGIFIYMGAHHNTKN

SEQ ID NO: 2999173 - protein, 25 aa, Entamoeba invadens
HKALEIRVFLLSGCLIHLPTLKMPK

SEQ ID NO: 2999174 - protein, 19 aa, Entamoeba invadens
HKCFICKSTGHLTKECPNK

SEQ ID NO: 2999175 - protein, 30 aa, Entamoeba invadens
HKCKDDFLPPKTLGYLCSTLCWVGSFLVQS

SEQ ID NO: 2999176 - protein, 31 aa, Entamoeba invadens
HKDDPILQSMLDGTIPLPNAIEPIPIESNSS

SEQ ID NO: 2999177 - protein, 26 aa, Entamoeba invadens
HKDIASYIQLYPIFKDYKFYGRFDNH

SEQ ID NO: 2999178 - protein, 17 aa, Entamoeba invadens
HKDLLVLFTKAKRKTED

SEQ ID NO: 2999179 - protein, 23 aa, Entamoeba invadens
HKDQPFIFNVQTFLTKRCLEKMA

SEQ ID NO: 2999180 - protein, 41 aa, Entamoeba invadens
HKEEVFKKLLLNYPFFDYKLRMLDQIALFLNMERDPLYIKA

SEQ ID NO: 2999181 - protein, 27 aa, Entamoeba invadens
HKEGKAIFFNTLNWYFEVTLIGKDEKN

SEQ ID NO: 2999182 - protein, 22 aa, Entamoeba invadens
HKEKIITLNTKIAENEKQIDQY

SEQ ID NO: 2999183 - protein, 17 aa, Entamoeba invadens
HKELLARVSLLESSKDI

SEQ ID NO: 2999184 - protein, 27 aa, Entamoeba invadens
HKFNQSEFTYLCSQILFVTQKVGTSNF

SEQ ID NO: 2999185 - protein, 24 aa, Entamoeba invadens
HKFYKVVVWYLASYSAFSEDKKNC

SEQ ID NO: 2999186 - protein, 23 aa, Entamoeba invadens
HKFYPAFIHILARLMNAHPEFRM

SEQ ID NO: 2999187 - protein, 24 aa, Entamoeba invadens
HKGEACGFGLFIAPLCSCHINDKI

SEQ ID NO: 2999188 - protein, 20 aa, Entamoeba invadens
HKGFYELILSRDSYVAYCET

SEQ ID NO: 2999189 - protein, 35 aa, Entamoeba invadens
HKGKTVVLVFYPHDWTYICPTEILGFGKLAQEMPE

SEQ ID NO: 2999190 - protein, 21 aa, Entamoeba invadens
HKHEISLMALSLDGTLLATTS

SEQ ID NO: 2999191 - protein, 18 aa, Entamoeba invadens
HKIAVLCFASDGTSFGAF

SEQ ID NO: 2999192 - protein, 20 aa, Entamoeba invadens
HKIFTILQKLGHLDFLIVGD

SEQ ID NO: 2999193 - protein, 25 aa, Entamoeba invadens
HKIFYVFELLVNRLGFIHRLIDDYT

SEQ ID NO: 2999194 - protein, 21 aa, Entamoeba invadens
HKIIRYVISNNLLPISFSDHY

SEQ ID NO: 2999195 - protein, 17 aa, Entamoeba invadens
HKILEDKEIKRNNWIVC

SEQ ID NO: 2999196 - protein, 17 aa, Entamoeba invadens
HKITQNLIIFIVGGVCL

SEQ ID NO: 2999197 - protein, 30 aa, Entamoeba invadens
HKKADEVILKMRIKLILDTAKGIQYLHANN

SEQ ID NO: 2999198 - protein, 25 aa, Entamoeba invadens
HKKCIKKLAIPCRPIFTLKGSHDTH

SEQ ID NO: 2999199 - protein, 27 aa, Entamoeba invadens
HKKEKMYIPELIFGHLLTSSNYRDDDK

SEQ ID NO: 2999200 - protein, 19 aa, Entamoeba invadens
HKKFDVSAPEHAELKTWGK

SEQ ID NO: 2999201 - protein, 25 aa, Entamoeba invadens
HKLDFYHINVWFAVTYTCTQRHLHT

SEQ ID NO: 2999202 - protein, 24 aa, Entamoeba invadens
HKLIELIEPITLLKKCFMGKRNSR

SEQ ID NO: 2999203 - protein, 18 aa, Entamoeba invadens
HKLVIPILSDVMIDKLTP

SEQ ID NO: 2999204 - protein, 22 aa, Entamoeba invadens
HKLVRYAISNNLLPWSFCTVFG

SEQ ID NO: 2999205 - protein, 17 aa, Entamoeba invadens
HKLYDKMAIESSTKIKE

SEQ ID NO: 2999206 - protein, 22 aa, Entamoeba invadens
HKNKKLLKPTKSLKQSRKTNLQ

SEQ ID NO: 2999207 - protein, 19 aa, Entamoeba invadens
HKNLAICFAPTLFTFAKEE

SEQ ID NO: 2999208 - protein, 24 aa, Entamoeba invadens
HKNNHPYHIVRNMHYSLLTEDWGA

SEQ ID NO: 2999209 - protein, 23 aa, Entamoeba invadens
HKNVVLFIGLCKEPNRVSIVTEY

SEQ ID NO: 2999210 - protein, 25 aa, Entamoeba invadens
HKQRASALKWLVALVLQTNAIQQDI

SEQ ID NO: 2999211 - protein, 34 aa, Entamoeba invadens
HKRDLSRYVKFPRYVRVQKEKRILMKRLKVPPAV

SEQ ID NO: 2999212 - protein, 25 aa, Entamoeba invadens
HKRNFIYKMLSVCYPTITFSLDIVP

SEQ ID NO: 2999213 - protein, 34 aa, Entamoeba invadens
HKRTILFSYDYQLPGFIYYIHCAEKMRDGIMYTL

SEQ ID NO: 2999214 - protein, 17 aa, Entamoeba invadens
HKRVVVHDILRSRSLSF

SEQ ID NO: 2999215 - protein, 25 aa, Entamoeba invadens
HKSLEPFGGLIAWLRKYSNDDFVAV

SEQ ID NO: 2999216 - protein, 22 aa, Entamoeba invadens
HKSVVLLYKNEFYSALYISSMP

SEQ ID NO: 2999217 - protein, 27 aa, Entamoeba invadens
HKSWKKRWFQTTPRNPFRLDYYTNDSC

SEQ ID NO: 2999218 - protein, 22 aa, Entamoeba invadens
HKTEIFVFKNVIYTISDRKKYG

SEQ ID NO: 2999219 - protein, 19 aa, Entamoeba invadens
HKTKFKKIIKLLENNKRDT

SEQ ID NO: 2999220 - protein, 25 aa, Entamoeba invadens
HKTTKVVLIMTNTYLYIATNDVIKY

SEQ ID NO: 2999221 - protein, 25 aa, Entamoeba invadens
HKVDVHHLLIQLFIRCEHSLSVHSC

SEQ ID NO: 2999222 - protein, 17 aa, Entamoeba invadens
HKWMHTKARRLRITSDQ

SEQ ID NO: 2999223 - protein, 23 aa, Entamoeba invadens
HKYLRSVTELNMRLLSLMSGRTK

SEQ ID NO: 2999224 - protein, 18 aa, Entamoeba invadens
HKYRGYMPNFPKRTHKSI

SEQ ID NO: 2999225 - protein, 20 aa, Entamoeba invadens
HLAIFRPDVQLFMTGTTTLC

SEQ ID NO: 2999226 - protein, 17 aa, Entamoeba invadens
HLAPPPSKGQPLRISRK

SEQ ID NO: 2999227 - protein, 25 aa, Entamoeba invadens
HLDKVVLKRREGCKVEISIKPLCST

SEQ ID NO: 2999228 - protein, 23 aa, Entamoeba invadens
HLDNCYYINFDLPSTLTGLTVSH

SEQ ID NO: 2999229 - protein, 26 aa, Entamoeba invadens
HLDSLFYTFNIPIKKPLMLSNLPHLT

SEQ ID NO: 2999230 - protein, 21 aa, Entamoeba invadens
HLDSPYLKLKPNADLTSVGLV

SEQ ID NO: 2999231 - protein, 25 aa, Entamoeba invadens
HLEDIYVGYRYYTTFNTKVSFPFGY

SEQ ID NO: 2999232 - protein, 21 aa, Entamoeba invadens
HLELKNFLKINGKPFKEDEVR

SEQ ID NO: 2999233 - protein, 24 aa, Entamoeba invadens
HLERGIPLLVIDLIKSIYTDENFV

SEQ ID NO: 2999234 - protein, 27 aa, Entamoeba invadens
HLESLLLLIGLVYKILPYFVKSARDTL

SEQ ID NO: 2999235 - protein, 23 aa, Entamoeba invadens
HLESPRKYPLLPGKRGSLSLHDM

SEQ ID NO: 2999236 - protein, 22 aa, Entamoeba invadens
HLFGIFSLLKMKQGNLLIIGPQ

SEQ ID NO: 2999237 - protein, 20 aa, Entamoeba invadens
HLFGVFIYEQVKRGEWIDDF

SEQ ID NO: 2999238 - protein, 17 aa, Entamoeba invadens
HLFLINFVPSECDERFV

SEQ ID NO: 2999239 - protein, 19 aa, Entamoeba invadens
HLFYIIDYCPGGEFYYYLQ

SEQ ID NO: 2999240 - protein, 32 aa, Entamoeba invadens
HLGFHKRTLFLFNDVLLFTSKVDKLLKVKTVI

SEQ ID NO: 2999241 - protein, 26 aa, Entamoeba invadens
HLGLYEFIGLYRFLEICFVVFNTNPG

SEQ ID NO: 2999242 - protein, 19 aa, Entamoeba invadens
HLHIFRYAFEILTKRLIDD

SEQ ID NO: 2999243 - protein, 21 aa, Entamoeba invadens
HLHTGLNFRKAMTLMFHGFFD

SEQ ID NO: 2999244 - protein, 28 aa, Entamoeba invadens
HLIDDEDYVLYYDLVARRNFNADNGDDN

SEQ ID NO: 2999245 - protein, 17 aa, Entamoeba invadens
HLILEKYCKARNVNFVP

SEQ ID NO: 2999246 - protein, 17 aa, Entamoeba invadens
HLINLFNVRPELSSMLS

SEQ ID NO: 2999247 - protein, 19 aa, Entamoeba invadens
HLIQTLKSEFLVESCDVIC

SEQ ID NO: 2999248 - protein, 22 aa, Entamoeba invadens
HLKDIYTNIVFFGDKTMEGGND

SEQ ID NO: 2999249 - protein, 26 aa, Entamoeba invadens
HLKEGLRPFLLFNYLENNCGNDMKSK

SEQ ID NO: 2999250 - protein, 24 aa, Entamoeba invadens
HLKEIVLFYTLFECIGYDSINNRC

SEQ ID NO: 2999251 - protein, 21 aa, Entamoeba invadens
HLKIILRSIYNYVLSIRGADD

SEQ ID NO: 2999252 - protein, 23 aa, Entamoeba invadens
HLKMAIYKYGTWMGGLVGSLSVA

SEQ ID NO: 2999253 - protein, 18 aa, Entamoeba invadens
HLKMVFDMANIEVKGFLT

SEQ ID NO: 2999254 - protein, 25 aa, Entamoeba invadens
HLKNASYIVLYYYTDNSESANDLEG

SEQ ID NO: 2999255 - protein, 18 aa, Entamoeba invadens
HLKVFRAHFNSLVPVEIA

SEQ ID NO: 2999256 - protein, 28 aa, Entamoeba invadens
HLLDKFQCEFIINFYGAVFIKTKFCMVA

SEQ ID NO: 2999257 - protein, 18 aa, Entamoeba invadens
HLMIISKYFVTINDFIHV

SEQ ID NO: 2999258 - protein, 18 aa, Entamoeba invadens
HLMRCKIECFLGCASLKS

SEQ ID NO: 2999259 - protein, 17 aa, Entamoeba invadens
HLMVWVKESYKGNLDMM

SEQ ID NO: 2999260 - protein, 17 aa, Entamoeba invadens
HLNGILHRDIKPDNILI

SEQ ID NO: 2999261 - protein, 44 aa, Entamoeba invadens
HLNHPNILKLLGFFEDSERWFLVLEYCKNGELYGLLQKAGRFEE

SEQ ID NO: 2999262 - protein, 18 aa, Entamoeba invadens
HLNIWRYGELVEEEEVKE

SEQ ID NO: 2999263 - protein, 18 aa, Entamoeba invadens
HLNLDIDGVFAKLYYRNL

SEQ ID NO: 2999264 - protein, 17 aa, Entamoeba invadens
HLNLEELCITPQPKLVI

SEQ ID NO: 2999265 - protein, 35 aa, Entamoeba invadens
HLNSLWSQVKPLPGAIRILQYFKKHSIPIALATST

SEQ ID NO: 2999266 - protein, 25 aa, Entamoeba invadens
HLNTDTLIECVFKNSFRLVEYSDKD

SEQ ID NO: 2999267 - protein, 22 aa, Entamoeba invadens
HLPSRLPCKVIGKYEYVASYGK

SEQ ID NO: 2999268 - protein, 18 aa, Entamoeba invadens
HLQDLYKHKLIEFIVDFM

SEQ ID NO: 2999269 - protein, 22 aa, Entamoeba invadens
HLQIVAQHFFFADDFINMILVC

SEQ ID NO: 2999270 - protein, 23 aa, Entamoeba invadens
HLQKHVFEITQAGLKFYRYKSHT

SEQ ID NO: 2999271 - protein, 34 aa, Entamoeba invadens
HLQMYDPLQIAVYPIICRLLVLPGASSLFFREGG

SEQ ID NO: 2999272 - protein, 25 aa, Entamoeba invadens
HLQQFIEFLDKDGKLPCVFFIFSRK

SEQ ID NO: 2999273 - protein, 26 aa, Entamoeba invadens
HLSDIVKLWRISLMSHQIVLNEECLQ

SEQ ID NO: 2999274 - protein, 25 aa, Entamoeba invadens
HLSDYLRFQLVTIPPTPVKTVVLDQ

SEQ ID NO: 2999275 - protein, 34 aa, Entamoeba invadens
HLSRALHDTLTLTFRWNIPIYTSKKTGTLFITKT

SEQ ID NO: 2999276 - protein, 25 aa, Entamoeba invadens
HLSRFVVKGTAFLWHQVRYMVGALF

SEQ ID NO: 2999277 - protein, 19 aa, Entamoeba invadens
HLSTLFKVTYRNGFTYHLP

SEQ ID NO: 2999278 - protein, 18 aa, Entamoeba invadens
HLTCLGRLFTREQDILVP

SEQ ID NO: 2999279 - protein, 26 aa, Entamoeba invadens
HLTEMEFYFLYLKVLFAKHKNTDVFT

SEQ ID NO: 2999280 - protein, 29 aa, Entamoeba invadens
HLTPQQTQIMKALAGFRQLRMLQKLNRKT

SEQ ID NO: 2999281 - protein, 23 aa, Entamoeba invadens
HLTRFIHRVVLEMISTPLSVIRE

SEQ ID NO: 2999282 - protein, 19 aa, Entamoeba invadens
HLTRPPTPPLFTFEKKNKE

SEQ ID NO: 2999283 - protein, 18 aa, Entamoeba invadens
HLTSYFYREFYRIIVYEE

SEQ ID NO: 2999284 - protein, 23 aa, Entamoeba invadens
HLVGNLLKKFINSVPNKLPQSLQ

SEQ ID NO: 2999285 - protein, 30 aa, Entamoeba invadens
HLVNGTFKHSFFDLFLLESRVLMDKNMIVD

SEQ ID NO: 2999286 - protein, 17 aa, Entamoeba invadens
HLYILQYVVQSDTITKT

SEQ ID NO: 2999287 - protein, 17 aa, Entamoeba invadens
HLYMLQYPDVVLDSDSS

SEQ ID NO: 2999288 - protein, 18 aa, Entamoeba invadens
HMEEGEITWWAFGNTLLS

SEQ ID NO: 2999289 - protein, 24 aa, Entamoeba invadens
HMEIVYEINYRFLEWVKGEHKCTE

SEQ ID NO: 2999290 - protein, 17 aa, Entamoeba invadens
HMIGHELTAYYGVAHGE

SEQ ID NO: 2999291 - protein, 21 aa, Entamoeba invadens
HMIVMEFIIYRSLDQIIKRYK

SEQ ID NO: 2999292 - protein, 21 aa, Entamoeba invadens
HMMLVCKYFQSFDDFIQVMSV

SEQ ID NO: 2999293 - protein, 31 aa, Entamoeba invadens
HMNTFSISLYNFIIPYFISNKNYSALSSAHE

SEQ ID NO: 2999294 - protein, 22 aa, Entamoeba invadens
HMPPHKIISVLEILSNPEFEKN

SEQ ID NO: 2999295 - protein, 28 aa, Entamoeba invadens
HMQNYTLYSSLRPFGCSLLVGGYDHRGY

SEQ ID NO: 2999296 - protein, 23 aa, Entamoeba invadens
HMQTNYKLIVIASQKIVKEPNYI

SEQ ID NO: 2999297 - protein, 25 aa, Entamoeba invadens
HMREDNTWPQVFLKVLCNPHYELML

SEQ ID NO: 2999298 - protein, 38 aa, Entamoeba invadens
HMRKVGVTSFKKISMINFLIFHFGYDWKEVVEAPQGGN

SEQ ID NO: 2999299 - protein, 26 aa, Entamoeba invadens
HMSDDMAKCFPILNSIIKLNKSEPFR

SEQ ID NO: 2999300 - protein, 20 aa, Entamoeba invadens
HMSDEDFLMLFEVGFEEFKG

SEQ ID NO: 2999301 - protein, 27 aa, Entamoeba invadens
HMYIDTNTLFLIYYLSATIVESETKSL

SEQ ID NO: 2999302 - protein, 26 aa, Entamoeba invadens
HNAFCNCFHLCRVVLPKYTKVSPTAF

SEQ ID NO: 2999303 - protein, 24 aa, Entamoeba invadens
HNAKKALDMLYDKLTLHLVGGAFN

SEQ ID NO: 2999304 - protein, 23 aa, Entamoeba invadens
HNAQVSSFKVQISAPASVVQEEE

SEQ ID NO: 2999305 - protein, 22 aa, Entamoeba invadens
HNCKKLIQLNLPKSLNVIESSC

SEQ ID NO: 2999306 - protein, 23 aa, Entamoeba invadens
HNCSALKLLRLYDCKQFSDVAFI

SEQ ID NO: 2999307 - protein, 17 aa, Entamoeba invadens
HNDPRFLGILNCEHSKK

SEQ ID NO: 2999308 - protein, 26 aa, Entamoeba invadens
HNEFALLDTFLEFLNRRLLSYRDYDF

SEQ ID NO: 2999309 - protein, 17 aa, Entamoeba invadens
HNEMMELKGNIRVFCRV

SEQ ID NO: 2999310 - protein, 23 aa, Entamoeba invadens
HNENYVLGITWFGKTIYRCTPFN

SEQ ID NO: 2999311 - protein, 24 aa, Entamoeba invadens
HNESFNIAIWKTVTPFFHILQGHT

SEQ ID NO: 2999312 - protein, 22 aa, Entamoeba invadens
HNFNAMLSLLQPLYEKMEKGGE

SEQ ID NO: 2999313 - protein, 32 aa, Entamoeba invadens
HNGAEKRVLFLLSDCLLLTKREDRLLKIRYVV

SEQ ID NO: 2999314 - protein, 22 aa, Entamoeba invadens
HNGLHCPNWCLFGHCVNCNSNE

SEQ ID NO: 2999315 - protein, 26 aa, Entamoeba invadens
HNILKHLVPFYIRCGLHPVENVAMSV

SEQ ID NO: 2999316 - protein, 23 aa, Entamoeba invadens
HNINSYPICDYIISLLTHDTYQK

SEQ ID NO: 2999317 - protein, 26 aa, Entamoeba invadens
HNIRKMLLYFKLINKLASPEQKTSLV

SEQ ID NO: 2999318 - protein, 23 aa, Entamoeba invadens
HNIRNYWLMQETLRFEKEHPERC

SEQ ID NO: 2999319 - protein, 19 aa, Entamoeba invadens
HNISSPFPTLKFLFEMEFS

SEQ ID NO: 2999320 - protein, 30 aa, Entamoeba invadens
HNKKMSHWYIQLLLLSPKSRRLQVLRRLIE

SEQ ID NO: 2999321 - protein, 25 aa, Entamoeba invadens
HNKRSLAFVLQFFECVEPPYCEVDN

SEQ ID NO: 2999322 - protein, 23 aa, Entamoeba invadens
HNLDVLSIGFMLSNPDAPVIWRG

SEQ ID NO: 2999323 - protein, 17 aa, Entamoeba invadens
HNLEDLILPNGLVLIGE

SEQ ID NO: 2999324 - protein, 26 aa, Entamoeba invadens
HNLKSQYMMYLGWYDNNVAHLNELPP

SEQ ID NO: 2999325 - protein, 18 aa, Entamoeba invadens
HNLKYDSCFLAKYGIEIC

SEQ ID NO: 2999326 - protein, 27 aa, Entamoeba invadens
HNMFYITHFLVMNKIDAFLPVFEEKKI

SEQ ID NO: 2999327 - protein, 21 aa, Entamoeba invadens
HNMYHPYMFTHIQAQCYAKLK

SEQ ID NO: 2999328 - protein, 21 aa, Entamoeba invadens
HNNEIFRLALQKARGVVTIAQ

SEQ ID NO: 2999329 - protein, 25 aa, Entamoeba invadens
HNNGNELWVILLEKAYAKVVGNYGL

SEQ ID NO: 2999330 - protein, 27 aa, Entamoeba invadens
HNNSVVKLYWAFQDDTNLYLILEYCPG

SEQ ID NO: 2999331 - protein, 24 aa, Entamoeba invadens
HNPMADMSIYFFIAQPFSREDYDM

SEQ ID NO: 2999332 - protein, 17 aa, Entamoeba invadens
HNRFYPPDYTLTKQRQV

SEQ ID NO: 2999333 - protein, 31 aa, Entamoeba invadens
HNRLYQIPHRLSIKLRTLLVSSNRIIALPTT

SEQ ID NO: 2999334 - protein, 18 aa, Entamoeba invadens
HNRYSEVISSKRTLYDLY

SEQ ID NO: 2999335 - protein, 25 aa, Entamoeba invadens
HNTSGNPWNLLPSAYRASFSKNQTN

SEQ ID NO: 2999336 - protein, 24 aa, Entamoeba invadens
HNTTPFYRYIIITHSDKEDTDNIK

SEQ ID NO: 2999337 - protein, 17 aa, Entamoeba invadens
HNTVFMSMGTSIYQCDI

SEQ ID NO: 2999338 - protein, 19 aa, Entamoeba invadens
HNVIPFLKEQEMLALMCVN

SEQ ID NO: 2999339 - protein, 21 aa, Entamoeba invadens
HNVMQYLIGLCLRGGWNQVKV

SEQ ID NO: 2999340 - protein, 17 aa, Entamoeba invadens
HPAMQHFMAALPVIPCL

SEQ ID NO: 2999341 - protein, 21 aa, Entamoeba invadens
HPARYNLLLRELLKNTQQTDL

SEQ ID NO: 2999342 - protein, 25 aa, Entamoeba invadens
HPAVSTPFLTIVYNLDNYAGLDEFS

SEQ ID NO: 2999343 - protein, 20 aa, Entamoeba invadens
HPDILGMTGIILASSTILLD

SEQ ID NO: 2999344 - protein, 26 aa, Entamoeba invadens
HPDYRLRVTVSLPAFDFGLSIRIDGM

SEQ ID NO: 2999345 - protein, 23 aa, Entamoeba invadens
HPEDLVFVLPHQLEVVRNKNVVV

SEQ ID NO: 2999346 - protein, 19 aa, Entamoeba invadens
HPELIRRLGCIAMNGLIEA

SEQ ID NO: 2999347 - protein, 19 aa, Entamoeba invadens
HPESLWRVVVTRLGKEDPD

SEQ ID NO: 2999348 - protein, 22 aa, Entamoeba invadens
HPFFNGIHWSTLFDEKRDDIFV

SEQ ID NO: 2999349 - protein, 35 aa, Entamoeba invadens
HPGIVDFFCYKEVVYLVLISSEFVRYTFKDNKIIV

SEQ ID NO: 2999350 - protein, 20 aa, Entamoeba invadens
HPHLYFQFKSVFESVTIYKP

SEQ ID NO: 2999351 - protein, 17 aa, Entamoeba invadens
HPIAPYLTTKVITIDRD

SEQ ID NO: 2999352 - protein, 33 aa, Entamoeba invadens
HPIDQIIKIFPQIETLILVEFPQTLTGITLQKV

SEQ ID NO: 2999353 - protein, 18 aa, Entamoeba invadens
HPKFVPMKGAWFIDKYLA

SEQ ID NO: 2999354 - protein, 19 aa, Entamoeba invadens
HPLEFPSLQVLDLSLNNLS

SEQ ID NO: 2999355 - protein, 26 aa, Entamoeba invadens
HPLIDDLYMFFIHPCGTSSTIETVIS

SEQ ID NO: 2999356 - protein, 27 aa, Entamoeba invadens
HPLPCEGVYFVLYKTNFDTLLKTHPLA

SEQ ID NO: 2999357 - protein, 20 aa, Entamoeba invadens
HPLTAMIWTNEEGSLYMPAM

SEQ ID NO: 2999358 - protein, 22 aa, Entamoeba invadens
HPLWSLWDSVLELAIPKFVMVQ

SEQ ID NO: 2999359 - protein, 20 aa, Entamoeba invadens
HPMFRYLKKNHQILSDALKL

SEQ ID NO: 2999360 - protein, 30 aa, Entamoeba invadens
HPNDDKNFFFTVFSAFWILSEGVGYIHQNL

SEQ ID NO: 2999361 - protein, 22 aa, Entamoeba invadens
HPNLPIMRFEDYSVFSLASSSV

SEQ ID NO: 2999362 - protein, 22 aa, Entamoeba invadens
HPNLVDYFDYFELPYSISQGGK

SEQ ID NO: 2999363 - protein, 35 aa, Entamoeba invadens
HPNVVTFYEAFYLPAKKLMWMSMEFMDGGCLTDIL

SEQ ID NO: 2999364 - protein, 28 aa, Entamoeba invadens
HPRDKLYNQLFLDLKYYEDLFDILNKLA

SEQ ID NO: 2999365 - protein, 25 aa, Entamoeba invadens
HPRKKSKITLPFFTVIKIESDEEAI

SEQ ID NO: 2999366 - protein, 20 aa, Entamoeba invadens
HPRVRYMALKLLDNINNKFV

SEQ ID NO: 2999367 - protein, 18 aa, Entamoeba invadens
HPSCFLIQNLNSGKYLGV

SEQ ID NO: 2999368 - protein, 26 aa, Entamoeba invadens
HPSIDSFINYALHSSLNYIFAVLTMD

SEQ ID NO: 2999369 - protein, 18 aa, Entamoeba invadens
HPSLVLQHLFRLCMSSNI

SEQ ID NO: 2999370 - protein, 18 aa, Entamoeba invadens
HPSVSDFSVFLSPKSRKQ

SEQ ID NO: 2999371 - protein, 19 aa, Entamoeba invadens
HPSVYPTFSIVDPVYTMSL

SEQ ID NO: 2999372 - protein, 30 aa, Entamoeba invadens
HPTDPMIRKAYYLYSLPIVVNDNVLIESNS

SEQ ID NO: 2999373 - protein, 18 aa, Entamoeba invadens
HPTLRERIKRIFTVKEGG

SEQ ID NO: 2999374 - protein, 26 aa, Entamoeba invadens
HPTRNSVIGTPFWMSPELIRSMDYGN

SEQ ID NO: 2999375 - protein, 17 aa, Entamoeba invadens
HPYAYDSFIKWETDDRT

SEQ ID NO: 2999376 - protein, 17 aa, Entamoeba invadens
HPYLVLIIDVNSSVIVY

SEQ ID NO: 2999377 - protein, 20 aa, Entamoeba invadens
HQCYVWDIWGDPSSSSLFDT

SEQ ID NO: 2999378 - protein, 19 aa, Entamoeba invadens
HQDDDVLMLITNQLKKDLQ

SEQ ID NO: 2999379 - protein, 26 aa, Entamoeba invadens
HQDILAFLSIFFYYLANFSELNKMNE

SEQ ID NO: 2999380 - protein, 25 aa, Entamoeba invadens
HQDTHGMLLSCFSAFWIETNGNVNF

SEQ ID NO: 2999381 - protein, 25 aa, Entamoeba invadens
HQDTHGMLLSCFSAFWVETNGDVNF

SEQ ID NO: 2999382 - protein, 24 aa, Entamoeba invadens
HQEAARLIIKFLKENKFTIDIVGH

SEQ ID NO: 2999383 - protein, 21 aa, Entamoeba invadens
HQFNGWGYIPSSYVIFEKYMY

SEQ ID NO: 2999384 - protein, 20 aa, Entamoeba invadens
HQFNILETITLIVSFMTTFL

SEQ ID NO: 2999385 - protein, 27 aa, Entamoeba invadens
HQFPEKLIPKFITLLDRGLNCSIHGSG

SEQ ID NO: 2999386 - protein, 19 aa, Entamoeba invadens
HQGLGGVRLVLLDIINKFK

SEQ ID NO: 2999387 - protein, 24 aa, Entamoeba invadens
HQHSRICLCLDLPGGPFYSTPFVL

SEQ ID NO: 2999388 - protein, 28 aa, Entamoeba invadens
HQIETVCLLLLMKVKYPDRIHLLRGNHE

SEQ ID NO: 2999389 - protein, 17 aa, Entamoeba invadens
HQKMTLLESAPILLQLK

SEQ ID NO: 2999390 - protein, 20 aa, Entamoeba invadens
HQLLFNACERFDIEEFWKAV

SEQ ID NO: 2999391 - protein, 25 aa, Entamoeba invadens
HQLTLKRVFVVLKLNTFSEIDYVQL

SEQ ID NO: 2999392 - protein, 25 aa, Entamoeba invadens
HQSLRYVYDLPKYKQNPFSIKSLNE

SEQ ID NO: 2999393 - protein, 22 aa, Entamoeba invadens
HQSNVQIISRILSGIRSLSSDD

SEQ ID NO: 2999394 - protein, 24 aa, Entamoeba invadens
HQTEQIYILPPTDTLVQLTPNVTG

SEQ ID NO: 2999395 - protein, 24 aa, Entamoeba invadens
HQTERIFILPPTDTSIQLTPNVTG

SEQ ID NO: 2999396 - protein, 18 aa, Entamoeba invadens
HQTKRLNAPQLLITNFRA

SEQ ID NO: 2999397 - protein, 41 aa, Entamoeba invadens
HQVGKLYVIFQGHEPFIFQALFVDWIIPKTSTKLPPAPSVK

SEQ ID NO: 2999398 - protein, 22 aa, Entamoeba invadens
HQYEELTMELSDFATLVETEET

SEQ ID NO: 2999399 - protein, 17 aa, Entamoeba invadens
HQYFLNCHTIGANYSFS

SEQ ID NO: 2999400 - protein, 17 aa, Entamoeba invadens
HRALVQLSYAIGVAHPL

SEQ ID NO: 2999401 - protein, 24 aa, Entamoeba invadens
HRALYYLGMCYLSGIGKAIDPKKA

SEQ ID NO: 2999402 - protein, 17 aa, Entamoeba invadens
HRDIKPANLLIFSTEME

SEQ ID NO: 2999403 - protein, 19 aa, Entamoeba invadens
HRDIKPDDILGVSIDTLDK

SEQ ID NO: 2999404 - protein, 19 aa, Entamoeba invadens
HRDIKPDNILIFSLDINDN

SEQ ID NO: 2999405 - protein, 23 aa, Entamoeba invadens
HRDIKPEHFLVFSLDINDKVNAK

SEQ ID NO: 2999406 - protein, 18 aa, Entamoeba invadens
HRDLKLENFLLKTPTQTN

SEQ ID NO: 2999407 - protein, 34 aa, Entamoeba invadens
HRDLKPENILLKENRPYPIIKIADFGMARNELFG

SEQ ID NO: 2999408 - protein, 18 aa, Entamoeba invadens
HRDRLFHQRISAMEGKSI

SEQ ID NO: 2999409 - protein, 27 aa, Entamoeba invadens
HRDVKPQNILLFNWTDIDTLNAKLTDF

SEQ ID NO: 2999410 - protein, 25 aa, Entamoeba invadens
HREEQTWETLLFQRGEYLKTRSQYV

SEQ ID NO: 2999411 - protein, 43 aa, Entamoeba invadens
HREEWNKRVVGDTPFYTVFYTESHLFGFFFSGGVTATERYFPD

SEQ ID NO: 2999412 - protein, 19 aa, Entamoeba invadens
HREFFQEEFFVKKFDVLLN

SEQ ID NO: 2999413 - protein, 22 aa, Entamoeba invadens
HRFNLHLYLDLRKVQVGNNFFE

SEQ ID NO: 2999414 - protein, 18 aa, Entamoeba invadens
HRFPFTFVIPMTNCPMLV

SEQ ID NO: 2999415 - protein, 19 aa, Entamoeba invadens
HRFYKGKIQIMPKCTLAGF

SEQ ID NO: 2999416 - protein, 19 aa, Entamoeba invadens
HRGFYKTELFESFLTLVQH

SEQ ID NO: 2999417 - protein, 21 aa, Entamoeba invadens
HRHIGPFWSDFARTTLSGLEN

SEQ ID NO: 2999418 - protein, 19 aa, Entamoeba invadens
HRIETLPFDLELDTPSKED

SEQ ID NO: 2999419 - protein, 22 aa, Entamoeba invadens
HRIPSLIYFCCVYLSEPRNAIK

SEQ ID NO: 2999420 - protein, 23 aa, Entamoeba invadens
HRISIMCHIAKVLPWRTMRFNEC

SEQ ID NO: 2999421 - protein, 19 aa, Entamoeba invadens
HRITEVIRLLISFARDMGF

SEQ ID NO: 2999422 - protein, 17 aa, Entamoeba invadens
HRKSYVFCPVDTCGRAI

SEQ ID NO: 2999423 - protein, 21 aa, Entamoeba invadens
HRLYHVFDQWDNPYPSVSPLN

SEQ ID NO: 2999424 - protein, 35 aa, Entamoeba invadens
HRNKVVLHVYNLIHYALYVLPILQEYVLHVLLCQP

SEQ ID NO: 2999425 - protein, 19 aa, Entamoeba invadens
HRPQFRSAVLMFQREFALR

SEQ ID NO: 2999426 - protein, 25 aa, Entamoeba invadens
HRQYVRDLVKCKIIMLSKHMYGCRV

SEQ ID NO: 2999427 - protein, 18 aa, Entamoeba invadens
HRRKVIVEFVAFVFGQAE

SEQ ID NO: 2999428 - protein, 25 aa, Entamoeba invadens
HRSFQDILFRLCEYATICIRSASIL

SEQ ID NO: 2999429 - protein, 25 aa, Entamoeba invadens
HRSKGRFPVLTWFSNKNKAALLRSA

SEQ ID NO: 2999430 - protein, 17 aa, Entamoeba invadens
HRTLRRVILTIYASQLE

SEQ ID NO: 2999431 - protein, 25 aa, Entamoeba invadens
HRTNRWNIRALYDMIDIAALNADKT

SEQ ID NO: 2999432 - protein, 18 aa, Entamoeba invadens
HRTQLHMFLSPNSSLLSF

SEQ ID NO: 2999433 - protein, 18 aa, Entamoeba invadens
HRVRCFVFRYPSISVENL

SEQ ID NO: 2999434 - protein, 19 aa, Entamoeba invadens
HRYTFYFEDFFHVDFTDVV

SEQ ID NO: 2999435 - protein, 27 aa, Entamoeba invadens
HSATNQLFQFIPYRNQAHPSCFLIQNL

SEQ ID NO: 2999436 - protein, 25 aa, Entamoeba invadens
HSDDIVDIKFWNELIVTASQDSLSC

SEQ ID NO: 2999437 - protein, 32 aa, Entamoeba invadens
HSDWFQAQLVVLELPRPLLTPGYEAVIHIHTC

SEQ ID NO: 2999438 - protein, 34 aa, Entamoeba invadens
HSEIKLLQQISFINFFGLIKFYDSMMSEQCYTQW

SEQ ID NO: 2999439 - protein, 21 aa, Entamoeba invadens
HSFESFLLLERVTDLGLLSEE

SEQ ID NO: 2999440 - protein, 18 aa, Entamoeba invadens
HSFFVTMQRSSLIQICLM

SEQ ID NO: 2999441 - protein, 29 aa, Entamoeba invadens
HSFVCCFAEEQFFWVYKFVTDKKEDRGVF

SEQ ID NO: 2999442 - protein, 25 aa, Entamoeba invadens
HSGFISYLLCCPRLEEWTDYSIAVV

SEQ ID NO: 2999443 - protein, 24 aa, Entamoeba invadens
HSGHVGPVLTIDYAPSGIEFCTGS

SEQ ID NO: 2999444 - protein, 18 aa, Entamoeba invadens
HSGKSTLFGHFIYQLGGV

SEQ ID NO: 2999445 - protein, 33 aa, Entamoeba invadens
HSGVGYLITVAHPKLFVLIDFLRKIENKTKKEW

SEQ ID NO: 2999446 - protein, 34 aa, Entamoeba invadens
HSGVGYLITVAHPKLFVLIDFLRKIENKTKKEWG

SEQ ID NO: 2999447 - protein, 17 aa, Entamoeba invadens
HSHYAFFFHLKQFQHRE

SEQ ID NO: 2999448 - protein, 18 aa, Entamoeba invadens
HSIFAERLNEKLKKKTQS

SEQ ID NO: 2999449 - protein, 26 aa, Entamoeba invadens
HSIIYYKTIFIYFDTTPSFGHTTGYL

SEQ ID NO: 2999450 - protein, 21 aa, Entamoeba invadens
HSILLLDFACFDECKAYRYNN

SEQ ID NO: 2999451 - protein, 21 aa, Entamoeba invadens
HSIVLPTLKALYKFLQHVDAE

SEQ ID NO: 2999452 - protein, 31 aa, Entamoeba invadens
HSIVTQNIPHPRLLFVFTPDEEIGESCDHVV

SEQ ID NO: 2999453 - protein, 23 aa, Entamoeba invadens
HSKFVEGLSLYHKDWRRIQQHVA

SEQ ID NO: 2999454 - protein, 19 aa, Entamoeba invadens
HSKLNDIFHLILAERKSWV

SEQ ID NO: 2999455 - protein, 25 aa, Entamoeba invadens
HSLAKWKRLQLHYLHIPVGEGIVTD

SEQ ID NO: 2999456 - protein, 33 aa, Entamoeba invadens
HSLCPPIFGHYIVKTAMILVLFGGTRSHETRIR

SEQ ID NO: 2999457 - protein, 34 aa, Entamoeba invadens
HSLKLTPRFRNTPSLLWFLEHFSPDTIAVFCFDE

SEQ ID NO: 2999458 - protein, 24 aa, Entamoeba invadens
HSLLFTCFSAFWIKTNQMVSINSH

SEQ ID NO: 2999459 - protein, 18 aa, Entamoeba invadens
HSLLTLSASILSLDLLHS

SEQ ID NO: 2999460 - protein, 17 aa, Entamoeba invadens
HSLRKIIMYLEKFMVLA

SEQ ID NO: 2999461 - protein, 19 aa, Entamoeba invadens
HSLSNIKGRLPTKAFTTLI

SEQ ID NO: 2999462 - protein, 34 aa, Entamoeba invadens
HSMCTLEFLPRRESYFWLLDALDMYKPVVWEFNR

SEQ ID NO: 2999463 - protein, 25 aa, Entamoeba invadens
HSNFSSFVRQLNIYGFHKVDHPLGQ

SEQ ID NO: 2999464 - protein, 24 aa, Entamoeba invadens
HSNIASFVRQLNIYGFHKVDNKEG

SEQ ID NO: 2999465 - protein, 37 aa, Entamoeba invadens
HSNSFYAQERPIFIGGVPLVMNVTLPLLTSSYEIKPN

SEQ ID NO: 2999466 - protein, 19 aa, Entamoeba invadens
HSPLLYYFDTLGGTSNDLS

SEQ ID NO: 2999467 - protein, 23 aa, Entamoeba invadens
HSQELLYPLFEALLTTTEAVKRI

SEQ ID NO: 2999468 - protein, 25 aa, Entamoeba invadens
HSRASKFFFLNFKNEFPDVQKTFMF

SEQ ID NO: 2999469 - protein, 24 aa, Entamoeba invadens
HSRRAVSCRFPFKGIIPSQIDEEL

SEQ ID NO: 2999470 - protein, 27 aa, Entamoeba invadens
HSSEFLSIFENVLSTIVKPMNDFKPKE

SEQ ID NO: 2999471 - protein, 28 aa, Entamoeba invadens
HSSSYLDVIKKIFKPQMLLSLRAAEADC

SEQ ID NO: 2999472 - protein, 22 aa, Entamoeba invadens
HSTDRIYVLPPTDNTTLLVPNI

SEQ ID NO: 2999473 - protein, 25 aa, Entamoeba invadens
HSTLHAFAHWTWVQSKGNLLICDIQ

SEQ ID NO: 2999474 - protein, 27 aa, Entamoeba invadens
HSTLRCPVCLGVTGGFFLRIKKEEKDN

SEQ ID NO: 2999475 - protein, 29 aa, Entamoeba invadens
HSVAFKSLLYVTFPLTLKVIGRSFFESCS

SEQ ID NO: 2999476 - protein, 40 aa, Entamoeba invadens
HSVEAFKVIVRAIKMWSKKRGIYGYVYSYLNGISIEILVA

SEQ ID NO: 2999477 - protein, 30 aa, Entamoeba invadens
HSVGGLYIRLALPILLRRGIFNNPNYTLFN

SEQ ID NO: 2999478 - protein, 20 aa, Entamoeba invadens
HSVGQLPTAVCTDSPMRCEN

SEQ ID NO: 2999479 - protein, 27 aa, Entamoeba invadens
HSVSSKPFCFYYNGSKLTFFEDAKTKE

SEQ ID NO: 2999480 - protein, 24 aa, Entamoeba invadens
HSWFKSFSFDDLYQKKLTPPFVPQ

SEQ ID NO: 2999481 - protein, 25 aa, Entamoeba invadens
HTDAKSLRKIVPPLLQRISAEFTNM

SEQ ID NO: 2999482 - protein, 24 aa, Entamoeba invadens
HTDPGHTLPPFKNLQTVIGVQQNV

SEQ ID NO: 2999483 - protein, 20 aa, Entamoeba invadens
HTECKLLITGTPLQNTLKEL

SEQ ID NO: 2999484 - protein, 23 aa, Entamoeba invadens
HTEKFCKYLTTYYLHESISECGK

SEQ ID NO: 2999485 - protein, 22 aa, Entamoeba invadens
HTEPKAFYLQDNSNKSLCVYSP

SEQ ID NO: 2999486 - protein, 30 aa, Entamoeba invadens
HTFKLTFIIENGFVYRIYYHIGKKEPLTVQ

SEQ ID NO: 2999487 - protein, 24 aa, Entamoeba invadens
HTGDVFYIERVVGSWAVVYVNEER

SEQ ID NO: 2999488 - protein, 27 aa, Entamoeba invadens
HTIILSHIEYLEPLLVFMNVIPNTSED

SEQ ID NO: 2999489 - protein, 19 aa, Entamoeba invadens
HTILELCFFSKSLLSREPN

SEQ ID NO: 2999490 - protein, 25 aa, Entamoeba invadens
HTIRSCDIKFQISLRPLYDSNTDMC

SEQ ID NO: 2999491 - protein, 23 aa, Entamoeba invadens
HTIWTPTQLTLPNGLTKIGFGAF

SEQ ID NO: 2999492 - protein, 23 aa, Entamoeba invadens
HTKLALPALNLFRLCELLYAKNQ

SEQ ID NO: 2999493 - protein, 21 aa, Entamoeba invadens
HTKLPRGGILVFLTGKREIED

SEQ ID NO: 2999494 - protein, 17 aa, Entamoeba invadens
HTKPYEFTPLLKIGDQV

SEQ ID NO: 2999495 - protein, 18 aa, Entamoeba invadens
HTKQYIRKQIRFIKNRFI

SEQ ID NO: 2999496 - protein, 35 aa, Entamoeba invadens
HTKREVVEWIKSQPIYEDILLYNAIDIDHLITLFR

SEQ ID NO: 2999497 - protein, 28 aa, Entamoeba invadens
HTKVQFYKIVVWYPVDYEFFLLHKNTNK

SEQ ID NO: 2999498 - protein, 25 aa, Entamoeba invadens
HTLKDEFFTALQTLLRIPCPLYHGF

SEQ ID NO: 2999499 - protein, 24 aa, Entamoeba invadens
HTLRLIDHFLFYNHICIVTEMLGI

SEQ ID NO: 2999500 - protein, 17 aa, Entamoeba invadens
HTLRLWDLDKMESVRRF

SEQ ID NO: 2999501 - protein, 27 aa, Entamoeba invadens
HTNDPIWMCMDGFKLWINMSECIEIFD

SEQ ID NO: 2999502 - protein, 20 aa, Entamoeba invadens
HTNHFGCFVCKTNLKGKQYK

SEQ ID NO: 2999503 - protein, 19 aa, Entamoeba invadens
HTNVPLYNALLKATPQQLE

SEQ ID NO: 2999504 - protein, 20 aa, Entamoeba invadens
HTQMLTKGLVTYFDVMKECK

SEQ ID NO: 2999505 - protein, 25 aa, Entamoeba invadens
HTSELYQFKAFLSGTSLNVLPIHSV

SEQ ID NO: 2999506 - protein, 25 aa, Entamoeba invadens
HTSTTNFLSVFSSKIKRLPTTKIVP

SEQ ID NO: 2999507 - protein, 31 aa, Entamoeba invadens
HTTNVLSIILPIIFDFLKKSPVNEFLLKDLK

SEQ ID NO: 2999508 - protein, 25 aa, Entamoeba invadens
HTTPNILNFPKVDGPLTGMGVGRRA

SEQ ID NO: 2999509 - protein, 17 aa, Entamoeba invadens
HTWKVNTVIFIVADNED

SEQ ID NO: 2999510 - protein, 17 aa, Entamoeba invadens
HVALRCDFLMITAMRDS

SEQ ID NO: 2999511 - protein, 27 aa, Entamoeba invadens
HVANFFAIRAQYYNKLRKPNAAIRDCT

SEQ ID NO: 2999512 - protein, 20 aa, Entamoeba invadens
HVANIMTYVDGAIGSDGFSV

SEQ ID NO: 2999513 - protein, 17 aa, Entamoeba invadens
HVCAKVISQRKFIEQKL

SEQ ID NO: 2999514 - protein, 24 aa, Entamoeba invadens
HVCGKVRFCGYLVKFNLDNYYYLQ

SEQ ID NO: 2999515 - protein, 50 aa, Entamoeba invadens
HVDFRLLNQHIPPKKTPPPPPKKPLPLAPTKIPPPPLKLPPQRLKLDVQK

SEQ ID NO: 2999516 - protein, 22 aa, Entamoeba invadens
HVEQIRSKHIIIVKPDEIKRNE

SEQ ID NO: 2999517 - protein, 19 aa, Entamoeba invadens
HVFNNYYSIGIDALIALTF

SEQ ID NO: 2999518 - protein, 26 aa, Entamoeba invadens
HVFTNNYLIDILTENGFFFNSHLSKV

SEQ ID NO: 2999519 - protein, 20 aa, Entamoeba invadens
HVGLRFCGMKRTIGDQVYSY

SEQ ID NO: 2999520 - protein, 23 aa, Entamoeba invadens
HVHALPGTPSYQPTARRIRGIID

SEQ ID NO: 2999521 - protein, 17 aa, Entamoeba invadens
HVIANNDTYLYLHCCAV

SEQ ID NO: 2999522 - protein, 22 aa, Entamoeba invadens
HVILYRQVWKRKGLSRNKRDLI

SEQ ID NO: 2999523 - protein, 17 aa, Entamoeba invadens
HVIPFLESINCHVRKTI

SEQ ID NO: 2999524 - protein, 17 aa, Entamoeba invadens
HVIPFLESVNCHVRKTI

SEQ ID NO: 2999525 - protein, 17 aa, Entamoeba invadens
HVKFFVRNLDRYDDFET

SEQ ID NO: 2999526 - protein, 17 aa, Entamoeba invadens
HVKFPVLPTNTKMLDVF

SEQ ID NO: 2999527 - protein, 23 aa, Entamoeba invadens
HVKLSNWILPHIDSIKNISYYKK

SEQ ID NO: 2999528 - protein, 32 aa, Entamoeba invadens
HVKNAPTNVLNNIYYILVSKEYENRKKQKNEK

SEQ ID NO: 2999529 - protein, 22 aa, Entamoeba invadens
HVLKNIRLFPRLSQIVFSIDYD

SEQ ID NO: 2999530 - protein, 17 aa, Entamoeba invadens
HVLKRYYNYLVNVDVSV

SEQ ID NO: 2999531 - protein, 31 aa, Entamoeba invadens
HVLNIRNRAFFICYYLTKVVLNYGLCSIGDD

SEQ ID NO: 2999532 - protein, 20 aa, Entamoeba invadens
HVLSVQILMELWKEKSGSKP

SEQ ID NO: 2999533 - protein, 31 aa, Entamoeba invadens
HVMGDLCMYFPRQMLTFFKMDPQNAAFVLIR

SEQ ID NO: 2999534 - protein, 23 aa, Entamoeba invadens
HVQARPLPPVPAPTPFPSTSGEV

SEQ ID NO: 2999535 - protein, 25 aa, Entamoeba invadens
HVQDSFFFLLDQVLTESLCWLIEMV

SEQ ID NO: 2999536 - protein, 26 aa, Entamoeba invadens
HVQSAKKLFVTGLPPTYTNNDFNILM

SEQ ID NO: 2999537 - protein, 27 aa, Entamoeba invadens
HVQSLDVLFKCYLVPLSYSKYSPIVQK

SEQ ID NO: 2999538 - protein, 24 aa, Entamoeba invadens
HVRSELFQLYHLLNEKIEANEQTD

SEQ ID NO: 2999539 - protein, 17 aa, Entamoeba invadens
HVRVFGEFCFCGCDSLS

SEQ ID NO: 2999540 - protein, 24 aa, Entamoeba invadens
HVSPKTLEMLKRVTTYKNPFDIID

SEQ ID NO: 2999541 - protein, 26 aa, Entamoeba invadens
HVSSYLILPIQRIPRYVMLIESLIKC

SEQ ID NO: 2999542 - protein, 25 aa, Entamoeba invadens
HVSYPCPRIFRNPDFKGFPKKLELV

SEQ ID NO: 2999543 - protein, 19 aa, Entamoeba invadens
HVVAGILSLFLEPNPEDPL

SEQ ID NO: 2999544 - protein, 18 aa, Entamoeba invadens
HVVFCALTPLQKMIYQRL

SEQ ID NO: 2999545 - protein, 20 aa, Entamoeba invadens
HVVLILDKQFHRLPWEAMKD

SEQ ID NO: 2999546 - protein, 27 aa, Entamoeba invadens
HVVLMSDIVFFLLKKKQKYTIQWMVEF

SEQ ID NO: 2999547 - protein, 20 aa, Entamoeba invadens
HVVRKIYVTEVALPNVIRRS

SEQ ID NO: 2999548 - protein, 25 aa, Entamoeba invadens
HVWKITMTVLPRTMRWWYSVIKDEE

SEQ ID NO: 2999549 - protein, 24 aa, Entamoeba invadens
HVWSDPIPLNIYLHSINLLQDVEQ

SEQ ID NO: 2999550 - protein, 25 aa, Entamoeba invadens
HVYDTINHWFGINNMYTVGSSYWND

SEQ ID NO: 2999551 - protein, 25 aa, Entamoeba invadens
HVYDTINHWFGMNNMYIVGSSYWND

SEQ ID NO: 2999552 - protein, 25 aa, Entamoeba invadens
HVYHNVMVDVIQFSMKFDKKSKTTL

SEQ ID NO: 2999553 - protein, 19 aa, Entamoeba invadens
HVYLYPQKTVLVTPTFRSK

SEQ ID NO: 2999554 - protein, 18 aa, Entamoeba invadens
HWDDLPKLDLKKLIGEKL

SEQ ID NO: 2999555 - protein, 18 aa, Entamoeba invadens
HWEGKLTKQQILQVDLRE

SEQ ID NO: 2999556 - protein, 17 aa, Entamoeba invadens
HWNLCDDSRMTLLKEKV

SEQ ID NO: 2999557 - protein, 17 aa, Entamoeba invadens
HWRLMKLFEERLSTACV

SEQ ID NO: 2999558 - protein, 19 aa, Entamoeba invadens
HWVTFFSNVGEHLFKMAAC

SEQ ID NO: 2999559 - protein, 18 aa, Entamoeba invadens
HYAFTSFSTYPIVNGKKI

SEQ ID NO: 2999560 - protein, 17 aa, Entamoeba invadens
HYARRQNLATLDPYNLS

SEQ ID NO: 2999561 - protein, 24 aa, Entamoeba invadens
HYDIEDEVFLKTQMFFDSTNELRK

SEQ ID NO: 2999562 - protein, 17 aa, Entamoeba invadens
HYEFFRGYERIETPTSF

SEQ ID NO: 2999563 - protein, 20 aa, Entamoeba invadens
HYEFPETVLRCLPKLPFEIT

SEQ ID NO: 2999564 - protein, 20 aa, Entamoeba invadens
HYGLFLQKMKEKDNLFISCQ

SEQ ID NO: 2999565 - protein, 33 aa, Entamoeba invadens
HYHELLISIGDCRTFLYSPRTHHTLPLSGRFHK

SEQ ID NO: 2999566 - protein, 25 aa, Entamoeba invadens
HYHMTFAIWDNFIVRNGFTEFIIFF

SEQ ID NO: 2999567 - protein, 26 aa, Entamoeba invadens
HYHPSFWHFHVHFTNIAFPSLTRNNV

SEQ ID NO: 2999568 - protein, 26 aa, Entamoeba invadens
HYKNFKTKMLCWTGKELWAFKEQNAG

SEQ ID NO: 2999569 - protein, 18 aa, Entamoeba invadens
HYKRVVFTLSLHKTLEQI

SEQ ID NO: 2999570 - protein, 24 aa, Entamoeba invadens
HYKTKPFVFSLLYETTLVFDFTQT

SEQ ID NO: 2999571 - protein, 21 aa, Entamoeba invadens
HYKTPLKRLNYLRERKIMGRN

SEQ ID NO: 2999572 - protein, 17 aa, Entamoeba invadens
HYLHFEKGLIHRDIKLE

SEQ ID NO: 2999573 - protein, 23 aa, Entamoeba invadens
HYNMKLYCRFYCKQDVRILKEGH

SEQ ID NO: 2999574 - protein, 19 aa, Entamoeba invadens
HYPQKLFLAMIHTMPNKIQ

SEQ ID NO: 2999575 - protein, 18 aa, Entamoeba invadens
HYPYGLRYLCKVINDGSL

SEQ ID NO: 2999576 - protein, 18 aa, Entamoeba invadens
HYSLLKNAIHLANEMVGI

SEQ ID NO: 2999577 - protein, 25 aa, Entamoeba invadens
HYVMSAYFHPNPMTPLIVSASLDQT

SEQ ID NO: 2999578 - protein, 17 aa, Entamoeba invadens
HYVYDYQMSYTEYLKKR

SEQ ID NO: 2999579 - protein, 26 aa, Entamoeba invadens
HYYDGTLFHRVIPKFMMQGGDPSGTG

SEQ ID NO: 2999580 - protein, 19 aa, Entamoeba invadens
HYYFFVYYSERQFVIRTRF

SEQ ID NO: 2999581 - protein, 18 aa, Entamoeba invadens
IAAFVQYVPLVIGTNSVS

SEQ ID NO: 2999582 - protein, 19 aa, Entamoeba invadens
IACFMNFSCSIPLHDKLAI

SEQ ID NO: 2999583 - protein, 17 aa, Entamoeba invadens
IACNALSEESAPSVTFS

SEQ ID NO: 2999584 - protein, 22 aa, Entamoeba invadens
IACSIARPFVSLALNGSTDCIT

SEQ ID NO: 2999585 - protein, 17 aa, Entamoeba invadens
IACSYIGARICTLYDSL

SEQ ID NO: 2999586 - protein, 19 aa, Entamoeba invadens
IACWCFYNFDLMPSRLSVL

SEQ ID NO: 2999587 - protein, 23 aa, Entamoeba invadens
IADEKRVELFSAQFFECVKKLPT

SEQ ID NO: 2999588 - protein, 30 aa, Entamoeba invadens
IADFIKDHWGLLIKLKLFQSVQYKKSLLDA

SEQ ID NO: 2999589 - protein, 28 aa, Entamoeba invadens
IADIWSCGVVLYVMAFGLMPFDGDTLDE

SEQ ID NO: 2999590 - protein, 18 aa, Entamoeba invadens
IADKLEGFQIDDKKMKVK

SEQ ID NO: 2999591 - protein, 18 aa, Entamoeba invadens
IADLRRFGEFNKALSDLV

SEQ ID NO: 2999592 - protein, 17 aa, Entamoeba invadens
IADRRIGILPGEKAPVI

SEQ ID NO: 2999593 - protein, 17 aa, Entamoeba invadens
IADWFGMDYTSSFFKIF

SEQ ID NO: 2999594 - protein, 20 aa, Entamoeba invadens
IADWLFSELNLLISNFPFER

SEQ ID NO: 2999595 - protein, 24 aa, Entamoeba invadens
IADYVCRYCLVLGVTRFINVNNLN

SEQ ID NO: 2999596 - protein, 27 aa, Entamoeba invadens
IAEADKLLVYLIFYISSLLLKFNGHTK

SEQ ID NO: 2999597 - protein, 23 aa, Entamoeba invadens
IAECAFIFCIELRRTTKDCTRKV

SEQ ID NO: 2999598 - protein, 18 aa, Entamoeba invadens
IAEDLTFISNAQAYVHTL

SEQ ID NO: 2999599 - protein, 23 aa, Entamoeba invadens
IAEDRVRFPWYVAGGDYNEKDAV

SEQ ID NO: 2999600 - protein, 20 aa, Entamoeba invadens
IAEGIKWSPIKYFNNKVVCD

SEQ ID NO: 2999601 - protein, 18 aa, Entamoeba invadens
IAEKLYQSGLISYPRTET

SEQ ID NO: 2999602 - protein, 18 aa, Entamoeba invadens
IAEMMIGIPIFPGESEYN

SEQ ID NO: 2999603 - protein, 23 aa, Entamoeba invadens
IAEPMASVLYYLDVNKNSTIKNF

SEQ ID NO: 2999604 - protein, 23 aa, Entamoeba invadens
IAEQFIWFMEQAVKSFLALRDYY

SEQ ID NO: 2999605 - protein, 29 aa, Entamoeba invadens
IAEVRQFFEIPFVVQLYYSATPTQLPVAG

SEQ ID NO: 2999606 - protein, 18 aa, Entamoeba invadens
IAFARARRIRMKRNQKRL

SEQ ID NO: 2999607 - protein, 18 aa, Entamoeba invadens
IAFCDRRRIIEKTQFFNM

SEQ ID NO: 2999608 - protein, 17 aa, Entamoeba invadens
IAFLFSALTENRYEELT

SEQ ID NO: 2999609 - protein, 20 aa, Entamoeba invadens
IAFLVTVNSIREGIVPAIRV

SEQ ID NO: 2999610 - protein, 26 aa, Entamoeba invadens
IAFNQRYKHMFRIVTSIGSVVEKNSL

SEQ ID NO: 2999611 - protein, 36 aa, Entamoeba invadens
IAFNSKYLMHTSAPHCWSFMLSGLVYLKELGDSIET

SEQ ID NO: 2999612 - protein, 18 aa, Entamoeba invadens
IAFQIIQYVFYNPNTKNK

SEQ ID NO: 2999613 - protein, 24 aa, Entamoeba invadens
IAGAQYRGQFEERLKAVLKEVKES

SEQ ID NO: 2999614 - protein, 18 aa, Entamoeba invadens
IAGLYDMGPLGCALKQNI

SEQ ID NO: 2999615 - protein, 18 aa, Entamoeba invadens
IAGVAYSGELLFALAGCC

SEQ ID NO: 2999616 - protein, 19 aa, Entamoeba invadens
IAGVVLPAILTLKSDVKSD

SEQ ID NO: 2999617 - protein, 25 aa, Entamoeba invadens
IAIAAFEFLLNNFEPIFYAIRIRNE

SEQ ID NO: 2999618 - protein, 18 aa, Entamoeba invadens
IAIARALIRNPKILLLDE

SEQ ID NO: 2999619 - protein, 20 aa, Entamoeba invadens
IAIEEPVISSFWAFKQGGSV

SEQ ID NO: 2999620 - protein, 24 aa, Entamoeba invadens
IAIFSTFFFEKIRRAFLDNVDKEK

SEQ ID NO: 2999621 - protein, 27 aa, Entamoeba invadens
IAIIFDKLFAMRRDFLAFRTSFETTNK

SEQ ID NO: 2999622 - protein, 27 aa, Entamoeba invadens
IAILRKYYADRKVEWALLEEKAMKYLA

SEQ ID NO: 2999623 - protein, 21 aa, Entamoeba invadens
IAINNLLVGFSVISLKIPRHE

SEQ ID NO: 2999624 - protein, 21 aa, Entamoeba invadens
IAIRKALLLPYVSKLLTTLEQ

SEQ ID NO: 2999625 - protein, 18 aa, Entamoeba invadens
IAIRLVHNIFTKIYDPSN

SEQ ID NO: 2999626 - protein, 20 aa, Entamoeba invadens
IAITIDNMLLDLLRQYFGFT

SEQ ID NO: 2999627 - protein, 26 aa, Entamoeba invadens
IAIVILRKYYADREVEWALLEEKAMK

SEQ ID NO: 2999628 - protein, 25 aa, Entamoeba invadens
IAKAKPLMNKALAKAFKTAHKVGNL

SEQ ID NO: 2999629 - protein, 25 aa, Entamoeba invadens
IAKEGYRYIIQPYSSYYNTEETDPV

SEQ ID NO: 2999630 - protein, 26 aa, Entamoeba invadens
IAKESLPFALEYFLAIESSQYEKEEE

SEQ ID NO: 2999631 - protein, 22 aa, Entamoeba invadens
IAKETQRIVPLQRVDMASSPEK

SEQ ID NO: 2999632 - protein, 23 aa, Entamoeba invadens
IAKFAFVPCMKPTGSIFDVINTS

SEQ ID NO: 2999633 - protein, 52 aa, Entamoeba invadens
IAKFTMTVDEFPRPLAISRLVKGAFIIQKKLSTIVIISLMKYDQVTPEREYY

SEQ ID NO: 2999634 - protein, 22 aa, Entamoeba invadens
IAKGDYYGLLGLGTVRYEATED

SEQ ID NO: 2999635 - protein, 37 aa, Entamoeba invadens
IAKGEVIVAWKKKWKYRIDWSLILEFSHPQLLNEGER

SEQ ID NO: 2999636 - protein, 22 aa, Entamoeba invadens
IAKKLDYQINLTKAYSSLFTQR

SEQ ID NO: 2999637 - protein, 22 aa, Entamoeba invadens
IAKLAALTLRKQPKGIWTRVKQ

SEQ ID NO: 2999638 - protein, 17 aa, Entamoeba invadens
IAKLNADEMKEHKEKII

SEQ ID NO: 2999639 - protein, 32 aa, Entamoeba invadens
IAKNIDFRVFYFYFDFLMNAFKNKSTIMDIDL

SEQ ID NO: 2999640 - protein, 26 aa, Entamoeba invadens
IAKPGSFPEYFTLSHLSTAISQRDES

SEQ ID NO: 2999641 - protein, 19 aa, Entamoeba invadens
IAKRAAWIERDLGSMLKFI

SEQ ID NO: 2999642 - protein, 17 aa, Entamoeba invadens
IAKREIIVFDGKFDWTG

SEQ ID NO: 2999643 - protein, 17 aa, Entamoeba invadens
IAKRMILSDVKSMFILG

SEQ ID NO: 2999644 - protein, 30 aa, Entamoeba invadens
IAKVFALFDVFFFKIPTQFWFELNDAVKCI

SEQ ID NO: 2999645 - protein, 23 aa, Entamoeba invadens
IAKVNFLCVFPTSYCILKGLDIK

SEQ ID NO: 2999646 - protein, 19 aa, Entamoeba invadens
IALCCIKDYKKRPPALEML

SEQ ID NO: 2999647 - protein, 19 aa, Entamoeba invadens
IALGAFKKVFINYGDKQFK

SEQ ID NO: 2999648 - protein, 17 aa, Entamoeba invadens
IALITKMDRPKILLFEY

SEQ ID NO: 2999649 - protein, 17 aa, Entamoeba invadens
IALLYRADTTDVIKWEH

SEQ ID NO: 2999650 - protein, 19 aa, Entamoeba invadens
IALMLPKKRAITGRQFLCV

SEQ ID NO: 2999651 - protein, 19 aa, Entamoeba invadens
IALQTFFNGLQNYFTTMIL

SEQ ID NO: 2999652 - protein, 20 aa, Entamoeba invadens
IALVLIHLHSLDIIYRDLKP

SEQ ID NO: 2999653 - protein, 18 aa, Entamoeba invadens
IAMKHFIDEFYAIFDSRA

SEQ ID NO: 2999654 - protein, 26 aa, Entamoeba invadens
IAMPDCRIVFLLFSLIPSTCVGKFKR

SEQ ID NO: 2999655 - protein, 26 aa, Entamoeba invadens
IAMPDCRIVFLLFSSIPSTCVGNFKR

SEQ ID NO: 2999656 - protein, 31 aa, Entamoeba invadens; identical to SEQ ID NO: 2941936

SEQ ID NO: 2999657 - protein, 26 aa, Entamoeba invadens
IANETGAFFFLINGPEIMSKMAGDSE

SEQ ID NO: 2999658 - protein, 26 aa, Entamoeba invadens
IANGDRLIKFLKDQLKFPNPGCSAEN

SEQ ID NO: 2999659 - protein, 21 aa, Entamoeba invadens
IANIPPKQPPYRRFFSSQQCT

SEQ ID NO: 2999660 - protein, 21 aa, Entamoeba invadens
IANKAFVFSLVNRLGEPFLVE

SEQ ID NO: 2999661 - protein, 24 aa, Entamoeba invadens
IANLGLFQTLIGFFSQFSKPLTTV

SEQ ID NO: 2999662 - protein, 26 aa, Entamoeba invadens
IANLKTQTMFLLIKMKMMKNRKEKMK

SEQ ID NO: 2999663 - protein, 17 aa, Entamoeba invadens
IANLLHEKVISGSATDL

SEQ ID NO: 2999664 - protein, 25 aa, Entamoeba invadens
IANLLQEMDFIRMESLGLSELNFPE

SEQ ID NO: 2999665 - protein, 25 aa, Entamoeba invadens
IANQLDGLFYEGFHLRADVMSNKGQ

SEQ ID NO: 2999666 - protein, 30 aa, Entamoeba invadens
IANVLYTISIYVASFYKLVKTRRGCYTETI

SEQ ID NO: 2999667 - protein, 20 aa, Entamoeba invadens
IANYLCINPVNLHIKISGKS

SEQ ID NO: 2999668 - protein, 21 aa, Entamoeba invadens
IANYLFILLAQMKSSAHSTDI

SEQ ID NO: 2999669 - protein, 20 aa, Entamoeba invadens
IANYMFSNCQNLSLVTGLEN

SEQ ID NO: 2999670 - protein, 27 aa, Entamoeba invadens
IAPEIYGMLELKKALLLTVVGAPTRRM

SEQ ID NO: 2999671 - protein, 20 aa, Entamoeba invadens
IAPFFPHKSIQQISLRIQWL

SEQ ID NO: 2999672 - protein, 23 aa, Entamoeba invadens
IAPIYDFIMPAEDQLSPLLMVAQ

SEQ ID NO: 2999673 - protein, 18 aa, Entamoeba invadens
IAPRIICAAVYKFTGKKM

SEQ ID NO: 2999674 - protein, 23 aa, Entamoeba invadens
IAPTLIMGIQDPMAEYIKVVICK

SEQ ID NO: 2999675 - protein, 22 aa, Entamoeba invadens
IAQHFGIEKLVWDELVKIGTSL

SEQ ID NO: 2999676 - protein, 22 aa, Entamoeba invadens
IAQIKSKLLHCSRLVLRDYYSK

SEQ ID NO: 2999677 - protein, 18 aa, Entamoeba invadens
IAQIYGQHTRWCIGKYGC

SEQ ID NO: 2999678 - protein, 22 aa, Entamoeba invadens
IAQLYYHYYLRTSETQFLIESS

SEQ ID NO: 2999679 - protein, 25 aa, Entamoeba invadens
IAQRYALNQFLPNSPPTLCADFCTK

SEQ ID NO: 2999680 - protein, 26 aa, Entamoeba invadens
IAQTQKKMIIPPKGKFVIGIRKTMTP

SEQ ID NO: 2999681 - protein, 26 aa, Entamoeba invadens
IAQVNLFPIFVLYEAEQTFVVDSVLP

SEQ ID NO: 2999682 - protein, 17 aa, Entamoeba invadens
IARFFVSYPSTCTGSLT

SEQ ID NO: 2999683 - protein, 36 aa, Entamoeba invadens
IARHHKITPPLVKAPLLFVTLRKWLANVPLEYVDQK

SEQ ID NO: 2999684 - protein, 23 aa, Entamoeba invadens
IARLFFFLRTIDDAINLVLVCKK

SEQ ID NO: 2999685 - protein, 18 aa, Entamoeba invadens
IARRGYVIIDPKGIIRYM

SEQ ID NO: 2999686 - protein, 29 aa, Entamoeba invadens
IASELKLYIDIFYVVKLLESAEIERLDDY

SEQ ID NO: 2999687 - protein, 26 aa, Entamoeba invadens
IASFDAAPCFPPDYSLRDVYLIETTE

SEQ ID NO: 2999688 - protein, 29 aa, Entamoeba invadens
IASHRRAIVIFLSWTLQIPYNKAMSIEVR

SEQ ID NO: 2999689 - protein, 22 aa, Entamoeba invadens
IASIEYTYAFFGLKPESTDMSV

SEQ ID NO: 2999690 - protein, 26 aa, Entamoeba invadens
IASIGISVFFPPAAPYVLVGAGVMLE

SEQ ID NO: 2999691 - protein, 19 aa, Entamoeba invadens
IASIIETSELWPESYRYIC

SEQ ID NO: 2999692 - protein, 25 aa, Entamoeba invadens
IASLDNVCLFISSFLEGFSLNEGGV

SEQ ID NO: 2999693 - protein, 24 aa, Entamoeba invadens
IASMLLNVIFMNPTSRYVFSKPVT

SEQ ID NO: 2999694 - protein, 28 aa, Entamoeba invadens
IASPDIQILFSPVFQKTPTILFDTNEDG

SEQ ID NO: 2999695 - protein, 25 aa, Entamoeba invadens
IASQKLNIDMIQRLSGRIPLEESER

SEQ ID NO: 2999696 - protein, 23 aa, Entamoeba invadens
IASQLAVLKYLHEKTSPILPSIL

SEQ ID NO: 2999697 - protein, 27 aa, Entamoeba invadens
IATEEHEIFWLFKLVMDVISPYYLHDE

SEQ ID NO: 2999698 - protein, 20 aa, Entamoeba invadens
IATGGLYLKPSQFTKTVIPA

SEQ ID NO: 2999699 - protein, 24 aa, Entamoeba invadens
IATKLLYELIVKKPAVFLAPLMNW

SEQ ID NO: 2999700 - protein, 31 aa, Entamoeba invadens
IAVAYGKWKIPLPMYRAIQYLLMSDNIETDG

SEQ ID NO: 2999701 - protein, 18 aa, Entamoeba invadens
IAVAYKCGTVKYIDRLSP

SEQ ID NO: 2999702 - protein, 20 aa, Entamoeba invadens
IAVCLAPGLMRKADMGFTSI

SEQ ID NO: 2999703 - protein, 17 aa, Entamoeba invadens
IAVFIKKLEDKLKEAVD

SEQ ID NO: 2999704 - protein, 17 aa, Entamoeba invadens
IAVIVKQAYLFTKTFVS

SEQ ID NO: 2999705 - protein, 18 aa, Entamoeba invadens
IAVIVKQAYLFTKTFVSV

SEQ ID NO: 2999706 - protein, 18 aa, Entamoeba invadens
IAVKQRKADFERVKKLQK

SEQ ID NO: 2999707 - protein, 26 aa, Entamoeba invadens
IAVKSKTLFPLIRIQNLFSNDDIRID

SEQ ID NO: 2999708 - protein, 19 aa, Entamoeba invadens
IAVTFGRQIPKCEIDIFDK

SEQ ID NO: 2999709 - protein, 17 aa, Entamoeba invadens
IAYKQKVSKKKSGAAGL

SEQ ID NO: 2999710 - protein, 19 aa, Entamoeba invadens
IAYLTLPNTFIERKRNVEK

SEQ ID NO: 2999711 - protein, 18 aa, Entamoeba invadens
IAYMKKIFVKKTNLYPII

SEQ ID NO: 2999712 - protein, 23 aa, Entamoeba invadens
ICCKDKLVFLFKSGNESFGFYNS

SEQ ID NO: 2999713 - protein, 18 aa, Entamoeba invadens
ICCRFFSKYKNLCEIVFP

SEQ ID NO: 2999714 - protein, 36 aa, Entamoeba invadens
ICCSDSRAPPEFIFDCTLGEIFVIRTAGGVMGTREF

SEQ ID NO: 2999715 - protein, 19 aa, Entamoeba invadens
ICDSWKHKAGDRPPIENVI

SEQ ID NO: 2999716 - protein, 31 aa, Entamoeba invadens
ICEDFGLRLVALWDLNQFYHDWIHKEEYKKL

SEQ ID NO: 2999717 - protein, 27 aa, Entamoeba invadens
ICENKEDRIALAKSLELAAREIPQVVE

SEQ ID NO: 2999718 - protein, 25 aa, Entamoeba invadens
ICERLRSWYVLKKYKRSCIFSQTGY

SEQ ID NO: 2999719 - protein, 18 aa, Entamoeba invadens
ICFKELLLILRYTPRVEG

SEQ ID NO: 2999720 - protein, 18 aa, Entamoeba invadens
ICFLVKQNISPYLDVSRQ

SEQ ID NO: 2999721 - protein, 26 aa, Entamoeba invadens
ICGPYECVTKYKYHLKITPGKLKAGK

SEQ ID NO: 2999722 - protein, 28 aa, Entamoeba invadens
ICGRTNILLIVITNKNYVFGSYSSVAIP

SEQ ID NO: 2999723 - protein, 17 aa, Entamoeba invadens
ICGSDNGLAWLYKDNLG

SEQ ID NO: 2999724 - protein, 19 aa, Entamoeba invadens
ICHEEIFDLSKKFCPKCGY

SEQ ID NO: 2999725 - protein, 25 aa, Entamoeba invadens
ICHGLTNYLISLKPLRDPIGDETKL

SEQ ID NO: 2999726 - protein, 26 aa, Entamoeba invadens
ICHGLTNYLISLKPLRDPIGDETKLP

SEQ ID NO: 2999727 - protein, 27 aa, Entamoeba invadens
ICHPRAILEITTLIRRILLHFESDAAM

SEQ ID NO: 2999728 - protein, 26 aa, Entamoeba invadens
ICIVRSIFDLFFGYCDGQKFFDRKNK

SEQ ID NO: 2999729 - protein, 18 aa, Entamoeba invadens
ICKCDPRVTLYFCPACNS

SEQ ID NO: 2999730 - protein, 23 aa, Entamoeba invadens
ICKEAITINRFNKIAFAKSTTKI

SEQ ID NO: 2999731 - protein, 31 aa, Entamoeba invadens
ICKSHQKTFFPVFQFTLFPRVMSYLKQTEEN

SEQ ID NO: 2999732 - protein, 26 aa, Entamoeba invadens
ICLCDDKIRELLRKFNPRQVPQVEQQ

SEQ ID NO: 2999733 - protein, 19 aa, Entamoeba invadens
ICLDSYHRTLEGFLSLIEF

SEQ ID NO: 2999734 - protein, 18 aa, Entamoeba invadens
ICLLVRYAEKRDAPELFI

SEQ ID NO: 2999735 - protein, 18 aa, Entamoeba invadens
ICLRSFLKLSPFPEYTCK

SEQ ID NO: 2999736 - protein, 17 aa, Entamoeba invadens
ICLYSHFNFFSNVETYH

SEQ ID NO: 2999737 - protein, 18 aa, Entamoeba invadens
ICMTCGCFLCYKDGKRRD

SEQ ID NO: 2999738 - protein, 17 aa, Entamoeba invadens
ICNAGILTALVAVVPLQ

SEQ ID NO: 2999739 - protein, 21 aa, Entamoeba invadens
ICNIGLYSRSGVCFSCEGCSN

SEQ ID NO: 2999740 - protein, 27 aa, Entamoeba invadens
ICNKKNLMVFFYLKRNTIIGTFNSEVL

SEQ ID NO: 2999741 - protein, 17 aa, Entamoeba invadens
ICNQLEFDFYQDLEMKT

SEQ ID NO: 2999742 - protein, 19 aa, Entamoeba invadens
ICPGGVGFDINCGVRLIRT

SEQ ID NO: 2999743 - protein, 27 aa, Entamoeba invadens
ICPHFSNELLYKILLNLQKKQKGDKIK

SEQ ID NO: 2999744 - protein, 26 aa, Entamoeba invadens
ICPHKTEFLMMLLENYRALTNGQSFP

SEQ ID NO: 2999745 - protein, 17 aa, Entamoeba invadens
ICPLDYSMHSRDLSHAD

SEQ ID NO: 2999746 - protein, 32 aa, Entamoeba invadens
ICRLHPTRFFDPFKFKLFPRVMTYLNQTKETE

SEQ ID NO: 2999747 - protein, 22 aa, Entamoeba invadens
ICRYAAISSFALRIDKYFPTIG

SEQ ID NO: 2999748 - protein, 17 aa, Entamoeba invadens
ICSICKPNMFPDVNGIC

SEQ ID NO: 2999749 - protein, 19 aa, Entamoeba invadens
ICSIYYKGILLFSQEKVLK

SEQ ID NO: 2999750 - protein, 19 aa, Entamoeba invadens
ICSVILFTRDFLPRCDFKP

SEQ ID NO: 2999751 - protein, 18 aa, Entamoeba invadens
ICTAIHTLLNWNIMFNNG

SEQ ID NO: 2999752 - protein, 34 aa, Entamoeba invadens
ICTDDHPPFPLNASPLLKVLLLDCFKTDINIRAS

SEQ ID NO: 2999753 - protein, 18 aa, Entamoeba invadens
ICTYYKPPEFYRITPRKA

SEQ ID NO: 2999754 - protein, 25 aa, Entamoeba invadens
ICVGKGCFKYCYSLKNVILSTNIQE

SEQ ID NO: 2999755 - protein, 18 aa, Entamoeba invadens
ICVNPTLRELKLSSIPFL

SEQ ID NO: 2999756 - protein, 25 aa, Entamoeba invadens
ICVTENYTVLKFGKLTVLKSVCINF

SEQ ID NO: 2999757 - protein, 18 aa, Entamoeba invadens
ICVTFNFNCLLVLREGGE

SEQ ID NO: 2999758 - protein, 19 aa, Entamoeba invadens
ICWGDVGIGMFFIEPDKLK

SEQ ID NO: 2999759 - protein, 17 aa, Entamoeba invadens
ICYHIALPTFLGKFDAK

SEQ ID NO: 2999760 - protein, 18 aa, Entamoeba invadens
ICYTDLYSPKCAVCGKSL

SEQ ID NO: 2999761 - protein, 22 aa, Entamoeba invadens
ICYWEYLALIQKYYTFDKKPKK

SEQ ID NO: 2999762 - protein, 24 aa, Entamoeba invadens
IDAAKVMWMLFEHPEIPITEIPTR

SEQ ID NO: 2999763 - protein, 24 aa, Entamoeba invadens
IDAALDFRNVSIIAHYIKERTKNA

SEQ ID NO: 2999764 - protein, 30 aa, Entamoeba invadens
IDAEEWVYNRSFIPLKLSLDKKNLIGNKVG

SEQ ID NO: 2999765 - protein, 28 aa, Entamoeba invadens
IDAFKLQKKFRVMIVLPAWSEGELQSIV

SEQ ID NO: 2999766 - protein, 18 aa, Entamoeba invadens
IDAFVQLCLEQLTLMRVI

SEQ ID NO: 2999767 - protein, 19 aa, Entamoeba invadens
IDAIKEMLELLIKLNKFAK

SEQ ID NO: 2999768 - protein, 28 aa, Entamoeba invadens
IDAKYKYLQLCMTLRSYGMNIYAGGIEP

SEQ ID NO: 2999769 - protein, 29 aa, Entamoeba invadens
IDALHGSPLMYFLNMFPKPFACSNGISVV

SEQ ID NO: 2999770 - protein, 21 aa, Entamoeba invadens
IDALRPFSYLMHAKLSSKQCI

SEQ ID NO: 2999771 - protein, 32 aa, Entamoeba invadens
IDALSLNICDFVQLRFLFVSLTSSYSDTYNTL

SEQ ID NO: 2999772 - protein, 26 aa, Entamoeba invadens
IDAMSKLISIILLMSDVPKKVVNTAL

SEQ ID NO: 2999773 - protein, 28 aa, Entamoeba invadens
IDAMSKLISIILLMSNVPKKSLTLLSVL

SEQ ID NO: 2999774 - protein, 26 aa, Entamoeba invadens
IDAMSKLISIILLMSNVPKKVVNTAL

SEQ ID NO: 2999775 - protein, 27 aa, Entamoeba invadens
IDAMSKLISIILLMSNVPKKVVNTALS

SEQ ID NO: 2999776 - protein, 24 aa, Entamoeba invadens
IDATKINIKPFKLSLSASTIKRRI

SEQ ID NO: 2999777 - protein, 24 aa, Entamoeba invadens
IDAVLNFLILVSETEMLSKRVVET

SEQ ID NO: 2999778 - protein, 26 aa, Entamoeba invadens
IDAVRVLFYGKFVQLAALLADVILSE

SEQ ID NO: 2999779 - protein, 25 aa, Entamoeba invadens
IDCKKPLCVPSCPAGINIPGFITEI

SEQ ID NO: 2999780 - protein, 22 aa, Entamoeba invadens
IDCSHILINPKLIRSNFINKIV

SEQ ID NO: 2999781 - protein, 28 aa, Entamoeba invadens
IDCSIQIFQLSDLWLSTLRLGGVGEERY

SEQ ID NO: 2999782 - protein, 28 aa, Entamoeba invadens
IDCTGIIRYMPYVHCFPDIFFVMKENFK

SEQ ID NO: 2999783 - protein, 22 aa, Entamoeba invadens
IDDFTIFPLIKNQYFYFELSDY

SEQ ID NO: 2999784 - protein, 25 aa, Entamoeba invadens
IDDIYFLTDLLTLPPPYPDTLTYSL

SEQ ID NO: 2999785 - protein, 30 aa, Entamoeba invadens
IDDLNYLSGLLVALYYNASFLSKCSISNFA

SEQ ID NO: 2999786 - protein, 21 aa, Entamoeba invadens
IDDRKTVLACYRVLLVFYDVE

SEQ ID NO: 2999787 - protein, 24 aa, Entamoeba invadens
IDDTYPLVYKMLTHMGKKGVNAAD

SEQ ID NO: 2999788 - protein, 24 aa, Entamoeba invadens
IDEKTLVFTPIKNAPDLSKMRIIT

SEQ ID NO: 2999789 - protein, 28 aa, Entamoeba invadens
IDELKKEHFIVLLTLMYVLVWDKVENQT

SEQ ID NO: 2999790 - protein, 26 aa, Entamoeba invadens
IDEQKLVFLLKILKEEWDRSSNGTDV

SEQ ID NO: 2999791 - protein, 23 aa, Entamoeba invadens
IDERGYIFGSYFEKVIDKMDVWF

SEQ ID NO: 2999792 - protein, 24 aa, Entamoeba invadens
IDETSPLVNYFVGGIVFGKESMMF

SEQ ID NO: 2999793 - protein, 18 aa, Entamoeba invadens
IDETTIVPIIRLTGDMRN

SEQ ID NO: 2999794 - protein, 24 aa, Entamoeba invadens
IDEVKIQLPFPLTEKHHILIQVRD

SEQ ID NO: 2999795 - protein, 31 aa, Entamoeba invadens
IDEYSKAIALCKDPIFYGNRAAAYTAIGEDL

SEQ ID NO: 2999796 - protein, 31 aa, Entamoeba invadens
IDFGRKMTGIFFPPLLFSTYVVYANLEGMNV

SEQ ID NO: 2999797 - protein, 30 aa, Entamoeba invadens
IDFPKYPCVIPHPKIPFYKLAAKIKRETDT

SEQ ID NO: 2999798 - protein, 18 aa, Entamoeba invadens
IDFSPYNEIFIGGEWVER

SEQ ID NO: 2999799 - protein, 17 aa, Entamoeba invadens
IDFYQINVWFEVTYDVT

SEQ ID NO: 2999800 - protein, 17 aa, Entamoeba invadens
IDFYTSITRARFEELNI

SEQ ID NO: 2999801 - protein, 17 aa, Entamoeba invadens
IDGAILINNSCSVCYEG

SEQ ID NO: 2999802 - protein, 33 aa, Entamoeba invadens
IDGDALTTLVLNKLRGLPVAAVRAPGFGETRKG

SEQ ID NO: 2999803 - protein, 24 aa, Entamoeba invadens
IDGDKIETILDWPLERQTSFCKKI

SEQ ID NO: 2999804 - protein, 26 aa, Entamoeba invadens
IDGKDRLLFIIVSNKGNVFGSYNSTK

SEQ ID NO: 2999805 - protein, 20 aa, Entamoeba invadens
IDGLQYLLVTQHHATFYYLK

SEQ ID NO: 2999806 - protein, 24 aa, Entamoeba invadens
IDGMIDCVFAYYSDSPLLLQSLQT

SEQ ID NO: 2999807 - protein, 26 aa, Entamoeba invadens
IDHFGPYQKYLILPYGTGNDLSRSLG

SEQ ID NO: 2999808 - protein, 17 aa, Entamoeba invadens
IDHFNIPIDNPCVLLMQ

SEQ ID NO: 2999809 - protein, 24 aa, Entamoeba invadens
IDHSGLITFFEFKKCMKKINVDPE

SEQ ID NO: 2999810 - protein, 23 aa, Entamoeba invadens
IDIAFWNHDLLIKTTVWNELWNK

SEQ ID NO: 2999811 - protein, 22 aa, Entamoeba invadens
IDIAKAILVCEFDAMLKVLQSM

SEQ ID NO: 2999812 - protein, 27 aa, Entamoeba invadens
IDIGGTNMRIIYLDLPSPGVRGELQTI

SEQ ID NO: 2999813 - protein, 21 aa, Entamoeba invadens
IDIGSIVRFVLSYGSYPHDVE

SEQ ID NO: 2999814 - protein, 26 aa, Entamoeba invadens
IDILIQRQCFRIWKKEYLSSFTRKCP

SEQ ID NO: 2999815 - protein, 26 aa, Entamoeba invadens
IDIMKNVLHFLKVGGLFVYSTCSLNP

SEQ ID NO: 2999816 - protein, 23 aa, Entamoeba invadens
IDISDILLYNLIEDKALLQNYTE

SEQ ID NO: 2999817 - protein, 17 aa, Entamoeba invadens
IDISHIKTIGEKCFYCC

SEQ ID NO: 2999818 - protein, 17 aa, Entamoeba invadens
IDKDNFMSLPLLQSVDL

SEQ ID NO: 2999819 - protein, 27 aa, Entamoeba invadens
IDKFNTFQPIWKPNLTYQPSATPKNLI

SEQ ID NO: 2999820 - protein, 19 aa, Entamoeba invadens
IDKFVLCRKCENPETVMIV

SEQ ID NO: 2999821 - protein, 17 aa, Entamoeba invadens
IDKINLLRAMFSSRQNE

SEQ ID NO: 2999822 - protein, 18 aa, Entamoeba invadens
IDKKPRIDLSFALVSRNV

SEQ ID NO: 2999823 - protein, 18 aa, Entamoeba invadens
IDKLFAIVIHSSARSLRQ

SEQ ID NO: 2999824 - protein, 18 aa, Entamoeba invadens
IDKLLLLEGEVFAKGCRL

SEQ ID NO: 2999825 - protein, 22 aa, Entamoeba invadens
IDKNDFVFLMETIKYADEDDES

SEQ ID NO: 2999826 - protein, 30 aa, Entamoeba invadens
IDKQNEILGGRRLVLYPAILNEDGKEDGKH

SEQ ID NO: 2999827 - protein, 34 aa, Entamoeba invadens
IDKSILDSAFFIISYLRDFPFMRMNKELAKVDID

SEQ ID NO: 2999828 - protein, 34 aa, Entamoeba invadens
IDKTFRINCVGGLDVGWVAYVIGITSDYRNLDFL

SEQ ID NO: 2999829 - protein, 19 aa, Entamoeba invadens
IDKTLLINSIFPSYRDLMN

SEQ ID NO: 2999830 - protein, 23 aa, Entamoeba invadens
IDKVLIYTKKTSLPRKLKINNSG

SEQ ID NO: 2999831 - protein, 31 aa, Entamoeba invadens
IDKYAQYQEIWLRGYWLIFAHDQIVRGKVDN

SEQ ID NO: 2999832 - protein, 22 aa, Entamoeba invadens
IDKYKFLLERFENEYMSIRDYE

SEQ ID NO: 2999833 - protein, 29 aa, Entamoeba invadens
IDLDDHNYLLFTNIEYIRGFSSSINFIKK

SEQ ID NO: 2999834 - protein, 23 aa, Entamoeba invadens
IDLHNFLYRVALVFDKRNIRMDG

SEQ ID NO: 2999835 - protein, 18 aa, Entamoeba invadens
IDLLLVNLFKARTYDEFR

SEQ ID NO: 2999836 - protein, 19 aa, Entamoeba invadens
IDLNTLIERYFGRLVCTIQ

SEQ ID NO: 2999837 - protein, 19 aa, Entamoeba invadens
IDLQMKLSDALVELSSLKQ

SEQ ID NO: 2999838 - protein, 26 aa, Entamoeba invadens
IDLRATLIPFPRWGSYQNFALFMAAF

SEQ ID NO: 2999839 - protein, 21 aa, Entamoeba invadens
IDLSDLLKQLEEIKLRTDDIV

SEQ ID NO: 2999840 - protein, 18 aa, Entamoeba invadens
IDLSIWNFSSHKKFLKMT

SEQ ID NO: 2999841 - protein, 18 aa, Entamoeba invadens
IDLTKMPFPCAIEGWFEF

SEQ ID NO: 2999842 - protein, 22 aa, Entamoeba invadens
IDLTQLYRLGIISMYFDKTVET

SEQ ID NO: 2999843 - protein, 17 aa, Entamoeba invadens
IDLVPYENNIWKVTAIV

SEQ ID NO: 2999844 - protein, 24 aa, Entamoeba invadens
IDLYVDLYNMFLSTVLHSSVEYGD

SEQ ID NO: 2999845 - protein, 20 aa, Entamoeba invadens
IDMIFLVHGLSNIEINAQEQ

SEQ ID NO: 2999846 - protein, 34 aa, Entamoeba invadens
IDMVAPQLCMGNLRLAHYLAQYGSTLLGTVRKNR

SEQ ID NO: 2999847 - protein, 20 aa, Entamoeba invadens
IDMVYPSFDSFLLNNGLTFG

SEQ ID NO: 2999848 - protein, 28 aa, Entamoeba invadens
IDNDPIKRVIFLHFFIHAADEMRKIKNF

SEQ ID NO: 2999849 - protein, 18 aa, Entamoeba invadens
IDNIISKELTLFQKDLVP

SEQ ID NO: 2999850 - protein, 19 aa, Entamoeba invadens
IDNIKLVQLLFPDVLIDRV

SEQ ID NO: 2999851 - protein, 24 aa, Entamoeba invadens
IDNIPCGLAWPLLIGEKGIGIHME

SEQ ID NO: 2999852 - protein, 26 aa, Entamoeba invadens
IDNKFVEYIISKWKAEFPTEMANLFI

SEQ ID NO: 2999853 - protein, 25 aa, Entamoeba invadens
IDNKIKEILPTGAIVYEKCPACGNE

SEQ ID NO: 2999854 - protein, 24 aa, Entamoeba invadens
IDNKLFFNGVNSFSSLTISVFEET

SEQ ID NO: 2999855 - protein, 27 aa, Entamoeba invadens
IDNNFKKILRLLFTMPEIKDPNLFPLI

SEQ ID NO: 2999856 - protein, 24 aa, Entamoeba invadens
IDNNFNILFTLGGDGTLRGANEID

SEQ ID NO: 2999857 - protein, 19 aa, Entamoeba invadens
IDNNYLRQFYQIRVHFPVT

SEQ ID NO: 2999858 - protein, 18 aa, Entamoeba invadens
IDNTFLDRDCTVAIKSVE

SEQ ID NO: 2999859 - protein, 19 aa, Entamoeba invadens
IDNTKTIKRLCSFEILPSF

SEQ ID NO: 2999860 - protein, 21 aa, Entamoeba invadens
IDNYSICDYIIALLKLDVFHQ

SEQ ID NO: 2999861 - protein, 22 aa, Entamoeba invadens
IDPLRKMLFNPSDKDKLAALKA

SEQ ID NO: 2999862 - protein, 23 aa, Entamoeba invadens
IDPNSVLPFFQLLTNNTFKSVLQ

SEQ ID NO: 2999863 - protein, 27 aa, Entamoeba invadens
IDPTELFMVYVFLFNNNVSPSGLLFEK

SEQ ID NO: 2999864 - protein, 24 aa, Entamoeba invadens
IDPTFVKGYSRLVLIYKELGDIDN

SEQ ID NO: 2999865 - protein, 23 aa, Entamoeba invadens
IDPTLSIMFSQITSLIIVPDNIQ

SEQ ID NO: 2999866 - protein, 17 aa, Entamoeba invadens
IDQLKNVITLKDTFPDQ

SEQ ID NO: 2999867 - protein, 19 aa, Entamoeba invadens
IDQTFPRCFNFIDAIFEDG

SEQ ID NO: 2999868 - protein, 18 aa, Entamoeba invadens
IDQVGFSMLFHLTSIEVK

SEQ ID NO: 2999869 - protein, 27 aa, Entamoeba invadens
IDQYLPKIFEHYATFLKLTVGTNGNSK

SEQ ID NO: 2999870 - protein, 31 aa, Entamoeba invadens
IDRCKENFVLGNWFYWYLTVECGCKDGDSCD

SEQ ID NO: 2999871 - protein, 27 aa, Entamoeba invadens
IDREEFKKFFKVLQSKIFDHAGDLKNI

SEQ ID NO: 2999872 - protein, 18 aa, Entamoeba invadens
IDRLSPKKSLIFDVPEGK

SEQ ID NO: 2999873 - protein, 23 aa, Entamoeba invadens
IDRRIEFFGIHWCIKEAVLKTTG

SEQ ID NO: 2999874 - protein, 27 aa, Entamoeba invadens
IDRTDPIWREPIFSIILNSGVVAETIL

SEQ ID NO: 2999875 - protein, 19 aa, Entamoeba invadens
IDRVYYSFNAVFTNGVFLL

SEQ ID NO: 2999876 - protein, 18 aa, Entamoeba invadens
IDRYYQIKSFTKEKFYKI

SEQ ID NO: 2999877 - protein, 24 aa, Entamoeba invadens
IDSDIKQFWCSAHRLALCGEGLEK

SEQ ID NO: 2999878 - protein, 23 aa, Entamoeba invadens
IDSFKQYFTFDPTYKDLKEIGMN

SEQ ID NO: 2999879 - protein, 33 aa, Entamoeba invadens
IDSLAPFQVIDRSSFRLILPSEQPVDFPFEINT

SEQ ID NO: 2999880 - protein, 17 aa, Entamoeba invadens
IDSNTLRFYNPSGRFVI

SEQ ID NO: 2999881 - protein, 36 aa, Entamoeba invadens
IDSQGNFVIFHDLYVKLLHLIGGPRDLHLSLTLDTF

SEQ ID NO: 2999882 - protein, 17 aa, Entamoeba invadens
IDSRAFSFCMIKTITIH

SEQ ID NO: 2999883 - protein, 25 aa, Entamoeba invadens
IDSSKFVFPMHLLKDKFTTKISALK

SEQ ID NO: 2999884 - protein, 22 aa, Entamoeba invadens
IDSTCKHNFLFRGNSPFTRVYS

SEQ ID NO: 2999885 - protein, 25 aa, Entamoeba invadens
IDSYPFFEYVMRVYAYAIGVKKNGN

SEQ ID NO: 2999886 - protein, 31 aa, Entamoeba invadens
IDTALLDLILIIFELYVLPKAHYKSIQGLDA

SEQ ID NO: 2999887 - protein, 17 aa, Entamoeba invadens
IDTIEGLSYIKKSFWID

SEQ ID NO: 2999888 - protein, 25 aa, Entamoeba invadens
IDTKKLKQLLFSVEINKVCLGLFGK

SEQ ID NO: 2999889 - protein, 25 aa, Entamoeba invadens
IDTKTSFIFSLVRNGILNPIKFDLQ

SEQ ID NO: 2999890 - protein, 26 aa, Entamoeba invadens
IDTLFVELTSFFNSLFKGSVSITLIN

SEQ ID NO: 2999891 - protein, 29 aa, Entamoeba invadens
IDTLMRQIPFVAYPDRNFSRFLFGGRIVV

SEQ ID NO: 2999892 - protein, 26 aa, Entamoeba invadens
IDTMSKLISIILLMSNVPKKVVNTAL

SEQ ID NO: 2999893 - protein, 26 aa, Entamoeba invadens
IDTNFLPYKQSIWSLGLCNTLYTKNS

SEQ ID NO: 2999894 - protein, 25 aa, Entamoeba invadens
IDTPKMTLFIRGEKVNLFVIYMMRG

SEQ ID NO: 2999895 - protein, 26 aa, Entamoeba invadens
IDTPSVVGLALALKKAFEYIDYENST

SEQ ID NO: 2999896 - protein, 21 aa, Entamoeba invadens
IDVINLSRLISSPSLKKVILY

SEQ ID NO: 2999897 - protein, 25 aa, Entamoeba invadens
IDVKARNFLVFQGDVSQVASKSGKE

SEQ ID NO: 2999898 - protein, 23 aa, Entamoeba invadens
IDVLLKMEPWQRNIYNPLLEHLK

SEQ ID NO: 2999899 - protein, 18 aa, Entamoeba invadens
IDVQAVVYSLNLLKEVNL

SEQ ID NO: 2999900 - protein, 18 aa, Entamoeba invadens
IDVVKLILEPTAAFYFYG

SEQ ID NO: 2999901 - protein, 18 aa, Entamoeba invadens
IDVVKLIPEPTAAFYFYG

SEQ ID NO: 2999902 - protein, 32 aa, Entamoeba invadens
IDVVKLIPEPTAAFYFYSIRNHAFNIENDVTK

SEQ ID NO: 2999903 - protein, 19 aa, Entamoeba invadens
IDVVLDPKPLVKSQTMIYC

SEQ ID NO: 2999904 - protein, 21 aa, Entamoeba invadens
IDVVLPQHIVPWIDIPRCPVC

SEQ ID NO: 2999905 - protein, 21 aa, Entamoeba invadens
IDWGNFWNCPNVEKIAIFSKK

SEQ ID NO: 2999906 - protein, 19 aa, Entamoeba invadens
IDWTFYCHKCDGMASLRTC

SEQ ID NO: 2999907 - protein, 21 aa, Entamoeba invadens
IDWTFYCKKCDGMASLRTCPH

SEQ ID NO: 2999908 - protein, 18 aa, Entamoeba invadens
IDYKNMMFICKKFQEIPD

SEQ ID NO: 2999909 - protein, 25 aa, Entamoeba invadens
IDYTQRFFFIFNDVSQVVRDTMLSV

SEQ ID NO: 2999910 - protein, 29 aa, Entamoeba invadens
IEAGFRPGWYYNRISKGLEWIDDILLTRT

SEQ ID NO: 2999911 - protein, 18 aa, Entamoeba invadens
IEAKVEVYPYTSFNEKMG

SEQ ID NO: 2999912 - protein, 18 aa, Entamoeba invadens
IEALYINVFKQCLQLVPL

SEQ ID NO: 2999913 - protein, 31 aa, Entamoeba invadens
IEARRYSLEGPITISSYNKLLLDMKTDQIEQ

SEQ ID NO: 2999914 - protein, 25 aa, Entamoeba invadens
IEASAWYFGPVILALKDPDFCVNYC

SEQ ID NO: 2999915 - protein, 26 aa, Entamoeba invadens
IEASGFIMMPLNPLYKVEQLLNLFKK

SEQ ID NO: 2999916 - protein, 19 aa, Entamoeba invadens
IEAVFKSPKFIKKVSVIFQ

SEQ ID NO: 2999917 - protein, 18 aa, Entamoeba invadens
IEAVVKWKANIDDRVLFN

SEQ ID NO: 2999918 - protein, 30 aa, Entamoeba invadens
IECFRLFFCEEIANNLLLFSNKKIAKEHKT

SEQ ID NO: 2999919 - protein, 22 aa, Entamoeba invadens
IECIPHCMFMKCYNLKEMVFPT

SEQ ID NO: 2999920 - protein, 38 aa, Entamoeba invadens
IECIPHCTFMKCYNLKKMIFPTTLKTIGKFAFKNCYSL

SEQ ID NO: 2999921 - protein, 19 aa, Entamoeba invadens
IECLQLLVDIVRELGFFVE

SEQ ID NO: 2999922 - protein, 26 aa, Entamoeba invadens
IECPKSAFLRMLKAAFYEAPDNHLII

SEQ ID NO: 2999923 - protein, 25 aa, Entamoeba invadens
IECVKKIVLYFESLSRFQKSPYIYP

SEQ ID NO: 2999924 - protein, 20 aa, Entamoeba invadens
IEDCFKRRLSDVFTPPIYHD

SEQ ID NO: 2999925 - protein, 17 aa, Entamoeba invadens
IEDEYPPHPLSLTEEKE

SEQ ID NO: 2999926 - protein, 25 aa, Entamoeba invadens
IEDFCFYECFGLSKVYLSFGITEFG

SEQ ID NO: 2999927 - protein, 18 aa, Entamoeba invadens
IEDGLNDSDMLKAQKADY

SEQ ID NO: 2999928 - protein, 31 aa, Entamoeba invadens
IEDHSFAMCFYLTRVVLPNNLLKIKNAAFAN

SEQ ID NO: 2999929 - protein, 23 aa, Entamoeba invadens
IEDKLYRKYLHLSTHSIGSLTHV

SEQ ID NO: 2999930 - protein, 19 aa, Entamoeba invadens
IEDLISPLLMKVLGEVTEN

SEQ ID NO: 2999931 - protein, 17 aa, Entamoeba invadens
IEDLLKNIFELLSRVCM

SEQ ID NO: 2999932 - protein, 23 aa, Entamoeba invadens
IEDLRVITFYMKNSKLKKQKSAI

SEQ ID NO: 2999933 - protein, 19 aa, Entamoeba invadens
IEDVTIEALLTALNPNKKI

SEQ ID NO: 2999934 - protein, 23 aa, Entamoeba invadens
IEDVVGFLNFFIDATKINIKPFK

SEQ ID NO: 2999935 - protein, 25 aa, Entamoeba invadens
IEEAKIKFYSPPKSKLFLMKGKFNL

SEQ ID NO: 2999936 - protein, 24 aa, Entamoeba invadens
IEEDGMVLLIQRLKYEEPLVVAYF

SEQ ID NO: 2999937 - protein, 18 aa, Entamoeba invadens
IEEDPERYLLYSNTDVYA

SEQ ID NO: 2999938 - protein, 17 aa, Entamoeba invadens
IEEGMTLGIFKYLLSEQ

SEQ ID NO: 2999939 - protein, 24 aa, Entamoeba invadens
IEEGYFFNYKLPRPSKKTIQLERI

SEQ ID NO: 2999940 - protein, 27 aa, Entamoeba invadens
IEEKCPELLWRWYITRGRTDEGVLCLL

SEQ ID NO: 2999941 - protein, 25 aa, Entamoeba invadens
IEEKDFHRIFKYLSVHDLVNCRLVC

SEQ ID NO: 2999942 - protein, 18 aa, Entamoeba invadens
IEEKIVLCYAPHVKFLIQ

SEQ ID NO: 2999943 - protein, 27 aa, Entamoeba invadens
IEEKKRKFFGVFYFYKMAEVDIEDVKV

SEQ ID NO: 2999944 - protein, 32 aa, Entamoeba invadens
IEEKRLCHFVKIMEFVMNMGNWTEWYDRCSLL

SEQ ID NO: 2999945 - protein, 18 aa, Entamoeba invadens
IEELVLQNVEIMDGAFSH

SEQ ID NO: 2999946 - protein, 24 aa, Entamoeba invadens
IEELYYVSSLLRKALDNCFIVDEV

SEQ ID NO: 2999947 - protein, 19 aa, Entamoeba invadens
IEENDFINILLTSTKCRYI

SEQ ID NO: 2999948 - protein, 22 aa, Entamoeba invadens
IEERSFKMYPITSFLEMLDENI

SEQ ID NO: 2999949 - protein, 38 aa, Entamoeba invadens
IEESLIKYIKKPTNNELIIPLMFGKKDKNKKKMVIEKR

SEQ ID NO: 2999950 - protein, 21 aa, Entamoeba invadens
IEETYLKRKVVIQSFADVLKE

SEQ ID NO: 2999951 - protein, 32 aa, Entamoeba invadens
IEEVKKMITVAPWFFVEITLLKRTANLEFNVV

SEQ ID NO: 2999952 - protein, 19 aa, Entamoeba invadens
IEFCEVVGSGWRPSPVLNE

SEQ ID NO: 2999953 - protein, 33 aa, Entamoeba invadens
IEFEKNDYRKFIFPFSYLTWLNEDDFKIEESTG

SEQ ID NO: 2999954 - protein, 22 aa, Entamoeba invadens
IEFGFYGFISMDLFTLPKQICN

SEQ ID NO: 2999955 - protein, 17 aa, Entamoeba invadens
IEFLNILQSFIKKDQTL

SEQ ID NO: 2999956 - protein, 18 aa, Entamoeba invadens
IEFLNMPMNFVFRGNIDF

SEQ ID NO: 2999957 - protein, 26 aa, Entamoeba invadens
IEFMGEGCELKFYLAPKFDEGQPEAQ

SEQ ID NO: 2999958 - protein, 18 aa, Entamoeba invadens
IEFSIPMFSDIVGHSIET

SEQ ID NO: 2999959 - protein, 25 aa, Entamoeba invadens
IEGCKLEFIIGLIDQICRGSEKKIA

SEQ ID NO: 2999960 - protein, 29 aa, Entamoeba invadens
IEGDIVLYYLYNWKVYNGVYYIPDDVTVV

SEQ ID NO: 2999961 - protein, 25 aa, Entamoeba invadens
IEGFCKVFKTLLSKLLSLNSEVSRL

SEQ ID NO: 2999962 - protein, 24 aa, Entamoeba invadens
IEGFIADKNIGLAQLIAVIKEFFT

SEQ ID NO: 2999963 - protein, 25 aa, Entamoeba invadens
IEGKLQYVVLGYAKAFEGIPRQLAD

SEQ ID NO: 2999964 - protein, 27 aa, Entamoeba invadens
IEGLDKLMFVIKMSEGWQFGFYSEDIA

SEQ ID NO: 2999965 - protein, 21 aa, Entamoeba invadens
IEGLLIQPVQRIMRYPIILKQ

SEQ ID NO: 2999966 - protein, 27 aa, Entamoeba invadens
IEHHEKTFFLYPGAPFFMNYDEYNEKE

SEQ ID NO: 2999967 - protein, 30 aa, Entamoeba invadens
IEHIELIFYQIIDWNTIITQSLYLEFTARN

SEQ ID NO: 2999968 - protein, 20 aa, Entamoeba invadens
IEHNLGVILTTKLLKHTLVN

SEQ ID NO: 2999969 - protein, 24 aa, Entamoeba invadens
IEHWLKTKPVCPIDFGPWVCDSTE

SEQ ID NO: 2999970 - protein, 35 aa, Entamoeba invadens
IEHYAIDMLKLFPNIKTLYLPSYKMRISNEVFLKI

SEQ ID NO: 2999971 - protein, 19 aa, Entamoeba invadens
IEIACPSRFASKAMQLFVV

SEQ ID NO: 2999972 - protein, 18 aa, Entamoeba invadens
IEIEDCFFKYRFGRICEK

SEQ ID NO: 2999973 - protein, 32 aa, Entamoeba invadens
IEIKHPERLAAKTIQFLIVNELFYDGKSLGFG

SEQ ID NO: 2999974 - protein, 23 aa, Entamoeba invadens
IEIKPRLFAEQLFVFDKWIMKGL

SEQ ID NO: 2999975 - protein, 19 aa, Entamoeba invadens
IEILLPTENLKRLSTNCKV

SEQ ID NO: 2999976 - protein, 19 aa, Entamoeba invadens
IEILPYLNGAQRKVVTYDF

SEQ ID NO: 2999977 - protein, 18 aa, Entamoeba invadens
IEILVMPSSLTYIGNFAF

SEQ ID NO: 2999978 - protein, 19 aa, Entamoeba invadens
IEISKAFTLPNEQFKYFDR

SEQ ID NO: 2999979 - protein, 26 aa, Entamoeba invadens
IEITVEPVMTFEGFAVYSREEKFNEK

SEQ ID NO: 2999980 - protein, 21 aa, Entamoeba invadens
IEIVKFIITNYDLIFTAEIVD

SEQ ID NO: 2999981 - protein, 18 aa, Entamoeba invadens
IEIYLNLLIMCVETIQVE

SEQ ID NO: 2999982 - protein, 31 aa, Entamoeba invadens
IEKDKVHFFLSTNWFLSINKQSARIVVWSME

SEQ ID NO: 2999983 - protein, 25 aa, Entamoeba invadens
IEKDPNYFVFTLKNPHNIQPTKFGR

SEQ ID NO: 2999984 - protein, 19 aa, Entamoeba invadens
IEKEIFNGWKKMNAMTPID

SEQ ID NO: 2999985 - protein, 29 aa, Entamoeba invadens
IEKETLAPAVLFFPYMQAVRFLADYLNGD

SEQ ID NO: 2999986 - protein, 17 aa, Entamoeba invadens
IEKHPFFNGIHWSTLFD

SEQ ID NO: 2999987 - protein, 20 aa, Entamoeba invadens
IEKIAMGMLYNDEKMKKIFP

SEQ ID NO: 2999988 - protein, 20 aa, Entamoeba invadens
IEKILRLIQQKLKDNDDQSS

SEQ ID NO: 2999989 - protein, 19 aa, Entamoeba invadens
IEKKFKGFTVILDSMTDKE

SEQ ID NO: 2999990 - protein, 17 aa, Entamoeba invadens
IEKLNDLPLEKPIEKVE

SEQ ID NO: 2999991 - protein, 17 aa, Entamoeba invadens
IEKNILHRDLKLQNFLL

SEQ ID NO: 2999992 - protein, 23 aa, Entamoeba invadens
IEKRGRLISNYMFFLVSSQESVK

SEQ ID NO: 2999993 - protein, 20 aa, Entamoeba invadens
IEKSIPSGKITKKKVLVKQV

SEQ ID NO: 2999994 - protein, 19 aa, Entamoeba invadens
IEKVILFQQRDCCSKTHIN

SEQ ID NO: 2999995 - protein, 31 aa, Entamoeba invadens
IEKWVAMIKNKLYDVPILFVGNKSDIEQQRD

SEQ ID NO: 2999996 - protein, 18 aa, Entamoeba invadens
IELCNSVFSCLYPTPQNV

SEQ ID NO: 2999997 - protein, 24 aa, Entamoeba invadens
IELFKTHHHLLFGENYIQELHEKA

SEQ ID NO: 2999998 - protein, 25 aa, Entamoeba invadens
IELIRRLHISIVRKLVKSTPETFVS

SEQ ID NO: 2999999 - protein, 25 aa, Entamoeba invadens
IELKYESYYLYCNSTMFIYVFDVTD

SEQ ID NO: 3000000 - protein, 25 aa, Entamoeba invadens
IELNSFIGFLLYMGVVHDSKKSLNY

SEQ ID NO: 3000001 - protein, 17 aa, Entamoeba invadens
IELPIKHPELFESLGIA

SEQ ID NO: 3000002 - protein, 17 aa, Entamoeba invadens
IELPRILVVRDGSKRVI

SEQ ID NO: 3000003 - protein, 29 aa, Entamoeba invadens
IELPSNFLIEMFFTIYSKASKRNNELGAL

SEQ ID NO: 3000004 - protein, 26 aa, Entamoeba invadens
IELPSSVSIICCCAFLSCGFESLTIP

SEQ ID NO: 3000005 - protein, 25 aa, Entamoeba invadens
IELTPPLVMLLNGFSHPCFGNKEAY

SEQ ID NO: 3000006 - protein, 17 aa, Entamoeba invadens
IELYKKLYAGESYTFNL

SEQ ID NO: 3000007 - protein, 18 aa, Entamoeba invadens
IELYKKLYTGESYTFNLL

SEQ ID NO: 3000008 - protein, 26 aa, Entamoeba invadens
IELYSDIYFFLTNPKRWRKDVMYREL

SEQ ID NO: 3000009 - protein, 24 aa, Entamoeba invadens
IELYSTNILPRFLEQVLLSRDKVT

SEQ ID NO: 3000010 - protein, 20 aa, Entamoeba invadens
IEMAKISGLVLVPDTLRNPL

SEQ ID NO: 3000011 - protein, 19 aa, Entamoeba invadens
IEMELYSDIVPKTAENFRC

SEQ ID NO: 3000012 - protein, 19 aa, Entamoeba invadens
IEMRRAFLDFIQKCLRYDP

SEQ ID NO: 3000013 - protein, 17 aa, Entamoeba invadens
IEMTEHYAKLFLRFIRR

SEQ ID NO: 3000014 - protein, 19 aa, Entamoeba invadens
IENCRMMLMCFETLTALKP

SEQ ID NO: 3000015 - protein, 31 aa, Entamoeba invadens
IENFDIHFSMFLVAIQRWLKLKIKSAMKIAL

SEQ ID NO: 3000016 - protein, 25 aa, Entamoeba invadens
IENFRTMIPQLFSAMMRMAQSSMGM

SEQ ID NO: 3000017 - protein, 26 aa, Entamoeba invadens
IENGEYEYLFWESLFDVKLEGFDVKV

SEQ ID NO: 3000018 - protein, 23 aa, Entamoeba invadens
IENHANLYVMFKSCTVRPSRGEA

SEQ ID NO: 3000019 - protein, 18 aa, Entamoeba invadens
IENICKEARMNCITPKNL

SEQ ID NO: 3000020 - protein, 18 aa, Entamoeba invadens
IENIPFLRTSQKNIKALS

SEQ ID NO: 3000021 - protein, 17 aa, Entamoeba invadens
IENKEHWTATKSKFWYL

SEQ ID NO: 3000022 - protein, 25 aa, Entamoeba invadens
IENKNIRGYYWTGNKSDLLSNEMSK

SEQ ID NO: 3000023 - protein, 17 aa, Entamoeba invadens
IENLMNLTLIPEDALRA

SEQ ID NO: 3000024 - protein, 27 aa, Entamoeba invadens
IENLQTLVIFCDGNLYKNYFDLFEQFV

SEQ ID NO: 3000025 - protein, 18 aa, Entamoeba invadens
IENLSFPKDLEMFATHNC

SEQ ID NO: 3000026 - protein, 23 aa, Entamoeba invadens
IENNVGFQLLKQMGFDQTQEYNT

SEQ ID NO: 3000027 - protein, 25 aa, Entamoeba invadens
IENPRIIERLIQDTIPLIVYTTNYT

SEQ ID NO: 3000028 - protein, 26 aa, Entamoeba invadens
IENRTTFTLTRLLKKLQKTFKKLQFS

SEQ ID NO: 3000029 - protein, 19 aa, Entamoeba invadens
IENTLKLFTELHACIQKFQ

SEQ ID NO: 3000030 - protein, 17 aa, Entamoeba invadens
IENVDFFVAHNNGFFVV

SEQ ID NO: 3000031 - protein, 25 aa, Entamoeba invadens
IENVELPMILLGKLSAKERHERALM

SEQ ID NO: 3000032 - protein, 18 aa, Entamoeba invadens
IENVVLYYKCDLLRENTI

SEQ ID NO: 3000033 - protein, 29 aa, Entamoeba invadens
IENWTLMEMYWEQAIFKYLRCDPQDHYFL

SEQ ID NO: 3000034 - protein, 23 aa, Entamoeba invadens
IENYKNFFLDFTNNVYISPRELN

SEQ ID NO: 3000035 - protein, 19 aa, Entamoeba invadens
IEPFNVFFNGEFPYCALDI

SEQ ID NO: 3000036 - protein, 27 aa, Entamoeba invadens
IEPGAFSMCRTLRRVFLPFQTQYHSTA

SEQ ID NO: 3000037 - protein, 18 aa, Entamoeba invadens
IEPLIKSYKLKIDSINLL

SEQ ID NO: 3000038 - protein, 25 aa, Entamoeba invadens
IEPQVRLGELWKESLMELSGGQKSL

SEQ ID NO: 3000039 - protein, 24 aa, Entamoeba invadens
IEPTPIPQLVLPIENKAVTTTPIE

SEQ ID NO: 3000040 - protein, 29 aa, Entamoeba invadens
IEQAQMKYVTLYKYWWDGLKEKVDIERWS

SEQ ID NO: 3000041 - protein, 31 aa, Entamoeba invadens
IEQECSVGHIIWYLSVFLGNCSRINSIVDDR

SEQ ID NO: 3000042 - protein, 24 aa, Entamoeba invadens
IEQFKKFFFDTVAVSYEFYLQMKA

SEQ ID NO: 3000043 - protein, 34 aa, Entamoeba invadens
IEQILSYVLTRPAYNAFGLCLFAIQSRLKIRMTN

SEQ ID NO: 3000044 - protein, 25 aa, Entamoeba invadens
IEQLKSFIVLMVGLQGRFEHDLGRN

SEQ ID NO: 3000045 - protein, 25 aa, Entamoeba invadens
IEQQKLKIIALETTLCYLNDESIEV

SEQ ID NO: 3000046 - protein, 21 aa, Entamoeba invadens
IEQVFMIFELLGKPNEKTWEG

SEQ ID NO: 3000047 - protein, 28 aa, Entamoeba invadens
IERAKRLAALRSAMFFDQQNARRQNKIK

SEQ ID NO: 3000048 - protein, 23 aa, Entamoeba invadens
IERDVLLLILNYADGKGIFCAKD

SEQ ID NO: 3000049 - protein, 24 aa, Entamoeba invadens
IERENWFVALGITKYDLIRTSPEE

SEQ ID NO: 3000050 - protein, 19 aa, Entamoeba invadens
IERIYYMGKLVFSLDQMVV

SEQ ID NO: 3000051 - protein, 22 aa, Entamoeba invadens
IERLMKCWILYNQDGGYQQGMS

SEQ ID NO: 3000052 - protein, 18 aa, Entamoeba invadens
IERLQFSYPISYDKYLEE

SEQ ID NO: 3000053 - protein, 18 aa, Entamoeba invadens
IERLYPNSVIKKVSGSFQ

SEQ ID NO: 3000054 - protein, 25 aa, Entamoeba invadens
IERQKKEYAVLTKKYNDLTVDFKDK

SEQ ID NO: 3000055 - protein, 26 aa, Entamoeba invadens
IERSISFLVSLLKKGWQNIKSVYVKT

SEQ ID NO: 3000056 - protein, 18 aa, Entamoeba invadens
IERYIACESLFNPELIGI

SEQ ID NO: 3000057 - protein, 24 aa, Entamoeba invadens
IESCGKMVLLDKLLVELKKDGHRV

SEQ ID NO: 3000058 - protein, 24 aa, Entamoeba invadens
IESFIKNYFNLFDTDPLSLSSFYT

SEQ ID NO: 3000059 - protein, 18 aa, Entamoeba invadens
IESGNKLLDLVFALLSKL

SEQ ID NO: 3000060 - protein, 36 aa, Entamoeba invadens
IESHFFSNCTLLAKVILPKYLTRLGLLCFEKCMSLK

SEQ ID NO: 3000061 - protein, 17 aa, Entamoeba invadens
IESLSDSTIYMAYYTIA

SEQ ID NO: 3000062 - protein, 41 aa, Entamoeba invadens
IESNDFFNSIQPKQPLFIRRIGTVLSPLREFIALNEITELK

SEQ ID NO: 3000063 - protein, 22 aa, Entamoeba invadens
IESNLPFYNLGAFFSNQQESIQ

SEQ ID NO: 3000064 - protein, 25 aa, Entamoeba invadens
IESSPSFLVVELFDFYAVNSFKEMN

SEQ ID NO: 3000065 - protein, 22 aa, Entamoeba invadens
IESVIMYRRYLTRFKQPLTQPE

SEQ ID NO: 3000066 - protein, 19 aa, Entamoeba invadens
IESYKFELEQLEWKWGICM

SEQ ID NO: 3000067 - protein, 28 aa, Entamoeba invadens
IETDINFLNFFYLIVSHPKYISALSLEN

SEQ ID NO: 3000068 - protein, 25 aa, Entamoeba invadens
IETEQIIRLFTVLLGRNVEIQVILK

SEQ ID NO: 3000069 - protein, 24 aa, Entamoeba invadens
IETGTFFTFSVLNSRFKVGDSHIV

SEQ ID NO: 3000070 - protein, 19 aa, Entamoeba invadens
IETIMNYLYNKGCTTKGIF

SEQ ID NO: 3000071 - protein, 23 aa, Entamoeba invadens
IETINIVMELAPFGCLMSKYKEI

SEQ ID NO: 3000072 - protein, 23 aa, Entamoeba invadens
IETKPIIRHSLSKELQMYYDMVV

SEQ ID NO: 3000073 - protein, 23 aa, Entamoeba invadens
IETLQFLVDLVRELGFFVQTEEC

SEQ ID NO: 3000074 - protein, 21 aa, Entamoeba invadens
IETMFKFMFNTTLIETNFVEN

SEQ ID NO: 3000075 - protein, 19 aa, Entamoeba invadens
IETMINYLYTKGCGTYGIF

SEQ ID NO: 3000076 - protein, 22 aa, Entamoeba invadens
IETNELLCCTSKFYITGYNTTK

SEQ ID NO: 3000077 - protein, 23 aa, Entamoeba invadens
IETQKKQILLERAKKMKVYDDLN

SEQ ID NO: 3000078 - protein, 25 aa, Entamoeba invadens
IETSEGDIWIVFKKIDEETFVGKRG

SEQ ID NO: 3000079 - protein, 17 aa, Entamoeba invadens
IETTPCFFLTSQSIEGE

SEQ ID NO: 3000080 - protein, 27 aa, Entamoeba invadens
IETVIYEQTLLALLFQMDFNATKIEVT

SEQ ID NO: 3000081 - protein, 23 aa, Entamoeba invadens
IETWISLSEKGGCDAGWGIIAEQ

SEQ ID NO: 3000082 - protein, 19 aa, Entamoeba invadens
IETYLIGIFADIDSPLNPS

SEQ ID NO: 3000083 - protein, 19 aa, Entamoeba invadens
IEVAPNLMFFGFVVDQRTQ

SEQ ID NO: 3000084 - protein, 21 aa, Entamoeba invadens
IEVFCGLPYIETTGFMAINRE

SEQ ID NO: 3000085 - protein, 28 aa, Entamoeba invadens
IEVKKIENWTDWWKIRQSSFYHLSQEAR

SEQ ID NO: 3000086 - protein, 26 aa, Entamoeba invadens
IEVLREWILLYMNCRINQRVGAGLLT

SEQ ID NO: 3000087 - protein, 32 aa, Entamoeba invadens
IEVLRYNFKTKIIYIALMVSWILKADETGELD

SEQ ID NO: 3000088 - protein, 17 aa, Entamoeba invadens
IEVLTTLVKDFCGEKDE

SEQ ID NO: 3000089 - protein, 38 aa, Entamoeba invadens
IEVNNLSMTLLWVFFLRQACLKNWPNSPLNIFERDGFI

SEQ ID NO: 3000090 - protein, 24 aa, Entamoeba invadens
IEVPPPVNWIKKDSGHFLFTLVNH

SEQ ID NO: 3000091 - protein, 17 aa, Entamoeba invadens
IEVPSINVLIDKIPDFY

SEQ ID NO: 3000092 - protein, 24 aa, Entamoeba invadens
IEVSFDGIVIPKDKILKIGADANK

SEQ ID NO: 3000093 - protein, 22 aa, Entamoeba invadens
IEVTWLITPDQSSCVLPEVIYE

SEQ ID NO: 3000094 - protein, 25 aa, Entamoeba invadens
IEVVSFKLKDPVHHDTPHKVDTLKH

SEQ ID NO: 3000095 - protein, 17 aa, Entamoeba invadens
IEVYFEKCLQDPSCLLQ

SEQ ID NO: 3000096 - protein, 35 aa, Entamoeba invadens
IEYDQLRALSFPQTDIFLICFSVVSPPSFDNVSAK

SEQ ID NO: 3000097 - protein, 25 aa, Entamoeba invadens
IEYEQMKMFLPMFNCLEDFSECNKL

SEQ ID NO: 3000098 - protein, 19 aa, Entamoeba invadens
IEYFDICRIKDAISLKAKL

SEQ ID NO: 3000099 - protein, 18 aa, Entamoeba invadens
IEYHSVLDIPMTPPTPMV

SEQ ID NO: 3000100 - protein, 20 aa, Entamoeba invadens
IEYKMDINTFFEGSQKKKVD

SEQ ID NO: 3000101 - protein, 19 aa, Entamoeba invadens
IEYLKKELAFSRQSFEQTS

SEQ ID NO: 3000102 - protein, 18 aa, Entamoeba invadens
IEYNTMRFLIFDSPTDDN

SEQ ID NO: 3000103 - protein, 25 aa, Entamoeba invadens
IEYSKQFVPVLQTLPLLELTIIDNE

SEQ ID NO: 3000104 - protein, 22 aa, Entamoeba invadens
IEYYFRYCYGTKGMKIIEPAWS

SEQ ID NO: 3000105 - protein, 17 aa, Entamoeba invadens
IFAGYRQPHPLKYVIEM

SEQ ID NO: 3000106 - protein, 31 aa, Entamoeba invadens
IFANDNPSPAFWKFMDLIAKKEKLKGYDRYA

SEQ ID NO: 3000107 - protein, 24 aa, Entamoeba invadens
IFANNKILVIPEFLTRLSNIEELD

SEQ ID NO: 3000108 - protein, 17 aa, Entamoeba invadens
IFATDFNLFRANKNKCE

SEQ ID NO: 3000109 - protein, 20 aa, Entamoeba invadens
IFCGLVALGIFHFGGGFDVD

SEQ ID NO: 3000110 - protein, 19 aa, Entamoeba invadens
IFCNMRKKVDWLTENMLKA

SEQ ID NO: 3000111 - protein, 18 aa, Entamoeba invadens
IFCNTTFNQILIFDSDST

SEQ ID NO: 3000112 - protein, 18 aa, Entamoeba invadens
IFCRECMIHLFSNNESVH

SEQ ID NO: 3000113 - protein, 17 aa, Entamoeba invadens
IFDDYFGVLNMFKSFFK

SEQ ID NO: 3000114 - protein, 19 aa, Entamoeba invadens
IFDHKVLVLPATEKDPFLQ

SEQ ID NO: 3000115 - protein, 28 aa, Entamoeba invadens
IFDLHKMFFEKLEKRFLAQKTDPLIVVS

SEQ ID NO: 3000116 - protein, 36 aa, Entamoeba invadens
IFDTLVLDFSLFYQFENPQTVILYVLQSFVSLIYNN

SEQ ID NO: 3000117 - protein, 32 aa, Entamoeba invadens
IFDVHLETPLQNSFYFIGKFYLTKTGAQEKMM

SEQ ID NO: 3000118 - protein, 17 aa, Entamoeba invadens
IFDVKRLIGRPVSDVIK

SEQ ID NO: 3000119 - protein, 18 aa, Entamoeba invadens
IFECGFSLVFFVSDEEAK

SEQ ID NO: 3000120 - protein, 25 aa, Entamoeba invadens
IFEELRNTLYFNLSLAFQKFMTQEI

SEQ ID NO: 3000121 - protein, 17 aa, Entamoeba invadens
IFEIQKKIKAEAILKHC

SEQ ID NO: 3000122 - protein, 19 aa, Entamoeba invadens
IFEKCTSLFHIDFGGSTII

SEQ ID NO: 3000123 - protein, 20 aa, Entamoeba invadens
IFEKCTSLFHIDFGGSTIIP

SEQ ID NO: 3000124 - protein, 20 aa, Entamoeba invadens
IFENENILLLGNFNDKLKET

SEQ ID NO: 3000125 - protein, 18 aa, Entamoeba invadens
IFEQLEANGFRLNKKKPD

SEQ ID NO: 3000126 - protein, 25 aa, Entamoeba invadens
IFEVLEKWYHYTKNQVIIFNNQQII

SEQ ID NO: 3000127 - protein, 18 aa, Entamoeba invadens
IFFFGYGESIEDPINNGF

SEQ ID NO: 3000128 - protein, 18 aa, Entamoeba invadens
IFFKTILRKKPFIIPSIF

SEQ ID NO: 3000129 - protein, 19 aa, Entamoeba invadens
IFFKYYKNGRTRAGINFLA

SEQ ID NO: 3000130 - protein, 19 aa, Entamoeba invadens
IFFLQRMVHHLTDKTLLSS

SEQ ID NO: 3000131 - protein, 28 aa, Entamoeba invadens
IFFNAKEVFRILLTLVSLLQDDDCLLFE

SEQ ID NO: 3000132 - protein, 35 aa, Entamoeba invadens
IFFSLKYDAHWFVTDHWYLFSQLPQFRTNPNKWKK

SEQ ID NO: 3000133 - protein, 25 aa, Entamoeba invadens
IFFTQNGILLGRFPINFKPDIQAIV

SEQ ID NO: 3000134 - protein, 19 aa, Entamoeba invadens
IFFTTIYEQLKTLLYMYIA

SEQ ID NO: 3000135 - protein, 19 aa, Entamoeba invadens
IFGEYPLHFAARSGDFETT

SEQ ID NO: 3000136 - protein, 17 aa, Entamoeba invadens
IFGFFTQSDIVPTEKWQ

SEQ ID NO: 3000137 - protein, 17 aa, Entamoeba invadens
IFGMKTPIDEQKLVFLL

SEQ ID NO: 3000138 - protein, 26 aa, Entamoeba invadens
IFGNRNLFEFFINANVIMMDGTFKSC

SEQ ID NO: 3000139 - protein, 30 aa, Entamoeba invadens
IFGQIASACRYLYFEKGIIHRDIKLDNFLV

SEQ ID NO: 3000140 - protein, 19 aa, Entamoeba invadens
IFGRLLSGTFLTSGNVLSS

SEQ ID NO: 3000141 - protein, 21 aa, Entamoeba invadens
IFICKTHAEMKYWVAQLSPYM

SEQ ID NO: 3000142 - protein, 17 aa, Entamoeba invadens
IFIILPDGSVMDKVMIK

SEQ ID NO: 3000143 - protein, 17 aa, Entamoeba invadens
IFIINFLQTVSRNESES

SEQ ID NO: 3000144 - protein, 23 aa, Entamoeba invadens
IFIKTFECLPLAATISRSVGDFF

SEQ ID NO: 3000145 - protein, 18 aa, Entamoeba invadens
IFISDVVAAFDLILREGV

SEQ ID NO: 3000146 - protein, 19 aa, Entamoeba invadens
IFISKGMNRIYPLNTTPFG

SEQ ID NO: 3000147 - protein, 17 aa, Entamoeba invadens
IFISTIIPELINLQNVN

SEQ ID NO: 3000148 - protein, 18 aa, Entamoeba invadens
IFIVANYFTSSKDYVTLE

SEQ ID NO: 3000149 - protein, 18 aa, Entamoeba invadens
IFIVSNYFDSISDFIALE

SEQ ID NO: 3000150 - protein, 18 aa, Entamoeba invadens
IFIWDKFHEFLGVLTNTV

SEQ ID NO: 3000151 - protein, 19 aa, Entamoeba invadens
IFKEKFFRVVNWYQVTFEE

SEQ ID NO: 3000152 - protein, 29 aa, Entamoeba invadens
IFKEKTEVTNFFYLSKQLYYVREKTKGKT

SEQ ID NO: 3000153 - protein, 18 aa, Entamoeba invadens
IFKERFYHIALHSGFYQK

SEQ ID NO: 3000154 - protein, 25 aa, Entamoeba invadens
IFKERFYHIALHSGFYQKLSFGRPK

SEQ ID NO: 3000155 - protein, 17 aa, Entamoeba invadens
IFKFFDEVLKCNREFLS

SEQ ID NO: 3000156 - protein, 24 aa, Entamoeba invadens
IFKGKFPQNRFGIPPDYKWDGIDR

SEQ ID NO: 3000157 - protein, 30 aa, Entamoeba invadens
IFKKKFNNSFFIRLNKLYLGLLNNQLNGTD

SEQ ID NO: 3000158 - protein, 18 aa, Entamoeba invadens
IFKTLNGILIKFDDRGCG

SEQ ID NO: 3000159 - protein, 18 aa, Entamoeba invadens
IFKVIKLLKEKDLSGVKS

SEQ ID NO: 3000160 - protein, 18 aa, Entamoeba invadens
IFKVLLIGDYGTGKTSLL

SEQ ID NO: 3000161 - protein, 28 aa, Entamoeba invadens
IFLANVLLYTWSEAVLLNFRVVSKSCLD

SEQ ID NO: 3000162 - protein, 18 aa, Entamoeba invadens
IFLDVLDTFRPICNNGLV

SEQ ID NO: 3000163 - protein, 19 aa, Entamoeba invadens
IFLKIEMFAKDVLLKNVKN

SEQ ID NO: 3000164 - protein, 19 aa, Entamoeba invadens
IFLQKMQPEHFAKLCPSTL

SEQ ID NO: 3000165 - protein, 19 aa, Entamoeba invadens
IFLRENMMANLFFNYDCDP

SEQ ID NO: 3000166 - protein, 18 aa, Entamoeba invadens
IFLTSVKLPSNVVKIPYG

SEQ ID NO: 3000167 - protein, 22 aa, Entamoeba invadens
IFLVDKLKLIQSKFPPYRYEQF

SEQ ID NO: 3000168 - protein, 18 aa, Entamoeba invadens
IFLVLKDPKMGKGDNDKK

SEQ ID NO: 3000169 - protein, 17 aa, Entamoeba invadens
IFMDLRNLTNLTSLSVN

SEQ ID NO: 3000170 - protein, 18 aa, Entamoeba invadens
IFMELINTVYQHALSFFD

SEQ ID NO: 3000171 - protein, 25 aa, Entamoeba invadens
IFMKEVIQFFPFVDIIELCFVSKRF

SEQ ID NO: 3000172 - protein, 18 aa, Entamoeba invadens
IFMRLGIKVLNVMKSEEI

SEQ ID NO: 3000173 - protein, 35 aa, Entamoeba invadens
IFNGNKKAILSLLYQLMYKFRLGNCSVRMVDFTKW

SEQ ID NO: 3000174 - protein, 19 aa, Entamoeba invadens
IFNLLLDEEMLVEFQFFGL

SEQ ID NO: 3000175 - protein, 35 aa, Entamoeba invadens
IFNNLLFMSKPTLRMVYRPPLKTLTPRRLITRTQP

SEQ ID NO: 3000176 - protein, 18 aa, Entamoeba invadens
IFNNNFFNEITKKSLNKW

SEQ ID NO: 3000177 - protein, 19 aa, Entamoeba invadens
IFNNNFFNEITKKSLNKWD

SEQ ID NO: 3000178 - protein, 17 aa, Entamoeba invadens
IFNQFCEAFKEVLRRDD

SEQ ID NO: 3000179 - protein, 17 aa, Entamoeba invadens
IFPDWLEVFPEKLEIEK

SEQ ID NO: 3000180 - protein, 17 aa, Entamoeba invadens
IFPLQTIQTPINSSLPT

SEQ ID NO: 3000181 - protein, 31 aa, Entamoeba invadens
IFPNMVLHYNFTPTLFCCAYFIALDPSINAL

SEQ ID NO: 3000182 - protein, 19 aa, Entamoeba invadens
IFPSFGLLVVLYQSLEKEC

SEQ ID NO: 3000183 - protein, 23 aa, Entamoeba invadens
IFQCTAFKNKLPDYIRAQNITYI

SEQ ID NO: 3000184 - protein, 21 aa, Entamoeba invadens
IFQENQIYFGFVRETDQIDDS

SEQ ID NO: 3000185 - protein, 17 aa, Entamoeba invadens
IFQFLCYIDPTQVSKYK

SEQ ID NO: 3000186 - protein, 18 aa, Entamoeba invadens
IFQILRHGQYTNLTLRFL

SEQ ID NO: 3000187 - protein, 17 aa, Entamoeba invadens
IFQKFNEASLTFAPTFK

SEQ ID NO: 3000188 - protein, 18 aa, Entamoeba invadens
IFQKLIETRFMSISRCSL

SEQ ID NO: 3000189 - protein, 17 aa, Entamoeba invadens
IFQNNLLSFPLSYCKTP

SEQ ID NO: 3000190 - protein, 41 aa, Entamoeba invadens
IFQVDLPNIEKFSYSPQGRYLVFWQLIPLQYVQGENGPQKV

SEQ ID NO: 3000191 - protein, 20 aa, Entamoeba invadens
IFQYEHFACLLPLHLYQVLH

SEQ ID NO: 3000192 - protein, 28 aa, Entamoeba invadens
IFRKSPVNKTFPLTVKYIGALDVQCLQP

SEQ ID NO: 3000193 - protein, 32 aa, Entamoeba invadens
IFRLLPSLCQSLLLRLVFLSSTIDLPTVEKQF

SEQ ID NO: 3000194 - protein, 23 aa, Entamoeba invadens
IFRNSYIFLNYYICNTISDVVQV

SEQ ID NO: 3000195 - protein, 25 aa, Entamoeba invadens
IFSDPLLFIFTLFKIRRIQIKITQF

SEQ ID NO: 3000196 - protein, 18 aa, Entamoeba invadens
IFSGCKLLDKINIPKSLK

SEQ ID NO: 3000197 - protein, 17 aa, Entamoeba invadens
IFSLMRKNKFADARRGT

SEQ ID NO: 3000198 - protein, 25 aa, Entamoeba invadens
IFSNYWHSLVFKRITGKFEFLSLSL

SEQ ID NO: 3000199 - protein, 17 aa, Entamoeba invadens
IFSSYRNALHCPILNEN

SEQ ID NO: 3000200 - protein, 17 aa, Entamoeba invadens
IFSVYRNGSRHLKRFSQ

SEQ ID NO: 3000201 - protein, 26 aa, Entamoeba invadens
IFTDLETFFIQSLYDDVMYPPTTYKE

SEQ ID NO: 3000202 - protein, 24 aa, Entamoeba invadens
IFTEKIMTWLLYPDVFDKFEAFLN

SEQ ID NO: 3000203 - protein, 24 aa, Entamoeba invadens
IFTKDLFIPDVLRKIKNNLLYVPK

SEQ ID NO: 3000204 - protein, 17 aa, Entamoeba invadens
IFTLIDKFRLHSNMIQM

SEQ ID NO: 3000205 - protein, 20 aa, Entamoeba invadens
IFTNLVYPNTFSFSSFFVLH

SEQ ID NO: 3000206 - protein, 17 aa, Entamoeba invadens
IFTSSLYEKLWPPSYEN

SEQ ID NO: 3000207 - protein, 18 aa, Entamoeba invadens
IFTYLTQTDIEPFINISH

SEQ ID NO: 3000208 - protein, 22 aa, Entamoeba invadens
IFVEENLYFVMTSYPSKRLADV

SEQ ID NO: 3000209 - protein, 17 aa, Entamoeba invadens
IFVFGDYVTICVDKTVE

SEQ ID NO: 3000210 - protein, 17 aa, Entamoeba invadens
IFVLPETLGKLTDLKKV

SEQ ID NO: 3000211 - protein, 35 aa, Entamoeba invadens
IFVSTYFLNLTFQNPPLYSSLLLKTSPELLTKMNV

SEQ ID NO: 3000212 - protein, 17 aa, Entamoeba invadens
IFVVKKKEKSTPPPQAV

SEQ ID NO: 3000213 - protein, 17 aa, Entamoeba invadens
IFVVSKFFTYAQDFVHL

SEQ ID NO: 3000214 - protein, 21 aa, Entamoeba invadens
IGACKMLLSLLLIAPEKEAIV

SEQ ID NO: 3000215 - protein, 24 aa, Entamoeba invadens
IGAFPCIQLLTPNKTILSMTLRHI

SEQ ID NO: 3000216 - protein, 17 aa, Entamoeba invadens
IGAFYKAANLESVKLPK

SEQ ID NO: 3000217 - protein, 18 aa, Entamoeba invadens
IGASILTSLTSFQKMWVT

SEQ ID NO: 3000218 - protein, 19 aa, Entamoeba invadens
IGATLKTLGCEALIDKKFV

SEQ ID NO: 3000219 - protein, 19 aa, Entamoeba invadens
IGCELWAQRIQLELANQVR

SEQ ID NO: 3000220 - protein, 24 aa, Entamoeba invadens
IGCIEIICFILTEHPRLFPNDVDV

SEQ ID NO: 3000221 - protein, 20 aa, Entamoeba invadens
IGCKKIVIKNLPKEREKNAL

SEQ ID NO: 3000222 - protein, 23 aa, Entamoeba invadens
IGCKMTMYLLEKSRIVSQAKEDR

SEQ ID NO: 3000223 - protein, 24 aa, Entamoeba invadens
IGCLKCVNGYYLDNYICETCFENC

SEQ ID NO: 3000224 - protein, 25 aa, Entamoeba invadens
IGCPTPFTWKLTQSKQSLVTCTSGT

SEQ ID NO: 3000225 - protein, 25 aa, Entamoeba invadens
IGCSLSNVFKFPRKLMNLKVDTKTL

SEQ ID NO: 3000226 - protein, 33 aa, Entamoeba invadens
IGDAYTLMINPIFKNLMKFLYDKNCFVVAKEVE

SEQ ID NO: 3000227 - protein, 30 aa, Entamoeba invadens
IGDEVIIFSPYFLEYPFYIENYGGVPVRVN

SEQ ID NO: 3000228 - protein, 22 aa, Entamoeba invadens
IGDFVLGRRVGFGSTAVVFLAF

SEQ ID NO: 3000229 - protein, 17 aa, Entamoeba invadens
IGDFWWDNFCEGDLKDI

SEQ ID NO: 3000230 - protein, 26 aa, Entamoeba invadens
IGDMPKYSNFSLLTQKLSKVTEPKEC

SEQ ID NO: 3000231 - protein, 27 aa, Entamoeba invadens
IGDMYGKFFLPSFNLRSFLTPEQEPQI

SEQ ID NO: 3000232 - protein, 37 aa, Entamoeba invadens
IGDNVFYNNFLLQRATVPLILLNSSAVFCGCHSLKTV

SEQ ID NO: 3000233 - protein, 26 aa, Entamoeba invadens
IGDQAFYYCPSLLLKLQRSYNNTVSF

SEQ ID NO: 3000234 - protein, 20 aa, Entamoeba invadens
IGDVFILRGKGHYSPKDCQM

SEQ ID NO: 3000235 - protein, 25 aa, Entamoeba invadens
IGDVFTRVLPIYYEKPDYNHSYKTL

SEQ ID NO: 3000236 - protein, 24 aa, Entamoeba invadens
IGDVFYISKTFSKAIDYYKRRLHE

SEQ ID NO: 3000237 - protein, 29 aa, Entamoeba invadens
IGEDGKPIPVWLYKFRGLGTMYYCEICGG

SEQ ID NO: 3000238 - protein, 25 aa, Entamoeba invadens
IGEEYTLVCAVYFALKYCGKRGAVC

SEQ ID NO: 3000239 - protein, 23 aa, Entamoeba invadens
IGEGSFGIQWLLKMKISREQDDN

SEQ ID NO: 3000240 - protein, 25 aa, Entamoeba invadens
IGEKCFNWCSYLSNITIPLSVTSFS

SEQ ID NO: 3000241 - protein, 27 aa, Entamoeba invadens
IGEKPATIFFFFFEKLMNEKKVQSMFW

SEQ ID NO: 3000242 - protein, 25 aa, Entamoeba invadens
IGELAFFNCTCLDNIILNGAIKEFG

SEQ ID NO: 3000243 - protein, 22 aa, Entamoeba invadens
IGELEHNFFLTRTELTRRIQVF

SEQ ID NO: 3000244 - protein, 32 aa, Entamoeba invadens
IGELFERFIKNFQAYYQYIGNIPLSFHTLAQL

SEQ ID NO: 3000245 - protein, 29 aa, Entamoeba invadens
IGELFKNFIPYFRVYYQFLGNTAISLHTL

SEQ ID NO: 3000246 - protein, 19 aa, Entamoeba invadens
IGEMKYRLLKDNALLERMI

SEQ ID NO: 3000247 - protein, 21 aa, Entamoeba invadens
IGERHAEFAEALYLAEKASAE

SEQ ID NO: 3000248 - protein, 25 aa, Entamoeba invadens
IGERRKAFEWHFLDLTKPKQQPPQP

SEQ ID NO: 3000249 - protein, 20 aa, Entamoeba invadens
IGERVLRMTSVIYPFPEYSD

SEQ ID NO: 3000250 - protein, 19 aa, Entamoeba invadens
IGESFPWTNNSKFMYLRQN

SEQ ID NO: 3000251 - protein, 25 aa, Entamoeba invadens
IGETTLLLRIRCTCVPEGQCVFVGG

SEQ ID NO: 3000252 - protein, 17 aa, Entamoeba invadens
IGFFKRCRPVTACQDPT

SEQ ID NO: 3000253 - protein, 17 aa, Entamoeba invadens
IGFFRNQEEYYWANQCV

SEQ ID NO: 3000254 - protein, 25 aa, Entamoeba invadens
IGFGDHYMSTPYLKFLIGNKSDIKN

SEQ ID NO: 3000255 - protein, 23 aa, Entamoeba invadens
IGFMAFLRCELLKKIKSQQLPNR

SEQ ID NO: 3000256 - protein, 18 aa, Entamoeba invadens
IGGCLNYVEWKFYCEYCF

SEQ ID NO: 3000257 - protein, 24 aa, Entamoeba invadens
IGGKAIITVWAKEQAKFEKREGQD

SEQ ID NO: 3000258 - protein, 26 aa, Entamoeba invadens
IGGKLIHLDVYPFLGAQLSVAKKLEQ

SEQ ID NO: 3000259 - protein, 22 aa, Entamoeba invadens
IGGMLEAIYYIIKNQHFGEDFS

SEQ ID NO: 3000260 - protein, 24 aa, Entamoeba invadens
IGGNSKFIVYYNIVSKVMIYKTKI

SEQ ID NO: 3000261 - protein, 30 aa, Entamoeba invadens
IGGNYSTNLLFLPTNKSYPPIRIKARDPAR

SEQ ID NO: 3000262 - protein, 29 aa, Entamoeba invadens
IGGQEVMRPFWRCNFPKTNVVIFVVDSCD

SEQ ID NO: 3000263 - protein, 18 aa, Entamoeba invadens
IGGQPCVIDPLLCSVDID

SEQ ID NO: 3000264 - protein, 18 aa, Entamoeba invadens
IGGSILMSLSTNASLIVT

SEQ ID NO: 3000265 - protein, 30 aa, Entamoeba invadens
IGHTGFYGCSNLQHIILPDNLLELKNYAFM

SEQ ID NO: 3000266 - protein, 24 aa, Entamoeba invadens
IGIKDILHFDYLDAPSPQVMVRAL

SEQ ID NO: 3000267 - protein, 18 aa, Entamoeba invadens
IGIKYDQVTPFMRQGYTI

SEQ ID NO: 3000268 - protein, 30 aa, Entamoeba invadens
IGINPMYMDRFVMDPVALSGLLTFILIAGE

SEQ ID NO: 3000269 - protein, 18 aa, Entamoeba invadens
IGISMFVKNKTAFPTGMC

SEQ ID NO: 3000270 - protein, 32 aa, Entamoeba invadens
IGISREPILVALFYNYGLSLLNNMTRRAAKFM

SEQ ID NO: 3000271 - protein, 33 aa, Entamoeba invadens
IGISREPILVSLFYNYGVLPLNNLSRRAAKFMN

SEQ ID NO: 3000272 - protein, 17 aa, Entamoeba invadens
IGITPRIKTMRKDDMFE

SEQ ID NO: 3000273 - protein, 25 aa, Entamoeba invadens
IGIVPLLREWLSVIEQIIQTPIEPS

SEQ ID NO: 3000274 - protein, 26 aa, Entamoeba invadens
IGIVSHPTLLKIFYKLRGVQNSFDLV

SEQ ID NO: 3000275 - protein, 27 aa, Entamoeba invadens
IGIYTYELFNFYNVKTIIRIGSAGAID

SEQ ID NO: 3000276 - protein, 27 aa, Entamoeba invadens
IGKAGYKWFPLWKQTNSIMTEFLADVN

SEQ ID NO: 3000277 - protein, 24 aa, Entamoeba invadens
IGKAMYNFTFNDCSGSALLNSRTT

SEQ ID NO: 3000278 - protein, 24 aa, Entamoeba invadens
IGKEAFAECFKLSKITLPSSVQKI

SEQ ID NO: 3000279 - protein, 24 aa, Entamoeba invadens
IGKEAQMRMLSTRVLIVGLSGIGC

SEQ ID NO: 3000280 - protein, 25 aa, Entamoeba invadens
IGKEAQMRMLSTRVLIVGLSGIGCE

SEQ ID NO: 3000281 - protein, 18 aa, Entamoeba invadens
IGKILITKNEIEELKMNI

SEQ ID NO: 3000282 - protein, 17 aa, Entamoeba invadens
IGKIYEVYKRRCRRFKD

SEQ ID NO: 3000283 - protein, 17 aa, Entamoeba invadens
IGKKLPPHLSPYGNGDG

SEQ ID NO: 3000284 - protein, 24 aa, Entamoeba invadens
IGKKLSLSIPMKRIHTVSIDGINF

SEQ ID NO: 3000285 - protein, 31 aa, Entamoeba invadens
IGKQLIFYHRELFENLPLKDFYFCESSNKLK

SEQ ID NO: 3000286 - protein, 28 aa, Entamoeba invadens
IGKQTPKFKRIGNLFYFVAEHLTEDDKE

SEQ ID NO: 3000287 - protein, 20 aa, Entamoeba invadens
IGKRRIPVNGLVGLTFLNIP

SEQ ID NO: 3000288 - protein, 17 aa, Entamoeba invadens
IGKSIKSEGIIRINDNQ

SEQ ID NO: 3000289 - protein, 31 aa, Entamoeba invadens
IGKTCFRYCIFLQDIKLLGLKEIPKRCFCNC

SEQ ID NO: 3000290 - protein, 25 aa, Entamoeba invadens
IGLERITMLYLGIPNIRKVTLFPRD

SEQ ID NO: 3000291 - protein, 26 aa, Entamoeba invadens
IGLNVNNPHFLIMQGKVMEVVDMKPK

SEQ ID NO: 3000292 - protein, 23 aa, Entamoeba invadens
IGLTNCIAVFFTHGHYDHIAGAH

SEQ ID NO: 3000293 - protein, 19 aa, Entamoeba invadens
IGLTYYTFLVLSNLCCNPS

SEQ ID NO: 3000294 - protein, 18 aa, Entamoeba invadens
IGMLKYPLVSDISKTIST

SEQ ID NO: 3000295 - protein, 24 aa, Entamoeba invadens
IGMLSAILEVLFQWVKTVEVTQEW

SEQ ID NO: 3000296 - protein, 17 aa, Entamoeba invadens
IGMMLSKLSVKSPIQVP

SEQ ID NO: 3000297 - protein, 18 aa, Entamoeba invadens
IGMTRVYYKDAQGAVILY

SEQ ID NO: 3000298 - protein, 24 aa, Entamoeba invadens
IGNIFIQVQPYLKAYNMFVANSAY

SEQ ID NO: 3000299 - protein, 24 aa, Entamoeba invadens
IGNKAFLHCNLLTQIVFGHSLQEI

SEQ ID NO: 3000300 - protein, 22 aa, Entamoeba invadens
IGNLPVVFLIEDSHYEVHRSMM

SEQ ID NO: 3000301 - protein, 17 aa, Entamoeba invadens
IGNSCLYYCNISCITLP

SEQ ID NO: 3000302 - protein, 27 aa, Entamoeba invadens
IGNYFEQFVYMWLNFKQKEDALSDLYG

SEQ ID NO: 3000303 - protein, 33 aa, Entamoeba invadens
IGPNIPNPYIIWVYCFVLFPKQISEEPLFTQYG

SEQ ID NO: 3000304 - protein, 19 aa, Entamoeba invadens
IGPSFKPYIDLNISKRVLK

SEQ ID NO: 3000305 - protein, 33 aa, Entamoeba invadens
IGPVEDLYFIDSEKVKMFIVSNFNYVVALSINA

SEQ ID NO: 3000306 - protein, 17 aa, Entamoeba invadens
IGQKCFYGCFNLVSINI

SEQ ID NO: 3000307 - protein, 49 aa, Entamoeba invadens
IGQKKFQDQAVWMLNAMWLKEKDARAEELWKFVGLFSSLEQENGKEGCG

SEQ ID NO: 3000308 - protein, 42 aa, Entamoeba invadens
IGQSWQFREFPIKDPYKFLERYLGFYVRLDSKEWPRDPWLKD

SEQ ID NO: 3000309 - protein, 28 aa, Entamoeba invadens
IGRDEEIKRVIRILSRRTKNNPVLIGEP

SEQ ID NO: 3000310 - protein, 23 aa, Entamoeba invadens
IGREKFLEEVWKWKDEYGKGICE

SEQ ID NO: 3000311 - protein, 17 aa, Entamoeba invadens
IGRFDPQFNAITGLNGS

SEQ ID NO: 3000312 - protein, 19 aa, Entamoeba invadens
IGRFFLCHGGLSPDLDVIT

SEQ ID NO: 3000313 - protein, 32 aa, Entamoeba invadens
IGRKMNKPRFIYLFNDLFLYGTGDENKNVVNA

SEQ ID NO: 3000314 - protein, 18 aa, Entamoeba invadens
IGRLPSIDPVSRSLILAG

SEQ ID NO: 3000315 - protein, 25 aa, Entamoeba invadens
IGRVSFLESFIYRNNTLQIREIASN

SEQ ID NO: 3000316 - protein, 30 aa, Entamoeba invadens
IGSATHGIYVFPFIQFPISKKTEIIGFKNN

SEQ ID NO: 3000317 - protein, 24 aa, Entamoeba invadens
IGSDGLLVIPFGNGPERILGNLDM

SEQ ID NO: 3000318 - protein, 24 aa, Entamoeba invadens
IGSHDPLLMITAKEKNSLFSPPEN

SEQ ID NO: 3000319 - protein, 27 aa, Entamoeba invadens
IGSKKYIVIVPFLFNKEKKMFDKMSET

SEQ ID NO: 3000320 - protein, 32 aa, Entamoeba invadens
IGSWAIVRVNETKYIYPYSFLHVFEDENDLKI

SEQ ID NO: 3000321 - protein, 24 aa, Entamoeba invadens
IGTKMFLQILFGVILKSCTDSLPH

SEQ ID NO: 3000322 - protein, 21 aa, Entamoeba invadens
IGTLYLSEAIWALNMARKLWA

SEQ ID NO: 3000323 - protein, 30 aa, Entamoeba invadens
IGTNSTLIMNFFKINIWFEVNYQTVLDNEK

SEQ ID NO: 3000324 - protein, 28 aa, Entamoeba invadens
IGTPEPFLYFYNTDKMVYLKKVPIENMN

SEQ ID NO: 3000325 - protein, 35 aa, Entamoeba invadens
IGTSTILLVTYFYINTQIYLLSLSIGDCHALRYNI

SEQ ID NO: 3000326 - protein, 20 aa, Entamoeba invadens
IGTYFNTLPWRLRCRIRHEE

SEQ ID NO: 3000327 - protein, 34 aa, Entamoeba invadens
IGVKFIEFSPISDDLLFAAFFPEKQRFPASIELY

SEQ ID NO: 3000328 - protein, 28 aa, Entamoeba invadens
IGVKKKFFQIFVWFKVNYRTVVKNKNSN

SEQ ID NO: 3000329 - protein, 38 aa, Entamoeba invadens
IGVNTLFFMRYLLIPFMKMPNLFKYIQSLITPIVCGKQ

SEQ ID NO: 3000330 - protein, 26 aa, Entamoeba invadens
IGYASYITLSLLRFGVSIQNALKEGE

SEQ ID NO: 3000331 - protein, 20 aa, Entamoeba invadens
IGYDLVMKMPKNGLLVNTAR

SEQ ID NO: 3000332 - protein, 33 aa, Entamoeba invadens
IGYFKEKYMIPMHFWLYYVINVEKHKVLYTHYE

SEQ ID NO: 3000333 - protein, 17 aa, Entamoeba invadens
IGYIPKANNRIKRIANG

SEQ ID NO: 3000334 - protein, 20 aa, Entamoeba invadens
IGYMYLECSAALDKPVTQLF

SEQ ID NO: 3000335 - protein, 25 aa, Entamoeba invadens
IGYSCFFGCVSLSHIALPDTVTQFG

SEQ ID NO: 3000336 - protein, 29 aa, Entamoeba invadens
IGYSFVYKWIVLLFRRDFTPKKCKRIWDA

SEQ ID NO: 3000337 - protein, 23 aa, Entamoeba invadens
IGYSYMKQFLLENQLTSIIRGHE

SEQ ID NO: 3000338 - protein, 23 aa, Entamoeba invadens
IHADSELQVLYLVSAINTSSEVD

SEQ ID NO: 3000339 - protein, 19 aa, Entamoeba invadens
IHCINILIAWLEVRGTVFT

SEQ ID NO: 3000340 - protein, 22 aa, Entamoeba invadens
IHDDNCFIFSLKQNGQIINRHF

SEQ ID NO: 3000341 - protein, 18 aa, Entamoeba invadens
IHDFRVQPGFLQRTFYAT

SEQ ID NO: 3000342 - protein, 18 aa, Entamoeba invadens
IHDPQACSYYYKNYFKLN

SEQ ID NO: 3000343 - protein, 26 aa, Entamoeba invadens
IHDRDNLEIFLSLLKENINATITAQD

SEQ ID NO: 3000344 - protein, 30 aa, Entamoeba invadens
IHEEKSFLFSMMSGFLPVAKSILSMVITHL

SEQ ID NO: 3000345 - protein, 32 aa, Entamoeba invadens
IHELNIPFKHLLPFYYNLKTPLIPTTLSDILI

SEQ ID NO: 3000346 - protein, 28 aa, Entamoeba invadens
IHEMFITEKTLEITPIIPIINENKESPL

SEQ ID NO: 3000347 - protein, 24 aa, Entamoeba invadens
IHENFKWKIFGVKILGDCLCDLYQ

SEQ ID NO: 3000348 - protein, 27 aa, Entamoeba invadens
IHESVTYFIYNFFKNEFKFVGDVVFVK

SEQ ID NO: 3000349 - protein, 26 aa, Entamoeba invadens
IHFEARVVGLILKLCFEDGIVSENKI

SEQ ID NO: 3000350 - protein, 35 aa, Entamoeba invadens
IHFSGRFKVLGNYKIYLRFLTFNMQSLRVESDTNS

SEQ ID NO: 3000351 - protein, 27 aa, Entamoeba invadens
IHGKFLRRRFCVFVVMKLASICSVDML

SEQ ID NO: 3000352 - protein, 25 aa, Entamoeba invadens
IHGQFWDLLELFKTGRRPPETKYVF

SEQ ID NO: 3000353 - protein, 20 aa, Entamoeba invadens
IHHDIKAGNILLSLDGKVKL

SEQ ID NO: 3000354 - protein, 24 aa, Entamoeba invadens
IHHIELIEAIQHKQLLETETQRSK

SEQ ID NO: 3000355 - protein, 17 aa, Entamoeba invadens
IHHNYFTAFIRALKCGY

SEQ ID NO: 3000356 - protein, 17 aa, Entamoeba invadens
IHIALICALVELGAMLP

SEQ ID NO: 3000357 - protein, 19 aa, Entamoeba invadens
IHIENPFVYARPCNIEEVY

SEQ ID NO: 3000358 - protein, 22 aa, Entamoeba invadens
IHIGSYCFSDCTGLTFLKFECH

SEQ ID NO: 3000359 - protein, 17 aa, Entamoeba invadens
IHIMFTCKKFRLFTNEY

SEQ ID NO: 3000360 - protein, 18 aa, Entamoeba invadens
IHIVYKKKRREKISRMLH

SEQ ID NO: 3000361 - protein, 28 aa, Entamoeba invadens
IHKERVMLVMPLYSLTHEFSGFAKFVFF

SEQ ID NO: 3000362 - protein, 19 aa, Entamoeba invadens
IHKIVFYDVVFINFFDDLK

SEQ ID NO: 3000363 - protein, 29 aa, Entamoeba invadens
IHKIVVDHFLLYVLLFEKGEIENSMEFSS

SEQ ID NO: 3000364 - protein, 20 aa, Entamoeba invadens
IHKLSYIHRDIKPDNILIGN

SEQ ID NO: 3000365 - protein, 20 aa, Entamoeba invadens
IHKNAKFLLAMFENHSRHEF

SEQ ID NO: 3000366 - protein, 28 aa, Entamoeba invadens
IHKSDVFELPLLYKLYTTEIVKTQTSEC

SEQ ID NO: 3000367 - protein, 28 aa, Entamoeba invadens
IHKYYEEKLTILALLRDSSAFASKRLDV

SEQ ID NO: 3000368 - protein, 17 aa, Entamoeba invadens
IHLKLQPGQMTVGGQMR

SEQ ID NO: 3000369 - protein, 17 aa, Entamoeba invadens
IHLLANLAGESSAIRDN

SEQ ID NO: 3000370 - protein, 18 aa, Entamoeba invadens
IHLLVKLGDAMILRFAIP

SEQ ID NO: 3000371 - protein, 17 aa, Entamoeba invadens
IHLLVKLSDAMILRFAI

SEQ ID NO: 3000372 - protein, 17 aa, Entamoeba invadens
IHLPKNLTQLPLQFFNC

SEQ ID NO: 3000373 - protein, 22 aa, Entamoeba invadens
IHNDIVVVVVFYELLQTPGCSD

SEQ ID NO: 3000374 - protein, 22 aa, Entamoeba invadens
IHNKVAVFGCCAFYPRVCGVGS

SEQ ID NO: 3000375 - protein, 27 aa, Entamoeba invadens
IHNLKQVLLYFITSEEIRLFLMVNHKC

SEQ ID NO: 3000376 - protein, 26 aa, Entamoeba invadens
IHNLTGYPVIPIIYKKFQDGESYYRI

SEQ ID NO: 3000377 - protein, 27 aa, Entamoeba invadens
IHNPSHLVVVLLFNYLHKLYDDNSEIL

SEQ ID NO: 3000378 - protein, 25 aa, Entamoeba invadens
IHNTNYLNHLLTFAIANTPAVNAVQ

SEQ ID NO: 3000379 - protein, 33 aa, Entamoeba invadens
IHPGVPYPFQDQFLYNFQLFQKCFVTKLLSERL

SEQ ID NO: 3000380 - protein, 17 aa, Entamoeba invadens
IHPYSKIAVIVKQAYLF

SEQ ID NO: 3000381 - protein, 17 aa, Entamoeba invadens
IHQIDLISLPYDKDARD

SEQ ID NO: 3000382 - protein, 24 aa, Entamoeba invadens
IHQTYHPVSPFKMAKLTIENNINF

SEQ ID NO: 3000383 - protein, 19 aa, Entamoeba invadens
IHRLKLATGKPILIAQESC

SEQ ID NO: 3000384 - protein, 18 aa, Entamoeba invadens
IHRLKLATGKPILIPKDL

SEQ ID NO: 3000385 - protein, 28 aa, Entamoeba invadens
IHSFLQKYPTFYKSIYKLAIMYDQVTPG

SEQ ID NO: 3000386 - protein, 33 aa, Entamoeba invadens
IHSLPAAHLSLFKGLMKLAFKITMYKDINMMDA

SEQ ID NO: 3000387 - protein, 18 aa, Entamoeba invadens
IHSNLSLCFLKLDRLDET

SEQ ID NO: 3000388 - protein, 18 aa, Entamoeba invadens
IHSPKTLDFSFTTTLNYM

SEQ ID NO: 3000389 - protein, 43 aa, Entamoeba invadens
IHTAAQMVNFLPINKEMQAEKLFLVPNPIPVPFPQNNEETQIA

SEQ ID NO: 3000390 - protein, 17 aa, Entamoeba invadens
IHTFMHLNRLILHSYNT

SEQ ID NO: 3000391 - protein, 25 aa, Entamoeba invadens
IHTIKDVFLLIQKTYPKLGAIFQDS

SEQ ID NO: 3000392 - protein, 37 aa, Entamoeba invadens
IHTYSGLFCVVINPYQFFPIYTHFMINKYTGRRKEEV

SEQ ID NO: 3000393 - protein, 23 aa, Entamoeba invadens
IHVFKSLFCKKKLFRVVVWFNVD

SEQ ID NO: 3000394 - protein, 24 aa, Entamoeba invadens
IHVFRTLPLCCLITSQHKKYLCVH

SEQ ID NO: 3000395 - protein, 17 aa, Entamoeba invadens
IHVHDLDFYAIGTTTCC

SEQ ID NO: 3000396 - protein, 27 aa, Entamoeba invadens
IHVIDPFVDYLAYLHECFDFAKLKEFI

SEQ ID NO: 3000397 - protein, 17 aa, Entamoeba invadens
IHVLPDETNSEQAESPS

SEQ ID NO: 3000398 - protein, 27 aa, Entamoeba invadens
IHYSNHVLTFLMDFAFEGELTVKGKSV

SEQ ID NO: 3000399 - protein, 17 aa, Entamoeba invadens
IHYTGWPDFGVPPNSLI

SEQ ID NO: 3000400 - protein, 17 aa, Entamoeba invadens
IIADENVFLVSDKFGDV

SEQ ID NO: 3000401 - protein, 18 aa, Entamoeba invadens
IIAHYIKERTKNAQFSII

SEQ ID NO: 3000402 - protein, 38 aa, Entamoeba invadens
IIAISMLHINPLKVLRYIPFLLHYIPNLETYEGNLMEA

SEQ ID NO: 3000403 - protein, 29 aa, Entamoeba invadens
IIAKSRVLPKFLILLHPATFLDQVIPLVQ

SEQ ID NO: 3000404 - protein, 25 aa, Entamoeba invadens
IIANNMYWSFFDDNITVVIPSTVRE

SEQ ID NO: 3000405 - protein, 35 aa, Entamoeba invadens
IIARKEVVCLPFYTFIVRYLYPRHEHITKLLAFTA

SEQ ID NO: 3000406 - protein, 25 aa, Entamoeba invadens
IICPLKKIEFTPGHQFVALSCGCVI

SEQ ID NO: 3000407 - protein, 28 aa, Entamoeba invadens
IICRLTTYNLCFMMPSFRDILAKLISQL

SEQ ID NO: 3000408 - protein, 17 aa, Entamoeba invadens
IIDAKPYNGIKAVNCGF

SEQ ID NO: 3000409 - protein, 26 aa, Entamoeba invadens
IIDFQTSYYCVPLCRYYVPNCEVCSS

SEQ ID NO: 3000410 - protein, 23 aa, Entamoeba invadens
IIDGLQYLLVARHNAVFYYVKEK

SEQ ID NO: 3000411 - protein, 18 aa, Entamoeba invadens
IIDIGLCVCDFIVKKTGE

SEQ ID NO: 3000412 - protein, 24 aa, Entamoeba invadens
IIDLTLGNPLLPPPEVYQKALEIV

SEQ ID NO: 3000413 - protein, 24 aa, Entamoeba invadens
IIDQTIYIFCEMTEYQCLGIQGKY

SEQ ID NO: 3000414 - protein, 17 aa, Entamoeba invadens
IIDSDYIVFVYSINDKE

SEQ ID NO: 3000415 - protein, 34 aa, Entamoeba invadens
IIDVGANYFISKKLPAALEFYDRKIKFVEEQKEK

SEQ ID NO: 3000416 - protein, 18 aa, Entamoeba invadens
IIEFSQIMYNETMIGLLA

SEQ ID NO: 3000417 - protein, 20 aa, Entamoeba invadens
IIEKLVNDIFRNAYVATIGA

SEQ ID NO: 3000418 - protein, 29 aa, Entamoeba invadens
IIEKRNQIILSHQLIAFSSLANAIQNNFQ

SEQ ID NO: 3000419 - protein, 26 aa, Entamoeba invadens
IIEQENHYLELNTMFEQLVKQNEENK

SEQ ID NO: 3000420 - protein, 37 aa, Entamoeba invadens
IIETLTSPLFNDTLYRRAFMFSFPVFTTAKKVIDTLF

SEQ ID NO: 3000421 - protein, 19 aa, Entamoeba invadens
IIEVNLVPKITYGEGAFAF

SEQ ID NO: 3000422 - protein, 18 aa, Entamoeba invadens
IIEYDIVFGYIFDNTINN

SEQ ID NO: 3000423 - protein, 19 aa, Entamoeba invadens
IIFDKPYVPDAIWTLSFLL

SEQ ID NO: 3000424 - protein, 19 aa, Entamoeba invadens
IIFPTLRRHKITFNDADKQ

SEQ ID NO: 3000425 - protein, 21 aa, Entamoeba invadens
IIFQFDKAVCLFVFKNGQMEE

SEQ ID NO: 3000426 - protein, 17 aa, Entamoeba invadens
IIFRIRIYSDTIDEFFL

SEQ ID NO: 3000427 - protein, 19 aa, Entamoeba invadens
IIFRNKLLDKLKGKRNVYL

SEQ ID NO: 3000428 - protein, 18 aa, Entamoeba invadens
IIGHRSLALYYKQNIKPV

SEQ ID NO: 3000429 - protein, 20 aa, Entamoeba invadens
IIGKERFLAPEALLQPSTIG

SEQ ID NO: 3000430 - protein, 17 aa, Entamoeba invadens
IIGKNLPRKIVLEKVSV

SEQ ID NO: 3000431 - protein, 17 aa, Entamoeba invadens
IIGPKFITSYDKSLFVI

SEQ ID NO: 3000432 - protein, 31 aa, Entamoeba invadens
IIGPPISLNLRNLLWHGFLEESDIFPSFGLL

SEQ ID NO: 3000433 - protein, 27 aa, Entamoeba invadens
IIGRQCCYYWEYLQSVVLPFGIKEIQN

SEQ ID NO: 3000434 - protein, 26 aa, Entamoeba invadens
IIGSEKYILLIEIIKSILSIPESHPF

SEQ ID NO: 3000435 - protein, 25 aa, Entamoeba invadens
IIGTGSFVTLPTWFVVKCKPNDKII

SEQ ID NO: 3000436 - protein, 27 aa, Entamoeba invadens
IIHENVTLPIYYVPVAISVVNNTPFAI

SEQ ID NO: 3000437 - protein, 27 aa, Entamoeba invadens
IIHFEIGALKNLRLLTKVKLPNKLKEV

SEQ ID NO: 3000438 - protein, 22 aa, Entamoeba invadens
IIHIVNPISCAFCYAYNGHTSQ

SEQ ID NO: 3000439 - protein, 22 aa, Entamoeba invadens
IIHKIEVILPSLKKTFTNSSSM

SEQ ID NO: 3000440 - protein, 18 aa, Entamoeba invadens
IIIPLRVTSISVCCFYGC

SEQ ID NO: 3000441 - protein, 17 aa, Entamoeba invadens
IIISLQKSYTLTSNSTN

SEQ ID NO: 3000442 - protein, 26 aa, Entamoeba invadens
IIITSFDVIFLLRLANLKTGEQHLRS

SEQ ID NO: 3000443 - protein, 24 aa, Entamoeba invadens
IIKEYFPELKEKALTPMRGDAVFN

SEQ ID NO: 3000444 - protein, 18 aa, Entamoeba invadens
IIKFWHFFRDLKDTNCVK

SEQ ID NO: 3000445 - protein, 20 aa, Entamoeba invadens
IIKGGIYTLNLGASGVKVMC

SEQ ID NO: 3000446 - protein, 23 aa, Entamoeba invadens
IIKKGLINPIQILSALIGLVTDK

SEQ ID NO: 3000447 - protein, 24 aa, Entamoeba invadens
IIKLTLICLSSLSIHKRCLDTLIQ

SEQ ID NO: 3000448 - protein, 17 aa, Entamoeba invadens
IIKLYEVIDGKDGRIYI

SEQ ID NO: 3000449 - protein, 17 aa, Entamoeba invadens
IIKLYLRSLPDSLIPSR

SEQ ID NO: 3000450 - protein, 26 aa, Entamoeba invadens
IIKNAKYFTSLYYLQTDLDYLIEFLE

SEQ ID NO: 3000451 - protein, 28 aa, Entamoeba invadens
IIKQQDFFCDLPMVLVKRSTCTAIPQAT

SEQ ID NO: 3000452 - protein, 18 aa, Entamoeba invadens
IIKSLPTRLRVLIKTLGD

SEQ ID NO: 3000453 - protein, 18 aa, Entamoeba invadens
IIKTYDVFAYDDYIIMIM

SEQ ID NO: 3000454 - protein, 23 aa, Entamoeba invadens
IIKYSKMFPLTTLNMNYKIFSCD

SEQ ID NO: 3000455 - protein, 18 aa, Entamoeba invadens
IILDCRPYTNAYANRVNG

SEQ ID NO: 3000456 - protein, 26 aa, Entamoeba invadens
IILDSRLTHLPLMCFQMCTNLKAIDL

SEQ ID NO: 3000457 - protein, 18 aa, Entamoeba invadens
IILLKDGTDTSQGKGQII

SEQ ID NO: 3000458 - protein, 17 aa, Entamoeba invadens
IILNYFDTFYNSRFVQN

SEQ ID NO: 3000459 - protein, 18 aa, Entamoeba invadens
IILPSTLTSICEEAFYNC

SEQ ID NO: 3000460 - protein, 19 aa, Entamoeba invadens
IILPSTLTSICEEAFYNCV

SEQ ID NO: 3000461 - protein, 19 aa, Entamoeba invadens
IIMAATNRPFDLDDAVLRR

SEQ ID NO: 3000462 - protein, 32 aa, Entamoeba invadens
IIMETYHPMFRSNLFRWLENLKYLNIAACVQF

SEQ ID NO: 3000463 - protein, 19 aa, Entamoeba invadens
IIMRFGCYKVLKPNLKDSK

SEQ ID NO: 3000464 - protein, 18 aa, Entamoeba invadens
IIMRQVFDVLTYLHKKGV

SEQ ID NO: 3000465 - protein, 19 aa, Entamoeba invadens
IIMTDWYACKDTVKMVLMG

SEQ ID NO: 3000466 - protein, 20 aa, Entamoeba invadens
IINDFKEKEIGGKKIKFVVL

SEQ ID NO: 3000467 - protein, 33 aa, Entamoeba invadens
IINESNGLLLQRSLYLLQCLYNKPFVNVDEVKV

SEQ ID NO: 3000468 - protein, 23 aa, Entamoeba invadens
IINGKALFIRKLSKMSVPTQPLE

SEQ ID NO: 3000469 - protein, 24 aa, Entamoeba invadens
IINQDSLWVVCSFLVLVIQNKDVT

SEQ ID NO: 3000470 - protein, 24 aa, Entamoeba invadens
IINQSIYVPNAYLPKSLDSKVKAV

SEQ ID NO: 3000471 - protein, 22 aa, Entamoeba invadens
IINRPVPFQYFLNALHYTDFEH

SEQ ID NO: 3000472 - protein, 20 aa, Entamoeba invadens
IINSLRAFGFERYIPQFMKF

SEQ ID NO: 3000473 - protein, 21 aa, Entamoeba invadens
IINTIIKNWYSTSVKFRYSNE

SEQ ID NO: 3000474 - protein, 17 aa, Entamoeba invadens
IINVVVFDALLSQIDNL

SEQ ID NO: 3000475 - protein, 27 aa, Entamoeba invadens
IINYYCLPYNFLICDYKTIKPEKLINT

SEQ ID NO: 3000476 - protein, 26 aa, Entamoeba invadens
IIPCARRCCFACILTGAPSLLEPMYL

SEQ ID NO: 3000477 - protein, 17 aa, Entamoeba invadens
IIPEPSDFWKVLFGLDH

SEQ ID NO: 3000478 - protein, 20 aa, Entamoeba invadens
IIPEVLRPFCGGVEKIPFVA

SEQ ID NO: 3000479 - protein, 22 aa, Entamoeba invadens
IIPLHGNWYNDARDLFFLDVPK

SEQ ID NO: 3000480 - protein, 19 aa, Entamoeba invadens
IIPLQCQTNYIFDTTPNQC

SEQ ID NO: 3000481 - protein, 17 aa, Entamoeba invadens
IIPSITLSGPTSFVPII

SEQ ID NO: 3000482 - protein, 21 aa, Entamoeba invadens
IIPTIIVDIGSYIIRAGLSTT

SEQ ID NO: 3000483 - protein, 20 aa, Entamoeba invadens
IIQEARPIFNDLKIGAPKHE

SEQ ID NO: 3000484 - protein, 24 aa, Entamoeba invadens
IIQEYIPVFFRKLTNHVAKEGVDS

SEQ ID NO: 3000485 - protein, 28 aa, Entamoeba invadens
IIQICKKYEFILDRFRINPIRISPDSKR

SEQ ID NO: 3000486 - protein, 30 aa, Entamoeba invadens
IIQICKKYEFILDRFRINPIRISPDSKRLF

SEQ ID NO: 3000487 - protein, 27 aa, Entamoeba invadens
IIQIISTTLTTPLLPSLPGNVIYLGMA

SEQ ID NO: 3000488 - protein, 18 aa, Entamoeba invadens
IIQKLYPRLKQDQFMLLW

SEQ ID NO: 3000489 - protein, 22 aa, Entamoeba invadens
IIQTFMHFVFLASEETLKIIAI

SEQ ID NO: 3000490 - protein, 21 aa, Entamoeba invadens
IIRGAYEFVPPTRSSRYKPER

SEQ ID NO: 3000491 - protein, 18 aa, Entamoeba invadens
IIRGKMTLDFHLQMLPKI

SEQ ID NO: 3000492 - protein, 19 aa, Entamoeba invadens
IIRLTLAVAYRFLNDEQMA

SEQ ID NO: 3000493 - protein, 17 aa, Entamoeba invadens
IIRLVSDFFVRDYDPTI

SEQ ID NO: 3000494 - protein, 25 aa, Entamoeba invadens
IIRMGKKYQLIAHQLIWNCDTYSTE

SEQ ID NO: 3000495 - protein, 17 aa, Entamoeba invadens
IIRTAKTLGLEITCSST

SEQ ID NO: 3000496 - protein, 20 aa, Entamoeba invadens
IIRYKVPYFIAKMLGKRGVL

SEQ ID NO: 3000497 - protein, 17 aa, Entamoeba invadens
IISAPSADAPMFVVGVN

SEQ ID NO: 3000498 - protein, 24 aa, Entamoeba invadens
IISAYIMYKADHVAYKKLKKFLKQ

SEQ ID NO: 3000499 - protein, 20 aa, Entamoeba invadens
IISDVLVPLYLIPYHQKIST

SEQ ID NO: 3000500 - protein, 22 aa, Entamoeba invadens
IISEFLVVRYWRTEENESTPMW

SEQ ID NO: 3000501 - protein, 17 aa, Entamoeba invadens
IISNFNNKQLRQIKLLS

SEQ ID NO: 3000502 - protein, 21 aa, Entamoeba invadens
IISPPFTICDIKILPILNVGD

SEQ ID NO: 3000503 - protein, 23 aa, Entamoeba invadens
IISQLTVNFPYLQLLNGQNVRNK

SEQ ID NO: 3000504 - protein, 21 aa, Entamoeba invadens
IISRFPTIHILSQSKWYDTVV

SEQ ID NO: 3000505 - protein, 17 aa, Entamoeba invadens
IISRILNITQRGVKGVF

SEQ ID NO: 3000506 - protein, 19 aa, Entamoeba invadens
IISSFWRKKYYFYTKVDRA

SEQ ID NO: 3000507 - protein, 20 aa, Entamoeba invadens
IISVFINLTFSQACLKQMLD

SEQ ID NO: 3000508 - protein, 19 aa, Entamoeba invadens
IISVYINPYRLSELYPFNR

SEQ ID NO: 3000509 - protein, 17 aa, Entamoeba invadens
IITCSFDQKLRVIETFL

SEQ ID NO: 3000510 - protein, 17 aa, Entamoeba invadens
IITIPPNYGCEFSLFLT

SEQ ID NO: 3000511 - protein, 34 aa, Entamoeba invadens
IITKRQTFIEKLIFYNILQWLDKLNVTVPIPAIL

SEQ ID NO: 3000512 - protein, 17 aa, Entamoeba invadens
IITLLLNEQFGLRSNIP

SEQ ID NO: 3000513 - protein, 28 aa, Entamoeba invadens
IITQPPPPPTDHPPLVFKIPMSSKVEKV

SEQ ID NO: 3000514 - protein, 29 aa, Entamoeba invadens
IITSLSTFLVLAFPYKSQDKPLPEKVEMS

SEQ ID NO: 3000515 - protein, 17 aa, Entamoeba invadens
IIVFHQLEKAQLIFINK

SEQ ID NO: 3000516 - protein, 17 aa, Entamoeba invadens
IIVLINDADWELVGLSE

SEQ ID NO: 3000517 - protein, 28 aa, Entamoeba invadens
IIVPVDRHIFLYFVTYKEYKEKNTQFEV

SEQ ID NO: 3000518 - protein, 18 aa, Entamoeba invadens
IIVRLFLMRNNEKLKCVY

SEQ ID NO: 3000519 - protein, 20 aa, Entamoeba invadens
IIYANNFKPSPPKYSFYNKN

SEQ ID NO: 3000520 - protein, 26 aa, Entamoeba invadens
IIYEIKKLYIYLPATVNKMWISQTTS

SEQ ID NO: 3000521 - protein, 22 aa, Entamoeba invadens
IIYESRLSGLPLEKCLSVIQSN

SEQ ID NO: 3000522 - protein, 18 aa, Entamoeba invadens
IIYLMLRGGLKYDLLTYL

SEQ ID NO: 3000523 - protein, 19 aa, Entamoeba invadens
IIYLTYCPSIQEVFFKKAT

SEQ ID NO: 3000524 - protein, 25 aa, Entamoeba invadens
IIYNIFIILIRIKCTSCSDTKLLED

SEQ ID NO: 3000525 - protein, 19 aa, Entamoeba invadens
IIYNNIFYNCKTGYSGDSR

SEQ ID NO: 3000526 - protein, 24 aa, Entamoeba invadens
IKADEFCHLIKWKAKKGRLDNIRS

SEQ ID NO: 3000527 - protein, 19 aa, Entamoeba invadens
IKADLFPESALFSVLPHVN

SEQ ID NO: 3000528 - protein, 26 aa, Entamoeba invadens
IKAFCEKKVMLPDNIPKVVILDEADS

SEQ ID NO: 3000529 - protein, 32 aa, Entamoeba invadens
IKAHGVTCFVSRQLIYPLPEQFFSANGIVSID

SEQ ID NO: 3000530 - protein, 28 aa, Entamoeba invadens
IKAHQNFPCIPFFGVYLQDLTFIHEGNE

SEQ ID NO: 3000531 - protein, 17 aa, Entamoeba invadens
IKALRFGGCNFSTKEIT

SEQ ID NO: 3000532 - protein, 24 aa, Entamoeba invadens
IKAPRNYIGLFTKALHNKSLPVNQ

SEQ ID NO: 3000533 - protein, 28 aa, Entamoeba invadens
IKAQNIKLGMYPPLYPAVCPTGAVSDKV

SEQ ID NO: 3000534 - protein, 33 aa, Entamoeba invadens
IKAVENILRLFGVKIFCFEELTNVLKEWVVHRD

SEQ ID NO: 3000535 - protein, 20 aa, Entamoeba invadens
IKAVLMLYKSAEIDVYSARD

SEQ ID NO: 3000536 - protein, 23 aa, Entamoeba invadens
IKAYYKFLVGITPSRFVSNALVS

SEQ ID NO: 3000537 - protein, 21 aa, Entamoeba invadens
IKCFKFCYSLKEIELPKSITL

SEQ ID NO: 3000538 - protein, 22 aa, Entamoeba invadens
IKCTTCTTGKYPSPSSPFSCID

SEQ ID NO: 3000539 - protein, 23 aa, Entamoeba invadens
IKDDQFFLTKNVALLSVLPELLE

SEQ ID NO: 3000540 - protein, 30 aa, Entamoeba invadens
IKDDQPITGKILKIALQAVYRLISSENSPK

SEQ ID NO: 3000541 - protein, 23 aa, Entamoeba invadens
IKDESILIMPLKTEPETGYFSLV

SEQ ID NO: 3000542 - protein, 26 aa, Entamoeba invadens
IKDESRVFIWKLVLNYYTFSMTERER

SEQ ID NO: 3000543 - protein, 26 aa, Entamoeba invadens
IKDFGVFNGIYAKAFGEHKPARACYA

SEQ ID NO: 3000544 - protein, 22 aa, Entamoeba invadens
IKDFLNIWKDSLPVSTDIIAGE

SEQ ID NO: 3000545 - protein, 27 aa, Entamoeba invadens
IKDKFQRIVLFTPTGWAKKLVSKGSFD

SEQ ID NO: 3000546 - protein, 26 aa, Entamoeba invadens
IKDKTQTIPLLPRDENMAPAFAFDAN

SEQ ID NO: 3000547 - protein, 36 aa, Entamoeba invadens
IKDLEHILMVKKNALLRLQKRLLFHRSKTIVYNKAG

SEQ ID NO: 3000548 - protein, 21 aa, Entamoeba invadens
IKDLISLCELVLNLDNYKALL

SEQ ID NO: 3000549 - protein, 19 aa, Entamoeba invadens
IKDLVYKTAYLQPINGTVT

SEQ ID NO: 3000550 - protein, 22 aa, Entamoeba invadens
IKDPDFIIWKFYESTKDYESNP

SEQ ID NO: 3000551 - protein, 25 aa, Entamoeba invadens
IKDPNLFPLINPKKNKIEFDIIMED

SEQ ID NO: 3000552 - protein, 25 aa, Entamoeba invadens
IKDQVPYPVFKKFNDFVYYCDDQHA

SEQ ID NO: 3000553 - protein, 23 aa, Entamoeba invadens
IKDTFREMVLLPSQIEVTTATCS

SEQ ID NO: 3000554 - protein, 26 aa, Entamoeba invadens
IKDVIFRHFAKIWSYKFINVTNGVTP

SEQ ID NO: 3000555 - protein, 19 aa, Entamoeba invadens
IKDVQFENLKDSLGDKKDT

SEQ ID NO: 3000556 - protein, 21 aa, Entamoeba invadens
IKECWAAHMIGHELTAYYGVA

SEQ ID NO: 3000557 - protein, 37 aa, Entamoeba invadens
IKEIDFSYSLLKTLPKSFMLLTGLRKLTLQHTSVKVP

SEQ ID NO: 3000558 - protein, 20 aa, Entamoeba invadens
IKEIKQFIIKPHLYDELEAS

SEQ ID NO: 3000559 - protein, 23 aa, Entamoeba invadens
IKEINPGLLNRLFKKSGNEGSSR

SEQ ID NO: 3000560 - protein, 24 aa, Entamoeba invadens
IKEIVLPPTIQTLGRRAFYNCKSL

SEQ ID NO: 3000561 - protein, 42 aa, Entamoeba invadens
IKEKICQIAFETYNFPLFCLISQPVLSLLSTGKSTGFCVESG

SEQ ID NO: 3000562 - protein, 19 aa, Entamoeba invadens
IKELFNFRELLKAQLELTY

SEQ ID NO: 3000563 - protein, 23 aa, Entamoeba invadens
IKELTKNVFLLKGVYHVVTDVKG

SEQ ID NO: 3000564 - protein, 24 aa, Entamoeba invadens
IKEMKMYNLFLISDPPKQKAMIIS

SEQ ID NO: 3000565 - protein, 27 aa, Entamoeba invadens
IKEQNILYLKIFNFIEKTFPKINTLQC

SEQ ID NO: 3000566 - protein, 24 aa, Entamoeba invadens
IKERAFLVPYKYHLVVPIDFPTTE

SEQ ID NO: 3000567 - protein, 24 aa, Entamoeba invadens
IKERHQYFLVPDYYFVDVKQTVST

SEQ ID NO: 3000568 - protein, 28 aa, Entamoeba invadens
IKESLKLYNVLILLKTCAKIEMINILNQ

SEQ ID NO: 3000569 - protein, 25 aa, Entamoeba invadens
IKETFEKYLILPQDLSPVSTQKSQE

SEQ ID NO: 3000570 - protein, 26 aa, Entamoeba invadens
IKETFLAAQGKFISELFSLHVAGGDD

SEQ ID NO: 3000571 - protein, 20 aa, Entamoeba invadens
IKETILPPPLPQSISEPPEH

SEQ ID NO: 3000572 - protein, 17 aa, Entamoeba invadens
IKFDIVLIDSFVSKKKI

SEQ ID NO: 3000573 - protein, 20 aa, Entamoeba invadens
IKFERLYVEVKKAQKFVLEI

SEQ ID NO: 3000574 - protein, 21 aa, Entamoeba invadens
IKFESFYHDIMKKKYYITFAM

SEQ ID NO: 3000575 - protein, 18 aa, Entamoeba invadens
IKFFYFSMEEKQPISNLT

SEQ ID NO: 3000576 - protein, 23 aa, Entamoeba invadens
IKFPISFPIIYKTLRVDGDMSVK

SEQ ID NO: 3000577 - protein, 22 aa, Entamoeba invadens
IKGAYFSAKGLRHPYLTVSSKT

SEQ ID NO: 3000578 - protein, 24 aa, Entamoeba invadens
IKGEKIPIRLPLKGVPLTSSYKNI

SEQ ID NO: 3000579 - protein, 20 aa, Entamoeba invadens
IKGIQSDTLCYFIDLPKIPG

SEQ ID NO: 3000580 - protein, 24 aa, Entamoeba invadens
IKGKNTIVIGYYNNTAKPVTAGQN

SEQ ID NO: 3000581 - protein, 18 aa, Entamoeba invadens
IKGLAKMMCLIKKNIREY

SEQ ID NO: 3000582 - protein, 18 aa, Entamoeba invadens
IKGLAYYTALEFSNTISK

SEQ ID NO: 3000583 - protein, 26 aa, Entamoeba invadens
IKGLNKLKILYFVKGVLPYPEKISSG

SEQ ID NO: 3000584 - protein, 18 aa, Entamoeba invadens
IKGNLPYKKYIGWQAVDV

SEQ ID NO: 3000585 - protein, 23 aa, Entamoeba invadens
IKGPELLTMWFGESEANVRNIFD

SEQ ID NO: 3000586 - protein, 24 aa, Entamoeba invadens
IKHYQNLFLIRTPSRVYNISATSE

SEQ ID NO: 3000587 - protein, 21 aa, Entamoeba invadens
IKIFNLAKNPFFEKTFSLQFG

SEQ ID NO: 3000588 - protein, 19 aa, Entamoeba invadens
IKIIQWKKTIWDKGVVSLF

SEQ ID NO: 3000589 - protein, 17 aa, Entamoeba invadens
IKIISSATFIFCKNLTN

SEQ ID NO: 3000590 - protein, 27 aa, Entamoeba invadens
IKILKKQMFFKCTALVNLTFEGVQEIE

SEQ ID NO: 3000591 - protein, 20 aa, Entamoeba invadens
IKIPYSVRVILDNSFKYAHI

SEQ ID NO: 3000592 - protein, 18 aa, Entamoeba invadens
IKISPLFVEPEKLSNFLK

SEQ ID NO: 3000593 - protein, 24 aa, Entamoeba invadens
IKKCLEDIFESKLPILEFCNIDTK

SEQ ID NO: 3000594 - protein, 31 aa, Entamoeba invadens
IKKCPLTSRRPLLQHIVLAGGSTLFEGLPER

SEQ ID NO: 3000595 - protein, 35 aa, Entamoeba invadens
IKKEEELMMWKGQTVGQYLRSTFGKAMNQKGVKDV

SEQ ID NO: 3000596 - protein, 30 aa, Entamoeba invadens
IKKEPFKPTLVFLPIIMDQLVKSRLQQIYK

SEQ ID NO: 3000597 - protein, 23 aa, Entamoeba invadens
IKKFKMPNSIFTLGFDCFFGCSN

SEQ ID NO: 3000598 - protein, 23 aa, Entamoeba invadens
IKKIQVPYVLRYLASELGAMNVR

SEQ ID NO: 3000599 - protein, 25 aa, Entamoeba invadens
IKKLFSVLQTFYLVFDEINNFTDMK

SEQ ID NO: 3000600 - protein, 27 aa, Entamoeba invadens
IKKLKFEVVFFWKFIDDNTLYFYDNKL

SEQ ID NO: 3000601 - protein, 18 aa, Entamoeba invadens
IKKMRNERNRNLLLEVAF

SEQ ID NO: 3000602 - protein, 25 aa, Entamoeba invadens
IKKNGKLILNAIQSVADLKKEEQIP

SEQ ID NO: 3000603 - protein, 33 aa, Entamoeba invadens
IKKQVFLHRIPHTLVFQLKRFSFNTLTFQQEKI

SEQ ID NO: 3000604 - protein, 23 aa, Entamoeba invadens
IKKRERLLSIIQTKKLRGINYIR

SEQ ID NO: 3000605 - protein, 25 aa, Entamoeba invadens
IKKSPLLFINLNYDAFDKLAKSRMT

SEQ ID NO: 3000606 - protein, 24 aa, Entamoeba invadens
IKKVPVGCFMFCSSLKSLGIEEDA

SEQ ID NO: 3000607 - protein, 29 aa, Entamoeba invadens
IKKVVAPYEILTFDIPRFKKDTPLTKYII

SEQ ID NO: 3000608 - protein, 34 aa, Entamoeba invadens
IKKYHYNPIPLNYITVKYFPNIKTLHLWSTRDEN

SEQ ID NO: 3000609 - protein, 23 aa, Entamoeba invadens
IKLDEFAVIKFPLSTETALKMIE

SEQ ID NO: 3000610 - protein, 33 aa, Entamoeba invadens
IKLHGKGHIFFETARFMFYTNRKVRIAQDIDEY

SEQ ID NO: 3000611 - protein, 20 aa, Entamoeba invadens
IKLICEGSFGMVYKGTFRGK

SEQ ID NO: 3000612 - protein, 26 aa, Entamoeba invadens
IKLNGMYCCILPIMPITKMDVYIENS

SEQ ID NO: 3000613 - protein, 29 aa, Entamoeba invadens
IKLQTLVCTFLIKYYPLIFRDTCENNGLL

SEQ ID NO: 3000614 - protein, 20 aa, Entamoeba invadens
IKLSDILTKLPIYCFRCCYN

SEQ ID NO: 3000615 - protein, 22 aa, Entamoeba invadens
IKLSELILYIKDNNGFKLYSLS

SEQ ID NO: 3000616 - protein, 26 aa, Entamoeba invadens
IKLSNTFHWNYGFDSTFTSLILTYDN

SEQ ID NO: 3000617 - protein, 28 aa, Entamoeba invadens
IKMDCQLMLLRHWTLYDSLFHTREIASR

SEQ ID NO: 3000618 - protein, 20 aa, Entamoeba invadens
IKMNMRLKMILDASEGILYL

SEQ ID NO: 3000619 - protein, 19 aa, Entamoeba invadens
IKMTHQLLLAVGYLHEKGI

SEQ ID NO: 3000620 - protein, 25 aa, Entamoeba invadens
IKNDPKHFMFTLQNQLNVQPSQIFP

SEQ ID NO: 3000621 - protein, 20 aa, Entamoeba invadens
IKNEKLVQLIFKAVDVDNDG

SEQ ID NO: 3000622 - protein, 21 aa, Entamoeba invadens
IKNEKLVQLIFKAVDVDNDGT

SEQ ID NO: 3000623 - protein, 23 aa, Entamoeba invadens
IKNEKLVQLIFKAVDVDNDGTID

SEQ ID NO: 3000624 - protein, 25 aa, Entamoeba invadens
IKNEWYGLQGWRMSIDNHEVKYFSG

SEQ ID NO: 3000625 - protein, 25 aa, Entamoeba invadens
IKNGQFYVPKFLNTLILINIHANVF

SEQ ID NO: 3000626 - protein, 39 aa, Entamoeba invadens
IKNIQNILSFLPPVYYSTLKMLLHYLRLVCDASAINKMN

SEQ ID NO: 3000627 - protein, 23 aa, Entamoeba invadens
IKNKSLFYSIIRHIDILSDEEVF

SEQ ID NO: 3000628 - protein, 23 aa, Entamoeba invadens
IKNLPFDESKLLYLKSYEVNGVT

SEQ ID NO: 3000629 - protein, 17 aa, Entamoeba invadens
IKNLRKVVVLCTPSQTL

SEQ ID NO: 3000630 - protein, 23 aa, Entamoeba invadens
IKNNFIWGTRFGIAYWGTSASAY

SEQ ID NO: 3000631 - protein, 25 aa, Entamoeba invadens
IKNSFPRTYLPTVFDNYLTTVKFKK

SEQ ID NO: 3000632 - protein, 20 aa, Entamoeba invadens
IKNTRLCVLILQALKEISPI

SEQ ID NO: 3000633 - protein, 19 aa, Entamoeba invadens
IKNVIEKRVKRWTKGGLIL

SEQ ID NO: 3000634 - protein, 21 aa, Entamoeba invadens
IKNVVFYLESMRDLCQFVKIN

SEQ ID NO: 3000635 - protein, 20 aa, Entamoeba invadens
IKPEKLINTKSLLFSKKEQL

SEQ ID NO: 3000636 - protein, 18 aa, Entamoeba invadens
IKPENFLVFEECPMKIKM

SEQ ID NO: 3000637 - protein, 22 aa, Entamoeba invadens
IKPMFNTLIGKVIEWSRIEMRP

SEQ ID NO: 3000638 - protein, 25 aa, Entamoeba invadens
IKPQLEFFNHVFVTSTALYNGSEQQ

SEQ ID NO: 3000639 - protein, 30 aa, Entamoeba invadens
IKPVQHITKYPLFLNTLKNLMDGAQKKLVE

SEQ ID NO: 3000640 - protein, 27 aa, Entamoeba invadens
IKQDPKLQFQWWFPLVESVTAVEFHQN

SEQ ID NO: 3000641 - protein, 26 aa, Entamoeba invadens
IKQEFHFLGFYVVDNLFNTPDAICCV

SEQ ID NO: 3000642 - protein, 19 aa, Entamoeba invadens
IKQKYVVEIIQASGLKLAD

SEQ ID NO: 3000643 - protein, 19 aa, Entamoeba invadens
IKQLAVLMRVWSTSDFGSM

SEQ ID NO: 3000644 - protein, 19 aa, Entamoeba invadens
IKQMIYKAYNLFGDQMDEN

SEQ ID NO: 3000645 - protein, 27 aa, Entamoeba invadens
IKQTNYFLIDILSELGYKYTWIIESKK

SEQ ID NO: 3000646 - protein, 17 aa, Entamoeba invadens
IKRDNQIADLEKAVAAL

SEQ ID NO: 3000647 - protein, 18 aa, Entamoeba invadens
IKRDNQIADLEKAVAALK

SEQ ID NO: 3000648 - protein, 17 aa, Entamoeba invadens
IKRHNQIVDLENEVAVL

SEQ ID NO: 3000649 - protein, 21 aa, Entamoeba invadens
IKRIHKIFLLIFEQMNNQDLK

SEQ ID NO: 3000650 - protein, 21 aa, Entamoeba invadens
IKRKCFEGCFWLPNISIPENV

SEQ ID NO: 3000651 - protein, 23 aa, Entamoeba invadens
IKRRISLRDFFPFKREEFPKLYE

SEQ ID NO: 3000652 - protein, 25 aa, Entamoeba invadens
IKRTDGIFALIMTPTRELTQQVFEV

SEQ ID NO: 3000653 - protein, 27 aa, Entamoeba invadens
IKRVKREFVLGILMYVGIPPDISVTNT

SEQ ID NO: 3000654 - protein, 19 aa, Entamoeba invadens
IKRVWEKFVSWYCARHQER

SEQ ID NO: 3000655 - protein, 32 aa, Entamoeba invadens
IKSGSLIVTGPFKLSGVPLLQINQRYVIATSQ

SEQ ID NO: 3000656 - protein, 22 aa, Entamoeba invadens
IKSHKFFRGVKFQLIRNIPPPI

SEQ ID NO: 3000657 - protein, 22 aa, Entamoeba invadens
IKSIEYLLNNYIAFEERRGEVF

SEQ ID NO: 3000658 - protein, 26 aa, Entamoeba invadens
IKSKEHFNFSLTYLTLLDEENGFLVV

SEQ ID NO: 3000659 - protein, 23 aa, Entamoeba invadens
IKSLGKEFLKFFRVENFQVPNNI

SEQ ID NO: 3000660 - protein, 18 aa, Entamoeba invadens
IKSLSLYGFDYFADVRSQ

SEQ ID NO: 3000661 - protein, 29 aa, Entamoeba invadens
IKSMPFNDLLLSLLGRQFSQWIKASSILR

SEQ ID NO: 3000662 - protein, 33 aa, Entamoeba invadens
IKSQQVRWVLSRSFVVWVPLTVVGKYVETSDSG

SEQ ID NO: 3000663 - protein, 20 aa, Entamoeba invadens
IKSRVWLMKESNDWLHHSNN

SEQ ID NO: 3000664 - protein, 19 aa, Entamoeba invadens
IKSSQIPYRFSSSTLLECD

SEQ ID NO: 3000665 - protein, 22 aa, Entamoeba invadens
IKSTLPMMFSYSTTKTNAIIKT

SEQ ID NO: 3000666 - protein, 25 aa, Entamoeba invadens
IKSYGKHLFYLFGVSEVIIPNTVTS

SEQ ID NO: 3000667 - protein, 25 aa, Entamoeba invadens
IKSYNFIINLPFKKQLIFKIHRTTD

SEQ ID NO: 3000668 - protein, 18 aa, Entamoeba invadens
IKSYVLRKVLNGIYFEFV

SEQ ID NO: 3000669 - protein, 17 aa, Entamoeba invadens
IKTAKYTALLPRATEDG

SEQ ID NO: 3000670 - protein, 20 aa, Entamoeba invadens
IKTDGFLTESFFAEDQPYQW

SEQ ID NO: 3000671 - protein, 24 aa, Entamoeba invadens
IKTENTLLLIPLSKTYPSINEQFL

SEQ ID NO: 3000672 - protein, 25 aa, Entamoeba invadens
IKTIQQFLVNCLFVAGCNTFFHYGF

SEQ ID NO: 3000673 - protein, 20 aa, Entamoeba invadens
IKTIRFGQCERFIAISRNEK

SEQ ID NO: 3000674 - protein, 37 aa, Entamoeba invadens
IKTLIDYYEKNWILGWPVLLWCQFNQMIRTVNLSESY

SEQ ID NO: 3000675 - protein, 18 aa, Entamoeba invadens
IKTPLIKISPLFVEPEKL

SEQ ID NO: 3000676 - protein, 17 aa, Entamoeba invadens
IKTQLFESLKVLSIHSL

SEQ ID NO: 3000677 - protein, 24 aa, Entamoeba invadens
IKTTKLCVMILNALKEVHPHIEYF

SEQ ID NO: 3000678 - protein, 30 aa, Entamoeba invadens
IKTTNLCGIGWRIGDYVYPLNMVVFANTCI

SEQ ID NO: 3000679 - protein, 20 aa, Entamoeba invadens
IKVANYFTSYLDYLNLEMVC

SEQ ID NO: 3000680 - protein, 25 aa, Entamoeba invadens
IKVHVHPTFRWGRDLGTIENFWLFI

SEQ ID NO: 3000681 - protein, 25 aa, Entamoeba invadens
IKVLMELIILKRLSAEFPDMFTKCN

SEQ ID NO: 3000682 - protein, 19 aa, Entamoeba invadens
IKVLMSVIILRRLCVEFPD

SEQ ID NO: 3000683 - protein, 18 aa, Entamoeba invadens
IKVNVFLDLLSGTTYEAT

SEQ ID NO: 3000684 - protein, 41 aa, Entamoeba invadens
IKVVCGFIRVLFMFEIPFVNVLVLLDKIFECGFSLVFFVSD

SEQ ID NO: 3000685 - protein, 17 aa, Entamoeba invadens
IKVYTIATNILMTENFN

SEQ ID NO: 3000686 - protein, 29 aa, Entamoeba invadens
IKYKIVNDNLKFVKPEWIYLCVNSGQVQP

SEQ ID NO: 3000687 - protein, 21 aa, Entamoeba invadens
IKYKVVYEEVPLLKKLGYTCT

SEQ ID NO: 3000688 - protein, 20 aa, Entamoeba invadens
IKYNQLKFSIKFFPNIETVS

SEQ ID NO: 3000689 - protein, 19 aa, Entamoeba invadens
IKYRDYYVSSIDVNCTTFT

SEQ ID NO: 3000690 - protein, 20 aa, Entamoeba invadens
IKYSMSCLCFMKVVDFSIKK

SEQ ID NO: 3000691 - protein, 19 aa, Entamoeba invadens
IKYTTLKSVGSAIFMKINE

SEQ ID NO: 3000692 - protein, 21 aa, Entamoeba invadens
ILAEKDGLLEKLKMAQEDRLE

SEQ ID NO: 3000693 - protein, 25 aa, Entamoeba invadens
ILAGHNVLVLMPTGGGKSLCYQLPM

SEQ ID NO: 3000694 - protein, 26 aa, Entamoeba invadens
ILAKQDKLLILLINELVQLKDIKEDQ

SEQ ID NO: 3000695 - protein, 17 aa, Entamoeba invadens
ILAMKKSAIVMLEASEK

SEQ ID NO: 3000696 - protein, 26 aa, Entamoeba invadens
ILAMPMFDSNGIRRPFTNEEYAEYEE

SEQ ID NO: 3000697 - protein, 20 aa, Entamoeba invadens
ILANPHVANFFAIRAQYYNK

SEQ ID NO: 3000698 - protein, 19 aa, Entamoeba invadens
ILANPVLLEPIYSVEILTP

SEQ ID NO: 3000699 - protein, 19 aa, Entamoeba invadens
ILASSSPRRKMIFEQLGLK

SEQ ID NO: 3000700 - protein, 26 aa, Entamoeba invadens
ILCDCEVSLFIFANDKLVVYSSKDVK

SEQ ID NO: 3000701 - protein, 17 aa, Entamoeba invadens
ILCDPSCSGSGILERKN

SEQ ID NO: 3000702 - protein, 19 aa, Entamoeba invadens
ILCHVATIDQYLPKIFEHY

SEQ ID NO: 3000703 - protein, 18 aa, Entamoeba invadens
ILCILYHLKRYGDALNVV

SEQ ID NO: 3000704 - protein, 19 aa, Entamoeba invadens
ILCNAQSPLLYSNLCFIRD

SEQ ID NO: 3000705 - protein, 20 aa, Entamoeba invadens
ILCQLVQLFQLTHSIVIGRD

SEQ ID NO: 3000706 - protein, 29 aa, Entamoeba invadens
ILCSDEIPILMYLTILKSIIEKAQEGLNK

SEQ ID NO: 3000707 - protein, 31 aa, Entamoeba invadens
ILCVPGCPFQPQAILPQLIRFLPITSDHEEE

SEQ ID NO: 3000708 - protein, 27 aa, Entamoeba invadens
ILCYQKGLILQLVLVFEPKGIHRFTLP

SEQ ID NO: 3000709 - protein, 21 aa, Entamoeba invadens
ILDDVLLYSYSDYIAPETQLE

SEQ ID NO: 3000710 - protein, 19 aa, Entamoeba invadens
ILDHFQIQGIFVLTTHFSN

SEQ ID NO: 3000711 - protein, 17 aa, Entamoeba invadens
ILDIAGFEIFRENSFEQ

SEQ ID NO: 3000712 - protein, 22 aa, Entamoeba invadens
ILDIFGFEIFPVNGFEQFCINY

SEQ ID NO: 3000713 - protein, 19 aa, Entamoeba invadens
ILDLCHGEWKDKPYVLDLC

SEQ ID NO: 3000714 - protein, 20 aa, Entamoeba invadens
ILDLLQNSFKWIPITNDLNP

SEQ ID NO: 3000715 - protein, 26 aa, Entamoeba invadens
ILDLTESLIFYCGDLVMTDNTQIIGI

SEQ ID NO: 3000716 - protein, 17 aa, Entamoeba invadens
ILDLTIDLFGNYVVQKL

SEQ ID NO: 3000717 - protein, 25 aa, Entamoeba invadens
ILDSICFVLGIQNLSLVRVTTIQEL

SEQ ID NO: 3000718 - protein, 24 aa, Entamoeba invadens
ILDVRKLIYLLGMVPGYDFERIID

SEQ ID NO: 3000719 - protein, 18 aa, Entamoeba invadens
ILDVYIRYLPTVLREKYL

SEQ ID NO: 3000720 - protein, 43 aa, Entamoeba invadens
ILECANLIDPFVSLYPHKVAFYTFFPYVDIKKLSGMRADYFFV

SEQ ID NO: 3000721 - protein, 19 aa, Entamoeba invadens
ILECTNTNYLWKQNCFLIT

SEQ ID NO: 3000722 - protein, 26 aa, Entamoeba invadens
ILEDIDGFCYFNTTFQGRPTPVRPVE

SEQ ID NO: 3000723 - protein, 27 aa, Entamoeba invadens
ILEDKTFTFKFLMNGINFILNDKEGDF

SEQ ID NO: 3000724 - protein, 19 aa, Entamoeba invadens
ILEFEDKIFDVMLLKMYTG

SEQ ID NO: 3000725 - protein, 25 aa, Entamoeba invadens
ILEISKRYSFFYKDSALIIPTYNDP

SEQ ID NO: 3000726 - protein, 25 aa, Entamoeba invadens
ILEKDEGWWKGSLNGAEGWIPNNYV

SEQ ID NO: 3000727 - protein, 20 aa, Entamoeba invadens
ILENYLIGIFADIDKPRNAE

SEQ ID NO: 3000728 - protein, 26 aa, Entamoeba invadens
ILEQLTVYQLLLNKPKLVYDIMQFEE

SEQ ID NO: 3000729 - protein, 19 aa, Entamoeba invadens
ILERAKAFAVPLISSMRYS

SEQ ID NO: 3000730 - protein, 17 aa, Entamoeba invadens
ILEVKYLLNVDHYFKID

SEQ ID NO: 3000731 - protein, 17 aa, Entamoeba invadens
ILFAKMMPFPTFEGSKK

SEQ ID NO: 3000732 - protein, 18 aa, Entamoeba invadens
ILFEIYDWDRFKTDDFLG

SEQ ID NO: 3000733 - protein, 18 aa, Entamoeba invadens
ILFELFPMELTKPETAPR

SEQ ID NO: 3000734 - protein, 19 aa, Entamoeba invadens
ILFIGMKNMRMVIVHLSRG

SEQ ID NO: 3000735 - protein, 19 aa, Entamoeba invadens
ILFKRIHVEDITLSDALFN

SEQ ID NO: 3000736 - protein, 18 aa, Entamoeba invadens
ILGDYKYCRFCEGEPYET

SEQ ID NO: 3000737 - protein, 22 aa, Entamoeba invadens
ILGEIVNCKPLFPGTSTLNQLD

SEQ ID NO: 3000738 - protein, 23 aa, Entamoeba invadens
ILGKIALDLMKKFSLLTPDNVET

SEQ ID NO: 3000739 - protein, 19 aa, Entamoeba invadens
ILGLDRPSCYVGEKAIEMN

SEQ ID NO: 3000740 - protein, 23 aa, Entamoeba invadens
ILGSPWNELRGKRPMVLKMEKRM

SEQ ID NO: 3000741 - protein, 17 aa, Entamoeba invadens
ILHFIDFEFANSYNAIP

SEQ ID NO: 3000742 - protein, 20 aa, Entamoeba invadens
ILHISKVLLMLATPQNYTSP

SEQ ID NO: 3000743 - protein, 17 aa, Entamoeba invadens
ILHKPFHINPFEGEFVA

SEQ ID NO: 3000744 - protein, 23 aa, Entamoeba invadens
ILHKQNLLFLVEDDNRNIFGGVL

SEQ ID NO: 3000745 - protein, 21 aa, Entamoeba invadens
ILHKRVHDVSMISSALEVLQT

SEQ ID NO: 3000746 - protein, 26 aa, Entamoeba invadens
ILHNDNIIFYFRFVPENVIRKTDNCK

SEQ ID NO: 3000747 - protein, 28 aa, Entamoeba invadens
ILHQFLEETVPLYIPLAKEFAQFHDQAL

SEQ ID NO: 3000748 - protein, 26 aa, Entamoeba invadens
ILHTNLCVTYLKLQKYKLVVVHASIV

SEQ ID NO: 3000749 - protein, 31 aa, Entamoeba invadens
ILHVYDLMDNSYLYPFGLGAYHSGVCAYGRE

SEQ ID NO: 3000750 - protein, 28 aa, Entamoeba invadens
ILICHKFMCILDRFRYNPIPVNSTKLFP

SEQ ID NO: 3000751 - protein, 19 aa, Entamoeba invadens
ILIDKPIQIIGVTEGKQKP

SEQ ID NO: 3000752 - protein, 18 aa, Entamoeba invadens
ILIEPIQHKPTPVMRMSI

SEQ ID NO: 3000753 - protein, 36 aa, Entamoeba invadens
ILILWDEFILNPNKHIFYFAVIAYLMQIRDDIMKET

SEQ ID NO: 3000754 - protein, 18 aa, Entamoeba invadens
ILIQLNMQTKFRLDLELL

SEQ ID NO: 3000755 - protein, 20 aa, Entamoeba invadens
ILISQGYTIVFHKPSKTKTL

SEQ ID NO: 3000756 - protein, 17 aa, Entamoeba invadens
ILIVSKYFSTLTDFYNI

SEQ ID NO: 3000757 - protein, 23 aa, Entamoeba invadens
ILKDTSAMGWWKKTFEKSGRDKE

SEQ ID NO: 3000758 - protein, 27 aa, Entamoeba invadens
ILKDYIRSLPNPLIPFDYYDNYINLPK

SEQ ID NO: 3000759 - protein, 19 aa, Entamoeba invadens
ILKELFPDYKKKSAASVRG

SEQ ID NO: 3000760 - protein, 25 aa, Entamoeba invadens
ILKELYTFEDGAFLVYDRIDYKEID

SEQ ID NO: 3000761 - protein, 17 aa, Entamoeba invadens
ILKHVLALCGKIISNPE

SEQ ID NO: 3000762 - protein, 19 aa, Entamoeba invadens
ILKIANRIPQCQLFVENTG

SEQ ID NO: 3000763 - protein, 20 aa, Entamoeba invadens
ILKKDFDVAILKLKKLNVDV

SEQ ID NO: 3000764 - protein, 23 aa, Entamoeba invadens
ILKKYSIHLLVKLSDAMILSDDQ

SEQ ID NO: 3000765 - protein, 22 aa, Entamoeba invadens
ILKLLKCDYIIKYYTSLRRQEE

SEQ ID NO: 3000766 - protein, 17 aa, Entamoeba invadens
ILKNCKAFYKKFGNTLL

SEQ ID NO: 3000767 - protein, 21 aa, Entamoeba invadens
ILKNIPLVGSQRKLKPVSFDS

SEQ ID NO: 3000768 - protein, 24 aa, Entamoeba invadens
ILKNRPEPIKPEQLASAISDISTV

SEQ ID NO: 3000769 - protein, 18 aa, Entamoeba invadens
ILKPNFDEKYLAQFAAFV

SEQ ID NO: 3000770 - protein, 22 aa, Entamoeba invadens
ILKQYVFERYLDNRQSADLYVL

SEQ ID NO: 3000771 - protein, 20 aa, Entamoeba invadens
ILKRDFDVAILKLKKLNVDV

SEQ ID NO: 3000772 - protein, 25 aa, Entamoeba invadens
ILKRQNMYLGLMMTTKFDENSTTYC

SEQ ID NO: 3000773 - protein, 27 aa, Entamoeba invadens
ILKTTHHPFLTHLYWSFSTEKCFYFVM

SEQ ID NO: 3000774 - protein, 18 aa, Entamoeba invadens
ILLDILVELGYHFQTKVS

SEQ ID NO: 3000775 - protein, 21 aa, Entamoeba invadens
ILLHLSQLEQLSFFSFPKLKT

SEQ ID NO: 3000776 - protein, 17 aa, Entamoeba invadens
ILLKKYDSIKIPKVSFN

SEQ ID NO: 3000777 - protein, 23 aa, Entamoeba invadens
ILLPTCVSIIKECSFWGCKNLRT

SEQ ID NO: 3000778 - protein, 18 aa, Entamoeba invadens
ILLPTQTKLLTPLEQNAK

SEQ ID NO: 3000779 - protein, 20 aa, Entamoeba invadens
ILLREIVTDPFLDKYSVIIM

SEQ ID NO: 3000780 - protein, 18 aa, Entamoeba invadens
ILLSNFHLPFNYFSLEND

SEQ ID NO: 3000781 - protein, 18 aa, Entamoeba invadens
ILLSSFDVAFIRENNMKN

SEQ ID NO: 3000782 - protein, 19 aa, Entamoeba invadens
ILLTISPNVFLYKDTPTIP

SEQ ID NO: 3000783 - protein, 25 aa, Entamoeba invadens
ILLVPKVNYVLPNGYIIILHDTMTS

SEQ ID NO: 3000784 - protein, 26 aa, Entamoeba invadens
ILLYTTPSVLCLCNVKKGFVSKNTMY

SEQ ID NO: 3000785 - protein, 17 aa, Entamoeba invadens
ILMAFGEIVEFLVETTT

SEQ ID NO: 3000786 - protein, 18 aa, Entamoeba invadens
ILMNLILNTNAIQTLPVS

SEQ ID NO: 3000787 - protein, 19 aa, Entamoeba invadens
ILNDYKGPLPFYALSLING

SEQ ID NO: 3000788 - protein, 21 aa, Entamoeba invadens
ILNELKIIRKLLKATCVLRKR

SEQ ID NO: 3000789 - protein, 17 aa, Entamoeba invadens
ILNFFRGFESTKHRISE

SEQ ID NO: 3000790 - protein, 18 aa, Entamoeba invadens
ILNFFTIENYCGSLPNLC

SEQ ID NO: 3000791 - protein, 28 aa, Entamoeba invadens
ILNGKLHLVLLLQCPLNISVGNYYKDFV

SEQ ID NO: 3000792 - protein, 34 aa, Entamoeba invadens
ILNGLDKSFLAFIERLFRLLKLIADNSKENLMTA

SEQ ID NO: 3000793 - protein, 25 aa, Entamoeba invadens
ILNHSFSQILFHLKCQHHKNVSLKG

SEQ ID NO: 3000794 - protein, 17 aa, Entamoeba invadens
ILNLLVRNIKVTLYVER

SEQ ID NO: 3000795 - protein, 21 aa, Entamoeba invadens
ILNMLVPKLLYGLQRDNMKAC

SEQ ID NO: 3000796 - protein, 27 aa, Entamoeba invadens
ILNNYKVHLFFIAQPFSREDYDMDTYK

SEQ ID NO: 3000797 - protein, 18 aa, Entamoeba invadens
ILNPLVIEFYTGSETFVS

SEQ ID NO: 3000798 - protein, 17 aa, Entamoeba invadens
ILNQNPIWKLYSTQKHG

SEQ ID NO: 3000799 - protein, 27 aa, Entamoeba invadens
ILNQYIQTFRAFPIPHQSPSNLFQTNE

SEQ ID NO: 3000800 - protein, 20 aa, Entamoeba invadens
ILNRLLTTPDIDILTNIYLT

SEQ ID NO: 3000801 - protein, 20 aa, Entamoeba invadens
ILNVCLKLSKLALHDKKFEK

SEQ ID NO: 3000802 - protein, 19 aa, Entamoeba invadens
ILPLCDCSLDMELTVPRSL

SEQ ID NO: 3000803 - protein, 24 aa, Entamoeba invadens
ILPQLYYHQFSIETKFKTIWDKYN

SEQ ID NO: 3000804 - protein, 23 aa, Entamoeba invadens
ILPSQTFFRCSNLKEIELPNSMI

SEQ ID NO: 3000805 - protein, 17 aa, Entamoeba invadens
ILPTIVSMYLRAINVVE

SEQ ID NO: 3000806 - protein, 25 aa, Entamoeba invadens
ILQEFVKYVDVIQKIPYSCFFTISQ

SEQ ID NO: 3000807 - protein, 17 aa, Entamoeba invadens
ILQEIKLPATLKFVGDN

SEQ ID NO: 3000808 - protein, 26 aa, Entamoeba invadens
ILQHINHPFIVKLHYAFQSPEKLYMV

SEQ ID NO: 3000809 - protein, 25 aa, Entamoeba invadens
ILQKMKLPTNLRKLEKWAVSVVDIP

SEQ ID NO: 3000810 - protein, 18 aa, Entamoeba invadens
ILQNGWTYATDLWSVGCT

SEQ ID NO: 3000811 - protein, 25 aa, Entamoeba invadens
ILQSLFQAYYEYPALFMSLDDSDST

SEQ ID NO: 3000812 - protein, 19 aa, Entamoeba invadens
ILQVDWYIRLLVQHDFNRI

SEQ ID NO: 3000813 - protein, 18 aa, Entamoeba invadens
ILRCIDTLMRQIPFVAYP

SEQ ID NO: 3000814 - protein, 17 aa, Entamoeba invadens
ILRLELYRLTHVGKIGT

SEQ ID NO: 3000815 - protein, 20 aa, Entamoeba invadens
ILRNQLLKDINLILTKINSL

SEQ ID NO: 3000816 - protein, 29 aa, Entamoeba invadens
ILSEAKGDFLFTEKPFALNFGRVQPKCFS

SEQ ID NO: 3000817 - protein, 21 aa, Entamoeba invadens
ILSEMFLMDKGYPSQNLRFVA

SEQ ID NO: 3000818 - protein, 21 aa, Entamoeba invadens
ILSFQLLDKFIVVQLSNLDVV

SEQ ID NO: 3000819 - protein, 24 aa, Entamoeba invadens
ILSGDAMRLYLLVDATGLVQDAKY

SEQ ID NO: 3000820 - protein, 18 aa, Entamoeba invadens
ILSLLKILQIPNVTVDFK

SEQ ID NO: 3000821 - protein, 30 aa, Entamoeba invadens
ILSLNKFFENYLFLTFKTYAIVLSVDSPNS

SEQ ID NO: 3000822 - protein, 17 aa, Entamoeba invadens
ILSLRNCVGNKWTLISE

SEQ ID NO: 3000823 - protein, 26 aa, Entamoeba invadens
ILSLSKLKHRIFAVEYFIKVAQEMKE

SEQ ID NO: 3000824 - protein, 30 aa, Entamoeba invadens
ILSNLPPVYTYFYLCVIVSSDGFVKISVLV

SEQ ID NO: 3000825 - protein, 17 aa, Entamoeba invadens
ILSSAGTYEMSFVQAGL

SEQ ID NO: 3000826 - protein, 20 aa, Entamoeba invadens
ILSTTELLFNIGTTTLMING

SEQ ID NO: 3000827 - protein, 18 aa, Entamoeba invadens
ILSTVWIFNSFSPQILHH

SEQ ID NO: 3000828 - protein, 17 aa, Entamoeba invadens
ILSVCDVVPFYQRKYRY

SEQ ID NO: 3000829 - protein, 17 aa, Entamoeba invadens
ILTCQKAKVVLSSFFVL

SEQ ID NO: 3000830 - protein, 24 aa, Entamoeba invadens
ILTEALFTYNRMFPTNNPHVVVVG

SEQ ID NO: 3000831 - protein, 19 aa, Entamoeba invadens
ILTETLAKMLDWYSLLYSN

SEQ ID NO: 3000832 - protein, 17 aa, Entamoeba invadens
ILTKFVEYIRMKARILI

SEQ ID NO: 3000833 - protein, 18 aa, Entamoeba invadens
ILTLNILDFSFKTAYFFA

SEQ ID NO: 3000834 - protein, 18 aa, Entamoeba invadens
ILTVAKYFLSISDFIILS

SEQ ID NO: 3000835 - protein, 17 aa, Entamoeba invadens
ILVDSIKFGPLPEMSRA

SEQ ID NO: 3000836 - protein, 18 aa, Entamoeba invadens
ILVIVNYVETLITSNSPK

SEQ ID NO: 3000837 - protein, 19 aa, Entamoeba invadens
ILVNILSATFKYISLPTNL

SEQ ID NO: 3000838 - protein, 20 aa, Entamoeba invadens
ILVTTLYLKFSSFPKYQRDG

SEQ ID NO: 3000839 - protein, 21 aa, Entamoeba invadens
ILWNAADGAVLKRFALGTAVE

SEQ ID NO: 3000840 - protein, 18 aa, Entamoeba invadens
ILYCEVGGIVITLGLHEN

SEQ ID NO: 3000841 - protein, 28 aa, Entamoeba invadens
ILYESQGLVPLLRLEWNKVDPNFIATFA

SEQ ID NO: 3000842 - protein, 17 aa, Entamoeba invadens
ILYLFLADDCDEEDYKK

SEQ ID NO: 3000843 - protein, 19 aa, Entamoeba invadens
ILYPDSNKMIISVFSAFWM

SEQ ID NO: 3000844 - protein, 24 aa, Entamoeba invadens
IMALYKVYKNVYLPSPPTIGVFLQ

SEQ ID NO: 3000845 - protein, 18 aa, Entamoeba invadens
IMARALKPFDEDGLIPVF

SEQ ID NO: 3000846 - protein, 17 aa, Entamoeba invadens
IMAVTLTPGVTVGMKMF

SEQ ID NO: 3000847 - protein, 17 aa, Entamoeba invadens
IMDDQTHFVFTLRNSKD

SEQ ID NO: 3000848 - protein, 17 aa, Entamoeba invadens
IMDFLLIGETFNEKDVK

SEQ ID NO: 3000849 - protein, 24 aa, Entamoeba invadens
IMDKLKMIGTFRKATEKDLRLSLQ

SEQ ID NO: 3000850 - protein, 24 aa, Entamoeba invadens
IMDKNYYEIAIAPLPERVINEQNE

SEQ ID NO: 3000851 - protein, 19 aa, Entamoeba invadens
IMDPGMYLVCYYRTLNVTT

SEQ ID NO: 3000852 - protein, 18 aa, Entamoeba invadens
IMDPLVELNGHIYSLYCI

SEQ ID NO: 3000853 - protein, 27 aa, Entamoeba invadens
IMEPKLYVPFMKRVIPVLFRIASMCYG

SEQ ID NO: 3000854 - protein, 19 aa, Entamoeba invadens
IMFHIDFGYILGKECKPFP

SEQ ID NO: 3000855 - protein, 17 aa, Entamoeba invadens
IMFIITSTDKDIFGSFH

SEQ ID NO: 3000856 - protein, 25 aa, Entamoeba invadens
IMFNNERPFAVLLPSGLKTLSVEGT

SEQ ID NO: 3000857 - protein, 27 aa, Entamoeba invadens
IMGTPFSRMFFYIRDLMKYLQTIGAES

SEQ ID NO: 3000858 - protein, 17 aa, Entamoeba invadens
IMIISRYFATIKDFVNL

SEQ ID NO: 3000859 - protein, 17 aa, Entamoeba invadens
IMIVCKYLNTFSDLVNI

SEQ ID NO: 3000860 - protein, 18 aa, Entamoeba invadens
IMIVSIYFETIKDYINLE

SEQ ID NO: 3000861 - protein, 20 aa, Entamoeba invadens
IMIVSKYFAIIKDFINLEFV

SEQ ID NO: 3000862 - protein, 20 aa, Entamoeba invadens
IMIVSKYFDDFRDFINLELV

SEQ ID NO: 3000863 - protein, 18 aa, Entamoeba invadens
IMIVSKYLETVRDFINLE

SEQ ID NO: 3000864 - protein, 17 aa, Entamoeba invadens
IMIVSKYLKTIIDFIKL

SEQ ID NO: 3000865 - protein, 21 aa, Entamoeba invadens
IMKAFGANLILTEGKLGMPGA

SEQ ID NO: 3000866 - protein, 25 aa, Entamoeba invadens
IMKAKRLLLLAFSEGKAKIIAKAIE

SEQ ID NO: 3000867 - protein, 26 aa, Entamoeba invadens
IMKCDVDIRKDLYGNIFLSGGNQSKN

SEQ ID NO: 3000868 - protein, 25 aa, Entamoeba invadens
IMKEKYIFESALHDFIIAKIINAER

SEQ ID NO: 3000869 - protein, 26 aa, Entamoeba invadens
IMKPQPKWFHLYKYLSSTSNNKVFID

SEQ ID NO: 3000870 - protein, 25 aa, Entamoeba invadens
IMKSWKRKWVRLTKTDIFVFDNPTK

SEQ ID NO: 3000871 - protein, 19 aa, Entamoeba invadens
IMLASRPLPVDLGKYEVKW

SEQ ID NO: 3000872 - protein, 17 aa, Entamoeba invadens
IMLGLYTISSALDFLHQ

SEQ ID NO: 3000873 - protein, 30 aa, Entamoeba invadens
IMLSEFYDLPLTRKWWIEDFNVFMGGGRIA

SEQ ID NO: 3000874 - protein, 18 aa, Entamoeba invadens
IMMECSDNIRQTIEKEVY

SEQ ID NO: 3000875 - protein, 18 aa, Entamoeba invadens
IMMLVGNKCDIVEKVIST

SEQ ID NO: 3000876 - protein, 19 aa, Entamoeba invadens
IMMSGVVLSIEMSALKRKM

SEQ ID NO: 3000877 - protein, 25 aa, Entamoeba invadens
IMMSLPSFEYIIKTLRLTFENDNSN

SEQ ID NO: 3000878 - protein, 23 aa, Entamoeba invadens
IMNYLFLERCCSLVLQLYASIAY

SEQ ID NO: 3000879 - protein, 30 aa, Entamoeba invadens
IMPKCTLCGFNWFNAYYTPGVSRISTNIRD

SEQ ID NO: 3000880 - protein, 20 aa, Entamoeba invadens
IMPVQRVPRYRLLLEDLLKN

SEQ ID NO: 3000881 - protein, 22 aa, Entamoeba invadens
IMQQMYADYLFRNTLLLADGDG

SEQ ID NO: 3000882 - protein, 18 aa, Entamoeba invadens
IMQYLSLLRIEFCEVSML

SEQ ID NO: 3000883 - protein, 28 aa, Entamoeba invadens
IMREVDDILLLPNIADYLDPYVLESISM

SEQ ID NO: 3000884 - protein, 18 aa, Entamoeba invadens
IMRLLLSMQHPPQSVIKA

SEQ ID NO: 3000885 - protein, 17 aa, Entamoeba invadens
IMSAMMDVDLFRLHFML

SEQ ID NO: 3000886 - protein, 18 aa, Entamoeba invadens
IMSELPSFFVMLQAIISL

SEQ ID NO: 3000887 - protein, 25 aa, Entamoeba invadens
IMSIQKFFNGLQNHFTRMLLSESRV

SEQ ID NO: 3000888 - protein, 25 aa, Entamoeba invadens
IMSKTRFLQIVNSLRFDKFAGERIK

SEQ ID NO: 3000889 - protein, 19 aa, Entamoeba invadens
IMSLERRVMRIFSVNDGQD

SEQ ID NO: 3000890 - protein, 24 aa, Entamoeba invadens
IMTERKFIFLGESISLISDTIIAL

SEQ ID NO: 3000891 - protein, 27 aa, Entamoeba invadens
IMVDGTALFGILNYVSSLPFNKVLPEK

SEQ ID NO: 3000892 - protein, 17 aa, Entamoeba invadens
IMVVSKYLLTINDFINI

SEQ ID NO: 3000893 - protein, 19 aa, Entamoeba invadens
IMVVSQYFLSFTDFIALEM

SEQ ID NO: 3000894 - protein, 25 aa, Entamoeba invadens
IMYDKMLIVCEFVDTALLLSDQTKY

SEQ ID NO: 3000895 - protein, 17 aa, Entamoeba invadens
IMYLKTKDLSVFNYLSN

SEQ ID NO: 3000896 - protein, 34 aa, Entamoeba invadens
INAIEDQWFYDNKVNFWRNVYGFNMTPMRAQVLN

SEQ ID NO: 3000897 - protein, 17 aa, Entamoeba invadens
INAINLFSRYFSMKYIH

SEQ ID NO: 3000898 - protein, 20 aa, Entamoeba invadens
INAIYFNGEWNEPFHILPNK

SEQ ID NO: 3000899 - protein, 18 aa, Entamoeba invadens
INAKLQPIQYTLSVKDCD

SEQ ID NO: 3000900 - protein, 23 aa, Entamoeba invadens
INALRMFLRQLPNNANFDIISFG

SEQ ID NO: 3000901 - protein, 19 aa, Entamoeba invadens
INAMKISFEKKDLISYLRN

SEQ ID NO: 3000902 - protein, 29 aa, Entamoeba invadens
INAVRFGQYLKFYLLSRQYFDDIKSLSLS

SEQ ID NO: 3000903 - protein, 18 aa, Entamoeba invadens
INCFILTTRVGGLGINLT

SEQ ID NO: 3000904 - protein, 22 aa, Entamoeba invadens
INCFVKFLDYFDHYETCEDFKK

SEQ ID NO: 3000905 - protein, 25 aa, Entamoeba invadens
INCKGKMLWVLSTLADVFVFSKTER

SEQ ID NO: 3000906 - protein, 17 aa, Entamoeba invadens
INCNQIMFQIRIYSETI

SEQ ID NO: 3000907 - protein, 17 aa, Entamoeba invadens
INCSYVLAMNREITLFP

SEQ ID NO: 3000908 - protein, 18 aa, Entamoeba invadens
INDCAISFQTPFFNFIMK

SEQ ID NO: 3000909 - protein, 26 aa, Entamoeba invadens
INDFELLFMDGTFSTAPKIFYQMYTI

SEQ ID NO: 3000910 - protein, 17 aa, Entamoeba invadens
INDFITISFVSKKYRNI

SEQ ID NO: 3000911 - protein, 19 aa, Entamoeba invadens
INDGLFVDHMRMCYTKIMC

SEQ ID NO: 3000912 - protein, 18 aa, Entamoeba invadens
INDIVFAIRDGKDELQFC

SEQ ID NO: 3000913 - protein, 18 aa, Entamoeba invadens
INDNFHFFFAHWSDVVRD

SEQ ID NO: 3000914 - protein, 25 aa, Entamoeba invadens
INDSFHLFNAIALFIGNIAFVNNNS

SEQ ID NO: 3000915 - protein, 38 aa, Entamoeba invadens
INDSKIFMFSYQPFSERELFFALLKQSIHDGTSIFKMG

SEQ ID NO: 3000916 - protein, 28 aa, Entamoeba invadens
INDSTILGFRMQWIAPFNASQKGNDKNT

SEQ ID NO: 3000917 - protein, 19 aa, Entamoeba invadens
INDTILKYLVVKLSQSPKA

SEQ ID NO: 3000918 - protein, 26 aa, Entamoeba invadens
INEDLRIKMFLWKTLQCDKDLGTVKN

SEQ ID NO: 3000919 - protein, 22 aa, Entamoeba invadens
INEGIFLTFDFGGGTLDTTCSS

SEQ ID NO: 3000920 - protein, 21 aa, Entamoeba invadens
INEGIFLTFDFGRGTLETTVA

SEQ ID NO: 3000921 - protein, 35 aa, Entamoeba invadens
INEHDQPFMYILYGWLIHLFVMNPSVNETFHVEEN

SEQ ID NO: 3000922 - protein, 25 aa, Entamoeba invadens
INEHTCLNVTVFHTFFDECNNLKKH

SEQ ID NO: 3000923 - protein, 25 aa, Entamoeba invadens
INEKPKLDAFDLLGMKPTQQPANTM

SEQ ID NO: 3000924 - protein, 25 aa, Entamoeba invadens
INENDIFYKYEKLLPKITNVINSIL

SEQ ID NO: 3000925 - protein, 26 aa, Entamoeba invadens
INEPLKKGGLVFDVKVTGPTTPADVQ

SEQ ID NO: 3000926 - protein, 27 aa, Entamoeba invadens
INERRYVHLYVKFFVKVRTAMAQVEAK

SEQ ID NO: 3000927 - protein, 27 aa, Entamoeba invadens
INERRYVQLYVKFFVKVRNAMLVVDTK

SEQ ID NO: 3000928 - protein, 25 aa, Entamoeba invadens
INERVKLVPLFQFFDSHLNQNIVYV

SEQ ID NO: 3000929 - protein, 28 aa, Entamoeba invadens
INETPRHFFCIIVWYKVSYEDAQINTTD

SEQ ID NO: 3000930 - protein, 29 aa, Entamoeba invadens
INEVKKPIFLFLLKIVKKLILHFKSPTLI

SEQ ID NO: 3000931 - protein, 17 aa, Entamoeba invadens
INEVPYLYDVINSGFVK

SEQ ID NO: 3000932 - protein, 20 aa, Entamoeba invadens
INFELVKMPMLRELTLRIGD

SEQ ID NO: 3000933 - protein, 28 aa, Entamoeba invadens
INFNVIQALAVFYLTETVWLFEGAKTTQ

SEQ ID NO: 3000934 - protein, 17 aa, Entamoeba invadens
INFPTTLKCFDKNILVE

SEQ ID NO: 3000935 - protein, 32 aa, Entamoeba invadens
INFQQYLANTLPFTLLSFIKKIEKFFESGTYT

SEQ ID NO: 3000936 - protein, 26 aa, Entamoeba invadens
INFQYKIPEWFLKMLTITSKQDRGPK

SEQ ID NO: 3000937 - protein, 19 aa, Entamoeba invadens
INFSKIHYSPFDSASLNVL

SEQ ID NO: 3000938 - protein, 21 aa, Entamoeba invadens
INFYQIKVWCSVTYICVHIHK

SEQ ID NO: 3000939 - protein, 19 aa, Entamoeba invadens
INGALMNSFSYFKKWTGLS

SEQ ID NO: 3000940 - protein, 24 aa, Entamoeba invadens
INGKKLLLKLLSNCNYHYQAVFSL

SEQ ID NO: 3000941 - protein, 21 aa, Entamoeba invadens
INGLIQYLHEKICIGYLCIWC

SEQ ID NO: 3000942 - protein, 23 aa, Entamoeba invadens
INGNFAQICGVFMKIYADYMRKA

SEQ ID NO: 3000943 - protein, 22 aa, Entamoeba invadens
INGSKIAAMRRNGEIEKSDVRR

SEQ ID NO: 3000944 - protein, 38 aa, Entamoeba invadens
INGSPATMEVFLISLLLGLPLLAPHRKIVIDLATNFLP

SEQ ID NO: 3000945 - protein, 26 aa, Entamoeba invadens
INGVQFFDYMLFRREPITLSSFLFQF

SEQ ID NO: 3000946 - protein, 22 aa, Entamoeba invadens
INHAQIRFLAINYSNEDPYLVA

SEQ ID NO: 3000947 - protein, 27 aa, Entamoeba invadens
INHLNPYLRGQLLKSVTHEFLMKEFNV

SEQ ID NO: 3000948 - protein, 24 aa, Entamoeba invadens
INHNHFEFTVTLALLTRTDTKTDQ

SEQ ID NO: 3000949 - protein, 21 aa, Entamoeba invadens
INIDELFVALGRKLLQINHKG

SEQ ID NO: 3000950 - protein, 24 aa, Entamoeba invadens
INIKVKDLLNKIPVFFLEVNDMTK

SEQ ID NO: 3000951 - protein, 17 aa, Entamoeba invadens
INIMCVCKNFRQTCLTF

SEQ ID NO: 3000952 - protein, 23 aa, Entamoeba invadens
INISLPLCLFKRPPTKMICLNAQ

SEQ ID NO: 3000953 - protein, 33 aa, Entamoeba invadens
INIVKSINNVLYFKAIILGVKLALLDKESDYDK

SEQ ID NO: 3000954 - protein, 17 aa, Entamoeba invadens
INKDLDIPLTTKSAGLP

SEQ ID NO: 3000955 - protein, 24 aa, Entamoeba invadens
INKHVVLAIVYNPIQEELFTALRG

SEQ ID NO: 3000956 - protein, 17 aa, Entamoeba invadens
INKIFERCIKEDIALLY

SEQ ID NO: 3000957 - protein, 19 aa, Entamoeba invadens
INKLLMTHLKKKVTLQYPK

SEQ ID NO: 3000958 - protein, 23 aa, Entamoeba invadens
INKLQKYHILSTDDFVKVKQPNL

SEQ ID NO: 3000959 - protein, 28 aa, Entamoeba invadens
INKMKFPKMIFLRKCDANMWSNQPIWSD

SEQ ID NO: 3000960 - protein, 24 aa, Entamoeba invadens
INKNCFFDCKNLQYVNIPLGVTKI

SEQ ID NO: 3000961 - protein, 25 aa, Entamoeba invadens
INKNCLWYIFDYLNLVVKHNEVNLM

SEQ ID NO: 3000962 - protein, 27 aa, Entamoeba invadens
INKSMFPLPQFSIVLWTNLPMINSELY

SEQ ID NO: 3000963 - protein, 18 aa, Entamoeba invadens
INKTDFFFTTLWSDLDVG

SEQ ID NO: 3000964 - protein, 28 aa, Entamoeba invadens
INLALPVFHIGFFRPIIQVLQCVCKNCN

SEQ ID NO: 3000965 - protein, 24 aa, Entamoeba invadens
INLDLKIRIMEQCCLGVQWLHNAF

SEQ ID NO: 3000966 - protein, 24 aa, Entamoeba invadens
INLEIETFALFKEPREALYSSIFN

SEQ ID NO: 3000967 - protein, 21 aa, Entamoeba invadens
INLFADLLLCPQEVEVYNVLS

SEQ ID NO: 3000968 - protein, 19 aa, Entamoeba invadens
INLFLEKHGILNCTNFIIV

SEQ ID NO: 3000969 - protein, 19 aa, Entamoeba invadens
INLIVQKYPHLFSVQLRTF

SEQ ID NO: 3000970 - protein, 25 aa, Entamoeba invadens
INLLPSHFHQLLRFISVEVANKNSP

SEQ ID NO: 3000971 - protein, 26 aa, Entamoeba invadens
INLPADLLVMITYIEKMDMFYDNIDQ

SEQ ID NO: 3000972 - protein, 26 aa, Entamoeba invadens
INLPKDLIVMISYIGKMELYYDLINK

SEQ ID NO: 3000973 - protein, 24 aa, Entamoeba invadens
INLVECRLFLTKLIAVLNRGDTFT

SEQ ID NO: 3000974 - protein, 19 aa, Entamoeba invadens
INLVIPPTKFTCEENCFYQ

SEQ ID NO: 3000975 - protein, 17 aa, Entamoeba invadens
INLVKFINNRNLSVGKG

SEQ ID NO: 3000976 - protein, 18 aa, Entamoeba invadens
INMGRYFVPSEIPCGCVC

SEQ ID NO: 3000977 - protein, 17 aa, Entamoeba invadens
INMKLKDSWNSHSELIV

SEQ ID NO: 3000978 - protein, 20 aa, Entamoeba invadens
INMVFVCKKFEEIPAMFHFN

SEQ ID NO: 3000979 - protein, 34 aa, Entamoeba invadens
INNEMDLFMVSKALLPCIVLFPDVYKTVKNTAIA

SEQ ID NO: 3000980 - protein, 23 aa, Entamoeba invadens
INNGLCLICASGTFYNETEKTCQ

SEQ ID NO: 3000981 - protein, 22 aa, Entamoeba invadens
INNKLKVFVTDSYTAGTFGGLI

SEQ ID NO: 3000982 - protein, 22 aa, Entamoeba invadens
INNLKPFPLVLEKKKIPIGMYQ

SEQ ID NO: 3000983 - protein, 28 aa, Entamoeba invadens
INNLKTAFILIPGSHLFYFSSSEKRVIS

SEQ ID NO: 3000984 - protein, 18 aa, Entamoeba invadens
INNLYKFTGLKKIDAINT

SEQ ID NO: 3000985 - protein, 23 aa, Entamoeba invadens
INNNSFSPVIKPLVNLLTTTNTN

SEQ ID NO: 3000986 - protein, 18 aa, Entamoeba invadens
INNPFKSGFFFGRTDKFV

SEQ ID NO: 3000987 - protein, 19 aa, Entamoeba invadens
INNRFFPKVIHLINSRQPN

SEQ ID NO: 3000988 - protein, 26 aa, Entamoeba invadens
INNTIHDLWDGIYIANDITDVKIIAD

SEQ ID NO: 3000989 - protein, 25 aa, Entamoeba invadens
INPESYITLIRQFYRPFSVQQDNIL

SEQ ID NO: 3000990 - protein, 17 aa, Entamoeba invadens
INPFNLPQSTPIQKIVI

SEQ ID NO: 3000991 - protein, 18 aa, Entamoeba invadens
INPLFHPITPRTELTEQK

SEQ ID NO: 3000992 - protein, 23 aa, Entamoeba invadens
INPLRVVVRNVPRAVTNDELRSL

SEQ ID NO: 3000993 - protein, 24 aa, Entamoeba invadens
INPNLAEFVNFYYTTNHDETIEKL

SEQ ID NO: 3000994 - protein, 31 aa, Entamoeba invadens
INPNYYSQKAYLWYVKHFMPDTIDFKELNII

SEQ ID NO: 3000995 - protein, 23 aa, Entamoeba invadens
INPQLEILVKLKTTILYGLTSQQ

SEQ ID NO: 3000996 - protein, 22 aa, Entamoeba invadens
INQAVIILGLLKELFVKYIQRS

SEQ ID NO: 3000997 - protein, 26 aa, Entamoeba invadens
INQIDTLCYLCDLKTMLLNGVCNVKN

SEQ ID NO: 3000998 - protein, 27 aa, Entamoeba invadens
INRNEQLIILLHYFNNKVMNIFGKEHF

SEQ ID NO: 3000999 - protein, 24 aa, Entamoeba invadens
INRVATYEVIPSASALILKALKEP

SEQ ID NO: 3001000 - protein, 24 aa, Entamoeba invadens
INSEIIICADCCPESYIILIASLI

SEQ ID NO: 3001001 - protein, 27 aa, Entamoeba invadens
INSENGPIPIAFFLDDMDDEDKDVQRK

SEQ ID NO: 3001002 - protein, 25 aa, Entamoeba invadens
INSLTMFIHKLIFQSFPSNTTSAPQ

SEQ ID NO: 3001003 - protein, 18 aa, Entamoeba invadens
INSLYTKLFTMKPTLFDE

SEQ ID NO: 3001004 - protein, 28 aa, Entamoeba invadens
INSPPTIIALGKYFHFLLSSNNFLEVEK

SEQ ID NO: 3001005 - protein, 25 aa, Entamoeba invadens
INSSSKRFFLFGMKNQWDEARFYDR

SEQ ID NO: 3001006 - protein, 25 aa, Entamoeba invadens
INSSSLPYTFLLDDSLTISNEAVSV

SEQ ID NO: 3001007 - protein, 26 aa, Entamoeba invadens
INSSTSFLFSIIRNGIFKPKKFDLIG

SEQ ID NO: 3001008 - protein, 27 aa, Entamoeba invadens
INSTLMKYYALMPSMMFIYETDVASFG

SEQ ID NO: 3001009 - protein, 25 aa, Entamoeba invadens
INSTTQTPYLLWTNKMRSELVDYVD

SEQ ID NO: 3001010 - protein, 24 aa, Entamoeba invadens
INSVKGFLIAILCGEYLFGVVVTK

SEQ ID NO: 3001011 - protein, 20 aa, Entamoeba invadens
INSYSFFRMSQFRNFCFFKC

SEQ ID NO: 3001012 - protein, 29 aa, Entamoeba invadens
INTALGCVTCTSGYYLYHKECAPCSDNCN

SEQ ID NO: 3001013 - protein, 24 aa, Entamoeba invadens
INTDYYTLFIQKQCTVLLLNNKNI

SEQ ID NO: 3001014 - protein, 38 aa, Entamoeba invadens
INTEYFPQQLGPSFYEQYQLEKAIFSFPNRLPGLKTAS

SEQ ID NO: 3001015 - protein, 37 aa, Entamoeba invadens
INTFKTFFFDNVIVDYKFYLQMYALGYTFHNVDYTQQ

SEQ ID NO: 3001016 - protein, 19 aa, Entamoeba invadens
INTFYGCSRLKEIRLPKLV

SEQ ID NO: 3001017 - protein, 23 aa, Entamoeba invadens
INTLNVFFTVKKSIFPTFTHKLI

SEQ ID NO: 3001018 - protein, 34 aa, Entamoeba invadens
INTLPPTYLASFQSTLYLINSRPLAVSSAYIAYP

SEQ ID NO: 3001019 - protein, 23 aa, Entamoeba invadens
INTNNYLKLLTKIKLLNSKISGR

SEQ ID NO: 3001020 - protein, 18 aa, Entamoeba invadens
INTNYSIVNYLLCKNWSS

SEQ ID NO: 3001021 - protein, 34 aa, Entamoeba invadens
INTYQKMMHLLQDTIIYNPLFIGRKFEKTRKFKP

SEQ ID NO: 3001022 - protein, 17 aa, Entamoeba invadens
INVAMFFECKSLCQISL

SEQ ID NO: 3001023 - protein, 26 aa, Entamoeba invadens
INVDPTKMLLFKSELKFIDNYIKTSV

SEQ ID NO: 3001024 - protein, 31 aa, Entamoeba invadens
INVFIEDHWKLLSKLKLFKSPNYRKALLDAF

SEQ ID NO: 3001025 - protein, 18 aa, Entamoeba invadens
INVFKILSPLFNKNTSRN

SEQ ID NO: 3001026 - protein, 17 aa, Entamoeba invadens
INVFNLDKKEVITSIVV

SEQ ID NO: 3001027 - protein, 24 aa, Entamoeba invadens
INVIRRYCHGVFEPTYRATIGVDF

SEQ ID NO: 3001028 - protein, 25 aa, Entamoeba invadens
INVKSQYILPFTFYVDTKPVCAFTA

SEQ ID NO: 3001029 - protein, 24 aa, Entamoeba invadens
INVLSSLFRYNSLQTNLYVAKCMT

SEQ ID NO: 3001030 - protein, 38 aa, Entamoeba invadens
INVNERLLHQMLWFGDYSYYSHRLIYHKDTLKIETPTF

SEQ ID NO: 3001031 - protein, 25 aa, Entamoeba invadens
INVQKEWFNFLFKTIDKKCMEKNSS

SEQ ID NO: 3001032 - protein, 26 aa, Entamoeba invadens
INVSELFDLVARKLPKTEKGLIDQDE

SEQ ID NO: 3001033 - protein, 20 aa, Entamoeba invadens
INWTAVLIKSGAGAIIGAIA

SEQ ID NO: 3001034 - protein, 26 aa, Entamoeba invadens
INYASLDSYLYNYKITEGTLNDTTTN

SEQ ID NO: 3001035 - protein, 23 aa, Entamoeba invadens
INYDFLMDIIKLLEQLLTKKADG

SEQ ID NO: 3001036 - protein, 17 aa, Entamoeba invadens
INYLLNYDYPGSNIGPE

SEQ ID NO: 3001037 - protein, 20 aa, Entamoeba invadens
INYSEFNNLCKLLPAKWECP

SEQ ID NO: 3001038 - protein, 20 aa, Entamoeba invadens
IPAIEYSMHVIALKSSPNPE

SEQ ID NO: 3001039 - protein, 17 aa, Entamoeba invadens
IPAMITTTAVVSGLQCI

SEQ ID NO: 3001040 - protein, 24 aa, Entamoeba invadens
IPAWCFGKCFSLRIVSLPKSVERI

SEQ ID NO: 3001041 - protein, 22 aa, Entamoeba invadens
IPCCAFLRCYRLNEIKVPQSVT

SEQ ID NO: 3001042 - protein, 20 aa, Entamoeba invadens
IPCFEGTIGGLRIIGRLAVG

SEQ ID NO: 3001043 - protein, 17 aa, Entamoeba invadens
IPCTVSIKYTYEPRSEK

SEQ ID NO: 3001044 - protein, 26 aa, Entamoeba invadens
IPDCCFMLCIRLKAIDLKNVCVLGQN

SEQ ID NO: 3001045 - protein, 23 aa, Entamoeba invadens
IPDCYKLLMFQDPSHLFMIKVCD

SEQ ID NO: 3001046 - protein, 18 aa, Entamoeba invadens
IPDFVKDLSISWYTNERH

SEQ ID NO: 3001047 - protein, 19 aa, Entamoeba invadens
IPDGFGINPLLADLISKLI

SEQ ID NO: 3001048 - protein, 28 aa, Entamoeba invadens
IPDIAITSLPVFSSCSSLLFCSRRLFDM

SEQ ID NO: 3001049 - protein, 25 aa, Entamoeba invadens
IPDKCFYMCANLKEIDLKHIRMFGE

SEQ ID NO: 3001050 - protein, 25 aa, Entamoeba invadens
IPDQARGIFIDWKGPKAKGMLKVRV

SEQ ID NO: 3001051 - protein, 24 aa, Entamoeba invadens
IPDSRFCIEFIYRLVSLDSNDKYV

SEQ ID NO: 3001052 - protein, 31 aa, Entamoeba invadens
IPDTKKGGLSKDFLWTFVLNNENEFDEAKCV

SEQ ID NO: 3001053 - protein, 23 aa, Entamoeba invadens
IPDTVTVFNFLKKLSFACNKIVQ

SEQ ID NO: 3001054 - protein, 24 aa, Entamoeba invadens
IPEGPGRVKFLLKLNEMRIQKEKE

SEQ ID NO: 3001055 - protein, 23 aa, Entamoeba invadens
IPEGTFMGCSMLNNALRTQKVET

SEQ ID NO: 3001056 - protein, 17 aa, Entamoeba invadens
IPELPEKFSLLTNLEML

SEQ ID NO: 3001057 - protein, 21 aa, Entamoeba invadens
IPEMIGLNLLLQCLDMYEKEI

SEQ ID NO: 3001058 - protein, 21 aa, Entamoeba invadens
IPEMKIDLQAFTTPLDIKKTS

SEQ ID NO: 3001059 - protein, 30 aa, Entamoeba invadens
IPERKVKYPLWMLVLLESVGKLGKTFESAL

SEQ ID NO: 3001060 - protein, 35 aa, Entamoeba invadens
IPESQLIFRFDFKQIFGWYPDFFQFHAKNMMRLYM

SEQ ID NO: 3001061 - protein, 24 aa, Entamoeba invadens
IPEVINCYVPSYSITLFGGNDMEP

SEQ ID NO: 3001062 - protein, 29 aa, Entamoeba invadens
IPEVKKMLRKVFPDRPLLEREDSNLVIAK

SEQ ID NO: 3001063 - protein, 25 aa, Entamoeba invadens
IPEVLVNLLIRVIMEYLILDNTLQN

SEQ ID NO: 3001064 - protein, 17 aa, Entamoeba invadens
IPFAKSEAIWKIVTEVI

SEQ ID NO: 3001065 - protein, 17 aa, Entamoeba invadens
IPFGLEKALKYLYTSGI

SEQ ID NO: 3001066 - protein, 19 aa, Entamoeba invadens
IPFHFIKPFQHYETFIGEA

SEQ ID NO: 3001067 - protein, 17 aa, Entamoeba invadens
IPFNCYTSFIQIGKLEG

SEQ ID NO: 3001068 - protein, 26 aa, Entamoeba invadens
IPGCLIPEKAIYTFEKWEKKLKEITN

SEQ ID NO: 3001069 - protein, 22 aa, Entamoeba invadens
IPGIDTVYITLLNQGIKDSPYK

SEQ ID NO: 3001070 - protein, 25 aa, Entamoeba invadens
IPGSMKRALAKKNIKFYTIDAIKIG

SEQ ID NO: 3001071 - protein, 18 aa, Entamoeba invadens
IPGTPYFKAIIHQNFENS

SEQ ID NO: 3001072 - protein, 26 aa, Entamoeba invadens
IPGTPYFRAILSLKKPRRVTLRFVRN

SEQ ID NO: 3001073 - protein, 20 aa, Entamoeba invadens
IPGYFKYVIKYEIDYQKYLK

SEQ ID NO: 3001074 - protein, 25 aa, Entamoeba invadens
IPHCTFLNCYNLKEIVFPETLKTIE

SEQ ID NO: 3001075 - protein, 24 aa, Entamoeba invadens
IPHCTFMKCYNLKEIVLPETFKII

SEQ ID NO: 3001076 - protein, 20 aa, Entamoeba invadens
IPHCTFMKCYNLKEMVLPET

SEQ ID NO: 3001077 - protein, 17 aa, Entamoeba invadens
IPHHIYASSMAFEKLCV

SEQ ID NO: 3001078 - protein, 21 aa, Entamoeba invadens
IPHIIILVTGRYSTLYLRFLP

SEQ ID NO: 3001079 - protein, 17 aa, Entamoeba invadens
IPHQSVVAIYLPNVLEY

SEQ ID NO: 3001080 - protein, 27 aa, Entamoeba invadens
IPIAKRRYLEVILPSRSEAIWVNFDWT

SEQ ID NO: 3001081 - protein, 33 aa, Entamoeba invadens
IPIDGLPSIYRLLLPFYGKISEWLTLPQTTEPT

SEQ ID NO: 3001082 - protein, 24 aa, Entamoeba invadens
IPIDNPCVLLMQDTSKTFLTATRA

SEQ ID NO: 3001083 - protein, 17 aa, Entamoeba invadens
IPIFAFSHKRSLDMTDD

SEQ ID NO: 3001084 - protein, 17 aa, Entamoeba invadens
IPIGCFSLCENITKIVI

SEQ ID NO: 3001085 - protein, 18 aa, Entamoeba invadens
IPIIQARIVFLLKGGKTE

SEQ ID NO: 3001086 - protein, 17 aa, Entamoeba invadens
IPILLAGNKSDLEEERA

SEQ ID NO: 3001087 - protein, 23 aa, Entamoeba invadens
IPINKNIVWRVPLKDNDKSAGEI

SEQ ID NO: 3001088 - protein, 20 aa, Entamoeba invadens
IPITTEYLDFIGSPLQGAQN

SEQ ID NO: 3001089 - protein, 26 aa, Entamoeba invadens
IPKDKLEVIFLHFPDVSSINDAFFQK

SEQ ID NO: 3001090 - protein, 21 aa, Entamoeba invadens
IPKDMFKMHFAEELLAGIAMG

SEQ ID NO: 3001091 - protein, 18 aa, Entamoeba invadens
IPKKIYQVRPRSIDFANF

SEQ ID NO: 3001092 - protein, 18 aa, Entamoeba invadens
IPKLDYAQHKGSCGKVAI

SEQ ID NO: 3001093 - protein, 29 aa, Entamoeba invadens
IPKLGNIFVYRLPVECLIKPIMNCIKMYQ

SEQ ID NO: 3001094 - protein, 26 aa, Entamoeba invadens
IPKSLNNILAFLRKKLRKSTFFEDKL

SEQ ID NO: 3001095 - protein, 32 aa, Entamoeba invadens
IPKVMEFSRLKYLKLKWTTYFLNYNLECLEQL

SEQ ID NO: 3001096 - protein, 22 aa, Entamoeba invadens
IPKVVCFLNPTIFKLDNSCIIP

SEQ ID NO: 3001097 - protein, 19 aa, Entamoeba invadens
IPKVVQILQDFFNGKEINK

SEQ ID NO: 3001098 - protein, 19 aa, Entamoeba invadens
IPKYPKGICKFAVTFEITA

SEQ ID NO: 3001099 - protein, 18 aa, Entamoeba invadens
IPLAPIHNPASYSVIEVA

SEQ ID NO: 3001100 - protein, 28 aa, Entamoeba invadens
IPLEKFHREFRVKGCLIVLIGNGPFKNA

SEQ ID NO: 3001101 - protein, 17 aa, Entamoeba invadens
IPLIKTVSDLSIYLSSL

SEQ ID NO: 3001102 - protein, 18 aa, Entamoeba invadens
IPLKVKSIEYQCFFGCRS

SEQ ID NO: 3001103 - protein, 18 aa, Entamoeba invadens
IPLLNLERCWAYANDLTP

SEQ ID NO: 3001104 - protein, 25 aa, Entamoeba invadens
IPLRPSYRLVGVIDPFAVLQAGEVA

SEQ ID NO: 3001105 - protein, 26 aa, Entamoeba invadens
IPLTKKTLKHFPRVKTLNLWSENDEN

SEQ ID NO: 3001106 - protein, 18 aa, Entamoeba invadens
IPLTVFAEDIKTLRSAIE

SEQ ID NO: 3001107 - protein, 19 aa, Entamoeba invadens
IPLYEKFVYHLAEYNYKNI

SEQ ID NO: 3001108 - protein, 88 aa, Entamoeba invadens
IPMADLTKWVKMRTNSTDVDFVLKKSLCDGVVLAKLMNYLRPNTVDVSKFTEKHVQNVKLCLDAGYQLLNIPRLLDENYVADDKVDDF

SEQ ID NO: 3001109 - protein, 31 aa, Entamoeba invadens
IPMENYTCLKYMIALLYHLSLSEKSKMNANT

SEQ ID NO: 3001110 - protein, 17 aa, Entamoeba invadens
IPMGTRAFSYNPIVSVD

SEQ ID NO: 3001111 - protein, 22 aa, Entamoeba invadens
IPMLLVYPRPFLDTGNANFVAG

SEQ ID NO: 3001112 - protein, 21 aa, Entamoeba invadens
IPMRRFDETVPLLRSHKGPVT

SEQ ID NO: 3001113 - protein, 20 aa, Entamoeba invadens
IPMSIKRLEKLSGLLLSSNQ

SEQ ID NO: 3001114 - protein, 25 aa, Entamoeba invadens
IPNADKVVLLLPGVEIPGFDALATK

SEQ ID NO: 3001115 - protein, 22 aa, Entamoeba invadens
IPNFFSLKSCQLLTLLEIDHCD

SEQ ID NO: 3001116 - protein, 18 aa, Entamoeba invadens
IPNFQITSLWLTVSELIK

SEQ ID NO: 3001117 - protein, 17 aa, Entamoeba invadens
IPNFSPFSFFEGSLPLT

SEQ ID NO: 3001118 - protein, 21 aa, Entamoeba invadens
IPNGMTFFFDFGGGTLDTVVG

SEQ ID NO: 3001119 - protein, 25 aa, Entamoeba invadens
IPNGQLKAFPWNCLALMTTTGAKGS

SEQ ID NO: 3001120 - protein, 18 aa, Entamoeba invadens
IPNPKTAIAVISCLSFLA

SEQ ID NO: 3001121 - protein, 25 aa, Entamoeba invadens
IPNSLKIVISKLRSVNKPEDTLKML

SEQ ID NO: 3001122 - protein, 28 aa, Entamoeba invadens
IPPAIMKCMYTLYYTPQPIEGIFRKSPV

SEQ ID NO: 3001123 - protein, 23 aa, Entamoeba invadens
IPPELIIEAFRKLAPEEAILVLQ

SEQ ID NO: 3001124 - protein, 33 aa, Entamoeba invadens
IPPIPNEISYLLRDFLLQCFQKNPLARASSTSL

SEQ ID NO: 3001125 - protein, 23 aa, Entamoeba invadens
IPPLEMLTKLTALDLFQCFYHAG

SEQ ID NO: 3001126 - protein, 17 aa, Entamoeba invadens
IPPLVTKNKEYSPKSFM

SEQ ID NO: 3001127 - protein, 17 aa, Entamoeba invadens
IPPMMIIACNLNPVIHC

SEQ ID NO: 3001128 - protein, 25 aa, Entamoeba invadens
IPPNKKNTLWFKKTNYKVVKPFESN

SEQ ID NO: 3001129 - protein, 24 aa, Entamoeba invadens
IPPNNFINFYDDFKTRMKQMVEIF

SEQ ID NO: 3001130 - protein, 20 aa, Entamoeba invadens
IPPQYPTLAAINFLLRRKRI

SEQ ID NO: 3001131 - protein, 19 aa, Entamoeba invadens
IPQKYSFIHLPQTYEQLIN

SEQ ID NO: 3001132 - protein, 19 aa, Entamoeba invadens
IPQLEHSFYIVDGRDQMIF

SEQ ID NO: 3001133 - protein, 20 aa, Entamoeba invadens
IPQLKLSVLGFILPYVIDSM

SEQ ID NO: 3001134 - protein, 19 aa, Entamoeba invadens
IPQNIWLFCEPDGLRISRI

SEQ ID NO: 3001135 - protein, 21 aa, Entamoeba invadens
IPQRLFNTLTDSTQLFRLYVW

SEQ ID NO: 3001136 - protein, 25 aa, Entamoeba invadens
IPQVSPLPLFFPSKTVEYPVEIIKE

SEQ ID NO: 3001137 - protein, 21 aa, Entamoeba invadens
IPRQSRLFAASFEDLHDFVRP

SEQ ID NO: 3001138 - protein, 26 aa, Entamoeba invadens
IPRSQKYYIFIAPLTQINIDEYNFIG

SEQ ID NO: 3001139 - protein, 23 aa, Entamoeba invadens
IPRTQIMIIKTPKVSALTSPVTV

SEQ ID NO: 3001140 - protein, 26 aa, Entamoeba invadens
IPRVKDILLLFNVYLHQVHQKELIEI

SEQ ID NO: 3001141 - protein, 28 aa, Entamoeba invadens
IPSDNSTLPPPPFTLPVSVGNTLENSDL

SEQ ID NO: 3001142 - protein, 17 aa, Entamoeba invadens
IPSIPQPTLPQMPQMNQ

SEQ ID NO: 3001143 - protein, 29 aa, Entamoeba invadens
IPSIPVLQSNVVIPPIQLQGVVQPTYPHK

SEQ ID NO: 3001144 - protein, 24 aa, Entamoeba invadens
IPSKVVYLDNGVLFWGSSGGNSYL

SEQ ID NO: 3001145 - protein, 18 aa, Entamoeba invadens
IPSLKELGAPLTTPSATS

SEQ ID NO: 3001146 - protein, 20 aa, Entamoeba invadens
IPSLRRYEQILKDWTCANSM

SEQ ID NO: 3001147 - protein, 20 aa, Entamoeba invadens
IPSPLVRFIHAAHLVVIDGV

SEQ ID NO: 3001148 - protein, 25 aa, Entamoeba invadens
IPSQCFFECKLLSKVTLHDSVECLC

SEQ ID NO: 3001149 - protein, 26 aa, Entamoeba invadens
IPSSWPFEVFPFILQHRSHSIPTLNI

SEQ ID NO: 3001150 - protein, 18 aa, Entamoeba invadens
IPSYIRESRVAVVVYDIS

SEQ ID NO: 3001151 - protein, 25 aa, Entamoeba invadens
IPSYYDILCFKPITEDALNFVLSKC

SEQ ID NO: 3001152 - protein, 17 aa, Entamoeba invadens
IPTFRSEDLPTFIVQII

SEQ ID NO: 3001153 - protein, 20 aa, Entamoeba invadens
IPTLLGLIASLYKENCKLKK

SEQ ID NO: 3001154 - protein, 23 aa, Entamoeba invadens
IPTNRPILPKIFSDSIYSQKEKW

SEQ ID NO: 3001155 - protein, 18 aa, Entamoeba invadens
IPVDCRFPYEFRAGKIKN

SEQ ID NO: 3001156 - protein, 17 aa, Entamoeba invadens
IPVFGFGAKKEGANELF

SEQ ID NO: 3001157 - protein, 25 aa, Entamoeba invadens
IPVIFDLIDFSPYNEIFIGGEWVEM

SEQ ID NO: 3001158 - protein, 18 aa, Entamoeba invadens
IPVLFTHKNFMAFVKKTS

SEQ ID NO: 3001159 - protein, 17 aa, Entamoeba invadens
IPVLLVGNKSDLLDEEN

SEQ ID NO: 3001160 - protein, 20 aa, Entamoeba invadens
IPVLPTLFRFGVSTFVELVG

SEQ ID NO: 3001161 - protein, 18 aa, Entamoeba invadens
IPVMSILLGAISNVYETS

SEQ ID NO: 3001162 - protein, 17 aa, Entamoeba invadens
IPVSFAKDALLYDTEKE

SEQ ID NO: 3001163 - protein, 19 aa, Entamoeba invadens
IPVSKTLCTLFPHIETQNI

SEQ ID NO: 3001164 - protein, 35 aa, Entamoeba invadens
IPWDKITVVSLYLLPEVLDLLYPLLEEKLHHTTLY

SEQ ID NO: 3001165 - protein, 34 aa, Entamoeba invadens
IPYCDLIQYKLFADEKMFLQFRENSKRVFLNGQP

SEQ ID NO: 3001166 - protein, 21 aa, Entamoeba invadens
IPYCIIEGLTFPEISQRLSRF

SEQ ID NO: 3001167 - protein, 32 aa, Entamoeba invadens
IPYKSSHFNVLFFKLLFRRIDGFIGDNPTPNH

SEQ ID NO: 3001168 - protein, 18 aa, Entamoeba invadens
IPYLGHWKDLLHFGFVNK

SEQ ID NO: 3001169 - protein, 19 aa, Entamoeba invadens
IPYVEFLGNGWTKKTKDLL

SEQ ID NO: 3001170 - protein, 17 aa, Entamoeba invadens
IPYYVRDAALAQVNAEV

SEQ ID NO: 3001171 - protein, 28 aa, Entamoeba invadens
IQAISFYLILPIQRIPRYELLIRDMLKD

SEQ ID NO: 3001172 - protein, 24 aa, Entamoeba invadens
IQANKVILKLPKVQQLKIVSPENK

SEQ ID NO: 3001173 - protein, 25 aa, Entamoeba invadens
IQARLVVIMKFKRVLKFSQLIAETT

SEQ ID NO: 3001174 - protein, 17 aa, Entamoeba invadens
IQATHVLWKPSVTRPRE

SEQ ID NO: 3001175 - protein, 18 aa, Entamoeba invadens
IQCTDGCMSIVYLKEPIK

SEQ ID NO: 3001176 - protein, 21 aa, Entamoeba invadens
IQDFCNLLVGTWKLNQRVFGF

SEQ ID NO: 3001177 - protein, 31 aa, Entamoeba invadens
IQDGNHYMAINFMPQFKGKSIIEIRYEDYKA

SEQ ID NO: 3001178 - protein, 18 aa, Entamoeba invadens
IQDLIKLMSDPMSKHVIV

SEQ ID NO: 3001179 - protein, 29 aa, Entamoeba invadens
IQDSTPSHLFIQTPFFEYKPNQQFHIQQI

SEQ ID NO: 3001180 - protein, 25 aa, Entamoeba invadens
IQDTTQLLLYTFIEPLKFSEVSTSL

SEQ ID NO: 3001181 - protein, 22 aa, Entamoeba invadens
IQDWFKNQLSFYRSSLEKYQND

SEQ ID NO: 3001182 - protein, 18 aa, Entamoeba invadens
IQDYWRMYVLDLKNITDD

SEQ ID NO: 3001183 - protein, 22 aa, Entamoeba invadens
IQEEFFFVGVILRSVQFSEIIL

SEQ ID NO: 3001184 - protein, 17 aa, Entamoeba invadens
IQEIKMESSPLSRLQNM

SEQ ID NO: 3001185 - protein, 18 aa, Entamoeba invadens
IQEIKYYDGFFGHRINPV

SEQ ID NO: 3001186 - protein, 18 aa, Entamoeba invadens
IQEMVPTQLLIPSKIIQE

SEQ ID NO: 3001187 - protein, 22 aa, Entamoeba invadens
IQEREMGMYRAMGGKKSLTELE

SEQ ID NO: 3001188 - protein, 24 aa, Entamoeba invadens
IQESYLLGLLNAFCSFTFEKPAKK

SEQ ID NO: 3001189 - protein, 28 aa, Entamoeba invadens
IQFAVEYSQILVLWRLKNDLFGYEKEIK

SEQ ID NO: 3001190 - protein, 24 aa, Entamoeba invadens
IQFIDPRIYVWRTEKRRRYILGEL

SEQ ID NO: 3001191 - protein, 20 aa, Entamoeba invadens
IQFPRTLIAIGDGAFYECVE

SEQ ID NO: 3001192 - protein, 20 aa, Entamoeba invadens
IQGEADLAFVRAKMTPLEDA

SEQ ID NO: 3001193 - protein, 25 aa, Entamoeba invadens
IQHFMYVVRCKTSMFYKTILADFVK

SEQ ID NO: 3001194 - protein, 18 aa, Entamoeba invadens
IQHIEAVDLDWNFVTPHS

SEQ ID NO: 3001195 - protein, 24 aa, Entamoeba invadens
IQHRKQIRALFKKTEDFLKSCPVK

SEQ ID NO: 3001196 - protein, 26 aa, Entamoeba invadens
IQHYRFNTTWYILDPLHLVTVNFQQR

SEQ ID NO: 3001197 - protein, 28 aa, Entamoeba invadens
IQIEMGQVTLFLPFNLISEMGGFIKRFP

SEQ ID NO: 3001198 - protein, 18 aa, Entamoeba invadens
IQIFKQRKFYRNEKDKNI

SEQ ID NO: 3001199 - protein, 18 aa, Entamoeba invadens
IQIFKQRKLYRNEKDKNI

SEQ ID NO: 3001200 - protein, 25 aa, Entamoeba invadens
IQIHKGGIFISDTINIIVVFNDYKD

SEQ ID NO: 3001201 - protein, 17 aa, Entamoeba invadens
IQIPTCFTNYKKVFKYP

SEQ ID NO: 3001202 - protein, 18 aa, Entamoeba invadens
IQISTADGFLIVYSITDR

SEQ ID NO: 3001203 - protein, 28 aa, Entamoeba invadens
IQITLPQYLLCLIIYKSRYFSLTNAEKV

SEQ ID NO: 3001204 - protein, 27 aa, Entamoeba invadens
IQKCVEMIWEKLGLIKTYLKSKSGDVD

SEQ ID NO: 3001205 - protein, 26 aa, Entamoeba invadens
IQKIEDFLVYFAVDLNLFEKTLEKDS

SEQ ID NO: 3001206 - protein, 20 aa, Entamoeba invadens
IQKKFGSYGLLYKSSRLKSD

SEQ ID NO: 3001207 - protein, 38 aa, Entamoeba invadens
IQKLRIFPYDIKNLAKYFYLNYLIIEQFNTIDLDKLKD

SEQ ID NO: 3001208 - protein, 27 aa, Entamoeba invadens
IQKLRMFPHKFQLIEVFPLLINEEDFS

SEQ ID NO: 3001209 - protein, 29 aa, Entamoeba invadens
IQKQICDFIAYKIIKYIDAGLEYCLEASE

SEQ ID NO: 3001210 - protein, 21 aa, Entamoeba invadens
IQKQILVTALPVLRFLAKNGH

SEQ ID NO: 3001211 - protein, 23 aa, Entamoeba invadens
IQKTPVWKLVDPFYFADAEENKR

SEQ ID NO: 3001212 - protein, 22 aa, Entamoeba invadens
IQKYGFPIVKLHNWEYKHKSNE

SEQ ID NO: 3001213 - protein, 28 aa, Entamoeba invadens
IQLDVLPSRRFLCCGPLYLVVNLVSRPT

SEQ ID NO: 3001214 - protein, 27 aa, Entamoeba invadens
IQLFELVCKYIFIRKTFGGAYGSLYTN

SEQ ID NO: 3001215 - protein, 18 aa, Entamoeba invadens
IQLLDIVCDLFTNTPTKA

SEQ ID NO: 3001216 - protein, 18 aa, Entamoeba invadens
IQLMSVRSDIPRIVCFEL

SEQ ID NO: 3001217 - protein, 18 aa, Entamoeba invadens
IQLYYKMRKDNETSFFVL

SEQ ID NO: 3001218 - protein, 51 aa, Entamoeba invadens
IQMNATLLMKFIEVQIKLLYPIAPHFSDYVWRDLLGNKTFLWNEKYPEICP

SEQ ID NO: 3001219 - protein, 24 aa, Entamoeba invadens
IQMNYGYPQPVYLVNYYPKDDNIY

SEQ ID NO: 3001220 - protein, 20 aa, Entamoeba invadens
IQMYRCLTSFLIDLKGFKPP

SEQ ID NO: 3001221 - protein, 27 aa, Entamoeba invadens
IQNDGKLFLVLFSRKSFIFFDSDMKFV

SEQ ID NO: 3001222 - protein, 28 aa, Entamoeba invadens
IQNIDMVIQILFINKKWQRVITTMKRMP

SEQ ID NO: 3001223 - protein, 24 aa, Entamoeba invadens
IQNKQRIIQTLSGIGRKMKEEQDT

SEQ ID NO: 3001224 - protein, 19 aa, Entamoeba invadens
IQNLMLRLGGMKSKINHLI

SEQ ID NO: 3001225 - protein, 27 aa, Entamoeba invadens
IQNRRGAISLICPCGLLPRLAELAMST

SEQ ID NO: 3001226 - protein, 17 aa, Entamoeba invadens
IQNVFSQKIDWNNPVDI

SEQ ID NO: 3001227 - protein, 24 aa, Entamoeba invadens
IQNVLNYPLSGLTLSLESIYSAID

SEQ ID NO: 3001228 - protein, 25 aa, Entamoeba invadens
IQPGPNKAIPGKPLVFLKSNTTSKP

SEQ ID NO: 3001229 - protein, 25 aa, Entamoeba invadens
IQPIILPFEGPFEMWVPFHVTNKRE

SEQ ID NO: 3001230 - protein, 17 aa, Entamoeba invadens
IQQALMVGLLTEAGFSF

SEQ ID NO: 3001231 - protein, 17 aa, Entamoeba invadens
IQQDILSIITFYMNSEN

SEQ ID NO: 3001232 - protein, 25 aa, Entamoeba invadens
IQQDKLVYLYSLPNNYIFSEFLVST

SEQ ID NO: 3001233 - protein, 28 aa, Entamoeba invadens
IQQGDEYFIPRLTFIKALSPSTFIVGDD

SEQ ID NO: 3001234 - protein, 36 aa, Entamoeba invadens
IQQNYSFQYKSIPMQLFYTISFKEKVEVIKFSPDEK

SEQ ID NO: 3001235 - protein, 24 aa, Entamoeba invadens
IQQRKQIRTLFKKSRRFLKELPSQ

SEQ ID NO: 3001236 - protein, 24 aa, Entamoeba invadens
IQQTMLLEMVLTGGNTLFDNLYDR

SEQ ID NO: 3001237 - protein, 18 aa, Entamoeba invadens
IQRALFATMSCLCLTIDV

SEQ ID NO: 3001238 - protein, 20 aa, Entamoeba invadens
IQRGLAVLDNLDKMGEAVFW

SEQ ID NO: 3001239 - protein, 19 aa, Entamoeba invadens
IQRICHFCATTSRIRAMAF

SEQ ID NO: 3001240 - protein, 19 aa, Entamoeba invadens
IQRISRHNCTKRKTTLLIW

SEQ ID NO: 3001241 - protein, 18 aa, Entamoeba invadens
IQRREVFTDIPKASFQKL

SEQ ID NO: 3001242 - protein, 27 aa, Entamoeba invadens
IQSIKKPALILFLETYPKFEDVHATFA

SEQ ID NO: 3001243 - protein, 31 aa, Entamoeba invadens
IQSKLLLKPRPIFCPFFQTHPVTIKITQNAT

SEQ ID NO: 3001244 - protein, 25 aa, Entamoeba invadens
IQSLEWHEFPLKECLMFGDVVFPLL

SEQ ID NO: 3001245 - protein, 27 aa, Entamoeba invadens
IQSLGTYPLRTFLKHNIKVTFNTDNTV

SEQ ID NO: 3001246 - protein, 18 aa, Entamoeba invadens
IQSLIPNGFVPTESPLLE

SEQ ID NO: 3001247 - protein, 19 aa, Entamoeba invadens
IQSNYIATFLRSQYSHLQE

SEQ ID NO: 3001248 - protein, 20 aa, Entamoeba invadens
IQTITFLRHLYDKCNYVGPH

SEQ ID NO: 3001249 - protein, 23 aa, Entamoeba invadens
IQTPKGVLLFGPPGTGKTLMARA

SEQ ID NO: 3001250 - protein, 25 aa, Entamoeba invadens
IQTPYTIWYTPVTGIWQTVWMEPVP

SEQ ID NO: 3001251 - protein, 23 aa, Entamoeba invadens
IQTQILLGTLKRKVDKRDIDFQR

SEQ ID NO: 3001252 - protein, 21 aa, Entamoeba invadens
IQTRKMVIAPTILDYQQKQEP

SEQ ID NO: 3001253 - protein, 28 aa, Entamoeba invadens
IQTTYNDPIYGIGWYKTRNNRMKAVVGS

SEQ ID NO: 3001254 - protein, 24 aa, Entamoeba invadens
IQTVQVKFAPLFPMNRNTPSDLEK

SEQ ID NO: 3001255 - protein, 24 aa, Entamoeba invadens
IQTYDLRSSFYSPTLSLTCDENAV

SEQ ID NO: 3001256 - protein, 19 aa, Entamoeba invadens
IQYLIARNTYDETLWQIFM

SEQ ID NO: 3001257 - protein, 23 aa, Entamoeba invadens
IQYMTDGMLLRAFLNAPDLKEYS

SEQ ID NO: 3001258 - protein, 27 aa, Entamoeba invadens
IRAKKENIFYFDMSYRAVPMSTKFIVL

SEQ ID NO: 3001259 - protein, 18 aa, Entamoeba invadens
IRALKRCTLVSHATLSRD

SEQ ID NO: 3001260 - protein, 19 aa, Entamoeba invadens
IRAMVNEKIYFNFYGKQKG

SEQ ID NO: 3001261 - protein, 21 aa, Entamoeba invadens
IRAVSFLPINITEKATRKFFA

SEQ ID NO: 3001262 - protein, 26 aa, Entamoeba invadens
IRCGAARIFYLQRAFKQSIKCFESAL

SEQ ID NO: 3001263 - protein, 21 aa, Entamoeba invadens
IRDFIKPFMLRRLKSDVQKEL

SEQ ID NO: 3001264 - protein, 21 aa, Entamoeba invadens
IRDIFRRYPNRYEKVIGTLCE

SEQ ID NO: 3001265 - protein, 19 aa, Entamoeba invadens
IRDIIVHPTLPYILTCSDD

SEQ ID NO: 3001266 - protein, 18 aa, Entamoeba invadens
IRDRERMLRRFLFDTTGE

SEQ ID NO: 3001267 - protein, 24 aa, Entamoeba invadens
IREAVRYLIKFLSTLNQFAVNINI

SEQ ID NO: 3001268 - protein, 19 aa, Entamoeba invadens
IREEGRKLLLKNNFKKEDL

SEQ ID NO: 3001269 - protein, 19 aa, Entamoeba invadens
IREFYTSLQPHILEQFQTA

SEQ ID NO: 3001270 - protein, 29 aa, Entamoeba invadens
IREHLLGAKIITFLLRVLDRCNRLDPEMK

SEQ ID NO: 3001271 - protein, 29 aa, Entamoeba invadens
IREIKDDLFVFCKALLYLHDDKISEALFT

SEQ ID NO: 3001272 - protein, 20 aa, Entamoeba invadens
IREKDGIWAALCWVSVLAGE

SEQ ID NO: 3001273 - protein, 17 aa, Entamoeba invadens
IREKRAYFPKKDKQLEC

SEQ ID NO: 3001274 - protein, 18 aa, Entamoeba invadens
IRELLHHLLKTISQPQKD

SEQ ID NO: 3001275 - protein, 24 aa, Entamoeba invadens
IREQCAYLFERVKAVLVRSTLMTQ

SEQ ID NO: 3001276 - protein, 18 aa, Entamoeba invadens
IRERPLFLPCVETCFQLI

SEQ ID NO: 3001277 - protein, 21 aa, Entamoeba invadens
IRETLVALYDEEFKLLRAPFD

SEQ ID NO: 3001278 - protein, 28 aa, Entamoeba invadens
IRFEETKYKILDLLKLVRIKSENVRFIP

SEQ ID NO: 3001279 - protein, 29 aa, Entamoeba invadens
IRFEPSIVTIPPKFACEFSLFLNPLCTST

SEQ ID NO: 3001280 - protein, 21 aa, Entamoeba invadens
IRFPKTYPVIYKTLRVDGELS

SEQ ID NO: 3001281 - protein, 20 aa, Entamoeba invadens
IRFVSKQDVLFRPNWIQLEQ

SEQ ID NO: 3001282 - protein, 24 aa, Entamoeba invadens
IRGKSAILIIYSLRDVGTLNEVDN

SEQ ID NO: 3001283 - protein, 25 aa, Entamoeba invadens
IRGVLFSCRQYFKVTVFLSRSCDDV

SEQ ID NO: 3001284 - protein, 18 aa, Entamoeba invadens
IRIETTSTYLYIPVSFES

SEQ ID NO: 3001285 - protein, 18 aa, Entamoeba invadens
IRKDMYAKNFLGILVHRV

SEQ ID NO: 3001286 - protein, 26 aa, Entamoeba invadens
IRKGCNLLVGTPGRLLDHIKSTQNLK

SEQ ID NO: 3001287 - protein, 20 aa, Entamoeba invadens
IRKLLCIDTFFPVEETISKF

SEQ ID NO: 3001288 - protein, 21 aa, Entamoeba invadens
IRKQIRFIKNRFIAQRNVLMY

SEQ ID NO: 3001289 - protein, 25 aa, Entamoeba invadens
IRKVNRLFFFVGRTIQFLSENILRE

SEQ ID NO: 3001290 - protein, 25 aa, Entamoeba invadens
IRKYKSFNVWKYCTEAFDYLGLAAI

SEQ ID NO: 3001291 - protein, 28 aa, Entamoeba invadens
IRLDPPHLLWVIPHLTSISVLQRFHQVS

SEQ ID NO: 3001292 - protein, 28 aa, Entamoeba invadens
IRLFTNEVLISFYVKFKSYFNRIKDDKG

SEQ ID NO: 3001293 - protein, 18 aa, Entamoeba invadens
IRLLISFARDMGFDIKTK

SEQ ID NO: 3001294 - protein, 19 aa, Entamoeba invadens
IRLLVQHDFNRIIPVLKTR

SEQ ID NO: 3001295 - protein, 27 aa, Entamoeba invadens
IRLSEALARLYLDKLVRIEYVKEATNL

SEQ ID NO: 3001296 - protein, 28 aa, Entamoeba invadens
IRLTQETLLKLMTFFGVEKKYMTVENVG

SEQ ID NO: 3001297 - protein, 33 aa, Entamoeba invadens
IRMIKDRLTIINTYLTVFRPNTQVMYSIYDVAD

SEQ ID NO: 3001298 - protein, 26 aa, Entamoeba invadens
IRMKDGHPFWYKFDDNWLFENSDIFV

SEQ ID NO: 3001299 - protein, 30 aa, Entamoeba invadens
IRMKNNQNNIFFALRGALDIQKEVTAKEII

SEQ ID NO: 3001300 - protein, 24 aa, Entamoeba invadens
IRMPQHKLIPNLYILMCQIVEIKQ

SEQ ID NO: 3001301 - protein, 30 aa, Entamoeba invadens
IRNIQSYVVYFFFPQPLSTTQIKFFEKIEE

SEQ ID NO: 3001302 - protein, 20 aa, Entamoeba invadens
IRNMSKLPKPSLHKMKGALV

SEQ ID NO: 3001303 - protein, 21 aa, Entamoeba invadens
IRNQRKTIVLTLIGNGVFGNP

SEQ ID NO: 3001304 - protein, 27 aa, Entamoeba invadens
IRNVEPLLCTLLLKLFKTDLVDNENVT

SEQ ID NO: 3001305 - protein, 19 aa, Entamoeba invadens
IRNVFYKSKKIFELLFIMC

SEQ ID NO: 3001306 - protein, 18 aa, Entamoeba invadens
IRPILPTDADSFCRNLNN

SEQ ID NO: 3001307 - protein, 18 aa, Entamoeba invadens
IRPKLSQLIDLGIHPSLV

SEQ ID NO: 3001308 - protein, 24 aa, Entamoeba invadens
IRPMSDVLLRSLGYEPITLPATSP

SEQ ID NO: 3001309 - protein, 25 aa, Entamoeba invadens
IRPRIYKRRVEGMWPTLCLWNDVNA

SEQ ID NO: 3001310 - protein, 23 aa, Entamoeba invadens
IRQFKLFECFPVLFNCFNNARQL

SEQ ID NO: 3001311 - protein, 17 aa, Entamoeba invadens
IRQFNLMTKKSADFFGH

SEQ ID NO: 3001312 - protein, 17 aa, Entamoeba invadens
IRQLFVVSPLNQRAQNL

SEQ ID NO: 3001313 - protein, 23 aa, Entamoeba invadens
IRQSKLVDLIHKSSLHNDCREAR

SEQ ID NO: 3001314 - protein, 24 aa, Entamoeba invadens
IRRIGWIGFYVCIRKTPAEFIDDK

SEQ ID NO: 3001315 - protein, 23 aa, Entamoeba invadens
IRRNMVFLKYRKYDEIFPCLNAK

SEQ ID NO: 3001316 - protein, 19 aa, Entamoeba invadens
IRRQFLEETKNKRNARLND

SEQ ID NO: 3001317 - protein, 20 aa, Entamoeba invadens
IRRRIQSRSFMFVDGVPLNV

SEQ ID NO: 3001318 - protein, 22 aa, Entamoeba invadens
IRRVSRYFLTTQDYITLEMVCK

SEQ ID NO: 3001319 - protein, 37 aa, Entamoeba invadens
IRSEHDILFLRQFNALAFPILRLLIPHCEKLKRRVNN

SEQ ID NO: 3001320 - protein, 19 aa, Entamoeba invadens
IRSHAQKYFLKMKKSNSRS

SEQ ID NO: 3001321 - protein, 17 aa, Entamoeba invadens
IRSPEGSVIRVVLYSFF

SEQ ID NO: 3001322 - protein, 19 aa, Entamoeba invadens
IRSRRIRRVALRNAQIKAR

SEQ ID NO: 3001323 - protein, 20 aa, Entamoeba invadens
IRSVTPLCTIPLKGKGTAVC

SEQ ID NO: 3001324 - protein, 25 aa, Entamoeba invadens
IRTINTVLRGLLRMGTDKQIKTFMK

SEQ ID NO: 3001325 - protein, 25 aa, Entamoeba invadens
IRTLPVDIWLHVIPQIIARIQSTAS

SEQ ID NO: 3001326 - protein, 25 aa, Entamoeba invadens
IRTLYTMTTLTTLSLPKSLILEPLE

SEQ ID NO: 3001327 - protein, 18 aa, Entamoeba invadens
IRVDHFCDADLRSLTCLT

SEQ ID NO: 3001328 - protein, 17 aa, Entamoeba invadens
IRVDWDYGYKEGREFGR

SEQ ID NO: 3001329 - protein, 20 aa, Entamoeba invadens
IRVEFYEFGLPELRENRLRD

SEQ ID NO: 3001330 - protein, 26 aa, Entamoeba invadens
IRVLKTSPITLFLLLSQFNLKHLDCK

SEQ ID NO: 3001331 - protein, 24 aa, Entamoeba invadens
IRWLDRSLIRLCQRFGDFRKDDPT

SEQ ID NO: 3001332 - protein, 17 aa, Entamoeba invadens
IRYTISSLTFENKEFEK

SEQ ID NO: 3001333 - protein, 20 aa, Entamoeba invadens
ISAILPYGYTIPKKVNPFMN

SEQ ID NO: 3001334 - protein, 27 aa, Entamoeba invadens
ISAITHSITLNTPPKFPVVSMVPPKTQ

SEQ ID NO: 3001335 - protein, 26 aa, Entamoeba invadens
ISAKKRALLEFWESRKDMWDVYYAPL

SEQ ID NO: 3001336 - protein, 18 aa, Entamoeba invadens
ISALFKKEAEDFLKSCPV

SEQ ID NO: 3001337 - protein, 18 aa, Entamoeba invadens
ISALLVFLSIDHTCLDIP

SEQ ID NO: 3001338 - protein, 27 aa, Entamoeba invadens
ISAQSTFLYFIKRTNYLLLFASKKLGV

SEQ ID NO: 3001339 - protein, 30 aa, Entamoeba invadens
ISCDVSTIFTLIFSDNKKYFIPKCVAKKLL

SEQ ID NO: 3001340 - protein, 25 aa, Entamoeba invadens
ISCKSSVSPFPPFMTTNYYPHNQET

SEQ ID NO: 3001341 - protein, 25 aa, Entamoeba invadens
ISCMGRNLFLNCSKLEKIVFDEITT

SEQ ID NO: 3001342 - protein, 22 aa, Entamoeba invadens
ISCPSVKMIVPYVARLRLEKYV

SEQ ID NO: 3001343 - protein, 24 aa, Entamoeba invadens
ISCSIFEILLKQPLNHGKIVFNPF

SEQ ID NO: 3001344 - protein, 22 aa, Entamoeba invadens
ISDFILSLPPKCFFYNESLLEI

SEQ ID NO: 3001345 - protein, 18 aa, Entamoeba invadens
ISDIFTGPTSPKKIILVR

SEQ ID NO: 3001346 - protein, 24 aa, Entamoeba invadens
ISDKEMFYVFCLCDHLVVNSHTFR

SEQ ID NO: 3001347 - protein, 24 aa, Entamoeba invadens
ISDKILLEPVKYTQRTKANTMSAF

SEQ ID NO: 3001348 - protein, 18 aa, Entamoeba invadens
ISDKLWDVVQRKKKEKAS

SEQ ID NO: 3001349 - protein, 18 aa, Entamoeba invadens
ISDLFVEDLTEAESLFKE

SEQ ID NO: 3001350 - protein, 29 aa, Entamoeba invadens
ISDLISEDFTWTNTFLYLVDIEDVIRRFH

SEQ ID NO: 3001351 - protein, 18 aa, Entamoeba invadens
ISDLVVYVDPLDGTDCFV

SEQ ID NO: 3001352 - protein, 17 aa, Entamoeba invadens
ISDLYYTAYRTPTKKDK

SEQ ID NO: 3001353 - protein, 20 aa, Entamoeba invadens
ISDMGRLLNSSFRAVFNTAN

SEQ ID NO: 3001354 - protein, 17 aa, Entamoeba invadens
ISDPHCSEYINSHFKQV

SEQ ID NO: 3001355 - protein, 23 aa, Entamoeba invadens
ISDYTHLKPTFSKMFSLSEVTFK

SEQ ID NO: 3001356 - protein, 20 aa, Entamoeba invadens
ISEFSNFFTQLALLDPEDKL

SEQ ID NO: 3001357 - protein, 24 aa, Entamoeba invadens
ISEGKSFIFTLNSPTIPPTKFERT

SEQ ID NO: 3001358 - protein, 17 aa, Entamoeba invadens
ISEIDFTTLLKAKNEAL

SEQ ID NO: 3001359 - protein, 23 aa, Entamoeba invadens
ISEMFELLAKKLLEKRKPMKKSH

SEQ ID NO: 3001360 - protein, 23 aa, Entamoeba invadens
ISENCFLWCRSLVSITIPENVRF

SEQ ID NO: 3001361 - protein, 29 aa, Entamoeba invadens
ISENLVPPITFFIPLEATSPSNFVLMSDP

SEQ ID NO: 3001362 - protein, 26 aa, Entamoeba invadens
ISEQEQYWIFQLVAAVLHMGNIYFTE

SEQ ID NO: 3001363 - protein, 23 aa, Entamoeba invadens
ISEQYIKIMPFELVVLNAFHHML

SEQ ID NO: 3001364 - protein, 23 aa, Entamoeba invadens
ISETMKKLLSRRTYTFKTTEDME

SEQ ID NO: 3001365 - protein, 25 aa, Entamoeba invadens
ISEYESRILALVKVVEQCKNKVNLS

SEQ ID NO: 3001366 - protein, 32 aa, Entamoeba invadens
ISEYIFNCDTFPEFWKFFIASAALHTSTHYKM

SEQ ID NO: 3001367 - protein, 17 aa, Entamoeba invadens
ISFDISLIRLKYNELKK

SEQ ID NO: 3001368 - protein, 18 aa, Entamoeba invadens
ISFECQLKLFQELLKSKK

SEQ ID NO: 3001369 - protein, 17 aa, Entamoeba invadens
ISFFNIKTKININENEL

SEQ ID NO: 3001370 - protein, 27 aa, Entamoeba invadens
ISFGGSDFIFWVGQAKPPKDIFDKAHK

SEQ ID NO: 3001371 - protein, 17 aa, Entamoeba invadens
ISFGYSPEKILFRDLNF

SEQ ID NO: 3001372 - protein, 20 aa, Entamoeba invadens
ISFSMDFISIRWKMSTTKPQ

SEQ ID NO: 3001373 - protein, 20 aa, Entamoeba invadens
ISFVFTPQMKHIVSLIFEKS

SEQ ID NO: 3001374 - protein, 24 aa, Entamoeba invadens
ISGAEAMVPLKKNKKAKCEYYGVF

SEQ ID NO: 3001375 - protein, 33 aa, Entamoeba invadens
ISGETVKFELVGKDTVYIVSSFEPVAPEEDFED

SEQ ID NO: 3001376 - protein, 17 aa, Entamoeba invadens
ISGLLFKGSMLELLEEY

SEQ ID NO: 3001377 - protein, 25 aa, Entamoeba invadens
ISGNLFDAFPTPIQQMFTLSSLCFV

SEQ ID NO: 3001378 - protein, 28 aa, Entamoeba invadens
ISGPILELIKKFIFRMMGEKDEIIIAFV

SEQ ID NO: 3001379 - protein, 22 aa, Entamoeba invadens
ISGVFLEMWNPSQGFLQEFTLP

SEQ ID NO: 3001380 - protein, 17 aa, Entamoeba invadens
ISHIDFIAMIEILGRVK

SEQ ID NO: 3001381 - protein, 24 aa, Entamoeba invadens
ISHNAFFQCPVMNTVLTLIAAHNK

SEQ ID NO: 3001382 - protein, 18 aa, Entamoeba invadens
ISIAKYRKYMRNNLGLLF

SEQ ID NO: 3001383 - protein, 23 aa, Entamoeba invadens
ISIATHFFPFFVGVLQNQKDESV

SEQ ID NO: 3001384 - protein, 26 aa, Entamoeba invadens
ISICIKFFQFCITNFQLMFPDQIDEN

SEQ ID NO: 3001385 - protein, 31 aa, Entamoeba invadens
ISIDFKDEYLPTVGTLLLSTASLACRQLDTQ

SEQ ID NO: 3001386 - protein, 23 aa, Entamoeba invadens
ISIDPKWLIELAPAFYQVADGKH

SEQ ID NO: 3001387 - protein, 25 aa, Entamoeba invadens
ISIKPLSCFFYTIDNYRAVLNGLFQ

SEQ ID NO: 3001388 - protein, 19 aa, Entamoeba invadens
ISILNLENIFDAFKGMLQI

SEQ ID NO: 3001389 - protein, 34 aa, Entamoeba invadens
ISINSPVCFKLFPHIHTLNFYKKSDLMYYTQYNE

SEQ ID NO: 3001390 - protein, 23 aa, Entamoeba invadens
ISIPNTIAVLPDFCFFKCTTLQS

SEQ ID NO: 3001391 - protein, 26 aa, Entamoeba invadens
ISIQSKKLFPYIDTLHLYLNCDVEFQ

SEQ ID NO: 3001392 - protein, 24 aa, Entamoeba invadens
ISITKRHIYYLEKDLFTCQNTVDR

SEQ ID NO: 3001393 - protein, 32 aa, Entamoeba invadens
ISITTKRRAILTSLYFNIYGKTITIPNINNSK

SEQ ID NO: 3001394 - protein, 17 aa, Entamoeba invadens
ISIVVRYTPSFKTIQKL

SEQ ID NO: 3001395 - protein, 18 aa, Entamoeba invadens
ISKALLKFSTHDGLEELT

SEQ ID NO: 3001396 - protein, 39 aa, Entamoeba invadens
ISKASLVPEFFYNLYLFPHLEFIGFIKCTLPVSRINPQT

SEQ ID NO: 3001397 - protein, 19 aa, Entamoeba invadens
ISKDLVLFCKSYGGYVKFG

SEQ ID NO: 3001398 - protein, 24 aa, Entamoeba invadens
ISKIPSELFALKNLQRLVFAQNSI

SEQ ID NO: 3001399 - protein, 23 aa, Entamoeba invadens
ISKKLFPHLTTNGCALLTTLYFS

SEQ ID NO: 3001400 - protein, 23 aa, Entamoeba invadens
ISKLELIEKLQIYKKCEFKKKYE

SEQ ID NO: 3001401 - protein, 23 aa, Entamoeba invadens
ISKLKKFKVEYLKFGEGELFDNF

SEQ ID NO: 3001402 - protein, 25 aa, Entamoeba invadens
ISKPETFIDIFYTRIGKIYEVYKRR

SEQ ID NO: 3001403 - protein, 19 aa, Entamoeba invadens
ISKRIGLPWYATVAAMEKY

SEQ ID NO: 3001404 - protein, 25 aa, Entamoeba invadens
ISKRYQWYLEKLTFAKDKFTNTLPP

SEQ ID NO: 3001405 - protein, 17 aa, Entamoeba invadens
ISKTILMTFGTASPNVL

SEQ ID NO: 3001406 - protein, 27 aa, Entamoeba invadens
ISKVLCEWYLMFVGQPIKQAEAAKIAF

SEQ ID NO: 3001407 - protein, 25 aa, Entamoeba invadens
ISKVNFFRVVIWYEVYYKTSVIKKS

SEQ ID NO: 3001408 - protein, 25 aa, Entamoeba invadens
ISKYGNSIGMRRIKALRFGGCNFST

SEQ ID NO: 3001409 - protein, 17 aa, Entamoeba invadens
ISLFKSIGYFDFELLEP

SEQ ID NO: 3001410 - protein, 18 aa, Entamoeba invadens
ISLFSILRVRVSSVEKGK

SEQ ID NO: 3001411 - protein, 23 aa, Entamoeba invadens
ISLGILSYGVLFEKIIESGTAFP

SEQ ID NO: 3001412 - protein, 19 aa, Entamoeba invadens
ISLIAMFVRPEDLFNFVAV

SEQ ID NO: 3001413 - protein, 27 aa, Entamoeba invadens
ISLISERLLHVSLLLVNTLIANYSPQT

SEQ ID NO: 3001414 - protein, 17 aa, Entamoeba invadens
ISLKTAHLFPKLETQYL

SEQ ID NO: 3001415 - protein, 33 aa, Entamoeba invadens
ISLLNQYFDVTYLRPFKFSTKSVPFIWVQSLQN

SEQ ID NO: 3001416 - protein, 20 aa, Entamoeba invadens
ISLLRSLCVMLYRSNGVKEC

SEQ ID NO: 3001417 - protein, 27 aa, Entamoeba invadens
ISLNDYLLLHQFIQIFGKKVSNLLLDM

SEQ ID NO: 3001418 - protein, 23 aa, Entamoeba invadens
ISLQQQPELPVRVLRRIEPEDDD

SEQ ID NO: 3001419 - protein, 18 aa, Entamoeba invadens
ISLVVSLFELCEHPLSDE

SEQ ID NO: 3001420 - protein, 20 aa, Entamoeba invadens
ISLYIRRRCYICGGVKNYNA

SEQ ID NO: 3001421 - protein, 17 aa, Entamoeba invadens
ISMLRTTRSLLLRDRLI

SEQ ID NO: 3001422 - protein, 18 aa, Entamoeba invadens
ISNCDVICCTLNSAGCDT

SEQ ID NO: 3001423 - protein, 25 aa, Entamoeba invadens
ISNEMFFPAFYPQTVLSLASHNSIS

SEQ ID NO: 3001424 - protein, 25 aa, Entamoeba invadens
ISNFNVKVPLYYLSNINLLNNPIMT

SEQ ID NO: 3001425 - protein, 26 aa, Entamoeba invadens
ISNGILTVRCNDTFYIANRICNNCTS

SEQ ID NO: 3001426 - protein, 22 aa, Entamoeba invadens
ISNHSFVLQKLIELKQEVFTFC

SEQ ID NO: 3001427 - protein, 25 aa, Entamoeba invadens
ISNKKMIRFCPNGIQLDINVICTLK

SEQ ID NO: 3001428 - protein, 17 aa, Entamoeba invadens
ISNKPVTFLKAAPNMFK

SEQ ID NO: 3001429 - protein, 25 aa, Entamoeba invadens
ISNLASCVFIYCTSLQSVTFPSKIG

SEQ ID NO: 3001430 - protein, 38 aa, Entamoeba invadens
ISNLKTLFDTPKWVPPEKLVLFKAICIMCHIIASHSDV

SEQ ID NO: 3001431 - protein, 27 aa, Entamoeba invadens
ISNLRKKNIPFITLSKAITKINGEVTG

SEQ ID NO: 3001432 - protein, 26 aa, Entamoeba invadens
ISNNQFFFHRLESKNILTIISYSYKT

SEQ ID NO: 3001433 - protein, 20 aa, Entamoeba invadens
ISNSFVWVDDFWGESHTIIL

SEQ ID NO: 3001434 - protein, 18 aa, Entamoeba invadens
ISNVPPTAFANCEILKNV

SEQ ID NO: 3001435 - protein, 18 aa, Entamoeba invadens
ISNYFIPPVDLFFTQDMC

SEQ ID NO: 3001436 - protein, 21 aa, Entamoeba invadens
ISPFYTSFFSALLNTLALPID

SEQ ID NO: 3001437 - protein, 30 aa, Entamoeba invadens
ISPKEEYILAAFFFPITRDGDLFETQINTC

SEQ ID NO: 3001438 - protein, 17 aa, Entamoeba invadens
ISQLLYYLVFNLDVAER

SEQ ID NO: 3001439 - protein, 27 aa, Entamoeba invadens
ISQMKAIKIVFPFSKLFHCVRHIHRDL

SEQ ID NO: 3001440 - protein, 17 aa, Entamoeba invadens
ISQPTPVLWTDDEQRLL

SEQ ID NO: 3001441 - protein, 20 aa, Entamoeba invadens
ISQPVLSFLSTGKSTGFCVE

SEQ ID NO: 3001442 - protein, 47 aa, Entamoeba invadens
ISQRKFIEQKLNEHIAIIVIQDTIHTWYQFRNWERSQRRTAAKDKEI

SEQ ID NO: 3001443 - protein, 19 aa, Entamoeba invadens
ISQSVIPKNFFASCIYLKE

SEQ ID NO: 3001444 - protein, 27 aa, Entamoeba invadens
ISRAFMVYDRLRKLPLFEENEYKIIQL

SEQ ID NO: 3001445 - protein, 19 aa, Entamoeba invadens
ISREFYLLAQKIYTQYKKL

SEQ ID NO: 3001446 - protein, 18 aa, Entamoeba invadens
ISRFLGPIVTTLQNLEKY

SEQ ID NO: 3001447 - protein, 20 aa, Entamoeba invadens
ISRLVLPLTRLLPNEILRDP

SEQ ID NO: 3001448 - protein, 24 aa, Entamoeba invadens
ISRNAIFRPLVISKEYWPEQQDVF

SEQ ID NO: 3001449 - protein, 23 aa, Entamoeba invadens
ISRNIGSFFDLYPIISNANKNKK

SEQ ID NO: 3001450 - protein, 24 aa, Entamoeba invadens
ISRNVPRLLWRVKYIQGDVSGAVR

SEQ ID NO: 3001451 - protein, 18 aa, Entamoeba invadens
ISRPTFVSLFQHADMIYY

SEQ ID NO: 3001452 - protein, 22 aa, Entamoeba invadens
ISRQLIHFCKAPIGIDLIKFKG

SEQ ID NO: 3001453 - protein, 24 aa, Entamoeba invadens
ISSAINVWNEKLLKDVFPVYQGAV

SEQ ID NO: 3001454 - protein, 22 aa, Entamoeba invadens
ISSCITCEPNYYLLNNNACIQC

SEQ ID NO: 3001455 - protein, 23 aa, Entamoeba invadens
ISSDFEMYPVPPPNLKTLSFVAP

SEQ ID NO: 3001456 - protein, 24 aa, Entamoeba invadens
ISSEALKLYIKYAKTINPKMTKDA

SEQ ID NO: 3001457 - protein, 26 aa, Entamoeba invadens
ISSITITSLCYILLHGLCEDNTKCKS

SEQ ID NO: 3001458 - protein, 24 aa, Entamoeba invadens
ISSKIEVVFYFKISNFFGHQIDYS

SEQ ID NO: 3001459 - protein, 18 aa, Entamoeba invadens
ISSLKKLRENSFESFELL

SEQ ID NO: 3001460 - protein, 21 aa, Entamoeba invadens
ISSLLKLIYIDFKTAKETTFD

SEQ ID NO: 3001461 - protein, 20 aa, Entamoeba invadens
ISSLQYYLRSFPSFRPKEFT

SEQ ID NO: 3001462 - protein, 18 aa, Entamoeba invadens
ISSLYFPIVIDQLSHNPL

SEQ ID NO: 3001463 - protein, 24 aa, Entamoeba invadens
ISSNVCQAILLSPTRELALQTQSV

SEQ ID NO: 3001464 - protein, 18 aa, Entamoeba invadens
ISSSWDHTLRLWDLDKME

SEQ ID NO: 3001465 - protein, 30 aa, Entamoeba invadens
ISSTNDMVLFYLKGLLELSTNKLSKCGMRI

SEQ ID NO: 3001466 - protein, 24 aa, Entamoeba invadens
ISSVTTRVPYLSKRTYIIKQIEKH

SEQ ID NO: 3001467 - protein, 26 aa, Entamoeba invadens
ISTFGDIYFWFDVCAPNITYFVSEKS

SEQ ID NO: 3001468 - protein, 27 aa, Entamoeba invadens
ISTLINRRMLLIQNYLTKNSSDIWKYL

SEQ ID NO: 3001469 - protein, 28 aa, Entamoeba invadens
ISTLSPLLVFYSFFVKSLARHEIFEISK

SEQ ID NO: 3001470 - protein, 31 aa, Entamoeba invadens
ISTNKRSFYTLIYNTLLPKETPKTALCRLKK

SEQ ID NO: 3001471 - protein, 30 aa, Entamoeba invadens
ISTPQNTFNLLFFIRTVFPVFHAPQHVMDT

SEQ ID NO: 3001472 - protein, 18 aa, Entamoeba invadens
ISTQKFKKLVLSETKQLS

SEQ ID NO: 3001473 - protein, 19 aa, Entamoeba invadens
ISTQLPFITTCKGFPVISI

SEQ ID NO: 3001474 - protein, 20 aa, Entamoeba invadens
ISTQRFKRLFSNEMRPLMTS

SEQ ID NO: 3001475 - protein, 27 aa, Entamoeba invadens
ISTSIFFESLFKLKVVPKALIVPNTIN

SEQ ID NO: 3001476 - protein, 25 aa, Entamoeba invadens
ISVCIYTNYAAFCAIGIPVHHVAFT

SEQ ID NO: 3001477 - protein, 23 aa, Entamoeba invadens
ISVDQLYRTKPCKYFFTTGTCRK

SEQ ID NO: 3001478 - protein, 19 aa, Entamoeba invadens
ISVERYSEIKWALRFDTEA

SEQ ID NO: 3001479 - protein, 18 aa, Entamoeba invadens
ISVIKLPETINSLPYKCF

SEQ ID NO: 3001480 - protein, 17 aa, Entamoeba invadens
ISVIWPCVHYLLTNYQN

SEQ ID NO: 3001481 - protein, 18 aa, Entamoeba invadens
ISVLQQRVSFLKKAVYYG

SEQ ID NO: 3001482 - protein, 18 aa, Entamoeba invadens
ISYLRTKIGLKENCLAAK

SEQ ID NO: 3001483 - protein, 19 aa, Entamoeba invadens
ITALMSFFSSRGKLIDLLT

SEQ ID NO: 3001484 - protein, 26 aa, Entamoeba invadens
ITAQLHNMLFVLDKETIRDFGLSVNR

SEQ ID NO: 3001485 - protein, 24 aa, Entamoeba invadens
ITARKGEEYLLDKKLKGIVKSVIF

SEQ ID NO: 3001486 - protein, 19 aa, Entamoeba invadens
ITAVKKLYPKIVLMAEVYE

SEQ ID NO: 3001487 - protein, 23 aa, Entamoeba invadens
ITAVLFYINLNYYNSTTGKLPSF

SEQ ID NO: 3001488 - protein, 20 aa, Entamoeba invadens
ITAVTQMKFIISQTASALCY

SEQ ID NO: 3001489 - protein, 37 aa, Entamoeba invadens
ITCCPIYDKFLYDIIKHPFNKYFMRGMLVTLATDSPM

SEQ ID NO: 3001490 - protein, 18 aa, Entamoeba invadens
ITCLSLEHRVVIRLRKVE

SEQ ID NO: 3001491 - protein, 18 aa, Entamoeba invadens
ITCSLRFPGQLNQDLKKL

SEQ ID NO: 3001492 - protein, 26 aa, Entamoeba invadens
ITDDMKPLIVKLYMNGKRVKLEFSET

SEQ ID NO: 3001493 - protein, 19 aa, Entamoeba invadens
ITDKMFTARFAEPLTERVL

SEQ ID NO: 3001494 - protein, 28 aa, Entamoeba invadens
ITDKRHFIFSNIKKFKINFGKTTNRLVT

SEQ ID NO: 3001495 - protein, 26 aa, Entamoeba invadens
ITDMEMLGLIYTWVLKNIESKVLIEW

SEQ ID NO: 3001496 - protein, 27 aa, Entamoeba invadens
ITEAKWLVFKLEYFRREILKELIIHAH

SEQ ID NO: 3001497 - protein, 19 aa, Entamoeba invadens
ITEELIINSMPKILTRVNR

SEQ ID NO: 3001498 - protein, 20 aa, Entamoeba invadens
ITEIILPPHLTELGNFAFDD

SEQ ID NO: 3001499 - protein, 26 aa, Entamoeba invadens
ITEIRELVEYPLLHPEIYKHVGIDPP

SEQ ID NO: 3001500 - protein, 31 aa, Entamoeba invadens
ITEKEMIKFLWNFLWGNAPRVRFFEKTVEKV

SEQ ID NO: 3001501 - protein, 32 aa, Entamoeba invadens
ITELNEKFLRLEPIIFVKGDTKIALYGMSYKK

SEQ ID NO: 3001502 - protein, 17 aa, Entamoeba invadens
ITEMRSWCFACCGSLKR

SEQ ID NO: 3001503 - protein, 23 aa, Entamoeba invadens
ITERDIVLFFKKTQPTNIKRITT

SEQ ID NO: 3001504 - protein, 25 aa, Entamoeba invadens
ITERNYLDIYKYRKWTEKQIPNFEE

SEQ ID NO: 3001505 - protein, 24 aa, Entamoeba invadens
ITEVDFINRLIYMSGYNLTDAQKE

SEQ ID NO: 3001506 - protein, 17 aa, Entamoeba invadens
ITFDFHLNKFRVTVRNI

SEQ ID NO: 3001507 - protein, 19 aa, Entamoeba invadens
ITFEYINAFYIQGSSKLMP

SEQ ID NO: 3001508 - protein, 17 aa, Entamoeba invadens
ITFFVSPKDHIYFMLRV

SEQ ID NO: 3001509 - protein, 22 aa, Entamoeba invadens
ITFMSSLTRFSDSVFAGCVSLK

SEQ ID NO: 3001510 - protein, 19 aa, Entamoeba invadens
ITFPSSLTYLGNSILFNCM

SEQ ID NO: 3001511 - protein, 24 aa, Entamoeba invadens
ITFPTDLYSFFRDKRDRFLDGQAQ

SEQ ID NO: 3001512 - protein, 36 aa, Entamoeba invadens
ITFSHIVFKILYDEFLKLYVILYKSTIDVDGETYVE

SEQ ID NO: 3001513 - protein, 24 aa, Entamoeba invadens
ITFYKYFPYTIRKNAFRNSGLQTI

SEQ ID NO: 3001514 - protein, 24 aa, Entamoeba invadens
ITGEDVLLYCAFIPSAHKKLDKTF

SEQ ID NO: 3001515 - protein, 21 aa, Entamoeba invadens
ITGHSQAVTKVLWPVEAQLFS

SEQ ID NO: 3001516 - protein, 24 aa, Entamoeba invadens
ITGKHCVVPLIYTNTNLPTELCDP

SEQ ID NO: 3001517 - protein, 29 aa, Entamoeba invadens
ITGKTLRAYIFIGPVYYQKLKHMVLDKMH

SEQ ID NO: 3001518 - protein, 23 aa, Entamoeba invadens
ITGKVFLEWYKKSVTKYCGDIED

SEQ ID NO: 3001519 - protein, 17 aa, Entamoeba invadens
ITGLYKRKKLSEIIYIE

SEQ ID NO: 3001520 - protein, 17 aa, Entamoeba invadens
ITGTPLQNTLKELWSLL

SEQ ID NO: 3001521 - protein, 28 aa, Entamoeba invadens
ITGVPIHFPYKYIYPEQYSFIKTVVSGV

SEQ ID NO: 3001522 - protein, 17 aa, Entamoeba invadens
ITGYYPDLLGTCVLCDP

SEQ ID NO: 3001523 - protein, 20 aa, Entamoeba invadens
ITHHNGFINTIAFSPDGSIM

SEQ ID NO: 3001524 - protein, 23 aa, Entamoeba invadens
ITIEDKKVLLSDTLYLVLKDVIK

SEQ ID NO: 3001525 - protein, 17 aa, Entamoeba invadens
ITIKQALEKYSATQLRL

SEQ ID NO: 3001526 - protein, 20 aa, Entamoeba invadens
ITIKYIDPILGIIPSKQRPR

SEQ ID NO: 3001527 - protein, 21 aa, Entamoeba invadens
ITILLGLIEKSFGRDVTFDVS

SEQ ID NO: 3001528 - protein, 17 aa, Entamoeba invadens
ITIPQFVTLIPINCFKD

SEQ ID NO: 3001529 - protein, 31 aa, Entamoeba invadens
ITIRQHGPLFIYLFRLMLATGIPELQKVNDI

SEQ ID NO: 3001530 - protein, 28 aa, Entamoeba invadens
ITIVLQSQKYFEALLPFTIYEEGREKIS

SEQ ID NO: 3001531 - protein, 23 aa, Entamoeba invadens
ITKDHVTFTVKGSVRRSGISDHT

SEQ ID NO: 3001532 - protein, 26 aa, Entamoeba invadens
ITKEKIPPTKTPPPPPSTKPPPINSL

SEQ ID NO: 3001533 - protein, 27 aa, Entamoeba invadens
ITKEQLKMWLEDVLLQFIKSQNKNTKN

SEQ ID NO: 3001534 - protein, 18 aa, Entamoeba invadens
ITKFNILQHWASDIVTAL

SEQ ID NO: 3001535 - protein, 25 aa, Entamoeba invadens
ITKIDTIRYFGILLYMGAHHDIKNP

SEQ ID NO: 3001536 - protein, 25 aa, Entamoeba invadens
ITKIVLYECPKIKRGLPLTKKKDGK

SEQ ID NO: 3001537 - protein, 17 aa, Entamoeba invadens
ITKLGEGSFGIVYMGNY

SEQ ID NO: 3001538 - protein, 27 aa, Entamoeba invadens
ITKLKFNYKERLMIPQSIDQLYGLNCL

SEQ ID NO: 3001539 - protein, 24 aa, Entamoeba invadens
ITKLYTKIGMICPCAVINVSAKEN

SEQ ID NO: 3001540 - protein, 21 aa, Entamoeba invadens
ITKNFELLQAYTTKFIRSIEN

SEQ ID NO: 3001541 - protein, 25 aa, Entamoeba invadens
ITKNLNFMYWDYIKAKTRIFNTEIY

SEQ ID NO: 3001542 - protein, 24 aa, Entamoeba invadens
ITKNTFLCVKRMPRIARPMQKKRA

SEQ ID NO: 3001543 - protein, 25 aa, Entamoeba invadens
ITKRSPPVYVKLPTQFRATTFPVLL

SEQ ID NO: 3001544 - protein, 23 aa, Entamoeba invadens
ITKTSLRLQLAQLNADNDNLTKA

SEQ ID NO: 3001545 - protein, 33 aa, Entamoeba invadens
ITLATPPPPTPLAVPPPLPPQSIHMAKSFQGAS

SEQ ID NO: 3001546 - protein, 22 aa, Entamoeba invadens
ITLCSRFWYKGINKNIIIYWKP

SEQ ID NO: 3001547 - protein, 19 aa, Entamoeba invadens
ITLDEHPLIDDLYMFFIHP

SEQ ID NO: 3001548 - protein, 27 aa, Entamoeba invadens
ITLENKFSFDEIILLLGAESATYYSEH

SEQ ID NO: 3001549 - protein, 32 aa, Entamoeba invadens
ITLENQIHSWWRLGGWYYFYLQFEEDGKRSTQ

SEQ ID NO: 3001550 - protein, 17 aa, Entamoeba invadens
ITLIYRGYKLEDSSVFS

SEQ ID NO: 3001551 - protein, 18 aa, Entamoeba invadens
ITLLCLKVNHPDTFILLR

SEQ ID NO: 3001552 - protein, 17 aa, Entamoeba invadens
ITLLENGYASLRLSPRD

SEQ ID NO: 3001553 - protein, 17 aa, Entamoeba invadens
ITLLRKKQQKYPVLLLT

SEQ ID NO: 3001554 - protein, 19 aa, Entamoeba invadens
ITLNYRPPELILGNGFYGT

SEQ ID NO: 3001555 - protein, 27 aa, Entamoeba invadens
ITLPQNTFSLCLKLCSIRLPNSITSLG

SEQ ID NO: 3001556 - protein, 18 aa, Entamoeba invadens
ITLPSSIYFIKNSAFADC

SEQ ID NO: 3001557 - protein, 18 aa, Entamoeba invadens
ITLRLVHNQLETARKQHK

SEQ ID NO: 3001558 - protein, 18 aa, Entamoeba invadens
ITLSSKLRYFVSHCNLQV

SEQ ID NO: 3001559 - protein, 25 aa, Entamoeba invadens
ITLSTPFIIAIFKTIYDMYIITQPS

SEQ ID NO: 3001560 - protein, 28 aa, Entamoeba invadens
ITLSTSLTSLPPFMFEYCFSLSNIEIPF

SEQ ID NO: 3001561 - protein, 29 aa, Entamoeba invadens
ITMFECFGWCEAYPLDTFKYPWKIAEFVN

SEQ ID NO: 3001562 - protein, 35 aa, Entamoeba invadens
ITMFECFGWCEAYTKDLFKFPWKIAEYVIAGNRPI

SEQ ID NO: 3001563 - protein, 39 aa, Entamoeba invadens
ITMFECFGWCQAYPKTQFKYPWVIAKFVIEGKRLDKKEN

SEQ ID NO: 3001564 - protein, 19 aa, Entamoeba invadens
ITMKLLKIPKELVTPTIEG

SEQ ID NO: 3001565 - protein, 24 aa, Entamoeba invadens
ITMLSCFAWDNSFPKTIYPCDHQP

SEQ ID NO: 3001566 - protein, 25 aa, Entamoeba invadens
ITMPHIINVINLRCYFGTKILNGFN

SEQ ID NO: 3001567 - protein, 35 aa, Entamoeba invadens
ITMYECFGWCNAYSEKQFKFPWKIAEFVTNGKRLE

SEQ ID NO: 3001568 - protein, 29 aa, Entamoeba invadens
ITMYEVFGWCEAYIIENFKFQWKIAEFVM

SEQ ID NO: 3001569 - protein, 27 aa, Entamoeba invadens
ITNDLKFIIIGFSDGVIRLYKYSDYSF

SEQ ID NO: 3001570 - protein, 17 aa, Entamoeba invadens
ITNISYIDWQRKLKNVF

SEQ ID NO: 3001571 - protein, 23 aa, Entamoeba invadens
ITNKLVCITAIPTGFKVVLRTYG

SEQ ID NO: 3001572 - protein, 20 aa, Entamoeba invadens
ITNLFDKMDPPPKGWETSIN

SEQ ID NO: 3001573 - protein, 34 aa, Entamoeba invadens
ITNLTTQLRLQPIRPLVYPLPFQQVVGSTSTVPI

SEQ ID NO: 3001574 - protein, 25 aa, Entamoeba invadens
ITNPNNCELFFYYGDYRKLNACGNN

SEQ ID NO: 3001575 - protein, 25 aa, Entamoeba invadens
ITNSLQIFTIYPKPSVIPIARETNF

SEQ ID NO: 3001576 - protein, 24 aa, Entamoeba invadens
ITPETFLVGVFRVIDKNCDGTLDK

SEQ ID NO: 3001577 - protein, 17 aa, Entamoeba invadens
ITPFYLKNREELNKYAL

SEQ ID NO: 3001578 - protein, 17 aa, Entamoeba invadens
ITPFYLKNRVEMNEWAL

SEQ ID NO: 3001579 - protein, 27 aa, Entamoeba invadens
ITPKTKNLFKFIQTQQFFSPFDIKLNT

SEQ ID NO: 3001580 - protein, 27 aa, Entamoeba invadens
ITPKTKNLFKYIQTQQFFTPLDIKLNT

SEQ ID NO: 3001581 - protein, 24 aa, Entamoeba invadens
ITPLVVQFKPPFTVINRTPLEIKI

SEQ ID NO: 3001582 - protein, 25 aa, Entamoeba invadens
ITPMGGFPHYGIVKNDFLMIKGTCA

SEQ ID NO: 3001583 - protein, 36 aa, Entamoeba invadens
ITPPLFRCYNKQKALPFLNFFFKIITDGLSVSFNAN

SEQ ID NO: 3001584 - protein, 28 aa, Entamoeba invadens
ITPTKIVGYLPYFKLKKSLDVVVENADG

SEQ ID NO: 3001585 - protein, 31 aa, Entamoeba invadens
ITPTTFEKMKKWLTHPALCNKNIEGCKLEFI

SEQ ID NO: 3001586 - protein, 28 aa, Entamoeba invadens
ITQELQKRLFTRYPFLHDENPTILYHKM

SEQ ID NO: 3001587 - protein, 22 aa, Entamoeba invadens
ITQELYLPFLQILKYCFSSSCT

SEQ ID NO: 3001588 - protein, 17 aa, Entamoeba invadens
ITQFFRFEHFVLVELYL

SEQ ID NO: 3001589 - protein, 18 aa, Entamoeba invadens
ITQHVPKIQTTIARKIQL

SEQ ID NO: 3001590 - protein, 27 aa, Entamoeba invadens
ITQINTFDELLMINPTFSDFHFVCYLK

SEQ ID NO: 3001591 - protein, 22 aa, Entamoeba invadens
ITQLTAFKASLSTQWKPSYEYY

SEQ ID NO: 3001592 - protein, 27 aa, Entamoeba invadens
ITQNLYFPCLVPYNEALDALKGFYPEL

SEQ ID NO: 3001593 - protein, 23 aa, Entamoeba invadens
ITQRYMIILCVKSVTQHVMGSET

SEQ ID NO: 3001594 - protein, 24 aa, Entamoeba invadens
ITQSPVIISPRPLEWIYDTHQTFF

SEQ ID NO: 3001595 - protein, 29 aa, Entamoeba invadens
ITQTRSYFQLIFFLFEKSKTIKQLVAPRI

SEQ ID NO: 3001596 - protein, 25 aa, Entamoeba invadens
ITQYNAIHPFPFYQRIVFPCEQMEI

SEQ ID NO: 3001597 - protein, 30 aa, Entamoeba invadens
ITRAYFNNKIPFIYIAKYITDFPNVKYIER

SEQ ID NO: 3001598 - protein, 28 aa, Entamoeba invadens
ITRHGDRLPFFFNLLPQNIQKNKKTGDL

SEQ ID NO: 3001599 - protein, 26 aa, Entamoeba invadens
ITRILDIIKIITFGTKIELAICAKTI

SEQ ID NO: 3001600 - protein, 17 aa, Entamoeba invadens
ITRPPWNYSMSKDQLDQ

SEQ ID NO: 3001601 - protein, 20 aa, Entamoeba invadens
ITSALYFLSAFLEQSATMNS

SEQ ID NO: 3001602 - protein, 25 aa, Entamoeba invadens
ITSCCPAWIELLEKEYPDLIPHVST

SEQ ID NO: 3001603 - protein, 20 aa, Entamoeba invadens
ITSDYLSPLQLLEDFYNVIP

SEQ ID NO: 3001604 - protein, 22 aa, Entamoeba invadens
ITSEYLRRPLDVPLKIDLFLQC

SEQ ID NO: 3001605 - protein, 28 aa, Entamoeba invadens
ITSGVDFPYLFLWGEFFGGYDQVQMGLA

SEQ ID NO: 3001606 - protein, 32 aa, Entamoeba invadens
ITSITSFFEANTFRELLYRVLDKDFSEHIPIA

SEQ ID NO: 3001607 - protein, 24 aa, Entamoeba invadens
ITSIYNYDNFLIKNLDLGTTLEQI

SEQ ID NO: 3001608 - protein, 23 aa, Entamoeba invadens
ITSLLKCNLLRKIDVRESNVVND

SEQ ID NO: 3001609 - protein, 17 aa, Entamoeba invadens
ITSLTLPSGLKTLPYKV

SEQ ID NO: 3001610 - protein, 22 aa, Entamoeba invadens
ITSRIKWCQIAPQTRPPWDDYC

SEQ ID NO: 3001611 - protein, 22 aa, Entamoeba invadens
ITSRVKVLSDWLQKSCLSFAVA

SEQ ID NO: 3001612 - protein, 34 aa, Entamoeba invadens
ITSSFVDLFNFLKNKKIVFKIVFCDRCISQMKAI

SEQ ID NO: 3001613 - protein, 17 aa, Entamoeba invadens
ITTCFEVLTKKGLNFQE

SEQ ID NO: 3001614 - protein, 20 aa, Entamoeba invadens
ITTCPMINNIFLPNTITKLE

SEQ ID NO: 3001615 - protein, 25 aa, Entamoeba invadens
ITTDVILKHLVFSLCIRLCDDFESV

SEQ ID NO: 3001616 - protein, 19 aa, Entamoeba invadens
ITTKKSLIALKSKIAKCDS

SEQ ID NO: 3001617 - protein, 26 aa, Entamoeba invadens
ITTLEEFQVSYFPVGFQPVYEHSNLY

SEQ ID NO: 3001618 - protein, 22 aa, Entamoeba invadens
ITTPPLFTIFKYMDDSERVTGY

SEQ ID NO: 3001619 - protein, 18 aa, Entamoeba invadens
ITTSFNWLSEMLSKMING

SEQ ID NO: 3001620 - protein, 20 aa, Entamoeba invadens
ITVSFPTPFPEDPVVFIFHL

SEQ ID NO: 3001621 - protein, 17 aa, Entamoeba invadens
ITYLPFLSEKELYRTVT

SEQ ID NO: 3001622 - protein, 20 aa, Entamoeba invadens
ITYYCSCGRFGFLISRPTDL

SEQ ID NO: 3001623 - protein, 23 aa, Entamoeba invadens
IVAASFLKYYLRTLPDSVIPSRY

SEQ ID NO: 3001624 - protein, 18 aa, Entamoeba invadens
IVALTCPQLFEVMSTNIV

SEQ ID NO: 3001625 - protein, 24 aa, Entamoeba invadens
IVASKSALKFIFVFDGTHHSDKIK

SEQ ID NO: 3001626 - protein, 30 aa, Entamoeba invadens
IVAVDFLMNLIDTGLFWYTKTEKKIVDYLT

SEQ ID NO: 3001627 - protein, 17 aa, Entamoeba invadens
IVCDVSCSLCISNTSCS

SEQ ID NO: 3001628 - protein, 17 aa, Entamoeba invadens
IVCKCGQRFCFQCGREM

SEQ ID NO: 3001629 - protein, 20 aa, Entamoeba invadens
IVCLCGQKFCFKCLGEFHAP

SEQ ID NO: 3001630 - protein, 21 aa, Entamoeba invadens
IVCTTLDTLYFYKHHLELLSH

SEQ ID NO: 3001631 - protein, 30 aa, Entamoeba invadens
IVDEIISGTKFLLYCWSRPDLRGYLNSQGV

SEQ ID NO: 3001632 - protein, 20 aa, Entamoeba invadens
IVDFFATWCGPCQLMGPIFE

SEQ ID NO: 3001633 - protein, 26 aa, Entamoeba invadens
IVDFKPNCLPVLVDSLVIVCHVNPLE

SEQ ID NO: 3001634 - protein, 18 aa, Entamoeba invadens
IVDFLRTFYNISSSFDFG

SEQ ID NO: 3001635 - protein, 17 aa, Entamoeba invadens
IVDFTLPHDVPTNIFHV

SEQ ID NO: 3001636 - protein, 26 aa, Entamoeba invadens
IVDGDGIRNFRFVNNLYGVVNRLKME

SEQ ID NO: 3001637 - protein, 26 aa, Entamoeba invadens
IVDGRDPLFYYSRDLVKYIKELGTKK

SEQ ID NO: 3001638 - protein, 24 aa, Entamoeba invadens
IVDIHYIIIIMSKTATFENCKNLV

SEQ ID NO: 3001639 - protein, 21 aa, Entamoeba invadens
IVDVKMRFNFIEFKNSNPTST

SEQ ID NO: 3001640 - protein, 17 aa, Entamoeba invadens
IVDVMVLVYITETLHSV

SEQ ID NO: 3001641 - protein, 20 aa, Entamoeba invadens
IVDWLQGIDVVFLVAYERVV

SEQ ID NO: 3001642 - protein, 19 aa, Entamoeba invadens
IVEASWLEAFNKIVQERGA

SEQ ID NO: 3001643 - protein, 27 aa, Entamoeba invadens
IVEDKMDMILFNLGSMQEVFAKKIDET

SEQ ID NO: 3001644 - protein, 27 aa, Entamoeba invadens
IVEDYALRLRHWIEFGFSEFGDLGAMG

SEQ ID NO: 3001645 - protein, 26 aa, Entamoeba invadens
IVEFKNTLLTLLKEKEKIRYDQELEK

SEQ ID NO: 3001646 - protein, 21 aa, Entamoeba invadens
IVEMLQLLIDFVRELGYFVET

SEQ ID NO: 3001647 - protein, 24 aa, Entamoeba invadens
IVENKIVFLYKLLDGSCPKSYGMK

SEQ ID NO: 3001648 - protein, 24 aa, Entamoeba invadens
IVEPQLFISALIKNVPKSIFEILN

SEQ ID NO: 3001649 - protein, 20 aa, Entamoeba invadens
IVEQLKLTINEKVDLEKTIE

SEQ ID NO: 3001650 - protein, 19 aa, Entamoeba invadens
IVEQQAVFIALLNQFGDVT

SEQ ID NO: 3001651 - protein, 21 aa, Entamoeba invadens
IVESLHFMLDFLRELGYKSET

SEQ ID NO: 3001652 - protein, 26 aa, Entamoeba invadens
IVEVAIIKKYLYKLTTDNVRTLWERF

SEQ ID NO: 3001653 - protein, 22 aa, Entamoeba invadens
IVEWTNMCQYRVLYRSTKDNLT

SEQ ID NO: 3001654 - protein, 37 aa, Entamoeba invadens
IVEYFKKTFKAYPMVRWFWMVEYSGGYFGFQTIFSCK

SEQ ID NO: 3001655 - protein, 20 aa, Entamoeba invadens
IVEYIPMRLSEKERVLLEIV

SEQ ID NO: 3001656 - protein, 30 aa, Entamoeba invadens
IVFCNSTVRAFLVFKLIRAMGEYFHLEKNK

SEQ ID NO: 3001657 - protein, 25 aa, Entamoeba invadens
IVFERVHILHNAGVLTFRAASSLAT

SEQ ID NO: 3001658 - protein, 17 aa, Entamoeba invadens
IVFHAVFRMRLIEMRHL

SEQ ID NO: 3001659 - protein, 18 aa, Entamoeba invadens
IVFKCPLVKLYLDSNNLS

SEQ ID NO: 3001660 - protein, 17 aa, Entamoeba invadens
IVFKGKFPPNCKNITAI

SEQ ID NO: 3001661 - protein, 18 aa, Entamoeba invadens
IVFRFSPSPTHQPPKESF

SEQ ID NO: 3001662 - protein, 30 aa, Entamoeba invadens
IVGDKTYRIRYLKHPYLSRKNDDLVVSKKV

SEQ ID NO: 3001663 - protein, 29 aa, Entamoeba invadens
IVGESLMKKYFGVLFMKLGSENTNDFLEI

SEQ ID NO: 3001664 - protein, 42 aa, Entamoeba invadens
IVGEYIEGLFWVFQYYTVGVPSWRWFYPEHYAPFAEDIYKYI

SEQ ID NO: 3001665 - protein, 19 aa, Entamoeba invadens
IVGEYYKINGVPYHKECTP

SEQ ID NO: 3001666 - protein, 17 aa, Entamoeba invadens
IVGFDGVKVYYYNSAED

SEQ ID NO: 3001667 - protein, 26 aa, Entamoeba invadens
IVGKRNLFFFNFDQKGNVFGAYIKSM

SEQ ID NO: 3001668 - protein, 23 aa, Entamoeba invadens
IVGMDLYLYDIDPISLSGVSKEF

SEQ ID NO: 3001669 - protein, 17 aa, Entamoeba invadens
IVGNLPGQSAWRVNPKV

SEQ ID NO: 3001670 - protein, 24 aa, Entamoeba invadens
IVGPSCTFNIFKTLNGILIKFDDR

SEQ ID NO: 3001671 - protein, 17 aa, Entamoeba invadens
IVGWYHSHPGFGCWLSS

SEQ ID NO: 3001672 - protein, 17 aa, Entamoeba invadens
IVHFHCGHSFHKKCLGS

SEQ ID NO: 3001673 - protein, 19 aa, Entamoeba invadens
IVHFYGAVFIINKMSMVTE

SEQ ID NO: 3001674 - protein, 18 aa, Entamoeba invadens
IVHFYGAVFIPTNICMVT

SEQ ID NO: 3001675 - protein, 19 aa, Entamoeba invadens
IVICNLFNSVLDKTQILPL

SEQ ID NO: 3001676 - protein, 24 aa, Entamoeba invadens
IVIDTLKLVLRFKDFLDPQTLEED

SEQ ID NO: 3001677 - protein, 26 aa, Entamoeba invadens
IVIGTPGRLLGLFNKGVLDLSQLDTF

SEQ ID NO: 3001678 - protein, 18 aa, Entamoeba invadens
IVIKKKRTDFSFLDSPND

SEQ ID NO: 3001679 - protein, 17 aa, Entamoeba invadens
IVILFFANKKCVGGIDL

SEQ ID NO: 3001680 - protein, 27 aa, Entamoeba invadens
IVIPQMTCHKVLPPSYQSDLIRQDPDI

SEQ ID NO: 3001681 - protein, 28 aa, Entamoeba invadens
IVISHDFITHVLPFFDVINRSSKIVEFS

SEQ ID NO: 3001682 - protein, 17 aa, Entamoeba invadens
IVISVGWRRYQTVATFS

SEQ ID NO: 3001683 - protein, 26 aa, Entamoeba invadens
IVIVQCLDYFDLVHLVINCSILIEFM

SEQ ID NO: 3001684 - protein, 24 aa, Entamoeba invadens
IVKAFLGCYLIINGTILEISLDST

SEQ ID NO: 3001685 - protein, 22 aa, Entamoeba invadens
IVKALHVTIIFEQQLYKRVYHK

SEQ ID NO: 3001686 - protein, 25 aa, Entamoeba invadens
IVKDLKTIFGIKDEIKCFLRKEVDK

SEQ ID NO: 3001687 - protein, 21 aa, Entamoeba invadens
IVKFVLLISKEIVPSAKKIQE

SEQ ID NO: 3001688 - protein, 24 aa, Entamoeba invadens
IVKGFIRDLVEFMYMVLCNSTINR

SEQ ID NO: 3001689 - protein, 17 aa, Entamoeba invadens
IVKLILHYNESVAPILL

SEQ ID NO: 3001690 - protein, 20 aa, Entamoeba invadens
IVKLLIEMLLCNTTANKLRY

SEQ ID NO: 3001691 - protein, 18 aa, Entamoeba invadens
IVKLLQKYSFKTLKLEGI

SEQ ID NO: 3001692 - protein, 19 aa, Entamoeba invadens
IVKLPLYLQVIPSSCFGLC

SEQ ID NO: 3001693 - protein, 20 aa, Entamoeba invadens
IVKNLCLKRPIFQKTAVGGH

SEQ ID NO: 3001694 - protein, 22 aa, Entamoeba invadens
IVKPGRFYVRCGALTEIGRKMN

SEQ ID NO: 3001695 - protein, 26 aa, Entamoeba invadens
IVKSCFVVISFLPQYFVEQPFLQLMN

SEQ ID NO: 3001696 - protein, 19 aa, Entamoeba invadens
IVKTPPCIFGMRLESLNRL

SEQ ID NO: 3001697 - protein, 27 aa, Entamoeba invadens
IVKVYEDLVYLIAYLDEKRQAHQGEEK

SEQ ID NO: 3001698 - protein, 17 aa, Entamoeba invadens
IVKYRERVLKIPVINPV

SEQ ID NO: 3001699 - protein, 18 aa, Entamoeba invadens
IVLEMTIYRLGGVIGLMS

SEQ ID NO: 3001700 - protein, 17 aa, Entamoeba invadens
IVLKIAKTKKAIAEPGV

SEQ ID NO: 3001701 - protein, 19 aa, Entamoeba invadens
IVLLDFVISFVYKEKTKKS

SEQ ID NO: 3001702 - protein, 17 aa, Entamoeba invadens
IVLLITFKNVIQNDILL

SEQ ID NO: 3001703 - protein, 17 aa, Entamoeba invadens
IVLNILNPNPFTLQPMT

SEQ ID NO: 3001704 - protein, 29 aa, Entamoeba invadens
IVLNKGYIPLFESKFLFLEKLLPALRSGV

SEQ ID NO: 3001705 - protein, 17 aa, Entamoeba invadens
IVLNSSRNCLLPFVDGY

SEQ ID NO: 3001706 - protein, 34 aa, Entamoeba invadens
IVLQPSKDFIIQGGAIRVFIVIDAQKEEIPVEKH

SEQ ID NO: 3001707 - protein, 21 aa, Entamoeba invadens
IVLSRYPLFQSRYNIPIAISN

SEQ ID NO: 3001708 - protein, 18 aa, Entamoeba invadens
IVLVCKKYKYVLDRIRMN

SEQ ID NO: 3001709 - protein, 26 aa, Entamoeba invadens
IVLVGGMTRMPLIQQTVFEIFGKYGN

SEQ ID NO: 3001710 - protein, 19 aa, Entamoeba invadens
IVMEYIDGVTLKRFLTQHY

SEQ ID NO: 3001711 - protein, 19 aa, Entamoeba invadens
IVMFGFAKSGKTTFIKDVV

SEQ ID NO: 3001712 - protein, 19 aa, Entamoeba invadens
IVMFLRKFMRQIECIVSYY

SEQ ID NO: 3001713 - protein, 23 aa, Entamoeba invadens
IVMKDLFRKYPQKYLPVIAKLCD

SEQ ID NO: 3001714 - protein, 20 aa, Entamoeba invadens
IVMLQKALSHFLQFCKIVNT

SEQ ID NO: 3001715 - protein, 17 aa, Entamoeba invadens
IVMRYYHPKDYYIDWDE

SEQ ID NO: 3001716 - protein, 19 aa, Entamoeba invadens
IVMVKWLTRDQPIGTAVFN

SEQ ID NO: 3001717 - protein, 22 aa, Entamoeba invadens
IVMYHMQFLNKDIDIYCCEECE

SEQ ID NO: 3001718 - protein, 42 aa, Entamoeba invadens
IVNNFNFFAIHWYYQTRRFFFKVIFNRLTIAPAFRITGSLLE

SEQ ID NO: 3001719 - protein, 28 aa, Entamoeba invadens
IVNNGIAKMVFPLQRIKLLLCNQHKDCF

SEQ ID NO: 3001720 - protein, 29 aa, Entamoeba invadens
IVNNRTVLQLAKLVFLMTIKSFYWKEEEN

SEQ ID NO: 3001721 - protein, 17 aa, Entamoeba invadens
IVNTPIFTFSPQLFKAL

SEQ ID NO: 3001722 - protein, 24 aa, Entamoeba invadens
IVNTWSFAILFSQFANGQNYLTDE

SEQ ID NO: 3001723 - protein, 21 aa, Entamoeba invadens
IVNYLLCKNWSSQYEYNILMI

SEQ ID NO: 3001724 - protein, 19 aa, Entamoeba invadens
IVPAFVQDKFDLKKYTKLC

SEQ ID NO: 3001725 - protein, 18 aa, Entamoeba invadens
IVPFFQTHNTFFSTFPCV

SEQ ID NO: 3001726 - protein, 18 aa, Entamoeba invadens
IVPFRDSHYLFSSYIFEQ

SEQ ID NO: 3001727 - protein, 30 aa, Entamoeba invadens
IVPHTVLNSYLFSVFLSFVYNSGVPTMVLP

SEQ ID NO: 3001728 - protein, 18 aa, Entamoeba invadens
IVPIIRLTGDMRNTVREY

SEQ ID NO: 3001729 - protein, 17 aa, Entamoeba invadens
IVPLIQELLITFITTYP

SEQ ID NO: 3001730 - protein, 17 aa, Entamoeba invadens
IVPVAKLIDNETEIEAL

SEQ ID NO: 3001731 - protein, 25 aa, Entamoeba invadens
IVPVERFDVIKIPRPNDFGSVAQVS

SEQ ID NO: 3001732 - protein, 21 aa, Entamoeba invadens
IVQERLAGIILINPQIQNSSL

SEQ ID NO: 3001733 - protein, 19 aa, Entamoeba invadens
IVQHFLFGKILPFEQPKRE

SEQ ID NO: 3001734 - protein, 24 aa, Entamoeba invadens
IVQKAIKIVPFLQSEDFSLTYVFR

SEQ ID NO: 3001735 - protein, 25 aa, Entamoeba invadens
IVQKKIYAMMLNDLKMKRVDQSAAL

SEQ ID NO: 3001736 - protein, 18 aa, Entamoeba invadens
IVQKLMRSIKTTFNTSKH

SEQ ID NO: 3001737 - protein, 24 aa, Entamoeba invadens
IVQKNSFKELYYSTSFLSQNVVHD

SEQ ID NO: 3001738 - protein, 26 aa, Entamoeba invadens
IVQKNYFKVFNLVDQYFLTTIPQDFN

SEQ ID NO: 3001739 - protein, 20 aa, Entamoeba invadens
IVQLIVWITNFSQEKLNGCL

SEQ ID NO: 3001740 - protein, 35 aa, Entamoeba invadens
IVQNSPLFRTQVANLSFIALLQSIGKMKKQFGSVN

SEQ ID NO: 3001741 - protein, 24 aa, Entamoeba invadens
IVQQQPLYFVQQPPIIQGQREALE

SEQ ID NO: 3001742 - protein, 17 aa, Entamoeba invadens
IVQTFMNLYGSYQPTLS

SEQ ID NO: 3001743 - protein, 17 aa, Entamoeba invadens
IVQTQYRRKWVNSNVVY

SEQ ID NO: 3001744 - protein, 26 aa, Entamoeba invadens
IVQVCRKFRFTLEKFRFNPIPITSHK

SEQ ID NO: 3001745 - protein, 24 aa, Entamoeba invadens
IVRAKIWELFWELQSQDFGMSETE

SEQ ID NO: 3001746 - protein, 21 aa, Entamoeba invadens
IVRFFGHFFHDNSLWIVMEIC

SEQ ID NO: 3001747 - protein, 30 aa, Entamoeba invadens
IVRHRNVAKLIYIQLLGYPTQYGQMECLTL

SEQ ID NO: 3001748 - protein, 27 aa, Entamoeba invadens
IVRIYNCFFCYFGGSLQFWIIMESCTQ

SEQ ID NO: 3001749 - protein, 31 aa, Entamoeba invadens
IVRNKPVGCVLIFLPGIFEITNLQREILSTP

SEQ ID NO: 3001750 - protein, 18 aa, Entamoeba invadens
IVRRYMLAVLDEKMGLSK

SEQ ID NO: 3001751 - protein, 35 aa, Entamoeba invadens
IVRSQTMIPTELLVLYKIPDTYIKDVLRLGAEMLP

SEQ ID NO: 3001752 - protein, 18 aa, Entamoeba invadens
IVRVEIPWFCLKSVGMDC

SEQ ID NO: 3001753 - protein, 30 aa, Entamoeba invadens
IVRVPDIRLFGITLLKTIITSNNFLQMASG

SEQ ID NO: 3001754 - protein, 33 aa, Entamoeba invadens
IVRYHKTALVLTKLGLISVVLFSNGKALFGDFI

SEQ ID NO: 3001755 - protein, 17 aa, Entamoeba invadens
IVSARIASYRFNGKVIS

SEQ ID NO: 3001756 - protein, 25 aa, Entamoeba invadens
IVSEKHENGWWYATNKENATVGFVP

SEQ ID NO: 3001757 - protein, 19 aa, Entamoeba invadens
IVSFHDISFGYSPEKILFR

SEQ ID NO: 3001758 - protein, 19 aa, Entamoeba invadens
IVSFKFEGLYGVKMLFDIG

SEQ ID NO: 3001759 - protein, 17 aa, Entamoeba invadens
IVSIFMESWNKNASELI

SEQ ID NO: 3001760 - protein, 24 aa, Entamoeba invadens
IVSILGFGVSKFSLGYKLNFIKER

SEQ ID NO: 3001761 - protein, 17 aa, Entamoeba invadens
IVSILTKSNVDGAIIVT

SEQ ID NO: 3001762 - protein, 27 aa, Entamoeba invadens
IVSKKKFYRIIVWFNVDFETVDRNKNR

SEQ ID NO: 3001763 - protein, 36 aa, Entamoeba invadens
IVSKKLDIFSLAITMWVLFFEDIPFSTYAQSVDDVR

SEQ ID NO: 3001764 - protein, 25 aa, Entamoeba invadens
IVSKSAYVLYYIRKDVDTYTGDVQK

SEQ ID NO: 3001765 - protein, 18 aa, Entamoeba invadens
IVSKYFKTIRDFIRLEFV

SEQ ID NO: 3001766 - protein, 21 aa, Entamoeba invadens
IVSKYFMCLSDFKNMVFVCKK

SEQ ID NO: 3001767 - protein, 18 aa, Entamoeba invadens
IVSKYFSTILDFIKLQFV

SEQ ID NO: 3001768 - protein, 18 aa, Entamoeba invadens
IVSKYFVCLNDFKNLILV

SEQ ID NO: 3001769 - protein, 18 aa, Entamoeba invadens
IVSLQLLRVEVIRSLRDV

SEQ ID NO: 3001770 - protein, 19 aa, Entamoeba invadens
IVSNVLRKGARNSRLWIHA

SEQ ID NO: 3001771 - protein, 17 aa, Entamoeba invadens
IVSPTEVFLGKERKRAG

SEQ ID NO: 3001772 - protein, 17 aa, Entamoeba invadens
IVSSCFTTFLVKDTQTN

SEQ ID NO: 3001773 - protein, 24 aa, Entamoeba invadens
IVSTNSLLLMSTWKGENQLKLGNI

SEQ ID NO: 3001774 - protein, 33 aa, Entamoeba invadens
IVSTVASDAFACAKLILVFRVDSTFDESLGFVK

SEQ ID NO: 3001775 - protein, 17 aa, Entamoeba invadens
IVSVYSAVSVINNAFDD

SEQ ID NO: 3001776 - protein, 25 aa, Entamoeba invadens
IVSYQLLNALLVFQSAVLRNDKEKI

SEQ ID NO: 3001777 - protein, 19 aa, Entamoeba invadens
IVTALITNDLKFIIIGFSD

SEQ ID NO: 3001778 - protein, 33 aa, Entamoeba invadens
IVTDKMMRIVQTWGILFPVELIDYINMYNRTQK

SEQ ID NO: 3001779 - protein, 28 aa, Entamoeba invadens
IVTGLQNLIHMLLLYHDPILSIHLDTYR

SEQ ID NO: 3001780 - protein, 27 aa, Entamoeba invadens
IVTGSLTITFTLPADYPTTLPSFTLKS

SEQ ID NO: 3001781 - protein, 18 aa, Entamoeba invadens
IVTINLLDVKMTATQMSK

SEQ ID NO: 3001782 - protein, 17 aa, Entamoeba invadens
IVTQFHYNPIPLTFNTL

SEQ ID NO: 3001783 - protein, 20 aa, Entamoeba invadens
IVVDKMLNVWFFSLKEIEGV

SEQ ID NO: 3001784 - protein, 17 aa, Entamoeba invadens
IVVEPPLEKRKKRSTGK

SEQ ID NO: 3001785 - protein, 19 aa, Entamoeba invadens
IVVHELFVYSFESPSIELK

SEQ ID NO: 3001786 - protein, 23 aa, Entamoeba invadens
IVVKKIMIYAKSLGKYGGSPFVY

SEQ ID NO: 3001787 - protein, 17 aa, Entamoeba invadens
IVVLDNKRLKIYSNNGK

SEQ ID NO: 3001788 - protein, 25 aa, Entamoeba invadens
IVVMLVNFFKDLYHGFEFSFTISDC

SEQ ID NO: 3001789 - protein, 17 aa, Entamoeba invadens
IVVPDKMVRKYTTMGYN

SEQ ID NO: 3001790 - protein, 21 aa, Entamoeba invadens
IVVSDIFLELFSNANLYDTYM

SEQ ID NO: 3001791 - protein, 18 aa, Entamoeba invadens
IVVVSKYFLSIKDFTNFV

SEQ ID NO: 3001792 - protein, 21 aa, Entamoeba invadens
IVWDRRFIKGVKYFDIKPTTA

SEQ ID NO: 3001793 - protein, 28 aa, Entamoeba invadens
IVYEHKRFFFHFFLSPENTEVLKFLTFL

SEQ ID NO: 3001794 - protein, 18 aa, Entamoeba invadens
IVYKWIGCEHMKAIFDSE

SEQ ID NO: 3001795 - protein, 19 aa, Entamoeba invadens
IVYLFEKRSLVSDDFIGAA

SEQ ID NO: 3001796 - protein, 20 aa, Entamoeba invadens
IVYLGEFRGYKVAIKKIKEG

SEQ ID NO: 3001797 - protein, 27 aa, Entamoeba invadens
IVYSTHSMFLAFSLLYLGSQGATQKEI

SEQ ID NO: 3001798 - protein, 21 aa, Entamoeba invadens
IWDVTSPEIAFQLLEENEFEK

SEQ ID NO: 3001799 - protein, 25 aa, Entamoeba invadens
IWENKQLFPFANVEELKLVNFSDVC

SEQ ID NO: 3001800 - protein, 26 aa, Entamoeba invadens
IWFQIPIRLKKTRKRENEKTRKRENE

SEQ ID NO: 3001801 - protein, 19 aa, Entamoeba invadens
IWGNLAVCYWNLGNEPLAF

SEQ ID NO: 3001802 - protein, 19 aa, Entamoeba invadens
IWKVTAIVHTLPFEYKFKI

SEQ ID NO: 3001803 - protein, 21 aa, Entamoeba invadens
IWKYKRSYLVYCQDSEIINFY

SEQ ID NO: 3001804 - protein, 18 aa, Entamoeba invadens
IWKYLSLWDGDMQVDGTC

SEQ ID NO: 3001805 - protein, 23 aa, Entamoeba invadens
IWNQKDFIVWVKKVLEYSLFPEK

SEQ ID NO: 3001806 - protein, 38 aa, Entamoeba invadens
IWQNRYNILIQFPDSLDLLLRAVPWNEFRAREEMADLI

SEQ ID NO: 3001807 - protein, 18 aa, Entamoeba invadens
IWRNKSRSCKTPFLMSTH

SEQ ID NO: 3001808 - protein, 19 aa, Entamoeba invadens
IWSGAVQTLLRALGNIMKV

SEQ ID NO: 3001809 - protein, 20 aa, Entamoeba invadens
IWSHACVIFELLTGDFLFSP

SEQ ID NO: 3001810 - protein, 22 aa, Entamoeba invadens
IWSIGVILVRMLTGKYPFYSKD

SEQ ID NO: 3001811 - protein, 18 aa, Entamoeba invadens
IWTRVKQISLIPTYMSGV

SEQ ID NO: 3001812 - protein, 19 aa, Entamoeba invadens
IWVMVPYGVEPDKLFHYFS

SEQ ID NO: 3001813 - protein, 18 aa, Entamoeba invadens
IYAKLRDGVLEHLIPYLV

SEQ ID NO: 3001814 - protein, 20 aa, Entamoeba invadens
IYAVRGFRNLYFLGAENEEQ

SEQ ID NO: 3001815 - protein, 18 aa, Entamoeba invadens
IYCINVLSHFYKDVADSE

SEQ ID NO: 3001816 - protein, 19 aa, Entamoeba invadens
IYDDELIAYILSRCLDVIR

SEQ ID NO: 3001817 - protein, 34 aa, Entamoeba invadens
IYDDTITKLFSLNYTILCHSGYYSNVTSCEKCID

SEQ ID NO: 3001818 - protein, 28 aa, Entamoeba invadens
IYDKTIVKPLFNTIQKYLKKDGKCIIFN

SEQ ID NO: 3001819 - protein, 22 aa, Entamoeba invadens
IYDKYLNPYTFYKANLNSTIRL

SEQ ID NO: 3001820 - protein, 24 aa, Entamoeba invadens
IYDSGLSVCKMFLRGMAQSVTSVT

SEQ ID NO: 3001821 - protein, 18 aa, Entamoeba invadens
IYDWNVTLPQVLHGALFN

SEQ ID NO: 3001822 - protein, 18 aa, Entamoeba invadens
IYEAFQVEIFATTGIEIY

SEQ ID NO: 3001823 - protein, 19 aa, Entamoeba invadens
IYEENGRYFLRKSHNVYNC

SEQ ID NO: 3001824 - protein, 25 aa, Entamoeba invadens
IYEKNIIRVMWVSGKMKGLNQVNPA

SEQ ID NO: 3001825 - protein, 20 aa, Entamoeba invadens
IYEQLKTLLYMYIANPKGNK

SEQ ID NO: 3001826 - protein, 20 aa, Entamoeba invadens
IYFIEKTCFPPLEAATRESL

SEQ ID NO: 3001827 - protein, 19 aa, Entamoeba invadens
IYFKELFVRCNGKYAASLG

SEQ ID NO: 3001828 - protein, 23 aa, Entamoeba invadens
IYGKLQMEFILKELLDSPNEEVI

SEQ ID NO: 3001829 - protein, 24 aa, Entamoeba invadens
IYHFIQNCWYHRPTDRIDIEEVVK

SEQ ID NO: 3001830 - protein, 17 aa, Entamoeba invadens
IYHGAMSIKYQAPQYFF

SEQ ID NO: 3001831 - protein, 18 aa, Entamoeba invadens
IYHLTNYIRSFIPAIEET

SEQ ID NO: 3001832 - protein, 27 aa, Entamoeba invadens
IYHRDMTLFINKIAKTNFEYPTYGPIG

SEQ ID NO: 3001833 - protein, 21 aa, Entamoeba invadens
IYIDYQCVLMVLLTSDTSFLI

SEQ ID NO: 3001834 - protein, 23 aa, Entamoeba invadens
IYIFGIINTIRIYLKPNSQSNNT

SEQ ID NO: 3001835 - protein, 17 aa, Entamoeba invadens
IYIPNSVTMIGTAVFKG

SEQ ID NO: 3001836 - protein, 17 aa, Entamoeba invadens
IYKDFKAQLSYLIALKR

SEQ ID NO: 3001837 - protein, 19 aa, Entamoeba invadens
IYKFIPRTVGPYEKPTAMI

SEQ ID NO: 3001838 - protein, 26 aa, Entamoeba invadens
IYKKDIVDEIIPIKTQDAWKTSRLVV

SEQ ID NO: 3001839 - protein, 18 aa, Entamoeba invadens
IYKVIKNKYTFKGDVVLY

SEQ ID NO: 3001840 - protein, 27 aa, Entamoeba invadens
IYLGDRWLRFDPPLGRIIKLDQIELIP

SEQ ID NO: 3001841 - protein, 17 aa, Entamoeba invadens
IYLVEAIEFMNFAFAEQ

SEQ ID NO: 3001842 - protein, 19 aa, Entamoeba invadens
IYMDRLQLGQQHFARRLCE

SEQ ID NO: 3001843 - protein, 26 aa, Entamoeba invadens
IYMNDDFLFYRPTPPSFFLQDGKVQI

SEQ ID NO: 3001844 - protein, 17 aa, Entamoeba invadens
IYMWFMGVDRDRSGTLE

SEQ ID NO: 3001845 - protein, 20 aa, Entamoeba invadens
IYNCAICMTCGCFLCYKDGK

SEQ ID NO: 3001846 - protein, 26 aa, Entamoeba invadens
IYNDKSVFWKLYYKSTVYNNEHVLLT

SEQ ID NO: 3001847 - protein, 30 aa, Entamoeba invadens
IYNEFKLSHKWRYILFKMNDKMTEIVVDTT

SEQ ID NO: 3001848 - protein, 17 aa, Entamoeba invadens
IYNIAQIIEYRPLTALP

SEQ ID NO: 3001849 - protein, 17 aa, Entamoeba invadens
IYNIIQLSWKQNPKERI

SEQ ID NO: 3001850 - protein, 20 aa, Entamoeba invadens
IYNLFANFVSIGKGGFGEVF

SEQ ID NO: 3001851 - protein, 34 aa, Entamoeba invadens
IYNMSSLDTLLPRLLVCWFGFDALKDTYIRAGDG

SEQ ID NO: 3001852 - protein, 30 aa, Entamoeba invadens
IYPFTTLENFPKLDKLPFPTIKKIDYGLCS

SEQ ID NO: 3001853 - protein, 18 aa, Entamoeba invadens
IYQIWPSITQEELLFSIR

SEQ ID NO: 3001854 - protein, 22 aa, Entamoeba invadens
IYQRQHLPYNLADRVRTSPVLT

SEQ ID NO: 3001855 - protein, 27 aa, Entamoeba invadens
IYQTNVKTVWLMTKKFHSLLELSKGCV

SEQ ID NO: 3001856 - protein, 29 aa, Entamoeba invadens
IYRCFHKYLAWVFGSYKKYIWFDQTKQKH

SEQ ID NO: 3001857 - protein, 24 aa, Entamoeba invadens
IYRKKKYFMQLPRKAFQEDKPTTS

SEQ ID NO: 3001858 - protein, 25 aa, Entamoeba invadens
IYRYGRNFLIPADRYSFPKFTGASI

SEQ ID NO: 3001859 - protein, 20 aa, Entamoeba invadens
IYSFAITMYEGIRWKEAYPI

SEQ ID NO: 3001860 - protein, 20 aa, Entamoeba invadens
IYSFAITMYETFNWGDAYPK

SEQ ID NO: 3001861 - protein, 20 aa, Entamoeba invadens
IYSFAITMYEVFGWKEAYSI

SEQ ID NO: 3001862 - protein, 20 aa, Entamoeba invadens
IYSFAITMYEVFGWKEAYSV

SEQ ID NO: 3001863 - protein, 27 aa, Entamoeba invadens
IYSIAAEILGFKYLRSLMRATSMITGG

SEQ ID NO: 3001864 - protein, 27 aa, Entamoeba invadens
IYSMRSVYKYLPYVKNYFIVTADQVPS

SEQ ID NO: 3001865 - protein, 30 aa, Entamoeba invadens
IYSQLPIYNVLDRFSDGMWKLLNEQKKTLQ

SEQ ID NO: 3001866 - protein, 20 aa, Entamoeba invadens
IYSVSLPHNFLRLCFVETHQ

SEQ ID NO: 3001867 - protein, 27 aa, Entamoeba invadens
IYTNIGPVLIVINPFKDLGLTTDEYVR

SEQ ID NO: 3001868 - protein, 17 aa, Entamoeba invadens
IYTQLMFDALTKNDVFN

SEQ ID NO: 3001869 - protein, 18 aa, Entamoeba invadens
IYTTERFEFSTKAIWSVL

SEQ ID NO: 3001870 - protein, 18 aa, Entamoeba invadens
IYVDGCYDMFHWGHANVI

SEQ ID NO: 3001871 - protein, 23 aa, Entamoeba invadens
IYVKIHCNRAIIGVLRGFDEYLN

SEQ ID NO: 3001872 - protein, 17 aa, Entamoeba invadens
IYVLDIGLLVCCSMFKD

SEQ ID NO: 3001873 - protein, 20 aa, Entamoeba invadens
IYVVVCNKIDLANPLITHEM

SEQ ID NO: 3001874 - protein, 25 aa, Entamoeba invadens
IYYDQLQILTQLFISPLRSQNTNSV

SEQ ID NO: 3001875 - protein, 29 aa, Entamoeba invadens
KAAATRVQIPLQLAWAISIHKSQGMTLER

SEQ ID NO: 3001876 - protein, 30 aa, Entamoeba invadens
KAADIYSFFITMLEIFIWEEVFQKDVLRFK

SEQ ID NO: 3001877 - protein, 17 aa, Entamoeba invadens
KAADLVFDKSKPIFRHD

SEQ ID NO: 3001878 - protein, 24 aa, Entamoeba invadens
KAAEAVVALPFQALRFKKLDTHDE

SEQ ID NO: 3001879 - protein, 21 aa, Entamoeba invadens
KAAEWTPEDFLWQGKCVVVGR

SEQ ID NO: 3001880 - protein, 22 aa, Entamoeba invadens
KAAFKVYLDYFGFRACFDPSEV

SEQ ID NO: 3001881 - protein, 18 aa, Entamoeba invadens
KAAFLPIAGKLIENVWDL

SEQ ID NO: 3001882 - protein, 22 aa, Entamoeba invadens
KAAFYEAPDNHLIIPYTAECEH

SEQ ID NO: 3001883 - protein, 26 aa, Entamoeba invadens
KAAGKKLVAMIAPATRIGIAEAFGLP

SEQ ID NO: 3001884 - protein, 22 aa, Entamoeba invadens
KAAHTQLPFHIAKKKVGYIDET

SEQ ID NO: 3001885 - protein, 25 aa, Entamoeba invadens
KAAISEMFFGVVLYLVEQEKMPCAI

SEQ ID NO: 3001886 - protein, 20 aa, Entamoeba invadens
KAAPFLPRSKSLQLEEEKMK

SEQ ID NO: 3001887 - protein, 18 aa, Entamoeba invadens
KAAQLIRSLVTTDNYVLV

SEQ ID NO: 3001888 - protein, 25 aa, Entamoeba invadens
KAASVAYLLEYWRKVPNVFSETYMM

SEQ ID NO: 3001889 - protein, 20 aa, Entamoeba invadens
KACLEPMIKAFRLACYKFPG

SEQ ID NO: 3001890 - protein, 21 aa, Entamoeba invadens
KACLEPMIKAFRLACYKFPGR

SEQ ID NO: 3001891 - protein, 22 aa, Entamoeba invadens
KACSVVQYFRFMNTLDNVHQVY

SEQ ID NO: 3001892 - protein, 22 aa, Entamoeba invadens
KACYMLAKMGLLRSFWCYFKNK

SEQ ID NO: 3001893 - protein, 24 aa, Entamoeba invadens
KADANFTYYRRESKYLLRVFDDLT

SEQ ID NO: 3001894 - protein, 24 aa, Entamoeba invadens
KADDVWKKLYDFADDLKVGDLDKQ

SEQ ID NO: 3001895 - protein, 20 aa, Entamoeba invadens
KADLFRLIHSVDSLPPEYRY

SEQ ID NO: 3001896 - protein, 24 aa, Entamoeba invadens
KADLSIFMLQKLFAFVNGEIDEES

SEQ ID NO: 3001897 - protein, 30 aa, Entamoeba invadens
KADNRNLLGLLYLLFRRYRLDVIKNEEGTE

SEQ ID NO: 3001898 - protein, 33 aa, Entamoeba invadens
KADSERLLVLTLWKQNIAVFTNPSPLVIPNDSL

SEQ ID NO: 3001899 - protein, 24 aa, Entamoeba invadens
KADVVVFSLKNPFDLNFVPFKLKD

SEQ ID NO: 3001900 - protein, 26 aa, Entamoeba invadens
KADVWALGCVLFKLCYFDTPFEESPM

SEQ ID NO: 3001901 - protein, 29 aa, Entamoeba invadens
KADYGKEVVIFLIVGPRLSGTDLETVLTI

SEQ ID NO: 3001902 - protein, 28 aa, Entamoeba invadens
KAEAAAKVFLPFTPSFITLFCETKERRP

SEQ ID NO: 3001903 - protein, 28 aa, Entamoeba invadens
KAECDLPKLLLPLNSLKELHLRKSVIPG

SEQ ID NO: 3001904 - protein, 19 aa, Entamoeba invadens
KAEEIWKFVATFSELEQEN

SEQ ID NO: 3001905 - protein, 21 aa, Entamoeba invadens
KAEIIELNKSFFESSAKISDF

SEQ ID NO: 3001906 - protein, 17 aa, Entamoeba invadens
KAEIVGCVIKYGGASKR

SEQ ID NO: 3001907 - protein, 26 aa, Entamoeba invadens
KAEKCVKCKNGYYPYTNGTCILCDST

SEQ ID NO: 3001908 - protein, 31 aa, Entamoeba invadens
KAEKFIPDYFQYYVHYPLSLTNYYKLKQSKN

SEQ ID NO: 3001909 - protein, 27 aa, Entamoeba invadens
KAENVLNIYYKFYWVMVNVSGYKKYSS

SEQ ID NO: 3001910 - protein, 21 aa, Entamoeba invadens
KAERLVDCDMSFLSQMRRIGC

SEQ ID NO: 3001911 - protein, 27 aa, Entamoeba invadens
KAEVYAIGLFLYYLLAGTLPRCCSNSS

SEQ ID NO: 3001912 - protein, 25 aa, Entamoeba invadens
KAFEIQYVALRNIRLILQKCKELLV

SEQ ID NO: 3001913 - protein, 19 aa, Entamoeba invadens
KAFEWHFLDLTKPKQQPPQ

SEQ ID NO: 3001914 - protein, 23 aa, Entamoeba invadens
KAFIKKLWGLHVNKYYKDGYDLN

SEQ ID NO: 3001915 - protein, 28 aa, Entamoeba invadens
KAFQPHFMDFLNGYFDLLKKLPISADYF

SEQ ID NO: 3001916 - protein, 25 aa, Entamoeba invadens
KAFREDFIYAFATYFDVAFPQSGEV

SEQ ID NO: 3001917 - protein, 19 aa, Entamoeba invadens
KAGFNHPMPVQKATIPVIL

SEQ ID NO: 3001918 - protein, 28 aa, Entamoeba invadens
KAGGFIAARFLTGVPPQEFYFHCMAGRE

SEQ ID NO: 3001919 - protein, 25 aa, Entamoeba invadens
KAGGNAQFALYLRQHGAEKLGLQEK

SEQ ID NO: 3001920 - protein, 25 aa, Entamoeba invadens
KAGHLCPFAPSMFPCYPYEKDPFVL

SEQ ID NO: 3001921 - protein, 28 aa, Entamoeba invadens
KAGKSYKYIKFDKKYFAFSLRSPNSPEP

SEQ ID NO: 3001922 - protein, 21 aa, Entamoeba invadens
KAGKWEVPLPKVKPISEAEVF

SEQ ID NO: 3001923 - protein, 18 aa, Entamoeba invadens
KAGRIEMELYSDIVPKTA

SEQ ID NO: 3001924 - protein, 25 aa, Entamoeba invadens
KAGVKFMFDCVMGLKTGFRGNGCIL

SEQ ID NO: 3001925 - protein, 27 aa, Entamoeba invadens
KAIEKYGEVFLRLNKVALLDSEWMNGS

SEQ ID NO: 3001926 - protein, 23 aa, Entamoeba invadens
KAIETLITLVPLSTRIIPQIFTD

SEQ ID NO: 3001927 - protein, 20 aa, Entamoeba invadens
KAILKKWFNEHYAYPYPSDE

SEQ ID NO: 3001928 - protein, 21 aa, Entamoeba invadens
KAINMSGKFFKEGIPLFVADS

SEQ ID NO: 3001929 - protein, 29 aa, Entamoeba invadens
KAIPQVVFNLCWWIYTFGNRTEGIFRVSG

SEQ ID NO: 3001930 - protein, 21 aa, Entamoeba invadens
KAIQVFLQRTPNLNFLNLTNC

SEQ ID NO: 3001931 - protein, 18 aa, Entamoeba invadens
KAIRGIGKLILLSKNRQL

SEQ ID NO: 3001932 - protein, 25 aa, Entamoeba invadens
KAISCNPFNHIYYSNRAACYSYLEN

SEQ ID NO: 3001933 - protein, 58 aa, Entamoeba invadens
KAISQRKLIEQIAINVIQDTIHIWYQFRNWFRLFKRTKKLKLLKKKLAVEIAKREAAE

SEQ ID NO: 3001934 - protein, 33 aa, Entamoeba invadens
KAISVIFELDFPNPVLLIKLKQLSTKFVMVTSN

SEQ ID NO: 3001935 - protein, 26 aa, Entamoeba invadens
KAIYMKPDLLLLDEPSNHLDFHALVW

SEQ ID NO: 3001936 - protein, 18 aa, Entamoeba invadens
KAKDLFTSDPYTIVSLAG

SEQ ID NO: 3001937 - protein, 19 aa, Entamoeba invadens
KAKERYMMADLFGLLPHAK

SEQ ID NO: 3001938 - protein, 19 aa, Entamoeba invadens
KAKGFWTQQKTVDEKYKTE

SEQ ID NO: 3001939 - protein, 29 aa, Entamoeba invadens
KAKIKELYPGLPIDTIFPKDVPINCANSK

SEQ ID NO: 3001940 - protein, 18 aa, Entamoeba invadens
KAKILELQCQVKFQLKKV

SEQ ID NO: 3001941 - protein, 17 aa, Entamoeba invadens
KAKIPEGYYAKDKVCTA

SEQ ID NO: 3001942 - protein, 17 aa, Entamoeba invadens
KAKKQAKQYARKVEKAE

SEQ ID NO: 3001943 - protein, 17 aa, Entamoeba invadens
KAKKQAKQYARNVEEAE

SEQ ID NO: 3001944 - protein, 19 aa, Entamoeba invadens
KAKLKRKCFICGNYGHSKD

SEQ ID NO: 3001945 - protein, 18 aa, Entamoeba invadens
KAKLLRPFSKGTTPHSHK

SEQ ID NO: 3001946 - protein, 24 aa, Entamoeba invadens
KAKLTERFIKITSIKTPLGVVVDL

SEQ ID NO: 3001947 - protein, 20 aa, Entamoeba invadens
KAKNSYIKYCQEKRESVKED

SEQ ID NO: 3001948 - protein, 40 aa, Entamoeba invadens
KAKTMWTVVCVFYIAIHCVIDIPQIPFLQFGFDGKEAHAK

SEQ ID NO: 3001949 - protein, 23 aa, Entamoeba invadens
KAKTSLLIPKFLENLSIYNSECE

SEQ ID NO: 3001950 - protein, 29 aa, Entamoeba invadens
KAKVNTEEFRFGKIKIFSKVGVLAEIEEI

SEQ ID NO: 3001951 - protein, 27 aa, Entamoeba invadens
KALCEITEKLFLWDKVRVEGGTYGVYA

SEQ ID NO: 3001952 - protein, 25 aa, Entamoeba invadens
KALFVDVFPCDFIVFSVYFSDGGET

SEQ ID NO: 3001953 - protein, 17 aa, Entamoeba invadens
KALGMLHDKFYKNDDII

SEQ ID NO: 3001954 - protein, 29 aa, Entamoeba invadens
KALHPPLSSTPSLYSIPLNEIKSIVLMSD

SEQ ID NO: 3001955 - protein, 17 aa, Entamoeba invadens
KALIYWDMKTKKPSKTV

SEQ ID NO: 3001956 - protein, 23 aa, Entamoeba invadens
KALLKKFIMSKINTLMVGLVYDK

SEQ ID NO: 3001957 - protein, 17 aa, Entamoeba invadens
KALLMKYLGGIDAVPIC

SEQ ID NO: 3001958 - protein, 25 aa, Entamoeba invadens
KALMKQLIVVFLVTRVVIVSDVPVP

SEQ ID NO: 3001959 - protein, 31 aa, Entamoeba invadens
KALQFNKIKFVFLLLDYWFEDYQKKICDENI

SEQ ID NO: 3001960 - protein, 18 aa, Entamoeba invadens
KALQIFPGDSILKKCEEN

SEQ ID NO: 3001961 - protein, 25 aa, Entamoeba invadens
KALSSFCMLAVQYMYYQKAILESRS

SEQ ID NO: 3001962 - protein, 18 aa, Entamoeba invadens
KAMDQYEIAGKRLNVKFA

SEQ ID NO: 3001963 - protein, 21 aa, Entamoeba invadens
KAMELSILCDCEVSLFIFAND

SEQ ID NO: 3001964 - protein, 20 aa, Entamoeba invadens
KAMKWKKKRQIGSTVMTLIL

SEQ ID NO: 3001965 - protein, 23 aa, Entamoeba invadens
KAMLFNNFESKYKLDGYLRDVCL

SEQ ID NO: 3001966 - protein, 26 aa, Entamoeba invadens
KAMNIPTFIRFPNFNLDFYEGDLLKR

SEQ ID NO: 3001967 - protein, 32 aa, Entamoeba invadens
KAMNLDAMKITPFNEVPFGLPPKYSALCPQGV

SEQ ID NO: 3001968 - protein, 19 aa, Entamoeba invadens
KAMQVERISMIYFSGNCLY

SEQ ID NO: 3001969 - protein, 21 aa, Entamoeba invadens
KAMYRQWFNKLTEITIDKVAS

SEQ ID NO: 3001970 - protein, 24 aa, Entamoeba invadens
KAMYRQWFNQLTEITIDKVTSEMA

SEQ ID NO: 3001971 - protein, 24 aa, Entamoeba invadens
KAMYRQWFNQLTELTIDKVSSQMA

SEQ ID NO: 3001972 - protein, 25 aa, Entamoeba invadens
KANCTACIYPHVFNGTKCELCQPNE

SEQ ID NO: 3001973 - protein, 25 aa, Entamoeba invadens
KANGLNPKPYYWYTDQRKYGSCPHG

SEQ ID NO: 3001974 - protein, 23 aa, Entamoeba invadens
KANIDIFLLKKYEMSFPLAQFRR

SEQ ID NO: 3001975 - protein, 24 aa, Entamoeba invadens
KANKERYFVLFNDIMVYGEGNKNS

SEQ ID NO: 3001976 - protein, 23 aa, Entamoeba invadens
KANLKIRLRFMTSVNIQETALHN

SEQ ID NO: 3001977 - protein, 26 aa, Entamoeba invadens
KANYDHNLTLAFDTYEKLGVPKLLDV

SEQ ID NO: 3001978 - protein, 22 aa, Entamoeba invadens
KANYVIPPKTWPSTGSVEFIDF

SEQ ID NO: 3001979 - protein, 23 aa, Entamoeba invadens
KAPLKDVLELWSGLGYNSRAKRL

SEQ ID NO: 3001980 - protein, 20 aa, Entamoeba invadens
KAPLKLPFIVDPEMTKIRGG

SEQ ID NO: 3001981 - protein, 25 aa, Entamoeba invadens
KAPLSIINSKFTKILLKKDILFIVC

SEQ ID NO: 3001982 - protein, 20 aa, Entamoeba invadens
KAPLYIVHLANKGGVKALEE

SEQ ID NO: 3001983 - protein, 22 aa, Entamoeba invadens
KAQILIVLKQWMQSYPSDFSAL

SEQ ID NO: 3001984 - protein, 22 aa, Entamoeba invadens
KAQITPIIRDGYIKYFNSNPFT

SEQ ID NO: 3001985 - protein, 26 aa, Entamoeba invadens
KAQKERYFFLFNDATIIYGEQEGKKI

SEQ ID NO: 3001986 - protein, 22 aa, Entamoeba invadens
KAQLKLFLSARKVYPAIQATIA

SEQ ID NO: 3001987 - protein, 23 aa, Entamoeba invadens
KAQNRIILMTFNALLNIEPSSHD

SEQ ID NO: 3001988 - protein, 32 aa, Entamoeba invadens
KAQQLELLVRCVFKIPEAFVSELDFLKNNNKT

SEQ ID NO: 3001989 - protein, 26 aa, Entamoeba invadens
KAQSVYYYHFFTPQFRNMTVKAYKEY

SEQ ID NO: 3001990 - protein, 26 aa, Entamoeba invadens
KAQTCRGMVGSPYWMAPEVLLDSTYT

SEQ ID NO: 3001991 - protein, 25 aa, Entamoeba invadens
KAREAPFFEFVLNTESFGQTVENIF

SEQ ID NO: 3001992 - protein, 22 aa, Entamoeba invadens
KAREWSFINDMRLLSSVCMYGA

SEQ ID NO: 3001993 - protein, 23 aa, Entamoeba invadens
KARGAYLVVITDREDLGKVADET

SEQ ID NO: 3001994 - protein, 21 aa, Entamoeba invadens
KARILYFSHKLAVILRKEEFE

SEQ ID NO: 3001995 - protein, 17 aa, Entamoeba invadens
KARLFETSPSGLYYGYK

SEQ ID NO: 3001996 - protein, 22 aa, Entamoeba invadens
KARLLIEGGILELFKKGFLDKN

SEQ ID NO: 3001997 - protein, 22 aa, Entamoeba invadens
KARNLVRRKCDMSPCSLTSAEN

SEQ ID NO: 3001998 - protein, 22 aa, Entamoeba invadens
KASEGKLQKIRFDLDEANNTKE

SEQ ID NO: 3001999 - protein, 23 aa, Entamoeba invadens
KASFIQLMGRPIKKGTKLAEPPK

SEQ ID NO: 3002000 - protein, 35 aa, Entamoeba invadens
KASKYNTFLYLTETAICFQYFLKDKKTELPYVIYY

SEQ ID NO: 3002001 - protein, 25 aa, Entamoeba invadens
KASVAASLIAQGYILASDSFQKAVQ

SEQ ID NO: 3002002 - protein, 27 aa, Entamoeba invadens
KATEDVLLLDVAPLTLGIETAGGVMTA

SEQ ID NO: 3002003 - protein, 24 aa, Entamoeba invadens
KATFPIEFQQSSPALLIPNQLRKS

SEQ ID NO: 3002004 - protein, 23 aa, Entamoeba invadens
KATFTQPIFLQKVYIGLQQINMK

SEQ ID NO: 3002005 - protein, 26 aa, Entamoeba invadens
KATHSFTLKCSPKFFFEFVTKYEQSG

SEQ ID NO: 3002006 - protein, 22 aa, Entamoeba invadens
KATIVMPEFAPTAKVMATKGYG

SEQ ID NO: 3002007 - protein, 36 aa, Entamoeba invadens
KATRDDLLYRLRTTELLYMYEKTIVDFTLPHDVPTN

SEQ ID NO: 3002008 - protein, 21 aa, Entamoeba invadens
KATRKFFAFSNPQSQPKTSPK

SEQ ID NO: 3002009 - protein, 25 aa, Entamoeba invadens
KATSKIFNLLIQKRGTYQNPIDIKL

SEQ ID NO: 3002010 - protein, 35 aa, Entamoeba invadens
KAVAGLVLFNQYWYWYPFTLALSLSFAPTTIIGVT

SEQ ID NO: 3002011 - protein, 26 aa, Entamoeba invadens
KAVCVEAGMFALRREALEIRHEDFQQ

SEQ ID NO: 3002012 - protein, 23 aa, Entamoeba invadens
KAVEIKPWMATAAIKSLREIGVE

SEQ ID NO: 3002013 - protein, 23 aa, Entamoeba invadens
KAVELCLKIGRYADALVMTEGNA

SEQ ID NO: 3002014 - protein, 23 aa, Entamoeba invadens
KAVELFRRLLECLQYFSIEDVEF

SEQ ID NO: 3002015 - protein, 25 aa, Entamoeba invadens
KAVENRIPMLLKLQGHLVKNAQLFG

SEQ ID NO: 3002016 - protein, 17 aa, Entamoeba invadens
KAVEYCVLLFKSNSSLL

SEQ ID NO: 3002017 - protein, 25 aa, Entamoeba invadens
KAVEYFIIDMVHIYELILNLDNYYS

SEQ ID NO: 3002018 - protein, 17 aa, Entamoeba invadens
KAVFASEWYKLRLQTRQ

SEQ ID NO: 3002019 - protein, 29 aa, Entamoeba invadens
KAVFKKKFYRIIVWFNLDFETVDKNKSRN

SEQ ID NO: 3002020 - protein, 23 aa, Entamoeba invadens
KAVFMLYPDFADIRKSVTVRIVD

SEQ ID NO: 3002021 - protein, 18 aa, Entamoeba invadens
KAVICAESTLFWRYQHLS

SEQ ID NO: 3002022 - protein, 17 aa, Entamoeba invadens
KAVILFPEYYKNPFTIV

SEQ ID NO: 3002023 - protein, 23 aa, Entamoeba invadens
KAVKKHMMLLAGNILLAQPTPTL

SEQ ID NO: 3002024 - protein, 23 aa, Entamoeba invadens
KAVLTHQFVKIKKISFSSKDVIV

SEQ ID NO: 3002025 - protein, 27 aa, Entamoeba invadens
KAVMVKTVPVFKYVPRSHRKEYYSVPS

SEQ ID NO: 3002026 - protein, 29 aa, Entamoeba invadens
KAVNSNNLHYLTLYNLPDGTTTEQVRSFL

SEQ ID NO: 3002027 - protein, 22 aa, Entamoeba invadens
KAVQMHFPTFKVSYAIARDVLS

SEQ ID NO: 3002028 - protein, 21 aa, Entamoeba invadens
KAVTLFEFPPQNPKILNENVL

SEQ ID NO: 3002029 - protein, 20 aa, Entamoeba invadens
KAVVNGPMTWPGALSIEDEW

SEQ ID NO: 3002030 - protein, 21 aa, Entamoeba invadens
KAWSQYFPFKISVFGNREVIN

SEQ ID NO: 3002031 - protein, 29 aa, Entamoeba invadens
KAWVRIQEKLYMSWINEVLEKRNMEATNL

SEQ ID NO: 3002032 - protein, 20 aa, Entamoeba invadens
KAYDLLIQAAAGLISVTGTP

SEQ ID NO: 3002033 - protein, 18 aa, Entamoeba invadens
KAYGFHVCVTKWLSLVQL

SEQ ID NO: 3002034 - protein, 24 aa, Entamoeba invadens
KAYQTTFKLFFTKYFKNLKGEHFN

SEQ ID NO: 3002035 - protein, 25 aa, Entamoeba invadens
KAYSSTLSFFYKVGKLYAGLVEGVF

SEQ ID NO: 3002036 - protein, 24 aa, Entamoeba invadens
KAYTLEVVTLWYRAPEILLGALKY

SEQ ID NO: 3002037 - protein, 17 aa, Entamoeba invadens
KCAFFVFCDECVFGFYS

SEQ ID NO: 3002038 - protein, 19 aa, Entamoeba invadens
KCAFMLCNSLRTISLSPHI

SEQ ID NO: 3002039 - protein, 19 aa, Entamoeba invadens
KCAKACPYTAIIKKTIPCM

SEQ ID NO: 3002040 - protein, 22 aa, Entamoeba invadens
KCCFKQCFALKTLVIPFTVVSI

SEQ ID NO: 3002041 - protein, 23 aa, Entamoeba invadens
KCDGFILTIEDYDGNLFGAVVFK

SEQ ID NO: 3002042 - protein, 25 aa, Entamoeba invadens
KCDKYNIAGLLKLMNEPLRVANSGQ

SEQ ID NO: 3002043 - protein, 21 aa, Entamoeba invadens
KCDLSLKHVLIVGLGGVGSYT

SEQ ID NO: 3002044 - protein, 26 aa, Entamoeba invadens
KCDLWSLGGLLYFLRTHVYPLSSNRQ

SEQ ID NO: 3002045 - protein, 28 aa, Entamoeba invadens
KCDLYSLGLVLYFLMTGKYPFNVNNLNE

SEQ ID NO: 3002046 - protein, 17 aa, Entamoeba invadens
KCDNNCFLCVRNVCFIC

SEQ ID NO: 3002047 - protein, 22 aa, Entamoeba invadens
KCEGTPFFMAPELLLENGVVST

SEQ ID NO: 3002048 - protein, 27 aa, Entamoeba invadens
KCEKEVYCVIPFIRPLDVYICLSHYKI

SEQ ID NO: 3002049 - protein, 30 aa, Entamoeba invadens
KCEKSQINMLWLLRFLVSSEVFKNSLYSEP

SEQ ID NO: 3002050 - protein, 23 aa, Entamoeba invadens
KCERLIKLKIPPFIKTLGESTFS

SEQ ID NO: 3002051 - protein, 23 aa, Entamoeba invadens
KCEYPCIHCSILTFCTKCDQYSY

SEQ ID NO: 3002052 - protein, 24 aa, Entamoeba invadens
KCEYPCTYCSNLTYCTKCDSYSYI

SEQ ID NO: 3002053 - protein, 18 aa, Entamoeba invadens
KCEYPCVFCSNQTFCTKC

SEQ ID NO: 3002054 - protein, 17 aa, Entamoeba invadens
KCFICGLEGHLEGDCPK

SEQ ID NO: 3002055 - protein, 17 aa, Entamoeba invadens
KCFKLEIIELPSGLVKM

SEQ ID NO: 3002056 - protein, 23 aa, Entamoeba invadens
KCFKRKHDLKKHITFHVKHSMKE

SEQ ID NO: 3002057 - protein, 29 aa, Entamoeba invadens
KCFLNCPRLRFVYLSKKVRKVGKSAFEKC

SEQ ID NO: 3002058 - protein, 20 aa, Entamoeba invadens
KCFNIKNIEFPNIPSNFVFE

SEQ ID NO: 3002059 - protein, 21 aa, Entamoeba invadens
KCFRLVNGVMVERTASEIIPA

SEQ ID NO: 3002060 - protein, 20 aa, Entamoeba invadens
KCFSKCSSLSIVFIPSSVKS

SEQ ID NO: 3002061 - protein, 18 aa, Entamoeba invadens
KCGFCELELGYYVSGNDC

SEQ ID NO: 3002062 - protein, 24 aa, Entamoeba invadens
KCGNALNFVFRSPNYSAPQINLKY

SEQ ID NO: 3002063 - protein, 20 aa, Entamoeba invadens
KCGSCFIIIYSIDSLKSFEV

SEQ ID NO: 3002064 - protein, 18 aa, Entamoeba invadens
KCHMKLGQFPLALREIKT

SEQ ID NO: 3002065 - protein, 48 aa, Entamoeba invadens
KCHQFICPSKKDFNLWINNIPLFCNFTGVFGYPLLSTSTKKKSGWRFP

SEQ ID NO: 3002066 - protein, 17 aa, Entamoeba invadens
KCHSFFCWVCMQVTNDH

SEQ ID NO: 3002067 - protein, 20 aa, Entamoeba invadens
KCIANIFLIPEKCFGGIDVV

SEQ ID NO: 3002068 - protein, 26 aa, Entamoeba invadens
KCIDVAYARLNIPKLIMADYVAQGTV

SEQ ID NO: 3002069 - protein, 18 aa, Entamoeba invadens
KCIDYTYLYGTPHPVEKL

SEQ ID NO: 3002070 - protein, 20 aa, Entamoeba invadens
KCIKCLDYAIYTNGECLTES

SEQ ID NO: 3002071 - protein, 24 aa, Entamoeba invadens
KCIMQAIIIGRLMDKYPTLLDSVN

SEQ ID NO: 3002072 - protein, 23 aa, Entamoeba invadens
KCIRSPTLVFFAKDKLLTDEFAS

SEQ ID NO: 3002073 - protein, 19 aa, Entamoeba invadens
KCISIFEFMATAATLDNSI

SEQ ID NO: 3002074 - protein, 17 aa, Entamoeba invadens
KCITLFDSLPLACKYTT

SEQ ID NO: 3002075 - protein, 24 aa, Entamoeba invadens
KCIYQTILLRKIVTEIPEFFEKID

SEQ ID NO: 3002076 - protein, 25 aa, Entamoeba invadens
KCKDKLRKFLFPFTSQIFDHKVLVL

SEQ ID NO: 3002077 - protein, 25 aa, Entamoeba invadens
KCKEKFLWEGYKEKDMKCHCEKCKN

SEQ ID NO: 3002078 - protein, 27 aa, Entamoeba invadens
KCKEMLSMFFYNPLPIKNTKIFDNMTY

SEQ ID NO: 3002079 - protein, 17 aa, Entamoeba invadens
KCKIQAIRFLTVWISNF

SEQ ID NO: 3002080 - protein, 17 aa, Entamoeba invadens
KCKLFVCPRCWNHDEKC

SEQ ID NO: 3002081 - protein, 17 aa, Entamoeba invadens
KCKPREMRYPLNTHYSP

SEQ ID NO: 3002082 - protein, 29 aa, Entamoeba invadens
KCKPVKDVLIPMIRNILFTYNTPTTQTIT

SEQ ID NO: 3002083 - protein, 30 aa, Entamoeba invadens
KCLHAALPHAFLDCHLMIEDPKRWAMDYVN

SEQ ID NO: 3002084 - protein, 24 aa, Entamoeba invadens
KCLIDLKTIFLNKNIVILKINGEV

SEQ ID NO: 3002085 - protein, 18 aa, Entamoeba invadens
KCLIVLMITGKITMGMFY

SEQ ID NO: 3002086 - protein, 24 aa, Entamoeba invadens
KCLKTSFFQWSPDNTAAAPCFEKA

SEQ ID NO: 3002087 - protein, 25 aa, Entamoeba invadens
KCLNEYRYITVKGSLAFVIKRLVVY

SEQ ID NO: 3002088 - protein, 23 aa, Entamoeba invadens
KCLRIEIDLYTLPEDLTKCDKWK

SEQ ID NO: 3002089 - protein, 22 aa, Entamoeba invadens
KCLRLFGTHRDGLIRPFHCFSL

SEQ ID NO: 3002090 - protein, 24 aa, Entamoeba invadens
KCNGKDVVLFFVAPPKNTEFKMPV

SEQ ID NO: 3002091 - protein, 17 aa, Entamoeba invadens
KCNSLTSVTLPRTLQKL

SEQ ID NO: 3002092 - protein, 18 aa, Entamoeba invadens
KCPFPGCTLSFKRKSDAK

SEQ ID NO: 3002093 - protein, 19 aa, Entamoeba invadens
KCPICDTYVRPYKKVRICD

SEQ ID NO: 3002094 - protein, 21 aa, Entamoeba invadens
KCPIEIEVLLYYFNYVTFSSD

SEQ ID NO: 3002095 - protein, 25 aa, Entamoeba invadens
KCPNLFETLVYIFKTMNNDSFLLNS

SEQ ID NO: 3002096 - protein, 26 aa, Entamoeba invadens
KCPYHFPPGLLIYKDPERKIAFFEVD

SEQ ID NO: 3002097 - protein, 18 aa, Entamoeba invadens
KCQFCSLMFPMKELSRHV

SEQ ID NO: 3002098 - protein, 18 aa, Entamoeba invadens
KCQMLSVIDLSASPLLHL

SEQ ID NO: 3002099 - protein, 17 aa, Entamoeba invadens
KCRENSGFYLLNGNCVA

SEQ ID NO: 3002100 - protein, 28 aa, Entamoeba invadens
KCSIQEVLQLFPALQTLYLYSGNSSNLN

SEQ ID NO: 3002101 - protein, 22 aa, Entamoeba invadens
KCSLPHFLVTVFQFYESQAYDQ

SEQ ID NO: 3002102 - protein, 21 aa, Entamoeba invadens
KCSMCSRVNLYLFKKQVKTLQ

SEQ ID NO: 3002103 - protein, 19 aa, Entamoeba invadens
KCSNACPTGYFADNQKCLK

SEQ ID NO: 3002104 - protein, 24 aa, Entamoeba invadens
KCSNDCPIGYFADNQKCLKCDDKC

SEQ ID NO: 3002105 - protein, 31 aa, Entamoeba invadens
KCSPEELTAVVLYKLKMSSLVGLPPTTPVKA

SEQ ID NO: 3002106 - protein, 26 aa, Entamoeba invadens
KCSSLVSINFPTSILAFGAFCFTGCQ

SEQ ID NO: 3002107 - protein, 25 aa, Entamoeba invadens
KCSSSPRFFSFSPTRLSNASSQAQK

SEQ ID NO: 3002108 - protein, 24 aa, Entamoeba invadens
KCTAISVFAFFKCNALSSIEVPHS

SEQ ID NO: 3002109 - protein, 20 aa, Entamoeba invadens
KCTIFPNTRLYCFNNYFIFS

SEQ ID NO: 3002110 - protein, 24 aa, Entamoeba invadens
KCTKLLHFKGEYFGGAVTAVCDCE

SEQ ID NO: 3002111 - protein, 17 aa, Entamoeba invadens
KCTNGLNIFSKYAWELK

SEQ ID NO: 3002112 - protein, 23 aa, Entamoeba invadens
KCTRLERLCLSEILCLRNLEFPD

SEQ ID NO: 3002113 - protein, 25 aa, Entamoeba invadens
KCTVKLHDLTTIFKLRKGEVLKKSP

SEQ ID NO: 3002114 - protein, 20 aa, Entamoeba invadens
KCVAKIINDVHLYINFLVRN

SEQ ID NO: 3002115 - protein, 26 aa, Entamoeba invadens
KCVEDLKFIDWKCIVGKLTVKQRGII

SEQ ID NO: 3002116 - protein, 24 aa, Entamoeba invadens
KCVIQNFIVMLKSCGETKEVQLIL

SEQ ID NO: 3002117 - protein, 21 aa, Entamoeba invadens
KCVKLSLKYNVLSKYTTFVAI

SEQ ID NO: 3002118 - protein, 22 aa, Entamoeba invadens
KCVKLSLKYNVLSKYTTFVAID

SEQ ID NO: 3002119 - protein, 19 aa, Entamoeba invadens
KCVPSLLRVFFQAVSVRYK

SEQ ID NO: 3002120 - protein, 22 aa, Entamoeba invadens
KCVSCKPNYYIKTSGNYKCQSC

SEQ ID NO: 3002121 - protein, 31 aa, Entamoeba invadens
KCVSLISIVLPSSVFMLGLSCFWSCHSLENV

SEQ ID NO: 3002122 - protein, 24 aa, Entamoeba invadens
KCVSLKCITLPTTLLSLPIGIFEE

SEQ ID NO: 3002123 - protein, 28 aa, Entamoeba invadens
KCVYVVHFVFVVRLLMILVRERRCVTCV

SEQ ID NO: 3002124 - protein, 19 aa, Entamoeba invadens
KCYALSINITFPPFDYDSY

SEQ ID NO: 3002125 - protein, 18 aa, Entamoeba invadens
KCYKDEDGYFYWVYKNYV

SEQ ID NO: 3002126 - protein, 28 aa, Entamoeba invadens
KCYLHTGPATAIDFFYDCKMTGASGEGD

SEQ ID NO: 3002127 - protein, 34 aa, Entamoeba invadens
KCYVKYLELRFVFIIKFPFFDGALKIAKKVPEEF

SEQ ID NO: 3002128 - protein, 18 aa, Entamoeba invadens
KDADLLLKIAQRSSASLG

SEQ ID NO: 3002129 - protein, 27 aa, Entamoeba invadens
KDAFTEKMFFDFSKNLKMLFTARIESY

SEQ ID NO: 3002130 - protein, 24 aa, Entamoeba invadens
KDAILKALIQKSIPKEMRYIAARK

SEQ ID NO: 3002131 - protein, 24 aa, Entamoeba invadens
KDAKKWVCYLKGRNGLKIDQLFKG

SEQ ID NO: 3002132 - protein, 18 aa, Entamoeba invadens
KDAKLQKFTTINPKLITE

SEQ ID NO: 3002133 - protein, 23 aa, Entamoeba invadens
KDAKSVLLCDNYCEWIDQKTETI

SEQ ID NO: 3002134 - protein, 26 aa, Entamoeba invadens
KDAKYNLEMFLYRDSLMKGDHYILNI

SEQ ID NO: 3002135 - protein, 22 aa, Entamoeba invadens
KDAMFLLHSLWKDDERGYYDEL

SEQ ID NO: 3002136 - protein, 25 aa, Entamoeba invadens
KDATGILDIFGFDIATSQKEEKRDL

SEQ ID NO: 3002137 - protein, 26 aa, Entamoeba invadens
KDAVDKFRVYKIPLPPPSNEHPQGQG

SEQ ID NO: 3002138 - protein, 24 aa, Entamoeba invadens
KDCAKLENLNLYAPLTSLSDTLTT

SEQ ID NO: 3002139 - protein, 24 aa, Entamoeba invadens
KDCELFNGILPFNITNLKTIEKDV

SEQ ID NO: 3002140 - protein, 27 aa, Entamoeba invadens
KDCLFEPFMWQLFSQRPTFEQCYTKFL

SEQ ID NO: 3002141 - protein, 24 aa, Entamoeba invadens
KDCLKQIEIFARSLNMEKGKAEIY

SEQ ID NO: 3002142 - protein, 17 aa, Entamoeba invadens
KDCVKWAFGKYQNYFVD

SEQ ID NO: 3002143 - protein, 24 aa, Entamoeba invadens
KDDDPTLTKLKKFEKEVLKQEETF

SEQ ID NO: 3002144 - protein, 19 aa, Entamoeba invadens
KDDFALITLMKPVCTTVGG

SEQ ID NO: 3002145 - protein, 25 aa, Entamoeba invadens
KDDIDYLTNYIKFIVPALEDPEDYQ

SEQ ID NO: 3002146 - protein, 35 aa, Entamoeba invadens
KDDKEIRMLFVLAPYSFLLFKITPTQIKSISLVEV

SEQ ID NO: 3002147 - protein, 24 aa, Entamoeba invadens
KDDLEQFYIKTPLLAAATAKLNNV

SEQ ID NO: 3002148 - protein, 24 aa, Entamoeba invadens
KDDMEKTEKYLAAALNEEVEAANE

SEQ ID NO: 3002149 - protein, 28 aa, Entamoeba invadens
KDDPFEFLNKLLLFVDKVEPKYLCNYKL

SEQ ID NO: 3002150 - protein, 24 aa, Entamoeba invadens
KDDPKHFVFTLKNPHNIPPTKFPV

SEQ ID NO: 3002151 - protein, 25 aa, Entamoeba invadens
KDDPLEILTTLYPKTELMLQNKRTI

SEQ ID NO: 3002152 - protein, 22 aa, Entamoeba invadens
KDDRGDMFGVYVYGTIDKTDVR

SEQ ID NO: 3002153 - protein, 25 aa, Entamoeba invadens
KDDSLPRILVFSSHLQQLIASKADH

SEQ ID NO: 3002154 - protein, 20 aa, Entamoeba invadens
KDDTWRVFAPDPKLFDEKIT

SEQ ID NO: 3002155 - protein, 25 aa, Entamoeba invadens
KDDVDLILKLFSLTKSKEGTNELKI

SEQ ID NO: 3002156 - protein, 22 aa, Entamoeba invadens
KDDVLMTVSLLEKKILDEKKKS

SEQ ID NO: 3002157 - protein, 28 aa, Entamoeba invadens
KDEAFKKMTSLLLWTAKGFVSGTKSLSI

SEQ ID NO: 3002158 - protein, 28 aa, Entamoeba invadens
KDEDSYVARLILFLAKKFTEYTQTKSSV

SEQ ID NO: 3002159 - protein, 24 aa, Entamoeba invadens
KDEDTIIWIVLKDGALNYSYCSKD

SEQ ID NO: 3002160 - protein, 19 aa, Entamoeba invadens
KDEFYQSFDYKELLEVKEG

SEQ ID NO: 3002161 - protein, 23 aa, Entamoeba invadens
KDEGMYILKGWVSCLKVISHLDH

SEQ ID NO: 3002162 - protein, 29 aa, Entamoeba invadens
KDEGSKVYWKWFLALSEVPRRSGNRLPPS

SEQ ID NO: 3002163 - protein, 24 aa, Entamoeba invadens
KDEGYFVFTMKNPHNILPTKFDKK

SEQ ID NO: 3002164 - protein, 20 aa, Entamoeba invadens
KDEHNLLFLVEDDELNTFGG

SEQ ID NO: 3002165 - protein, 25 aa, Entamoeba invadens
KDEIQNFVPFIPKLLETIGTMLNRK

SEQ ID NO: 3002166 - protein, 31 aa, Entamoeba invadens
KDEKKELEEKMLLRQLFLSKEHKDVAEINND

SEQ ID NO: 3002167 - protein, 23 aa, Entamoeba invadens
KDEKTYIKQLKKDEKAEAEQTKK

SEQ ID NO: 3002168 - protein, 25 aa, Entamoeba invadens
KDEKYALVFGILNALKMANVRYELV

SEQ ID NO: 3002169 - protein, 20 aa, Entamoeba invadens
KDELIDQLQRSMATKGVNWE

SEQ ID NO: 3002170 - protein, 25 aa, Entamoeba invadens
KDEMEAFLLYIYTGNPSFPVRDFVV

SEQ ID NO: 3002171 - protein, 24 aa, Entamoeba invadens
KDEQKMFFWQGKDTSIKSRGTTSI

SEQ ID NO: 3002172 - protein, 35 aa, Entamoeba invadens
KDEQVKILKNTQLLTRKPSAPIRKKSSRVLSVQSD

SEQ ID NO: 3002173 - protein, 26 aa, Entamoeba invadens
KDEQYGFIFDSLDYFYSHAISVIEQY

SEQ ID NO: 3002174 - protein, 27 aa, Entamoeba invadens
KDERFEERFMYFGAAKLLPEAKSENSN

SEQ ID NO: 3002175 - protein, 18 aa, Entamoeba invadens
KDETPRLKLIDFSTLETP

SEQ ID NO: 3002176 - protein, 27 aa, Entamoeba invadens
KDETTLQINFLLFTQGNFTALKEEMSK

SEQ ID NO: 3002177 - protein, 29 aa, Entamoeba invadens
KDEVESFHRYEVLPYFIKRLNELLVVAKK

SEQ ID NO: 3002178 - protein, 21 aa, Entamoeba invadens
KDEVTAFFKKVGCEQAVEQVM

SEQ ID NO: 3002179 - protein, 27 aa, Entamoeba invadens
KDFETYQQALLLGLLNQYCSFTVKKQR

SEQ ID NO: 3002180 - protein, 20 aa, Entamoeba invadens
KDFFLGKLLDVVRYAELRKE

SEQ ID NO: 3002181 - protein, 19 aa, Entamoeba invadens
KDFFPGKSLKKLFVAETCV

SEQ ID NO: 3002182 - protein, 18 aa, Entamoeba invadens
KDFKDLYIPYVGNLVLLS

SEQ ID NO: 3002183 - protein, 22 aa, Entamoeba invadens
KDFKMLTLEGWYEMLWHSDISV

SEQ ID NO: 3002184 - protein, 19 aa, Entamoeba invadens
KDFNTQFLNGYMRIVQTQY

SEQ ID NO: 3002185 - protein, 18 aa, Entamoeba invadens
KDFWDFMDLIAEKIELKG

SEQ ID NO: 3002186 - protein, 24 aa, Entamoeba invadens
KDGERLMYTFKFLNDLDVMLEVTT

SEQ ID NO: 3002187 - protein, 31 aa, Entamoeba invadens
KDGIVYLGTFFPINAIFKSALLTKSKKIAKF

SEQ ID NO: 3002188 - protein, 24 aa, Entamoeba invadens
KDGKQFLIQVKFSDKKEHVERKAP

SEQ ID NO: 3002189 - protein, 23 aa, Entamoeba invadens
KDGNPFKFFQRGFFKNCTEDMYF

SEQ ID NO: 3002190 - protein, 21 aa, Entamoeba invadens
KDGNYYFFNNTCLQCSNCAKG

SEQ ID NO: 3002191 - protein, 19 aa, Entamoeba invadens
KDGTKLRFENYGDVEPGVI

SEQ ID NO: 3002192 - protein, 22 aa, Entamoeba invadens
KDGVIAMWSLNNGTGLYEFLYD

SEQ ID NO: 3002193 - protein, 25 aa, Entamoeba invadens
KDGYHPYRVILCRVLLGRDGRDYEF

SEQ ID NO: 3002194 - protein, 17 aa, Entamoeba invadens
KDHHLMCYPGDYDTFEA

SEQ ID NO: 3002195 - protein, 23 aa, Entamoeba invadens
KDHIAFFYFQKIEFVQPVTSFPA

SEQ ID NO: 3002196 - protein, 29 aa, Entamoeba invadens
KDHIPEIVVNYFIRLFIDRFDRVVFNHLM

SEQ ID NO: 3002197 - protein, 25 aa, Entamoeba invadens
KDHQQKYIYLSPFRVKEFSSQICQM

SEQ ID NO: 3002198 - protein, 28 aa, Entamoeba invadens
KDHTYEVPLWVGLYFKTNKMCKVIIPSW

SEQ ID NO: 3002199 - protein, 20 aa, Entamoeba invadens
KDHVFALCDVAYVIGSVLNG

SEQ ID NO: 3002200 - protein, 20 aa, Entamoeba invadens
KDIASYIQLYPIFNDYKFYG

SEQ ID NO: 3002201 - protein, 18 aa, Entamoeba invadens
KDIDFLDQKAVIKIGPNL

SEQ ID NO: 3002202 - protein, 22 aa, Entamoeba invadens
KDIDLAILKYLVENNPQLNLFI

SEQ ID NO: 3002203 - protein, 30 aa, Entamoeba invadens
KDIDSGFVECPFWLPPEVISNRKWSTKSDV

SEQ ID NO: 3002204 - protein, 24 aa, Entamoeba invadens
KDIFYRTTVVLAENVKILGKNTFK

SEQ ID NO: 3002205 - protein, 22 aa, Entamoeba invadens
KDIGNHWVLISKELYGRTPNAV

SEQ ID NO: 3002206 - protein, 17 aa, Entamoeba invadens
KDIHNILLNCQYEDPLE

SEQ ID NO: 3002207 - protein, 18 aa, Entamoeba invadens
KDIKIVWKHLTETLKIPP

SEQ ID NO: 3002208 - protein, 17 aa, Entamoeba invadens
KDILISFKSIGTAQYTA

SEQ ID NO: 3002209 - protein, 21 aa, Entamoeba invadens
KDILKYKTEIDAYKLQLKNQQ

SEQ ID NO: 3002210 - protein, 23 aa, Entamoeba invadens
KDIPHSILVFYASVLRIVAVIRH

SEQ ID NO: 3002211 - protein, 24 aa, Entamoeba invadens
KDIPQHFIFNFGVLDVHLQQLNTL

SEQ ID NO: 3002212 - protein, 25 aa, Entamoeba invadens
KDIQSLMQAILFGLKGVCTYISHAY

SEQ ID NO: 3002213 - protein, 20 aa, Entamoeba invadens
KDIRVVTFRTSLKQIGKFKN

SEQ ID NO: 3002214 - protein, 25 aa, Entamoeba invadens
KDITAIPMILLAPFGYSKNSPTAFT

SEQ ID NO: 3002215 - protein, 28 aa, Entamoeba invadens
KDIVHWFKTEFFHWVEDYCLECGSKDVS

SEQ ID NO: 3002216 - protein, 23 aa, Entamoeba invadens
KDIVLCVVGMHKNSFVEKTIIEN

SEQ ID NO: 3002217 - protein, 17 aa, Entamoeba invadens
KDIYIEKVILFQQRDCC

SEQ ID NO: 3002218 - protein, 25 aa, Entamoeba invadens
KDIYKKIMVFKNRKLQLSIFDIELK

SEQ ID NO: 3002219 - protein, 26 aa, Entamoeba invadens
KDKDGNMFYCYTYLVKNKSGEEHEQH

SEQ ID NO: 3002220 - protein, 33 aa, Entamoeba invadens
KDKDVFLNIGSVFRFMYLLADTQYCNDYSRFHG

SEQ ID NO: 3002221 - protein, 30 aa, Entamoeba invadens
KDKEAILEANMKYAVLLSASRAAEERNLKE

SEQ ID NO: 3002222 - protein, 24 aa, Entamoeba invadens
KDKEKIVLCVMRMKNVVSGLEDRV

SEQ ID NO: 3002223 - protein, 24 aa, Entamoeba invadens
KDKELVFQIKLPLKKKEIMKTTIN

SEQ ID NO: 3002224 - protein, 21 aa, Entamoeba invadens
KDKEYILPNILTKEAYEISPT

SEQ ID NO: 3002225 - protein, 26 aa, Entamoeba invadens
KDKHNKLTFVFLTDILMFTNAEKEKL

SEQ ID NO: 3002226 - protein, 24 aa, Entamoeba invadens
KDKKYELDIYDSRGTLICYDFTEL

SEQ ID NO: 3002227 - protein, 30 aa, Entamoeba invadens
KDKNRLVYLIATLRTLLGKSSQCKVIVFFS

SEQ ID NO: 3002228 - protein, 24 aa, Entamoeba invadens
KDKQNFIDDIKQLQKTQIFNENTI

SEQ ID NO: 3002229 - protein, 22 aa, Entamoeba invadens
KDKRIGWNWIKCSTTKGSHLIC

SEQ ID NO: 3002230 - protein, 23 aa, Entamoeba invadens
KDKSYFPFKGTTLAVIVFNAQDH

SEQ ID NO: 3002231 - protein, 31 aa, Entamoeba invadens
KDKWQFSEFLSFEDVAIFGTLIGLLTQKHKV

SEQ ID NO: 3002232 - protein, 22 aa, Entamoeba invadens
KDKYEWLKLELIEDATKLIQDC

SEQ ID NO: 3002233 - protein, 18 aa, Entamoeba invadens
KDKYGMDYVFANELEIKA

SEQ ID NO: 3002234 - protein, 38 aa, Entamoeba invadens
KDKYNESDFVLMFMNPTQPLENWMVKELLENIDVKARG

SEQ ID NO: 3002235 - protein, 20 aa, Entamoeba invadens
KDLAIDMIKFLLGKAENQFT

SEQ ID NO: 3002236 - protein, 21 aa, Entamoeba invadens
KDLCASTLYYWIKSSDHHVAS

SEQ ID NO: 3002237 - protein, 29 aa, Entamoeba invadens
KDLDNGLILIALFEALRKMKVNFKYNRNP

SEQ ID NO: 3002238 - protein, 24 aa, Entamoeba invadens
KDLDTIRDYLLYCLDLNNDAVNQA

SEQ ID NO: 3002239 - protein, 28 aa, Entamoeba invadens
KDLDYEMLISFYFWDKMGYTQNITYINS

SEQ ID NO: 3002240 - protein, 17 aa, Entamoeba invadens
KDLEDMTEAIILNDEEE

SEQ ID NO: 3002241 - protein, 35 aa, Entamoeba invadens
KDLEKKGLIKAVRQDNHIWIFTKTAKATEASTAAA

SEQ ID NO: 3002242 - protein, 23 aa, Entamoeba invadens
KDLFNQPFSLYKIDSIGIGDKSA

SEQ ID NO: 3002243 - protein, 17 aa, Entamoeba invadens
KDLIGNMLVLDPQKRLG

SEQ ID NO: 3002244 - protein, 20 aa, Entamoeba invadens
KDLILYYRKCSERCSALTHG

SEQ ID NO: 3002245 - protein, 17 aa, Entamoeba invadens
KDLLEKCFERVDKKLME

SEQ ID NO: 3002246 - protein, 20 aa, Entamoeba invadens
KDLLFLIVKSSEHHPEFFEF

SEQ ID NO: 3002247 - protein, 24 aa, Entamoeba invadens
KDLPDPIIPRELYPKFLACASTYY

SEQ ID NO: 3002248 - protein, 27 aa, Entamoeba invadens
KDLPPNFQLIQPDRFFISTTTVLLAEV

SEQ ID NO: 3002249 - protein, 22 aa, Entamoeba invadens
KDLPQFVDFLREPTLTQTIIQR

SEQ ID NO: 3002250 - protein, 21 aa, Entamoeba invadens
KDLQFHKKYNCFDGRFQFVTG

SEQ ID NO: 3002251 - protein, 28 aa, Entamoeba invadens
KDLQIMYQFADLFWGHFSGSWRKFVICV

SEQ ID NO: 3002252 - protein, 26 aa, Entamoeba invadens
KDLSDGIILISLFEALTKKKVSFKFN

SEQ ID NO: 3002253 - protein, 27 aa, Entamoeba invadens
KDLSDGIILISLFEALTKKKVSFKFNK

SEQ ID NO: 3002254 - protein, 24 aa, Entamoeba invadens
KDLSFFSVYKLLPTMDGNFVSFKR

SEQ ID NO: 3002255 - protein, 20 aa, Entamoeba invadens
KDLSISWYTNERHSVWLPCN

SEQ ID NO: 3002256 - protein, 28 aa, Entamoeba invadens
KDMAGLFKPQMAVPFLKALREVTDLPIF

SEQ ID NO: 3002257 - protein, 29 aa, Entamoeba invadens
KDMKEFLEEYPILSFERLIGKKGEMKSGI

SEQ ID NO: 3002258 - protein, 27 aa, Entamoeba invadens
KDMRTKCAMCTAIRYCNYCTFTSETCR

SEQ ID NO: 3002259 - protein, 22 aa, Entamoeba invadens
KDNASWYYGELAKYSAMMLDKK

SEQ ID NO: 3002260 - protein, 24 aa, Entamoeba invadens
KDNEKLVPPFIGSTPAKGTDQSRS

SEQ ID NO: 3002261 - protein, 24 aa, Entamoeba invadens
KDNENYLLLFTKCDQVSVLPTEEV

SEQ ID NO: 3002262 - protein, 25 aa, Entamoeba invadens
KDNFDTVIFFAKGKFYELYENDADI

SEQ ID NO: 3002263 - protein, 19 aa, Entamoeba invadens
KDNGFFVFSLRNNTGDQPR

SEQ ID NO: 3002264 - protein, 23 aa, Entamoeba invadens
KDNKFGGVIIDKIPQRMGIIVGQ

SEQ ID NO: 3002265 - protein, 24 aa, Entamoeba invadens
KDNKKMLLLMNQMKFTYCGIVHVR

SEQ ID NO: 3002266 - protein, 37 aa, Entamoeba invadens
KDNMDMFHANPIPLTLKTLKFFTKIETLNLWSEEDES

SEQ ID NO: 3002267 - protein, 26 aa, Entamoeba invadens
KDNMSKFHFNPIPLTELTLKYFPNLE

SEQ ID NO: 3002268 - protein, 35 aa, Entamoeba invadens
KDNNHLLFFPRPNQKDTVLFFIMNCFEIRMKKSNL

SEQ ID NO: 3002269 - protein, 27 aa, Entamoeba invadens
KDNTLKLLYNDWTFGYNILQELDFGMG

SEQ ID NO: 3002270 - protein, 29 aa, Entamoeba invadens
KDNVLKMMISAIIVALKMANPKYEATKET

SEQ ID NO: 3002271 - protein, 21 aa, Entamoeba invadens
KDNVQFIHFEPSALPVCVSLV

SEQ ID NO: 3002272 - protein, 24 aa, Entamoeba invadens
KDNVVWMVDPLMMRKVKSFVNDDY

SEQ ID NO: 3002273 - protein, 17 aa, Entamoeba invadens
KDPFCKVKIPGATLVYR

SEQ ID NO: 3002274 - protein, 35 aa, Entamoeba invadens
KDPLEFYRTLPYQTDILTYPLMFQQFLAESELALW

SEQ ID NO: 3002275 - protein, 27 aa, Entamoeba invadens
KDPNAEPIPPPPFPKYVVKKKKGADGG

SEQ ID NO: 3002276 - protein, 21 aa, Entamoeba invadens
KDPNKVFSIAFRTPVTNNKGI

SEQ ID NO: 3002277 - protein, 32 aa, Entamoeba invadens
KDQKEWDLLFQKLNIFYNIDLYVKEICEIFIS

SEQ ID NO: 3002278 - protein, 26 aa, Entamoeba invadens
KDQTAFQQCFLLALLNQHARITLKRP

SEQ ID NO: 3002279 - protein, 26 aa, Entamoeba invadens
KDQTCLKLFNVVNKAVKMCWGCSKEN

SEQ ID NO: 3002280 - protein, 22 aa, Entamoeba invadens
KDRKTFGFIKDIVSLGGSLTFG

SEQ ID NO: 3002281 - protein, 19 aa, Entamoeba invadens
KDRLMTEDEWRKLGVQQSV

SEQ ID NO: 3002282 - protein, 18 aa, Entamoeba invadens
KDRMISLTKLAVQTGASD

SEQ ID NO: 3002283 - protein, 22 aa, Entamoeba invadens
KDRNCLFAYQKDGKSFIYTVYW

SEQ ID NO: 3002284 - protein, 32 aa, Entamoeba invadens; identical to SEQ ID NO: 2946129

SEQ ID NO: 3002285 - protein, 19 aa, Entamoeba invadens
KDRYTRCLELYVAPRKTVT

SEQ ID NO: 3002286 - protein, 23 aa, Entamoeba invadens
KDSDLYIPFPSFPHLTSLCVRYT

SEQ ID NO: 3002287 - protein, 27 aa, Entamoeba invadens
KDSFEDLYFTIALFKKINTLNFDIKQV

SEQ ID NO: 3002288 - protein, 23 aa, Entamoeba invadens
KDSILISLLDRLGFCFDYYETGI

SEQ ID NO: 3002289 - protein, 23 aa, Entamoeba invadens
KDSIRVKRYGKRTLPIISFETTF

SEQ ID NO: 3002290 - protein, 24 aa, Entamoeba invadens
KDSKNLLCQLFLHVNGKFNVFNSK

SEQ ID NO: 3002291 - protein, 18 aa, Entamoeba invadens
KDSLPFALSLLDVLCRRF

SEQ ID NO: 3002292 - protein, 22 aa, Entamoeba invadens
KDSLRRFKALLLLHSVLQMEQN

SEQ ID NO: 3002293 - protein, 31 aa, Entamoeba invadens
KDSVSLGYVRFYMTTLPYFTTQKTVLQFIKD

SEQ ID NO: 3002294 - protein, 30 aa, Entamoeba invadens
KDTDTYMENLPKFFPKYTKTEFLVNRMKIC

SEQ ID NO: 3002295 - protein, 18 aa, Entamoeba invadens
KDTDWLSAIRMYSAALGH

SEQ ID NO: 3002296 - protein, 35 aa, Entamoeba invadens
KDTDYIHVISFADIFPFTLLQFRLKQYFKEWKSIV

SEQ ID NO: 3002297 - protein, 23 aa, Entamoeba invadens
KDTFGIFSIYRNVAMRYFNELEV

SEQ ID NO: 3002298 - protein, 20 aa, Entamoeba invadens
KDTFNPLSLYSFPLQSKNTS

SEQ ID NO: 3002299 - protein, 30 aa, Entamoeba invadens
KDTHQHVPFPIILIFALNKWRQEHNTTGIP

SEQ ID NO: 3002300 - protein, 26 aa, Entamoeba invadens
KDTIKFSELILYIRDHNGFKSYSLSD

SEQ ID NO: 3002301 - protein, 25 aa, Entamoeba invadens
KDTIRELLQNKLDLSMLIISKTLSK

SEQ ID NO: 3002302 - protein, 23 aa, Entamoeba invadens
KDTKCLIQKSIFEKYKEKETKEK

SEQ ID NO: 3002303 - protein, 26 aa, Entamoeba invadens
KDTLRQFKALLLFHLLSQTDNSLVFE

SEQ ID NO: 3002304 - protein, 25 aa, Entamoeba invadens
KDTTQYIPNVLTPIPKRFVENADDD

SEQ ID NO: 3002305 - protein, 30 aa, Entamoeba invadens
KDTTTIGDFSFVNLNFDKPASTTAPTTTTG

SEQ ID NO: 3002306 - protein, 17 aa, Entamoeba invadens
KDTVFDWKIYEKEFTID

SEQ ID NO: 3002307 - protein, 20 aa, Entamoeba invadens
KDVDALFDAIDELKERVGYN

SEQ ID NO: 3002308 - protein, 20 aa, Entamoeba invadens
KDVKIMLSTLFMSLEKTHKK

SEQ ID NO: 3002309 - protein, 26 aa, Entamoeba invadens
KDVLLITKLLPNFRVAVDYTASPKLL

SEQ ID NO: 3002310 - protein, 27 aa, Entamoeba invadens
KDVLMLNKRYKNYLSKRMRILSSTENV

SEQ ID NO: 3002311 - protein, 24 aa, Entamoeba invadens
KDVPLQIFNPFPTQEELLKTRSQS

SEQ ID NO: 3002312 - protein, 32 aa, Entamoeba invadens
KDVQLIKSLFPSCKIFVVYPYKKNKATHLRAN

SEQ ID NO: 3002313 - protein, 18 aa, Entamoeba invadens
KDVRIKRGIVGSGVVKVV

SEQ ID NO: 3002314 - protein, 34 aa, Entamoeba invadens
KDVRIKRGIVVIVFRLTNICVLIKGICRLKCLLS

SEQ ID NO: 3002315 - protein, 21 aa, Entamoeba invadens
KDVSLLQPFLKKIVNMIVLAC

SEQ ID NO: 3002316 - protein, 20 aa, Entamoeba invadens
KDVTWIFESFQMEPRDHQMV

SEQ ID NO: 3002317 - protein, 25 aa, Entamoeba invadens
KDVVTLLLEYTPIKVVLNKGGITLD

SEQ ID NO: 3002318 - protein, 20 aa, Entamoeba invadens
KDVYYPFISENWRSIEHAKV

SEQ ID NO: 3002319 - protein, 19 aa, Entamoeba invadens
KDWAKYIDNILLKYSDILE

SEQ ID NO: 3002320 - protein, 34 aa, Entamoeba invadens
KDYCAFCDVFIPPSLVGPFWVGIYVIDREFDNKY

SEQ ID NO: 3002321 - protein, 19 aa, Entamoeba invadens
KDYHSINNLIYNYGYNQQR

SEQ ID NO: 3002322 - protein, 26 aa, Entamoeba invadens
KDYKKMLILGAKFLELKNYDATFSVY

SEQ ID NO: 3002323 - protein, 21 aa, Entamoeba invadens
KDYLTYEETLHFLAKHANVHI

SEQ ID NO: 3002324 - protein, 23 aa, Entamoeba invadens
KDYQRLVFCINPDNFEKVSTSPS

SEQ ID NO: 3002325 - protein, 24 aa, Entamoeba invadens
KEAANMYAEILKTTKLAKTGILTN

SEQ ID NO: 3002326 - protein, 24 aa, Entamoeba invadens
KEAFHFIEDILFMNGIVVTGARDE

SEQ ID NO: 3002327 - protein, 20 aa, Entamoeba invadens
KEAFTVAPKNVWKFVLATNI

SEQ ID NO: 3002328 - protein, 24 aa, Entamoeba invadens
KEAHEIIENIKLLKNNLEEKVNTL

SEQ ID NO: 3002329 - protein, 23 aa, Entamoeba invadens
KEAIEFVLMMQSLYTLLKQNPSG

SEQ ID NO: 3002330 - protein, 19 aa, Entamoeba invadens
KEAIYTTGFWSSKEHLFVD

SEQ ID NO: 3002331 - protein, 19 aa, Entamoeba invadens
KEAKRLKAKTTKLKRRRNI

SEQ ID NO: 3002332 - protein, 24 aa, Entamoeba invadens
KEAKVKPVFLYVKEQNQVQPSVKL

SEQ ID NO: 3002333 - protein, 18 aa, Entamoeba invadens
KEALAGLKFHGMGVVVQE

SEQ ID NO: 3002334 - protein, 34 aa, Entamoeba invadens
KEALLTPPVHGTLYKRSFIDAPKRGYTTSGTTVK

SEQ ID NO: 3002335 - protein, 22 aa, Entamoeba invadens
KEALNLIKLIKTVTPLYEFNEL

SEQ ID NO: 3002336 - protein, 31 aa, Entamoeba invadens; identical to SEQ ID NO: 2716646

SEQ ID NO: 3002337 - protein, 18 aa, Entamoeba invadens
KEAMIRMKNNQNNIFFAL

SEQ ID NO: 3002338 - protein, 23 aa, Entamoeba invadens
KEANRLFLRLVNSGMEKANYCEV

SEQ ID NO: 3002339 - protein, 25 aa, Entamoeba invadens
KEANVDVLPYDSFYEKFLELVGDEV

SEQ ID NO: 3002340 - protein, 23 aa, Entamoeba invadens
KEAPISCIYLDNAFLIVGDVLGG

SEQ ID NO: 3002341 - protein, 20 aa, Entamoeba invadens
KEAQFVATIWDTAGQERFRN

SEQ ID NO: 3002342 - protein, 23 aa, Entamoeba invadens
KEATCSILFVFGKLICANPVACE

SEQ ID NO: 3002343 - protein, 23 aa, Entamoeba invadens
KECDEIWICRGDMGVQLGFVGMA

SEQ ID NO: 3002344 - protein, 32 aa, Entamoeba invadens
KECDGIELLGRTLFYLNKGEDLLFLKEVEKRL

SEQ ID NO: 3002345 - protein, 34 aa, Entamoeba invadens
KECEKTCVAYLKSINKFFATLDDLSILLNQTKQK

SEQ ID NO: 3002346 - protein, 27 aa, Entamoeba invadens
KECFDVKFCLSNPTNWKTLMNSIQADT

SEQ ID NO: 3002347 - protein, 21 aa, Entamoeba invadens
KECHESVLMILFVCEEFINPK

SEQ ID NO: 3002348 - protein, 20 aa, Entamoeba invadens
KECILCKPFSILQNKSCLPF

SEQ ID NO: 3002349 - protein, 23 aa, Entamoeba invadens
KECKIDENGALKALGCYKKNNEK

SEQ ID NO: 3002350 - protein, 25 aa, Entamoeba invadens
KECKIINFYNFGSIKISYPGEKKKN

SEQ ID NO: 3002351 - protein, 21 aa, Entamoeba invadens
KECLMFGDVVFPLLHINTTNE

SEQ ID NO: 3002352 - protein, 18 aa, Entamoeba invadens
KECLPIVICGNKSDLEMD

SEQ ID NO: 3002353 - protein, 20 aa, Entamoeba invadens
KECVSLKTIILPKSLNEIGE

SEQ ID NO: 3002354 - protein, 20 aa, Entamoeba invadens
KEDAVLRIFYQVCHAVAYMH

SEQ ID NO: 3002355 - protein, 19 aa, Entamoeba invadens
KEDCIVVLLSRIQNMLNLT

SEQ ID NO: 3002356 - protein, 25 aa, Entamoeba invadens
KEDEDLLLSVAFGYPVDKLNYGNKE

SEQ ID NO: 3002357 - protein, 27 aa, Entamoeba invadens
KEDELSGLFGLLEGGLHPPNSPLSLES

SEQ ID NO: 3002358 - protein, 27 aa, Entamoeba invadens
KEDEYFQFMWELRLVFSSGLTQLEEVT

SEQ ID NO: 3002359 - protein, 24 aa, Entamoeba invadens
KEDFTVFNGIYPFGLTNLKSVEPG

SEQ ID NO: 3002360 - protein, 47 aa, Entamoeba invadens
KEDGNDFFYALSDGVIIRQIILKYYPTYKMDVKFGQSGLIMKNSNIT

SEQ ID NO: 3002361 - protein, 23 aa, Entamoeba invadens
KEDGNIICPFCNAITHISSPKDS

SEQ ID NO: 3002362 - protein, 23 aa, Entamoeba invadens
KEDGNIICPFCNSITHISSPKDS

SEQ ID NO: 3002363 - protein, 19 aa, Entamoeba invadens
KEDIMTIKAYRKDAGSLMS

SEQ ID NO: 3002364 - protein, 43 aa, Entamoeba invadens
KEDLDALKTVYPNAKTFAIVLTYQEYCLRPFEVGNDENVFVIN

SEQ ID NO: 3002365 - protein, 17 aa, Entamoeba invadens
KEDLSKLTTEYKKLEAD

SEQ ID NO: 3002366 - protein, 29 aa, Entamoeba invadens
KEDLSKRSLKPKKTIQRISRHNCTKRKTT

SEQ ID NO: 3002367 - protein, 22 aa, Entamoeba invadens
KEDNIILRLDGVDLQRIRSNAN

SEQ ID NO: 3002368 - protein, 29 aa, Entamoeba invadens
KEDNIMKCPSRKNVPLPKGRKRMTKNNKQ

SEQ ID NO: 3002369 - protein, 24 aa, Entamoeba invadens
KEDPFLKFNYIDIKTIRGIWIKYV

SEQ ID NO: 3002370 - protein, 23 aa, Entamoeba invadens
KEDQIKYFFYRKGVVNEEEMLKI

SEQ ID NO: 3002371 - protein, 29 aa, Entamoeba invadens
KEDSFFKENWGWFKVFVQTTFTADTEKVF

SEQ ID NO: 3002372 - protein, 26 aa, Entamoeba invadens
KEDSYFAKVVLLISQKYFLSMQNEKE

SEQ ID NO: 3002373 - protein, 18 aa, Entamoeba invadens
KEEALLSFKYTFDLAQWE

SEQ ID NO: 3002374 - protein, 17 aa, Entamoeba invadens
KEECVDIYIMAAAVADY

SEQ ID NO: 3002375 - protein, 29 aa, Entamoeba invadens
KEEDETFIKFLFDPEFLDARRSVPKWSKI

SEQ ID NO: 3002376 - protein, 28 aa, Entamoeba invadens
KEEDEYKIPLMWRLTQLAMQNDGKSKAQ

SEQ ID NO: 3002377 - protein, 25 aa, Entamoeba invadens
KEEDGLWYVRRGGDRTHRERRDRDE

SEQ ID NO: 3002378 - protein, 27 aa, Entamoeba invadens
KEEDRRILLAYRIYWFEKNVEQKEGDS

SEQ ID NO: 3002379 - protein, 26 aa, Entamoeba invadens
KEEEAKPLFILPNTNIQPLTDVMKEY

SEQ ID NO: 3002380 - protein, 29 aa, Entamoeba invadens
KEEGKPVKRMSFLGRRQQTNGPKKEHSQL

SEQ ID NO: 3002381 - protein, 28 aa, Entamoeba invadens
KEEHKGIAFLWYFLDNDQEGLFGFADDI

SEQ ID NO: 3002382 - protein, 29 aa, Entamoeba invadens
KEEIEHLNTLLLKKGLLLENTRIDKIDDK

SEQ ID NO: 3002383 - protein, 23 aa, Entamoeba invadens
KEEILFLVNIDSLPLYFSNLDVD

SEQ ID NO: 3002384 - protein, 26 aa, Entamoeba invadens
KEEIRKFKKSIPWNQPEKVDFVKQFK

SEQ ID NO: 3002385 - protein, 31 aa, Entamoeba invadens
KEEITRLEIPMAMFHFGGTFTHIIGEKPVEM

SEQ ID NO: 3002386 - protein, 17 aa, Entamoeba invadens
KEEIYGLVLVEDRKLHS

SEQ ID NO: 3002387 - protein, 17 aa, Entamoeba invadens
KEEKIVIFAYHVDVITG

SEQ ID NO: 3002388 - protein, 28 aa, Entamoeba invadens
KEEKSFIVMMFSAFWLSQDGKASFHSMI

SEQ ID NO: 3002389 - protein, 17 aa, Entamoeba invadens
KEELKNFLRILNPNYSD

SEQ ID NO: 3002390 - protein, 20 aa, Entamoeba invadens
KEELQLLNDRIRQYKSGIMR

SEQ ID NO: 3002391 - protein, 28 aa, Entamoeba invadens
KEELQWCKAYLIGLLILCETRNSLCGFN

SEQ ID NO: 3002392 - protein, 29 aa, Entamoeba invadens
KEELRGIIPRSLKYLFERLNNQNEGGVIS

SEQ ID NO: 3002393 - protein, 22 aa, Entamoeba invadens
KEEMEKFLAAKLKFGENEIVAK

SEQ ID NO: 3002394 - protein, 21 aa, Entamoeba invadens
KEEMKYFSWALQIEKIEVGDV

SEQ ID NO: 3002395 - protein, 22 aa, Entamoeba invadens
KEENLKLKNEIKIKDCELDKTM

SEQ ID NO: 3002396 - protein, 17 aa, Entamoeba invadens
KEENSLPQMIRALKMMK

SEQ ID NO: 3002397 - protein, 27 aa, Entamoeba invadens
KEEQEKYNLLLRKMKFDYLDEISKVKT

SEQ ID NO: 3002398 - protein, 23 aa, Entamoeba invadens
KEESILNVYWKRSAPMPQNFLDT

SEQ ID NO: 3002399 - protein, 24 aa, Entamoeba invadens
KEEWKNVVLAYEPVWAIGTGKTAT

SEQ ID NO: 3002400 - protein, 22 aa, Entamoeba invadens
KEEYITAIFYGNDLIFGFDEIK

SEQ ID NO: 3002401 - protein, 18 aa, Entamoeba invadens
KEFCCIIKTGRSVVLKTT

SEQ ID NO: 3002402 - protein, 39 aa, Entamoeba invadens
KEFEGEVCMIIVWPFKLFIYIRLKTIYIRHFVLKKFVIS

SEQ ID NO: 3002403 - protein, 24 aa, Entamoeba invadens
KEFIKHIVLLILDEIHLKFHVNMV

SEQ ID NO: 3002404 - protein, 28 aa, Entamoeba invadens
KEFKADVLGFYIVKLESIDFLIDRIGDV

SEQ ID NO: 3002405 - protein, 20 aa, Entamoeba invadens
KEFMDGILNMLFVENHLIGT

SEQ ID NO: 3002406 - protein, 31 aa, Entamoeba invadens
KEFNGQKLNGWFLNIKRKENYKPFICFNCGG

SEQ ID NO: 3002407 - protein, 25 aa, Entamoeba invadens
KEFNQLLDFRIKEFLRKLMSGKKVE

SEQ ID NO: 3002408 - protein, 31 aa, Entamoeba invadens
KEFNQLLEFRIRMLLRKLFAGKKLECKQCYE

SEQ ID NO: 3002409 - protein, 19 aa, Entamoeba invadens
KEFPNIKKLSVIKTLIIPK

SEQ ID NO: 3002410 - protein, 20 aa, Entamoeba invadens
KEFQPVLRALKCNKFFTKLK

SEQ ID NO: 3002411 - protein, 24 aa, Entamoeba invadens
KEGAYFARALTDIGIDTTYILPGG

SEQ ID NO: 3002412 - protein, 21 aa, Entamoeba invadens
KEGCLFYEILALKNTNLTEMF

SEQ ID NO: 3002413 - protein, 22 aa, Entamoeba invadens
KEGDWWLGELNGQQGYFPYNYT

SEQ ID NO: 3002414 - protein, 23 aa, Entamoeba invadens
KEGFKRPNVIDPQQLELTKSLYE

SEQ ID NO: 3002415 - protein, 34 aa, Entamoeba invadens
KEGFLLEYHSSQLFPERWFDLVVVLRTDNTVLYD

SEQ ID NO: 3002416 - protein, 18 aa, Entamoeba invadens
KEGFLLKEKLKKMQTRKK

SEQ ID NO: 3002417 - protein, 23 aa, Entamoeba invadens
KEGGILFAFGYDSFFPKTDLAIM

SEQ ID NO: 3002418 - protein, 20 aa, Entamoeba invadens
KEGLKFLADTFSPCVQRLNK

SEQ ID NO: 3002419 - protein, 32 aa, Entamoeba invadens
KEGMEPFVFRYERPFKIIFGGKLQIGDLDVKI

SEQ ID NO: 3002420 - protein, 25 aa, Entamoeba invadens
KEGNLVIFAHSFILAARSPLFQVEL

SEQ ID NO: 3002421 - protein, 27 aa, Entamoeba invadens
KEGRTITFGCPYYFKNMSRGFVKIKGF

SEQ ID NO: 3002422 - protein, 17 aa, Entamoeba invadens
KEGSRLCALSLLINLAK

SEQ ID NO: 3002423 - protein, 17 aa, Entamoeba invadens
KEHFVRQLVSGLIPCEI

SEQ ID NO: 3002424 - protein, 37 aa, Entamoeba invadens
KEHGALRKVVYSSADLFVVCFSLIDPKSFLNVVKCWL

SEQ ID NO: 3002425 - protein, 31 aa, Entamoeba invadens
KEHPLKLTIRALSGPIYDIAWTGDSQRICVV

SEQ ID NO: 3002426 - protein, 24 aa, Entamoeba invadens
KEHRVVLDVLAKVEPTRKCFRLVN

SEQ ID NO: 3002427 - protein, 24 aa, Entamoeba invadens
KEHSKFYFDDWTKSGEFFDNKRVI

SEQ ID NO: 3002428 - protein, 24 aa, Entamoeba invadens
KEHWQYFVAPLRDLLGTNYIIKYC

SEQ ID NO: 3002429 - protein, 21 aa, Entamoeba invadens
KEHWTATKSKFWYLSQQVKES

SEQ ID NO: 3002430 - protein, 19 aa, Entamoeba invadens
KEICILTDLTKDVVIKYIP

SEQ ID NO: 3002431 - protein, 21 aa, Entamoeba invadens
KEIFDIVDFMLIITKMIENYV

SEQ ID NO: 3002432 - protein, 23 aa, Entamoeba invadens
KEIFDIVDFMLIITKMIENYVSL

SEQ ID NO: 3002433 - protein, 17 aa, Entamoeba invadens
KEIFEHPFLKKHFDNFV

SEQ ID NO: 3002434 - protein, 17 aa, Entamoeba invadens
KEIFFRSLGLSCCAKRN

SEQ ID NO: 3002435 - protein, 27 aa, Entamoeba invadens
KEIGIDEDLIWLKTQLHARGLKLMLDF

SEQ ID NO: 3002436 - protein, 28 aa, Entamoeba invadens
KEIGNYILRLISLAWNKTIIKKIGLFNA

SEQ ID NO: 3002437 - protein, 25 aa, Entamoeba invadens
KEIHSKVPLWLSKIFNKSGITCSQV

SEQ ID NO: 3002438 - protein, 21 aa, Entamoeba invadens
KEIIIVFANHLDWYTTLFANQ

SEQ ID NO: 3002439 - protein, 23 aa, Entamoeba invadens
KEIIQFSSLCDVPFYPPTEDMKK

SEQ ID NO: 3002440 - protein, 17 aa, Entamoeba invadens
KEILLPKSLQEVEESAF

SEQ ID NO: 3002441 - protein, 17 aa, Entamoeba invadens
KEILPKYYKHTNFCGFT

SEQ ID NO: 3002442 - protein, 20 aa, Entamoeba invadens
KEIPFLCRCSKEAVLDIFHN

SEQ ID NO: 3002443 - protein, 20 aa, Entamoeba invadens
KEIPKMCFAYCKSLTKVVFS

SEQ ID NO: 3002444 - protein, 19 aa, Entamoeba invadens
KEIPLTIIPICECVKVIKQ

SEQ ID NO: 3002445 - protein, 26 aa, Entamoeba invadens
KEIRRTVEILVFHLNSLQTTPFSRIS

SEQ ID NO: 3002446 - protein, 27 aa, Entamoeba invadens
KEISDFAFFRCLSLTKIDIPKSVTKIG

SEQ ID NO: 3002447 - protein, 25 aa, Entamoeba invadens
KEISRPMSLLEAKQKRRELEKERQM

SEQ ID NO: 3002448 - protein, 18 aa, Entamoeba invadens
KEIVDYKSRIWKCSKHYS

SEQ ID NO: 3002449 - protein, 25 aa, Entamoeba invadens
KEIVEWMKRLFDYTNYESLNFTISQ

SEQ ID NO: 3002450 - protein, 23 aa, Entamoeba invadens
KEIVKVLPVIIPVFVALPSNDRM

SEQ ID NO: 3002451 - protein, 19 aa, Entamoeba invadens
KEIYPYNYFNKINIENNIG

SEQ ID NO: 3002452 - protein, 18 aa, Entamoeba invadens
KEIYRGYLRALVDYLSGL

SEQ ID NO: 3002453 - protein, 29 aa, Entamoeba invadens
KEKADLSVAFIFVSVNIMCFRKGMRLVHE

SEQ ID NO: 3002454 - protein, 26 aa, Entamoeba invadens
KEKAVLNLPPILVRQNKDLTDLKDLK

SEQ ID NO: 3002455 - protein, 30 aa, Entamoeba invadens
KEKDAHAEEIWNFVNLFSSLEQENGKEGNG

SEQ ID NO: 3002456 - protein, 30 aa, Entamoeba invadens
KEKDEEFCCFLLPDYLFMAKIRRDEVGDVP

SEQ ID NO: 3002457 - protein, 31 aa, Entamoeba invadens
KEKELEDMLNAELLALQNQDAIEKEKRDRRR

SEQ ID NO: 3002458 - protein, 18 aa, Entamoeba invadens
KEKFKFEWSIADFVSHGN

SEQ ID NO: 3002459 - protein, 23 aa, Entamoeba invadens
KEKFLMKHVIGINKEFKKYEEEV

SEQ ID NO: 3002460 - protein, 24 aa, Entamoeba invadens
KEKFMFHKMLLNNELPLSIGGGVG

SEQ ID NO: 3002461 - protein, 26 aa, Entamoeba invadens
KEKHKALIFCQTKQMLNILQKVLEYN

SEQ ID NO: 3002462 - protein, 22 aa, Entamoeba invadens
KEKIFPYEVTSWMLKEWQKTRG

SEQ ID NO: 3002463 - protein, 19 aa, Entamoeba invadens
KEKIIEIAAITKKSETMTE

SEQ ID NO: 3002464 - protein, 24 aa, Entamoeba invadens
KEKILTHKMTVKFLLDGARGILYL

SEQ ID NO: 3002465 - protein, 28 aa, Entamoeba invadens
KEKKEVPLMKPLLFSKGKMCRKSDDKAD

SEQ ID NO: 3002466 - protein, 23 aa, Entamoeba invadens
KEKKFLTQILGKLVLNVGEKRAY

SEQ ID NO: 3002467 - protein, 22 aa, Entamoeba invadens
KEKKHHGLFGRKKPKKGDVDDD

SEQ ID NO: 3002468 - protein, 22 aa, Entamoeba invadens
KEKKLCIRYRFVKGMVETFYIC

SEQ ID NO: 3002469 - protein, 23 aa, Entamoeba invadens
KEKKSIPLASLPPPFVKTESSSS

SEQ ID NO: 3002470 - protein, 21 aa, Entamoeba invadens
KEKKTTRRKLKSGMSRKEGQN

SEQ ID NO: 3002471 - protein, 22 aa, Entamoeba invadens
KEKLDEVLAVLDLAKTGKSKVS

SEQ ID NO: 3002472 - protein, 27 aa, Entamoeba invadens
KEKLLEYRKLLTILLNYGTGAAPSIIK

SEQ ID NO: 3002473 - protein, 26 aa, Entamoeba invadens
KEKLLLLEVVILCALAFKCEEECFLD

SEQ ID NO: 3002474 - protein, 22 aa, Entamoeba invadens
KEKMGIPFLLRCCSDCANALMY

SEQ ID NO: 3002475 - protein, 18 aa, Entamoeba invadens
KEKMKFPAIVHKMVLEPG

SEQ ID NO: 3002476 - protein, 24 aa, Entamoeba invadens
KEKMPEHFEVFRLLCVMISEIVNQ

SEQ ID NO: 3002477 - protein, 19 aa, Entamoeba invadens
KEKMRPGVQLVLTDPTEIE

SEQ ID NO: 3002478 - protein, 26 aa, Entamoeba invadens
KEKNEKYFIILNFKNTKTTVTMFFHS

SEQ ID NO: 3002479 - protein, 28 aa, Entamoeba invadens
KEKNLGPDYWLIAARLMRSVLQSVEDKG

SEQ ID NO: 3002480 - protein, 23 aa, Entamoeba invadens
KEKQKISEYCGEALGKVFYDSQI

SEQ ID NO: 3002481 - protein, 30 aa, Entamoeba invadens
KEKRGEIQYSLLPKITAPTIPKTTKPTSKH

SEQ ID NO: 3002482 - protein, 25 aa, Entamoeba invadens
KEKRTQFHMLVRELHGYDSRCDEGV

SEQ ID NO: 3002483 - protein, 19 aa, Entamoeba invadens
KEKRVNEVLFWTVPGPEEE

SEQ ID NO: 3002484 - protein, 26 aa, Entamoeba invadens
KEKSLTRPLFCSAIKGKKSVVLLMRM

SEQ ID NO: 3002485 - protein, 39 aa, Entamoeba invadens
KEKTGKHSYYIPKGWFQSFIIPLYVGQPVTAKLYFREMF

SEQ ID NO: 3002486 - protein, 26 aa, Entamoeba invadens
KEKTKDILLLFKYDRWGCFKEQILGP

SEQ ID NO: 3002487 - protein, 24 aa, Entamoeba invadens
KEKTKLDFKIPGLLIMDTPGHESF

SEQ ID NO: 3002488 - protein, 24 aa, Entamoeba invadens
KEKTRLGMLFIMNNYAFIMNVCKL

SEQ ID NO: 3002489 - protein, 26 aa, Entamoeba invadens
KEKVEKAITPKLRFGKSPKKTKEDTP

SEQ ID NO: 3002490 - protein, 23 aa, Entamoeba invadens
KEKVKIERRLAFKIAGRQKIDFE

SEQ ID NO: 3002491 - protein, 25 aa, Entamoeba invadens
KEKWKVKAFLLSDWKMKEFKDNKIT

SEQ ID NO: 3002492 - protein, 17 aa, Entamoeba invadens
KEKYDIIICDWMGINLY

SEQ ID NO: 3002493 - protein, 24 aa, Entamoeba invadens
KEKYIKLPSIIVLNSLRGYSIQTN

SEQ ID NO: 3002494 - protein, 20 aa, Entamoeba invadens
KELCKGMVNLAKYADLDGKK

SEQ ID NO: 3002495 - protein, 23 aa, Entamoeba invadens
KELDDKKLLGDFLVYIGDSENDL

SEQ ID NO: 3002496 - protein, 25 aa, Entamoeba invadens
KELETILRLFVPSLKNVKNIKQVTK

SEQ ID NO: 3002497 - protein, 18 aa, Entamoeba invadens
KELFITDLRTGITKSFFN

SEQ ID NO: 3002498 - protein, 35 aa, Entamoeba invadens
KELFVSFPNFVGTPKYDPMLSSLLKSVFVGNEAFC

SEQ ID NO: 3002499 - protein, 23 aa, Entamoeba invadens
KELGEWQHGILMTWTSGNNWRCE

SEQ ID NO: 3002500 - protein, 24 aa, Entamoeba invadens
KELKDFIARCFVFDFKQRPSCAEL

SEQ ID NO: 3002501 - protein, 24 aa, Entamoeba invadens
KELKDQIILDLYNYVYPRGEFDHE

SEQ ID NO: 3002502 - protein, 19 aa, Entamoeba invadens
KELKDYPTIFIVANKIDTK

SEQ ID NO: 3002503 - protein, 20 aa, Entamoeba invadens
KELKHTYTLLLKLEQDLALK

SEQ ID NO: 3002504 - protein, 20 aa, Entamoeba invadens
KELKLIKMVKLLKSNFEKGN

SEQ ID NO: 3002505 - protein, 19 aa, Entamoeba invadens
KELKRDLLILNTVENKVRE

SEQ ID NO: 3002506 - protein, 23 aa, Entamoeba invadens
KELLKWDVVFWSEPESNVKTLRV

SEQ ID NO: 3002507 - protein, 18 aa, Entamoeba invadens
KELLLFDEAKRAGAPPYI

SEQ ID NO: 3002508 - protein, 26 aa, Entamoeba invadens
KELLLHNTVLCISTKAVPPVFKGNLL

SEQ ID NO: 3002509 - protein, 18 aa, Entamoeba invadens
KELLVKVDKEITVDPIAK

SEQ ID NO: 3002510 - protein, 20 aa, Entamoeba invadens
KELMLNYDNFKELCFKTWID

SEQ ID NO: 3002511 - protein, 20 aa, Entamoeba invadens
KELMLVDIRNYKKGMAKYKN

SEQ ID NO: 3002512 - protein, 17 aa, Entamoeba invadens
KELMNVIYKQNYRQLIS

SEQ ID NO: 3002513 - protein, 18 aa, Entamoeba invadens
KELMSILMMARDCRLSTP

SEQ ID NO: 3002514 - protein, 18 aa, Entamoeba invadens
KELNDPLSKLYIIVEREC

SEQ ID NO: 3002515 - protein, 17 aa, Entamoeba invadens
KELNEELVPFPLSTVYS

SEQ ID NO: 3002516 - protein, 23 aa, Entamoeba invadens
KELNELRLYVYKNVPQTNEEKAP

SEQ ID NO: 3002517 - protein, 25 aa, Entamoeba invadens
KELNTKIPFTLLKDLVEKVEIWFDP

SEQ ID NO: 3002518 - protein, 18 aa, Entamoeba invadens
KELNYLFGEYGDLTRIIM

SEQ ID NO: 3002519 - protein, 24 aa, Entamoeba invadens
KELPIEMFCGCSCLTFISLPTTLT

SEQ ID NO: 3002520 - protein, 22 aa, Entamoeba invadens
KELPIYDGYLFHAIDKERTHFR

SEQ ID NO: 3002521 - protein, 24 aa, Entamoeba invadens
KELRALLMISKKLKQKRLEAGALV

SEQ ID NO: 3002522 - protein, 18 aa, Entamoeba invadens
KELRRYGPFKGKVPRIIC

SEQ ID NO: 3002523 - protein, 34 aa, Entamoeba invadens
KELSFAFFHSLFETFNMCLPMRLIEALSYSCLNK

SEQ ID NO: 3002524 - protein, 27 aa, Entamoeba invadens
KELTKVTMLYIPTISLYKTVAFNHCRN

SEQ ID NO: 3002525 - protein, 27 aa, Entamoeba invadens
KELTKVTMPYIPTISLYKTVAFNHCRN

SEQ ID NO: 3002526 - protein, 29 aa, Entamoeba invadens
KELVAMRNILYASAKSVVICFSMGSQESY

SEQ ID NO: 3002527 - protein, 17 aa, Entamoeba invadens
KELVMCNLYPHSHSFQL

SEQ ID NO: 3002528 - protein, 18 aa, Entamoeba invadens
KELVNCIPLILFDEYDRP

SEQ ID NO: 3002529 - protein, 33 aa, Entamoeba invadens
KELVNVGRLTFVMLPSFSFPQNKMNMEILKYAE

SEQ ID NO: 3002530 - protein, 31 aa, Entamoeba invadens
KELYGNLFHLLQTEPVYLARLINSLVQSESD

SEQ ID NO: 3002531 - protein, 22 aa, Entamoeba invadens
KEMCDILVLFYKRKDVNPFDII

SEQ ID NO: 3002532 - protein, 26 aa, Entamoeba invadens
KEMCELFRIDLFGSIVYSILIEKSRK

SEQ ID NO: 3002533 - protein, 24 aa, Entamoeba invadens
KEMDGMLEGLEDLLSNLDDIDISS

SEQ ID NO: 3002534 - protein, 18 aa, Entamoeba invadens
KEMDPFDAAFYRIVYNLY

SEQ ID NO: 3002535 - protein, 26 aa, Entamoeba invadens
KEMENYYKLRKSMGVIPGLERRMSEQ

SEQ ID NO: 3002536 - protein, 30 aa, Entamoeba invadens
KEMIIARKRYGFPEALFNLAVIDITAEGIQ

SEQ ID NO: 3002537 - protein, 19 aa, Entamoeba invadens
KEMIIKLGEAIWTYCSNKF

SEQ ID NO: 3002538 - protein, 18 aa, Entamoeba invadens
KEMKNSPIVVFVKVLRKG

SEQ ID NO: 3002539 - protein, 22 aa, Entamoeba invadens
KEMLNCIILNLFMEGKTTREDY

SEQ ID NO: 3002540 - protein, 23 aa, Entamoeba invadens
KEMLNCILLNLFMEGQTTREDYL

SEQ ID NO: 3002541 - protein, 26 aa, Entamoeba invadens
KEMLSDFRIWISFSATLQKYVLAKVI

SEQ ID NO: 3002542 - protein, 21 aa, Entamoeba invadens
KEMRKFKLAPLLIKEVTRQVH

SEQ ID NO: 3002543 - protein, 28 aa, Entamoeba invadens
KEMSLKFILNPLTLFDFNNLTLLTSLEI

SEQ ID NO: 3002544 - protein, 24 aa, Entamoeba invadens
KEMSMPVPCFNVINGGAHAGNALA

SEQ ID NO: 3002545 - protein, 20 aa, Entamoeba invadens
KEMVLLLLSCGECRLDHINI

SEQ ID NO: 3002546 - protein, 23 aa, Entamoeba invadens
KEMVVYIKQYHTTGLTWNPNGAE

SEQ ID NO: 3002547 - protein, 30 aa, Entamoeba invadens
KEMYNILTEKILMLNIYFSEIEPKKITKMY

SEQ ID NO: 3002548 - protein, 32 aa, Entamoeba invadens; identical to SEQ ID NO: 2529067

SEQ ID NO: 3002549 - protein, 18 aa, Entamoeba invadens
KENEISFFFTFPRNQMNS

SEQ ID NO: 3002550 - protein, 25 aa, Entamoeba invadens
KENGKWWCGNLIVVEFSETIESKRS

SEQ ID NO: 3002551 - protein, 24 aa, Entamoeba invadens
KENIFVFGGEYRPVPLQQTFFGVT

SEQ ID NO: 3002552 - protein, 25 aa, Entamoeba invadens
KENIIITLLENGYASLRLSPRDPRR

SEQ ID NO: 3002553 - protein, 25 aa, Entamoeba invadens
KENIMLVFRTTNSSLFFGLYSEKKI

SEQ ID NO: 3002554 - protein, 26 aa, Entamoeba invadens
KENKQIVEFFTTKLLNLPLNDDSLLG

SEQ ID NO: 3002555 - protein, 30 aa, Entamoeba invadens
KENLDMLNLFKSCISKFATPSPLVFPCPSL

SEQ ID NO: 3002556 - protein, 22 aa, Entamoeba invadens
KENLNKFFLSKSHTTWLLEVIG

SEQ ID NO: 3002557 - protein, 27 aa, Entamoeba invadens
KENLRLFFELIKGRNIILSSGAFTSSE

SEQ ID NO: 3002558 - protein, 27 aa, Entamoeba invadens
KENPQVIRFIQFLNLESTKKLTKDDWN

SEQ ID NO: 3002559 - protein, 20 aa, Entamoeba invadens
KENQLLMDITEQLRIFVLDA

SEQ ID NO: 3002560 - protein, 26 aa, Entamoeba invadens
KENSNTLPFQVKLRTSGSGPKTTPPV

SEQ ID NO: 3002561 - protein, 18 aa, Entamoeba invadens
KENVKLQDLLKRAEVLTQ

SEQ ID NO: 3002562 - protein, 25 aa, Entamoeba invadens
KEPELLSIKLVFSDLKKFADDTYKS

SEQ ID NO: 3002563 - protein, 26 aa, Entamoeba invadens
KEPFTPISSVLLKYFTPEMLDLYTKY

SEQ ID NO: 3002564 - protein, 23 aa, Entamoeba invadens
KEPLCGWYHSHPSYKCWLSAIDV

SEQ ID NO: 3002565 - protein, 24 aa, Entamoeba invadens
KEPLSITIFEACEKYFKGNSKEVI

SEQ ID NO: 3002566 - protein, 20 aa, Entamoeba invadens
KEPNFLFVTMLRNLVEKLDE

SEQ ID NO: 3002567 - protein, 19 aa, Entamoeba invadens
KEPNTLNLIDFGMLGGGHK

SEQ ID NO: 3002568 - protein, 31 aa, Entamoeba invadens
KEPSEPPFQYWIFFLRMNISVLNNLRKSLRL

SEQ ID NO: 3002569 - protein, 23 aa, Entamoeba invadens
KEPYMMPLNALLDEYLDKFKKYF

SEQ ID NO: 3002570 - protein, 26 aa, Entamoeba invadens
KEQHLQTMLKPLPFNGSLEEDEVEQI

SEQ ID NO: 3002571 - protein, 26 aa, Entamoeba invadens
KEQIEFWGFLGAVKVFYEKHNRTPID

SEQ ID NO: 3002572 - protein, 17 aa, Entamoeba invadens
KEQIFTTTIFKIPNTIK

SEQ ID NO: 3002573 - protein, 27 aa, Entamoeba invadens
KEQKKPSIPIINTTKPTPLAPKNKKDD

SEQ ID NO: 3002574 - protein, 20 aa, Entamoeba invadens
KEQLARYRQLQSQKYHQTST

SEQ ID NO: 3002575 - protein, 27 aa, Entamoeba invadens
KEQLEQLFMTVGKVLKVSIPTNKKGKP

SEQ ID NO: 3002576 - protein, 27 aa, Entamoeba invadens
KEQLKQLFMTVGKVLKISIPTNKKGKP

SEQ ID NO: 3002577 - protein, 25 aa, Entamoeba invadens
KEQLPKLDVAPQYSLNPFSDTQNLP

SEQ ID NO: 3002578 - protein, 26 aa, Entamoeba invadens
KEQLRDLFMEHGDAWKMGRYSNETGI

SEQ ID NO: 3002579 - protein, 34 aa, Entamoeba invadens
KEQNNLLIFDIDLEKWLFEILTNYLKDTDEPTTL

SEQ ID NO: 3002580 - protein, 17 aa, Entamoeba invadens
KEQQRLFTELSLNKFRK

SEQ ID NO: 3002581 - protein, 25 aa, Entamoeba invadens
KEQRLKMSLKLDLVTKILQEGLGGQ

SEQ ID NO: 3002582 - protein, 24 aa, Entamoeba invadens
KEQTPPMSFGFDELALSAPQTQSD

SEQ ID NO: 3002583 - protein, 28 aa, Entamoeba invadens
KEQTTFQQCFLLYILNKHAKITIKRPKK

SEQ ID NO: 3002584 - protein, 29 aa, Entamoeba invadens
KERDEILMGLRQAPPDKLKFSNMAKIFPE

SEQ ID NO: 3002585 - protein, 43 aa, Entamoeba invadens
KERDNNHIALWMEFTLEAAAYATMLFREILKMPGDLDNQIDTM

SEQ ID NO: 3002586 - protein, 24 aa, Entamoeba invadens
KERDYWINFIIKTLTTVNQQTLSK

SEQ ID NO: 3002587 - protein, 21 aa, Entamoeba invadens
KEREEGLLLNVFKVDKTDGQK

SEQ ID NO: 3002588 - protein, 22 aa, Entamoeba invadens
KERFDEIFGTTKYSKLIEDTQK

SEQ ID NO: 3002589 - protein, 24 aa, Entamoeba invadens
KERGDMHFYLVGFYGSVFGKNAEK

SEQ ID NO: 3002590 - protein, 33 aa, Entamoeba invadens
KERGGLELFGKLLGCLFIKKYIDLSVIIDKALQ

SEQ ID NO: 3002591 - protein, 24 aa, Entamoeba invadens
KERGTILDILSRRPASGDLHVCIC

SEQ ID NO: 3002592 - protein, 27 aa, Entamoeba invadens
KERGVFRFLPEFLSAFFYNAHVYLYPQ

SEQ ID NO: 3002593 - protein, 17 aa, Entamoeba invadens
KERILSLLGYVAGEYDM

SEQ ID NO: 3002594 - protein, 25 aa, Entamoeba invadens
KERKNLLSGMNIFVGGKPKISTEVL

SEQ ID NO: 3002595 - protein, 39 aa, Entamoeba invadens
KERKRDAFRLGSEQWEWLFWVGFRDIFVWKKGSEYENFC

SEQ ID NO: 3002596 - protein, 24 aa, Entamoeba invadens
KERLKKIFQTENLVWIYSNVEEEQ

SEQ ID NO: 3002597 - protein, 25 aa, Entamoeba invadens
KERLKQLALEKIDLSKDPYFHKTHT

SEQ ID NO: 3002598 - protein, 17 aa, Entamoeba invadens
KERLLKEKLEKEKLAKL

SEQ ID NO: 3002599 - protein, 22 aa, Entamoeba invadens
KERLNNILSFCGFETDDQAEKC

SEQ ID NO: 3002600 - protein, 22 aa, Entamoeba invadens
KERLNVLLFKILQEISNGLAEY

SEQ ID NO: 3002601 - protein, 26 aa, Entamoeba invadens
KERLQKFNLELFKRRCEALKKAYNKK

SEQ ID NO: 3002602 - protein, 17 aa, Entamoeba invadens
KERLYDVKSGVSSFVID

SEQ ID NO: 3002603 - protein, 26 aa, Entamoeba invadens
KERPYVIKSGYFSPFVICICGDGRVL

SEQ ID NO: 3002604 - protein, 23 aa, Entamoeba invadens
KERRPFKCILDVGLARTTTGARI

SEQ ID NO: 3002605 - protein, 18 aa, Entamoeba invadens
KERSLCVGSKRFDNPKKE

SEQ ID NO: 3002606 - protein, 24 aa, Entamoeba invadens
KERSVYYKIITSPLLQPFCEKYYI

SEQ ID NO: 3002607 - protein, 25 aa, Entamoeba invadens
KERVSSYVFDLLKDKSKFVNVVFDN

SEQ ID NO: 3002608 - protein, 24 aa, Entamoeba invadens
KERYALIVSFFKDNNCVVPTSHAL

SEQ ID NO: 3002609 - protein, 23 aa, Entamoeba invadens
KERYQYTLMSTSSYLKKLNPPNS

SEQ ID NO: 3002610 - protein, 20 aa, Entamoeba invadens
KESERRLALFRMKKVLTNYK

SEQ ID NO: 3002611 - protein, 17 aa, Entamoeba invadens
KESFILLLVVIACLDSG

SEQ ID NO: 3002612 - protein, 17 aa, Entamoeba invadens
KESFIRKILVETLAKYP

SEQ ID NO: 3002613 - protein, 31 aa, Entamoeba invadens
KESHGFWALVQWIFSFICQKISNLIFGSMLQ

SEQ ID NO: 3002614 - protein, 17 aa, Entamoeba invadens
KESHLSLLVLPKCVKTL

SEQ ID NO: 3002615 - protein, 17 aa, Entamoeba invadens
KESILSQMIPQLRIKRF

SEQ ID NO: 3002616 - protein, 24 aa, Entamoeba invadens
KESKDETFKICWGDVGIGMFFIEP

SEQ ID NO: 3002617 - protein, 27 aa, Entamoeba invadens
KESKKDIKLVSKISIKKVVERAEIMDE

SEQ ID NO: 3002618 - protein, 17 aa, Entamoeba invadens
KESKWLFVFGNSKSKEY

SEQ ID NO: 3002619 - protein, 21 aa, Entamoeba invadens
KESLLVCWNCQTLVMYTEQKN

SEQ ID NO: 3002620 - protein, 26 aa, Entamoeba invadens
KESLTEYIKLVQLFDKSWTSRNNLVT

SEQ ID NO: 3002621 - protein, 24 aa, Entamoeba invadens
KESNPLLERVWNNILLKSKEQQID

SEQ ID NO: 3002622 - protein, 25 aa, Entamoeba invadens
KESQLPRLLKSDPIAKYYGFERGDV

SEQ ID NO: 3002623 - protein, 30 aa, Entamoeba invadens
KESREKIEMFAKLPFLISNVVEILDMPPEE

SEQ ID NO: 3002624 - protein, 26 aa, Entamoeba invadens
KESTNIFTTIFYPFDSSKVVTQGTQR

SEQ ID NO: 3002625 - protein, 21 aa, Entamoeba invadens
KESWKTKIFRLYVLTDNCSSE

SEQ ID NO: 3002626 - protein, 18 aa, Entamoeba invadens
KESYPKYTFVVIDTPKPT

SEQ ID NO: 3002627 - protein, 23 aa, Entamoeba invadens
KETCNWKTLYWTINDEGIKYLRA

SEQ ID NO: 3002628 - protein, 23 aa, Entamoeba invadens
KETDKYFISLNPTGITLLNGFAC

SEQ ID NO: 3002629 - protein, 22 aa, Entamoeba invadens
KETEIKFVGVEKDFMTLKDIKD

SEQ ID NO: 3002630 - protein, 24 aa, Entamoeba invadens
KETKRTAFFWNQETDPKLFSNALT

SEQ ID NO: 3002631 - protein, 18 aa, Entamoeba invadens
KETLIKEVRRKEASLFSL

SEQ ID NO: 3002632 - protein, 22 aa, Entamoeba invadens
KETLPSLPSLLLKKISEADSTT

SEQ ID NO: 3002633 - protein, 28 aa, Entamoeba invadens
KETLYDSITLPLLRPELFKKGSLTKRSK

SEQ ID NO: 3002634 - protein, 26 aa, Entamoeba invadens
KETNGKLMNELYSLKAKNEKQETEIQ

SEQ ID NO: 3002635 - protein, 23 aa, Entamoeba invadens
KETNLTILSLKNEILRINPNLAE

SEQ ID NO: 3002636 - protein, 28 aa, Entamoeba invadens
KETPITLDFGGMKVTPPAGFKISTTANA

SEQ ID NO: 3002637 - protein, 23 aa, Entamoeba invadens
KETRMFCTTLQKFAFVETELPND

SEQ ID NO: 3002638 - protein, 30 aa, Entamoeba invadens
KETSKYIGIPCFWGRLFVIEKLSEDGDFEA

SEQ ID NO: 3002639 - protein, 24 aa, Entamoeba invadens
KETTSELLALFYPDKPKQITNFMK

SEQ ID NO: 3002640 - protein, 27 aa, Entamoeba invadens
KETYNEIMKLLNAKFIAVTAANQKGGK

SEQ ID NO: 3002641 - protein, 25 aa, Entamoeba invadens
KEVAELYFEFYGTLMPLDIRQKFDD

SEQ ID NO: 3002642 - protein, 23 aa, Entamoeba invadens
KEVAPFITVLYELVNDRSAQDDI

SEQ ID NO: 3002643 - protein, 20 aa, Entamoeba invadens
KEVATYWINNYKIDGWRLDQ

SEQ ID NO: 3002644 - protein, 23 aa, Entamoeba invadens
KEVDELYHRLSVSKLADFSCETL

SEQ ID NO: 3002645 - protein, 26 aa, Entamoeba invadens
KEVDKIRYLWLMNSKDIKPSFLSQFF

SEQ ID NO: 3002646 - protein, 21 aa, Entamoeba invadens
KEVEFTLVVLFSSYTYEVLEV

SEQ ID NO: 3002647 - protein, 22 aa, Entamoeba invadens
KEVEFTLVVLFSSYTYEVVEVD

SEQ ID NO: 3002648 - protein, 28 aa, Entamoeba invadens
KEVEKDGHLLWLLLEKIPKEEQTVIFCA

SEQ ID NO: 3002649 - protein, 18 aa, Entamoeba invadens
KEVELRLWDIAGQEKYIA

SEQ ID NO: 3002650 - protein, 60 aa, Entamoeba invadens
KEVESDMKDFSILVGIRDRKLLLCKIRTVRKNLRKISLLKVRLIAQMRRGLDMVSYENQQ

SEQ ID NO: 3002651 - protein, 25 aa, Entamoeba invadens
KEVEYEYMAWYLGDINVINGGVVND

SEQ ID NO: 3002652 - protein, 17 aa, Entamoeba invadens
KEVFSFMDINPPGLKNP

SEQ ID NO: 3002653 - protein, 23 aa, Entamoeba invadens
KEVGNKWTFISKCLQGRSANDVK

SEQ ID NO: 3002654 - protein, 19 aa, Entamoeba invadens
KEVICVEPAIVKKSHMSRS

SEQ ID NO: 3002655 - protein, 20 aa, Entamoeba invadens
KEVIWGPARWCYSGKRCTKE

SEQ ID NO: 3002656 - protein, 30 aa, Entamoeba invadens; identical to SEQ ID NO: 2517425

SEQ ID NO: 3002657 - protein, 22 aa, Entamoeba invadens
KEVKLLLPLEIFRSQKQKENYI

SEQ ID NO: 3002658 - protein, 20 aa, Entamoeba invadens
KEVLMRMYDAMQAQWFYPNY

SEQ ID NO: 3002659 - protein, 24 aa, Entamoeba invadens
KEVLSMFFYNPLPIKNTKIFDNMT

SEQ ID NO: 3002660 - protein, 20 aa, Entamoeba invadens
KEVMCANYPLFKSEKLILGI

SEQ ID NO: 3002661 - protein, 26 aa, Entamoeba invadens
KEVRRKTRCLQTKDIFAFPALANNTT

SEQ ID NO: 3002662 - protein, 25 aa, Entamoeba invadens
KEVSQHRLFIPKLESKLKLMTDSEK

SEQ ID NO: 3002663 - protein, 27 aa, Entamoeba invadens
KEVVILFLKIFLINPTRFVGLCKTFSF

SEQ ID NO: 3002664 - protein, 21 aa, Entamoeba invadens
KEVVMLLKEIGFDGLVMTDWF

SEQ ID NO: 3002665 - protein, 26 aa, Entamoeba invadens
KEVVQYPVEFPDKFRKFGMEPSKGVL

SEQ ID NO: 3002666 - protein, 19 aa, Entamoeba invadens
KEVYFGKIRIFQKNEIIKV

SEQ ID NO: 3002667 - protein, 20 aa, Entamoeba invadens
KEVYLVTRKMEFYKVNFPEF

SEQ ID NO: 3002668 - protein, 21 aa, Entamoeba invadens
KEWINFGHRFKFRSGLGAKFD

SEQ ID NO: 3002669 - protein, 17 aa, Entamoeba invadens
KEWKSGMPLPMVFVSTS

SEQ ID NO: 3002670 - protein, 17 aa, Entamoeba invadens
KEWMFDEKKFFDEQGLN

SEQ ID NO: 3002671 - protein, 18 aa, Entamoeba invadens
KEWYDYQQSYLICTLMKE

SEQ ID NO: 3002672 - protein, 20 aa, Entamoeba invadens
KEYCKSITKISQEFQKKLED

SEQ ID NO: 3002673 - protein, 27 aa, Entamoeba invadens
KEYDYSTLFLGDYVDRGLMSCEVITTL

SEQ ID NO: 3002674 - protein, 23 aa, Entamoeba invadens
KEYFRVFGLIESAEIVRETRDGR

SEQ ID NO: 3002675 - protein, 17 aa, Entamoeba invadens
KEYGFVSFANPTEFLSA

SEQ ID NO: 3002676 - protein, 17 aa, Entamoeba invadens
KEYGLFEHQGDKQYFDF

SEQ ID NO: 3002677 - protein, 25 aa, Entamoeba invadens
KEYGMKFVYQLILANDVRAAIHLLI

SEQ ID NO: 3002678 - protein, 39 aa, Entamoeba invadens
KEYIKGIVWVYLYYTGHPISWEFGYRPFYAPTLTMLNTY

SEQ ID NO: 3002679 - protein, 17 aa, Entamoeba invadens
KEYLWYRKIVEMPWSNK

SEQ ID NO: 3002680 - protein, 23 aa, Entamoeba invadens
KEYRTFINYFPKRGERFCCGKID

SEQ ID NO: 3002681 - protein, 20 aa, Entamoeba invadens
KEYYIVNITADFKFFNRFIK

SEQ ID NO: 3002682 - protein, 28 aa, Entamoeba invadens
KFAAAIVKFLMWVEKKFGEKLSVKSLID

SEQ ID NO: 3002683 - protein, 23 aa, Entamoeba invadens
KFAACDFFAKVIKSLSLYGFDYF

SEQ ID NO: 3002684 - protein, 24 aa, Entamoeba invadens
KFAASIFKFLIKVEKKFGKKLSVK

SEQ ID NO: 3002685 - protein, 23 aa, Entamoeba invadens
KFACEFSIYLKPKCTCRINNTIC

SEQ ID NO: 3002686 - protein, 25 aa, Entamoeba invadens
KFAEFPQDILKLKKLTNLFATCNYI

SEQ ID NO: 3002687 - protein, 23 aa, Entamoeba invadens
KFAMYLDHKIVLLKKYPSVVNNG

SEQ ID NO: 3002688 - protein, 23 aa, Entamoeba invadens
KFANTFIPYILKQVQITTDFQNE

SEQ ID NO: 3002689 - protein, 27 aa, Entamoeba invadens
KFATVVFVPLRMMRKIRPIQAKLVDAL

SEQ ID NO: 3002690 - protein, 17 aa, Entamoeba invadens
KFAVIKKAAFELKVGEM

SEQ ID NO: 3002691 - protein, 22 aa, Entamoeba invadens
KFAWDIVDFVVSGKRLKRPSYL

SEQ ID NO: 3002692 - protein, 18 aa, Entamoeba invadens
KFCGAVFKLKNGKKSNVC

SEQ ID NO: 3002693 - protein, 35 aa, Entamoeba invadens
KFCNKITEETWWFIINKIYFKILEEVGYYHRKDES

SEQ ID NO: 3002694 - protein, 23 aa, Entamoeba invadens
KFCQVVFEFLMSKLSITQTRSYF

SEQ ID NO: 3002695 - protein, 19 aa, Entamoeba invadens
KFCSAHFVEFFLAKIQEGK

SEQ ID NO: 3002696 - protein, 20 aa, Entamoeba invadens
KFCVYLLTSINPGFKYHTYI

SEQ ID NO: 3002697 - protein, 31 aa, Entamoeba invadens
KFDALFVIRRLEATLWYKAISAFYTLENYKS

SEQ ID NO: 3002698 - protein, 26 aa, Entamoeba invadens
KFDAVKHLLIWNIGKQNPKVVPTISG

SEQ ID NO: 3002699 - protein, 25 aa, Entamoeba invadens
KFDDDRLIPVFGFGDKTTGGNAVFD

SEQ ID NO: 3002700 - protein, 25 aa, Entamoeba invadens
KFDDDRLIPVYGFGDKTTGDRAVFD

SEQ ID NO: 3002701 - protein, 20 aa, Entamoeba invadens
KFDETPLYLNPTDSFRLMSA

SEQ ID NO: 3002702 - protein, 18 aa, Entamoeba invadens
KFDHPYIKNVLVGSQVLL

SEQ ID NO: 3002703 - protein, 17 aa, Entamoeba invadens
KFDLNKLKKEKSGWKCL

SEQ ID NO: 3002704 - protein, 21 aa, Entamoeba invadens
KFDPNLLDPKFVFSKEEETVI

SEQ ID NO: 3002705 - protein, 17 aa, Entamoeba invadens
KFDVIIPKLIEANHLLL

SEQ ID NO: 3002706 - protein, 18 aa, Entamoeba invadens
KFDWLKMEQISPISKEMN

SEQ ID NO: 3002707 - protein, 18 aa, Entamoeba invadens
KFECEKLRYFLTDESPVC

SEQ ID NO: 3002708 - protein, 17 aa, Entamoeba invadens
KFEFLMLVQYWPGGRCY

SEQ ID NO: 3002709 - protein, 26 aa, Entamoeba invadens
KFEHFESWKPKIFFIATENINVINSH

SEQ ID NO: 3002710 - protein, 18 aa, Entamoeba invadens
KFEKIDFSRAALKNLKFV

SEQ ID NO: 3002711 - protein, 24 aa, Entamoeba invadens
KFEKLPKHFTQLQSLTKLICHTNN

SEQ ID NO: 3002712 - protein, 22 aa, Entamoeba invadens
KFEMVLDRFRYNPIPVKSTKLF

SEQ ID NO: 3002713 - protein, 21 aa, Entamoeba invadens
KFENEIPFILPKISDDDEPIK

SEQ ID NO: 3002714 - protein, 31 aa, Entamoeba invadens
KFENTTFFQRVIWYPVPYFVFSEHPQNVSFK

SEQ ID NO: 3002715 - protein, 25 aa, Entamoeba invadens
KFEPKYICDTVLYTVGYRFMGNIPK

SEQ ID NO: 3002716 - protein, 29 aa, Entamoeba invadens
KFEQKSFHPVLTTIPLYFDSHNKAIEITE

SEQ ID NO: 3002717 - protein, 20 aa, Entamoeba invadens
KFERKYQRPASPLHFKMSRV

SEQ ID NO: 3002718 - protein, 19 aa, Entamoeba invadens
KFFHIDFGHFLGNFKKKFG

SEQ ID NO: 3002719 - protein, 19 aa, Entamoeba invadens
KFFPSLETCFLYSKTDKRY

SEQ ID NO: 3002720 - protein, 18 aa, Entamoeba invadens
KFFTNFFNEKLDLEIDDY

SEQ ID NO: 3002721 - protein, 24 aa, Entamoeba invadens
KFGKLFEDTITSLKFPDGSHFIAE

SEQ ID NO: 3002722 - protein, 21 aa, Entamoeba invadens
KFGLRQMLLRNFPGVKKFIGL

SEQ ID NO: 3002723 - protein, 28 aa, Entamoeba invadens
KFGNAKLVFESILSLKYISNTICDKKDA

SEQ ID NO: 3002724 - protein, 23 aa, Entamoeba invadens
KFGNYYGPLLTSMDKKRLPKVLG

SEQ ID NO: 3002725 - protein, 20 aa, Entamoeba invadens
KFGPILPVTDFLPTQTILEI

SEQ ID NO: 3002726 - protein, 17 aa, Entamoeba invadens
KFGRIDCLINNAGYALV

SEQ ID NO: 3002727 - protein, 21 aa, Entamoeba invadens
KFGRNIETWFYLKGGDDGNSI

SEQ ID NO: 3002728 - protein, 20 aa, Entamoeba invadens
KFGSNIETWFYLKGGDDGNS

SEQ ID NO: 3002729 - protein, 20 aa, Entamoeba invadens
KFGVYVQERVEIGVPLLEEN

SEQ ID NO: 3002730 - protein, 25 aa, Entamoeba invadens
KFGYTYDSVLYYFDSYNNHDMSDFK

SEQ ID NO: 3002731 - protein, 20 aa, Entamoeba invadens
KFGYTYSSVLFLFDGNDELQ

SEQ ID NO: 3002732 - protein, 27 aa, Entamoeba invadens
KFHCPLKPFHFYALKTTSGKRPWMISS

SEQ ID NO: 3002733 - protein, 20 aa, Entamoeba invadens
KFHFNPIPLNCKTIRYFSNI

SEQ ID NO: 3002734 - protein, 22 aa, Entamoeba invadens
KFHFNPIPLNIKTLGYFPNIET

SEQ ID NO: 3002735 - protein, 19 aa, Entamoeba invadens
KFHFNPIPLNSKTLGYFPN

SEQ ID NO: 3002736 - protein, 25 aa, Entamoeba invadens
KFHFNPIPLNVRTRYFFPKIETLVI

SEQ ID NO: 3002737 - protein, 18 aa, Entamoeba invadens
KFHFNPIPLNYKTIGYFP

SEQ ID NO: 3002738 - protein, 21 aa, Entamoeba invadens
KFHFNPIPLNYKTIKYFTNIE

SEQ ID NO: 3002739 - protein, 17 aa, Entamoeba invadens
KFHFNPIPLTNKTFKHF

SEQ ID NO: 3002740 - protein, 17 aa, Entamoeba invadens
KFHFNPIPLTPKTLKYF

SEQ ID NO: 3002741 - protein, 19 aa, Entamoeba invadens
KFHFNPIPLTPKTLKYFPR

SEQ ID NO: 3002742 - protein, 19 aa, Entamoeba invadens
KFHFNPIPLTSHTRSYFTH

SEQ ID NO: 3002743 - protein, 20 aa, Entamoeba invadens
KFHFNPIPLTTHTRPFFPNL

SEQ ID NO: 3002744 - protein, 21 aa, Entamoeba invadens
KFHYNPIFLTQSKLIFFENLE

SEQ ID NO: 3002745 - protein, 17 aa, Entamoeba invadens
KFHYNPIPITRKTQKYF

SEQ ID NO: 3002746 - protein, 18 aa, Entamoeba invadens
KFHYNPIPITRKTQKYFP

SEQ ID NO: 3002747 - protein, 21 aa, Entamoeba invadens
KFHYNPIPLTKKTRKYFPNIE

SEQ ID NO: 3002748 - protein, 20 aa, Entamoeba invadens
KFHYNPVPLTLRSISFFPKI

SEQ ID NO: 3002749 - protein, 30 aa, Entamoeba invadens
KFIGSCVFNGNYYILSEHAIFKVDADALAK

SEQ ID NO: 3002750 - protein, 21 aa, Entamoeba invadens
KFIILLKKGKNKNAFFVMSNK

SEQ ID NO: 3002751 - protein, 17 aa, Entamoeba invadens
KFIIRLFENPVQCLTAT

SEQ ID NO: 3002752 - protein, 21 aa, Entamoeba invadens
KFIKWRNYQSSQESVFLAIIN

SEQ ID NO: 3002753 - protein, 18 aa, Entamoeba invadens
KFITSYDKSLFVIDKYRD

SEQ ID NO: 3002754 - protein, 25 aa, Entamoeba invadens
KFIYENYRYFTREGLRYSIDKLDIA

SEQ ID NO: 3002755 - protein, 19 aa, Entamoeba invadens
KFKDFKLYDYLGAVDLKNP

SEQ ID NO: 3002756 - protein, 18 aa, Entamoeba invadens
KFKFPWKIAEFVISGKRL

SEQ ID NO: 3002757 - protein, 23 aa, Entamoeba invadens
KFKGFMDLFDYNPISLTTKTINY

SEQ ID NO: 3002758 - protein, 24 aa, Entamoeba invadens
KFKIRRYTIPIKKKKTKKVADKEW

SEQ ID NO: 3002759 - protein, 17 aa, Entamoeba invadens
KFKIVFCGTLIVCHVFI

SEQ ID NO: 3002760 - protein, 25 aa, Entamoeba invadens
KFKNFKFYFKVIYDDKNPFFNTNNV

SEQ ID NO: 3002761 - protein, 30 aa, Entamoeba invadens
KFKNRNVMKLIYLDLLGYNTQFAQIECLAL

SEQ ID NO: 3002762 - protein, 31 aa, Entamoeba invadens
KFKSMMEKFKYNPIPLTLTTKRYFPNIEILN

SEQ ID NO: 3002763 - protein, 22 aa, Entamoeba invadens
KFKTIWDKYNTVLNYCMTQLSS

SEQ ID NO: 3002764 - protein, 17 aa, Entamoeba invadens
KFKVCVPYIGTILDNIA

SEQ ID NO: 3002765 - protein, 23 aa, Entamoeba invadens
KFLDDICLQPIPLPNEVLSNIYF

SEQ ID NO: 3002766 - protein, 32 aa, Entamoeba invadens
KFLERWEVFYDLVESLWPFVVSMRYEEKVIVE

SEQ ID NO: 3002767 - protein, 24 aa, Entamoeba invadens
KFLGKILVKITFSQLVRLQKEFFV

SEQ ID NO: 3002768 - protein, 26 aa, Entamoeba invadens
KFLKLGIPFFMWEIGQCVLLTPKEGV

SEQ ID NO: 3002769 - protein, 21 aa, Entamoeba invadens
KFLMNLFTGAEYDKVVEELTR

SEQ ID NO: 3002770 - protein, 21 aa, Entamoeba invadens
KFLPHLIEYMVRIYKEAQVNT

SEQ ID NO: 3002771 - protein, 28 aa, Entamoeba invadens
KFLQSKNVWICPPAEYFDKIINEGCACL

SEQ ID NO: 3002772 - protein, 18 aa, Entamoeba invadens
KFLSLIKDMSRVIDLMPK

SEQ ID NO: 3002773 - protein, 41 aa, Entamoeba invadens
KFLSSEKSKWILLKPFIQCFGIPPSFFLRVSKKMNITTALE

SEQ ID NO: 3002774 - protein, 18 aa, Entamoeba invadens
KFLSVCWCGQGSQDKLKT

SEQ ID NO: 3002775 - protein, 17 aa, Entamoeba invadens
KFLTIVKSLFDSGVLKN

SEQ ID NO: 3002776 - protein, 20 aa, Entamoeba invadens
KFMHNPFYAAPEMYLGRIEE

SEQ ID NO: 3002777 - protein, 17 aa, Entamoeba invadens
KFMIDAAKGILYLHENG

SEQ ID NO: 3002778 - protein, 19 aa, Entamoeba invadens
KFMMELYTKQKEENAKLVT

SEQ ID NO: 3002779 - protein, 24 aa, Entamoeba invadens
KFNEYLEAYAFRDIAKQPPQPPEN

SEQ ID NO: 3002780 - protein, 23 aa, Entamoeba invadens
KFNNFKVIPNQRGKFKAVGEVYE

SEQ ID NO: 3002781 - protein, 19 aa, Entamoeba invadens
KFNPFHLMRELCSSMIQRS

SEQ ID NO: 3002782 - protein, 23 aa, Entamoeba invadens
KFNVGRHFIFKLPTKKSKDAHRY

SEQ ID NO: 3002783 - protein, 20 aa, Entamoeba invadens
KFNVTFKFVPNDLPTEIIKE

SEQ ID NO: 3002784 - protein, 34 aa, Entamoeba invadens
KFPANPILPHSIVSGFLFLRVICPALTTPEASVF

SEQ ID NO: 3002785 - protein, 18 aa, Entamoeba invadens
KFPGLRVEEFLLSFANET

SEQ ID NO: 3002786 - protein, 30 aa, Entamoeba invadens
KFPPSPCPVYILSLPFYKEQLEKVIVGETT

SEQ ID NO: 3002787 - protein, 25 aa, Entamoeba invadens
KFPRYVRVQKEKRILMKRLKVPPAV

SEQ ID NO: 3002788 - protein, 17 aa, Entamoeba invadens
KFPWSIAEFVIKGSRLP

SEQ ID NO: 3002789 - protein, 20 aa, Entamoeba invadens
KFQAKRFAVPPPVKQKPTKE

SEQ ID NO: 3002790 - protein, 28 aa, Entamoeba invadens
KFQCDYIIHFYGAVFIPNKLCMVTEFAQ

SEQ ID NO: 3002791 - protein, 25 aa, Entamoeba invadens
KFQDSLLKFHFNPIPITSKTKRLFP

SEQ ID NO: 3002792 - protein, 17 aa, Entamoeba invadens
KFQDWYCANIEKVEEIA

SEQ ID NO: 3002793 - protein, 25 aa, Entamoeba invadens
KFQNAQIKYIITAFQISQKGTVFED

SEQ ID NO: 3002794 - protein, 29 aa, Entamoeba invadens
KFQQIEFNIIRGYYWTGCKSNIINLRSQL

SEQ ID NO: 3002795 - protein, 28 aa, Entamoeba invadens
KFQQIEFNIIRGYYWTGCKSNMFSNEIE

SEQ ID NO: 3002796 - protein, 29 aa, Entamoeba invadens
KFQQIEFNIIRGYYWTGCKSNVFSNEIEK

SEQ ID NO: 3002797 - protein, 28 aa, Entamoeba invadens
KFQQIEFNIIRGYYWTGNPLQNNYKLLM

SEQ ID NO: 3002798 - protein, 22 aa, Entamoeba invadens
KFQSLRTKTENFYVFGFADEFS

SEQ ID NO: 3002799 - protein, 23 aa, Entamoeba invadens
KFQTIPSLFYRGSIGAIVVYDLT

SEQ ID NO: 3002800 - protein, 21 aa, Entamoeba invadens
KFRACVFTQQFIKLIVSVYSM

SEQ ID NO: 3002801 - protein, 25 aa, Entamoeba invadens
KFRCDYIVHFYGAVFIPNKICMVTE

SEQ ID NO: 3002802 - protein, 23 aa, Entamoeba invadens
KFRCDYIVHFYGAVFIPNKMCMV

SEQ ID NO: 3002803 - protein, 20 aa, Entamoeba invadens
KFRCDYIVHFYGAVFIPNKV

SEQ ID NO: 3002804 - protein, 27 aa, Entamoeba invadens
KFRCDYIVHFYGAVFMTNKICLVTEFA

SEQ ID NO: 3002805 - protein, 26 aa, Entamoeba invadens
KFRCEYIVHFYGAVFIPNKACMVIEF

SEQ ID NO: 3002806 - protein, 26 aa, Entamoeba invadens
KFRCEYIVHFYGAVFIPNKICMVTEF

SEQ ID NO: 3002807 - protein, 28 aa, Entamoeba invadens
KFRCEYIVHFYGAVFIPNKVCLVTEFAL

SEQ ID NO: 3002808 - protein, 19 aa, Entamoeba invadens
KFRCEYIVHFYGAVFIPTN

SEQ ID NO: 3002809 - protein, 24 aa, Entamoeba invadens
KFRCKYIVHFYGAVFVPNKICMVT

SEQ ID NO: 3002810 - protein, 27 aa, Entamoeba invadens
KFRDDGTGITLPEGPWIEVVQTPTPPG

SEQ ID NO: 3002811 - protein, 21 aa, Entamoeba invadens
KFRETLDKFRYNPIPITSQHI

SEQ ID NO: 3002812 - protein, 19 aa, Entamoeba invadens
KFRGHKILIQESETKKLFI

SEQ ID NO: 3002813 - protein, 22 aa, Entamoeba invadens
KFRKDIIIVVLANKVLVYDFKN

SEQ ID NO: 3002814 - protein, 17 aa, Entamoeba invadens
KFRNEYIVHFYGAVFIP

SEQ ID NO: 3002815 - protein, 24 aa, Entamoeba invadens
KFRSDYIVHFYGAVFIPNKICMVT

SEQ ID NO: 3002816 - protein, 23 aa, Entamoeba invadens
KFRSEYIIHFYGACFIPNHICMV

SEQ ID NO: 3002817 - protein, 27 aa, Entamoeba invadens
KFRSEYIIHFYGACFIPNHICTVTEFA

SEQ ID NO: 3002818 - protein, 26 aa, Entamoeba invadens
KFRSEYIVHFYGAILIPTHVCMVTEY

SEQ ID NO: 3002819 - protein, 23 aa, Entamoeba invadens
KFRSEYIVHFYGAVFIPSKVCMV

SEQ ID NO: 3002820 - protein, 23 aa, Entamoeba invadens
KFRSEYIVHFYGAVFIQNKICMV

SEQ ID NO: 3002821 - protein, 24 aa, Entamoeba invadens
KFRSEYIVHFYGAVFVPNNVCIVN

SEQ ID NO: 3002822 - protein, 25 aa, Entamoeba invadens
KFRSEYIVHFYGAVLIPNKICMVTE

SEQ ID NO: 3002823 - protein, 23 aa, Entamoeba invadens
KFRSEYTVHFYGAVFIPNKVCMV

SEQ ID NO: 3002824 - protein, 17 aa, Entamoeba invadens
KFRTTVEQYIIKMATFD

SEQ ID NO: 3002825 - protein, 18 aa, Entamoeba invadens
KFSAECDCMKTTIAELEE

SEQ ID NO: 3002826 - protein, 19 aa, Entamoeba invadens
KFSALLKNKYPLGNRKLKT

SEQ ID NO: 3002827 - protein, 21 aa, Entamoeba invadens
KFSAWELPISFFNIKTKININ

SEQ ID NO: 3002828 - protein, 23 aa, Entamoeba invadens
KFSCILDRFRYNPIPITSTKLFP

SEQ ID NO: 3002829 - protein, 28 aa, Entamoeba invadens
KFSDKYDSVFRFVLNNTLIVDTLKTARK

SEQ ID NO: 3002830 - protein, 21 aa, Entamoeba invadens
KFSDLLIQNVDMKKSIGGLQS

SEQ ID NO: 3002831 - protein, 21 aa, Entamoeba invadens
KFSDLLIQNVNMKKSIDGLQS

SEQ ID NO: 3002832 - protein, 35 aa, Entamoeba invadens
KFSGYFSPKLEKSHLFPHIFFDEHRLSRRMSHSFK

SEQ ID NO: 3002833 - protein, 31 aa, Entamoeba invadens
KFSNETFFVFNTTNYIPLKRKIENNAPETIL

SEQ ID NO: 3002834 - protein, 20 aa, Entamoeba invadens
KFSNFLWEKAKINLNNKKRV

SEQ ID NO: 3002835 - protein, 22 aa, Entamoeba invadens
KFSSFKLPQPSLIFKDNKIEPD

SEQ ID NO: 3002836 - protein, 23 aa, Entamoeba invadens
KFSSMISSFYRGSDGAFVVFDVT

SEQ ID NO: 3002837 - protein, 20 aa, Entamoeba invadens
KFSTHYLFSGELINLYSAWN

SEQ ID NO: 3002838 - protein, 22 aa, Entamoeba invadens
KFSTLLVLAKNFYKFYIGYFKD

SEQ ID NO: 3002839 - protein, 24 aa, Entamoeba invadens
KFSYYALEYLIAEFEEFSNVGLLV

SEQ ID NO: 3002840 - protein, 19 aa, Entamoeba invadens
KFTDLGALQTWLNTIGKGE

SEQ ID NO: 3002841 - protein, 22 aa, Entamoeba invadens
KFTDYCHEVIFMTGLPSPGKSF

SEQ ID NO: 3002842 - protein, 28 aa, Entamoeba invadens
KFTKDGVKFVYFLLSKKFQQSATYTILK

SEQ ID NO: 3002843 - protein, 22 aa, Entamoeba invadens
KFTLRVSPELISLKKGFACEFS

SEQ ID NO: 3002844 - protein, 24 aa, Entamoeba invadens
KFTMGKWILNFSILEFIVSHQEEL

SEQ ID NO: 3002845 - protein, 27 aa, Entamoeba invadens
KFTSPPTEYYLYKKLKTISSEPILDFQ

SEQ ID NO: 3002846 - protein, 18 aa, Entamoeba invadens
KFVEIKKNNVKVPMVCLK

SEQ ID NO: 3002847 - protein, 26 aa, Entamoeba invadens
KFVELKTLVINYLRQCTFLDEVLSIR

SEQ ID NO: 3002848 - protein, 21 aa, Entamoeba invadens
KFVEYFKVNLIDILNTEQRTP

SEQ ID NO: 3002849 - protein, 17 aa, Entamoeba invadens
KFVFITKVDTLLKENKV

SEQ ID NO: 3002850 - protein, 21 aa, Entamoeba invadens
KFVGFYKVYCGLKEPIHVYTD

SEQ ID NO: 3002851 - protein, 24 aa, Entamoeba invadens
KFVGNSAFIKCQNLRKVILQHVNY

SEQ ID NO: 3002852 - protein, 18 aa, Entamoeba invadens
KFVILLINRREIQPHHLI

SEQ ID NO: 3002853 - protein, 38 aa, Entamoeba invadens
KFVKEMTLKCYTLEMAVFLFGIKFVDFPDSIKESLKLY

SEQ ID NO: 3002854 - protein, 27 aa, Entamoeba invadens
KFVQALNRQSVLAQEKLLFESKEQNLI

SEQ ID NO: 3002855 - protein, 24 aa, Entamoeba invadens
KFVVSYCCHLRLLNYRYHFNTIEF

SEQ ID NO: 3002856 - protein, 17 aa, Entamoeba invadens
KFVVYFIDEVEELSLAL

SEQ ID NO: 3002857 - protein, 19 aa, Entamoeba invadens
KFWALNMVLTEKYKFPQTE

SEQ ID NO: 3002858 - protein, 21 aa, Entamoeba invadens
KFWSYKDRIAYLDGERHFNLS

SEQ ID NO: 3002859 - protein, 19 aa, Entamoeba invadens
KFYDVNKPFYYPPERRDLI

SEQ ID NO: 3002860 - protein, 20 aa, Entamoeba invadens
KFYELYPLIAQTMQSLLANN

SEQ ID NO: 3002861 - protein, 19 aa, Entamoeba invadens
KFYFTVLPHTTLSFKIMTY

SEQ ID NO: 3002862 - protein, 24 aa, Entamoeba invadens
KGAAYSLPTIYQVDDYWLNGTQET

SEQ ID NO: 3002863 - protein, 18 aa, Entamoeba invadens
KGADLSLSLAYRAAIKKV

SEQ ID NO: 3002864 - protein, 27 aa, Entamoeba invadens
KGAIKKYYRIIVWFNVDFTIVDKNKKY

SEQ ID NO: 3002865 - protein, 17 aa, Entamoeba invadens
KGAMFRQPLLEFSGACE

SEQ ID NO: 3002866 - protein, 28 aa, Entamoeba invadens
KGATLIPVLNYLNFLNVVDLSGLEISKK

SEQ ID NO: 3002867 - protein, 23 aa, Entamoeba invadens
KGAVTLLRPRTLRWSYSVVEGSS

SEQ ID NO: 3002868 - protein, 20 aa, Entamoeba invadens
KGAYFRQGMLEISILSMLND

SEQ ID NO: 3002869 - protein, 19 aa, Entamoeba invadens
KGCDYYTIRSVPSLVTLHK

SEQ ID NO: 3002870 - protein, 25 aa, Entamoeba invadens
KGCKLHDVVIVYTPASNLKKTNGMD

SEQ ID NO: 3002871 - protein, 27 aa, Entamoeba invadens
KGCKNMKICPGAKVLYLSAASGTTVSH

SEQ ID NO: 3002872 - protein, 24 aa, Entamoeba invadens
KGCLKCIDMFYLNTTNNECLPCVN

SEQ ID NO: 3002873 - protein, 19 aa, Entamoeba invadens
KGCLLFVIQCTDGCMSIVY

SEQ ID NO: 3002874 - protein, 26 aa, Entamoeba invadens
KGCNIKTTFLLPNTLTRFSITDSDIQ

SEQ ID NO: 3002875 - protein, 18 aa, Entamoeba invadens
KGCVALVDIALPKTLKLV

SEQ ID NO: 3002876 - protein, 21 aa, Entamoeba invadens
KGCVLLPSITLPLTVKSYGQS

SEQ ID NO: 3002877 - protein, 26 aa, Entamoeba invadens
KGCYFHLCQSLWRKVNTLGLSSRFKE

SEQ ID NO: 3002878 - protein, 21 aa, Entamoeba invadens
KGDDFPFFETLISPVVTSQVG

SEQ ID NO: 3002879 - protein, 27 aa, Entamoeba invadens
KGDENHFMFTLKNPYKIPPTRFFPIEV

SEQ ID NO: 3002880 - protein, 26 aa, Entamoeba invadens
KGDFDLLQAFEFCDFILKTSSPLYDA

SEQ ID NO: 3002881 - protein, 25 aa, Entamoeba invadens
KGDFNVFFSFFAPPYERQQKVPVCQ

SEQ ID NO: 3002882 - protein, 19 aa, Entamoeba invadens
KGDFPLNVAFQNPHCIGFL

SEQ ID NO: 3002883 - protein, 23 aa, Entamoeba invadens
KGDKGWIVIDTLCSIEAAAVGLK

SEQ ID NO: 3002884 - protein, 17 aa, Entamoeba invadens
KGDKPVVVVKEAKPKEL

SEQ ID NO: 3002885 - protein, 18 aa, Entamoeba invadens
KGDLKIDGITYTLPINNG

SEQ ID NO: 3002886 - protein, 26 aa, Entamoeba invadens
KGDLPKIPEIFFTAKNMKELKKGLKK

SEQ ID NO: 3002887 - protein, 25 aa, Entamoeba invadens
KGDMRLKFIIQMCACALNGRDMIYN

SEQ ID NO: 3002888 - protein, 20 aa, Entamoeba invadens
KGDYITVVVKDFKTLNQMLE

SEQ ID NO: 3002889 - protein, 53 aa, Entamoeba invadens
KGDYNPYLPEIPPKTPPVYLFFKDFQLQPMKFVLTFKLGSASLELLPYNAMTA

SEQ ID NO: 3002890 - protein, 22 aa, Entamoeba invadens
KGDYVLLFTDGFHDNLDPDICG

SEQ ID NO: 3002891 - protein, 24 aa, Entamoeba invadens
KGEFVTYQHFLLSLDNCKFESVHI

SEQ ID NO: 3002892 - protein, 25 aa, Entamoeba invadens
KGEISWDDLVKLLVGPTKGHGGAIL

SEQ ID NO: 3002893 - protein, 22 aa, Entamoeba invadens
KGEKLVCIDLEPPKPINTSTYL

SEQ ID NO: 3002894 - protein, 24 aa, Entamoeba invadens
KGELPFCLEMMYKDGWERSCDVCL

SEQ ID NO: 3002895 - protein, 18 aa, Entamoeba invadens
KGESLRIQYRDALISIII

SEQ ID NO: 3002896 - protein, 26 aa, Entamoeba invadens
KGESMPIRVFLANLDLTPSYHNINNM

SEQ ID NO: 3002897 - protein, 25 aa, Entamoeba invadens
KGEVFNMRPFIPCSLGIGIEKDQIV

SEQ ID NO: 3002898 - protein, 28 aa, Entamoeba invadens
KGEVFPDLDVLPLFLTKKKVLSRVEVTG

SEQ ID NO: 3002899 - protein, 21 aa, Entamoeba invadens
KGEYRWAATVLNHLVFADVNN

SEQ ID NO: 3002900 - protein, 19 aa, Entamoeba invadens
KGFADFSLKLVMRQSAIKA

SEQ ID NO: 3002901 - protein, 27 aa, Entamoeba invadens
KGFEKVKRLILHPIPFDTKRDLITPSL

SEQ ID NO: 3002902 - protein, 17 aa, Entamoeba invadens
KGFFYLVRAVKCFCGKT

SEQ ID NO: 3002903 - protein, 20 aa, Entamoeba invadens
KGFIELLPGTETRDVTENKK

SEQ ID NO: 3002904 - protein, 20 aa, Entamoeba invadens
KGFLLAPLREMDNSYILQIC

SEQ ID NO: 3002905 - protein, 21 aa, Entamoeba invadens
KGFLPKQPVIVRARFFSKTAQ

SEQ ID NO: 3002906 - protein, 18 aa, Entamoeba invadens
KGFLTSNEFFRVMTNLDE

SEQ ID NO: 3002907 - protein, 25 aa, Entamoeba invadens
KGFNIAYILFSVLVKISIESPTLFA

SEQ ID NO: 3002908 - protein, 19 aa, Entamoeba invadens
KGFNLLIQKIINDAPNREV

SEQ ID NO: 3002909 - protein, 21 aa, Entamoeba invadens
KGGITLDIVFGKFSFSCGNAG

SEQ ID NO: 3002910 - protein, 17 aa, Entamoeba invadens
KGGKIMQMTLKFKGKQL

SEQ ID NO: 3002911 - protein, 18 aa, Entamoeba invadens
KGGKIMQMTLKFKGKQLT

SEQ ID NO: 3002912 - protein, 23 aa, Entamoeba invadens
KGGLLFVNAVYPDKFGVQELMAV

SEQ ID NO: 3002913 - protein, 24 aa, Entamoeba invadens
KGGRKYVVLVFNNALCVLKEQDED

SEQ ID NO: 3002914 - protein, 24 aa, Entamoeba invadens
KGGRRKWDKTIYSTEYYNGEYTGA

SEQ ID NO: 3002915 - protein, 30 aa, Entamoeba invadens
KGHCLSCRRGFAPILSSPPVCTECGCRECN

SEQ ID NO: 3002916 - protein, 21 aa, Entamoeba invadens
KGHIFGSFNKSPIPSAHKKKY

SEQ ID NO: 3002917 - protein, 22 aa, Entamoeba invadens
KGHTLPTFKSLLLFHIIEKNGD

SEQ ID NO: 3002918 - protein, 17 aa, Entamoeba invadens
KGHYIACIFGSSSMGYC

SEQ ID NO: 3002919 - protein, 21 aa, Entamoeba invadens
KGIDLRLSPIRVRPKSPKSVV

SEQ ID NO: 3002920 - protein, 17 aa, Entamoeba invadens
KGIFDCGYPDYAYPNLF

SEQ ID NO: 3002921 - protein, 18 aa, Entamoeba invadens
KGIKNGIAYQFFVGTNSD

SEQ ID NO: 3002922 - protein, 19 aa, Entamoeba invadens
KGILPWLCPDAKTQVTLEY

SEQ ID NO: 3002923 - protein, 30 aa, Entamoeba invadens
KGILSDMLMPLLLRLIDEDDYFITWANAQS

SEQ ID NO: 3002924 - protein, 17 aa, Entamoeba invadens
KGILYLHENGILHRDIK

SEQ ID NO: 3002925 - protein, 23 aa, Entamoeba invadens
KGIPAIEKTLYMRHRSYLNAWTK

SEQ ID NO: 3002926 - protein, 19 aa, Entamoeba invadens
KGIRIPLYLPSQVDPIINC

SEQ ID NO: 3002927 - protein, 23 aa, Entamoeba invadens
KGITPIFRLNPSLEVFIGEDLKR

SEQ ID NO: 3002928 - protein, 31 aa, Entamoeba invadens
KGIYNVEVVSLLLLFKLKYPDKIHLIRGNFD

SEQ ID NO: 3002929 - protein, 24 aa, Entamoeba invadens
KGKEIPFELLSTFPPVDSTSTSQA

SEQ ID NO: 3002930 - protein, 26 aa, Entamoeba invadens
KGKFFLPGFIDCHIHAPQYATVATQF

SEQ ID NO: 3002931 - protein, 23 aa, Entamoeba invadens
KGKFLLINFSNLEQITWTDFLIS

SEQ ID NO: 3002932 - protein, 19 aa, Entamoeba invadens
KGKGDLLFLIEDDKKNKFG

SEQ ID NO: 3002933 - protein, 17 aa, Entamoeba invadens
KGKISRVLSSKAALCAR

SEQ ID NO: 3002934 - protein, 26 aa, Entamoeba invadens
KGKIWAKVFIKSKPQRYGIKFCFFFR

SEQ ID NO: 3002935 - protein, 18 aa, Entamoeba invadens
KGKIYIVMDYCTNGSLKM

SEQ ID NO: 3002936 - protein, 23 aa, Entamoeba invadens
KGKKLLYFHAPFTCFNNPNNEVD

SEQ ID NO: 3002937 - protein, 25 aa, Entamoeba invadens
KGKLKSVTLLLFSNNVVITKVPTTG

SEQ ID NO: 3002938 - protein, 24 aa, Entamoeba invadens
KGKLLELFQTSVFTKPLIVRVNHI

SEQ ID NO: 3002939 - protein, 28 aa, Entamoeba invadens
KGKNTTGTFLFPKEPWWKVHFGSDEGKV

SEQ ID NO: 3002940 - protein, 24 aa, Entamoeba invadens
KGKPNVIIVIKMKGGKIFGGYFSH

SEQ ID NO: 3002941 - protein, 26 aa, Entamoeba invadens
KGKRNVYLFVLTNDKNFYCFKLGNFP

SEQ ID NO: 3002942 - protein, 22 aa, Entamoeba invadens
KGKSLLLVNDFFKPPLEKAGTD

SEQ ID NO: 3002943 - protein, 24 aa, Entamoeba invadens
KGKTSVLMMVGLQGAGKTTTITKL

SEQ ID NO: 3002944 - protein, 23 aa, Entamoeba invadens
KGKTYLGIREIYEKDGKYQLGKK

SEQ ID NO: 3002945 - protein, 27 aa, Entamoeba invadens
KGKVLLQMGNLKKPLLHNGIRITMCSV

SEQ ID NO: 3002946 - protein, 22 aa, Entamoeba invadens
KGKVLLYYFETLSLKIEKFGNN

SEQ ID NO: 3002947 - protein, 28 aa, Entamoeba invadens
KGKYEKDIAEIIRFICSANVCLPNCIPK

SEQ ID NO: 3002948 - protein, 20 aa, Entamoeba invadens
KGKYKDLLRVTSKKTMEMFD

SEQ ID NO: 3002949 - protein, 26 aa, Entamoeba invadens
KGLESLEIIPFIRFIDLSSTEVKDEV

SEQ ID NO: 3002950 - protein, 19 aa, Entamoeba invadens
KGLFHRFSKPKIGVGSVAP

SEQ ID NO: 3002951 - protein, 20 aa, Entamoeba invadens
KGLFSKYLQIISSSVQHRCA

SEQ ID NO: 3002952 - protein, 21 aa, Entamoeba invadens
KGLLKKKKQLKKRFWRETYGG

SEQ ID NO: 3002953 - protein, 18 aa, Entamoeba invadens
KGLLTPPGAMDLLGLKGK

SEQ ID NO: 3002954 - protein, 28 aa, Entamoeba invadens
KGLMTIFMLTMELLFPNLQTNRLAEPSV

SEQ ID NO: 3002955 - protein, 23 aa, Entamoeba invadens
KGLNVMDYLIKPVQHITKYPLFL

SEQ ID NO: 3002956 - protein, 20 aa, Entamoeba invadens
KGLVTYFDVMKECKIDENGA

SEQ ID NO: 3002957 - protein, 35 aa, Entamoeba invadens
KGLVWVLKYYYQGCKGWGWFFPHNYAPFITDMAKY

SEQ ID NO: 3002958 - protein, 25 aa, Entamoeba invadens
KGMVKPSLYFVLENSFANINQSALF

SEQ ID NO: 3002959 - protein, 27 aa, Entamoeba invadens
KGMWAKGFFMFQWADNSLPIASIDKTK

SEQ ID NO: 3002960 - protein, 27 aa, Entamoeba invadens
KGNEMNGLPLMWYDSLVLEKITMKKCR

SEQ ID NO: 3002961 - protein, 24 aa, Entamoeba invadens
KGNGSCVVLLIGGLMHNLFNHNCF

SEQ ID NO: 3002962 - protein, 30 aa, Entamoeba invadens
KGNHYFLDVDLPITPFYLKNREEMNKWAID

SEQ ID NO: 3002963 - protein, 22 aa, Entamoeba invadens
KGNLLELFQTSVFTKPLIVRVN

SEQ ID NO: 3002964 - protein, 37 aa, Entamoeba invadens
KGNMLKFHFNPIPLTPEILPLFPNIETLNVWSLPAEF

SEQ ID NO: 3002965 - protein, 30 aa, Entamoeba invadens
KGNMLKFHFNPIPLTPEILPLFPNVETLNV

SEQ ID NO: 3002966 - protein, 25 aa, Entamoeba invadens
KGNSHLILAYVLRPSNKSLLIEKSK

SEQ ID NO: 3002967 - protein, 23 aa, Entamoeba invadens
KGNTSHMLGWLKEHLEAEGLKVE

SEQ ID NO: 3002968 - protein, 20 aa, Entamoeba invadens
KGNVSAFKNKFAQYAEESEQ

SEQ ID NO: 3002969 - protein, 17 aa, Entamoeba invadens
KGNVSGLTEYMSRLLRA

SEQ ID NO: 3002970 - protein, 25 aa, Entamoeba invadens
KGPDLNMEIPFFKTTPQGKFNVKKD

SEQ ID NO: 3002971 - protein, 28 aa, Entamoeba invadens
KGPRGYIRPQLTMEEFAALGIKDEEEIN

SEQ ID NO: 3002972 - protein, 22 aa, Entamoeba invadens
KGQLLKLTRSGCYYRLLGGVRG

SEQ ID NO: 3002973 - protein, 17 aa, Entamoeba invadens
KGQLLKVYHGKVLLELR

SEQ ID NO: 3002974 - protein, 29 aa, Entamoeba invadens
KGQSFMIYQIRKMVGFALMLTNMRYSKEM

SEQ ID NO: 3002975 - protein, 26 aa, Entamoeba invadens
KGQTDPLYALSFLLDSRSLQVSIQTL

SEQ ID NO: 3002976 - protein, 24 aa, Entamoeba invadens
KGRAVEFTVAVYPLCTLEKTIDIT

SEQ ID NO: 3002977 - protein, 31 aa, Entamoeba invadens
KGRCISLLCYDRLLWVIPLGSNRSSYRVDLE

SEQ ID NO: 3002978 - protein, 28 aa, Entamoeba invadens
KGREATLIHIFQFSKVFLTCPGVLENNS

SEQ ID NO: 3002979 - protein, 21 aa, Entamoeba invadens
KGRFPALTWFNKTNGSALVRC

SEQ ID NO: 3002980 - protein, 27 aa, Entamoeba invadens
KGRPDVFVPLLKTYVIKCSKYGFKFAS

SEQ ID NO: 3002981 - protein, 17 aa, Entamoeba invadens
KGRPQILNFFRGFESTK

SEQ ID NO: 3002982 - protein, 17 aa, Entamoeba invadens
KGRTTVVIAHRLSTIQN

SEQ ID NO: 3002983 - protein, 21 aa, Entamoeba invadens
KGRTVILDQPYGPARITKDGV

SEQ ID NO: 3002984 - protein, 26 aa, Entamoeba invadens
KGSAYFALLCAPLYASLSEKSDFSLF

SEQ ID NO: 3002985 - protein, 25 aa, Entamoeba invadens
KGSKHSVLIYTLKLLKSITDLSIDE

SEQ ID NO: 3002986 - protein, 37 aa, Entamoeba invadens
KGSLIQSGCICGKYFCVGTVFGALRTSYPPTSKSVFK

SEQ ID NO: 3002987 - protein, 18 aa, Entamoeba invadens
KGSMFRTPLLEFSGACEG

SEQ ID NO: 3002988 - protein, 26 aa, Entamoeba invadens
KGSQEPLLFDIPTQSGKVRLEVSSDK

SEQ ID NO: 3002989 - protein, 26 aa, Entamoeba invadens
KGSSFSPYFASFYQIEKRRGSKFFVG

SEQ ID NO: 3002990 - protein, 22 aa, Entamoeba invadens
KGSVALPFLRIGRLQFSENDCL

SEQ ID NO: 3002991 - protein, 23 aa, Entamoeba invadens
KGTINLPYVYGRVTIHGNGDGLS

SEQ ID NO: 3002992 - protein, 29 aa, Entamoeba invadens
KGTKIPFRNTFPVFPIRNDVIVELYENKK

SEQ ID NO: 3002993 - protein, 24 aa, Entamoeba invadens
KGTKKLFTRGIPQNLKKIGIRAFS

SEQ ID NO: 3002994 - protein, 25 aa, Entamoeba invadens
KGTKKLFTRGIPQNLKKIGIRAFSD

SEQ ID NO: 3002995 - protein, 18 aa, Entamoeba invadens
KGTPLVQGLPASPGAACG

SEQ ID NO: 3002996 - protein, 21 aa, Entamoeba invadens
KGTQHVFLPPQLKSLKLEETC

SEQ ID NO: 3002997 - protein, 19 aa, Entamoeba invadens
KGVCKLLSYYYEKKTFVLI

SEQ ID NO: 3002998 - protein, 29 aa, Entamoeba invadens
KGVFNDPKHFFFVLKRKGVSDVKKYTRKS

SEQ ID NO: 3002999 - protein, 17 aa, Entamoeba invadens
KGVFYLLPEIIVEYFGS

SEQ ID NO: 3003000 - protein, 51 aa, Entamoeba invadens
KGVINNVIQCLNCIILNALPLEKKFFSEFLTFPNVFNLLKSYCETAKNESS

SEQ ID NO: 3003001 - protein, 17 aa, Entamoeba invadens
KGVLCFCSSKYGCEKMG

SEQ ID NO: 3003002 - protein, 24 aa, Entamoeba invadens
KGVSGYMLFVQWKCGEKSGKTERC

SEQ ID NO: 3003003 - protein, 27 aa, Entamoeba invadens
KGVVSYLKLPLQPLLSLLIDTESVITV

SEQ ID NO: 3003004 - protein, 19 aa, Entamoeba invadens
KGWIIIDTLCCNESAATGL

SEQ ID NO: 3003005 - protein, 20 aa, Entamoeba invadens
KGWNKKWFQNSYATPTVLDC

SEQ ID NO: 3003006 - protein, 17 aa, Entamoeba invadens
KGYDEKLMKFTLVHLTD

SEQ ID NO: 3003007 - protein, 17 aa, Entamoeba invadens
KGYDPMLDRVIVSLLRG

SEQ ID NO: 3003008 - protein, 25 aa, Entamoeba invadens
KGYESFPWFIKRAHSPSRGLYSVHI

SEQ ID NO: 3003009 - protein, 25 aa, Entamoeba invadens
KGYGRLSIVLSKRKDYEKALKAIDT

SEQ ID NO: 3003010 - protein, 25 aa, Entamoeba invadens
KGYGTYWCGFMKGLLTPPGAMDLLG

SEQ ID NO: 3003011 - protein, 24 aa, Entamoeba invadens
KGYNFPSFEIGFTKFIQLSGLIER

SEQ ID NO: 3003012 - protein, 23 aa, Entamoeba invadens
KGYNSWVYGIEKGFWIHAQHNKS

SEQ ID NO: 3003013 - protein, 25 aa, Entamoeba invadens
KGYSLYIRPCFISTYPHVGVSAPEN

SEQ ID NO: 3003014 - protein, 26 aa, Entamoeba invadens
KGYSSPCLWILTKDNILFFKNEQSVK

SEQ ID NO: 3003015 - protein, 19 aa, Entamoeba invadens
KGYYLGLRIENDKASILLS

SEQ ID NO: 3003016 - protein, 20 aa, Entamoeba invadens
KHCLKFGKAFARFQQCLTKE

SEQ ID NO: 3003017 - protein, 19 aa, Entamoeba invadens
KHDAVEEAKKAWLASKESK

SEQ ID NO: 3003018 - protein, 23 aa, Entamoeba invadens
KHDIYFVDMPFLNETWNTLYQKD

SEQ ID NO: 3003019 - protein, 18 aa, Entamoeba invadens
KHDLHLVEIVKFLKNVFG

SEQ ID NO: 3003020 - protein, 17 aa, Entamoeba invadens
KHDMNCSVKLRPKKMRG

SEQ ID NO: 3003021 - protein, 27 aa, Entamoeba invadens
KHEFYFHSIFLFHHIPEFVNTIIESQD

SEQ ID NO: 3003022 - protein, 25 aa, Entamoeba invadens
KHEHVYLLTTLKTLLVEPKLARNLY

SEQ ID NO: 3003023 - protein, 39 aa, Entamoeba invadens
KHEPRMFEVDLKENAFLLGRFHGFKFFEAGEGDLKVWRK

SEQ ID NO: 3003024 - protein, 22 aa, Entamoeba invadens
KHFISLGLINALDWMFSLNEED

SEQ ID NO: 3003025 - protein, 25 aa, Entamoeba invadens
KHFKTSQFIVVSLKSGMFDNANVLF

SEQ ID NO: 3003026 - protein, 30 aa, Entamoeba invadens
KHFLVTELIPFFDKPFVIGKPLIVGQIAEE

SEQ ID NO: 3003027 - protein, 17 aa, Entamoeba invadens
KHFQIPFGVTRLCTQSF

SEQ ID NO: 3003028 - protein, 19 aa, Entamoeba invadens
KHGFLISHNLKRERGAKKE

SEQ ID NO: 3003029 - protein, 18 aa, Entamoeba invadens
KHGIIYRDLKPENVLLTC

SEQ ID NO: 3003030 - protein, 17 aa, Entamoeba invadens
KHGLFEVIKGKLYQIRG

SEQ ID NO: 3003031 - protein, 22 aa, Entamoeba invadens
KHGLKVLFHEKPFKGVNGSGKH

SEQ ID NO: 3003032 - protein, 17 aa, Entamoeba invadens
KHGMEVFGAKRPVSWIL

SEQ ID NO: 3003033 - protein, 17 aa, Entamoeba invadens
KHGMEVFGAKRPVSWIM

SEQ ID NO: 3003034 - protein, 26 aa, Entamoeba invadens
KHHNFPQIYLFFPQMQTFYVETTLQY

SEQ ID NO: 3003035 - protein, 23 aa, Entamoeba invadens
KHIRGLKCLGIESSIEYFDICRI

SEQ ID NO: 3003036 - protein, 26 aa, Entamoeba invadens
KHISTPLQTLPLDFHDFSLDDAITFL

SEQ ID NO: 3003037 - protein, 38 aa, Entamoeba invadens
KHKKIVLVLNKCDLVPTWATARWIQVLSKEFPTIAFHA

SEQ ID NO: 3003038 - protein, 17 aa, Entamoeba invadens
KHKKSSVIKVKVLVSGF

SEQ ID NO: 3003039 - protein, 23 aa, Entamoeba invadens
KHKLVELWGTKKVDPIPSFDYLP

SEQ ID NO: 3003040 - protein, 17 aa, Entamoeba invadens
KHKLWPTIAQIVPNIIL

SEQ ID NO: 3003041 - protein, 34 aa, Entamoeba invadens
KHKYYDMFAQPFKKYYPFVAGYIALYSNDMAEFF

SEQ ID NO: 3003042 - protein, 27 aa, Entamoeba invadens
KHLCFANLVLLEKFVLPTTLTKIRNFM

SEQ ID NO: 3003043 - protein, 25 aa, Entamoeba invadens
KHLFDKILFVKDSEFLRCYCAELVK

SEQ ID NO: 3003044 - protein, 17 aa, Entamoeba invadens
KHLHRGFYKTELFESFL

SEQ ID NO: 3003045 - protein, 24 aa, Entamoeba invadens
KHLIPTLDTFPEHDLREVINSFSE

SEQ ID NO: 3003046 - protein, 29 aa, Entamoeba invadens
KHLKCEIKWFNILPTNKVKTLFIIGHITQ

SEQ ID NO: 3003047 - protein, 31 aa, Entamoeba invadens
KHLKFVKCAPMWFQFMTNLKIEVALIPNGIE

SEQ ID NO: 3003048 - protein, 25 aa, Entamoeba invadens
KHLKLFSVCRFSFSTTFDNCEILEV

SEQ ID NO: 3003049 - protein, 18 aa, Entamoeba invadens
KHLLPMLRIYYELYELNL

SEQ ID NO: 3003050 - protein, 21 aa, Entamoeba invadens
KHNDKLPFELKTPQWSVEIDW

SEQ ID NO: 3003051 - protein, 21 aa, Entamoeba invadens
KHNIKMVYAVNRGVFSMIFND

SEQ ID NO: 3003052 - protein, 22 aa, Entamoeba invadens
KHNIKMVYAVNRGVFSMIFNDF

SEQ ID NO: 3003053 - protein, 27 aa, Entamoeba invadens
KHNQNTLWYFCEFLHQIILKKDINKMD

SEQ ID NO: 3003054 - protein, 22 aa, Entamoeba invadens
KHNVFILYPSLKTEILKPVFKN

SEQ ID NO: 3003055 - protein, 25 aa, Entamoeba invadens
KHPDPFACKVLYQSKTITSKPPLVT

SEQ ID NO: 3003056 - protein, 29 aa, Entamoeba invadens
KHPFFKNMDFDLVLAKKIKPPFIPNVTSK

SEQ ID NO: 3003057 - protein, 17 aa, Entamoeba invadens
KHPFILMCKTHKYGLEG

SEQ ID NO: 3003058 - protein, 26 aa, Entamoeba invadens
KHPHGPSLLFQSPLSFMEVTLVFETP

SEQ ID NO: 3003059 - protein, 24 aa, Entamoeba invadens
KHPNLITMYGLFKSDDSIFMVLDL

SEQ ID NO: 3003060 - protein, 19 aa, Entamoeba invadens
KHQILKMHHFGISRDFVTE

SEQ ID NO: 3003061 - protein, 17 aa, Entamoeba invadens
KHQIQKMLLDIICGILL

SEQ ID NO: 3003062 - protein, 29 aa, Entamoeba invadens
KHQKLEDFVLGWINEKVAPYGLRVNKLGE

SEQ ID NO: 3003063 - protein, 29 aa, Entamoeba invadens
KHQSSHGDLYIYFTVKMPRLQEISMHIDK

SEQ ID NO: 3003064 - protein, 31 aa, Entamoeba invadens
KHRNVLVKAKKLLLKFQKVLEQEKSCKEKGV

SEQ ID NO: 3003065 - protein, 17 aa, Entamoeba invadens
KHSGEVLSIIFLSETLA

SEQ ID NO: 3003066 - protein, 25 aa, Entamoeba invadens
KHSMHKFQEKNMLNARIAEIQTQPD

SEQ ID NO: 3003067 - protein, 27 aa, Entamoeba invadens
KHSSVLVHNAFGEIPLFCALRSQNSDF

SEQ ID NO: 3003068 - protein, 23 aa, Entamoeba invadens
KHTCNCFCHALGLFKIKLTRPDT

SEQ ID NO: 3003069 - protein, 20 aa, Entamoeba invadens
KHTISSFKALLLYHHLSKNG

SEQ ID NO: 3003070 - protein, 20 aa, Entamoeba invadens
KHTLNKSVLLYTLFNAIHNS

SEQ ID NO: 3003071 - protein, 22 aa, Entamoeba invadens
KHTPRTGWVYCKVPNPESISDH

SEQ ID NO: 3003072 - protein, 24 aa, Entamoeba invadens
KHTTPPKPAGVAPPLEKGKKEKSR

SEQ ID NO: 3003073 - protein, 19 aa, Entamoeba invadens
KHTWVRIPSVISPPVNCLE

SEQ ID NO: 3003074 - protein, 19 aa, Entamoeba invadens
KHVGFEFQFDYIQLDFQRF

SEQ ID NO: 3003075 - protein, 24 aa, Entamoeba invadens
KHVIPMIIKVFPKQTCVGLSLNEL

SEQ ID NO: 3003076 - protein, 20 aa, Entamoeba invadens
KHVKMKLFYGVHCPAHRCNL

SEQ ID NO: 3003077 - protein, 20 aa, Entamoeba invadens
KHVQQMLIKLGYNCGPKGAD

SEQ ID NO: 3003078 - protein, 22 aa, Entamoeba invadens
KHVYHDFYMMVKGNQFKNKKAL

SEQ ID NO: 3003079 - protein, 23 aa, Entamoeba invadens
KHVYHDFYMMVKGNQFKNKKALA

SEQ ID NO: 3003080 - protein, 30 aa, Entamoeba invadens
KHWATVISQLPRIGLLRLFVDQKTKDWIDG

SEQ ID NO: 3003081 - protein, 19 aa, Entamoeba invadens
KHWSMLGEVAAYDRPADSL

SEQ ID NO: 3003082 - protein, 20 aa, Entamoeba invadens
KHYLRLVKVITPDSVRPLDV

SEQ ID NO: 3003083 - protein, 27 aa, Entamoeba invadens
KHYTPEVISLWYRAPEILFKMPSYTSA

SEQ ID NO: 3003084 - protein, 18 aa, Entamoeba invadens
KIACYFKAEKKGKLIASA

SEQ ID NO: 3003085 - protein, 25 aa, Entamoeba invadens
KIAEMPIDTLFPQKLATQLNEEPTE

SEQ ID NO: 3003086 - protein, 28 aa, Entamoeba invadens
KIAENHHLLIDLLRLNGYVFNTSFSSGK

SEQ ID NO: 3003087 - protein, 26 aa, Entamoeba invadens
KIAFFQNTCECKVPFWVSRLLEKDGV

SEQ ID NO: 3003088 - protein, 23 aa, Entamoeba invadens
KIANLWSQWFDIPEGAISKDTNF

SEQ ID NO: 3003089 - protein, 18 aa, Entamoeba invadens
KIARRRVVGQLNKCIKIF

SEQ ID NO: 3003090 - protein, 25 aa, Entamoeba invadens
KIASLILAIAFDCHVAIPVDTHVFT

SEQ ID NO: 3003091 - protein, 23 aa, Entamoeba invadens
KICKMVNDMLLYDLSIDCNEAIE

SEQ ID NO: 3003092 - protein, 26 aa, Entamoeba invadens
KICNLPKLKIQILKICYCSSLKSLKL

SEQ ID NO: 3003093 - protein, 18 aa, Entamoeba invadens
KICSLFILSMNNYSRNSS

SEQ ID NO: 3003094 - protein, 23 aa, Entamoeba invadens
KICSSCIAGYYLDETTRTCKKGN

SEQ ID NO: 3003095 - protein, 26 aa, Entamoeba invadens
KICVYSHFAMVNPFLTMDMSYNVPVN

SEQ ID NO: 3003096 - protein, 26 aa, Entamoeba invadens
KIDDFSPLCSLPKLTYLNLANNIIKS

SEQ ID NO: 3003097 - protein, 20 aa, Entamoeba invadens
KIDDITAFVLQWLRKNEVIL

SEQ ID NO: 3003098 - protein, 26 aa, Entamoeba invadens
KIDDKTFVFSLKRNGIFNTKIFNVKQ

SEQ ID NO: 3003099 - protein, 17 aa, Entamoeba invadens
KIDDYTLFGCKKLEIYP

SEQ ID NO: 3003100 - protein, 28 aa, Entamoeba invadens
KIDEIIIDFYRIVVWFNVDYTTVDMNSN

SEQ ID NO: 3003101 - protein, 18 aa, Entamoeba invadens
KIDELPVNQLPTDSSSTQ

SEQ ID NO: 3003102 - protein, 24 aa, Entamoeba invadens
KIDFFQINVWFAVDYTFMQNNKNT

SEQ ID NO: 3003103 - protein, 18 aa, Entamoeba invadens
KIDFSRFAILSAKLFIML

SEQ ID NO: 3003104 - protein, 29 aa, Entamoeba invadens
KIDFSVCFRWIVLLFKREFRREECLELWD

SEQ ID NO: 3003105 - protein, 22 aa, Entamoeba invadens
KIDFTIYKLLKNKYKFEGDVVL

SEQ ID NO: 3003106 - protein, 22 aa, Entamoeba invadens
KIDFYRINVWFNVDYTFTQTHR

SEQ ID NO: 3003107 - protein, 23 aa, Entamoeba invadens
KIDIFGKKKSLFQTTVVPMGKVV

SEQ ID NO: 3003108 - protein, 26 aa, Entamoeba invadens
KIDIGSTLRFVLPYGSFPFDVTVDTN

SEQ ID NO: 3003109 - protein, 21 aa, Entamoeba invadens
KIDIYCFGLTCFEICAERPLT

SEQ ID NO: 3003110 - protein, 19 aa, Entamoeba invadens
KIDLYMCDHIVVIGNIPER

SEQ ID NO: 3003111 - protein, 21 aa, Entamoeba invadens
KIDQFCTFGFLIKSLEEVDAF

SEQ ID NO: 3003112 - protein, 19 aa, Entamoeba invadens
KIDQYFGRVVAIDASILVY

SEQ ID NO: 3003113 - protein, 25 aa, Entamoeba invadens
KIDRDHYICIICFKRMSRGYACYHC

SEQ ID NO: 3003114 - protein, 26 aa, Entamoeba invadens
KIECPKSAFLRMLKAAFYEAPDSHLV

SEQ ID NO: 3003115 - protein, 33 aa, Entamoeba invadens
KIEDEPFDFLNKLLLFVKKVKPEYLTKIKLIPN

SEQ ID NO: 3003116 - protein, 19 aa, Entamoeba invadens
KIEDIFTTLIRDAAPNMEK

SEQ ID NO: 3003117 - protein, 23 aa, Entamoeba invadens
KIEDLVFVLPHQLEVVRNKNVVV

SEQ ID NO: 3003118 - protein, 18 aa, Entamoeba invadens
KIEDMEIKMTALNATQNN

SEQ ID NO: 3003119 - protein, 20 aa, Entamoeba invadens
KIEELCAKVDELSDVITRRG

SEQ ID NO: 3003120 - protein, 21 aa, Entamoeba invadens
KIEGEYFTFTFSDTKRLSCIL

SEQ ID NO: 3003121 - protein, 27 aa, Entamoeba invadens
KIEGFEGMVALLKTQLEKSKVDTQELT

SEQ ID NO: 3003122 - protein, 24 aa, Entamoeba invadens
KIEIIKIRSLLKKARKEKKGVIKT

SEQ ID NO: 3003123 - protein, 25 aa, Entamoeba invadens
KIEILETFPAYYYRAVYYGKNDCNI

SEQ ID NO: 3003124 - protein, 20 aa, Entamoeba invadens
KIEIPTTITSLGLCCFLKCS

SEQ ID NO: 3003125 - protein, 21 aa, Entamoeba invadens
KIEIWRMPILSQSTSLQPELQ

SEQ ID NO: 3003126 - protein, 23 aa, Entamoeba invadens
KIEKIGDLILVQLMEIKFLEIQS

SEQ ID NO: 3003127 - protein, 24 aa, Entamoeba invadens
KIEKKFYEFLNCVGHVIGDGKNKI

SEQ ID NO: 3003128 - protein, 32 aa, Entamoeba invadens
KIEKKRERPGTYLYLLLDYYEAGNINDFVEEQ

SEQ ID NO: 3003129 - protein, 17 aa, Entamoeba invadens
KIELVLWDTAGQEKYNC

SEQ ID NO: 3003130 - protein, 19 aa, Entamoeba invadens
KIEMEKMRQKVSFLEIIPI

SEQ ID NO: 3003131 - protein, 27 aa, Entamoeba invadens
KIENDNFEMILMKLVQYKQKASTAKTN

SEQ ID NO: 3003132 - protein, 26 aa, Entamoeba invadens
KIENKFHALYDILKLLKDLNDSFQSI

SEQ ID NO: 3003133 - protein, 23 aa, Entamoeba invadens
KIENYEPQINALEAQKKMALDNK

SEQ ID NO: 3003134 - protein, 23 aa, Entamoeba invadens
KIENYESHIKALEAQKKMALDDK

SEQ ID NO: 3003135 - protein, 23 aa, Entamoeba invadens
KIENYESHIKALEVQKKMALDDK

SEQ ID NO: 3003136 - protein, 18 aa, Entamoeba invadens
KIERERLEKFATTPEDVL

SEQ ID NO: 3003137 - protein, 21 aa, Entamoeba invadens
KIERYYFEELYRIVFSQTKRF

SEQ ID NO: 3003138 - protein, 25 aa, Entamoeba invadens
KIESDAKAEMLERALKDRDALKAQI

SEQ ID NO: 3003139 - protein, 17 aa, Entamoeba invadens
KIESSSSGVILLQNELK

SEQ ID NO: 3003140 - protein, 17 aa, Entamoeba invadens
KIESVVYTLLFLENAIN

SEQ ID NO: 3003141 - protein, 28 aa, Entamoeba invadens
KIEVENFFIAFVWVLKNINRNVLSYYFS

SEQ ID NO: 3003142 - protein, 25 aa, Entamoeba invadens
KIEYLWRFNTWPKEKYSTVIITLEE

SEQ ID NO: 3003143 - protein, 23 aa, Entamoeba invadens
KIFDVMLLKMYTGDTPKFIQELC

SEQ ID NO: 3003144 - protein, 21 aa, Entamoeba invadens
KIFEQSIFYNCHKLTKISFTE

SEQ ID NO: 3003145 - protein, 17 aa, Entamoeba invadens
KIFEYQFAGCKNLKTVK

SEQ ID NO: 3003146 - protein, 32 aa, Entamoeba invadens
KIFFNAKEVFRILLTLVFFYCKKMTVFCLNTL

SEQ ID NO: 3003147 - protein, 24 aa, Entamoeba invadens
KIFHSRCFNLWKKQQQLEQKHKQE

SEQ ID NO: 3003148 - protein, 25 aa, Entamoeba invadens
KIFKERFYRIALHSGFYQKLSLLED

SEQ ID NO: 3003149 - protein, 26 aa, Entamoeba invadens
KIFKPKIIELFLKKSTLQKLKNIYDK

SEQ ID NO: 3003150 - protein, 18 aa, Entamoeba invadens
KIFQEILYSEVVGEKNRK

SEQ ID NO: 3003151 - protein, 19 aa, Entamoeba invadens
KIFRIYLCFMMSEAGNVES

SEQ ID NO: 3003152 - protein, 18 aa, Entamoeba invadens
KIFSKVGVLAEIEEIREN

SEQ ID NO: 3003153 - protein, 19 aa, Entamoeba invadens
KIFVEGEHPHLYFQFKSVF

SEQ ID NO: 3003154 - protein, 17 aa, Entamoeba invadens
KIFVKKTNLYPIIETFE

SEQ ID NO: 3003155 - protein, 18 aa, Entamoeba invadens
KIFVVSDRMMYKLGYVDR

SEQ ID NO: 3003156 - protein, 24 aa, Entamoeba invadens
KIGAHHVMTPLYSKAPYSKCSSCT

SEQ ID NO: 3003157 - protein, 20 aa, Entamoeba invadens
KIGAVLSFGPTPIDYLPSVC

SEQ ID NO: 3003158 - protein, 24 aa, Entamoeba invadens
KIGDNYFKLVHFTSFQISQNVTSL

SEQ ID NO: 3003159 - protein, 31 aa, Entamoeba invadens
KIGELDFLTGPLLYQQSWTKLIKDGFLAQVH

SEQ ID NO: 3003160 - protein, 30 aa, Entamoeba invadens
KIGFCSRNVISLLLIKDKVIEGLLQMSIQS

SEQ ID NO: 3003161 - protein, 24 aa, Entamoeba invadens
KIGFNTISKFWVSLRRYQELQIFD

SEQ ID NO: 3003162 - protein, 20 aa, Entamoeba invadens
KIGFYLPNPRKEPVIKLKIG

SEQ ID NO: 3003163 - protein, 29 aa, Entamoeba invadens
KIGGIDLQFHPILPWIYSVGADGTMQMFT

SEQ ID NO: 3003164 - protein, 24 aa, Entamoeba invadens
KIGKHSIWYGFDNTFIVPSTVVEI

SEQ ID NO: 3003165 - protein, 38 aa, Entamoeba invadens
KIGKLENYQYSLEKLMSLITFSGAIFQSVKKPFAIIGE

SEQ ID NO: 3003166 - protein, 29 aa, Entamoeba invadens
KIGKQTPKFKLIGNLFYFVAEHLTEDDKE

SEQ ID NO: 3003167 - protein, 33 aa, Entamoeba invadens
KIGKTCFRYCIFLHDIKLPIGLKEIPKKCFCNC

SEQ ID NO: 3003168 - protein, 18 aa, Entamoeba invadens
KIGLCNVFLMHTSASLSI

SEQ ID NO: 3003169 - protein, 24 aa, Entamoeba invadens
KIGQYFFYEFTSLTSIDIPSNVTH

SEQ ID NO: 3003170 - protein, 26 aa, Entamoeba invadens
KIGVHNIWYGLLPKKYEVPSTVVAIG

SEQ ID NO: 3003171 - protein, 17 aa, Entamoeba invadens
KIHALFDKYSPVSYDNP

SEQ ID NO: 3003172 - protein, 25 aa, Entamoeba invadens
KIHGSNFSLYYTGKSWRVAKRNSLL

SEQ ID NO: 3003173 - protein, 21 aa, Entamoeba invadens
KIHQVTKLYFTFKNFQAEDLL

SEQ ID NO: 3003174 - protein, 23 aa, Entamoeba invadens
KIHSPIVYIITNIAPPPVGQKEA

SEQ ID NO: 3003175 - protein, 30 aa, Entamoeba invadens
KIIASLSTTFNYFELLQLFGDNGYTLFDSP

SEQ ID NO: 3003176 - protein, 18 aa, Entamoeba invadens
KIIDFKKVQFDAKSGNIY

SEQ ID NO: 3003177 - protein, 23 aa, Entamoeba invadens
KIIDRKAFCFKTQQGVFVTPTVI

SEQ ID NO: 3003178 - protein, 23 aa, Entamoeba invadens
KIIEGLVKYTLLFDLTGVTNNLK

SEQ ID NO: 3003179 - protein, 29 aa, Entamoeba invadens
KIIELLRTIRSYIDFLYIIDANVFERGLH

SEQ ID NO: 3003180 - protein, 31 aa, Entamoeba invadens
KIIELRREISFFILMKLFAILFEEKIEFQNI

SEQ ID NO: 3003181 - protein, 17 aa, Entamoeba invadens
KIIFQGSAGLQALKTVP

SEQ ID NO: 3003182 - protein, 23 aa, Entamoeba invadens
KIIGEQKIIFLVVTDRGSIFGFY

SEQ ID NO: 3003183 - protein, 24 aa, Entamoeba invadens
KIIGFINPALFDYFKRCGVDYSFC

SEQ ID NO: 3003184 - protein, 17 aa, Entamoeba invadens
KIIIDMYMRNGNKWTLM

SEQ ID NO: 3003185 - protein, 17 aa, Entamoeba invadens
KIIIMSATLAVELFEKY

SEQ ID NO: 3003186 - protein, 17 aa, Entamoeba invadens
KIILMAFGEIVEFLVET

SEQ ID NO: 3003187 - protein, 18 aa, Entamoeba invadens
KIIMYLEKFMVLALENHE

SEQ ID NO: 3003188 - protein, 20 aa, Entamoeba invadens
KIISTQLFKLIPLLAHKYQD

SEQ ID NO: 3003189 - protein, 19 aa, Entamoeba invadens
KIITPKFSLVDSLIQNYDS

SEQ ID NO: 3003190 - protein, 27 aa, Entamoeba invadens
KIKCYCFLNCELLVSVSLPDCVTLFGD

SEQ ID NO: 3003191 - protein, 25 aa, Entamoeba invadens
KIKDRIPENWPSALKSRIIKERSLM

SEQ ID NO: 3003192 - protein, 26 aa, Entamoeba invadens
KIKEEKEMLLKDLSNGSDLSSKLNEK

SEQ ID NO: 3003193 - protein, 20 aa, Entamoeba invadens
KIKFGFSVNILLLSKTFSLG

SEQ ID NO: 3003194 - protein, 17 aa, Entamoeba invadens
KIKFKFPWKIAEFVISG

SEQ ID NO: 3003195 - protein, 19 aa, Entamoeba invadens
KIKFTQFIWAIIEQVNKEV

SEQ ID NO: 3003196 - protein, 31 aa, Entamoeba invadens
KIKHGFKYYKEFYQILVWYEVDYFTVNNNCN

SEQ ID NO: 3003197 - protein, 24 aa, Entamoeba invadens
KIKMFREMIHRLKVAHPDIEELKL

SEQ ID NO: 3003198 - protein, 21 aa, Entamoeba invadens
KIKNFSFPFLSERVAEMKKQR

SEQ ID NO: 3003199 - protein, 17 aa, Entamoeba invadens
KIKNYESQIKAFEAQKK

SEQ ID NO: 3003200 - protein, 29 aa, Entamoeba invadens
KIKPEFAKYFTFLDTFNFYEEFNGSMYFT

SEQ ID NO: 3003201 - protein, 26 aa, Entamoeba invadens
KIKQDYIFQIWCEAVYYLVHSHQQSI

SEQ ID NO: 3003202 - protein, 23 aa, Entamoeba invadens
KIKQFGFYVDGIRAAVMSGAASV

SEQ ID NO: 3003203 - protein, 32 aa, Entamoeba invadens
KIKRGKLLNFERFLMCILKSLNFQCVRAVYEA

SEQ ID NO: 3003204 - protein, 21 aa, Entamoeba invadens
KIKRGLPLTKKKDGKTLYYVM

SEQ ID NO: 3003205 - protein, 24 aa, Entamoeba invadens
KIKSHMWWNGFNWDDLYQKKIQAS

SEQ ID NO: 3003206 - protein, 17 aa, Entamoeba invadens
KIKSMIQQWGNKFPNEL

SEQ ID NO: 3003207 - protein, 26 aa, Entamoeba invadens
KIKSQTSPIILFFEKTQNVFGLFLPK

SEQ ID NO: 3003208 - protein, 17 aa, Entamoeba invadens
KIKSVIGKVLFDFGFDL

SEQ ID NO: 3003209 - protein, 18 aa, Entamoeba invadens
KIKTDPGVPHLCALKEQL

SEQ ID NO: 3003210 - protein, 26 aa, Entamoeba invadens
KIKTTKLCVLILKSLKMLHPELECFS

SEQ ID NO: 3003211 - protein, 25 aa, Entamoeba invadens
KIKTTKLCVLILLSLQDLYNDKEYF

SEQ ID NO: 3003212 - protein, 18 aa, Entamoeba invadens
KIKTVFKVMLLGIKDFEK

SEQ ID NO: 3003213 - protein, 23 aa, Entamoeba invadens
KIKVKHLGEGKYFISYTLPSVKG

SEQ ID NO: 3003214 - protein, 30 aa, Entamoeba invadens
KIKVVLKKEFFRTIVWFNVDFETVDRNKNR

SEQ ID NO: 3003215 - protein, 20 aa, Entamoeba invadens
KILCFDFIKNRNLFVRTCLL

SEQ ID NO: 3003216 - protein, 25 aa, Entamoeba invadens
KILDKAIIIRKISLALLGKFFEDIT

SEQ ID NO: 3003217 - protein, 18 aa, Entamoeba invadens
KILGEGSFGIVYKGKYRG

SEQ ID NO: 3003218 - protein, 17 aa, Entamoeba invadens
KILGRKKGPWLKEILRG

SEQ ID NO: 3003219 - protein, 25 aa, Entamoeba invadens
KILHKQNLLFLVEDDNRNIFGGVLY

SEQ ID NO: 3003220 - protein, 28 aa, Entamoeba invadens
KILKDKTAFTLLLFPNKIKINNQLDVKT

SEQ ID NO: 3003221 - protein, 17 aa, Entamoeba invadens
KILLPTSLVSLCSNCFI

SEQ ID NO: 3003222 - protein, 20 aa, Entamoeba invadens
KILMRFFKTGKGEYGEGDIF

SEQ ID NO: 3003223 - protein, 19 aa, Entamoeba invadens
KILPTLHTLTLEYPDYKIL

SEQ ID NO: 3003224 - protein, 30 aa, Entamoeba invadens
KILSAEPISLPVYLERVKKLALGCSTTVLI

SEQ ID NO: 3003225 - protein, 17 aa, Entamoeba invadens
KILSLDGGGLKVMLEVI

SEQ ID NO: 3003226 - protein, 17 aa, Entamoeba invadens
KILSLLYGKCFLNNSKD

SEQ ID NO: 3003227 - protein, 19 aa, Entamoeba invadens
KILTDLINSIQSGQLKPSV

SEQ ID NO: 3003228 - protein, 19 aa, Entamoeba invadens
KILTFSIPQSVTYLSSFCF

SEQ ID NO: 3003229 - protein, 18 aa, Entamoeba invadens
KILTRLSGDLNRAHLVGA

SEQ ID NO: 3003230 - protein, 34 aa, Entamoeba invadens
KIMEWTKGYIWRLTNKFNIGERITWFYEVKNNKR

SEQ ID NO: 3003231 - protein, 25 aa, Entamoeba invadens
KIMKDAFSFLPTFLETFKTLKNILA

SEQ ID NO: 3003232 - protein, 27 aa, Entamoeba invadens
KIMSYELKMKVLLDVLKAIQFLHKNNV

SEQ ID NO: 3003233 - protein, 24 aa, Entamoeba invadens
KINEFITQLFTYESELLLQKNDQS

SEQ ID NO: 3003234 - protein, 19 aa, Entamoeba invadens
KINFFFPSEKQSKTQTRTA

SEQ ID NO: 3003235 - protein, 23 aa, Entamoeba invadens
KINFYQIKVWCSVTYICVHIHKG

SEQ ID NO: 3003236 - protein, 25 aa, Entamoeba invadens
KINHFSVYICPNLLIQNYSEYNTKQ

SEQ ID NO: 3003237 - protein, 27 aa, Entamoeba invadens
KINHRKILDAIFILAGVPREKFPAIFS

SEQ ID NO: 3003238 - protein, 17 aa, Entamoeba invadens
KININTPYLPKPLVEHY

SEQ ID NO: 3003239 - protein, 26 aa, Entamoeba invadens
KINKERSLCVASKRFDNPKKETIQEV

SEQ ID NO: 3003240 - protein, 29 aa, Entamoeba invadens
KINKKELVFLLCSDAVFRSGHLDCWSSLV

SEQ ID NO: 3003241 - protein, 31 aa, Entamoeba invadens
KINKNKVDVLLDVLPLIIKTASEELSEAEKA

SEQ ID NO: 3003242 - protein, 31 aa, Entamoeba invadens
KINLEKYFSAHRKIILENIPVRKVVNKQGCV

SEQ ID NO: 3003243 - protein, 23 aa, Entamoeba invadens
KINMINTCAFYRCSNLECAKNMK

SEQ ID NO: 3003244 - protein, 28 aa, Entamoeba invadens
KINNINCYIYITYVYGVYSFGEQGKKLS

SEQ ID NO: 3003245 - protein, 23 aa, Entamoeba invadens
KINPNMFDFFNPVFQTPKVHKDL

SEQ ID NO: 3003246 - protein, 30 aa, Entamoeba invadens
KINSLTPIQTLPKLTYIPLADKQRPKRLED

SEQ ID NO: 3003247 - protein, 27 aa, Entamoeba invadens
KINSYGVKAYYKPNDKWDLNAEINKAN

SEQ ID NO: 3003248 - protein, 19 aa, Entamoeba invadens
KIPEGYYAKDKVCTACVAN

SEQ ID NO: 3003249 - protein, 24 aa, Entamoeba invadens
KIPESLFSMGKLIELFLNCNQIPE

SEQ ID NO: 3003250 - protein, 29 aa, Entamoeba invadens
KIPESLFSMGRLVGLFLNCNQIPELPEKF

SEQ ID NO: 3003251 - protein, 28 aa, Entamoeba invadens
KIPFEQLVNLFYLTIKYSSKTPNFFVPI

SEQ ID NO: 3003252 - protein, 18 aa, Entamoeba invadens
KIPFLGINCGNVGFLINS

SEQ ID NO: 3003253 - protein, 17 aa, Entamoeba invadens
KIPIGMYQYTPLQMTYS

SEQ ID NO: 3003254 - protein, 17 aa, Entamoeba invadens
KIPKLSLGFEKIKSSLT

SEQ ID NO: 3003255 - protein, 21 aa, Entamoeba invadens
KIPPCISNWKNKNGYTIALDK

SEQ ID NO: 3003256 - protein, 17 aa, Entamoeba invadens
KIPPFIKTLGESTFSFC

SEQ ID NO: 3003257 - protein, 23 aa, Entamoeba invadens
KIPPLWRHYNSSSNAIIFVLDSN

SEQ ID NO: 3003258 - protein, 30 aa, Entamoeba invadens
KIPYLQDLGVTIVWLNPIYASPDADNGYDI

SEQ ID NO: 3003259 - protein, 24 aa, Entamoeba invadens
KIQAFIDLLKKLFPNLQTLLLTPT

SEQ ID NO: 3003260 - protein, 21 aa, Entamoeba invadens
KIQEKLYLNFLFSQDKTDNLL

SEQ ID NO: 3003261 - protein, 17 aa, Entamoeba invadens
KIQFMKTELTYIGNCHI

SEQ ID NO: 3003262 - protein, 18 aa, Entamoeba invadens
KIQIWDIMSMTIIAEFKE

SEQ ID NO: 3003263 - protein, 32 aa, Entamoeba invadens
KIQNHTIERWVGMLGGYSVVRPKDADLIVVGG

SEQ ID NO: 3003264 - protein, 20 aa, Entamoeba invadens
KIQPIFTKMYQQNAAAGNMP

SEQ ID NO: 3003265 - protein, 21 aa, Entamoeba invadens
KIQPPFFNRIAPQSQSQLFLH

SEQ ID NO: 3003266 - protein, 23 aa, Entamoeba invadens
KIRAVVCNRLFPQQWSRITNFFP

SEQ ID NO: 3003267 - protein, 19 aa, Entamoeba invadens
KIREFFEKSLLFNNSLYYE

SEQ ID NO: 3003268 - protein, 20 aa, Entamoeba invadens
KIREIHIEDEVRKEKGAQIQ

SEQ ID NO: 3003269 - protein, 35 aa, Entamoeba invadens
KIREIPVGVFSLKLYPKLQMLDLSKNEIKIIENVE

SEQ ID NO: 3003270 - protein, 26 aa, Entamoeba invadens
KIRELKIPYTVWFSKSKRTLFEISDI

SEQ ID NO: 3003271 - protein, 27 aa, Entamoeba invadens
KIRERKLPLIEVLKMTINVAKGVQALN

SEQ ID NO: 3003272 - protein, 20 aa, Entamoeba invadens
KIRFFTPFIMEYVPQTIERI

SEQ ID NO: 3003273 - protein, 17 aa, Entamoeba invadens
KIRFVITQKLSEAFYRP

SEQ ID NO: 3003274 - protein, 17 aa, Entamoeba invadens
KIRHMTPKQYKQLKSYH

SEQ ID NO: 3003275 - protein, 26 aa, Entamoeba invadens
KIRKQQEELLEKLKIAKLAEEKAKAE

SEQ ID NO: 3003276 - protein, 17 aa, Entamoeba invadens
KIRLCGSESNWDLFKLW

SEQ ID NO: 3003277 - protein, 17 aa, Entamoeba invadens
KIRPELMKIQKKIDAVE

SEQ ID NO: 3003278 - protein, 23 aa, Entamoeba invadens
KIRPIFEEVNLSLFNGLVLAKKR

SEQ ID NO: 3003279 - protein, 23 aa, Entamoeba invadens
KIRPLWRHYYSGSNAIIFVLDSN

SEQ ID NO: 3003280 - protein, 43 aa, Entamoeba invadens
KIRQYICEPAMEYFKFPLFCLISQPVLSLLSTGKSTGFCVESG

SEQ ID NO: 3003281 - protein, 40 aa, Entamoeba invadens
KIRTTFFQMYFSTLYICGFDDMLKFIKIEQFVALTDSMNV

SEQ ID NO: 3003282 - protein, 34 aa, Entamoeba invadens
KIRTWKRRYFVIKNNFIFYFPSSQPDSTPKGMIE

SEQ ID NO: 3003283 - protein, 19 aa, Entamoeba invadens
KIRVVNIVGLGYSYCSKNG

SEQ ID NO: 3003284 - protein, 20 aa, Entamoeba invadens
KIRVVVPPSISLLNLSHNNL

SEQ ID NO: 3003285 - protein, 17 aa, Entamoeba invadens
KIRWDIGTTIPLSVSVN

SEQ ID NO: 3003286 - protein, 18 aa, Entamoeba invadens
KIRYPLTKCDWVALPDFE

SEQ ID NO: 3003287 - protein, 20 aa, Entamoeba invadens
KISANFRAISLLLRCGVPRK

SEQ ID NO: 3003288 - protein, 23 aa, Entamoeba invadens
KISDTFFYSIRSWTVKEGDLYLG

SEQ ID NO: 3003289 - protein, 20 aa, Entamoeba invadens
KISELMQKIVKLEKEKEGKV

SEQ ID NO: 3003290 - protein, 17 aa, Entamoeba invadens
KISFCRLTGLKLSDWNT

SEQ ID NO: 3003291 - protein, 27 aa, Entamoeba invadens
KISFDYYPFIGPFTETIFKSLPLKKDA

SEQ ID NO: 3003292 - protein, 18 aa, Entamoeba invadens
KISFMNWSAKLTNLRVRG

SEQ ID NO: 3003293 - protein, 21 aa, Entamoeba invadens
KISFVDFYNKFIDLAVLRVDP

SEQ ID NO: 3003294 - protein, 21 aa, Entamoeba invadens
KISHDISLLIPEIWSRMRRNE

SEQ ID NO: 3003295 - protein, 24 aa, Entamoeba invadens
KISHNKFFNIPYSGIYMIGDEYMV

SEQ ID NO: 3003296 - protein, 34 aa, Entamoeba invadens
KISKIEAFESQKFSFFLVDFCDLRSAQTSLFLTG

SEQ ID NO: 3003297 - protein, 34 aa, Entamoeba invadens
KISKRKYDKILAYIFLFMTFIPDSLKSPDELSSV

SEQ ID NO: 3003298 - protein, 22 aa, Entamoeba invadens
KISKRRIVFVTTQPLPSVLRRQ

SEQ ID NO: 3003299 - protein, 24 aa, Entamoeba invadens
KISLKPYHIVSPLVSTFSLSQMFS

SEQ ID NO: 3003300 - protein, 28 aa, Entamoeba invadens
KISSKRIIKFVLWNIVDYKTFLKENGQG

SEQ ID NO: 3003301 - protein, 21 aa, Entamoeba invadens
KISSMINKYESLEQKKIREIH

SEQ ID NO: 3003302 - protein, 31 aa, Entamoeba invadens
KISSVYFFRCPKLNSFTFPKSLKLLSLDSCN

SEQ ID NO: 3003303 - protein, 22 aa, Entamoeba invadens
KISTLVDFPIYDLDLTQYVKKY

SEQ ID NO: 3003304 - protein, 25 aa, Entamoeba invadens
KISTNPILLNLLFDDIQKTPVKGNI

SEQ ID NO: 3003305 - protein, 23 aa, Entamoeba invadens
KISTQCFFACKMMITLEVPEKLI

SEQ ID NO: 3003306 - protein, 26 aa, Entamoeba invadens
KITDKQHIPFIKKVFLYFSENNIGFN

SEQ ID NO: 3003307 - protein, 20 aa, Entamoeba invadens
KITFKLSQRTTFFATKAMLR

SEQ ID NO: 3003308 - protein, 33 aa, Entamoeba invadens
KITFSTYIDVTPDFWLVFGDTTIAFVGRRLCAN

SEQ ID NO: 3003309 - protein, 27 aa, Entamoeba invadens
KITGTGEQACRFLRTLRKGKKYVMREN

SEQ ID NO: 3003310 - protein, 20 aa, Entamoeba invadens
KITHLIFERFKELSNPAPDP

SEQ ID NO: 3003311 - protein, 22 aa, Entamoeba invadens
KITLLNEYVFNKANFSAFTIPD

SEQ ID NO: 3003312 - protein, 20 aa, Entamoeba invadens
KITNALYFETSAKSGENVKK

SEQ ID NO: 3003313 - protein, 22 aa, Entamoeba invadens
KITNYLFDWRDGMIVKSIGGED

SEQ ID NO: 3003314 - protein, 19 aa, Entamoeba invadens
KITPHEYYLYFNATTRPVS

SEQ ID NO: 3003315 - protein, 24 aa, Entamoeba invadens
KITPTGCFVFVSGKVLIYIKDIPS

SEQ ID NO: 3003316 - protein, 19 aa, Entamoeba invadens
KITSFPEKYNIVYKGGSGA

SEQ ID NO: 3003317 - protein, 17 aa, Entamoeba invadens
KITTFTRNIRRVRKEVI

SEQ ID NO: 3003318 - protein, 23 aa, Entamoeba invadens
KITTMYLLDRTYTIDPKSAVCET

SEQ ID NO: 3003319 - protein, 21 aa, Entamoeba invadens
KITTPPLFKIFKYMDDSERVT

SEQ ID NO: 3003320 - protein, 28 aa, Entamoeba invadens
KITVPIDKWPNLLPTILQWTQSPNDLQK

SEQ ID NO: 3003321 - protein, 22 aa, Entamoeba invadens
KITVRDFLSRGLSFVINETIEG

SEQ ID NO: 3003322 - protein, 30 aa, Entamoeba invadens
KIVATLQNILPEIIAQIRKVVISNLENGRN

SEQ ID NO: 3003323 - protein, 24 aa, Entamoeba invadens
KIVCAIIHSLFPTEFDYKKMTFAN

SEQ ID NO: 3003324 - protein, 20 aa, Entamoeba invadens
KIVDLDMFLSIFNTAFNING

SEQ ID NO: 3003325 - protein, 17 aa, Entamoeba invadens
KIVELNVFVREECFDVS

SEQ ID NO: 3003326 - protein, 17 aa, Entamoeba invadens
KIVEPYITYGYPSLKTV

SEQ ID NO: 3003327 - protein, 24 aa, Entamoeba invadens
KIVFGAALPGCKYISKLYSETDVN

SEQ ID NO: 3003328 - protein, 19 aa, Entamoeba invadens
KIVHVIIKNMFDLTTEKPQ

SEQ ID NO: 3003329 - protein, 17 aa, Entamoeba invadens
KIVLYISDTYTIPSLKF

SEQ ID NO: 3003330 - protein, 20 aa, Entamoeba invadens
KIVMNAFFIDEGKHYLMQID

SEQ ID NO: 3003331 - protein, 30 aa, Entamoeba invadens
KIVNTLSDLFLIFSLFKKINTLSFPTVIFS

SEQ ID NO: 3003332 - protein, 22 aa, Entamoeba invadens
KIVPSHITVSLLLNAMKNDTHK

SEQ ID NO: 3003333 - protein, 19 aa, Entamoeba invadens
KIVPYYLDYNMAVNKVLRK

SEQ ID NO: 3003334 - protein, 45 aa, Entamoeba invadens
KIVQEAVIWPMLRPDIFTGLRAPPKGILLFGPPGTGKTLIGKAVA

SEQ ID NO: 3003335 - protein, 17 aa, Entamoeba invadens
KIVRPRGASLFGNFDPT

SEQ ID NO: 3003336 - protein, 25 aa, Entamoeba invadens
KIVSYYVLNCQLPPAKLIQLNMAIT

SEQ ID NO: 3003337 - protein, 36 aa, Entamoeba invadens
KIVTDYYRLHGKLPQLFWWAFRRQIMINDKGELLFS

SEQ ID NO: 3003338 - protein, 27 aa, Entamoeba invadens
KIVTICKTLIFSAKTKGIRVSALRLLV

SEQ ID NO: 3003339 - protein, 17 aa, Entamoeba invadens
KIWEFYERFFRKVEKEM

SEQ ID NO: 3003340 - protein, 19 aa, Entamoeba invadens
KIYCNDDLLELLAGELCND

SEQ ID NO: 3003341 - protein, 17 aa, Entamoeba invadens
KIYFKVMFMNVKNYDKF

SEQ ID NO: 3003342 - protein, 24 aa, Entamoeba invadens
KIYKEEIPIFIKFYDKFDCDTYND

SEQ ID NO: 3003343 - protein, 18 aa, Entamoeba invadens
KIYNKKVATPIPELCAGL

SEQ ID NO: 3003344 - protein, 18 aa, Entamoeba invadens
KIYNLRYQLKKKVIHYKT

SEQ ID NO: 3003345 - protein, 27 aa, Entamoeba invadens
KKADGLEVILLRRFVSFLQQRAESFVI

SEQ ID NO: 3003346 - protein, 23 aa, Entamoeba invadens
KKAFYEIIVWFDVDYETVDRNSS

SEQ ID NO: 3003347 - protein, 36 aa, Entamoeba invadens
KKAGFKWRVQTEKPLFPIFICDAGLIIISKYPIVYN

SEQ ID NO: 3003348 - protein, 24 aa, Entamoeba invadens
KKAIEGTLVVKNTQIKNIEKEKKE

SEQ ID NO: 3003349 - protein, 21 aa, Entamoeba invadens
KKAIENIPRSTFFYFDANAGV

SEQ ID NO: 3003350 - protein, 29 aa, Entamoeba invadens
KKAKGFGYYFMMSRIIPKCFQLKGLKCAE

SEQ ID NO: 3003351 - protein, 17 aa, Entamoeba invadens
KKALLIRKMLQEKADEI

SEQ ID NO: 3003352 - protein, 25 aa, Entamoeba invadens
KKALPKKMVVKCKKIPTKMSEDDEK

SEQ ID NO: 3003353 - protein, 18 aa, Entamoeba invadens
KKAQKKLNKCKEACILKD

SEQ ID NO: 3003354 - protein, 23 aa, Entamoeba invadens
KKAYNFLKDLLLKMGFKITQNEA

SEQ ID NO: 3003355 - protein, 28 aa, Entamoeba invadens
KKCCHPNVLLFLGVSFLASKQVVLVTEL

SEQ ID NO: 3003356 - protein, 24 aa, Entamoeba invadens
KKCEAFLFNDRVIWFTVSKAYKVG

SEQ ID NO: 3003357 - protein, 28 aa, Entamoeba invadens
KKCEKFVILIGLLLFKVENYNTDFVFTF

SEQ ID NO: 3003358 - protein, 18 aa, Entamoeba invadens
KKCFFRCSKLPSVMFSRN

SEQ ID NO: 3003359 - protein, 20 aa, Entamoeba invadens
KKCFICGSTEHLARDCPKVT

SEQ ID NO: 3003360 - protein, 25 aa, Entamoeba invadens
KKCGEVVLFMKVNPFALSRQKANDP

SEQ ID NO: 3003361 - protein, 27 aa, Entamoeba invadens
KKCKKCKKCKFKIRNIYKHVYKKSMGL

SEQ ID NO: 3003362 - protein, 36 aa, Entamoeba invadens
KKCKTLIETLPYYLYTKPHPSPIFPKLLFADIRHNV

SEQ ID NO: 3003363 - protein, 19 aa, Entamoeba invadens
KKCLKCEDGFVLVNDECVS

SEQ ID NO: 3003364 - protein, 24 aa, Entamoeba invadens
KKCLRLKFCLNAANNLLYLHENGI

SEQ ID NO: 3003365 - protein, 27 aa, Entamoeba invadens
KKCNDVQFLVISLKDTLYERADALVGV

SEQ ID NO: 3003366 - protein, 23 aa, Entamoeba invadens
KKCPLADYLLTPSVTIIDPMFGV

SEQ ID NO: 3003367 - protein, 18 aa, Entamoeba invadens
KKCPLEEYSLTPSVAIID

SEQ ID NO: 3003368 - protein, 30 aa, Entamoeba invadens
KKCPLTSRRPLLQHIVLAGGSTLFPGLPER

SEQ ID NO: 3003369 - protein, 27 aa, Entamoeba invadens
KKCSNLFVPFILQVRKFIAQAEVFLLN

SEQ ID NO: 3003370 - protein, 18 aa, Entamoeba invadens
KKCTFADNFISFKKLPKI

SEQ ID NO: 3003371 - protein, 20 aa, Entamoeba invadens
KKCYLPDLIPILNRMRDTIT

SEQ ID NO: 3003372 - protein, 25 aa, Entamoeba invadens
KKCYPKRFLQKKFDKLIFNLNSSIG

SEQ ID NO: 3003373 - protein, 22 aa, Entamoeba invadens
KKDAKLEYFLLPKQAPTPDEAL

SEQ ID NO: 3003374 - protein, 26 aa, Entamoeba invadens
KKDDEFCCFLFNDYLVFAKVRREDVG

SEQ ID NO: 3003375 - protein, 25 aa, Entamoeba invadens
KKDEKFFVIIVLPLFSEGELKHKSV

SEQ ID NO: 3003376 - protein, 23 aa, Entamoeba invadens
KKDFKVIAVQWDRIPCGGPYLPL

SEQ ID NO: 3003377 - protein, 26 aa, Entamoeba invadens
KKDFQSVGHLLWDYGIPTAMSLSDCC

SEQ ID NO: 3003378 - protein, 24 aa, Entamoeba invadens
KKDGKFCYYYVSTKYANSSRCFDE

SEQ ID NO: 3003379 - protein, 25 aa, Entamoeba invadens
KKDLEKIFGIIRKSFIISQMNWKKT

SEQ ID NO: 3003380 - protein, 22 aa, Entamoeba invadens
KKDLRKIWTLADSGRNGSLNAH

SEQ ID NO: 3003381 - protein, 25 aa, Entamoeba invadens
KKDNFLLGMKFSIARFDSVMRYDPK

SEQ ID NO: 3003382 - protein, 31 aa, Entamoeba invadens
KKDPDLSKYWQFWLDQLPSKKSPNSPPLPLG

SEQ ID NO: 3003383 - protein, 26 aa, Entamoeba invadens
KKDPYYFKRCLISAVALLKIVMHAKQ

SEQ ID NO: 3003384 - protein, 28 aa, Entamoeba invadens
KKDQNYIEFERCLKYYLISKTHPEYTRN

SEQ ID NO: 3003385 - protein, 26 aa, Entamoeba invadens
KKDRVNTNIIFPKLENFKSPIEYKEE

SEQ ID NO: 3003386 - protein, 19 aa, Entamoeba invadens
KKDTFKIGVLIENTTDEVN

SEQ ID NO: 3003387 - protein, 25 aa, Entamoeba invadens
KKDVQFTYSMLLMKLSQETTEAICD

SEQ ID NO: 3003388 - protein, 24 aa, Entamoeba invadens
KKEAAFFPITIYGKKPANLSDCQN

SEQ ID NO: 3003389 - protein, 24 aa, Entamoeba invadens
KKEAFTICPYLVFTSDLVSSDFQR

SEQ ID NO: 3003390 - protein, 19 aa, Entamoeba invadens
KKEAIVVAPLVITSPGCKT

SEQ ID NO: 3003391 - protein, 22 aa, Entamoeba invadens
KKEEIVVCTKDIQEKEKHLKEL

SEQ ID NO: 3003392 - protein, 17 aa, Entamoeba invadens
KKEFQPCVLYNKITKRL

SEQ ID NO: 3003393 - protein, 17 aa, Entamoeba invadens
KKEFRVIPPKFPADIEA

SEQ ID NO: 3003394 - protein, 32 aa, Entamoeba invadens
KKEIKLFVPLTEFQRIWYKKVLMGDITTIIGE

SEQ ID NO: 3003395 - protein, 23 aa, Entamoeba invadens
KKEIRKFLELIGQKYTDDEFETL

SEQ ID NO: 3003396 - protein, 25 aa, Entamoeba invadens
KKEKIEYAPLWLPSDIEKCQICGKS

SEQ ID NO: 3003397 - protein, 24 aa, Entamoeba invadens
KKEKTVPLQLPKVDKRTTKRKKAV

SEQ ID NO: 3003398 - protein, 23 aa, Entamoeba invadens
KKEKWEFVLHEIVFLVSFEENGK

SEQ ID NO: 3003399 - protein, 18 aa, Entamoeba invadens
KKEMTVLVIRPDRYKNLS

SEQ ID NO: 3003400 - protein, 25 aa, Entamoeba invadens
KKEPNTIRAFYRLLEQHRKNSEEDP

SEQ ID NO: 3003401 - protein, 28 aa, Entamoeba invadens
KKEQLHEYIIRLKKLNGLITITVEMHQQ

SEQ ID NO: 3003402 - protein, 38 aa, Entamoeba invadens
KKERDMLIYGFNYLDILSIYHPRYYNTGVLPKAIDLYF

SEQ ID NO: 3003403 - protein, 24 aa, Entamoeba invadens
KKETVEFAFKYYITPYVIEHLKET

SEQ ID NO: 3003404 - protein, 19 aa, Entamoeba invadens
KKEVAPPSFNFSGGFQTEE

SEQ ID NO: 3003405 - protein, 17 aa, Entamoeba invadens
KKEVCSVEKWLGALRKT

SEQ ID NO: 3003406 - protein, 18 aa, Entamoeba invadens
KKEWIIYASLRDVEHTVK

SEQ ID NO: 3003407 - protein, 22 aa, Entamoeba invadens
KKEYQILLYYLCLVAYQGEDAL

SEQ ID NO: 3003408 - protein, 26 aa, Entamoeba invadens
KKFAAAIVKFLMWAEKKFGKKVSVRN

SEQ ID NO: 3003409 - protein, 17 aa, Entamoeba invadens
KKFAEAFQMVPRVLAEN

SEQ ID NO: 3003410 - protein, 21 aa, Entamoeba invadens
KKFFKPEFINRLDDIVVFTPL

SEQ ID NO: 3003411 - protein, 20 aa, Entamoeba invadens
KKFHFNPISLNSKTIGFFPN

SEQ ID NO: 3003412 - protein, 18 aa, Entamoeba invadens
KKFKMALILARDPRFKRL

SEQ ID NO: 3003413 - protein, 18 aa, Entamoeba invadens
KKFKNVLAVIQKLAPTLH

SEQ ID NO: 3003414 - protein, 24 aa, Entamoeba invadens
KKFKQKILPTYYYADFEASTQRIH

SEQ ID NO: 3003415 - protein, 17 aa, Entamoeba invadens
KKFLLFRCVLENNLIQI

SEQ ID NO: 3003416 - protein, 21 aa, Entamoeba invadens
KKFLNILDRFRYNPISVSTLK

SEQ ID NO: 3003417 - protein, 20 aa, Entamoeba invadens
KKFMDTITKIFKRLIRVYAH

SEQ ID NO: 3003418 - protein, 17 aa, Entamoeba invadens
KKFMRDLPEPILPKEGY

SEQ ID NO: 3003419 - protein, 19 aa, Entamoeba invadens
KKFMSLRRLSGDLEQISLF

SEQ ID NO: 3003420 - protein, 26 aa, Entamoeba invadens
KKFNEIPLMFHFNPIRWEKNMGSYFK

SEQ ID NO: 3003421 - protein, 26 aa, Entamoeba invadens
KKFNPKEALFYLPELLEAKSVQMGIA

SEQ ID NO: 3003422 - protein, 25 aa, Entamoeba invadens
KKFPNELYHFADFKQIWINSGFPLV

SEQ ID NO: 3003423 - protein, 25 aa, Entamoeba invadens
KKFPSGRGYIRYLYNKRIEMIDGKV

SEQ ID NO: 3003424 - protein, 28 aa, Entamoeba invadens
KKFQDQAVWMLNAMWFKEKDARAEELWS

SEQ ID NO: 3003425 - protein, 32 aa, Entamoeba invadens
KKFQEVPAMFRYNPIYLFSHFNFFPNVETYHL

SEQ ID NO: 3003426 - protein, 25 aa, Entamoeba invadens
KKFSCILDRFRYNPIPITSTKLFPN

SEQ ID NO: 3003427 - protein, 24 aa, Entamoeba invadens
KKFSKMYMSLSHDALRLYASEDSK

SEQ ID NO: 3003428 - protein, 25 aa, Entamoeba invadens
KKFSNLMVLIYRYSDQDATCQLLRT

SEQ ID NO: 3003429 - protein, 17 aa, Entamoeba invadens
KKFVIPVSPKEKEKRKS

SEQ ID NO: 3003430 - protein, 19 aa, Entamoeba invadens
KKFYIHRDIKPDNFVMGSG

SEQ ID NO: 3003431 - protein, 22 aa, Entamoeba invadens
KKFYSDYLPYEGQGIGIKTPCE

SEQ ID NO: 3003432 - protein, 25 aa, Entamoeba invadens
KKGDPFVFNIFNSSNILVVGPFIVR

SEQ ID NO: 3003433 - protein, 25 aa, Entamoeba invadens
KKGEPLFAAIFRVLRAYCASHVDMG

SEQ ID NO: 3003434 - protein, 24 aa, Entamoeba invadens
KKGFACEFTLIIAPFCTSKIDTTI

SEQ ID NO: 3003435 - protein, 23 aa, Entamoeba invadens
KKGFTLVTLIIFSDIAVLAENVG

SEQ ID NO: 3003436 - protein, 23 aa, Entamoeba invadens
KKGGRYFMQALDTGKDDADAKKT

SEQ ID NO: 3003437 - protein, 29 aa, Entamoeba invadens
KKGKKSDYLWTLFFNDLSLFDARRIQSDM

SEQ ID NO: 3003438 - protein, 21 aa, Entamoeba invadens
KKGKTFHSGFKLPFHIYEDSE

SEQ ID NO: 3003439 - protein, 26 aa, Entamoeba invadens
KKGKVKFRVTFTVDVNALLTVSAVVV

SEQ ID NO: 3003440 - protein, 25 aa, Entamoeba invadens
KKGNFYLALVFLHYAMVFTPQYGDI

SEQ ID NO: 3003441 - protein, 19 aa, Entamoeba invadens
KKGRWMVQIQYECKKRQFE

SEQ ID NO: 3003442 - protein, 17 aa, Entamoeba invadens
KKGWIHRDIKPDNFIMG

SEQ ID NO: 3003443 - protein, 19 aa, Entamoeba invadens
KKHGFLSFLHFTKKPKESK

SEQ ID NO: 3003444 - protein, 32 aa, Entamoeba invadens
KKHGVTLHFKRFPFFFAYLKEAAGSELVWKDM

SEQ ID NO: 3003445 - protein, 21 aa, Entamoeba invadens
KKHIALLLGAFSHTGDLITKT

SEQ ID NO: 3003446 - protein, 30 aa, Entamoeba invadens
KKHIIPPFSIVPTKYRGFIKRWAKTQRLSI

SEQ ID NO: 3003447 - protein, 18 aa, Entamoeba invadens
KKHPKFLKKVNLVCGCSV

SEQ ID NO: 3003448 - protein, 18 aa, Entamoeba invadens
KKHRLRVSITQSSKYKLN

SEQ ID NO: 3003449 - protein, 17 aa, Entamoeba invadens
KKHSAADRMKYVASARS

SEQ ID NO: 3003450 - protein, 24 aa, Entamoeba invadens
KKHSEFIQYPIMLYVTKETEEEVT

SEQ ID NO: 3003451 - protein, 24 aa, Entamoeba invadens
KKIDFFRINIWFGVEYTFAQLHSD

SEQ ID NO: 3003452 - protein, 25 aa, Entamoeba invadens
KKIDQQFFGTPIKLPLSTPQRKRTI

SEQ ID NO: 3003453 - protein, 27 aa, Entamoeba invadens
KKIEVIHLMEDLLLELGFELITKTLSG

SEQ ID NO: 3003454 - protein, 17 aa, Entamoeba invadens
KKIFMRLGIKVLNVMKS

SEQ ID NO: 3003455 - protein, 20 aa, Entamoeba invadens
KKIFMRLGIKVLNVMKSEEI

SEQ ID NO: 3003456 - protein, 33 aa, Entamoeba invadens
KKIGTTFKMFTPFFKVYFLYISHYNSTVEILAT

SEQ ID NO: 3003457 - protein, 22 aa, Entamoeba invadens
KKIIEKLLKILRTYLRKQSQNY

SEQ ID NO: 3003458 - protein, 18 aa, Entamoeba invadens
KKIKEFGLSCLLCDAVNV

SEQ ID NO: 3003459 - protein, 24 aa, Entamoeba invadens
KKIKGIQNIIFYELPNSANFVPEL

SEQ ID NO: 3003460 - protein, 26 aa, Entamoeba invadens
KKIKMFREMIHRLKVAHPDIEELKLM

SEQ ID NO: 3003461 - protein, 40 aa, Entamoeba invadens
KKIKNIQVILSFLPILYYNTLKLLIHYLSLVVGASQVNKM

SEQ ID NO: 3003462 - protein, 17 aa, Entamoeba invadens
KKILFSKGFRVFGGDSR

SEQ ID NO: 3003463 - protein, 20 aa, Entamoeba invadens
KKILKLFNAEHLPLVPKEIF

SEQ ID NO: 3003464 - protein, 24 aa, Entamoeba invadens
KKIPQQIILEKFGNAKLVFESILS

SEQ ID NO: 3003465 - protein, 23 aa, Entamoeba invadens
KKISQLLPFVQQNTNLWPHLSSA

SEQ ID NO: 3003466 - protein, 19 aa, Entamoeba invadens
KKISYLYNDTYTCGKLVNS

SEQ ID NO: 3003467 - protein, 23 aa, Entamoeba invadens
KKITEMWVNWKAKLAANPKTAAY

SEQ ID NO: 3003468 - protein, 27 aa, Entamoeba invadens
KKIVEPLFVQIFRSDLLTRDFQVETLR

SEQ ID NO: 3003469 - protein, 17 aa, Entamoeba invadens
KKIVKLLDDLLTLVSDT

SEQ ID NO: 3003470 - protein, 22 aa, Entamoeba invadens
KKIVVFVLTCDQVEYISAVLHS

SEQ ID NO: 3003471 - protein, 21 aa, Entamoeba invadens
KKKAILVLPECYIDFVNEDEM

SEQ ID NO: 3003472 - protein, 24 aa, Entamoeba invadens
KKKAPPRIYFPSTCPNHGPHGCCT

SEQ ID NO: 3003473 - protein, 23 aa, Entamoeba invadens
KKKCRYLFFWRYVIRMCNVERPI

SEQ ID NO: 3003474 - protein, 23 aa, Entamoeba invadens
KKKFEEIIRFVPPDYRLCQRNRF

SEQ ID NO: 3003475 - protein, 24 aa, Entamoeba invadens
KKKFPTYDLPLLKPLEDMGVTDAD

SEQ ID NO: 3003476 - protein, 20 aa, Entamoeba invadens
KKKFVYIFKKRTTAKQFTED

SEQ ID NO: 3003477 - protein, 25 aa, Entamoeba invadens
KKKGFPRLLEFFKKDKRSASLSAKV

SEQ ID NO: 3003478 - protein, 22 aa, Entamoeba invadens
KKKGITMEIALKGSPKTFDVDE

SEQ ID NO: 3003479 - protein, 23 aa, Entamoeba invadens
KKKIAHLEQKLQDLEYRPVGTSN

SEQ ID NO: 3003480 - protein, 25 aa, Entamoeba invadens
KKKKHGFFSFLKRKAKDKSKEVKDA

SEQ ID NO: 3003481 - protein, 21 aa, Entamoeba invadens
KKKKLQYEYDQLINLVSGHED

SEQ ID NO: 3003482 - protein, 27 aa, Entamoeba invadens
KKKKMGFFKEIWRRITPGHSPALSPKM

SEQ ID NO: 3003483 - protein, 25 aa, Entamoeba invadens
KKKLLTRQFDIKSITGLFMRARPLH

SEQ ID NO: 3003484 - protein, 25 aa, Entamoeba invadens
KKKNKFLFQFYNPKLSQEDFLYSTN

SEQ ID NO: 3003485 - protein, 33 aa, Entamoeba invadens
KKKNNYFWKELFASIPMWIFNDSLRRHCAFKIL

SEQ ID NO: 3003486 - protein, 24 aa, Entamoeba invadens
KKKNSGGLLGFLKKEEKKEEKKEE

SEQ ID NO: 3003487 - protein, 20 aa, Entamoeba invadens
KKKPDLPSPGFSSPLITKFA

SEQ ID NO: 3003488 - protein, 17 aa, Entamoeba invadens
KKKPNYIASDVDKFALL

SEQ ID NO: 3003489 - protein, 29 aa, Entamoeba invadens
KKKRIDGVDYFFNAFFRPNDRNSLSKVKN

SEQ ID NO: 3003490 - protein, 25 aa, Entamoeba invadens
KKKSNVTLPFFTIKSVVFSPTDRVD

SEQ ID NO: 3003491 - protein, 24 aa, Entamoeba invadens
KKKTFFTLQFMKVTKIVFNDVEEW

SEQ ID NO: 3003492 - protein, 25 aa, Entamoeba invadens
KKKTPKYGLIYHATLIGQAPAKSKG

SEQ ID NO: 3003493 - protein, 21 aa, Entamoeba invadens
KKKVDILAYWVSQSLYESIND

SEQ ID NO: 3003494 - protein, 20 aa, Entamoeba invadens
KKKVYWVDFEKSESLYVNLH

SEQ ID NO: 3003495 - protein, 19 aa, Entamoeba invadens
KKKYAYLDVDAVDKLHRDN

SEQ ID NO: 3003496 - protein, 31 aa, Entamoeba invadens
KKKYNTDFYILDKFPSAIRPFYTMPDVDDPH

SEQ ID NO: 3003497 - protein, 17 aa, Entamoeba invadens
KKKYRLLDPSGFDLKTG

SEQ ID NO: 3003498 - protein, 27 aa, Entamoeba invadens
KKKYTIVPFKLKRNNYLIRTEATVVIF

SEQ ID NO: 3003499 - protein, 23 aa, Entamoeba invadens
KKKYYITFAMQKLVTGKFSVLVK

SEQ ID NO: 3003500 - protein, 18 aa, Entamoeba invadens
KKLAQLTKTFRRPEYIRA

SEQ ID NO: 3003501 - protein, 22 aa, Entamoeba invadens
KKLAYLYIMNYAKTQQDNAIKS

SEQ ID NO: 3003502 - protein, 33 aa, Entamoeba invadens
KKLDAPLQPYEFLKLLTLYFIVMKKDKKNLFLS

SEQ ID NO: 3003503 - protein, 30 aa, Entamoeba invadens
KKLDYKTIGTFLRTFGRVVSYRIRCVARDV

SEQ ID NO: 3003504 - protein, 22 aa, Entamoeba invadens
KKLEIYPKFIPTKTATFCDGYL

SEQ ID NO: 3003505 - protein, 25 aa, Entamoeba invadens
KKLEKGFVTLRHGPNQYFYCLHCDK

SEQ ID NO: 3003506 - protein, 24 aa, Entamoeba invadens
KKLELITRVWSMYPEMVKSVNILL

SEQ ID NO: 3003507 - protein, 29 aa, Entamoeba invadens
KKLETDTHFQIILLFTLEVLKDGVDKEYG

SEQ ID NO: 3003508 - protein, 30 aa, Entamoeba invadens
KKLETFIDQYQSARRVLYGQNTFGRKRQFP

SEQ ID NO: 3003509 - protein, 22 aa, Entamoeba invadens
KKLFIDYGIVDVRLLYQPIVVK

SEQ ID NO: 3003510 - protein, 24 aa, Entamoeba invadens
KKLGEGFLKLFTKELTEEMLLLSK

SEQ ID NO: 3003511 - protein, 19 aa, Entamoeba invadens
KKLIIVCKESAFVPAPSWS

SEQ ID NO: 3003512 - protein, 20 aa, Entamoeba invadens
KKLINLLEKFHFNPIPLSQK

SEQ ID NO: 3003513 - protein, 22 aa, Entamoeba invadens
KKLISFIEFVITNYPNLFPDDV

SEQ ID NO: 3003514 - protein, 18 aa, Entamoeba invadens
KKLKFMMELYTKQKEENA

SEQ ID NO: 3003515 - protein, 23 aa, Entamoeba invadens
KKLKPSRRNLLKKLQNEKREAAE

SEQ ID NO: 3003516 - protein, 31 aa, Entamoeba invadens
KKLKSLVEVMAYFFENFQTIAPFINQVIAQY

SEQ ID NO: 3003517 - protein, 23 aa, Entamoeba invadens
KKLMFVNINFLKSYCFFMETNFY

SEQ ID NO: 3003518 - protein, 21 aa, Entamoeba invadens
KKLNDFKVTHLPTMLAGYVEV

SEQ ID NO: 3003519 - protein, 20 aa, Entamoeba invadens
KKLPKIGVTTLLKKLTNPTD

SEQ ID NO: 3003520 - protein, 25 aa, Entamoeba invadens
KKLPNNQFWRVIKAYALSNTNQEEE

SEQ ID NO: 3003521 - protein, 25 aa, Entamoeba invadens
KKLQDQYDQLINLVYGHEDETNNLN

SEQ ID NO: 3003522 - protein, 28 aa, Entamoeba invadens
KKLRDILMSLLRNTTPLFPEIYNYNAFL

SEQ ID NO: 3003523 - protein, 26 aa, Entamoeba invadens
KKLRNVVLFLVSKYREKYGFKSLDKY

SEQ ID NO: 3003524 - protein, 18 aa, Entamoeba invadens
KKLSDEWAIPFFETSAQN

SEQ ID NO: 3003525 - protein, 19 aa, Entamoeba invadens
KKLTELNEQLDLERTTDQQ

SEQ ID NO: 3003526 - protein, 17 aa, Entamoeba invadens
KKLVELMGIPAIEANCE

SEQ ID NO: 3003527 - protein, 18 aa, Entamoeba invadens
KKMMLDVCQPIKGLIAAI

SEQ ID NO: 3003528 - protein, 23 aa, Entamoeba invadens
KKMQQIVTNQWRSLGANFKRKFP

SEQ ID NO: 3003529 - protein, 17 aa, Entamoeba invadens
KKMSVVTSVKWAKKKYV

SEQ ID NO: 3003530 - protein, 17 aa, Entamoeba invadens
KKMWDQVPEKRPQIAEV

SEQ ID NO: 3003531 - protein, 19 aa, Entamoeba invadens
KKNANLAFRLFEVGTKFGN

SEQ ID NO: 3003532 - protein, 18 aa, Entamoeba invadens
KKNFACEFSVYLTPLYST

SEQ ID NO: 3003533 - protein, 26 aa, Entamoeba invadens
KKNFEKLEWIYFDLTQIDVTEYKKVI

SEQ ID NO: 3003534 - protein, 26 aa, Entamoeba invadens
KKNGGDYLLTLPSMVFFFGMNVNQSI

SEQ ID NO: 3003535 - protein, 23 aa, Entamoeba invadens
KKNGNFGIVLLTLGINDNENILQ

SEQ ID NO: 3003536 - protein, 17 aa, Entamoeba invadens
KKNIGVFVYGDGGYVFG

SEQ ID NO: 3003537 - protein, 24 aa, Entamoeba invadens
KKNIMLLCVSEAGWVFGCFTTTAV

SEQ ID NO: 3003538 - protein, 23 aa, Entamoeba invadens
KKNKMCTFTITLTPFCSTQLKDT

SEQ ID NO: 3003539 - protein, 17 aa, Entamoeba invadens
KKNPPLCPSKKPTKLPL

SEQ ID NO: 3003540 - protein, 27 aa, Entamoeba invadens
KKNQLTYEDLLLLLLTQLHGDYTYKEL

SEQ ID NO: 3003541 - protein, 36 aa, Entamoeba invadens
KKNRKTAKRQVAPLAQSQFISPLGRSKSPVGSPRLS

SEQ ID NO: 3003542 - protein, 22 aa, Entamoeba invadens
KKNVVLIPFCPYNFQVSSKMVS

SEQ ID NO: 3003543 - protein, 23 aa, Entamoeba invadens
KKPFIIPSIFLPNTFYHFELYCH

SEQ ID NO: 3003544 - protein, 21 aa, Entamoeba invadens
KKPIPPFILYNNRTLEEILYS

SEQ ID NO: 3003545 - protein, 25 aa, Entamoeba invadens
KKPKDEAYQFLKNLPLYSGEPQSQP

SEQ ID NO: 3003546 - protein, 42 aa, Entamoeba invadens
KKPKKLVHLCIPQSNIKLMGKMRKCLPIWKEDLPNLKQKLDT

SEQ ID NO: 3003547 - protein, 20 aa, Entamoeba invadens
KKPLLLILQNLDPAGEDLCV

SEQ ID NO: 3003548 - protein, 28 aa, Entamoeba invadens
KKPMKYIRSIYNRLLLENPSIRAAAITT

SEQ ID NO: 3003549 - protein, 24 aa, Entamoeba invadens
KKPNNLPMFLIVQEVIKNISKEVT

SEQ ID NO: 3003550 - protein, 17 aa, Entamoeba invadens
KKPRIVSELFTLEKARK

SEQ ID NO: 3003551 - protein, 25 aa, Entamoeba invadens
KKPTGEWVTLLLLHVPRGNLKSDKL

SEQ ID NO: 3003552 - protein, 24 aa, Entamoeba invadens
KKPTKKAVAKKDSLDLSDSDDDIK

SEQ ID NO: 3003553 - protein, 23 aa, Entamoeba invadens
KKPTKYITLVLKLLTIRPDRKIV

SEQ ID NO: 3003554 - protein, 19 aa, Entamoeba invadens
KKPVIFLVGNKKDLKKNST

SEQ ID NO: 3003555 - protein, 35 aa, Entamoeba invadens
KKPVIQTIFLGKYYYIFILKAMVWICDENGVLHTL

SEQ ID NO: 3003556 - protein, 19 aa, Entamoeba invadens
KKQAKQYARKVEKAERKLA

SEQ ID NO: 3003557 - protein, 17 aa, Entamoeba invadens
KKQFVFQNSWGLSTRSI

SEQ ID NO: 3003558 - protein, 28 aa, Entamoeba invadens
KKQGKKPYLGFTLTLHSPLVLVENGVRE

SEQ ID NO: 3003559 - protein, 24 aa, Entamoeba invadens
KKQKVLDFGRLPWKRIQIENENKG

SEQ ID NO: 3003560 - protein, 51 aa, Entamoeba invadens
KKQLKTLRRLRIMNHILRHLKHKRRWLWTTKRRPRRLPRTNLIEERRLSQS

SEQ ID NO: 3003561 - protein, 24 aa, Entamoeba invadens
KKQLQIVVVLGSIYQLLATNRKST

SEQ ID NO: 3003562 - protein, 20 aa, Entamoeba invadens
KKQPAKNVVFPLTCLEFLNT

SEQ ID NO: 3003563 - protein, 24 aa, Entamoeba invadens
KKQPTFLPSAFLTYTTFSKSQIVW

SEQ ID NO: 3003564 - protein, 29 aa, Entamoeba invadens
KKQTTIQPIPRYPAAFPFGYDKNPRYPPA

SEQ ID NO: 3003565 - protein, 23 aa, Entamoeba invadens
KKQWPYSSIAIAMEVIPRTLAAN

SEQ ID NO: 3003566 - protein, 25 aa, Entamoeba invadens
KKREMLLVGIGLGFYLESSLEEAQE

SEQ ID NO: 3003567 - protein, 40 aa, Entamoeba invadens
KKREYLKGYLPILQGFTKKANFRLLFSSDLFPVKADVIAQ

SEQ ID NO: 3003568 - protein, 26 aa, Entamoeba invadens
KKRGEMKVYKYLKPPPSLSEIIRNET

SEQ ID NO: 3003569 - protein, 23 aa, Entamoeba invadens
KKRKRSLGFLSPRSRKGISILKK

SEQ ID NO: 3003570 - protein, 28 aa, Entamoeba invadens
KKRLEPFYLMNVVLYIDSFNTLQKFHMV

SEQ ID NO: 3003571 - protein, 19 aa, Entamoeba invadens
KKRMEFKPLGPTLQKIELK

SEQ ID NO: 3003572 - protein, 19 aa, Entamoeba invadens
KKRMEFKPLGPTLQRIELK

SEQ ID NO: 3003573 - protein, 20 aa, Entamoeba invadens
KKRMFKWDYIRKASTRIVFT

SEQ ID NO: 3003574 - protein, 34 aa, Entamoeba invadens
KKRNESIYLLMNYLVKYPFLKLEEKLSQYTIEDY

SEQ ID NO: 3003575 - protein, 24 aa, Entamoeba invadens
KKRNRIEILIKAKSFYREAINANN

SEQ ID NO: 3003576 - protein, 24 aa, Entamoeba invadens
KKRNYFVRFPGDGDVRDGFVTDLV

SEQ ID NO: 3003577 - protein, 19 aa, Entamoeba invadens
KKRRRLVYDSSMMDFSKES

SEQ ID NO: 3003578 - protein, 17 aa, Entamoeba invadens
KKRRVIIGMFDASGMKF

SEQ ID NO: 3003579 - protein, 29 aa, Entamoeba invadens
KKRSCSICKSNYYPIQGRCVPCDYGCTSC

SEQ ID NO: 3003580 - protein, 20 aa, Entamoeba invadens
KKRVDALKELNLFESLFSQD

SEQ ID NO: 3003581 - protein, 17 aa, Entamoeba invadens
KKRYDMVIHLRTTAIGA

SEQ ID NO: 3003582 - protein, 24 aa, Entamoeba invadens
KKRYQPPLVGTQRKHPQFARKRNA

SEQ ID NO: 3003583 - protein, 25 aa, Entamoeba invadens
KKSDKYVPGYFHYVYDYQMSYTEYL

SEQ ID NO: 3003584 - protein, 18 aa, Entamoeba invadens
KKSDTLTGLFKSGSIGSS

SEQ ID NO: 3003585 - protein, 23 aa, Entamoeba invadens
KKSDWLQPLSTLNQMKKEGDLVI

SEQ ID NO: 3003586 - protein, 26 aa, Entamoeba invadens
KKSDWVIVDLLLLRNVAKLGIGEGVF

SEQ ID NO: 3003587 - protein, 26 aa, Entamoeba invadens
KKSENFFNVVVWYPVPYKVYHETQVP

SEQ ID NO: 3003588 - protein, 25 aa, Entamoeba invadens
KKSGEIVMKMRIKLMLDTAKGIQYL

SEQ ID NO: 3003589 - protein, 29 aa, Entamoeba invadens
KKSIGKVFNVWWNLRKFLVEFSTQKTVGE

SEQ ID NO: 3003590 - protein, 24 aa, Entamoeba invadens
KKSKYYDMFAQPFKKYYPFVAGYI

SEQ ID NO: 3003591 - protein, 17 aa, Entamoeba invadens
KKSLGSPALGKFSSMIF

SEQ ID NO: 3003592 - protein, 27 aa, Entamoeba invadens
KKSLNKWDKKLLFFNIREFVAESGSTS

SEQ ID NO: 3003593 - protein, 28 aa, Entamoeba invadens
KKSLNKWDKKLLFFNIREFVAESGSTSK

SEQ ID NO: 3003594 - protein, 30 aa, Entamoeba invadens
KKSLNKWDKKLLFSTLESLLQRVEEHQNNA

SEQ ID NO: 3003595 - protein, 27 aa, Entamoeba invadens
KKSLNKWNKKLLFFNIREFVAESGSTS

SEQ ID NO: 3003596 - protein, 18 aa, Entamoeba invadens
KKSLSFYDRKTRQFEMNN

SEQ ID NO: 3003597 - protein, 18 aa, Entamoeba invadens
KKSLSPLKKLKVLESPIV

SEQ ID NO: 3003598 - protein, 29 aa, Entamoeba invadens
KKSMCPKNILILMFLQDKVMDAIIQYACR

SEQ ID NO: 3003599 - protein, 25 aa, Entamoeba invadens
KKSNFKFPIVKIADYGFSRGLNDMM

SEQ ID NO: 3003600 - protein, 33 aa, Entamoeba invadens
KKSPFPLTDVHFLPKWFSLDSLICAGDGLSVCY

SEQ ID NO: 3003601 - protein, 26 aa, Entamoeba invadens
KKSPKTNYNFFLSRNYPPLAEQLSHS

SEQ ID NO: 3003602 - protein, 25 aa, Entamoeba invadens
KKSRYDLQLIFKRCDYYTLMADSAM

SEQ ID NO: 3003603 - protein, 26 aa, Entamoeba invadens
KKSRYDLQYIFKQCDYYTLMADSAMY

SEQ ID NO: 3003604 - protein, 27 aa, Entamoeba invadens
KKSSKVFFFNDVYLMFMRDVDGMWEVQ

SEQ ID NO: 3003605 - protein, 34 aa, Entamoeba invadens
KKSSSFSCDFWSLGIILFSMAFGDSPFFDTNPDI

SEQ ID NO: 3003606 - protein, 25 aa, Entamoeba invadens
KKSVSMLYALIKKDYVFNKSSVLNT

SEQ ID NO: 3003607 - protein, 25 aa, Entamoeba invadens
KKTEITFFQLQFPFAEVVISPDQFK

SEQ ID NO: 3003608 - protein, 25 aa, Entamoeba invadens
KKTEKQILAFLQIGNVRLGDGTCFD

SEQ ID NO: 3003609 - protein, 25 aa, Entamoeba invadens
KKTENFCYTLTQKLISLLCCIKEIP

SEQ ID NO: 3003610 - protein, 19 aa, Entamoeba invadens
KKTFIYPPSVNPDWNQAFR

SEQ ID NO: 3003611 - protein, 20 aa, Entamoeba invadens
KKTFSVFAVFKNPETAENIA

SEQ ID NO: 3003612 - protein, 24 aa, Entamoeba invadens
KKTGEFLYFGTLDNYPYEILFHVA

SEQ ID NO: 3003613 - protein, 24 aa, Entamoeba invadens
KKTGYMKCVWASKLERCTLILQEH

SEQ ID NO: 3003614 - protein, 23 aa, Entamoeba invadens
KKTKQFILDLLGSNPDIMTFADI

SEQ ID NO: 3003615 - protein, 20 aa, Entamoeba invadens
KKTLGLLGKQAKVVIPRGTI

SEQ ID NO: 3003616 - protein, 17 aa, Entamoeba invadens
KKTLKLMSSFFVISIEL

SEQ ID NO: 3003617 - protein, 21 aa, Entamoeba invadens
KKTLQMIKIKNINFNGMVWMN

SEQ ID NO: 3003618 - protein, 33 aa, Entamoeba invadens
KKTNKSRYFYLFNDLLLYGPGVKKINVSEWFYL

SEQ ID NO: 3003619 - protein, 24 aa, Entamoeba invadens
KKTSPIILSHHMLMGLKGPKAGKM

SEQ ID NO: 3003620 - protein, 18 aa, Entamoeba invadens
KKTSYDFRRLLLSEYDQL

SEQ ID NO: 3003621 - protein, 25 aa, Entamoeba invadens
KKTVERFLWGVYYTHNSLIKCSKFD

SEQ ID NO: 3003622 - protein, 24 aa, Entamoeba invadens
KKVDDKHFQKVLKSELKSLNDKCE

SEQ ID NO: 3003623 - protein, 25 aa, Entamoeba invadens
KKVDPIPSFDYLPEPTINPISPVSH

SEQ ID NO: 3003624 - protein, 20 aa, Entamoeba invadens
KKVEWSVKLQIALFIEDRVY

SEQ ID NO: 3003625 - protein, 21 aa, Entamoeba invadens
KKVFHPNIVLFMGACTESTIM

SEQ ID NO: 3003626 - protein, 20 aa, Entamoeba invadens
KKVIDTLFTRFMVPLGDKPS

SEQ ID NO: 3003627 - protein, 20 aa, Entamoeba invadens
KKVKEWCIIPLYKLVMHDDH

SEQ ID NO: 3003628 - protein, 24 aa, Entamoeba invadens
KKVKVPTFIVYGEKYRFAQAMKKL

SEQ ID NO: 3003629 - protein, 24 aa, Entamoeba invadens
KKVLIGAADVIKLIENGDFYKLES

SEQ ID NO: 3003630 - protein, 21 aa, Entamoeba invadens
KKVNFRFCFNCKEAWHEGLTC

SEQ ID NO: 3003631 - protein, 22 aa, Entamoeba invadens
KKVQEKKLFNPLTGSFETLKTT

SEQ ID NO: 3003632 - protein, 30 aa, Entamoeba invadens
KKVSDVKRLLKNYNFKTVKLCKTKNSTMAK

SEQ ID NO: 3003633 - protein, 18 aa, Entamoeba invadens
KKVSLPKLPKFKDVIGKA

SEQ ID NO: 3003634 - protein, 25 aa, Entamoeba invadens
KKVTPINYISFLQSIVNKYNLKDNK

SEQ ID NO: 3003635 - protein, 18 aa, Entamoeba invadens
KKVVCFLCGESHLFKDCP

SEQ ID NO: 3003636 - protein, 17 aa, Entamoeba invadens
KKVVFPSFFYKLNKRDI

SEQ ID NO: 3003637 - protein, 20 aa, Entamoeba invadens
KKVVGISISAFVCVFERRMV

SEQ ID NO: 3003638 - protein, 24 aa, Entamoeba invadens
KKVVKILQFFPALENYKNFFIDFS

SEQ ID NO: 3003639 - protein, 29 aa, Entamoeba invadens
KKVVNSRKLQILYFDDNGTNIRKCFVCGK

SEQ ID NO: 3003640 - protein, 25 aa, Entamoeba invadens
KKVWVAFAEFCVRNHFISLARKAFG

SEQ ID NO: 3003641 - protein, 20 aa, Entamoeba invadens
KKWDGEVLIIQFSETLESKK

SEQ ID NO: 3003642 - protein, 31 aa, Entamoeba invadens
KKWNRRWVVLKKNCLMIFKSAGEGQTMVVIQ

SEQ ID NO: 3003643 - protein, 21 aa, Entamoeba invadens
KKWPDYQLRPNFLITLVEAPS

SEQ ID NO: 3003644 - protein, 19 aa, Entamoeba invadens
KKWTELLKKDGLNLKWIRE

SEQ ID NO: 3003645 - protein, 21 aa, Entamoeba invadens
KKWVCVIFGPEDTIWENGIFQ

SEQ ID NO: 3003646 - protein, 21 aa, Entamoeba invadens
KKWWKEDEVCNFYKGLMACGV

SEQ ID NO: 3003647 - protein, 19 aa, Entamoeba invadens
KKYANLCEVVLPTTIKKIE

SEQ ID NO: 3003648 - protein, 21 aa, Entamoeba invadens
KKYEFLLDRFRENPIPIYPDT

SEQ ID NO: 3003649 - protein, 30 aa, Entamoeba invadens
KKYESEYLIEIFFWRLVKYKIDQQKNPTEE

SEQ ID NO: 3003650 - protein, 17 aa, Entamoeba invadens
KKYFRYRTLDELIMRIP

SEQ ID NO: 3003651 - protein, 17 aa, Entamoeba invadens
KKYFTIEESSKLLNFIR

SEQ ID NO: 3003652 - protein, 18 aa, Entamoeba invadens
KKYIIKFYEMFFNNNLET

SEQ ID NO: 3003653 - protein, 26 aa, Entamoeba invadens
KKYKIDYLPHYLFVQLNRFDSFGVDV

SEQ ID NO: 3003654 - protein, 25 aa, Entamoeba invadens
KKYKNILRLFTFNPTDDISLFDNME

SEQ ID NO: 3003655 - protein, 21 aa, Entamoeba invadens
KKYKRMMLYICNDIAFICSQP

SEQ ID NO: 3003656 - protein, 24 aa, Entamoeba invadens
KKYLREAPSPVWPISLYDQLVEMT

SEQ ID NO: 3003657 - protein, 25 aa, Entamoeba invadens
KKYNDRAYTLLKRISTPISKEDIDK

SEQ ID NO: 3003658 - protein, 22 aa, Entamoeba invadens
KKYNTEIILLWGNPKNMDFSIY

SEQ ID NO: 3003659 - protein, 25 aa, Entamoeba invadens
KKYSCILDRFRYNPIPITSTKLFPN

SEQ ID NO: 3003660 - protein, 23 aa, Entamoeba invadens
KKYSDICDVFFVNPIPLDEQNEK

SEQ ID NO: 3003661 - protein, 18 aa, Entamoeba invadens
KKYTAIIYLMLRGGLKYD

SEQ ID NO: 3003662 - protein, 28 aa, Entamoeba invadens
KKYTKKYIQRYLQKYLGKVPQKISKDFI

SEQ ID NO: 3003663 - protein, 31 aa, Entamoeba invadens
KKYTRKSVGYSMWLFSAIENLVSVNGAFVLV

SEQ ID NO: 3003664 - protein, 21 aa, Entamoeba invadens
KKYVPPYTFSNCEQLSLVTGS

SEQ ID NO: 3003665 - protein, 24 aa, Entamoeba invadens
KKYYGSVVFLMDGFYSEAFLGHET

SEQ ID NO: 3003666 - protein, 24 aa, Entamoeba invadens
KLADDWKILFYETSAKNKINITET

SEQ ID NO: 3003667 - protein, 23 aa, Entamoeba invadens
KLADYRFNLWPAYSDTFEEEMYD

SEQ ID NO: 3003668 - protein, 25 aa, Entamoeba invadens
KLAECLMVLMGVDPSMFMKKSEEEK

SEQ ID NO: 3003669 - protein, 22 aa, Entamoeba invadens
KLAENVLLAHKLKEIALTIGEF

SEQ ID NO: 3003670 - protein, 18 aa, Entamoeba invadens
KLAEQLNSQLFDEDPQKY

SEQ ID NO: 3003671 - protein, 18 aa, Entamoeba invadens
KLAFFRQGMLEIAVLTAL

SEQ ID NO: 3003672 - protein, 36 aa, Entamoeba invadens
KLAFHAMWKDKYLTEKLFLNPFVDKPLTEKVTCDRL

SEQ ID NO: 3003673 - protein, 29 aa, Entamoeba invadens
KLAFSSDVLKIVFILRNCPVPEIVKVLKY

SEQ ID NO: 3003674 - protein, 17 aa, Entamoeba invadens
KLAFTRNCLSCHENMFL

SEQ ID NO: 3003675 - protein, 21 aa, Entamoeba invadens
KLAGIVLINPQVEKGSLCFSC

SEQ ID NO: 3003676 - protein, 18 aa, Entamoeba invadens
KLALKLGISCARKNMFRT

SEQ ID NO: 3003677 - protein, 26 aa, Entamoeba invadens
KLARVSYLDFLNRTLCWDPEIRLTPG

SEQ ID NO: 3003678 - protein, 22 aa, Entamoeba invadens
KLAVETILSLSVEILPKADTLR

SEQ ID NO: 3003679 - protein, 18 aa, Entamoeba invadens
KLAVINRPKMTELISVLA

SEQ ID NO: 3003680 - protein, 27 aa, Entamoeba invadens
KLCDFRFFNMKMLKSVNLPNTLKTVGI

SEQ ID NO: 3003681 - protein, 27 aa, Entamoeba invadens
KLCDFRFFNMKMLKSVNLPTTLETVGI

SEQ ID NO: 3003682 - protein, 18 aa, Entamoeba invadens
KLCDGDNFILKKFAVFQL

SEQ ID NO: 3003683 - protein, 18 aa, Entamoeba invadens
KLCDLVASPPLGIKEYRL

SEQ ID NO: 3003684 - protein, 19 aa, Entamoeba invadens
KLCESLLTEFKITTANAPM

SEQ ID NO: 3003685 - protein, 21 aa, Entamoeba invadens
KLCFSLCTSLVDIKLPTTLER

SEQ ID NO: 3003686 - protein, 19 aa, Entamoeba invadens
KLCSIRLPNSITSLGDFCF

SEQ ID NO: 3003687 - protein, 21 aa, Entamoeba invadens
KLCVVFTIPIFQNCVHFVVME

SEQ ID NO: 3003688 - protein, 26 aa, Entamoeba invadens
KLDAETALLDLQKTFEAANNELITFK

SEQ ID NO: 3003689 - protein, 30 aa, Entamoeba invadens
KLDDFTWNVWDPINPFSLLPEKLIVRFDQE

SEQ ID NO: 3003690 - protein, 22 aa, Entamoeba invadens
KLDEFAVIKFPLSTETALKMIE

SEQ ID NO: 3003691 - protein, 20 aa, Entamoeba invadens
KLDEVIVLLNIIKSSFPFLI

SEQ ID NO: 3003692 - protein, 22 aa, Entamoeba invadens
KLDFAYHPVPFSFFLQNGDGVQ

SEQ ID NO: 3003693 - protein, 28 aa, Entamoeba invadens
KLDFRATLNPFPRWGNYQNFGKFMSAVK

SEQ ID NO: 3003694 - protein, 36 aa, Entamoeba invadens
KLDFTSILQSLFLSGSHFFYHFLDMYKDECSKFSKT

SEQ ID NO: 3003695 - protein, 18 aa, Entamoeba invadens
KLDNEDDLPLRRAKITLE

SEQ ID NO: 3003696 - protein, 24 aa, Entamoeba invadens
KLDQIECAQGHIIDCVSGIEMVHP

SEQ ID NO: 3003697 - protein, 24 aa, Entamoeba invadens
KLDQIKETFLYRPNTLQRETQTKV

SEQ ID NO: 3003698 - protein, 27 aa, Entamoeba invadens
KLDQTYCLGVLLFHSRLLLFHTTDKTY

SEQ ID NO: 3003699 - protein, 25 aa, Entamoeba invadens
KLDRFRDFFRQLLSDLMRDTPLDYV

SEQ ID NO: 3003700 - protein, 32 aa, Entamoeba invadens
KLDTLVEGKLPRKSIMQLKNICAGIGTPNSML

SEQ ID NO: 3003701 - protein, 21 aa, Entamoeba invadens
KLDTYAKFRSAKILEFFNLKN

SEQ ID NO: 3003702 - protein, 27 aa, Entamoeba invadens
KLDVTRIYMQCLTPFISNVFLTIYSDA

SEQ ID NO: 3003703 - protein, 28 aa, Entamoeba invadens
KLEDNTTLQYLFYLDQLPISQAPMATHS

SEQ ID NO: 3003704 - protein, 25 aa, Entamoeba invadens
KLEEFYPSILFHVVMKKKLGEVKEA

SEQ ID NO: 3003705 - protein, 19 aa, Entamoeba invadens
KLEEGFTFAMLVLAPEDVT

SEQ ID NO: 3003706 - protein, 20 aa, Entamoeba invadens
KLEEIMKRKITFLNDCVGEE

SEQ ID NO: 3003707 - protein, 23 aa, Entamoeba invadens
KLEFVRLAVLLKEYTLALKQRST

SEQ ID NO: 3003708 - protein, 17 aa, Entamoeba invadens
KLEGFQIDDKKMKVKVR

SEQ ID NO: 3003709 - protein, 21 aa, Entamoeba invadens
KLEGTWLLIEKSELGSMFSIK

SEQ ID NO: 3003710 - protein, 21 aa, Entamoeba invadens
KLEIVLFKTTKLVTIKNRMFQ

SEQ ID NO: 3003711 - protein, 19 aa, Entamoeba invadens
KLEIVQFLGDFRNLEDCVF

SEQ ID NO: 3003712 - protein, 21 aa, Entamoeba invadens
KLEIYLKKEKLFDGKRGYVGA

SEQ ID NO: 3003713 - protein, 20 aa, Entamoeba invadens
KLEKIFLIKDLYTEVMRKVK

SEQ ID NO: 3003714 - protein, 27 aa, Entamoeba invadens
KLEKIIFNYNIYLYDHLLFSGCVSLKE

SEQ ID NO: 3003715 - protein, 25 aa, Entamoeba invadens
KLELKKLVYLYLMNYSRSQPERAIL

SEQ ID NO: 3003716 - protein, 18 aa, Entamoeba invadens
KLELLSLPLPLVPQDVPM

SEQ ID NO: 3003717 - protein, 27 aa, Entamoeba invadens
KLEQEYDYLTFLKIGQTNVISDLNKII

SEQ ID NO: 3003718 - protein, 26 aa, Entamoeba invadens
KLERRDLIQIAPWKSITSITLTTASK

SEQ ID NO: 3003719 - protein, 27 aa, Entamoeba invadens
KLEVPSFLVLLHKLLFQKNPAVNYKQM

SEQ ID NO: 3003720 - protein, 19 aa, Entamoeba invadens
KLFCEKYKKQAKSEHWQIQ

SEQ ID NO: 3003721 - protein, 21 aa, Entamoeba invadens
KLFEPFSINLVFDMLSDPQFR

SEQ ID NO: 3003722 - protein, 19 aa, Entamoeba invadens
KLFHIDFGFIFGNTVPLKA

SEQ ID NO: 3003723 - protein, 17 aa, Entamoeba invadens
KLFIQVPKQVGEKRTIQ

SEQ ID NO: 3003724 - protein, 20 aa, Entamoeba invadens
KLFKTILELVPTESQTIVKD

SEQ ID NO: 3003725 - protein, 27 aa, Entamoeba invadens
KLFKTSEFILKMKKILYSLGVAFEFFD

SEQ ID NO: 3003726 - protein, 18 aa, Entamoeba invadens
KLFQLRERMWTKEGFELI

SEQ ID NO: 3003727 - protein, 21 aa, Entamoeba invadens
KLFQMFFENFEVPSIAIMNSA

SEQ ID NO: 3003728 - protein, 20 aa, Entamoeba invadens
KLFRVVVWFNVDCRTVSMNN

SEQ ID NO: 3003729 - protein, 17 aa, Entamoeba invadens
KLFTVVNAKIPLPKSAS

SEQ ID NO: 3003730 - protein, 21 aa, Entamoeba invadens
KLFVACMFFTQIVLSKVKIIN

SEQ ID NO: 3003731 - protein, 26 aa, Entamoeba invadens
KLFVIDINLFPSYHKKFSPSDLVTLL

SEQ ID NO: 3003732 - protein, 18 aa, Entamoeba invadens
KLFVLKSTFMYIVDLTNY

SEQ ID NO: 3003733 - protein, 18 aa, Entamoeba invadens
KLFVNPKIICLNIELELK

SEQ ID NO: 3003734 - protein, 18 aa, Entamoeba invadens
KLGDLLKKMLFQFKEIAQ

SEQ ID NO: 3003735 - protein, 20 aa, Entamoeba invadens
KLGDMLPRLLLLLQDEDTNI

SEQ ID NO: 3003736 - protein, 25 aa, Entamoeba invadens
KLGDVVVKLLLYKQVKGVFDQIKNT

SEQ ID NO: 3003737 - protein, 28 aa, Entamoeba invadens
KLGEALSLFIPMLNVYKLYVGNSDLSIN

SEQ ID NO: 3003738 - protein, 17 aa, Entamoeba invadens
KLGEGSFGIVYKGLYRG

SEQ ID NO: 3003739 - protein, 17 aa, Entamoeba invadens
KLGEGSFGIVYKGSYRG

SEQ ID NO: 3003740 - protein, 27 aa, Entamoeba invadens
KLGEWSLNMLVLLWFHICRNEVTVTQN

SEQ ID NO: 3003741 - protein, 20 aa, Entamoeba invadens
KLGGKKKPPMWSREYSVMTS

SEQ ID NO: 3003742 - protein, 25 aa, Entamoeba invadens
KLGIKHVRGILLYGPPGCGKTLMAR

SEQ ID NO: 3003743 - protein, 22 aa, Entamoeba invadens
KLGINITPLFDTLVKQNQLEVL

SEQ ID NO: 3003744 - protein, 17 aa, Entamoeba invadens
KLGKKEWIIYASLRDVE

SEQ ID NO: 3003745 - protein, 24 aa, Entamoeba invadens
KLGTLPVFKQQFIDPIKFGSYTSA

SEQ ID NO: 3003746 - protein, 21 aa, Entamoeba invadens
KLGTTWFNNGNILIKIGDVFE

SEQ ID NO: 3003747 - protein, 23 aa, Entamoeba invadens
KLGVKSFYKILTKQQIKDWETSY

SEQ ID NO: 3003748 - protein, 19 aa, Entamoeba invadens
KLHEESVLLTGLHPCGDLT

SEQ ID NO: 3003749 - protein, 18 aa, Entamoeba invadens
KLHEYWSKVIQYFSQYFT

SEQ ID NO: 3003750 - protein, 21 aa, Entamoeba invadens
KLHKFEIAVKQRKADFERVKK

SEQ ID NO: 3003751 - protein, 26 aa, Entamoeba invadens
KLHKTTLLTFYLKTDAAKLALRSYCI

SEQ ID NO: 3003752 - protein, 23 aa, Entamoeba invadens
KLHLFGPLTYFELPTPKKTETDE

SEQ ID NO: 3003753 - protein, 29 aa, Entamoeba invadens
KLHLRTEWQSLLQDVLLLTAITKQHTKDI

SEQ ID NO: 3003754 - protein, 30 aa, Entamoeba invadens
KLHLRTEWQSLLQDVLLLTAITKQHTKDIP

SEQ ID NO: 3003755 - protein, 19 aa, Entamoeba invadens
KLHMMIIHAIVRMTYPVDH

SEQ ID NO: 3003756 - protein, 20 aa, Entamoeba invadens
KLHMRILPLVAHAIVDLSLY

SEQ ID NO: 3003757 - protein, 23 aa, Entamoeba invadens
KLHPPQHVLFLGKALLENNHYIP

SEQ ID NO: 3003758 - protein, 19 aa, Entamoeba invadens
KLHRLPQVKVPKTLEEVLP

SEQ ID NO: 3003759 - protein, 20 aa, Entamoeba invadens
KLHSPYKSIVTHAPANKQLT

SEQ ID NO: 3003760 - protein, 18 aa, Entamoeba invadens
KLHYLLNSQKSKTLTSSE

SEQ ID NO: 3003761 - protein, 17 aa, Entamoeba invadens
KLIAFVCDETLKALTFL

SEQ ID NO: 3003762 - protein, 20 aa, Entamoeba invadens
KLIALYIQICGVFPKSPDVL

SEQ ID NO: 3003763 - protein, 25 aa, Entamoeba invadens
KLIDKKYRVCDLYKLLIQFDDKNSD

SEQ ID NO: 3003764 - protein, 25 aa, Entamoeba invadens
KLIENKLLVDISPIKDLGGILRASS

SEQ ID NO: 3003765 - protein, 28 aa, Entamoeba invadens
KLIFFENLETLILWPENNFLAFKHLTSY

SEQ ID NO: 3003766 - protein, 28 aa, Entamoeba invadens
KLIFFENLETLILWPQNNFLAFKHLTSY

SEQ ID NO: 3003767 - protein, 19 aa, Entamoeba invadens
KLIFPKTKKENSYHKCITV

SEQ ID NO: 3003768 - protein, 24 aa, Entamoeba invadens
KLIGGVFYDFFPRKGKRGGACQEI

SEQ ID NO: 3003769 - protein, 18 aa, Entamoeba invadens
KLIIMERGPFDSVGLFTR

SEQ ID NO: 3003770 - protein, 22 aa, Entamoeba invadens
KLIISIFKSLFSTSPFFVGKFR

SEQ ID NO: 3003771 - protein, 22 aa, Entamoeba invadens
KLIKNYEMFLYNFQVFVHKNLN

SEQ ID NO: 3003772 - protein, 18 aa, Entamoeba invadens
KLILKYINNMGLELDFSC

SEQ ID NO: 3003773 - protein, 17 aa, Entamoeba invadens
KLILPTTLSEIRGFDWC

SEQ ID NO: 3003774 - protein, 25 aa, Entamoeba invadens
KLINQLIKVVFPFASTKSNMFKRTV

SEQ ID NO: 3003775 - protein, 28 aa, Entamoeba invadens
KLIPEPTAAFYFYGIQKHAFNIENDITK

SEQ ID NO: 3003776 - protein, 28 aa, Entamoeba invadens
KLIPKEAIPMFFLWDDALDAKGDDEKVQ

SEQ ID NO: 3003777 - protein, 20 aa, Entamoeba invadens
KLIQDCEVVTLPVVRNLLIG

SEQ ID NO: 3003778 - protein, 21 aa, Entamoeba invadens
KLIQMLNKGIKFHKAKNYLQK

SEQ ID NO: 3003779 - protein, 17 aa, Entamoeba invadens
KLIQSKFPPYRYEQFLI

SEQ ID NO: 3003780 - protein, 17 aa, Entamoeba invadens
KLITSLSCGIPSTVGCV

SEQ ID NO: 3003781 - protein, 20 aa, Entamoeba invadens
KLIVKIHTKLPRGGILVFLT

SEQ ID NO: 3003782 - protein, 18 aa, Entamoeba invadens
KLIVLTIPKKSILTRFNS

SEQ ID NO: 3003783 - protein, 22 aa, Entamoeba invadens
KLKAKVLLDLYFKSAPPNEMDE

SEQ ID NO: 3003784 - protein, 20 aa, Entamoeba invadens
KLKCDSVKIFWRLSKEEIIS

SEQ ID NO: 3003785 - protein, 27 aa, Entamoeba invadens
KLKDYIKIVQICDKLWNLSGNAVTFNQ

SEQ ID NO: 3003786 - protein, 27 aa, Entamoeba invadens
KLKENPPPLLFLSFHTEVYDKSDDMSV

SEQ ID NO: 3003787 - protein, 22 aa, Entamoeba invadens
KLKFVLMVYKSAENDIFTARDM

SEQ ID NO: 3003788 - protein, 28 aa, Entamoeba invadens
KLKHITPLINCLPVFKLNFSENEIVEIP

SEQ ID NO: 3003789 - protein, 17 aa, Entamoeba invadens
KLKHTNMIFVDMADSLT

SEQ ID NO: 3003790 - protein, 23 aa, Entamoeba invadens
KLKIGYNTSIFKKGNYACIAEMI

SEQ ID NO: 3003791 - protein, 29 aa, Entamoeba invadens
KLKIINDWLQTANLLYPVAYQRVEDLISN

SEQ ID NO: 3003792 - protein, 34 aa, Entamoeba invadens
KLKIKFSELVSVYYLLESPILPLQINDLIIEGWL

SEQ ID NO: 3003793 - protein, 21 aa, Entamoeba invadens
KLKKFQYTSYLCTDKLTENAL

SEQ ID NO: 3003794 - protein, 26 aa, Entamoeba invadens
KLKLLSLLDCHAITSPSPRVRSSSLG

SEQ ID NO: 3003795 - protein, 28 aa, Entamoeba invadens
KLKLMQDKILNFYYSKGRQLPWRETTDK

SEQ ID NO: 3003796 - protein, 31 aa, Entamoeba invadens
KLKLNLSTLGSPMFDLIKTPTPLSRPSFFVK

SEQ ID NO: 3003797 - protein, 19 aa, Entamoeba invadens
KLKNLPLLDKSGLTHLDVA

SEQ ID NO: 3003798 - protein, 21 aa, Entamoeba invadens
KLKNSITEILFKLPGKTTVVT

SEQ ID NO: 3003799 - protein, 17 aa, Entamoeba invadens
KLKNTGGLRRKSFSQQF

SEQ ID NO: 3003800 - protein, 17 aa, Entamoeba invadens
KLKPEHFIVLFNKLTTV

SEQ ID NO: 3003801 - protein, 21 aa, Entamoeba invadens
KLKPEVLLSLISYLVYDMSTD

SEQ ID NO: 3003802 - protein, 23 aa, Entamoeba invadens
KLKRKEAWKQSRKARKAEWKKRQ

SEQ ID NO: 3003803 - protein, 17 aa, Entamoeba invadens
KLKSFAEDLLKTLRTIS

SEQ ID NO: 3003804 - protein, 18 aa, Entamoeba invadens
KLKSIIIPPKIRSISSGC

SEQ ID NO: 3003805 - protein, 19 aa, Entamoeba invadens
KLKSKLFEPFSINLVFDML

SEQ ID NO: 3003806 - protein, 25 aa, Entamoeba invadens
KLKTKQLPLSLWEKVIQLETKFCST

SEQ ID NO: 3003807 - protein, 20 aa, Entamoeba invadens
KLKYYIELPGKVGAKREDVV

SEQ ID NO: 3003808 - protein, 19 aa, Entamoeba invadens
KLLCYDLCNSGYDTVDTFY

SEQ ID NO: 3003809 - protein, 24 aa, Entamoeba invadens
KLLDTPFCVFPILDVLEVYQDTKQ

SEQ ID NO: 3003810 - protein, 17 aa, Entamoeba invadens
KLLFAYSKALLARSDYN

SEQ ID NO: 3003811 - protein, 18 aa, Entamoeba invadens
KLLGFYSTMDSTIACSAF

SEQ ID NO: 3003812 - protein, 18 aa, Entamoeba invadens
KLLHFKRVEIVTEDFSLL

SEQ ID NO: 3003813 - protein, 20 aa, Entamoeba invadens
KLLHPQNFLTGNIAPFPNVS

SEQ ID NO: 3003814 - protein, 18 aa, Entamoeba invadens
KLLKIEIPTTITSLGLCC

SEQ ID NO: 3003815 - protein, 23 aa, Entamoeba invadens
KLLKKTLRILVSDQFPLIMDNLK

SEQ ID NO: 3003816 - protein, 29 aa, Entamoeba invadens
KLLKYDEEYTWVFPPTKASGFFIGPFIME

SEQ ID NO: 3003817 - protein, 25 aa, Entamoeba invadens
KLLLKNCFFEKYRLLQYIGKGSFGS

SEQ ID NO: 3003818 - protein, 31 aa, Entamoeba invadens
KLLLTPYEKNIEFWRQLWRTCEQSDLVLQIV

SEQ ID NO: 3003819 - protein, 32 aa, Entamoeba invadens
KLLMLEESWWYYIDVYRLLYPELPPSEFSDFV

SEQ ID NO: 3003820 - protein, 21 aa, Entamoeba invadens
KLLNLLDRKYYKEALIKVVVE

SEQ ID NO: 3003821 - protein, 20 aa, Entamoeba invadens
KLLNLPLNDDSLLGLSLSAE

SEQ ID NO: 3003822 - protein, 19 aa, Entamoeba invadens
KLLNYMMVSPMYSPLNPHL

SEQ ID NO: 3003823 - protein, 19 aa, Entamoeba invadens
KLLSIVRGLAEQYPSMLIF

SEQ ID NO: 3003824 - protein, 22 aa, Entamoeba invadens
KLLSKLTFPRRFKLGKDAEKRV

SEQ ID NO: 3003825 - protein, 19 aa, Entamoeba invadens
KLLSTSWKLSKEQGVFRVG

SEQ ID NO: 3003826 - protein, 19 aa, Entamoeba invadens
KLLVVPFEQFGCLANPACM

SEQ ID NO: 3003827 - protein, 17 aa, Entamoeba invadens
KLMELLIRYGGDIGKMY

SEQ ID NO: 3003828 - protein, 31 aa, Entamoeba invadens
KLMERMGVSTVLFLVGQILLERKFVFVGDEL

SEQ ID NO: 3003829 - protein, 20 aa, Entamoeba invadens
KLMFSQLMREMTQHLFNIRN

SEQ ID NO: 3003830 - protein, 20 aa, Entamoeba invadens
KLMHLMLKQSVPTMTVDVDQ

SEQ ID NO: 3003831 - protein, 17 aa, Entamoeba invadens
KLMISGNYNLAVMLPPV

SEQ ID NO: 3003832 - protein, 25 aa, Entamoeba invadens
KLMITNSRIWGCSKAGLHCGGKDTR

SEQ ID NO: 3003833 - protein, 21 aa, Entamoeba invadens
KLMTSVEVTFYMQKPENVKAE

SEQ ID NO: 3003834 - protein, 25 aa, Entamoeba invadens
KLNASLKRKIAMKDWQRRNLQRQKA

SEQ ID NO: 3003835 - protein, 20 aa, Entamoeba invadens
KLNEILIQKIVKEKKCVFAA

SEQ ID NO: 3003836 - protein, 19 aa, Entamoeba invadens
KLNELQLIFGRKSTIIGQY

SEQ ID NO: 3003837 - protein, 25 aa, Entamoeba invadens
KLNFHYQTYHHVQFCPVCINQQKSF

SEQ ID NO: 3003838 - protein, 23 aa, Entamoeba invadens
KLNILCEKMWYLELDTNNGIISQ

SEQ ID NO: 3003839 - protein, 26 aa, Entamoeba invadens
KLNNSMMLLFLFQKGKYTYGAFVAED

SEQ ID NO: 3003840 - protein, 18 aa, Entamoeba invadens
KLNPVLANPLFSSLVSIF

SEQ ID NO: 3003841 - protein, 29 aa, Entamoeba invadens
KLNRTLSEIPAYHKILLTGTPIQNNTDEL

SEQ ID NO: 3003842 - protein, 25 aa, Entamoeba invadens
KLNSSWFAKLGMWHKALTKLEDEGG

SEQ ID NO: 3003843 - protein, 23 aa, Entamoeba invadens
KLNVDNFVRYWMNLDYPRVDDTP

SEQ ID NO: 3003844 - protein, 30 aa, Entamoeba invadens
KLNVIVADRIFDLVTPLLTEFTYQAMVYDT

SEQ ID NO: 3003845 - protein, 20 aa, Entamoeba invadens
KLNVYTPTPQVIFSKSPPSP

SEQ ID NO: 3003846 - protein, 19 aa, Entamoeba invadens
KLNWDVRSVLLIFGELNFK

SEQ ID NO: 3003847 - protein, 25 aa, Entamoeba invadens
KLPDTFSVPIKKRKPHRRTSSVEVS

SEQ ID NO: 3003848 - protein, 19 aa, Entamoeba invadens
KLPFYKKSYLLHFKVDFYQ

SEQ ID NO: 3003849 - protein, 30 aa, Entamoeba invadens
KLPKDKLFSTSFFYTIIKRAVSQYTTKKIA

SEQ ID NO: 3003850 - protein, 27 aa, Entamoeba invadens
KLPKTSILRYLGILLYMGAHHDVINPV

SEQ ID NO: 3003851 - protein, 19 aa, Entamoeba invadens
KLPKYWGISSRRKKYHGHY

SEQ ID NO: 3003852 - protein, 17 aa, Entamoeba invadens
KLPLFEENEYKIIQLIN

SEQ ID NO: 3003853 - protein, 20 aa, Entamoeba invadens
KLPLGKIKILEQPTTCPLCH

SEQ ID NO: 3003854 - protein, 20 aa, Entamoeba invadens
KLPLHFMRQEIDAEKLYKIF

SEQ ID NO: 3003855 - protein, 20 aa, Entamoeba invadens
KLPMFYHYKNKVCMIKYVRY

SEQ ID NO: 3003856 - protein, 22 aa, Entamoeba invadens
KLPQDILEKCNTSGVPIVSVDW

SEQ ID NO: 3003857 - protein, 19 aa, Entamoeba invadens
KLPRIVYNSDESLLSWMFV

SEQ ID NO: 3003858 - protein, 22 aa, Entamoeba invadens
KLPRNLKKLFKPLPQMGNVEAD

SEQ ID NO: 3003859 - protein, 24 aa, Entamoeba invadens
KLPSSPRLLPAYLTKQTTQPIKSS

SEQ ID NO: 3003860 - protein, 22 aa, Entamoeba invadens
KLPTSLVELTLYGSSKAVNVND

SEQ ID NO: 3003861 - protein, 20 aa, Entamoeba invadens
KLQDQYDQLINLVSGHEDET

SEQ ID NO: 3003862 - protein, 25 aa, Entamoeba invadens
KLQEVDATLLFLQSKEVPSMIKAAA

SEQ ID NO: 3003863 - protein, 17 aa, Entamoeba invadens
KLQIDIPGSLIDLTQIP

SEQ ID NO: 3003864 - protein, 19 aa, Entamoeba invadens
KLQKFTTINPKLITEAVQV

SEQ ID NO: 3003865 - protein, 20 aa, Entamoeba invadens
KLQKLVIVKAFSTFQKMLFT

SEQ ID NO: 3003866 - protein, 21 aa, Entamoeba invadens
KLQKTFKKLQFYVEPEMSFVQ

SEQ ID NO: 3003867 - protein, 28 aa, Entamoeba invadens
KLQLDYLDLYLIHWPVSIKVGATFPMKK

SEQ ID NO: 3003868 - protein, 26 aa, Entamoeba invadens
KLQNLNCVFDYLKDEKLNLTSSAEDI

SEQ ID NO: 3003869 - protein, 20 aa, Entamoeba invadens
KLQPKDFYLYTFPTSREESN

SEQ ID NO: 3003870 - protein, 22 aa, Entamoeba invadens
KLQQPPVIFYNTTNVHLIKSYS

SEQ ID NO: 3003871 - protein, 24 aa, Entamoeba invadens
KLQSIELLYVIMIFQECSAVRGAI

SEQ ID NO: 3003872 - protein, 25 aa, Entamoeba invadens
KLQTKREWLSTQLFPPYFGAEIHNF

SEQ ID NO: 3003873 - protein, 23 aa, Entamoeba invadens
KLQTYYCSKLYNPPKKQFANEIP

SEQ ID NO: 3003874 - protein, 17 aa, Entamoeba invadens
KLQWRMQLCDVLDVSDD

SEQ ID NO: 3003875 - protein, 22 aa, Entamoeba invadens
KLQYEYDQFINLVFGHEDETNN

SEQ ID NO: 3003876 - protein, 19 aa, Entamoeba invadens
KLRDDTDDEFKRIEKKLVF

SEQ ID NO: 3003877 - protein, 21 aa, Entamoeba invadens
KLRDGVLEHLIPYLVQKSKTN

SEQ ID NO: 3003878 - protein, 27 aa, Entamoeba invadens
KLREESPAYFLWKSFVQPEDASFVNKF

SEQ ID NO: 3003879 - protein, 17 aa, Entamoeba invadens
KLREGSFGIVFKGTYRG

SEQ ID NO: 3003880 - protein, 18 aa, Entamoeba invadens
KLREIVVDLKYNYFNADV

SEQ ID NO: 3003881 - protein, 31 aa, Entamoeba invadens
KLRELFNMFFKVEFFERVWSKTTPEDDVSEH

SEQ ID NO: 3003882 - protein, 19 aa, Entamoeba invadens
KLRENSFESFELLENQLFL

SEQ ID NO: 3003883 - protein, 24 aa, Entamoeba invadens
KLRGAIPFDPKVFAKNLWGDFAFD

SEQ ID NO: 3003884 - protein, 18 aa, Entamoeba invadens
KLRGLTSYIFYLIDNNHN

SEQ ID NO: 3003885 - protein, 18 aa, Entamoeba invadens
KLRIDSCPIFTLSSLANL

SEQ ID NO: 3003886 - protein, 17 aa, Entamoeba invadens
KLRIIRDLCLPFVKTNE

SEQ ID NO: 3003887 - protein, 20 aa, Entamoeba invadens
KLRKLVFPASIIFHDEMVDY

SEQ ID NO: 3003888 - protein, 18 aa, Entamoeba invadens
KLRKLVFPTSYTKYDRLN

SEQ ID NO: 3003889 - protein, 17 aa, Entamoeba invadens
KLRLVQYRQHQAELLQK

SEQ ID NO: 3003890 - protein, 27 aa, Entamoeba invadens
KLRSKVWQILLGYLPPNQLTWGEVIQQ

SEQ ID NO: 3003891 - protein, 17 aa, Entamoeba invadens
KLRTKFVLDASKGILYF

SEQ ID NO: 3003892 - protein, 17 aa, Entamoeba invadens
KLRTQKALPKTFEFIEY

SEQ ID NO: 3003893 - protein, 20 aa, Entamoeba invadens
KLRVKMCLDAIKGIVYLHTN

SEQ ID NO: 3003894 - protein, 19 aa, Entamoeba invadens
KLSALTLPNFNGKLTFAIN

SEQ ID NO: 3003895 - protein, 37 aa, Entamoeba invadens
KLSDEDLMFILEFFVSKVDFINFLCVTKKYLKIPEKY

SEQ ID NO: 3003896 - protein, 25 aa, Entamoeba invadens
KLSDLAVNILPLWVTFMKDQKEWDL

SEQ ID NO: 3003897 - protein, 24 aa, Entamoeba invadens
KLSEKKLCDDLEAQKVLNNTLEND

SEQ ID NO: 3003898 - protein, 22 aa, Entamoeba invadens
KLSERFYLRQDGTRIYFFSLEE

SEQ ID NO: 3003899 - protein, 26 aa, Entamoeba invadens
KLSEVVGLLDMLICFVTYASSHDLMC

SEQ ID NO: 3003900 - protein, 18 aa, Entamoeba invadens
KLSGWFKNDTLVTKDIPK

SEQ ID NO: 3003901 - protein, 20 aa, Entamoeba invadens
KLSIELPKKRLFRNYDVTIT

SEQ ID NO: 3003902 - protein, 23 aa, Entamoeba invadens
KLSKLFATTILIVKCKKLEVSIS

SEQ ID NO: 3003903 - protein, 18 aa, Entamoeba invadens
KLSKLKLPNFNKKLLFQI

SEQ ID NO: 3003904 - protein, 32 aa, Entamoeba invadens
KLSLKSPIEKILLFFPNIETLYFNSYSTRMKK

SEQ ID NO: 3003905 - protein, 17 aa, Entamoeba invadens
KLSLKYNVLSKYTTFVA

SEQ ID NO: 3003906 - protein, 17 aa, Entamoeba invadens
KLSMWPKYNTYVADERY

SEQ ID NO: 3003907 - protein, 21 aa, Entamoeba invadens
KLSNTFHWNYGFDSTFTSLIL

SEQ ID NO: 3003908 - protein, 21 aa, Entamoeba invadens
KLSNYIDLLISITANTVCADC

SEQ ID NO: 3003909 - protein, 18 aa, Entamoeba invadens
KLSPIAFLNCEKLHEIYL

SEQ ID NO: 3003910 - protein, 21 aa, Entamoeba invadens
KLSPLITPRTIALGGQLLLST

SEQ ID NO: 3003911 - protein, 23 aa, Entamoeba invadens
KLSSIRLLLIPSYNIKISNFELK

SEQ ID NO: 3003912 - protein, 23 aa, Entamoeba invadens
KLSSIRLLYIPSYNIKISNFELK

SEQ ID NO: 3003913 - protein, 21 aa, Entamoeba invadens
KLSSVFMAFSPTDLKMLSPEH

SEQ ID NO: 3003914 - protein, 29 aa, Entamoeba invadens
KLSWESHCRVYFLLIPSKKFEVSPENYTK

SEQ ID NO: 3003915 - protein, 22 aa, Entamoeba invadens
KLTALDLFQCFYHAGVSFPSSL

SEQ ID NO: 3003916 - protein, 21 aa, Entamoeba invadens
KLTHWPVIFEEAKKFIEWEGL

SEQ ID NO: 3003917 - protein, 30 aa, Entamoeba invadens
KLTKHSQPFIKIKKLMILNDDKWSLEIDTI

SEQ ID NO: 3003918 - protein, 19 aa, Entamoeba invadens
KLTKQFNRILKRDKIYEVC

SEQ ID NO: 3003919 - protein, 20 aa, Entamoeba invadens
KLTKRFVGGYIIGLRDRHLE

SEQ ID NO: 3003920 - protein, 22 aa, Entamoeba invadens
KLTNTCFLITKKLTIIETNGVG

SEQ ID NO: 3003921 - protein, 26 aa, Entamoeba invadens
KLTVPVNYNIPLVLPKTLKGLQFPTD

SEQ ID NO: 3003922 - protein, 21 aa, Entamoeba invadens
KLTVSLLNLMKQIGGLCETLD

SEQ ID NO: 3003923 - protein, 25 aa, Entamoeba invadens
KLVDESFLFWDKQLKFVKRIGTLSE

SEQ ID NO: 3003924 - protein, 19 aa, Entamoeba invadens
KLVDGVGTEYVKYLKYADS

SEQ ID NO: 3003925 - protein, 21 aa, Entamoeba invadens
KLVEIVNILLPTFSTSVSVER

SEQ ID NO: 3003926 - protein, 25 aa, Entamoeba invadens
KLVESFTDWKFVDAVPYFATQTNCK

SEQ ID NO: 3003927 - protein, 21 aa, Entamoeba invadens
KLVEVIPESFFFQIKDVYIDE

SEQ ID NO: 3003928 - protein, 21 aa, Entamoeba invadens
KLVGYRFIRFTNEMDARNFIE

SEQ ID NO: 3003929 - protein, 20 aa, Entamoeba invadens
KLVKLPKGLITIELPEFQKV

SEQ ID NO: 3003930 - protein, 27 aa, Entamoeba invadens
KLVKYKKLAFEFPSKYFSDAVTNDINN

SEQ ID NO: 3003931 - protein, 17 aa, Entamoeba invadens
KLVLPLEGSKRSVITDL

SEQ ID NO: 3003932 - protein, 31 aa, Entamoeba invadens
KLVLREATRLLNLLMFNALTSKTQDLCNTQT

SEQ ID NO: 3003933 - protein, 30 aa, Entamoeba invadens
KLVLTRYYPHAIIDIQYKYLQSLLTLYVGN

SEQ ID NO: 3003934 - protein, 17 aa, Entamoeba invadens
KLVLYFANALEKENTED

SEQ ID NO: 3003935 - protein, 19 aa, Entamoeba invadens
KLVNFFRVRMYGLMLKEIV

SEQ ID NO: 3003936 - protein, 24 aa, Entamoeba invadens
KLVNKDLLVFISSKLKSPSESLAL

SEQ ID NO: 3003937 - protein, 18 aa, Entamoeba invadens
KLVSYSCYYNGCTVPNCE

SEQ ID NO: 3003938 - protein, 23 aa, Entamoeba invadens
KLVVPHNVGFLSLKNLKLTALEI

SEQ ID NO: 3003939 - protein, 20 aa, Entamoeba invadens
KLVYKKKFESVKVAAALAFN

SEQ ID NO: 3003940 - protein, 20 aa, Entamoeba invadens
KLVYLCVFAGCDYCKSLRGV

SEQ ID NO: 3003941 - protein, 23 aa, Entamoeba invadens
KLWDEFITFPDTTLYVYCIVGYL

SEQ ID NO: 3003942 - protein, 20 aa, Entamoeba invadens
KLYDQFSGGMWKLTDEQKKR

SEQ ID NO: 3003943 - protein, 18 aa, Entamoeba invadens
KLYELWRFKDSMQDNEVL

SEQ ID NO: 3003944 - protein, 22 aa, Entamoeba invadens
KLYKQILHCAEALPVQAFTPVE

SEQ ID NO: 3003945 - protein, 19 aa, Entamoeba invadens
KLYNNKFFLDVQKYTNFNV

SEQ ID NO: 3003946 - protein, 18 aa, Entamoeba invadens
KLYNTLITLKACGQIKVI

SEQ ID NO: 3003947 - protein, 20 aa, Entamoeba invadens
KLYYRNLNHKMIFDFKTNFD

SEQ ID NO: 3003948 - protein, 17 aa, Entamoeba invadens
KLYYVDDLRFLSTLSLI

SEQ ID NO: 3003949 - protein, 26 aa, Entamoeba invadens
KMAVNSGYWSLYRYDPRLVQEGKAGL

SEQ ID NO: 3003950 - protein, 28 aa, Entamoeba invadens
KMAVRTFYNFFLYINKSVDIKIQRKLFK

SEQ ID NO: 3003951 - protein, 27 aa, Entamoeba invadens
KMCEGSMMGIIWVEKACVKCALENNFE

SEQ ID NO: 3003952 - protein, 25 aa, Entamoeba invadens
KMCSKALFDAGFLLAKKLKEIMETD

SEQ ID NO: 3003953 - protein, 24 aa, Entamoeba invadens
KMDDGIIEIFYIKGSLEMGSVSVG

SEQ ID NO: 3003954 - protein, 27 aa, Entamoeba invadens
KMDESDKTLIFVYRPLEKNEDEVKEFL

SEQ ID NO: 3003955 - protein, 28 aa, Entamoeba invadens
KMDGTRVLFLPQLPAALQIVLGPNLTPE

SEQ ID NO: 3003956 - protein, 25 aa, Entamoeba invadens
KMDHSTLTVLVLNDGLFNRCQVEPL

SEQ ID NO: 3003957 - protein, 23 aa, Entamoeba invadens
KMDRPKILLFEYGKNKSTLVGSL

SEQ ID NO: 3003958 - protein, 30 aa, Entamoeba invadens
KMEDWEIRQALRRLGLKTVGTLADQKRRLE

SEQ ID NO: 3003959 - protein, 37 aa, Entamoeba invadens
KMEETPSTFFGFGASGSTPFFNFQKTPQSVEFGSACM

SEQ ID NO: 3003960 - protein, 18 aa, Entamoeba invadens
KMEEVFEADWWFGKITMN

SEQ ID NO: 3003961 - protein, 19 aa, Entamoeba invadens
KMEFVIYKVSRFGKKPTAI

SEQ ID NO: 3003962 - protein, 23 aa, Entamoeba invadens
KMEKRMLELLKYWLEKSPDCCAP

SEQ ID NO: 3003963 - protein, 31 aa, Entamoeba invadens
KMELTGNFALNLKVLVIYSTLTLNGGVVTIN

SEQ ID NO: 3003964 - protein, 30 aa, Entamoeba invadens
KMFAEQLFALDLWLMKKLTIFDFLSKSKEF

SEQ ID NO: 3003965 - protein, 20 aa, Entamoeba invadens
KMFGFVLGNARYKAFQVTDY

SEQ ID NO: 3003966 - protein, 17 aa, Entamoeba invadens
KMFKIRDSIRGYEGELI

SEQ ID NO: 3003967 - protein, 23 aa, Entamoeba invadens
KMFLGRRKLAQTPWFKFANNPRY

SEQ ID NO: 3003968 - protein, 17 aa, Entamoeba invadens
KMFQTIYDSLKLPEVGS

SEQ ID NO: 3003969 - protein, 25 aa, Entamoeba invadens
KMFSEYFVRLVAMYNSLGIVIEENT

SEQ ID NO: 3003970 - protein, 22 aa, Entamoeba invadens
KMFSMACILRRKAKIQRNFYLF

SEQ ID NO: 3003971 - protein, 17 aa, Entamoeba invadens
KMFVYNPAKRITAAQAL

SEQ ID NO: 3003972 - protein, 34 aa, Entamoeba invadens
KMGCCIDLLAPLFTFVGYQLDLPMNIKAKIVFGA

SEQ ID NO: 3003973 - protein, 21 aa, Entamoeba invadens
KMGGLRPTWEIAYYSWEEAVL

SEQ ID NO: 3003974 - protein, 35 aa, Entamoeba invadens
KMGQIMFENYKIPSLFVLPSTFLTVLGNGLECGIC

SEQ ID NO: 3003975 - protein, 25 aa, Entamoeba invadens
KMGWDDFLKSYLAPIRMKVMGFVRS

SEQ ID NO: 3003976 - protein, 19 aa, Entamoeba invadens
KMGYYTMLSLFTVGSRRGK

SEQ ID NO: 3003977 - protein, 27 aa, Entamoeba invadens
KMHITQNFFCYVPIFVKGNISIRISDL

SEQ ID NO: 3003978 - protein, 19 aa, Entamoeba invadens
KMHLYTLKPIVRTAVTLPQ

SEQ ID NO: 3003979 - protein, 28 aa, Entamoeba invadens
KMHTETWILMVLWYGGDPSKFTDYENMK

SEQ ID NO: 3003980 - protein, 25 aa, Entamoeba invadens
KMIDLKITVIFLFDEFFDLSESLKI

SEQ ID NO: 3003981 - protein, 17 aa, Entamoeba invadens
KMIGREAFYGCQQLTNF

SEQ ID NO: 3003982 - protein, 17 aa, Entamoeba invadens
KMIKYAVYVLPDSVPME

SEQ ID NO: 3003983 - protein, 22 aa, Entamoeba invadens
KMINRLFICAICDEKYFRNDKG

SEQ ID NO: 3003984 - protein, 21 aa, Entamoeba invadens
KMINRLFICAICDQKYFRNDK

SEQ ID NO: 3003985 - protein, 33 aa, Entamoeba invadens
KMKEKFIKMINEKDRLTMYVTQKDDQLQEASVK

SEQ ID NO: 3003986 - protein, 31 aa, Entamoeba invadens
KMKEQVYPTLPYEYAMRALNKFKLDDFNLSR

SEQ ID NO: 3003987 - protein, 29 aa, Entamoeba invadens
KMKERLDYIITTYAQFLGPLPKAEIDLIK

SEQ ID NO: 3003988 - protein, 27 aa, Entamoeba invadens
KMKETKIAFLFYLFKVSVDEFLEANEY

SEQ ID NO: 3003989 - protein, 17 aa, Entamoeba invadens
KMKIIIDASKRILHLHE

SEQ ID NO: 3003990 - protein, 18 aa, Entamoeba invadens
KMKITVGAPFRGIVKKIM

SEQ ID NO: 3003991 - protein, 24 aa, Entamoeba invadens
KMKKMFKLLLEYSVFAKNENVKIA

SEQ ID NO: 3003992 - protein, 18 aa, Entamoeba invadens
KMKLLAHKLMELGIKMDN

SEQ ID NO: 3003993 - protein, 30 aa, Entamoeba invadens
KMKNSLYEVAPCDAVFTLKKRHFIQEGELN

SEQ ID NO: 3003994 - protein, 29 aa, Entamoeba invadens
KMKPFQIDALNWLIRRHHLGVNSILADEM

SEQ ID NO: 3003995 - protein, 30 aa, Entamoeba invadens
KMKSQFYVTYWMLLNWLTSGSDDVSEKMIK

SEQ ID NO: 3003996 - protein, 25 aa, Entamoeba invadens
KMKTKKFCMYTLMGSSIEILSSELL

SEQ ID NO: 3003997 - protein, 26 aa, Entamoeba invadens
KMKTTKLCIIILKSLKEMHPDVEFFS

SEQ ID NO: 3003998 - protein, 17 aa, Entamoeba invadens
KMLCCQIVPNRYTLLDY

SEQ ID NO: 3003999 - protein, 22 aa, Entamoeba invadens
KMLDRVLWFYNTCVIKRVLQSA

SEQ ID NO: 3004000 - protein, 17 aa, Entamoeba invadens
KMLFEVFGRFEFDFSKL

SEQ ID NO: 3004001 - protein, 20 aa, Entamoeba invadens
KMLFNGKLHIDTMKKFGVNS

SEQ ID NO: 3004002 - protein, 20 aa, Entamoeba invadens
KMLLRLHEIFFEKLTEKYEE

SEQ ID NO: 3004003 - protein, 20 aa, Entamoeba invadens
KMLPPRPEYTKGKKFRVLSL

SEQ ID NO: 3004004 - protein, 18 aa, Entamoeba invadens
KMLQFNWKNQISLKKSRI

SEQ ID NO: 3004005 - protein, 17 aa, Entamoeba invadens
KMMALEYAPAVRVNAVC

SEQ ID NO: 3004006 - protein, 36 aa, Entamoeba invadens
KMMATFSKLLPLNIIGKCVLLIYKDLHQVPTSKCIT

SEQ ID NO: 3004007 - protein, 21 aa, Entamoeba invadens
KMMFNILQECDKYLALKAKGV

SEQ ID NO: 3004008 - protein, 18 aa, Entamoeba invadens
KMMKLFGTSIFKERVHEL

SEQ ID NO: 3004009 - protein, 27 aa, Entamoeba invadens
KMMRIVQTWGVLFPKQLFDYTNMYMKY

SEQ ID NO: 3004010 - protein, 27 aa, Entamoeba invadens
KMMTKTYTDLILPKVTRLSLVKLDKQF

SEQ ID NO: 3004011 - protein, 18 aa, Entamoeba invadens
KMNATAHKVRLIGLTGPQ

SEQ ID NO: 3004012 - protein, 23 aa, Entamoeba invadens
KMNKSLKLLLAALRKSEGLFREM

SEQ ID NO: 3004013 - protein, 22 aa, Entamoeba invadens
KMNNQMCIFSYTPDSDLLKEKT

SEQ ID NO: 3004014 - protein, 18 aa, Entamoeba invadens
KMNQIVKLLILNVNCKKC

SEQ ID NO: 3004015 - protein, 20 aa, Entamoeba invadens
KMPCDIYSLAISFFEIIGWA

SEQ ID NO: 3004016 - protein, 37 aa, Entamoeba invadens
KMQHGFILNNGYFMPAIGLGTWLAKPGEVGAAVQLSL

SEQ ID NO: 3004017 - protein, 22 aa, Entamoeba invadens
KMQKRVFSLTLPSTLKTLEIGE

SEQ ID NO: 3004018 - protein, 17 aa, Entamoeba invadens
KMQQLVVDLMMSSSFPA

SEQ ID NO: 3004019 - protein, 18 aa, Entamoeba invadens
KMQSIVAKRESCEKMMQS

SEQ ID NO: 3004020 - protein, 19 aa, Entamoeba invadens
KMRNDSIITTLFAGQFKSN

SEQ ID NO: 3004021 - protein, 18 aa, Entamoeba invadens
KMRPKTVGCIDYQILYDA

SEQ ID NO: 3004022 - protein, 23 aa, Entamoeba invadens
KMRQLIELPPKFFSDQLFEFQQA

SEQ ID NO: 3004023 - protein, 29 aa, Entamoeba invadens
KMRVTFRVQHQPVLGFRILNTVSKLGKQV

SEQ ID NO: 3004024 - protein, 24 aa, Entamoeba invadens
KMRYKRIEKLYLPSKITLFGVSGH

SEQ ID NO: 3004025 - protein, 25 aa, Entamoeba invadens
KMSEEFNLLTRCKEDLEKQNIELTT

SEQ ID NO: 3004026 - protein, 24 aa, Entamoeba invadens
KMSIIQRAILNFPNFENLSSRKFI

SEQ ID NO: 3004027 - protein, 21 aa, Entamoeba invadens
KMSLHLPWNKLNSQPVVVQIK

SEQ ID NO: 3004028 - protein, 17 aa, Entamoeba invadens
KMSPSIDPFPPSNFNPL

SEQ ID NO: 3004029 - protein, 24 aa, Entamoeba invadens
KMSSLFVLLVSFNPNFSAFNRKLL

SEQ ID NO: 3004030 - protein, 27 aa, Entamoeba invadens
KMSSLNLAIVWVPCLFEVPIDQNFQTN

SEQ ID NO: 3004031 - protein, 21 aa, Entamoeba invadens
KMSVELPVCKILIISMCQNCD

SEQ ID NO: 3004032 - protein, 23 aa, Entamoeba invadens
KMTDAVIMLSYRCPYRAVREFCA

SEQ ID NO: 3004033 - protein, 31 aa, Entamoeba invadens
KMTEPEFLGLFTPFGPISRHNFHVSDRLFHS

SEQ ID NO: 3004034 - protein, 17 aa, Entamoeba invadens
KMTGKFDGELNFINGSL

SEQ ID NO: 3004035 - protein, 27 aa, Entamoeba invadens
KMTHAFHTIIPKPTTFWRTLLGQQVLK

SEQ ID NO: 3004036 - protein, 23 aa, Entamoeba invadens
KMTKNTLSIPKICKIRFSNHDVI

SEQ ID NO: 3004037 - protein, 25 aa, Entamoeba invadens
KMTLKQFLNVFKQLGIYFFEEPEVF

SEQ ID NO: 3004038 - protein, 20 aa, Entamoeba invadens
KMTRPEFEALPGWKKQKQKY

SEQ ID NO: 3004039 - protein, 19 aa, Entamoeba invadens
KMTSYGDAPMPFIIGCQRK

SEQ ID NO: 3004040 - protein, 22 aa, Entamoeba invadens
KMTTNWLYLSKISAQKEYCFMK

SEQ ID NO: 3004041 - protein, 25 aa, Entamoeba invadens
KMTYKKYFMLPETTNHILTLSLVNS

SEQ ID NO: 3004042 - protein, 44 aa, Entamoeba invadens
KMVAACCGYFFWDLMHFIPYPLVEKLFDFVYKKIELFGSVQTEG

SEQ ID NO: 3004043 - protein, 19 aa, Entamoeba invadens
KMVTTHFTLSNIKLLLLSW

SEQ ID NO: 3004044 - protein, 18 aa, Entamoeba invadens
KMWEREGFIYNINKLKSP

SEQ ID NO: 3004045 - protein, 21 aa, Entamoeba invadens
KMWTEVRGIELPIFKNDMINA

SEQ ID NO: 3004046 - protein, 17 aa, Entamoeba invadens
KMYCSPLQLSFIHKKLN

SEQ ID NO: 3004047 - protein, 22 aa, Entamoeba invadens
KMYIGAWYINPAIDTAINIVDT

SEQ ID NO: 3004048 - protein, 23 aa, Entamoeba invadens
KMYKDRVVFLKNEQQKKLQTTPQ

SEQ ID NO: 3004049 - protein, 22 aa, Entamoeba invadens
KMYKMFYDSFDAEYTKIQCISF

SEQ ID NO: 3004050 - protein, 17 aa, Entamoeba invadens
KMYNFFGSAYQLSVLIL

SEQ ID NO: 3004051 - protein, 30 aa, Entamoeba invadens
KMYQSFAVPTPLILYTRVFLDEITGLVHLY

SEQ ID NO: 3004052 - protein, 29 aa, Entamoeba invadens
KMYRPKNYLPLFLNPLLAVVPTTPEMLNK

SEQ ID NO: 3004053 - protein, 18 aa, Entamoeba invadens
KNAFLPNVPFEVLRNYCL

SEQ ID NO: 3004054 - protein, 18 aa, Entamoeba invadens
KNAFNGYCYLEELVIPKS

SEQ ID NO: 3004055 - protein, 18 aa, Entamoeba invadens
KNAGVFVYENGGGLFASC

SEQ ID NO: 3004056 - protein, 17 aa, Entamoeba invadens
KNAINERRYVQLYVKFF

SEQ ID NO: 3004057 - protein, 33 aa, Entamoeba invadens
KNAINERRYVQLYVKFFVKVRNAMLVVDTKKDL

SEQ ID NO: 3004058 - protein, 25 aa, Entamoeba invadens
KNAKRICITIPDSVGFLKLMEVNKT

SEQ ID NO: 3004059 - protein, 17 aa, Entamoeba invadens
KNALFRLDIRSIGINRQ

SEQ ID NO: 3004060 - protein, 19 aa, Entamoeba invadens
KNALKIILMAFGEIVEFLV

SEQ ID NO: 3004061 - protein, 31 aa, Entamoeba invadens
KNARRQRLLKSFYLPLLSTTHYIRKGKVLMK

SEQ ID NO: 3004062 - protein, 17 aa, Entamoeba invadens
KNARYLVNLFNIKELRK

SEQ ID NO: 3004063 - protein, 23 aa, Entamoeba invadens
KNAVLQGLNCNCSLIVGPPGTGK

SEQ ID NO: 3004064 - protein, 27 aa, Entamoeba invadens
KNAVNSGYWSLYRYDPRLIQEGKAALQ

SEQ ID NO: 3004065 - protein, 25 aa, Entamoeba invadens
KNAVPIPQHWCQRKRFLSGRREKEA

SEQ ID NO: 3004066 - protein, 19 aa, Entamoeba invadens
KNAYFMWSVNFSQTNAILL

SEQ ID NO: 3004067 - protein, 19 aa, Entamoeba invadens
KNCDLLKEAVLSSALTAIP

SEQ ID NO: 3004068 - protein, 17 aa, Entamoeba invadens
KNCDVSILTNLPVDKKM

SEQ ID NO: 3004069 - protein, 19 aa, Entamoeba invadens
KNCEYGRLKTLLKEIPVSI

SEQ ID NO: 3004070 - protein, 26 aa, Entamoeba invadens
KNCFKLKEVILPPFINMLGTETFDGC

SEQ ID NO: 3004071 - protein, 24 aa, Entamoeba invadens
KNCISLHRIQFPDSLKVIKEYAFL

SEQ ID NO: 3004072 - protein, 17 aa, Entamoeba invadens
KNCTALRHINIPFNLKI

SEQ ID NO: 3004073 - protein, 23 aa, Entamoeba invadens
KNCTDLFDFLSLGVLIDGRVFGT

SEQ ID NO: 3004074 - protein, 18 aa, Entamoeba invadens
KNCTKLTKVVISKNLKKL

SEQ ID NO: 3004075 - protein, 26 aa, Entamoeba invadens
KNDEQNRLIALWRYIAKRYCNEEGIA

SEQ ID NO: 3004076 - protein, 27 aa, Entamoeba invadens
KNDEQNRLIALWRYIAKRYNNEEGVAG

SEQ ID NO: 3004077 - protein, 21 aa, Entamoeba invadens
KNDFALWKKSKSGEPWWASQW

SEQ ID NO: 3004078 - protein, 25 aa, Entamoeba invadens
KNDHEFLYDLLCQIDIIIQKEAKET

SEQ ID NO: 3004079 - protein, 17 aa, Entamoeba invadens
KNDHGYTVVPTLHFPLL

SEQ ID NO: 3004080 - protein, 28 aa, Entamoeba invadens
KNDKGEGIFYYYTYNAFGGWVPSWVMNS

SEQ ID NO: 3004081 - protein, 25 aa, Entamoeba invadens
KNDMCISFAKGPFVKQRNLSLFKIY

SEQ ID NO: 3004082 - protein, 29 aa, Entamoeba invadens
KNDMIIPDIHRLVVWYPVSLQESKTLFSE

SEQ ID NO: 3004083 - protein, 24 aa, Entamoeba invadens
KNDNDFFIFSFNTTAGENPLKIKR

SEQ ID NO: 3004084 - protein, 26 aa, Entamoeba invadens
KNDQEIFCVMLRLVKGRKCYSLPLIL

SEQ ID NO: 3004085 - protein, 21 aa, Entamoeba invadens
KNDVLYYFNLKTVVVKKNTIG

SEQ ID NO: 3004086 - protein, 28 aa, Entamoeba invadens
KNDYLDYSMIYSLQRLFSDMALGVCTCS

SEQ ID NO: 3004087 - protein, 25 aa, Entamoeba invadens
KNEEFKLDCGLYVWINGNNLFQFGD

SEQ ID NO: 3004088 - protein, 24 aa, Entamoeba invadens
KNEELRIAIINFATKKTSFLQQEL

SEQ ID NO: 3004089 - protein, 17 aa, Entamoeba invadens
KNEFLFCHLEELTIWSV

SEQ ID NO: 3004090 - protein, 26 aa, Entamoeba invadens
KNEHSLYQFNLLDFYSRTLKIELPLS

SEQ ID NO: 3004091 - protein, 25 aa, Entamoeba invadens
KNEIDERMLLNLQKKKWTDSLQVES

SEQ ID NO: 3004092 - protein, 23 aa, Entamoeba invadens
KNEISIFNQLLWSDPELSDGFKK

SEQ ID NO: 3004093 - protein, 22 aa, Entamoeba invadens
KNEKEKLMKDLTSCGDVTQRLN

SEQ ID NO: 3004094 - protein, 33 aa, Entamoeba invadens
KNEKQILQLMASLVKFFLYKNTNLHSTMFNVWF

SEQ ID NO: 3004095 - protein, 22 aa, Entamoeba invadens
KNEKRILLLQKVLYCEGGSKHK

SEQ ID NO: 3004096 - protein, 17 aa, Entamoeba invadens
KNEKYIFLEKKFCEIFS

SEQ ID NO: 3004097 - protein, 24 aa, Entamoeba invadens
KNELLLHFELIGRIELHPSISNRP

SEQ ID NO: 3004098 - protein, 24 aa, Entamoeba invadens
KNELRVLMKCWVVYYQDCGYQQGQ

SEQ ID NO: 3004099 - protein, 17 aa, Entamoeba invadens
KNELTPMGLFGSQNKDP

SEQ ID NO: 3004100 - protein, 20 aa, Entamoeba invadens
KNELVNIERLNFIMDTLENT

SEQ ID NO: 3004101 - protein, 18 aa, Entamoeba invadens
KNENDKFLKFPKKILVFD

SEQ ID NO: 3004102 - protein, 25 aa, Entamoeba invadens
KNENKRFLEYFDSYIKYNNLERGVN

SEQ ID NO: 3004103 - protein, 27 aa, Entamoeba invadens
KNEQEIFCVLLRLVKGRKCYSMPLILK

SEQ ID NO: 3004104 - protein, 28 aa, Entamoeba invadens
KNERILENVWWVLKALVNNNPHAQKMLF

SEQ ID NO: 3004105 - protein, 28 aa, Entamoeba invadens
KNERKKTHYLPLFPSKPHPKQQKASTET

SEQ ID NO: 3004106 - protein, 26 aa, Entamoeba invadens
KNETIYKPLRIFKDKSYKSADVEIHE

SEQ ID NO: 3004107 - protein, 23 aa, Entamoeba invadens
KNEYIRVLTDAEVEYNFLTSKMT

SEQ ID NO: 3004108 - protein, 26 aa, Entamoeba invadens
KNFEAHHLFIDFLRDMGYSFASQYTS

SEQ ID NO: 3004109 - protein, 27 aa, Entamoeba invadens
KNFEIISVFVIRRLFNKIGNDFYNAND

SEQ ID NO: 3004110 - protein, 30 aa, Entamoeba invadens
KNFLLKLIKTQHFNAWWFSQYTPFKHKIRE

SEQ ID NO: 3004111 - protein, 22 aa, Entamoeba invadens
KNFPTTGILQIFINPDDEFGLY

SEQ ID NO: 3004112 - protein, 30 aa, Entamoeba invadens
KNFRQTCLTFKYNPIPLDKLTFQIFSNIET

SEQ ID NO: 3004113 - protein, 18 aa, Entamoeba invadens
KNFVLFDSICNIMQLINF

SEQ ID NO: 3004114 - protein, 27 aa, Entamoeba invadens
KNFVVLNKFYEVHNLLQWLSSISVEFA

SEQ ID NO: 3004115 - protein, 27 aa, Entamoeba invadens
KNGDTLLHMLIILGYTNLVEMVIAKGA

SEQ ID NO: 3004116 - protein, 25 aa, Entamoeba invadens
KNGEQRIFTVKQPILDIPALCVHLD

SEQ ID NO: 3004117 - protein, 20 aa, Entamoeba invadens
KNGFDLKKTLFVEKQYIGQS

SEQ ID NO: 3004118 - protein, 25 aa, Entamoeba invadens
KNGFEELLFVLKRKSYWNNKDLWIN

SEQ ID NO: 3004119 - protein, 17 aa, Entamoeba invadens
KNGFRQDRNYCYPCATG

SEQ ID NO: 3004120 - protein, 18 aa, Entamoeba invadens
KNGIVPEIVQKASLKSPA

SEQ ID NO: 3004121 - protein, 36 aa, Entamoeba invadens
KNGYSPIHYTIMKQNLPLFKILQSHSYQTSKTSLKL

SEQ ID NO: 3004122 - protein, 25 aa, Entamoeba invadens
KNGYYLLAVSYERKKFRPTIVCDGM

SEQ ID NO: 3004123 - protein, 25 aa, Entamoeba invadens
KNHFLAVLKHPKTQPFRLKCLNWNE

SEQ ID NO: 3004124 - protein, 23 aa, Entamoeba invadens
KNHKFFHNLTLLAEKVNSFIVRG

SEQ ID NO: 3004125 - protein, 23 aa, Entamoeba invadens
KNHLPNIPLLRQHLLRQGRLTQE

SEQ ID NO: 3004126 - protein, 36 aa, Entamoeba invadens
KNHNNYRVLFEMRPFPKIPILSLWMHDVVNINEMDT

SEQ ID NO: 3004127 - protein, 23 aa, Entamoeba invadens
KNHRDGILGFRTGKKTLLVMAGN

SEQ ID NO: 3004128 - protein, 18 aa, Entamoeba invadens
KNIALSCNLTKICDFAFC

SEQ ID NO: 3004129 - protein, 19 aa, Entamoeba invadens
KNIDFIMDPGMYLVCYYRT

SEQ ID NO: 3004130 - protein, 21 aa, Entamoeba invadens
KNIEKLQTTILEKTQKIKNLE

SEQ ID NO: 3004131 - protein, 25 aa, Entamoeba invadens
KNIEKVDCFLVIYSITDKDTLLHLP

SEQ ID NO: 3004132 - protein, 25 aa, Entamoeba invadens
KNIEPTRFYPLKLGNSVYIFQNDYM

SEQ ID NO: 3004133 - protein, 25 aa, Entamoeba invadens
KNIIHDELMFPELLAVLKTYKKKEV

SEQ ID NO: 3004134 - protein, 20 aa, Entamoeba invadens
KNIIRLYLNGGIDISEERED

SEQ ID NO: 3004135 - protein, 25 aa, Entamoeba invadens
KNIKKFNYLYPVTYTQYIREKSLYN

SEQ ID NO: 3004136 - protein, 33 aa, Entamoeba invadens
KNIKKIFFKAKEVFRILFTLVSSLQEDDCLLFE

SEQ ID NO: 3004137 - protein, 25 aa, Entamoeba invadens
KNIKNKWILELKKNAPSVPVIVVGT

SEQ ID NO: 3004138 - protein, 34 aa, Entamoeba invadens
KNILLRFFDVGLQTYVYIPYKPNYKMLMSGYYTK

SEQ ID NO: 3004139 - protein, 22 aa, Entamoeba invadens
KNILTIISYSYKTGFSITAKVC

SEQ ID NO: 3004140 - protein, 24 aa, Entamoeba invadens
KNINEQFRLILQAKTDTYQQTKAR

SEQ ID NO: 3004141 - protein, 20 aa, Entamoeba invadens
KNINIPPYIISLGYQCFCNC

SEQ ID NO: 3004142 - protein, 26 aa, Entamoeba invadens
KNIPVIMALLGVWYNNFYKAESQAIL

SEQ ID NO: 3004143 - protein, 30 aa, Entamoeba invadens
KNIQAISFYLILPIQRIPRYELLIRDMLKD

SEQ ID NO: 3004144 - protein, 21 aa, Entamoeba invadens
KNIQILCELVKLLSFAEEVST

SEQ ID NO: 3004145 - protein, 30 aa, Entamoeba invadens
KNIREYKLRDVQRPVIVLSMFNEKEVSAYK

SEQ ID NO: 3004146 - protein, 33 aa, Entamoeba invadens
KNIRKKWLSNNRLFYSLVYSLIFTNKEMTRRPK

SEQ ID NO: 3004147 - protein, 21 aa, Entamoeba invadens
KNIRNRLLIATKKPILAFEPY

SEQ ID NO: 3004148 - protein, 18 aa, Entamoeba invadens
KNISLPLSVKKICYGAFF

SEQ ID NO: 3004149 - protein, 17 aa, Entamoeba invadens
KNITYLPFLSEKELYRT

SEQ ID NO: 3004150 - protein, 33 aa, Entamoeba invadens
KNIVQIYNVYYFDYYVYMVMEYIGGGSLDSRIN

SEQ ID NO: 3004151 - protein, 33 aa, Entamoeba invadens
KNIYEISFTDPFKYKLFKRTFTVFGRGRIDKVP

SEQ ID NO: 3004152 - protein, 22 aa, Entamoeba invadens
KNIYELELTFSRQPVGLKREMI

SEQ ID NO: 3004153 - protein, 25 aa, Entamoeba invadens
KNIYETNYWILPPSGPDAWHGFPNI

SEQ ID NO: 3004154 - protein, 26 aa, Entamoeba invadens
KNIYKKIMVFKNRKLQLLIYDIELKY

SEQ ID NO: 3004155 - protein, 24 aa, Entamoeba invadens
KNKCPVFCMRWTPDGRRLITGSNN

SEQ ID NO: 3004156 - protein, 25 aa, Entamoeba invadens
KNKDDLLEIPLPDKSLAKVSSKQKQ

SEQ ID NO: 3004157 - protein, 44 aa, Entamoeba invadens
KNKEDLCGFNIWPYAYMDKSIKYRGFFDVIHFAITWDDQSYTAN

SEQ ID NO: 3004158 - protein, 27 aa, Entamoeba invadens
KNKEIRLFADLFYALSIPLPKSEIDNF

SEQ ID NO: 3004159 - protein, 20 aa, Entamoeba invadens
KNKIALIKSFGKTLVDSLLP

SEQ ID NO: 3004160 - protein, 24 aa, Entamoeba invadens
KNKIGELYLCPHSSHLSQPLDVVI

SEQ ID NO: 3004161 - protein, 21 aa, Entamoeba invadens
KNKINFLQVSEIFKQKVWEVN

SEQ ID NO: 3004162 - protein, 17 aa, Entamoeba invadens
KNKIRHMTPKQYKQLKS

SEQ ID NO: 3004163 - protein, 29 aa, Entamoeba invadens
KNKKNFVQNLLIDMLLEFGFFFESKMAKK

SEQ ID NO: 3004164 - protein, 34 aa, Entamoeba invadens
KNKLEIRLGIVNMAFFTVTPKRTPSSTPLLPQFF

SEQ ID NO: 3004165 - protein, 17 aa, Entamoeba invadens
KNKLIVLTIPKKSILTR

SEQ ID NO: 3004166 - protein, 37 aa, Entamoeba invadens
KNKLKKVLYDHKKLQKALFKHVERVKRLAKYRIRQYE

SEQ ID NO: 3004167 - protein, 22 aa, Entamoeba invadens
KNKLQFMKKYTLFMNCYDSIAV

SEQ ID NO: 3004168 - protein, 22 aa, Entamoeba invadens
KNKNFRNFKLFKVSSKNGTGMD

SEQ ID NO: 3004169 - protein, 17 aa, Entamoeba invadens
KNKPKMVMITYKNNGPH

SEQ ID NO: 3004170 - protein, 32 aa, Entamoeba invadens
KNKQTLPLLSHRFQPRVLAPLPQTIPRNQLQQ

SEQ ID NO: 3004171 - protein, 29 aa, Entamoeba invadens
KNKSLNNIIFYILFKRKSSITFKTNMSGR

SEQ ID NO: 3004172 - protein, 30 aa, Entamoeba invadens
KNKTIFIQNFLFDVLLEKGYFFNTKLSKKS

SEQ ID NO: 3004173 - protein, 23 aa, Entamoeba invadens
KNKTISIVSFQPALKGILVADVN

SEQ ID NO: 3004174 - protein, 24 aa, Entamoeba invadens
KNKTPQKLLKKTPPKTIPNITDSI

SEQ ID NO: 3004175 - protein, 21 aa, Entamoeba invadens
KNLAVFIDGGVYYQACIQMIR

SEQ ID NO: 3004176 - protein, 25 aa, Entamoeba invadens
KNLDYKVFCILTYKLGQVTILKNSL

SEQ ID NO: 3004177 - protein, 17 aa, Entamoeba invadens
KNLFELLNKMKEFNIIT

SEQ ID NO: 3004178 - protein, 17 aa, Entamoeba invadens
KNLFFQSRILDEVVNDQ

SEQ ID NO: 3004179 - protein, 20 aa, Entamoeba invadens
KNLFKFIQTQQFFSPFDIKL

SEQ ID NO: 3004180 - protein, 21 aa, Entamoeba invadens
KNLIILDARFPFEYEQGHIIN

SEQ ID NO: 3004181 - protein, 36 aa, Entamoeba invadens
KNLILVCKKFEEIPLMFHFNPISWKPKIKIYFENVE

SEQ ID NO: 3004182 - protein, 36 aa, Entamoeba invadens
KNLILVCKKFNEIPLMFHFNPIQWKPKMKKYFKNVE

SEQ ID NO: 3004183 - protein, 31 aa, Entamoeba invadens
KNLKMIFEISMLFPHKTVQQIIMRLKWNSQK

SEQ ID NO: 3004184 - protein, 18 aa, Entamoeba invadens
KNLLIAFIEAAIPPILES

SEQ ID NO: 3004185 - protein, 27 aa, Entamoeba invadens
KNLLKYGIVNKILKLLSLSTYSLAIIH

SEQ ID NO: 3004186 - protein, 20 aa, Entamoeba invadens
KNLMICLTPSLKISPRILSN

SEQ ID NO: 3004187 - protein, 20 aa, Entamoeba invadens
KNLPLKPDLPRIQYLNVGFN

SEQ ID NO: 3004188 - protein, 21 aa, Entamoeba invadens
KNLPQLPSRKVVYPLRDVALK

SEQ ID NO: 3004189 - protein, 29 aa, Entamoeba invadens
KNLQNTISDTILPILKNDLKKTQLALDDT

SEQ ID NO: 3004190 - protein, 17 aa, Entamoeba invadens
KNLRLLIPIEIAVKMED

SEQ ID NO: 3004191 - protein, 19 aa, Entamoeba invadens
KNLSFKGGFGLLKYGPSVD

SEQ ID NO: 3004192 - protein, 23 aa, Entamoeba invadens
KNLSLAFFGKIKKYMELREKLRK

SEQ ID NO: 3004193 - protein, 24 aa, Entamoeba invadens
KNLTLLNSPTFLPIVHSYSLHCTT

SEQ ID NO: 3004194 - protein, 21 aa, Entamoeba invadens
KNMFPYTFTVTRQYKYMYCPG

SEQ ID NO: 3004195 - protein, 22 aa, Entamoeba invadens
KNMLNARIAGIQAKLDEERQKA

SEQ ID NO: 3004196 - protein, 25 aa, Entamoeba invadens
KNMNDPFFALRYQCNINKELDDVMK

SEQ ID NO: 3004197 - protein, 25 aa, Entamoeba invadens
KNMSAFIRNFVFDSCLEFGYFFNSK

SEQ ID NO: 3004198 - protein, 27 aa, Entamoeba invadens
KNNERALYVYAYFLARVAAGMVAEEDV

SEQ ID NO: 3004199 - protein, 35 aa, Entamoeba invadens
KNNILMFNVCLLLSRISLDFGIHPGVPYPFQDQFL

SEQ ID NO: 3004200 - protein, 25 aa, Entamoeba invadens
KNNINSYIFALKILCTYVNHLEVKD

SEQ ID NO: 3004201 - protein, 29 aa, Entamoeba invadens
KNNLKFITSFYYFFFSHPQKGMYYNLLDE

SEQ ID NO: 3004202 - protein, 25 aa, Entamoeba invadens
KNNNNLPFLLKIKAIYGRVFALAKC

SEQ ID NO: 3004203 - protein, 18 aa, Entamoeba invadens
KNNPLQSYLIGININTRY

SEQ ID NO: 3004204 - protein, 20 aa, Entamoeba invadens
KNNVIMIITETIRKLNNRSS

SEQ ID NO: 3004205 - protein, 26 aa, Entamoeba invadens
KNPLLQILRGFLLDKSKWTVFVTIGC

SEQ ID NO: 3004206 - protein, 17 aa, Entamoeba invadens
KNPNGMIELFSNVVFVA

SEQ ID NO: 3004207 - protein, 27 aa, Entamoeba invadens
KNPTRNSIIGTPFWMPPELIKSQNYDT

SEQ ID NO: 3004208 - protein, 24 aa, Entamoeba invadens
KNPYPFILSSLLNSMLGPIVEDII

SEQ ID NO: 3004209 - protein, 32 aa, Entamoeba invadens
KNQKILEMALSQKLKFETLFLEQNEQLQIIET

SEQ ID NO: 3004210 - protein, 25 aa, Entamoeba invadens
KNQKKRMRKRKAVVKKREIQKAEKL

SEQ ID NO: 3004211 - protein, 22 aa, Entamoeba invadens
KNQLTYEDLLLLLLTQLHGDYT

SEQ ID NO: 3004212 - protein, 25 aa, Entamoeba invadens
KNQNVRYIFYPLADSDIAISYTSNL

SEQ ID NO: 3004213 - protein, 17 aa, Entamoeba invadens
KNQQYKIFHFNTGFIFF

SEQ ID NO: 3004214 - protein, 19 aa, Entamoeba invadens
KNQRSSFEPFLWTVSDHEN

SEQ ID NO: 3004215 - protein, 20 aa, Entamoeba invadens
KNRAECNPFLLFCKDHRENV

SEQ ID NO: 3004216 - protein, 18 aa, Entamoeba invadens
KNRALQFAMVLKGDNNYK

SEQ ID NO: 3004217 - protein, 25 aa, Entamoeba invadens
KNRDIYVIYMSQSVFDIKRVLLNKF

SEQ ID NO: 3004218 - protein, 22 aa, Entamoeba invadens
KNRFGCVITEKVEREATWVADE

SEQ ID NO: 3004219 - protein, 20 aa, Entamoeba invadens
KNRHSKVPSHLPLSVRFYWD

SEQ ID NO: 3004220 - protein, 19 aa, Entamoeba invadens
KNRIPPEVNILASSAFEKC

SEQ ID NO: 3004221 - protein, 21 aa, Entamoeba invadens
KNRIRFEWLMNLFETDNQDLL

SEQ ID NO: 3004222 - protein, 23 aa, Entamoeba invadens
KNRKLAKLTKRIEDGLNDSDMLK

SEQ ID NO: 3004223 - protein, 27 aa, Entamoeba invadens
KNRKTVLPKMFYKIVVWFNVDFGTVDK

SEQ ID NO: 3004224 - protein, 18 aa, Entamoeba invadens
KNRKYEVLVVAYSHVKNA

SEQ ID NO: 3004225 - protein, 22 aa, Entamoeba invadens
KNRMEWLTGIKNYRPKASIFQI

SEQ ID NO: 3004226 - protein, 23 aa, Entamoeba invadens
KNRPAYYRQAMLEIAILQVLNVK

SEQ ID NO: 3004227 - protein, 23 aa, Entamoeba invadens
KNRYDLQLIFKQCDYYTLMADSA

SEQ ID NO: 3004228 - protein, 29 aa, Entamoeba invadens
KNSECYQLGFLIFLLVQHNREVVVQNTEK

SEQ ID NO: 3004229 - protein, 23 aa, Entamoeba invadens
KNSFKWCTLFSSIKVRKYNYNNS

SEQ ID NO: 3004230 - protein, 23 aa, Entamoeba invadens
KNSFLHVRSWYKDLKEAVPDVAV

SEQ ID NO: 3004231 - protein, 24 aa, Entamoeba invadens
KNSIYPINPISFMTQLESCYLFEA

SEQ ID NO: 3004232 - protein, 23 aa, Entamoeba invadens
KNSKLFSSLYYLDGDLQLIAQFL

SEQ ID NO: 3004233 - protein, 19 aa, Entamoeba invadens
KNSKLGTTYIPFAISKPFN

SEQ ID NO: 3004234 - protein, 26 aa, Entamoeba invadens
KNSKSLLFLFQSYFSDPREKELKNLS

SEQ ID NO: 3004235 - protein, 26 aa, Entamoeba invadens
KNSLRLYYFFFQKVANHFIFKHDVTK

SEQ ID NO: 3004236 - protein, 24 aa, Entamoeba invadens
KNSMNILPLLSFKIPFTLGTNSEI

SEQ ID NO: 3004237 - protein, 23 aa, Entamoeba invadens
KNSSIKKLFHSLSSQIGFFEVDG

SEQ ID NO: 3004238 - protein, 25 aa, Entamoeba invadens
KNSSLRPKTLLSPKKDDVPPLKLEE

SEQ ID NO: 3004239 - protein, 22 aa, Entamoeba invadens
KNSVLDLMQKSFFGGGTVVMSD

SEQ ID NO: 3004240 - protein, 27 aa, Entamoeba invadens
KNSVSRFELIRKQRKPITFGEQDLGEL

SEQ ID NO: 3004241 - protein, 27 aa, Entamoeba invadens
KNSYACQFTFKYVYPDLGMNPTLVVVE

SEQ ID NO: 3004242 - protein, 27 aa, Entamoeba invadens
KNSYGLPIADFCPCPFKCGINNQPPTA

SEQ ID NO: 3004243 - protein, 24 aa, Entamoeba invadens
KNSYITSLIGVPVLPPLPKFEISE

SEQ ID NO: 3004244 - protein, 33 aa, Entamoeba invadens
KNTDKSMFCEMKYFMMLLKGISTKRIVDVKMRF

SEQ ID NO: 3004245 - protein, 23 aa, Entamoeba invadens
KNTFNMCYSLSFIKVPNGLTYIG

SEQ ID NO: 3004246 - protein, 18 aa, Entamoeba invadens
KNTFQMLLLCSDDFLRKI

SEQ ID NO: 3004247 - protein, 23 aa, Entamoeba invadens
KNTIILNETFKFLNVVWTCFSSK

SEQ ID NO: 3004248 - protein, 24 aa, Entamoeba invadens
KNTLLGFMYCNIPSVNTLESLYNC

SEQ ID NO: 3004249 - protein, 36 aa, Entamoeba invadens
KNTLSKKAGLQFPVARIHAALKKGRYGEHVNKMASV

SEQ ID NO: 3004250 - protein, 31 aa, Entamoeba invadens
KNTMTWNTVCRTILFCLNNSIKGIIFDTPPT

SEQ ID NO: 3004251 - protein, 23 aa, Entamoeba invadens
KNTMWKNQKLTLTDKFELALNCT

SEQ ID NO: 3004252 - protein, 23 aa, Entamoeba invadens
KNTPDHLFLLLSTSDACVVPLLR

SEQ ID NO: 3004253 - protein, 25 aa, Entamoeba invadens
KNTPKLESINLYALLTSLQDTLPSQ

SEQ ID NO: 3004254 - protein, 24 aa, Entamoeba invadens
KNTPNYLLFQINRFFISTDLTAQK

SEQ ID NO: 3004255 - protein, 22 aa, Entamoeba invadens
KNTTCIVGVYSAFFIETVDDGS

SEQ ID NO: 3004256 - protein, 18 aa, Entamoeba invadens
KNTTLLTFLSNALQIKGV

SEQ ID NO: 3004257 - protein, 24 aa, Entamoeba invadens
KNTVPPMFTFLYGVMATVAVTTKN

SEQ ID NO: 3004258 - protein, 23 aa, Entamoeba invadens
KNVCFLVVYSPLPKHVITQIRNV

SEQ ID NO: 3004259 - protein, 22 aa, Entamoeba invadens
KNVDMFLELHNLERLRIFSSGK

SEQ ID NO: 3004260 - protein, 23 aa, Entamoeba invadens
KNVEKINFLKIREKKINTEKKPK

SEQ ID NO: 3004261 - protein, 22 aa, Entamoeba invadens
KNVFFLEVGISENTFVLGHAVN

SEQ ID NO: 3004262 - protein, 20 aa, Entamoeba invadens
KNVFLVAANGFVYNNMSCKS

SEQ ID NO: 3004263 - protein, 19 aa, Entamoeba invadens
KNVFLYFIELNGVRIPERF

SEQ ID NO: 3004264 - protein, 17 aa, Entamoeba invadens
KNVFSFVNLKRFTIVGK

SEQ ID NO: 3004265 - protein, 21 aa, Entamoeba invadens
KNVFVLKGCTPIPGATIFGFD

SEQ ID NO: 3004266 - protein, 24 aa, Entamoeba invadens
KNVGMNVWLMLFARLVLKTKNTKN

SEQ ID NO: 3004267 - protein, 26 aa, Entamoeba invadens
KNVIGLYDVFLTPSTLYIVFELVDGG

SEQ ID NO: 3004268 - protein, 17 aa, Entamoeba invadens
KNVINTLSVLAINFMSK

SEQ ID NO: 3004269 - protein, 21 aa, Entamoeba invadens
KNVLLMGIEYIEVIDLDVIDF

SEQ ID NO: 3004270 - protein, 17 aa, Entamoeba invadens
KNVLLVRINMDKDLLLT

SEQ ID NO: 3004271 - protein, 23 aa, Entamoeba invadens
KNVPFGCFDLLLARVELTKGPKG

SEQ ID NO: 3004272 - protein, 19 aa, Entamoeba invadens
KNVRLILNKAYELSVTSPK

SEQ ID NO: 3004273 - protein, 30 aa, Entamoeba invadens
KNVSSMPVTFLHMALLENGVKVLPRVLLKD

SEQ ID NO: 3004274 - protein, 26 aa, Entamoeba invadens
KNVTDFFVTLAKLLLKAKVTKPIEKP

SEQ ID NO: 3004275 - protein, 32 aa, Entamoeba invadens
KNVVLYLDTLNDVYYFMFINKSCLSVVQTMYI

SEQ ID NO: 3004276 - protein, 27 aa, Entamoeba invadens
KNVVVYFYHKRFLISDVFLGCVEFDLT

SEQ ID NO: 3004277 - protein, 23 aa, Entamoeba invadens
KNVYSPLLVVTPMDTPMVEDDSE

SEQ ID NO: 3004278 - protein, 20 aa, Entamoeba invadens
KNWDGKAGYLLLKSERTGKT

SEQ ID NO: 3004279 - protein, 24 aa, Entamoeba invadens
KNWRPIKYLIPEIVNIFGNFLSVD

SEQ ID NO: 3004280 - protein, 19 aa, Entamoeba invadens
KNWVCLTYEAPKSKNLVVA

SEQ ID NO: 3004281 - protein, 33 aa, Entamoeba invadens
KNYAWVPAPPFTIFLWAYLPKGNYTILDVVSPS

SEQ ID NO: 3004282 - protein, 24 aa, Entamoeba invadens
KNYAYLHIQTVHFFVKSFDKESLI

SEQ ID NO: 3004283 - protein, 27 aa, Entamoeba invadens
KNYHDPTLPITFFQTYMLKDPHSSYGL

SEQ ID NO: 3004284 - protein, 17 aa, Entamoeba invadens
KNYILPEQFLDYHVAKY

SEQ ID NO: 3004285 - protein, 21 aa, Entamoeba invadens
KNYLIQSLIRIVTALKGEYGN

SEQ ID NO: 3004286 - protein, 21 aa, Entamoeba invadens
KNYLLDIFEPIIFGLSSGGDY

SEQ ID NO: 3004287 - protein, 17 aa, Entamoeba invadens
KNYMFIHFKDAECAKEA

SEQ ID NO: 3004288 - protein, 25 aa, Entamoeba invadens
KNYQDLFQTFSKWTGKARYSVLYDS

SEQ ID NO: 3004289 - protein, 31 aa, Entamoeba invadens
KNYQPFRIKDTLKFILTAQLPEWKYEIEAPL

SEQ ID NO: 3004290 - protein, 31 aa, Entamoeba invadens
KNYSPGDFLGVGLVIEMIRMYGIRPCELGPF

SEQ ID NO: 3004291 - protein, 18 aa, Entamoeba invadens
KNYSVDVMILPATVKSIE

SEQ ID NO: 3004292 - protein, 21 aa, Entamoeba invadens
KNYTHVITPKTFQNFKPLYRE

SEQ ID NO: 3004293 - protein, 24 aa, Entamoeba invadens
KNYTNWIRQLIQLIKDTPFDYKTQ

SEQ ID NO: 3004294 - protein, 32 aa, Entamoeba invadens
KPAEVEPFWLNIYHTMLLHGLLYWKHRPCIEF

SEQ ID NO: 3004295 - protein, 24 aa, Entamoeba invadens
KPANVVLFNYKKFIDINAKLADLG

SEQ ID NO: 3004296 - protein, 21 aa, Entamoeba invadens
KPAPDVYFEALRRAGPGLKPQ

SEQ ID NO: 3004297 - protein, 23 aa, Entamoeba invadens
KPCFDNFIRFISGYSDDKNSLLS

SEQ ID NO: 3004298 - protein, 20 aa, Entamoeba invadens
KPCIFFMQNGYCKKGDNCTF

SEQ ID NO: 3004299 - protein, 26 aa, Entamoeba invadens
KPDALEYMYYDEILSKLFKQYNEIRD

SEQ ID NO: 3004300 - protein, 23 aa, Entamoeba invadens
KPDNILMFSMDFFEKVNAKLTDF

SEQ ID NO: 3004301 - protein, 23 aa, Entamoeba invadens
KPDNILVFSMDFLEKVNAKLTDF

SEQ ID NO: 3004302 - protein, 42 aa, Entamoeba invadens
KPDNYLIRPIQRPPRYKLLLEAVLESLPTWWKKERKELKMST

SEQ ID NO: 3004303 - protein, 23 aa, Entamoeba invadens
KPDSVLLSSLFIFGIELAQVKQV

SEQ ID NO: 3004304 - protein, 24 aa, Entamoeba invadens
KPDVRFVIHHSLPKTLEGYYQESG

SEQ ID NO: 3004305 - protein, 23 aa, Entamoeba invadens
KPDVVFILGFSHSAHFEYAAIMD

SEQ ID NO: 3004306 - protein, 33 aa, Entamoeba invadens
KPEIRNIVDYFSALNLLFYPSSKKFIDVVQSTN

SEQ ID NO: 3004307 - protein, 17 aa, Entamoeba invadens
KPEMLGHYLGEFSITYK

SEQ ID NO: 3004308 - protein, 18 aa, Entamoeba invadens
KPEMLGHYLGEFSITYKP

SEQ ID NO: 3004309 - protein, 19 aa, Entamoeba invadens
KPFARLVECSWMSLNSGDA

SEQ ID NO: 3004310 - protein, 24 aa, Entamoeba invadens
KPFDFKIIKLFPKNVNIFFTFLSN

SEQ ID NO: 3004311 - protein, 20 aa, Entamoeba invadens
KPFIEMVFDLICECLTAITD

SEQ ID NO: 3004312 - protein, 19 aa, Entamoeba invadens
KPFRAVPCQPKPLKIDQQD

SEQ ID NO: 3004313 - protein, 19 aa, Entamoeba invadens
KPFVVDYVLPPSAEPLRSF

SEQ ID NO: 3004314 - protein, 28 aa, Entamoeba invadens
KPGFGHLCCLKCLRPKQGSNSVCICRVP

SEQ ID NO: 3004315 - protein, 24 aa, Entamoeba invadens
KPGKLEIYVFLDGKKINEVPYLYD

SEQ ID NO: 3004316 - protein, 17 aa, Entamoeba invadens
KPGMLYLLPTTTDTYQL

SEQ ID NO: 3004317 - protein, 18 aa, Entamoeba invadens
KPGYACEFEIFIKPLCSC

SEQ ID NO: 3004318 - protein, 17 aa, Entamoeba invadens
KPHISFEGFDGFFKILM

SEQ ID NO: 3004319 - protein, 31 aa, Entamoeba invadens
KPHKEYTDKPLFFFIGLSLKQDTHFLSTIQK

SEQ ID NO: 3004320 - protein, 17 aa, Entamoeba invadens
KPIDDWLCQCKNTPMGI

SEQ ID NO: 3004321 - protein, 25 aa, Entamoeba invadens
KPIEKKLRYQIDKLLSHTKADEKLE

SEQ ID NO: 3004322 - protein, 19 aa, Entamoeba invadens
KPIEPAPFGMEPFGVKNEL

SEQ ID NO: 3004323 - protein, 24 aa, Entamoeba invadens
KPIGKISPPLIFPNKTREIKNDFN

SEQ ID NO: 3004324 - protein, 33 aa, Entamoeba invadens
KPIIEVFSRMNFAYVLLSKRNLNLFVQKKLVDG

SEQ ID NO: 3004325 - protein, 19 aa, Entamoeba invadens
KPILNVLSSDQIFYSTEPT

SEQ ID NO: 3004326 - protein, 24 aa, Entamoeba invadens
KPINKQFTEWITPQNYKQLDKSVF

SEQ ID NO: 3004327 - protein, 32 aa, Entamoeba invadens
KPINLEFEKVFWPYLLISKKRYAGVFWCNAEK

SEQ ID NO: 3004328 - protein, 20 aa, Entamoeba invadens
KPINNLLFSKHIVVDHSSIR

SEQ ID NO: 3004329 - protein, 30 aa, Entamoeba invadens
KPKDFAFLVAEWYQLCLTYNKMKQVLYVKG

SEQ ID NO: 3004330 - protein, 17 aa, Entamoeba invadens
KPKFDKMYKEYYDKVYA

SEQ ID NO: 3004331 - protein, 25 aa, Entamoeba invadens
KPKSAYLLHTNLIVLVYSIASLESF

SEQ ID NO: 3004332 - protein, 24 aa, Entamoeba invadens
KPKSLNLEFFECLTPIIAVEKNTI

SEQ ID NO: 3004333 - protein, 29 aa, Entamoeba invadens
KPKTTKKSKRPLTPYLRFAQAKREEIKAG

SEQ ID NO: 3004334 - protein, 24 aa, Entamoeba invadens
KPLDKKWFVCTIPETWNKGTVESK

SEQ ID NO: 3004335 - protein, 18 aa, Entamoeba invadens
KPLILRVEFAGCSNLNII

SEQ ID NO: 3004336 - protein, 20 aa, Entamoeba invadens
KPLINRVGDYIITSGKIKKF

SEQ ID NO: 3004337 - protein, 20 aa, Entamoeba invadens
KPLKFNAPSNGSYFTIRQAT

SEQ ID NO: 3004338 - protein, 20 aa, Entamoeba invadens
KPLQEWSGLKGHRVLYDSQK

SEQ ID NO: 3004339 - protein, 17 aa, Entamoeba invadens
KPLRKSVSVSKPVQKEQ

SEQ ID NO: 3004340 - protein, 39 aa, Entamoeba invadens
KPLRNKLVHHLIMEYGIYQRLNIYKPWRATNEQLEMFHS

SEQ ID NO: 3004341 - protein, 28 aa, Entamoeba invadens
KPLRNKLVHHLIMSYGVYQRLNIYKPWR

SEQ ID NO: 3004342 - protein, 22 aa, Entamoeba invadens
KPLSEIVIFPIAKVVVKNKENI

SEQ ID NO: 3004343 - protein, 27 aa, Entamoeba invadens
KPLSFRKKALFNFGAVQLAMHAFASLN

SEQ ID NO: 3004344 - protein, 17 aa, Entamoeba invadens
KPLSIHHIPITISFGIT

SEQ ID NO: 3004345 - protein, 20 aa, Entamoeba invadens
KPLVGKYLVVDGHNYHDTCF

SEQ ID NO: 3004346 - protein, 23 aa, Entamoeba invadens
KPLVPKEEQIQRGLAVLDNLDKM

SEQ ID NO: 3004347 - protein, 27 aa, Entamoeba invadens
KPMGISMGGGMMGMPAITLADLQKGKQ

SEQ ID NO: 3004348 - protein, 19 aa, Entamoeba invadens
KPNFELCHLFGAEKGINCC

SEQ ID NO: 3004349 - protein, 23 aa, Entamoeba invadens
KPNIKVSCYCGHEFCFGCGRERH

SEQ ID NO: 3004350 - protein, 32 aa, Entamoeba invadens
KPNKVYILKYLTTKIFDTFYFSSPLQTDPITG

SEQ ID NO: 3004351 - protein, 27 aa, Entamoeba invadens
KPNNKPFPPFIKDGWMKKNIIAYDFLL

SEQ ID NO: 3004352 - protein, 23 aa, Entamoeba invadens
KPNSILRFGINITPTLFVTNNIC

SEQ ID NO: 3004353 - protein, 24 aa, Entamoeba invadens
KPNSNLIVTGIFYSLGNSSKNNLI

SEQ ID NO: 3004354 - protein, 25 aa, Entamoeba invadens
KPNTFRPKEIAALFFKKLMNQIKTK

SEQ ID NO: 3004355 - protein, 38 aa, Entamoeba invadens
KPNTFRPKEIAALFFKTLMNQIKMEMPDLVRPNMFVGV

SEQ ID NO: 3004356 - protein, 17 aa, Entamoeba invadens
KPNYIASDVDKFALLLP

SEQ ID NO: 3004357 - protein, 27 aa, Entamoeba invadens
KPNYVIYHELLLTSNSYMRCVTAIEGK

SEQ ID NO: 3004358 - protein, 31 aa, Entamoeba invadens
KPPDPRLPKPLFAWNLPKGYEAVLKKAYKQT

SEQ ID NO: 3004359 - protein, 19 aa, Entamoeba invadens
KPPEFYRITPRKALNAIYI

SEQ ID NO: 3004360 - protein, 23 aa, Entamoeba invadens
KPPFPVEFSLPRKTPNYALQFLP

SEQ ID NO: 3004361 - protein, 21 aa, Entamoeba invadens
KPPKGVILYGPPGTGKTLLAK

SEQ ID NO: 3004362 - protein, 17 aa, Entamoeba invadens
KPPLPLSEAFVTQCKHT

SEQ ID NO: 3004363 - protein, 19 aa, Entamoeba invadens
KPPTLPKRPNFKAPMPPSG

SEQ ID NO: 3004364 - protein, 30 aa, Entamoeba invadens
KPPYEDLMTMRILELIKKHPPPTFKNKEEN

SEQ ID NO: 3004365 - protein, 25 aa, Entamoeba invadens
KPQAPQTAFQLHKADPELGNKPWKE

SEQ ID NO: 3004366 - protein, 51 aa, Entamoeba invadens
KPQESEYYKVKYGESDFVLMFWNPNQPLEQWMVKDLLESIDVKPRGIRVGR

SEQ ID NO: 3004367 - protein, 23 aa, Entamoeba invadens
KPQIVVLCCKKFTFKKGIKFECM

SEQ ID NO: 3004368 - protein, 22 aa, Entamoeba invadens
KPQNVFVYSSVPTQFHSRRIQQ

SEQ ID NO: 3004369 - protein, 31 aa, Entamoeba invadens
KPQRRKLALVDPLDFFLNFPSTQFSQLSPAE

SEQ ID NO: 3004370 - protein, 19 aa, Entamoeba invadens
KPQTIRVPAEMKRLAVSCE

SEQ ID NO: 3004371 - protein, 18 aa, Entamoeba invadens
KPQVLEKIRKIKFQKIEQ

SEQ ID NO: 3004372 - protein, 29 aa, Entamoeba invadens
KPREFFKVRVLYDFDYFESLKYPSDKFDY

SEQ ID NO: 3004373 - protein, 29 aa, Entamoeba invadens
KPRKIRSKKILSLEEQLALVESVVSSGAE

SEQ ID NO: 3004374 - protein, 39 aa, Entamoeba invadens
KPRKKKIYVNAGVDKKFLKYLAIAAPVKGLTAEVYDKLI

SEQ ID NO: 3004375 - protein, 17 aa, Entamoeba invadens
KPRRPTCVQPGKKKMTK

SEQ ID NO: 3004376 - protein, 26 aa, Entamoeba invadens
KPRVNTEEFRFGKTKIFFKVGVLAEI

SEQ ID NO: 3004377 - protein, 30 aa, Entamoeba invadens
KPRVYKKRAKKYPVAKPKKAKNSYIKYCQE

SEQ ID NO: 3004378 - protein, 23 aa, Entamoeba invadens
KPSELRRAFTQFKRLNSIDKGDE

SEQ ID NO: 3004379 - protein, 21 aa, Entamoeba invadens
KPSENFAFQFRLYSASNLAES

SEQ ID NO: 3004380 - protein, 18 aa, Entamoeba invadens
KPSKKTANFFIWSEIYTP

SEQ ID NO: 3004381 - protein, 30 aa, Entamoeba invadens
KPSNPCPLPMLFRLFLRKDYTVEVFSMLCE

SEQ ID NO: 3004382 - protein, 25 aa, Entamoeba invadens
KPSPLVRIPVFYRDNGAYVVTTTNC

SEQ ID NO: 3004383 - protein, 27 aa, Entamoeba invadens
KPSQRKVLWTCLIKNVIRELKVSQLSG

SEQ ID NO: 3004384 - protein, 23 aa, Entamoeba invadens
KPTDLAKAFPGLKGTEAILQFMA

SEQ ID NO: 3004385 - protein, 18 aa, Entamoeba invadens
KPTFDFGNIFNQPPKEQT

SEQ ID NO: 3004386 - protein, 23 aa, Entamoeba invadens
KPTFHLTGPYGVLTRILPYPLNH

SEQ ID NO: 3004387 - protein, 17 aa, Entamoeba invadens
KPTLAELIAMQKAGNLP

SEQ ID NO: 3004388 - protein, 27 aa, Entamoeba invadens
KPTMTLRFQNFYYFAEFLADDVITSLT

SEQ ID NO: 3004389 - protein, 21 aa, Entamoeba invadens
KPTSLIFIREFRVPVNAFVTC

SEQ ID NO: 3004390 - protein, 17 aa, Entamoeba invadens
KPTVIIFGPGDEQVIHK

SEQ ID NO: 3004391 - protein, 28 aa, Entamoeba invadens
KPVHQLMSYELFMKALLKHSWNNYEELN

SEQ ID NO: 3004392 - protein, 20 aa, Entamoeba invadens
KPVLPFFPQVVVPQQPTIVA

SEQ ID NO: 3004393 - protein, 24 aa, Entamoeba invadens
KPVTFLKAAPNMFKSPLKTSKKLI

SEQ ID NO: 3004394 - protein, 18 aa, Entamoeba invadens
KPYILRRMKKEVEKSLPP

SEQ ID NO: 3004395 - protein, 24 aa, Entamoeba invadens
KQAISVNFLLFSQGSFQVLKDELV

SEQ ID NO: 3004396 - protein, 19 aa, Entamoeba invadens
KQAKSEHWQIQRGKEDLSK

SEQ ID NO: 3004397 - protein, 35 aa, Entamoeba invadens
KQAKSGTEEFKFGKIKIFFKVADNQRLQNGITEHK

SEQ ID NO: 3004398 - protein, 36 aa, Entamoeba invadens
KQAKSGTEEFKFGKIKIFFKVGVLAEIEERRRVDEE

SEQ ID NO: 3004399 - protein, 26 aa, Entamoeba invadens
KQATYLFSSLTRLAVLVLKTGEKMKN

SEQ ID NO: 3004400 - protein, 21 aa, Entamoeba invadens
KQCALKAFDLFKAAASKKQSD

SEQ ID NO: 3004401 - protein, 20 aa, Entamoeba invadens
KQCFSACHFLKEIKLVEGLC

SEQ ID NO: 3004402 - protein, 30 aa, Entamoeba invadens
KQCPNPLSFCSFVFVFRTALDKNYFIPANY

SEQ ID NO: 3004403 - protein, 25 aa, Entamoeba invadens
KQCRVCTTGYYPSNANLSCIPCDST

SEQ ID NO: 3004404 - protein, 32 aa, Entamoeba invadens
KQDPPNIHLLRKGEYLFDIPTTFETPSKKLMT

SEQ ID NO: 3004405 - protein, 22 aa, Entamoeba invadens
KQDPVIYMYQWDVDGYQKNLQK

SEQ ID NO: 3004406 - protein, 28 aa, Entamoeba invadens
KQDQPTASPFGGFNPAAAKLKKTTKKVV

SEQ ID NO: 3004407 - protein, 20 aa, Entamoeba invadens
KQDVLFPPSLTYLRLESASV

SEQ ID NO: 3004408 - protein, 18 aa, Entamoeba invadens
KQDVLFRPNWIQLEQIDL

SEQ ID NO: 3004409 - protein, 25 aa, Entamoeba invadens
KQEEKLKSIIKRLSLIEKGVNEVKR

SEQ ID NO: 3004410 - protein, 34 aa, Entamoeba invadens
KQEEYFQDMTILMRIYLNALRPFCDYRSCGPLAI

SEQ ID NO: 3004411 - protein, 51 aa, Entamoeba invadens
KQEIIDCPYPFFIFEWQYLWFIHAFNIETSLRVFDYILMDGIVALMSVTNN

SEQ ID NO: 3004412 - protein, 26 aa, Entamoeba invadens
KQEILKLYTGIMKYGADFGLIELMFD

SEQ ID NO: 3004413 - protein, 30 aa, Entamoeba invadens
KQEKHKRVMFALGTVLYCVANKGGVKTPYW

SEQ ID NO: 3004414 - protein, 20 aa, Entamoeba invadens
KQENLFLLQNKTTQIFVISS

SEQ ID NO: 3004415 - protein, 29 aa, Entamoeba invadens
KQEQRILQLKRQLLDFGFFAEVVGSDVNA

SEQ ID NO: 3004416 - protein, 44 aa, Entamoeba invadens
KQERKKRQLLRTAERQKQIYTPVYPKYLISKLAEHKDEILAKEA

SEQ ID NO: 3004417 - protein, 19 aa, Entamoeba invadens
KQERVLSPVLFSTGTTQVA

SEQ ID NO: 3004418 - protein, 30 aa, Entamoeba invadens
KQESFVFGSVWFFFEVMTRIVVSILDASGN

SEQ ID NO: 3004419 - protein, 24 aa, Entamoeba invadens
KQETSFFNLFKRKENHSVSPQMNY

SEQ ID NO: 3004420 - protein, 22 aa, Entamoeba invadens
KQFESVFDLFKKIFVELNKSEK

SEQ ID NO: 3004421 - protein, 28 aa, Entamoeba invadens
KQFIPQNPGCVLSIVRITLKNGCYHEDI

SEQ ID NO: 3004422 - protein, 27 aa, Entamoeba invadens
KQFITQILGLIKPYFTLQKQSLTKQAA

SEQ ID NO: 3004423 - protein, 19 aa, Entamoeba invadens
KQFKSLWRKVQTGGFIKVQ

SEQ ID NO: 3004424 - protein, 21 aa, Entamoeba invadens
KQFPELPILVPDSVEYAMAVK

SEQ ID NO: 3004425 - protein, 20 aa, Entamoeba invadens
KQFYSAHDDIYPFVTKHWAI

SEQ ID NO: 3004426 - protein, 22 aa, Entamoeba invadens
KQGMFETFVTGWKFFMSVEDVS

SEQ ID NO: 3004427 - protein, 27 aa, Entamoeba invadens
KQHDFFASIKFALIRNMTPPIVPKLMG

SEQ ID NO: 3004428 - protein, 31 aa, Entamoeba invadens
KQHEMLYILYRNIKHFITLKKELFSSQISCF

SEQ ID NO: 3004429 - protein, 19 aa, Entamoeba invadens
KQHEQLMAKLLQRFTLNEQ

SEQ ID NO: 3004430 - protein, 26 aa, Entamoeba invadens
KQHYKELVLVLSQAIRFDLFTPEQNK

SEQ ID NO: 3004431 - protein, 22 aa, Entamoeba invadens
KQIADIKMFLVGAGAIGCEVIK

SEQ ID NO: 3004432 - protein, 24 aa, Entamoeba invadens
KQIDQSLAGYLSFMKTMEDKPYCL

SEQ ID NO: 3004433 - protein, 19 aa, Entamoeba invadens
KQIEDVKMFLVGAGAIGCE

SEQ ID NO: 3004434 - protein, 25 aa, Entamoeba invadens
KQIEFPFRYGMVKTLRILFSSMINT

SEQ ID NO: 3004435 - protein, 18 aa, Entamoeba invadens
KQIEKCAFYNCDFQKVVF

SEQ ID NO: 3004436 - protein, 29 aa, Entamoeba invadens
KQIKATSEDFFLFGSPYVYQTLEFYRRNK

SEQ ID NO: 3004437 - protein, 25 aa, Entamoeba invadens
KQIKTMSFPKIYDSTPITFECEIDN

SEQ ID NO: 3004438 - protein, 32 aa, Entamoeba invadens
KQIKTVVHPQVSAYFLIIYETSDSANTTQYIN

SEQ ID NO: 3004439 - protein, 24 aa, Entamoeba invadens
KQINDLVYLNSDIVLFCFSVDSKN

SEQ ID NO: 3004440 - protein, 19 aa, Entamoeba invadens
KQINLLNQMKNIYSYDGFA

SEQ ID NO: 3004441 - protein, 22 aa, Entamoeba invadens
KQIWLEKIDAKPTKHRPPPPQK

SEQ ID NO: 3004442 - protein, 33 aa, Entamoeba invadens
KQKEKVVPVIIPPVRPHLRPQVKPVVPERRVEV

SEQ ID NO: 3004443 - protein, 25 aa, Entamoeba invadens
KQKGIFFLCDPILGDDGRLYTKPEV

SEQ ID NO: 3004444 - protein, 23 aa, Entamoeba invadens
KQKIRCLIPCAIDQDPYFRMTRD

SEQ ID NO: 3004445 - protein, 30 aa, Entamoeba invadens
KQKIVLCCEPIFWMYANYLKESFIRENPTV

SEQ ID NO: 3004446 - protein, 24 aa, Entamoeba invadens
KQKKGVFDTGVDCLLFTAIDKNPM

SEQ ID NO: 3004447 - protein, 25 aa, Entamoeba invadens
KQKLEPTCNFFIQNAKRINSLRKVR

SEQ ID NO: 3004448 - protein, 21 aa, Entamoeba invadens
KQKLIEAGYLALKEAVTKLEI

SEQ ID NO: 3004449 - protein, 26 aa, Entamoeba invadens
KQKVNRIHSILYAGTWGNLIARIDNE

SEQ ID NO: 3004450 - protein, 23 aa, Entamoeba invadens
KQLALFVVVLKRLLKSNNMNIVT

SEQ ID NO: 3004451 - protein, 36 aa, Entamoeba invadens
KQLDLRSFLIMPVQRLPRYSLLLADLIKHTSKDHPD

SEQ ID NO: 3004452 - protein, 17 aa, Entamoeba invadens
KQLGLVLSFVLQFDNKK

SEQ ID NO: 3004453 - protein, 24 aa, Entamoeba invadens
KQLICIARALLKGSKILIMDEATA

SEQ ID NO: 3004454 - protein, 19 aa, Entamoeba invadens
KQLKILFGGGFTQNECSSY

SEQ ID NO: 3004455 - protein, 27 aa, Entamoeba invadens
KQLKKRFWRETYGGAKLFMMSELYHSH

SEQ ID NO: 3004456 - protein, 17 aa, Entamoeba invadens
KQLLLKEQQYKQSLTSS

SEQ ID NO: 3004457 - protein, 21 aa, Entamoeba invadens
KQLMINTTWLSPELKEILKAA

SEQ ID NO: 3004458 - protein, 30 aa, Entamoeba invadens
KQLNEVLTAKYIYQVLIGLEYIHSQGIVHR

SEQ ID NO: 3004459 - protein, 18 aa, Entamoeba invadens
KQLQINAIALSKQTRQWT

SEQ ID NO: 3004460 - protein, 59 aa, Entamoeba invadens
KQLTSARRIEFLQHTMQMVYVSYHEIQHRNQGLLLEIKTMVECNALFKQRSEEGMRNIK

SEQ ID NO: 3004461 - protein, 17 aa, Entamoeba invadens
KQLVLVSKKYRQIFEML

SEQ ID NO: 3004462 - protein, 26 aa, Entamoeba invadens
KQLVSPFLKIPPLLEIPALYNIKNNK

SEQ ID NO: 3004463 - protein, 24 aa, Entamoeba invadens
KQLYLQASVIYKKMSEDITKGDIT

SEQ ID NO: 3004464 - protein, 34 aa, Entamoeba invadens
KQMENELKRLNELYGPLLQEKNEKDKQIEFGNKE

SEQ ID NO: 3004465 - protein, 21 aa, Entamoeba invadens
KQMRFAIRSDKAMKAFLCFDQ

SEQ ID NO: 3004466 - protein, 26 aa, Entamoeba invadens
KQMSDAKHVPPITINTKSISDRINTF

SEQ ID NO: 3004467 - protein, 19 aa, Entamoeba invadens
KQMYSIYTTEYFSDAQFSI

SEQ ID NO: 3004468 - protein, 24 aa, Entamoeba invadens
KQNHKFLMFVHQQLKVMIFALNKE

SEQ ID NO: 3004469 - protein, 20 aa, Entamoeba invadens
KQNIKMLYDSALAGFEGRDL

SEQ ID NO: 3004470 - protein, 18 aa, Entamoeba invadens
KQNLLNQISEHNEKYDKM

SEQ ID NO: 3004471 - protein, 26 aa, Entamoeba invadens
KQNMFYYFHALFLKKVGNLSFVKDHL

SEQ ID NO: 3004472 - protein, 21 aa, Entamoeba invadens
KQPCFQLISPIQSKSYFIQCT

SEQ ID NO: 3004473 - protein, 17 aa, Entamoeba invadens
KQPKGIWTRVKQISLIP

SEQ ID NO: 3004474 - protein, 38 aa, Entamoeba invadens
KQPPSPHHMKYPPKPPTIPPKPLAYKKPWNPAKVSGST

SEQ ID NO: 3004475 - protein, 18 aa, Entamoeba invadens
KQPVNFPDYFQFKINLSN

SEQ ID NO: 3004476 - protein, 24 aa, Entamoeba invadens
KQQDDFDTMFYFGSIDFEYTVTLE

SEQ ID NO: 3004477 - protein, 23 aa, Entamoeba invadens
KQQKYPVLLLTTGTIEKYVTDSR

SEQ ID NO: 3004478 - protein, 20 aa, Entamoeba invadens
KQQLLFVGLIPIDKKQFEKR

SEQ ID NO: 3004479 - protein, 20 aa, Entamoeba invadens
KQQLQQITWIDLSFSVCHLA

SEQ ID NO: 3004480 - protein, 29 aa, Entamoeba invadens
KQQQKTSLFLNFSNLLVNAIRKAIKSVLT

SEQ ID NO: 3004481 - protein, 26 aa, Entamoeba invadens
KQQTYRWFVCLFSREFHYHMTFAIWD

SEQ ID NO: 3004482 - protein, 26 aa, Entamoeba invadens
KQQVYGLLVCFFARQLSVHNTCPIYD

SEQ ID NO: 3004483 - protein, 21 aa, Entamoeba invadens
KQRDFHINWKYRQAMRFLSMY

SEQ ID NO: 3004484 - protein, 17 aa, Entamoeba invadens
KQREMLSFVDRFSYTIV

SEQ ID NO: 3004485 - protein, 17 aa, Entamoeba invadens
KQRLVLSGFEKITRIKK

SEQ ID NO: 3004486 - protein, 27 aa, Entamoeba invadens
KQRNDFLFLFVNELQRSLMACHGRLME

SEQ ID NO: 3004487 - protein, 24 aa, Entamoeba invadens
KQRNDLFIIMNKVEGLISVVDFEM

SEQ ID NO: 3004488 - protein, 27 aa, Entamoeba invadens
KQRYSQMFPYSITLIQTYRVTEGKSIR

SEQ ID NO: 3004489 - protein, 18 aa, Entamoeba invadens
KQSARVFLARAYCLLGLN

SEQ ID NO: 3004490 - protein, 34 aa, Entamoeba invadens
KQSDFLPKIRGRKSLYFIIFDSNLNVFGVYVNTT

SEQ ID NO: 3004491 - protein, 27 aa, Entamoeba invadens
KQSDGGWFSSWWKSESDELNMMKKVVE

SEQ ID NO: 3004492 - protein, 17 aa, Entamoeba invadens
KQSLMSFLTGKPREKVV

SEQ ID NO: 3004493 - protein, 24 aa, Entamoeba invadens
KQSLNSLFPGLKNLFCECVEKCTN

SEQ ID NO: 3004494 - protein, 25 aa, Entamoeba invadens
KQSLNSLFPGLKNLFCECVEKCTNV

SEQ ID NO: 3004495 - protein, 23 aa, Entamoeba invadens
KQSSFIVVIVSETHVLEGCTVDC

SEQ ID NO: 3004496 - protein, 17 aa, Entamoeba invadens
KQSSGFLNFLKVGKKDS

SEQ ID NO: 3004497 - protein, 24 aa, Entamoeba invadens
KQSYETFVAFPIIKTNFATNENGV

SEQ ID NO: 3004498 - protein, 22 aa, Entamoeba invadens
KQTIANLYFEKVSNWLTECPDI

SEQ ID NO: 3004499 - protein, 22 aa, Entamoeba invadens
KQTNFLYFLLSQTNIDTILNLP

SEQ ID NO: 3004500 - protein, 24 aa, Entamoeba invadens
KQTTYNQYLLFKNVLETSEECLKV

SEQ ID NO: 3004501 - protein, 23 aa, Entamoeba invadens
KQVAQFDTFYYREIYYANIDCTF

SEQ ID NO: 3004502 - protein, 25 aa, Entamoeba invadens
KQVGLVLDFVLQFDNKKLGNSSIQN

SEQ ID NO: 3004503 - protein, 30 aa, Entamoeba invadens
KQVMELIPEFFYFPEFLRNFDKFDLKKRND

SEQ ID NO: 3004504 - protein, 28 aa, Entamoeba invadens
KQVRGKVDAFYLFVAPPSMEVLEQRLRG

SEQ ID NO: 3004505 - protein, 24 aa, Entamoeba invadens
KQVTPLLFVIEDVVPIGVGKCDLP

SEQ ID NO: 3004506 - protein, 36 aa, Entamoeba invadens
KQVYDGVGVIPLDCPWFICYFSGRPHINFSCKSQDT

SEQ ID NO: 3004507 - protein, 25 aa, Entamoeba invadens
KQYDDVLRINCQLIEIADGCERCHQ

SEQ ID NO: 3004508 - protein, 21 aa, Entamoeba invadens
KQYLDIEKFVTFLFTVADKKN

SEQ ID NO: 3004509 - protein, 29 aa, Entamoeba invadens
KQYLNDFYKIKWFNPIQPILITKQPELKN

SEQ ID NO: 3004510 - protein, 21 aa, Entamoeba invadens
KQYNYVFVCCGRQSPYTFDKA

SEQ ID NO: 3004511 - protein, 17 aa, Entamoeba invadens
KQYRELFKAMRKNNPKS

SEQ ID NO: 3004512 - protein, 28 aa, Entamoeba invadens
KQYSSFYHNLKNLRWFPTTQRTIEYHDH

SEQ ID NO: 3004513 - protein, 20 aa, Entamoeba invadens
KRAAVLCLGFVLLKKVDELC

SEQ ID NO: 3004514 - protein, 25 aa, Entamoeba invadens
KRAGEILPTFPWPKEFEKSVFESPD

SEQ ID NO: 3004515 - protein, 22 aa, Entamoeba invadens
KRALIAMRQLYKQQPQILSINP

SEQ ID NO: 3004516 - protein, 20 aa, Entamoeba invadens
KRALMILQKFDKGVTDMFEF

SEQ ID NO: 3004517 - protein, 20 aa, Entamoeba invadens
KRARWILDLLKTDEKEKKTN

SEQ ID NO: 3004518 - protein, 37 aa, Entamoeba invadens
KRAWVPPHVFALKNHFFFGCVKLTKLVLPKSVSVFGE

SEQ ID NO: 3004519 - protein, 20 aa, Entamoeba invadens
KRCCQNAFVANLYISAAFSN

SEQ ID NO: 3004520 - protein, 23 aa, Entamoeba invadens
KRCFLCYRPCCKNHSINLEADAE

SEQ ID NO: 3004521 - protein, 22 aa, Entamoeba invadens
KRCKPYADIYIEASKRLGVDIK

SEQ ID NO: 3004522 - protein, 18 aa, Entamoeba invadens
KRCQLIEDIISQIEKYQI

SEQ ID NO: 3004523 - protein, 19 aa, Entamoeba invadens
KRCSAITRLKLTKSITKFG

SEQ ID NO: 3004524 - protein, 19 aa, Entamoeba invadens
KRCSSLVDITLPSGLSFIG

SEQ ID NO: 3004525 - protein, 24 aa, Entamoeba invadens
KRDDFKRVLNTYAVRGFPSDVIDD

SEQ ID NO: 3004526 - protein, 27 aa, Entamoeba invadens
KRDFKKKPFPPARIRKLMKIATDKKHV

SEQ ID NO: 3004527 - protein, 18 aa, Entamoeba invadens
KRDFTHSSSKKWLEALTV

SEQ ID NO: 3004528 - protein, 22 aa, Entamoeba invadens
KRDILEVLLKGIKKFHLQVTLL

SEQ ID NO: 3004529 - protein, 26 aa, Entamoeba invadens
KRDKDAIPVFLWMANNYFTVQGSDQK

SEQ ID NO: 3004530 - protein, 26 aa, Entamoeba invadens
KRDKKHHKEIFKAMEKAEKNKAKLEK

SEQ ID NO: 3004531 - protein, 27 aa, Entamoeba invadens
KRDLDYLFDIFYCPETIIKEGKFTAGP

SEQ ID NO: 3004532 - protein, 28 aa, Entamoeba invadens
KRDLDYLFDIFYCPETIIMEGKFTAGPG

SEQ ID NO: 3004533 - protein, 23 aa, Entamoeba invadens
KRDLSRYVKFPRYVRVQKEKRIL

SEQ ID NO: 3004534 - protein, 28 aa, Entamoeba invadens
KRDVMAIYHQNMPLLLKEIAQTTFEYEV

SEQ ID NO: 3004535 - protein, 22 aa, Entamoeba invadens
KRDWECIDSLRLGLLNDHLTAL

SEQ ID NO: 3004536 - protein, 24 aa, Entamoeba invadens
KREDLKHELLITQKLWSAFPSADE

SEQ ID NO: 3004537 - protein, 33 aa, Entamoeba invadens
KREEALLCYIDFLRYWFFLREDQKWFHPTTKIL

SEQ ID NO: 3004538 - protein, 26 aa, Entamoeba invadens
KREEKILVKVLPKYFAFIQENPQTLI

SEQ ID NO: 3004539 - protein, 27 aa, Entamoeba invadens
KREELIDFIHACSERIRILKQKNSELQ

SEQ ID NO: 3004540 - protein, 18 aa, Entamoeba invadens
KREFCVRDFTFIVDVPIK

SEQ ID NO: 3004541 - protein, 20 aa, Entamoeba invadens
KREIIVFDGKFDWTGFKGQK

SEQ ID NO: 3004542 - protein, 19 aa, Entamoeba invadens
KREINQSRMPLLLETIRER

SEQ ID NO: 3004543 - protein, 21 aa, Entamoeba invadens
KRELGLLVVKQRKMVDYIINE

SEQ ID NO: 3004544 - protein, 25 aa, Entamoeba invadens
KRENKLEQLPFYAKARRVKVLMCTW

SEQ ID NO: 3004545 - protein, 25 aa, Entamoeba invadens
KRENVHLLNLPFYQTGQIVKNPVSQ

SEQ ID NO: 3004546 - protein, 27 aa, Entamoeba invadens
KREQNDMLFQLPYLQFLRTAYCNTMIE

SEQ ID NO: 3004547 - protein, 25 aa, Entamoeba invadens
KREQYRAIRNLDLRFRFSLGTELDT

SEQ ID NO: 3004548 - protein, 26 aa, Entamoeba invadens
KRERSGALLIATKLTQTPAFANEQNS

SEQ ID NO: 3004549 - protein, 19 aa, Entamoeba invadens
KRETFMTKVKEACDKNKIA

SEQ ID NO: 3004550 - protein, 21 aa, Entamoeba invadens
KREVGLWTSYFKLPLDEQKAE

SEQ ID NO: 3004551 - protein, 24 aa, Entamoeba invadens
KREVQFFGFPTGVLAKQKIIGVLK

SEQ ID NO: 3004552 - protein, 30 aa, Entamoeba invadens
KRFDKNFHTFISNFLIDIALENGFSLNTRF

SEQ ID NO: 3004553 - protein, 21 aa, Entamoeba invadens
KRFFDSFKYVKDCDLLICIGT

SEQ ID NO: 3004554 - protein, 22 aa, Entamoeba invadens
KRFHYQQLIKHLKTLQQTYLNA

SEQ ID NO: 3004555 - protein, 22 aa, Entamoeba invadens
KRFKNWVLSRQNSTPLLSELQE

SEQ ID NO: 3004556 - protein, 20 aa, Entamoeba invadens
KRFKSYIKAIPKAQITPIIR

SEQ ID NO: 3004557 - protein, 26 aa, Entamoeba invadens
KRFQTPYYVHRYIINNTEGICLNCHG

SEQ ID NO: 3004558 - protein, 24 aa, Entamoeba invadens
KRFTYAEKLILPNFPNFDIVCNDI

SEQ ID NO: 3004559 - protein, 17 aa, Entamoeba invadens
KRFVGNDVVVVVFKEMN

SEQ ID NO: 3004560 - protein, 20 aa, Entamoeba invadens
KRFVNQLRKYKKSIPIVVVG

SEQ ID NO: 3004561 - protein, 17 aa, Entamoeba invadens
KRFYDEGPAPSFEAFEP

SEQ ID NO: 3004562 - protein, 20 aa, Entamoeba invadens
KRFYRTSLFMNLQKKRYESA

SEQ ID NO: 3004563 - protein, 34 aa, Entamoeba invadens
KRGDLQSQLCELLDFFFKRTVQVCVVKYEGFLEG

SEQ ID NO: 3004564 - protein, 31 aa, Entamoeba invadens
KRGHIIRNWLQRWFVLTSDILYYFDAEKLHL

SEQ ID NO: 3004565 - protein, 23 aa, Entamoeba invadens
KRGIAKKGTLIGYTVNVVLKNME

SEQ ID NO: 3004566 - protein, 17 aa, Entamoeba invadens
KRGIIRCLIPEEVNSLK

SEQ ID NO: 3004567 - protein, 31 aa, Entamoeba invadens
KRGWAIGKLGNKIGLFPLAKSIVVPLEQTDL

SEQ ID NO: 3004568 - protein, 29 aa, Entamoeba invadens
KRGYACEVEILLLIRCTLKIKSEVLIVSK

SEQ ID NO: 3004569 - protein, 19 aa, Entamoeba invadens
KRHIGNDIVVVVFLDEGVK

SEQ ID NO: 3004570 - protein, 18 aa, Entamoeba invadens
KRHIGNDVVVLIFKEYAG

SEQ ID NO: 3004571 - protein, 19 aa, Entamoeba invadens
KRICLDIYSLPHFADYFTE

SEQ ID NO: 3004572 - protein, 21 aa, Entamoeba invadens
KRIDIPKILIGILGLTCLCGD

SEQ ID NO: 3004573 - protein, 20 aa, Entamoeba invadens
KRIEDPLIVLIQKLQEKNHA

SEQ ID NO: 3004574 - protein, 32 aa, Entamoeba invadens
KRIEQLKYFLIPKTTLPIPPPIPKQPTVKPML

SEQ ID NO: 3004575 - protein, 17 aa, Entamoeba invadens
KRILASRRFVGEERLLT

SEQ ID NO: 3004576 - protein, 25 aa, Entamoeba invadens
KRINTFFSSQLFYEFLRRPNETTIV

SEQ ID NO: 3004577 - protein, 35 aa, Entamoeba invadens
KRISDTFVWYLNRFPIRVLVWKDYIAFLIESEHAN

SEQ ID NO: 3004578 - protein, 27 aa, Entamoeba invadens
KRISRTYTLYAIDYPFALTKNTFLEKN

SEQ ID NO: 3004579 - protein, 21 aa, Entamoeba invadens
KRITGKFEFLSLSLPILVNLL

SEQ ID NO: 3004580 - protein, 17 aa, Entamoeba invadens
KRIVSLYHKAPAMTGVE

SEQ ID NO: 3004581 - protein, 38 aa, Entamoeba invadens
KRIYSSLHLSIKKVSLAEAIRFVKIIRGQSPVCGPMNS

SEQ ID NO: 3004582 - protein, 22 aa, Entamoeba invadens
KRKCMMFFKELGQAKAEIVIPL

SEQ ID NO: 3004583 - protein, 20 aa, Entamoeba invadens
KRKELLQYMSKIRKLFNEGD

SEQ ID NO: 3004584 - protein, 29 aa, Entamoeba invadens
KRKENIKRIVQFLGVVFPRALEVKWRFEI

SEQ ID NO: 3004585 - protein, 23 aa, Entamoeba invadens
KRKKNISYFYINYTNAIETIVFR

SEQ ID NO: 3004586 - protein, 24 aa, Entamoeba invadens
KRKKRRLIVLFGAKAEFCHVHTNF

SEQ ID NO: 3004587 - protein, 24 aa, Entamoeba invadens
KRKLLTKLWDELPRSWKILVADQV

SEQ ID NO: 3004588 - protein, 18 aa, Entamoeba invadens
KRKLVEQLHSSPSPMIVF

SEQ ID NO: 3004589 - protein, 17 aa, Entamoeba invadens
KRKMNATAHKVRLIGLT

SEQ ID NO: 3004590 - protein, 17 aa, Entamoeba invadens
KRKQLEGILLRFSELVA

SEQ ID NO: 3004591 - protein, 24 aa, Entamoeba invadens
KRKSIHANYSPLRKCYFVEEGVEV

SEQ ID NO: 3004592 - protein, 21 aa, Entamoeba invadens
KRLCGYLGLFPPSAREERAKQ

SEQ ID NO: 3004593 - protein, 24 aa, Entamoeba invadens
KRLEMIYLMNVSLYFEKFGDVQHF

SEQ ID NO: 3004594 - protein, 21 aa, Entamoeba invadens
KRLFEGFFNFTKTRKMSTARG

SEQ ID NO: 3004595 - protein, 26 aa, Entamoeba invadens
KRLFKKMIKVFQKDWWFGVCSKDEAI

SEQ ID NO: 3004596 - protein, 22 aa, Entamoeba invadens
KRLFSLSFKKRIFSLEVVIIGE

SEQ ID NO: 3004597 - protein, 24 aa, Entamoeba invadens
KRLIEYVHMYYVDPTTDKPHPVVR

SEQ ID NO: 3004598 - protein, 17 aa, Entamoeba invadens
KRLIGRRFSDPTIQEDM

SEQ ID NO: 3004599 - protein, 25 aa, Entamoeba invadens
KRLKKIDCIPLYLFDIISSCWQQDT

SEQ ID NO: 3004600 - protein, 19 aa, Entamoeba invadens
KRLLTKPMKIDWTFYCKKC

SEQ ID NO: 3004601 - protein, 20 aa, Entamoeba invadens
KRLNLEKERRLNALSYHNVP

SEQ ID NO: 3004602 - protein, 21 aa, Entamoeba invadens
KRLNRLIKVYTIATNILMTEN

SEQ ID NO: 3004603 - protein, 29 aa, Entamoeba invadens
KRLQNRGFKFLIPKMIYLEAPQTIIPNTT

SEQ ID NO: 3004604 - protein, 20 aa, Entamoeba invadens
KRLQRNWRNSASSEKVALKD

SEQ ID NO: 3004605 - protein, 24 aa, Entamoeba invadens
KRLQSFEIPKSVILLGLCILEGCT

SEQ ID NO: 3004606 - protein, 18 aa, Entamoeba invadens
KRLSEELGKEKEKRESAE

SEQ ID NO: 3004607 - protein, 31 aa, Entamoeba invadens
KRLSLKPELWKFVNPFFPYINSVDREKIQTE

SEQ ID NO: 3004608 - protein, 18 aa, Entamoeba invadens
KRLTFNLKILKQKMDSRK

SEQ ID NO: 3004609 - protein, 32 aa, Entamoeba invadens
KRLTLFHAELVMQYLKCLIKKNMFTEVLEINN

SEQ ID NO: 3004610 - protein, 35 aa, Entamoeba invadens
KRLVLKREMYFVLKLIDFLVTSSEKFRACVFTQQF

SEQ ID NO: 3004611 - protein, 18 aa, Entamoeba invadens
KRMGVENTYFPCFVSQAA

SEQ ID NO: 3004612 - protein, 19 aa, Entamoeba invadens
KRMIELSKLLIYFNGSDST

SEQ ID NO: 3004613 - protein, 19 aa, Entamoeba invadens
KRMKKEYELILFTSADQRY

SEQ ID NO: 3004614 - protein, 21 aa, Entamoeba invadens
KRMLPQLYINCDCELYGENDV

SEQ ID NO: 3004615 - protein, 35 aa, Entamoeba invadens
KRMNITQKCFNWYTPPLPLYGIAERPIVVSFKSPS

SEQ ID NO: 3004616 - protein, 29 aa, Entamoeba invadens
KRMNQTLILLDSFSYFCMCVRDKIANFVR

SEQ ID NO: 3004617 - protein, 25 aa, Entamoeba invadens
KRMPAENVTLLRSLLKLCSKIDSMS

SEQ ID NO: 3004618 - protein, 17 aa, Entamoeba invadens
KRMYALVEFLISNSKDI

SEQ ID NO: 3004619 - protein, 29 aa, Entamoeba invadens
KRNAVFTKMFYQIVVWFNVDYTTVYNNNE

SEQ ID NO: 3004620 - protein, 17 aa, Entamoeba invadens
KRNDVVHLLEDLLFEDN

SEQ ID NO: 3004621 - protein, 23 aa, Entamoeba invadens
KRNDYYYLCSRAFNPTFTDFLVS

SEQ ID NO: 3004622 - protein, 23 aa, Entamoeba invadens
KRNEHIAITAMKTPFTLGTNSEI

SEQ ID NO: 3004623 - protein, 29 aa, Entamoeba invadens
KRNKQSFLEYMWLTQLEFVRTVRGQLVTI

SEQ ID NO: 3004624 - protein, 23 aa, Entamoeba invadens
KRNKTFLSLLDIYTKNKLDINLK

SEQ ID NO: 3004625 - protein, 26 aa, Entamoeba invadens
KRNLLETLVLIYYIGRKRDFDVSLIS

SEQ ID NO: 3004626 - protein, 23 aa, Entamoeba invadens
KRNSIVGTPYWMAPEVIRNKLYD

SEQ ID NO: 3004627 - protein, 24 aa, Entamoeba invadens
KRNSSYVFVKILSPISNFKISPDD

SEQ ID NO: 3004628 - protein, 18 aa, Entamoeba invadens
KRPCQSIYSGYRTQFWNA

SEQ ID NO: 3004629 - protein, 18 aa, Entamoeba invadens
KRPGKTFCVWPSNHQMMV

SEQ ID NO: 3004630 - protein, 20 aa, Entamoeba invadens
KRPIPIPDQNKMIHWGTLRP

SEQ ID NO: 3004631 - protein, 20 aa, Entamoeba invadens
KRPIYIRLECVCTSVSYGKD

SEQ ID NO: 3004632 - protein, 24 aa, Entamoeba invadens
KRPNRFFVPQFSQNVLFTLFGEKQ

SEQ ID NO: 3004633 - protein, 27 aa, Entamoeba invadens
KRPVSWIMICRVILYSLMEIHKGTVYF

SEQ ID NO: 3004634 - protein, 20 aa, Entamoeba invadens
KRQHFSIKCNGLVLACTECG

SEQ ID NO: 3004635 - protein, 21 aa, Entamoeba invadens
KRQIGSTVMTLILLKERANEV

SEQ ID NO: 3004636 - protein, 27 aa, Entamoeba invadens
KRQIKQLHNRIKYLTGKKPAKKTDEFK

SEQ ID NO: 3004637 - protein, 28 aa, Entamoeba invadens
KRQKENLFLFLVDFIRIPTQPVVSKVIV

SEQ ID NO: 3004638 - protein, 22 aa, Entamoeba invadens
KRQLHEIKVFYEKTKAKMSCKS

SEQ ID NO: 3004639 - protein, 20 aa, Entamoeba invadens
KRQPLSLPFVLLFLTNLIGD

SEQ ID NO: 3004640 - protein, 25 aa, Entamoeba invadens
KRQREYFTALRRTLNGLINKVTPKN

SEQ ID NO: 3004641 - protein, 22 aa, Entamoeba invadens
KRQRLLLDALYNLSGMFFCLKD

SEQ ID NO: 3004642 - protein, 24 aa, Entamoeba invadens
KRQTLAILGTIWQYLNLKQMSREE

SEQ ID NO: 3004643 - protein, 29 aa, Entamoeba invadens
KRRCNTEVMFIHFPDFLLDPVTAPRSDCP

SEQ ID NO: 3004644 - protein, 24 aa, Entamoeba invadens
KRRPTDFFELFAKSLCIGNKEDVI

SEQ ID NO: 3004645 - protein, 29 aa, Entamoeba invadens
KRRSVNCFLFNDFLIITKINATGTLHRGK

SEQ ID NO: 3004646 - protein, 25 aa, Entamoeba invadens
KRSFYKTVVWFRVPYENTLDPAYAT

SEQ ID NO: 3004647 - protein, 37 aa, Entamoeba invadens
KRSISKWINIQLSRDYLLTEKYKYLPISLEGNDLFNA

SEQ ID NO: 3004648 - protein, 24 aa, Entamoeba invadens
KRSKGILFFGPPGTGKTMLAKAVA

SEQ ID NO: 3004649 - protein, 17 aa, Entamoeba invadens
KRSPMMPLPPPPMPTDA

SEQ ID NO: 3004650 - protein, 22 aa, Entamoeba invadens
KRSRAWQTTNWSYMAGIFAVMK

SEQ ID NO: 3004651 - protein, 18 aa, Entamoeba invadens
KRSSNLPAPVRRLQSRKR

SEQ ID NO: 3004652 - protein, 27 aa, Entamoeba invadens
KRSVAVPVVFDLVYSRQLTQTRCTFKE

SEQ ID NO: 3004653 - protein, 17 aa, Entamoeba invadens
KRTDPLFDPRAPGAVVL

SEQ ID NO: 3004654 - protein, 24 aa, Entamoeba invadens
KRTEVNKKIYRIGAGALRNANTEF

SEQ ID NO: 3004655 - protein, 26 aa, Entamoeba invadens
KRTIKDIPLFYTKTLFMDSSSDFSKF

SEQ ID NO: 3004656 - protein, 20 aa, Entamoeba invadens
KRTILLLGATGFVGKFILRS

SEQ ID NO: 3004657 - protein, 19 aa, Entamoeba invadens
KRTIPRLRGVYNFVKWLEE

SEQ ID NO: 3004658 - protein, 19 aa, Entamoeba invadens
KRTLINSFKLKIHKLEEEE

SEQ ID NO: 3004659 - protein, 20 aa, Entamoeba invadens
KRTLYDLYGFEKGTHKVVMK

SEQ ID NO: 3004660 - protein, 46 aa, Entamoeba invadens
KRTNIFLEAAGHKILIGTLTPIECEQITLDLVFGRNEEVTLINEGP

SEQ ID NO: 3004661 - protein, 32 aa, Entamoeba invadens
KRTTPRSVIIPRSPRLSQFSYYIIPHHSHRRS

SEQ ID NO: 3004662 - protein, 21 aa, Entamoeba invadens
KRTVGFHFSARIFEYVVYCKN

SEQ ID NO: 3004663 - protein, 26 aa, Entamoeba invadens
KRVDNRCVLCAPSGYYDLCTDETSDG

SEQ ID NO: 3004664 - protein, 20 aa, Entamoeba invadens
KRVFRELFYTYTLSVVINNP

SEQ ID NO: 3004665 - protein, 40 aa, Entamoeba invadens
KRVGSLFLKDPGLLPEPQELYFFGFLRVVDVDKVKVQDDV

SEQ ID NO: 3004666 - protein, 24 aa, Entamoeba invadens
KRVIEFLAVFLMNLTESIIPSSLY

SEQ ID NO: 3004667 - protein, 25 aa, Entamoeba invadens
KRVITELYYIDAKRNYLVLKSEVEH

SEQ ID NO: 3004668 - protein, 24 aa, Entamoeba invadens
KRVKAFGLPMILVGGGGYTVSNTA

SEQ ID NO: 3004669 - protein, 18 aa, Entamoeba invadens
KRVMLSYLAIYNIEPCKG

SEQ ID NO: 3004670 - protein, 27 aa, Entamoeba invadens
KRVRKYQNYFLQYGFSYITENSVQKPH

SEQ ID NO: 3004671 - protein, 26 aa, Entamoeba invadens
KRVTFDPKVLVLFYKCFSECVFLKEI

SEQ ID NO: 3004672 - protein, 20 aa, Entamoeba invadens
KRVYGNRKALYKEEKAEKFL

SEQ ID NO: 3004673 - protein, 28 aa, Entamoeba invadens
KRWATKINFFSYEKVLIPINIKNTHWVL

SEQ ID NO: 3004674 - protein, 25 aa, Entamoeba invadens
KRWDYLQRMNMLPSRRFKRKVKPML

SEQ ID NO: 3004675 - protein, 24 aa, Entamoeba invadens
KRYFKQCEFKLWRKKPDVQIVAQE

SEQ ID NO: 3004676 - protein, 18 aa, Entamoeba invadens
KRYFVQLLEQYHAVKRIR

SEQ ID NO: 3004677 - protein, 24 aa, Entamoeba invadens
KRYHIIEYITVFHKRSIAGYNTRH

SEQ ID NO: 3004678 - protein, 25 aa, Entamoeba invadens
KRYQPMFLHCRSLREIFIETPPKDL

SEQ ID NO: 3004679 - protein, 28 aa, Entamoeba invadens
KSACIDIVSFLPIVFTKAAEVVSGGVVG

SEQ ID NO: 3004680 - protein, 19 aa, Entamoeba invadens
KSADIYSFAITLLEVLTWV

SEQ ID NO: 3004681 - protein, 46 aa, Entamoeba invadens
KSADVFSFGITLFETFKWGEAYDKERFRFPWKIAEFIMSGNRLEKP

SEQ ID NO: 3004682 - protein, 32 aa, Entamoeba invadens
KSAHKGKWYMYVYGVIDLLLGKSTVPAQEYQV

SEQ ID NO: 3004683 - protein, 22 aa, Entamoeba invadens
KSALDFLNLPVSVSRGVLGNLT

SEQ ID NO: 3004684 - protein, 18 aa, Entamoeba invadens
KSALFEPLKSFTVSHFPS

SEQ ID NO: 3004685 - protein, 24 aa, Entamoeba invadens
KSAMRLFSICDFFMTTFIEGKSTN

SEQ ID NO: 3004686 - protein, 24 aa, Entamoeba invadens
KSAMRLFSICDFFMTTFVEGKSTN

SEQ ID NO: 3004687 - protein, 22 aa, Entamoeba invadens
KSANVLIFSKSIKSPVIAKLCD

SEQ ID NO: 3004688 - protein, 21 aa, Entamoeba invadens
KSAQQFTYNFGANAFVHKKKN

SEQ ID NO: 3004689 - protein, 18 aa, Entamoeba invadens
KSATSVAPLPKPPKQKVV

SEQ ID NO: 3004690 - protein, 23 aa, Entamoeba invadens
KSAVSFLKVNPWFTLTQDIERFY

SEQ ID NO: 3004691 - protein, 27 aa, Entamoeba invadens
KSCDLHVFFALHRLFIEAKTAYKVTQP

SEQ ID NO: 3004692 - protein, 22 aa, Entamoeba invadens
KSCIDGFYLENDECKRGDISDC

SEQ ID NO: 3004693 - protein, 18 aa, Entamoeba invadens
KSCILWNAADGAVLKRFA

SEQ ID NO: 3004694 - protein, 27 aa, Entamoeba invadens
KSCKGPNDFFYAFVEYGKEEEASKALK

SEQ ID NO: 3004695 - protein, 20 aa, Entamoeba invadens
KSCLLHRYANQYFPDPQLPA

SEQ ID NO: 3004696 - protein, 22 aa, Entamoeba invadens
KSCPVKKLTLNTLFALMSQEEK

SEQ ID NO: 3004697 - protein, 22 aa, Entamoeba invadens
KSCPVKKLTLNTLFALMTQEEK

SEQ ID NO: 3004698 - protein, 25 aa, Entamoeba invadens
KSCRTSIVGTPYWMPPELIRSQKYD

SEQ ID NO: 3004699 - protein, 22 aa, Entamoeba invadens
KSCWASIVKVVFYSLQTLFPNK

SEQ ID NO: 3004700 - protein, 25 aa, Entamoeba invadens
KSDESVFHIWFYRKSDLFKCYEECH

SEQ ID NO: 3004701 - protein, 21 aa, Entamoeba invadens
KSDFMNVFPYMKSVVGPNGVG

SEQ ID NO: 3004702 - protein, 30 aa, Entamoeba invadens
KSDKGGRCIGIGYLVFPCKEAAQACEEMMD

SEQ ID NO: 3004703 - protein, 22 aa, Entamoeba invadens
KSDLLFCQKLGFNTLRKHAKVE

SEQ ID NO: 3004704 - protein, 34 aa, Entamoeba invadens
KSDNIPVFQKLVSSMLFYFEKLMGLSQVIPSNTV

SEQ ID NO: 3004705 - protein, 30 aa, Entamoeba invadens
KSDSSLFIRSFETKFPPLESSWSPSEKLFV

SEQ ID NO: 3004706 - protein, 24 aa, Entamoeba invadens
KSDYHVFNLKRKAVLLDPISQSKF

SEQ ID NO: 3004707 - protein, 20 aa, Entamoeba invadens
KSEARPLNALETKEKIIPQL

SEQ ID NO: 3004708 - protein, 27 aa, Entamoeba invadens
KSEATTIFPLVLALPKSPRINPPEENI

SEQ ID NO: 3004709 - protein, 27 aa, Entamoeba invadens
KSEATTILPFVLALPKSPRINPPEENI

SEQ ID NO: 3004710 - protein, 23 aa, Entamoeba invadens
KSECELLKMKVTELTKLNGDLTT

SEQ ID NO: 3004711 - protein, 17 aa, Entamoeba invadens
KSECFNGCMMLSFISLK

SEQ ID NO: 3004712 - protein, 26 aa, Entamoeba invadens
KSECKKLLVPILMRTPDDGMVISKLK

SEQ ID NO: 3004713 - protein, 19 aa, Entamoeba invadens
KSEDLEYLINSFKVEGSKG

SEQ ID NO: 3004714 - protein, 27 aa, Entamoeba invadens
KSEETWMPYYLYHLKNINPNIVDLSVL

SEQ ID NO: 3004715 - protein, 17 aa, Entamoeba invadens
KSEFWHPNVYPDGKVCI

SEQ ID NO: 3004716 - protein, 26 aa, Entamoeba invadens
KSEKAIIPIKPPLPMLNKRDVKCREE

SEQ ID NO: 3004717 - protein, 26 aa, Entamoeba invadens
KSEKPLPQFVIWFPVTHDYAKEFEGQ

SEQ ID NO: 3004718 - protein, 18 aa, Entamoeba invadens
KSEKSYLGKTYYLYKNNS

SEQ ID NO: 3004719 - protein, 19 aa, Entamoeba invadens
KSELERQLEEIKSINEGFV

SEQ ID NO: 3004720 - protein, 23 aa, Entamoeba invadens
KSELNLIIYRREKVIDQLYEYIR

SEQ ID NO: 3004721 - protein, 17 aa, Entamoeba invadens
KSELWEVIWKDYAAWEN

SEQ ID NO: 3004722 - protein, 24 aa, Entamoeba invadens
KSEMKIPLFSLFGKIPVEKVQKII

SEQ ID NO: 3004723 - protein, 24 aa, Entamoeba invadens
KSENEYFWSYKNYGAFKTQKKQRY

SEQ ID NO: 3004724 - protein, 22 aa, Entamoeba invadens
KSESMFLEYMKNGGGALCPSCG

SEQ ID NO: 3004725 - protein, 25 aa, Entamoeba invadens
KSEWNGVPVYFKLDKKDKTKKTLRF

SEQ ID NO: 3004726 - protein, 23 aa, Entamoeba invadens
KSEYELNIWINKLSLEANAWGVF

SEQ ID NO: 3004727 - protein, 24 aa, Entamoeba invadens
KSEYERDFALKIHQFQASFPQTLK

SEQ ID NO: 3004728 - protein, 35 aa, Entamoeba invadens
KSFAFVFNLLRFSYPTPFYFLTGSKRVFSVYIAIG

SEQ ID NO: 3004729 - protein, 20 aa, Entamoeba invadens
KSFCLEMTETDVRRVIVFWK

SEQ ID NO: 3004730 - protein, 19 aa, Entamoeba invadens
KSFDDFFVPNLIGVQTHTM

SEQ ID NO: 3004731 - protein, 21 aa, Entamoeba invadens
KSFDPRLFTSHFNHVFVIVQP

SEQ ID NO: 3004732 - protein, 31 aa, Entamoeba invadens
KSFFNQIQMLYGQNRKYTKPLRIRCLGVDGR

SEQ ID NO: 3004733 - protein, 25 aa, Entamoeba invadens
KSFGIFNFVGLFVELVYQTKLSNYF

SEQ ID NO: 3004734 - protein, 20 aa, Entamoeba invadens
KSFHGKYLTATPAGDISATA

SEQ ID NO: 3004735 - protein, 17 aa, Entamoeba invadens
KSFLNIVTVMWDWPKES

SEQ ID NO: 3004736 - protein, 23 aa, Entamoeba invadens
KSFLNVVKCWLPEIQSARPEVSI

SEQ ID NO: 3004737 - protein, 25 aa, Entamoeba invadens
KSFNILRQIAVQLPINTFPLELIKR

SEQ ID NO: 3004738 - protein, 20 aa, Entamoeba invadens
KSFNLSVKVPKDIIGITPRI

SEQ ID NO: 3004739 - protein, 17 aa, Entamoeba invadens
KSFPSLVNPLKKRVIEI

SEQ ID NO: 3004740 - protein, 26 aa, Entamoeba invadens
KSFQNTLLERSPLYTLPSPIVLSKQN

SEQ ID NO: 3004741 - protein, 22 aa, Entamoeba invadens
KSFRHRIVLSTLLGQTIRVTRI

SEQ ID NO: 3004742 - protein, 22 aa, Entamoeba invadens
KSFRVYLNFLEGKRVVEEQLSV

SEQ ID NO: 3004743 - protein, 23 aa, Entamoeba invadens
KSFSDFICIQLIVKKYSNLLEMF

SEQ ID NO: 3004744 - protein, 19 aa, Entamoeba invadens
KSFYFNTNLVHIFEGAFSN

SEQ ID NO: 3004745 - protein, 24 aa, Entamoeba invadens
KSGFACEFSVYYVKPLCSCKINNT

SEQ ID NO: 3004746 - protein, 23 aa, Entamoeba invadens
KSGGLFNLSFDTLKMAYLNDSSD

SEQ ID NO: 3004747 - protein, 29 aa, Entamoeba invadens
KSGIDIALFRLNYVIYLFSIVESSMKVPP

SEQ ID NO: 3004748 - protein, 22 aa, Entamoeba invadens
KSGIYREVVLPLLLERLKVDIF

SEQ ID NO: 3004749 - protein, 23 aa, Entamoeba invadens
KSGQLFAFCHFLNVDLALVILTT

SEQ ID NO: 3004750 - protein, 22 aa, Entamoeba invadens
KSGQPFYIYNLIEELDEEGEYY

SEQ ID NO: 3004751 - protein, 18 aa, Entamoeba invadens
KSGRGRVSSGRWGCGVFN

SEQ ID NO: 3004752 - protein, 22 aa, Entamoeba invadens
KSGVFFTTLIKQKVNGVGLGVD

SEQ ID NO: 3004753 - protein, 20 aa, Entamoeba invadens
KSGWRFPLPVYRSIEYLTTT

SEQ ID NO: 3004754 - protein, 21 aa, Entamoeba invadens
KSGWRYPIPIFRTIQYLKYNK

SEQ ID NO: 3004755 - protein, 22 aa, Entamoeba invadens
KSHHKTLIGTPYFLAPEIVDES

SEQ ID NO: 3004756 - protein, 27 aa, Entamoeba invadens
KSHLLSVLCILLSSLNYRVLVCASTNV

SEQ ID NO: 3004757 - protein, 19 aa, Entamoeba invadens
KSHPPIHPTKLIETGLVGN

SEQ ID NO: 3004758 - protein, 25 aa, Entamoeba invadens
KSHSDIYIFSLLRNVLQKIVNWRNE

SEQ ID NO: 3004759 - protein, 23 aa, Entamoeba invadens
KSHTFFDGIRWNSLLNESREDIF

SEQ ID NO: 3004760 - protein, 23 aa, Entamoeba invadens
KSHTTWLLEVIGAGLQLNLSDST

SEQ ID NO: 3004761 - protein, 34 aa, Entamoeba invadens
KSIAFSEQFMKSLPLLWKNIYRNNLGLCERPSFY

SEQ ID NO: 3004762 - protein, 18 aa, Entamoeba invadens
KSIAGGVAYRPTDKVTIG

SEQ ID NO: 3004763 - protein, 17 aa, Entamoeba invadens
KSIDYKCFSKCSSLSIV

SEQ ID NO: 3004764 - protein, 33 aa, Entamoeba invadens
KSIEAFQQGVLIYLLVRSSYTVTLKRLDKTAKK

SEQ ID NO: 3004765 - protein, 25 aa, Entamoeba invadens
KSIEELFIVAYPVLSRYFVNPDVPF

SEQ ID NO: 3004766 - protein, 29 aa, Entamoeba invadens
KSIETPSFHILWFDTIFQKQKERKKYMEA

SEQ ID NO: 3004767 - protein, 20 aa, Entamoeba invadens
KSIFEILNTPPLYDALDTSQ

SEQ ID NO: 3004768 - protein, 27 aa, Entamoeba invadens
KSIGLYEYYPPLDLSLMTSLKRFECSD

SEQ ID NO: 3004769 - protein, 19 aa, Entamoeba invadens
KSIGYFDFELLEPILHPKT

SEQ ID NO: 3004770 - protein, 21 aa, Entamoeba invadens
KSIHYISLKSCTLVELPHLVL

SEQ ID NO: 3004771 - protein, 18 aa, Entamoeba invadens
KSIIVDDFFVVNDALSGI

SEQ ID NO: 3004772 - protein, 19 aa, Entamoeba invadens
KSIIWEIVKQLRPGMSLDR

SEQ ID NO: 3004773 - protein, 18 aa, Entamoeba invadens
KSIKPFLLRRVKSDVEKS

SEQ ID NO: 3004774 - protein, 21 aa, Entamoeba invadens
KSILSSVWIFNSFSPQILHHI

SEQ ID NO: 3004775 - protein, 23 aa, Entamoeba invadens
KSIRDFVIILTSNHQLTITRLEG

SEQ ID NO: 3004776 - protein, 24 aa, Entamoeba invadens
KSIRTQIVQFFRLTVRKYMSSKAE

SEQ ID NO: 3004777 - protein, 19 aa, Entamoeba invadens
KSISKQNYYYGFDAILKEG

SEQ ID NO: 3004778 - protein, 24 aa, Entamoeba invadens
KSITLSTNLKYISPRAFLSCLSLS

SEQ ID NO: 3004779 - protein, 18 aa, Entamoeba invadens
KSKAPNGDYIVIAKEMKS

SEQ ID NO: 3004780 - protein, 27 aa, Entamoeba invadens
KSKEDQLLPLLSKIYYIGLYNDDKQKL

SEQ ID NO: 3004781 - protein, 30 aa, Entamoeba invadens
KSKEELIEYFKKFTFNSVELEFIKAGQLKG

SEQ ID NO: 3004782 - protein, 25 aa, Entamoeba invadens
KSKEEQHVFLALSYKFRKNIGDKKT

SEQ ID NO: 3004783 - protein, 25 aa, Entamoeba invadens
KSKEFATILFGWLDQNKDGYLEGRE

SEQ ID NO: 3004784 - protein, 18 aa, Entamoeba invadens
KSKEGEMRLIHKSSAELG

SEQ ID NO: 3004785 - protein, 27 aa, Entamoeba invadens
KSKEGFFPKVFAVYKLETQKRGRPKKL

SEQ ID NO: 3004786 - protein, 26 aa, Entamoeba invadens
KSKFEDIYFVYNCIDLLFSKLSKSLE

SEQ ID NO: 3004787 - protein, 17 aa, Entamoeba invadens
KSKILLEKVKALKALNK

SEQ ID NO: 3004788 - protein, 22 aa, Entamoeba invadens
KSKKFFLEKYDALVRQILESVV

SEQ ID NO: 3004789 - protein, 23 aa, Entamoeba invadens
KSKKLVWLNHLGKAMVLVRVGSF

SEQ ID NO: 3004790 - protein, 22 aa, Entamoeba invadens
KSKKVFELLKNLSMSLITTSAH

SEQ ID NO: 3004791 - protein, 31 aa, Entamoeba invadens
KSKLAYHEQFVLMLTFFHTKTRHVELYELLY

SEQ ID NO: 3004792 - protein, 30 aa, Entamoeba invadens
KSKLAYHEQFVLMLTFFHTKTTHVELYELL

SEQ ID NO: 3004793 - protein, 18 aa, Entamoeba invadens
KSKLFLMKGKFNLKTMTF

SEQ ID NO: 3004794 - protein, 28 aa, Entamoeba invadens
KSKNIVTLFILIWIKLKCLGFKTTLGIQ

SEQ ID NO: 3004795 - protein, 29 aa, Entamoeba invadens
KSKNPNKYIFFKIVVWYNVDYNTFVLNKN

SEQ ID NO: 3004796 - protein, 40 aa, Entamoeba invadens
KSKQNANLLLRYFFSHSRGVDLLMWAFERELTENPPESKY

SEQ ID NO: 3004797 - protein, 23 aa, Entamoeba invadens
KSKRYLKLLYTKMNELPSLRSKK

SEQ ID NO: 3004798 - protein, 28 aa, Entamoeba invadens
KSKSNELLIVLPKNTLFGEKHYLTGKTH

SEQ ID NO: 3004799 - protein, 25 aa, Entamoeba invadens
KSKVCGHIFSKDAIFNLIGHVKQMK

SEQ ID NO: 3004800 - protein, 19 aa, Entamoeba invadens
KSKYKVFLPHTAGRYAVRP

SEQ ID NO: 3004801 - protein, 22 aa, Entamoeba invadens
KSKYNYYFNFSPKNIVLIKDIT

SEQ ID NO: 3004802 - protein, 22 aa, Entamoeba invadens
KSKYYDMFAQPFKKYYSFVAGY

SEQ ID NO: 3004803 - protein, 18 aa, Entamoeba invadens
KSLAFLYVATFNADSLFN

SEQ ID NO: 3004804 - protein, 27 aa, Entamoeba invadens
KSLCYQLPMLFKDGYTLVVSPLISLMQ

SEQ ID NO: 3004805 - protein, 34 aa, Entamoeba invadens
KSLDFELYVPIIEPVPFSYFVYVVSDSFVKCTST

SEQ ID NO: 3004806 - protein, 23 aa, Entamoeba invadens
KSLDPFFIGYIDILKADICIKSV

SEQ ID NO: 3004807 - protein, 25 aa, Entamoeba invadens
KSLEFLEEVILPEHLIVIGYQSFAG

SEQ ID NO: 3004808 - protein, 25 aa, Entamoeba invadens
KSLEGAVYAMYLYTNAQTLTEKLVD

SEQ ID NO: 3004809 - protein, 26 aa, Entamoeba invadens
KSLERLYEQNSMYRNSLKEISATVES

SEQ ID NO: 3004810 - protein, 20 aa, Entamoeba invadens
KSLFGFYHLIFDELKSRKII

SEQ ID NO: 3004811 - protein, 26 aa, Entamoeba invadens
KSLFPNSYLDQFVAARYSLSCYFKAM

SEQ ID NO: 3004812 - protein, 21 aa, Entamoeba invadens
KSLFYKRFYNVIFSKICFTQS

SEQ ID NO: 3004813 - protein, 17 aa, Entamoeba invadens
KSLILLTKNKETKPYQS

SEQ ID NO: 3004814 - protein, 23 aa, Entamoeba invadens
KSLKHPCLIILYEAVITPHNYYF

SEQ ID NO: 3004815 - protein, 21 aa, Entamoeba invadens
KSLKTFFKNFGSKASTPKKAF

SEQ ID NO: 3004816 - protein, 27 aa, Entamoeba invadens
KSLLVSKEILLFLKAMLNIRNTNNKEI

SEQ ID NO: 3004817 - protein, 26 aa, Entamoeba invadens
KSLNKWDKKLLFFNIREFVAESGSTS

SEQ ID NO: 3004818 - protein, 25 aa, Entamoeba invadens
KSLNYLYNRIDGNKFYRAIMSKTRF

SEQ ID NO: 3004819 - protein, 17 aa, Entamoeba invadens
KSLPRIYIDGCYDLFHW

SEQ ID NO: 3004820 - protein, 24 aa, Entamoeba invadens
KSLPRPMELQLEKVYFPSVLVTKK

SEQ ID NO: 3004821 - protein, 54 aa, Entamoeba invadens
KSLRTVMFSMYLFNPVLFYIQVEIMRLMLWGEESFFWLEKKSMSLVFTHAKERM

SEQ ID NO: 3004822 - protein, 19 aa, Entamoeba invadens
KSLSIVSIPFGVTIIDDGC

SEQ ID NO: 3004823 - protein, 25 aa, Entamoeba invadens
KSLTKKYITIPPIKKIPKISEIKCG

SEQ ID NO: 3004824 - protein, 25 aa, Entamoeba invadens
KSLTTPALCAWKKATLLSLIVRHTQ

SEQ ID NO: 3004825 - protein, 18 aa, Entamoeba invadens
KSLTYLMESLLNHLFKTK

SEQ ID NO: 3004826 - protein, 22 aa, Entamoeba invadens
KSLVANAPRRYFKLPYGQICKL

SEQ ID NO: 3004827 - protein, 26 aa, Entamoeba invadens
KSMDELVIAFVTLVGRFYRNPNFSRE

SEQ ID NO: 3004828 - protein, 17 aa, Entamoeba invadens
KSMFLSNCTLLQTKYPV

SEQ ID NO: 3004829 - protein, 30 aa, Entamoeba invadens
KSMNKLPDKLPAMDFFIAKGFASKLSDTFN

SEQ ID NO: 3004830 - protein, 20 aa, Entamoeba invadens
KSMQIKKKKTLKTNSVKMSS

SEQ ID NO: 3004831 - protein, 20 aa, Entamoeba invadens
KSMRTFPLKCGYEATYLTAI

SEQ ID NO: 3004832 - protein, 23 aa, Entamoeba invadens
KSMSSIQVLKKIPARILCEMVLF

SEQ ID NO: 3004833 - protein, 24 aa, Entamoeba invadens
KSNERFFMKQSYDPKVWGKKQCPP

SEQ ID NO: 3004834 - protein, 22 aa, Entamoeba invadens
KSNFQYPIVKIADYGFSRGISD

SEQ ID NO: 3004835 - protein, 25 aa, Entamoeba invadens
KSNFYDAIRFVLCDEKFGNLRAGDR

SEQ ID NO: 3004836 - protein, 20 aa, Entamoeba invadens
KSNLKAFQILHNAYLSGIDS

SEQ ID NO: 3004837 - protein, 18 aa, Entamoeba invadens
KSNLLLRFTRNEFDPEKR

SEQ ID NO: 3004838 - protein, 27 aa, Entamoeba invadens
KSNLMDAISFVLGVRVGFLRGSNLKDL

SEQ ID NO: 3004839 - protein, 20 aa, Entamoeba invadens
KSNLVLPDGPFLCDDNPNNN

SEQ ID NO: 3004840 - protein, 22 aa, Entamoeba invadens
KSNMICLSKFYPGDFSIIFNCV

SEQ ID NO: 3004841 - protein, 23 aa, Entamoeba invadens
KSNMTMFRKSRVFKLAGSNGFDY

SEQ ID NO: 3004842 - protein, 23 aa, Entamoeba invadens
KSNVMIIIKAEGSIFGCYTSELL

SEQ ID NO: 3004843 - protein, 25 aa, Entamoeba invadens
KSPFPQNHIFLARASFKGGCTVDMK

SEQ ID NO: 3004844 - protein, 19 aa, Entamoeba invadens
KSPINAIIPFRFANELEAP

SEQ ID NO: 3004845 - protein, 23 aa, Entamoeba invadens
KSPKATYKVYYPSKISMSVNDKF

SEQ ID NO: 3004846 - protein, 26 aa, Entamoeba invadens
KSPKELKLIKMVKLLKSNFEKGNQYV

SEQ ID NO: 3004847 - protein, 19 aa, Entamoeba invadens
KSPLLLKIADIELKHKNKI

SEQ ID NO: 3004848 - protein, 25 aa, Entamoeba invadens
KSPNSKTKNLKYSATYKPTDNLKLS

SEQ ID NO: 3004849 - protein, 22 aa, Entamoeba invadens
KSPPMPPRAAPPPPKPKLPQVK

SEQ ID NO: 3004850 - protein, 18 aa, Entamoeba invadens
KSPRKSMMFIFDSSQNAS

SEQ ID NO: 3004851 - protein, 27 aa, Entamoeba invadens
KSPYIKTNFLILDFLGGIINVINRERF

SEQ ID NO: 3004852 - protein, 17 aa, Entamoeba invadens
KSPYIYPEYGLGELPQA

SEQ ID NO: 3004853 - protein, 24 aa, Entamoeba invadens
KSQIDALWNENFKIAFFSRTVTVK

SEQ ID NO: 3004854 - protein, 29 aa, Entamoeba invadens
KSQITKIDIIRYFGILLYMGAHHDIKNPI

SEQ ID NO: 3004855 - protein, 26 aa, Entamoeba invadens
KSQKELQTQYNGLKSKIEGVTSELDT

SEQ ID NO: 3004856 - protein, 22 aa, Entamoeba invadens
KSQLLRAVAGIAPRSIYTTGKG

SEQ ID NO: 3004857 - protein, 20 aa, Entamoeba invadens
KSQNFIFKNLKYSINDRKNV

SEQ ID NO: 3004858 - protein, 23 aa, Entamoeba invadens
KSQNLGMIGTPYISPVVMLEKGD

SEQ ID NO: 3004859 - protein, 24 aa, Entamoeba invadens
KSQVWITCDDGCKRCFIKDNLTKE

SEQ ID NO: 3004860 - protein, 20 aa, Entamoeba invadens
KSRFIIQLYQVYETSTNLFL

SEQ ID NO: 3004861 - protein, 26 aa, Entamoeba invadens
KSRGFAIIEFAAKVSVLKALELNGTT

SEQ ID NO: 3004862 - protein, 17 aa, Entamoeba invadens
KSRLEHFASIKKLDLFA

SEQ ID NO: 3004863 - protein, 23 aa, Entamoeba invadens
KSRLPLIVVFTKTDVSPATKLEE

SEQ ID NO: 3004864 - protein, 20 aa, Entamoeba invadens
KSRLQQIYKFNMFAGIVSGI

SEQ ID NO: 3004865 - protein, 32 aa, Entamoeba invadens; identical to SEQ ID NO: 2530708

SEQ ID NO: 3004866 - protein, 31 aa, Entamoeba invadens
KSRNWQSQQVSFLIALLSLKYNITFEKPSKL

SEQ ID NO: 3004867 - protein, 24 aa, Entamoeba invadens
KSRPKIFPVLFDQRKLLKQSKAVN

SEQ ID NO: 3004868 - protein, 24 aa, Entamoeba invadens
KSRQILTTLLKQQPYLFTVSEYFT

SEQ ID NO: 3004869 - protein, 25 aa, Entamoeba invadens
KSRSCKTPFLMSTHRKKTPELFDDL

SEQ ID NO: 3004870 - protein, 20 aa, Entamoeba invadens
KSRVDLKEQLENRESQEHYI

SEQ ID NO: 3004871 - protein, 21 aa, Entamoeba invadens
KSRVVFADLAYKQPHLLLLDE

SEQ ID NO: 3004872 - protein, 23 aa, Entamoeba invadens
KSRYDLQLIFKHCDYYTLMADSA

SEQ ID NO: 3004873 - protein, 21 aa, Entamoeba invadens
KSRYFRKISANFRAISLLLRC

SEQ ID NO: 3004874 - protein, 29 aa, Entamoeba invadens
KSSEYETFYFDFLRCLKSFGSLKSVEEVE

SEQ ID NO: 3004875 - protein, 18 aa, Entamoeba invadens
KSSFILYPDSNKMIISVF

SEQ ID NO: 3004876 - protein, 32 aa, Entamoeba invadens
KSSFQFFSQFFQFLPNSWGFKQLFVYKLIKKQ

SEQ ID NO: 3004877 - protein, 23 aa, Entamoeba invadens
KSSILDITVPLKSGIFANKDDIS

SEQ ID NO: 3004878 - protein, 20 aa, Entamoeba invadens
KSSKILFKFGEKGDLVVKFD

SEQ ID NO: 3004879 - protein, 23 aa, Entamoeba invadens
KSSKKYCVFLEDDEGRVCSDSDN

SEQ ID NO: 3004880 - protein, 24 aa, Entamoeba invadens
KSSKLIMNLFQLMTNSNIAVFQEM

SEQ ID NO: 3004881 - protein, 23 aa, Entamoeba invadens
KSSKSLLITLMNGTAVLKNDDKT

SEQ ID NO: 3004882 - protein, 23 aa, Entamoeba invadens
KSSKTKVYLLHKVYLFLEQNESN

SEQ ID NO: 3004883 - protein, 25 aa, Entamoeba invadens
KSSLKHLPFLIPNNLKVLVLNNTFV

SEQ ID NO: 3004884 - protein, 22 aa, Entamoeba invadens
KSSLKLCFKIAKNSFINAMDEK

SEQ ID NO: 3004885 - protein, 26 aa, Entamoeba invadens
KSSLRKLFINNVFDPLIRPTIGVDLS

SEQ ID NO: 3004886 - protein, 31 aa, Entamoeba invadens
KSSLRSIIQLLFQRKWIDGKRIFVGILGEVW

SEQ ID NO: 3004887 - protein, 20 aa, Entamoeba invadens
KSSMQAIMLGGLKPFYVVPV

SEQ ID NO: 3004888 - protein, 17 aa, Entamoeba invadens
KSSRFFSTFTGTFDGKR

SEQ ID NO: 3004889 - protein, 23 aa, Entamoeba invadens
KSSRFLPLPLQTIFEEDWFSEIS

SEQ ID NO: 3004890 - protein, 26 aa, Entamoeba invadens
KSSSCCFPFSFFKSFNFGSKHSKGSY

SEQ ID NO: 3004891 - protein, 21 aa, Entamoeba invadens
KSSTLEWYQKLEGKALALESE

SEQ ID NO: 3004892 - protein, 17 aa, Entamoeba invadens
KSSVNPFPPFMTSAYFK

SEQ ID NO: 3004893 - protein, 32 aa, Entamoeba invadens
KSSVYALHSVISRALFACKILNQLPVEVINSR

SEQ ID NO: 3004894 - protein, 26 aa, Entamoeba invadens
KSTIIWFYKHFLPDTIEFGFYGFISM

SEQ ID NO: 3004895 - protein, 19 aa, Entamoeba invadens
KSTLFGHFIYQLGGVDKRT

SEQ ID NO: 3004896 - protein, 21 aa, Entamoeba invadens
KSTLFVVNKQRLNGGYFTVGK

SEQ ID NO: 3004897 - protein, 21 aa, Entamoeba invadens
KSTSWLDKFIEKQEKSKTVGE

SEQ ID NO: 3004898 - protein, 21 aa, Entamoeba invadens
KSTVAPQFLRICKVTFSVGDE

SEQ ID NO: 3004899 - protein, 27 aa, Entamoeba invadens
KSVFDMSPGSTLLDLKQKFAAAENHDV

SEQ ID NO: 3004900 - protein, 17 aa, Entamoeba invadens
KSVFLIAGTLRPETMYG

SEQ ID NO: 3004901 - protein, 26 aa, Entamoeba invadens
KSVFTPKIRKTLFSTPKLFSNTPTPN

SEQ ID NO: 3004902 - protein, 21 aa, Entamoeba invadens
KSVKKGRWSKDEKIRAVVCNR

SEQ ID NO: 3004903 - protein, 18 aa, Entamoeba invadens
KSVKRGIAKKGTLIGYTV

SEQ ID NO: 3004904 - protein, 25 aa, Entamoeba invadens
KSVKRNRVILFNDLTFDDTNVFGTK

SEQ ID NO: 3004905 - protein, 19 aa, Entamoeba invadens
KSVNPFWCEVFQVDATLGE

SEQ ID NO: 3004906 - protein, 31 aa, Entamoeba invadens
KSVQNPIRGLFLRTYLLDTLKPVLPDINSKK

SEQ ID NO: 3004907 - protein, 24 aa, Entamoeba invadens
KSVSFDNFVFYGAKWNFAGDDSFQ

SEQ ID NO: 3004908 - protein, 19 aa, Entamoeba invadens
KSVTLKFTEDLFLSGETFS

SEQ ID NO: 3004909 - protein, 22 aa, Entamoeba invadens
KSVTRIGAFSFRKCVALKKIEI

SEQ ID NO: 3004910 - protein, 20 aa, Entamoeba invadens
KSVVPYLGLFLSDVLFTDDG

SEQ ID NO: 3004911 - protein, 31 aa, Entamoeba invadens
KSVVTQLLLKKKDLVFLLEDSHQNRFGGYLH

SEQ ID NO: 3004912 - protein, 19 aa, Entamoeba invadens
KSVVVLKETTLVKSEIIGP

SEQ ID NO: 3004913 - protein, 25 aa, Entamoeba invadens
KSWKKRWCVLTPTGMIFYFKDKKDV

SEQ ID NO: 3004914 - protein, 21 aa, Entamoeba invadens
KSWYTLLSLIPNSPLLKYNDF

SEQ ID NO: 3004915 - protein, 17 aa, Entamoeba invadens
KSYFEQLDDFKLEEDID

SEQ ID NO: 3004916 - protein, 23 aa, Entamoeba invadens
KSYGYYYDFVPFNGTRCRVIVNN

SEQ ID NO: 3004917 - protein, 26 aa, Entamoeba invadens
KSYLGKTYYLYKNNSNYWTLSTRFDC

SEQ ID NO: 3004918 - protein, 21 aa, Entamoeba invadens
KSYLKIEKLTKKEDLRKSRIE

SEQ ID NO: 3004919 - protein, 27 aa, Entamoeba invadens
KSYNIPKLVLGFYPLFEPDISNEVIYP

SEQ ID NO: 3004920 - protein, 21 aa, Entamoeba invadens
KSYQLFMSKYRKDSPIFTLEE

SEQ ID NO: 3004921 - protein, 17 aa, Entamoeba invadens
KSYSKILVLPKDFDEKK

SEQ ID NO: 3004922 - protein, 22 aa, Entamoeba invadens
KSYTDFLQSHLFAQTTPKSALS

SEQ ID NO: 3004923 - protein, 27 aa, Entamoeba invadens
KSYTNFVYLSLRLLLTEVNPLFVLSFS

SEQ ID NO: 3004924 - protein, 25 aa, Entamoeba invadens
KSYTPFFNVSIVTLVFRFDEESSFK

SEQ ID NO: 3004925 - protein, 18 aa, Entamoeba invadens
KSYTSVLELLRSEEQRFY

SEQ ID NO: 3004926 - protein, 20 aa, Entamoeba invadens
KSYVYTYIKSYNKKTYIVDF

SEQ ID NO: 3004927 - protein, 19 aa, Entamoeba invadens
KTAFYSGFMLSELSYKCKA

SEQ ID NO: 3004928 - protein, 26 aa, Entamoeba invadens
KTAIAVISCLSFLAGVPNLEILEKHK

SEQ ID NO: 3004929 - protein, 19 aa, Entamoeba invadens
KTAKELKSFKWITQNCNEK

SEQ ID NO: 3004930 - protein, 22 aa, Entamoeba invadens
KTAQLFFEKFGVKSLSFKAQQI

SEQ ID NO: 3004931 - protein, 33 aa, Entamoeba invadens
KTAQTRVARYWPMFPRTFALFKKLFTEQTNFPA

SEQ ID NO: 3004932 - protein, 18 aa, Entamoeba invadens
KTARKIAFNQRYKHMFRI

SEQ ID NO: 3004933 - protein, 18 aa, Entamoeba invadens
KTASTLPLIKQKTGNVVV

SEQ ID NO: 3004934 - protein, 26 aa, Entamoeba invadens
KTATSFNWIMERCEQLGYEFKKRSTK

SEQ ID NO: 3004935 - protein, 17 aa, Entamoeba invadens
KTAYEYRCTLGMGVTGY

SEQ ID NO: 3004936 - protein, 18 aa, Entamoeba invadens
KTCKLCIDGNYYDKTTKN

SEQ ID NO: 3004937 - protein, 21 aa, Entamoeba invadens
KTCKPNFPEAYFANDKVYTAC

SEQ ID NO: 3004938 - protein, 26 aa, Entamoeba invadens
KTCKSCRMIYGCELCVNLLVGNVEST

SEQ ID NO: 3004939 - protein, 18 aa, Entamoeba invadens
KTCKTCLTGYNLYNNKCY

SEQ ID NO: 3004940 - protein, 30 aa, Entamoeba invadens
KTCLDALVSLSRIYWNLRTPEAVKRALLFA

SEQ ID NO: 3004941 - protein, 20 aa, Entamoeba invadens
KTCLLVTYTTNSFPDTYVPT

SEQ ID NO: 3004942 - protein, 19 aa, Entamoeba invadens
KTCLPGVRPALIKGLADMM

SEQ ID NO: 3004943 - protein, 19 aa, Entamoeba invadens
KTCLPGVRPALIKGLAKMM

SEQ ID NO: 3004944 - protein, 17 aa, Entamoeba invadens
KTCNILYQFLPIENNDV

SEQ ID NO: 3004945 - protein, 25 aa, Entamoeba invadens
KTCTDLYVIHLPIGPSFHFKVFNII

SEQ ID NO: 3004946 - protein, 29 aa, Entamoeba invadens
KTDAAGWLGWIMKILELMDADLIKCIGAC

SEQ ID NO: 3004947 - protein, 29 aa, Entamoeba invadens
KTDAAGWLSWIMKILELMDADLIKCIGAC

SEQ ID NO: 3004948 - protein, 23 aa, Entamoeba invadens
KTDCYKDVQVGWYGGSIGFHSDD

SEQ ID NO: 3004949 - protein, 28 aa, Entamoeba invadens
KTDESDKTLIFEYRPLEKNEDDVKEFLS

SEQ ID NO: 3004950 - protein, 20 aa, Entamoeba invadens
KTDHQAFAGTFVYLLHYYHM

SEQ ID NO: 3004951 - protein, 28 aa, Entamoeba invadens
KTDIKDFPQILFTVQQYHQLLKSLANDS

SEQ ID NO: 3004952 - protein, 22 aa, Entamoeba invadens
KTDIPPFFVNILVDFAAMPFAV

SEQ ID NO: 3004953 - protein, 24 aa, Entamoeba invadens
KTDKLDLFIQKYPKQFYPKGYAFM

SEQ ID NO: 3004954 - protein, 21 aa, Entamoeba invadens
KTDLKEFIVIESGVRVHLTQY

SEQ ID NO: 3004955 - protein, 18 aa, Entamoeba invadens
KTDLLKTVPWKYSKSHFQ

SEQ ID NO: 3004956 - protein, 25 aa, Entamoeba invadens
KTDPTLYRNYFGISLIDLLNEENRM

SEQ ID NO: 3004957 - protein, 20 aa, Entamoeba invadens
KTDQLLKLCFQFTSSETITK

SEQ ID NO: 3004958 - protein, 22 aa, Entamoeba invadens
KTDTFTFAFSKISTFFPSLLVA

SEQ ID NO: 3004959 - protein, 23 aa, Entamoeba invadens
KTDTFTFAFSKISTFFPSLLVAH

SEQ ID NO: 3004960 - protein, 25 aa, Entamoeba invadens
KTDVMKILTDFYVVTSYKLNGMKED

SEQ ID NO: 3004961 - protein, 38 aa, Entamoeba invadens
KTDWQSKFLIPRTFLGKILRLLKILNKFPLFKNDDQLR

SEQ ID NO: 3004962 - protein, 27 aa, Entamoeba invadens
KTDYLQKVLVILLNWLASVTDADVQDW

SEQ ID NO: 3004963 - protein, 31 aa, Entamoeba invadens
KTEAFLFVKSLTYLLTLFSELPDTPLRTTIA

SEQ ID NO: 3004964 - protein, 20 aa, Entamoeba invadens
KTEALLPMKGILNVMVYMDT

SEQ ID NO: 3004965 - protein, 26 aa, Entamoeba invadens
KTECPFRINLNFKAKLGKWKITKMVL

SEQ ID NO: 3004966 - protein, 24 aa, Entamoeba invadens
KTEHSISRFTLYDAVPTFKPKLDN

SEQ ID NO: 3004967 - protein, 28 aa, Entamoeba invadens
KTEIIKQTPLLFQLSAHLDQLIKQRKDL

SEQ ID NO: 3004968 - protein, 25 aa, Entamoeba invadens
KTEIQGFYGIPLRVAISKSQWRFPL

SEQ ID NO: 3004969 - protein, 25 aa, Entamoeba invadens
KTEKAVMFGLNALINLCSNKETREA

SEQ ID NO: 3004970 - protein, 31 aa, Entamoeba invadens
KTEKDLAGARKRFGRFRRRSADNEKRTKAKS

SEQ ID NO: 3004971 - protein, 17 aa, Entamoeba invadens
KTELEAFEQAAKTYKQS

SEQ ID NO: 3004972 - protein, 28 aa, Entamoeba invadens
KTEMIHLLIDMLREFGYFFQTRMTVGKS

SEQ ID NO: 3004973 - protein, 26 aa, Entamoeba invadens
KTENETLKQQLLKENNFNLKSDDEIF

SEQ ID NO: 3004974 - protein, 24 aa, Entamoeba invadens
KTEQNIFYLALPENSKFQSETAKT

SEQ ID NO: 3004975 - protein, 18 aa, Entamoeba invadens
KTFALNHLKDIYTNIVFF

SEQ ID NO: 3004976 - protein, 23 aa, Entamoeba invadens
KTFDCLPICALLHSELGKFFCVH

SEQ ID NO: 3004977 - protein, 26 aa, Entamoeba invadens
KTFDFKAFMELYLPYSYTGSQTEFIK

SEQ ID NO: 3004978 - protein, 21 aa, Entamoeba invadens
KTFDLLRQYPSPQFLAAVVFL

SEQ ID NO: 3004979 - protein, 23 aa, Entamoeba invadens
KTFDPFIIIKGRDMLKLIGRGAD

SEQ ID NO: 3004980 - protein, 22 aa, Entamoeba invadens
KTFFGNLIFFCHSQKVDSLHFL

SEQ ID NO: 3004981 - protein, 17 aa, Entamoeba invadens
KTFFSICEVFLQTETNP

SEQ ID NO: 3004982 - protein, 22 aa, Entamoeba invadens
KTFIVTSRFIPDGTHLVKPLEQ

SEQ ID NO: 3004983 - protein, 24 aa, Entamoeba invadens
KTFIYSFMMMLCSGIPQLKHVEDV

SEQ ID NO: 3004984 - protein, 24 aa, Entamoeba invadens
KTFMSAYYMMRQLSFGKMDLELHL

SEQ ID NO: 3004985 - protein, 19 aa, Entamoeba invadens
KTFQWKRVYGNRKALYKEE

SEQ ID NO: 3004986 - protein, 21 aa, Entamoeba invadens
KTFSNVIMAIGSFGIVFEGNG

SEQ ID NO: 3004987 - protein, 19 aa, Entamoeba invadens
KTFVFLSHQPPYNILDMMA

SEQ ID NO: 3004988 - protein, 20 aa, Entamoeba invadens
KTFVYFPNIETLHLWDEEDE

SEQ ID NO: 3004989 - protein, 17 aa, Entamoeba invadens
KTFYDVIMWFNVDYETY

SEQ ID NO: 3004990 - protein, 26 aa, Entamoeba invadens
KTGDSFWRFCLFLRKLCENIRVGRIF

SEQ ID NO: 3004991 - protein, 35 aa, Entamoeba invadens
KTGENEPFWLNVYHIMLLHGLMYWKHRPNVEFKDM

SEQ ID NO: 3004992 - protein, 23 aa, Entamoeba invadens
KTGHLYAYLSSNPSQFSFYGHVD

SEQ ID NO: 3004993 - protein, 19 aa, Entamoeba invadens
KTGIKEMLLNIFPQNEENV

SEQ ID NO: 3004994 - protein, 27 aa, Entamoeba invadens
KTGIKKFKINAIIPTRLQCVIDALLVE

SEQ ID NO: 3004995 - protein, 23 aa, Entamoeba invadens
KTGKILIDLIYEGLLNIADSGMM

SEQ ID NO: 3004996 - protein, 30 aa, Entamoeba invadens
KTGLINNMFQCIWLCLSFSGKNLAQSVFKD

SEQ ID NO: 3004997 - protein, 17 aa, Entamoeba invadens
KTGLRLHKSFMKIEFSR

SEQ ID NO: 3004998 - protein, 19 aa, Entamoeba invadens
KTGLVSCQIIFKTATSRDV

SEQ ID NO: 3004999 - protein, 25 aa, Entamoeba invadens
KTGTHMLLSTFDGKLFYVNKDLIDV

SEQ ID NO: 3005000 - protein, 21 aa, Entamoeba invadens
KTGTMFLYRPGSVNGRSVTHA

SEQ ID NO: 3005001 - protein, 23 aa, Entamoeba invadens
KTGYDLQLIFKQCDYYTLMADSA

SEQ ID NO: 3005002 - protein, 27 aa, Entamoeba invadens
KTGYEEYFILLQNKLPPTPTLNITSLT

SEQ ID NO: 3005003 - protein, 29 aa, Entamoeba invadens
KTHEEPKVCFLFKNIFVVCKVKNYQGKVL

SEQ ID NO: 3005004 - protein, 25 aa, Entamoeba invadens
KTHEILSIADLRKIEEWTSMKATDV

SEQ ID NO: 3005005 - protein, 17 aa, Entamoeba invadens
KTHFPVRPISPTTQEHG

SEQ ID NO: 3005006 - protein, 34 aa, Entamoeba invadens
KTHGYIERLKLWRNNKYKWFRPGSFFPTNQMYDI

SEQ ID NO: 3005007 - protein, 19 aa, Entamoeba invadens
KTHKAVVPNLPPIKREPPP

SEQ ID NO: 3005008 - protein, 21 aa, Entamoeba invadens
KTHLPSKKLLSKLLIRSGQIE

SEQ ID NO: 3005009 - protein, 21 aa, Entamoeba invadens
KTIAHPFFRIVSISTEYDEIQ

SEQ ID NO: 3005010 - protein, 17 aa, Entamoeba invadens
KTIAYFPNIETLNLWST

SEQ ID NO: 3005011 - protein, 30 aa, Entamoeba invadens
KTICNNFLCAFLLIRIRLEGISPALPFCSG

SEQ ID NO: 3005012 - protein, 18 aa, Entamoeba invadens
KTIDPFCPQKRKDTVQKI

SEQ ID NO: 3005013 - protein, 23 aa, Entamoeba invadens
KTIDQIFEFGLKIKEYQIVDTLL

SEQ ID NO: 3005014 - protein, 30 aa, Entamoeba invadens
KTIDSIISVLYKKGFLIKGIFRESQVASIR

SEQ ID NO: 3005015 - protein, 27 aa, Entamoeba invadens
KTIEDSISIFKLFIKTLENENAKILQL

SEQ ID NO: 3005016 - protein, 17 aa, Entamoeba invadens
KTIFDMHLYGPAMLACF

SEQ ID NO: 3005017 - protein, 25 aa, Entamoeba invadens
KTIGGYKVHIPPFLRKKSAEKHVEK

SEQ ID NO: 3005018 - protein, 21 aa, Entamoeba invadens
KTIGHFFNIETLNLWNKNDEN

SEQ ID NO: 3005019 - protein, 17 aa, Entamoeba invadens
KTIILPESLKQIKDECF

SEQ ID NO: 3005020 - protein, 18 aa, Entamoeba invadens
KTIILQQTALLQIAQRAS

SEQ ID NO: 3005021 - protein, 19 aa, Entamoeba invadens
KTIITSNNFLQMASGASLL

SEQ ID NO: 3005022 - protein, 18 aa, Entamoeba invadens
KTIIYTEAPFLIPKEIFR

SEQ ID NO: 3005023 - protein, 18 aa, Entamoeba invadens
KTIKQLLMKAREAPFFEF

SEQ ID NO: 3005024 - protein, 22 aa, Entamoeba invadens
KTIKRLCSFEILPSFIQEIIIS

SEQ ID NO: 3005025 - protein, 17 aa, Entamoeba invadens
KTILRKKPFIIPSIFLP

SEQ ID NO: 3005026 - protein, 24 aa, Entamoeba invadens
KTINYFPKILTLYLYHKEDEIFLN

SEQ ID NO: 3005027 - protein, 29 aa, Entamoeba invadens
KTIRGIWIKYVSLGKITLPQNLKILTLQN

SEQ ID NO: 3005028 - protein, 29 aa, Entamoeba invadens
KTIVGFKQLLDKGLITQIAFETLVENYLN

SEQ ID NO: 3005029 - protein, 17 aa, Entamoeba invadens
KTIVMFLRKFMRQIECI

SEQ ID NO: 3005030 - protein, 18 aa, Entamoeba invadens
KTIVSILFGIALDKQYIT

SEQ ID NO: 3005031 - protein, 20 aa, Entamoeba invadens
KTIYISEYTIVKKVFEDYSY

SEQ ID NO: 3005032 - protein, 28 aa, Entamoeba invadens
KTKDGYYGWMIINVPLNIIDYVKLENKS

SEQ ID NO: 3005033 - protein, 28 aa, Entamoeba invadens
KTKENLALINLYMSYPTEFITLKEQTFA

SEQ ID NO: 3005034 - protein, 31 aa, Entamoeba invadens
KTKEVAQLSFLTWILNEQFSFTFQRPKKRST

SEQ ID NO: 3005035 - protein, 25 aa, Entamoeba invadens
KTKEWVVEQILLKKYPAIKDELFSL

SEQ ID NO: 3005036 - protein, 18 aa, Entamoeba invadens
KTKIFFKDKEIEALKKKL

SEQ ID NO: 3005037 - protein, 25 aa, Entamoeba invadens
KTKKGEKFPCQVSVQSLGGLEVSDN

SEQ ID NO: 3005038 - protein, 24 aa, Entamoeba invadens
KTKKKYPIFIGTVSGILSEMFLMD

SEQ ID NO: 3005039 - protein, 17 aa, Entamoeba invadens
KTKKSFQVLSKNLPSVL

SEQ ID NO: 3005040 - protein, 29 aa, Entamoeba invadens
KTKKTIAWYPIFFFKTMKSPNITFKNVIL

SEQ ID NO: 3005041 - protein, 26 aa, Entamoeba invadens
KTKLKPSCFIFLKFFVKEKSTNNRGL

SEQ ID NO: 3005042 - protein, 32 aa, Entamoeba invadens
KTKLPPLFCRYKLLPFYLDLFRSNMPEASSAV

SEQ ID NO: 3005043 - protein, 20 aa, Entamoeba invadens
KTKMNSVLYVLMWTANSSCV

SEQ ID NO: 3005044 - protein, 26 aa, Entamoeba invadens
KTKPSIAIIKFIKYLHTINEKRIEVQ

SEQ ID NO: 3005045 - protein, 26 aa, Entamoeba invadens
KTKQTIKMLLPENVVIDNVVYDQNSI

SEQ ID NO: 3005046 - protein, 22 aa, Entamoeba invadens
KTKREVKPIYYFVKAVINNIRD

SEQ ID NO: 3005047 - protein, 28 aa, Entamoeba invadens
KTKTLLAYHYYYALSFLPQYRDVTTFLQ

SEQ ID NO: 3005048 - protein, 24 aa, Entamoeba invadens
KTKYKDLYDLIASKKTHKAKEQKT

SEQ ID NO: 3005049 - protein, 23 aa, Entamoeba invadens
KTLAKWLVDKITRLGFNCYRIIN

SEQ ID NO: 3005050 - protein, 20 aa, Entamoeba invadens
KTLALLSDMTDLLNAAQKLC

SEQ ID NO: 3005051 - protein, 32 aa, Entamoeba invadens
KTLCNVCVNGVLTMCYGVDGVPAYVDFTKETA

SEQ ID NO: 3005052 - protein, 21 aa, Entamoeba invadens
KTLCTLFPHIETQNIYNFYDP

SEQ ID NO: 3005053 - protein, 17 aa, Entamoeba invadens
KTLDYSFVRPLSIDFLR

SEQ ID NO: 3005054 - protein, 23 aa, Entamoeba invadens
KTLETPLLSIPKIKDIPPINHIK

SEQ ID NO: 3005055 - protein, 25 aa, Entamoeba invadens
KTLFAKMLKMCKADWYYPNYSREES

SEQ ID NO: 3005056 - protein, 18 aa, Entamoeba invadens
KTLFGYFDNKFYTFDDKE

SEQ ID NO: 3005057 - protein, 19 aa, Entamoeba invadens
KTLFNFSHIETLHLFDVED

SEQ ID NO: 3005058 - protein, 18 aa, Entamoeba invadens
KTLFVGNLLPGMASELIG

SEQ ID NO: 3005059 - protein, 21 aa, Entamoeba invadens
KTLIIFLDHTNPWFRRLNTQI

SEQ ID NO: 3005060 - protein, 17 aa, Entamoeba invadens
KTLKCMEVVLNNLLINN

SEQ ID NO: 3005061 - protein, 27 aa, Entamoeba invadens
KTLKIDTIFKEQLPKVPKYFLEATSFK

SEQ ID NO: 3005062 - protein, 25 aa, Entamoeba invadens
KTLKKDMLIFFKRQTQLMALENDYL

SEQ ID NO: 3005063 - protein, 27 aa, Entamoeba invadens
KTLKKEISKKGLFTLTGMNGKADVVVS

SEQ ID NO: 3005064 - protein, 21 aa, Entamoeba invadens
KTLKLLRLRQINNAVFIRANA

SEQ ID NO: 3005065 - protein, 20 aa, Entamoeba invadens
KTLKLYWCDKLQNLSLANGL

SEQ ID NO: 3005066 - protein, 20 aa, Entamoeba invadens
KTLKMWCFGYCRELNQVTLN

SEQ ID NO: 3005067 - protein, 21 aa, Entamoeba invadens
KTLKYFPNIETLNLWSDKVDT

SEQ ID NO: 3005068 - protein, 33 aa, Entamoeba invadens
KTLMGLGASRQLAIEAYIVCKKNMELAANYLFE

SEQ ID NO: 3005069 - protein, 20 aa, Entamoeba invadens
KTLNDLFSHIPRPFEPPCIY

SEQ ID NO: 3005070 - protein, 27 aa, Entamoeba invadens
KTLNSDVLMYPLIDENFIKKVFGQIMC

SEQ ID NO: 3005071 - protein, 28 aa, Entamoeba invadens
KTLQKYLSKLIQIPYLRLTCVFDSRHFE

SEQ ID NO: 3005072 - protein, 21 aa, Entamoeba invadens
KTLQLLLIDQITCEDGIIPFE

SEQ ID NO: 3005073 - protein, 23 aa, Entamoeba invadens
KTLQRVLTIIFRVTQDQLGVKNC

SEQ ID NO: 3005074 - protein, 23 aa, Entamoeba invadens
KTLRELIMRIPLQVSNNLRDEIN

SEQ ID NO: 3005075 - protein, 19 aa, Entamoeba invadens
KTLRIFKVVGETQLVYNSH

SEQ ID NO: 3005076 - protein, 29 aa, Entamoeba invadens
KTLTGALFQLPPVIAAVKRTLRIRTIYKT

SEQ ID NO: 3005077 - protein, 24 aa, Entamoeba invadens
KTLTKLLRCDTPFQRLTEIGVPTI

SEQ ID NO: 3005078 - protein, 25 aa, Entamoeba invadens
KTLTTLAAWELKTTDFKIIFTETKK

SEQ ID NO: 3005079 - protein, 22 aa, Entamoeba invadens
KTLVEMILIKNMPWEYTYTDDY

SEQ ID NO: 3005080 - protein, 21 aa, Entamoeba invadens
KTLYVVGTYLIGKEIFVEEIA

SEQ ID NO: 3005081 - protein, 17 aa, Entamoeba invadens
KTLYYDVEPFYFYVLCE

SEQ ID NO: 3005082 - protein, 40 aa, Entamoeba invadens
KTMDRIRMFLGYPLPHQIEKSCLIVLKYVLCDSSRSLNNL

SEQ ID NO: 3005083 - protein, 23 aa, Entamoeba invadens
KTMEKEFLTFEKPAMFKGPFELV

SEQ ID NO: 3005084 - protein, 26 aa, Entamoeba invadens
KTMENVLFLWALRNPACGYIQGLNDL

SEQ ID NO: 3005085 - protein, 20 aa, Entamoeba invadens
KTMFLFSFKNDGKTPEIFNK

SEQ ID NO: 3005086 - protein, 31 aa, Entamoeba invadens
KTMKYGISFSFPFLQSKPLSFRKKALFNFGA

SEQ ID NO: 3005087 - protein, 19 aa, Entamoeba invadens
KTNANAYMLFYQKIHTDET

SEQ ID NO: 3005088 - protein, 22 aa, Entamoeba invadens
KTNDIGCFKWVDLRSWISSTLV

SEQ ID NO: 3005089 - protein, 23 aa, Entamoeba invadens
KTNEKYIISFDPQIITIPPNYGC

SEQ ID NO: 3005090 - protein, 26 aa, Entamoeba invadens
KTNEVFFTVLVVDLIKNWKAEDVIAM

SEQ ID NO: 3005091 - protein, 17 aa, Entamoeba invadens
KTNFEYPTYGPIGSYVK

SEQ ID NO: 3005092 - protein, 26 aa, Entamoeba invadens
KTNFNPQIAPPPLISKIPQIVKTPVF

SEQ ID NO: 3005093 - protein, 40 aa, Entamoeba invadens
KTNGRIAQFKSLQTSPLQLVKKDGIFQIKVRENVPVMGSR

SEQ ID NO: 3005094 - protein, 30 aa, Entamoeba invadens
KTNHLQDTLRLLTLLFKFGKFREVEHAVTA

SEQ ID NO: 3005095 - protein, 19 aa, Entamoeba invadens
KTNILNELPYYAKVKEVTV

SEQ ID NO: 3005096 - protein, 23 aa, Entamoeba invadens
KTNNYTIKPFKPIRSKLTTSRRE

SEQ ID NO: 3005097 - protein, 23 aa, Entamoeba invadens
KTNPICINSFFKPLKIRSVVAMN

SEQ ID NO: 3005098 - protein, 32 aa, Entamoeba invadens
KTNPLLKDISSLFWFFKYFSPETFDNNFSEID

SEQ ID NO: 3005099 - protein, 26 aa, Entamoeba invadens
KTNRKYLLFLLNMYYTLCANDTSGTV

SEQ ID NO: 3005100 - protein, 26 aa, Entamoeba invadens
KTNSLFVSFLMAYLAQPLLTPESVSK

SEQ ID NO: 3005101 - protein, 22 aa, Entamoeba invadens
KTNVLRVYGFGHTLLDFVQKNN

SEQ ID NO: 3005102 - protein, 19 aa, Entamoeba invadens
KTNYLSKMYNFFGSAYQLS

SEQ ID NO: 3005103 - protein, 19 aa, Entamoeba invadens
KTNYTIFSLFICHSKTDFK

SEQ ID NO: 3005104 - protein, 24 aa, Entamoeba invadens
KTNYYYTAHFFPNFGDKGLQNRIT

SEQ ID NO: 3005105 - protein, 23 aa, Entamoeba invadens
KTPEDMLPLPINPKFSKTLVFAI

SEQ ID NO: 3005106 - protein, 24 aa, Entamoeba invadens
KTPGNLPLVYFPNEQLVMVYSNIV

SEQ ID NO: 3005107 - protein, 29 aa, Entamoeba invadens
KTPKDKMFRTMFFYKLIQQVVSVYTGKAM

SEQ ID NO: 3005108 - protein, 18 aa, Entamoeba invadens
KTPNVFEVLKPKPRRKET

SEQ ID NO: 3005109 - protein, 25 aa, Entamoeba invadens
KTPQLDIIQMIRNAGRNDIADRYLE

SEQ ID NO: 3005110 - protein, 24 aa, Entamoeba invadens
KTPRDLFFARIKSVLSRNAIASTV

SEQ ID NO: 3005111 - protein, 41 aa, Entamoeba invadens
KTQHDIVQKMGAMWWFVLVERNVWRCAQWFTDYFKSEVISV

SEQ ID NO: 3005112 - protein, 23 aa, Entamoeba invadens
KTQIFVFLVMEFVEGQTLANYLN

SEQ ID NO: 3005113 - protein, 21 aa, Entamoeba invadens
KTQKEEAIPIDKGKIKKNPSM

SEQ ID NO: 3005114 - protein, 17 aa, Entamoeba invadens
KTQLHARGLKLMLDFVP

SEQ ID NO: 3005115 - protein, 18 aa, Entamoeba invadens
KTQLIKGKYEKDIAEITV

SEQ ID NO: 3005116 - protein, 18 aa, Entamoeba invadens
KTQNVFGLFLPKSPNCFD

SEQ ID NO: 3005117 - protein, 26 aa, Entamoeba invadens
KTQRWPDLINFLTVDPTLPKLKAISN

SEQ ID NO: 3005118 - protein, 26 aa, Entamoeba invadens
KTQVHYHYGFYWLNVFMNPRTIDKIV

SEQ ID NO: 3005119 - protein, 21 aa, Entamoeba invadens
KTQYFWNHLLGRSGAAPFSCP

SEQ ID NO: 3005120 - protein, 22 aa, Entamoeba invadens
KTQYFWTHLLGKSGAAPFSCPT

SEQ ID NO: 3005121 - protein, 22 aa, Entamoeba invadens
KTREEWLYAMKMQSYRAALELF

SEQ ID NO: 3005122 - protein, 28 aa, Entamoeba invadens
KTRKVFVGYCILIMKTLYNFCKAKEKTN

SEQ ID NO: 3005123 - protein, 21 aa, Entamoeba invadens
KTRRMICPRVFFSYTNKHDIL

SEQ ID NO: 3005124 - protein, 23 aa, Entamoeba invadens
KTSITRSLFRIHKIDFGQDDIID

SEQ ID NO: 3005125 - protein, 26 aa, Entamoeba invadens
KTSKTPLLFQIVWTTIKSNKLLDNNF

SEQ ID NO: 3005126 - protein, 18 aa, Entamoeba invadens
KTSLPRKLKINNSGKKLK

SEQ ID NO: 3005127 - protein, 24 aa, Entamoeba invadens
KTSMDIMMYLLDRVNPSNSTPVSR

SEQ ID NO: 3005128 - protein, 46 aa, Entamoeba invadens
KTSNLREGYQQLVDGCRLCGTNCIKLLQIVYGASFKKLANEQENLN

SEQ ID NO: 3005129 - protein, 25 aa, Entamoeba invadens
KTSRKYFGIGYKAKYLWKTFYEVHC

SEQ ID NO: 3005130 - protein, 29 aa, Entamoeba invadens
KTSSFILERFIVAYDYLFKDIGTITNKKF

SEQ ID NO: 3005131 - protein, 27 aa, Entamoeba invadens
KTSSMLRFLQNMPLLKVLDLSGMKMSL

SEQ ID NO: 3005132 - protein, 22 aa, Entamoeba invadens
KTSVKPAFYVPCAIHPLLYEDS

SEQ ID NO: 3005133 - protein, 39 aa, Entamoeba invadens
KTSWVCLGAFIFLRYICPAIIQPLEWGLAYEPPTDMADT

SEQ ID NO: 3005134 - protein, 24 aa, Entamoeba invadens
KTTAEYFVQPLIKGLKDSDSYVKR

SEQ ID NO: 3005135 - protein, 38 aa, Entamoeba invadens
KTTEVHHFLMDLLQLFGYVFLSWRRFASGRLIQTGKST

SEQ ID NO: 3005136 - protein, 18 aa, Entamoeba invadens
KTTGVYLLIPPKISARDL

SEQ ID NO: 3005137 - protein, 19 aa, Entamoeba invadens
KTTIKLSDLILYIRDHNGF

SEQ ID NO: 3005138 - protein, 23 aa, Entamoeba invadens
KTTKIYVTQPRRISAVGLSARVS

SEQ ID NO: 3005139 - protein, 19 aa, Entamoeba invadens
KTTLLSLPIVCEECQLKKV

SEQ ID NO: 3005140 - protein, 25 aa, Entamoeba invadens
KTTNKPGWCFDDFDGAGTIKPKIYA

SEQ ID NO: 3005141 - protein, 23 aa, Entamoeba invadens
KTTNLTMLILLVKCFIGVELKKN

SEQ ID NO: 3005142 - protein, 19 aa, Entamoeba invadens
KTTNWFEAGVDFNSIDWSK

SEQ ID NO: 3005143 - protein, 28 aa, Entamoeba invadens
KTTPDYSKWPYLLKNYDQLEIRSGQYTP

SEQ ID NO: 3005144 - protein, 28 aa, Entamoeba invadens
KTTTKTLNFYIWKQYTFPNGKTIDAEQL

SEQ ID NO: 3005145 - protein, 35 aa, Entamoeba invadens
KTTTNPIVNLIARTIIIEYFRDEGFRIELTNYFKY

SEQ ID NO: 3005146 - protein, 28 aa, Entamoeba invadens
KTTVSDLQLLYFFFKELQKIGGETNYEV

SEQ ID NO: 3005147 - protein, 20 aa, Entamoeba invadens
KTTYPLYDFLADQVTKSLCF

SEQ ID NO: 3005148 - protein, 28 aa, Entamoeba invadens
KTTYVFVMAFSMFLFQQPNLENFKRCPP

SEQ ID NO: 3005149 - protein, 30 aa, Entamoeba invadens
KTVAIFGELKIRDPVIRKWVEQLGGELIAR

SEQ ID NO: 3005150 - protein, 26 aa, Entamoeba invadens
KTVAKEIILFLNTLLSRKAETQIFTS

SEQ ID NO: 3005151 - protein, 18 aa, Entamoeba invadens
KTVEKKKQLLSGKNSMKK

SEQ ID NO: 3005152 - protein, 29 aa, Entamoeba invadens
KTVFKYLPPNCYIFFLAINKKYCDASIEQ

SEQ ID NO: 3005153 - protein, 27 aa, Entamoeba invadens
KTVKDLVVLLFETALLSSGFSLDDPAA

SEQ ID NO: 3005154 - protein, 19 aa, Entamoeba invadens
KTVKRPLPKPPLSTLNQTS

SEQ ID NO: 3005155 - protein, 27 aa, Entamoeba invadens
KTVMIPDPLLIKFIGEKYVIASTDGKI

SEQ ID NO: 3005156 - protein, 17 aa, Entamoeba invadens
KTVPWKYSKSHFQMEYQ

SEQ ID NO: 3005157 - protein, 18 aa, Entamoeba invadens
KTVTLSLDLTSIGDKCFF

SEQ ID NO: 3005158 - protein, 23 aa, Entamoeba invadens
KTVTPFFHILQGHTNLIRDLDFD

SEQ ID NO: 3005159 - protein, 35 aa, Entamoeba invadens
KTVTQGMFEALFILDEYLQWGFTEKLATNTVRSNL

SEQ ID NO: 3005160 - protein, 17 aa, Entamoeba invadens
KTVTSLITKLFDDPKEK

SEQ ID NO: 3005161 - protein, 17 aa, Entamoeba invadens
KTVTSLITKLFNDPKEK

SEQ ID NO: 3005162 - protein, 21 aa, Entamoeba invadens
KTVVLYFETLSDIIVFVCVNK

SEQ ID NO: 3005163 - protein, 18 aa, Entamoeba invadens
KTWELVSKVLLINKMFKN

SEQ ID NO: 3005164 - protein, 19 aa, Entamoeba invadens
KTWRSEMVQGFYGRKKRGG

SEQ ID NO: 3005165 - protein, 25 aa, Entamoeba invadens
KTYEPFLEVFVNQIIKNWSASEIAA

SEQ ID NO: 3005166 - protein, 23 aa, Entamoeba invadens
KTYEWLFWDVSGAAKFRGLWRSY

SEQ ID NO: 3005167 - protein, 20 aa, Entamoeba invadens
KTYIHHIIEGYPTDFPRVVS

SEQ ID NO: 3005168 - protein, 30 aa, Entamoeba invadens
KTYILRDDVKLIFFVFDKRGKKINKAFKEM

SEQ ID NO: 3005169 - protein, 23 aa, Entamoeba invadens
KTYKKYYGLVAERLCVLFNKFKD

SEQ ID NO: 3005170 - protein, 18 aa, Entamoeba invadens
KTYLARCLSIDSLPLRLK

SEQ ID NO: 3005171 - protein, 19 aa, Entamoeba invadens
KTYLRMLPEPLLTYKIGET

SEQ ID NO: 3005172 - protein, 23 aa, Entamoeba invadens
KTYRWNIRVLYDMIDIAALNGYK

SEQ ID NO: 3005173 - protein, 20 aa, Entamoeba invadens
KTYTRWVVLKRKCMMFFKEL

SEQ ID NO: 3005174 - protein, 26 aa, Entamoeba invadens
KTYVERLELFKDLYLSKALEVIPDDV

SEQ ID NO: 3005175 - protein, 28 aa, Entamoeba invadens
KVAEGLHLLIDILLELGYFFTSKVSKGV

SEQ ID NO: 3005176 - protein, 29 aa, Entamoeba invadens
KVAEYPHDSAFWQESWTSPVKSRKGSYSL

SEQ ID NO: 3005177 - protein, 17 aa, Entamoeba invadens
KVAHYMKYLELPVIDES

SEQ ID NO: 3005178 - protein, 19 aa, Entamoeba invadens
KVANIICFAGYGLISALNV

SEQ ID NO: 3005179 - protein, 17 aa, Entamoeba invadens
KVAYLSDAAYVKTQIFN

SEQ ID NO: 3005180 - protein, 19 aa, Entamoeba invadens
KVCDARRSYFNYFTKRVEK

SEQ ID NO: 3005181 - protein, 22 aa, Entamoeba invadens
KVCGRRSCLSNIFISCNGIGDS

SEQ ID NO: 3005182 - protein, 19 aa, Entamoeba invadens
KVCILSCPFEPPKTKTTTN

SEQ ID NO: 3005183 - protein, 18 aa, Entamoeba invadens
KVCKKYLEIPSMFHYNPV

SEQ ID NO: 3005184 - protein, 27 aa, Entamoeba invadens
KVCLTRTMALLRKYLTGIPKNTYQVGS

SEQ ID NO: 3005185 - protein, 19 aa, Entamoeba invadens
KVCMCKSGFYLSGKGVCSR

SEQ ID NO: 3005186 - protein, 22 aa, Entamoeba invadens
KVCMICFETVRQGMNCLNCCSG

SEQ ID NO: 3005187 - protein, 21 aa, Entamoeba invadens
KVCTGIGFAIYGTEEDAHKTK

SEQ ID NO: 3005188 - protein, 18 aa, Entamoeba invadens
KVCVINTLLIHSEGGTLC

SEQ ID NO: 3005189 - protein, 34 aa, Entamoeba invadens
KVCVRFIYRKQEFFIPIILLLRVYTGMSDREIFE

SEQ ID NO: 3005190 - protein, 18 aa, Entamoeba invadens
KVDAVINVVFKDTKESGS

SEQ ID NO: 3005191 - protein, 27 aa, Entamoeba invadens
KVDCLQFLIHLYLSKFPTQFLALISHC

SEQ ID NO: 3005192 - protein, 20 aa, Entamoeba invadens
KVDCRIFIVSLKEVFEFGTK

SEQ ID NO: 3005193 - protein, 24 aa, Entamoeba invadens
KVDEFLMIINLTNLPIHVGDMLNY

SEQ ID NO: 3005194 - protein, 22 aa, Entamoeba invadens
KVDELLPIKNLVISGCGTSLYA

SEQ ID NO: 3005195 - protein, 24 aa, Entamoeba invadens
KVDGDFFLLFSHGKVKNIIHLDET

SEQ ID NO: 3005196 - protein, 25 aa, Entamoeba invadens
KVDKENALFLKKREKNQKKRMRKRK

SEQ ID NO: 3005197 - protein, 25 aa, Entamoeba invadens
KVDKETTLYFFKSLATFVGGICAKK

SEQ ID NO: 3005198 - protein, 28 aa, Entamoeba invadens
KVDKKYYPKFFYLIEHHFLIKEYLKSSH

SEQ ID NO: 3005199 - protein, 25 aa, Entamoeba invadens
KVDLFYQCCLGIQWLHNKLNIIHRD

SEQ ID NO: 3005200 - protein, 18 aa, Entamoeba invadens
KVDLILKRSFYQVIVHYA

SEQ ID NO: 3005201 - protein, 19 aa, Entamoeba invadens
KVDSFFELVPTTPTITPVV

SEQ ID NO: 3005202 - protein, 27 aa, Entamoeba invadens
KVDSRYRFQGGYYCMVNRADGKAIRAN

SEQ ID NO: 3005203 - protein, 25 aa, Entamoeba invadens
KVDTLLKRVLLFVHTYYITNLKLFV

SEQ ID NO: 3005204 - protein, 19 aa, Entamoeba invadens
KVDYKLLDVQQGDSAIVII

SEQ ID NO: 3005205 - protein, 25 aa, Entamoeba invadens
KVEAKITLGIFFQIVFQSFKINDIF

SEQ ID NO: 3005206 - protein, 27 aa, Entamoeba invadens
KVEDFLLKNYYNIPSLASFLVKFQASK

SEQ ID NO: 3005207 - protein, 26 aa, Entamoeba invadens
KVEEICWKWRLGMAKDLKIVYFVFED

SEQ ID NO: 3005208 - protein, 19 aa, Entamoeba invadens
KVEFFRIKANKAEYAFYVG

SEQ ID NO: 3005209 - protein, 24 aa, Entamoeba invadens
KVEFYVEPSAAIVDYIRTCRTKPT

SEQ ID NO: 3005210 - protein, 28 aa, Entamoeba invadens
KVEGMEVVLLFISAPDGLLERPKRELRW

SEQ ID NO: 3005211 - protein, 24 aa, Entamoeba invadens
KVEKHVICFQILEASPINLCSVYS

SEQ ID NO: 3005212 - protein, 23 aa, Entamoeba invadens
KVEKIEVIPLPELDDKQLQKQYG

SEQ ID NO: 3005213 - protein, 24 aa, Entamoeba invadens
KVEKKFYEIVLWFNVDYCTVEANK

SEQ ID NO: 3005214 - protein, 28 aa, Entamoeba invadens
KVEKNVFSLFFALIPFNELQKAITEFEN

SEQ ID NO: 3005215 - protein, 26 aa, Entamoeba invadens
KVELKRPLFITSLPRSGSTFLHNLIA

SEQ ID NO: 3005216 - protein, 27 aa, Entamoeba invadens
KVELTNMKFIFTTFKTIIAEYSTIANS

SEQ ID NO: 3005217 - protein, 25 aa, Entamoeba invadens
KVENLLSVFSLFYSVCLPQLSHEQL

SEQ ID NO: 3005218 - protein, 27 aa, Entamoeba invadens
KVENVLNPPIFFLQLFKKRKDNVTLIQ

SEQ ID NO: 3005219 - protein, 23 aa, Entamoeba invadens
KVEQLLNLFKKVNPALIVTKTCM

SEQ ID NO: 3005220 - protein, 18 aa, Entamoeba invadens
KVEQPKSSWFGWGSKPLP

SEQ ID NO: 3005221 - protein, 25 aa, Entamoeba invadens
KVEQTLLLKELQALTALPTATRTTA

SEQ ID NO: 3005222 - protein, 24 aa, Entamoeba invadens
KVETNLFCLRVMTGSIILNDIVSA

SEQ ID NO: 3005223 - protein, 29 aa, Entamoeba invadens
KVEVLSFEGMWWYGRKENSFGYFPGEYCQ

SEQ ID NO: 3005224 - protein, 21 aa, Entamoeba invadens
KVEYCSKCEPGYFLYDENEPQ

SEQ ID NO: 3005225 - protein, 29 aa, Entamoeba invadens
KVEYSFCYKWIVLLFKRDFEPAECLRVWD

SEQ ID NO: 3005226 - protein, 23 aa, Entamoeba invadens
KVFDSIICLQNYSGAFGGVESVV

SEQ ID NO: 3005227 - protein, 24 aa, Entamoeba invadens
KVFESKEPLILKDSTLRVEQPNSG

SEQ ID NO: 3005228 - protein, 26 aa, Entamoeba invadens
KVFHKTLMYKVYTFLLKTFQEVDDVN

SEQ ID NO: 3005229 - protein, 21 aa, Entamoeba invadens
KVFHNFVEARLNFLPTFKINQ

SEQ ID NO: 3005230 - protein, 17 aa, Entamoeba invadens
KVFPKNIFVYFDTNNKT

SEQ ID NO: 3005231 - protein, 29 aa, Entamoeba invadens
KVFQPKTLDIFPYLLVNIGSGVSILRVND

SEQ ID NO: 3005232 - protein, 17 aa, Entamoeba invadens
KVFYQIIAWFEVDYGTV

SEQ ID NO: 3005233 - protein, 20 aa, Entamoeba invadens
KVGAVFKLPKLTLCFEDTFW

SEQ ID NO: 3005234 - protein, 17 aa, Entamoeba invadens
KVGFYYCTNLEYVVMSS

SEQ ID NO: 3005235 - protein, 27 aa, Entamoeba invadens
KVGGIPYYPIGMKYPTIPSGKYMYLLA

SEQ ID NO: 3005236 - protein, 29 aa, Entamoeba invadens
KVGGIPYYPIGMKYPTIPSGKYMYLLAQI

SEQ ID NO: 3005237 - protein, 28 aa, Entamoeba invadens
KVGGQKNVLLLIFSKKGYLFGSFHSSVP

SEQ ID NO: 3005238 - protein, 43 aa, Entamoeba invadens
KVGGWMVIPIAEDGLFQGKLMLVWKWTTEVLMNIPCYERKDDR

SEQ ID NO: 3005239 - protein, 21 aa, Entamoeba invadens
KVGIILFVLGMMRRIKDTSVE

SEQ ID NO: 3005240 - protein, 21 aa, Entamoeba invadens
KVGNRLFVFGFTKNFTYLFQL

SEQ ID NO: 3005241 - protein, 24 aa, Entamoeba invadens
KVGVQAIMMCAFQRGLRKYFNIQN

SEQ ID NO: 3005242 - protein, 17 aa, Entamoeba invadens
KVGYYKKGADCVLCDVK

SEQ ID NO: 3005243 - protein, 23 aa, Entamoeba invadens
KVHGESSFFVWANRGKQSLAADI

SEQ ID NO: 3005244 - protein, 38 aa, Entamoeba invadens
KVHKDLPYDFFKNSFCDIPVTANIYFDKNIVGKVIATL

SEQ ID NO: 3005245 - protein, 20 aa, Entamoeba invadens
KVHPKCLLVLFRMTVILLIF

SEQ ID NO: 3005246 - protein, 19 aa, Entamoeba invadens
KVHWKINLVKIKKSSFFNI

SEQ ID NO: 3005247 - protein, 24 aa, Entamoeba invadens
KVIAETLFYSFSSLLQKHFADFSV

SEQ ID NO: 3005248 - protein, 17 aa, Entamoeba invadens
KVIDHILQITKVDRSRI

SEQ ID NO: 3005249 - protein, 19 aa, Entamoeba invadens
KVIEALFLWSSDNVLFDKV

SEQ ID NO: 3005250 - protein, 22 aa, Entamoeba invadens
KVIEDMLFYKRKYEYYRNPEIL

SEQ ID NO: 3005251 - protein, 19 aa, Entamoeba invadens
KVIEQFNYVCTQISVCFDA

SEQ ID NO: 3005252 - protein, 20 aa, Entamoeba invadens
KVIFAIHIPFMVSGSNDYPV

SEQ ID NO: 3005253 - protein, 21 aa, Entamoeba invadens
KVIFQLPIINQNCLWYLMEYL

SEQ ID NO: 3005254 - protein, 19 aa, Entamoeba invadens
KVIIKEFLAWEGDFGGRKN

SEQ ID NO: 3005255 - protein, 19 aa, Entamoeba invadens
KVIIKRLAALSVKTQRNQC

SEQ ID NO: 3005256 - protein, 19 aa, Entamoeba invadens
KVIKKLEKIFLIKDLYTEV

SEQ ID NO: 3005257 - protein, 27 aa, Entamoeba invadens
KVIKRFILHTKRTAFIVEHDFIMATYL

SEQ ID NO: 3005258 - protein, 28 aa, Entamoeba invadens
KVILAMCTGCWVLNSLWIDKCIEKGKIV

SEQ ID NO: 3005259 - protein, 26 aa, Entamoeba invadens
KVILGYLPQFIQVLKFESYTCSALAL

SEQ ID NO: 3005260 - protein, 17 aa, Entamoeba invadens
KVILLNVPPVEKQIAYY

SEQ ID NO: 3005261 - protein, 20 aa, Entamoeba invadens
KVILPHSLSSVFYNRGYYGT

SEQ ID NO: 3005262 - protein, 19 aa, Entamoeba invadens
KVIMNFWLDTHHQDFTQAM

SEQ ID NO: 3005263 - protein, 18 aa, Entamoeba invadens
KVIPLELKALFCGLPLCC

SEQ ID NO: 3005264 - protein, 27 aa, Entamoeba invadens
KVIPNECFYFCKLTKIDLPKSLQCIGE

SEQ ID NO: 3005265 - protein, 30 aa, Entamoeba invadens
KVIVYSCLMGRIGVLVPLNFKNEAEFFVNL

SEQ ID NO: 3005266 - protein, 17 aa, Entamoeba invadens
KVIYVYRGIYDRHIFEN

SEQ ID NO: 3005267 - protein, 25 aa, Entamoeba invadens
KVKCTPLQLFFTTFQTHHGLVQIRP

SEQ ID NO: 3005268 - protein, 20 aa, Entamoeba invadens
KVKCVLWDTAGQERFMNISS

SEQ ID NO: 3005269 - protein, 33 aa, Entamoeba invadens
KVKDLQKILALDLKIVMLLYNSVSDIVLKCNVD

SEQ ID NO: 3005270 - protein, 18 aa, Entamoeba invadens
KVKEMLRRVFPNRQLLDC

SEQ ID NO: 3005271 - protein, 27 aa, Entamoeba invadens
KVKERKIPMCQWPLFIYNEFENEVGKS

SEQ ID NO: 3005272 - protein, 19 aa, Entamoeba invadens
KVKIEIKLKKKDGANWDNL

SEQ ID NO: 3005273 - protein, 20 aa, Entamoeba invadens
KVKIIFDFQCYKQHIVTTIT

SEQ ID NO: 3005274 - protein, 28 aa, Entamoeba invadens
KVKIINDWLQTVNLLYPVAYQRVEDLIS

SEQ ID NO: 3005275 - protein, 30 aa, Entamoeba invadens
KVKMTVRTFYNFLLYIKESVDIKIQRKLFK

SEQ ID NO: 3005276 - protein, 29 aa, Entamoeba invadens
KVKMTVRTFYNFLLYIKESVDIKVQHKLF

SEQ ID NO: 3005277 - protein, 24 aa, Entamoeba invadens
KVKREVLYFLRRFSQTVDPSKIIW

SEQ ID NO: 3005278 - protein, 27 aa, Entamoeba invadens
KVKRKFDGYVIFRPKYRRFEVYEDSDG

SEQ ID NO: 3005279 - protein, 18 aa, Entamoeba invadens
KVKRRIYIRVVEDELNES

SEQ ID NO: 3005280 - protein, 17 aa, Entamoeba invadens
KVKSFCLEMTETDVRRV

SEQ ID NO: 3005281 - protein, 28 aa, Entamoeba invadens
KVKSIEYQCFFGCRSLSSITIPPSVTSF

SEQ ID NO: 3005282 - protein, 28 aa, Entamoeba invadens
KVKSLIVSFFYNDLKPSNPALLIDIKKS

SEQ ID NO: 3005283 - protein, 23 aa, Entamoeba invadens
KVKTKYFRDVTASHIHALLNGHF

SEQ ID NO: 3005284 - protein, 18 aa, Entamoeba invadens
KVKTMRDYKAASEELMRT

SEQ ID NO: 3005285 - protein, 25 aa, Entamoeba invadens
KVKTTRLCVLILKSLKDLKPSVEYF

SEQ ID NO: 3005286 - protein, 18 aa, Entamoeba invadens
KVKVILKKEGREIATLIS

SEQ ID NO: 3005287 - protein, 29 aa, Entamoeba invadens
KVLALNRLQVLFWYGSPFNFDMIENVVKT

SEQ ID NO: 3005288 - protein, 25 aa, Entamoeba invadens
KVLCEWYLVFVGQPIKQAEAAKFAF

SEQ ID NO: 3005289 - protein, 17 aa, Entamoeba invadens
KVLCYNSNGSKIKKCFI

SEQ ID NO: 3005290 - protein, 32 aa, Entamoeba invadens
KVLDAKYQFFGCKKFAVLADVLCGLCIGKTVE

SEQ ID NO: 3005291 - protein, 33 aa, Entamoeba invadens
KVLDAVLRYCYLWFNFMPLTRGTAACGMYFLFG

SEQ ID NO: 3005292 - protein, 20 aa, Entamoeba invadens
KVLDVLLRSESPIIFFEFKK

SEQ ID NO: 3005293 - protein, 17 aa, Entamoeba invadens
KVLFLSNELLAQAKISE

SEQ ID NO: 3005294 - protein, 17 aa, Entamoeba invadens
KVLFMKKCFLHGDCLEM

SEQ ID NO: 3005295 - protein, 31 aa, Entamoeba invadens
KVLGAKYQFFGCKKFAVLADVLCGLCIGKTV

SEQ ID NO: 3005296 - protein, 18 aa, Entamoeba invadens
KVLGYIKTAFHFVEENSQ

SEQ ID NO: 3005297 - protein, 20 aa, Entamoeba invadens
KVLIFMKPDSNIGLIYSLLP

SEQ ID NO: 3005298 - protein, 19 aa, Entamoeba invadens
KVLIKIHQIMYHKMGEREG

SEQ ID NO: 3005299 - protein, 17 aa, Entamoeba invadens
KVLKLQCGMGHHNTVGF

SEQ ID NO: 3005300 - protein, 18 aa, Entamoeba invadens
KVLKVSIPTNKKGKPKSC

SEQ ID NO: 3005301 - protein, 22 aa, Entamoeba invadens
KVLLIIPEFFQTEMKKHTKTMS

SEQ ID NO: 3005302 - protein, 18 aa, Entamoeba invadens
KVLLIRRGCDLFESLFVV

SEQ ID NO: 3005303 - protein, 18 aa, Entamoeba invadens
KVLLLGESGVGKSAICHR

SEQ ID NO: 3005304 - protein, 22 aa, Entamoeba invadens
KVLLSLLDNWRKEKHKALIFCQ

SEQ ID NO: 3005305 - protein, 28 aa, Entamoeba invadens
KVLMCEPYEHLKTWKFSDETITFDFAKY

SEQ ID NO: 3005306 - protein, 21 aa, Entamoeba invadens
KVLPALLRYFEISTEGVSLFS

SEQ ID NO: 3005307 - protein, 19 aa, Entamoeba invadens
KVLPCFHVICRDCILSLMK

SEQ ID NO: 3005308 - protein, 18 aa, Entamoeba invadens
KVLPFLHTILVQKSPLEK

SEQ ID NO: 3005309 - protein, 20 aa, Entamoeba invadens
KVLPKIIHRLPNLVSLDLSE

SEQ ID NO: 3005310 - protein, 18 aa, Entamoeba invadens
KVLQFYKEHDKCFKEVDP

SEQ ID NO: 3005311 - protein, 17 aa, Entamoeba invadens
KVLQYLVIKANSPYMAS

SEQ ID NO: 3005312 - protein, 24 aa, Entamoeba invadens
KVLSDRFIDYNLAKTRVLEMKKKK

SEQ ID NO: 3005313 - protein, 26 aa, Entamoeba invadens
KVLTHYIVYILRCSPFRVGSYLLVKG

SEQ ID NO: 3005314 - protein, 19 aa, Entamoeba invadens
KVLTKIVIPNKMKIIGEYS

SEQ ID NO: 3005315 - protein, 29 aa, Entamoeba invadens
KVLTNSLKNPASLEKLWKIKEETHAINNV

SEQ ID NO: 3005316 - protein, 17 aa, Entamoeba invadens
KVLVFNGIFDVIATCWE

SEQ ID NO: 3005317 - protein, 17 aa, Entamoeba invadens
KVLVTTPKGFLSVDEIV

SEQ ID NO: 3005318 - protein, 20 aa, Entamoeba invadens
KVLYLVQWQNFSLTEATWIL

SEQ ID NO: 3005319 - protein, 19 aa, Entamoeba invadens
KVLYQTRVNFSLDIIAKRE

SEQ ID NO: 3005320 - protein, 26 aa, Entamoeba invadens
KVMELYIDFMPINADLFISSSPNFCS

SEQ ID NO: 3005321 - protein, 26 aa, Entamoeba invadens
KVMGGFDRVLVDAPCTGLGIISKDSS

SEQ ID NO: 3005322 - protein, 21 aa, Entamoeba invadens
KVMLIGFPRDVTDKAVNSLLA

SEQ ID NO: 3005323 - protein, 35 aa, Entamoeba invadens
KVNALTKAIFLHPYAKEMLLKKTVLELLRNDFAAI

SEQ ID NO: 3005324 - protein, 30 aa, Entamoeba invadens
KVNEMQLLLMDLLGVFGFFFETKRVHGKKT

SEQ ID NO: 3005325 - protein, 20 aa, Entamoeba invadens
KVNFRILKDGDIITLAGGKG

SEQ ID NO: 3005326 - protein, 26 aa, Entamoeba invadens
KVNKEFYYFDIMPVPESVGSLFLVGK

SEQ ID NO: 3005327 - protein, 26 aa, Entamoeba invadens
KVNKKRFYKIVIWYQVDFDTFHNVAK

SEQ ID NO: 3005328 - protein, 17 aa, Entamoeba invadens
KVNLFNFGKFVVRFYNI

SEQ ID NO: 3005329 - protein, 23 aa, Entamoeba invadens
KVNLPPPLEYYPPNGYNKSDYNI

SEQ ID NO: 3005330 - protein, 18 aa, Entamoeba invadens
KVNLWIYQNVVIALKSGT

SEQ ID NO: 3005331 - protein, 26 aa, Entamoeba invadens
KVNNRVVFMKWWRGSKKKSGTLKMVL

SEQ ID NO: 3005332 - protein, 25 aa, Entamoeba invadens
KVNPNFSFGLLTNFKEIVDRYYFDY

SEQ ID NO: 3005333 - protein, 27 aa, Entamoeba invadens
KVNPPPILRANLYQLLSKIIPRMTYFS

SEQ ID NO: 3005334 - protein, 26 aa, Entamoeba invadens
KVNQEPLIEPKKRMPPHVPKETIDQF

SEQ ID NO: 3005335 - protein, 22 aa, Entamoeba invadens
KVNYCQYGSGFFFINGEKLKKL

SEQ ID NO: 3005336 - protein, 26 aa, Entamoeba invadens
KVPAQRIRILFITHSHIDHVGGIVSF

SEQ ID NO: 3005337 - protein, 22 aa, Entamoeba invadens
KVPEIVYEWIGCKHMKTIFDSE

SEQ ID NO: 3005338 - protein, 24 aa, Entamoeba invadens
KVPGALPALRIQIYERMSKYLKHF

SEQ ID NO: 3005339 - protein, 19 aa, Entamoeba invadens
KVPKDIIGITPRIKTMRKD

SEQ ID NO: 3005340 - protein, 26 aa, Entamoeba invadens
KVPKYKQYYIFFTSPINDGIVETLAE

SEQ ID NO: 3005341 - protein, 23 aa, Entamoeba invadens
KVPNDLRKPFWELQLKVEESISD

SEQ ID NO: 3005342 - protein, 26 aa, Entamoeba invadens
KVPNGNGCLVCKVGYYKKGADCVLCD

SEQ ID NO: 3005343 - protein, 37 aa, Entamoeba invadens
KVPRGGMGMVGMGMGMAGFNPSKVTLKKTGTSGASQQ

SEQ ID NO: 3005344 - protein, 30 aa, Entamoeba invadens
KVPSHLPLSVRFYWDSKVPKGYYNKEYFRT

SEQ ID NO: 3005345 - protein, 49 aa, Entamoeba invadens
KVPVKKGMCDAVVFCLSLMGIDFPHFIREGFRILKTGGLMFIAEVKGRF

SEQ ID NO: 3005346 - protein, 19 aa, Entamoeba invadens
KVQAILTQLLVTATTPWAD

SEQ ID NO: 3005347 - protein, 32 aa, Entamoeba invadens
KVQDDVIRVCFVFEKLFLVSKIKTFQGKVLEK

SEQ ID NO: 3005348 - protein, 29 aa, Entamoeba invadens
KVQKRYEDYLTLLAANKNPTKYTLKNRHE

SEQ ID NO: 3005349 - protein, 26 aa, Entamoeba invadens
KVQLINYHHLHQAVLFTYAEHLRKIN

SEQ ID NO: 3005350 - protein, 17 aa, Entamoeba invadens
KVQLVQAKPFYRAEEYH

SEQ ID NO: 3005351 - protein, 24 aa, Entamoeba invadens
KVQQEDEVVLALRSILTARRVDTN

SEQ ID NO: 3005352 - protein, 25 aa, Entamoeba invadens
KVQQLYVGFFGYVLKHIDILKEVSF

SEQ ID NO: 3005353 - protein, 30 aa, Entamoeba invadens
KVQRKLFKTAFLFFQPFKSYTTYMGDRDET

SEQ ID NO: 3005354 - protein, 26 aa, Entamoeba invadens
KVQVDIPYIFLLKNNPEVIRNFVYVY

SEQ ID NO: 3005355 - protein, 19 aa, Entamoeba invadens
KVREELACWKAVNTQLLSL

SEQ ID NO: 3005356 - protein, 30 aa, Entamoeba invadens
KVREKRGICLVNRLISMLSAFQAATTIQNV

SEQ ID NO: 3005357 - protein, 24 aa, Entamoeba invadens
KVREMFPCLILCSRGFPDNATLDL

SEQ ID NO: 3005358 - protein, 35 aa, Entamoeba invadens
KVRHTFFIEYLLDKKFFVLAYFWEENVISLFVQLL

SEQ ID NO: 3005359 - protein, 23 aa, Entamoeba invadens
KVRINTAYTLFYAVRPTIDVEHF

SEQ ID NO: 3005360 - protein, 30 aa, Entamoeba invadens
KVRYNDLLMFKIQILMKGKLYNAVLDFIKT

SEQ ID NO: 3005361 - protein, 25 aa, Entamoeba invadens
KVSAIISLPEHAAIMYNYGSLVNCS

SEQ ID NO: 3005362 - protein, 29 aa, Entamoeba invadens
KVSDLVHFFYQILIMMELISDKYTSLGWM

SEQ ID NO: 3005363 - protein, 26 aa, Entamoeba invadens
KVSDSVSMKCFNLFYGCYSCDYKQNS

SEQ ID NO: 3005364 - protein, 25 aa, Entamoeba invadens
KVSDVYFTAFRTPTKAKKGNYFVCG

SEQ ID NO: 3005365 - protein, 27 aa, Entamoeba invadens
KVSEWAFWWINIINMQFTYLTPKDKGI

SEQ ID NO: 3005366 - protein, 21 aa, Entamoeba invadens
KVSFNEVLSMKLPEHPKSTPK

SEQ ID NO: 3005367 - protein, 20 aa, Entamoeba invadens
KVSFPPVIRVIGDSAFQDDI

SEQ ID NO: 3005368 - protein, 20 aa, Entamoeba invadens
KVSFRPQIIQWILEKKVTNN

SEQ ID NO: 3005369 - protein, 22 aa, Entamoeba invadens
KVSLIVPIRINATAFYRETIIA

SEQ ID NO: 3005370 - protein, 26 aa, Entamoeba invadens
KVSMGSFFCMLLSKGRLYTWGSFSFG

SEQ ID NO: 3005371 - protein, 26 aa, Entamoeba invadens
KVSNHPWLIQDFVKTFPEVLSGILPK

SEQ ID NO: 3005372 - protein, 25 aa, Entamoeba invadens
KVSQSCGIGFNWAMKTGPLCEEEMM

SEQ ID NO: 3005373 - protein, 27 aa, Entamoeba invadens
KVSSISIGIDFIWDKEYFKALTQLEGV

SEQ ID NO: 3005374 - protein, 27 aa, Entamoeba invadens
KVSSWMYAPVCALFHFSSIHSPTCRFA

SEQ ID NO: 3005375 - protein, 25 aa, Entamoeba invadens
KVSVLGKMIQLFFKTKEGAAGSADK

SEQ ID NO: 3005376 - protein, 18 aa, Entamoeba invadens
KVTAIRYILRASAVASKY

SEQ ID NO: 3005377 - protein, 29 aa, Entamoeba invadens
KVTDPKFKKIAYIEFLLHKYQQTIEELMK

SEQ ID NO: 3005378 - protein, 18 aa, Entamoeba invadens
KVTFNTFWTDYEGIDKKC

SEQ ID NO: 3005379 - protein, 25 aa, Entamoeba invadens
KVTKFGPFFDYFRKSVKLAESADVS

SEQ ID NO: 3005380 - protein, 18 aa, Entamoeba invadens
KVTLLSFEVTFNSTLQTT

SEQ ID NO: 3005381 - protein, 17 aa, Entamoeba invadens
KVTPKWYLYPTEPIEHS

SEQ ID NO: 3005382 - protein, 25 aa, Entamoeba invadens
KVTTEYTFIFNPNKYLKSTQIAFTL

SEQ ID NO: 3005383 - protein, 25 aa, Entamoeba invadens
KVTTRLELFLMKFTDAVFKKDQDTF

SEQ ID NO: 3005384 - protein, 19 aa, Entamoeba invadens
KVVESLLGYSKFFEDFVFL

SEQ ID NO: 3005385 - protein, 31 aa, Entamoeba invadens
KVVEWLTGSVTVKYTFLTQSHKSGKWNILKC

SEQ ID NO: 3005386 - protein, 20 aa, Entamoeba invadens
KVVFYLSALRDATTFILINK

SEQ ID NO: 3005387 - protein, 21 aa, Entamoeba invadens
KVVHIHYIGWPDFGTPEDKTS

SEQ ID NO: 3005388 - protein, 17 aa, Entamoeba invadens
KVVIYKLCLPDSGEKIK

SEQ ID NO: 3005389 - protein, 18 aa, Entamoeba invadens
KVVLSSFFVLRKDYSVID

SEQ ID NO: 3005390 - protein, 27 aa, Entamoeba invadens
KVVPHLLFNLLVGCKVVLFQSKKLYDA

SEQ ID NO: 3005391 - protein, 20 aa, Entamoeba invadens
KVVPYLEITGKLLYSNMKEA

SEQ ID NO: 3005392 - protein, 24 aa, Entamoeba invadens
KVVQMIFKRLFRIYAHIYLHHLNQ

SEQ ID NO: 3005393 - protein, 18 aa, Entamoeba invadens
KVVRLLYQRAVEGKPLYD

SEQ ID NO: 3005394 - protein, 26 aa, Entamoeba invadens
KVVSWQLLCRAVMYSLSVLNAPRLYF

SEQ ID NO: 3005395 - protein, 18 aa, Entamoeba invadens
KVVTLRPKDTCLFTIEIS

SEQ ID NO: 3005396 - protein, 24 aa, Entamoeba invadens
KVVTSYIHFIVMYLDDLTKSQNTE

SEQ ID NO: 3005397 - protein, 20 aa, Entamoeba invadens
KVWSEFFEIPVGALSRKTDF

SEQ ID NO: 3005398 - protein, 22 aa, Entamoeba invadens
KVWSELFDIPIGALSRDSNFYI

SEQ ID NO: 3005399 - protein, 17 aa, Entamoeba invadens
KVYAFINYDSFDAADKA

SEQ ID NO: 3005400 - protein, 25 aa, Entamoeba invadens
KVYDRMNQFPFPFAETIVLDISNNL

SEQ ID NO: 3005401 - protein, 18 aa, Entamoeba invadens
KVYGFNGDTLLNRTIRFG

SEQ ID NO: 3005402 - protein, 27 aa, Entamoeba invadens
KVYISKQLLCFINARPADMIILVGGGD

SEQ ID NO: 3005403 - protein, 27 aa, Entamoeba invadens
KVYKDQAIFFLNAFWAECGSEAEYIWK

SEQ ID NO: 3005404 - protein, 20 aa, Entamoeba invadens
KVYLGRLTNHLRMGIVGLPN

SEQ ID NO: 3005405 - protein, 24 aa, Entamoeba invadens
KVYLPAEKTIYRGFMYNAYSASND

SEQ ID NO: 3005406 - protein, 22 aa, Entamoeba invadens
KVYSWFSLSVLTFWICHHPQNI

SEQ ID NO: 3005407 - protein, 40 aa, Entamoeba invadens
KWAGECLILPNFLILPVQRFPRYVMLLESLLKATPPIEEY

SEQ ID NO: 3005408 - protein, 18 aa, Entamoeba invadens
KWCEVAYKNGLHLVIGEI

SEQ ID NO: 3005409 - protein, 28 aa, Entamoeba invadens
KWCLKVPNYQRNWFIGIRLENTNELIGF

SEQ ID NO: 3005410 - protein, 26 aa, Entamoeba invadens
KWFELASHFYWGTWSLIQAALSSIDF

SEQ ID NO: 3005411 - protein, 18 aa, Entamoeba invadens
KWFWNNMDMGFIKAERGD

SEQ ID NO: 3005412 - protein, 26 aa, Entamoeba invadens
KWGNKILRMNFWDTPRLMNGFGPTPY

SEQ ID NO: 3005413 - protein, 19 aa, Entamoeba invadens
KWGWTLKEMREREDFIGDE

SEQ ID NO: 3005414 - protein, 24 aa, Entamoeba invadens
KWHEELRFMIDPHNLPSILFEIYD

SEQ ID NO: 3005415 - protein, 20 aa, Entamoeba invadens
KWIMEVIGCGLTLPVDDHKT

SEQ ID NO: 3005416 - protein, 20 aa, Entamoeba invadens
KWIQAKYRMPNISVFDFTPI

SEQ ID NO: 3005417 - protein, 20 aa, Entamoeba invadens
KWITVEYPIQPILENGTQTT

SEQ ID NO: 3005418 - protein, 28 aa, Entamoeba invadens
KWKVDAKMNKRMWGRILVGAEKSIKRVI

SEQ ID NO: 3005419 - protein, 18 aa, Entamoeba invadens
KWLARQFQLIGVIYEKHK

SEQ ID NO: 3005420 - protein, 20 aa, Entamoeba invadens
KWLDLALDLFSEAMKTIFID

SEQ ID NO: 3005421 - protein, 22 aa, Entamoeba invadens
KWLHSQHFLHKLIVLGNNELKI

SEQ ID NO: 3005422 - protein, 20 aa, Entamoeba invadens
KWLSYGCRLTDYYCREYLVE

SEQ ID NO: 3005423 - protein, 25 aa, Entamoeba invadens
KWMAAFPHDFLDQCDKGIGVLPRLD

SEQ ID NO: 3005424 - protein, 21 aa, Entamoeba invadens
KWMNRSCGCAFGFGGKFVSYN

SEQ ID NO: 3005425 - protein, 30 aa, Entamoeba invadens
KWPDYQLRPNFLIALVEAPSLFINHLEDAK

SEQ ID NO: 3005426 - protein, 33 aa, Entamoeba invadens
KWPENSLIAIGGFLFLRFINPALVSPQRFGAQM

SEQ ID NO: 3005427 - protein, 18 aa, Entamoeba invadens
KWTENLVYSFFNTSQSIS

SEQ ID NO: 3005428 - protein, 19 aa, Entamoeba invadens
KWTFLINKSTPLTVKEKKV

SEQ ID NO: 3005429 - protein, 20 aa, Entamoeba invadens
KWTLLQRRMDQLDQMLNLLY

SEQ ID NO: 3005430 - protein, 17 aa, Entamoeba invadens
KWTTSGKYFIPSTTRHL

SEQ ID NO: 3005431 - protein, 28 aa, Entamoeba invadens
KWVEGKISNFYYLMYLNTKSGRTFNDVT

SEQ ID NO: 3005432 - protein, 24 aa, Entamoeba invadens
KWVPEVQHFCQDVKLLLVGTKNDC

SEQ ID NO: 3005433 - protein, 18 aa, Entamoeba invadens
KWYPIELDKKFPKSTQKP

SEQ ID NO: 3005434 - protein, 25 aa, Entamoeba invadens
KWYRANVVVVAPKANILKCVDTGVF

SEQ ID NO: 3005435 - protein, 31 aa, Entamoeba invadens
KWYVELFHSCRIIVHYFLISLSKNTNNYVAA

SEQ ID NO: 3005436 - protein, 30 aa, Entamoeba invadens
KYAENIMLMERRFISLFAQGGYEDFFSTDI

SEQ ID NO: 3005437 - protein, 17 aa, Entamoeba invadens
KYAFPMNRIVLLPCNSR

SEQ ID NO: 3005438 - protein, 17 aa, Entamoeba invadens
KYALPPDFSLKFTFRRF

SEQ ID NO: 3005439 - protein, 31 aa, Entamoeba invadens
KYAVTLVSDILILIKKIPPVWARAVVEAAEA

SEQ ID NO: 3005440 - protein, 19 aa, Entamoeba invadens
KYCFLATFCKTRFNSCCKS

SEQ ID NO: 3005441 - protein, 23 aa, Entamoeba invadens
KYCGDFVGLFLNALLNPEFEITQ

SEQ ID NO: 3005442 - protein, 28 aa, Entamoeba invadens
KYCKVKCLYPFLENQVVRVIRNIPEKLL

SEQ ID NO: 3005443 - protein, 25 aa, Entamoeba invadens
KYCMNQYLHLIPIKSQYTLIDTKSR

SEQ ID NO: 3005444 - protein, 20 aa, Entamoeba invadens
KYDFEGIVYNNFHNYLKVDI

SEQ ID NO: 3005445 - protein, 18 aa, Entamoeba invadens
KYDIHKYIDILFNNECET

SEQ ID NO: 3005446 - protein, 21 aa, Entamoeba invadens
KYDLKIEYIDRLTLSKKYLHI

SEQ ID NO: 3005447 - protein, 24 aa, Entamoeba invadens
KYDPLNPCQYFAPNTQYFQPEHHF

SEQ ID NO: 3005448 - protein, 28 aa, Entamoeba invadens
KYDSLTRLYYRFAAGVFIVFSINDTTSF

SEQ ID NO: 3005449 - protein, 26 aa, Entamoeba invadens
KYDSVWMRGYWLIFSQDQAVKGKIDK

SEQ ID NO: 3005450 - protein, 26 aa, Entamoeba invadens
KYDSVWMRGYWLIFSQDQAVKGNIDK

SEQ ID NO: 3005451 - protein, 23 aa, Entamoeba invadens
KYECRVFCKQSCYGKMKVRWHSC

SEQ ID NO: 3005452 - protein, 27 aa, Entamoeba invadens
KYEDALNAMYYILQALAFVCGQKEDMK

SEQ ID NO: 3005453 - protein, 28 aa, Entamoeba invadens
KYEDFINIILVCKKFEYILDRIRMNPVQ

SEQ ID NO: 3005454 - protein, 24 aa, Entamoeba invadens
KYEDQCFTTPFKLKAFREDFIYAF

SEQ ID NO: 3005455 - protein, 26 aa, Entamoeba invadens
KYEEKTMDIIIPLNKDCIGKNFIFKV

SEQ ID NO: 3005456 - protein, 24 aa, Entamoeba invadens
KYEIGHFFIAVDISTFRDLDEFKK

SEQ ID NO: 3005457 - protein, 29 aa, Entamoeba invadens
KYEKTKMVFWYFWFLSFAFEQPDKPKEPE

SEQ ID NO: 3005458 - protein, 35 aa, Entamoeba invadens
KYENVALCFKLIIKQCIFLCQMLRTSLKQCSLVNV

SEQ ID NO: 3005459 - protein, 24 aa, Entamoeba invadens
KYEQLQWISFASSSQLKVLLPTKL

SEQ ID NO: 3005460 - protein, 30 aa, Entamoeba invadens
KYEVLFNCCGLFDLYQLKKIVWDTDEFCKC

SEQ ID NO: 3005461 - protein, 18 aa, Entamoeba invadens
KYFAKTLIVHELVKSLDL

SEQ ID NO: 3005462 - protein, 29 aa, Entamoeba invadens
KYFDHLETLILWLFIPNNNNYLNFSKMNS

SEQ ID NO: 3005463 - protein, 18 aa, Entamoeba invadens
KYFETFGPIRKTSDKKPQ

SEQ ID NO: 3005464 - protein, 20 aa, Entamoeba invadens
KYFGVLFKNAEQEFAFFLNP

SEQ ID NO: 3005465 - protein, 22 aa, Entamoeba invadens
KYFHSTVLFGDSLYIYGGRTRS

SEQ ID NO: 3005466 - protein, 18 aa, Entamoeba invadens
KYFPKSPESIIKLLEETK

SEQ ID NO: 3005467 - protein, 34 aa, Entamoeba invadens
KYFPRIETLYLYDQTDPFWFDLSQRLGLSTRDVL

SEQ ID NO: 3005468 - protein, 18 aa, Entamoeba invadens
KYFTLKGKDQGGLMLAPR

SEQ ID NO: 3005469 - protein, 28 aa, Entamoeba invadens
KYGCISCDIGYYLLFAKCYLCSENCTSC

SEQ ID NO: 3005470 - protein, 21 aa, Entamoeba invadens
KYGLPLIPDEHWEPLFAELGK

SEQ ID NO: 3005471 - protein, 24 aa, Entamoeba invadens
KYGNNLPLIVTSLGKWCFYNCTNL

SEQ ID NO: 3005472 - protein, 18 aa, Entamoeba invadens
KYGQICDEPMYWKTDDKL

SEQ ID NO: 3005473 - protein, 21 aa, Entamoeba invadens
KYGVIFGASFIQKADPKNKGR

SEQ ID NO: 3005474 - protein, 25 aa, Entamoeba invadens
KYHGWSVKHPFNGKLLPIIEDDELV

SEQ ID NO: 3005475 - protein, 27 aa, Entamoeba invadens
KYHQTVLMLVAAIKKRKLAKLATIKSQ

SEQ ID NO: 3005476 - protein, 20 aa, Entamoeba invadens
KYHRAQFVLQKTTKLLLEEC

SEQ ID NO: 3005477 - protein, 26 aa, Entamoeba invadens
KYHTIKMIDYFLYQGHVCIVSELLSV

SEQ ID NO: 3005478 - protein, 18 aa, Entamoeba invadens
KYHTVAEDALFILRTHLL

SEQ ID NO: 3005479 - protein, 20 aa, Entamoeba invadens
KYIDALYEDKLNHPEDLVFV

SEQ ID NO: 3005480 - protein, 26 aa, Entamoeba invadens
KYIDKIFVNGNRWTKLFITHDIMAEG

SEQ ID NO: 3005481 - protein, 18 aa, Entamoeba invadens
KYIDNILLKYSDILEYSF

SEQ ID NO: 3005482 - protein, 20 aa, Entamoeba invadens
KYIEFVKIENKQLNDIIIAK

SEQ ID NO: 3005483 - protein, 23 aa, Entamoeba invadens
KYIETEIIPRYKQFDKAHNLLHV

SEQ ID NO: 3005484 - protein, 23 aa, Entamoeba invadens
KYIKEKFTTIPRLAFMPTGPLQK

SEQ ID NO: 3005485 - protein, 20 aa, Entamoeba invadens
KYIKLLINIIQTALSSHSFF

SEQ ID NO: 3005486 - protein, 19 aa, Entamoeba invadens
KYILKYLEMFYGNKTLNEL

SEQ ID NO: 3005487 - protein, 23 aa, Entamoeba invadens
KYIVNDYFLQVCSLITAVFCEKY

SEQ ID NO: 3005488 - protein, 17 aa, Entamoeba invadens
KYIYYDYRTYLYEYKIS

SEQ ID NO: 3005489 - protein, 25 aa, Entamoeba invadens
KYKENDFFKEFFASRYFGDTEKNAS

SEQ ID NO: 3005490 - protein, 30 aa, Entamoeba invadens
KYKENFRVLQERPFLVWTDNTSAFKEYAQS

SEQ ID NO: 3005491 - protein, 25 aa, Entamoeba invadens
KYKFKGEIVLYYIDSWDIKKGIYII

SEQ ID NO: 3005492 - protein, 19 aa, Entamoeba invadens
KYKKKRWDPALKAQAVKLA

SEQ ID NO: 3005493 - protein, 18 aa, Entamoeba invadens
KYKLIFDSSKYETLSNAI

SEQ ID NO: 3005494 - protein, 17 aa, Entamoeba invadens
KYKLVGVVIHSGGAHGG

SEQ ID NO: 3005495 - protein, 21 aa, Entamoeba invadens
KYKNLKVALLEKARDVSTGAT

SEQ ID NO: 3005496 - protein, 18 aa, Entamoeba invadens
KYKNLLQELWYTEQTHVN

SEQ ID NO: 3005497 - protein, 32 aa, Entamoeba invadens
KYKPTLLVAVPRFYEKLLVRLNEVLKTSKLAT

SEQ ID NO: 3005498 - protein, 18 aa, Entamoeba invadens
KYKVLYIDDCDHNSILET

SEQ ID NO: 3005499 - protein, 19 aa, Entamoeba invadens
KYLDKNLFVINNFEKPHAL

SEQ ID NO: 3005500 - protein, 22 aa, Entamoeba invadens
KYLFYNCRSLSSISLPEKLVVL

SEQ ID NO: 3005501 - protein, 26 aa, Entamoeba invadens
KYLGRRAFYYCKNLKEVIYPKIIKRC

SEQ ID NO: 3005502 - protein, 26 aa, Entamoeba invadens
KYLGRRAFYYCKSLKEVIYPKIIERC

SEQ ID NO: 3005503 - protein, 34 aa, Entamoeba invadens
KYLHDKNISMYFVYQWLALLFKRDFGGEIYELWD

SEQ ID NO: 3005504 - protein, 20 aa, Entamoeba invadens
KYLISLFTEANYFDNVYPSV

SEQ ID NO: 3005505 - protein, 19 aa, Entamoeba invadens
KYLKFEDKIFDVMLLKMYT

SEQ ID NO: 3005506 - protein, 35 aa, Entamoeba invadens
KYLNNRTKQTPFYPYLLLSINRSRLSSAHETILLA

SEQ ID NO: 3005507 - protein, 19 aa, Entamoeba invadens
KYLQTKFMQLPNPPFYAKK

SEQ ID NO: 3005508 - protein, 26 aa, Entamoeba invadens
KYLSPTANVLLLKSAVHYVEKMLDVF

SEQ ID NO: 3005509 - protein, 17 aa, Entamoeba invadens
KYLTKDNGFFVFSLRNN

SEQ ID NO: 3005510 - protein, 21 aa, Entamoeba invadens
KYLVIPDVWEIEIGGIVMACR

SEQ ID NO: 3005511 - protein, 19 aa, Entamoeba invadens
KYMELANRVFRLPVKAAEC

SEQ ID NO: 3005512 - protein, 25 aa, Entamoeba invadens
KYMFDQILFARDSEFLRCYCAELVK

SEQ ID NO: 3005513 - protein, 19 aa, Entamoeba invadens
KYMNDVHNLVLTPLKTYGE

SEQ ID NO: 3005514 - protein, 38 aa, Entamoeba invadens
KYNANFVWIHREPLEQIKSLIPLLLGAQGRFEHDLGRN

SEQ ID NO: 3005515 - protein, 24 aa, Entamoeba invadens
KYNEKFLLGYKEGSDFYLGTIDAK

SEQ ID NO: 3005516 - protein, 26 aa, Entamoeba invadens
KYNGKYIYKQALLYALKMIQKYGVVD

SEQ ID NO: 3005517 - protein, 26 aa, Entamoeba invadens
KYNHLSTINILLPLSTPNIPDNYGQL

SEQ ID NO: 3005518 - protein, 19 aa, Entamoeba invadens
KYNITYWIYGHTHSNFNDY

SEQ ID NO: 3005519 - protein, 19 aa, Entamoeba invadens
KYNMLVLDTVFRTYFRILK

SEQ ID NO: 3005520 - protein, 26 aa, Entamoeba invadens
KYNPAFVMPSFRKTIIRLLTQLKYSS

SEQ ID NO: 3005521 - protein, 24 aa, Entamoeba invadens
KYNTLHYILVLDHKNPHVMDLDMK

SEQ ID NO: 3005522 - protein, 24 aa, Entamoeba invadens
KYNTLHYILVMENNEPRITDLDIK

SEQ ID NO: 3005523 - protein, 26 aa, Entamoeba invadens
KYPNKHEFLMKFLGNMLQVKGVIFEN

SEQ ID NO: 3005524 - protein, 27 aa, Entamoeba invadens
KYPVPRRLLVITSLIKTNAFLLEDKNN

SEQ ID NO: 3005525 - protein, 19 aa, Entamoeba invadens
KYQEPLFQPYQSEKKRPMN

SEQ ID NO: 3005526 - protein, 19 aa, Entamoeba invadens
KYQITPRDKAIRTDITMRR

SEQ ID NO: 3005527 - protein, 34 aa, Entamoeba invadens
KYQLKTTYSLILSKYPLIPVTSYIPHSTLYGRQI

SEQ ID NO: 3005528 - protein, 25 aa, Entamoeba invadens
KYQLKYNKEHLDPKAFRVYCANNNL

SEQ ID NO: 3005529 - protein, 24 aa, Entamoeba invadens
KYQRPVSHMIGTVSSFMTCTSTLC

SEQ ID NO: 3005530 - protein, 24 aa, Entamoeba invadens
KYQSAAFPALLLFIRNNGGSIQAW

SEQ ID NO: 3005531 - protein, 19 aa, Entamoeba invadens
KYRDTIEKLHFNPIPLTTK

SEQ ID NO: 3005532 - protein, 32 aa, Entamoeba invadens
KYREEISQLKSKRLTNFFWSKDNGEKAEAEKQ

SEQ ID NO: 3005533 - protein, 19 aa, Entamoeba invadens
KYREMLEKLLKYEPNNMEL

SEQ ID NO: 3005534 - protein, 23 aa, Entamoeba invadens
KYRFILDRFRYNPISIQSKKLFP

SEQ ID NO: 3005535 - protein, 18 aa, Entamoeba invadens
KYRLLKDNALLERMIDVD

SEQ ID NO: 3005536 - protein, 21 aa, Entamoeba invadens
KYRQIFEMLHFNPVPINNKTI

SEQ ID NO: 3005537 - protein, 17 aa, Entamoeba invadens
KYRSMVNMYYRGSSGGV

SEQ ID NO: 3005538 - protein, 17 aa, Entamoeba invadens
KYSATISALLVFLSIDH

SEQ ID NO: 3005539 - protein, 33 aa, Entamoeba invadens
KYSFVMAKVPLCNPLSFFSLRKLKEAEVLTLDQ

SEQ ID NO: 3005540 - protein, 27 aa, Entamoeba invadens
KYSHPKFMVFEVFPVAPPAVRPQAVSD

SEQ ID NO: 3005541 - protein, 26 aa, Entamoeba invadens
KYSMRSVFMYLPYIKNYFLITDNQIP

SEQ ID NO: 3005542 - protein, 25 aa, Entamoeba invadens
KYSNLLEMFHFNPIPLTTKTILYFP

SEQ ID NO: 3005543 - protein, 23 aa, Entamoeba invadens
KYSSKFVRILSSKIFQDKKLKDL

SEQ ID NO: 3005544 - protein, 27 aa, Entamoeba invadens
KYTDDGFRIYSLEELGLDKNKKGGNTP

SEQ ID NO: 3005545 - protein, 27 aa, Entamoeba invadens
KYTDEALCWFFDALFHMNSLYDLGEVP

SEQ ID NO: 3005546 - protein, 18 aa, Entamoeba invadens
KYTEILSALLTGSSDMVR

SEQ ID NO: 3005547 - protein, 27 aa, Entamoeba invadens
KYTESLTFVYQFLLELNPKYSTTQVIA

SEQ ID NO: 3005548 - protein, 23 aa, Entamoeba invadens
KYTFCLNPQFLNRSFIHTQLDLN

SEQ ID NO: 3005549 - protein, 17 aa, Entamoeba invadens
KYTFVVIDTPKPTSLTV

SEQ ID NO: 3005550 - protein, 28 aa, Entamoeba invadens
KYTGIPVFWGRIVKALPFFQPTAEEMKV

SEQ ID NO: 3005551 - protein, 21 aa, Entamoeba invadens
KYTKIFVQTAQLFEKENKEEK

SEQ ID NO: 3005552 - protein, 20 aa, Entamoeba invadens
KYTPEDILGLLRQGLESEAD

SEQ ID NO: 3005553 - protein, 24 aa, Entamoeba invadens
KYTPETQPLAFWVFDIQSVENAIT

SEQ ID NO: 3005554 - protein, 25 aa, Entamoeba invadens
KYTRITTLSPYIDPMCYTLLFPFGN

SEQ ID NO: 3005555 - protein, 24 aa, Entamoeba invadens
KYTTLMYMSFLFSGMIYNNNNCFY

SEQ ID NO: 3005556 - protein, 18 aa, Entamoeba invadens
KYVCSVFPKINTFRSTPS

SEQ ID NO: 3005557 - protein, 17 aa, Entamoeba invadens
KYVDILVCGDSKSVKKS

SEQ ID NO: 3005558 - protein, 37 aa, Entamoeba invadens
KYVESLRVYLSYILNCPYFVSRFPVFSSSKTLTDSLI

SEQ ID NO: 3005559 - protein, 23 aa, Entamoeba invadens
KYVFDLISIGFYSRGFTTLQTLS

SEQ ID NO: 3005560 - protein, 21 aa, Entamoeba invadens
KYVNYAFIRFSRFLGNCITKS

SEQ ID NO: 3005561 - protein, 21 aa, Entamoeba invadens
KYVPCHCILFSDICVFAEYSQ

SEQ ID NO: 3005562 - protein, 19 aa, Entamoeba invadens
KYVTAFKKSGLFIEKDKED

SEQ ID NO: 3005563 - protein, 18 aa, Entamoeba invadens
KYVYQILDGLSFIHEQGI

SEQ ID NO: 3005564 - protein, 19 aa, Entamoeba invadens
KYWLSYGERYITRKYLKVL

SEQ ID NO: 3005565 - protein, 24 aa, Entamoeba invadens
KYYDNFCEWTFNIFLVLNNNKEQK

SEQ ID NO: 3005566 - protein, 21 aa, Entamoeba invadens
KYYIQKLVLFKLPSNLTEVNF

SEQ ID NO: 3005567 - protein, 26 aa, Entamoeba invadens
LAADEAMLLQRQKVLFLSNELLAQAK

SEQ ID NO: 3005568 - protein, 18 aa, Entamoeba invadens
LAAKLKFGENEIVAKPRS

SEQ ID NO: 3005569 - protein, 18 aa, Entamoeba invadens
LAANLNVSGYKLLCGLFL

SEQ ID NO: 3005570 - protein, 23 aa, Entamoeba invadens
LAAQFSHRKFFHNLNRNKMNNKS

SEQ ID NO: 3005571 - protein, 26 aa, Entamoeba invadens
LAARQMHLAKFLRSLQRMADEFSVAV

SEQ ID NO: 3005572 - protein, 23 aa, Entamoeba invadens
LAAVQLVFYAHFDEEWDGNVTTD

SEQ ID NO: 3005573 - protein, 19 aa, Entamoeba invadens
LAAYFKQVYIWQGGNDINC

SEQ ID NO: 3005574 - protein, 20 aa, Entamoeba invadens
LACAVSKSGWRFPLPVYRSI

SEQ ID NO: 3005575 - protein, 17 aa, Entamoeba invadens
LACFPMQDVLSLKAKYI

SEQ ID NO: 3005576 - protein, 20 aa, Entamoeba invadens
LACIDGFNYINGYCLLCDLN

SEQ ID NO: 3005577 - protein, 18 aa, Entamoeba invadens
LACQKLSEVVLPSKLSVV

SEQ ID NO: 3005578 - protein, 26 aa, Entamoeba invadens
LADFNQMMWFIIRKEGEMKVYAYMQC

SEQ ID NO: 3005579 - protein, 26 aa, Entamoeba invadens
LADGRYICDILLTQLPVIFDLDKTDV

SEQ ID NO: 3005580 - protein, 30 aa, Entamoeba invadens
LADKTPCLLALYRVHFIFEPNPLMQNTEGI

SEQ ID NO: 3005581 - protein, 35 aa, Entamoeba invadens
LADLKKMRRRFWFEKFHWFISSENFVIISGKDALQ

SEQ ID NO: 3005582 - protein, 20 aa, Entamoeba invadens
LADPQLLMKMKMYMLEMDIP

SEQ ID NO: 3005583 - protein, 17 aa, Entamoeba invadens
LADVYSFGITFLEIMKW

SEQ ID NO: 3005584 - protein, 17 aa, Entamoeba invadens
LAEIEIGRDVKLGFGCF

SEQ ID NO: 3005585 - protein, 19 aa, Entamoeba invadens
LAELIPLNVFILPSTEETS

SEQ ID NO: 3005586 - protein, 21 aa, Entamoeba invadens
LAELLVTVVYTLTLVRGNEMK

SEQ ID NO: 3005587 - protein, 35 aa, Entamoeba invadens
LAELSSHLFFLPKAPKYFSKIETFVVVFLGTTLES

SEQ ID NO: 3005588 - protein, 25 aa, Entamoeba invadens
LAEQYPSMLIFVDTYNQMKQHGIEF

SEQ ID NO: 3005589 - protein, 26 aa, Entamoeba invadens
LAETNRALEVLRLTSEFLATIEQTES

SEQ ID NO: 3005590 - protein, 21 aa, Entamoeba invadens
LAEVSVVVPYTTPIKGKDVVC

SEQ ID NO: 3005591 - protein, 29 aa, Entamoeba invadens
LAEVVRLAPPLSIILVKQGTYDESEKILI

SEQ ID NO: 3005592 - protein, 23 aa, Entamoeba invadens
LAEYLHLEAELPFITFDDLLAHL

SEQ ID NO: 3005593 - protein, 18 aa, Entamoeba invadens
LAFFLRRNEYIKVLEVVD

SEQ ID NO: 3005594 - protein, 20 aa, Entamoeba invadens
LAFHPRKRVHRLRAATSAFP

SEQ ID NO: 3005595 - protein, 30 aa, Entamoeba invadens
LAGHDIVPIRIFLKKLPLSPSMKNVGNIFT

SEQ ID NO: 3005596 - protein, 17 aa, Entamoeba invadens
LAGLLNALKLVNKKIED

SEQ ID NO: 3005597 - protein, 23 aa, Entamoeba invadens
LAGLYYRGVGVVTPIFSLRTKAS

SEQ ID NO: 3005598 - protein, 17 aa, Entamoeba invadens
LAGMFLIVMPELDSFFM

SEQ ID NO: 3005599 - protein, 28 aa, Entamoeba invadens
LAGPMEKLFFIPERTKVGIVTCGGLCPG

SEQ ID NO: 3005600 - protein, 28 aa, Entamoeba invadens
LAGVEDFFFIISTRPFALKLAKVPCFIM

SEQ ID NO: 3005601 - protein, 25 aa, Entamoeba invadens
LAHGMCLIKLPFIKEVKKLQLKYAD

SEQ ID NO: 3005602 - protein, 32 aa, Entamoeba invadens
LAHLFSTQRWIPEEKITFFKALCLMCHHVAQN

SEQ ID NO: 3005603 - protein, 35 aa, Entamoeba invadens
LAHMWFGDLVTMKWWDDIWLNEGFASYVGTLFGVS

SEQ ID NO: 3005604 - protein, 33 aa, Entamoeba invadens
LAHMWFGDLVTMKWWNDLWLNEGFASYMGDLFG

SEQ ID NO: 3005605 - protein, 17 aa, Entamoeba invadens
LAIANYDATIKIYDVTG

SEQ ID NO: 3005606 - protein, 27 aa, Entamoeba invadens
LAIEVLKYYFRSLPTPLIHPHTDYLRC

SEQ ID NO: 3005607 - protein, 29 aa, Entamoeba invadens
LAKDFLNLKIFKGIDFLNLTTIGTVFVRT

SEQ ID NO: 3005608 - protein, 19 aa, Entamoeba invadens
LAKILSLLFEWDALREDDL

SEQ ID NO: 3005609 - protein, 19 aa, Entamoeba invadens
LAKIVIKDLEKKGLIKAVR

SEQ ID NO: 3005610 - protein, 27 aa, Entamoeba invadens
LAKKNKCHTLWNPAPAPRTFDIEMIKD

SEQ ID NO: 3005611 - protein, 31 aa, Entamoeba invadens
LAKLDNEDDLPLRRAKITLEAAQKRAAKPVK

SEQ ID NO: 3005612 - protein, 26 aa, Entamoeba invadens
LAKLDNFYMPFFLQRADDPVPNVRIH

SEQ ID NO: 3005613 - protein, 26 aa, Entamoeba invadens
LAKLELYFSEYLRTNFKWIYNGKDKY

SEQ ID NO: 3005614 - protein, 28 aa, Entamoeba invadens
LAKLELYFSEYLRTNFRWIYNGKDKYGL

SEQ ID NO: 3005615 - protein, 31 aa, Entamoeba invadens
LAKLELYFSEYLRTNFRWIYNGKGKYGLGDN

SEQ ID NO: 3005616 - protein, 23 aa, Entamoeba invadens
LAKMLDWYSLLYSNYNMLITEDT

SEQ ID NO: 3005617 - protein, 18 aa, Entamoeba invadens
LAKNFYKFYIGYFKDEQD

SEQ ID NO: 3005618 - protein, 18 aa, Entamoeba invadens
LAKPKLPSLGGKRPRDTN

SEQ ID NO: 3005619 - protein, 19 aa, Entamoeba invadens
LAKTLVRCLLQTGSYPDNL

SEQ ID NO: 3005620 - protein, 20 aa, Entamoeba invadens
LAKYALFFKSSTAPFHSLIT

SEQ ID NO: 3005621 - protein, 17 aa, Entamoeba invadens
LALDLRRKRDKLRFDVQ

SEQ ID NO: 3005622 - protein, 17 aa, Entamoeba invadens
LALDTSIIPLTSTILQI

SEQ ID NO: 3005623 - protein, 25 aa, Entamoeba invadens
LALKKILHHYGPVLVAIQTTNTGFP

SEQ ID NO: 3005624 - protein, 22 aa, Entamoeba invadens
LALKVLPLIPTFLIDKRTDVRS

SEQ ID NO: 3005625 - protein, 17 aa, Entamoeba invadens
LALLTQYADVTISVRGK

SEQ ID NO: 3005626 - protein, 23 aa, Entamoeba invadens
LALPKRMPVFPRGAEVLKKDSIK

SEQ ID NO: 3005627 - protein, 23 aa, Entamoeba invadens
LALPKRMPVFPRGAEVLKKDTIK

SEQ ID NO: 3005628 - protein, 17 aa, Entamoeba invadens
LALRKNPLYPTTNTRLL

SEQ ID NO: 3005629 - protein, 29 aa, Entamoeba invadens
LALYEQRFKIKYPLKKCDWIALPDFEAGA

SEQ ID NO: 3005630 - protein, 27 aa, Entamoeba invadens
LAMKEDKMQFVAPPVIVGLSEKEVGNR

SEQ ID NO: 3005631 - protein, 25 aa, Entamoeba invadens
LAMKKKYSFIILNKKRRNQKMAARF

SEQ ID NO: 3005632 - protein, 18 aa, Entamoeba invadens
LAMKKKYSFIILNKKRTS

SEQ ID NO: 3005633 - protein, 22 aa, Entamoeba invadens
LANAVIYFRFVEDVITLKLVNK

SEQ ID NO: 3005634 - protein, 17 aa, Entamoeba invadens
LANCWMTSRLYFGCLVA

SEQ ID NO: 3005635 - protein, 23 aa, Entamoeba invadens
LANKWMCGVIVSSRQCFKNDKDG

SEQ ID NO: 3005636 - protein, 29 aa, Entamoeba invadens
LANQMQQPQLVLPPTTPLKIVEKEPKVDD

SEQ ID NO: 3005637 - protein, 18 aa, Entamoeba invadens
LANSFKWGNGFDGKLESV

SEQ ID NO: 3005638 - protein, 17 aa, Entamoeba invadens
LANVLLYFTSSADVVTF

SEQ ID NO: 3005639 - protein, 21 aa, Entamoeba invadens
LANVVLYFKSFSDVKRFKLVN

SEQ ID NO: 3005640 - protein, 29 aa, Entamoeba invadens
LANVVTNFLLFHCSIYLVAKFGYFERLKE

SEQ ID NO: 3005641 - protein, 21 aa, Entamoeba invadens
LANYKTVFYSKSNLALSCIQM

SEQ ID NO: 3005642 - protein, 33 aa, Entamoeba invadens
LAPIRMKVMGFVRSWVKWRFIDFEDVDMRSNLE

SEQ ID NO: 3005643 - protein, 26 aa, Entamoeba invadens
LAPKYPATFEPFIYTIVDILCEDKEL

SEQ ID NO: 3005644 - protein, 23 aa, Entamoeba invadens
LAPLIPMIIERLINTFQMEDDDD

SEQ ID NO: 3005645 - protein, 26 aa, Entamoeba invadens
LAPQGLVYYKYSFGFDNGIDQGFERI

SEQ ID NO: 3005646 - protein, 26 aa, Entamoeba invadens
LAPRAKKIVEEGITLGVPKSMKKATN

SEQ ID NO: 3005647 - protein, 26 aa, Entamoeba invadens
LAQDGYQWFFKNLLVTVWSAPKYCYR

SEQ ID NO: 3005648 - protein, 23 aa, Entamoeba invadens
LAQFPRIFGFDPMHLMLKQKSND

SEQ ID NO: 3005649 - protein, 18 aa, Entamoeba invadens
LAQMKVPAQRIRILFITH

SEQ ID NO: 3005650 - protein, 20 aa, Entamoeba invadens
LAQQVLEHLLRHAEGRAEGR

SEQ ID NO: 3005651 - protein, 23 aa, Entamoeba invadens
LAQVAHTWGVFGYPIECAVKKSS

SEQ ID NO: 3005652 - protein, 37 aa, Entamoeba invadens
LARDSYFGTFIRQRIDWLNKQLPKSLQIKRFGILLEG

SEQ ID NO: 3005653 - protein, 25 aa, Entamoeba invadens
LARKLSCCVPFGTPLVKMDNEWVKA

SEQ ID NO: 3005654 - protein, 17 aa, Entamoeba invadens
LASAVTVALYRKMSSYL

SEQ ID NO: 3005655 - protein, 23 aa, Entamoeba invadens
LASFPKMFGLSNIQKEIYPYNYF

SEQ ID NO: 3005656 - protein, 20 aa, Entamoeba invadens
LASLAARNEVLKNSKDLATK

SEQ ID NO: 3005657 - protein, 24 aa, Entamoeba invadens
LASLLPHWIVHFTATSYSSLYIAA

SEQ ID NO: 3005658 - protein, 17 aa, Entamoeba invadens
LASYRKFKYYSDNFETI

SEQ ID NO: 3005659 - protein, 37 aa, Entamoeba invadens
LATALAVAVLRKFFFERIVEWKLLEKKALNYLEKHNI

SEQ ID NO: 3005660 - protein, 25 aa, Entamoeba invadens
LATEPKKQAKQYARKVEEAERKLAE

SEQ ID NO: 3005661 - protein, 29 aa, Entamoeba invadens
LATESGIQLASLPPIGFAKVNIKEASPSS

SEQ ID NO: 3005662 - protein, 22 aa, Entamoeba invadens
LATGIDYLFRVIPNLNTLCSSI

SEQ ID NO: 3005663 - protein, 22 aa, Entamoeba invadens
LATIGCNFTCKFCQNWDISQCA

SEQ ID NO: 3005664 - protein, 29 aa, Entamoeba invadens
LATKELISWIMFRLFNLLEKTAAFKEISE

SEQ ID NO: 3005665 - protein, 22 aa, Entamoeba invadens
LATKYGIKVLKMDFSIFSEFSN

SEQ ID NO: 3005666 - protein, 19 aa, Entamoeba invadens
LATLKYVYYFDLNSDTCLD

SEQ ID NO: 3005667 - protein, 17 aa, Entamoeba invadens
LATSYFRKVIYGKRPIE

SEQ ID NO: 3005668 - protein, 20 aa, Entamoeba invadens
LAVDLKTVYAFPLDNFKPNK

SEQ ID NO: 3005669 - protein, 21 aa, Entamoeba invadens
LAVFPNVILALSNLQKLYIAS

SEQ ID NO: 3005670 - protein, 20 aa, Entamoeba invadens
LAVLFCAVTRWTFNGQTLCG

SEQ ID NO: 3005671 - protein, 18 aa, Entamoeba invadens
LAVLIGLASQICTLTVEK

SEQ ID NO: 3005672 - protein, 18 aa, Entamoeba invadens
LAVLSYFEKNGDDRAREI

SEQ ID NO: 3005673 - protein, 18 aa, Entamoeba invadens
LAVPQHTIQLAFNKDIEL

SEQ ID NO: 3005674 - protein, 19 aa, Entamoeba invadens
LAVSYDRRRYRPSIVCDGM

SEQ ID NO: 3005675 - protein, 18 aa, Entamoeba invadens
LAVVKTVIVRYGANQISR

SEQ ID NO: 3005676 - protein, 18 aa, Entamoeba invadens
LAYELSVAKGINPDKPRN

SEQ ID NO: 3005677 - protein, 22 aa, Entamoeba invadens
LAYKHLHFYSYGLMKERISKTI

SEQ ID NO: 3005678 - protein, 24 aa, Entamoeba invadens
LAYQQPTILPCRCIARYDYIKNSE

SEQ ID NO: 3005679 - protein, 18 aa, Entamoeba invadens
LAYSYLVGILNKRPERIL

SEQ ID NO: 3005680 - protein, 24 aa, Entamoeba invadens
LAYTPLFLSILKLENDIILPNFSY

SEQ ID NO: 3005681 - protein, 18 aa, Entamoeba invadens
LCAIFKIEEDENKVEALV

SEQ ID NO: 3005682 - protein, 21 aa, Entamoeba invadens
LCAKAFQFFCQGQSGMRAVPA

SEQ ID NO: 3005683 - protein, 21 aa, Entamoeba invadens
LCATYPRTFVLPSTVTREMIF

SEQ ID NO: 3005684 - protein, 18 aa, Entamoeba invadens
LCCNWLIRYGARVDIENE

SEQ ID NO: 3005685 - protein, 18 aa, Entamoeba invadens
LCCYPSYDFVHCLVDSFE

SEQ ID NO: 3005686 - protein, 17 aa, Entamoeba invadens
LCDCQVSLMVFKDEKLV

SEQ ID NO: 3005687 - protein, 24 aa, Entamoeba invadens
LCDGRTLFTLFQIIKNAIPNERHE

SEQ ID NO: 3005688 - protein, 21 aa, Entamoeba invadens
LCDNFLLISKKTRTLESIYYI

SEQ ID NO: 3005689 - protein, 17 aa, Entamoeba invadens
LCDVDSFDFTLVYTRKK

SEQ ID NO: 3005690 - protein, 26 aa, Entamoeba invadens
LCEAWKLLVELPWTDKQFYTDNELQI

SEQ ID NO: 3005691 - protein, 17 aa, Entamoeba invadens
LCEDCYYKADGNCFPCF

SEQ ID NO: 3005692 - protein, 38 aa, Entamoeba invadens
LCEERIIPQLKGKKFFFSRIFQLKPLNREVKMILISEG

SEQ ID NO: 3005693 - protein, 18 aa, Entamoeba invadens
LCEMALKSPLESDDVDDW

SEQ ID NO: 3005694 - protein, 25 aa, Entamoeba invadens
LCERLSFDFFPLSLVDPLIHLLPRK

SEQ ID NO: 3005695 - protein, 32 aa, Entamoeba invadens
LCESYNQILHPKPQYLQFLSRTFENSQNVLKY

SEQ ID NO: 3005696 - protein, 20 aa, Entamoeba invadens
LCETHMIFFISRFVSGGDVF

SEQ ID NO: 3005697 - protein, 20 aa, Entamoeba invadens
LCEVFWVKSVTFPRKIWVHR

SEQ ID NO: 3005698 - protein, 17 aa, Entamoeba invadens
LCEWFICEVGRSTKLAE

SEQ ID NO: 3005699 - protein, 27 aa, Entamoeba invadens
LCFEDTFWSDYLIQKKLSLLPEGRYEV

SEQ ID NO: 3005700 - protein, 17 aa, Entamoeba invadens
LCFFFDDKIDKKFVEEW

SEQ ID NO: 3005701 - protein, 17 aa, Entamoeba invadens
LCFICNNNFILNNETLC

SEQ ID NO: 3005702 - protein, 18 aa, Entamoeba invadens
LCFKCKEPIIGDFILVNG

SEQ ID NO: 3005703 - protein, 25 aa, Entamoeba invadens
LCGGDFFFGMFVRQLLEMNAKEKMV

SEQ ID NO: 3005704 - protein, 24 aa, Entamoeba invadens
LCGKQYDLFLTYLAKICMAYCDSQ

SEQ ID NO: 3005705 - protein, 19 aa, Entamoeba invadens
LCGKSELLTVFFNTTKEIK

SEQ ID NO: 3005706 - protein, 18 aa, Entamoeba invadens
LCGKVHPEKFELKRLILA

SEQ ID NO: 3005707 - protein, 17 aa, Entamoeba invadens
LCGVVCGTFELVNYINP

SEQ ID NO: 3005708 - protein, 19 aa, Entamoeba invadens
LCHMLTKPPFPVEFSLPRK

SEQ ID NO: 3005709 - protein, 30 aa, Entamoeba invadens
LCIDKLCDFRFFNMKMLKSVNLPTTLETVG

SEQ ID NO: 3005710 - protein, 27 aa, Entamoeba invadens
LCIDQAYLLVKIPKLITAQGVVFLHEE

SEQ ID NO: 3005711 - protein, 17 aa, Entamoeba invadens
LCIESVDASLFDTLALT

SEQ ID NO: 3005712 - protein, 20 aa, Entamoeba invadens
LCIFCCARFSFRIGEVFYSQ

SEQ ID NO: 3005713 - protein, 19 aa, Entamoeba invadens
LCIPNFAGPDHFLFGISEG

SEQ ID NO: 3005714 - protein, 18 aa, Entamoeba invadens
LCIPPLLEYKNVIGGAET

SEQ ID NO: 3005715 - protein, 20 aa, Entamoeba invadens
LCIPYKVYRPKIPSDVYILF

SEQ ID NO: 3005716 - protein, 34 aa, Entamoeba invadens
LCIVISGLPDGPFYSAPFVLQAREKRTTKTEGQQ

SEQ ID NO: 3005717 - protein, 18 aa, Entamoeba invadens
LCKASLICKMKFSPFDSF

SEQ ID NO: 3005718 - protein, 21 aa, Entamoeba invadens
LCKFFSFHTRQKLQFSPPLIK

SEQ ID NO: 3005719 - protein, 19 aa, Entamoeba invadens
LCKKAFWEECYKTELKNFS

SEQ ID NO: 3005720 - protein, 23 aa, Entamoeba invadens
LCKKHNFLFPSIQLEYQNVQYKT

SEQ ID NO: 3005721 - protein, 24 aa, Entamoeba invadens
LCKTIECYIPPHLVIPKSVVCLGN

SEQ ID NO: 3005722 - protein, 34 aa, Entamoeba invadens
LCKTIPLYMHKFFPVYMELLIRLITPGNPVKVRA

SEQ ID NO: 3005723 - protein, 18 aa, Entamoeba invadens
LCLEQLTLMRVINQNIFD

SEQ ID NO: 3005724 - protein, 18 aa, Entamoeba invadens
LCLFGHQCFVFCAQLSTI

SEQ ID NO: 3005725 - protein, 18 aa, Entamoeba invadens
LCLGCNRNYILKDGMCVK

SEQ ID NO: 3005726 - protein, 18 aa, Entamoeba invadens
LCLKKSLKYNILSQYTSF

SEQ ID NO: 3005727 - protein, 27 aa, Entamoeba invadens
LCLQVWDRIFAYPERNLYYFVASSIIL

SEQ ID NO: 3005728 - protein, 17 aa, Entamoeba invadens
LCLSFARLVAHIKMGAK

SEQ ID NO: 3005729 - protein, 26 aa, Entamoeba invadens
LCLTLGTPQQFISNKARWKCFVCSCC

SEQ ID NO: 3005730 - protein, 29 aa, Entamoeba invadens
LCMDNFIDIVTFPLKVISSPFDALTQFVT

SEQ ID NO: 3005731 - protein, 18 aa, Entamoeba invadens
LCMNSMRYISFFDNNQKL

SEQ ID NO: 3005732 - protein, 18 aa, Entamoeba invadens
LCMPMDFGVKKEFVQESG

SEQ ID NO: 3005733 - protein, 23 aa, Entamoeba invadens
LCNSNNLYLLYSGKDIKGLENPL

SEQ ID NO: 3005734 - protein, 29 aa, Entamoeba invadens
LCNVCVNGVLTMCYGVDGVPAYVDFTKET

SEQ ID NO: 3005735 - protein, 23 aa, Entamoeba invadens
LCPASFLLRCDTLKEYTGNYEKE

SEQ ID NO: 3005736 - protein, 20 aa, Entamoeba invadens
LCPEIVWTPSMKRLFCLIVE

SEQ ID NO: 3005737 - protein, 19 aa, Entamoeba invadens
LCPLVMYLRQDAVDRITSF

SEQ ID NO: 3005738 - protein, 26 aa, Entamoeba invadens
LCPSKKPTKLPLPRVPTEPLQQTKQE

SEQ ID NO: 3005739 - protein, 17 aa, Entamoeba invadens
LCPVLLIQDVTYMYIRH

SEQ ID NO: 3005740 - protein, 24 aa, Entamoeba invadens
LCQDKFDVLYISTVGVDYTPKQTQ

SEQ ID NO: 3005741 - protein, 23 aa, Entamoeba invadens
LCRALNAFLKFDVETFIAFQKSI

SEQ ID NO: 3005742 - protein, 17 aa, Entamoeba invadens
LCRCSKEAVLDIFHNIQ

SEQ ID NO: 3005743 - protein, 34 aa, Entamoeba invadens
LCRLYKVQMTKQIFPPFLLLVKTPEKYSENEPIW

SEQ ID NO: 3005744 - protein, 27 aa, Entamoeba invadens
LCRNNVLTQTLFDYLMLTDPNDVLDKT

SEQ ID NO: 3005745 - protein, 18 aa, Entamoeba invadens
LCSDMLGILLTRHGSHFK

SEQ ID NO: 3005746 - protein, 27 aa, Entamoeba invadens
LCSGDANGIFRIWDLRTKKTTKAYQFP

SEQ ID NO: 3005747 - protein, 17 aa, Entamoeba invadens
LCSGLASGALCAIKGES

SEQ ID NO: 3005748 - protein, 30 aa, Entamoeba invadens
LCSGLLNSLLYELPFPLIPRESVIYMQDLL

SEQ ID NO: 3005749 - protein, 19 aa, Entamoeba invadens
LCSLAIDAVTVCAGGDLKK

SEQ ID NO: 3005750 - protein, 20 aa, Entamoeba invadens
LCSNGFIITSKIICILNATC

SEQ ID NO: 3005751 - protein, 29 aa, Entamoeba invadens
LCSSMLSILPYSSGGILPIILTSFNNLSK

SEQ ID NO: 3005752 - protein, 27 aa, Entamoeba invadens
LCTPIGIIPILYIKEPLKWEGCSWGFL

SEQ ID NO: 3005753 - protein, 18 aa, Entamoeba invadens
LCVHPPPHRPPLPAIPPP

SEQ ID NO: 3005754 - protein, 19 aa, Entamoeba invadens
LCVLKLYCMNPQLIEQRGF

SEQ ID NO: 3005755 - protein, 20 aa, Entamoeba invadens
LCVSPGKLCWVVYVDAIVVE

SEQ ID NO: 3005756 - protein, 26 aa, Entamoeba invadens
LCVTGFAFMFNEKLLIVAEGSKKSIV

SEQ ID NO: 3005757 - protein, 27 aa, Entamoeba invadens
LCWKGVPWHFRPKVWRILTNETPLSLS

SEQ ID NO: 3005758 - protein, 18 aa, Entamoeba invadens
LCWLVENTEIKFVPAYGG

SEQ ID NO: 3005759 - protein, 17 aa, Entamoeba invadens
LCYIDPTQVSKYKALLS

SEQ ID NO: 3005760 - protein, 23 aa, Entamoeba invadens
LCYQQAVVLALLNRYCSFEIERP

SEQ ID NO: 3005761 - protein, 22 aa, Entamoeba invadens
LDAFANLFCAKRGLDFSVVDAP

SEQ ID NO: 3005762 - protein, 28 aa, Entamoeba invadens
LDAIEHGLPPTGGWGLGIDRLSMLLADV

SEQ ID NO: 3005763 - protein, 25 aa, Entamoeba invadens
LDALEDIHRMYFKVGFNLTGATTDF

SEQ ID NO: 3005764 - protein, 19 aa, Entamoeba invadens
LDALGLSFIRLCSMSRLNQ

SEQ ID NO: 3005765 - protein, 25 aa, Entamoeba invadens
LDALKGFYPELLYDETLKLANIKNV

SEQ ID NO: 3005766 - protein, 32 aa, Entamoeba invadens
LDALLKDPFLQTTPFLIFGNKIDMPGAVSEQQ

SEQ ID NO: 3005767 - protein, 17 aa, Entamoeba invadens
LDALLKQRTEVLLEKEG

SEQ ID NO: 3005768 - protein, 25 aa, Entamoeba invadens
LDAPVNRFLKYPKIFENLLGAIDNK

SEQ ID NO: 3005769 - protein, 31 aa, Entamoeba invadens
LDARVARLIKMIFDKGMMTATLKSAGLNVAN

SEQ ID NO: 3005770 - protein, 24 aa, Entamoeba invadens
LDAVKSLKINPWFSSPYSIMKFHT

SEQ ID NO: 3005771 - protein, 26 aa, Entamoeba invadens
LDCDPAFLVDTFLPKVYTFATYQSES

SEQ ID NO: 3005772 - protein, 25 aa, Entamoeba invadens
LDCEIPPTLLSFAKNSIFSAEQTKR

SEQ ID NO: 3005773 - protein, 19 aa, Entamoeba invadens
LDCFNYSLPSLMESLVLVL

SEQ ID NO: 3005774 - protein, 23 aa, Entamoeba invadens
LDCKLHVYIPKATKGEVFPDLDV

SEQ ID NO: 3005775 - protein, 27 aa, Entamoeba invadens
LDDDKFVALLFFVNFVTSQVKVLSDRL

SEQ ID NO: 3005776 - protein, 24 aa, Entamoeba invadens
LDDFKSLLILLKRKCEDDGKEILN

SEQ ID NO: 3005777 - protein, 25 aa, Entamoeba invadens
LDDGYLWVVMEYMNGGCLTDLLNEY

SEQ ID NO: 3005778 - protein, 17 aa, Entamoeba invadens
LDDIRKNFKGVVKSVFL

SEQ ID NO: 3005779 - protein, 28 aa, Entamoeba invadens
LDDKFALPKTLAIETLLRSNYSFLNEVR

SEQ ID NO: 3005780 - protein, 23 aa, Entamoeba invadens
LDDKLLENIFSFLSLEDLMKTME

SEQ ID NO: 3005781 - protein, 34 aa, Entamoeba invadens
LDDLMKKLRMTTPHFIRCILPNTQKRRHYFIDST

SEQ ID NO: 3005782 - protein, 17 aa, Entamoeba invadens
LDDLSVSLAIRDDADRF

SEQ ID NO: 3005783 - protein, 32 aa, Entamoeba invadens
LDDNEKFILKKYSIHLLLKLSDAMILRFAIPS

SEQ ID NO: 3005784 - protein, 32 aa, Entamoeba invadens
LDDNEKFILKKYSIRLLVKLSEAMILRFEIPS

SEQ ID NO: 3005785 - protein, 25 aa, Entamoeba invadens
LDDNKIVLLGKIAHYISLAHKNEKI

SEQ ID NO: 3005786 - protein, 25 aa, Entamoeba invadens
LDDNTFRFYFIPVVRGSFTEQEFQE

SEQ ID NO: 3005787 - protein, 28 aa, Entamoeba invadens
LDDPAAFAGRIYRMVKLGLSLDDKEEEV

SEQ ID NO: 3005788 - protein, 24 aa, Entamoeba invadens
LDDTALGFLIYKYYRLTGQKVHIH

SEQ ID NO: 3005789 - protein, 23 aa, Entamoeba invadens
LDDTLIHTYPNPVIQRVGLYPVE

SEQ ID NO: 3005790 - protein, 23 aa, Entamoeba invadens
LDDVCWLFNVRGSDVPYIPVAYC

SEQ ID NO: 3005791 - protein, 23 aa, Entamoeba invadens
LDDVLLWICTNVPQHLIPRSLGG

SEQ ID NO: 3005792 - protein, 19 aa, Entamoeba invadens
LDEFIQKRGFYWKSVECHT

SEQ ID NO: 3005793 - protein, 26 aa, Entamoeba invadens
LDEFQSEYIVHFYGAVFIPNKVCMVT

SEQ ID NO: 3005794 - protein, 25 aa, Entamoeba invadens
LDEFSKRHFVVTSKFLYQLKQIVET

SEQ ID NO: 3005795 - protein, 29 aa, Entamoeba invadens
LDEKFDIEKFFRVVIWYQVDAQTALNSSL

SEQ ID NO: 3005796 - protein, 27 aa, Entamoeba invadens
LDEKHVRRLWVMNLQLFDVTNLEVDGL

SEQ ID NO: 3005797 - protein, 24 aa, Entamoeba invadens
LDEKYWDALAVRIRYEELQYAIGA

SEQ ID NO: 3005798 - protein, 17 aa, Entamoeba invadens
LDELDIDMFYIKSDKKR

SEQ ID NO: 3005799 - protein, 27 aa, Entamoeba invadens
LDELKHYLCFIFLDEFTVWAPKSSDDI

SEQ ID NO: 3005800 - protein, 29 aa, Entamoeba invadens
LDEMCYRLNKFIITLFPEYKDLFTGAELE

SEQ ID NO: 3005801 - protein, 33 aa, Entamoeba invadens
LDENFQRREKIYEKCILVLDKLKSITSDFENDL

SEQ ID NO: 3005802 - protein, 27 aa, Entamoeba invadens
LDEQKLIQFFEKCGNIRLLESSAPEVV

SEQ ID NO: 3005803 - protein, 18 aa, Entamoeba invadens
LDEQLKFDVLRYNKIFLY

SEQ ID NO: 3005804 - protein, 22 aa, Entamoeba invadens
LDERLVWFVTFVFEKRIRREWF

SEQ ID NO: 3005805 - protein, 27 aa, Entamoeba invadens
LDFCGQPFDFLEFFEDTYFITTVVIKN

SEQ ID NO: 3005806 - protein, 24 aa, Entamoeba invadens
LDFENLLSCRLVCKRWKEILFFFP

SEQ ID NO: 3005807 - protein, 22 aa, Entamoeba invadens
LDFIPKMQFCLLSKTVPSFLVC

SEQ ID NO: 3005808 - protein, 29 aa, Entamoeba invadens
LDFNLMSNRMLAFIIKNNFAIFPSAKKCF

SEQ ID NO: 3005809 - protein, 24 aa, Entamoeba invadens
LDFSKLSIDESMRIMFAAFVMGGE

SEQ ID NO: 3005810 - protein, 27 aa, Entamoeba invadens
LDFSVDFDIICSLPIDQPSRDLLCVGN

SEQ ID NO: 3005811 - protein, 20 aa, Entamoeba invadens
LDFVVRNNVFKMFSINFVKV

SEQ ID NO: 3005812 - protein, 26 aa, Entamoeba invadens
LDGAHIVLLFFDLTRSVSLNNVKYWY

SEQ ID NO: 3005813 - protein, 30 aa, Entamoeba invadens
LDGDEYLVIWNPLFLPKLGKKSHPPANYDF

SEQ ID NO: 3005814 - protein, 32 aa, Entamoeba invadens
LDGNKIDSILPIRAFYGLEKLSMKNNLLTERS

SEQ ID NO: 3005815 - protein, 20 aa, Entamoeba invadens
LDGRKKFLAEFIGFLTPRKT

SEQ ID NO: 3005816 - protein, 19 aa, Entamoeba invadens
LDGTYLFRVSKKTLDYPLV

SEQ ID NO: 3005817 - protein, 31 aa, Entamoeba invadens
LDGVVYNQLFLLYRDMFLNYDKFFNTHKTKQ

SEQ ID NO: 3005818 - protein, 31 aa, Entamoeba invadens
LDGYHIMIVSKYFSTILDFIKLQFVCKKFNN

SEQ ID NO: 3005819 - protein, 22 aa, Entamoeba invadens
LDGYLIQTFKGSCLLRIVETAI

SEQ ID NO: 3005820 - protein, 39 aa, Entamoeba invadens
LDIHVYMFDWYMVWFSRILPCDFLYAVFDFCLLDGYKAM

SEQ ID NO: 3005821 - protein, 18 aa, Entamoeba invadens
LDIITIGPLTNIAIALTL

SEQ ID NO: 3005822 - protein, 23 aa, Entamoeba invadens
LDILLKIFFSYQHNCTLIRQDIY

SEQ ID NO: 3005823 - protein, 26 aa, Entamoeba invadens
LDILREHNFFFNSTLSKKSNKTFQLE

SEQ ID NO: 3005824 - protein, 25 aa, Entamoeba invadens
LDINRTFQLHYKYKVRFGAGQKELF

SEQ ID NO: 3005825 - protein, 18 aa, Entamoeba invadens
LDIPKTAAPTLITQNFMY

SEQ ID NO: 3005826 - protein, 25 aa, Entamoeba invadens
LDIPQLQISALIFLRQFVTETSNIQ

SEQ ID NO: 3005827 - protein, 27 aa, Entamoeba invadens
LDIQLPGIEMLIPHYIRYINEVIFKVN

SEQ ID NO: 3005828 - protein, 19 aa, Entamoeba invadens
LDIRLFPKAPLTREDRQQK

SEQ ID NO: 3005829 - protein, 28 aa, Entamoeba invadens
LDISAYFDNMIFLFSFEVLTNGVYGDKY

SEQ ID NO: 3005830 - protein, 19 aa, Entamoeba invadens
LDISKLKALGWAPTVGFEE

SEQ ID NO: 3005831 - protein, 26 aa, Entamoeba invadens
LDIVKRKIILYKVNYTKFKQSKSPLN

SEQ ID NO: 3005832 - protein, 20 aa, Entamoeba invadens
LDIYLQKNKIHRIKEIDLAN

SEQ ID NO: 3005833 - protein, 36 aa, Entamoeba invadens
LDKCTEYCIMVDNLCQFLPQERVSAFSSLNPAELLK

SEQ ID NO: 3005834 - protein, 25 aa, Entamoeba invadens
LDKDPKVTYILSEKVKYVYRAVEDV

SEQ ID NO: 3005835 - protein, 18 aa, Entamoeba invadens
LDKEIEAEQSRRATPIIF

SEQ ID NO: 3005836 - protein, 27 aa, Entamoeba invadens
LDKFRCDYIIHFYGAVFIPSKVCMVTE

SEQ ID NO: 3005837 - protein, 28 aa, Entamoeba invadens
LDKFRCEYFVHFYGAVFIPTKFCMVTEY

SEQ ID NO: 3005838 - protein, 27 aa, Entamoeba invadens
LDKFRSDYIIHFYGAVNILNKICMVTE

SEQ ID NO: 3005839 - protein, 29 aa, Entamoeba invadens
LDKFRSDYIVHFYGAVFIPNKVCMVTEFA

SEQ ID NO: 3005840 - protein, 28 aa, Entamoeba invadens
LDKFRSEFIVHFYGAVFIPNKVCMVTEY

SEQ ID NO: 3005841 - protein, 32 aa, Entamoeba invadens
LDKFRSEYIIHFYGAVFIPKKICLVTEFAKYG

SEQ ID NO: 3005842 - protein, 29 aa, Entamoeba invadens
LDKFRSEYIVYFFGAVFVSNKVSLVTEFA

SEQ ID NO: 3005843 - protein, 40 aa, Entamoeba invadens
LDKGFIESFTDYITKLRLYIPFILLKDRLLIELSGEIERP

SEQ ID NO: 3005844 - protein, 17 aa, Entamoeba invadens
LDKGIVLNILNPNPFTL

SEQ ID NO: 3005845 - protein, 18 aa, Entamoeba invadens
LDKIGVFSPLRCDTTIIV

SEQ ID NO: 3005846 - protein, 18 aa, Entamoeba invadens
LDKIIKECTIEFKTKGLI

SEQ ID NO: 3005847 - protein, 20 aa, Entamoeba invadens
LDKIMFCYGVGYKKARKENG

SEQ ID NO: 3005848 - protein, 27 aa, Entamoeba invadens
LDKINIPSNLLFFKKAFSSQNLLKQLN

SEQ ID NO: 3005849 - protein, 28 aa, Entamoeba invadens
LDKKMNTMLRHLALPFSTKIKNVIGDVS

SEQ ID NO: 3005850 - protein, 27 aa, Entamoeba invadens
LDKLRSEFIVYFYGAVFIPSKICMVTK

SEQ ID NO: 3005851 - protein, 26 aa, Entamoeba invadens
LDKLTPPFVYVVLRVKWESIPSGYNV

SEQ ID NO: 3005852 - protein, 26 aa, Entamoeba invadens
LDKNRYLDRLLFFDDVEPMKLLKYQK

SEQ ID NO: 3005853 - protein, 17 aa, Entamoeba invadens
LDKRWMQVLLPKSDVFM

SEQ ID NO: 3005854 - protein, 22 aa, Entamoeba invadens
LDKYYHLAKQYGYRARSAFKLI

SEQ ID NO: 3005855 - protein, 25 aa, Entamoeba invadens
LDLAKSLFTLFPRKYHTNLHRLYLV

SEQ ID NO: 3005856 - protein, 17 aa, Entamoeba invadens
LDLALDLFSEAMKTIFI

SEQ ID NO: 3005857 - protein, 28 aa, Entamoeba invadens
LDLFIQCCLGVQWFHEILKLVHGNIKPS

SEQ ID NO: 3005858 - protein, 28 aa, Entamoeba invadens
LDLKKDCYNLIFSRKLQSIPSAWPICSF

SEQ ID NO: 3005859 - protein, 26 aa, Entamoeba invadens
LDLKKSIPTTWVSPLCGSLSQIYVEY

SEQ ID NO: 3005860 - protein, 34 aa, Entamoeba invadens
LDLLKHACTIFKPFVSRPWTILKKDYLTRPIRIC

SEQ ID NO: 3005861 - protein, 17 aa, Entamoeba invadens
LDLNTLSTPILLRLLTI

SEQ ID NO: 3005862 - protein, 22 aa, Entamoeba invadens
LDLPKLCGLAKNYYSVKARCRI

SEQ ID NO: 3005863 - protein, 31 aa, Entamoeba invadens
LDLQGFLIMPVQRLPRYTLLLTDLVKRTPET

SEQ ID NO: 3005864 - protein, 25 aa, Entamoeba invadens
LDLQKIVFTYLYPRLDINVSTKLNH

SEQ ID NO: 3005865 - protein, 25 aa, Entamoeba invadens
LDLQNFTSMFRFPVTVNTYIPDLQI

SEQ ID NO: 3005866 - protein, 34 aa, Entamoeba invadens
LDLRSYLITPVQRLPRYNLLLTDLLKQTPEDHVD

SEQ ID NO: 3005867 - protein, 20 aa, Entamoeba invadens
LDLSFVQFFGEQQNMTRITA

SEQ ID NO: 3005868 - protein, 19 aa, Entamoeba invadens
LDLTYIDDRIIAMGYPAFG

SEQ ID NO: 3005869 - protein, 31 aa, Entamoeba invadens
LDLWQTFYDLYFNALTFKKFNLITPLTHPEP

SEQ ID NO: 3005870 - protein, 25 aa, Entamoeba invadens
LDMELINGVFPYEVSYKTFVLLKGL

SEQ ID NO: 3005871 - protein, 24 aa, Entamoeba invadens
LDMFPKDWIALDNKIGLLRGSTEC

SEQ ID NO: 3005872 - protein, 24 aa, Entamoeba invadens
LDMKAYYVFYCNQDVRILKQDNLK

SEQ ID NO: 3005873 - protein, 22 aa, Entamoeba invadens
LDNCYYINFDLPSTLTGLTVSH

SEQ ID NO: 3005874 - protein, 23 aa, Entamoeba invadens
LDNDAIMGMKFMKEARKKEVEQL

SEQ ID NO: 3005875 - protein, 29 aa, Entamoeba invadens
LDNFDRIINYIKNPWLYGHDQYQTVGAIK

SEQ ID NO: 3005876 - protein, 29 aa, Entamoeba invadens
LDNFIHFPDKLPTIFLSREFDVPLKIDLF

SEQ ID NO: 3005877 - protein, 22 aa, Entamoeba invadens
LDNFTITKNVFLVAANGFVYNN

SEQ ID NO: 3005878 - protein, 25 aa, Entamoeba invadens
LDNIPKVKFILNKIELIQSGVETVT

SEQ ID NO: 3005879 - protein, 27 aa, Entamoeba invadens
LDNLDKMGEAVFWNNPKDFVTAANENM

SEQ ID NO: 3005880 - protein, 30 aa, Entamoeba invadens
LDNNKITTLCPFGVFLQLRTISFKNNLIED

SEQ ID NO: 3005881 - protein, 30 aa, Entamoeba invadens
LDNNNCNILSLLFWGIVSNDSTCLRCEEGT

SEQ ID NO: 3005882 - protein, 25 aa, Entamoeba invadens
LDNQLEYIVLPLLSTPHQTNVLWLY

SEQ ID NO: 3005883 - protein, 19 aa, Entamoeba invadens
LDNSQLYPEIKYLGGIDKR

SEQ ID NO: 3005884 - protein, 28 aa, Entamoeba invadens
LDNTHTFKYYNIPKDSLLYIGHVKQRSI

SEQ ID NO: 3005885 - protein, 23 aa, Entamoeba invadens
LDNVPVLMMSFYETLQQKQYQQA

SEQ ID NO: 3005886 - protein, 25 aa, Entamoeba invadens
LDNYPYEILFHVAPLLPNTQSDQML

SEQ ID NO: 3005887 - protein, 17 aa, Entamoeba invadens
LDPIKKSPVRGGLPSLI

SEQ ID NO: 3005888 - protein, 21 aa, Entamoeba invadens
LDPNMTFSILFKTPAINDKGI

SEQ ID NO: 3005889 - protein, 18 aa, Entamoeba invadens
LDPSVSLLFLIKNKDDFN

SEQ ID NO: 3005890 - protein, 24 aa, Entamoeba invadens
LDPTLEIPPFSALGLNILYLAVED

SEQ ID NO: 3005891 - protein, 18 aa, Entamoeba invadens
LDPVFSFLNQHDFSSLSL

SEQ ID NO: 3005892 - protein, 21 aa, Entamoeba invadens
LDPWYEFRAVVYKDNLTALTQ

SEQ ID NO: 3005893 - protein, 25 aa, Entamoeba invadens
LDQCTSKKFIFPRVINFKGSVEHIT

SEQ ID NO: 3005894 - protein, 19 aa, Entamoeba invadens
LDQILGYNTVLRVIFDSLT

SEQ ID NO: 3005895 - protein, 23 aa, Entamoeba invadens
LDQKNIFFELFDTLKTTGDLIKL

SEQ ID NO: 3005896 - protein, 24 aa, Entamoeba invadens
LDQKSGMLYLLKVLVEVFVQTKQL

SEQ ID NO: 3005897 - protein, 25 aa, Entamoeba invadens
LDQLKPFFAAFIDKFYDVFPECSDR

SEQ ID NO: 3005898 - protein, 21 aa, Entamoeba invadens
LDQLQQNFDYFKKNADTDAAD

SEQ ID NO: 3005899 - protein, 24 aa, Entamoeba invadens
LDQLQQNFDYLKKNADTDAADKKK

SEQ ID NO: 3005900 - protein, 18 aa, Entamoeba invadens
LDQMASKFSDLLIQNVDM

SEQ ID NO: 3005901 - protein, 24 aa, Entamoeba invadens
LDQPTRVWGYIPVKGDNPSYEIIT

SEQ ID NO: 3005902 - protein, 25 aa, Entamoeba invadens
LDRDKKLLIILDNQFKVIKALNIKE

SEQ ID NO: 3005903 - protein, 18 aa, Entamoeba invadens
LDRPTSFELVKHPWLSTA

SEQ ID NO: 3005904 - protein, 28 aa, Entamoeba invadens
LDRSFRLETLLMLELFSVSNSIVLTLQK

SEQ ID NO: 3005905 - protein, 22 aa, Entamoeba invadens
LDRVLSLMPRIACNSLIHQNAI

SEQ ID NO: 3005906 - protein, 24 aa, Entamoeba invadens
LDSKEWPRDPWLKDCTIVNTDETA

SEQ ID NO: 3005907 - protein, 25 aa, Entamoeba invadens
LDSKYLFRIQQLQLGIDAGESESFL

SEQ ID NO: 3005908 - protein, 24 aa, Entamoeba invadens
LDSLFLIDCYLAYLKLPGNDQLEA

SEQ ID NO: 3005909 - protein, 24 aa, Entamoeba invadens
LDSLMRFLESPDLKADFILLAQPA

SEQ ID NO: 3005910 - protein, 17 aa, Entamoeba invadens
LDSRMVLGLDELGYQCV

SEQ ID NO: 3005911 - protein, 31 aa, Entamoeba invadens
LDSVTFPSYLLTIWDRCFEFCMSLKSIKIAQ

SEQ ID NO: 3005912 - protein, 27 aa, Entamoeba invadens
LDSYNTAMVIKLLLQLHSEGLTLLMVT

SEQ ID NO: 3005913 - protein, 24 aa, Entamoeba invadens
LDTATLWSILKGRRNIMIVIEDTR

SEQ ID NO: 3005914 - protein, 23 aa, Entamoeba invadens
LDTDIFTTTFVLKEGSNVFNPDK

SEQ ID NO: 3005915 - protein, 24 aa, Entamoeba invadens
LDTFKSLKTLWLPEIKRLNRDIPI

SEQ ID NO: 3005916 - protein, 24 aa, Entamoeba invadens
LDTFKSLKTLWLPEIRRLNRDIPI

SEQ ID NO: 3005917 - protein, 30 aa, Entamoeba invadens
LDTILVELTVFKLKLKLGPTELLLVINEGE

SEQ ID NO: 3005918 - protein, 38 aa, Entamoeba invadens
LDTKKVLPSYVRLIQKFDPFFIVMKQIFYNLNRVIPLV

SEQ ID NO: 3005919 - protein, 24 aa, Entamoeba invadens
LDTKYKIFLYNELVSTTLISEDVF

SEQ ID NO: 3005920 - protein, 27 aa, Entamoeba invadens
LDTNVLCLLKLFLLEKRVLVVASREQA

SEQ ID NO: 3005921 - protein, 21 aa, Entamoeba invadens
LDTPKSLFALYKSDSKKYDVK

SEQ ID NO: 3005922 - protein, 24 aa, Entamoeba invadens
LDTQIDILTLILTVLNCAPAIENR

SEQ ID NO: 3005923 - protein, 31 aa, Entamoeba invadens
LDTQLLLIEKVIPYSYDYFTGVLPPFALDED

SEQ ID NO: 3005924 - protein, 33 aa, Entamoeba invadens
LDTQTAELLIPPNILPLFPAIVVNKMCKLYRNI

SEQ ID NO: 3005925 - protein, 25 aa, Entamoeba invadens
LDTRSGRMRLSLGKNIQLSPPRQDL

SEQ ID NO: 3005926 - protein, 18 aa, Entamoeba invadens
LDTVDVLYIWVGSKCAVQ

SEQ ID NO: 3005927 - protein, 23 aa, Entamoeba invadens
LDTYHMMVVSKYLFTIKDFTTIQ

SEQ ID NO: 3005928 - protein, 23 aa, Entamoeba invadens
LDTYHMMVVSKYLFTIKDFTTLQ

SEQ ID NO: 3005929 - protein, 21 aa, Entamoeba invadens
LDTYHMMVVSKYLITIKDFIT

SEQ ID NO: 3005930 - protein, 26 aa, Entamoeba invadens
LDVDMYKLLKFLLVNKVVRETTSTER

SEQ ID NO: 3005931 - protein, 22 aa, Entamoeba invadens
LDVGLVLAAGIRQQALQLQHGL

SEQ ID NO: 3005932 - protein, 24 aa, Entamoeba invadens
LDVKEIYPFIKIVNLEILEEAFPT

SEQ ID NO: 3005933 - protein, 32 aa, Entamoeba invadens
LDVLIQRSIQTDPHLMFFGFVVDSNSHYAQFL

SEQ ID NO: 3005934 - protein, 25 aa, Entamoeba invadens
LDVLKKYFPAMETLALNLPPQIPKT

SEQ ID NO: 3005935 - protein, 19 aa, Entamoeba invadens
LDVPDSIHQLLLSINKEKG

SEQ ID NO: 3005936 - protein, 31 aa, Entamoeba invadens
LDVRGFLIMPVQRLPRYNLLLTDLLKNTPQT

SEQ ID NO: 3005937 - protein, 21 aa, Entamoeba invadens
LDVSFLHLSKISKLLSQWVVL

SEQ ID NO: 3005938 - protein, 24 aa, Entamoeba invadens
LDVYSTISFAFLYSIQGVYSAISD

SEQ ID NO: 3005939 - protein, 17 aa, Entamoeba invadens
LDWKNAILRHFFQHGFD

SEQ ID NO: 3005940 - protein, 20 aa, Entamoeba invadens
LDYDSLRFKSSRFFSTFTGT

SEQ ID NO: 3005941 - protein, 23 aa, Entamoeba invadens
LEADCHGWLLYYTKTGFVDETII

SEQ ID NO: 3005942 - protein, 23 aa, Entamoeba invadens
LEADTFLFQLAASDPLQLLDVMM

SEQ ID NO: 3005943 - protein, 18 aa, Entamoeba invadens
LEAEIAPLTQRFSYSQQQ

SEQ ID NO: 3005944 - protein, 20 aa, Entamoeba invadens
LEAFFHTNRNALGYIKKYLQ

SEQ ID NO: 3005945 - protein, 23 aa, Entamoeba invadens
LEAISYLVTIPEGCDQLLKDVVS

SEQ ID NO: 3005946 - protein, 24 aa, Entamoeba invadens
LEAKLLCELVRRKFAPETLQMAAK

SEQ ID NO: 3005947 - protein, 24 aa, Entamoeba invadens
LEAQNDLDRLPTLIFKAIDSDNSG

SEQ ID NO: 3005948 - protein, 20 aa, Entamoeba invadens
LEATKLVFSRIAFEIKDGLV

SEQ ID NO: 3005949 - protein, 19 aa, Entamoeba invadens
LECDVWISLIFDQLEKIRK

SEQ ID NO: 3005950 - protein, 31 aa, Entamoeba invadens
LECFLEKDVQLLFPLYYFIQIAHDKRYTETR

SEQ ID NO: 3005951 - protein, 33 aa, Entamoeba invadens
LECLTWKDPFDEKLFPYSWDITNLISKGERPAI

SEQ ID NO: 3005952 - protein, 26 aa, Entamoeba invadens
LECQLKKYQEIPWISEIRKKRETEDL

SEQ ID NO: 3005953 - protein, 28 aa, Entamoeba invadens
LECRRGVIYLTFFDALYSKEIRGKNIIV

SEQ ID NO: 3005954 - protein, 19 aa, Entamoeba invadens
LECTRLGLKTVWLGGTFTT

SEQ ID NO: 3005955 - protein, 24 aa, Entamoeba invadens
LEDCLRRDFTINGLFYRIEDGVIE

SEQ ID NO: 3005956 - protein, 25 aa, Entamoeba invadens
LEDEKKQWVVKAKSIWENIQRNKEE

SEQ ID NO: 3005957 - protein, 25 aa, Entamoeba invadens
LEDEKKQWVVKAKSIWENIQRNKEG

SEQ ID NO: 3005958 - protein, 19 aa, Entamoeba invadens
LEDFIKPKGATKRGPKRKG

SEQ ID NO: 3005959 - protein, 34 aa, Entamoeba invadens
LEDFKGKFVVLLFYPLDWTFVCPTEMLGYSKLAE

SEQ ID NO: 3005960 - protein, 34 aa, Entamoeba invadens
LEDGNEIGFYFQEPYIFRFYYYDGDNACQYPEEV

SEQ ID NO: 3005961 - protein, 20 aa, Entamoeba invadens
LEDIEMVFISAGSANATCLQ

SEQ ID NO: 3005962 - protein, 28 aa, Entamoeba invadens
LEDILDFFQVLFIVVSTRNMDWINKLNQ

SEQ ID NO: 3005963 - protein, 18 aa, Entamoeba invadens
LEDIRLDENCLIFGQDHV

SEQ ID NO: 3005964 - protein, 17 aa, Entamoeba invadens
LEDKHYIFVSLFETGAM

SEQ ID NO: 3005965 - protein, 27 aa, Entamoeba invadens
LEDKKRLFSMLVVRYEALLKNQKTTQV

SEQ ID NO: 3005966 - protein, 30 aa, Entamoeba invadens
LEDKSSWCMGFLFTDIFILARSTIHNVAGT

SEQ ID NO: 3005967 - protein, 18 aa, Entamoeba invadens
LEDLTMLELLRLTYTQTQ

SEQ ID NO: 3005968 - protein, 43 aa, Entamoeba invadens
LEDNNILVIRKKIELLKNAMKNEFFFEMLLKEMGKSQKEIEEI

SEQ ID NO: 3005969 - protein, 27 aa, Entamoeba invadens
LEDNTTLQYLFYLDQIGISQAPMATHA

SEQ ID NO: 3005970 - protein, 18 aa, Entamoeba invadens
LEDQISVLKFTKYPSEGY

SEQ ID NO: 3005971 - protein, 24 aa, Entamoeba invadens
LEDTDGFCYFNTTFQGRPTPVRPV

SEQ ID NO: 3005972 - protein, 24 aa, Entamoeba invadens
LEDTPFGFLIYRYAMEKHIKLTFV

SEQ ID NO: 3005973 - protein, 18 aa, Entamoeba invadens
LEDVGGLFPFFEKKKETT

SEQ ID NO: 3005974 - protein, 25 aa, Entamoeba invadens
LEDVPPPTPTLPQRPKRMLESSMNK

SEQ ID NO: 3005975 - protein, 30 aa, Entamoeba invadens
LEECVLQKITILEIHRLLAERLQSSATDIT

SEQ ID NO: 3005976 - protein, 25 aa, Entamoeba invadens
LEEEQIAMKKELLNGSDGASRLTNE

SEQ ID NO: 3005977 - protein, 18 aa, Entamoeba invadens
LEEIIPFLDVLKDLPENG

SEQ ID NO: 3005978 - protein, 26 aa, Entamoeba invadens
LEEIKSINEGFVKNIQNLEQTNTNVN

SEQ ID NO: 3005979 - protein, 18 aa, Entamoeba invadens
LEEIVHVVRLSTTTVRVR

SEQ ID NO: 3005980 - protein, 17 aa, Entamoeba invadens
LEEKGIVGSAYIPVLET

SEQ ID NO: 3005981 - protein, 27 aa, Entamoeba invadens
LEEKQYLMAFVFALHLNDEGLIKTIFR

SEQ ID NO: 3005982 - protein, 24 aa, Entamoeba invadens
LEELKNLVLYLQQTIIKTQSELID

SEQ ID NO: 3005983 - protein, 24 aa, Entamoeba invadens
LEELLYLHLAIFTTIEQLGFFGKN

SEQ ID NO: 3005984 - protein, 22 aa, Entamoeba invadens
LEEMIDRWLCFIQQTTQKEWEV

SEQ ID NO: 3005985 - protein, 25 aa, Entamoeba invadens
LEENIYRKPLPAMFDELLVGHNGGL

SEQ ID NO: 3005986 - protein, 18 aa, Entamoeba invadens
LEESIFVVIKKQATFPVE

SEQ ID NO: 3005987 - protein, 27 aa, Entamoeba invadens
LEESLTKMFSILGIAFNSKYLMHTSAP

SEQ ID NO: 3005988 - protein, 27 aa, Entamoeba invadens
LEETVRVLPLIDYRTLRINTRVLHSES

SEQ ID NO: 3005989 - protein, 27 aa, Entamoeba invadens
LEEVELLMFACLYVFKIMDDETLRTWL

SEQ ID NO: 3005990 - protein, 23 aa, Entamoeba invadens
LEEVYLHSMTFITPSVLIGSETD

SEQ ID NO: 3005991 - protein, 19 aa, Entamoeba invadens
LEEYWQSHKELWAYSIFFF

SEQ ID NO: 3005992 - protein, 17 aa, Entamoeba invadens
LEFFQRNFTSFDPISFS

SEQ ID NO: 3005993 - protein, 17 aa, Entamoeba invadens
LEFHKTVLNLLKTPSDD

SEQ ID NO: 3005994 - protein, 22 aa, Entamoeba invadens
LEFKCFFMCGSLVKVRIPKTVS

SEQ ID NO: 3005995 - protein, 27 aa, Entamoeba invadens
LEFLEDIIGTAKYIEPIDLKTGDLESL

SEQ ID NO: 3005996 - protein, 23 aa, Entamoeba invadens
LEFPLCFTVFGATKYSLNNEGGV

SEQ ID NO: 3005997 - protein, 31 aa, Entamoeba invadens
LEFQDYLIVSKTDCLFLFEAIQKKEKVCSRE

SEQ ID NO: 3005998 - protein, 27 aa, Entamoeba invadens
LEFSSTMFPVIPPKYNFLSPKLRFDTL

SEQ ID NO: 3005999 - protein, 27 aa, Entamoeba invadens
LEFSSTMFPVIPPKYNFLSPKLTQESL

SEQ ID NO: 3006000 - protein, 19 aa, Entamoeba invadens
LEFTSCFLCGKTGHLSNMC

SEQ ID NO: 3006001 - protein, 23 aa, Entamoeba invadens
LEGCDYYEIRSVPPLVTLKPGYA

SEQ ID NO: 3006002 - protein, 42 aa, Entamoeba invadens
LEGIRITRLGYPNRIIYNEFLKRYFFLGTNINKKTSDAMPVV

SEQ ID NO: 3006003 - protein, 25 aa, Entamoeba invadens
LEGLSRLYNYLTKKKALVHYGLFEP

SEQ ID NO: 3006004 - protein, 18 aa, Entamoeba invadens
LEGRLLMIKGSASTLDLA

SEQ ID NO: 3006005 - protein, 24 aa, Entamoeba invadens
LEGVGKIQNLMKKIIKMCGGEVRI

SEQ ID NO: 3006006 - protein, 29 aa, Entamoeba invadens
LEHEIQVDLFELAKRKASLALTSQGREIL

SEQ ID NO: 3006007 - protein, 27 aa, Entamoeba invadens
LEHFASIKKLDLFACETLAFIAHEAEL

SEQ ID NO: 3006008 - protein, 20 aa, Entamoeba invadens
LEHIVFPKHLKEVYVNSCFI

SEQ ID NO: 3006009 - protein, 19 aa, Entamoeba invadens
LEHLTFSKSLFIIPNGCCD

SEQ ID NO: 3006010 - protein, 30 aa, Entamoeba invadens
LEHPISNLLEILPLLYSSILQFFVYAESDK

SEQ ID NO: 3006011 - protein, 20 aa, Entamoeba invadens
LEHRNSISFSQQFKSRVDLK

SEQ ID NO: 3006012 - protein, 25 aa, Entamoeba invadens
LEHSPRLILVLPSVLQKGIPNTLYI

SEQ ID NO: 3006013 - protein, 18 aa, Entamoeba invadens
LEICFGGAVLWTGRSPMV

SEQ ID NO: 3006014 - protein, 28 aa, Entamoeba invadens
LEIEIDAVFSKLLLLKKKRYAAIMVNEN

SEQ ID NO: 3006015 - protein, 22 aa, Entamoeba invadens
LEIENYFVLANTFKIAKMISDK

SEQ ID NO: 3006016 - protein, 19 aa, Entamoeba invadens
LEIGFEEQKFVEQIGFPRA

SEQ ID NO: 3006017 - protein, 19 aa, Entamoeba invadens
LEIICYIDRLIGDYFTVPI

SEQ ID NO: 3006018 - protein, 18 aa, Entamoeba invadens
LEILINKECYPKAKSVKF

SEQ ID NO: 3006019 - protein, 20 aa, Entamoeba invadens
LEIMNYIKELLRPENKYSAE

SEQ ID NO: 3006020 - protein, 20 aa, Entamoeba invadens
LEIPKLSALGLNVLYLAVED

SEQ ID NO: 3006021 - protein, 26 aa, Entamoeba invadens
LEIRDFNMAYLLFTSIVKQSLSVQTE

SEQ ID NO: 3006022 - protein, 22 aa, Entamoeba invadens
LEISQIILICKEKTVFDIYLKV

SEQ ID NO: 3006023 - protein, 19 aa, Entamoeba invadens
LEIVLFKTTKLVTIKNRMF

SEQ ID NO: 3006024 - protein, 26 aa, Entamoeba invadens
LEIYDVVRYLVYWGKAKVIEAVFLDD

SEQ ID NO: 3006025 - protein, 33 aa, Entamoeba invadens
LEKDFPVFFVKLLEVYLFPILVVKDGNETFPRC

SEQ ID NO: 3006026 - protein, 20 aa, Entamoeba invadens
LEKDMLFEMLKAATFMNIDM

SEQ ID NO: 3006027 - protein, 30 aa, Entamoeba invadens
LEKEYPPGIYTFPFSFKVPLDTPPSSLYHE

SEQ ID NO: 3006028 - protein, 17 aa, Entamoeba invadens
LEKFKIYCTKNTVTLPK

SEQ ID NO: 3006029 - protein, 24 aa, Entamoeba invadens
LEKFPTFYKSLYQLSILYENVTYG

SEQ ID NO: 3006030 - protein, 19 aa, Entamoeba invadens
LEKGKSLEMTLTRKSVEEK

SEQ ID NO: 3006031 - protein, 25 aa, Entamoeba invadens
LEKGNIFVYLVGNKIDMETREVQQK

SEQ ID NO: 3006032 - protein, 23 aa, Entamoeba invadens
LEKKFDFFQVQIPVLKTPKDEVD

SEQ ID NO: 3006033 - protein, 24 aa, Entamoeba invadens
LEKKGFPAFAIPKALYIEHTPFSE

SEQ ID NO: 3006034 - protein, 25 aa, Entamoeba invadens
LEKKKRVLMMSEFFTVGSMPSEYES

SEQ ID NO: 3006035 - protein, 18 aa, Entamoeba invadens
LEKLFPQNRPKVTSAALV

SEQ ID NO: 3006036 - protein, 17 aa, Entamoeba invadens
LEKLKVLCFDRKLVDVD

SEQ ID NO: 3006037 - protein, 25 aa, Entamoeba invadens
LEKLQMYLRCFVNHNDFATVKACVA

SEQ ID NO: 3006038 - protein, 23 aa, Entamoeba invadens
LEKLTLCYDLLPTVFKKPLSSPE

SEQ ID NO: 3006039 - protein, 18 aa, Entamoeba invadens
LEKNQFVTFLKTVEFANA

SEQ ID NO: 3006040 - protein, 19 aa, Entamoeba invadens
LEKNRAYFPIIDYTEYTSD

SEQ ID NO: 3006041 - protein, 23 aa, Entamoeba invadens
LEKSITPFPFNLKLTIKELRIND

SEQ ID NO: 3006042 - protein, 19 aa, Entamoeba invadens
LEKVPLRNGLPYPLVDCLE

SEQ ID NO: 3006043 - protein, 24 aa, Entamoeba invadens
LEKVYLLNVVLYADSLETIKKLVQ

SEQ ID NO: 3006044 - protein, 19 aa, Entamoeba invadens
LEKYMKYNLYFGQNIGSVI

SEQ ID NO: 3006045 - protein, 32 aa, Entamoeba invadens
LEKYMVYDFLYSYCFPFLVYKQRILTNQTLLN

SEQ ID NO: 3006046 - protein, 30 aa, Entamoeba invadens
LEKYSATQLRLLFLLQSWDTVINFSDTALD

SEQ ID NO: 3006047 - protein, 25 aa, Entamoeba invadens
LEKYSIPFDVKFLSGIRKSKHLFVG

SEQ ID NO: 3006048 - protein, 19 aa, Entamoeba invadens
LELAIYVASQFAGCPYFVA

SEQ ID NO: 3006049 - protein, 19 aa, Entamoeba invadens
LELAVQICPLDYSMHSRDL

SEQ ID NO: 3006050 - protein, 34 aa, Entamoeba invadens
LELGDAFTWFSKAQEYFFNWFRTVLKDTEQSKRS

SEQ ID NO: 3006051 - protein, 22 aa, Entamoeba invadens
LELIKTILVQLIKALSYCHSHR

SEQ ID NO: 3006052 - protein, 20 aa, Entamoeba invadens
LELKRIEAILIKLGITDSTL

SEQ ID NO: 3006053 - protein, 26 aa, Entamoeba invadens
LELKTVLSFFAFQLPVVGQIFSKCST

SEQ ID NO: 3006054 - protein, 17 aa, Entamoeba invadens
LELMRILVDLEGMEWNQ

SEQ ID NO: 3006055 - protein, 18 aa, Entamoeba invadens
LELNQFLQALLQHPSYTF

SEQ ID NO: 3006056 - protein, 40 aa, Entamoeba invadens
LELNTTAEALMWVFLLRQSFIGFYDPNEINMALFSCAEND

SEQ ID NO: 3006057 - protein, 26 aa, Entamoeba invadens
LELPTTLTFLIMKKVPRGLLKNAFLP

SEQ ID NO: 3006058 - protein, 20 aa, Entamoeba invadens
LELREFDYLITVPKIEEGME

SEQ ID NO: 3006059 - protein, 17 aa, Entamoeba invadens
LELSDVKEIFKSKGIQL

SEQ ID NO: 3006060 - protein, 19 aa, Entamoeba invadens
LELVFKQICPLDLYVNIQT

SEQ ID NO: 3006061 - protein, 17 aa, Entamoeba invadens
LELYKKLYDGESFKFNL

SEQ ID NO: 3006062 - protein, 23 aa, Entamoeba invadens
LEMDKPLFFNTIAKDLAIKIPKE

SEQ ID NO: 3006063 - protein, 18 aa, Entamoeba invadens
LEMGAVERLIVWENLKSI

SEQ ID NO: 3006064 - protein, 26 aa, Entamoeba invadens
LEMLKNAFSTFRINLVLDLKANKERM

SEQ ID NO: 3006065 - protein, 29 aa, Entamoeba invadens
LEMVEKVCVMLLILFNDNASYQEFKNGDI

SEQ ID NO: 3006066 - protein, 25 aa, Entamoeba invadens
LEMVKIYQNIFIEKLQLDFKNPNNE

SEQ ID NO: 3006067 - protein, 32 aa, Entamoeba invadens
LEMVRKYVSKIVAFFLFYHENCEFQWDTKTVN

SEQ ID NO: 3006068 - protein, 17 aa, Entamoeba invadens
LENALIASQGILPLCQD

SEQ ID NO: 3006069 - protein, 17 aa, Entamoeba invadens
LENDIPRFLTECATFIL

SEQ ID NO: 3006070 - protein, 34 aa, Entamoeba invadens
LENEFANFVLKQVYPFTALPSFTVAPLNVYTNTD

SEQ ID NO: 3006071 - protein, 27 aa, Entamoeba invadens
LENFKDQFVLLKIITFLYCVTHNSPEN

SEQ ID NO: 3006072 - protein, 30 aa, Entamoeba invadens
LENFKEYFMKFGGIFSCKVVPEKKYGFVCF

SEQ ID NO: 3006073 - protein, 29 aa, Entamoeba invadens
LENFMCHRHLLLDLSPQVNFIVGENGSGK

SEQ ID NO: 3006074 - protein, 27 aa, Entamoeba invadens
LENFRTEFLRYCPLYENIYQTLSESDI

SEQ ID NO: 3006075 - protein, 25 aa, Entamoeba invadens
LENGRNCFIEILKSYRKIIRTVKED

SEQ ID NO: 3006076 - protein, 39 aa, Entamoeba invadens
LENGVKVLPRVLLKDFAELGFPFFGYEEIVKSLREKHDG

SEQ ID NO: 3006077 - protein, 21 aa, Entamoeba invadens
LENGVPFLPIGMYYSSITEDE

SEQ ID NO: 3006078 - protein, 23 aa, Entamoeba invadens
LENKFSFDEIILLLGAESATYYS

SEQ ID NO: 3006079 - protein, 29 aa, Entamoeba invadens
LENKIFENVPPLVAPYNNLLIKTKHLIIP

SEQ ID NO: 3006080 - protein, 35 aa, Entamoeba invadens
LENKTEIGFYFTKVYIFTLFFLDTPVQKVIEDLKN

SEQ ID NO: 3006081 - protein, 23 aa, Entamoeba invadens
LENLEQALKFIVADGIKLVNIDA

SEQ ID NO: 3006082 - protein, 24 aa, Entamoeba invadens
LENLKNQLILAAKSRKLGGVLRGS

SEQ ID NO: 3006083 - protein, 18 aa, Entamoeba invadens
LENLLNTPQFRGIIQRSA

SEQ ID NO: 3006084 - protein, 21 aa, Entamoeba invadens
LENMYLPRNLVRLGGSVFQGC

SEQ ID NO: 3006085 - protein, 23 aa, Entamoeba invadens
LENNFSFDEIILLLGAESATYYS

SEQ ID NO: 3006086 - protein, 24 aa, Entamoeba invadens
LENNTEFKYVPLSTKFRNMNDAER

SEQ ID NO: 3006087 - protein, 24 aa, Entamoeba invadens
LENQSFEIFLTKVNPTLYTNLLSK

SEQ ID NO: 3006088 - protein, 25 aa, Entamoeba invadens
LENSFQFIGPFGKTPFVIPKNKSNA

SEQ ID NO: 3006089 - protein, 23 aa, Entamoeba invadens
LENTEQALKFIIADGVHLVNIDA

SEQ ID NO: 3006090 - protein, 18 aa, Entamoeba invadens
LENVILPLSITELSPFCF

SEQ ID NO: 3006091 - protein, 25 aa, Entamoeba invadens
LENYPTLNVFFFIQNLESKVADLVS

SEQ ID NO: 3006092 - protein, 21 aa, Entamoeba invadens
LEPIFLMNVVLYITQSDVENF

SEQ ID NO: 3006093 - protein, 32 aa, Entamoeba invadens
LEPKFLKHTCLPLIKDWIHLRRHQLLFNACER

SEQ ID NO: 3006094 - protein, 17 aa, Entamoeba invadens
LEPQIKETFLAAQGKFI

SEQ ID NO: 3006095 - protein, 19 aa, Entamoeba invadens
LEQETLLLQVDREARLLFC

SEQ ID NO: 3006096 - protein, 24 aa, Entamoeba invadens
LEQHFRYFFMHWCSYVRDAFHVLL

SEQ ID NO: 3006097 - protein, 21 aa, Entamoeba invadens
LEQLCSHWNLCDDSRMTLLKE

SEQ ID NO: 3006098 - protein, 24 aa, Entamoeba invadens
LEQNINFIGVFMQNTTQLDFIKQN

SEQ ID NO: 3006099 - protein, 26 aa, Entamoeba invadens
LEQNKLVNLHRLFYGSAGVAKERLMN

SEQ ID NO: 3006100 - protein, 21 aa, Entamoeba invadens
LEQYNKIFSWFNLVDQDRSGT

SEQ ID NO: 3006101 - protein, 17 aa, Entamoeba invadens
LERKYFQKIGGIGVAEL

SEQ ID NO: 3006102 - protein, 24 aa, Entamoeba invadens
LERLKHPFLVNLYAEFESPKYHLF

SEQ ID NO: 3006103 - protein, 23 aa, Entamoeba invadens
LERQYYLDYWTIQSTFVLLENNH

SEQ ID NO: 3006104 - protein, 24 aa, Entamoeba invadens
LERRYLGLSQAKKRKTRRLKVNRE

SEQ ID NO: 3006105 - protein, 22 aa, Entamoeba invadens
LESAVIPNLFFFNRNKTEASSR

SEQ ID NO: 3006106 - protein, 28 aa, Entamoeba invadens
LESDFKYDYLISPLMKPADFDAKPMVLF

SEQ ID NO: 3006107 - protein, 21 aa, Entamoeba invadens
LESEFIIWKRVRKCLKTTFMS

SEQ ID NO: 3006108 - protein, 25 aa, Entamoeba invadens
LESEKDQLFLFLKEVQKFSNNGTKF

SEQ ID NO: 3006109 - protein, 36 aa, Entamoeba invadens
LESETIYSLLLARGMALRSTFLSSLIQFVQSQKSAI

SEQ ID NO: 3006110 - protein, 17 aa, Entamoeba invadens
LESFQKVIKVWNSESSI

SEQ ID NO: 3006111 - protein, 20 aa, Entamoeba invadens
LESGSCLDVPLLLKWTDEYE

SEQ ID NO: 3006112 - protein, 31 aa, Entamoeba invadens
LESKWFGEAEKFVKALFSLAEKLSPCVIFID

SEQ ID NO: 3006113 - protein, 30 aa, Entamoeba invadens
LESLFTFLGLNPLVFLMIRPVVSDLYVDKR

SEQ ID NO: 3006114 - protein, 26 aa, Entamoeba invadens
LESLKMLHINPWYISVDNIRSFFRHF

SEQ ID NO: 3006115 - protein, 24 aa, Entamoeba invadens
LESLKSIIIPKYITSLKAYTFADC

SEQ ID NO: 3006116 - protein, 17 aa, Entamoeba invadens
LESLPDTFALLSSLTFL

SEQ ID NO: 3006117 - protein, 34 aa, Entamoeba invadens
LESLQQFISANQLPHLLFYGPPGTGKTTTALAIV

SEQ ID NO: 3006118 - protein, 18 aa, Entamoeba invadens
LESLRCLFSKKEKFELVK

SEQ ID NO: 3006119 - protein, 18 aa, Entamoeba invadens
LESLTIFSTVRKIGREAF

SEQ ID NO: 3006120 - protein, 24 aa, Entamoeba invadens
LESLVMMEKFFQYCEKTETYFPAL

SEQ ID NO: 3006121 - protein, 19 aa, Entamoeba invadens
LESPWLCVCLFLLFFHVDI

SEQ ID NO: 3006122 - protein, 25 aa, Entamoeba invadens
LESSLPFLHFFDGFRTSHEIQKIHQ

SEQ ID NO: 3006123 - protein, 24 aa, Entamoeba invadens
LESSQPLLTSFRRSYEESVEKSRV

SEQ ID NO: 3006124 - protein, 21 aa, Entamoeba invadens
LESSTKCFISFVLESQKFERL

SEQ ID NO: 3006125 - protein, 30 aa, Entamoeba invadens
LESVKMLHINPWFISIQNIKTFFYHFHTET

SEQ ID NO: 3006126 - protein, 25 aa, Entamoeba invadens
LESVYKKIFCPSRATLYYSCDEEEK

SEQ ID NO: 3006127 - protein, 18 aa, Entamoeba invadens
LESWVIDDTFKYINHIKV

SEQ ID NO: 3006128 - protein, 28 aa, Entamoeba invadens
LETEKKLSESLLLPPFNSLMVQNGSENY

SEQ ID NO: 3006129 - protein, 26 aa, Entamoeba invadens
LETGHDIIFFWVARMVMMSLELTDKI

SEQ ID NO: 3006130 - protein, 18 aa, Entamoeba invadens
LETIIRLLDEDLSQITIH

SEQ ID NO: 3006131 - protein, 26 aa, Entamoeba invadens
LETIKKENQFIKKQRIQLELQNHENE

SEQ ID NO: 3006132 - protein, 24 aa, Entamoeba invadens
LETIPHCAFFRCYKLSEIKVPNSV

SEQ ID NO: 3006133 - protein, 25 aa, Entamoeba invadens
LETIPHCAFFRCYKLSKIRIPTSVT

SEQ ID NO: 3006134 - protein, 18 aa, Entamoeba invadens
LETISLLGYLYHVQDVHG

SEQ ID NO: 3006135 - protein, 25 aa, Entamoeba invadens
LETLDFVILNCATLFSKCDFVVYGE

SEQ ID NO: 3006136 - protein, 20 aa, Entamoeba invadens
LETLFIHQVYNIKFTKNFVN

SEQ ID NO: 3006137 - protein, 25 aa, Entamoeba invadens
LETSGLVFRFQLPSSLAYKHLHFYS

SEQ ID NO: 3006138 - protein, 24 aa, Entamoeba invadens
LETTKQFLLPISNTKDKNFSMLQE

SEQ ID NO: 3006139 - protein, 23 aa, Entamoeba invadens
LEVCSNMLYAKNLTLIYNEWQCY

SEQ ID NO: 3006140 - protein, 18 aa, Entamoeba invadens
LEVFMKKARDVCDKKPFV

SEQ ID NO: 3006141 - protein, 18 aa, Entamoeba invadens
LEVGYFYSLTFEEMCSFN

SEQ ID NO: 3006142 - protein, 22 aa, Entamoeba invadens
LEVKWRFEISTQRPLIQNTLEK

SEQ ID NO: 3006143 - protein, 18 aa, Entamoeba invadens
LEVLKPLEKQLQGQEFKR

SEQ ID NO: 3006144 - protein, 26 aa, Entamoeba invadens
LEVNELHMKLLLKIDGFVGLNETYRP

SEQ ID NO: 3006145 - protein, 23 aa, Entamoeba invadens
LEVRRAMLAMFKNNFDNPEKLQE

SEQ ID NO: 3006146 - protein, 19 aa, Entamoeba invadens
LEVTLTYAALEDLFELMKA

SEQ ID NO: 3006147 - protein, 19 aa, Entamoeba invadens
LEVWHFVGITGSAGFVYDD

SEQ ID NO: 3006148 - protein, 17 aa, Entamoeba invadens
LEVYCGCAMYNTLQHVN

SEQ ID NO: 3006149 - protein, 30 aa, Entamoeba invadens
LEVYKKHPNWPLKCYGFASALCLSLNISTD

SEQ ID NO: 3006150 - protein, 32 aa, Entamoeba invadens
LEWCNVCIDILPYSLLDFLSSPMNYLIGVPSE

SEQ ID NO: 3006151 - protein, 34 aa, Entamoeba invadens
LEWIYDTHQTFFHFGILLTIPNLSAISKVLYVSH

SEQ ID NO: 3006152 - protein, 17 aa, Entamoeba invadens
LEWVRKQLPTRIVSSVT

SEQ ID NO: 3006153 - protein, 19 aa, Entamoeba invadens
LEYDSLLTHLSRALHDTLT

SEQ ID NO: 3006154 - protein, 18 aa, Entamoeba invadens
LEYEVSIGVLPKTAMRRS

SEQ ID NO: 3006155 - protein, 20 aa, Entamoeba invadens
LEYFAFLYDTSVVVFHNVNS

SEQ ID NO: 3006156 - protein, 26 aa, Entamoeba invadens
LEYFSHNRFVFDTFIGAAVLDPGSID

SEQ ID NO: 3006157 - protein, 17 aa, Entamoeba invadens
LEYLINSFKVEGSKGKR

SEQ ID NO: 3006158 - protein, 22 aa, Entamoeba invadens
LEYSYLIPVPLSLNIRSFDVIY

SEQ ID NO: 3006159 - protein, 17 aa, Entamoeba invadens
LFAASFEDLHDFVRPPI

SEQ ID NO: 3006160 - protein, 20 aa, Entamoeba invadens
LFAEQRFDFLDSSVLLYMKT

SEQ ID NO: 3006161 - protein, 17 aa, Entamoeba invadens
LFAFFDDETRYFLVMEF

SEQ ID NO: 3006162 - protein, 17 aa, Entamoeba invadens
LFAIIQKSPGAVKRATI

SEQ ID NO: 3006163 - protein, 17 aa, Entamoeba invadens
LFALYKSDSKKYDVKKV

SEQ ID NO: 3006164 - protein, 17 aa, Entamoeba invadens
LFAMLFKENPTDKKSCV

SEQ ID NO: 3006165 - protein, 19 aa, Entamoeba invadens
LFATMSCLCLTIDVSSKKF

SEQ ID NO: 3006166 - protein, 17 aa, Entamoeba invadens
LFCFNMDNEPFALSNSV

SEQ ID NO: 3006167 - protein, 23 aa, Entamoeba invadens
LFCGQVLEDYKWLSYKQVGMYVN

SEQ ID NO: 3006168 - protein, 17 aa, Entamoeba invadens
LFCVKTELENFVEKKKN

SEQ ID NO: 3006169 - protein, 17 aa, Entamoeba invadens
LFCVRRGTNDQEKVFPF

SEQ ID NO: 3006170 - protein, 26 aa, Entamoeba invadens
LFDEINWKLEKLIQFTFNICHLCQFK

SEQ ID NO: 3006171 - protein, 36 aa, Entamoeba invadens
LFDENAILFKFYQYIRSLLVYSRSFPRNLKQYFMLF

SEQ ID NO: 3006172 - protein, 18 aa, Entamoeba invadens
LFDIVNDPNMLMLKDWEE

SEQ ID NO: 3006173 - protein, 26 aa, Entamoeba invadens
LFDKMKLYFKIMILNVDDFSTFNMWN

SEQ ID NO: 3006174 - protein, 18 aa, Entamoeba invadens
LFDLFSRIKHTSSDSKSD

SEQ ID NO: 3006175 - protein, 18 aa, Entamoeba invadens
LFDLIEDIKMKKAKEVVC

SEQ ID NO: 3006176 - protein, 18 aa, Entamoeba invadens
LFDVLPLSAVIDNSVFCV

SEQ ID NO: 3006177 - protein, 20 aa, Entamoeba invadens
LFDVVLCNIPTLISRYILVN

SEQ ID NO: 3006178 - protein, 20 aa, Entamoeba invadens
LFEAIFIDQLIEKMKPFFEE

SEQ ID NO: 3006179 - protein, 27 aa, Entamoeba invadens
LFECVIWKEPYLDKQFKFAWDIVDFVV

SEQ ID NO: 3006180 - protein, 19 aa, Entamoeba invadens
LFEKYICKGVYNNLSAFKP

SEQ ID NO: 3006181 - protein, 18 aa, Entamoeba invadens
LFELLNKMKEFNIITTED

SEQ ID NO: 3006182 - protein, 19 aa, Entamoeba invadens
LFELVNLIVSIPNAFDFDV

SEQ ID NO: 3006183 - protein, 21 aa, Entamoeba invadens
LFEMFLAIFLVDEEHRKLITT

SEQ ID NO: 3006184 - protein, 18 aa, Entamoeba invadens
LFEMLKAATFMNIDMLVE

SEQ ID NO: 3006185 - protein, 26 aa, Entamoeba invadens
LFENKNFYRRVFLPKINYSEFVQLKK

SEQ ID NO: 3006186 - protein, 20 aa, Entamoeba invadens
LFEQNVFFVAVLEYLQSGSD

SEQ ID NO: 3006187 - protein, 17 aa, Entamoeba invadens
LFEQYRPKNVEFILTKA

SEQ ID NO: 3006188 - protein, 17 aa, Entamoeba invadens
LFETPWVEMPDHALLFI

SEQ ID NO: 3006189 - protein, 20 aa, Entamoeba invadens
LFEVKKIPRVLKGRSTIQIN

SEQ ID NO: 3006190 - protein, 20 aa, Entamoeba invadens
LFEYTFHQCKLLKKITLNEG

SEQ ID NO: 3006191 - protein, 34 aa, Entamoeba invadens
LFFATTKLFFSPNVPLRQLLFTTLRCIIPYACDV

SEQ ID NO: 3006192 - protein, 21 aa, Entamoeba invadens
LFFKQMIAPMEYLQNTKKFIH

SEQ ID NO: 3006193 - protein, 21 aa, Entamoeba invadens
LFFMELLGQCFVMSSSLPRLE

SEQ ID NO: 3006194 - protein, 20 aa, Entamoeba invadens
LFGAGYIFSASAPPFTCSAA

SEQ ID NO: 3006195 - protein, 17 aa, Entamoeba invadens
LFGDIMRIDNHTGIGVG

SEQ ID NO: 3006196 - protein, 19 aa, Entamoeba invadens
LFGGDEWSTLFSPINSLQM

SEQ ID NO: 3006197 - protein, 18 aa, Entamoeba invadens
LFGHTTKYCPNSQEAGKC

SEQ ID NO: 3006198 - protein, 17 aa, Entamoeba invadens
LFGIRKEIPVSVDDIDW

SEQ ID NO: 3006199 - protein, 24 aa, Entamoeba invadens
LFGKECVFLSLKKVVLESVFSVTF

SEQ ID NO: 3006200 - protein, 17 aa, Entamoeba invadens
LFGNFDPTQKPLRKSVS

SEQ ID NO: 3006201 - protein, 25 aa, Entamoeba invadens
LFGNYVVQKLLEYGPPKLIVDVFKQ

SEQ ID NO: 3006202 - protein, 21 aa, Entamoeba invadens
LFGPARYYEVYLKAFDKGIIL

SEQ ID NO: 3006203 - protein, 18 aa, Entamoeba invadens
LFGVIKREEKIELKVLIR

SEQ ID NO: 3006204 - protein, 20 aa, Entamoeba invadens
LFHIDFGHFLGNVIKLGFYK

SEQ ID NO: 3006205 - protein, 18 aa, Entamoeba invadens
LFHKMPFEKTLNLKLFQV

SEQ ID NO: 3006206 - protein, 17 aa, Entamoeba invadens
LFHTLFNSKEFITKCKD

SEQ ID NO: 3006207 - protein, 19 aa, Entamoeba invadens
LFHVFDYREEFQKTLTRDM

SEQ ID NO: 3006208 - protein, 20 aa, Entamoeba invadens
LFHWFTGPLNDSIRSSLSTY

SEQ ID NO: 3006209 - protein, 29 aa, Entamoeba invadens
LFICSDNYPYILFNNRLNYIYVAKNLEIC

SEQ ID NO: 3006210 - protein, 21 aa, Entamoeba invadens
LFIESIKTPLPTSFRLTKTSE

SEQ ID NO: 3006211 - protein, 18 aa, Entamoeba invadens
LFIHSLIQKIVEVLDKCF

SEQ ID NO: 3006212 - protein, 17 aa, Entamoeba invadens
LFIPIFSQSVREFFTEF

SEQ ID NO: 3006213 - protein, 19 aa, Entamoeba invadens
LFIQSVRLLAPMVFGKRLT

SEQ ID NO: 3006214 - protein, 21 aa, Entamoeba invadens
LFIRIKQVELLYYLDKNKKDQ

SEQ ID NO: 3006215 - protein, 19 aa, Entamoeba invadens
LFISKHLQHVFSKCLSQFK

SEQ ID NO: 3006216 - protein, 21 aa, Entamoeba invadens
LFISKTPESIFFLNKERMLSS

SEQ ID NO: 3006217 - protein, 29 aa, Entamoeba invadens
LFKANAVDLILPFLADPTLCQEALFLLSN

SEQ ID NO: 3006218 - protein, 20 aa, Entamoeba invadens
LFKCTEAFFMPFVVNSEEIG

SEQ ID NO: 3006219 - protein, 19 aa, Entamoeba invadens
LFKGKMQIIIKSRCGHCIK

SEQ ID NO: 3006220 - protein, 20 aa, Entamoeba invadens
LFKILIIGESGVGKTAIMQR

SEQ ID NO: 3006221 - protein, 17 aa, Entamoeba invadens
LFKILVIGDSGVGKTSI

SEQ ID NO: 3006222 - protein, 19 aa, Entamoeba invadens
LFKINHCLLHRLSIANKRT

SEQ ID NO: 3006223 - protein, 17 aa, Entamoeba invadens
LFKKDSMIFRVVGTNGE

SEQ ID NO: 3006224 - protein, 19 aa, Entamoeba invadens
LFKLIPLLAHKYQDQLVPR

SEQ ID NO: 3006225 - protein, 20 aa, Entamoeba invadens
LFKNWVNFTSVVLLTNTIKI

SEQ ID NO: 3006226 - protein, 20 aa, Entamoeba invadens
LFKRRELLKIAFKLGKRVIE

SEQ ID NO: 3006227 - protein, 17 aa, Entamoeba invadens
LFKSLLSAFNFSSESQP

SEQ ID NO: 3006228 - protein, 26 aa, Entamoeba invadens
LFLAKENVMFSLFIFNDNQPCVDLKL

SEQ ID NO: 3006229 - protein, 18 aa, Entamoeba invadens
LFLETKKRKMGYGGSGFK

SEQ ID NO: 3006230 - protein, 21 aa, Entamoeba invadens
LFLFIPDKVTALCLVQINKEW

SEQ ID NO: 3006231 - protein, 17 aa, Entamoeba invadens
LFLFNSMDFARLENLLQ

SEQ ID NO: 3006232 - protein, 17 aa, Entamoeba invadens
LFLGDYVDRGCFGTEVI

SEQ ID NO: 3006233 - protein, 45 aa, Entamoeba invadens
LFLGKYIGQYLVKVYNRYAFVKYYSGKPFATFRSPLRKLGDYFVL

SEQ ID NO: 3006234 - protein, 26 aa, Entamoeba invadens
LFMKEPTFFALPVTPNGLLCISLKCV

SEQ ID NO: 3006235 - protein, 20 aa, Entamoeba invadens
LFMQEAVIILFKENSDRIDM

SEQ ID NO: 3006236 - protein, 18 aa, Entamoeba invadens
LFMRPHMLNFLTPEEIRD

SEQ ID NO: 3006237 - protein, 18 aa, Entamoeba invadens
LFMSSTMIPLKGGMLKVT

SEQ ID NO: 3006238 - protein, 17 aa, Entamoeba invadens
LFMTSFVEKVSAIGYTI

SEQ ID NO: 3006239 - protein, 17 aa, Entamoeba invadens
LFMTSFVEKVSTIGYTI

SEQ ID NO: 3006240 - protein, 17 aa, Entamoeba invadens
LFNEVIYMLGVDLGQAF

SEQ ID NO: 3006241 - protein, 17 aa, Entamoeba invadens
LFNICKLCKNLLTKIRP

SEQ ID NO: 3006242 - protein, 19 aa, Entamoeba invadens
LFNNNFFNEITKKSLNKWD

SEQ ID NO: 3006243 - protein, 19 aa, Entamoeba invadens
LFNPTLWCENYFSRRVEGC

SEQ ID NO: 3006244 - protein, 23 aa, Entamoeba invadens
LFNPVVMLCFKIVSVSVETCVAV

SEQ ID NO: 3006245 - protein, 27 aa, Entamoeba invadens
LFNTVLEFMKILVILLEKFDSIEDSRC

SEQ ID NO: 3006246 - protein, 19 aa, Entamoeba invadens
LFNVAYYFKRESLVNGNYN

SEQ ID NO: 3006247 - protein, 25 aa, Entamoeba invadens
LFPEHTCPYVFVYQSNFSSAVSSDF

SEQ ID NO: 3006248 - protein, 24 aa, Entamoeba invadens
LFPESVGGGLDRKFKSKFAQAEID

SEQ ID NO: 3006249 - protein, 22 aa, Entamoeba invadens
LFPFTEVLSLYLPLEKSFHIPP

SEQ ID NO: 3006250 - protein, 24 aa, Entamoeba invadens
LFPNIQTHYLYFSYEKKLANVSLE

SEQ ID NO: 3006251 - protein, 23 aa, Entamoeba invadens
LFQKWIKQLVYFIGEFELNKLTT

SEQ ID NO: 3006252 - protein, 24 aa, Entamoeba invadens
LFQLEKRAFYLSLSKHFESIRANG

SEQ ID NO: 3006253 - protein, 17 aa, Entamoeba invadens
LFQLSKLMDNEIDVEGI

SEQ ID NO: 3006254 - protein, 17 aa, Entamoeba invadens
LFQYPWTIADFVSGGKR

SEQ ID NO: 3006255 - protein, 21 aa, Entamoeba invadens
LFRIARVLVHKNYRKQGKGQQ

SEQ ID NO: 3006256 - protein, 37 aa, Entamoeba invadens
LFRKTSLLPATTWPWYKLISAIKLFTFPPGVNRFNRK

SEQ ID NO: 3006257 - protein, 17 aa, Entamoeba invadens
LFRNVAKSLDLPMVKSD

SEQ ID NO: 3006258 - protein, 23 aa, Entamoeba invadens
LFSAFGRILHIWVDTKKQIGFIT

SEQ ID NO: 3006259 - protein, 19 aa, Entamoeba invadens
LFSCAFSGTKLRNLKLPNK

SEQ ID NO: 3006260 - protein, 17 aa, Entamoeba invadens
LFSCRQDYKVTVFLSRS

SEQ ID NO: 3006261 - protein, 25 aa, Entamoeba invadens
LFSDDGFFTTFFYSFCKTFFNEFYS

SEQ ID NO: 3006262 - protein, 23 aa, Entamoeba invadens
LFSISHYFLSFSDFVALEMVCKK

SEQ ID NO: 3006263 - protein, 21 aa, Entamoeba invadens
LFSISLLSESYRTFLKSFKVT

SEQ ID NO: 3006264 - protein, 18 aa, Entamoeba invadens
LFSKFREFLEKFPTFYKS

SEQ ID NO: 3006265 - protein, 18 aa, Entamoeba invadens
LFSLKTLDVLFKPSVHVS

SEQ ID NO: 3006266 - protein, 20 aa, Entamoeba invadens
LFSPQIHKIVFYDVVFINFF

SEQ ID NO: 3006267 - protein, 25 aa, Entamoeba invadens
LFSRHIKVVPLLHGLTEPLQNMNYV

SEQ ID NO: 3006268 - protein, 18 aa, Entamoeba invadens
LFSSKDKFDSGCGWPAFT

SEQ ID NO: 3006269 - protein, 32 aa, Entamoeba invadens
LFSVSDFEIFLVKLNKIKWRMRANPLVPQNIK

SEQ ID NO: 3006270 - protein, 20 aa, Entamoeba invadens
LFSYIVDPKARMPPSQNWYI

SEQ ID NO: 3006271 - protein, 24 aa, Entamoeba invadens
LFTCKPAMDPPSRPLDHTTPLHLV

SEQ ID NO: 3006272 - protein, 29 aa, Entamoeba invadens
LFTDKRKPWTGILLFGPPGTGKSFLAKAV

SEQ ID NO: 3006273 - protein, 19 aa, Entamoeba invadens
LFTEGLLLPNGNALPVLTK

SEQ ID NO: 3006274 - protein, 25 aa, Entamoeba invadens
LFTHSKLWKLYFEIAFETNFDAFLF

SEQ ID NO: 3006275 - protein, 28 aa, Entamoeba invadens
LFTHSTIYKRIFWYQVKYKKFKANASEN

SEQ ID NO: 3006276 - protein, 19 aa, Entamoeba invadens
LFTLNAVSQFLLSNYAFFD

SEQ ID NO: 3006277 - protein, 18 aa, Entamoeba invadens
LFTMIMRDSERFSVQRGL

SEQ ID NO: 3006278 - protein, 23 aa, Entamoeba invadens
LFTMRYVYLLIKNTQVTNLAIFE

SEQ ID NO: 3006279 - protein, 27 aa, Entamoeba invadens
LFTNKFIKKYITYARRKQKVVLSQQAQ

SEQ ID NO: 3006280 - protein, 18 aa, Entamoeba invadens
LFTQLSPTLATFLENKDP

SEQ ID NO: 3006281 - protein, 17 aa, Entamoeba invadens
LFTYYPQDYVKNIVEYE

SEQ ID NO: 3006282 - protein, 19 aa, Entamoeba invadens
LFVACMFFTQIVLSKVKII

SEQ ID NO: 3006283 - protein, 19 aa, Entamoeba invadens
LFVDEIWKSVIKKEKYKET

SEQ ID NO: 3006284 - protein, 17 aa, Entamoeba invadens
LFVINNFEKPHALVSMK

SEQ ID NO: 3006285 - protein, 36 aa, Entamoeba invadens
LFVKEYVNLFFSFLDKQLFVYLLRTCPKITQDMVMN

SEQ ID NO: 3006286 - protein, 17 aa, Entamoeba invadens
LFVNKPYTKTILDILRS

SEQ ID NO: 3006287 - protein, 26 aa, Entamoeba invadens
LFVSIQKLFNNLLSTPIELIPEFFYL

SEQ ID NO: 3006288 - protein, 34 aa, Entamoeba invadens
LFYKDENLTKLFAFLKRIIPTITLSPTNFSQTTT

SEQ ID NO: 3006289 - protein, 31 aa, Entamoeba invadens
LGAFLVQHDVILFLRCLLGVDSSFDIMSSVF

SEQ ID NO: 3006290 - protein, 23 aa, Entamoeba invadens
LGAKKQFYLMSNMKMFAKDYGGE

SEQ ID NO: 3006291 - protein, 17 aa, Entamoeba invadens
LGALLKQYKVNSSILFG

SEQ ID NO: 3006292 - protein, 18 aa, Entamoeba invadens
LGALYVLGKLYNEIGRDL

SEQ ID NO: 3006293 - protein, 25 aa, Entamoeba invadens
LGASFEMVYPIYSKIEIFGTSISTD

SEQ ID NO: 3006294 - protein, 17 aa, Entamoeba invadens
LGASQPGLGAKPPGLGQ

SEQ ID NO: 3006295 - protein, 18 aa, Entamoeba invadens
LGAVMVYDVTKKSSFEAL

SEQ ID NO: 3006296 - protein, 17 aa, Entamoeba invadens
LGCLLGVRKNLVKDDKM

SEQ ID NO: 3006297 - protein, 19 aa, Entamoeba invadens
LGCRCFMLCISLSSITLSS

SEQ ID NO: 3006298 - protein, 24 aa, Entamoeba invadens
LGCTRCINGFYYSYNTKTCERCNS

SEQ ID NO: 3006299 - protein, 17 aa, Entamoeba invadens
LGCVILKIKGDADKFAV

SEQ ID NO: 3006300 - protein, 30 aa, Entamoeba invadens
LGDADIFKYKFIFLPLHTSSHFSLIVLCFN

SEQ ID NO: 3006301 - protein, 18 aa, Entamoeba invadens
LGDALILRFAIPSRIMTK

SEQ ID NO: 3006302 - protein, 22 aa, Entamoeba invadens
LGDAMILRFAIPSRKMTKEDLF

SEQ ID NO: 3006303 - protein, 22 aa, Entamoeba invadens
LGDFYDIFRVFHDGELPLKYCL

SEQ ID NO: 3006304 - protein, 25 aa, Entamoeba invadens
LGDHYIKQWIVSAPYMKAAEVTSDM

SEQ ID NO: 3006305 - protein, 29 aa, Entamoeba invadens
LGDKFPLIPQTYYPSWTSMNFNTGFPLVA

SEQ ID NO: 3006306 - protein, 19 aa, Entamoeba invadens
LGDLKIEFCEVVGSGWRPS

SEQ ID NO: 3006307 - protein, 20 aa, Entamoeba invadens
LGDNCFIHNSSNLWFNANDN

SEQ ID NO: 3006308 - protein, 20 aa, Entamoeba invadens
LGDRNLHPPLTFEPEIVSIN

SEQ ID NO: 3006309 - protein, 24 aa, Entamoeba invadens
LGDYNIAFFIYSSLIKYSMSKVGG

SEQ ID NO: 3006310 - protein, 19 aa, Entamoeba invadens
LGEAERLAREALLMKTPDP

SEQ ID NO: 3006311 - protein, 19 aa, Entamoeba invadens
LGECFFGMFVLYSMQGAAA

SEQ ID NO: 3006312 - protein, 26 aa, Entamoeba invadens
LGELPPVYFQVLKALIEFLVKVAARS

SEQ ID NO: 3006313 - protein, 27 aa, Entamoeba invadens
LGENNKNRIIKNVNFKQLGQEIAQNKI

SEQ ID NO: 3006314 - protein, 25 aa, Entamoeba invadens
LGEPYRRLIITPQDYPYHSLSRKIG

SEQ ID NO: 3006315 - protein, 17 aa, Entamoeba invadens
LGESCFMGCISLVSIQL

SEQ ID NO: 3006316 - protein, 20 aa, Entamoeba invadens
LGEVSAGLHYLHFNKRIVHR

SEQ ID NO: 3006317 - protein, 18 aa, Entamoeba invadens
LGEVSSGLHYLHFNKRLV

SEQ ID NO: 3006318 - protein, 29 aa, Entamoeba invadens
LGFFSSKRLEWHYLFIACSYIGARICTLY

SEQ ID NO: 3006319 - protein, 38 aa, Entamoeba invadens
LGFVQCSTLVLFPFKTAALIFIKTLLSLMGPIYQKNIR

SEQ ID NO: 3006320 - protein, 20 aa, Entamoeba invadens
LGGHYFFDFFSIRLEYESVK

SEQ ID NO: 3006321 - protein, 22 aa, Entamoeba invadens
LGGNCKTFIIGTVSPSMSAIRE

SEQ ID NO: 3006322 - protein, 24 aa, Entamoeba invadens
LGHRCFFLCINLAKVVLPKTLKEI

SEQ ID NO: 3006323 - protein, 19 aa, Entamoeba invadens
LGIEPFLSKSKKAISWHLN

SEQ ID NO: 3006324 - protein, 24 aa, Entamoeba invadens
LGIKRELYCLQVHTGDFVGAFETR

SEQ ID NO: 3006325 - protein, 18 aa, Entamoeba invadens
LGINVDTIFKISLSKAYG

SEQ ID NO: 3006326 - protein, 27 aa, Entamoeba invadens
LGIPNNLLTLLFHKLDSGIFDAGDYFQ

SEQ ID NO: 3006327 - protein, 34 aa, Entamoeba invadens
LGITIWEIFYMRRPFEEYFHLFSDDLNTFTKFVD

SEQ ID NO: 3006328 - protein, 25 aa, Entamoeba invadens
LGITQMFNLLQLLLTRIDFNHSKTL

SEQ ID NO: 3006329 - protein, 17 aa, Entamoeba invadens
LGIVIQICQVMLTQTWE

SEQ ID NO: 3006330 - protein, 28 aa, Entamoeba invadens
LGKDVKVFLLRDFFSLILKTASSEPIPV

SEQ ID NO: 3006331 - protein, 18 aa, Entamoeba invadens
LGKDYVIPHTLMKKYIAY

SEQ ID NO: 3006332 - protein, 18 aa, Entamoeba invadens
LGKFGFTSGVKHTLLVGG

SEQ ID NO: 3006333 - protein, 19 aa, Entamoeba invadens
LGKFLIETLIKLGRNNNCH

SEQ ID NO: 3006334 - protein, 29 aa, Entamoeba invadens
LGKGKRLRPLSILAFYKAAGGRMEQDNKY

SEQ ID NO: 3006335 - protein, 24 aa, Entamoeba invadens
LGKLNDIKQNRLRKVFDVDPNVYQ

SEQ ID NO: 3006336 - protein, 24 aa, Entamoeba invadens
LGKNRPILTKRFDLKYLLRDSLSH

SEQ ID NO: 3006337 - protein, 25 aa, Entamoeba invadens
LGKRPFCVSILYQTYPKVIDYMDAE

SEQ ID NO: 3006338 - protein, 19 aa, Entamoeba invadens
LGKTVEILAFILGVSCLKD

SEQ ID NO: 3006339 - protein, 17 aa, Entamoeba invadens
LGKVVNIFLLDYLNVYG

SEQ ID NO: 3006340 - protein, 24 aa, Entamoeba invadens
LGKYIVLNPQMLKINLGKGEVILS

SEQ ID NO: 3006341 - protein, 34 aa, Entamoeba invadens
LGLFDKPMGGVLIYHPFVLHALLKAVHSSLPLQQ

SEQ ID NO: 3006342 - protein, 17 aa, Entamoeba invadens
LGLIRSILSIQAQFHTQ

SEQ ID NO: 3006343 - protein, 17 aa, Entamoeba invadens
LGLMDEISEMTAHLNDL

SEQ ID NO: 3006344 - protein, 17 aa, Entamoeba invadens
LGLMRFEKLGAICRKTF

SEQ ID NO: 3006345 - protein, 25 aa, Entamoeba invadens
LGMLKEYRTLVNYFPIRGEHFCSGT

SEQ ID NO: 3006346 - protein, 18 aa, Entamoeba invadens
LGMLVIYLQCLDKPLFGD

SEQ ID NO: 3006347 - protein, 24 aa, Entamoeba invadens
LGMTMWELFYCKNLLTEFMKKTKE

SEQ ID NO: 3006348 - protein, 24 aa, Entamoeba invadens
LGNDKLICIWGKDGKLEKKIERTD

SEQ ID NO: 3006349 - protein, 23 aa, Entamoeba invadens
LGNIMQMIGLNHPMFQGGNIEKK

SEQ ID NO: 3006350 - protein, 24 aa, Entamoeba invadens
LGNKVNIDIALPSKIVLIGSLTKN

SEQ ID NO: 3006351 - protein, 23 aa, Entamoeba invadens
LGNNIFQFINLTSLVIVRNMDNM

SEQ ID NO: 3006352 - protein, 23 aa, Entamoeba invadens
LGNRWTEISKFLPGRAANTVKNR

SEQ ID NO: 3006353 - protein, 17 aa, Entamoeba invadens
LGNYVFCLCHSLNSIRI

SEQ ID NO: 3006354 - protein, 29 aa, Entamoeba invadens
LGPNFSILPQFMYHLRRSHFLQVFNCSPD

SEQ ID NO: 3006355 - protein, 26 aa, Entamoeba invadens
LGPSDGFIFIIGCNSLRYLYLNESEI

SEQ ID NO: 3006356 - protein, 21 aa, Entamoeba invadens
LGQEDLFVQPIGATTPKGTIV

SEQ ID NO: 3006357 - protein, 17 aa, Entamoeba invadens
LGQIRQYSSKNYLPKMS

SEQ ID NO: 3006358 - protein, 32 aa, Entamoeba invadens
LGQKKFQDQAVWMLNALWLKEKDAHAEEIWNF

SEQ ID NO: 3006359 - protein, 24 aa, Entamoeba invadens
LGQNEIQALFPFYNVLLGASELNI

SEQ ID NO: 3006360 - protein, 37 aa, Entamoeba invadens
LGQNNYMFTEISNIPLILYFISSDLYTQFLTYKSVQG

SEQ ID NO: 3006361 - protein, 48 aa, Entamoeba invadens
LGQNNYMFTEISNIPLILYIISSDLYTQFLTYKSVQGTLLMSGNYLKT

SEQ ID NO: 3006362 - protein, 24 aa, Entamoeba invadens
LGQSSKYFVAFKSIVDWANDLLDY

SEQ ID NO: 3006363 - protein, 29 aa, Entamoeba invadens
LGRACPEHLIRIPILGSFACGKTSLRWCY

SEQ ID NO: 3006364 - protein, 20 aa, Entamoeba invadens
LGRKFIPDRLKIIIQLFVTA

SEQ ID NO: 3006365 - protein, 25 aa, Entamoeba invadens
LGRNHKGRFIPITNMCFFGKADRAQ

SEQ ID NO: 3006366 - protein, 19 aa, Entamoeba invadens
LGRQNIGIIIITETGYSFG

SEQ ID NO: 3006367 - protein, 25 aa, Entamoeba invadens
LGRVKRMFVSLKEASRLLHEAGNVF

SEQ ID NO: 3006368 - protein, 25 aa, Entamoeba invadens
LGSCLKPRLPQPPTVKVITQHVPKI

SEQ ID NO: 3006369 - protein, 17 aa, Entamoeba invadens
LGSEAFIVYRRTVLEMP

SEQ ID NO: 3006370 - protein, 18 aa, Entamoeba invadens
LGSFIRTVISKRTNLINK

SEQ ID NO: 3006371 - protein, 18 aa, Entamoeba invadens
LGSKRNSILFAFGKGDLV

SEQ ID NO: 3006372 - protein, 21 aa, Entamoeba invadens
LGSLLLGKLRDEYYGKVITTF

SEQ ID NO: 3006373 - protein, 25 aa, Entamoeba invadens
LGSRNVIFPKYAFLMSPQPICPIQL

SEQ ID NO: 3006374 - protein, 20 aa, Entamoeba invadens
LGTQFYHKKLVGTLTVFNEN

SEQ ID NO: 3006375 - protein, 19 aa, Entamoeba invadens
LGTTFSAAFVFDEVRQEAK

SEQ ID NO: 3006376 - protein, 24 aa, Entamoeba invadens
LGTTKYCSHFLRGKQCINPECTYL

SEQ ID NO: 3006377 - protein, 23 aa, Entamoeba invadens
LGTVFLVSYLYTEGTVIAELVLQ

SEQ ID NO: 3006378 - protein, 25 aa, Entamoeba invadens
LGTVIKFDANLFKRPSLKGDALSAS

SEQ ID NO: 3006379 - protein, 20 aa, Entamoeba invadens
LGTYALFYHREGTEGRMHVY

SEQ ID NO: 3006380 - protein, 26 aa, Entamoeba invadens
LGVDHHRFFRDVLIQMTDLTTRSLRS

SEQ ID NO: 3006381 - protein, 20 aa, Entamoeba invadens
LGVIAYLAISGNLPFYDDDE

SEQ ID NO: 3006382 - protein, 25 aa, Entamoeba invadens
LGVISSLHYLKFLKELEPITVETYQ

SEQ ID NO: 3006383 - protein, 24 aa, Entamoeba invadens
LGVRNIWHAMLMPLNNDIPEGVIR

SEQ ID NO: 3006384 - protein, 33 aa, Entamoeba invadens
LGVVMQNKYLILYLYNHQIKIISLPQGDEELLS

SEQ ID NO: 3006385 - protein, 19 aa, Entamoeba invadens
LGWSCRQLHGIIFGTEGEL

SEQ ID NO: 3006386 - protein, 18 aa, Entamoeba invadens
LGYIKKYLQVKITNLEAN

SEQ ID NO: 3006387 - protein, 18 aa, Entamoeba invadens
LGYKLYPTSTYANALQEI

SEQ ID NO: 3006388 - protein, 20 aa, Entamoeba invadens
LGYLSVNQLKNHPWFEGINW

SEQ ID NO: 3006389 - protein, 28 aa, Entamoeba invadens
LGYPNRIIYNEFLKRYFFLGTNINKKTS

SEQ ID NO: 3006390 - protein, 17 aa, Entamoeba invadens
LGYQCESALWINSYNTA

SEQ ID NO: 3006391 - protein, 19 aa, Entamoeba invadens
LGYTILHYASFTNSLEVLD

SEQ ID NO: 3006392 - protein, 20 aa, Entamoeba invadens
LGYWIDRVRSVEPDVFIMVV

SEQ ID NO: 3006393 - protein, 28 aa, Entamoeba invadens
LHAISHFTFIIIYDKKTIYIIEPDALKI

SEQ ID NO: 3006394 - protein, 18 aa, Entamoeba invadens
LHARRFLHRDLKPQNILL

SEQ ID NO: 3006395 - protein, 23 aa, Entamoeba invadens
LHCEKSVLHYVNTNILTSIDYEM

SEQ ID NO: 3006396 - protein, 24 aa, Entamoeba invadens
LHCVAKYYWNIFNEFFFDSKMNVK

SEQ ID NO: 3006397 - protein, 25 aa, Entamoeba invadens
LHDDDTIFLLQLMAPLQSVDFVVLM

SEQ ID NO: 3006398 - protein, 21 aa, Entamoeba invadens
LHDFLDFNYSSDLSKDSLVRN

SEQ ID NO: 3006399 - protein, 30 aa, Entamoeba invadens
LHEEVYSLLISTLFDLHLVLLPNAQETAMV

SEQ ID NO: 3006400 - protein, 20 aa, Entamoeba invadens
LHEILSPKIVVIPVNITPKT

SEQ ID NO: 3006401 - protein, 24 aa, Entamoeba invadens
LHEKEDDIVDLEKHVKMLQNTISD

SEQ ID NO: 3006402 - protein, 58 aa, Entamoeba invadens
LHELDKCEYLGLYYNTFHQWTGMTAPRVIFECRNLKNLDIFHLNNAICGKENIMIVIV

SEQ ID NO: 3006403 - protein, 18 aa, Entamoeba invadens
LHELMKAKVPYFDEFVLF

SEQ ID NO: 3006404 - protein, 26 aa, Entamoeba invadens
LHELSKKIPCYWGRILNISDLNYNNL

SEQ ID NO: 3006405 - protein, 18 aa, Entamoeba invadens
LHENGILHRDIKPDNFLI

SEQ ID NO: 3006406 - protein, 18 aa, Entamoeba invadens
LHENGILHRDIKPDNILV

SEQ ID NO: 3006407 - protein, 18 aa, Entamoeba invadens
LHENIKVLKKHLYALDQL

SEQ ID NO: 3006408 - protein, 30 aa, Entamoeba invadens
LHESELWNLEPQKKYFLVRGNSAIVAFHTN

SEQ ID NO: 3006409 - protein, 19 aa, Entamoeba invadens
LHFKAAYIALHNFYEKSVP

SEQ ID NO: 3006410 - protein, 18 aa, Entamoeba invadens
LHFPLIVKKDKTGNHNTN

SEQ ID NO: 3006411 - protein, 20 aa, Entamoeba invadens
LHFSGVKWIFWDVCGQQKFR

SEQ ID NO: 3006412 - protein, 18 aa, Entamoeba invadens
LHGQFYDLLRIFETVQYP

SEQ ID NO: 3006413 - protein, 19 aa, Entamoeba invadens
LHGWAFTLDKFAKMWSEKF

SEQ ID NO: 3006414 - protein, 20 aa, Entamoeba invadens
LHHKEIVLVLSKIDRLIVEL

SEQ ID NO: 3006415 - protein, 17 aa, Entamoeba invadens
LHHLGIKCSNLIFNNRH

SEQ ID NO: 3006416 - protein, 19 aa, Entamoeba invadens
LHHLSTLADFLLRRALRNK

SEQ ID NO: 3006417 - protein, 28 aa, Entamoeba invadens
LHHNMELAPVKLPKVFRILEDYITKNIT

SEQ ID NO: 3006418 - protein, 25 aa, Entamoeba invadens
LHHTYNALLSFFKTPSNFFSSQPSI

SEQ ID NO: 3006419 - protein, 20 aa, Entamoeba invadens
LHHVWMLHRDLKSLNVLLKM

SEQ ID NO: 3006420 - protein, 26 aa, Entamoeba invadens
LHICAKTMNVLPLKSYFISKFEQFLK

SEQ ID NO: 3006421 - protein, 19 aa, Entamoeba invadens
LHIIKTVFGLLRQIGWDDG

SEQ ID NO: 3006422 - protein, 27 aa, Entamoeba invadens
LHINKSLPRVSSPSPIPLTLSEDQKTI

SEQ ID NO: 3006423 - protein, 25 aa, Entamoeba invadens
LHIPIDCTIQSKTWYFVFLHFEQKI

SEQ ID NO: 3006424 - protein, 24 aa, Entamoeba invadens
LHKCMRILPFLQNTGGFFCALFEK

SEQ ID NO: 3006425 - protein, 20 aa, Entamoeba invadens
LHKFEVFLSGLYCLLTDEPT

SEQ ID NO: 3006426 - protein, 24 aa, Entamoeba invadens
LHKGFPEGLFTYLTRNTLDDKTKG

SEQ ID NO: 3006427 - protein, 18 aa, Entamoeba invadens
LHKLDNSDVLLICTTTAK

SEQ ID NO: 3006428 - protein, 18 aa, Entamoeba invadens
LHKTKYIKQVTAPVGIVV

SEQ ID NO: 3006429 - protein, 26 aa, Entamoeba invadens
LHLENGPIYVTPISKELFAVVVGTKQ

SEQ ID NO: 3006430 - protein, 18 aa, Entamoeba invadens
LHLKGLSVVLDRLYLFVL

SEQ ID NO: 3006431 - protein, 17 aa, Entamoeba invadens
LHLKLKCSIVPTAFCKE

SEQ ID NO: 3006432 - protein, 17 aa, Entamoeba invadens
LHLLDCYNDYVLENDED

SEQ ID NO: 3006433 - protein, 18 aa, Entamoeba invadens
LHLNKRSGKPRLSRSIKA

SEQ ID NO: 3006434 - protein, 17 aa, Entamoeba invadens
LHLSAVCLLRPTSANME

SEQ ID NO: 3006435 - protein, 18 aa, Entamoeba invadens
LHMYRLTQQFIVDAFLRI

SEQ ID NO: 3006436 - protein, 20 aa, Entamoeba invadens
LHNCAPFISKLYTLVNAPEY

SEQ ID NO: 3006437 - protein, 24 aa, Entamoeba invadens
LHNEDLHVLRLLPYDSIGEVDEQI

SEQ ID NO: 3006438 - protein, 23 aa, Entamoeba invadens
LHNKFFEQFIQTYLLDNDDFVVS

SEQ ID NO: 3006439 - protein, 25 aa, Entamoeba invadens
LHNKSPFTVFLKYANTTLKMEHGFS

SEQ ID NO: 3006440 - protein, 24 aa, Entamoeba invadens
LHNLALIIINVFNKGAKTSKICDF

SEQ ID NO: 3006441 - protein, 18 aa, Entamoeba invadens
LHNNGILHRDIKPANLLI

SEQ ID NO: 3006442 - protein, 25 aa, Entamoeba invadens
LHNSREYEWFVQRLGWIVKVSDASY

SEQ ID NO: 3006443 - protein, 26 aa, Entamoeba invadens
LHPATFLDQVIPLVQALFSVVTGLQQ

SEQ ID NO: 3006444 - protein, 33 aa, Entamoeba invadens
LHPNGYLLPQPQAYAPLIIPKEIWRLCDFVRPH

SEQ ID NO: 3006445 - protein, 20 aa, Entamoeba invadens
LHPPKFEMDYTKYNKDDVSL

SEQ ID NO: 3006446 - protein, 34 aa, Entamoeba invadens
LHPPLTCIPDTFILPLNQIQRILIATDGISVLQE

SEQ ID NO: 3006447 - protein, 18 aa, Entamoeba invadens
LHPPLTFEPEIVSINVKK

SEQ ID NO: 3006448 - protein, 27 aa, Entamoeba invadens
LHQANFFFHFFAFVRKLNKQEHMEVFK

SEQ ID NO: 3006449 - protein, 28 aa, Entamoeba invadens
LHQKYSTSLPPFIPRNIKGFGLYMKAKH

SEQ ID NO: 3006450 - protein, 37 aa, Entamoeba invadens
LHQYYGDLALLRDYRPWYYRTTFRSPLRKLFDICVLR

SEQ ID NO: 3006451 - protein, 19 aa, Entamoeba invadens
LHRDIKLDNLLVFSKNPND

SEQ ID NO: 3006452 - protein, 24 aa, Entamoeba invadens
LHRDIKPDNFLIFSLDPNEKVNAK

SEQ ID NO: 3006453 - protein, 24 aa, Entamoeba invadens
LHRDIKPDNLLIFGIDINEMVNAK

SEQ ID NO: 3006454 - protein, 24 aa, Entamoeba invadens
LHRDIKPDYILVFSLDLNDKVNAK

SEQ ID NO: 3006455 - protein, 19 aa, Entamoeba invadens
LHSIKIIHHDIKAGNILLS

SEQ ID NO: 3006456 - protein, 18 aa, Entamoeba invadens
LHSLDIIYRDLKPENILL

SEQ ID NO: 3006457 - protein, 17 aa, Entamoeba invadens
LHTDKIVMRIVELLLSK

SEQ ID NO: 3006458 - protein, 24 aa, Entamoeba invadens
LHTFDIPNFTVLLNALHRLGVVLS

SEQ ID NO: 3006459 - protein, 18 aa, Entamoeba invadens
LHTIKSHTWNIFNTSAIT

SEQ ID NO: 3006460 - protein, 23 aa, Entamoeba invadens
LHTKTFGLYLTRALVNIRRHTET

SEQ ID NO: 3006461 - protein, 18 aa, Entamoeba invadens
LHTSYPFLPELKSPEKAS

SEQ ID NO: 3006462 - protein, 24 aa, Entamoeba invadens
LHTTPNVLIIQLIKDYPTKADKLK

SEQ ID NO: 3006463 - protein, 19 aa, Entamoeba invadens
LHTTSLLHHTYNALLSFFK

SEQ ID NO: 3006464 - protein, 64 aa, Entamoeba invadens
LHVCAKAISQRKLIEWKLDEQIVIIVIQDTIHIWYHFRNWVWFRLFQKVRPILKKRRVDEEFAA

SEQ ID NO: 3006465 - protein, 28 aa, Entamoeba invadens
LHVVYNTIWEHYFMLFCFERGFEEAMNV

SEQ ID NO: 3006466 - protein, 27 aa, Entamoeba invadens
LHWATYNYQVDLLSLLLLYGANVHAEN

SEQ ID NO: 3006467 - protein, 17 aa, Entamoeba invadens
LHYASFTNSLEVLDKLE

SEQ ID NO: 3006468 - protein, 19 aa, Entamoeba invadens
LHYDGIIMTDWYACKDTVK

SEQ ID NO: 3006469 - protein, 34 aa, Entamoeba invadens
LHYNESVAPILLNDLRFFTALKYLAINKYEEETQ

SEQ ID NO: 3006470 - protein, 19 aa, Entamoeba invadens
LIAALPDSNRHVLWYFCDF

SEQ ID NO: 3006471 - protein, 19 aa, Entamoeba invadens
LIAAPRRTLRKSQHSASKS

SEQ ID NO: 3006472 - protein, 18 aa, Entamoeba invadens
LIAAVRKRKALPEGVPGL

SEQ ID NO: 3006473 - protein, 34 aa, Entamoeba invadens
LIACQGVLFKISLGNFFLFEKDGVEYQVSINNNI

SEQ ID NO: 3006474 - protein, 24 aa, Entamoeba invadens
LIAEDFIIRLFEDSSLCAFHAKRI

SEQ ID NO: 3006475 - protein, 18 aa, Entamoeba invadens
LIALFKKANNKSHEIFLY

SEQ ID NO: 3006476 - protein, 21 aa, Entamoeba invadens
LIALKDFFNQQVPLVLDRFHA

SEQ ID NO: 3006477 - protein, 19 aa, Entamoeba invadens
LIANSEFFEYFNSFGNIKN

SEQ ID NO: 3006478 - protein, 19 aa, Entamoeba invadens
LIANSEFLEFFKSFGNIES

SEQ ID NO: 3006479 - protein, 17 aa, Entamoeba invadens
LIASYRFLDDNTFRFYF

SEQ ID NO: 3006480 - protein, 20 aa, Entamoeba invadens
LICEEILMKTLSPYSQYNRR

SEQ ID NO: 3006481 - protein, 18 aa, Entamoeba invadens
LICNSMLKLFAKKNLNIF

SEQ ID NO: 3006482 - protein, 35 aa, Entamoeba invadens
LICVTEYGAIFRKGGVGLVVKWTCEMKEAVMYRVN

SEQ ID NO: 3006483 - protein, 20 aa, Entamoeba invadens
LIDAFAGVGPFAIPAALKGV

SEQ ID NO: 3006484 - protein, 20 aa, Entamoeba invadens
LIDCEMKNFWCSAHRVNLMG

SEQ ID NO: 3006485 - protein, 19 aa, Entamoeba invadens
LIDDHKWMHTKARRLRITS

SEQ ID NO: 3006486 - protein, 20 aa, Entamoeba invadens
LIDEIRKYFLKLQPKNTKDS

SEQ ID NO: 3006487 - protein, 17 aa, Entamoeba invadens
LIDFQLKAFQLPAELLT

SEQ ID NO: 3006488 - protein, 26 aa, Entamoeba invadens
LIDGIPVFLHRFRIKFVECARFVESL

SEQ ID NO: 3006489 - protein, 23 aa, Entamoeba invadens
LIDGKTVNMFWSLKDFKQRTETQ

SEQ ID NO: 3006490 - protein, 19 aa, Entamoeba invadens
LIDIGLLNLKIIDSFDVSV

SEQ ID NO: 3006491 - protein, 18 aa, Entamoeba invadens
LIDILRNVKRFKNWVLSR

SEQ ID NO: 3006492 - protein, 18 aa, Entamoeba invadens
LIDLPPNAPFPALVNEPF

SEQ ID NO: 3006493 - protein, 24 aa, Entamoeba invadens
LIDPSLSIKPHTCYKFAVFNLGCN

SEQ ID NO: 3006494 - protein, 23 aa, Entamoeba invadens
LIDSEMKNFWCAAHRVNLMGESL

SEQ ID NO: 3006495 - protein, 18 aa, Entamoeba invadens
LIDSNTLRFYNPSGRFVI

SEQ ID NO: 3006496 - protein, 22 aa, Entamoeba invadens
LIDYNGFFIRTKFRCGMWERVE

SEQ ID NO: 3006497 - protein, 27 aa, Entamoeba invadens
LIDYSQGRGFFLKLPTRNNPIVLEGIG

SEQ ID NO: 3006498 - protein, 23 aa, Entamoeba invadens
LIEADLVVFAYPVQWQSIPGDLK

SEQ ID NO: 3006499 - protein, 18 aa, Entamoeba invadens
LIEEVRIAPWTSMNVLAK

SEQ ID NO: 3006500 - protein, 26 aa, Entamoeba invadens
LIEFNKFIAIPISELYFWDSSQRENS

SEQ ID NO: 3006501 - protein, 17 aa, Entamoeba invadens
LIEFTLAPIYKIDNEVP

SEQ ID NO: 3006502 - protein, 23 aa, Entamoeba invadens
LIEGGIPFLSLSDLTGMPVKRIT

SEQ ID NO: 3006503 - protein, 18 aa, Entamoeba invadens
LIEGLDLIYQKPILEFFL

SEQ ID NO: 3006504 - protein, 19 aa, Entamoeba invadens
LIEKLLLYQSIKHVEITYK

SEQ ID NO: 3006505 - protein, 19 aa, Entamoeba invadens
LIEMACNCWGFDNTTFEND

SEQ ID NO: 3006506 - protein, 18 aa, Entamoeba invadens
LIEMGFPRDDAIKALKKA

SEQ ID NO: 3006507 - protein, 26 aa, Entamoeba invadens
LIENIQRKWILYPVTYEQFITNNDSN

SEQ ID NO: 3006508 - protein, 19 aa, Entamoeba invadens
LIENLVMLNNNLKARQQEV

SEQ ID NO: 3006509 - protein, 26 aa, Entamoeba invadens
LIEPCNLIKYHPLANYIKTGNDGRCA

SEQ ID NO: 3006510 - protein, 27 aa, Entamoeba invadens
LIEPEKYFWMKKLFMDCPHILVQNDVV

SEQ ID NO: 3006511 - protein, 17 aa, Entamoeba invadens
LIEQIKKSPYQKVFGVV

SEQ ID NO: 3006512 - protein, 23 aa, Entamoeba invadens
LIETFKDYFEVMKTVWGMEGNDK

SEQ ID NO: 3006513 - protein, 17 aa, Entamoeba invadens
LIFDFEFGTFDMSLIAI

SEQ ID NO: 3006514 - protein, 20 aa, Entamoeba invadens
LIFDFLSKIFVFEADKRMSP

SEQ ID NO: 3006515 - protein, 26 aa, Entamoeba invadens
LIFFENLETLILWPQNNFLAFKHLTP

SEQ ID NO: 3006516 - protein, 17 aa, Entamoeba invadens
LIFSTIFNTKFCTNYPF

SEQ ID NO: 3006517 - protein, 17 aa, Entamoeba invadens
LIGETISTQLKLLDGSE

SEQ ID NO: 3006518 - protein, 19 aa, Entamoeba invadens
LIGILGMICSFHLFVTSHV

SEQ ID NO: 3006519 - protein, 31 aa, Entamoeba invadens
LIGLKNFLIEDIAIFFDAPCACGKINEVKEL

SEQ ID NO: 3006520 - protein, 19 aa, Entamoeba invadens
LIGLKYLHDAGIVYRDLKP

SEQ ID NO: 3006521 - protein, 29 aa, Entamoeba invadens
LIGLRSKGFLSLDKVLPVLLEMLCTKDKN

SEQ ID NO: 3006522 - protein, 26 aa, Entamoeba invadens
LIGNKAFLHCNLLTQIVFGHSLQEIG

SEQ ID NO: 3006523 - protein, 38 aa, Entamoeba invadens
LIGQMCEFGLLKKYLISLFPEANYFDDVYPSVIAVFGG

SEQ ID NO: 3006524 - protein, 19 aa, Entamoeba invadens
LIGSPKFFDKHIGYMAFTL

SEQ ID NO: 3006525 - protein, 18 aa, Entamoeba invadens
LIHRDIKPANFLLDENFL

SEQ ID NO: 3006526 - protein, 23 aa, Entamoeba invadens
LIHSFMGLLFSDKVIPFQEELII

SEQ ID NO: 3006527 - protein, 19 aa, Entamoeba invadens
LIHTLLAEAKYPQFTALKV

SEQ ID NO: 3006528 - protein, 25 aa, Entamoeba invadens
LIIDAQIIALIDLTALPNLRRLEIK

SEQ ID NO: 3006529 - protein, 20 aa, Entamoeba invadens
LIIDTNVLLRNQASQLFKKA

SEQ ID NO: 3006530 - protein, 17 aa, Entamoeba invadens
LIIFHTLCSSDIKELVR

SEQ ID NO: 3006531 - protein, 26 aa, Entamoeba invadens
LIIGDKKPFFISLPCKRNISMEQYPD

SEQ ID NO: 3006532 - protein, 24 aa, Entamoeba invadens
LIIKPKEIIPYSFPCVHGKKMMEG

SEQ ID NO: 3006533 - protein, 18 aa, Entamoeba invadens
LIILSACFKDLYPYLLVQ

SEQ ID NO: 3006534 - protein, 17 aa, Entamoeba invadens
LIIPPRVKSLGDTCFCN

SEQ ID NO: 3006535 - protein, 24 aa, Entamoeba invadens
LIIPTTVRIIQKNSLPPGLTRLVI

SEQ ID NO: 3006536 - protein, 20 aa, Entamoeba invadens
LIISSLLRKASIPMKHSAVA

SEQ ID NO: 3006537 - protein, 22 aa, Entamoeba invadens
LIIVTRKRYIYMYTTDGNLVDK

SEQ ID NO: 3006538 - protein, 24 aa, Entamoeba invadens
LIKDMCLMVNMVVKYRGTMFRAIV

SEQ ID NO: 3006539 - protein, 19 aa, Entamoeba invadens
LIKDVILNMLVPKLLYGLQ

SEQ ID NO: 3006540 - protein, 34 aa, Entamoeba invadens
LIKEYDIYFDITLQIVIYFLQIAGIDINVTFNSD

SEQ ID NO: 3006541 - protein, 21 aa, Entamoeba invadens
LIKEYFPQLSQYSRFVSTGLF

SEQ ID NO: 3006542 - protein, 19 aa, Entamoeba invadens
LIKFGKGVTILFVGDKDCG

SEQ ID NO: 3006543 - protein, 24 aa, Entamoeba invadens
LIKFKGACDILFRSARRRLKSENS

SEQ ID NO: 3006544 - protein, 26 aa, Entamoeba invadens
LIKKEAALLYGLIHARYILTSSGLKK

SEQ ID NO: 3006545 - protein, 26 aa, Entamoeba invadens
LIKKLYNETLLQDLLAENPALVNERK

SEQ ID NO: 3006546 - protein, 34 aa, Entamoeba invadens
LIKKTVVDLIYFWFFQAFSKLLNKLKIKTLKTYF

SEQ ID NO: 3006547 - protein, 20 aa, Entamoeba invadens
LIKMILIGDSGVGKSCLMNQ

SEQ ID NO: 3006548 - protein, 25 aa, Entamoeba invadens
LIKQTFPRLFLFDDMFNYVKEEDGV

SEQ ID NO: 3006549 - protein, 28 aa, Entamoeba invadens
LIKRGYACEFSLCLTPLCTCKINTTIQI

SEQ ID NO: 3006550 - protein, 21 aa, Entamoeba invadens
LIKRYILNEFIDIYDPIIVDT

SEQ ID NO: 3006551 - protein, 29 aa, Entamoeba invadens
LIKSCEGYFKNWIQLTTYKINFDTNKGVE

SEQ ID NO: 3006552 - protein, 17 aa, Entamoeba invadens
LIKTCFPQHSLSSIDIS

SEQ ID NO: 3006553 - protein, 22 aa, Entamoeba invadens
LIKTENLFIDQPKIIQTNKFIP

SEQ ID NO: 3006554 - protein, 19 aa, Entamoeba invadens
LIKTIFRTMPSEKFPGVAA

SEQ ID NO: 3006555 - protein, 34 aa, Entamoeba invadens
LIKYGSFNTLQFGPIILFLLSDTILIGMTKTKVK

SEQ ID NO: 3006556 - protein, 17 aa, Entamoeba invadens
LILACDGIWDVLTSEQC

SEQ ID NO: 3006557 - protein, 17 aa, Entamoeba invadens
LILALESEFIIWKRVRK

SEQ ID NO: 3006558 - protein, 22 aa, Entamoeba invadens
LILSSLEWYITPAVDPKMLIDY

SEQ ID NO: 3006559 - protein, 19 aa, Entamoeba invadens
LILTDPYIALHNYGLDNAK

SEQ ID NO: 3006560 - protein, 17 aa, Entamoeba invadens
LILVNGEKYCRYKTVRK

SEQ ID NO: 3006561 - protein, 19 aa, Entamoeba invadens
LIMDGQLLKYATLEALIDY

SEQ ID NO: 3006562 - protein, 18 aa, Entamoeba invadens
LINFPSLKERIVGALGGL

SEQ ID NO: 3006563 - protein, 26 aa, Entamoeba invadens
LINITEFLPIDFTYTKHLKLFDVYQF

SEQ ID NO: 3006564 - protein, 18 aa, Entamoeba invadens
LINKCEKVAIVTSGCYQC

SEQ ID NO: 3006565 - protein, 25 aa, Entamoeba invadens
LINKQKLSLLLDLDSTIIFTDQTHL

SEQ ID NO: 3006566 - protein, 42 aa, Entamoeba invadens
LINLCEKMMEILSKLLPLVSIGRCVILVYKSLYEVHSSKCIT

SEQ ID NO: 3006567 - protein, 25 aa, Entamoeba invadens
LINLCKEMMEILSKLLPIDNIGRHV

SEQ ID NO: 3006568 - protein, 22 aa, Entamoeba invadens
LINLKFFDHVHWQLDVCWDSPA

SEQ ID NO: 3006569 - protein, 19 aa, Entamoeba invadens
LINMMINYVGFDNFMNGIS

SEQ ID NO: 3006570 - protein, 23 aa, Entamoeba invadens
LINNDPVLPLFLANSISSKDKTI

SEQ ID NO: 3006571 - protein, 19 aa, Entamoeba invadens
LINSKIMCGILEGVKREIF

SEQ ID NO: 3006572 - protein, 17 aa, Entamoeba invadens
LINTRFNITLRIPNKRA

SEQ ID NO: 3006573 - protein, 31 aa, Entamoeba invadens
LINVAIEYGWFFFSIITKSLVLYLEENKIYD

SEQ ID NO: 3006574 - protein, 28 aa, Entamoeba invadens
LIPEVTILEIPYSLLFTFRVPESVQEIH

SEQ ID NO: 3006575 - protein, 17 aa, Entamoeba invadens
LIPIYKGKTFKLKVTCF

SEQ ID NO: 3006576 - protein, 17 aa, Entamoeba invadens
LIPLLSESLVSSPLPKE

SEQ ID NO: 3006577 - protein, 17 aa, Entamoeba invadens
LIPNGFVPTESPLLENR

SEQ ID NO: 3006578 - protein, 23 aa, Entamoeba invadens
LIPVYEVPKFELSDGSSFIICLC

SEQ ID NO: 3006579 - protein, 18 aa, Entamoeba invadens
LIQMYNTYFLFNRNVIQT

SEQ ID NO: 3006580 - protein, 30 aa, Entamoeba invadens
LIQSDEYFKYLLNPLLPVILKTVSSSNEEL

SEQ ID NO: 3006581 - protein, 18 aa, Entamoeba invadens
LIQSFRHINIMSIIGVVP

SEQ ID NO: 3006582 - protein, 26 aa, Entamoeba invadens
LIQSVQSLSLFLFVACCHPTAEIRQK

SEQ ID NO: 3006583 - protein, 28 aa, Entamoeba invadens
LIQVCKKFVFLLDRFRINPIRITQHTVK

SEQ ID NO: 3006584 - protein, 20 aa, Entamoeba invadens
LIRDQIPQCPLNQLTNLQLF

SEQ ID NO: 3006585 - protein, 39 aa, Entamoeba invadens
LIREDFVNCIKVILQQRASFKMCTFFGIIMPECQFISMQ

SEQ ID NO: 3006586 - protein, 19 aa, Entamoeba invadens
LIREFVSCIYMTEFYKTLV

SEQ ID NO: 3006587 - protein, 18 aa, Entamoeba invadens
LIRFCPQGTPLDKDVVCT

SEQ ID NO: 3006588 - protein, 19 aa, Entamoeba invadens
LIRHFQVNGLPPTTIYLFL

SEQ ID NO: 3006589 - protein, 22 aa, Entamoeba invadens
LIRIDGLFELIPNKVYQFRGYD

SEQ ID NO: 3006590 - protein, 34 aa, Entamoeba invadens
LIRKPLTFEVLNPKLQPWWIVRTCLTDQEGKVRY

SEQ ID NO: 3006591 - protein, 18 aa, Entamoeba invadens
LIRKVILLYCKDFEMCEL

SEQ ID NO: 3006592 - protein, 17 aa, Entamoeba invadens
LIRLCNTLLPGDPVEDI

SEQ ID NO: 3006593 - protein, 18 aa, Entamoeba invadens
LIRLIKRFTVSKKRTVIL

SEQ ID NO: 3006594 - protein, 26 aa, Entamoeba invadens
LIRNAFYHIILYRTLFVKQSHIISAR

SEQ ID NO: 3006595 - protein, 19 aa, Entamoeba invadens
LIRPFHCFSLAESETKGLV

SEQ ID NO: 3006596 - protein, 17 aa, Entamoeba invadens
LIRSPNLKILFKKELLT

SEQ ID NO: 3006597 - protein, 26 aa, Entamoeba invadens
LIRVCGKVGFCGYLVKFDLENFYYLQ

SEQ ID NO: 3006598 - protein, 18 aa, Entamoeba invadens
LIRVCGNVGFCGYYVEFD

SEQ ID NO: 3006599 - protein, 26 aa, Entamoeba invadens
LISADVKVLYYLTAHLFEGCIKLTNL

SEQ ID NO: 3006600 - protein, 21 aa, Entamoeba invadens
LISDFTFKTWTFYITRTEAES

SEQ ID NO: 3006601 - protein, 18 aa, Entamoeba invadens
LISDKFFNKVIGTLPKQS

SEQ ID NO: 3006602 - protein, 20 aa, Entamoeba invadens
LISFGLVDNPNYTNKCCIGK

SEQ ID NO: 3006603 - protein, 18 aa, Entamoeba invadens
LISIIIPSSVISIGDGCF

SEQ ID NO: 3006604 - protein, 17 aa, Entamoeba invadens
LISIKRPTFSGDLKKEG

SEQ ID NO: 3006605 - protein, 20 aa, Entamoeba invadens
LISLTNHVKSVLRLALKEIN

SEQ ID NO: 3006606 - protein, 21 aa, Entamoeba invadens
LISNQIFRNLMKYIYDRGNFV

SEQ ID NO: 3006607 - protein, 26 aa, Entamoeba invadens
LISNTTIISLLKWINDDFVPTMDRIG

SEQ ID NO: 3006608 - protein, 25 aa, Entamoeba invadens
LISPYILNFIGMVNTPISALTEMAP

SEQ ID NO: 3006609 - protein, 18 aa, Entamoeba invadens
LISQCGTGIYVTENGRGC

SEQ ID NO: 3006610 - protein, 26 aa, Entamoeba invadens
LISSQYFRGIELFELFLWNTSKEKCQ

SEQ ID NO: 3006611 - protein, 19 aa, Entamoeba invadens
LISTEDPEWPIARNAQGVE

SEQ ID NO: 3006612 - protein, 17 aa, Entamoeba invadens
LISYILALITDDVELEI

SEQ ID NO: 3006613 - protein, 20 aa, Entamoeba invadens
LITAFEVGEATFLDWYPDCS

SEQ ID NO: 3006614 - protein, 28 aa, Entamoeba invadens
LITDDEIKYFFFTHKIIDENAIRWSLYE

SEQ ID NO: 3006615 - protein, 18 aa, Entamoeba invadens
LITFLVGNDFLPKIPSLK

SEQ ID NO: 3006616 - protein, 19 aa, Entamoeba invadens
LITFPIIEIVQNAFSKCLN

SEQ ID NO: 3006617 - protein, 19 aa, Entamoeba invadens
LITMVEGMRQTALNVLDLR

SEQ ID NO: 3006618 - protein, 20 aa, Entamoeba invadens
LITNFHLQDLYKHKLIEFIV

SEQ ID NO: 3006619 - protein, 47 aa, Entamoeba invadens
LITPQSFYQLYQLFDKTRSLASLYYNPICYSFILREIAFKGNVNIKH

SEQ ID NO: 3006620 - protein, 47 aa, Entamoeba invadens
LITPQSFYQLYQLFDKTRSLASLYYNPICYSFILREIALKGNVNIKH

SEQ ID NO: 3006621 - protein, 18 aa, Entamoeba invadens
LITQGYTVVFHKPSKTKT

SEQ ID NO: 3006622 - protein, 25 aa, Entamoeba invadens
LITTHKFKIVVFTGSIAPGIPSNIF

SEQ ID NO: 3006623 - protein, 19 aa, Entamoeba invadens
LIVEWFSKFGLQVKNFDKD

SEQ ID NO: 3006624 - protein, 19 aa, Entamoeba invadens
LIVPPVTMMDFLKSIRNSR

SEQ ID NO: 3006625 - protein, 23 aa, Entamoeba invadens
LIVSFMTTFLDKTKLHISHTAIN

SEQ ID NO: 3006626 - protein, 34 aa, Entamoeba invadens
LIVSLFKVTPTELFFKHFMALIRKIVTENAEYLF

SEQ ID NO: 3006627 - protein, 17 aa, Entamoeba invadens
LIVSRFFEYDSDFINIT

SEQ ID NO: 3006628 - protein, 17 aa, Entamoeba invadens
LIVSRFLMSAQDYINVI

SEQ ID NO: 3006629 - protein, 19 aa, Entamoeba invadens
LIVVGGLFPSIDYYAVFDG

SEQ ID NO: 3006630 - protein, 19 aa, Entamoeba invadens
LIYGFFLKEDVTEARQVGD

SEQ ID NO: 3006631 - protein, 32 aa, Entamoeba invadens
LIYITQPMVNVIQILDFSLAVVKTVIVRYGAN

SEQ ID NO: 3006632 - protein, 18 aa, Entamoeba invadens
LIYKSFTEKSECSRLLVL

SEQ ID NO: 3006633 - protein, 19 aa, Entamoeba invadens
LIYLDLSFNALERSTSDIE

SEQ ID NO: 3006634 - protein, 29 aa, Entamoeba invadens
LIYYSLEQLLMPLPLPKRYGTILRLCIQN

SEQ ID NO: 3006635 - protein, 25 aa, Entamoeba invadens
LKAARIKRQLIFKGVLKGDETSQIE

SEQ ID NO: 3006636 - protein, 19 aa, Entamoeba invadens
LKAFRTKISFLDFSQEIFS

SEQ ID NO: 3006637 - protein, 17 aa, Entamoeba invadens
LKAIPSYLIFNCNKIRE

SEQ ID NO: 3006638 - protein, 24 aa, Entamoeba invadens
LKAKMTLRIFGKQVPVPKMSVEAV

SEQ ID NO: 3006639 - protein, 17 aa, Entamoeba invadens
LKALFCGLPLCCVTSDS

SEQ ID NO: 3006640 - protein, 20 aa, Entamoeba invadens
LKALIDWIYIDNSSPDMKIC

SEQ ID NO: 3006641 - protein, 32 aa, Entamoeba invadens
LKALIEQRFDNLDPCILLYMKTVINFEGEKAN

SEQ ID NO: 3006642 - protein, 18 aa, Entamoeba invadens
LKCFCECNYITSLTLPEG

SEQ ID NO: 3006643 - protein, 21 aa, Entamoeba invadens
LKCGYTSMQGWRRTMEDSHIV

SEQ ID NO: 3006644 - protein, 17 aa, Entamoeba invadens
LKCIKKFPQGPSPLHMT

SEQ ID NO: 3006645 - protein, 24 aa, Entamoeba invadens
LKCLNCFECFFTIKKLLEHTKVCR

SEQ ID NO: 3006646 - protein, 20 aa, Entamoeba invadens
LKCMEVVLNNLLINNYSIHF

SEQ ID NO: 3006647 - protein, 21 aa, Entamoeba invadens
LKCMEVVLNNLLINNYSIHFT

SEQ ID NO: 3006648 - protein, 18 aa, Entamoeba invadens
LKCPESLVSLLLCEGMED

SEQ ID NO: 3006649 - protein, 18 aa, Entamoeba invadens
LKCVLQHFLAMLNEIQTV

SEQ ID NO: 3006650 - protein, 18 aa, Entamoeba invadens
LKCYEILTNWIKCGLLNY

SEQ ID NO: 3006651 - protein, 23 aa, Entamoeba invadens
LKDDFPLLLLGNKVNCTDGSKFG

SEQ ID NO: 3006652 - protein, 31 aa, Entamoeba invadens
LKDDKEVDWFLNKWYYFFFVSIDGEDNGIPQ

SEQ ID NO: 3006653 - protein, 25 aa, Entamoeba invadens
LKDEAVIYTLPLDELMLKIEPDLVR

SEQ ID NO: 3006654 - protein, 24 aa, Entamoeba invadens
LKDEELQFAYYRTISGDEESKRVK

SEQ ID NO: 3006655 - protein, 20 aa, Entamoeba invadens
LKDFPNIKKLSVIKTLIIQK

SEQ ID NO: 3006656 - protein, 25 aa, Entamoeba invadens
LKDGLFVGFSQLCAITLPTSLKILN

SEQ ID NO: 3006657 - protein, 17 aa, Entamoeba invadens
LKDGLNKFKFGATELSI

SEQ ID NO: 3006658 - protein, 38 aa, Entamoeba invadens
LKDIKLYEIVYPETYFHYYLKYFSVRTKVRARKIIYSA

SEQ ID NO: 3006659 - protein, 25 aa, Entamoeba invadens
LKDKKTELPYVIYYDDIDTLEKTKI

SEQ ID NO: 3006660 - protein, 19 aa, Entamoeba invadens
LKDLIKRLLNHLPEQRPTF

SEQ ID NO: 3006661 - protein, 21 aa, Entamoeba invadens
LKDLKVISYGACQFPTLGFVI

SEQ ID NO: 3006662 - protein, 24 aa, Entamoeba invadens
LKDNNLYAFLLSKKASKHFEVLYD

SEQ ID NO: 3006663 - protein, 26 aa, Entamoeba invadens
LKDTNEIYCTIHLPQPKNLQAAVTME

SEQ ID NO: 3006664 - protein, 25 aa, Entamoeba invadens
LKDYIKIVQICDKLWNLSGNVVTFN

SEQ ID NO: 3006665 - protein, 17 aa, Entamoeba invadens
LKDYLSVLNFDARFNNY

SEQ ID NO: 3006666 - protein, 23 aa, Entamoeba invadens
LKEAVYTYLQIFGKASLLSTACI

SEQ ID NO: 3006667 - protein, 17 aa, Entamoeba invadens
LKEAYEFCLRFKAKNRT

SEQ ID NO: 3006668 - protein, 37 aa, Entamoeba invadens
LKEDIFKFIKAHWHILSFIKPFTSQKWRKAILDAFNH

SEQ ID NO: 3006669 - protein, 28 aa, Entamoeba invadens
LKEIGDFAFCRCTNLVYLVVPQNVVFFG

SEQ ID NO: 3006670 - protein, 29 aa, Entamoeba invadens
LKEIVEVLFSQGILKVLFATETFAMGVNM

SEQ ID NO: 3006671 - protein, 30 aa, Entamoeba invadens
LKEIVKYPKFLIPKYFACVMKKVYQSLIQN

SEQ ID NO: 3006672 - protein, 27 aa, Entamoeba invadens
LKEKANPYTLYFKKLKLFLNNIKITTG

SEQ ID NO: 3006673 - protein, 24 aa, Entamoeba invadens
LKEKLKFLDIMNRVPMHDGGIVSS

SEQ ID NO: 3006674 - protein, 28 aa, Entamoeba invadens
LKEKVLNFLYESPNLSRYLKFPVVESNI

SEQ ID NO: 3006675 - protein, 29 aa, Entamoeba invadens
LKELVTRFFIVLSLYRLFIAQKQNPQEIG

SEQ ID NO: 3006676 - protein, 19 aa, Entamoeba invadens
LKEMKRQFDLWKSQFEEKK

SEQ ID NO: 3006677 - protein, 25 aa, Entamoeba invadens
LKENLMIIIVSTKGHIFGSFNKSPI

SEQ ID NO: 3006678 - protein, 19 aa, Entamoeba invadens
LKEPFYPEKYPQGTTFAHQ

SEQ ID NO: 3006679 - protein, 25 aa, Entamoeba invadens
LKEREVVMWVLLPANKHSYNYPIKI

SEQ ID NO: 3006680 - protein, 24 aa, Entamoeba invadens
LKESAPCFLVQIPKLYLKDGLSLY

SEQ ID NO: 3006681 - protein, 27 aa, Entamoeba invadens
LKEVAELYFEFYGTLMPLDIRQKLDDF

SEQ ID NO: 3006682 - protein, 31 aa, Entamoeba invadens
LKEVCDKGAMIFWFAYMPLQGTRKEFTEMTQ

SEQ ID NO: 3006683 - protein, 18 aa, Entamoeba invadens
LKEVILSKRLFFLEDKVF

SEQ ID NO: 3006684 - protein, 22 aa, Entamoeba invadens
LKEVKGRTIRWLCKHPPGQKCS

SEQ ID NO: 3006685 - protein, 17 aa, Entamoeba invadens
LKEVVQAWTYKPGFPVV

SEQ ID NO: 3006686 - protein, 17 aa, Entamoeba invadens
LKFEIHHQSFLAFFLLR

SEQ ID NO: 3006687 - protein, 22 aa, Entamoeba invadens
LKFEWEGKELKGEKLHIVGKNK

SEQ ID NO: 3006688 - protein, 24 aa, Entamoeba invadens
LKFFDGMAFGPLYPNFKENLETGA

SEQ ID NO: 3006689 - protein, 23 aa, Entamoeba invadens
LKFGRNIETWFYLKGGNDGNTIV

SEQ ID NO: 3006690 - protein, 19 aa, Entamoeba invadens
LKFIIDKYTEIRSYIKPCW

SEQ ID NO: 3006691 - protein, 19 aa, Entamoeba invadens
LKFLIIGDTAVGKTSILLR

SEQ ID NO: 3006692 - protein, 23 aa, Entamoeba invadens
LKFLKTYPCVLKLLREKSNEPTL

SEQ ID NO: 3006693 - protein, 23 aa, Entamoeba invadens
LKFLPDFNHNPLKVLDLSGNDFN

SEQ ID NO: 3006694 - protein, 18 aa, Entamoeba invadens
LKFNSIYNCSEYFCLFKK

SEQ ID NO: 3006695 - protein, 19 aa, Entamoeba invadens
LKFPLMQIDFRISSESRKE

SEQ ID NO: 3006696 - protein, 19 aa, Entamoeba invadens
LKFVPDMSDLYFAFFTALA

SEQ ID NO: 3006697 - protein, 17 aa, Entamoeba invadens
LKFYLKGILYEEVIFTE

SEQ ID NO: 3006698 - protein, 28 aa, Entamoeba invadens
LKGAPRKYKAMLWKKLLNLDTIDEKTKT

SEQ ID NO: 3006699 - protein, 19 aa, Entamoeba invadens
LKGCKFYDNTIPNKCLLCA

SEQ ID NO: 3006700 - protein, 18 aa, Entamoeba invadens
LKGFYGISIINVASDTSM

SEQ ID NO: 3006701 - protein, 19 aa, Entamoeba invadens
LKGISLLPKRAVHVNQCEI

SEQ ID NO: 3006702 - protein, 17 aa, Entamoeba invadens
LKGLVSNSQFLLSPVDE

SEQ ID NO: 3006703 - protein, 18 aa, Entamoeba invadens
LKGNFFEIFWDIVNGRDE

SEQ ID NO: 3006704 - protein, 23 aa, Entamoeba invadens
LKGNVYLGFKDLETAKNVMISIA

SEQ ID NO: 3006705 - protein, 19 aa, Entamoeba invadens
LKGQRFVAVGQIMHKRAVD

SEQ ID NO: 3006706 - protein, 25 aa, Entamoeba invadens
LKGRHLPLITVFQDPTFGGTTASYA

SEQ ID NO: 3006707 - protein, 26 aa, Entamoeba invadens
LKGVIAHYFTIQPLKFRADIEVTCYA

SEQ ID NO: 3006708 - protein, 25 aa, Entamoeba invadens
LKHEEFLCFCGKYVDFPFEVKKRSK

SEQ ID NO: 3006709 - protein, 29 aa, Entamoeba invadens
LKHINNYAFKFCWNIKTLSFPNLLSKINY

SEQ ID NO: 3006710 - protein, 21 aa, Entamoeba invadens
LKHLKMCVDNYRILGDDKSKP

SEQ ID NO: 3006711 - protein, 23 aa, Entamoeba invadens
LKHLNGLKRLYNLRKLSAKNNLI

SEQ ID NO: 3006712 - protein, 30 aa, Entamoeba invadens
LKHMAKTFPVPQWLPLLFAIELSKPELFDI

SEQ ID NO: 3006713 - protein, 22 aa, Entamoeba invadens
LKHREDVIADMRLKKKQDTDEK

SEQ ID NO: 3006714 - protein, 20 aa, Entamoeba invadens
LKIAVSMCYCDMKRLLQVVS

SEQ ID NO: 3006715 - protein, 22 aa, Entamoeba invadens
LKIDGITYTLPINNGINCLHGG

SEQ ID NO: 3006716 - protein, 42 aa, Entamoeba invadens
LKIEGPSQQPLRSLLIMPVQRIPRYVLLIKDLLKNTDESHKD

SEQ ID NO: 3006717 - protein, 27 aa, Entamoeba invadens
LKIFDCFHFNPFPLSATTRKFFTNLET

SEQ ID NO: 3006718 - protein, 26 aa, Entamoeba invadens
LKIGSIYGFLLFSCDKERVFEAKNLL

SEQ ID NO: 3006719 - protein, 18 aa, Entamoeba invadens
LKILATCGIDLKLIMENK

SEQ ID NO: 3006720 - protein, 41 aa, Entamoeba invadens
LKINPYITDVFLPNKLFKYFPSLITLRFPIDKIRLFEKEEI

SEQ ID NO: 3006721 - protein, 17 aa, Entamoeba invadens
LKIPLETGGFRATKVVV

SEQ ID NO: 3006722 - protein, 22 aa, Entamoeba invadens
LKIRNRISFSYPIFTQDQIHEF

SEQ ID NO: 3006723 - protein, 19 aa, Entamoeba invadens
LKISSPKFGPILPVTDFLP

SEQ ID NO: 3006724 - protein, 20 aa, Entamoeba invadens
LKIVSKSIKFARPADCLPKV

SEQ ID NO: 3006725 - protein, 18 aa, Entamoeba invadens
LKIYSPYVVDLTLVDLPG

SEQ ID NO: 3006726 - protein, 24 aa, Entamoeba invadens
LKKCRLMGITLPPSLTYLKAENCR

SEQ ID NO: 3006727 - protein, 24 aa, Entamoeba invadens
LKKEFYQIVVWFNVDFQTVDKNKS

SEQ ID NO: 3006728 - protein, 31 aa, Entamoeba invadens
LKKENLVFGSLYVLLKCGYVLDLQKPSKKTE

SEQ ID NO: 3006729 - protein, 24 aa, Entamoeba invadens
LKKGLYYSFVLMLKTFRYKSEEQR

SEQ ID NO: 3006730 - protein, 22 aa, Entamoeba invadens
LKKHRFLQIPDDNQPILNLCVS

SEQ ID NO: 3006731 - protein, 20 aa, Entamoeba invadens
LKKILRRKKPTKEELNFHRF

SEQ ID NO: 3006732 - protein, 21 aa, Entamoeba invadens
LKKLNFFSNKIKTVPIRLCFD

SEQ ID NO: 3006733 - protein, 21 aa, Entamoeba invadens
LKKNSLLVKSFYDVADNIRCF

SEQ ID NO: 3006734 - protein, 21 aa, Entamoeba invadens
LKKNSLLVKSFYDVAENIRCF

SEQ ID NO: 3006735 - protein, 29 aa, Entamoeba invadens
LKKRSTEIYNWLKNSLFSYFKAPNCVVIG

SEQ ID NO: 3006736 - protein, 21 aa, Entamoeba invadens
LKKRVVLYCMEILISDVLKEK

SEQ ID NO: 3006737 - protein, 19 aa, Entamoeba invadens
LKKSVAFELVYVKWGYQDI

SEQ ID NO: 3006738 - protein, 24 aa, Entamoeba invadens
LKKTEIRFISLMKLVLCLATNLKD

SEQ ID NO: 3006739 - protein, 23 aa, Entamoeba invadens
LKKTWMEVFLPKSDVFMSFFSFY

SEQ ID NO: 3006740 - protein, 17 aa, Entamoeba invadens
LKKVCSVLMLLSVSYGE

SEQ ID NO: 3006741 - protein, 33 aa, Entamoeba invadens
LKKVCYPKMMKLKPSYWFPNASVAFFKIVVWHD

SEQ ID NO: 3006742 - protein, 29 aa, Entamoeba invadens
LKKVPTPSRPLPPPPLKKSQQLRQNIEEY

SEQ ID NO: 3006743 - protein, 20 aa, Entamoeba invadens
LKKYPYHGKTRKVFVGYCIL

SEQ ID NO: 3006744 - protein, 18 aa, Entamoeba invadens
LKKYSIHLLVKLSDAMIL

SEQ ID NO: 3006745 - protein, 22 aa, Entamoeba invadens
LKLAQTPIFVYSVLVYTHCHME

SEQ ID NO: 3006746 - protein, 22 aa, Entamoeba invadens
LKLDQLIKEITKWEIFGNVIAW

SEQ ID NO: 3006747 - protein, 17 aa, Entamoeba invadens
LKLFEEKNEKRILLLQK

SEQ ID NO: 3006748 - protein, 22 aa, Entamoeba invadens
LKLHFKIMILNVNDFSVFNNWD

SEQ ID NO: 3006749 - protein, 32 aa, Entamoeba invadens
LKLKIREVFAVPSIYYLHLITQGISTVITDVN

SEQ ID NO: 3006750 - protein, 26 aa, Entamoeba invadens
LKLKSKPVLKVLNFLVELAVAPDSPL

SEQ ID NO: 3006751 - protein, 21 aa, Entamoeba invadens
LKLLKKAMPLIFEAGTLLKAN

SEQ ID NO: 3006752 - protein, 19 aa, Entamoeba invadens
LKLLLIAHPDLASCPFHNK

SEQ ID NO: 3006753 - protein, 20 aa, Entamoeba invadens
LKLLNTNIPVIKKSSQKTKK

SEQ ID NO: 3006754 - protein, 20 aa, Entamoeba invadens
LKLLTPEFKAVLKAAGMKRK

SEQ ID NO: 3006755 - protein, 18 aa, Entamoeba invadens
LKLMKISIDFYSSTEIKN

SEQ ID NO: 3006756 - protein, 20 aa, Entamoeba invadens
LKLPNFNKKLLFQITNEEKE

SEQ ID NO: 3006757 - protein, 23 aa, Entamoeba invadens
LKLTKIYVLNYKGSSLLVNDENL

SEQ ID NO: 3006758 - protein, 21 aa, Entamoeba invadens
LKLTRIYVLNYKGSPLLVNDE

SEQ ID NO: 3006759 - protein, 21 aa, Entamoeba invadens
LKLVKITALSLTLISHYLLWN

SEQ ID NO: 3006760 - protein, 17 aa, Entamoeba invadens
LKLYINWCTIRNSTLET

SEQ ID NO: 3006761 - protein, 17 aa, Entamoeba invadens
LKLYRRKGLYILEEMKE

SEQ ID NO: 3006762 - protein, 26 aa, Entamoeba invadens
LKMCKRCFVMWIKPEIVTQIKCDDVE

SEQ ID NO: 3006763 - protein, 19 aa, Entamoeba invadens
LKMDKLIYCTAEQAMMDYI

SEQ ID NO: 3006764 - protein, 19 aa, Entamoeba invadens
LKMFPSLQTLYLTRLPPNV

SEQ ID NO: 3006765 - protein, 21 aa, Entamoeba invadens
LKMKVVVVRKIREKIMIGMMT

SEQ ID NO: 3006766 - protein, 37 aa, Entamoeba invadens
LKMNLTHQVLLTVANLFLKYLEPRFKPFVDGIYLVDY

SEQ ID NO: 3006767 - protein, 23 aa, Entamoeba invadens
LKMPESLRNLIITCLKKVSDTEY

SEQ ID NO: 3006768 - protein, 18 aa, Entamoeba invadens
LKMQLKMFEKEKKILGLS

SEQ ID NO: 3006769 - protein, 21 aa, Entamoeba invadens
LKMRCKHCLTCNSTNYKTNGG

SEQ ID NO: 3006770 - protein, 19 aa, Entamoeba invadens
LKMSKYFHMFVGNNYWGKT

SEQ ID NO: 3006771 - protein, 21 aa, Entamoeba invadens
LKMSVVRFPVVKNFLEIERSL

SEQ ID NO: 3006772 - protein, 19 aa, Entamoeba invadens
LKMTWFTNILIIKENVIQI

SEQ ID NO: 3006773 - protein, 26 aa, Entamoeba invadens
LKMVCGSLLFKDSHPMFWEVACILQD

SEQ ID NO: 3006774 - protein, 28 aa, Entamoeba invadens
LKMYCCPVLKSFSLPQKVKNLSLSGFDK

SEQ ID NO: 3006775 - protein, 22 aa, Entamoeba invadens
LKNDVIFYFKTKSSSFNLITDV

SEQ ID NO: 3006776 - protein, 21 aa, Entamoeba invadens
LKNHRDSILGLRTGKKTAMVI

SEQ ID NO: 3006777 - protein, 26 aa, Entamoeba invadens
LKNITNLQFLQTLKLRFVSRNENIVN

SEQ ID NO: 3006778 - protein, 24 aa, Entamoeba invadens
LKNKKGIPFIAIAELKGKAKDSAT

SEQ ID NO: 3006779 - protein, 25 aa, Entamoeba invadens
LKNKMLIPDFTIPPFSFENTFVVVF

SEQ ID NO: 3006780 - protein, 22 aa, Entamoeba invadens
LKNKQDILLNTLKKITNYIDKK

SEQ ID NO: 3006781 - protein, 25 aa, Entamoeba invadens
LKNNPNLFIYVVQSHIQKIPKSCFE

SEQ ID NO: 3006782 - protein, 28 aa, Entamoeba invadens
LKNPEKFVFELFTRIQLIDEVIYNISRK

SEQ ID NO: 3006783 - protein, 26 aa, Entamoeba invadens
LKNPISLFGVIAARLLCLQKLANAHA

SEQ ID NO: 3006784 - protein, 25 aa, Entamoeba invadens
LKNQTLVQDFFYTKDIQLWVLNHTF

SEQ ID NO: 3006785 - protein, 30 aa, Entamoeba invadens
LKNQYNINPFLFAFKNPKTHFRSCDDSFLE

SEQ ID NO: 3006786 - protein, 23 aa, Entamoeba invadens
LKNRPPYMRQGMLEIAVLELINS

SEQ ID NO: 3006787 - protein, 20 aa, Entamoeba invadens
LKNSFVLDPLITALSKFTSL

SEQ ID NO: 3006788 - protein, 29 aa, Entamoeba invadens
LKNSKIPDQIPFIIVCDRFNYVEEMTQYL

SEQ ID NO: 3006789 - protein, 24 aa, Entamoeba invadens
LKNSQYLCALAYFVQKKKVSVEYT

SEQ ID NO: 3006790 - protein, 26 aa, Entamoeba invadens
LKNTRFLDSLIPLFKLPSLKKVYMEI

SEQ ID NO: 3006791 - protein, 34 aa, Entamoeba invadens
LKNVDLWNCKYAVSYLEKLKLFIKTMVEYKKSNS

SEQ ID NO: 3006792 - protein, 20 aa, Entamoeba invadens
LKNVILYINSFHTLSEFLRI

SEQ ID NO: 3006793 - protein, 20 aa, Entamoeba invadens
LKNVILYIPTIEDVFQFILI

SEQ ID NO: 3006794 - protein, 19 aa, Entamoeba invadens
LKNVILYLESLDDVLNFML

SEQ ID NO: 3006795 - protein, 19 aa, Entamoeba invadens
LKNVLLYLETLDDILNFML

SEQ ID NO: 3006796 - protein, 33 aa, Entamoeba invadens
LKNVQYRTPLHYLCRQMDIGKLLPILRKVLSSD

SEQ ID NO: 3006797 - protein, 21 aa, Entamoeba invadens
LKNVVLYFKTIDDIRSFVFVN

SEQ ID NO: 3006798 - protein, 18 aa, Entamoeba invadens
LKPEDIGFIIAPTFHVKS

SEQ ID NO: 3006799 - protein, 22 aa, Entamoeba invadens
LKPELILAINGLLQDLNHPNEY

SEQ ID NO: 3006800 - protein, 19 aa, Entamoeba invadens
LKPIRKPVEKIQKLSSQLI

SEQ ID NO: 3006801 - protein, 32 aa, Entamoeba invadens
LKPLIQDFEIYTLYFGGYQLFSKSFPQVEEDL

SEQ ID NO: 3006802 - protein, 20 aa, Entamoeba invadens
LKPTKGVILASRELYCVYDT

SEQ ID NO: 3006803 - protein, 24 aa, Entamoeba invadens
LKPTQMWMRQISKKSWVECVSQEN

SEQ ID NO: 3006804 - protein, 17 aa, Entamoeba invadens
LKPYLRRSTLIKEIIDK

SEQ ID NO: 3006805 - protein, 17 aa, Entamoeba invadens
LKPYLRRTTLIKEIVEK

SEQ ID NO: 3006806 - protein, 29 aa, Entamoeba invadens
LKQDPDVLDTWFSSGLFPFSVMGWPEKTL

SEQ ID NO: 3006807 - protein, 24 aa, Entamoeba invadens
LKQENGVFAFYPICTVLSGEMQEH

SEQ ID NO: 3006808 - protein, 22 aa, Entamoeba invadens
LKQIKTYLVSFLTRSKPLEEFD

SEQ ID NO: 3006809 - protein, 30 aa, Entamoeba invadens
LKQKEMELAAWRSGVVDTYLKSVFSKMEKK

SEQ ID NO: 3006810 - protein, 25 aa, Entamoeba invadens
LKQLITPITLVLSTLSIRQSALDHS

SEQ ID NO: 3006811 - protein, 23 aa, Entamoeba invadens
LKQLVRVYFTLMTTTHHTSGISF

SEQ ID NO: 3006812 - protein, 27 aa, Entamoeba invadens
LKQPIKGDLWLNLSVQGKLHINLDTLK

SEQ ID NO: 3006813 - protein, 26 aa, Entamoeba invadens
LKQQSILSLLITPVQRLPRYKLLLTD

SEQ ID NO: 3006814 - protein, 26 aa, Entamoeba invadens
LKQREFVRVQAMLYYTNMAGGQAVCV

SEQ ID NO: 3006815 - protein, 23 aa, Entamoeba invadens
LKQSLFHMGPLLDDDFVEAEFTE

SEQ ID NO: 3006816 - protein, 23 aa, Entamoeba invadens
LKQVKGALFNRGVKYILVCKEDH

SEQ ID NO: 3006817 - protein, 18 aa, Entamoeba invadens
LKQVSMVIQFFVLGSLGE

SEQ ID NO: 3006818 - protein, 25 aa, Entamoeba invadens
LKQYLHVLVVPLIPPEWFHDYINMP

SEQ ID NO: 3006819 - protein, 29 aa, Entamoeba invadens
LKRAEVWRRFFNYIAKNDSYYVWENKRLR

SEQ ID NO: 3006820 - protein, 21 aa, Entamoeba invadens
LKRCFEAGFGFALTKTYPLEK

SEQ ID NO: 3006821 - protein, 25 aa, Entamoeba invadens
LKREHEELMRIEAIKALERQKREEE

SEQ ID NO: 3006822 - protein, 17 aa, Entamoeba invadens
LKRFDVIYFANKQLTQN

SEQ ID NO: 3006823 - protein, 27 aa, Entamoeba invadens
LKRFEYLLDAFGHFFKSKPLMKKMESV

SEQ ID NO: 3006824 - protein, 18 aa, Entamoeba invadens
LKRFYLFREYETPPLSVA

SEQ ID NO: 3006825 - protein, 25 aa, Entamoeba invadens
LKRITFKYEILREAVPKIHINFCFK

SEQ ID NO: 3006826 - protein, 23 aa, Entamoeba invadens
LKRKFDMLPSCQIYKDYEITDDT

SEQ ID NO: 3006827 - protein, 23 aa, Entamoeba invadens
LKRKLDQIRFDLAKQSKEENVVL

SEQ ID NO: 3006828 - protein, 30 aa, Entamoeba invadens
LKRNPMMKWMNLKYLFKLLPNLVTVVGKSF

SEQ ID NO: 3006829 - protein, 30 aa, Entamoeba invadens
LKRQEKILFPPLKLLELPPNVTEHIFDFLP

SEQ ID NO: 3006830 - protein, 29 aa, Entamoeba invadens
LKRQGTKFVIHEPAVFKLPGAEQFVIYGE

SEQ ID NO: 3006831 - protein, 24 aa, Entamoeba invadens
LKRQKSIRLIGKISGSALTYNDIV

SEQ ID NO: 3006832 - protein, 22 aa, Entamoeba invadens
LKRSTLEPKKFKKPAKLSVSFK

SEQ ID NO: 3006833 - protein, 24 aa, Entamoeba invadens
LKRTMYDYLGGILPLPSVAQSRSF

SEQ ID NO: 3006834 - protein, 25 aa, Entamoeba invadens
LKSAGVIFIQFAFRWINCCLLREFS

SEQ ID NO: 3006835 - protein, 30 aa, Entamoeba invadens
LKSDKLDKFYKLFSVVIFGGIHSPQKAIEH

SEQ ID NO: 3006836 - protein, 29 aa, Entamoeba invadens
LKSEKPLPKFVIWFPVTYDYAKEFEGQNI

SEQ ID NO: 3006837 - protein, 25 aa, Entamoeba invadens
LKSFFAVILVERYLTLQTPRVVDEK

SEQ ID NO: 3006838 - protein, 19 aa, Entamoeba invadens
LKSFSFQNQNFFTSQFWAS

SEQ ID NO: 3006839 - protein, 25 aa, Entamoeba invadens
LKSGFACEFSVYYVKPLCSCKINST

SEQ ID NO: 3006840 - protein, 17 aa, Entamoeba invadens
LKSIDLLCGCSVGSILV

SEQ ID NO: 3006841 - protein, 24 aa, Entamoeba invadens
LKSIEFVGQVYIPEYLCYNCHFLE

SEQ ID NO: 3006842 - protein, 30 aa, Entamoeba invadens
LKSKKFVHLLEVMLLVGNFLNKGTAKGNVT

SEQ ID NO: 3006843 - protein, 23 aa, Entamoeba invadens
LKSKKYLMYFCVSMLLSVKEEIM

SEQ ID NO: 3006844 - protein, 24 aa, Entamoeba invadens
LKSKTKWIIVYKNNIPITTDEPIK

SEQ ID NO: 3006845 - protein, 17 aa, Entamoeba invadens
LKSLRLISLCHSQFEGF

SEQ ID NO: 3006846 - protein, 23 aa, Entamoeba invadens
LKSLYFPTTLVDLTLDSVALPVC

SEQ ID NO: 3006847 - protein, 40 aa, Entamoeba invadens
LKSMIFPFEWCNICIDLIPYSLLDYLTSPMTYLVGVPAEY

SEQ ID NO: 3006848 - protein, 23 aa, Entamoeba invadens
LKSQWSLFLPEQLERWKSVRDVQ

SEQ ID NO: 3006849 - protein, 17 aa, Entamoeba invadens
LKSSLCYKKFLGVVISL

SEQ ID NO: 3006850 - protein, 30 aa, Entamoeba invadens
LKSSLTSGLPNLLFFGPPGSGKTTSILALS

SEQ ID NO: 3006851 - protein, 24 aa, Entamoeba invadens
LKSTPFIKQLIFNDSIDLQFEVDT

SEQ ID NO: 3006852 - protein, 24 aa, Entamoeba invadens
LKSVFLKFIKKIQDSLFAAIRSAN

SEQ ID NO: 3006853 - protein, 20 aa, Entamoeba invadens
LKSVRKLLVGPLGMKTLDPT

SEQ ID NO: 3006854 - protein, 18 aa, Entamoeba invadens
LKSVVIPMSVTKLGESCF

SEQ ID NO: 3006855 - protein, 21 aa, Entamoeba invadens
LKSVWRANWFKRDLLYWDGEN

SEQ ID NO: 3006856 - protein, 36 aa, Entamoeba invadens
LKSYLNERIVSFSIPTFIFTLPEFPRTSFGKVYLPK

SEQ ID NO: 3006857 - protein, 25 aa, Entamoeba invadens
LKTADTLFNFILINKKCQLTVNSLH

SEQ ID NO: 3006858 - protein, 26 aa, Entamoeba invadens
LKTAPKTTIYYLKGEAFATQTVNTKD

SEQ ID NO: 3006859 - protein, 29 aa, Entamoeba invadens
LKTDLFENFVYFITNVRCRRLLTFDEFTS

SEQ ID NO: 3006860 - protein, 26 aa, Entamoeba invadens
LKTDPLWSNILKLMKNFWYDQRVQRY

SEQ ID NO: 3006861 - protein, 30 aa, Entamoeba invadens
LKTEIRSFLTILSLVCFSLKKIKQTLGELK

SEQ ID NO: 3006862 - protein, 24 aa, Entamoeba invadens
LKTFRSGFLIRQKLYEELYEHQRV

SEQ ID NO: 3006863 - protein, 25 aa, Entamoeba invadens
LKTGFDVLYYLKTSNQFKYFGTDTN

SEQ ID NO: 3006864 - protein, 17 aa, Entamoeba invadens
LKTIKYFDHLETLILWL

SEQ ID NO: 3006865 - protein, 17 aa, Entamoeba invadens
LKTIRIFAGAKGQLKYF

SEQ ID NO: 3006866 - protein, 21 aa, Entamoeba invadens
LKTIRLICTIPPTWGLEETKN

SEQ ID NO: 3006867 - protein, 17 aa, Entamoeba invadens
LKTLISIFYTLLIDSEH

SEQ ID NO: 3006868 - protein, 18 aa, Entamoeba invadens
LKTLPSLPYLVVDEADRM

SEQ ID NO: 3006869 - protein, 25 aa, Entamoeba invadens
LKTLYLQSNNLLHFPRCVCNLTTLK

SEQ ID NO: 3006870 - protein, 20 aa, Entamoeba invadens
LKTPILFLFTEMSVSIQSDP

SEQ ID NO: 3006871 - protein, 27 aa, Entamoeba invadens
LKTPQDVFCFFLKAGHLCPFAPSMFPC

SEQ ID NO: 3006872 - protein, 26 aa, Entamoeba invadens
LKTQKSRRFSFREKKYVEDIMPELVD

SEQ ID NO: 3006873 - protein, 27 aa, Entamoeba invadens
LKTSKITHMTPIRPIFLLSKSQNNKKN

SEQ ID NO: 3006874 - protein, 24 aa, Entamoeba invadens
LKTTNWPITFLSQIGLSKGVYKNV

SEQ ID NO: 3006875 - protein, 25 aa, Entamoeba invadens
LKTVVLPSTLFFISDSVFEGCVSLS

SEQ ID NO: 3006876 - protein, 23 aa, Entamoeba invadens
LKTWEGTILLVSHQRQFLNAIVT

SEQ ID NO: 3006877 - protein, 25 aa, Entamoeba invadens
LKVAAPILKFAVSVPFFATLSETSL

SEQ ID NO: 3006878 - protein, 19 aa, Entamoeba invadens
LKVDFVFFVPSHILRKLGA

SEQ ID NO: 3006879 - protein, 17 aa, Entamoeba invadens
LKVFPKLHTLQITSEAL

SEQ ID NO: 3006880 - protein, 18 aa, Entamoeba invadens
LKVHWFYGKPGCGKSFTA

SEQ ID NO: 3006881 - protein, 24 aa, Entamoeba invadens
LKVITMDIILRDFSIMFYHLVVQM

SEQ ID NO: 3006882 - protein, 17 aa, Entamoeba invadens
LKVLKQIIEPFLDQNGV

SEQ ID NO: 3006883 - protein, 34 aa, Entamoeba invadens
LKVLVCLDDCLLSYFLVGFNLNLFLTLEINNKQE

SEQ ID NO: 3006884 - protein, 22 aa, Entamoeba invadens
LKVRKVYYDLYKSFINALDVLT

SEQ ID NO: 3006885 - protein, 18 aa, Entamoeba invadens
LKVRRYSESTLKYMYDPV

SEQ ID NO: 3006886 - protein, 25 aa, Entamoeba invadens
LKVSRILLAYIIRVGVYIRKRKVLC

SEQ ID NO: 3006887 - protein, 26 aa, Entamoeba invadens
LKVSVKALTLIEKCAYFPMKDVNFGV

SEQ ID NO: 3006888 - protein, 19 aa, Entamoeba invadens
LKVSYYLCSQFTPDFQWYC

SEQ ID NO: 3006889 - protein, 26 aa, Entamoeba invadens
LKVTEIYTCGLLTQNCVLFTCLDKEA

SEQ ID NO: 3006890 - protein, 18 aa, Entamoeba invadens
LKVWEKVNELGDCHALAV

SEQ ID NO: 3006891 - protein, 29 aa, Entamoeba invadens
LKWGEVYDKEFFKFPWKIAEFVISNKRLE

SEQ ID NO: 3006892 - protein, 18 aa, Entamoeba invadens
LKWNCLCGWVGKESVKLS

SEQ ID NO: 3006893 - protein, 17 aa, Entamoeba invadens
LKWTLFQKRMSKAFRQL

SEQ ID NO: 3006894 - protein, 19 aa, Entamoeba invadens
LKYFPRIETLNIWSKDEEA

SEQ ID NO: 3006895 - protein, 19 aa, Entamoeba invadens
LKYHVNAFNKYMIVTYDDI

SEQ ID NO: 3006896 - protein, 22 aa, Entamoeba invadens
LKYIPHAIYKLLENIPMPWEDI

SEQ ID NO: 3006897 - protein, 19 aa, Entamoeba invadens
LKYKLCSLLQTADPLKLQV

SEQ ID NO: 3006898 - protein, 22 aa, Entamoeba invadens
LKYNALVEIILIRGEKNKKDVR

SEQ ID NO: 3006899 - protein, 25 aa, Entamoeba invadens
LKYNNILPELFPVNLGNILTLTKLV

SEQ ID NO: 3006900 - protein, 25 aa, Entamoeba invadens
LKYTPKGVFCLMTFYGPACPNNSGL

SEQ ID NO: 3006901 - protein, 19 aa, Entamoeba invadens
LLAFCYKNKMMHDNTQTLE

SEQ ID NO: 3006902 - protein, 17 aa, Entamoeba invadens
LLAFHYSLSKTTTPQFF

SEQ ID NO: 3006903 - protein, 20 aa, Entamoeba invadens
LLAGLNIALLYRADTTDVIK

SEQ ID NO: 3006904 - protein, 17 aa, Entamoeba invadens
LLAHKKAELDDVSLKLL

SEQ ID NO: 3006905 - protein, 25 aa, Entamoeba invadens
LLAHKYQDQLVPRLSWLCLVLSEIQ

SEQ ID NO: 3006906 - protein, 23 aa, Entamoeba invadens
LLAKYNPVSIEIPRFDKDTPSTH

SEQ ID NO: 3006907 - protein, 34 aa, Entamoeba invadens
LLAQRHTQMFILLRQFFLLIMSQDKSISKMALEE

SEQ ID NO: 3006908 - protein, 24 aa, Entamoeba invadens
LLARNGILGCLYLQNFGNKLVLVA

SEQ ID NO: 3006909 - protein, 17 aa, Entamoeba invadens
LLASYMFTVYCPNFERV

SEQ ID NO: 3006910 - protein, 21 aa, Entamoeba invadens
LLATSLINNIFWRVNTISFGH

SEQ ID NO: 3006911 - protein, 19 aa, Entamoeba invadens
LLCEAIVITLLTPDQTMVL

SEQ ID NO: 3006912 - protein, 22 aa, Entamoeba invadens
LLCFGFCMNLKTLKVPKAAKRF

SEQ ID NO: 3006913 - protein, 17 aa, Entamoeba invadens
LLCGESYRLFEGECLPI

SEQ ID NO: 3006914 - protein, 18 aa, Entamoeba invadens
LLCIGARAFYNCSNLKKL

SEQ ID NO: 3006915 - protein, 31 aa, Entamoeba invadens
LLCSKANYIFKENIEFGFNLLRSIISLCDNQ

SEQ ID NO: 3006916 - protein, 21 aa, Entamoeba invadens
LLCVATNILNLWRANSTIYQI

SEQ ID NO: 3006917 - protein, 18 aa, Entamoeba invadens
LLCVDLCTTGKPVETPIK

SEQ ID NO: 3006918 - protein, 20 aa, Entamoeba invadens
LLDALLVLKSFPPQFEMIDI

SEQ ID NO: 3006919 - protein, 28 aa, Entamoeba invadens
LLDDEDYVIYYDRFPKKIDLNEDYYDDD

SEQ ID NO: 3006920 - protein, 17 aa, Entamoeba invadens
LLDFINLPKQRMINNKF

SEQ ID NO: 3006921 - protein, 19 aa, Entamoeba invadens
LLDIMRSTKSLLVSKEILL

SEQ ID NO: 3006922 - protein, 18 aa, Entamoeba invadens
LLDKNLYQYCKLHRNSGI

SEQ ID NO: 3006923 - protein, 20 aa, Entamoeba invadens
LLDLIKSFFLSPETTLFVPA

SEQ ID NO: 3006924 - protein, 31 aa, Entamoeba invadens
LLDMAARETLLKLLFSVCFYREVLNGKKLEF

SEQ ID NO: 3006925 - protein, 21 aa, Entamoeba invadens
LLDMNKSCRRYILSGVCKFMT

SEQ ID NO: 3006926 - protein, 24 aa, Entamoeba invadens
LLDNSMRAFQAMLKEMSVAPVGNK

SEQ ID NO: 3006927 - protein, 17 aa, Entamoeba invadens
LLDPNYKPVFTVASDDK

SEQ ID NO: 3006928 - protein, 18 aa, Entamoeba invadens
LLDSFRFFFDADVMKLYY

SEQ ID NO: 3006929 - protein, 19 aa, Entamoeba invadens
LLDTFLQQFDAVKITKTQN

SEQ ID NO: 3006930 - protein, 27 aa, Entamoeba invadens
LLDVADGIKLINFIEALSNLKIEGYIK

SEQ ID NO: 3006931 - protein, 18 aa, Entamoeba invadens
LLDVGFYTTTLTFVSQNK

SEQ ID NO: 3006932 - protein, 25 aa, Entamoeba invadens
LLECDVWISLIFDQLEKIRKNEKAK

SEQ ID NO: 3006933 - protein, 17 aa, Entamoeba invadens
LLEDRVYVKKYYNNEKY

SEQ ID NO: 3006934 - protein, 19 aa, Entamoeba invadens
LLEDRVYVKKYYNNEKYNI

SEQ ID NO: 3006935 - protein, 20 aa, Entamoeba invadens
LLEEIFSGYPMYLHRMYQDV

SEQ ID NO: 3006936 - protein, 25 aa, Entamoeba invadens
LLEELYTFEDGAFLVYDRIDYKEID

SEQ ID NO: 3006937 - protein, 25 aa, Entamoeba invadens
LLEENTAFVFLLKENGKESMKKYSI

SEQ ID NO: 3006938 - protein, 27 aa, Entamoeba invadens
LLEEQLPIFFNYLITPMGPPLVSNELF

SEQ ID NO: 3006939 - protein, 17 aa, Entamoeba invadens
LLEFENEIYMLDKFRSE

SEQ ID NO: 3006940 - protein, 19 aa, Entamoeba invadens
LLEFKNFRRTLKSKDQRAL

SEQ ID NO: 3006941 - protein, 17 aa, Entamoeba invadens
LLEFNSIDLDMFLHTID

SEQ ID NO: 3006942 - protein, 25 aa, Entamoeba invadens
LLEGRSRFARLGLFVHITASFMNPG

SEQ ID NO: 3006943 - protein, 17 aa, Entamoeba invadens
LLEHSIGYVWTGKRNPI

SEQ ID NO: 3006944 - protein, 17 aa, Entamoeba invadens
LLEIILPSTMKSIGDEC

SEQ ID NO: 3006945 - protein, 20 aa, Entamoeba invadens
LLEIVRRQHDVLVKMKSDRA

SEQ ID NO: 3006946 - protein, 19 aa, Entamoeba invadens
LLEKKKPMRKVRGNHAKLM

SEQ ID NO: 3006947 - protein, 27 aa, Entamoeba invadens
LLEKMVWWCGRLFQSEFEMLMKSIADI

SEQ ID NO: 3006948 - protein, 17 aa, Entamoeba invadens
LLEKVSELNTQLGKLEN

SEQ ID NO: 3006949 - protein, 22 aa, Entamoeba invadens
LLELELTFPTLLKGAISYLEKL

SEQ ID NO: 3006950 - protein, 25 aa, Entamoeba invadens
LLELKKIYNVLGLRHKVLKDRHEEC

SEQ ID NO: 3006951 - protein, 18 aa, Entamoeba invadens
LLELPYHLEQNLVNDIMS

SEQ ID NO: 3006952 - protein, 18 aa, Entamoeba invadens
LLEMFAGEISNEELTFCF

SEQ ID NO: 3006953 - protein, 23 aa, Entamoeba invadens
LLEPTNFYLWQFAGEVALKLNDM

SEQ ID NO: 3006954 - protein, 20 aa, Entamoeba invadens
LLERYKATLLTKSFTDLIYF

SEQ ID NO: 3006955 - protein, 19 aa, Entamoeba invadens
LLESLIRISQAHAKLMMHK

SEQ ID NO: 3006956 - protein, 22 aa, Entamoeba invadens
LLETLEMYIPIDDHYIGSTSLI

SEQ ID NO: 3006957 - protein, 17 aa, Entamoeba invadens
LLETPLHLAALSGDLEA

SEQ ID NO: 3006958 - protein, 19 aa, Entamoeba invadens
LLEVIEPFEWVHLLITHLP

SEQ ID NO: 3006959 - protein, 29 aa, Entamoeba invadens
LLEYHKKSGLLFPSFLADATNYMKQTKNC

SEQ ID NO: 3006960 - protein, 20 aa, Entamoeba invadens
LLFANSSFLGNPRGLLKDIS

SEQ ID NO: 3006961 - protein, 24 aa, Entamoeba invadens
LLFEYVERLELFKSYIDILLNEVK

SEQ ID NO: 3006962 - protein, 17 aa, Entamoeba invadens
LLFIYKLKEHNNEIDSE

SEQ ID NO: 3006963 - protein, 18 aa, Entamoeba invadens
LLFKGFKMEFLELKDQDG

SEQ ID NO: 3006964 - protein, 18 aa, Entamoeba invadens
LLFNIENFIFPNTFKNCE

SEQ ID NO: 3006965 - protein, 27 aa, Entamoeba invadens
LLFSEFQRCNYLKFEILNNANGANYIT

SEQ ID NO: 3006966 - protein, 17 aa, Entamoeba invadens
LLFTPDKNNLAAEKIRL

SEQ ID NO: 3006967 - protein, 19 aa, Entamoeba invadens
LLFVALETLLFAKKVERLK

SEQ ID NO: 3006968 - protein, 19 aa, Entamoeba invadens
LLFVEQLLTLFIQTVTQCK

SEQ ID NO: 3006969 - protein, 19 aa, Entamoeba invadens
LLFVVITTEHLIFGGYKDL

SEQ ID NO: 3006970 - protein, 25 aa, Entamoeba invadens
LLGDYKTLSYWLQAINFVIQDLVQS

SEQ ID NO: 3006971 - protein, 17 aa, Entamoeba invadens
LLGFLQGETSNFEIVYY

SEQ ID NO: 3006972 - protein, 20 aa, Entamoeba invadens
LLGKYLLQGWTMLQASCHVH

SEQ ID NO: 3006973 - protein, 33 aa, Entamoeba invadens
LLGLFNGMRLFSKFLYIFIQMCKMNKIEDPKTF

SEQ ID NO: 3006974 - protein, 28 aa, Entamoeba invadens
LLGLYDIINCWIGISPPLLKSVAAFMAS

SEQ ID NO: 3006975 - protein, 20 aa, Entamoeba invadens
LLGNGYGFAVDWWSYGTLIY

SEQ ID NO: 3006976 - protein, 28 aa, Entamoeba invadens
LLGQQMTPLLFIVEAVFPMNVGLMQMPP

SEQ ID NO: 3006977 - protein, 18 aa, Entamoeba invadens
LLGSDLYINIIQKSFRLG

SEQ ID NO: 3006978 - protein, 31 aa, Entamoeba invadens
LLGVFYRINYDKYLYPYIPPHVTLPKEIIKV

SEQ ID NO: 3006979 - protein, 18 aa, Entamoeba invadens
LLGYGFVISENPYDEVLL

SEQ ID NO: 3006980 - protein, 28 aa, Entamoeba invadens
LLHFMERKIVCLSSVRFLIFDEADRMLD

SEQ ID NO: 3006981 - protein, 17 aa, Entamoeba invadens
LLHVPRGNLKSDKLDKF

SEQ ID NO: 3006982 - protein, 20 aa, Entamoeba invadens
LLIEGYCITFPFKNKRLVSA

SEQ ID NO: 3006983 - protein, 24 aa, Entamoeba invadens
LLIEKKFIKEFPQDLLDESINTAI

SEQ ID NO: 3006984 - protein, 19 aa, Entamoeba invadens
LLIFHHSPRNPQSSQMLIQ

SEQ ID NO: 3006985 - protein, 19 aa, Entamoeba invadens
LLIITGYLKSASDFITFMQ

SEQ ID NO: 3006986 - protein, 27 aa, Entamoeba invadens
LLIKEVMTLIIQFMDWGFSIPNEVLVE

SEQ ID NO: 3006987 - protein, 18 aa, Entamoeba invadens
LLILVEKRAHINKEMMEE

SEQ ID NO: 3006988 - protein, 18 aa, Entamoeba invadens
LLINGQVLFASKFTVFVI

SEQ ID NO: 3006989 - protein, 17 aa, Entamoeba invadens
LLINKKVIAANEVDYLL

SEQ ID NO: 3006990 - protein, 17 aa, Entamoeba invadens
LLIPIEIAVKMEDREMV

SEQ ID NO: 3006991 - protein, 17 aa, Entamoeba invadens
LLIRSRSAALFSGNFCN

SEQ ID NO: 3006992 - protein, 20 aa, Entamoeba invadens
LLISGKLDPHSKLRSKVWQI

SEQ ID NO: 3006993 - protein, 20 aa, Entamoeba invadens
LLISMLKQQLIENRYIAAIC

SEQ ID NO: 3006994 - protein, 19 aa, Entamoeba invadens
LLISNFPFERIVNSCWDGA

SEQ ID NO: 3006995 - protein, 17 aa, Entamoeba invadens
LLITAMLTHTVIKSFFP

SEQ ID NO: 3006996 - protein, 24 aa, Entamoeba invadens
LLITDFKETFYWTNGIWKERDFVK

SEQ ID NO: 3006997 - protein, 27 aa, Entamoeba invadens
LLIVAKYFLYRCDFINVICVCKKFKET

SEQ ID NO: 3006998 - protein, 19 aa, Entamoeba invadens
LLIVAKYFVTISDFVSLVQ

SEQ ID NO: 3006999 - protein, 18 aa, Entamoeba invadens
LLIVAKYLEYLSDFKNVV

SEQ ID NO: 3007000 - protein, 19 aa, Entamoeba invadens
LLKAYYWTLGNNTHFEQFT

SEQ ID NO: 3007001 - protein, 26 aa, Entamoeba invadens
LLKDDQLQFAYYRTISGDEESHRVKF

SEQ ID NO: 3007002 - protein, 26 aa, Entamoeba invadens
LLKENRVFIPFFKFNSQNKSILVIDL

SEQ ID NO: 3007003 - protein, 17 aa, Entamoeba invadens
LLKFLQQVMVFVVSKKD

SEQ ID NO: 3007004 - protein, 17 aa, Entamoeba invadens
LLKFPEGKIPPVVSLLT

SEQ ID NO: 3007005 - protein, 17 aa, Entamoeba invadens
LLKLKLKSKPVLKVLNF

SEQ ID NO: 3007006 - protein, 18 aa, Entamoeba invadens
LLKMEIVLGKFPQTVASD

SEQ ID NO: 3007007 - protein, 18 aa, Entamoeba invadens
LLKMGRLHVHMAKALPQH

SEQ ID NO: 3007008 - protein, 17 aa, Entamoeba invadens
LLKMILIGDSGVGKSSL

SEQ ID NO: 3007009 - protein, 27 aa, Entamoeba invadens
LLKMKDLPVVILRPSIIYGQGDVTGIA

SEQ ID NO: 3007010 - protein, 35 aa, Entamoeba invadens
LLKNLESKIIYIRRYFDYIVDLFDLDKKRMMTLDE

SEQ ID NO: 3007011 - protein, 20 aa, Entamoeba invadens
LLKRAFHELTETIRPISVLV

SEQ ID NO: 3007012 - protein, 20 aa, Entamoeba invadens
LLKSARLLGVKLNLTASEFT

SEQ ID NO: 3007013 - protein, 19 aa, Entamoeba invadens
LLKSKVGILGAGGLGSPVI

SEQ ID NO: 3007014 - protein, 18 aa, Entamoeba invadens
LLKTIIPRAKDTLPSVRI

SEQ ID NO: 3007015 - protein, 24 aa, Entamoeba invadens
LLKTNVVVFCDIPQHWRTEDDVRR

SEQ ID NO: 3007016 - protein, 18 aa, Entamoeba invadens
LLKVDFLRVIFSYQYFFE

SEQ ID NO: 3007017 - protein, 21 aa, Entamoeba invadens
LLKVGLLVLFKGKATIDGGDY

SEQ ID NO: 3007018 - protein, 18 aa, Entamoeba invadens
LLLGNFNDKLKETCQRNG

SEQ ID NO: 3007019 - protein, 18 aa, Entamoeba invadens
LLLILRYTPRVEGDTGIL

SEQ ID NO: 3007020 - protein, 19 aa, Entamoeba invadens
LLLIMDLHCRLINHPVGLL

SEQ ID NO: 3007021 - protein, 24 aa, Entamoeba invadens
LLLKRDYYYIFSDLSLYTCVDEKI

SEQ ID NO: 3007022 - protein, 25 aa, Entamoeba invadens
LLLLHIDNILFYQTAPWAWKEETLF

SEQ ID NO: 3007023 - protein, 22 aa, Entamoeba invadens
LLLPYLQRFLRKQDDKSLQKLK

SEQ ID NO: 3007024 - protein, 18 aa, Entamoeba invadens
LLLSDTITSLVWNKRDLK

SEQ ID NO: 3007025 - protein, 17 aa, Entamoeba invadens
LLLSTMNIGSLIDLPPN

SEQ ID NO: 3007026 - protein, 17 aa, Entamoeba invadens
LLLTCSLDSTVTLWSVS
